United States Patent 7,341,835 (METHODS OF ANALYSIS OF ALTERNATIVE SPLICING IN MOUSE) - sequence listing, part 7

SEQ ID NO: 239710 - DNA, 25 bp, Mus musculus
ccagctgcagcagttctatgctgcc

SEQ ID NO: 239711 - DNA, 25 bp, Mus musculus
ccagctgcagctgctgataaagatg

SEQ ID NO: 239712 - DNA, 25 bp, Mus musculus
ccagctgcaggatgaagtggcccag

SEQ ID NO: 239713 - DNA, 25 bp, Mus musculus
ccagctgcaggccacaggcaggatg

SEQ ID NO: 239714 - DNA, 25 bp, Mus musculus
ccagctgcaggtggtggctgagccg

SEQ ID NO: 239715 - DNA, 25 bp, Mus musculus
ccagctgcagtcccacttgttcggc

SEQ ID NO: 239716 - DNA, 25 bp, Mus musculus
ccagctgccaaacgtcaaactccgt

SEQ ID NO: 239717 - DNA, 25 bp, Mus musculus
ccagctgccagcaggtagatcatga

SEQ ID NO: 239718 - DNA, 25 bp, Mus musculus
ccagctgccagcaggtctccccctc

SEQ ID NO: 239719 - DNA, 25 bp, Mus musculus
ccagctgccggactgccctccaggg

SEQ ID NO: 239720 - DNA, 25 bp, Mus musculus
ccagctgcctgagggtacaagttca

SEQ ID NO: 239721 - DNA, 25 bp, Mus musculus
ccagctgcctttttcaacatggatt

SEQ ID NO: 239722 - DNA, 25 bp, Mus musculus
ccagctgcgcagactactttactgg

SEQ ID NO: 239723 - DNA, 25 bp, Mus musculus
ccagctgctcccggcaggaaaagga

SEQ ID NO: 239724 - DNA, 25 bp, Mus musculus
ccagctgctgacagtatccctggaa

SEQ ID NO: 239725 - DNA, 25 bp, Mus musculus
ccagctgctgacccaggtcctgagg

SEQ ID NO: 239726 - DNA, 25 bp, Mus musculus
ccagctgctgagaacccaatatggc

SEQ ID NO: 239727 - DNA, 25 bp, Mus musculus
ccagctggacaaaatggggtggatg

SEQ ID NO: 239728 - DNA, 25 bp, Mus musculus
ccagctggagaaagattccagttgg

SEQ ID NO: 239729 - DNA, 25 bp, Mus musculus
ccagctggagaagctccatttctga

SEQ ID NO: 239730 - DNA, 25 bp, Mus musculus
ccagctggagaagttgtgtgactcc

SEQ ID NO: 239731 - DNA, 25 bp, Mus musculus
ccagctggagacctccacacagcac

SEQ ID NO: 239732 - DNA, 25 bp, Mus musculus
ccagctggagagtaggtggcattga

SEQ ID NO: 239733 - DNA, 25 bp, Mus musculus
ccagctggagggagagcgtgagcgt

SEQ ID NO: 239734 - DNA, 25 bp, Mus musculus
ccagctggaggtcacctcagcacct

SEQ ID NO: 239735 - DNA, 25 bp, Mus musculus
ccagctggcaaggttatgaaaacta

SEQ ID NO: 239736 - DNA, 25 bp, Mus musculus
ccagctgggagggcgtggagctggt

SEQ ID NO: 239737 - DNA, 25 bp, Mus musculus
ccagctgggaggtggagatgtcatc

SEQ ID NO: 239738 - DNA, 25 bp, Mus musculus
ccagctgggccaatgaaaaccaact

SEQ ID NO: 239739 - DNA, 25 bp, Mus musculus
ccagctggtggaggaggaagtgaac

SEQ ID NO: 239740 - DNA, 25 bp, Mus musculus
ccagctgtaccccgggagggacatt

SEQ ID NO: 239741 - DNA, 25 bp, Mus musculus
ccagctgtcaacaaggtctaggaaa

SEQ ID NO: 239742 - DNA, 25 bp, Mus musculus
ccagctgtcccagatgaacgggctt

SEQ ID NO: 239743 - DNA, 25 bp, Mus musculus
ccagctgtcccaggggtgactttcc

SEQ ID NO: 239744 - DNA, 25 bp, Mus musculus
ccagctgtcttgcaggtggaatgcc

SEQ ID NO: 239745 - DNA, 25 bp, Mus musculus
ccagctgtgagacagacattgacga

SEQ ID NO: 239746 - DNA, 25 bp, Mus musculus
ccagctgtgagacagactcttcctg

SEQ ID NO: 239747 - DNA, 25 bp, Mus musculus
ccagctgtggggcagttttggcacg

SEQ ID NO: 239748 - DNA, 25 bp, Mus musculus
ccagctgtggtagtcaggagttcag

SEQ ID NO: 239749 - DNA, 25 bp, Mus musculus
ccagctgtggtattcaggctgaaca

SEQ ID NO: 239750 - DNA, 25 bp, Mus musculus
ccagctgtggttcggggccaggaaa

SEQ ID NO: 239751 - DNA, 25 bp, Mus musculus
ccagctgttgcagtcttcgcataag

SEQ ID NO: 239752 - DNA, 25 bp, Mus musculus
ccagctgttttaaaaggattgcggg

SEQ ID NO: 239753 - DNA, 25 bp, Mus musculus
ccagctgttttaaagcaaacggtgc

SEQ ID NO: 239754 - DNA, 25 bp, Mus musculus
ccagctgtttttgttgtacggacat

SEQ ID NO: 239755 - DNA, 25 bp, Mus musculus
ccagcttacggacatgctcccaaat

SEQ ID NO: 239756 - DNA, 25 bp, Mus musculus
ccagcttcacgctgtccctgaagtg

SEQ ID NO: 239757 - DNA, 25 bp, Mus musculus
ccagcttcagatctacccaaacgag

SEQ ID NO: 239758 - DNA, 25 bp, Mus musculus
ccagcttcagattcccaggaaaact

SEQ ID NO: 239759 - DNA, 25 bp, Mus musculus
ccagcttcagcagcatctacagggg

SEQ ID NO: 239760 - DNA, 25 bp, Mus musculus
ccagcttcagcagctctagccaaga

SEQ ID NO: 239761 - DNA, 25 bp, Mus musculus
ccagcttcagctgtttgttcaggat

SEQ ID NO: 239762 - DNA, 25 bp, Mus musculus
ccagcttcaggttgcatcagtgaca

SEQ ID NO: 239763 - DNA, 25 bp, Mus musculus
ccagcttcagtaaagagggctggcc

SEQ ID NO: 239764 - DNA, 25 bp, Mus musculus
ccagcttcagtgaatggaactccca

SEQ ID NO: 239765 - DNA, 25 bp, Mus musculus
ccagcttccagatacctcagtccat

SEQ ID NO: 239766 - DNA, 25 bp, Mus musculus
ccagcttccagccctacgttcttcc

SEQ ID NO: 239767 - DNA, 25 bp, Mus musculus
ccagcttcccagccggaacccagac

SEQ ID NO: 239768 - DNA, 25 bp, Mus musculus
ccagcttccctcgcaacctcctgac

SEQ ID NO: 239769 - DNA, 25 bp, Mus musculus
ccagcttccctcgcggggctgcggt

SEQ ID NO: 239770 - DNA, 25 bp, Mus musculus
ccagcttcctgaatgttttggctgg

SEQ ID NO: 239771 - DNA, 25 bp, Mus musculus
ccagcttcctgatgaggagtctctg

SEQ ID NO: 239772 - DNA, 25 bp, Mus musculus
ccagcttcctgcttcagtaacttgt

SEQ ID NO: 239773 - DNA, 25 bp, Mus musculus
ccagcttcgcaggacccaacctcct

SEQ ID NO: 239774 - DNA, 25 bp, Mus musculus
ccagcttctagagatcatgagggcc

SEQ ID NO: 239775 - DNA, 25 bp, Mus musculus
ccagcttctagagcctgtttctctc

SEQ ID NO: 239776 - DNA, 25 bp, Mus musculus
ccagcttgaaggtactaaagaaata

SEQ ID NO: 239777 - DNA, 25 bp, Mus musculus
ccagcttgccagcgtttttcgttgg

SEQ ID NO: 239778 - DNA, 25 bp, Mus musculus
ccagcttgctgccacagctgccaca

SEQ ID NO: 239779 - DNA, 25 bp, Mus musculus
ccagcttgcttgaaactttgggaac

SEQ ID NO: 239780 - DNA, 25 bp, Mus musculus
ccagcttgcttggctgaagccaacc

SEQ ID NO: 239781 - DNA, 25 bp, Mus musculus
ccagcttggaggcgaatgaagtgta

SEQ ID NO: 239782 - DNA, 25 bp, Mus musculus
ccagcttgtgaggttcttgtttcct

SEQ ID NO: 239783 - DNA, 25 bp, Mus musculus
ccagcttgtgcggctagaagaggaa

SEQ ID NO: 239784 - DNA, 25 bp, Mus musculus
ccagcttgtgcgtgatattgtggtc

SEQ ID NO: 239785 - DNA, 25 bp, Mus musculus
ccagcttgtgtctgaaggtgcttcc

SEQ ID NO: 239786 - DNA, 25 bp, Mus musculus
ccagctttagaaggcatggatgata

SEQ ID NO: 239787 - DNA, 25 bp, Mus musculus
ccagctttagtcctcaaaggccagt

SEQ ID NO: 239788 - DNA, 25 bp, Mus musculus
ccagctttatgtcagtcagccccag

SEQ ID NO: 239789 - DNA, 25 bp, Mus musculus
ccagctttcgacccgaggactatct

SEQ ID NO: 239790 - DNA, 25 bp, Mus musculus
ccagctttcgacccggattctcaaa

SEQ ID NO: 239791 - DNA, 25 bp, Mus musculus
ccagctttgagatggctatgaacgg

SEQ ID NO: 239792 - DNA, 25 bp, Mus musculus
ccagctttgaggaagattgcaagcc

SEQ ID NO: 239793 - DNA, 25 bp, Mus musculus
ccagctttgaggaagcgagtctcca

SEQ ID NO: 239794 - DNA, 25 bp, Mus musculus
ccagctttggggggctggctgtggg

SEQ ID NO: 239795 - DNA, 25 bp, Mus musculus
ccagctttgtttctcccaggactca

SEQ ID NO: 239796 - DNA, 25 bp, Mus musculus
ccagctttttgctgccccttaccgg

SEQ ID NO: 239797 - DNA, 25 bp, Mus musculus
ccaggaaaagaaggtgggcgactgc

SEQ ID NO: 239798 - DNA, 25 bp, Mus musculus
ccaggaaaagaagttctgggagtca

SEQ ID NO: 239799 - DNA, 25 bp, Mus musculus
ccaggaaaataagcaaaaattccca

SEQ ID NO: 239800 - DNA, 25 bp, Mus musculus
ccaggaaaataaggtgttttcacgt

SEQ ID NO: 239801 - DNA, 25 bp, Mus musculus
ccaggaaaataagttctgaaaatca

SEQ ID NO: 239802 - DNA, 25 bp, Mus musculus
ccaggaaaatatgggctggcgctgc

SEQ ID NO: 239803 - DNA, 25 bp, Mus musculus
ccaggaaaatctttacatgaggaac

SEQ ID NO: 239804 - DNA, 25 bp, Mus musculus
ccaggaaaatgtttacatgaggaac

SEQ ID NO: 239805 - DNA, 25 bp, Mus musculus
ccaggaaacaagaacgtatctcctc

SEQ ID NO: 239806 - DNA, 25 bp, Mus musculus
ccaggaaacagaaagctggtccaaa

SEQ ID NO: 239807 - DNA, 25 bp, Mus musculus
ccaggaaacaggaaggagtcttcac

SEQ ID NO: 239808 - DNA, 25 bp, Mus musculus
ccaggaaacatggaaataagcagca

SEQ ID NO: 239809 - DNA, 25 bp, Mus musculus
ccaggaaaccaggaatgacacggga

SEQ ID NO: 239810 - DNA, 25 bp, Mus musculus
ccaggaaagagacatggcaagtgtc

SEQ ID NO: 239811 - DNA, 25 bp, Mus musculus
ccaggaaagaggtgcccactcatga

SEQ ID NO: 239812 - DNA, 25 bp, Mus musculus
ccaggaaagttcaaatagcccgtcc

SEQ ID NO: 239813 - DNA, 25 bp, Mus musculus
ccaggaaagttctcaatctcacagg

SEQ ID NO: 239814 - DNA, 25 bp, Mus musculus
ccaggaaatgcaggttttccttact

SEQ ID NO: 239815 - DNA, 25 bp, Mus musculus
ccaggaacacaaaggtaagaaagca

SEQ ID NO: 239816 - DNA, 25 bp, Mus musculus
ccaggaacacctgctgacctctgtg

SEQ ID NO: 239817 - DNA, 25 bp, Mus musculus
ccaggaacacctttatctgaattat

SEQ ID NO: 239818 - DNA, 25 bp, Mus musculus
ccaggaacacgggggcttcttcaca

SEQ ID NO: 239819 - DNA, 25 bp, Mus musculus
ccaggaacagagagaacattataag

SEQ ID NO: 239820 - DNA, 25 bp, Mus musculus
ccaggaacagctcaaggccgtgcat

SEQ ID NO: 239821 - DNA, 25 bp, Mus musculus
ccaggaacaggtatacaagagacta

SEQ ID NO: 239822 - DNA, 25 bp, Mus musculus
ccaggaaccaagaatgcttttgggt

SEQ ID NO: 239823 - DNA, 25 bp, Mus musculus
ccaggaaccagtaattccacgatgg

SEQ ID NO: 239824 - DNA, 25 bp, Mus musculus
ccaggaacccaagaatttattgcca

SEQ ID NO: 239825 - DNA, 25 bp, Mus musculus
ccaggaaccgcaggctgttgccgca

SEQ ID NO: 239826 - DNA, 25 bp, Mus musculus
ccaggaaccgcgtctcttgcaaaac

SEQ ID NO: 239827 - DNA, 25 bp, Mus musculus
ccaggaacctctcctcctggctgta

SEQ ID NO: 239828 - DNA, 25 bp, Mus musculus
ccaggaacctggttggcaaagtgat

SEQ ID NO: 239829 - DNA, 25 bp, Mus musculus
ccaggaacggagggcatggctgcca

SEQ ID NO: 239830 - DNA, 25 bp, Mus musculus
ccaggaacggagttatggcattcct

SEQ ID NO: 239831 - DNA, 25 bp, Mus musculus
ccaggaactacgagcgcgaggtaga

SEQ ID NO: 239832 - DNA, 25 bp, Mus musculus
ccaggaactcgaggctcctggagga

SEQ ID NO: 239833 - DNA, 25 bp, Mus musculus
ccaggaactctgcgggaccttctgt

SEQ ID NO: 239834 - DNA, 25 bp, Mus musculus
ccaggaacttttcagctgccaaaag

SEQ ID NO: 239835 - DNA, 25 bp, Mus musculus
ccaggaacttttcagttggcaggca

SEQ ID NO: 239836 - DNA, 25 bp, Mus musculus
ccaggaagaaaggaaaatcagaggc

SEQ ID NO: 239837 - DNA, 25 bp, Mus musculus
ccaggaagaaaggtcaggatcgcag

SEQ ID NO: 239838 - DNA, 25 bp, Mus musculus
ccaggaagaaattccaaattacaga

SEQ ID NO: 239839 - DNA, 25 bp, Mus musculus
ccaggaagaacgcggagggagctat

SEQ ID NO: 239840 - DNA, 25 bp, Mus musculus
ccaggaagagaaggcttcagatgct

SEQ ID NO: 239841 - DNA, 25 bp, Mus musculus
ccaggaagagacttcacagctcagg

SEQ ID NO: 239842 - DNA, 25 bp, Mus musculus
ccaggaagagcctccacctctcctc

SEQ ID NO: 239843 - DNA, 25 bp, Mus musculus
ccaggaagaggaaagagatgagccg

SEQ ID NO: 239844 - DNA, 25 bp, Mus musculus
ccaggaagaggacatgacagatgac

SEQ ID NO: 239845 - DNA, 25 bp, Mus musculus
ccaggaagaggcggtgacagaggcc

SEQ ID NO: 239846 - DNA, 25 bp, Mus musculus
ccaggaagatccactcctatgtgtt

SEQ ID NO: 239847 - DNA, 25 bp, Mus musculus
ccaggaagcacctgccattgtggct

SEQ ID NO: 239848 - DNA, 25 bp, Mus musculus
ccaggaagcagagaggagaaaagga

SEQ ID NO: 239849 - DNA, 25 bp, Mus musculus
ccaggaagcaggtgtctagtcacat

SEQ ID NO: 239850 - DNA, 25 bp, Mus musculus
ccaggaagcaggtgtctagtcatat

SEQ ID NO: 239851 - DNA, 25 bp, Mus musculus
ccaggaagccaggtctttggccagt

SEQ ID NO: 239852 - DNA, 25 bp, Mus musculus
ccaggaagccctgaggtcacttggt

SEQ ID NO: 239853 - DNA, 25 bp, Mus musculus
ccaggaagccctgaggtgtggttcc

SEQ ID NO: 239854 - DNA, 25 bp, Mus musculus
ccaggaagcgccacacccccagagg

SEQ ID NO: 239855 - DNA, 25 bp, Mus musculus
ccaggaagctactgggccgcgttgg

SEQ ID NO: 239856 - DNA, 25 bp, Mus musculus
ccaggaagctggagaaggggtggaa

SEQ ID NO: 239857 - DNA, 25 bp, Mus musculus
ccaggaagctggtccagctcagctt

SEQ ID NO: 239858 - DNA, 25 bp, Mus musculus
ccaggaagctttgcagatctgaacg

SEQ ID NO: 239859 - DNA, 25 bp, Mus musculus
ccaggaaggcaaattcgtgattact

SEQ ID NO: 239860 - DNA, 25 bp, Mus musculus
ccaggaagggactatattgatcagt

SEQ ID NO: 239861 - DNA, 25 bp, Mus musculus
ccaggaagttacaatccaagtaaac

SEQ ID NO: 239862 - DNA, 25 bp, Mus musculus
ccaggaatatattccaatgcaagcc

SEQ ID NO: 239863 - DNA, 25 bp, Mus musculus
ccaggaatattggcagtgctgtggg

SEQ ID NO: 239864 - DNA, 25 bp, Mus musculus
ccaggaatgaggctgctgcagagcc

SEQ ID NO: 239865 - DNA, 25 bp, Mus musculus
ccaggaatgccatttatgtcgtgtg

SEQ ID NO: 239866 - DNA, 25 bp, Mus musculus
ccaggaatggacatttggtcagcgc

SEQ ID NO: 239867 - DNA, 25 bp, Mus musculus
ccaggaattagtgtcggagctccaa

SEQ ID NO: 239868 - DNA, 25 bp, Mus musculus
ccaggaattcagcaccccatgaaca

SEQ ID NO: 239869 - DNA, 25 bp, Mus musculus
ccaggaattcaggaaatattttcaa

SEQ ID NO: 239870 - DNA, 25 bp, Mus musculus
ccaggacaagatgcgagctacacct

SEQ ID NO: 239871 - DNA, 25 bp, Mus musculus
ccaggacaagcaggtcccatgcatc

SEQ ID NO: 239872 - DNA, 25 bp, Mus musculus
ccaggacaaggaagaaaccgttgga

SEQ ID NO: 239873 - DNA, 25 bp, Mus musculus
ccaggacacagaccgtgctggaatc

SEQ ID NO: 239874 - DNA, 25 bp, Mus musculus
ccaggacaccaagagggaagctgct

SEQ ID NO: 239875 - DNA, 25 bp, Mus musculus
ccaggacaccagctgaggagggcag

SEQ ID NO: 239876 - DNA, 25 bp, Mus musculus
ccaggacacgtttctgtgttgtggg

SEQ ID NO: 239877 - DNA, 25 bp, Mus musculus
ccaggacactgccactgcacagcct

SEQ ID NO: 239878 - DNA, 25 bp, Mus musculus
ccaggacagagagattgtgacacgg

SEQ ID NO: 239879 - DNA, 25 bp, Mus musculus
ccaggacagaggattccctgtctcc

SEQ ID NO: 239880 - DNA, 25 bp, Mus musculus
ccaggacagaggcttccccacctcc

SEQ ID NO: 239881 - DNA, 25 bp, Mus musculus
ccaggacagcaaggccctccttttt

SEQ ID NO: 239882 - DNA, 25 bp, Mus musculus
ccaggacagcagggtgtgcaggggc

SEQ ID NO: 239883 - DNA, 25 bp, Mus musculus
ccaggacagccagggtctctggaac

SEQ ID NO: 239884 - DNA, 25 bp, Mus musculus
ccaggacagccagggtgagtccagt

SEQ ID NO: 239885 - DNA, 25 bp, Mus musculus
ccaggacaggaaggtacttctccat

SEQ ID NO: 239886 - DNA, 25 bp, Mus musculus
ccaggacatagagaccatagaatcc

SEQ ID NO: 239887 - DNA, 25 bp, Mus musculus
ccaggacatctgcaggatctgccac

SEQ ID NO: 239888 - DNA, 25 bp, Mus musculus
ccaggaccaaaggagccaaaccagc

SEQ ID NO: 239889 - DNA, 25 bp, Mus musculus
ccaggaccaaagggaccactttcca

SEQ ID NO: 239890 - DNA, 25 bp, Mus musculus
ccaggaccacgatgtccctggtaga

SEQ ID NO: 239891 - DNA, 25 bp, Mus musculus
ccaggaccactgctctgctgcctgc

SEQ ID NO: 239892 - DNA, 25 bp, Mus musculus
ccaggaccactggttctacgggtgc

SEQ ID NO: 239893 - DNA, 25 bp, Mus musculus
ccaggaccaggctttcttgatcatg

SEQ ID NO: 239894 - DNA, 25 bp, Mus musculus
ccaggaccatgcaaaagcaaaagaa

SEQ ID NO: 239895 - DNA, 25 bp, Mus musculus
ccaggacccagtggaacaattggat

SEQ ID NO: 239896 - DNA, 25 bp, Mus musculus
ccaggaccccacctggattccgagc

SEQ ID NO: 239897 - DNA, 25 bp, Mus musculus
ccaggacccccaggtgatgctggcg

SEQ ID NO: 239898 - DNA, 25 bp, Mus musculus
ccaggacccgctcagatcttgacag

SEQ ID NO: 239899 - DNA, 25 bp, Mus musculus
ccaggacccgctcagggaaacagat

SEQ ID NO: 239900 - DNA, 25 bp, Mus musculus
ccaggaccgcagcacttcatccacc

SEQ ID NO: 239901 - DNA, 25 bp, Mus musculus
ccaggacctaggctggcacgcttca

SEQ ID NO: 239902 - DNA, 25 bp, Mus musculus
ccaggacctcaaggacggtatttat

SEQ ID NO: 239903 - DNA, 25 bp, Mus musculus
ccaggacctgcagctcttatgctct

SEQ ID NO: 239904 - DNA, 25 bp, Mus musculus
ccaggacctgcaggccccccaggat

SEQ ID NO: 239905 - DNA, 25 bp, Mus musculus
ccaggaccttatcaggtttgcacag

SEQ ID NO: 239906 - DNA, 25 bp, Mus musculus
ccaggaccttgctgcaggcaccttt

SEQ ID NO: 239907 - DNA, 25 bp, Mus musculus
ccaggacgaagggtcctgtgcgcag

SEQ ID NO: 239908 - DNA, 25 bp, Mus musculus
ccaggacgacggcccttcaaattgg

SEQ ID NO: 239909 - DNA, 25 bp, Mus musculus
ccaggacgagctgaattctttatac

SEQ ID NO: 239910 - DNA, 25 bp, Mus musculus
ccaggacgagggcttcatcactgta

SEQ ID NO: 239911 - DNA, 25 bp, Mus musculus
ccaggacggaataggaaccaagatg

SEQ ID NO: 239912 - DNA, 25 bp, Mus musculus
ccaggacggggagacccatataatg

SEQ ID NO: 239913 - DNA, 25 bp, Mus musculus
ccaggacgtggctccttccagcctg

SEQ ID NO: 239914 - DNA, 25 bp, Mus musculus
ccaggactcaaatattctccttctt

SEQ ID NO: 239915 - DNA, 25 bp, Mus musculus
ccaggactcccccaagcaggcggac

SEQ ID NO: 239916 - DNA, 25 bp, Mus musculus
ccaggactcggaagtggacagtggc

SEQ ID NO: 239917 - DNA, 25 bp, Mus musculus
ccaggactgaatctacccaaacgag

SEQ ID NO: 239918 - DNA, 25 bp, Mus musculus
ccaggacttgcttgtgacgaatgga

SEQ ID NO: 239919 - DNA, 25 bp, Mus musculus
ccaggacttggactattttgaaaga

SEQ ID NO: 239920 - DNA, 25 bp, Mus musculus
ccaggacttggagagctgtcacctt

SEQ ID NO: 239921 - DNA, 25 bp, Mus musculus
ccaggagaaactgggagctgaaaag

SEQ ID NO: 239922 - DNA, 25 bp, Mus musculus
ccaggagaaagctattacaagccag

SEQ ID NO: 239923 - DNA, 25 bp, Mus musculus
ccaggagaaggtgaggtacaccaga

SEQ ID NO: 239924 - DNA, 25 bp, Mus musculus
ccaggagaatggtccgtctcccagg

SEQ ID NO: 239925 - DNA, 25 bp, Mus musculus
ccaggagacaaattgagacctacag

SEQ ID NO: 239926 - DNA, 25 bp, Mus musculus
ccaggagacaagcatctaatgatga

SEQ ID NO: 239927 - DNA, 25 bp, Mus musculus
ccaggagacacatcaagttggaccc

SEQ ID NO: 239928 - DNA, 25 bp, Mus musculus
ccaggagacacgagattccggggat

SEQ ID NO: 239929 - DNA, 25 bp, Mus musculus
ccaggagacacgggacgctgtatca

SEQ ID NO: 239930 - DNA, 25 bp, Mus musculus
ccaggagaccagggagagaaataca

SEQ ID NO: 239931 - DNA, 25 bp, Mus musculus
ccaggagacctggtgggtgtgaaca

SEQ ID NO: 239932 - DNA, 25 bp, Mus musculus
ccaggagactaagccttctgatgat

SEQ ID NO: 239933 - DNA, 25 bp, Mus musculus
ccaggagagaaggatgtgcgggcgc

SEQ ID NO: 239934 - DNA, 25 bp, Mus musculus
ccaggagagaggggagaaaggggag

SEQ ID NO: 239935 - DNA, 25 bp, Mus musculus
ccaggagagcaagctgatcatcctg

SEQ ID NO: 239936 - DNA, 25 bp, Mus musculus
ccaggagagcaggtcggcagctctg

SEQ ID NO: 239937 - DNA, 25 bp, Mus musculus
ccaggagagggctgctattttgatg

SEQ ID NO: 239938 - DNA, 25 bp, Mus musculus
ccaggagagtgagccaaggagatgg

SEQ ID NO: 239939 - DNA, 25 bp, Mus musculus
ccaggagagtgaggtgctggtaact

SEQ ID NO: 239940 - DNA, 25 bp, Mus musculus
ccaggagatgaagtgataattatgg

SEQ ID NO: 239941 - DNA, 25 bp, Mus musculus
ccaggagatgagattagcattaaga

SEQ ID NO: 239942 - DNA, 25 bp, Mus musculus
ccaggagatgagattgactgggaaa

SEQ ID NO: 239943 - DNA, 25 bp, Mus musculus
ccaggagcacagatctgggagccgc

SEQ ID NO: 239944 - DNA, 25 bp, Mus musculus
ccaggagcagacacggatcatcctg

SEQ ID NO: 239945 - DNA, 25 bp, Mus musculus
ccaggagcagaggctcatctacctg

SEQ ID NO: 239946 - DNA, 25 bp, Mus musculus
ccaggagcagagggggatgccccat

SEQ ID NO: 239947 - DNA, 25 bp, Mus musculus
ccaggagcagctggctgcagagctg

SEQ ID NO: 239948 - DNA, 25 bp, Mus musculus
ccaggagcaggggggactccccact

SEQ ID NO: 239949 - DNA, 25 bp, Mus musculus
ccaggagcaggtgtagctacttcac

SEQ ID NO: 239950 - DNA, 25 bp, Mus musculus
ccaggagccagcaggtctattttgt

SEQ ID NO: 239951 - DNA, 25 bp, Mus musculus
ccaggagccagcaggtggagcacgc

SEQ ID NO: 239952 - DNA, 25 bp, Mus musculus
ccaggagccaggtggtgtccctcag

SEQ ID NO: 239953 - DNA, 25 bp, Mus musculus
ccaggagccctgccacattgtccaa

SEQ ID NO: 239954 - DNA, 25 bp, Mus musculus
ccaggagccctgtgcttgatgggcg

SEQ ID NO: 239955 - DNA, 25 bp, Mus musculus
ccaggagccggaaagaagagacgcc

SEQ ID NO: 239956 - DNA, 25 bp, Mus musculus
ccaggagccgggcattcaactcgga

SEQ ID NO: 239957 - DNA, 25 bp, Mus musculus
ccaggagcggttcacgtctgtgacg

SEQ ID NO: 239958 - DNA, 25 bp, Mus musculus
ccaggagcggttcaggtctgtgacg

SEQ ID NO: 239959 - DNA, 25 bp, Mus musculus
ccaggagctctgaggtctacgctca

SEQ ID NO: 239960 - DNA, 25 bp, Mus musculus
ccaggagctctgtggtctacgctca

SEQ ID NO: 239961 - DNA, 25 bp, Mus musculus
ccaggagctgctggagtgggaactg

SEQ ID NO: 239962 - DNA, 25 bp, Mus musculus
ccaggagctgctgttccaggtgctg

SEQ ID NO: 239963 - DNA, 25 bp, Mus musculus
ccaggaggaagaagactcagaaagt

SEQ ID NO: 239964 - DNA, 25 bp, Mus musculus
ccaggaggaagaggaagtccaagaa

SEQ ID NO: 239965 - DNA, 25 bp, Mus musculus
ccaggaggaagatgctgtcgccgag

SEQ ID NO: 239966 - DNA, 25 bp, Mus musculus
ccaggaggacagatcttctatcggg

SEQ ID NO: 239967 - DNA, 25 bp, Mus musculus
ccaggaggacagcgagacggtcatc

SEQ ID NO: 239968 - DNA, 25 bp, Mus musculus
ccaggaggaccctggggtcaagagt

SEQ ID NO: 239969 - DNA, 25 bp, Mus musculus
ccaggaggacctggggtcagacagc

SEQ ID NO: 239970 - DNA, 25 bp, Mus musculus
ccaggaggcagagagtgctacaata

SEQ ID NO: 239971 - DNA, 25 bp, Mus musculus
ccaggaggcagaggtaagaaagtgc

SEQ ID NO: 239972 - DNA, 25 bp, Mus musculus
ccaggaggcagaggtccctggctgc

SEQ ID NO: 239973 - DNA, 25 bp, Mus musculus
ccaggagggaagatatgaatctgaa

SEQ ID NO: 239974 - DNA, 25 bp, Mus musculus
ccaggagggacgattctgacgttgg

SEQ ID NO: 239975 - DNA, 25 bp, Mus musculus
ccaggaggtcaagattcgggaagaa

SEQ ID NO: 239976 - DNA, 25 bp, Mus musculus
ccaggaggtgacgggtctcactcta

SEQ ID NO: 239977 - DNA, 25 bp, Mus musculus
ccaggaggtgacggtgcagcggaac

SEQ ID NO: 239978 - DNA, 25 bp, Mus musculus
ccaggaggtgacgttgctgtcccag

SEQ ID NO: 239979 - DNA, 25 bp, Mus musculus
ccaggaggtggcaaggtgcaaatag

SEQ ID NO: 239980 - DNA, 25 bp, Mus musculus
ccaggaggtggcaaggtgcagataa

SEQ ID NO: 239981 - DNA, 25 bp, Mus musculus
ccaggaggttatcggcagcggagca

SEQ ID NO: 239982 - DNA, 25 bp, Mus musculus
ccaggaggttatcggtaaggcgagt

SEQ ID NO: 239983 - DNA, 25 bp, Mus musculus
ccaggaggtttactgccggctcctg

SEQ ID NO: 239984 - DNA, 25 bp, Mus musculus
ccaggagtcaaaggtccacgaacca

SEQ ID NO: 239985 - DNA, 25 bp, Mus musculus
ccaggagtcccagtgtcttgctgca

SEQ ID NO: 239986 - DNA, 25 bp, Mus musculus
ccaggagtctgagagcccaccttct

SEQ ID NO: 239987 - DNA, 25 bp, Mus musculus
ccaggagtctgagaggcggaagaag

SEQ ID NO: 239988 - DNA, 25 bp, Mus musculus
ccaggagtgaagaccttgcacttga

SEQ ID NO: 239989 - DNA, 25 bp, Mus musculus
ccaggagtgagaagacataattcca

SEQ ID NO: 239990 - DNA, 25 bp, Mus musculus
ccaggagtgcaagaacctgatcctc

SEQ ID NO: 239991 - DNA, 25 bp, Mus musculus
ccaggagtgcaagggctccagcata

SEQ ID NO: 239992 - DNA, 25 bp, Mus musculus
ccaggagtgcagtatctctcctctc

SEQ ID NO: 239993 - DNA, 25 bp, Mus musculus
ccaggagtgcccaggcgaccacctc

SEQ ID NO: 239994 - DNA, 25 bp, Mus musculus
ccaggagttctaggaaacagctcaa

SEQ ID NO: 239995 - DNA, 25 bp, Mus musculus
ccaggagttctagggtatccctcct

SEQ ID NO: 239996 - DNA, 25 bp, Mus musculus
ccaggagtttgttcaggaagtggac

SEQ ID NO: 239997 - DNA, 25 bp, Mus musculus
ccaggataacacctgacactgaaga

SEQ ID NO: 239998 - DNA, 25 bp, Mus musculus
ccaggataacacgtccctagctgtt

SEQ ID NO: 239999 - DNA, 25 bp, Mus musculus
ccaggataccaaggctcctgtgatg

SEQ ID NO: 240000 - DNA, 25 bp, Mus musculus
ccaggatactggagcttgcctctcc

SEQ ID NO: 240001 - DNA, 25 bp, Mus musculus
ccaggatatgagtgttttatggcta

SEQ ID NO: 240002 - DNA, 25 bp, Mus musculus
ccaggatcagttatgagacttcaga

SEQ ID NO: 240003 - DNA, 25 bp, Mus musculus
ccaggatcagttatggcagtaatgg

SEQ ID NO: 240004 - DNA, 25 bp, Mus musculus
ccaggatcagttatgtttttatttc

SEQ ID NO: 240005 - DNA, 25 bp, Mus musculus
ccaggatccaggcgccaggcagcac

SEQ ID NO: 240006 - DNA, 25 bp, Mus musculus
ccaggatccaggttttatccagagg

SEQ ID NO: 240007 - DNA, 25 bp, Mus musculus
ccaggatcccctcctgtgcccctgg

SEQ ID NO: 240008 - DNA, 25 bp, Mus musculus
ccaggatcccctggcctcgctggac

SEQ ID NO: 240009 - DNA, 25 bp, Mus musculus
ccaggatcctcatccgagagtccgg

SEQ ID NO: 240010 - DNA, 25 bp, Mus musculus
ccaggatcctccagtgtctccagaa

SEQ ID NO: 240011 - DNA, 25 bp, Mus musculus
ccaggatcggaacaagtctgggacc

SEQ ID NO: 240012 - DNA, 25 bp, Mus musculus
ccaggatcggaacaattggtaccct

SEQ ID NO: 240013 - DNA, 25 bp, Mus musculus
ccaggatctatgaggaaatgaataa

SEQ ID NO: 240014 - DNA, 25 bp, Mus musculus
ccaggatctatgagttaaacgccaa

SEQ ID NO: 240015 - DNA, 25 bp, Mus musculus
ccaggatctcttgcctcaatcaaga

SEQ ID NO: 240016 - DNA, 25 bp, Mus musculus
ccaggatgcaggagcctccagacag

SEQ ID NO: 240017 - DNA, 25 bp, Mus musculus
ccaggatgcgctcctccgcctctga

SEQ ID NO: 240018 - DNA, 25 bp, Mus musculus
ccaggatgcggggtaccgaatgtat

SEQ ID NO: 240019 - DNA, 25 bp, Mus musculus
ccaggatgctggcaggtatctgtgt

SEQ ID NO: 240020 - DNA, 25 bp, Mus musculus
ccaggatggaaccgggcgcagcgcg

SEQ ID NO: 240021 - DNA, 25 bp, Mus musculus
ccaggatggcatcacctttattgac

SEQ ID NO: 240022 - DNA, 25 bp, Mus musculus
ccaggatggcgacgatttccagagc

SEQ ID NO: 240023 - DNA, 25 bp, Mus musculus
ccaggatggctgatatagacagaat

SEQ ID NO: 240024 - DNA, 25 bp, Mus musculus
ccaggatgggccgaaagaattcagt

SEQ ID NO: 240025 - DNA, 25 bp, Mus musculus
ccaggatgtggctggaccgcttcga

SEQ ID NO: 240026 - DNA, 25 bp, Mus musculus
ccaggatgttgacctaaagattgtc

SEQ ID NO: 240027 - DNA, 25 bp, Mus musculus
ccaggatgttgagaaagcaactagt

SEQ ID NO: 240028 - DNA, 25 bp, Mus musculus
ccaggattcaagggagccccgggcg

SEQ ID NO: 240029 - DNA, 25 bp, Mus musculus
ccaggattggaaaggttccaggatg

SEQ ID NO: 240030 - DNA, 25 bp, Mus musculus
ccaggatttaaccctgagataccag

SEQ ID NO: 240031 - DNA, 25 bp, Mus musculus
ccaggatttgggagccaaagactct

SEQ ID NO: 240032 - DNA, 25 bp, Mus musculus
ccaggatttggggtggtatcacggc

SEQ ID NO: 240033 - DNA, 25 bp, Mus musculus
ccaggcaaagatacagagtcagggg

SEQ ID NO: 240034 - DNA, 25 bp, Mus musculus
ccaggcaactaggaggctggattgt

SEQ ID NO: 240035 - DNA, 25 bp, Mus musculus
ccaggcaactagggtttcaactctg

SEQ ID NO: 240036 - DNA, 25 bp, Mus musculus
ccaggcaaggcgggcatctcctccc

SEQ ID NO: 240037 - DNA, 25 bp, Mus musculus
ccaggcaaggcgttcacagacgagg

SEQ ID NO: 240038 - DNA, 25 bp, Mus musculus
ccaggcaagggttgcccttcaccat

SEQ ID NO: 240039 - DNA, 25 bp, Mus musculus
ccaggcaagtggaggatccattttc

SEQ ID NO: 240040 - DNA, 25 bp, Mus musculus
ccaggcaattctagtggctgcggct

SEQ ID NO: 240041 - DNA, 25 bp, Mus musculus
ccaggcaccagaaacctcatccagc

SEQ ID NO: 240042 - DNA, 25 bp, Mus musculus
ccaggcaccagccagtaagtgctcc

SEQ ID NO: 240043 - DNA, 25 bp, Mus musculus
ccaggcaccaggcaccaacagagag

SEQ ID NO: 240044 - DNA, 25 bp, Mus musculus
ccaggcaccaggtcctgtttattgc

SEQ ID NO: 240045 - DNA, 25 bp, Mus musculus
ccaggcaccaggttgctccaggacc

SEQ ID NO: 240046 - DNA, 25 bp, Mus musculus
ccaggcaccagtacagaaagcaagc

SEQ ID NO: 240047 - DNA, 25 bp, Mus musculus
ccaggcaccagtgtgtccattgtcc

SEQ ID NO: 240048 - DNA, 25 bp, Mus musculus
ccaggcacccagagttttgctctgc

SEQ ID NO: 240049 - DNA, 25 bp, Mus musculus
ccaggcacccatggctcaaactacc

SEQ ID NO: 240050 - DNA, 25 bp, Mus musculus
ccaggcactcaaatgaacatggttg

SEQ ID NO: 240051 - DNA, 25 bp, Mus musculus
ccaggcactcagagaatgggacacc

SEQ ID NO: 240052 - DNA, 25 bp, Mus musculus
ccaggcactcagtttttcagttcta

SEQ ID NO: 240053 - DNA, 25 bp, Mus musculus
ccaggcactcggggtcctgagaagc

SEQ ID NO: 240054 - DNA, 25 bp, Mus musculus
ccaggcacttaaggaaattggggat

SEQ ID NO: 240055 - DNA, 25 bp, Mus musculus
ccaggcagaagctgggaagtcatca

SEQ ID NO: 240056 - DNA, 25 bp, Mus musculus
ccaggcagaaggcgacagacttatt

SEQ ID NO: 240057 - DNA, 25 bp, Mus musculus
ccaggcagacgatgttgaatgacaa

SEQ ID NO: 240058 - DNA, 25 bp, Mus musculus
ccaggcagagagatcgccttacagc

SEQ ID NO: 240059 - DNA, 25 bp, Mus musculus
ccaggcagagctggcaccagaaacc

SEQ ID NO: 240060 - DNA, 25 bp, Mus musculus
ccaggcagaggacagctcctctgtc

SEQ ID NO: 240061 - DNA, 25 bp, Mus musculus
ccaggcagatacaacagcacaacca

SEQ ID NO: 240062 - DNA, 25 bp, Mus musculus
ccaggcagatgcccgacactccaga

SEQ ID NO: 240063 - DNA, 25 bp, Mus musculus
ccaggcagatgcccggatgctgatg

SEQ ID NO: 240064 - DNA, 25 bp, Mus musculus
ccaggcagctgggtaccgggtgctg

SEQ ID NO: 240065 - DNA, 25 bp, Mus musculus
ccaggcagcttattgatgtcctcga

SEQ ID NO: 240066 - DNA, 25 bp, Mus musculus
ccaggcagtgaaggaccgtgcaggc

SEQ ID NO: 240067 - DNA, 25 bp, Mus musculus
ccaggcagtgaaggcccttgctgct

SEQ ID NO: 240068 - DNA, 25 bp, Mus musculus
ccaggcagtgagatgtccctagaca

SEQ ID NO: 240069 - DNA, 25 bp, Mus musculus
ccaggcagtgctgaaaaccaagcca

SEQ ID NO: 240070 - DNA, 25 bp, Mus musculus
ccaggcagttcaaggcaataaaagc

SEQ ID NO: 240071 - DNA, 25 bp, Mus musculus
ccaggcagttcaagggctaacttaa

SEQ ID NO: 240072 - DNA, 25 bp, Mus musculus
ccaggcataggtcacctccaaggtc

SEQ ID NO: 240073 - DNA, 25 bp, Mus musculus
ccaggcatagtggagtcccagaggc

SEQ ID NO: 240074 - DNA, 25 bp, Mus musculus
ccaggcatcacagagctctgcaggt

SEQ ID NO: 240075 - DNA, 25 bp, Mus musculus
ccaggcatctatgttctgcggttcg

SEQ ID NO: 240076 - DNA, 25 bp, Mus musculus
ccaggcatctctcccttctgcatgc

SEQ ID NO: 240077 - DNA, 25 bp, Mus musculus
ccaggcatgaggggccataaagggg

SEQ ID NO: 240078 - DNA, 25 bp, Mus musculus
ccaggcatgcagtaaaggccaaaaa

SEQ ID NO: 240079 - DNA, 25 bp, Mus musculus
ccaggcatgctccctgacctcagct

SEQ ID NO: 240080 - DNA, 25 bp, Mus musculus
ccaggcattgtggactctagaaaaa

SEQ ID NO: 240081 - DNA, 25 bp, Mus musculus
ccaggcattgtggattatcagactc

SEQ ID NO: 240082 - DNA, 25 bp, Mus musculus
ccaggccaaagattatttgtataac

SEQ ID NO: 240083 - DNA, 25 bp, Mus musculus
ccaggccaagaagggggatggaaat

SEQ ID NO: 240084 - DNA, 25 bp, Mus musculus
ccaggccaaggaggagtcagaaaag

SEQ ID NO: 240085 - DNA, 25 bp, Mus musculus
ccaggccaccccttaaatgtaggta

SEQ ID NO: 240086 - DNA, 25 bp, Mus musculus
ccaggccaccccttcctgcaaggcc

SEQ ID NO: 240087 - DNA, 25 bp, Mus musculus
ccaggccacctcgggcaaggtggct

SEQ ID NO: 240088 - DNA, 25 bp, Mus musculus
ccaggccactcaggatcggaacgtc

SEQ ID NO: 240089 - DNA, 25 bp, Mus musculus
ccaggccactgagtcttctggccga

SEQ ID NO: 240090 - DNA, 25 bp, Mus musculus
ccaggccagaaatcacaaacttcgt

SEQ ID NO: 240091 - DNA, 25 bp, Mus musculus
ccaggccagcagacacacaaccttt

SEQ ID NO: 240092 - DNA, 25 bp, Mus musculus
ccaggccagcagccctagctagcat

SEQ ID NO: 240093 - DNA, 25 bp, Mus musculus
ccaggccagcagccctgtctccagg

SEQ ID NO: 240094 - DNA, 25 bp, Mus musculus
ccaggccagcagcttcaccaatctt

SEQ ID NO: 240095 - DNA, 25 bp, Mus musculus
ccaggccagcaggtgtacagtgggc

SEQ ID NO: 240096 - DNA, 25 bp, Mus musculus
ccaggccagcagtgggctctggcaa

SEQ ID NO: 240097 - DNA, 25 bp, Mus musculus
ccaggccatcactgacaaaagaaag

SEQ ID NO: 240098 - DNA, 25 bp, Mus musculus
ccaggccatgtggactggcaggctg

SEQ ID NO: 240099 - DNA, 25 bp, Mus musculus
ccaggccattgtggaaagcccccct

SEQ ID NO: 240100 - DNA, 25 bp, Mus musculus
ccaggcccaaatgtaccgtctaacc

SEQ ID NO: 240101 - DNA, 25 bp, Mus musculus
ccaggcccaagacatccaggccagc

SEQ ID NO: 240102 - DNA, 25 bp, Mus musculus
ccaggcccaggaagaaacatgtatc

SEQ ID NO: 240103 - DNA, 25 bp, Mus musculus
ccaggcccaggaagaagaatgtccc

SEQ ID NO: 240104 - DNA, 25 bp, Mus musculus
ccaggcccaggcgtgctggtcacca

SEQ ID NO: 240105 - DNA, 25 bp, Mus musculus
ccaggcccaggtgttatctgcagcc

SEQ ID NO: 240106 - DNA, 25 bp, Mus musculus
ccaggccccacaggtgccaaaggcg

SEQ ID NO: 240107 - DNA, 25 bp, Mus musculus
ccaggccccagctttggtggcccca

SEQ ID NO: 240108 - DNA, 25 bp, Mus musculus
ccaggccccgcaggtcaagacggcc

SEQ ID NO: 240109 - DNA, 25 bp, Mus musculus
ccaggccccggaaggaaaagcgcaa

SEQ ID NO: 240110 - DNA, 25 bp, Mus musculus
ccaggcccctagccaccttctagct

SEQ ID NO: 240111 - DNA, 25 bp, Mus musculus
ccaggcccggaaaaggagtcaggcg

SEQ ID NO: 240112 - DNA, 25 bp, Mus musculus
ccaggcccggaagttcctgttcctc

SEQ ID NO: 240113 - DNA, 25 bp, Mus musculus
ccaggcccgtgaccacctctctggc

SEQ ID NO: 240114 - DNA, 25 bp, Mus musculus
ccaggccctcagtggctcccacaga

SEQ ID NO: 240115 - DNA, 25 bp, Mus musculus
ccaggccctcagtggtcccctttac

SEQ ID NO: 240116 - DNA, 25 bp, Mus musculus
ccaggccctccggaggacctggcgc

SEQ ID NO: 240117 - DNA, 25 bp, Mus musculus
ccaggccctgaatgaagaagagtca

SEQ ID NO: 240118 - DNA, 25 bp, Mus musculus
ccaggccctgctggagctccaggac

SEQ ID NO: 240119 - DNA, 25 bp, Mus musculus
ccaggcccttcgggagcagatggtg

SEQ ID NO: 240120 - DNA, 25 bp, Mus musculus
ccaggccgaaccagtggctgcagca

SEQ ID NO: 240121 - DNA, 25 bp, Mus musculus
ccaggccgcaggcatcaatacttgt

SEQ ID NO: 240122 - DNA, 25 bp, Mus musculus
ccaggccggcccgcaagctataagc

SEQ ID NO: 240123 - DNA, 25 bp, Mus musculus
ccaggccggcccgcagactttgtgt

SEQ ID NO: 240124 - DNA, 25 bp, Mus musculus
ccaggccgggaggcccagatggggg

SEQ ID NO: 240125 - DNA, 25 bp, Mus musculus
ccaggccgtgaatgaccagtgcctg

SEQ ID NO: 240126 - DNA, 25 bp, Mus musculus
ccaggccgtggactaaagaccagga

SEQ ID NO: 240127 - DNA, 25 bp, Mus musculus
ccaggcctagctcaagtcttttatt

SEQ ID NO: 240128 - DNA, 25 bp, Mus musculus
ccaggcctccagttctcccaggcct

SEQ ID NO: 240129 - DNA, 25 bp, Mus musculus
ccaggcctctggcagagcctgcccc

SEQ ID NO: 240130 - DNA, 25 bp, Mus musculus
ccaggcctgcgggtggacaaatcct

SEQ ID NO: 240131 - DNA, 25 bp, Mus musculus
ccaggcctggcttcttcacaaaatc

SEQ ID NO: 240132 - DNA, 25 bp, Mus musculus
ccaggcctgtcttcagtcccctaac

SEQ ID NO: 240133 - DNA, 25 bp, Mus musculus
ccaggcctgttaagaccactgttcc

SEQ ID NO: 240134 - DNA, 25 bp, Mus musculus
ccaggccttaaggctgccctgccct

SEQ ID NO: 240135 - DNA, 25 bp, Mus musculus
ccaggccttgggaaaagctgtgttc

SEQ ID NO: 240136 - DNA, 25 bp, Mus musculus
ccaggcgagcgggctaaccattttg

SEQ ID NO: 240137 - DNA, 25 bp, Mus musculus
ccaggcgccgaacagcagcgggcgg

SEQ ID NO: 240138 - DNA, 25 bp, Mus musculus
ccaggcgcggcgggatatgtggtac

SEQ ID NO: 240139 - DNA, 25 bp, Mus musculus
ccaggcgctagagctagtctaccca

SEQ ID NO: 240140 - DNA, 25 bp, Mus musculus
ccaggcgctagaggtgacccttccc

SEQ ID NO: 240141 - DNA, 25 bp, Mus musculus
ccaggcggagagagcaacttcttcg

SEQ ID NO: 240142 - DNA, 25 bp, Mus musculus
ccaggcggatggcacccttatcaca

SEQ ID NO: 240143 - DNA, 25 bp, Mus musculus
ccaggcggcttctgctgcaggagtc

SEQ ID NO: 240144 - DNA, 25 bp, Mus musculus
ccaggcggggcgcagctgggcacca

SEQ ID NO: 240145 - DNA, 25 bp, Mus musculus
ccaggcgtagaccccgactgcaggg

SEQ ID NO: 240146 - DNA, 25 bp, Mus musculus
ccaggcgtatttcagatgatgacac

SEQ ID NO: 240147 - DNA, 25 bp, Mus musculus
ccaggcgtcccaaaaagcctctaag

SEQ ID NO: 240148 - DNA, 25 bp, Mus musculus
ccaggcgtcgggattatcgtggccg

SEQ ID NO: 240149 - DNA, 25 bp, Mus musculus
ccaggcgtggcggacccaggcaccc

SEQ ID NO: 240150 - DNA, 25 bp, Mus musculus
ccaggcgtggggccgcagcctcgtg

SEQ ID NO: 240151 - DNA, 25 bp, Mus musculus
ccaggctacaaagaacccaagagat

SEQ ID NO: 240152 - DNA, 25 bp, Mus musculus
ccaggctacaggagatcgctctgga

SEQ ID NO: 240153 - DNA, 25 bp, Mus musculus
ccaggctcacagaagagagctgtga

SEQ ID NO: 240154 - DNA, 25 bp, Mus musculus
ccaggctcacagaaggctgttcatt

SEQ ID NO: 240155 - DNA, 25 bp, Mus musculus
ccaggctcagccgagatgccgcgcc

SEQ ID NO: 240156 - DNA, 25 bp, Mus musculus
ccaggctccagatgatgagaagctg

SEQ ID NO: 240157 - DNA, 25 bp, Mus musculus
ccaggctccagatgctgtggccagc

SEQ ID NO: 240158 - DNA, 25 bp, Mus musculus
ccaggctcccgagggatcatgcctg

SEQ ID NO: 240159 - DNA, 25 bp, Mus musculus
ccaggctccgtcaagcccccggaag

SEQ ID NO: 240160 - DNA, 25 bp, Mus musculus
ccaggctcctccagatgtcaacttg

SEQ ID NO: 240161 - DNA, 25 bp, Mus musculus
ccaggctcgccaggctggaacgctt

SEQ ID NO: 240162 - DNA, 25 bp, Mus musculus
ccaggctcgccagggaagtctactg

SEQ ID NO: 240163 - DNA, 25 bp, Mus musculus
ccaggctcgccagggtggctgtctg

SEQ ID NO: 240164 - DNA, 25 bp, Mus musculus
ccaggctcgggggctgcccctggag

SEQ ID NO: 240165 - DNA, 25 bp, Mus musculus
ccaggctcggggggaaagaggagga

SEQ ID NO: 240166 - DNA, 25 bp, Mus musculus
ccaggctctccaaaagtaaagcacc

SEQ ID NO: 240167 - DNA, 25 bp, Mus musculus
ccaggctctgtctaggtatcttttg

SEQ ID NO: 240168 - DNA, 25 bp, Mus musculus
ccaggctctgtgatcgtggccttca

SEQ ID NO: 240169 - DNA, 25 bp, Mus musculus
ccaggctctgttgctaacggacatg

SEQ ID NO: 240170 - DNA, 25 bp, Mus musculus
ccaggctgacaaggcccttttagct

SEQ ID NO: 240171 - DNA, 25 bp, Mus musculus
ccaggctgacgggtatcaccacagc

SEQ ID NO: 240172 - DNA, 25 bp, Mus musculus
ccaggctgaggagggaggagcaggc

SEQ ID NO: 240173 - DNA, 25 bp, Mus musculus
ccaggctgagtaccagctccaagtc

SEQ ID NO: 240174 - DNA, 25 bp, Mus musculus
ccaggctgagtgtttatcatggctt

SEQ ID NO: 240175 - DNA, 25 bp, Mus musculus
ccaggctgcaatgaggtcaactccg

SEQ ID NO: 240176 - DNA, 25 bp, Mus musculus
ccaggctgcaggcctgtgggccgaa

SEQ ID NO: 240177 - DNA, 25 bp, Mus musculus
ccaggctgcctcgaatcttaggtgc

SEQ ID NO: 240178 - DNA, 25 bp, Mus musculus
ccaggctgctcccagcgtttcccaa

SEQ ID NO: 240179 - DNA, 25 bp, Mus musculus
ccaggctgctgcgagtctgttgctg

SEQ ID NO: 240180 - DNA, 25 bp, Mus musculus
ccaggctggcaggaaccacacagag

SEQ ID NO: 240181 - DNA, 25 bp, Mus musculus
ccaggctggcaggtgctcaccgagt

SEQ ID NO: 240182 - DNA, 25 bp, Mus musculus
ccaggctggcatgaaatcctggggc

SEQ ID NO: 240183 - DNA, 25 bp, Mus musculus
ccaggctggggaagaccttgcactt

SEQ ID NO: 240184 - DNA, 25 bp, Mus musculus
ccaggctggtaaaggagagaatgaa

SEQ ID NO: 240185 - DNA, 25 bp, Mus musculus
ccaggctgtgctggccagctcagca

SEQ ID NO: 240186 - DNA, 25 bp, Mus musculus
ccaggctgtgggtcctcccaggaag

SEQ ID NO: 240187 - DNA, 25 bp, Mus musculus
ccaggctgttcagaaggctgtgggc

SEQ ID NO: 240188 - DNA, 25 bp, Mus musculus
ccaggctgttcaggtcctgctctcc

SEQ ID NO: 240189 - DNA, 25 bp, Mus musculus
ccaggcttaacagagccatcgtgac

SEQ ID NO: 240190 - DNA, 25 bp, Mus musculus
ccaggcttgaaacagccgctgcagg

SEQ ID NO: 240191 - DNA, 25 bp, Mus musculus
ccaggcttgaaacaggccggtagtg

SEQ ID NO: 240192 - DNA, 25 bp, Mus musculus
ccaggcttgtagaaaatgatgtagc

SEQ ID NO: 240193 - DNA, 25 bp, Mus musculus
ccaggctttggaggaagtggccaga

SEQ ID NO: 240194 - DNA, 25 bp, Mus musculus
ccaggctttggagtaggccagactc

SEQ ID NO: 240195 - DNA, 25 bp, Mus musculus
ccagggaaaaggtacaactgatgag

SEQ ID NO: 240196 - DNA, 25 bp, Mus musculus
ccagggaaaagttattaaatgcaag

SEQ ID NO: 240197 - DNA, 25 bp, Mus musculus
ccagggaaactgggatctgttggca

SEQ ID NO: 240198 - DNA, 25 bp, Mus musculus
ccagggaaatacagttattcatggt

SEQ ID NO: 240199 - DNA, 25 bp, Mus musculus
ccagggaacaaggtcagtgacatca

SEQ ID NO: 240200 - DNA, 25 bp, Mus musculus
ccagggaacagccaggaggatgttg

SEQ ID NO: 240201 - DNA, 25 bp, Mus musculus
ccagggaagagagagagagagagag

SEQ ID NO: 240202 - DNA, 25 bp, Mus musculus
ccagggaagccagggtctttgtgaa

SEQ ID NO: 240203 - DNA, 25 bp, Mus musculus
ccagggaatgtgagatacctttatc

SEQ ID NO: 240204 - DNA, 25 bp, Mus musculus
ccagggacagactcactctgtggag

SEQ ID NO: 240205 - DNA, 25 bp, Mus musculus
ccagggacagctgactttaagacca

SEQ ID NO: 240206 - DNA, 25 bp, Mus musculus
ccagggacatcagttccagacacga

SEQ ID NO: 240207 - DNA, 25 bp, Mus musculus
ccagggaccactgagaggcctacgt

SEQ ID NO: 240208 - DNA, 25 bp, Mus musculus
ccagggaccactgagcctgagcaga

SEQ ID NO: 240209 - DNA, 25 bp, Mus musculus
ccagggaccagcctgcactggatgg

SEQ ID NO: 240210 - DNA, 25 bp, Mus musculus
ccagggaccagtagaacaacagtta

SEQ ID NO: 240211 - DNA, 25 bp, Mus musculus
ccagggacctgagggtacagtcctc

SEQ ID NO: 240212 - DNA, 25 bp, Mus musculus
ccagggacgaaaggagtctgagggt

SEQ ID NO: 240213 - DNA, 25 bp, Mus musculus
ccagggacgcgcggtgagccccagg

SEQ ID NO: 240214 - DNA, 25 bp, Mus musculus
ccagggactgtgggctgggattctt

SEQ ID NO: 240215 - DNA, 25 bp, Mus musculus
ccagggagacaaggcggactatttc

SEQ ID NO: 240216 - DNA, 25 bp, Mus musculus
ccagggagacgaaggaggcgttctt

SEQ ID NO: 240217 - DNA, 25 bp, Mus musculus
ccagggagagaaggtgtcttaccac

SEQ ID NO: 240218 - DNA, 25 bp, Mus musculus
ccagggagagcagcaggaggacagc

SEQ ID NO: 240219 - DNA, 25 bp, Mus musculus
ccagggagatgccattgggtaccta

SEQ ID NO: 240220 - DNA, 25 bp, Mus musculus
ccagggaggatggctgatcatatga

SEQ ID NO: 240221 - DNA, 25 bp, Mus musculus
ccagggaggatgggaaaacctggag

SEQ ID NO: 240222 - DNA, 25 bp, Mus musculus
ccagggaggttccagatcacacaag

SEQ ID NO: 240223 - DNA, 25 bp, Mus musculus
ccagggaggttccaggtgtgtgtga

SEQ ID NO: 240224 - DNA, 25 bp, Mus musculus
ccagggagtaaagggacatctctac

SEQ ID NO: 240225 - DNA, 25 bp, Mus musculus
ccagggagtgggagattactacaag

SEQ ID NO: 240226 - DNA, 25 bp, Mus musculus
ccagggagtgggaggtagtgtcggt

SEQ ID NO: 240227 - DNA, 25 bp, Mus musculus
ccagggagtgtggtcttctcagtta

SEQ ID NO: 240228 - DNA, 25 bp, Mus musculus
ccagggatcagtgggcgagcttcac

SEQ ID NO: 240229 - DNA, 25 bp, Mus musculus
ccagggatcagtggtaccgggcttt

SEQ ID NO: 240230 - DNA, 25 bp, Mus musculus
ccagggatccacgaggacccgcctc

SEQ ID NO: 240231 - DNA, 25 bp, Mus musculus
ccagggatcccaggtcttcctggcc

SEQ ID NO: 240232 - DNA, 25 bp, Mus musculus
ccagggatctctctctccacccccg

SEQ ID NO: 240233 - DNA, 25 bp, Mus musculus
ccagggatctgatgcgggctcctgg

SEQ ID NO: 240234 - DNA, 25 bp, Mus musculus
ccagggattcatgctgtattttcat

SEQ ID NO: 240235 - DNA, 25 bp, Mus musculus
ccagggattcccgtcttctccctcc

SEQ ID NO: 240236 - DNA, 25 bp, Mus musculus
ccagggcaagaaagtatccacggac

SEQ ID NO: 240237 - DNA, 25 bp, Mus musculus
ccagggcaagaagcatcctcctcct

SEQ ID NO: 240238 - DNA, 25 bp, Mus musculus
ccagggcaagaaggtgggaatccta

SEQ ID NO: 240239 - DNA, 25 bp, Mus musculus
ccagggcaagccccaggactggacg

SEQ ID NO: 240240 - DNA, 25 bp, Mus musculus
ccagggcaaggattctgtacccaga

SEQ ID NO: 240241 - DNA, 25 bp, Mus musculus
ccagggcaaggtatgtcctctggtc

SEQ ID NO: 240242 - DNA, 25 bp, Mus musculus
ccagggcaaggtggctgcctttgac

SEQ ID NO: 240243 - DNA, 25 bp, Mus musculus
ccagggcaccaaggctgctttggca

SEQ ID NO: 240244 - DNA, 25 bp, Mus musculus
ccagggcaccaagttctccagccaa

SEQ ID NO: 240245 - DNA, 25 bp, Mus musculus
ccagggcagcagagaatcagctgtt

SEQ ID NO: 240246 - DNA, 25 bp, Mus musculus
ccagggcataggagaacattctggc

SEQ ID NO: 240247 - DNA, 25 bp, Mus musculus
ccagggcataggaggtaacaacaac

SEQ ID NO: 240248 - DNA, 25 bp, Mus musculus
ccagggcatcggatgctggggctgc

SEQ ID NO: 240249 - DNA, 25 bp, Mus musculus
ccagggcatggacaagtccagttca

SEQ ID NO: 240250 - DNA, 25 bp, Mus musculus
ccagggccacaaggtgaccgaggct

SEQ ID NO: 240251 - DNA, 25 bp, Mus musculus
ccagggccaggtcctgtgcgcaggt

SEQ ID NO: 240252 - DNA, 25 bp, Mus musculus
ccagggccagtttcttctgggacca

SEQ ID NO: 240253 - DNA, 25 bp, Mus musculus
ccagggccattgtgacttcttcgtc

SEQ ID NO: 240254 - DNA, 25 bp, Mus musculus
ccagggcccctgggcccacctggcc

SEQ ID NO: 240255 - DNA, 25 bp, Mus musculus
ccagggcccgcccaaccagcagagg

SEQ ID NO: 240256 - DNA, 25 bp, Mus musculus
ccagggccctccgggcagagcgccg

SEQ ID NO: 240257 - DNA, 25 bp, Mus musculus
ccagggccggagataatagaatctg

SEQ ID NO: 240258 - DNA, 25 bp, Mus musculus
ccagggcctgccagggacatcacag

SEQ ID NO: 240259 - DNA, 25 bp, Mus musculus
ccagggcgacttcgagaagccccgg

SEQ ID NO: 240260 - DNA, 25 bp, Mus musculus
ccagggcgagaacctggagacggac

SEQ ID NO: 240261 - DNA, 25 bp, Mus musculus
ccagggcgcaagtgtgagccactgc

SEQ ID NO: 240262 - DNA, 25 bp, Mus musculus
ccagggctaccgtcatacctcacta

SEQ ID NO: 240263 - DNA, 25 bp, Mus musculus
ccagggctcaggagctccttcctga

SEQ ID NO: 240264 - DNA, 25 bp, Mus musculus
ccagggctctccgaacctagctagc

SEQ ID NO: 240265 - DNA, 25 bp, Mus musculus
ccagggctctccgagaccgaagccc

SEQ ID NO: 240266 - DNA, 25 bp, Mus musculus
ccagggctctccggcgcatctccca

SEQ ID NO: 240267 - DNA, 25 bp, Mus musculus
ccagggctgaggcttgttccccctg

SEQ ID NO: 240268 - DNA, 25 bp, Mus musculus
ccagggctgcctcaggtcgcatagg

SEQ ID NO: 240269 - DNA, 25 bp, Mus musculus
ccagggcttccaaggcccttgtcca

SEQ ID NO: 240270 - DNA, 25 bp, Mus musculus
ccagggcttcccagacactccgtgg

SEQ ID NO: 240271 - DNA, 25 bp, Mus musculus
ccagggcttcccagagaagcgatgt

SEQ ID NO: 240272 - DNA, 25 bp, Mus musculus
ccagggcttcccaggatctggagac

SEQ ID NO: 240273 - DNA, 25 bp, Mus musculus
ccaggggaaggctactacatgggca

SEQ ID NO: 240274 - DNA, 25 bp, Mus musculus
ccaggggaatcaaagttgctacaac

SEQ ID NO: 240275 - DNA, 25 bp, Mus musculus
ccaggggaggccagtggtgagaaac

SEQ ID NO: 240276 - DNA, 25 bp, Mus musculus
ccaggggagtgcgagacaaagctgg

SEQ ID NO: 240277 - DNA, 25 bp, Mus musculus
ccaggggatccaggaccagatgtaa

SEQ ID NO: 240278 - DNA, 25 bp, Mus musculus
ccaggggcaaggtttcagccacaaa

SEQ ID NO: 240279 - DNA, 25 bp, Mus musculus
ccaggggcacctggcgaggaggaag

SEQ ID NO: 240280 - DNA, 25 bp, Mus musculus
ccaggggcacctggtctcccttcca

SEQ ID NO: 240281 - DNA, 25 bp, Mus musculus
ccaggggcaggatggtgttgctgac

SEQ ID NO: 240282 - DNA, 25 bp, Mus musculus
ccaggggccccagcccctctggttt

SEQ ID NO: 240283 - DNA, 25 bp, Mus musculus
ccaggggcgagagggagctgctgca

SEQ ID NO: 240284 - DNA, 25 bp, Mus musculus
ccaggggcgttcagtatgcctgtgt

SEQ ID NO: 240285 - DNA, 25 bp, Mus musculus
ccaggggcttcagagatcatgtgtg

SEQ ID NO: 240286 - DNA, 25 bp, Mus musculus
ccagggggcaggcagccactcccga

SEQ ID NO: 240287 - DNA, 25 bp, Mus musculus
ccagggggctgacggacgagtccgg

SEQ ID NO: 240288 - DNA, 25 bp, Mus musculus
ccagggggctgacggtcgaagaaag

SEQ ID NO: 240289 - DNA, 25 bp, Mus musculus
ccaggggtggtcgggctcagaaagt

SEQ ID NO: 240290 - DNA, 25 bp, Mus musculus
ccaggggtggtcggtggatggcttg

SEQ ID NO: 240291 - DNA, 25 bp, Mus musculus
ccaggggttagtgtggagaggatgc

SEQ ID NO: 240292 - DNA, 25 bp, Mus musculus
ccaggggttgaagacgttgatgtca

SEQ ID NO: 240293 - DNA, 25 bp, Mus musculus
ccagggtagtgggagccctcgtaga

SEQ ID NO: 240294 - DNA, 25 bp, Mus musculus
ccagggtcactgtgactccagctcc

SEQ ID NO: 240295 - DNA, 25 bp, Mus musculus
ccagggtcagcttccaagcaaccgc

SEQ ID NO: 240296 - DNA, 25 bp, Mus musculus
ccagggtcaggtgaaccaccaaaat

SEQ ID NO: 240297 - DNA, 25 bp, Mus musculus
ccagggtccacctggtgctacaggg

SEQ ID NO: 240298 - DNA, 25 bp, Mus musculus
ccagggtcccgcaagaatcaaaaga

SEQ ID NO: 240299 - DNA, 25 bp, Mus musculus
ccagggtcctgtttgggcttcctgt

SEQ ID NO: 240300 - DNA, 25 bp, Mus musculus
ccagggtcggacaaatgacaaagag

SEQ ID NO: 240301 - DNA, 25 bp, Mus musculus
ccagggtgatcgaggggctgacatg

SEQ ID NO: 240302 - DNA, 25 bp, Mus musculus
ccagggtggtcaggaaggtctatat

SEQ ID NO: 240303 - DNA, 25 bp, Mus musculus
ccagggtgtgcaagggcgaccaggg

SEQ ID NO: 240304 - DNA, 25 bp, Mus musculus
ccagggttacagacagggtttctct

SEQ ID NO: 240305 - DNA, 25 bp, Mus musculus
ccagggttacagatgctctctgatg

SEQ ID NO: 240306 - DNA, 25 bp, Mus musculus
ccagggttcaccagataaatttaac

SEQ ID NO: 240307 - DNA, 25 bp, Mus musculus
ccagggtttacaaaggagcagccat

SEQ ID NO: 240308 - DNA, 25 bp, Mus musculus
ccagggtttgctgagagtggacaga

SEQ ID NO: 240309 - DNA, 25 bp, Mus musculus
ccaggtaaagcctgccgggagtgaa

SEQ ID NO: 240310 - DNA, 25 bp, Mus musculus
ccaggtacaagacgaactggagaaa

SEQ ID NO: 240311 - DNA, 25 bp, Mus musculus
ccaggtacaagatcaagtctccagt

SEQ ID NO: 240312 - DNA, 25 bp, Mus musculus
ccaggtacaaggaaggaaaagatgg

SEQ ID NO: 240313 - DNA, 25 bp, Mus musculus
ccaggtacagatcatattgatcagt

SEQ ID NO: 240314 - DNA, 25 bp, Mus musculus
ccaggtacagcaatgacatttcttc

SEQ ID NO: 240315 - DNA, 25 bp, Mus musculus
ccaggtaccaggatttccaatttcg

SEQ ID NO: 240316 - DNA, 25 bp, Mus musculus
ccaggtaccaggcatacttctccgc

SEQ ID NO: 240317 - DNA, 25 bp, Mus musculus
ccaggtacctgatgtgatggtggtg

SEQ ID NO: 240318 - DNA, 25 bp, Mus musculus
ccaggtacctgggagcccgaaccaa

SEQ ID NO: 240319 - DNA, 25 bp, Mus musculus
ccaggtactacagtgtctaatgcac

SEQ ID NO: 240320 - DNA, 25 bp, Mus musculus
ccaggtagatgctgagaggaaaacc

SEQ ID NO: 240321 - DNA, 25 bp, Mus musculus
ccaggtataaaagcttatgcactgg

SEQ ID NO: 240322 - DNA, 25 bp, Mus musculus
ccaggtatcttgatgtcagcccatc

SEQ ID NO: 240323 - DNA, 25 bp, Mus musculus
ccaggtattgagacaatgatggtga

SEQ ID NO: 240324 - DNA, 25 bp, Mus musculus
ccaggtcaaagtgattgtgtgtcgc

SEQ ID NO: 240325 - DNA, 25 bp, Mus musculus
ccaggtcaaggactatgagaaagcc

SEQ ID NO: 240326 - DNA, 25 bp, Mus musculus
ccaggtcaaggagtccatgaagatt

SEQ ID NO: 240327 - DNA, 25 bp, Mus musculus
ccaggtcaaggatgataatggggga

SEQ ID NO: 240328 - DNA, 25 bp, Mus musculus
ccaggtcaaggctctggataagcac

SEQ ID NO: 240329 - DNA, 25 bp, Mus musculus
ccaggtcaagggcaagcctgacctg

SEQ ID NO: 240330 - DNA, 25 bp, Mus musculus
ccaggtcactaggggcttcagaaga

SEQ ID NO: 240331 - DNA, 25 bp, Mus musculus
ccaggtcagcaggcgctttgccctg

SEQ ID NO: 240332 - DNA, 25 bp, Mus musculus
ccaggtcagggccagggattctggg

SEQ ID NO: 240333 - DNA, 25 bp, Mus musculus
ccaggtcagggccaggtgtctccag

SEQ ID NO: 240334 - DNA, 25 bp, Mus musculus
ccaggtcagtgcttcgcaagatgga

SEQ ID NO: 240335 - DNA, 25 bp, Mus musculus
ccaggtccagaacggaggttccaca

SEQ ID NO: 240336 - DNA, 25 bp, Mus musculus
ccaggtccagctggacccccaaacc

SEQ ID NO: 240337 - DNA, 25 bp, Mus musculus
ccaggtccaggtcccgttcaagaag

SEQ ID NO: 240338 - DNA, 25 bp, Mus musculus
ccaggtccatgaccgaaatgcgact

SEQ ID NO: 240339 - DNA, 25 bp, Mus musculus
ccaggtccatggtaccaaccaaaaa

SEQ ID NO: 240340 - DNA, 25 bp, Mus musculus
ccaggtcccctctggatcataaaga

SEQ ID NO: 240341 - DNA, 25 bp, Mus musculus
ccaggtccgaagcaggctcctggag

SEQ ID NO: 240342 - DNA, 25 bp, Mus musculus
ccaggtccgaagtgctgactggtca

SEQ ID NO: 240343 - DNA, 25 bp, Mus musculus
ccaggtcctgcgggttctccagggg

SEQ ID NO: 240344 - DNA, 25 bp, Mus musculus
ccaggtcgctcaggacatcagcaac

SEQ ID NO: 240345 - DNA, 25 bp, Mus musculus
ccaggtcgctcaggcttgcagatgg

SEQ ID NO: 240346 - DNA, 25 bp, Mus musculus
ccaggtcgtaaggaggtgcctgcag

SEQ ID NO: 240347 - DNA, 25 bp, Mus musculus
ccaggtcgtggggttgtgctgggcc

SEQ ID NO: 240348 - DNA, 25 bp, Mus musculus
ccaggtctccttcaggctccatgtt

SEQ ID NO: 240349 - DNA, 25 bp, Mus musculus
ccaggtctccttcagttaaagctag

SEQ ID NO: 240350 - DNA, 25 bp, Mus musculus
ccaggtctgagagcccaacatgcaa

SEQ ID NO: 240351 - DNA, 25 bp, Mus musculus
ccaggtcttccaggcccaaagggtg

SEQ ID NO: 240352 - DNA, 25 bp, Mus musculus
ccaggtgaacaatgcagcagcaagt

SEQ ID NO: 240353 - DNA, 25 bp, Mus musculus
ccaggtgacaaagcaggtaaacact

SEQ ID NO: 240354 - DNA, 25 bp, Mus musculus
ccaggtgagtcagcagattcacaac

SEQ ID NO: 240355 - DNA, 25 bp, Mus musculus
ccaggtgatgacagaggacaaaggt

SEQ ID NO: 240356 - DNA, 25 bp, Mus musculus
ccaggtgatgacagtcacctctcct

SEQ ID NO: 240357 - DNA, 25 bp, Mus musculus
ccaggtgcaaagaggaaaacaccat

SEQ ID NO: 240358 - DNA, 25 bp, Mus musculus
ccaggtgcaaccagagctgcctgcc

SEQ ID NO: 240359 - DNA, 25 bp, Mus musculus
ccaggtgcaccagcgagcctgtcac

SEQ ID NO: 240360 - DNA, 25 bp, Mus musculus
ccaggtgcagagggcagctgagaca

SEQ ID NO: 240361 - DNA, 25 bp, Mus musculus
ccaggtgcagcctctaggtcgccat

SEQ ID NO: 240362 - DNA, 25 bp, Mus musculus
ccaggtgcagctggtgatcaaggac

SEQ ID NO: 240363 - DNA, 25 bp, Mus musculus
ccaggtgccacacggccatggctac

SEQ ID NO: 240364 - DNA, 25 bp, Mus musculus
ccaggtgccaggaagtggtcatatt

SEQ ID NO: 240365 - DNA, 25 bp, Mus musculus
ccaggtgccccagataagccaaaga

SEQ ID NO: 240366 - DNA, 25 bp, Mus musculus
ccaggtgccccaggtgttccatgag

SEQ ID NO: 240367 - DNA, 25 bp, Mus musculus
ccaggtgccccaggtttcttgaact

SEQ ID NO: 240368 - DNA, 25 bp, Mus musculus
ccaggtgctaatggcaatcctggac

SEQ ID NO: 240369 - DNA, 25 bp, Mus musculus
ccaggtggaaagcaagcagaacaca

SEQ ID NO: 240370 - DNA, 25 bp, Mus musculus
ccaggtggacatgacagtggccgag

SEQ ID NO: 240371 - DNA, 25 bp, Mus musculus
ccaggtggacattgaggcactgcaa

SEQ ID NO: 240372 - DNA, 25 bp, Mus musculus
ccaggtggagagcatatccgagggc

SEQ ID NO: 240373 - DNA, 25 bp, Mus musculus
ccaggtggagataagtcattgtgat

SEQ ID NO: 240374 - DNA, 25 bp, Mus musculus
ccaggtggagctgcctctgtacaac

SEQ ID NO: 240375 - DNA, 25 bp, Mus musculus
ccaggtggcagaggacctggtggct

SEQ ID NO: 240376 - DNA, 25 bp, Mus musculus
ccaggtggccgagaagctgtttgac

SEQ ID NO: 240377 - DNA, 25 bp, Mus musculus
ccaggtggctgagctcccgccagtg

SEQ ID NO: 240378 - DNA, 25 bp, Mus musculus
ccaggtggctgccccagtgcgggta

SEQ ID NO: 240379 - DNA, 25 bp, Mus musculus
ccaggtggctggtaccaattctatt

SEQ ID NO: 240380 - DNA, 25 bp, Mus musculus
ccaggtggtcatcaacggctcagag

SEQ ID NO: 240381 - DNA, 25 bp, Mus musculus
ccaggtggtgatctgcgaccagtac

SEQ ID NO: 240382 - DNA, 25 bp, Mus musculus
ccaggtggttcgccctagtcgaggg

SEQ ID NO: 240383 - DNA, 25 bp, Mus musculus
ccaggtgtttcagggctaccagtgg

SEQ ID NO: 240384 - DNA, 25 bp, Mus musculus
ccaggttagcaataggagaagatgg

SEQ ID NO: 240385 - DNA, 25 bp, Mus musculus
ccaggttatacaggacattgcccta

SEQ ID NO: 240386 - DNA, 25 bp, Mus musculus
ccaggttcaagacgatctggctgaa

SEQ ID NO: 240387 - DNA, 25 bp, Mus musculus
ccaggttcaggaataagactgtcaa

SEQ ID NO: 240388 - DNA, 25 bp, Mus musculus
ccaggttcaggtgttggcagccgag

SEQ ID NO: 240389 - DNA, 25 bp, Mus musculus
ccaggttcccagtttagccaggccc

SEQ ID NO: 240390 - DNA, 25 bp, Mus musculus
ccaggttctcagagccatcgtggct

SEQ ID NO: 240391 - DNA, 25 bp, Mus musculus
ccaggttggaagagcaattctacag

SEQ ID NO: 240392 - DNA, 25 bp, Mus musculus
ccaggttgtagcaaatgacaagatt

SEQ ID NO: 240393 - DNA, 25 bp, Mus musculus
ccaggtttccaaggtggcgacagac

SEQ ID NO: 240394 - DNA, 25 bp, Mus musculus
ccaggtttctttcagccttttatgt

SEQ ID NO: 240395 - DNA, 25 bp, Mus musculus
ccaggtttgagaatttgacttcgga

SEQ ID NO: 240396 - DNA, 25 bp, Mus musculus
ccaggtttgggttccccaggatgaa

SEQ ID NO: 240397 - DNA, 25 bp, Mus musculus
ccaggtttgtcaaaaataaggccag

SEQ ID NO: 240398 - DNA, 25 bp, Mus musculus
ccagtaaaaaccagaatgacccatt

SEQ ID NO: 240399 - DNA, 25 bp, Mus musculus
ccagtaaaaaccagaccgacgtgac

SEQ ID NO: 240400 - DNA, 25 bp, Mus musculus
ccagtaaacccagtgatcaggtgta

SEQ ID NO: 240401 - DNA, 25 bp, Mus musculus
ccagtaaagcagtggtggcagcaat

SEQ ID NO: 240402 - DNA, 25 bp, Mus musculus
ccagtaaagcagttttcctttggaa

SEQ ID NO: 240403 - DNA, 25 bp, Mus musculus
ccagtaacaagaggcttcccgagga

SEQ ID NO: 240404 - DNA, 25 bp, Mus musculus
ccagtaacaagcaaggaatccaagt

SEQ ID NO: 240405 - DNA, 25 bp, Mus musculus
ccagtaacagcacccaggcagacaa

SEQ ID NO: 240406 - DNA, 25 bp, Mus musculus
ccagtaacaggcacatccaggaccc

SEQ ID NO: 240407 - DNA, 25 bp, Mus musculus
ccagtaacagttacagaaaccccgg

SEQ ID NO: 240408 - DNA, 25 bp, Mus musculus
ccagtaacgtgtgctgccatgcttt

SEQ ID NO: 240409 - DNA, 25 bp, Mus musculus
ccagtaagaaccgggacactcttct

SEQ ID NO: 240410 - DNA, 25 bp, Mus musculus
ccagtaagcagataaggatgaatgt

SEQ ID NO: 240411 - DNA, 25 bp, Mus musculus
ccagtaagcatcagttcagaaacca

SEQ ID NO: 240412 - DNA, 25 bp, Mus musculus
ccagtaaggaaactctcggtgccat

SEQ ID NO: 240413 - DNA, 25 bp, Mus musculus
ccagtaagggacaagcctacacagg

SEQ ID NO: 240414 - DNA, 25 bp, Mus musculus
ccagtaagtatgataggctgggctt

SEQ ID NO: 240415 - DNA, 25 bp, Mus musculus
ccagtaatacattcaaactacaact

SEQ ID NO: 240416 - DNA, 25 bp, Mus musculus
ccagtaatgtgaagctgcagcctgt

SEQ ID NO: 240417 - DNA, 25 bp, Mus musculus
ccagtaatgtgaaggcaaagcccat

SEQ ID NO: 240418 - DNA, 25 bp, Mus musculus
ccagtaatttgtactataccaactg

SEQ ID NO: 240419 - DNA, 25 bp, Mus musculus
ccagtacaaagcccagcacctcacc

SEQ ID NO: 240420 - DNA, 25 bp, Mus musculus
ccagtacaaagctgtcttgatattt

SEQ ID NO: 240421 - DNA, 25 bp, Mus musculus
ccagtacaaaggacaaagccaaagt

SEQ ID NO: 240422 - DNA, 25 bp, Mus musculus
ccagtacaaagggaagtgtggtccc

SEQ ID NO: 240423 - DNA, 25 bp, Mus musculus
ccagtacaaaggggaccatggaact

SEQ ID NO: 240424 - DNA, 25 bp, Mus musculus
ccagtacaaaggtgtctcttgctca

SEQ ID NO: 240425 - DNA, 25 bp, Mus musculus
ccagtacaaaggtgtggtatcagta

SEQ ID NO: 240426 - DNA, 25 bp, Mus musculus
ccagtacaaggagcttcctccaatg

SEQ ID NO: 240427 - DNA, 25 bp, Mus musculus
ccagtacagccaggtgaccgagctg

SEQ ID NO: 240428 - DNA, 25 bp, Mus musculus
ccagtacattacgatgagactgagg

SEQ ID NO: 240429 - DNA, 25 bp, Mus musculus
ccagtacattacggctgagcgggag

SEQ ID NO: 240430 - DNA, 25 bp, Mus musculus
ccagtaccaagacaaagcctatttc

SEQ ID NO: 240431 - DNA, 25 bp, Mus musculus
ccagtaccaaggacctgtgttacat

SEQ ID NO: 240432 - DNA, 25 bp, Mus musculus
ccagtaccaggaatgggcacccctg

SEQ ID NO: 240433 - DNA, 25 bp, Mus musculus
ccagtaccagtcctcttctccaaag

SEQ ID NO: 240434 - DNA, 25 bp, Mus musculus
ccagtacccaggtctgtgaactcgt

SEQ ID NO: 240435 - DNA, 25 bp, Mus musculus
ccagtacctggagcaatcaaagtat

SEQ ID NO: 240436 - DNA, 25 bp, Mus musculus
ccagtacctggagggcctgttcttc

SEQ ID NO: 240437 - DNA, 25 bp, Mus musculus
ccagtactagttaagtgcctgaaga

SEQ ID NO: 240438 - DNA, 25 bp, Mus musculus
ccagtactcacctagagtggaccag

SEQ ID NO: 240439 - DNA, 25 bp, Mus musculus
ccagtactgtcacagatgcaggaga

SEQ ID NO: 240440 - DNA, 25 bp, Mus musculus
ccagtactgtcacaggtctggggct

SEQ ID NO: 240441 - DNA, 25 bp, Mus musculus
ccagtacttagcactcctacagcag

SEQ ID NO: 240442 - DNA, 25 bp, Mus musculus
ccagtacttagcactttatttgcag

SEQ ID NO: 240443 - DNA, 25 bp, Mus musculus
ccagtacttgacaggttcttgtctg

SEQ ID NO: 240444 - DNA, 25 bp, Mus musculus
ccagtacttggggccttttgctcga

SEQ ID NO: 240445 - DNA, 25 bp, Mus musculus
ccagtacttgggtctgacaagatgt

SEQ ID NO: 240446 - DNA, 25 bp, Mus musculus
ccagtactttgtgacaggtgtgtgc

SEQ ID NO: 240447 - DNA, 25 bp, Mus musculus
ccagtagaacaagagactaagtctg

SEQ ID NO: 240448 - DNA, 25 bp, Mus musculus
ccagtagaacaagtatcatctcaga

SEQ ID NO: 240449 - DNA, 25 bp, Mus musculus
ccagtagagaagctgaagggaacga

SEQ ID NO: 240450 - DNA, 25 bp, Mus musculus
ccagtagcaagatggactgtaacaa

SEQ ID NO: 240451 - DNA, 25 bp, Mus musculus
ccagtagcaaggaggccaatgccca

SEQ ID NO: 240452 - DNA, 25 bp, Mus musculus
ccagtagcaagttgcaggaggccaa

SEQ ID NO: 240453 - DNA, 25 bp, Mus musculus
ccagtagcagtgtcagtgtgcactc

SEQ ID NO: 240454 - DNA, 25 bp, Mus musculus
ccagtagtactacatgccaaatccg

SEQ ID NO: 240455 - DNA, 25 bp, Mus musculus
ccagtagtactagatgccaaatccg

SEQ ID NO: 240456 - DNA, 25 bp, Mus musculus
ccagtataaccctttaatggctact

SEQ ID NO: 240457 - DNA, 25 bp, Mus musculus
ccagtatagatgaaggcaaaagaaa

SEQ ID NO: 240458 - DNA, 25 bp, Mus musculus
ccagtatagatgtaggcaaaagaaa

SEQ ID NO: 240459 - DNA, 25 bp, Mus musculus
ccagtatagccaggtcatccacagg

SEQ ID NO: 240460 - DNA, 25 bp, Mus musculus
ccagtatcagagagacaagattgag

SEQ ID NO: 240461 - DNA, 25 bp, Mus musculus
ccagtatcggtaactgtgaatgctt

SEQ ID NO: 240462 - DNA, 25 bp, Mus musculus
ccagtatcggtaagtgttattgtaa

SEQ ID NO: 240463 - DNA, 25 bp, Mus musculus
ccagtatcggtactaatgtctgcga

SEQ ID NO: 240464 - DNA, 25 bp, Mus musculus
ccagtatcggtactcctccaaagtt

SEQ ID NO: 240465 - DNA, 25 bp, Mus musculus
ccagtatctcctcgctcttcgaacg

SEQ ID NO: 240466 - DNA, 25 bp, Mus musculus
ccagtatcttcagtcaagacctttg

SEQ ID NO: 240467 - DNA, 25 bp, Mus musculus
ccagtatgagcaagatccagtatgt

SEQ ID NO: 240468 - DNA, 25 bp, Mus musculus
ccagtatgcaggtgtcactgaactg

SEQ ID NO: 240469 - DNA, 25 bp, Mus musculus
ccagtatgcaggttgtccttgttcc

SEQ ID NO: 240470 - DNA, 25 bp, Mus musculus
ccagtatggaccgatgggtcccacc

SEQ ID NO: 240471 - DNA, 25 bp, Mus musculus
ccagtatggaccggtgtgttcctct

SEQ ID NO: 240472 - DNA, 25 bp, Mus musculus
ccagtatggagacacggactatttg

SEQ ID NO: 240473 - DNA, 25 bp, Mus musculus
ccagtatggagatcctcaccacgat

SEQ ID NO: 240474 - DNA, 25 bp, Mus musculus
ccagtatgggagtcaagctgtgcaa

SEQ ID NO: 240475 - DNA, 25 bp, Mus musculus
ccagtatgtctcaggctgaatttga

SEQ ID NO: 240476 - DNA, 25 bp, Mus musculus
ccagtattcagatggaaaactacag

SEQ ID NO: 240477 - DNA, 25 bp, Mus musculus
ccagtattcctgggggttcggcaga

SEQ ID NO: 240478 - DNA, 25 bp, Mus musculus
ccagtatttcaggagcctctttcag

SEQ ID NO: 240479 - DNA, 25 bp, Mus musculus
ccagtatttcaggcaggcaaccttc

SEQ ID NO: 240480 - DNA, 25 bp, Mus musculus
ccagtatttcccaggtgcggggtcc

SEQ ID NO: 240481 - DNA, 25 bp, Mus musculus
ccagtcaaacagtggcttgcattgt

SEQ ID NO: 240482 - DNA, 25 bp, Mus musculus
ccagtcaaacagtggtattttaaca

SEQ ID NO: 240483 - DNA, 25 bp, Mus musculus
ccagtcaatcaggaatgtcaagtga

SEQ ID NO: 240484 - DNA, 25 bp, Mus musculus
ccagtcacactgcgagttacacttc

SEQ ID NO: 240485 - DNA, 25 bp, Mus musculus
ccagtcacactgcgggagaaagcaa

SEQ ID NO: 240486 - DNA, 25 bp, Mus musculus
ccagtcacagtttgtggggacatcc

SEQ ID NO: 240487 - DNA, 25 bp, Mus musculus
ccagtcaccgacatgtgagccactg

SEQ ID NO: 240488 - DNA, 25 bp, Mus musculus
ccagtcacggaggcctcctctgtca

SEQ ID NO: 240489 - DNA, 25 bp, Mus musculus
ccagtcactatgtgctgtgagtggc

SEQ ID NO: 240490 - DNA, 25 bp, Mus musculus
ccagtcactgcacagcccatcgttt

SEQ ID NO: 240491 - DNA, 25 bp, Mus musculus
ccagtcactgcaggaagtatttgta

SEQ ID NO: 240492 - DNA, 25 bp, Mus musculus
ccagtcactgcttgtctcttacttt

SEQ ID NO: 240493 - DNA, 25 bp, Mus musculus
ccagtcactttcctaaccgcacaga

SEQ ID NO: 240494 - DNA, 25 bp, Mus musculus
ccagtcactttcctaccagcaatgc

SEQ ID NO: 240495 - DNA, 25 bp, Mus musculus
ccagtcagaatacagtttggtcagt

SEQ ID NO: 240496 - DNA, 25 bp, Mus musculus
ccagtcagcaagggtattcttcagt

SEQ ID NO: 240497 - DNA, 25 bp, Mus musculus
ccagtcagccaggttcaataagcac

SEQ ID NO: 240498 - DNA, 25 bp, Mus musculus
ccagtcagctcagaccctgctggac

SEQ ID NO: 240499 - DNA, 25 bp, Mus musculus
ccagtcagctcagctttgcggagcc

SEQ ID NO: 240500 - DNA, 25 bp, Mus musculus
ccagtcaggctggagtgacgagtat

SEQ ID NO: 240501 - DNA, 25 bp, Mus musculus
ccagtcagtacagcaaacaattggg

SEQ ID NO: 240502 - DNA, 25 bp, Mus musculus
ccagtcagtacaggttcatcgtttt

SEQ ID NO: 240503 - DNA, 25 bp, Mus musculus
ccagtcagtattacccttctagctg

SEQ ID NO: 240504 - DNA, 25 bp, Mus musculus
ccagtcatcttgatcgactgcgggc

SEQ ID NO: 240505 - DNA, 25 bp, Mus musculus
ccagtccaaaagagtacacacgaag

SEQ ID NO: 240506 - DNA, 25 bp, Mus musculus
ccagtccaattcagccaccagcaca

SEQ ID NO: 240507 - DNA, 25 bp, Mus musculus
ccagtccaattcaggcatggtccag

SEQ ID NO: 240508 - DNA, 25 bp, Mus musculus
ccagtccacagccattcctgcgccc

SEQ ID NO: 240509 - DNA, 25 bp, Mus musculus
ccagtccaccatgctgatggggatt

SEQ ID NO: 240510 - DNA, 25 bp, Mus musculus
ccagtccactgactttaactggtac

SEQ ID NO: 240511 - DNA, 25 bp, Mus musculus
ccagtccatcaccaagaacaagaaa

SEQ ID NO: 240512 - DNA, 25 bp, Mus musculus
ccagtccattgaggcgcccttgaca

SEQ ID NO: 240513 - DNA, 25 bp, Mus musculus
ccagtccccacgggcactatgaacg

SEQ ID NO: 240514 - DNA, 25 bp, Mus musculus
ccagtccccctactgtgacagatac

SEQ ID NO: 240515 - DNA, 25 bp, Mus musculus
ccagtcccgaagatccgcctccgac

SEQ ID NO: 240516 - DNA, 25 bp, Mus musculus
ccagtcccgatgaagaactaagtgg

SEQ ID NO: 240517 - DNA, 25 bp, Mus musculus
ccagtcccgatgaagaatggataac

SEQ ID NO: 240518 - DNA, 25 bp, Mus musculus
ccagtcctaacacttccagaaactc

SEQ ID NO: 240519 - DNA, 25 bp, Mus musculus
ccagtcctacagtgtctacagctac

SEQ ID NO: 240520 - DNA, 25 bp, Mus musculus
ccagtcctagaggccgggataactg

SEQ ID NO: 240521 - DNA, 25 bp, Mus musculus
ccagtcctcaggttctaagcgcagc

SEQ ID NO: 240522 - DNA, 25 bp, Mus musculus
ccagtcctcctaaggtgatcttagt

SEQ ID NO: 240523 - DNA, 25 bp, Mus musculus
ccagtcctcctaagtggagggcagc

SEQ ID NO: 240524 - DNA, 25 bp, Mus musculus
ccagtcctgcagagtagagctctgg

SEQ ID NO: 240525 - DNA, 25 bp, Mus musculus
ccagtcctgcagccctctctccttc

SEQ ID NO: 240526 - DNA, 25 bp, Mus musculus
ccagtcctgcccagctcaatggtgg

SEQ ID NO: 240527 - DNA, 25 bp, Mus musculus
ccagtcctgcccaggatggcagtac

SEQ ID NO: 240528 - DNA, 25 bp, Mus musculus
ccagtcctgtggtagaagaaagacc

SEQ ID NO: 240529 - DNA, 25 bp, Mus musculus
ccagtcctgttcagcaccaacacca

SEQ ID NO: 240530 - DNA, 25 bp, Mus musculus
ccagtcctgttcagcaccatcagca

SEQ ID NO: 240531 - DNA, 25 bp, Mus musculus
ccagtccttggcagcaggaggagcc

SEQ ID NO: 240532 - DNA, 25 bp, Mus musculus
ccagtcctttgagattgagcgtcac

SEQ ID NO: 240533 - DNA, 25 bp, Mus musculus
ccagtcgcccaaaagacctagtggt

SEQ ID NO: 240534 - DNA, 25 bp, Mus musculus
ccagtcgcggacagtggcaaccctg

SEQ ID NO: 240535 - DNA, 25 bp, Mus musculus
ccagtcgtgaagcgactccggccct

SEQ ID NO: 240536 - DNA, 25 bp, Mus musculus
ccagtctaagttctttcgagttttg

SEQ ID NO: 240537 - DNA, 25 bp, Mus musculus
ccagtctacaatcggtggagacaca

SEQ ID NO: 240538 - DNA, 25 bp, Mus musculus
ccagtctaggaaggtccttttgata

SEQ ID NO: 240539 - DNA, 25 bp, Mus musculus
ccagtctcacagccgagggttgatg

SEQ ID NO: 240540 - DNA, 25 bp, Mus musculus
ccagtctcagatgatacaactcttc

SEQ ID NO: 240541 - DNA, 25 bp, Mus musculus
ccagtctcagattgttatagatgat

SEQ ID NO: 240542 - DNA, 25 bp, Mus musculus
ccagtctccaagatggcggtaaatg

SEQ ID NO: 240543 - DNA, 25 bp, Mus musculus
ccagtctccaggtgattggatgtgt

SEQ ID NO: 240544 - DNA, 25 bp, Mus musculus
ccagtctcgtcacagataacatctg

SEQ ID NO: 240545 - DNA, 25 bp, Mus musculus
ccagtctcgtcacaggaatggcggc

SEQ ID NO: 240546 - DNA, 25 bp, Mus musculus
ccagtctctgccaaacacaccagaa

SEQ ID NO: 240547 - DNA, 25 bp, Mus musculus
ccagtctctgccaacattgtcctcg

SEQ ID NO: 240548 - DNA, 25 bp, Mus musculus
ccagtctgaatggtgggtgcaagtc

SEQ ID NO: 240549 - DNA, 25 bp, Mus musculus
ccagtctgaccgagtcagcaggacc

SEQ ID NO: 240550 - DNA, 25 bp, Mus musculus
ccagtctgagccgaatccaccttga

SEQ ID NO: 240551 - DNA, 25 bp, Mus musculus
ccagtctgcagcaagccccgcccaa

SEQ ID NO: 240552 - DNA, 25 bp, Mus musculus
ccagtctgcataaggctgcggagaa

SEQ ID NO: 240553 - DNA, 25 bp, Mus musculus
ccagtctgcggggcggttgccgctg

SEQ ID NO: 240554 - DNA, 25 bp, Mus musculus
ccagtctggcaggatcttgtgctga

SEQ ID NO: 240555 - DNA, 25 bp, Mus musculus
ccagtctgggggaggaaagaccaca

SEQ ID NO: 240556 - DNA, 25 bp, Mus musculus
ccagtcttcccagagtttccagagt

SEQ ID NO: 240557 - DNA, 25 bp, Mus musculus
ccagtcttcctaaatctgcagaaga

SEQ ID NO: 240558 - DNA, 25 bp, Mus musculus
ccagtcttggcagagttttgcctgt

SEQ ID NO: 240559 - DNA, 25 bp, Mus musculus
ccagtctttccgaagtctggggcta

SEQ ID NO: 240560 - DNA, 25 bp, Mus musculus
ccagtgaaaaatcagggggcctgtg

SEQ ID NO: 240561 - DNA, 25 bp, Mus musculus
ccagtgaaatgcctgcccagaaaaa

SEQ ID NO: 240562 - DNA, 25 bp, Mus musculus
ccagtgaaatgtcagaaaatcaaga

SEQ ID NO: 240563 - DNA, 25 bp, Mus musculus
ccagtgaaatgtctgcccagaaaaa

SEQ ID NO: 240564 - DNA, 25 bp, Mus musculus
ccagtgaaccggttccacttgaaaa

SEQ ID NO: 240565 - DNA, 25 bp, Mus musculus
ccagtgaactaggtggccttagaca

SEQ ID NO: 240566 - DNA, 25 bp, Mus musculus
ccagtgaagcaccaggtttggaaac

SEQ ID NO: 240567 - DNA, 25 bp, Mus musculus
ccagtgaagtgataagttgcaaggt

SEQ ID NO: 240568 - DNA, 25 bp, Mus musculus
ccagtgaattcttggacctgagttc

SEQ ID NO: 240569 - DNA, 25 bp, Mus musculus
ccagtgacacagcttcagcggtggg

SEQ ID NO: 240570 - DNA, 25 bp, Mus musculus
ccagtgacacaggttcagcggtggg

SEQ ID NO: 240571 - DNA, 25 bp, Mus musculus
ccagtgacacccgtgccggcataga

SEQ ID NO: 240572 - DNA, 25 bp, Mus musculus
ccagtgacagtgacctggctgaaga

SEQ ID NO: 240573 - DNA, 25 bp, Mus musculus
ccagtgaccaaccagattgagagcc

SEQ ID NO: 240574 - DNA, 25 bp, Mus musculus
ccagtgaccaaccaggtcgagtgtc

SEQ ID NO: 240575 - DNA, 25 bp, Mus musculus
ccagtgactaaaagtagtagaagga

SEQ ID NO: 240576 - DNA, 25 bp, Mus musculus
ccagtgagacagtcatcgctccacc

SEQ ID NO: 240577 - DNA, 25 bp, Mus musculus
ccagtgagacagtgggggatcttcg

SEQ ID NO: 240578 - DNA, 25 bp, Mus musculus
ccagtgaggaaaggagggcggaaat

SEQ ID NO: 240579 - DNA, 25 bp, Mus musculus
ccagtgaggactgggttgactgtgg

SEQ ID NO: 240580 - DNA, 25 bp, Mus musculus
ccagtgaggagaaggacctcaccat

SEQ ID NO: 240581 - DNA, 25 bp, Mus musculus
ccagtgaggagattccccccctagg

SEQ ID NO: 240582 - DNA, 25 bp, Mus musculus
ccagtgaggccccagggcaactggg

SEQ ID NO: 240583 - DNA, 25 bp, Mus musculus
ccagtgaggtgtgttgaggtcattg

SEQ ID NO: 240584 - DNA, 25 bp, Mus musculus
ccagtgataaactcgatgacctcac

SEQ ID NO: 240585 - DNA, 25 bp, Mus musculus
ccagtgatatacatggagatgactt

SEQ ID NO: 240586 - DNA, 25 bp, Mus musculus
ccagtgatgaaaagcttgttcggcc

SEQ ID NO: 240587 - DNA, 25 bp, Mus musculus
ccagtgatgaaaaggaagtaccatt

SEQ ID NO: 240588 - DNA, 25 bp, Mus musculus
ccagtgatgatgtttttccctaggc

SEQ ID NO: 240589 - DNA, 25 bp, Mus musculus
ccagtgatttgctgtcagaagctat

SEQ ID NO: 240590 - DNA, 25 bp, Mus musculus
ccagtgcaagaatggccatttgtgc

SEQ ID NO: 240591 - DNA, 25 bp, Mus musculus
ccagtgcaagacagggtctcatgga

SEQ ID NO: 240592 - DNA, 25 bp, Mus musculus
ccagtgcaagatgaagcactgattc

SEQ ID NO: 240593 - DNA, 25 bp, Mus musculus
ccagtgcacaagtgcacttaatgca

SEQ ID NO: 240594 - DNA, 25 bp, Mus musculus
ccagtgcaccctggaacagcttcag

SEQ ID NO: 240595 - DNA, 25 bp, Mus musculus
ccagtgcacggtgatatttttgaat

SEQ ID NO: 240596 - DNA, 25 bp, Mus musculus
ccagtgcagaagctgtagctatctc

SEQ ID NO: 240597 - DNA, 25 bp, Mus musculus
ccagtgcagcaggccacgcggggac

SEQ ID NO: 240598 - DNA, 25 bp, Mus musculus
ccagtgcagcgctgtagcatcctag

SEQ ID NO: 240599 - DNA, 25 bp, Mus musculus
ccagtgccaaaagaattcagaagga

SEQ ID NO: 240600 - DNA, 25 bp, Mus musculus
ccagtgccaaaagtgctggacccaa

SEQ ID NO: 240601 - DNA, 25 bp, Mus musculus
ccagtgccacggaggatctagataa

SEQ ID NO: 240602 - DNA, 25 bp, Mus musculus
ccagtgccacggagtcggaccagga

SEQ ID NO: 240603 - DNA, 25 bp, Mus musculus
ccagtgccagcccaggcctccagcc

SEQ ID NO: 240604 - DNA, 25 bp, Mus musculus
ccagtgccagtttcctagattggac

SEQ ID NO: 240605 - DNA, 25 bp, Mus musculus
ccagtgcccccaccggatgcagaag

SEQ ID NO: 240606 - DNA, 25 bp, Mus musculus
ccagtgcccccaggcttccccccaa

SEQ ID NO: 240607 - DNA, 25 bp, Mus musculus
ccagtgccctgggcaaggccaccaa

SEQ ID NO: 240608 - DNA, 25 bp, Mus musculus
ccagtgccgcacagtctggaataaa

SEQ ID NO: 240609 - DNA, 25 bp, Mus musculus
ccagtgcctctgactaggtctgcga

SEQ ID NO: 240610 - DNA, 25 bp, Mus musculus
ccagtgcctggggttctgcagcttc

SEQ ID NO: 240611 - DNA, 25 bp, Mus musculus
ccagtgcgactgaagcgaaggctga

SEQ ID NO: 240612 - DNA, 25 bp, Mus musculus
ccagtgcgcacgccggaccctgagc

SEQ ID NO: 240613 - DNA, 25 bp, Mus musculus
ccagtgctctgttgcatatgacatg

SEQ ID NO: 240614 - DNA, 25 bp, Mus musculus
ccagtgctctgttgcgctgacccct

SEQ ID NO: 240615 - DNA, 25 bp, Mus musculus
ccagtgcttagtgtggatctgttaa

SEQ ID NO: 240616 - DNA, 25 bp, Mus musculus
ccagtgcttccaaagcacaggctgg

SEQ ID NO: 240617 - DNA, 25 bp, Mus musculus
ccagtgcttccaaagccaggtgtca

SEQ ID NO: 240618 - DNA, 25 bp, Mus musculus
ccagtggaaatcacggttatctgcg

SEQ ID NO: 240619 - DNA, 25 bp, Mus musculus
ccagtggaacagattgttgtggtgg

SEQ ID NO: 240620 - DNA, 25 bp, Mus musculus
ccagtggaacgtgggatctcatcag

SEQ ID NO: 240621 - DNA, 25 bp, Mus musculus
ccagtggaactacaggtgaccccaa

SEQ ID NO: 240622 - DNA, 25 bp, Mus musculus
ccagtggaaggcaaaggctgcgaag

SEQ ID NO: 240623 - DNA, 25 bp, Mus musculus
ccagtggagaagatctcttcactgg

SEQ ID NO: 240624 - DNA, 25 bp, Mus musculus
ccagtggatcggaaaaggcctactg

SEQ ID NO: 240625 - DNA, 25 bp, Mus musculus
ccagtggcaaaccgggaataattct

SEQ ID NO: 240626 - DNA, 25 bp, Mus musculus
ccagtggcaattcaggttcattttg

SEQ ID NO: 240627 - DNA, 25 bp, Mus musculus
ccagtggcaattcaggttcccaggt

SEQ ID NO: 240628 - DNA, 25 bp, Mus musculus
ccagtggcaattcaggttctcttgc

SEQ ID NO: 240629 - DNA, 25 bp, Mus musculus
ccagtggcacagatgccctaggtct

SEQ ID NO: 240630 - DNA, 25 bp, Mus musculus
ccagtggcacaggtctccaccgcta

SEQ ID NO: 240631 - DNA, 25 bp, Mus musculus
ccagtgggacccagcatgctggcga

SEQ ID NO: 240632 - DNA, 25 bp, Mus musculus
ccagtgggagaaagtgagagcacca

SEQ ID NO: 240633 - DNA, 25 bp, Mus musculus
ccagtgggctccagcagcccaagcc

SEQ ID NO: 240634 - DNA, 25 bp, Mus musculus
ccagtgggggaacaggttgagtgat

SEQ ID NO: 240635 - DNA, 25 bp, Mus musculus
ccagtgggggaacagtttctctaat

SEQ ID NO: 240636 - DNA, 25 bp, Mus musculus
ccagtggtatgaggttgaacggaca

SEQ ID NO: 240637 - DNA, 25 bp, Mus musculus
ccagtggtatgagtggttcagaaat

SEQ ID NO: 240638 - DNA, 25 bp, Mus musculus
ccagtggtggaagaggagaactttg

SEQ ID NO: 240639 - DNA, 25 bp, Mus musculus
ccagtggtggaagtcgtgttcaagg

SEQ ID NO: 240640 - DNA, 25 bp, Mus musculus
ccagtggtggagccttcccatcagg

SEQ ID NO: 240641 - DNA, 25 bp, Mus musculus
ccagtggtggccctgtctctctgga

SEQ ID NO: 240642 - DNA, 25 bp, Mus musculus
ccagtggtggctttggtggcatatc

SEQ ID NO: 240643 - DNA, 25 bp, Mus musculus
ccagtggtgtgttagagtggattga

SEQ ID NO: 240644 - DNA, 25 bp, Mus musculus
ccagtggtgtgttaggtatggcttt

SEQ ID NO: 240645 - DNA, 25 bp, Mus musculus
ccagtggtgtgttaggtgcggtggc

SEQ ID NO: 240646 - DNA, 25 bp, Mus musculus
ccagtggttgctatggaacatcatt

SEQ ID NO: 240647 - DNA, 25 bp, Mus musculus
ccagtggttgctatggtctgggagg

SEQ ID NO: 240648 - DNA, 25 bp, Mus musculus
ccagtgtaaccaaagatgtcgcact

SEQ ID NO: 240649 - DNA, 25 bp, Mus musculus
ccagtgtaagattaatgtggctgct

SEQ ID NO: 240650 - DNA, 25 bp, Mus musculus
ccagtgtatgccacatgagtctttc

SEQ ID NO: 240651 - DNA, 25 bp, Mus musculus
ccagtgtatgtcttggtggtcacta

SEQ ID NO: 240652 - DNA, 25 bp, Mus musculus
ccagtgtcaggtcaattaccatgct

SEQ ID NO: 240653 - DNA, 25 bp, Mus musculus
ccagtgtcagtatgtggtccagtgt

SEQ ID NO: 240654 - DNA, 25 bp, Mus musculus
ccagtgtccaccagggtttgacctg

SEQ ID NO: 240655 - DNA, 25 bp, Mus musculus
ccagtgtcctcttctagttctttgt

SEQ ID NO: 240656 - DNA, 25 bp, Mus musculus
ccagtgtcctggaaggtggtttgct

SEQ ID NO: 240657 - DNA, 25 bp, Mus musculus
ccagtgtcctggcagcccaaacgat

SEQ ID NO: 240658 - DNA, 25 bp, Mus musculus
ccagtgtctcaggaatgtcaagtga

SEQ ID NO: 240659 - DNA, 25 bp, Mus musculus
ccagtgtctcaggcggcttggattt

SEQ ID NO: 240660 - DNA, 25 bp, Mus musculus
ccagtgtctcaggtgactcaagtac

SEQ ID NO: 240661 - DNA, 25 bp, Mus musculus
ccagtgtctcaggtgactccaatga

SEQ ID NO: 240662 - DNA, 25 bp, Mus musculus
ccagtgtctgcgagcccagatgccc

SEQ ID NO: 240663 - DNA, 25 bp, Mus musculus
ccagtgtctgcgatggttgtgagct

SEQ ID NO: 240664 - DNA, 25 bp, Mus musculus
ccagtgtgaacagaggcagaaactt

SEQ ID NO: 240665 - DNA, 25 bp, Mus musculus
ccagtgtgactggtttcatatgtcc

SEQ ID NO: 240666 - DNA, 25 bp, Mus musculus
ccagtgtgcgcagcctggaagggcg

SEQ ID NO: 240667 - DNA, 25 bp, Mus musculus
ccagtgtgcgcagcttgcttctcca

SEQ ID NO: 240668 - DNA, 25 bp, Mus musculus
ccagtgtgtggatgtggacgagtgt

SEQ ID NO: 240669 - DNA, 25 bp, Mus musculus
ccagtgtgtggcccgccacctctag

SEQ ID NO: 240670 - DNA, 25 bp, Mus musculus
ccagtgtgttaagccaaatttacgg

SEQ ID NO: 240671 - DNA, 25 bp, Mus musculus
ccagtgtgttaagtattttggaaat

SEQ ID NO: 240672 - DNA, 25 bp, Mus musculus
ccagtgttcaaacatgcccagttgc

SEQ ID NO: 240673 - DNA, 25 bp, Mus musculus
ccagtgttcacactacctttctgat

SEQ ID NO: 240674 - DNA, 25 bp, Mus musculus
ccagtgttccaaggagaccccctcc

SEQ ID NO: 240675 - DNA, 25 bp, Mus musculus
ccagtgttccaaggtttggtgccgt

SEQ ID NO: 240676 - DNA, 25 bp, Mus musculus
ccagtgttctggtacccactgtggg

SEQ ID NO: 240677 - DNA, 25 bp, Mus musculus
ccagtgttctggtacgctccggaat

SEQ ID NO: 240678 - DNA, 25 bp, Mus musculus
ccagtgttgctgagattgccaaaat

SEQ ID NO: 240679 - DNA, 25 bp, Mus musculus
ccagtgttggtgccatggtggcttc

SEQ ID NO: 240680 - DNA, 25 bp, Mus musculus
ccagtgtttatggcttgaagatgca

SEQ ID NO: 240681 - DNA, 25 bp, Mus musculus
ccagtgtttgaatgaccttcttttg

SEQ ID NO: 240682 - DNA, 25 bp, Mus musculus
ccagttaaaaaatcttgcccagtcc

SEQ ID NO: 240683 - DNA, 25 bp, Mus musculus
ccagttaagagagaacagagtttcc

SEQ ID NO: 240684 - DNA, 25 bp, Mus musculus
ccagttaaggaacaggctttcatgc

SEQ ID NO: 240685 - DNA, 25 bp, Mus musculus
ccagttaatagcagagggctaccgt

SEQ ID NO: 240686 - DNA, 25 bp, Mus musculus
ccagttaatgcttcaaactgttcca

SEQ ID NO: 240687 - DNA, 25 bp, Mus musculus
ccagttactctacatcccctcctct

SEQ ID NO: 240688 - DNA, 25 bp, Mus musculus
ccagttactctacttcatctactct

SEQ ID NO: 240689 - DNA, 25 bp, Mus musculus
ccagttattcagtggttctgggaag

SEQ ID NO: 240690 - DNA, 25 bp, Mus musculus
ccagttattcagttcgttactggca

SEQ ID NO: 240691 - DNA, 25 bp, Mus musculus
ccagttcaacaaacggtgtttgcct

SEQ ID NO: 240692 - DNA, 25 bp, Mus musculus
ccagttcaacaaacgttgacttgct

SEQ ID NO: 240693 - DNA, 25 bp, Mus musculus
ccagttcagcagcctgcagcagggc

SEQ ID NO: 240694 - DNA, 25 bp, Mus musculus
ccagttcagcagggcacctacgccc

SEQ ID NO: 240695 - DNA, 25 bp, Mus musculus
ccagttccaagaaaggtgcttacag

SEQ ID NO: 240696 - DNA, 25 bp, Mus musculus
ccagttccaagaggtgggatgctat

SEQ ID NO: 240697 - DNA, 25 bp, Mus musculus
ccagttccaggaagtcgttcttctc

SEQ ID NO: 240698 - DNA, 25 bp, Mus musculus
ccagttccagtaagtgcaataaaag

SEQ ID NO: 240699 - DNA, 25 bp, Mus musculus
ccagttccatagtgatgttaattat

SEQ ID NO: 240700 - DNA, 25 bp, Mus musculus
ccagttcccaggtctttcatagtac

SEQ ID NO: 240701 - DNA, 25 bp, Mus musculus
ccagttccccgaattccgtgtagag

SEQ ID NO: 240702 - DNA, 25 bp, Mus musculus
ccagttccccggtatccctctcacg

SEQ ID NO: 240703 - DNA, 25 bp, Mus musculus
ccagttcccttcaaggcatgagaga

SEQ ID NO: 240704 - DNA, 25 bp, Mus musculus
ccagttccgttggcgtctccaaggc

SEQ ID NO: 240705 - DNA, 25 bp, Mus musculus
ccagttccgttgggatccgcgcggg

SEQ ID NO: 240706 - DNA, 25 bp, Mus musculus
ccagttcctgagcggcatcccagag

SEQ ID NO: 240707 - DNA, 25 bp, Mus musculus
ccagttcctggaccctgtattgggc

SEQ ID NO: 240708 - DNA, 25 bp, Mus musculus
ccagttcgagggggctgaagaatac

SEQ ID NO: 240709 - DNA, 25 bp, Mus musculus
ccagttcggagaggctctgtctgcc

SEQ ID NO: 240710 - DNA, 25 bp, Mus musculus
ccagttcggagaggtggttctggaa

SEQ ID NO: 240711 - DNA, 25 bp, Mus musculus
ccagttcggcaaagagacttctggt

SEQ ID NO: 240712 - DNA, 25 bp, Mus musculus
ccagttcggcaaaggtgacatttgc

SEQ ID NO: 240713 - DNA, 25 bp, Mus musculus
ccagttctaattgtaatcgtgttcc

SEQ ID NO: 240714 - DNA, 25 bp, Mus musculus
ccagttctatgatggagaatccggg

SEQ ID NO: 240715 - DNA, 25 bp, Mus musculus
ccagttctcagagccccgtattcga

SEQ ID NO: 240716 - DNA, 25 bp, Mus musculus
ccagttctctgagactcgtctgcca

SEQ ID NO: 240717 - DNA, 25 bp, Mus musculus
ccagttcttcagtgctgagcctacc

SEQ ID NO: 240718 - DNA, 25 bp, Mus musculus
ccagttcttgcatggggatgatgac

SEQ ID NO: 240719 - DNA, 25 bp, Mus musculus
ccagttgatggtcacccttcctttc

SEQ ID NO: 240720 - DNA, 25 bp, Mus musculus
ccagttgatggttggcagaacgaga

SEQ ID NO: 240721 - DNA, 25 bp, Mus musculus
ccagttgcaagtattccccttccat

SEQ ID NO: 240722 - DNA, 25 bp, Mus musculus
ccagttgcagattgaacttcatgag

SEQ ID NO: 240723 - DNA, 25 bp, Mus musculus
ccagttgcagcaggtactctgaagc

SEQ ID NO: 240724 - DNA, 25 bp, Mus musculus
ccagttgcaggtacaacataagaga

SEQ ID NO: 240725 - DNA, 25 bp, Mus musculus
ccagttgcctcggagtttcagcctc

SEQ ID NO: 240726 - DNA, 25 bp, Mus musculus
ccagttgcctctcagtttcagcctc

SEQ ID NO: 240727 - DNA, 25 bp, Mus musculus
ccagttgctcaggcagtgcttttac

SEQ ID NO: 240728 - DNA, 25 bp, Mus musculus
ccagttggctggagggaaggtggct

SEQ ID NO: 240729 - DNA, 25 bp, Mus musculus
ccagttgtccccaaggtcagcatgt

SEQ ID NO: 240730 - DNA, 25 bp, Mus musculus
ccagttgtcgccctttaaccatgca

SEQ ID NO: 240731 - DNA, 25 bp, Mus musculus
ccagttgtcgggcagaactgtgtct

SEQ ID NO: 240732 - DNA, 25 bp, Mus musculus
ccagttgtcgggcagccagccattc

SEQ ID NO: 240733 - DNA, 25 bp, Mus musculus
ccagttgtgagatgtggtgatctac

SEQ ID NO: 240734 - DNA, 25 bp, Mus musculus
ccagtttaacaagacagtggagcat

SEQ ID NO: 240735 - DNA, 25 bp, Mus musculus
ccagtttagaggtctttcagcaagc

SEQ ID NO: 240736 - DNA, 25 bp, Mus musculus
ccagtttagaggttatctggaatac

SEQ ID NO: 240737 - DNA, 25 bp, Mus musculus
ccagtttcagcgtgcgggaggtgct

SEQ ID NO: 240738 - DNA, 25 bp, Mus musculus
ccagtttccgtgcctttgaagatga

SEQ ID NO: 240739 - DNA, 25 bp, Mus musculus
ccagtttgaataataggaatatccg

SEQ ID NO: 240740 - DNA, 25 bp, Mus musculus
ccagtttgaataatatttccctcat

SEQ ID NO: 240741 - DNA, 25 bp, Mus musculus
ccagtttgacaggacacagagctgc

SEQ ID NO: 240742 - DNA, 25 bp, Mus musculus
ccagtttgcaggagcattaagaaga

SEQ ID NO: 240743 - DNA, 25 bp, Mus musculus
ccagtttgcatttaggaggactgac

SEQ ID NO: 240744 - DNA, 25 bp, Mus musculus
ccagtttgctaagaactttgttgcc

SEQ ID NO: 240745 - DNA, 25 bp, Mus musculus
ccagtttggagagtgtgacttgctg

SEQ ID NO: 240746 - DNA, 25 bp, Mus musculus
ccagtttggagggtttctctgtgta

SEQ ID NO: 240747 - DNA, 25 bp, Mus musculus
ccagtttgggaagaaaggtggcagg

SEQ ID NO: 240748 - DNA, 25 bp, Mus musculus
ccagtttgggtgtctggagacatgg

SEQ ID NO: 240749 - DNA, 25 bp, Mus musculus
ccagttttacaggaatctgggcaaa

SEQ ID NO: 240750 - DNA, 25 bp, Mus musculus
ccagttttccagagccccttccaat

SEQ ID NO: 240751 - DNA, 25 bp, Mus musculus
ccagttttccattgggtcaggatca

SEQ ID NO: 240752 - DNA, 25 bp, Mus musculus
ccagttttccccaaggcaagtcttg

SEQ ID NO: 240753 - DNA, 25 bp, Mus musculus
ccagttttccccaaggctagcttcc

SEQ ID NO: 240754 - DNA, 25 bp, Mus musculus
ccagttttcggagtctattgcatct

SEQ ID NO: 240755 - DNA, 25 bp, Mus musculus
ccagttttctcaggaaattgggctt

SEQ ID NO: 240756 - DNA, 25 bp, Mus musculus
ccagttttgctgagaatggaatcat

SEQ ID NO: 240757 - DNA, 25 bp, Mus musculus
ccagtttttccaccgctctccagcc

SEQ ID NO: 240758 - DNA, 25 bp, Mus musculus
ccataaaaaaaccgacaagctgggc

SEQ ID NO: 240759 - DNA, 25 bp, Mus musculus
ccataaaaacattgcaaagaactga

SEQ ID NO: 240760 - DNA, 25 bp, Mus musculus
ccataaacacggcttttttcacagg

SEQ ID NO: 240761 - DNA, 25 bp, Mus musculus
ccataaacagcaagcctgtcattcc

SEQ ID NO: 240762 - DNA, 25 bp, Mus musculus
ccataaacagcaaggggagatgttg

SEQ ID NO: 240763 - DNA, 25 bp, Mus musculus
ccataaacatgctcagcaaagaagt

SEQ ID NO: 240764 - DNA, 25 bp, Mus musculus
ccataaacatggaataccaaattga

SEQ ID NO: 240765 - DNA, 25 bp, Mus musculus
ccataaacatggacttgaattttat

SEQ ID NO: 240766 - DNA, 25 bp, Mus musculus
ccataaagaatttgggagggctgga

SEQ ID NO: 240767 - DNA, 25 bp, Mus musculus
ccataaagaggaaaccactgagaaa

SEQ ID NO: 240768 - DNA, 25 bp, Mus musculus
ccataaagaggaaccaggccattta

SEQ ID NO: 240769 - DNA, 25 bp, Mus musculus
ccataaagaggatggagatattcta

SEQ ID NO: 240770 - DNA, 25 bp, Mus musculus
ccataaagcccaaactcccacaatc

SEQ ID NO: 240771 - DNA, 25 bp, Mus musculus
ccataaagcccaagtggaacggctg

SEQ ID NO: 240772 - DNA, 25 bp, Mus musculus
ccataacaacaaagaagggattcac

SEQ ID NO: 240773 - DNA, 25 bp, Mus musculus
ccataacaattgaagtcagaaggag

SEQ ID NO: 240774 - DNA, 25 bp, Mus musculus
ccataacacgacaaggtgtccaggc

SEQ ID NO: 240775 - DNA, 25 bp, Mus musculus
ccataacctacaagctaccacattt

SEQ ID NO: 240776 - DNA, 25 bp, Mus musculus
ccataacctacaagttgttatccga

SEQ ID NO: 240777 - DNA, 25 bp, Mus musculus
ccataacctacacagcgtacggcat

SEQ ID NO: 240778 - DNA, 25 bp, Mus musculus
ccataacggtggggtttgcaatagc

SEQ ID NO: 240779 - DNA, 25 bp, Mus musculus
ccataagaacgggagaggctccatc

SEQ ID NO: 240780 - DNA, 25 bp, Mus musculus
ccataagtgaagagagaagtttatt

SEQ ID NO: 240781 - DNA, 25 bp, Mus musculus
ccataagtttggatgatttaccttg

SEQ ID NO: 240782 - DNA, 25 bp, Mus musculus
ccataatcgaaggttggctgctgag

SEQ ID NO: 240783 - DNA, 25 bp, Mus musculus
ccataatgcagggcacaccaagagc

SEQ ID NO: 240784 - DNA, 25 bp, Mus musculus
ccataatggagatggttctgccgat

SEQ ID NO: 240785 - DNA, 25 bp, Mus musculus
ccatacaagtatgaacacaattttg

SEQ ID NO: 240786 - DNA, 25 bp, Mus musculus
ccatacacaaggccagctgttgcca

SEQ ID NO: 240787 - DNA, 25 bp, Mus musculus
ccatacacaggctcatcagcaggac

SEQ ID NO: 240788 - DNA, 25 bp, Mus musculus
ccatacacaggggtctgtatgaagc

SEQ ID NO: 240789 - DNA, 25 bp, Mus musculus
ccatacacatatggaggggcttttt

SEQ ID NO: 240790 - DNA, 25 bp, Mus musculus
ccatacagaaagagtatgaaaagac

SEQ ID NO: 240791 - DNA, 25 bp, Mus musculus
ccatacagctggtaaacaccagaga

SEQ ID NO: 240792 - DNA, 25 bp, Mus musculus
ccatacaggtatgtcatcaggcagc

SEQ ID NO: 240793 - DNA, 25 bp, Mus musculus
ccatacatagggaaaggcaggagca

SEQ ID NO: 240794 - DNA, 25 bp, Mus musculus
ccatacatcagccctcgtggtagct

SEQ ID NO: 240795 - DNA, 25 bp, Mus musculus
ccatacatcagttttgcaggtgacg

SEQ ID NO: 240796 - DNA, 25 bp, Mus musculus
ccatacatccggggactgagtgggg

SEQ ID NO: 240797 - DNA, 25 bp, Mus musculus
ccataccagcgaggggtcccgtagc

SEQ ID NO: 240798 - DNA, 25 bp, Mus musculus
ccataccagcttcagatctacccaa

SEQ ID NO: 240799 - DNA, 25 bp, Mus musculus
ccataccagcttcaggttgcatcag

SEQ ID NO: 240800 - DNA, 25 bp, Mus musculus
ccatacccaaaggtatcacagccac

SEQ ID NO: 240801 - DNA, 25 bp, Mus musculus
ccatacccaatcagggggagatctt

SEQ ID NO: 240802 - DNA, 25 bp, Mus musculus
ccatacccaatcaggtgatccgcag

SEQ ID NO: 240803 - DNA, 25 bp, Mus musculus
ccatacccagcctggtctatacaga

SEQ ID NO: 240804 - DNA, 25 bp, Mus musculus
ccataccccatgtcagggagacagc

SEQ ID NO: 240805 - DNA, 25 bp, Mus musculus
ccataccctgttgtggcctcttcct

SEQ ID NO: 240806 - DNA, 25 bp, Mus musculus
ccataccgcaagagacagataaatc

SEQ ID NO: 240807 - DNA, 25 bp, Mus musculus
ccataccgcaagatcgtctacttca

SEQ ID NO: 240808 - DNA, 25 bp, Mus musculus
ccatacctaaggtggagattctaga

SEQ ID NO: 240809 - DNA, 25 bp, Mus musculus
ccatacctgagctcgatgtcggttg

SEQ ID NO: 240810 - DNA, 25 bp, Mus musculus
ccatacctgagctcgctggcttctc

SEQ ID NO: 240811 - DNA, 25 bp, Mus musculus
ccatacctgctgagggacccagggt

SEQ ID NO: 240812 - DNA, 25 bp, Mus musculus
ccatacctgctgctccagcacggaa

SEQ ID NO: 240813 - DNA, 25 bp, Mus musculus
ccatacgatcacaagatgtctggtc

SEQ ID NO: 240814 - DNA, 25 bp, Mus musculus
ccatacgatcacaagattggcgaaa

SEQ ID NO: 240815 - DNA, 25 bp, Mus musculus
ccatacggacatatagattcttgta

SEQ ID NO: 240816 - DNA, 25 bp, Mus musculus
ccatacggacttggacattaaggcc

SEQ ID NO: 240817 - DNA, 25 bp, Mus musculus
ccatacggctggctcggatggcgtc

SEQ ID NO: 240818 - DNA, 25 bp, Mus musculus
ccatacgtttttcagaatgccggac

SEQ ID NO: 240819 - DNA, 25 bp, Mus musculus
ccatactaatttatcgcggaaccct

SEQ ID NO: 240820 - DNA, 25 bp, Mus musculus
ccatactaatttatggcggaaccct

SEQ ID NO: 240821 - DNA, 25 bp, Mus musculus
ccatactatctatgcaaaagtagac

SEQ ID NO: 240822 - DNA, 25 bp, Mus musculus
ccatactatgatccctcaagaacag

SEQ ID NO: 240823 - DNA, 25 bp, Mus musculus
ccatactcccgagatgttagatgta

SEQ ID NO: 240824 - DNA, 25 bp, Mus musculus
ccatactgaagctgacattatctct

SEQ ID NO: 240825 - DNA, 25 bp, Mus musculus
ccatactgtctactggtgccctccc

SEQ ID NO: 240826 - DNA, 25 bp, Mus musculus
ccatactgtctactgttccaccaag

SEQ ID NO: 240827 - DNA, 25 bp, Mus musculus
ccatactgtgagctggcccagtcct

SEQ ID NO: 240828 - DNA, 25 bp, Mus musculus
ccatactgtgagctggttcacccac

SEQ ID NO: 240829 - DNA, 25 bp, Mus musculus
ccatacttcagactagcttcctttt

SEQ ID NO: 240830 - DNA, 25 bp, Mus musculus
ccatacttcaggtcttcagcaatat

SEQ ID NO: 240831 - DNA, 25 bp, Mus musculus
ccatacttcccaagacagcattttc

SEQ ID NO: 240832 - DNA, 25 bp, Mus musculus
ccatagaacagaactcatgggaaga

SEQ ID NO: 240833 - DNA, 25 bp, Mus musculus
ccatagaacaggccaaagtagaaga

SEQ ID NO: 240834 - DNA, 25 bp, Mus musculus
ccatagacctcatcttcagtcccta

SEQ ID NO: 240835 - DNA, 25 bp, Mus musculus
ccatagacctcatggcctctacaag

SEQ ID NO: 240836 - DNA, 25 bp, Mus musculus
ccatagacctcattgggcaagagct

SEQ ID NO: 240837 - DNA, 25 bp, Mus musculus
ccatagacgagaggctcagagccct

SEQ ID NO: 240838 - DNA, 25 bp, Mus musculus
ccatagagaatcaggctgtcaccaa

SEQ ID NO: 240839 - DNA, 25 bp, Mus musculus
ccatagcaacaacagccatgggttc

SEQ ID NO: 240840 - DNA, 25 bp, Mus musculus
ccatagcagaccggatcctcttcag

SEQ ID NO: 240841 - DNA, 25 bp, Mus musculus
ccatagccatgctttctggcatatg

SEQ ID NO: 240842 - DNA, 25 bp, Mus musculus
ccatagcccagcaggaagcaacttc

SEQ ID NO: 240843 - DNA, 25 bp, Mus musculus
ccatagcccagcaggtgaccaacca

SEQ ID NO: 240844 - DNA, 25 bp, Mus musculus
ccataggaaatgcagaccagcagaa

SEQ ID NO: 240845 - DNA, 25 bp, Mus musculus
ccatagggagaggagccgccgccat

SEQ ID NO: 240846 - DNA, 25 bp, Mus musculus
ccatagggagaggagccgcctgtcc

SEQ ID NO: 240847 - DNA, 25 bp, Mus musculus
ccataggtaacattgccaagactta

SEQ ID NO: 240848 - DNA, 25 bp, Mus musculus
ccatagtactttccgttgtgtccag

SEQ ID NO: 240849 - DNA, 25 bp, Mus musculus
ccatagtactttttgcatagtaata

SEQ ID NO: 240850 - DNA, 25 bp, Mus musculus
ccatagtcacaggacgtccagcagg

SEQ ID NO: 240851 - DNA, 25 bp, Mus musculus
ccatagtgataagcaccctgtgacc

SEQ ID NO: 240852 - DNA, 25 bp, Mus musculus
ccatagtggctgcagagaatgatgt

SEQ ID NO: 240853 - DNA, 25 bp, Mus musculus
ccatagtgggacaatatcccagccc

SEQ ID NO: 240854 - DNA, 25 bp, Mus musculus
ccatatacatggtggtacaccatga

SEQ ID NO: 240855 - DNA, 25 bp, Mus musculus
ccatatatcaaatctggaggtgaac

SEQ ID NO: 240856 - DNA, 25 bp, Mus musculus
ccatatatcagtgagatttcaccga

SEQ ID NO: 240857 - DNA, 25 bp, Mus musculus
ccatatatgcagagatgagccgcca

SEQ ID NO: 240858 - DNA, 25 bp, Mus musculus
ccatatatgtggggccgagcaatat

SEQ ID NO: 240859 - DNA, 25 bp, Mus musculus
ccatatcaagaagccctggctgtcc

SEQ ID NO: 240860 - DNA, 25 bp, Mus musculus
ccatatcaagaaggagtttgacaag

SEQ ID NO: 240861 - DNA, 25 bp, Mus musculus
ccatatcaagtctatgcatggaaca

SEQ ID NO: 240862 - DNA, 25 bp, Mus musculus
ccatatcaagtttagagacgtggag

SEQ ID NO: 240863 - DNA, 25 bp, Mus musculus
ccatatcaagtttcttacttatcaa

SEQ ID NO: 240864 - DNA, 25 bp, Mus musculus
ccatatcatctcagatggaggctgc

SEQ ID NO: 240865 - DNA, 25 bp, Mus musculus
ccatatcccaagtgtctgataacaa

SEQ ID NO: 240866 - DNA, 25 bp, Mus musculus
ccatatcctcagattcagaaaaacc

SEQ ID NO: 240867 - DNA, 25 bp, Mus musculus
ccatatcctcagcctctccagcttc

SEQ ID NO: 240868 - DNA, 25 bp, Mus musculus
ccatatccttccagatgtatcggga

SEQ ID NO: 240869 - DNA, 25 bp, Mus musculus
ccatatccttccagatgtatctgga

SEQ ID NO: 240870 - DNA, 25 bp, Mus musculus
ccatatccttccaggagtttatcat

SEQ ID NO: 240871 - DNA, 25 bp, Mus musculus
ccatatgaacttggcatggaacatt

SEQ ID NO: 240872 - DNA, 25 bp, Mus musculus
ccatatgaatatcaagatggatgct

SEQ ID NO: 240873 - DNA, 25 bp, Mus musculus
ccatatgatacaggtctaccgcagc

SEQ ID NO: 240874 - DNA, 25 bp, Mus musculus
ccatatgcagaagttgctctgggct

SEQ ID NO: 240875 - DNA, 25 bp, Mus musculus
ccatatgcagcagatttttatcatt

SEQ ID NO: 240876 - DNA, 25 bp, Mus musculus
ccatatgcagcaggggggagcaccg

SEQ ID NO: 240877 - DNA, 25 bp, Mus musculus
ccatatgccaatggctggaagctaa

SEQ ID NO: 240878 - DNA, 25 bp, Mus musculus
ccatatgctgaaggagttattcctg

SEQ ID NO: 240879 - DNA, 25 bp, Mus musculus
ccatatgctgaagtatttcatggtt

SEQ ID NO: 240880 - DNA, 25 bp, Mus musculus
ccatatggaaaaaggaaatatatga

SEQ ID NO: 240881 - DNA, 25 bp, Mus musculus
ccatatggaagactcggagatcaaa

SEQ ID NO: 240882 - DNA, 25 bp, Mus musculus
ccatatgtgaaggaagaagaaatcg

SEQ ID NO: 240883 - DNA, 25 bp, Mus musculus
ccatattaccctagattggtgctga

SEQ ID NO: 240884 - DNA, 25 bp, Mus musculus
ccatattattggcaggattgaaagc

SEQ ID NO: 240885 - DNA, 25 bp, Mus musculus
ccatattattggcagggcagaggag

SEQ ID NO: 240886 - DNA, 25 bp, Mus musculus
ccatattcagcagatttgtgaaaac

SEQ ID NO: 240887 - DNA, 25 bp, Mus musculus
ccatattcaggcaaatgctgaacta

SEQ ID NO: 240888 - DNA, 25 bp, Mus musculus
ccatattcccagcttctccagttgg

SEQ ID NO: 240889 - DNA, 25 bp, Mus musculus
ccatattcccgtggcatctttctta

SEQ ID NO: 240890 - DNA, 25 bp, Mus musculus
ccatattgacacacatgcgggtgga

SEQ ID NO: 240891 - DNA, 25 bp, Mus musculus
ccatattgccaatggtgcagccgga

SEQ ID NO: 240892 - DNA, 25 bp, Mus musculus
ccatattgcccaaggacctgagccc

SEQ ID NO: 240893 - DNA, 25 bp, Mus musculus
ccatattgcccaagtcaaagtaaac

SEQ ID NO: 240894 - DNA, 25 bp, Mus musculus
ccatattggcgcaccactctcaagc

SEQ ID NO: 240895 - DNA, 25 bp, Mus musculus
ccatatttagattataaaaaagaaa

SEQ ID NO: 240896 - DNA, 25 bp, Mus musculus
ccatatttagcattcccgtcaataa

SEQ ID NO: 240897 - DNA, 25 bp, Mus musculus
ccatatttgaaaatgctgtggatgc

SEQ ID NO: 240898 - DNA, 25 bp, Mus musculus
ccatatttgaatcatttccaccctc

SEQ ID NO: 240899 - DNA, 25 bp, Mus musculus
ccatatttgacgcggaaaaggatat

SEQ ID NO: 240900 - DNA, 25 bp, Mus musculus
ccatatttgcagaagtcgagtccct

SEQ ID NO: 240901 - DNA, 25 bp, Mus musculus
ccatcaaaaaggcaaacataaatgg

SEQ ID NO: 240902 - DNA, 25 bp, Mus musculus
ccatcaaaaggagaagaaatgctta

SEQ ID NO: 240903 - DNA, 25 bp, Mus musculus
ccatcaaaaggaggaagctggctaa

SEQ ID NO: 240904 - DNA, 25 bp, Mus musculus
ccatcaaaattcagattgccttctc

SEQ ID NO: 240905 - DNA, 25 bp, Mus musculus
ccatcaaacaggttactatgaaaaa

SEQ ID NO: 240906 - DNA, 25 bp, Mus musculus
ccatcaaacagtcaaaatatctgtg

SEQ ID NO: 240907 - DNA, 25 bp, Mus musculus
ccatcaacaagcaaatccgcgacac

SEQ ID NO: 240908 - DNA, 25 bp, Mus musculus
ccatcaacacaccctttggggcgat

SEQ ID NO: 240909 - DNA, 25 bp, Mus musculus
ccatcaacaggatcattcggacaaa

SEQ ID NO: 240910 - DNA, 25 bp, Mus musculus
ccatcaaccaggaaagccgggtgag

SEQ ID NO: 240911 - DNA, 25 bp, Mus musculus
ccatcaactaaccaatactggagta

SEQ ID NO: 240912 - DNA, 25 bp, Mus musculus
ccatcaactacaagctgtatctttt

SEQ ID NO: 240913 - DNA, 25 bp, Mus musculus
ccatcaactacaagggcccaccctt

SEQ ID NO: 240914 - DNA, 25 bp, Mus musculus
ccatcaactggaccctcattcatgg

SEQ ID NO: 240915 - DNA, 25 bp, Mus musculus
ccatcaagcagggtttcaaagataa

SEQ ID NO: 240916 - DNA, 25 bp, Mus musculus
ccatcaagcctcagcagggatcaca

SEQ ID NO: 240917 - DNA, 25 bp, Mus musculus
ccatcaagcggccagggacgatccg

SEQ ID NO: 240918 - DNA, 25 bp, Mus musculus
ccatcaagcggccagggagagacga

SEQ ID NO: 240919 - DNA, 25 bp, Mus musculus
ccatcaaggcagagtgctcgatccg

SEQ ID NO: 240920 - DNA, 25 bp, Mus musculus
ccatcaaggtagaggcccctaacag

SEQ ID NO: 240921 - DNA, 25 bp, Mus musculus
ccatcaaggtgctctcgtcagttcc

SEQ ID NO: 240922 - DNA, 25 bp, Mus musculus
ccatcaagtgggttcatgtactgga

SEQ ID NO: 240923 - DNA, 25 bp, Mus musculus
ccatcaatagtcaaggtgaatatga

SEQ ID NO: 240924 - DNA, 25 bp, Mus musculus
ccatcaatcaggtgaatcccccgga

SEQ ID NO: 240925 - DNA, 25 bp, Mus musculus
ccatcaatcaggtgactgtgacgag

SEQ ID NO: 240926 - DNA, 25 bp, Mus musculus
ccatcaatgttggccccacgggtac

SEQ ID NO: 240927 - DNA, 25 bp, Mus musculus
ccatcaatgttggtgggcttccacc

SEQ ID NO: 240928 - DNA, 25 bp, Mus musculus
ccatcaatgttggtggtggcttcca

SEQ ID NO: 240929 - DNA, 25 bp, Mus musculus
ccatcacaagatctgatactcttgg

SEQ ID NO: 240930 - DNA, 25 bp, Mus musculus
ccatcacaaggtctgatactcttgg

SEQ ID NO: 240931 - DNA, 25 bp, Mus musculus
ccatcacacacacttccttcccatc

SEQ ID NO: 240932 - DNA, 25 bp, Mus musculus
ccatcacacacagatctcagtaaga

SEQ ID NO: 240933 - DNA, 25 bp, Mus musculus
ccatcacacagcctcggcccacact

SEQ ID NO: 240934 - DNA, 25 bp, Mus musculus
ccatcacaccaccagtcccgctcgg

SEQ ID NO: 240935 - DNA, 25 bp, Mus musculus
ccatcacagatgccgcaatgatggc

SEQ ID NO: 240936 - DNA, 25 bp, Mus musculus
ccatcacatacacgatattgatgag

SEQ ID NO: 240937 - DNA, 25 bp, Mus musculus
ccatcacatacacgcaatgcaccga

SEQ ID NO: 240938 - DNA, 25 bp, Mus musculus
ccatcacattaaagtttcactagaa

SEQ ID NO: 240939 - DNA, 25 bp, Mus musculus
ccatcaccaaaaatgggtacaagtt

SEQ ID NO: 240940 - DNA, 25 bp, Mus musculus
ccatcaccaaagccccccatcaaca

SEQ ID NO: 240941 - DNA, 25 bp, Mus musculus
ccatcaccaagaacaagaaaacagt

SEQ ID NO: 240942 - DNA, 25 bp, Mus musculus
ccatcaccaagatgacacttgggag

SEQ ID NO: 240943 - DNA, 25 bp, Mus musculus
ccatcaccaagcccccgaggcatgg

SEQ ID NO: 240944 - DNA, 25 bp, Mus musculus
ccatcaccaagctcctccagacaac

SEQ ID NO: 240945 - DNA, 25 bp, Mus musculus
ccatcaccaaggaagatttggaaaa

SEQ ID NO: 240946 - DNA, 25 bp, Mus musculus
ccatcaccaaggatcagttcatgtg

SEQ ID NO: 240947 - DNA, 25 bp, Mus musculus
ccatcaccaagtcagaaggtcagtt

SEQ ID NO: 240948 - DNA, 25 bp, Mus musculus
ccatcaccaagtcggatgctctggg

SEQ ID NO: 240949 - DNA, 25 bp, Mus musculus
ccatcaccagcatccatgtcttaca

SEQ ID NO: 240950 - DNA, 25 bp, Mus musculus
ccatcaccagccaccatcgagacac

SEQ ID NO: 240951 - DNA, 25 bp, Mus musculus
ccatcaccagccagtgtggggcagg

SEQ ID NO: 240952 - DNA, 25 bp, Mus musculus
ccatcaccagggtgtttccacaggt

SEQ ID NO: 240953 - DNA, 25 bp, Mus musculus
ccatcaccaggtgcgtgatgacatt

SEQ ID NO: 240954 - DNA, 25 bp, Mus musculus
ccatcacccagggcaccccactcaa

SEQ ID NO: 240955 - DNA, 25 bp, Mus musculus
ccatcaccccagaggtgtggccaaa

SEQ ID NO: 240956 - DNA, 25 bp, Mus musculus
ccatcacccgaaacaggccaccatc

SEQ ID NO: 240957 - DNA, 25 bp, Mus musculus
ccatcacccttgcagcatacgaagg

SEQ ID NO: 240958 - DNA, 25 bp, Mus musculus
ccatcaccgtcacagagccccctgt

SEQ ID NO: 240959 - DNA, 25 bp, Mus musculus
ccatcaccgtcacagagtcatacca

SEQ ID NO: 240960 - DNA, 25 bp, Mus musculus
ccatcacctatgagacactaaagta

SEQ ID NO: 240961 - DNA, 25 bp, Mus musculus
ccatcacctatgagagcggagaagc

SEQ ID NO: 240962 - DNA, 25 bp, Mus musculus
ccatcacctatgagatggtagaaga

SEQ ID NO: 240963 - DNA, 25 bp, Mus musculus
ccatcacctgagggccaacgaggtg

SEQ ID NO: 240964 - DNA, 25 bp, Mus musculus
ccatcaccttcattcacaacgacag

SEQ ID NO: 240965 - DNA, 25 bp, Mus musculus
ccatcaccttggcatttagtaagaa

SEQ ID NO: 240966 - DNA, 25 bp, Mus musculus
ccatcacgcaaggcatcccgaggtc

SEQ ID NO: 240967 - DNA, 25 bp, Mus musculus
ccatcactaaaagaagtgctcagag

SEQ ID NO: 240968 - DNA, 25 bp, Mus musculus
ccatcactcagctggagcaattcaa

SEQ ID NO: 240969 - DNA, 25 bp, Mus musculus
ccatcactcagggaaaccttagccc

SEQ ID NO: 240970 - DNA, 25 bp, Mus musculus
ccatcactcagggcgttcccttgga

SEQ ID NO: 240971 - DNA, 25 bp, Mus musculus
ccatcactcaggtcgctgttattcc

SEQ ID NO: 240972 - DNA, 25 bp, Mus musculus
ccatcactcctaagcaccaaggaac

SEQ ID NO: 240973 - DNA, 25 bp, Mus musculus
ccatcactcctaagcggttaatttc

SEQ ID NO: 240974 - DNA, 25 bp, Mus musculus
ccatcactcgagcttctagggacct

SEQ ID NO: 240975 - DNA, 25 bp, Mus musculus
ccatcactctcaacctgctgtcgct

SEQ ID NO: 240976 - DNA, 25 bp, Mus musculus
ccatcactctccggatgttgggaag

SEQ ID NO: 240977 - DNA, 25 bp, Mus musculus
ccatcactggagcaggccttatgac

SEQ ID NO: 240978 - DNA, 25 bp, Mus musculus
ccatcactgtccaagacccagcaac

SEQ ID NO: 240979 - DNA, 25 bp, Mus musculus
ccatcactgtccaagtggacacggg

SEQ ID NO: 240980 - DNA, 25 bp, Mus musculus
ccatcagaacagcgcaagaagagag

SEQ ID NO: 240981 - DNA, 25 bp, Mus musculus
ccatcagaagatgaaaaagggttca

SEQ ID NO: 240982 - DNA, 25 bp, Mus musculus
ccatcagaagtcctaggtactggtg

SEQ ID NO: 240983 - DNA, 25 bp, Mus musculus
ccatcagaagttttcctgacttctc

SEQ ID NO: 240984 - DNA, 25 bp, Mus musculus
ccatcagacactggtgaggagcatg

SEQ ID NO: 240985 - DNA, 25 bp, Mus musculus
ccatcagacatattggctggatccc

SEQ ID NO: 240986 - DNA, 25 bp, Mus musculus
ccatcagaccagaagctgaccacct

SEQ ID NO: 240987 - DNA, 25 bp, Mus musculus
ccatcagaccaggccagctgttgcc

SEQ ID NO: 240988 - DNA, 25 bp, Mus musculus
ccatcagacgctcagatatgctgaa

SEQ ID NO: 240989 - DNA, 25 bp, Mus musculus
ccatcagacggaactggtgtcctta

SEQ ID NO: 240990 - DNA, 25 bp, Mus musculus
ccatcagacggctggaagaggccca

SEQ ID NO: 240991 - DNA, 25 bp, Mus musculus
ccatcagacggtatcgagtggccca

SEQ ID NO: 240992 - DNA, 25 bp, Mus musculus
ccatcagacttctacctgtgtcttc

SEQ ID NO: 240993 - DNA, 25 bp, Mus musculus
ccatcagagagacatcttctctgtc

SEQ ID NO: 240994 - DNA, 25 bp, Mus musculus
ccatcagagagccctctccaggcca

SEQ ID NO: 240995 - DNA, 25 bp, Mus musculus
ccatcagcaagccaccaccacgaaa

SEQ ID NO: 240996 - DNA, 25 bp, Mus musculus
ccatcagcaccagggacccagggtc

SEQ ID NO: 240997 - DNA, 25 bp, Mus musculus
ccatcagcaccctccagcacggaag

SEQ ID NO: 240998 - DNA, 25 bp, Mus musculus
ccatcagcaccggccccccacttcc

SEQ ID NO: 240999 - DNA, 25 bp, Mus musculus
ccatcagccagaccacagatgacat

SEQ ID NO: 241000 - DNA, 25 bp, Mus musculus
ccatcagccaggtaagaatctaccc

SEQ ID NO: 241001 - DNA, 25 bp, Mus musculus
ccatcagccaggtcaggaatctacc

SEQ ID NO: 241002 - DNA, 25 bp, Mus musculus
ccatcagcccaggatgctatctccc

SEQ ID NO: 241003 - DNA, 25 bp, Mus musculus
ccatcagcccaggcgattaaatccc

SEQ ID NO: 241004 - DNA, 25 bp, Mus musculus
ccatcagccctcccaaaacatgact

SEQ ID NO: 241005 - DNA, 25 bp, Mus musculus
ccatcagccgagatgaacctctagt

SEQ ID NO: 241006 - DNA, 25 bp, Mus musculus
ccatcagctgactacccaggcggct

SEQ ID NO: 241007 - DNA, 25 bp, Mus musculus
ccatcagctgagtgactgtggagac

SEQ ID NO: 241008 - DNA, 25 bp, Mus musculus
ccatcagcttcattgatgaagcccg

SEQ ID NO: 241009 - DNA, 25 bp, Mus musculus
ccatcagcttcattggggttccttg

SEQ ID NO: 241010 - DNA, 25 bp, Mus musculus
ccatcaggaagggatgcggtaaaaa

SEQ ID NO: 241011 - DNA, 25 bp, Mus musculus
ccatcaggaggaggagatagaagag

SEQ ID NO: 241012 - DNA, 25 bp, Mus musculus
ccatcagggaagatacattgtgtgt

SEQ ID NO: 241013 - DNA, 25 bp, Mus musculus
ccatcagggaagcttccctgttgaa

SEQ ID NO: 241014 - DNA, 25 bp, Mus musculus
ccatcagggttccagggacttcctg

SEQ ID NO: 241015 - DNA, 25 bp, Mus musculus
ccatcaggtcaccaccatgggattt

SEQ ID NO: 241016 - DNA, 25 bp, Mus musculus
ccatcaggtcaccagcatgggattt

SEQ ID NO: 241017 - DNA, 25 bp, Mus musculus
ccatcagtacagggagcagatcaag

SEQ ID NO: 241018 - DNA, 25 bp, Mus musculus
ccatcagtacagtcatgcctgcagc

SEQ ID NO: 241019 - DNA, 25 bp, Mus musculus
ccatcagtcctcagatgcggtgagc

SEQ ID NO: 241020 - DNA, 25 bp, Mus musculus
ccatcagtcctctacgaatgtccac

SEQ ID NO: 241021 - DNA, 25 bp, Mus musculus
ccatcagtgatgatttcctattatg

SEQ ID NO: 241022 - DNA, 25 bp, Mus musculus
ccatcagtgatgctctccttacaga

SEQ ID NO: 241023 - DNA, 25 bp, Mus musculus
ccatcagttctgtgctcaaagatcc

SEQ ID NO: 241024 - DNA, 25 bp, Mus musculus
ccatcatagccaagttcctgtacgg

SEQ ID NO: 241025 - DNA, 25 bp, Mus musculus
ccatcatcaatggcattgtggagga

SEQ ID NO: 241026 - DNA, 25 bp, Mus musculus
ccatcatcacagacaccacggcgac

SEQ ID NO: 241027 - DNA, 25 bp, Mus musculus
ccatcatcacagattctcgagcagg

SEQ ID NO: 241028 - DNA, 25 bp, Mus musculus
ccatcatcacaggtattccagcatc

SEQ ID NO: 241029 - DNA, 25 bp, Mus musculus
ccatcatcacggcagatggcagtga

SEQ ID NO: 241030 - DNA, 25 bp, Mus musculus
ccatcatcagagagcttcatggagt

SEQ ID NO: 241031 - DNA, 25 bp, Mus musculus
ccatcatcagatggcaaggtcagcc

SEQ ID NO: 241032 - DNA, 25 bp, Mus musculus
ccatcatcagctctaggagttccag

SEQ ID NO: 241033 - DNA, 25 bp, Mus musculus
ccatcatcaggcaaacaggcatggg

SEQ ID NO: 241034 - DNA, 25 bp, Mus musculus
ccatcatcagtgtcccttgggaagg

SEQ ID NO: 241035 - DNA, 25 bp, Mus musculus
ccatcatcagtttttccagaggcct

SEQ ID NO: 241036 - DNA, 25 bp, Mus musculus
ccatcatccacaagactgcgggaag

SEQ ID NO: 241037 - DNA, 25 bp, Mus musculus
ccatcatccgggccatccgaaccat

SEQ ID NO: 241038 - DNA, 25 bp, Mus musculus
ccatcatcgaacagactcaccacct

SEQ ID NO: 241039 - DNA, 25 bp, Mus musculus
ccatcatcgaacagttcatgcaaca

SEQ ID NO: 241040 - DNA, 25 bp, Mus musculus
ccatcatcggagaagcttctgagaa

SEQ ID NO: 241041 - DNA, 25 bp, Mus musculus
ccatcatcggcgctggcgagaacct

SEQ ID NO: 241042 - DNA, 25 bp, Mus musculus
ccatcatctctcattactcgggttt

SEQ ID NO: 241043 - DNA, 25 bp, Mus musculus
ccatcatctgcactgctctgagaga

SEQ ID NO: 241044 - DNA, 25 bp, Mus musculus
ccatcatctggccagaaccagactt

SEQ ID NO: 241045 - DNA, 25 bp, Mus musculus
ccatcatctggccaggatactcaca

SEQ ID NO: 241046 - DNA, 25 bp, Mus musculus
ccatcatgaacggacccaagtgtgc

SEQ ID NO: 241047 - DNA, 25 bp, Mus musculus
ccatcatgaatcccagcccggaggg

SEQ ID NO: 241048 - DNA, 25 bp, Mus musculus
ccatcatgagatatctgccaagaga

SEQ ID NO: 241049 - DNA, 25 bp, Mus musculus
ccatcatgaggaaatttgccccgcg

SEQ ID NO: 241050 - DNA, 25 bp, Mus musculus
ccatcatgcgcccgaatgacagtcc

SEQ ID NO: 241051 - DNA, 25 bp, Mus musculus
ccatcatgctggggaaacaactgga

SEQ ID NO: 241052 - DNA, 25 bp, Mus musculus
ccatcatgctgggtggaagtgagag

SEQ ID NO: 241053 - DNA, 25 bp, Mus musculus
ccatcattgcaatctccacatggtc

SEQ ID NO: 241054 - DNA, 25 bp, Mus musculus
ccatcattgcagctgtgatcactgc

SEQ ID NO: 241055 - DNA, 25 bp, Mus musculus
ccatcattgcaggctcaaacatact

SEQ ID NO: 241056 - DNA, 25 bp, Mus musculus
ccatcattggcgattccggggtgca

SEQ ID NO: 241057 - DNA, 25 bp, Mus musculus
ccatcattggcggtgcccagatcat

SEQ ID NO: 241058 - DNA, 25 bp, Mus musculus
ccatccaaagagcagcacctgacgt

SEQ ID NO: 241059 - DNA, 25 bp, Mus musculus
ccatccaaccgaggagagtcaacag

SEQ ID NO: 241060 - DNA, 25 bp, Mus musculus
ccatccacacgttccgccaggtacg

SEQ ID NO: 241061 - DNA, 25 bp, Mus musculus
ccatccacccggctgccaataacta

SEQ ID NO: 241062 - DNA, 25 bp, Mus musculus
ccatccagaggcagctgcgagcttc

SEQ ID NO: 241063 - DNA, 25 bp, Mus musculus
ccatccagctcactactgtaacaga

SEQ ID NO: 241064 - DNA, 25 bp, Mus musculus
ccatccaggccaggctgggcagcat

SEQ ID NO: 241065 - DNA, 25 bp, Mus musculus
ccatccatagtgaccatgagggtgg

SEQ ID NO: 241066 - DNA, 25 bp, Mus musculus
ccatccatcgcaagtccacttgatc

SEQ ID NO: 241067 - DNA, 25 bp, Mus musculus
ccatccatgacaaggagtatgtcag

SEQ ID NO: 241068 - DNA, 25 bp, Mus musculus
ccatccatgccagtttgccttctat

SEQ ID NO: 241069 - DNA, 25 bp, Mus musculus
ccatcccaaagaaccatggatcggt

SEQ ID NO: 241070 - DNA, 25 bp, Mus musculus
ccatcccaaccgagatcctatgatt

SEQ ID NO: 241071 - DNA, 25 bp, Mus musculus
ccatcccaagaccctcctcatccgc

SEQ ID NO: 241072 - DNA, 25 bp, Mus musculus
ccatcccaagggaagggaggaagag

SEQ ID NO: 241073 - DNA, 25 bp, Mus musculus
ccatcccaagggaaggggagaggcc

SEQ ID NO: 241074 - DNA, 25 bp, Mus musculus
ccatcccaccaattcccacagagaa

SEQ ID NO: 241075 - DNA, 25 bp, Mus musculus
ccatcccactattggctttggacct

SEQ ID NO: 241076 - DNA, 25 bp, Mus musculus
ccatcccaggtgacaccgcttggct

SEQ ID NO: 241077 - DNA, 25 bp, Mus musculus
ccatcccagtgatgaatctggctac

SEQ ID NO: 241078 - DNA, 25 bp, Mus musculus
ccatcccagtgatggctaccataga

SEQ ID NO: 241079 - DNA, 25 bp, Mus musculus
ccatcccatcacctggaacaacctg

SEQ ID NO: 241080 - DNA, 25 bp, Mus musculus
ccatcccatgcccctgtttcactgg

SEQ ID NO: 241081 - DNA, 25 bp, Mus musculus
ccatccccaaagatggacaaaagag

SEQ ID NO: 241082 - DNA, 25 bp, Mus musculus
ccatccccagaggattatcacaaaa

SEQ ID NO: 241083 - DNA, 25 bp, Mus musculus
ccatccccagccctattcaggttat

SEQ ID NO: 241084 - DNA, 25 bp, Mus musculus
ccatccccagccctcaacttaatga

SEQ ID NO: 241085 - DNA, 25 bp, Mus musculus
ccatccccaggtgctgctttcctgc

SEQ ID NO: 241086 - DNA, 25 bp, Mus musculus
ccatccccatcaggccaaccagagg

SEQ ID NO: 241087 - DNA, 25 bp, Mus musculus
ccatcccccgcttgaaagatgccaa

SEQ ID NO: 241088 - DNA, 25 bp, Mus musculus
ccatccccgagcccggaagagaaaa

SEQ ID NO: 241089 - DNA, 25 bp, Mus musculus
ccatcccctcagctaacaatgaaga

SEQ ID NO: 241090 - DNA, 25 bp, Mus musculus
ccatcccctcccaagtttcagatta

SEQ ID NO: 241091 - DNA, 25 bp, Mus musculus
ccatccccttaaaggatcctctgaa

SEQ ID NO: 241092 - DNA, 25 bp, Mus musculus
ccatcccgaccattgggtttaatgt

SEQ ID NO: 241093 - DNA, 25 bp, Mus musculus
ccatccctgctgtgggcctccctga

SEQ ID NO: 241094 - DNA, 25 bp, Mus musculus
ccatccctggcctatctccctggag

SEQ ID NO: 241095 - DNA, 25 bp, Mus musculus
ccatccgacagcccgccggagtcct

SEQ ID NO: 241096 - DNA, 25 bp, Mus musculus
ccatccgagcagtggcaaagcaaca

SEQ ID NO: 241097 - DNA, 25 bp, Mus musculus
ccatccgccaccaggccaaccatat

SEQ ID NO: 241098 - DNA, 25 bp, Mus musculus
ccatccgcgccaagaacatttaaaa

SEQ ID NO: 241099 - DNA, 25 bp, Mus musculus
ccatccgctgtgctttgacctcgaa

SEQ ID NO: 241100 - DNA, 25 bp, Mus musculus
ccatccggaaccaggtgtcaccctg

SEQ ID NO: 241101 - DNA, 25 bp, Mus musculus
ccatccggaagaaagcaaaagagaa

SEQ ID NO: 241102 - DNA, 25 bp, Mus musculus
ccatccggagccagaatgacagcca

SEQ ID NO: 241103 - DNA, 25 bp, Mus musculus
ccatccggagccaggtcatccacgc

SEQ ID NO: 241104 - DNA, 25 bp, Mus musculus
ccatccggatagacaagcgtgagaa

SEQ ID NO: 241105 - DNA, 25 bp, Mus musculus
ccatccgggaagggaaactgcccgt

SEQ ID NO: 241106 - DNA, 25 bp, Mus musculus
ccatccggttgttgccgaatacacc

SEQ ID NO: 241107 - DNA, 25 bp, Mus musculus
ccatccgtgcctctgagatcccgtt

SEQ ID NO: 241108 - DNA, 25 bp, Mus musculus
ccatccgtgtagaggagcaggcgag

SEQ ID NO: 241109 - DNA, 25 bp, Mus musculus
ccatcctaccagttcgcagaccagt

SEQ ID NO: 241110 - DNA, 25 bp, Mus musculus
ccatcctaccatatctgtctcggac

SEQ ID NO: 241111 - DNA, 25 bp, Mus musculus
ccatcctatgaatctgttgatgaca

SEQ ID NO: 241112 - DNA, 25 bp, Mus musculus
ccatcctcaagcgcggtttccgtga

SEQ ID NO: 241113 - DNA, 25 bp, Mus musculus
ccatcctcacaaaagcacttgcaag

SEQ ID NO: 241114 - DNA, 25 bp, Mus musculus
ccatcctcagagatggccgccaaga

SEQ ID NO: 241115 - DNA, 25 bp, Mus musculus
ccatcctcaggctgcgctacatggt

SEQ ID NO: 241116 - DNA, 25 bp, Mus musculus
ccatcctcaggtgagactttcaaag

SEQ ID NO: 241117 - DNA, 25 bp, Mus musculus
ccatcctcaggtgtgtggtagaaga

SEQ ID NO: 241118 - DNA, 25 bp, Mus musculus
ccatcctcaggttcaggcagctgct

SEQ ID NO: 241119 - DNA, 25 bp, Mus musculus
ccatcctcagtggtacacttagcta

SEQ ID NO: 241120 - DNA, 25 bp, Mus musculus
ccatcctcatcaccggagaatccgg

SEQ ID NO: 241121 - DNA, 25 bp, Mus musculus
ccatcctcccaacagatgcagcgaa

SEQ ID NO: 241122 - DNA, 25 bp, Mus musculus
ccatcctccgagtacatcaccaagc

SEQ ID NO: 241123 - DNA, 25 bp, Mus musculus
ccatcctctgagcccctccccccgc

SEQ ID NO: 241124 - DNA, 25 bp, Mus musculus
ccatcctctggagacaggttttctc

SEQ ID NO: 241125 - DNA, 25 bp, Mus musculus
ccatcctctggagggtctggaatcc

SEQ ID NO: 241126 - DNA, 25 bp, Mus musculus
ccatcctgaagtccctgctatgtgg

SEQ ID NO: 241127 - DNA, 25 bp, Mus musculus
ccatcctgaagtttatcccgatgcc

SEQ ID NO: 241128 - DNA, 25 bp, Mus musculus
ccatcctgagcggctctctgtggat

SEQ ID NO: 241129 - DNA, 25 bp, Mus musculus
ccatcctgaggcctgactaccagaa

SEQ ID NO: 241130 - DNA, 25 bp, Mus musculus
ccatcctgcagaagcaccctaggat

SEQ ID NO: 241131 - DNA, 25 bp, Mus musculus
ccatcctgcagaccttatgtgagca

SEQ ID NO: 241132 - DNA, 25 bp, Mus musculus
ccatcctgcaggggctggcgagatg

SEQ ID NO: 241133 - DNA, 25 bp, Mus musculus
ccatcctggacaggccaaccaggat

SEQ ID NO: 241134 - DNA, 25 bp, Mus musculus
ccatcctggacagtctgcacctgtc

SEQ ID NO: 241135 - DNA, 25 bp, Mus musculus
ccatcctggagggctcctgtgatgc

SEQ ID NO: 241136 - DNA, 25 bp, Mus musculus
ccatcctggagtgtacaactctact

SEQ ID NO: 241137 - DNA, 25 bp, Mus musculus
ccatcctggcctcccttttttttgt

SEQ ID NO: 241138 - DNA, 25 bp, Mus musculus
ccatcctggcgatcattacagggga

SEQ ID NO: 241139 - DNA, 25 bp, Mus musculus
ccatcctggcggggaattctaccgg

SEQ ID NO: 241140 - DNA, 25 bp, Mus musculus
ccatcctgtctatggagaaaataag

SEQ ID NO: 241141 - DNA, 25 bp, Mus musculus
ccatccttaagtggccaaatgtaaa

SEQ ID NO: 241142 - DNA, 25 bp, Mus musculus
ccatccttacagcaggtggcccctt

SEQ ID NO: 241143 - DNA, 25 bp, Mus musculus
ccatccttaccctatccagcaatct

SEQ ID NO: 241144 - DNA, 25 bp, Mus musculus
ccatccttagtcagacgcgcacgga

SEQ ID NO: 241145 - DNA, 25 bp, Mus musculus
ccatccttgaaattttctgaattcc

SEQ ID NO: 241146 - DNA, 25 bp, Mus musculus
ccatccttgaatgtccagtttcaga

SEQ ID NO: 241147 - DNA, 25 bp, Mus musculus
ccatccttgtcgctgcggatgggac

SEQ ID NO: 241148 - DNA, 25 bp, Mus musculus
ccatcctttgcatgtgtctaaggat

SEQ ID NO: 241149 - DNA, 25 bp, Mus musculus
ccatcgaaagaacttgtcaatgtcc

SEQ ID NO: 241150 - DNA, 25 bp, Mus musculus
ccatcgaatacccgactcagcccta

SEQ ID NO: 241151 - DNA, 25 bp, Mus musculus
ccatcgaatacccgagttggattgt

SEQ ID NO: 241152 - DNA, 25 bp, Mus musculus
ccatcgacctggctgctgcaagaac

SEQ ID NO: 241153 - DNA, 25 bp, Mus musculus
ccatcgaccttccaggagatcctga

SEQ ID NO: 241154 - DNA, 25 bp, Mus musculus
ccatcgaccttccaggttttgggaa

SEQ ID NO: 241155 - DNA, 25 bp, Mus musculus
ccatcgagcaggtattcccaagcca

SEQ ID NO: 241156 - DNA, 25 bp, Mus musculus
ccatcgagcaggtgtcaccggatga

SEQ ID NO: 241157 - DNA, 25 bp, Mus musculus
ccatcgagctcatgaacacttcagt

SEQ ID NO: 241158 - DNA, 25 bp, Mus musculus
ccatcgagctcatgatcagtaatgg

SEQ ID NO: 241159 - DNA, 25 bp, Mus musculus
ccatcgagctcatgtgttctgtgcc

SEQ ID NO: 241160 - DNA, 25 bp, Mus musculus
ccatcgagctcatgttaccgaagtg

SEQ ID NO: 241161 - DNA, 25 bp, Mus musculus
ccatcgaggaggtgtaccacagcag

SEQ ID NO: 241162 - DNA, 25 bp, Mus musculus
ccatcgaggtggcaggccccactga

SEQ ID NO: 241163 - DNA, 25 bp, Mus musculus
ccatcgataggcccagcagctgtag

SEQ ID NO: 241164 - DNA, 25 bp, Mus musculus
ccatcgataggctcaggtattacct

SEQ ID NO: 241165 - DNA, 25 bp, Mus musculus
ccatcgatagtgtgtgcccttgccc

SEQ ID NO: 241166 - DNA, 25 bp, Mus musculus
ccatcgatcagatgttgctttgtgt

SEQ ID NO: 241167 - DNA, 25 bp, Mus musculus
ccatcgatcaggcccaatgatgatc

SEQ ID NO: 241168 - DNA, 25 bp, Mus musculus
ccatcgatcaggtcaactttgtagt

SEQ ID NO: 241169 - DNA, 25 bp, Mus musculus
ccatcgatgacgtgaaaagacaccg

SEQ ID NO: 241170 - DNA, 25 bp, Mus musculus
ccatcgatgcagtgaagcctggtgt

SEQ ID NO: 241171 - DNA, 25 bp, Mus musculus
ccatcgatgtgcgagattgtgaagg

SEQ ID NO: 241172 - DNA, 25 bp, Mus musculus
ccatcgatgtgcgagggaaggttgt

SEQ ID NO: 241173 - DNA, 25 bp, Mus musculus
ccatcgcaagtccacttgatcccag

SEQ ID NO: 241174 - DNA, 25 bp, Mus musculus
ccatcgcagaccattgcccagactc

SEQ ID NO: 241175 - DNA, 25 bp, Mus musculus
ccatcgccagctcaggcaccttaag

SEQ ID NO: 241176 - DNA, 25 bp, Mus musculus
ccatcgctacagatactttatgcat

SEQ ID NO: 241177 - DNA, 25 bp, Mus musculus
ccatcgctgcattctgctctggcca

SEQ ID NO: 241178 - DNA, 25 bp, Mus musculus
ccatcggaccccgaggagccaacat

SEQ ID NO: 241179 - DNA, 25 bp, Mus musculus
ccatcggacctgatttcaagtccaa

SEQ ID NO: 241180 - DNA, 25 bp, Mus musculus
ccatcggacctgctatctgatgtcc

SEQ ID NO: 241181 - DNA, 25 bp, Mus musculus
ccatcggacttttgatcctcacttc

SEQ ID NO: 241182 - DNA, 25 bp, Mus musculus
ccatcggacttttggacagtttctt

SEQ ID NO: 241183 - DNA, 25 bp, Mus musculus
ccatcggagccggggggacctcggg

SEQ ID NO: 241184 - DNA, 25 bp, Mus musculus
ccatcggatcaatggctctgcctgg

SEQ ID NO: 241185 - DNA, 25 bp, Mus musculus
ccatcggcaaggttcagaagaagag

SEQ ID NO: 241186 - DNA, 25 bp, Mus musculus
ccatcggcaccggcttttcctagat

SEQ ID NO: 241187 - DNA, 25 bp, Mus musculus
ccatcggccaggtttggccgtcgtg

SEQ ID NO: 241188 - DNA, 25 bp, Mus musculus
ccatcggccagtgggatctggtgtg

SEQ ID NO: 241189 - DNA, 25 bp, Mus musculus
ccatcggcgggctcctggccttgtg

SEQ ID NO: 241190 - DNA, 25 bp, Mus musculus
ccatcggcggggaagtttggtgagc

SEQ ID NO: 241191 - DNA, 25 bp, Mus musculus
ccatcggcttcagatatttatcaac

SEQ ID NO: 241192 - DNA, 25 bp, Mus musculus
ccatcggcttggtttggttccagtg

SEQ ID NO: 241193 - DNA, 25 bp, Mus musculus
ccatcgggaaacgtctctggagctg

SEQ ID NO: 241194 - DNA, 25 bp, Mus musculus
ccatcgggatggcagcataggtggc

SEQ ID NO: 241195 - DNA, 25 bp, Mus musculus
ccatcgggatggcaggatccaagtg

SEQ ID NO: 241196 - DNA, 25 bp, Mus musculus
ccatcggggcagaagagattgtgga

SEQ ID NO: 241197 - DNA, 25 bp, Mus musculus
ccatcgggtcgtaggtctcaaaaga

SEQ ID NO: 241198 - DNA, 25 bp, Mus musculus
ccatcggtacagggactgagactat

SEQ ID NO: 241199 - DNA, 25 bp, Mus musculus
ccatcgtcacggattccacactacg

SEQ ID NO: 241200 - DNA, 25 bp, Mus musculus
ccatcgtgacagagatggtcaagag

SEQ ID NO: 241201 - DNA, 25 bp, Mus musculus
ccatcgtgacagaggaacagaaatt

SEQ ID NO: 241202 - DNA, 25 bp, Mus musculus
ccatcgtgacagaggcgttctctgc

SEQ ID NO: 241203 - DNA, 25 bp, Mus musculus
ccatcgtgacagagtggaatctggt

SEQ ID NO: 241204 - DNA, 25 bp, Mus musculus
ccatcgtgacagagtgggacctggt

SEQ ID NO: 241205 - DNA, 25 bp, Mus musculus
ccatcgtgactgagtggaaccttgt

SEQ ID NO: 241206 - DNA, 25 bp, Mus musculus
ccatcgtgagacataggaggcggtt

SEQ ID NO: 241207 - DNA, 25 bp, Mus musculus
ccatcgtgaggaactatgaatggga

SEQ ID NO: 241208 - DNA, 25 bp, Mus musculus
ccatcgtgaggtagttgaaatgtaa

SEQ ID NO: 241209 - DNA, 25 bp, Mus musculus
ccatcgtgatcggcaagaagccagt

SEQ ID NO: 241210 - DNA, 25 bp, Mus musculus
ccatcgtgatcggtgagaaggaccg

SEQ ID NO: 241211 - DNA, 25 bp, Mus musculus
ccatcgtgtctagaccttaaactac

SEQ ID NO: 241212 - DNA, 25 bp, Mus musculus
ccatcgtgtctagagccttgcacat

SEQ ID NO: 241213 - DNA, 25 bp, Mus musculus
ccatcgttaaggtcttccatggtgc

SEQ ID NO: 241214 - DNA, 25 bp, Mus musculus
ccatctaagcagccttcctgcagca

SEQ ID NO: 241215 - DNA, 25 bp, Mus musculus
ccatctaagcaggtggcccgacggg

SEQ ID NO: 241216 - DNA, 25 bp, Mus musculus
ccatctacacagaaccagagcatga

SEQ ID NO: 241217 - DNA, 25 bp, Mus musculus
ccatctacacccaggtgattcgagt

SEQ ID NO: 241218 - DNA, 25 bp, Mus musculus
ccatctacactggaattacactatc

SEQ ID NO: 241219 - DNA, 25 bp, Mus musculus
ccatctacagaggctgatccccggc

SEQ ID NO: 241220 - DNA, 25 bp, Mus musculus
ccatctacaggcctgtccactggga

SEQ ID NO: 241221 - DNA, 25 bp, Mus musculus
ccatctacaggctgtttgattatcg

SEQ ID NO: 241222 - DNA, 25 bp, Mus musculus
ccatctacagtggctacagctttga

SEQ ID NO: 241223 - DNA, 25 bp, Mus musculus
ccatctacgaggtagatgcacggga

SEQ ID NO: 241224 - DNA, 25 bp, Mus musculus
ccatctacgaggttcccaaagaggt

SEQ ID NO: 241225 - DNA, 25 bp, Mus musculus
ccatctactatatctctgctcatgt

SEQ ID NO: 241226 - DNA, 25 bp, Mus musculus
ccatctagagacacggaagcctgtg

SEQ ID NO: 241227 - DNA, 25 bp, Mus musculus
ccatctagcaagcagctatggccgg

SEQ ID NO: 241228 - DNA, 25 bp, Mus musculus
ccatctagcaagcaggcatgacttg

SEQ ID NO: 241229 - DNA, 25 bp, Mus musculus
ccatctagcactaagagcggcgcta

SEQ ID NO: 241230 - DNA, 25 bp, Mus musculus
ccatctagctaatggggtagctggg

SEQ ID NO: 241231 - DNA, 25 bp, Mus musculus
ccatctagtgaatagtggaggagtg

SEQ ID NO: 241232 - DNA, 25 bp, Mus musculus
ccatctagtgctcttcctcctggcc

SEQ ID NO: 241233 - DNA, 25 bp, Mus musculus
ccatctatagatcttaccaatatat

SEQ ID NO: 241234 - DNA, 25 bp, Mus musculus
ccatctataggattcatgaataaaa

SEQ ID NO: 241235 - DNA, 25 bp, Mus musculus
ccatctatgagagaatatcaaagaa

SEQ ID NO: 241236 - DNA, 25 bp, Mus musculus
ccatctattatgtagatgtgcagaa

SEQ ID NO: 241237 - DNA, 25 bp, Mus musculus
ccatctattcctgaataaacactga

SEQ ID NO: 241238 - DNA, 25 bp, Mus musculus
ccatctcaaaacctgacaagacatt

SEQ ID NO: 241239 - DNA, 25 bp, Mus musculus
ccatctcaaccaggatgcgtacact

SEQ ID NO: 241240 - DNA, 25 bp, Mus musculus
ccatctcaacttgaggccatccgct

SEQ ID NO: 241241 - DNA, 25 bp, Mus musculus
ccatctcaacttgagtcagaagagg

SEQ ID NO: 241242 - DNA, 25 bp, Mus musculus
ccatctcacaattttacgcagatag

SEQ ID NO: 241243 - DNA, 25 bp, Mus musculus
ccatctcacaattttctggactgaa

SEQ ID NO: 241244 - DNA, 25 bp, Mus musculus
ccatctcacagtggagatgaatctg

SEQ ID NO: 241245 - DNA, 25 bp, Mus musculus
ccatctcagagatgggctttgctgg

SEQ ID NO: 241246 - DNA, 25 bp, Mus musculus
ccatctcagaggctggtgtttgctt

SEQ ID NO: 241247 - DNA, 25 bp, Mus musculus
ccatctcagtgaaaggtaaaccaga

SEQ ID NO: 241248 - DNA, 25 bp, Mus musculus
ccatctccaagcaggggtattttgc

SEQ ID NO: 241249 - DNA, 25 bp, Mus musculus
ccatctccaagcagtatgtctggat

SEQ ID NO: 241250 - DNA, 25 bp, Mus musculus
ccatctccacagctgcggtgctctt

SEQ ID NO: 241251 - DNA, 25 bp, Mus musculus
ccatctccagacagataccagaagc

SEQ ID NO: 241252 - DNA, 25 bp, Mus musculus
ccatctccagcccaggtgaacacca

SEQ ID NO: 241253 - DNA, 25 bp, Mus musculus
ccatctcccagactgataatggtct

SEQ ID NO: 241254 - DNA, 25 bp, Mus musculus
ccatctccgagctgatccacaccga

SEQ ID NO: 241255 - DNA, 25 bp, Mus musculus
ccatctcctccccagatcagcaccg

SEQ ID NO: 241256 - DNA, 25 bp, Mus musculus
ccatctctaagatgtaaagaaggaa

SEQ ID NO: 241257 - DNA, 25 bp, Mus musculus
ccatctctacagattcctgcggaac

SEQ ID NO: 241258 - DNA, 25 bp, Mus musculus
ccatctctagatctccattcggaca

SEQ ID NO: 241259 - DNA, 25 bp, Mus musculus
ccatctctcatcagcatccgccacc

SEQ ID NO: 241260 - DNA, 25 bp, Mus musculus
ccatctcttttaggatggacgacag

SEQ ID NO: 241261 - DNA, 25 bp, Mus musculus
ccatctgaaagctgggttgcaggcc

SEQ ID NO: 241262 - DNA, 25 bp, Mus musculus
ccatctgaagaaatcaaaggctctt

SEQ ID NO: 241263 - DNA, 25 bp, Mus musculus
ccatctgaagagtctactcggatgg

SEQ ID NO: 241264 - DNA, 25 bp, Mus musculus
ccatctgaaggacaaggagctccag

SEQ ID NO: 241265 - DNA, 25 bp, Mus musculus
ccatctgattccagctgaccagggt

SEQ ID NO: 241266 - DNA, 25 bp, Mus musculus
ccatctgcaaggatgctacggaaga

SEQ ID NO: 241267 - DNA, 25 bp, Mus musculus
ccatctgcaaggatggagaatacat

SEQ ID NO: 241268 - DNA, 25 bp, Mus musculus
ccatctgcagaaaaatatcgtttgc

SEQ ID NO: 241269 - DNA, 25 bp, Mus musculus
ccatctgcagaaagtggaagaaaat

SEQ ID NO: 241270 - DNA, 25 bp, Mus musculus
ccatctgcagggttatcaagatgtc

SEQ ID NO: 241271 - DNA, 25 bp, Mus musculus
ccatctgcatcagactccgtgcttc

SEQ ID NO: 241272 - DNA, 25 bp, Mus musculus
ccatctgccggctctgggggacctt

SEQ ID NO: 241273 - DNA, 25 bp, Mus musculus
ccatctgccggctgccgttccgagc

SEQ ID NO: 241274 - DNA, 25 bp, Mus musculus
ccatctgccgggaaggaagcacagg

SEQ ID NO: 241275 - DNA, 25 bp, Mus musculus
ccatctgcgcgggagagtcctttca

SEQ ID NO: 241276 - DNA, 25 bp, Mus musculus
ccatctggagaatgtgaggtggaca

SEQ ID NO: 241277 - DNA, 25 bp, Mus musculus
ccatctggagacctggtacggagca

SEQ ID NO: 241278 - DNA, 25 bp, Mus musculus
ccatctggcaaagggtatacctggc

SEQ ID NO: 241279 - DNA, 25 bp, Mus musculus
ccatctggccacaggggcattgttg

SEQ ID NO: 241280 - DNA, 25 bp, Mus musculus
ccatctgtaagaaggtcccaggtaa

SEQ ID NO: 241281 - DNA, 25 bp, Mus musculus
ccatctgtactgtgtacagtgcttc

SEQ ID NO: 241282 - DNA, 25 bp, Mus musculus
ccatctgtagggctgcctctctgga

SEQ ID NO: 241283 - DNA, 25 bp, Mus musculus
ccatctgtagggctgttgccaaggc

SEQ ID NO: 241284 - DNA, 25 bp, Mus musculus
ccatctgtctgcaaggatccagcaa

SEQ ID NO: 241285 - DNA, 25 bp, Mus musculus
ccatctgtgcaggtcctacggctct

SEQ ID NO: 241286 - DNA, 25 bp, Mus musculus
ccatctgtggataagctatatccac

SEQ ID NO: 241287 - DNA, 25 bp, Mus musculus
ccatctgtgggagtatgtcatggcc

SEQ ID NO: 241288 - DNA, 25 bp, Mus musculus
ccatcttaattaagaacattacttc

SEQ ID NO: 241289 - DNA, 25 bp, Mus musculus
ccatcttagaacatcctttactgtg

SEQ ID NO: 241290 - DNA, 25 bp, Mus musculus
ccatcttagttcgttgtgatgacga

SEQ ID NO: 241291 - DNA, 25 bp, Mus musculus
ccatcttcaagccttctgtggatga

SEQ ID NO: 241292 - DNA, 25 bp, Mus musculus
ccatcttcaaggacctgccgctgcc

SEQ ID NO: 241293 - DNA, 25 bp, Mus musculus
ccatcttcaaggtgttcgacgccat

SEQ ID NO: 241294 - DNA, 25 bp, Mus musculus
ccatcttcaccactgaccggggggt

SEQ ID NO: 241295 - DNA, 25 bp, Mus musculus
ccatcttcaccatggaaaagaacaa

SEQ ID NO: 241296 - DNA, 25 bp, Mus musculus
ccatcttccaggagaaccacaatgt

SEQ ID NO: 241297 - DNA, 25 bp, Mus musculus
ccatcttccccaggttctccaagcc

SEQ ID NO: 241298 - DNA, 25 bp, Mus musculus
ccatcttcgccataggtagcattgc

SEQ ID NO: 241299 - DNA, 25 bp, Mus musculus
ccatcttcgtctcctgccgtggatg

SEQ ID NO: 241300 - DNA, 25 bp, Mus musculus
ccatcttgactcggaggaagacgat

SEQ ID NO: 241301 - DNA, 25 bp, Mus musculus
ccatcttgactcggtggacaccatg

SEQ ID NO: 241302 - DNA, 25 bp, Mus musculus
ccatcttgcttagcctcaaagagtt

SEQ ID NO: 241303 - DNA, 25 bp, Mus musculus
ccatcttggccaaatgtaccgtcta

SEQ ID NO: 241304 - DNA, 25 bp, Mus musculus
ccatcttggtgaataagtacaacaa

SEQ ID NO: 241305 - DNA, 25 bp, Mus musculus
ccatcttgtactcagccagaagcac

SEQ ID NO: 241306 - DNA, 25 bp, Mus musculus
ccatcttgtggggatctacttcacc

SEQ ID NO: 241307 - DNA, 25 bp, Mus musculus
ccatcttgtgggggtcttctgggta

SEQ ID NO: 241308 - DNA, 25 bp, Mus musculus
ccatctttaaaagatgttcctcctg

SEQ ID NO: 241309 - DNA, 25 bp, Mus musculus
ccatctttacatatctacgcctgca

SEQ ID NO: 241310 - DNA, 25 bp, Mus musculus
ccatctttacatctggctgagcatc

SEQ ID NO: 241311 - DNA, 25 bp, Mus musculus
ccatctttattaagcatgtgaagta

SEQ ID NO: 241312 - DNA, 25 bp, Mus musculus
ccatctttattaagtacaaatcgaa

SEQ ID NO: 241313 - DNA, 25 bp, Mus musculus
ccatctttcgactaagatgcttagt

SEQ ID NO: 241314 - DNA, 25 bp, Mus musculus
ccatctttgaaatgcccatttgggg

SEQ ID NO: 241315 - DNA, 25 bp, Mus musculus
ccatctttgatcgggtgctgacaga

SEQ ID NO: 241316 - DNA, 25 bp, Mus musculus
ccatctttgatcggtccctctccag

SEQ ID NO: 241317 - DNA, 25 bp, Mus musculus
ccatctttggagaaaaatgtggaat

SEQ ID NO: 241318 - DNA, 25 bp, Mus musculus
ccatctttggagaataatgtggaat

SEQ ID NO: 241319 - DNA, 25 bp, Mus musculus
ccatcttttccaaacatcaacatgg

SEQ ID NO: 241320 - DNA, 25 bp, Mus musculus
ccatgaaaaacccgtctcgatactg

SEQ ID NO: 241321 - DNA, 25 bp, Mus musculus
ccatgaaaaatttggaaatcggtag

SEQ ID NO: 241322 - DNA, 25 bp, Mus musculus
ccatgaaacccaattccaaatctat

SEQ ID NO: 241323 - DNA, 25 bp, Mus musculus
ccatgaaagagaaaggtgttgacct

SEQ ID NO: 241324 - DNA, 25 bp, Mus musculus
ccatgaaagagacaggtgttgacct

SEQ ID NO: 241325 - DNA, 25 bp, Mus musculus
ccatgaaagaggcgccagccacctg

SEQ ID NO: 241326 - DNA, 25 bp, Mus musculus
ccatgaaagtgagatgagcatcagg

SEQ ID NO: 241327 - DNA, 25 bp, Mus musculus
ccatgaaatgagtttctctaatagc

SEQ ID NO: 241328 - DNA, 25 bp, Mus musculus
ccatgaaatgattgactctggtgtg

SEQ ID NO: 241329 - DNA, 25 bp, Mus musculus
ccatgaaatggccctgcggattgtg

SEQ ID NO: 241330 - DNA, 25 bp, Mus musculus
ccatgaaattcaaggatccagtgaa

SEQ ID NO: 241331 - DNA, 25 bp, Mus musculus
ccatgaacaacgcaggactaaattc

SEQ ID NO: 241332 - DNA, 25 bp, Mus musculus
ccatgaacaagaagtcctaccctag

SEQ ID NO: 241333 - DNA, 25 bp, Mus musculus
ccatgaacacagctatcgcggtaaa

SEQ ID NO: 241334 - DNA, 25 bp, Mus musculus
ccatgaacacagctttttgccttcg

SEQ ID NO: 241335 - DNA, 25 bp, Mus musculus
ccatgaacagcaaaggtcaatatcc

SEQ ID NO: 241336 - DNA, 25 bp, Mus musculus
ccatgaacatatcccgtactcttcc

SEQ ID NO: 241337 - DNA, 25 bp, Mus musculus
ccatgaacatgggtccaggagtgcg

SEQ ID NO: 241338 - DNA, 25 bp, Mus musculus
ccatgaaccgaggcatcaaggcctg

SEQ ID NO: 241339 - DNA, 25 bp, Mus musculus
ccatgaaccgcacttgctagtgtgc

SEQ ID NO: 241340 - DNA, 25 bp, Mus musculus
ccatgaacctggaaaacactggcca

SEQ ID NO: 241341 - DNA, 25 bp, Mus musculus
ccatgaacgcccgggcctggaagcg

SEQ ID NO: 241342 - DNA, 25 bp, Mus musculus
ccatgaagaaaaaagatgttggatc

SEQ ID NO: 241343 - DNA, 25 bp, Mus musculus
ccatgaagaacaattgccagccatg

SEQ ID NO: 241344 - DNA, 25 bp, Mus musculus
ccatgaagaacgtgaccgagctgaa

SEQ ID NO: 241345 - DNA, 25 bp, Mus musculus
ccatgaagaacttccacaggagagc

SEQ ID NO: 241346 - DNA, 25 bp, Mus musculus
ccatgaagaggaagttggtgtcctt

SEQ ID NO: 241347 - DNA, 25 bp, Mus musculus
ccatgaagagtctttgcagtttaaa

SEQ ID NO: 241348 - DNA, 25 bp, Mus musculus
ccatgaagatcaagatcattgctcc

SEQ ID NO: 241349 - DNA, 25 bp, Mus musculus
ccatgaagatcaagcagatgtggat

SEQ ID NO: 241350 - DNA, 25 bp, Mus musculus
ccatgaagcacgagaacgaggccct

SEQ ID NO: 241351 - DNA, 25 bp, Mus musculus
ccatgaagcaggtggcaggtaccat

SEQ ID NO: 241352 - DNA, 25 bp, Mus musculus
ccatgaagctgtagtgcagttgaac

SEQ ID NO: 241353 - DNA, 25 bp, Mus musculus
ccatgaagctgtagtgccaactact

SEQ ID NO: 241354 - DNA, 25 bp, Mus musculus
ccatgaaggaaagactcaggcagct

SEQ ID NO: 241355 - DNA, 25 bp, Mus musculus
ccatgaaggaaagttacccagcatg

SEQ ID NO: 241356 - DNA, 25 bp, Mus musculus
ccatgaaggaagccaaggacatgaa

SEQ ID NO: 241357 - DNA, 25 bp, Mus musculus
ccatgaaggatcaggatgacgatgc

SEQ ID NO: 241358 - DNA, 25 bp, Mus musculus
ccatgaaggatcaggcccttaagga

SEQ ID NO: 241359 - DNA, 25 bp, Mus musculus
ccatgaagtacaggctggacattgt

SEQ ID NO: 241360 - DNA, 25 bp, Mus musculus
ccatgaagtacctgaacgtgctggc

SEQ ID NO: 241361 - DNA, 25 bp, Mus musculus
ccatgaagtgggctttgttatccag

SEQ ID NO: 241362 - DNA, 25 bp, Mus musculus
ccatgaatacgtcagacatctggca

SEQ ID NO: 241363 - DNA, 25 bp, Mus musculus
ccatgaattttccaggtctctttaa

SEQ ID NO: 241364 - DNA, 25 bp, Mus musculus
ccatgaattttccagttcaaaagga

SEQ ID NO: 241365 - DNA, 25 bp, Mus musculus
ccatgacaagctccaccgcacagcc

SEQ ID NO: 241366 - DNA, 25 bp, Mus musculus
ccatgacaaggagtatgtcagggct

SEQ ID NO: 241367 - DNA, 25 bp, Mus musculus
ccatgacagtgtctcggttattccc

SEQ ID NO: 241368 - DNA, 25 bp, Mus musculus
ccatgacatcagcagcggacagttc

SEQ ID NO: 241369 - DNA, 25 bp, Mus musculus
ccatgacatccttggcagcactgca

SEQ ID NO: 241370 - DNA, 25 bp, Mus musculus
ccatgaccaaaggactctgatcact

SEQ ID NO: 241371 - DNA, 25 bp, Mus musculus
ccatgaccaagaggtcgctcgcatt

SEQ ID NO: 241372 - DNA, 25 bp, Mus musculus
ccatgaccaaggacaaacagaagat

SEQ ID NO: 241373 - DNA, 25 bp, Mus musculus
ccatgaccaaggatgaacagcaact

SEQ ID NO: 241374 - DNA, 25 bp, Mus musculus
ccatgaccacagctgttggtctgat

SEQ ID NO: 241375 - DNA, 25 bp, Mus musculus
ccatgaccaggaataactcaacctg

SEQ ID NO: 241376 - DNA, 25 bp, Mus musculus
ccatgaccaggcgctggctcaggca

SEQ ID NO: 241377 - DNA, 25 bp, Mus musculus
ccatgaccatacagatcatgtcatc

SEQ ID NO: 241378 - DNA, 25 bp, Mus musculus
ccatgacccagaggcaaaactccca

SEQ ID NO: 241379 - DNA, 25 bp, Mus musculus
ccatgacccaggtatacaagagact

SEQ ID NO: 241380 - DNA, 25 bp, Mus musculus
ccatgaccccagtgaccgtctggtt

SEQ ID NO: 241381 - DNA, 25 bp, Mus musculus
ccatgaccggaatccatgcccagaa

SEQ ID NO: 241382 - DNA, 25 bp, Mus musculus
ccatgaccggatttaattggtgatt

SEQ ID NO: 241383 - DNA, 25 bp, Mus musculus
ccatgaccggcttccttcaataagt

SEQ ID NO: 241384 - DNA, 25 bp, Mus musculus
ccatgacctcgaaaacgggctgtaa

SEQ ID NO: 241385 - DNA, 25 bp, Mus musculus
ccatgaccttggaagggcctggttc

SEQ ID NO: 241386 - DNA, 25 bp, Mus musculus
ccatgactattctcccggggccgcc

SEQ ID NO: 241387 - DNA, 25 bp, Mus musculus
ccatgactcctgacggtgaccctaa

SEQ ID NO: 241388 - DNA, 25 bp, Mus musculus
ccatgactctagccagcagggcctc

SEQ ID NO: 241389 - DNA, 25 bp, Mus musculus
ccatgactctcaggcaaggccagct

SEQ ID NO: 241390 - DNA, 25 bp, Mus musculus
ccatgactgaagggcatccgtctct

SEQ ID NO: 241391 - DNA, 25 bp, Mus musculus
ccatgactgtctatacaactaaaat

SEQ ID NO: 241392 - DNA, 25 bp, Mus musculus
ccatgactgtctatagacctgcaat

SEQ ID NO: 241393 - DNA, 25 bp, Mus musculus
ccatgactttggatggaagacttcg

SEQ ID NO: 241394 - DNA, 25 bp, Mus musculus
ccatgactttggcaccaggaagcct

SEQ ID NO: 241395 - DNA, 25 bp, Mus musculus
ccatgacttttgtacaaacaaattt

SEQ ID NO: 241396 - DNA, 25 bp, Mus musculus
ccatgagaaagagccactggcaagc

SEQ ID NO: 241397 - DNA, 25 bp, Mus musculus
ccatgagaaataaagacaaaaggct

SEQ ID NO: 241398 - DNA, 25 bp, Mus musculus
ccatgagaaattgccagtagttatc

SEQ ID NO: 241399 - DNA, 25 bp, Mus musculus
ccatgagaagaggaagcttcttgat

SEQ ID NO: 241400 - DNA, 25 bp, Mus musculus
ccatgagaagctgcccatggtgctg

SEQ ID NO: 241401 - DNA, 25 bp, Mus musculus
ccatgagaaggtactgaatgaggct

SEQ ID NO: 241402 - DNA, 25 bp, Mus musculus
ccatgagaccctggacatgaacaag

SEQ ID NO: 241403 - DNA, 25 bp, Mus musculus
ccatgagaccctgtacatgggctgt

SEQ ID NO: 241404 - DNA, 25 bp, Mus musculus
ccatgagagacttccagacagaact

SEQ ID NO: 241405 - DNA, 25 bp, Mus musculus
ccatgagagagatcccatggtttcc

SEQ ID NO: 241406 - DNA, 25 bp, Mus musculus
ccatgagagaggactgcctccagag

SEQ ID NO: 241407 - DNA, 25 bp, Mus musculus
ccatgagagaggtatatgctatgat

SEQ ID NO: 241408 - DNA, 25 bp, Mus musculus
ccatgagagggtgtggaccgtgtct

SEQ ID NO: 241409 - DNA, 25 bp, Mus musculus
ccatgagagttgactctgtgcagat

SEQ ID NO: 241410 - DNA, 25 bp, Mus musculus
ccatgagagttgggcacttgctgga

SEQ ID NO: 241411 - DNA, 25 bp, Mus musculus
ccatgagatccagctgtaggagact

SEQ ID NO: 241412 - DNA, 25 bp, Mus musculus
ccatgagatggattctgacgttggg

SEQ ID NO: 241413 - DNA, 25 bp, Mus musculus
ccatgagcaaagaggtgcaagatct

SEQ ID NO: 241414 - DNA, 25 bp, Mus musculus
ccatgagcagaacctcaggttctcc

SEQ ID NO: 241415 - DNA, 25 bp, Mus musculus
ccatgagcagatgaacgaattccgc

SEQ ID NO: 241416 - DNA, 25 bp, Mus musculus
ccatgagcagggtgtccctgtataa

SEQ ID NO: 241417 - DNA, 25 bp, Mus musculus
ccatgagccactgccagcgttccat

SEQ ID NO: 241418 - DNA, 25 bp, Mus musculus
ccatgagccgggtgaacctgaattt

SEQ ID NO: 241419 - DNA, 25 bp, Mus musculus
ccatgagctagggcacgttctcagc

SEQ ID NO: 241420 - DNA, 25 bp, Mus musculus
ccatgaggaaacccagtcgcatagg

SEQ ID NO: 241421 - DNA, 25 bp, Mus musculus
ccatgaggaggaagtcaacaccctg

SEQ ID NO: 241422 - DNA, 25 bp, Mus musculus
ccatgaggatttgggatttagaatt

SEQ ID NO: 241423 - DNA, 25 bp, Mus musculus
ccatgaggtcacgtaaacagagagt

SEQ ID NO: 241424 - DNA, 25 bp, Mus musculus
ccatgagtactacagcatgggcgca

SEQ ID NO: 241425 - DNA, 25 bp, Mus musculus
ccatgagtagcgaaagcaaatcaga

SEQ ID NO: 241426 - DNA, 25 bp, Mus musculus
ccatgagtcagaagcccatctcggt

SEQ ID NO: 241427 - DNA, 25 bp, Mus musculus
ccatgagtcagaaggtgttgcagcc

SEQ ID NO: 241428 - DNA, 25 bp, Mus musculus
ccatgagttcaaagaaaatccctga

SEQ ID NO: 241429 - DNA, 25 bp, Mus musculus
ccatgagttcatcgatggctaaagt

SEQ ID NO: 241430 - DNA, 25 bp, Mus musculus
ccatgagttcatcgatgtctacttc

SEQ ID NO: 241431 - DNA, 25 bp, Mus musculus
ccatgagttcgagcccgccggagtc

SEQ ID NO: 241432 - DNA, 25 bp, Mus musculus
ccatgatcaccagtgattcaggcca

SEQ ID NO: 241433 - DNA, 25 bp, Mus musculus
ccatgatccagagtcaggtgtggct

SEQ ID NO: 241434 - DNA, 25 bp, Mus musculus
ccatgatcctcatcggggtactttt

SEQ ID NO: 241435 - DNA, 25 bp, Mus musculus
ccatgatcgacacaaatgaagaaaa

SEQ ID NO: 241436 - DNA, 25 bp, Mus musculus
ccatgatcgacacaataaaattgaa

SEQ ID NO: 241437 - DNA, 25 bp, Mus musculus
ccatgatcttcctggacaaaccaat

SEQ ID NO: 241438 - DNA, 25 bp, Mus musculus
ccatgatgaacatggaagggttatt

SEQ ID NO: 241439 - DNA, 25 bp, Mus musculus
ccatgatgaacatggtgaagattcc

SEQ ID NO: 241440 - DNA, 25 bp, Mus musculus
ccatgatgaccctatcaaggagagt

SEQ ID NO: 241441 - DNA, 25 bp, Mus musculus
ccatgatgcatatcttcctcctggc

SEQ ID NO: 241442 - DNA, 25 bp, Mus musculus
ccatgatggcggagtgtctggaaaa

SEQ ID NO: 241443 - DNA, 25 bp, Mus musculus
ccatgatggctgaccatgatgtgcc

SEQ ID NO: 241444 - DNA, 25 bp, Mus musculus
ccatgatgtacgcaccagttgaatt

SEQ ID NO: 241445 - DNA, 25 bp, Mus musculus
ccatgatgtacgccagtgaattcat

SEQ ID NO: 241446 - DNA, 25 bp, Mus musculus
ccatgattaatgaattagtagaaga

SEQ ID NO: 241447 - DNA, 25 bp, Mus musculus
ccatgattagagggggacatgtcaa

SEQ ID NO: 241448 - DNA, 25 bp, Mus musculus
ccatgattattggagccccagaacg

SEQ ID NO: 241449 - DNA, 25 bp, Mus musculus
ccatgattgacaatgagacgctgcc

SEQ ID NO: 241450 - DNA, 25 bp, Mus musculus
ccatgatttatgggctcattgttgg

SEQ ID NO: 241451 - DNA, 25 bp, Mus musculus
ccatgatttatgtttgagattgctg

SEQ ID NO: 241452 - DNA, 25 bp, Mus musculus
ccatgcaaaatagcggtcacacaac

SEQ ID NO: 241453 - DNA, 25 bp, Mus musculus
ccatgcaaacagaacatgttggagc

SEQ ID NO: 241454 - DNA, 25 bp, Mus musculus
ccatgcaaacggtgttcaatatgaa

SEQ ID NO: 241455 - DNA, 25 bp, Mus musculus
ccatgcaaactcgccctgggcagtg

SEQ ID NO: 241456 - DNA, 25 bp, Mus musculus
ccatgcaacaacaagggaagtactc

SEQ ID NO: 241457 - DNA, 25 bp, Mus musculus
ccatgcaacaacaagggagctcact

SEQ ID NO: 241458 - DNA, 25 bp, Mus musculus
ccatgcaagtaatcggagaggtatt

SEQ ID NO: 241459 - DNA, 25 bp, Mus musculus
ccatgcaagtaatcggtggcaatta

SEQ ID NO: 241460 - DNA, 25 bp, Mus musculus
ccatgcaagtgccaaatttacggat

SEQ ID NO: 241461 - DNA, 25 bp, Mus musculus
ccatgcaatcaatgtttgcaaaaaa

SEQ ID NO: 241462 - DNA, 25 bp, Mus musculus
ccatgcaccaaatgactcgaccgat

SEQ ID NO: 241463 - DNA, 25 bp, Mus musculus
ccatgcacggagttgtgggaccgta

SEQ ID NO: 241464 - DNA, 25 bp, Mus musculus
ccatgcagagcgagatcaagaaatc

SEQ ID NO: 241465 - DNA, 25 bp, Mus musculus
ccatgcagcacaacccttccaggca

SEQ ID NO: 241466 - DNA, 25 bp, Mus musculus
ccatgcagcaccctgacacccaggg

SEQ ID NO: 241467 - DNA, 25 bp, Mus musculus
ccatgcagccaggcgatgacgtggt

SEQ ID NO: 241468 - DNA, 25 bp, Mus musculus
ccatgcaggaatatttaaggctgca

SEQ ID NO: 241469 - DNA, 25 bp, Mus musculus
ccatgcaggatgccagccccgcctt

SEQ ID NO: 241470 - DNA, 25 bp, Mus musculus
ccatgcagtgtgtggcacctctgca

SEQ ID NO: 241471 - DNA, 25 bp, Mus musculus
ccatgcataggaagcaccttcagga

SEQ ID NO: 241472 - DNA, 25 bp, Mus musculus
ccatgccaaacagagcatgctggag

SEQ ID NO: 241473 - DNA, 25 bp, Mus musculus
ccatgccaaacagctgcagagaaaa

SEQ ID NO: 241474 - DNA, 25 bp, Mus musculus
ccatgccaaagtctttgaaaccatc

SEQ ID NO: 241475 - DNA, 25 bp, Mus musculus
ccatgccaattgaggtcatgatgaa

SEQ ID NO: 241476 - DNA, 25 bp, Mus musculus
ccatgccagcatcagggagcctgta

SEQ ID NO: 241477 - DNA, 25 bp, Mus musculus
ccatgccataaggaaatcctacctt

SEQ ID NO: 241478 - DNA, 25 bp, Mus musculus
ccatgccatcaagaatgaggagatt

SEQ ID NO: 241479 - DNA, 25 bp, Mus musculus
ccatgcccatccgttcaattccacg

SEQ ID NO: 241480 - DNA, 25 bp, Mus musculus
ccatgccctctttagcagatatatt

SEQ ID NO: 241481 - DNA, 25 bp, Mus musculus
ccatgccctgtgatcagaccacctc

SEQ ID NO: 241482 - DNA, 25 bp, Mus musculus
ccatgcctgaaaaagaggcggcggg

SEQ ID NO: 241483 - DNA, 25 bp, Mus musculus
ccatgcctgaaaaaggtactgttgg

SEQ ID NO: 241484 - DNA, 25 bp, Mus musculus
ccatgccttagtgggctgggtgggt

SEQ ID NO: 241485 - DNA, 25 bp, Mus musculus
ccatgcgaatgttcggagcgaccgt

SEQ ID NO: 241486 - DNA, 25 bp, Mus musculus
ccatgcgagctgatggctttgtgcc

SEQ ID NO: 241487 - DNA, 25 bp, Mus musculus
ccatgcgagctggtccctgagttgg

SEQ ID NO: 241488 - DNA, 25 bp, Mus musculus
ccatgcgcagctccagacctcttgg

SEQ ID NO: 241489 - DNA, 25 bp, Mus musculus
ccatgcgtcaggaaatgtgttttcc

SEQ ID NO: 241490 - DNA, 25 bp, Mus musculus
ccatgctaagaggggatgtgaagtg

SEQ ID NO: 241491 - DNA, 25 bp, Mus musculus
ccatgctaccaacaagtatgaggta

SEQ ID NO: 241492 - DNA, 25 bp, Mus musculus
ccatgctcattgtgattatgtgggt

SEQ ID NO: 241493 - DNA, 25 bp, Mus musculus
ccatgctcattgtggtactgatagg

SEQ ID NO: 241494 - DNA, 25 bp, Mus musculus
ccatgctccccacccccgatctttc

SEQ ID NO: 241495 - DNA, 25 bp, Mus musculus
ccatgctccgaaagcatgtggaatt

SEQ ID NO: 241496 - DNA, 25 bp, Mus musculus
ccatgctccgagccgctggtttgtc

SEQ ID NO: 241497 - DNA, 25 bp, Mus musculus
ccatgctccgagggtctgactacag

SEQ ID NO: 241498 - DNA, 25 bp, Mus musculus
ccatgctctataaggatgttcgcaa

SEQ ID NO: 241499 - DNA, 25 bp, Mus musculus
ccatgctctctggtcttgtgcaact

SEQ ID NO: 241500 - DNA, 25 bp, Mus musculus
ccatgctctgcaggcttcgagtacc

SEQ ID NO: 241501 - DNA, 25 bp, Mus musculus
ccatgctctgcgttgctgctctcca

SEQ ID NO: 241502 - DNA, 25 bp, Mus musculus
ccatgctgaaaagagcaaggaaccc

SEQ ID NO: 241503 - DNA, 25 bp, Mus musculus
ccatgctgaacgctgagatcatctt

SEQ ID NO: 241504 - DNA, 25 bp, Mus musculus
ccatgctgactcggctgaaagcaaa

SEQ ID NO: 241505 - DNA, 25 bp, Mus musculus
ccatgctgactcgggttatcttctc

SEQ ID NO: 241506 - DNA, 25 bp, Mus musculus
ccatgctgagcaagctcatgttggg

SEQ ID NO: 241507 - DNA, 25 bp, Mus musculus
ccatgctgcagataagtgattgaca

SEQ ID NO: 241508 - DNA, 25 bp, Mus musculus
ccatgctgcagataagttactctca

SEQ ID NO: 241509 - DNA, 25 bp, Mus musculus
ccatgctgcaggtgctgggccccaa

SEQ ID NO: 241510 - DNA, 25 bp, Mus musculus
ccatgctggcaaagagtgatggcgt

SEQ ID NO: 241511 - DNA, 25 bp, Mus musculus
ccatgctggcagcgaacatgcgccg

SEQ ID NO: 241512 - DNA, 25 bp, Mus musculus
ccatgctggtaacgattcactaatc

SEQ ID NO: 241513 - DNA, 25 bp, Mus musculus
ccatgctggtaaggattcactaatc

SEQ ID NO: 241514 - DNA, 25 bp, Mus musculus
ccatgctgtcagccgttgactactt

SEQ ID NO: 241515 - DNA, 25 bp, Mus musculus
ccatgctgtccagagatgggtggct

SEQ ID NO: 241516 - DNA, 25 bp, Mus musculus
ccatgctgtgccttgcacaacccgg

SEQ ID NO: 241517 - DNA, 25 bp, Mus musculus
ccatgctgtggagattcatgacttg

SEQ ID NO: 241518 - DNA, 25 bp, Mus musculus
ccatgctgttctgaatgaagggacc

SEQ ID NO: 241519 - DNA, 25 bp, Mus musculus
ccatgctgttcttttcaggggagtt

SEQ ID NO: 241520 - DNA, 25 bp, Mus musculus
ccatgcttcactagaaagaaaaatg

SEQ ID NO: 241521 - DNA, 25 bp, Mus musculus
ccatgcttcggaaagtccttcaggc

SEQ ID NO: 241522 - DNA, 25 bp, Mus musculus
ccatgcttctgtggacgcagacgat

SEQ ID NO: 241523 - DNA, 25 bp, Mus musculus
ccatggaaaccagaagcgaatggaa

SEQ ID NO: 241524 - DNA, 25 bp, Mus musculus
ccatggaaaccagtattgcagcacc

SEQ ID NO: 241525 - DNA, 25 bp, Mus musculus
ccatggaacaccccatgcttaccgc

SEQ ID NO: 241526 - DNA, 25 bp, Mus musculus
ccatggaacaggaggaagtgaacat

SEQ ID NO: 241527 - DNA, 25 bp, Mus musculus
ccatggaaccagaaaatgagaaaat

SEQ ID NO: 241528 - DNA, 25 bp, Mus musculus
ccatggaaccagctctgttaaggaa

SEQ ID NO: 241529 - DNA, 25 bp, Mus musculus
ccatggaagagatctgtgaaggttc

SEQ ID NO: 241530 - DNA, 25 bp, Mus musculus
ccatggaatccacagttgatgatga

SEQ ID NO: 241531 - DNA, 25 bp, Mus musculus
ccatggaatccctttcagaaatcag

SEQ ID NO: 241532 - DNA, 25 bp, Mus musculus
ccatggaatccgataaagataaagt

SEQ ID NO: 241533 - DNA, 25 bp, Mus musculus
ccatggacaagatgcaatcactgta

SEQ ID NO: 241534 - DNA, 25 bp, Mus musculus
ccatggacaatgaagattacgaaca

SEQ ID NO: 241535 - DNA, 25 bp, Mus musculus
ccatggacagactacagatgctgga

SEQ ID NO: 241536 - DNA, 25 bp, Mus musculus
ccatggacagtctacagatgctgga

SEQ ID NO: 241537 - DNA, 25 bp, Mus musculus
ccatggacatgatgttgacggcatg

SEQ ID NO: 241538 - DNA, 25 bp, Mus musculus
ccatggacatgcacaatatcgccat

SEQ ID NO: 241539 - DNA, 25 bp, Mus musculus
ccatggacctagtccaaggcggttg

SEQ ID NO: 241540 - DNA, 25 bp, Mus musculus
ccatggacttggcatctgggtgttt

SEQ ID NO: 241541 - DNA, 25 bp, Mus musculus
ccatggacttgggaacacaccagtg

SEQ ID NO: 241542 - DNA, 25 bp, Mus musculus
ccatggagaaaacctgaagactgag

SEQ ID NO: 241543 - DNA, 25 bp, Mus musculus
ccatggagaacaagcattgatgatg

SEQ ID NO: 241544 - DNA, 25 bp, Mus musculus
ccatggagaacaggtgcttttacaa

SEQ ID NO: 241545 - DNA, 25 bp, Mus musculus
ccatggagaacgagagtctccatca

SEQ ID NO: 241546 - DNA, 25 bp, Mus musculus
ccatggagaacgagcctggaattgt

SEQ ID NO: 241547 - DNA, 25 bp, Mus musculus
ccatggagacgatctatgacatgct

SEQ ID NO: 241548 - DNA, 25 bp, Mus musculus
ccatggagagattgatcctgttaca

SEQ ID NO: 241549 - DNA, 25 bp, Mus musculus
ccatggagatggagcagttgacctt

SEQ ID NO: 241550 - DNA, 25 bp, Mus musculus
ccatggagcgatggttgtcggtgcc

SEQ ID NO: 241551 - DNA, 25 bp, Mus musculus
ccatggagcgatgtacctgacctct

SEQ ID NO: 241552 - DNA, 25 bp, Mus musculus
ccatggagcgatgtggacagaagta

SEQ ID NO: 241553 - DNA, 25 bp, Mus musculus
ccatggagctctttctacctccagt

SEQ ID NO: 241554 - DNA, 25 bp, Mus musculus
ccatggaggaggagagtataaagga

SEQ ID NO: 241555 - DNA, 25 bp, Mus musculus
ccatggaggaggctacgcaagggca

SEQ ID NO: 241556 - DNA, 25 bp, Mus musculus
ccatggaggaggggccttcatgatc

SEQ ID NO: 241557 - DNA, 25 bp, Mus musculus
ccatggagttaagcacggaaataac

SEQ ID NO: 241558 - DNA, 25 bp, Mus musculus
ccatggagttaagtggctaaaagcc

SEQ ID NO: 241559 - DNA, 25 bp, Mus musculus
ccatggatcaggaagatcctggccc

SEQ ID NO: 241560 - DNA, 25 bp, Mus musculus
ccatggatggagggatcgcttacac

SEQ ID NO: 241561 - DNA, 25 bp, Mus musculus
ccatggatggcggggatctgatgag

SEQ ID NO: 241562 - DNA, 25 bp, Mus musculus
ccatggatggtgttgttacagatct

SEQ ID NO: 241563 - DNA, 25 bp, Mus musculus
ccatggatgtccagctggctaacct

SEQ ID NO: 241564 - DNA, 25 bp, Mus musculus
ccatggatgttggcaaggcccgagg

SEQ ID NO: 241565 - DNA, 25 bp, Mus musculus
ccatggattcagagtccagaacttt

SEQ ID NO: 241566 - DNA, 25 bp, Mus musculus
ccatggcaccaggattttaattcct

SEQ ID NO: 241567 - DNA, 25 bp, Mus musculus
ccatggcagagcacctgacccagcc

SEQ ID NO: 241568 - DNA, 25 bp, Mus musculus
ccatggcagagcgatggcagcacct

SEQ ID NO: 241569 - DNA, 25 bp, Mus musculus
ccatggcagcaaacccctccccctc

SEQ ID NO: 241570 - DNA, 25 bp, Mus musculus
ccatggcagcaaagatccctccccg

SEQ ID NO: 241571 - DNA, 25 bp, Mus musculus
ccatggcagcagcttctaggtgcgc

SEQ ID NO: 241572 - DNA, 25 bp, Mus musculus
ccatggcaggcagtgtggattgtct

SEQ ID NO: 241573 - DNA, 25 bp, Mus musculus
ccatggcaggggagtcctcatggaa

SEQ ID NO: 241574 - DNA, 25 bp, Mus musculus
ccatggcagttgcgggagtgggagg

SEQ ID NO: 241575 - DNA, 25 bp, Mus musculus
ccatggcatcagaacggggctcttt

SEQ ID NO: 241576 - DNA, 25 bp, Mus musculus
ccatggcatcaggacgggcctcttc

SEQ ID NO: 241577 - DNA, 25 bp, Mus musculus
ccatggccaagatggagttccagaa

SEQ ID NO: 241578 - DNA, 25 bp, Mus musculus
ccatggccactgtggcctcctgagt

SEQ ID NO: 241579 - DNA, 25 bp, Mus musculus
ccatggccactgtggtctctgtgat

SEQ ID NO: 241580 - DNA, 25 bp, Mus musculus
ccatggccagggctctgacagcttc

SEQ ID NO: 241581 - DNA, 25 bp, Mus musculus
ccatggccagtaactctgaatgtga

SEQ ID NO: 241582 - DNA, 25 bp, Mus musculus
ccatggccagtgaggtgttcggaag

SEQ ID NO: 241583 - DNA, 25 bp, Mus musculus
ccatggcccgtattcggaaactaag

SEQ ID NO: 241584 - DNA, 25 bp, Mus musculus
ccatggcccgtgatgcttcatttct

SEQ ID NO: 241585 - DNA, 25 bp, Mus musculus
ccatggcccgtgtgtcagtggtgtt

SEQ ID NO: 241586 - DNA, 25 bp, Mus musculus
ccatggcctcagcaatgtgaagctg

SEQ ID NO: 241587 - DNA, 25 bp, Mus musculus
ccatggccttatgttgacttacttt

SEQ ID NO: 241588 - DNA, 25 bp, Mus musculus
ccatggcctttaagcctggaaagga

SEQ ID NO: 241589 - DNA, 25 bp, Mus musculus
ccatggcctttttgcctccagcgtc

SEQ ID NO: 241590 - DNA, 25 bp, Mus musculus
ccatggcgaaccaggtgatcaggtg

SEQ ID NO: 241591 - DNA, 25 bp, Mus musculus
ccatggcgaccagtacaaggccaca

SEQ ID NO: 241592 - DNA, 25 bp, Mus musculus
ccatggcgacctggtgactccatac

SEQ ID NO: 241593 - DNA, 25 bp, Mus musculus
ccatggcgcctgtgaaaaagcttgt

SEQ ID NO: 241594 - DNA, 25 bp, Mus musculus
ccatggcgctccagactgtacccac

SEQ ID NO: 241595 - DNA, 25 bp, Mus musculus
ccatggcgctccagaggctggagga

SEQ ID NO: 241596 - DNA, 25 bp, Mus musculus
ccatggcgctccagggacctctgag

SEQ ID NO: 241597 - DNA, 25 bp, Mus musculus
ccatggcgctccaggtgcccatcag

SEQ ID NO: 241598 - DNA, 25 bp, Mus musculus
ccatggcggctctacagccagaatg

SEQ ID NO: 241599 - DNA, 25 bp, Mus musculus
ccatggcggctctaggctccagcag

SEQ ID NO: 241600 - DNA, 25 bp, Mus musculus
ccatggcggctgggaccctgtacac

SEQ ID NO: 241601 - DNA, 25 bp, Mus musculus
ccatggcggggcccctaacggctag

SEQ ID NO: 241602 - DNA, 25 bp, Mus musculus
ccatggctactggggatgcacaaaa

SEQ ID NO: 241603 - DNA, 25 bp, Mus musculus
ccatggctactggttcaagatggct

SEQ ID NO: 241604 - DNA, 25 bp, Mus musculus
ccatggctcactggtcctgcgactg

SEQ ID NO: 241605 - DNA, 25 bp, Mus musculus
ccatggctcagactccgtggtttcc

SEQ ID NO: 241606 - DNA, 25 bp, Mus musculus
ccatggctcagcaagcttccctgct

SEQ ID NO: 241607 - DNA, 25 bp, Mus musculus
ccatggctcagcaagcttccctggc

SEQ ID NO: 241608 - DNA, 25 bp, Mus musculus
ccatggctcgcaggtttgcctgcaa

SEQ ID NO: 241609 - DNA, 25 bp, Mus musculus
ccatggctcgggactcggccagact

SEQ ID NO: 241610 - DNA, 25 bp, Mus musculus
ccatggctctgcaggtagccagaaa

SEQ ID NO: 241611 - DNA, 25 bp, Mus musculus
ccatggctctggggttggttctgga

SEQ ID NO: 241612 - DNA, 25 bp, Mus musculus
ccatggctgacacgcttccaggtcc

SEQ ID NO: 241613 - DNA, 25 bp, Mus musculus
ccatggctgacacggtccgaggaga

SEQ ID NO: 241614 - DNA, 25 bp, Mus musculus
ccatggctgagactctgaagactct

SEQ ID NO: 241615 - DNA, 25 bp, Mus musculus
ccatggctggcaatgtccacagaca

SEQ ID NO: 241616 - DNA, 25 bp, Mus musculus
ccatggcttaaaagagtctccccca

SEQ ID NO: 241617 - DNA, 25 bp, Mus musculus
ccatggcttaaaagccgaagaagca

SEQ ID NO: 241618 - DNA, 25 bp, Mus musculus
ccatggcttaaaagctcgtgtggcc

SEQ ID NO: 241619 - DNA, 25 bp, Mus musculus
ccatgggaaacctgaatctgtatcg

SEQ ID NO: 241620 - DNA, 25 bp, Mus musculus
ccatgggaagatcccaacgctggtg

SEQ ID NO: 241621 - DNA, 25 bp, Mus musculus
ccatgggaaggatcatgcgtccaga

SEQ ID NO: 241622 - DNA, 25 bp, Mus musculus
ccatgggaccggtccaacgggcgct

SEQ ID NO: 241623 - DNA, 25 bp, Mus musculus
ccatgggactggagggtgacagaag

SEQ ID NO: 241624 - DNA, 25 bp, Mus musculus
ccatgggcaaatcaggaaaggatgt

SEQ ID NO: 241625 - DNA, 25 bp, Mus musculus
ccatgggcaatgacacgtccccatc

SEQ ID NO: 241626 - DNA, 25 bp, Mus musculus
ccatgggctcccggccccgtggggc

SEQ ID NO: 241627 - DNA, 25 bp, Mus musculus
ccatgggctgaactacgctgccatg

SEQ ID NO: 241628 - DNA, 25 bp, Mus musculus
ccatgggcttcactggtaaacaggt

SEQ ID NO: 241629 - DNA, 25 bp, Mus musculus
ccatggggcaggcagtgacgcgccg

SEQ ID NO: 241630 - DNA, 25 bp, Mus musculus
ccatggggcctttagatgggaaagt

SEQ ID NO: 241631 - DNA, 25 bp, Mus musculus
ccatggggtgcgccccgggatgccg

SEQ ID NO: 241632 - DNA, 25 bp, Mus musculus
ccatgggtacaagggcaagctccag

SEQ ID NO: 241633 - DNA, 25 bp, Mus musculus
ccatgggtgatgctggggagatggt

SEQ ID NO: 241634 - DNA, 25 bp, Mus musculus
ccatgggtttcaagcctggggaaaa

SEQ ID NO: 241635 - DNA, 25 bp, Mus musculus
ccatgggtttcaagtcttgtgatgg

SEQ ID NO: 241636 - DNA, 25 bp, Mus musculus
ccatggtaacaggcctgatggaatc

SEQ ID NO: 241637 - DNA, 25 bp, Mus musculus
ccatggtaacagtcaacaaatgcat

SEQ ID NO: 241638 - DNA, 25 bp, Mus musculus
ccatggtagattacgctcacaacaa

SEQ ID NO: 241639 - DNA, 25 bp, Mus musculus
ccatggtcaagacgtccgtcctcgt

SEQ ID NO: 241640 - DNA, 25 bp, Mus musculus
ccatggtcagcaatggggctggaga

SEQ ID NO: 241641 - DNA, 25 bp, Mus musculus
ccatggtcagcaatgggttcagacc

SEQ ID NO: 241642 - DNA, 25 bp, Mus musculus
ccatggtcatcggaaattaccggac

SEQ ID NO: 241643 - DNA, 25 bp, Mus musculus
ccatggtcatcggcaactatcgaac

SEQ ID NO: 241644 - DNA, 25 bp, Mus musculus
ccatggtcctagtcaagagaatcca

SEQ ID NO: 241645 - DNA, 25 bp, Mus musculus
ccatggtctcttcccatacatggcc

SEQ ID NO: 241646 - DNA, 25 bp, Mus musculus
ccatggtgaagatttacccaataaa

SEQ ID NO: 241647 - DNA, 25 bp, Mus musculus
ccatggtgaagctaatctggaaatg

SEQ ID NO: 241648 - DNA, 25 bp, Mus musculus
ccatggtgaaggaagatgaggctcg

SEQ ID NO: 241649 - DNA, 25 bp, Mus musculus
ccatggtgaagggaatgtacggcat

SEQ ID NO: 241650 - DNA, 25 bp, Mus musculus
ccatggtgaaggtgtttagctctga

SEQ ID NO: 241651 - DNA, 25 bp, Mus musculus
ccatggtgactgatggtggaatgta

SEQ ID NO: 241652 - DNA, 25 bp, Mus musculus
ccatggtgagcccattggccggggt

SEQ ID NO: 241653 - DNA, 25 bp, Mus musculus
ccatggtgggacagggcaagaccgt

SEQ ID NO: 241654 - DNA, 25 bp, Mus musculus
ccatggtggtctccgggttctgcag

SEQ ID NO: 241655 - DNA, 25 bp, Mus musculus
ccatggttgcaggtctgcaataatt

SEQ ID NO: 241656 - DNA, 25 bp, Mus musculus
ccatggttggcaggtgaatttggaa

SEQ ID NO: 241657 - DNA, 25 bp, Mus musculus
ccatgtaagcagctgtccggcagag

SEQ ID NO: 241658 - DNA, 25 bp, Mus musculus
ccatgtacagactcatcccacctct

SEQ ID NO: 241659 - DNA, 25 bp, Mus musculus
ccatgtacagctcacaaactcaaac

SEQ ID NO: 241660 - DNA, 25 bp, Mus musculus
ccatgtaccaagtgtccccaaggaa

SEQ ID NO: 241661 - DNA, 25 bp, Mus musculus
ccatgtacccagaggatcattacag

SEQ ID NO: 241662 - DNA, 25 bp, Mus musculus
ccatgtacccccatgcccggttacg

SEQ ID NO: 241663 - DNA, 25 bp, Mus musculus
ccatgtacccgcacgtgacacaagc

SEQ ID NO: 241664 - DNA, 25 bp, Mus musculus
ccatgtacgagctggtggtgatttt

SEQ ID NO: 241665 - DNA, 25 bp, Mus musculus
ccatgtactaagacctgttcccgtc

SEQ ID NO: 241666 - DNA, 25 bp, Mus musculus
ccatgtactaagggatacagtggaa

SEQ ID NO: 241667 - DNA, 25 bp, Mus musculus
ccatgtactaaggtatacagttttg

SEQ ID NO: 241668 - DNA, 25 bp, Mus musculus
ccatgtactaagtttccccctgctc

SEQ ID NO: 241669 - DNA, 25 bp, Mus musculus
ccatgtagagcaaggaaagaccgta

SEQ ID NO: 241670 - DNA, 25 bp, Mus musculus
ccatgtataaagatgtggtgaaggc

SEQ ID NO: 241671 - DNA, 25 bp, Mus musculus
ccatgtataaagttctagatgtggt

SEQ ID NO: 241672 - DNA, 25 bp, Mus musculus
ccatgtatacagatgccgatgaatg

SEQ ID NO: 241673 - DNA, 25 bp, Mus musculus
ccatgtatacagttgccgatgaatg

SEQ ID NO: 241674 - DNA, 25 bp, Mus musculus
ccatgtatccaaaagaaatccagag

SEQ ID NO: 241675 - DNA, 25 bp, Mus musculus
ccatgtatccaaaagcaaatttcgc

SEQ ID NO: 241676 - DNA, 25 bp, Mus musculus
ccatgtatggcaaggatttaattaa

SEQ ID NO: 241677 - DNA, 25 bp, Mus musculus
ccatgtatggcaaggctggccttct

SEQ ID NO: 241678 - DNA, 25 bp, Mus musculus
ccatgtattccccgtgaatcccttg

SEQ ID NO: 241679 - DNA, 25 bp, Mus musculus
ccatgtcaaaaaggtatggttccga

SEQ ID NO: 241680 - DNA, 25 bp, Mus musculus
ccatgtcaacagcgtgagcaccact

SEQ ID NO: 241681 - DNA, 25 bp, Mus musculus
ccatgtcaagaggcctcacaccttg

SEQ ID NO: 241682 - DNA, 25 bp, Mus musculus
ccatgtcactcacccccaattccag

SEQ ID NO: 241683 - DNA, 25 bp, Mus musculus
ccatgtcatcatatgatttttggtg

SEQ ID NO: 241684 - DNA, 25 bp, Mus musculus
ccatgtcatcattatcacttatgcc

SEQ ID NO: 241685 - DNA, 25 bp, Mus musculus
ccatgtcatccagttactgctgacc

SEQ ID NO: 241686 - DNA, 25 bp, Mus musculus
ccatgtccaagcggggtgccacggc

SEQ ID NO: 241687 - DNA, 25 bp, Mus musculus
ccatgtccacccgagtggcccatcc

SEQ ID NO: 241688 - DNA, 25 bp, Mus musculus
ccatgtccactgaggaaacctcacc

SEQ ID NO: 241689 - DNA, 25 bp, Mus musculus
ccatgtccactgagggtgtgctgat

SEQ ID NO: 241690 - DNA, 25 bp, Mus musculus
ccatgtccagaacagtgtccccgat

SEQ ID NO: 241691 - DNA, 25 bp, Mus musculus
ccatgtccagattcggaaactaagg

SEQ ID NO: 241692 - DNA, 25 bp, Mus musculus
ccatgtccagcaccaaagaaggcat

SEQ ID NO: 241693 - DNA, 25 bp, Mus musculus
ccatgtccaggcaagatcagctctg

SEQ ID NO: 241694 - DNA, 25 bp, Mus musculus
ccatgtccaggttttcccatcatat

SEQ ID NO: 241695 - DNA, 25 bp, Mus musculus
ccatgtccatggaagacagcagtga

SEQ ID NO: 241696 - DNA, 25 bp, Mus musculus
ccatgtcccacaattctcgactatc

SEQ ID NO: 241697 - DNA, 25 bp, Mus musculus
ccatgtcccacagtaacccctctaa

SEQ ID NO: 241698 - DNA, 25 bp, Mus musculus
ccatgtccgcaggcggctcaaagac

SEQ ID NO: 241699 - DNA, 25 bp, Mus musculus
ccatgtcgagtggcctcggatgtgg

SEQ ID NO: 241700 - DNA, 25 bp, Mus musculus
ccatgtcgggtgtgaagattgctcc

SEQ ID NO: 241701 - DNA, 25 bp, Mus musculus
ccatgtctcacccgggtgctgggga

SEQ ID NO: 241702 - DNA, 25 bp, Mus musculus
ccatgtctccatgtcttcctccaag

SEQ ID NO: 241703 - DNA, 25 bp, Mus musculus
ccatgtctcttgcacaagttgatgg

SEQ ID NO: 241704 - DNA, 25 bp, Mus musculus
ccatgtctgcaagcatcctggtcaa

SEQ ID NO: 241705 - DNA, 25 bp, Mus musculus
ccatgtctttaagaattctgtcttt

SEQ ID NO: 241706 - DNA, 25 bp, Mus musculus
ccatgtctttaaggtgtttgtggcc

SEQ ID NO: 241707 - DNA, 25 bp, Mus musculus
ccatgtcttttcttcggtgggtctc

SEQ ID NO: 241708 - DNA, 25 bp, Mus musculus
ccatgtcttttcttgccaatgaggc

SEQ ID NO: 241709 - DNA, 25 bp, Mus musculus
ccatgtgaagttccgctcgctgtcc

SEQ ID NO: 241710 - DNA, 25 bp, Mus musculus
ccatgtgattctggaggagcaaaaa

SEQ ID NO: 241711 - DNA, 25 bp, Mus musculus
ccatgtgcaggacccaaggctggaa

SEQ ID NO: 241712 - DNA, 25 bp, Mus musculus
ccatgtgccagggaaaccgtgacga

SEQ ID NO: 241713 - DNA, 25 bp, Mus musculus
ccatgtgctgcacaatcctggagga

SEQ ID NO: 241714 - DNA, 25 bp, Mus musculus
ccatgtggactggcaggctgtgggg

SEQ ID NO: 241715 - DNA, 25 bp, Mus musculus
ccatgtggatgctgcctggggtggg

SEQ ID NO: 241716 - DNA, 25 bp, Mus musculus
ccatgtggatggctgactctgtggc

SEQ ID NO: 241717 - DNA, 25 bp, Mus musculus
ccatgtggcagtggtccccagtgct

SEQ ID NO: 241718 - DNA, 25 bp, Mus musculus
ccatgtgggagattgtgaccttgga

SEQ ID NO: 241719 - DNA, 25 bp, Mus musculus
ccatgtggttcatcggctggactgt

SEQ ID NO: 241720 - DNA, 25 bp, Mus musculus
ccatgtgtgaggacgtgaatgagtg

SEQ ID NO: 241721 - DNA, 25 bp, Mus musculus
ccatgtgtgaggtcgtgaatgagtg

SEQ ID NO: 241722 - DNA, 25 bp, Mus musculus
ccatgtgtgcagcttccattgaaga

SEQ ID NO: 241723 - DNA, 25 bp, Mus musculus
ccatgtgtgcaggttgtacttgttt

SEQ ID NO: 241724 - DNA, 25 bp, Mus musculus
ccatgtgtttgagatcctgtcaaac

SEQ ID NO: 241725 - DNA, 25 bp, Mus musculus
ccatgttactgcacgaccacaggag

SEQ ID NO: 241726 - DNA, 25 bp, Mus musculus
ccatgttactggagtgccgatggcg

SEQ ID NO: 241727 - DNA, 25 bp, Mus musculus
ccatgttcagaaaggagctcttacc

SEQ ID NO: 241728 - DNA, 25 bp, Mus musculus
ccatgttccggcttttccccagtct

SEQ ID NO: 241729 - DNA, 25 bp, Mus musculus
ccatgttcctagagtacaacaaagc

SEQ ID NO: 241730 - DNA, 25 bp, Mus musculus
ccatgttcgacaccacgccccactc

SEQ ID NO: 241731 - DNA, 25 bp, Mus musculus
ccatgttcgagtgctaaggataccg

SEQ ID NO: 241732 - DNA, 25 bp, Mus musculus
ccatgttgcagaggttctcaggaca

SEQ ID NO: 241733 - DNA, 25 bp, Mus musculus
ccatgttggaggacaagacatttca

SEQ ID NO: 241734 - DNA, 25 bp, Mus musculus
ccatgttggagggagttaaatacct

SEQ ID NO: 241735 - DNA, 25 bp, Mus musculus
ccatgtttgcagccagcagcaagtg

SEQ ID NO: 241736 - DNA, 25 bp, Mus musculus
ccatgtttgccaagggaaagaaggc

SEQ ID NO: 241737 - DNA, 25 bp, Mus musculus
ccattaaaaagagcaacagtgtgaa

SEQ ID NO: 241738 - DNA, 25 bp, Mus musculus
ccattaaaaagcctcaagcccaagg

SEQ ID NO: 241739 - DNA, 25 bp, Mus musculus
ccattaaaaagctcactctgcagag

SEQ ID NO: 241740 - DNA, 25 bp, Mus musculus
ccattaaaacaaagatgtctcattt

SEQ ID NO: 241741 - DNA, 25 bp, Mus musculus
ccattaaaacaaaggggaagcgtgc

SEQ ID NO: 241742 - DNA, 25 bp, Mus musculus
ccattaaaagggggaggagtgtctc

SEQ ID NO: 241743 - DNA, 25 bp, Mus musculus
ccattaaacatgcccactgtcacgc

SEQ ID NO: 241744 - DNA, 25 bp, Mus musculus
ccattaaagctcagagccggccacc

SEQ ID NO: 241745 - DNA, 25 bp, Mus musculus
ccattaaagctcagtaccgcacaac

SEQ ID NO: 241746 - DNA, 25 bp, Mus musculus
ccattaacaaggaccctgcagtggg

SEQ ID NO: 241747 - DNA, 25 bp, Mus musculus
ccattaacaaggagacgactgcaca

SEQ ID NO: 241748 - DNA, 25 bp, Mus musculus
ccattaactttagcccagaaactag

SEQ ID NO: 241749 - DNA, 25 bp, Mus musculus
ccattaactttaggtgctgctttcc

SEQ ID NO: 241750 - DNA, 25 bp, Mus musculus
ccattaataaggaccaaaatgtctt

SEQ ID NO: 241751 - DNA, 25 bp, Mus musculus
ccattaatcaacagattcaaggcct

SEQ ID NO: 241752 - DNA, 25 bp, Mus musculus
ccattaatcccacaggctctgttgt

SEQ ID NO: 241753 - DNA, 25 bp, Mus musculus
ccattaatctgtacccgcttaccaa

SEQ ID NO: 241754 - DNA, 25 bp, Mus musculus
ccattacaaacagtggccagtttca

SEQ ID NO: 241755 - DNA, 25 bp, Mus musculus
ccattacaagaccgaccagggcatc

SEQ ID NO: 241756 - DNA, 25 bp, Mus musculus
ccattaccaaagcagagttctcgtc

SEQ ID NO: 241757 - DNA, 25 bp, Mus musculus
ccattaccaaagcaggcttcttccc

SEQ ID NO: 241758 - DNA, 25 bp, Mus musculus
ccattaccaaggtcccttcagagaa

SEQ ID NO: 241759 - DNA, 25 bp, Mus musculus
ccattaccacccaagattcagtttg

SEQ ID NO: 241760 - DNA, 25 bp, Mus musculus
ccattacctaaatgactgataatgg

SEQ ID NO: 241761 - DNA, 25 bp, Mus musculus
ccattacctaaatggacaggatcct

SEQ ID NO: 241762 - DNA, 25 bp, Mus musculus
ccattacctccaggctcggttgtcc

SEQ ID NO: 241763 - DNA, 25 bp, Mus musculus
ccattacctccagtgtgacaaatac

SEQ ID NO: 241764 - DNA, 25 bp, Mus musculus
ccattactcgcagggcaacaaagaa

SEQ ID NO: 241765 - DNA, 25 bp, Mus musculus
ccattactcgcagtgagatgagtca

SEQ ID NO: 241766 - DNA, 25 bp, Mus musculus
ccattactctacggctggcccgctc

SEQ ID NO: 241767 - DNA, 25 bp, Mus musculus
ccattactgctgacctcaggatgtc

SEQ ID NO: 241768 - DNA, 25 bp, Mus musculus
ccattactgggggatgcagagagca

SEQ ID NO: 241769 - DNA, 25 bp, Mus musculus
ccattagaaacaagccacggaagag

SEQ ID NO: 241770 - DNA, 25 bp, Mus musculus
ccattagaaaccacctaccctcagg

SEQ ID NO: 241771 - DNA, 25 bp, Mus musculus
ccattagacaagccctgacgtcaag

SEQ ID NO: 241772 - DNA, 25 bp, Mus musculus
ccattagagagaggcaggagtacgt

SEQ ID NO: 241773 - DNA, 25 bp, Mus musculus
ccattagcaaaggtggattgcactg

SEQ ID NO: 241774 - DNA, 25 bp, Mus musculus
ccattaggaagatcaaaggcacagc

SEQ ID NO: 241775 - DNA, 25 bp, Mus musculus
ccattaggacctcggggagaaagag

SEQ ID NO: 241776 - DNA, 25 bp, Mus musculus
ccattagggcagaatatgcagacag

SEQ ID NO: 241777 - DNA, 25 bp, Mus musculus
ccattagtatagcaagaagccagtt

SEQ ID NO: 241778 - DNA, 25 bp, Mus musculus
ccattagtcagagaattgtaagtgc

SEQ ID NO: 241779 - DNA, 25 bp, Mus musculus
ccattatacaaatgtcggagtcttc

SEQ ID NO: 241780 - DNA, 25 bp, Mus musculus
ccattataccctctcctaccaccac

SEQ ID NO: 241781 - DNA, 25 bp, Mus musculus
ccattatcaagttctcagatgaata

SEQ ID NO: 241782 - DNA, 25 bp, Mus musculus
ccattatgaaattgaagaccaaatt

SEQ ID NO: 241783 - DNA, 25 bp, Mus musculus
ccattatgaagaaacagggaagctc

SEQ ID NO: 241784 - DNA, 25 bp, Mus musculus
ccattatggagcagagaatgacgga

SEQ ID NO: 241785 - DNA, 25 bp, Mus musculus
ccattcaaaggcattggccaggagc

SEQ ID NO: 241786 - DNA, 25 bp, Mus musculus
ccattcacaagaattggcctacagg

SEQ ID NO: 241787 - DNA, 25 bp, Mus musculus
ccattcacaagctaattctgatcag

SEQ ID NO: 241788 - DNA, 25 bp, Mus musculus
ccattcacaaggattcagggaatat

SEQ ID NO: 241789 - DNA, 25 bp, Mus musculus
ccattcacacaggccgatacaaagc

SEQ ID NO: 241790 - DNA, 25 bp, Mus musculus
ccattcacacgggaagagtcaccga

SEQ ID NO: 241791 - DNA, 25 bp, Mus musculus
ccattcacacgggatgaaattgttg

SEQ ID NO: 241792 - DNA, 25 bp, Mus musculus
ccattcacaggcatcctacatcaat

SEQ ID NO: 241793 - DNA, 25 bp, Mus musculus
ccattcacctacgattaccacaccc

SEQ ID NO: 241794 - DNA, 25 bp, Mus musculus
ccattcacctacggcaagagatgtc

SEQ ID NO: 241795 - DNA, 25 bp, Mus musculus
ccattcagaagatgcaaccctgaga

SEQ ID NO: 241796 - DNA, 25 bp, Mus musculus
ccattcagcctttggctacaatgga

SEQ ID NO: 241797 - DNA, 25 bp, Mus musculus
ccattcagctgcagagtgctgatcc

SEQ ID NO: 241798 - DNA, 25 bp, Mus musculus
ccattcatcaactggccttgacaga

SEQ ID NO: 241799 - DNA, 25 bp, Mus musculus
ccattcatcaggaagcaggtgtgca

SEQ ID NO: 241800 - DNA, 25 bp, Mus musculus
ccattcatctctggtcttgacgaag

SEQ ID NO: 241801 - DNA, 25 bp, Mus musculus
ccattcatctgggaatgattttgca

SEQ ID NO: 241802 - DNA, 25 bp, Mus musculus
ccattcatgaaagctccttgtgaac

SEQ ID NO: 241803 - DNA, 25 bp, Mus musculus
ccattcatgaaaggaagaacaattg

SEQ ID NO: 241804 - DNA, 25 bp, Mus musculus
ccattcattcattcccactatgggc

SEQ ID NO: 241805 - DNA, 25 bp, Mus musculus
ccattcatttcagttgcctctctgc

SEQ ID NO: 241806 - DNA, 25 bp, Mus musculus
ccattccaaggcaacccgcagggtc

SEQ ID NO: 241807 - DNA, 25 bp, Mus musculus
ccattccacctccttaaaaatataa

SEQ ID NO: 241808 - DNA, 25 bp, Mus musculus
ccattccagaggcattaaaagctgg

SEQ ID NO: 241809 - DNA, 25 bp, Mus musculus
ccattccatttcactccgcagatga

SEQ ID NO: 241810 - DNA, 25 bp, Mus musculus
ccattccccaaagtaatggactcat

SEQ ID NO: 241811 - DNA, 25 bp, Mus musculus
ccattccggagtgagaacaatctcc

SEQ ID NO: 241812 - DNA, 25 bp, Mus musculus
ccattccggcgcccatggcgaattg

SEQ ID NO: 241813 - DNA, 25 bp, Mus musculus
ccattcctaagaagacccagcacta

SEQ ID NO: 241814 - DNA, 25 bp, Mus musculus
ccattcctaagaaggccacagaccc

SEQ ID NO: 241815 - DNA, 25 bp, Mus musculus
ccattcctagtccaattcaggttat

SEQ ID NO: 241816 - DNA, 25 bp, Mus musculus
ccattcctatgatcgtcatcttctt

SEQ ID NO: 241817 - DNA, 25 bp, Mus musculus
ccattcctccaggaacaacaggcaa

SEQ ID NO: 241818 - DNA, 25 bp, Mus musculus
ccattcctccaggtacatttgattc

SEQ ID NO: 241819 - DNA, 25 bp, Mus musculus
ccattcctccaggtcttgccgtcac

SEQ ID NO: 241820 - DNA, 25 bp, Mus musculus
ccattcctgcctaaattttaagcgg

SEQ ID NO: 241821 - DNA, 25 bp, Mus musculus
ccattccttgaagaggagcagacag

SEQ ID NO: 241822 - DNA, 25 bp, Mus musculus
ccattccttgaagaggttgcccacg

SEQ ID NO: 241823 - DNA, 25 bp, Mus musculus
ccattcgctgctattctccactcca

SEQ ID NO: 241824 - DNA, 25 bp, Mus musculus
ccattcggacccagtcgacctgata

SEQ ID NO: 241825 - DNA, 25 bp, Mus musculus
ccattcggcaaagatgacagaaggc

SEQ ID NO: 241826 - DNA, 25 bp, Mus musculus
ccattctaacagcctgcagactgca

SEQ ID NO: 241827 - DNA, 25 bp, Mus musculus
ccattctacacagctcacatgagcc

SEQ ID NO: 241828 - DNA, 25 bp, Mus musculus
ccattctcaaaaatttcaaaggcca

SEQ ID NO: 241829 - DNA, 25 bp, Mus musculus
ccattctcaagaggtctgaatttcc

SEQ ID NO: 241830 - DNA, 25 bp, Mus musculus
ccattctcaatggaaatatggaaac

SEQ ID NO: 241831 - DNA, 25 bp, Mus musculus
ccattctcaatgggaaaaagagctt

SEQ ID NO: 241832 - DNA, 25 bp, Mus musculus
ccattctcacagagatgaggcttga

SEQ ID NO: 241833 - DNA, 25 bp, Mus musculus
ccattctcacagagtgttctccatg

SEQ ID NO: 241834 - DNA, 25 bp, Mus musculus
ccattctcagcaggccgcagatcat

SEQ ID NO: 241835 - DNA, 25 bp, Mus musculus
ccattctcagcatcatgctgggaga

SEQ ID NO: 241836 - DNA, 25 bp, Mus musculus
ccattctcagcgctgtgtagttctg

SEQ ID NO: 241837 - DNA, 25 bp, Mus musculus
ccattctcaggaaaactactcagca

SEQ ID NO: 241838 - DNA, 25 bp, Mus musculus
ccattctcgaggtggctgttatcta

SEQ ID NO: 241839 - DNA, 25 bp, Mus musculus
ccattctctccagctctgggcccca

SEQ ID NO: 241840 - DNA, 25 bp, Mus musculus
ccattctctggaagattaggtcaga

SEQ ID NO: 241841 - DNA, 25 bp, Mus musculus
ccattctctggaagtcctagtcact

SEQ ID NO: 241842 - DNA, 25 bp, Mus musculus
ccattctgattgggactggaaaagg

SEQ ID NO: 241843 - DNA, 25 bp, Mus musculus
ccattctgattggggtactggaaaa

SEQ ID NO: 241844 - DNA, 25 bp, Mus musculus
ccattctgcgattcccaaggccttc

SEQ ID NO: 241845 - DNA, 25 bp, Mus musculus
ccattctgcttagcctgctgaggca

SEQ ID NO: 241846 - DNA, 25 bp, Mus musculus
ccattctgcttagtgcctgcacgtc

SEQ ID NO: 241847 - DNA, 25 bp, Mus musculus
ccattctgtgctgcctgccagccct

SEQ ID NO: 241848 - DNA, 25 bp, Mus musculus
ccattctgtggctttcactttttct

SEQ ID NO: 241849 - DNA, 25 bp, Mus musculus
ccattctgttgcaccaagtatagat

SEQ ID NO: 241850 - DNA, 25 bp, Mus musculus
ccattcttaagattcctttgagaga

SEQ ID NO: 241851 - DNA, 25 bp, Mus musculus
ccattcttagaaaacgcctccttgg

SEQ ID NO: 241852 - DNA, 25 bp, Mus musculus
ccattcttcaggtgttgggaaacca

SEQ ID NO: 241853 - DNA, 25 bp, Mus musculus
ccattcttctgggtcggatgctctg

SEQ ID NO: 241854 - DNA, 25 bp, Mus musculus
ccattcttgactgggctgctggacc

SEQ ID NO: 241855 - DNA, 25 bp, Mus musculus
ccattgaaacggataaggaaggcgt

SEQ ID NO: 241856 - DNA, 25 bp, Mus musculus
ccattgaaacgggatgggaactctc

SEQ ID NO: 241857 - DNA, 25 bp, Mus musculus
ccattgaaagaggcttcatcactgt

SEQ ID NO: 241858 - DNA, 25 bp, Mus musculus
ccattgaagtgaaagctgctcctga

SEQ ID NO: 241859 - DNA, 25 bp, Mus musculus
ccattgaagtgaaaggagatttcta

SEQ ID NO: 241860 - DNA, 25 bp, Mus musculus
ccattgaatatactgttgaatcaag

SEQ ID NO: 241861 - DNA, 25 bp, Mus musculus
ccattgaatatagacctgaaaacca

SEQ ID NO: 241862 - DNA, 25 bp, Mus musculus
ccattgaatatgagatgtgcataat

SEQ ID NO: 241863 - DNA, 25 bp, Mus musculus
ccattgaatatgaggtgtcagctgt

SEQ ID NO: 241864 - DNA, 25 bp, Mus musculus
ccattgaccagcaggaatccagcca

SEQ ID NO: 241865 - DNA, 25 bp, Mus musculus
ccattgagaagagatgaggctgtga

SEQ ID NO: 241866 - DNA, 25 bp, Mus musculus
ccattgagactgacaatttatttca

SEQ ID NO: 241867 - DNA, 25 bp, Mus musculus
ccattgagactgccaaacaagaagc

SEQ ID NO: 241868 - DNA, 25 bp, Mus musculus
ccattgagctcaagaaaccacagtg

SEQ ID NO: 241869 - DNA, 25 bp, Mus musculus
ccattgaggacccggagctagaagc

SEQ ID NO: 241870 - DNA, 25 bp, Mus musculus
ccattgaggcagaagtgctgtgtgg

SEQ ID NO: 241871 - DNA, 25 bp, Mus musculus
ccattgaggcagaagttgacccacc

SEQ ID NO: 241872 - DNA, 25 bp, Mus musculus
ccattgaggttgagcaacattttga

SEQ ID NO: 241873 - DNA, 25 bp, Mus musculus
ccattgaggttgagggaatagccag

SEQ ID NO: 241874 - DNA, 25 bp, Mus musculus
ccattgaggttgaggtgtcctcaac

SEQ ID NO: 241875 - DNA, 25 bp, Mus musculus
ccattgagtacatggccccagagat

SEQ ID NO: 241876 - DNA, 25 bp, Mus musculus
ccattgagtagatttgaaagaagcg

SEQ ID NO: 241877 - DNA, 25 bp, Mus musculus
ccattgattaagagtgtcaacagga

SEQ ID NO: 241878 - DNA, 25 bp, Mus musculus
ccattgattaaggcagtagagtgtc

SEQ ID NO: 241879 - DNA, 25 bp, Mus musculus
ccattgcaaaggctgggatcatctg

SEQ ID NO: 241880 - DNA, 25 bp, Mus musculus
ccattgcaaatgctgaaaaaggagt

SEQ ID NO: 241881 - DNA, 25 bp, Mus musculus
ccattgcaaatgctgagtgaattat

SEQ ID NO: 241882 - DNA, 25 bp, Mus musculus
ccattgcaagataaataggatttac

SEQ ID NO: 241883 - DNA, 25 bp, Mus musculus
ccattgcaagcaaggggaagggagg

SEQ ID NO: 241884 - DNA, 25 bp, Mus musculus
ccattgcagaaacagacatggcaag

SEQ ID NO: 241885 - DNA, 25 bp, Mus musculus
ccattgccaaagaagattcccagcg

SEQ ID NO: 241886 - DNA, 25 bp, Mus musculus
ccattgccaaagaagctcctatgct

SEQ ID NO: 241887 - DNA, 25 bp, Mus musculus
ccattgccaagaagaacgctgtgga

SEQ ID NO: 241888 - DNA, 25 bp, Mus musculus
ccattgccagaatggaccatctgcg

SEQ ID NO: 241889 - DNA, 25 bp, Mus musculus
ccattgccagagatccttgtgtgtg

SEQ ID NO: 241890 - DNA, 25 bp, Mus musculus
ccattgcccgcaattgggcagatgc

SEQ ID NO: 241891 - DNA, 25 bp, Mus musculus
ccattgccgagctcggcttcatgac

SEQ ID NO: 241892 - DNA, 25 bp, Mus musculus
ccattgccgcaggaacaccccaatt

SEQ ID NO: 241893 - DNA, 25 bp, Mus musculus
ccattgccgcaggggtgatgtttat

SEQ ID NO: 241894 - DNA, 25 bp, Mus musculus
ccattgccgtgcaggcagccagctc

SEQ ID NO: 241895 - DNA, 25 bp, Mus musculus
ccattgcctcagcaactatcagacc

SEQ ID NO: 241896 - DNA, 25 bp, Mus musculus
ccattgcctcagcctctccaacccc

SEQ ID NO: 241897 - DNA, 25 bp, Mus musculus
ccattgcgaggctcctgacagtgct

SEQ ID NO: 241898 - DNA, 25 bp, Mus musculus
ccattgcgctacaggggcgggacaa

SEQ ID NO: 241899 - DNA, 25 bp, Mus musculus
ccattgctaactgaaatggcaaaga

SEQ ID NO: 241900 - DNA, 25 bp, Mus musculus
ccattgctcaaggctgccttagact

SEQ ID NO: 241901 - DNA, 25 bp, Mus musculus
ccattgctggggggaaaggctcaag

SEQ ID NO: 241902 - DNA, 25 bp, Mus musculus
ccattgcttcaaccagggccagtcc

SEQ ID NO: 241903 - DNA, 25 bp, Mus musculus
ccattgctttaaggacctgcaggaa

SEQ ID NO: 241904 - DNA, 25 bp, Mus musculus
ccattggaaacaggttcagacaatg

SEQ ID NO: 241905 - DNA, 25 bp, Mus musculus
ccattggaaagatggtggaaccagg

SEQ ID NO: 241906 - DNA, 25 bp, Mus musculus
ccattggaacaaaattctcagatcg

SEQ ID NO: 241907 - DNA, 25 bp, Mus musculus
ccattggaggaataaacattgctga

SEQ ID NO: 241908 - DNA, 25 bp, Mus musculus
ccattggcaagggcacagtcagtgg

SEQ ID NO: 241909 - DNA, 25 bp, Mus musculus
ccattggcaggttgtccgattgctt

SEQ ID NO: 241910 - DNA, 25 bp, Mus musculus
ccattggctggattgctgctggaca

SEQ ID NO: 241911 - DNA, 25 bp, Mus musculus
ccattggctggcaaggtcagcctgt

SEQ ID NO: 241912 - DNA, 25 bp, Mus musculus
ccattggctggttttcccatcatat

SEQ ID NO: 241913 - DNA, 25 bp, Mus musculus
ccattggtctgcaggcaccgctcct

SEQ ID NO: 241914 - DNA, 25 bp, Mus musculus
ccattggtgagctgaaaaatgaatc

SEQ ID NO: 241915 - DNA, 25 bp, Mus musculus
ccattggtgagtatggcccaccccc

SEQ ID NO: 241916 - DNA, 25 bp, Mus musculus
ccattggtttacagtccctggatga

SEQ ID NO: 241917 - DNA, 25 bp, Mus musculus
ccattgtagaagctggtgggatgca

SEQ ID NO: 241918 - DNA, 25 bp, Mus musculus
ccattgtcaggtgcgtgaagctgct

SEQ ID NO: 241919 - DNA, 25 bp, Mus musculus
ccattgtcgagggggtggcaccgaa

SEQ ID NO: 241920 - DNA, 25 bp, Mus musculus
ccattgtcgaggtgtcaagctctcc

SEQ ID NO: 241921 - DNA, 25 bp, Mus musculus
ccattgtgaagtctcttattggtgc

SEQ ID NO: 241922 - DNA, 25 bp, Mus musculus
ccattgtgacagagtgggacttggt

SEQ ID NO: 241923 - DNA, 25 bp, Mus musculus
ccattgtggataagtgctgctaaag

SEQ ID NO: 241924 - DNA, 25 bp, Mus musculus
ccattgtgggagagccaggctactg

SEQ ID NO: 241925 - DNA, 25 bp, Mus musculus
ccattgttaagaccgagaattcatg

SEQ ID NO: 241926 - DNA, 25 bp, Mus musculus
ccattgttactgttacagatttggg

SEQ ID NO: 241927 - DNA, 25 bp, Mus musculus
ccattgttcaggctccaggccgggc

SEQ ID NO: 241928 - DNA, 25 bp, Mus musculus
ccattgtttgtgcagttgctttatt

SEQ ID NO: 241929 - DNA, 25 bp, Mus musculus
ccatttacagggagaagctgggcac

SEQ ID NO: 241930 - DNA, 25 bp, Mus musculus
ccatttacagggggtgatgtgcaac

SEQ ID NO: 241931 - DNA, 25 bp, Mus musculus
ccatttacagttgtaacagttggag

SEQ ID NO: 241932 - DNA, 25 bp, Mus musculus
ccatttactttgggtcactgcccag

SEQ ID NO: 241933 - DNA, 25 bp, Mus musculus
ccatttagaaggtgtgccgatgctc

SEQ ID NO: 241934 - DNA, 25 bp, Mus musculus
ccatttagatctgaacaatgcccag

SEQ ID NO: 241935 - DNA, 25 bp, Mus musculus
ccatttagcatggctgttggaaagc

SEQ ID NO: 241936 - DNA, 25 bp, Mus musculus
ccatttatctgtaacagcgtggaag

SEQ ID NO: 241937 - DNA, 25 bp, Mus musculus
ccatttatggaagccctgcagaggc

SEQ ID NO: 241938 - DNA, 25 bp, Mus musculus
ccatttcaaggtctcaaaagattca

SEQ ID NO: 241939 - DNA, 25 bp, Mus musculus
ccatttcacagggagcccgaaccaa

SEQ ID NO: 241940 - DNA, 25 bp, Mus musculus
ccatttcactccgcagatgaccctc

SEQ ID NO: 241941 - DNA, 25 bp, Mus musculus
ccatttcagcaggatagtcattgca

SEQ ID NO: 241942 - DNA, 25 bp, Mus musculus
ccatttcagcaggttcaggcgcagc

SEQ ID NO: 241943 - DNA, 25 bp, Mus musculus
ccatttcagtcaggaagtcctacct

SEQ ID NO: 241944 - DNA, 25 bp, Mus musculus
ccatttccaagcgcctgagaagaag

SEQ ID NO: 241945 - DNA, 25 bp, Mus musculus
ccatttccacatagtgctggggatc

SEQ ID NO: 241946 - DNA, 25 bp, Mus musculus
ccatttccacatagttcagcaatca

SEQ ID NO: 241947 - DNA, 25 bp, Mus musculus
ccatttccactcatcctccttgtga

SEQ ID NO: 241948 - DNA, 25 bp, Mus musculus
ccatttccactctgcttccctgtgc

SEQ ID NO: 241949 - DNA, 25 bp, Mus musculus
ccatttcccagggcacaccaataaa

SEQ ID NO: 241950 - DNA, 25 bp, Mus musculus
ccatttccctggcaggttcaccgga

SEQ ID NO: 241951 - DNA, 25 bp, Mus musculus
ccatttcggatgttcctgccttctc

SEQ ID NO: 241952 - DNA, 25 bp, Mus musculus
ccatttctaagcaggctgaggtctc

SEQ ID NO: 241953 - DNA, 25 bp, Mus musculus
ccatttctacaaaagattgatgtat

SEQ ID NO: 241954 - DNA, 25 bp, Mus musculus
ccatttctacaaaaggtacacaata

SEQ ID NO: 241955 - DNA, 25 bp, Mus musculus
ccatttctgaaagattagaacacct

SEQ ID NO: 241956 - DNA, 25 bp, Mus musculus
ccatttctgaaaggccagtgaatgt

SEQ ID NO: 241957 - DNA, 25 bp, Mus musculus
ccatttctttcatagatgaagcccg

SEQ ID NO: 241958 - DNA, 25 bp, Mus musculus
ccatttgaaaatgatgccagaattt

SEQ ID NO: 241959 - DNA, 25 bp, Mus musculus
ccatttgaacagccctgctttaagg

SEQ ID NO: 241960 - DNA, 25 bp, Mus musculus
ccatttgaacaggtcttatgcaagc

SEQ ID NO: 241961 - DNA, 25 bp, Mus musculus
ccatttgagagagagaaggagaggg

SEQ ID NO: 241962 - DNA, 25 bp, Mus musculus
ccatttgcagaggcaggcaggtttc

SEQ ID NO: 241963 - DNA, 25 bp, Mus musculus
ccatttggccgtaggtttagtctcc

SEQ ID NO: 241964 - DNA, 25 bp, Mus musculus
ccatttgggagtcaggacacctata

SEQ ID NO: 241965 - DNA, 25 bp, Mus musculus
ccatttgtgaagatatcgatgagtg

SEQ ID NO: 241966 - DNA, 25 bp, Mus musculus
ccatttgtgaagatgaagatgaatg

SEQ ID NO: 241967 - DNA, 25 bp, Mus musculus
ccatttgtgagactcgccccaccca

SEQ ID NO: 241968 - DNA, 25 bp, Mus musculus
ccatttgtggggcggatgtctgctc

SEQ ID NO: 241969 - DNA, 25 bp, Mus musculus
ccatttgtggggtctcaaagcaagc

SEQ ID NO: 241970 - DNA, 25 bp, Mus musculus
ccattttaaataggttgtaggaagt

SEQ ID NO: 241971 - DNA, 25 bp, Mus musculus
ccattttacagaactgtatgaggct

SEQ ID NO: 241972 - DNA, 25 bp, Mus musculus
ccattttagatctgcctcactagta

SEQ ID NO: 241973 - DNA, 25 bp, Mus musculus
ccattttcaatgggaaagcgagctt

SEQ ID NO: 241974 - DNA, 25 bp, Mus musculus
ccattttcacgtggagcctgacagc

SEQ ID NO: 241975 - DNA, 25 bp, Mus musculus
ccattttcacgtgggcgggccaggc

SEQ ID NO: 241976 - DNA, 25 bp, Mus musculus
ccattttcagtgatataccgatact

SEQ ID NO: 241977 - DNA, 25 bp, Mus musculus
ccattttcagtgtttgtgaggaaac

SEQ ID NO: 241978 - DNA, 25 bp, Mus musculus
ccattttccatcaagatcagagaca

SEQ ID NO: 241979 - DNA, 25 bp, Mus musculus
ccattttcggctggacgtcgactgt

SEQ ID NO: 241980 - DNA, 25 bp, Mus musculus
ccattttctaggaaacctcgtgttg

SEQ ID NO: 241981 - DNA, 25 bp, Mus musculus
ccattttctctatgagtattggaga

SEQ ID NO: 241982 - DNA, 25 bp, Mus musculus
ccattttgacaagaagcagacaggc

SEQ ID NO: 241983 - DNA, 25 bp, Mus musculus
ccattttgacaaggaccatggcggg

SEQ ID NO: 241984 - DNA, 25 bp, Mus musculus
ccattttgacaccatttggaggtgt

SEQ ID NO: 241985 - DNA, 25 bp, Mus musculus
ccatttttacaaggcatcaaggagt

SEQ ID NO: 241986 - DNA, 25 bp, Mus musculus
ccatttttcaaggaagagaagtggt

SEQ ID NO: 241987 - DNA, 25 bp, Mus musculus
ccatttttcagagctgcgttcagtt

SEQ ID NO: 241988 - DNA, 25 bp, Mus musculus
cccaaaaagaaaaacatcattccag

SEQ ID NO: 241989 - DNA, 25 bp, Mus musculus
cccaaaacaagctaatgtctgcgac

SEQ ID NO: 241990 - DNA, 25 bp, Mus musculus
cccaaaacaagttgctcccaaatta

SEQ ID NO: 241991 - DNA, 25 bp, Mus musculus
cccaaaacagaataaatggagagga

SEQ ID NO: 241992 - DNA, 25 bp, Mus musculus
cccaaaacagactgagaatgaagcc

SEQ ID NO: 241993 - DNA, 25 bp, Mus musculus
cccaaaacaggccccagggctggcg

SEQ ID NO: 241994 - DNA, 25 bp, Mus musculus
cccaaaacagtatctttcagaataa

SEQ ID NO: 241995 - DNA, 25 bp, Mus musculus
cccaaaacagtgggaaatgcctgga

SEQ ID NO: 241996 - DNA, 25 bp, Mus musculus
cccaaaacctgacgtccacgtctgg

SEQ ID NO: 241997 - DNA, 25 bp, Mus musculus
cccaaaacgcagctgcagcactggg

SEQ ID NO: 241998 - DNA, 25 bp, Mus musculus
cccaaaacgcaggaccatcagaatc

SEQ ID NO: 241999 - DNA, 25 bp, Mus musculus
cccaaaacggacctacgagcagagg

SEQ ID NO: 242000 - DNA, 25 bp, Mus musculus
cccaaaagaaaggctgaaggggatg

SEQ ID NO: 242001 - DNA, 25 bp, Mus musculus
cccaaaagacctccgtctggatttt

SEQ ID NO: 242002 - DNA, 25 bp, Mus musculus
cccaaaagagaaaaggaagcagtat

SEQ ID NO: 242003 - DNA, 25 bp, Mus musculus
cccaaaagcaaggatgaagtggccc

SEQ ID NO: 242004 - DNA, 25 bp, Mus musculus
cccaaaagccaaagatgtgtgccaa

SEQ ID NO: 242005 - DNA, 25 bp, Mus musculus
cccaaaatcacagaataccacctcc

SEQ ID NO: 242006 - DNA, 25 bp, Mus musculus
cccaaaatcacagagaagcagaaca

SEQ ID NO: 242007 - DNA, 25 bp, Mus musculus
cccaaaatctcaagaaggtggattt

SEQ ID NO: 242008 - DNA, 25 bp, Mus musculus
cccaaaatctcaagctgcgagcctg

SEQ ID NO: 242009 - DNA, 25 bp, Mus musculus
cccaaaatggacacgctccccagag

SEQ ID NO: 242010 - DNA, 25 bp, Mus musculus
cccaaaattaggctgcgggacaaag

SEQ ID NO: 242011 - DNA, 25 bp, Mus musculus
cccaaaattgctgtgatcgcctgca

SEQ ID NO: 242012 - DNA, 25 bp, Mus musculus
cccaaacacaaggcgaaggagatgc

SEQ ID NO: 242013 - DNA, 25 bp, Mus musculus
cccaaacacacaccagtcatcttca

SEQ ID NO: 242014 - DNA, 25 bp, Mus musculus
cccaaacagcaagcgcctgtgagag

SEQ ID NO: 242015 - DNA, 25 bp, Mus musculus
cccaaacagcagaaggtagagcttg

SEQ ID NO: 242016 - DNA, 25 bp, Mus musculus
cccaaacatagtgaagttgttcgaa

SEQ ID NO: 242017 - DNA, 25 bp, Mus musculus
cccaaacattatagccagtgatggt

SEQ ID NO: 242018 - DNA, 25 bp, Mus musculus
cccaaacattataggatatcgtgct

SEQ ID NO: 242019 - DNA, 25 bp, Mus musculus
cccaaaccaaaagttgatgtaggag

SEQ ID NO: 242020 - DNA, 25 bp, Mus musculus
cccaaaccaacaggtgtgcccaagg

SEQ ID NO: 242021 - DNA, 25 bp, Mus musculus
cccaaaccaccctgctgagacagtg

SEQ ID NO: 242022 - DNA, 25 bp, Mus musculus
cccaaaccactgtggattacgctcg

SEQ ID NO: 242023 - DNA, 25 bp, Mus musculus
cccaaaccagggtgtggacattgta

SEQ ID NO: 242024 - DNA, 25 bp, Mus musculus
cccaaaccaggtgtatatcaacatc

SEQ ID NO: 242025 - DNA, 25 bp, Mus musculus
cccaaaccatagagagacactacgc

SEQ ID NO: 242026 - DNA, 25 bp, Mus musculus
cccaaacccaagaaaatgatctgaa

SEQ ID NO: 242027 - DNA, 25 bp, Mus musculus
cccaaacccagacttacagctctga

SEQ ID NO: 242028 - DNA, 25 bp, Mus musculus
cccaaacccagatcagtggaccatc

SEQ ID NO: 242029 - DNA, 25 bp, Mus musculus
cccaaacccaggtctggaggtgact

SEQ ID NO: 242030 - DNA, 25 bp, Mus musculus
cccaaaccttcccaggaaactccat

SEQ ID NO: 242031 - DNA, 25 bp, Mus musculus
cccaaaccttcccaggcacatctcc

SEQ ID NO: 242032 - DNA, 25 bp, Mus musculus
cccaaacggatgaaaaccgtcaagg

SEQ ID NO: 242033 - DNA, 25 bp, Mus musculus
cccaaactgagatttgcaacagcat

SEQ ID NO: 242034 - DNA, 25 bp, Mus musculus
cccaaacttccagacctgaggtcca

SEQ ID NO: 242035 - DNA, 25 bp, Mus musculus
cccaaacttccaggcacatctcagg

SEQ ID NO: 242036 - DNA, 25 bp, Mus musculus
cccaaagaaaatatggccaacagca

SEQ ID NO: 242037 - DNA, 25 bp, Mus musculus
cccaaagaaaatatggctttacaag

SEQ ID NO: 242038 - DNA, 25 bp, Mus musculus
cccaaagaaagaagatgtcagccca

SEQ ID NO: 242039 - DNA, 25 bp, Mus musculus
cccaaagaaaggtcaaatggttagc

SEQ ID NO: 242040 - DNA, 25 bp, Mus musculus
cccaaagaacagaaaatcaatcttt

SEQ ID NO: 242041 - DNA, 25 bp, Mus musculus
cccaaagaacaggtcctcagaatgg

SEQ ID NO: 242042 - DNA, 25 bp, Mus musculus
cccaaagaagacacccatataatgc

SEQ ID NO: 242043 - DNA, 25 bp, Mus musculus
cccaaagacgcaggaaaaggaagaa

SEQ ID NO: 242044 - DNA, 25 bp, Mus musculus
cccaaagagcccagcaaaggaagcc

SEQ ID NO: 242045 - DNA, 25 bp, Mus musculus
cccaaagagggtcttgagagcagac

SEQ ID NO: 242046 - DNA, 25 bp, Mus musculus
cccaaagatcagagatggagtctca

SEQ ID NO: 242047 - DNA, 25 bp, Mus musculus
cccaaagatcaggagatttgtacac

SEQ ID NO: 242048 - DNA, 25 bp, Mus musculus
cccaaagcctgaaaccaaaattctc

SEQ ID NO: 242049 - DNA, 25 bp, Mus musculus
cccaaagcctgatgaggatgatgcc

SEQ ID NO: 242050 - DNA, 25 bp, Mus musculus
cccaaagctaacagggacagttaaa

SEQ ID NO: 242051 - DNA, 25 bp, Mus musculus
cccaaaggacagaataatcctcagg

SEQ ID NO: 242052 - DNA, 25 bp, Mus musculus
cccaaaggacagctggctgtatagg

SEQ ID NO: 242053 - DNA, 25 bp, Mus musculus
cccaaaggagggaccgctgacaaag

SEQ ID NO: 242054 - DNA, 25 bp, Mus musculus
cccaaaggatggctccatctccatt

SEQ ID NO: 242055 - DNA, 25 bp, Mus musculus
cccaaaggcagccctggccctgtgg

SEQ ID NO: 242056 - DNA, 25 bp, Mus musculus
cccaaaggcatcagatttcgtggat

SEQ ID NO: 242057 - DNA, 25 bp, Mus musculus
cccaaaggctctccgggttcaatag

SEQ ID NO: 242058 - DNA, 25 bp, Mus musculus
cccaaaggtcaggcgggtgaacctg

SEQ ID NO: 242059 - DNA, 25 bp, Mus musculus
cccaaaggtgccaacggcgagcctg

SEQ ID NO: 242060 - DNA, 25 bp, Mus musculus
cccaaagtattccaggctctgtgca

SEQ ID NO: 242061 - DNA, 25 bp, Mus musculus
cccaaagtcagagaagtcctgcatg

SEQ ID NO: 242062 - DNA, 25 bp, Mus musculus
cccaaagtcagtcgaaacgttgaaa

SEQ ID NO: 242063 - DNA, 25 bp, Mus musculus
cccaaagtcagtgaacttctgggtc

SEQ ID NO: 242064 - DNA, 25 bp, Mus musculus
cccaaagtccaggatgttgtaccac

SEQ ID NO: 242065 - DNA, 25 bp, Mus musculus
cccaaagtgaaaaagtactgtctga

SEQ ID NO: 242066 - DNA, 25 bp, Mus musculus
cccaaataatgacctagccctcatc

SEQ ID NO: 242067 - DNA, 25 bp, Mus musculus
cccaaataatgatgtctatactctt

SEQ ID NO: 242068 - DNA, 25 bp, Mus musculus
cccaaatacctctcaaaaatagtga

SEQ ID NO: 242069 - DNA, 25 bp, Mus musculus
cccaaatcagatcgacatcaggatg

SEQ ID NO: 242070 - DNA, 25 bp, Mus musculus
cccaaatccaagtgggtattccatg

SEQ ID NO: 242071 - DNA, 25 bp, Mus musculus
cccaaatctgcagatctcataggat

SEQ ID NO: 242072 - DNA, 25 bp, Mus musculus
cccaaatctgcagatgtgaatccta

SEQ ID NO: 242073 - DNA, 25 bp, Mus musculus
cccaaatctgtgctgaagagacctg

SEQ ID NO: 242074 - DNA, 25 bp, Mus musculus
cccaaatgaccactgagattccagt

SEQ ID NO: 242075 - DNA, 25 bp, Mus musculus
cccaaatgaccagagaacttcacct

SEQ ID NO: 242076 - DNA, 25 bp, Mus musculus
cccaaatgactaagtacctacagtc

SEQ ID NO: 242077 - DNA, 25 bp, Mus musculus
cccaaatgactaagttacagtgcta

SEQ ID NO: 242078 - DNA, 25 bp, Mus musculus
cccaaatgctggaccctcccaggcc

SEQ ID NO: 242079 - DNA, 25 bp, Mus musculus
cccaaattgacaggtagctacatca

SEQ ID NO: 242080 - DNA, 25 bp, Mus musculus
cccaacaaaaagttgattcaccaaa

SEQ ID NO: 242081 - DNA, 25 bp, Mus musculus
cccaacaaccaggtagctaagtggg

SEQ ID NO: 242082 - DNA, 25 bp, Mus musculus
cccaacaagacgatgatgatgacga

SEQ ID NO: 242083 - DNA, 25 bp, Mus musculus
cccaacaagtgccagagaggagttt

SEQ ID NO: 242084 - DNA, 25 bp, Mus musculus
cccaacaagtgccaggtacatattt

SEQ ID NO: 242085 - DNA, 25 bp, Mus musculus
cccaacacagagggtgaacagccag

SEQ ID NO: 242086 - DNA, 25 bp, Mus musculus
cccaacacagtggggctgtggtcac

SEQ ID NO: 242087 - DNA, 25 bp, Mus musculus
cccaacaccagaactattgtcccag

SEQ ID NO: 242088 - DNA, 25 bp, Mus musculus
cccaacacccagcaagaagtctatg

SEQ ID NO: 242089 - DNA, 25 bp, Mus musculus
cccaacactgagggcagggcctacg

SEQ ID NO: 242090 - DNA, 25 bp, Mus musculus
cccaacagaagctgacatcatgttc

SEQ ID NO: 242091 - DNA, 25 bp, Mus musculus
cccaacagaagctgcatgtctgctg

SEQ ID NO: 242092 - DNA, 25 bp, Mus musculus
cccaacagaaggcgacatcccaggc

SEQ ID NO: 242093 - DNA, 25 bp, Mus musculus
cccaacagaatgcaggctggtgaga

SEQ ID NO: 242094 - DNA, 25 bp, Mus musculus
cccaacagagagggcccccagcatg

SEQ ID NO: 242095 - DNA, 25 bp, Mus musculus
cccaacagagcaagtgacaaatgac

SEQ ID NO: 242096 - DNA, 25 bp, Mus musculus
cccaacagagcaatctctggcaaac

SEQ ID NO: 242097 - DNA, 25 bp, Mus musculus
cccaacagccaggaggctctgcaga

SEQ ID NO: 242098 - DNA, 25 bp, Mus musculus
cccaacagcgggccacagattgtac

SEQ ID NO: 242099 - DNA, 25 bp, Mus musculus
cccaacagcgggtctggaggagggg

SEQ ID NO: 242100 - DNA, 25 bp, Mus musculus
cccaacaggtaattggcacgggaga

SEQ ID NO: 242101 - DNA, 25 bp, Mus musculus
cccaacatcatgaaagccaagaaga

SEQ ID NO: 242102 - DNA, 25 bp, Mus musculus
cccaacatgcggacctcatgcctga

SEQ ID NO: 242103 - DNA, 25 bp, Mus musculus
cccaacatgcgggaattcatcctct

SEQ ID NO: 242104 - DNA, 25 bp, Mus musculus
cccaaccaagctgctggaagctctg

SEQ ID NO: 242105 - DNA, 25 bp, Mus musculus
cccaaccaaggaatcactgagattc

SEQ ID NO: 242106 - DNA, 25 bp, Mus musculus
cccaaccaatggcttcgagctgtat

SEQ ID NO: 242107 - DNA, 25 bp, Mus musculus
cccaaccacagatgactacagctgt

SEQ ID NO: 242108 - DNA, 25 bp, Mus musculus
cccaaccacgctggggtctccaatg

SEQ ID NO: 242109 - DNA, 25 bp, Mus musculus
cccaaccagaccgtggacatgcttc

SEQ ID NO: 242110 - DNA, 25 bp, Mus musculus
cccaaccagcctcaggaagcaggcc

SEQ ID NO: 242111 - DNA, 25 bp, Mus musculus
cccaaccaggtgatgagactatcca

SEQ ID NO: 242112 - DNA, 25 bp, Mus musculus
cccaacccaaatcttccaccacctg

SEQ ID NO: 242113 - DNA, 25 bp, Mus musculus
cccaacccaagtgacgttttgaatc

SEQ ID NO: 242114 - DNA, 25 bp, Mus musculus
cccaacccacgaagggcgaatcgcc

SEQ ID NO: 242115 - DNA, 25 bp, Mus musculus
cccaacccagagaagagtgacagca

SEQ ID NO: 242116 - DNA, 25 bp, Mus musculus
cccaacccagagaaggcccagcttg

SEQ ID NO: 242117 - DNA, 25 bp, Mus musculus
cccaacccagtgacaatgcccctga

SEQ ID NO: 242118 - DNA, 25 bp, Mus musculus
cccaaccccaggcacagctgacttt

SEQ ID NO: 242119 - DNA, 25 bp, Mus musculus
cccaacccggaggaccaggactgag

SEQ ID NO: 242120 - DNA, 25 bp, Mus musculus
cccaaccgagatcctatgattgaca

SEQ ID NO: 242121 - DNA, 25 bp, Mus musculus
cccaacctcagacgacaatttccaa

SEQ ID NO: 242122 - DNA, 25 bp, Mus musculus
cccaacctcagcaaagccagtggcc

SEQ ID NO: 242123 - DNA, 25 bp, Mus musculus
cccaacctcagcacttttctgtact

SEQ ID NO: 242124 - DNA, 25 bp, Mus musculus
cccaacctcagctttctgacctgtg

SEQ ID NO: 242125 - DNA, 25 bp, Mus musculus
cccaaccttttgacaaggtcagggc

SEQ ID NO: 242126 - DNA, 25 bp, Mus musculus
cccaacgaaaattgaacagatcgaa

SEQ ID NO: 242127 - DNA, 25 bp, Mus musculus
cccaacgacaaaactaatatccagg

SEQ ID NO: 242128 - DNA, 25 bp, Mus musculus
cccaacgacaaaactgctaacccag

SEQ ID NO: 242129 - DNA, 25 bp, Mus musculus
cccaacgacattgtgtacctcatcc

SEQ ID NO: 242130 - DNA, 25 bp, Mus musculus
cccaacgcaaatctggtgcaataac

SEQ ID NO: 242131 - DNA, 25 bp, Mus musculus
cccaacgcctctagtaaccctgacc

SEQ ID NO: 242132 - DNA, 25 bp, Mus musculus
cccaacgctagaacatacaacatca

SEQ ID NO: 242133 - DNA, 25 bp, Mus musculus
cccaacggctctgcctgcagtgggg

SEQ ID NO: 242134 - DNA, 25 bp, Mus musculus
cccaacggctctgcgttgctgctct

SEQ ID NO: 242135 - DNA, 25 bp, Mus musculus
cccaacgtacagagccattgtcact

SEQ ID NO: 242136 - DNA, 25 bp, Mus musculus
cccaacgttcagaaccccaaatctc

SEQ ID NO: 242137 - DNA, 25 bp, Mus musculus
cccaactacacgagacctgtgttcc

SEQ ID NO: 242138 - DNA, 25 bp, Mus musculus
cccaactacagaaaagcagtcagct

SEQ ID NO: 242139 - DNA, 25 bp, Mus musculus
cccaactatactgtcactgccctgc

SEQ ID NO: 242140 - DNA, 25 bp, Mus musculus
cccaactattcacacctcctggagg

SEQ ID NO: 242141 - DNA, 25 bp, Mus musculus
cccaactattcacaggctcagcagc

SEQ ID NO: 242142 - DNA, 25 bp, Mus musculus
cccaactattgtgaccagatgggaa

SEQ ID NO: 242143 - DNA, 25 bp, Mus musculus
cccaactcaaggtctgatccggatg

SEQ ID NO: 242144 - DNA, 25 bp, Mus musculus
cccaactcaaggtgctgtcccacaa

SEQ ID NO: 242145 - DNA, 25 bp, Mus musculus
cccaactcagcgggtggataccctt

SEQ ID NO: 242146 - DNA, 25 bp, Mus musculus
cccaactcagcgggttcttccagtt

SEQ ID NO: 242147 - DNA, 25 bp, Mus musculus
cccaactccaagggctgggtcttca

SEQ ID NO: 242148 - DNA, 25 bp, Mus musculus
cccaactccaaggttacagagtcat

SEQ ID NO: 242149 - DNA, 25 bp, Mus musculus
cccaactccttcagcgcatcatgac

SEQ ID NO: 242150 - DNA, 25 bp, Mus musculus
cccaactccttcaggtccatctctg

SEQ ID NO: 242151 - DNA, 25 bp, Mus musculus
cccaactctcgtggaagcacaagcc

SEQ ID NO: 242152 - DNA, 25 bp, Mus musculus
cccaactctcttccatgcgccaatg

SEQ ID NO: 242153 - DNA, 25 bp, Mus musculus
cccaactgagggcaggctggatata

SEQ ID NO: 242154 - DNA, 25 bp, Mus musculus
cccaactgctgcaacaccagcacag

SEQ ID NO: 242155 - DNA, 25 bp, Mus musculus
cccaactgtacgcggagactgcggc

SEQ ID NO: 242156 - DNA, 25 bp, Mus musculus
cccaactgtagtgctggacccaaag

SEQ ID NO: 242157 - DNA, 25 bp, Mus musculus
cccaacttaaagactgaagtgttgg

SEQ ID NO: 242158 - DNA, 25 bp, Mus musculus
cccaacttataaagatgattataga

SEQ ID NO: 242159 - DNA, 25 bp, Mus musculus
cccaacttcaagggtgctgctcagg

SEQ ID NO: 242160 - DNA, 25 bp, Mus musculus
cccaacttcaggtaccaatggggat

SEQ ID NO: 242161 - DNA, 25 bp, Mus musculus
cccaacttcctccagctgcagaatc

SEQ ID NO: 242162 - DNA, 25 bp, Mus musculus
cccaacttcgccaggtcctagagtc

SEQ ID NO: 242163 - DNA, 25 bp, Mus musculus
cccaacttctcggtctactatacca

SEQ ID NO: 242164 - DNA, 25 bp, Mus musculus
cccaagaaaaaggtgcgcatggtga

SEQ ID NO: 242165 - DNA, 25 bp, Mus musculus
cccaagaaaatggatgagtatgtgg

SEQ ID NO: 242166 - DNA, 25 bp, Mus musculus
cccaagaaacatgcactgataaagc

SEQ ID NO: 242167 - DNA, 25 bp, Mus musculus
cccaagaaacatgggattactgctg

SEQ ID NO: 242168 - DNA, 25 bp, Mus musculus
cccaagaaactccaggctgcgctgg

SEQ ID NO: 242169 - DNA, 25 bp, Mus musculus
cccaagaaaggtggcaggagatcgc

SEQ ID NO: 242170 - DNA, 25 bp, Mus musculus
cccaagaaccagacccgagtcagaa

SEQ ID NO: 242171 - DNA, 25 bp, Mus musculus
cccaagaacccaggtggaaagcaca

SEQ ID NO: 242172 - DNA, 25 bp, Mus musculus
cccaagaagcgtgggaccttcattg

SEQ ID NO: 242173 - DNA, 25 bp, Mus musculus
cccaagaagtctagaaattctgtgc

SEQ ID NO: 242174 - DNA, 25 bp, Mus musculus
cccaagaagtctagggcacttgatg

SEQ ID NO: 242175 - DNA, 25 bp, Mus musculus
cccaagaagtgagaacggagcacct

SEQ ID NO: 242176 - DNA, 25 bp, Mus musculus
cccaagaagtgaggccgggagcagg

SEQ ID NO: 242177 - DNA, 25 bp, Mus musculus
cccaagacaagtgtcagcggaaact

SEQ ID NO: 242178 - DNA, 25 bp, Mus musculus
cccaagacaagttcgagaaatggta

SEQ ID NO: 242179 - DNA, 25 bp, Mus musculus
cccaagacacaattgaattaaacag

SEQ ID NO: 242180 - DNA, 25 bp, Mus musculus
cccaagacacagataagccaggact

SEQ ID NO: 242181 - DNA, 25 bp, Mus musculus
cccaagacacccaggccagccacgc

SEQ ID NO: 242182 - DNA, 25 bp, Mus musculus
cccaagaccagctcacggatgattg

SEQ ID NO: 242183 - DNA, 25 bp, Mus musculus
cccaagaccagtgacagtgggaact

SEQ ID NO: 242184 - DNA, 25 bp, Mus musculus
cccaagaccatgtgtgccgacaaca

SEQ ID NO: 242185 - DNA, 25 bp, Mus musculus
cccaagagaaggatgggtagaacaa

SEQ ID NO: 242186 - DNA, 25 bp, Mus musculus
cccaagagcacacattgaaaagggc

SEQ ID NO: 242187 - DNA, 25 bp, Mus musculus
cccaagagcagagagatcatctcct

SEQ ID NO: 242188 - DNA, 25 bp, Mus musculus
cccaagagccagatggtccagcgct

SEQ ID NO: 242189 - DNA, 25 bp, Mus musculus
cccaagagcccacagtcgaaggatc

SEQ ID NO: 242190 - DNA, 25 bp, Mus musculus
cccaagaggaagaagtccaggagga

SEQ ID NO: 242191 - DNA, 25 bp, Mus musculus
cccaagaggaagaggaagtccaaga

SEQ ID NO: 242192 - DNA, 25 bp, Mus musculus
cccaagagggggaatacctccacgg

SEQ ID NO: 242193 - DNA, 25 bp, Mus musculus
cccaagagtgatggaaagaactcaa

SEQ ID NO: 242194 - DNA, 25 bp, Mus musculus
cccaagataaggatggtagaggtgg

SEQ ID NO: 242195 - DNA, 25 bp, Mus musculus
cccaagataaggcactcctgcagat

SEQ ID NO: 242196 - DNA, 25 bp, Mus musculus
cccaagatcctggagcacttggaat

SEQ ID NO: 242197 - DNA, 25 bp, Mus musculus
cccaagatgagcagctgtggcggct

SEQ ID NO: 242198 - DNA, 25 bp, Mus musculus
cccaagatgtcgccctgatgattcg

SEQ ID NO: 242199 - DNA, 25 bp, Mus musculus
cccaagatgtctgacagaacagtaa

SEQ ID NO: 242200 - DNA, 25 bp, Mus musculus
cccaagatgtctgtatggggagaga

SEQ ID NO: 242201 - DNA, 25 bp, Mus musculus
cccaagattagaaggacctcttcct

SEQ ID NO: 242202 - DNA, 25 bp, Mus musculus
cccaagcaaggttgaaaggaaatgt

SEQ ID NO: 242203 - DNA, 25 bp, Mus musculus
cccaagcacaaggtgagactgtgga

SEQ ID NO: 242204 - DNA, 25 bp, Mus musculus
cccaagcagacagaccgtgcgagtc

SEQ ID NO: 242205 - DNA, 25 bp, Mus musculus
cccaagccagccccgcagccctaca

SEQ ID NO: 242206 - DNA, 25 bp, Mus musculus
cccaagccaggaacctctcagtcaa

SEQ ID NO: 242207 - DNA, 25 bp, Mus musculus
cccaagccaggaacttctcagccag

SEQ ID NO: 242208 - DNA, 25 bp, Mus musculus
cccaagccaggctttcttgatcatg

SEQ ID NO: 242209 - DNA, 25 bp, Mus musculus
cccaagcccaggacaccgtgcatta

SEQ ID NO: 242210 - DNA, 25 bp, Mus musculus
cccaagcccagttccacaagaggaa

SEQ ID NO: 242211 - DNA, 25 bp, Mus musculus
cccaagccggtgccgggctttcagg

SEQ ID NO: 242212 - DNA, 25 bp, Mus musculus
cccaagcctctctggaactgaaaag

SEQ ID NO: 242213 - DNA, 25 bp, Mus musculus
cccaagcctctctggagtccatgta

SEQ ID NO: 242214 - DNA, 25 bp, Mus musculus
cccaagcggaaggagcatagtgaaa

SEQ ID NO: 242215 - DNA, 25 bp, Mus musculus
cccaagcggacaagtattccaccaa

SEQ ID NO: 242216 - DNA, 25 bp, Mus musculus
cccaagctaaaggagctgaatctgt

SEQ ID NO: 242217 - DNA, 25 bp, Mus musculus
cccaagctatacaaggtgggcctgg

SEQ ID NO: 242218 - DNA, 25 bp, Mus musculus
cccaagctgcaccaggaggcggtgg

SEQ ID NO: 242219 - DNA, 25 bp, Mus musculus
cccaagctgctttctggcttgctgg

SEQ ID NO: 242220 - DNA, 25 bp, Mus musculus
cccaagcttcctgatgctccattgc

SEQ ID NO: 242221 - DNA, 25 bp, Mus musculus
cccaagcttctgaggagctagaagc

SEQ ID NO: 242222 - DNA, 25 bp, Mus musculus
cccaaggaaggagtctatgaactgg

SEQ ID NO: 242223 - DNA, 25 bp, Mus musculus
cccaaggaagttcatgttctgtggt

SEQ ID NO: 242224 - DNA, 25 bp, Mus musculus
cccaaggaatgattcccgttgcgca

SEQ ID NO: 242225 - DNA, 25 bp, Mus musculus
cccaaggacagtttagagacgtgga

SEQ ID NO: 242226 - DNA, 25 bp, Mus musculus
cccaaggaccattctggatgcagac

SEQ ID NO: 242227 - DNA, 25 bp, Mus musculus
cccaaggagaagaagaatttggaat

SEQ ID NO: 242228 - DNA, 25 bp, Mus musculus
cccaaggagaagaagggctccagca

SEQ ID NO: 242229 - DNA, 25 bp, Mus musculus
cccaaggagtgggggtgggcttagg

SEQ ID NO: 242230 - DNA, 25 bp, Mus musculus
cccaaggatgacctgggccttttgc

SEQ ID NO: 242231 - DNA, 25 bp, Mus musculus
cccaaggccacagccaggagaaact

SEQ ID NO: 242232 - DNA, 25 bp, Mus musculus
cccaagggaagggaggaagagacag

SEQ ID NO: 242233 - DNA, 25 bp, Mus musculus
cccaagggaaggggagaggcctgtc

SEQ ID NO: 242234 - DNA, 25 bp, Mus musculus
cccaagggacaaccaggcaaccgag

SEQ ID NO: 242235 - DNA, 25 bp, Mus musculus
cccaagggagacagaggcgatgttg

SEQ ID NO: 242236 - DNA, 25 bp, Mus musculus
cccaagggagagactggacctgctg

SEQ ID NO: 242237 - DNA, 25 bp, Mus musculus
cccaagggaggtgaggaggaagaag

SEQ ID NO: 242238 - DNA, 25 bp, Mus musculus
cccaagggggagaagggccacattg

SEQ ID NO: 242239 - DNA, 25 bp, Mus musculus
cccaagggtgaacagggtgcctctg

SEQ ID NO: 242240 - DNA, 25 bp, Mus musculus
cccaaggtgcagcaacctcactttg

SEQ ID NO: 242241 - DNA, 25 bp, Mus musculus
cccaaggtgcaggctttggttagaa

SEQ ID NO: 242242 - DNA, 25 bp, Mus musculus
cccaaggtgccagaggaggatgact

SEQ ID NO: 242243 - DNA, 25 bp, Mus musculus
cccaaggtgctacaagaaatgtctg

SEQ ID NO: 242244 - DNA, 25 bp, Mus musculus
cccaagtaagaagactagcagtgag

SEQ ID NO: 242245 - DNA, 25 bp, Mus musculus
cccaagtaagataccaaggtataaa

SEQ ID NO: 242246 - DNA, 25 bp, Mus musculus
cccaagtacccgcctacagtttcaa

SEQ ID NO: 242247 - DNA, 25 bp, Mus musculus
cccaagtatgagcccaattttgccc

SEQ ID NO: 242248 - DNA, 25 bp, Mus musculus
cccaagtatgcaggctgctcgtcag

SEQ ID NO: 242249 - DNA, 25 bp, Mus musculus
cccaagtatgcagtgctcgatgaag

SEQ ID NO: 242250 - DNA, 25 bp, Mus musculus
cccaagtcatcttggctgaagagga

SEQ ID NO: 242251 - DNA, 25 bp, Mus musculus
cccaagtcggatgtggaaatggaag

SEQ ID NO: 242252 - DNA, 25 bp, Mus musculus
cccaagtcgggacccttgcacaagc

SEQ ID NO: 242253 - DNA, 25 bp, Mus musculus
cccaagtcggttaacagtgatgtca

SEQ ID NO: 242254 - DNA, 25 bp, Mus musculus
cccaagtctctcaagagtcaccatg

SEQ ID NO: 242255 - DNA, 25 bp, Mus musculus
cccaagtctctcaagtatctcagca

SEQ ID NO: 242256 - DNA, 25 bp, Mus musculus
cccaagtctgctgccctgctgtcct

SEQ ID NO: 242257 - DNA, 25 bp, Mus musculus
cccaagtgaacaagaactggaatgc

SEQ ID NO: 242258 - DNA, 25 bp, Mus musculus
cccaagtgcgagatgttgcatgtgg

SEQ ID NO: 242259 - DNA, 25 bp, Mus musculus
cccaagtgcgaggaaaaatccgctg

SEQ ID NO: 242260 - DNA, 25 bp, Mus musculus
cccaagtgctgcaggaggctacttt

SEQ ID NO: 242261 - DNA, 25 bp, Mus musculus
cccaagtggaaagctgcggctgctg

SEQ ID NO: 242262 - DNA, 25 bp, Mus musculus
cccaagttacgtaatcattgcaacg

SEQ ID NO: 242263 - DNA, 25 bp, Mus musculus
cccaagttcaagggaatcaaagact

SEQ ID NO: 242264 - DNA, 25 bp, Mus musculus
cccaagttcaggaagaagcacacag

SEQ ID NO: 242265 - DNA, 25 bp, Mus musculus
cccaagttcaggagctctgcacacc

SEQ ID NO: 242266 - DNA, 25 bp, Mus musculus
cccaagttcccagaccttgtgaccg

SEQ ID NO: 242267 - DNA, 25 bp, Mus musculus
cccaagttcccagcaagccccgccc

SEQ ID NO: 242268 - DNA, 25 bp, Mus musculus
cccaagttgagttcatggcatctca

SEQ ID NO: 242269 - DNA, 25 bp, Mus musculus
cccaataaaagataattggttaagg

SEQ ID NO: 242270 - DNA, 25 bp, Mus musculus
cccaataaaaggctcccgtccacct

SEQ ID NO: 242271 - DNA, 25 bp, Mus musculus
cccaatacagtgttatttctgctca

SEQ ID NO: 242272 - DNA, 25 bp, Mus musculus
cccaatagagataatgcaggggatg

SEQ ID NO: 242273 - DNA, 25 bp, Mus musculus
cccaatagagatggcttgccagtag

SEQ ID NO: 242274 - DNA, 25 bp, Mus musculus
cccaatatttcagctaaactctgtt

SEQ ID NO: 242275 - DNA, 25 bp, Mus musculus
cccaatatttcaggtttcacagaca

SEQ ID NO: 242276 - DNA, 25 bp, Mus musculus
cccaatcagagtgcggagatccaag

SEQ ID NO: 242277 - DNA, 25 bp, Mus musculus
cccaatccagagctaagctaggaat

SEQ ID NO: 242278 - DNA, 25 bp, Mus musculus
cccaatccagcatacagagctaagc

SEQ ID NO: 242279 - DNA, 25 bp, Mus musculus
cccaatcccactgattttaggtgat

SEQ ID NO: 242280 - DNA, 25 bp, Mus musculus
cccaatcctcaaccagttctgtatt

SEQ ID NO: 242281 - DNA, 25 bp, Mus musculus
cccaatcctcgagccctgacatact

SEQ ID NO: 242282 - DNA, 25 bp, Mus musculus
cccaatcgcaagacggtgcctctgg

SEQ ID NO: 242283 - DNA, 25 bp, Mus musculus
cccaatcgcaaggattcttcttctc

SEQ ID NO: 242284 - DNA, 25 bp, Mus musculus
cccaatctggggaactctgataaga

SEQ ID NO: 242285 - DNA, 25 bp, Mus musculus
cccaatgaaaaaaggctctggaatg

SEQ ID NO: 242286 - DNA, 25 bp, Mus musculus
cccaatgaagatgaacagagcctcc

SEQ ID NO: 242287 - DNA, 25 bp, Mus musculus
cccaatgaatccccagcttcacacc

SEQ ID NO: 242288 - DNA, 25 bp, Mus musculus
cccaatgacaggttcattttgctgg

SEQ ID NO: 242289 - DNA, 25 bp, Mus musculus
cccaatgacggtcaagatgctgaat

SEQ ID NO: 242290 - DNA, 25 bp, Mus musculus
cccaatgctcggtccgcggaggggc

SEQ ID NO: 242291 - DNA, 25 bp, Mus musculus
cccaatgctctccctctagagtgca

SEQ ID NO: 242292 - DNA, 25 bp, Mus musculus
cccaatggaggttctgaagacccga

SEQ ID NO: 242293 - DNA, 25 bp, Mus musculus
cccaatggggaaggtctaaatgcca

SEQ ID NO: 242294 - DNA, 25 bp, Mus musculus
cccaatggggctcctcctccaggca

SEQ ID NO: 242295 - DNA, 25 bp, Mus musculus
cccaatggtcctgagctgtttgggg

SEQ ID NO: 242296 - DNA, 25 bp, Mus musculus
cccaatgtatctggtgaccacatta

SEQ ID NO: 242297 - DNA, 25 bp, Mus musculus
cccaatgtctttgcaccctgtgacc

SEQ ID NO: 242298 - DNA, 25 bp, Mus musculus
cccaatgttgtacggctgatggatg

SEQ ID NO: 242299 - DNA, 25 bp, Mus musculus
cccaatgttgtacggtggttacgct

SEQ ID NO: 242300 - DNA, 25 bp, Mus musculus
cccaattcaggaagcacagaccaag

SEQ ID NO: 242301 - DNA, 25 bp, Mus musculus
cccaattccaagagatatgtccggc

SEQ ID NO: 242302 - DNA, 25 bp, Mus musculus
cccaattctggcaggaagcagtgaa

SEQ ID NO: 242303 - DNA, 25 bp, Mus musculus
cccaattctggcaggacatgaagct

SEQ ID NO: 242304 - DNA, 25 bp, Mus musculus
cccaattctggcaggtagtgctgcc

SEQ ID NO: 242305 - DNA, 25 bp, Mus musculus
cccaattctgggacactcactctta

SEQ ID NO: 242306 - DNA, 25 bp, Mus musculus
cccaattgatcatgggccctgggga

SEQ ID NO: 242307 - DNA, 25 bp, Mus musculus
cccaattgcccaagaacaaacctgt

SEQ ID NO: 242308 - DNA, 25 bp, Mus musculus
cccaattgcccaagagttaaccagc

SEQ ID NO: 242309 - DNA, 25 bp, Mus musculus
cccaattgcccaaggtaataatctt

SEQ ID NO: 242310 - DNA, 25 bp, Mus musculus
cccaattgtcttgcttcattaaaaa

SEQ ID NO: 242311 - DNA, 25 bp, Mus musculus
cccaattgtcttgcttcattaacaa

SEQ ID NO: 242312 - DNA, 25 bp, Mus musculus
cccaattgttatggctttgagtgct

SEQ ID NO: 242313 - DNA, 25 bp, Mus musculus
cccaatttcaggctcacccatgaca

SEQ ID NO: 242314 - DNA, 25 bp, Mus musculus
cccacaaaagcagctatgccccctc

SEQ ID NO: 242315 - DNA, 25 bp, Mus musculus
cccacaaaatcatgcaaatcaagag

SEQ ID NO: 242316 - DNA, 25 bp, Mus musculus
cccacaaacaggtcagcccttctta

SEQ ID NO: 242317 - DNA, 25 bp, Mus musculus
cccacaacgctgcttctgaaccagc

SEQ ID NO: 242318 - DNA, 25 bp, Mus musculus
cccacaacgttcacccggccacaca

SEQ ID NO: 242319 - DNA, 25 bp, Mus musculus
cccacaagatccagtccccgctgct

SEQ ID NO: 242320 - DNA, 25 bp, Mus musculus
cccacaagcctgaaatcaactccac

SEQ ID NO: 242321 - DNA, 25 bp, Mus musculus
cccacaagcctgagccaggagggcc

SEQ ID NO: 242322 - DNA, 25 bp, Mus musculus
cccacaaggctcagacagcagtgac

SEQ ID NO: 242323 - DNA, 25 bp, Mus musculus
cccacaatcgaagatgcttataaaa

SEQ ID NO: 242324 - DNA, 25 bp, Mus musculus
cccacaatcggcagagttcacggcc

SEQ ID NO: 242325 - DNA, 25 bp, Mus musculus
cccacaatgattcggcagacgggcc

SEQ ID NO: 242326 - DNA, 25 bp, Mus musculus
cccacacacaagtctggccacagat

SEQ ID NO: 242327 - DNA, 25 bp, Mus musculus
cccacacagcaggaggtcccaggta

SEQ ID NO: 242328 - DNA, 25 bp, Mus musculus
cccacaccactggtgatccagcagc

SEQ ID NO: 242329 - DNA, 25 bp, Mus musculus
cccacaccaggatgcaggcagcctc

SEQ ID NO: 242330 - DNA, 25 bp, Mus musculus
cccacacccacagggctgtccccca

SEQ ID NO: 242331 - DNA, 25 bp, Mus musculus
cccacaccccaggaagtcagaggca

SEQ ID NO: 242332 - DNA, 25 bp, Mus musculus
cccacaccccgtgacccgcagggcc

SEQ ID NO: 242333 - DNA, 25 bp, Mus musculus
cccacacgctgattctctacctgag

SEQ ID NO: 242334 - DNA, 25 bp, Mus musculus
cccacacgctgcaggtgctgttatc

SEQ ID NO: 242335 - DNA, 25 bp, Mus musculus
cccacacggacagcgcgctttggat

SEQ ID NO: 242336 - DNA, 25 bp, Mus musculus
cccacacggacagcggcacagccga

SEQ ID NO: 242337 - DNA, 25 bp, Mus musculus
cccacacggcttcagaaaagaagtt

SEQ ID NO: 242338 - DNA, 25 bp, Mus musculus
cccacacggcttcagaaggaagagg

SEQ ID NO: 242339 - DNA, 25 bp, Mus musculus
cccacacggcttcagtctttgcagt

SEQ ID NO: 242340 - DNA, 25 bp, Mus musculus
cccacactggcagccaccaccaagg

SEQ ID NO: 242341 - DNA, 25 bp, Mus musculus
cccacactggccgccactgggaagc

SEQ ID NO: 242342 - DNA, 25 bp, Mus musculus
cccacactggtgcagaagagaagag

SEQ ID NO: 242343 - DNA, 25 bp, Mus musculus
cccacactgtctgaactcacgctcg

SEQ ID NO: 242344 - DNA, 25 bp, Mus musculus
cccacacttcttcctgccttaacca

SEQ ID NO: 242345 - DNA, 25 bp, Mus musculus
cccacagaaaacaaagtggagcgac

SEQ ID NO: 242346 - DNA, 25 bp, Mus musculus
cccacagaaatgctgcacaatgtca

SEQ ID NO: 242347 - DNA, 25 bp, Mus musculus
cccacagaacacggaatgacaaggt

SEQ ID NO: 242348 - DNA, 25 bp, Mus musculus
cccacagaacacgtgaaagcagagc

SEQ ID NO: 242349 - DNA, 25 bp, Mus musculus
cccacagaacgagagcgccatctgt

SEQ ID NO: 242350 - DNA, 25 bp, Mus musculus
cccacagaaggacccagaaatctac

SEQ ID NO: 242351 - DNA, 25 bp, Mus musculus
cccacagacaggtggtggctggcct

SEQ ID NO: 242352 - DNA, 25 bp, Mus musculus
cccacagatgaagtgtcctatacag

SEQ ID NO: 242353 - DNA, 25 bp, Mus musculus
cccacagatggaacagattctggtt

SEQ ID NO: 242354 - DNA, 25 bp, Mus musculus
cccacagcacccaccatcccctgcc

SEQ ID NO: 242355 - DNA, 25 bp, Mus musculus
cccacagcacccagcatgaggagct

SEQ ID NO: 242356 - DNA, 25 bp, Mus musculus
cccacagcacgccactggcagatcc

SEQ ID NO: 242357 - DNA, 25 bp, Mus musculus
cccacagcagaaactgcagttggtg

SEQ ID NO: 242358 - DNA, 25 bp, Mus musculus
cccacagcagagtctgtgcgcccca

SEQ ID NO: 242359 - DNA, 25 bp, Mus musculus
cccacagcaggagtggacagcatgg

SEQ ID NO: 242360 - DNA, 25 bp, Mus musculus
cccacagcatccgaacttttgtgag

SEQ ID NO: 242361 - DNA, 25 bp, Mus musculus
cccacagccaacaggtcagaccaag

SEQ ID NO: 242362 - DNA, 25 bp, Mus musculus
cccacagccaccgagactccagacc

SEQ ID NO: 242363 - DNA, 25 bp, Mus musculus
cccacagccaccgagccgtcaagct

SEQ ID NO: 242364 - DNA, 25 bp, Mus musculus
cccacagccccgcagacactgggtt

SEQ ID NO: 242365 - DNA, 25 bp, Mus musculus
cccacagccgcagccttaccagcca

SEQ ID NO: 242366 - DNA, 25 bp, Mus musculus
cccacagccgcagcgtcctcagaat

SEQ ID NO: 242367 - DNA, 25 bp, Mus musculus
cccacagcggaaccgacaaaggtta

SEQ ID NO: 242368 - DNA, 25 bp, Mus musculus
cccacagcggaaccgcttcttcact

SEQ ID NO: 242369 - DNA, 25 bp, Mus musculus
cccacagcggaaccggacgccctgg

SEQ ID NO: 242370 - DNA, 25 bp, Mus musculus
cccacagcgtcctccgggtagctgg

SEQ ID NO: 242371 - DNA, 25 bp, Mus musculus
cccacagctaggctttcagtctctg

SEQ ID NO: 242372 - DNA, 25 bp, Mus musculus
cccacagctccttcccagctggtgg

SEQ ID NO: 242373 - DNA, 25 bp, Mus musculus
cccacagctggtggagatgattgca

SEQ ID NO: 242374 - DNA, 25 bp, Mus musculus
cccacagctggtggagttgttggga

SEQ ID NO: 242375 - DNA, 25 bp, Mus musculus
cccacagctgtctagctgtttcctc

SEQ ID NO: 242376 - DNA, 25 bp, Mus musculus
cccacagcttcccaggagatgtacg

SEQ ID NO: 242377 - DNA, 25 bp, Mus musculus
cccacaggaaacaggagcagcgttg

SEQ ID NO: 242378 - DNA, 25 bp, Mus musculus
cccacaggaaaggaatggagagtct

SEQ ID NO: 242379 - DNA, 25 bp, Mus musculus
cccacaggaaagtacctggccagtg

SEQ ID NO: 242380 - DNA, 25 bp, Mus musculus
cccacaggaaccagctgatggccag

SEQ ID NO: 242381 - DNA, 25 bp, Mus musculus
cccacaggaagactggtgggaacac

SEQ ID NO: 242382 - DNA, 25 bp, Mus musculus
cccacaggaagtcagctagcagcca

SEQ ID NO: 242383 - DNA, 25 bp, Mus musculus
cccacaggacagagttcctgtagtt

SEQ ID NO: 242384 - DNA, 25 bp, Mus musculus
cccacaggagagaagcatcaagatg

SEQ ID NO: 242385 - DNA, 25 bp, Mus musculus
cccacaggagagaagggtcaccgct

SEQ ID NO: 242386 - DNA, 25 bp, Mus musculus
cccacaggccagccttcttgctaag

SEQ ID NO: 242387 - DNA, 25 bp, Mus musculus
cccacaggcgcaagaaaagagaagc

SEQ ID NO: 242388 - DNA, 25 bp, Mus musculus
cccacaggcgggcggtgtatcctca

SEQ ID NO: 242389 - DNA, 25 bp, Mus musculus
cccacaggtcggaaggctgcctctc

SEQ ID NO: 242390 - DNA, 25 bp, Mus musculus
cccacagtcagccttttatgtcacc

SEQ ID NO: 242391 - DNA, 25 bp, Mus musculus
cccacagtgccaagatttttttcgt

SEQ ID NO: 242392 - DNA, 25 bp, Mus musculus
cccacagtgccaaggtcaaaattgc

SEQ ID NO: 242393 - DNA, 25 bp, Mus musculus
cccacagtgggggctgaagaatact

SEQ ID NO: 242394 - DNA, 25 bp, Mus musculus
cccacagtggttctcactgtggatg

SEQ ID NO: 242395 - DNA, 25 bp, Mus musculus
cccacagttcagaaactgtgaagtt

SEQ ID NO: 242396 - DNA, 25 bp, Mus musculus
cccacatactatatatgccgttcct

SEQ ID NO: 242397 - DNA, 25 bp, Mus musculus
cccacatagagaaggtgacagatgt

SEQ ID NO: 242398 - DNA, 25 bp, Mus musculus
cccacatcaaggtggtggtcggcgg

SEQ ID NO: 242399 - DNA, 25 bp, Mus musculus
cccacatcaattgccagtctgcaag

SEQ ID NO: 242400 - DNA, 25 bp, Mus musculus
cccacatgctaacaggggctaccag

SEQ ID NO: 242401 - DNA, 25 bp, Mus musculus
cccacatgtcacagctaaagtccag

SEQ ID NO: 242402 - DNA, 25 bp, Mus musculus
cccacattcaacccatggggccgcc

SEQ ID NO: 242403 - DNA, 25 bp, Mus musculus
cccacattcaactccagcgccgtct

SEQ ID NO: 242404 - DNA, 25 bp, Mus musculus
cccacattcaggtccaacaaagttc

SEQ ID NO: 242405 - DNA, 25 bp, Mus musculus
cccacattccagggccctctgcctc

SEQ ID NO: 242406 - DNA, 25 bp, Mus musculus
cccacatttttctgaattattttga

SEQ ID NO: 242407 - DNA, 25 bp, Mus musculus
cccaccaaagcacagtgtcctcaac

SEQ ID NO: 242408 - DNA, 25 bp, Mus musculus
cccaccaacaaggcctgtttcgatt

SEQ ID NO: 242409 - DNA, 25 bp, Mus musculus
cccaccaacatccagagcaagcacc

SEQ ID NO: 242410 - DNA, 25 bp, Mus musculus
cccaccaacatccagctttccaagc

SEQ ID NO: 242411 - DNA, 25 bp, Mus musculus
cccaccaagaataaagcgctaactg

SEQ ID NO: 242412 - DNA, 25 bp, Mus musculus
cccaccaagatcccagtgattatag

SEQ ID NO: 242413 - DNA, 25 bp, Mus musculus
cccaccaattcccacagagaaccag

SEQ ID NO: 242414 - DNA, 25 bp, Mus musculus
cccaccacacctgtctcctccttca

SEQ ID NO: 242415 - DNA, 25 bp, Mus musculus
cccaccacagaggcctcaggatgac

SEQ ID NO: 242416 - DNA, 25 bp, Mus musculus
cccaccacagatctgcgatggcgtc

SEQ ID NO: 242417 - DNA, 25 bp, Mus musculus
cccaccaccccaggcccagagtcta

SEQ ID NO: 242418 - DNA, 25 bp, Mus musculus
cccaccaccgggtgtgatgaatcaa

SEQ ID NO: 242419 - DNA, 25 bp, Mus musculus
cccaccactccctaggtgttgggag

SEQ ID NO: 242420 - DNA, 25 bp, Mus musculus
cccaccagaaggaccctgctctgga

SEQ ID NO: 242421 - DNA, 25 bp, Mus musculus
cccaccagaaggtggtagccaattc

SEQ ID NO: 242422 - DNA, 25 bp, Mus musculus
cccaccagagacaaggtccactggg

SEQ ID NO: 242423 - DNA, 25 bp, Mus musculus
cccaccagagagtgctgatcccagc

SEQ ID NO: 242424 - DNA, 25 bp, Mus musculus
cccaccagagcccgagacagtgatg

SEQ ID NO: 242425 - DNA, 25 bp, Mus musculus
cccaccagatgcagcatccctggag

SEQ ID NO: 242426 - DNA, 25 bp, Mus musculus
cccaccagatgcaggagagaagatg

SEQ ID NO: 242427 - DNA, 25 bp, Mus musculus
cccaccagatgcagtgttgtggtcc

SEQ ID NO: 242428 - DNA, 25 bp, Mus musculus
cccaccagccaacagaacctgagcc

SEQ ID NO: 242429 - DNA, 25 bp, Mus musculus
cccaccagccaacagtgcaacatag

SEQ ID NO: 242430 - DNA, 25 bp, Mus musculus
cccaccaggaagtacccagcgagcc

SEQ ID NO: 242431 - DNA, 25 bp, Mus musculus
cccaccaggcaaggtactggtgagg

SEQ ID NO: 242432 - DNA, 25 bp, Mus musculus
cccaccaggcagaaggcgacagact

SEQ ID NO: 242433 - DNA, 25 bp, Mus musculus
cccaccatacttcagactagcttcc

SEQ ID NO: 242434 - DNA, 25 bp, Mus musculus
cccaccatacttcaggtcttcagca

SEQ ID NO: 242435 - DNA, 25 bp, Mus musculus
cccaccatcatcagagagcttcatg

SEQ ID NO: 242436 - DNA, 25 bp, Mus musculus
cccaccatcatcaggcaaacaggca

SEQ ID NO: 242437 - DNA, 25 bp, Mus musculus
cccaccatcatcagtgtcccttggg

SEQ ID NO: 242438 - DNA, 25 bp, Mus musculus
cccaccatcatgatttaagcagcat

SEQ ID NO: 242439 - DNA, 25 bp, Mus musculus
cccaccatgaatttgtggccctaat

SEQ ID NO: 242440 - DNA, 25 bp, Mus musculus
cccaccatgatgggaagaaaggaaa

SEQ ID NO: 242441 - DNA, 25 bp, Mus musculus
cccaccattccggagtgagaacaat

SEQ ID NO: 242442 - DNA, 25 bp, Mus musculus
cccacccagctccaggactcccctg

SEQ ID NO: 242443 - DNA, 25 bp, Mus musculus
cccacccagctccagttaacctgtg

SEQ ID NO: 242444 - DNA, 25 bp, Mus musculus
cccacccattggctggcaaggtcag

SEQ ID NO: 242445 - DNA, 25 bp, Mus musculus
cccacccattggctggttttcccat

SEQ ID NO: 242446 - DNA, 25 bp, Mus musculus
cccaccccagggttcctgctggact

SEQ ID NO: 242447 - DNA, 25 bp, Mus musculus
cccaccccagtacggcctctactct

SEQ ID NO: 242448 - DNA, 25 bp, Mus musculus
cccaccccatccagaaaatgaggaa

SEQ ID NO: 242449 - DNA, 25 bp, Mus musculus
cccaccccattcaagaaattggcac

SEQ ID NO: 242450 - DNA, 25 bp, Mus musculus
cccaccccccagcaagagccagagg

SEQ ID NO: 242451 - DNA, 25 bp, Mus musculus
cccaccccccaggacatgacagatg

SEQ ID NO: 242452 - DNA, 25 bp, Mus musculus
cccaccccgctggcaaatctcatgc

SEQ ID NO: 242453 - DNA, 25 bp, Mus musculus
cccacccctcaagcatgaccagtgt

SEQ ID NO: 242454 - DNA, 25 bp, Mus musculus
cccacccctcaagttcacagctccc

SEQ ID NO: 242455 - DNA, 25 bp, Mus musculus
cccacccctcaggtgttacatgtag

SEQ ID NO: 242456 - DNA, 25 bp, Mus musculus
cccacccggacaaggactggttcca

SEQ ID NO: 242457 - DNA, 25 bp, Mus musculus
cccacccggaggagtgccggcattg

SEQ ID NO: 242458 - DNA, 25 bp, Mus musculus
cccaccctctgtggatttcctgaaa

SEQ ID NO: 242459 - DNA, 25 bp, Mus musculus
cccaccctgaaaagtgcaggtgtgc

SEQ ID NO: 242460 - DNA, 25 bp, Mus musculus
cccaccctgtcagaagcccagagga

SEQ ID NO: 242461 - DNA, 25 bp, Mus musculus
cccaccctgtcaggccttgccagca

SEQ ID NO: 242462 - DNA, 25 bp, Mus musculus
cccaccgagcaggtgacattcccac

SEQ ID NO: 242463 - DNA, 25 bp, Mus musculus
cccaccgaggccagggactcagcga

SEQ ID NO: 242464 - DNA, 25 bp, Mus musculus
cccaccgcagcccagggagaaagtg

SEQ ID NO: 242465 - DNA, 25 bp, Mus musculus
cccaccgcaggtatcatccggatat

SEQ ID NO: 242466 - DNA, 25 bp, Mus musculus
cccaccgccaagagaataaagactc

SEQ ID NO: 242467 - DNA, 25 bp, Mus musculus
cccaccgccaagatggattcatggg

SEQ ID NO: 242468 - DNA, 25 bp, Mus musculus
cccaccgccatgcctgtctcctccc

SEQ ID NO: 242469 - DNA, 25 bp, Mus musculus
cccaccgctagtctgaaagaaagac

SEQ ID NO: 242470 - DNA, 25 bp, Mus musculus
cccaccggaactccatggtccccag

SEQ ID NO: 242471 - DNA, 25 bp, Mus musculus
cccaccggctggaggcatcatgaca

SEQ ID NO: 242472 - DNA, 25 bp, Mus musculus
cccaccgggcagatcctgccccgtc

SEQ ID NO: 242473 - DNA, 25 bp, Mus musculus
cccaccggggagaagaactggagaa

SEQ ID NO: 242474 - DNA, 25 bp, Mus musculus
cccaccggggagaagacctgtgtag

SEQ ID NO: 242475 - DNA, 25 bp, Mus musculus
cccaccgtccggcaggggttcatgg

SEQ ID NO: 242476 - DNA, 25 bp, Mus musculus
cccaccgtccggcagtgttctcccg

SEQ ID NO: 242477 - DNA, 25 bp, Mus musculus
cccaccgtgttcggggcgggccaat

SEQ ID NO: 242478 - DNA, 25 bp, Mus musculus
cccacctaagacagcgaaggtgtcc

SEQ ID NO: 242479 - DNA, 25 bp, Mus musculus
cccacctacaaagagaaaaaactgg

SEQ ID NO: 242480 - DNA, 25 bp, Mus musculus
cccacctacaaagaggtcttctggg

SEQ ID NO: 242481 - DNA, 25 bp, Mus musculus
cccacctacagagaggaggcttctc

SEQ ID NO: 242482 - DNA, 25 bp, Mus musculus
cccacctacaggatgtcaatcggga

SEQ ID NO: 242483 - DNA, 25 bp, Mus musculus
cccacctacgggtggcggctgacag

SEQ ID NO: 242484 - DNA, 25 bp, Mus musculus
cccacctactgagctggtctgtaac

SEQ ID NO: 242485 - DNA, 25 bp, Mus musculus
cccacctactgggaccagcgggaag

SEQ ID NO: 242486 - DNA, 25 bp, Mus musculus
cccacctactggggacttctggtcc

SEQ ID NO: 242487 - DNA, 25 bp, Mus musculus
cccacctatccacccatgaacccaa

SEQ ID NO: 242488 - DNA, 25 bp, Mus musculus
cccacctccagggtgaagttgattc

SEQ ID NO: 242489 - DNA, 25 bp, Mus musculus
cccacctgagctggatgtaccctct

SEQ ID NO: 242490 - DNA, 25 bp, Mus musculus
cccacctgatgagccaggtctggac

SEQ ID NO: 242491 - DNA, 25 bp, Mus musculus
cccacctgcaagacagccccggatt

SEQ ID NO: 242492 - DNA, 25 bp, Mus musculus
cccacctgcaagattctggtgctaa

SEQ ID NO: 242493 - DNA, 25 bp, Mus musculus
cccacctgcaagctacagacagccc

SEQ ID NO: 242494 - DNA, 25 bp, Mus musculus
cccacctgcaagtctacagagagcc

SEQ ID NO: 242495 - DNA, 25 bp, Mus musculus
cccacctgccagacgcacagccgag

SEQ ID NO: 242496 - DNA, 25 bp, Mus musculus
cccacctggacaggacaatgtatct

SEQ ID NO: 242497 - DNA, 25 bp, Mus musculus
cccacctggagctacattgcctccc

SEQ ID NO: 242498 - DNA, 25 bp, Mus musculus
cccaccttctgaagattccgagagg

SEQ ID NO: 242499 - DNA, 25 bp, Mus musculus
cccaccttctgtcagacatgtgtaa

SEQ ID NO: 242500 - DNA, 25 bp, Mus musculus
cccaccttctgtcagctggcatgtg

SEQ ID NO: 242501 - DNA, 25 bp, Mus musculus
cccaccttctgtcaggtccccctgg

SEQ ID NO: 242502 - DNA, 25 bp, Mus musculus
cccaccttgaggcctttcttccagg

SEQ ID NO: 242503 - DNA, 25 bp, Mus musculus
cccaccttgagggaagtaaccagga

SEQ ID NO: 242504 - DNA, 25 bp, Mus musculus
cccaccttgagggtcctgagtcccc

SEQ ID NO: 242505 - DNA, 25 bp, Mus musculus
cccaccttgatcagagtattgttac

SEQ ID NO: 242506 - DNA, 25 bp, Mus musculus
cccaccttgccaggttctgccttag

SEQ ID NO: 242507 - DNA, 25 bp, Mus musculus
cccacctttgagatgacagagacac

SEQ ID NO: 242508 - DNA, 25 bp, Mus musculus
cccacctttgagtgactgccaggat

SEQ ID NO: 242509 - DNA, 25 bp, Mus musculus
cccacctttggaatgactattccaa

SEQ ID NO: 242510 - DNA, 25 bp, Mus musculus
cccacgaaatggcaaatcccaaatg

SEQ ID NO: 242511 - DNA, 25 bp, Mus musculus
cccacgaactgggtgactttgccat

SEQ ID NO: 242512 - DNA, 25 bp, Mus musculus
cccacgaactgggtgcagccctggg

SEQ ID NO: 242513 - DNA, 25 bp, Mus musculus
cccacgaaggatcttaccaatcctg

SEQ ID NO: 242514 - DNA, 25 bp, Mus musculus
cccacgaaggatcttttttgctcca

SEQ ID NO: 242515 - DNA, 25 bp, Mus musculus
cccacgactgcactgggccctgctg

SEQ ID NO: 242516 - DNA, 25 bp, Mus musculus
cccacgagtgccaaaggtgtgactg

SEQ ID NO: 242517 - DNA, 25 bp, Mus musculus
cccacgcaagatggctgccagcaac

SEQ ID NO: 242518 - DNA, 25 bp, Mus musculus
cccacgcacgaaaaacactctgttt

SEQ ID NO: 242519 - DNA, 25 bp, Mus musculus
cccacgcagagggtctggagacatg

SEQ ID NO: 242520 - DNA, 25 bp, Mus musculus
cccacgcaggatcatgtgttcaaca

SEQ ID NO: 242521 - DNA, 25 bp, Mus musculus
cccacgccaggattacatcttctac

SEQ ID NO: 242522 - DNA, 25 bp, Mus musculus
cccacgcctggcctctgccttcggg

SEQ ID NO: 242523 - DNA, 25 bp, Mus musculus
cccacgcgcagcaacacctccagaa

SEQ ID NO: 242524 - DNA, 25 bp, Mus musculus
cccacgcgcagcgctgtgtagttct

SEQ ID NO: 242525 - DNA, 25 bp, Mus musculus
cccacgcgtcagaggtccctctgtc

SEQ ID NO: 242526 - DNA, 25 bp, Mus musculus
cccacgctaagatgcccctagacct

SEQ ID NO: 242527 - DNA, 25 bp, Mus musculus
cccacgctccaggagaggcgggaga

SEQ ID NO: 242528 - DNA, 25 bp, Mus musculus
cccacgctgaagcaggcttccagcc

SEQ ID NO: 242529 - DNA, 25 bp, Mus musculus
cccacgctgaagcaggtcataaagc

SEQ ID NO: 242530 - DNA, 25 bp, Mus musculus
cccacgctgcctcagcaagccccgc

SEQ ID NO: 242531 - DNA, 25 bp, Mus musculus
cccacggaactacagggtccaactg

SEQ ID NO: 242532 - DNA, 25 bp, Mus musculus
cccacggacgaccatgacacccgaa

SEQ ID NO: 242533 - DNA, 25 bp, Mus musculus
cccacggagctcgtaccctacgggc

SEQ ID NO: 242534 - DNA, 25 bp, Mus musculus
cccacggcatcacaaggccatcgcc

SEQ ID NO: 242535 - DNA, 25 bp, Mus musculus
cccacggcatcacactatggagtgt

SEQ ID NO: 242536 - DNA, 25 bp, Mus musculus
cccacggcctctggactgccatcag

SEQ ID NO: 242537 - DNA, 25 bp, Mus musculus
cccacggcctctggtgtttgcagag

SEQ ID NO: 242538 - DNA, 25 bp, Mus musculus
cccacggcctggaggaggacagtgg

SEQ ID NO: 242539 - DNA, 25 bp, Mus musculus
cccacggcctggaggttgcagagga

SEQ ID NO: 242540 - DNA, 25 bp, Mus musculus
cccacggctccaaggatgccaacaa

SEQ ID NO: 242541 - DNA, 25 bp, Mus musculus
cccacggctgctgacctcctgcaga

SEQ ID NO: 242542 - DNA, 25 bp, Mus musculus
cccacggctggggactccttttcac

SEQ ID NO: 242543 - DNA, 25 bp, Mus musculus
cccacggtcctgaggtccacctcca

SEQ ID NO: 242544 - DNA, 25 bp, Mus musculus
cccacgtacctcaggctcatgtaca

SEQ ID NO: 242545 - DNA, 25 bp, Mus musculus
cccacgtacctcagtacaagcccac

SEQ ID NO: 242546 - DNA, 25 bp, Mus musculus
cccacgtacctcagttctggctcaa

SEQ ID NO: 242547 - DNA, 25 bp, Mus musculus
cccacgtatgcaggctctgcctggt

SEQ ID NO: 242548 - DNA, 25 bp, Mus musculus
cccacgtcaccctggtcttcctcct

SEQ ID NO: 242549 - DNA, 25 bp, Mus musculus
cccacgtccgtcaggtatttgtcaa

SEQ ID NO: 242550 - DNA, 25 bp, Mus musculus
cccacgtgatggagtatcccggcaa

SEQ ID NO: 242551 - DNA, 25 bp, Mus musculus
cccacgtgctcctggcccagaatcc

SEQ ID NO: 242552 - DNA, 25 bp, Mus musculus
cccacgtgtgcagggtcctgtgggc

SEQ ID NO: 242553 - DNA, 25 bp, Mus musculus
cccacgttgctctggtcgaatggta

SEQ ID NO: 242554 - DNA, 25 bp, Mus musculus
cccacgttgggatctgaaccaatga

SEQ ID NO: 242555 - DNA, 25 bp, Mus musculus
cccacgttttctcctcagagctgcg

SEQ ID NO: 242556 - DNA, 25 bp, Mus musculus
cccactaatgtcgaaagagatgaca

SEQ ID NO: 242557 - DNA, 25 bp, Mus musculus
cccactaatgtcggcacaccattcc

SEQ ID NO: 242558 - DNA, 25 bp, Mus musculus
cccactagacgaaggaaacagcaag

SEQ ID NO: 242559 - DNA, 25 bp, Mus musculus
cccactagagtgcggccaaggattc

SEQ ID NO: 242560 - DNA, 25 bp, Mus musculus
cccactatgctgctgtgtgctgctc

SEQ ID NO: 242561 - DNA, 25 bp, Mus musculus
cccactattggcttaagtttgctgt

SEQ ID NO: 242562 - DNA, 25 bp, Mus musculus
cccactattggctttggaccttgaa

SEQ ID NO: 242563 - DNA, 25 bp, Mus musculus
cccactattggggcatctttcatga

SEQ ID NO: 242564 - DNA, 25 bp, Mus musculus
cccactcatgttactgggcctggtg

SEQ ID NO: 242565 - DNA, 25 bp, Mus musculus
cccactccaggatcttttccccagg

SEQ ID NO: 242566 - DNA, 25 bp, Mus musculus
cccactccaggcacactggcaacct

SEQ ID NO: 242567 - DNA, 25 bp, Mus musculus
cccactccaggcagcttcttcggct

SEQ ID NO: 242568 - DNA, 25 bp, Mus musculus
cccactccccagagcctcaagtcag

SEQ ID NO: 242569 - DNA, 25 bp, Mus musculus
cccactccggcggccccgcaatctg

SEQ ID NO: 242570 - DNA, 25 bp, Mus musculus
cccactctacagcttggccagcaaa

SEQ ID NO: 242571 - DNA, 25 bp, Mus musculus
cccactctacaggttcacctggtca

SEQ ID NO: 242572 - DNA, 25 bp, Mus musculus
cccactctcctgaacttccaggtcc

SEQ ID NO: 242573 - DNA, 25 bp, Mus musculus
cccactctcctgggctgcaactgga

SEQ ID NO: 242574 - DNA, 25 bp, Mus musculus
cccactctcctggtcctgagtcaga

SEQ ID NO: 242575 - DNA, 25 bp, Mus musculus
cccactctgaggagaagaattgagc

SEQ ID NO: 242576 - DNA, 25 bp, Mus musculus
cccactctgaggtccagagttcaaa

SEQ ID NO: 242577 - DNA, 25 bp, Mus musculus
cccactctgcaaagtgacccagact

SEQ ID NO: 242578 - DNA, 25 bp, Mus musculus
cccactctgcaaagtggcctatgag

SEQ ID NO: 242579 - DNA, 25 bp, Mus musculus
cccactctggagccccatgtggaac

SEQ ID NO: 242580 - DNA, 25 bp, Mus musculus
cccactcttcagttctgagaagaag

SEQ ID NO: 242581 - DNA, 25 bp, Mus musculus
cccactgaagatgatgcttctgtga

SEQ ID NO: 242582 - DNA, 25 bp, Mus musculus
cccactgaagatggactggaaacat

SEQ ID NO: 242583 - DNA, 25 bp, Mus musculus
cccactgacagaaacaaataaaacc

SEQ ID NO: 242584 - DNA, 25 bp, Mus musculus
cccactgacagaaaccgtaatcctc

SEQ ID NO: 242585 - DNA, 25 bp, Mus musculus
cccactgacccagactctcaggtgg

SEQ ID NO: 242586 - DNA, 25 bp, Mus musculus
cccactgatgacactttcatggtgg

SEQ ID NO: 242587 - DNA, 25 bp, Mus musculus
cccactgcaatttgaagagcttgtc

SEQ ID NO: 242588 - DNA, 25 bp, Mus musculus
cccactgcacagcgaccagcagcca

SEQ ID NO: 242589 - DNA, 25 bp, Mus musculus
cccactgcatcaacacaaacttgac

SEQ ID NO: 242590 - DNA, 25 bp, Mus musculus
cccactgccagacccaggcaccccg

SEQ ID NO: 242591 - DNA, 25 bp, Mus musculus
cccactgccatgagagctgtttgac

SEQ ID NO: 242592 - DNA, 25 bp, Mus musculus
cccactgccatgtcccagtatgagg

SEQ ID NO: 242593 - DNA, 25 bp, Mus musculus
cccactgccggatcctaataactat

SEQ ID NO: 242594 - DNA, 25 bp, Mus musculus
cccactgcgctccaggtgccacatc

SEQ ID NO: 242595 - DNA, 25 bp, Mus musculus
cccactgctgaggcggacaaatcag

SEQ ID NO: 242596 - DNA, 25 bp, Mus musculus
cccactggagagaccactgctattt

SEQ ID NO: 242597 - DNA, 25 bp, Mus musculus
cccactggagcagctaaatgagatg

SEQ ID NO: 242598 - DNA, 25 bp, Mus musculus
cccactggcctcttcaggtggagcc

SEQ ID NO: 242599 - DNA, 25 bp, Mus musculus
cccactggctttcagggacttcctg

SEQ ID NO: 242600 - DNA, 25 bp, Mus musculus
cccactggggaaaagggaaagcttg

SEQ ID NO: 242601 - DNA, 25 bp, Mus musculus
cccactgtaaggcagtggaactcac

SEQ ID NO: 242602 - DNA, 25 bp, Mus musculus
cccactgtacaacatcagccatgca

SEQ ID NO: 242603 - DNA, 25 bp, Mus musculus
cccactgtacaacttgactggtctg

SEQ ID NO: 242604 - DNA, 25 bp, Mus musculus
cccactgtcaatatgagaagaacaa

SEQ ID NO: 242605 - DNA, 25 bp, Mus musculus
cccactgtcaatatgatataaatga

SEQ ID NO: 242606 - DNA, 25 bp, Mus musculus
cccactgtcgacccgacaaaactta

SEQ ID NO: 242607 - DNA, 25 bp, Mus musculus
cccactgtcgacccggaggaggagg

SEQ ID NO: 242608 - DNA, 25 bp, Mus musculus
cccactgtgctaagaggtccagcat

SEQ ID NO: 242609 - DNA, 25 bp, Mus musculus
cccactgtgctaagtgacattgacc

SEQ ID NO: 242610 - DNA, 25 bp, Mus musculus
cccactgtggaaggaagtttggcac

SEQ ID NO: 242611 - DNA, 25 bp, Mus musculus
cccactgtgttgagcacatcgagtc

SEQ ID NO: 242612 - DNA, 25 bp, Mus musculus
cccactgtgttgaggtcctgagttc

SEQ ID NO: 242613 - DNA, 25 bp, Mus musculus
cccacttacacaggccgccccggga

SEQ ID NO: 242614 - DNA, 25 bp, Mus musculus
cccacttactggtgcccggcgcccc

SEQ ID NO: 242615 - DNA, 25 bp, Mus musculus
cccacttcagaaggcccgaaaggag

SEQ ID NO: 242616 - DNA, 25 bp, Mus musculus
cccacttcagtgtgtagaaggcccg

SEQ ID NO: 242617 - DNA, 25 bp, Mus musculus
cccacttctcttagagtgtggggcc

SEQ ID NO: 242618 - DNA, 25 bp, Mus musculus
cccacttctgggaggcctggccttg

SEQ ID NO: 242619 - DNA, 25 bp, Mus musculus
cccacttcttctcagaaaagaggcc

SEQ ID NO: 242620 - DNA, 25 bp, Mus musculus
cccacttcttctcagataaggatga

SEQ ID NO: 242621 - DNA, 25 bp, Mus musculus
cccacttgctcagccttcctgatca

SEQ ID NO: 242622 - DNA, 25 bp, Mus musculus
cccactttcagagcaccccccggcc

SEQ ID NO: 242623 - DNA, 25 bp, Mus musculus
cccactttcagagccctccaactcc

SEQ ID NO: 242624 - DNA, 25 bp, Mus musculus
cccactttcataagattcggctcct

SEQ ID NO: 242625 - DNA, 25 bp, Mus musculus
cccagaaaagaaggtctctggtaag

SEQ ID NO: 242626 - DNA, 25 bp, Mus musculus
cccagaaaagcggtttccaacttgg

SEQ ID NO: 242627 - DNA, 25 bp, Mus musculus
cccagaaaagcttccgtagtgtgtt

SEQ ID NO: 242628 - DNA, 25 bp, Mus musculus
cccagaaaatgaacaatcacttttt

SEQ ID NO: 242629 - DNA, 25 bp, Mus musculus
cccagaaaatttcaggccctcagta

SEQ ID NO: 242630 - DNA, 25 bp, Mus musculus
cccagaaacaagaagctcaggcgaa

SEQ ID NO: 242631 - DNA, 25 bp, Mus musculus
cccagaaacttcaggaggagttaga

SEQ ID NO: 242632 - DNA, 25 bp, Mus musculus
cccagaaagaagagaggagaagggg

SEQ ID NO: 242633 - DNA, 25 bp, Mus musculus
cccagaaagtgcttctctccttggt

SEQ ID NO: 242634 - DNA, 25 bp, Mus musculus
cccagaaagtggtcacgcccgggtc

SEQ ID NO: 242635 - DNA, 25 bp, Mus musculus
cccagaaattccaaggtccccctgg

SEQ ID NO: 242636 - DNA, 25 bp, Mus musculus
cccagaaattccaaggtgtgagact

SEQ ID NO: 242637 - DNA, 25 bp, Mus musculus
cccagaaattgaagagaaacttcat

SEQ ID NO: 242638 - DNA, 25 bp, Mus musculus
cccagaacaagactgagaatcagag

SEQ ID NO: 242639 - DNA, 25 bp, Mus musculus
cccagaacaagagctgaggctgcag

SEQ ID NO: 242640 - DNA, 25 bp, Mus musculus
cccagaacaagattactactcaact

SEQ ID NO: 242641 - DNA, 25 bp, Mus musculus
cccagaacacgagcccaagatgatt

SEQ ID NO: 242642 - DNA, 25 bp, Mus musculus
cccagaacagatcgggaagctgcat

SEQ ID NO: 242643 - DNA, 25 bp, Mus musculus
cccagaaccaggccaagaaaggaga

SEQ ID NO: 242644 - DNA, 25 bp, Mus musculus
cccagaaccaggcccctaatcaagg

SEQ ID NO: 242645 - DNA, 25 bp, Mus musculus
cccagaaccagggcaaaaaggcaga

SEQ ID NO: 242646 - DNA, 25 bp, Mus musculus
cccagaacgatgtggaacagggaaa

SEQ ID NO: 242647 - DNA, 25 bp, Mus musculus
cccagaacgtcaaggcaatccttag

SEQ ID NO: 242648 - DNA, 25 bp, Mus musculus
cccagaacgtcaagggtgagtcagc

SEQ ID NO: 242649 - DNA, 25 bp, Mus musculus
cccagaactaaagaatgaagtctta

SEQ ID NO: 242650 - DNA, 25 bp, Mus musculus
cccagaagaatatgctggaccgctt

SEQ ID NO: 242651 - DNA, 25 bp, Mus musculus
cccagaagaatatggtggcctgggc

SEQ ID NO: 242652 - DNA, 25 bp, Mus musculus
cccagaagaatctgatgccaacgca

SEQ ID NO: 242653 - DNA, 25 bp, Mus musculus
cccagaagacacgaaggcaaccaag

SEQ ID NO: 242654 - DNA, 25 bp, Mus musculus
cccagaagacacggatactgagaac

SEQ ID NO: 242655 - DNA, 25 bp, Mus musculus
cccagaagactgcgctgagtggacc

SEQ ID NO: 242656 - DNA, 25 bp, Mus musculus
cccagaagaggacactacatgaagg

SEQ ID NO: 242657 - DNA, 25 bp, Mus musculus
cccagaagagggctacaggggaaga

SEQ ID NO: 242658 - DNA, 25 bp, Mus musculus
cccagaagagttctcttccttcatc

SEQ ID NO: 242659 - DNA, 25 bp, Mus musculus
cccagaagagtttgtggcagctgga

SEQ ID NO: 242660 - DNA, 25 bp, Mus musculus
cccagaagatcgtgattttaaaaat

SEQ ID NO: 242661 - DNA, 25 bp, Mus musculus
cccagaagcaagacgcgggcgatcc

SEQ ID NO: 242662 - DNA, 25 bp, Mus musculus
cccagaagcaaggggtggatgagag

SEQ ID NO: 242663 - DNA, 25 bp, Mus musculus
cccagaagcacagcaagaaggccgg

SEQ ID NO: 242664 - DNA, 25 bp, Mus musculus
cccagaagcagcccactgagtctct

SEQ ID NO: 242665 - DNA, 25 bp, Mus musculus
cccagaagcaggtactctatctaca

SEQ ID NO: 242666 - DNA, 25 bp, Mus musculus
cccagaagcagtaccccaccccagg

SEQ ID NO: 242667 - DNA, 25 bp, Mus musculus
cccagaaggagatccttaagctgtt

SEQ ID NO: 242668 - DNA, 25 bp, Mus musculus
cccagaaggaggtcaagatggggtt

SEQ ID NO: 242669 - DNA, 25 bp, Mus musculus
cccagaaggcagagaactgtgccaa

SEQ ID NO: 242670 - DNA, 25 bp, Mus musculus
cccagaagtaagattggcctgttcg

SEQ ID NO: 242671 - DNA, 25 bp, Mus musculus
cccagaagtacgtgggacctcttaa

SEQ ID NO: 242672 - DNA, 25 bp, Mus musculus
cccagaagtcccaggactctcggct

SEQ ID NO: 242673 - DNA, 25 bp, Mus musculus
cccagaagtcccaggttgttcagat

SEQ ID NO: 242674 - DNA, 25 bp, Mus musculus
cccagaataaggaagcggggagtga

SEQ ID NO: 242675 - DNA, 25 bp, Mus musculus
cccagaatactgaacttcgtgtatt

SEQ ID NO: 242676 - DNA, 25 bp, Mus musculus
cccagaatactgacaaaaaaagccc

SEQ ID NO: 242677 - DNA, 25 bp, Mus musculus
cccagaatatgaccccagcagcgac

SEQ ID NO: 242678 - DNA, 25 bp, Mus musculus
cccagaatatgatggaccccagaga

SEQ ID NO: 242679 - DNA, 25 bp, Mus musculus
cccagaatatgcgatgatccctcct

SEQ ID NO: 242680 - DNA, 25 bp, Mus musculus
cccagaatcctgggccaccaattca

SEQ ID NO: 242681 - DNA, 25 bp, Mus musculus
cccagaattaggtatcgaagtgaga

SEQ ID NO: 242682 - DNA, 25 bp, Mus musculus
cccagaatttgaggtctttaagtgg

SEQ ID NO: 242683 - DNA, 25 bp, Mus musculus
cccagacaagggaggatctccttat

SEQ ID NO: 242684 - DNA, 25 bp, Mus musculus
cccagacaagggccctctggtggaa

SEQ ID NO: 242685 - DNA, 25 bp, Mus musculus
cccagacaagtaggtatcgcagggt

SEQ ID NO: 242686 - DNA, 25 bp, Mus musculus
cccagacacaagcattcccactatg

SEQ ID NO: 242687 - DNA, 25 bp, Mus musculus
cccagacacagaaagccatcaccaa

SEQ ID NO: 242688 - DNA, 25 bp, Mus musculus
cccagacaggcctagtgccaaacca

SEQ ID NO: 242689 - DNA, 25 bp, Mus musculus
cccagacagtcaggatggtgtcaca

SEQ ID NO: 242690 - DNA, 25 bp, Mus musculus
cccagacatcagcagcccagtggta

SEQ ID NO: 242691 - DNA, 25 bp, Mus musculus
cccagacatgctgctcatcgggaac

SEQ ID NO: 242692 - DNA, 25 bp, Mus musculus
cccagacattgccagccttggggag

SEQ ID NO: 242693 - DNA, 25 bp, Mus musculus
cccagacattggacggaagaagtcc

SEQ ID NO: 242694 - DNA, 25 bp, Mus musculus
cccagaccagatcatccagcccctc

SEQ ID NO: 242695 - DNA, 25 bp, Mus musculus
cccagaccaggatgaggaggagggt

SEQ ID NO: 242696 - DNA, 25 bp, Mus musculus
cccagacccaagaccatttcccagc

SEQ ID NO: 242697 - DNA, 25 bp, Mus musculus
cccagacccaagactctccctctgc

SEQ ID NO: 242698 - DNA, 25 bp, Mus musculus
cccagaccctgaaggagctgcctct

SEQ ID NO: 242699 - DNA, 25 bp, Mus musculus
cccagaccgatatgacagcctggac

SEQ ID NO: 242700 - DNA, 25 bp, Mus musculus
cccagacgaattggaatcccagtca

SEQ ID NO: 242701 - DNA, 25 bp, Mus musculus
cccagacgcacgaagctctttgtgt

SEQ ID NO: 242702 - DNA, 25 bp, Mus musculus
cccagacgcttgtcggagctccaac

SEQ ID NO: 242703 - DNA, 25 bp, Mus musculus
cccagactgcagactcacgcccact

SEQ ID NO: 242704 - DNA, 25 bp, Mus musculus
cccagacttccacacgcgcacggac

SEQ ID NO: 242705 - DNA, 25 bp, Mus musculus
cccagagaaaaggtggagcttttgt

SEQ ID NO: 242706 - DNA, 25 bp, Mus musculus
cccagagaaaggatgcaagctgttg

SEQ ID NO: 242707 - DNA, 25 bp, Mus musculus
cccagagaacaggctgtgaaaacag

SEQ ID NO: 242708 - DNA, 25 bp, Mus musculus
cccagagaaccaaaggacttcagga

SEQ ID NO: 242709 - DNA, 25 bp, Mus musculus
cccagagaagagtaaactggtgcag

SEQ ID NO: 242710 - DNA, 25 bp, Mus musculus
cccagagaagagtgacagcagctac

SEQ ID NO: 242711 - DNA, 25 bp, Mus musculus
cccagagaagatgtgagcccacctg

SEQ ID NO: 242712 - DNA, 25 bp, Mus musculus
cccagagaaggaagacaccaaatcc

SEQ ID NO: 242713 - DNA, 25 bp, Mus musculus
cccagagaaggaaggaatgtcactg

SEQ ID NO: 242714 - DNA, 25 bp, Mus musculus
cccagagaaggaaggtatttccaaa

SEQ ID NO: 242715 - DNA, 25 bp, Mus musculus
cccagagaaggcccagcttgggaca

SEQ ID NO: 242716 - DNA, 25 bp, Mus musculus
cccagagaagggggaactgattacc

SEQ ID NO: 242717 - DNA, 25 bp, Mus musculus
cccagagaagtccaggaagatgggc

SEQ ID NO: 242718 - DNA, 25 bp, Mus musculus
cccagagacaatctcatttgagatg

SEQ ID NO: 242719 - DNA, 25 bp, Mus musculus
cccagagacaatctcgctgcgaaaa

SEQ ID NO: 242720 - DNA, 25 bp, Mus musculus
cccagagagaggtcatcttccatga

SEQ ID NO: 242721 - DNA, 25 bp, Mus musculus
cccagagagcccaggcttacagtga

SEQ ID NO: 242722 - DNA, 25 bp, Mus musculus
cccagagataagctgacgctgggca

SEQ ID NO: 242723 - DNA, 25 bp, Mus musculus
cccagagatcagaggatgcagcacc

SEQ ID NO: 242724 - DNA, 25 bp, Mus musculus
cccagagatggactccagattccaa

SEQ ID NO: 242725 - DNA, 25 bp, Mus musculus
cccagagatggctagcctatgtctc

SEQ ID NO: 242726 - DNA, 25 bp, Mus musculus
cccagagatggctaggtacaaatgg

SEQ ID NO: 242727 - DNA, 25 bp, Mus musculus
cccagagatgggcacctccgtctgg

SEQ ID NO: 242728 - DNA, 25 bp, Mus musculus
cccagagcaatagactgatgatgct

SEQ ID NO: 242729 - DNA, 25 bp, Mus musculus
cccagagcacaggggcctggatcgt

SEQ ID NO: 242730 - DNA, 25 bp, Mus musculus
cccagagcaggagactctgagttca

SEQ ID NO: 242731 - DNA, 25 bp, Mus musculus
cccagagcagtgctaccatctcagg

SEQ ID NO: 242732 - DNA, 25 bp, Mus musculus
cccagagccaaaaaccaaagatgac

SEQ ID NO: 242733 - DNA, 25 bp, Mus musculus
cccagagccaaaacttccacggaat

SEQ ID NO: 242734 - DNA, 25 bp, Mus musculus
cccagagccagatgaagagctagag

SEQ ID NO: 242735 - DNA, 25 bp, Mus musculus
cccagagccaggctccccagcacag

SEQ ID NO: 242736 - DNA, 25 bp, Mus musculus
cccagagcccggcagatgcccccac

SEQ ID NO: 242737 - DNA, 25 bp, Mus musculus
cccagagcccggcagtcaggagtgg

SEQ ID NO: 242738 - DNA, 25 bp, Mus musculus
cccagagccctttggatccagccat

SEQ ID NO: 242739 - DNA, 25 bp, Mus musculus
cccagagccgacagagcaagtgttt

SEQ ID NO: 242740 - DNA, 25 bp, Mus musculus
cccagagccgacagagcttcgtcca

SEQ ID NO: 242741 - DNA, 25 bp, Mus musculus
cccagagcgaagaggagcatagaaa

SEQ ID NO: 242742 - DNA, 25 bp, Mus musculus
cccagagcgaatggcggaggctggc

SEQ ID NO: 242743 - DNA, 25 bp, Mus musculus
cccagagcggctccggagttgagct

SEQ ID NO: 242744 - DNA, 25 bp, Mus musculus
cccagagcgggagctcttggctaga

SEQ ID NO: 242745 - DNA, 25 bp, Mus musculus
cccagagcggttttgctgtattgcc

SEQ ID NO: 242746 - DNA, 25 bp, Mus musculus
cccagagctaaggttcccgaggaga

SEQ ID NO: 242747 - DNA, 25 bp, Mus musculus
cccagagctagatttgtcaaatcct

SEQ ID NO: 242748 - DNA, 25 bp, Mus musculus
cccagagctcaaggagcgaatctgc

SEQ ID NO: 242749 - DNA, 25 bp, Mus musculus
cccagagctcaaggctaaccctttc

SEQ ID NO: 242750 - DNA, 25 bp, Mus musculus
cccagagctcccagacttcttcgag

SEQ ID NO: 242751 - DNA, 25 bp, Mus musculus
cccagagctccgggctcaagtccac

SEQ ID NO: 242752 - DNA, 25 bp, Mus musculus
cccagagcttagttcacaagccaga

SEQ ID NO: 242753 - DNA, 25 bp, Mus musculus
cccagagcttcaggaggaatttggc

SEQ ID NO: 242754 - DNA, 25 bp, Mus musculus
cccagaggagaaattgtgaaaatgt

SEQ ID NO: 242755 - DNA, 25 bp, Mus musculus
cccagaggagaacagtgccaggtca

SEQ ID NO: 242756 - DNA, 25 bp, Mus musculus
cccagaggagaaggaggagcaggct

SEQ ID NO: 242757 - DNA, 25 bp, Mus musculus
cccagaggagatgctgtctatgtac

SEQ ID NO: 242758 - DNA, 25 bp, Mus musculus
cccagaggagattgagaaggaggag

SEQ ID NO: 242759 - DNA, 25 bp, Mus musculus
cccagaggagcaagatatctgttgc

SEQ ID NO: 242760 - DNA, 25 bp, Mus musculus
cccagaggaggacgatgtcatgatg

SEQ ID NO: 242761 - DNA, 25 bp, Mus musculus
cccagaggagggagtgagctacttt

SEQ ID NO: 242762 - DNA, 25 bp, Mus musculus
cccagaggagtaccctcacctgaag

SEQ ID NO: 242763 - DNA, 25 bp, Mus musculus
cccagaggagttggatattctaaaa

SEQ ID NO: 242764 - DNA, 25 bp, Mus musculus
cccagaggcagactcacctcaaccc

SEQ ID NO: 242765 - DNA, 25 bp, Mus musculus
cccagaggcggacccaccctcagcg

SEQ ID NO: 242766 - DNA, 25 bp, Mus musculus
cccagaggctagtgggtcatcttgg

SEQ ID NO: 242767 - DNA, 25 bp, Mus musculus
cccagaggctagtggttacttacac

SEQ ID NO: 242768 - DNA, 25 bp, Mus musculus
cccagaggctagtggttacttacag

SEQ ID NO: 242769 - DNA, 25 bp, Mus musculus
cccagaggctcagggtccggaccgc

SEQ ID NO: 242770 - DNA, 25 bp, Mus musculus
cccagaggctcctgaggaagaagct

SEQ ID NO: 242771 - DNA, 25 bp, Mus musculus
cccagagggcattcaaagggatggg

SEQ ID NO: 242772 - DNA, 25 bp, Mus musculus
cccagaggtgagcacctgaagatgg

SEQ ID NO: 242773 - DNA, 25 bp, Mus musculus
cccagagtacaaagctcccaggagg

SEQ ID NO: 242774 - DNA, 25 bp, Mus musculus
cccagagtacaaaggcgtggtttct

SEQ ID NO: 242775 - DNA, 25 bp, Mus musculus
cccagagtaggaggtggtgcccatg

SEQ ID NO: 242776 - DNA, 25 bp, Mus musculus
cccagagtatacaggatcccaaact

SEQ ID NO: 242777 - DNA, 25 bp, Mus musculus
cccagagtatacaggtctgtgagtt

SEQ ID NO: 242778 - DNA, 25 bp, Mus musculus
cccagagtcaccaaatgaccccaag

SEQ ID NO: 242779 - DNA, 25 bp, Mus musculus
cccagagtgattgacagggagggtg

SEQ ID NO: 242780 - DNA, 25 bp, Mus musculus
cccagataaccaggtgattgttcag

SEQ ID NO: 242781 - DNA, 25 bp, Mus musculus
cccagatacaccagttgtgacacag

SEQ ID NO: 242782 - DNA, 25 bp, Mus musculus
cccagataccagattaagcttgcaa

SEQ ID NO: 242783 - DNA, 25 bp, Mus musculus
cccagataccattaaaaagagaaat

SEQ ID NO: 242784 - DNA, 25 bp, Mus musculus
cccagatacccagaaatggaactgc

SEQ ID NO: 242785 - DNA, 25 bp, Mus musculus
cccagatatttgcgaacaaggagca

SEQ ID NO: 242786 - DNA, 25 bp, Mus musculus
cccagatcaaatcgtgtccagccct

SEQ ID NO: 242787 - DNA, 25 bp, Mus musculus
cccagatcaactattagacatgttc

SEQ ID NO: 242788 - DNA, 25 bp, Mus musculus
cccagatcccaaacctagagactga

SEQ ID NO: 242789 - DNA, 25 bp, Mus musculus
cccagatcccagaacactgcggccc

SEQ ID NO: 242790 - DNA, 25 bp, Mus musculus
cccagatcccaggcctctatggccc

SEQ ID NO: 242791 - DNA, 25 bp, Mus musculus
cccagatctccatgctggagaacat

SEQ ID NO: 242792 - DNA, 25 bp, Mus musculus
cccagatgcagggctgtagcagtgg

SEQ ID NO: 242793 - DNA, 25 bp, Mus musculus
cccagatgcaggttctgcatttcaa

SEQ ID NO: 242794 - DNA, 25 bp, Mus musculus
cccagatgccaaatagaccttctgg

SEQ ID NO: 242795 - DNA, 25 bp, Mus musculus
cccagatgccaaattggatgaatat

SEQ ID NO: 242796 - DNA, 25 bp, Mus musculus
cccagatgtctgatacatatctgag

SEQ ID NO: 242797 - DNA, 25 bp, Mus musculus
cccagatgtctggagtggatgacca

SEQ ID NO: 242798 - DNA, 25 bp, Mus musculus
cccagatgtgaccagctcattgcct

SEQ ID NO: 242799 - DNA, 25 bp, Mus musculus
cccagatgtgagcaggaggcctctg

SEQ ID NO: 242800 - DNA, 25 bp, Mus musculus
cccagattaaagtcaaataatttag

SEQ ID NO: 242801 - DNA, 25 bp, Mus musculus
cccagattaagtctcctgaaaggtg

SEQ ID NO: 242802 - DNA, 25 bp, Mus musculus
cccagattactaaggacaacataga

SEQ ID NO: 242803 - DNA, 25 bp, Mus musculus
cccagattataagtttccagaactg

SEQ ID NO: 242804 - DNA, 25 bp, Mus musculus
cccagattatgcacaggacctcagt

SEQ ID NO: 242805 - DNA, 25 bp, Mus musculus
cccagattcaaactgccgtggtgag

SEQ ID NO: 242806 - DNA, 25 bp, Mus musculus
cccagattccaggataacataaatg

SEQ ID NO: 242807 - DNA, 25 bp, Mus musculus
cccagattgtaaagcgtgaagacag

SEQ ID NO: 242808 - DNA, 25 bp, Mus musculus
cccagattgtaaagtgatggttcat

SEQ ID NO: 242809 - DNA, 25 bp, Mus musculus
cccagcaaaaatcccaggatcacca

SEQ ID NO: 242810 - DNA, 25 bp, Mus musculus
cccagcaaaaatgggggcagccaca

SEQ ID NO: 242811 - DNA, 25 bp, Mus musculus
cccagcaaaatgtggattttgttga

SEQ ID NO: 242812 - DNA, 25 bp, Mus musculus
cccagcaaaggctaattctggctta

SEQ ID NO: 242813 - DNA, 25 bp, Mus musculus
cccagcaacaaacatctctccaact

SEQ ID NO: 242814 - DNA, 25 bp, Mus musculus
cccagcaacaaagtcacttagaaac

SEQ ID NO: 242815 - DNA, 25 bp, Mus musculus
cccagcaacaattgaaatggcgatt

SEQ ID NO: 242816 - DNA, 25 bp, Mus musculus
cccagcaacactgcaatggctgctg

SEQ ID NO: 242817 - DNA, 25 bp, Mus musculus
cccagcaacatacgtgatggaccaa

SEQ ID NO: 242818 - DNA, 25 bp, Mus musculus
cccagcaaccaggagctggagccct

SEQ ID NO: 242819 - DNA, 25 bp, Mus musculus
cccagcaagccaagctgatctataa

SEQ ID NO: 242820 - DNA, 25 bp, Mus musculus
cccagcaatgccagtgccttcgtgc

SEQ ID NO: 242821 - DNA, 25 bp, Mus musculus
cccagcaatgccagttttcccatga

SEQ ID NO: 242822 - DNA, 25 bp, Mus musculus
cccagcacacagacctatgcttgga

SEQ ID NO: 242823 - DNA, 25 bp, Mus musculus
cccagcacacaggaggtctggcatt

SEQ ID NO: 242824 - DNA, 25 bp, Mus musculus
cccagcacacggcagccggttgcct

SEQ ID NO: 242825 - DNA, 25 bp, Mus musculus
cccagcacacggcagtgactgatca

SEQ ID NO: 242826 - DNA, 25 bp, Mus musculus
cccagcacagcaatcttccctggta

SEQ ID NO: 242827 - DNA, 25 bp, Mus musculus
cccagcacagcatgagaaactctct

SEQ ID NO: 242828 - DNA, 25 bp, Mus musculus
cccagcaccctgaagcaatcccaca

SEQ ID NO: 242829 - DNA, 25 bp, Mus musculus
cccagcaccgatcggtcagcacctg

SEQ ID NO: 242830 - DNA, 25 bp, Mus musculus
cccagcacctgcgcttagatccggc

SEQ ID NO: 242831 - DNA, 25 bp, Mus musculus
cccagcacctgcggaaaatttccct

SEQ ID NO: 242832 - DNA, 25 bp, Mus musculus
cccagcacctggctgacagcctacg

SEQ ID NO: 242833 - DNA, 25 bp, Mus musculus
cccagcacctgtcagaaccaccccc

SEQ ID NO: 242834 - DNA, 25 bp, Mus musculus
cccagcacctgtcagacaccactaa

SEQ ID NO: 242835 - DNA, 25 bp, Mus musculus
cccagcacctgtcagacgagaagaa

SEQ ID NO: 242836 - DNA, 25 bp, Mus musculus
cccagcacctgtccctcactctccc

SEQ ID NO: 242837 - DNA, 25 bp, Mus musculus
cccagcacgccgctttttagaactt

SEQ ID NO: 242838 - DNA, 25 bp, Mus musculus
cccagcactcgggaggcagaggcag

SEQ ID NO: 242839 - DNA, 25 bp, Mus musculus
cccagcactgcatgagaaactctct

SEQ ID NO: 242840 - DNA, 25 bp, Mus musculus
cccagcactggagagaaacttgatg

SEQ ID NO: 242841 - DNA, 25 bp, Mus musculus
cccagcactggggatgtccagctcg

SEQ ID NO: 242842 - DNA, 25 bp, Mus musculus
cccagcactgtgtcgaccccctcac

SEQ ID NO: 242843 - DNA, 25 bp, Mus musculus
cccagcagaaggagtgtcctctccc

SEQ ID NO: 242844 - DNA, 25 bp, Mus musculus
cccagcagaaggcagcaagcgccca

SEQ ID NO: 242845 - DNA, 25 bp, Mus musculus
cccagcagagggtcgaatcaacacc

SEQ ID NO: 242846 - DNA, 25 bp, Mus musculus
cccagcagcaagaaggtgacgggcc

SEQ ID NO: 242847 - DNA, 25 bp, Mus musculus
cccagcagcaagtgggcagaagttc

SEQ ID NO: 242848 - DNA, 25 bp, Mus musculus
cccagcagcattctgcagacctccc

SEQ ID NO: 242849 - DNA, 25 bp, Mus musculus
cccagcagctacattttcttaaaac

SEQ ID NO: 242850 - DNA, 25 bp, Mus musculus
cccagcagctctactgacagtcttt

SEQ ID NO: 242851 - DNA, 25 bp, Mus musculus
cccagcaggactcggatgaggccat

SEQ ID NO: 242852 - DNA, 25 bp, Mus musculus
cccagcaggcagctgccagaccctc

SEQ ID NO: 242853 - DNA, 25 bp, Mus musculus
cccagcaggccacaggcaatgtgag

SEQ ID NO: 242854 - DNA, 25 bp, Mus musculus
cccagcagtattcctcctgcttcta

SEQ ID NO: 242855 - DNA, 25 bp, Mus musculus
cccagcagtcagggcatctgttatg

SEQ ID NO: 242856 - DNA, 25 bp, Mus musculus
cccagcagtgcccgaattgagagaa

SEQ ID NO: 242857 - DNA, 25 bp, Mus musculus
cccagcagtggataaaatattttga

SEQ ID NO: 242858 - DNA, 25 bp, Mus musculus
cccagcatacgggcaccttgttgtg

SEQ ID NO: 242859 - DNA, 25 bp, Mus musculus
cccagcatagccccttcacagaatt

SEQ ID NO: 242860 - DNA, 25 bp, Mus musculus
cccagcatccacgcacatgaggaag

SEQ ID NO: 242861 - DNA, 25 bp, Mus musculus
cccagcatcgcaaggaaactcattt

SEQ ID NO: 242862 - DNA, 25 bp, Mus musculus
cccagcatcgcaaggcctctgcagg

SEQ ID NO: 242863 - DNA, 25 bp, Mus musculus
cccagcatcgcaagggtactggcgg

SEQ ID NO: 242864 - DNA, 25 bp, Mus musculus
cccagcatgagtccgcagagtcctt

SEQ ID NO: 242865 - DNA, 25 bp, Mus musculus
cccagcatgcactaggaggaatttg

SEQ ID NO: 242866 - DNA, 25 bp, Mus musculus
cccagcatgtccagctgcccgagag

SEQ ID NO: 242867 - DNA, 25 bp, Mus musculus
cccagcattcagaagatgacttaca

SEQ ID NO: 242868 - DNA, 25 bp, Mus musculus
cccagcatttctcaaaaactgttct

SEQ ID NO: 242869 - DNA, 25 bp, Mus musculus
cccagcatttctcaaatcatctgaa

SEQ ID NO: 242870 - DNA, 25 bp, Mus musculus
cccagcatttgggggagagcacggt

SEQ ID NO: 242871 - DNA, 25 bp, Mus musculus
cccagccaaagccctggactatttg

SEQ ID NO: 242872 - DNA, 25 bp, Mus musculus
cccagccacagatgaacgagaccgt

SEQ ID NO: 242873 - DNA, 25 bp, Mus musculus
cccagccacgagcctcccaagctga

SEQ ID NO: 242874 - DNA, 25 bp, Mus musculus
cccagccactccagctcccggcaac

SEQ ID NO: 242875 - DNA, 25 bp, Mus musculus
cccagccaggaatgccatttatgtc

SEQ ID NO: 242876 - DNA, 25 bp, Mus musculus
cccagccaggagagaatctgggagc

SEQ ID NO: 242877 - DNA, 25 bp, Mus musculus
cccagccaggagctatcctctgaac

SEQ ID NO: 242878 - DNA, 25 bp, Mus musculus
cccagccatcccccgcttgaaagat

SEQ ID NO: 242879 - DNA, 25 bp, Mus musculus
cccagccatgcctatggaggccata

SEQ ID NO: 242880 - DNA, 25 bp, Mus musculus
cccagccatgctatcccaatagaaa

SEQ ID NO: 242881 - DNA, 25 bp, Mus musculus
cccagcccaagttccaaagaacatt

SEQ ID NO: 242882 - DNA, 25 bp, Mus musculus
cccagcccagaaaagcggtttccaa

SEQ ID NO: 242883 - DNA, 25 bp, Mus musculus
cccagcccagaaaagcttccgtagt

SEQ ID NO: 242884 - DNA, 25 bp, Mus musculus
cccagcccagaacaagcctgccatc

SEQ ID NO: 242885 - DNA, 25 bp, Mus musculus
cccagcccagaagtaccattcccgg

SEQ ID NO: 242886 - DNA, 25 bp, Mus musculus
cccagcccagagatacattgttgca

SEQ ID NO: 242887 - DNA, 25 bp, Mus musculus
cccagcccaggtccctgtggcccct

SEQ ID NO: 242888 - DNA, 25 bp, Mus musculus
cccagcccaggtgaggaattttaaa

SEQ ID NO: 242889 - DNA, 25 bp, Mus musculus
cccagcccaggttccgagtccgagg

SEQ ID NO: 242890 - DNA, 25 bp, Mus musculus
cccagccccagcagcctggtagatt

SEQ ID NO: 242891 - DNA, 25 bp, Mus musculus
cccagccccagtccttcaggctccc

SEQ ID NO: 242892 - DNA, 25 bp, Mus musculus
cccagcccctgatacgacccggaca

SEQ ID NO: 242893 - DNA, 25 bp, Mus musculus
cccagcccctggttccacaccctct

SEQ ID NO: 242894 - DNA, 25 bp, Mus musculus
cccagcccctgtcctgcacttcttc

SEQ ID NO: 242895 - DNA, 25 bp, Mus musculus
cccagcccctgtgccgggagcccgt

SEQ ID NO: 242896 - DNA, 25 bp, Mus musculus
cccagccctcacctcctgtctcaca

SEQ ID NO: 242897 - DNA, 25 bp, Mus musculus
cccagccctgagggccatggcggac

SEQ ID NO: 242898 - DNA, 25 bp, Mus musculus
cccagccctgctcctgccatgccct

SEQ ID NO: 242899 - DNA, 25 bp, Mus musculus
cccagccctttaaggcctccagcat

SEQ ID NO: 242900 - DNA, 25 bp, Mus musculus
cccagccgctatggagatggaaacc

SEQ ID NO: 242901 - DNA, 25 bp, Mus musculus
cccagccgctcatgtgggatatgag

SEQ ID NO: 242902 - DNA, 25 bp, Mus musculus
cccagccggagtgcccatgaacggg

SEQ ID NO: 242903 - DNA, 25 bp, Mus musculus
cccagccggagtgttcttttgttca

SEQ ID NO: 242904 - DNA, 25 bp, Mus musculus
cccagccgtgggcagagttctctga

SEQ ID NO: 242905 - DNA, 25 bp, Mus musculus
cccagcctacggttgtctaccggac

SEQ ID NO: 242906 - DNA, 25 bp, Mus musculus
cccagcctacgtggtgaagatggac

SEQ ID NO: 242907 - DNA, 25 bp, Mus musculus
cccagcctagaagagctccgaggtt

SEQ ID NO: 242908 - DNA, 25 bp, Mus musculus
cccagcctagaagagtatgagccca

SEQ ID NO: 242909 - DNA, 25 bp, Mus musculus
cccagcctaggcgaaacctgaccaa

SEQ ID NO: 242910 - DNA, 25 bp, Mus musculus
cccagcctcaagctcccagggcttg

SEQ ID NO: 242911 - DNA, 25 bp, Mus musculus
cccagcctcaagggcttgccaacac

SEQ ID NO: 242912 - DNA, 25 bp, Mus musculus
cccagcctcaaggtgagcaaagcaa

SEQ ID NO: 242913 - DNA, 25 bp, Mus musculus
cccagcctcaggtcacgcccgggtc

SEQ ID NO: 242914 - DNA, 25 bp, Mus musculus
cccagcctccaaaagccctgccctt

SEQ ID NO: 242915 - DNA, 25 bp, Mus musculus
cccagcctccacctcctcagtggca

SEQ ID NO: 242916 - DNA, 25 bp, Mus musculus
cccagcctcgtgcccagcagcagga

SEQ ID NO: 242917 - DNA, 25 bp, Mus musculus
cccagcctgacgggaggaaaacttt

SEQ ID NO: 242918 - DNA, 25 bp, Mus musculus
cccagcctgacgtttctcttcagca

SEQ ID NO: 242919 - DNA, 25 bp, Mus musculus
cccagcgaacatgctcactgttggt

SEQ ID NO: 242920 - DNA, 25 bp, Mus musculus
cccagcgaacatggcctcaggagtt

SEQ ID NO: 242921 - DNA, 25 bp, Mus musculus
cccagcgagagggtggtccggtgag

SEQ ID NO: 242922 - DNA, 25 bp, Mus musculus
cccagcgagcagccctgcaactccc

SEQ ID NO: 242923 - DNA, 25 bp, Mus musculus
cccagcgagcgctgcgaagctgggg

SEQ ID NO: 242924 - DNA, 25 bp, Mus musculus
cccagcgaggagagagtgtatatgg

SEQ ID NO: 242925 - DNA, 25 bp, Mus musculus
cccagcgattctgaaggtgaagaga

SEQ ID NO: 242926 - DNA, 25 bp, Mus musculus
cccagcgcaagagcctgttattctc

SEQ ID NO: 242927 - DNA, 25 bp, Mus musculus
cccagcgcagccatggagccccgcg

SEQ ID NO: 242928 - DNA, 25 bp, Mus musculus
cccagcgcagggacagtcacgagga

SEQ ID NO: 242929 - DNA, 25 bp, Mus musculus
cccagcgcagggttaatttctaatg

SEQ ID NO: 242930 - DNA, 25 bp, Mus musculus
cccagcgcctgcaggcttttgaggc

SEQ ID NO: 242931 - DNA, 25 bp, Mus musculus
cccagcgcctgcaggggctccctcc

SEQ ID NO: 242932 - DNA, 25 bp, Mus musculus
cccagcgcgtggcatgaagcactac

SEQ ID NO: 242933 - DNA, 25 bp, Mus musculus
cccagcgcgtgggacgaattcatac

SEQ ID NO: 242934 - DNA, 25 bp, Mus musculus
cccagcgcttcagcaccgcacagtg

SEQ ID NO: 242935 - DNA, 25 bp, Mus musculus
cccagcgcttcagggagcgacaggc

SEQ ID NO: 242936 - DNA, 25 bp, Mus musculus
cccagcgctttggagctgtgtggac

SEQ ID NO: 242937 - DNA, 25 bp, Mus musculus
cccagcgctttggagctgtgtgtgg

SEQ ID NO: 242938 - DNA, 25 bp, Mus musculus
cccagcggactctgggagtctgtcc

SEQ ID NO: 242939 - DNA, 25 bp, Mus musculus
cccagcggaggaggttgtaagcatc

SEQ ID NO: 242940 - DNA, 25 bp, Mus musculus
cccagcggatcctgagagaaggctt

SEQ ID NO: 242941 - DNA, 25 bp, Mus musculus
cccagcggcagagatagctgttgtg

SEQ ID NO: 242942 - DNA, 25 bp, Mus musculus
cccagcggcagcaggaacggagcac

SEQ ID NO: 242943 - DNA, 25 bp, Mus musculus
cccagcggcagcagggccgggagca

SEQ ID NO: 242944 - DNA, 25 bp, Mus musculus
cccagcggcagctgagcagaataag

SEQ ID NO: 242945 - DNA, 25 bp, Mus musculus
cccagcggtaactcgatcccgtact

SEQ ID NO: 242946 - DNA, 25 bp, Mus musculus
cccagcgtggctggtcttgagacca

SEQ ID NO: 242947 - DNA, 25 bp, Mus musculus
cccagctacaagaggaatcattgac

SEQ ID NO: 242948 - DNA, 25 bp, Mus musculus
cccagctacaggtacattactgggc

SEQ ID NO: 242949 - DNA, 25 bp, Mus musculus
cccagctacccccagatccctgcag

SEQ ID NO: 242950 - DNA, 25 bp, Mus musculus
cccagctacccttcctgcacccagg

SEQ ID NO: 242951 - DNA, 25 bp, Mus musculus
cccagctagaggaagcctccattta

SEQ ID NO: 242952 - DNA, 25 bp, Mus musculus
cccagctagaggaaggcagagcatg

SEQ ID NO: 242953 - DNA, 25 bp, Mus musculus
cccagctagccctcctgtaagtaac

SEQ ID NO: 242954 - DNA, 25 bp, Mus musculus
cccagctagctgtgcgcagttcctg

SEQ ID NO: 242955 - DNA, 25 bp, Mus musculus
cccagctcacgagacagggcagggc

SEQ ID NO: 242956 - DNA, 25 bp, Mus musculus
cccagctcacttcttccccgtccct

SEQ ID NO: 242957 - DNA, 25 bp, Mus musculus
cccagctcagcatgaaagcatccct

SEQ ID NO: 242958 - DNA, 25 bp, Mus musculus
cccagctcaggaggaaaactccctc

SEQ ID NO: 242959 - DNA, 25 bp, Mus musculus
cccagctcagtggatctggcgagtg

SEQ ID NO: 242960 - DNA, 25 bp, Mus musculus
cccagctccagccccctgaagacga

SEQ ID NO: 242961 - DNA, 25 bp, Mus musculus
cccagctccaggactcccctgaggc

SEQ ID NO: 242962 - DNA, 25 bp, Mus musculus
cccagctccagtgaggacagcgatg

SEQ ID NO: 242963 - DNA, 25 bp, Mus musculus
cccagctccagttaacctgtggaag

SEQ ID NO: 242964 - DNA, 25 bp, Mus musculus
cccagctcccaacccctccaaggcc

SEQ ID NO: 242965 - DNA, 25 bp, Mus musculus
cccagctcccagctaaatgtggtca

SEQ ID NO: 242966 - DNA, 25 bp, Mus musculus
cccagctcctccgacgtggtgacgt

SEQ ID NO: 242967 - DNA, 25 bp, Mus musculus
cccagctcgagccagacagattccc

SEQ ID NO: 242968 - DNA, 25 bp, Mus musculus
cccagctcgtaaagctcaatgtcga

SEQ ID NO: 242969 - DNA, 25 bp, Mus musculus
cccagctctgccctggattggtagc

SEQ ID NO: 242970 - DNA, 25 bp, Mus musculus
cccagctctggacgctatgctgcga

SEQ ID NO: 242971 - DNA, 25 bp, Mus musculus
cccagctctgggatgggttgaagac

SEQ ID NO: 242972 - DNA, 25 bp, Mus musculus
cccagctctggggagaactctgata

SEQ ID NO: 242973 - DNA, 25 bp, Mus musculus
cccagctctggggagaatgtactgg

SEQ ID NO: 242974 - DNA, 25 bp, Mus musculus
cccagctcttcaggttgatcgcctt

SEQ ID NO: 242975 - DNA, 25 bp, Mus musculus
cccagctgagactggctggtggaca

SEQ ID NO: 242976 - DNA, 25 bp, Mus musculus
cccagctgagcacgttgagccacgt

SEQ ID NO: 242977 - DNA, 25 bp, Mus musculus
cccagctgagcggcagccgccacct

SEQ ID NO: 242978 - DNA, 25 bp, Mus musculus
cccagctgagcggtcaaagcagccg

SEQ ID NO: 242979 - DNA, 25 bp, Mus musculus
cccagctgccagcaggtagatcatg

SEQ ID NO: 242980 - DNA, 25 bp, Mus musculus
cccagctgccagcaggtctccccct

SEQ ID NO: 242981 - DNA, 25 bp, Mus musculus
cccagctgctcccggcaggaaaagg

SEQ ID NO: 242982 - DNA, 25 bp, Mus musculus
cccagctggagaaagattccagttg

SEQ ID NO: 242983 - DNA, 25 bp, Mus musculus
cccagctggagaagctccatttctg

SEQ ID NO: 242984 - DNA, 25 bp, Mus musculus
cccagctggaggtcacctcagcacc

SEQ ID NO: 242985 - DNA, 25 bp, Mus musculus
cccagctgtcccagatgaacgggct

SEQ ID NO: 242986 - DNA, 25 bp, Mus musculus
cccagctgtcccaggggtgactttc

SEQ ID NO: 242987 - DNA, 25 bp, Mus musculus
cccagctgtggggcagttttggcac

SEQ ID NO: 242988 - DNA, 25 bp, Mus musculus
cccagctgtggtagtcaggagttca

SEQ ID NO: 242989 - DNA, 25 bp, Mus musculus
cccagctgtggtattcaggctgaac

SEQ ID NO: 242990 - DNA, 25 bp, Mus musculus
cccagctgttgcagtcttcgcataa

SEQ ID NO: 242991 - DNA, 25 bp, Mus musculus
cccagctgttttaaaaggattgcgg

SEQ ID NO: 242992 - DNA, 25 bp, Mus musculus
cccagctgttttaaagcaaacggtg

SEQ ID NO: 242993 - DNA, 25 bp, Mus musculus
cccagcttcacgctgtccctgaagt

SEQ ID NO: 242994 - DNA, 25 bp, Mus musculus
cccagcttcagctgtttgttcagga

SEQ ID NO: 242995 - DNA, 25 bp, Mus musculus
cccagcttccctcgcaacctcctga

SEQ ID NO: 242996 - DNA, 25 bp, Mus musculus
cccagcttccctcgcggggctgcgg

SEQ ID NO: 242997 - DNA, 25 bp, Mus musculus
cccagcttcgcaggacccaacctcc

SEQ ID NO: 242998 - DNA, 25 bp, Mus musculus
cccagcttcggcttgttttattgtc

SEQ ID NO: 242999 - DNA, 25 bp, Mus musculus
cccagcttcgggtcttttcacctga

SEQ ID NO: 243000 - DNA, 25 bp, Mus musculus
cccagcttgccagcgtttttcgttg

SEQ ID NO: 243001 - DNA, 25 bp, Mus musculus
cccaggaaaccaggaatgacacggg

SEQ ID NO: 243002 - DNA, 25 bp, Mus musculus
cccaggaaagagacatggcaagtgt

SEQ ID NO: 243003 - DNA, 25 bp, Mus musculus
cccaggaaagagcccaagatgattg

SEQ ID NO: 243004 - DNA, 25 bp, Mus musculus
cccaggaaagaggtgcccactcatg

SEQ ID NO: 243005 - DNA, 25 bp, Mus musculus
cccaggaaaggtgattgatgagatt

SEQ ID NO: 243006 - DNA, 25 bp, Mus musculus
cccaggaaagtttctatgttgtcta

SEQ ID NO: 243007 - DNA, 25 bp, Mus musculus
cccaggaacaggtatacaagagact

SEQ ID NO: 243008 - DNA, 25 bp, Mus musculus
cccaggaaccagtaattccacgatg

SEQ ID NO: 243009 - DNA, 25 bp, Mus musculus
cccaggaaccgcgtctcttgcaaaa

SEQ ID NO: 243010 - DNA, 25 bp, Mus musculus
cccaggaagagcctccacctctcct

SEQ ID NO: 243011 - DNA, 25 bp, Mus musculus
cccaggaagaggacatgacagatga

SEQ ID NO: 243012 - DNA, 25 bp, Mus musculus
cccaggaagctggagaaggggtgga

SEQ ID NO: 243013 - DNA, 25 bp, Mus musculus
cccaggaagctggtccagctcagct

SEQ ID NO: 243014 - DNA, 25 bp, Mus musculus
cccaggaatatattccaatgcaagc

SEQ ID NO: 243015 - DNA, 25 bp, Mus musculus
cccaggaatattggcagtgctgtgg

SEQ ID NO: 243016 - DNA, 25 bp, Mus musculus
cccaggaattagtgtcggagctcca

SEQ ID NO: 243017 - DNA, 25 bp, Mus musculus
cccaggacactgccactgcacagcc

SEQ ID NO: 243018 - DNA, 25 bp, Mus musculus
cccaggacagacagctgcagcacga

SEQ ID NO: 243019 - DNA, 25 bp, Mus musculus
cccaggacagagagattgtgacacg

SEQ ID NO: 243020 - DNA, 25 bp, Mus musculus
cccaggacagaggattccctgtctc

SEQ ID NO: 243021 - DNA, 25 bp, Mus musculus
cccaggacagaggcttccccacctc

SEQ ID NO: 243022 - DNA, 25 bp, Mus musculus
cccaggacagcaaggccctcctttt

SEQ ID NO: 243023 - DNA, 25 bp, Mus musculus
cccaggacagctggatcgccggggt

SEQ ID NO: 243024 - DNA, 25 bp, Mus musculus
cccaggaccttgctgcaggcacctt

SEQ ID NO: 243025 - DNA, 25 bp, Mus musculus
cccaggacgagctgaattctttata

SEQ ID NO: 243026 - DNA, 25 bp, Mus musculus
cccaggacgagggcttcatcactgt

SEQ ID NO: 243027 - DNA, 25 bp, Mus musculus
cccaggactggtcaatgtggctacc

SEQ ID NO: 243028 - DNA, 25 bp, Mus musculus
cccaggagaaactgggagctgaaaa

SEQ ID NO: 243029 - DNA, 25 bp, Mus musculus
cccaggagaaagctattacaagcca

SEQ ID NO: 243030 - DNA, 25 bp, Mus musculus
cccaggagacacatcaagttggacc

SEQ ID NO: 243031 - DNA, 25 bp, Mus musculus
cccaggagagaaggatgtgcgggcg

SEQ ID NO: 243032 - DNA, 25 bp, Mus musculus
cccaggagagattccttctgtcact

SEQ ID NO: 243033 - DNA, 25 bp, Mus musculus
cccaggagagcaggtcggcagctct

SEQ ID NO: 243034 - DNA, 25 bp, Mus musculus
cccaggagaggactcttccccccac

SEQ ID NO: 243035 - DNA, 25 bp, Mus musculus
cccaggagagtgagccaaggagatg

SEQ ID NO: 243036 - DNA, 25 bp, Mus musculus
cccaggagagtgaggtgctggtaac

SEQ ID NO: 243037 - DNA, 25 bp, Mus musculus
cccaggagagtttccttctgtcact

SEQ ID NO: 243038 - DNA, 25 bp, Mus musculus
cccaggagatgaagtgataattatg

SEQ ID NO: 243039 - DNA, 25 bp, Mus musculus
cccaggagcaggtgtagctacttca

SEQ ID NO: 243040 - DNA, 25 bp, Mus musculus
cccaggagccagcaggtctattttg

SEQ ID NO: 243041 - DNA, 25 bp, Mus musculus
cccaggagccagcaggtggagcacg

SEQ ID NO: 243042 - DNA, 25 bp, Mus musculus
cccaggagccctgccacattgtcca

SEQ ID NO: 243043 - DNA, 25 bp, Mus musculus
cccaggagccctgtgcttgatgggc

SEQ ID NO: 243044 - DNA, 25 bp, Mus musculus
cccaggagctctcaggtctacgctc

SEQ ID NO: 243045 - DNA, 25 bp, Mus musculus
cccaggagctctgaggtctacgctc

SEQ ID NO: 243046 - DNA, 25 bp, Mus musculus
cccaggagctgctggagtgggaact

SEQ ID NO: 243047 - DNA, 25 bp, Mus musculus
cccaggagctgctgttccaggtgct

SEQ ID NO: 243048 - DNA, 25 bp, Mus musculus
cccaggaggaccctggggtcaagag

SEQ ID NO: 243049 - DNA, 25 bp, Mus musculus
cccaggaggacctggggtcagacag

SEQ ID NO: 243050 - DNA, 25 bp, Mus musculus
cccaggagtgcaagaacctgatcct

SEQ ID NO: 243051 - DNA, 25 bp, Mus musculus
cccaggagtgcaagggctccagcat

SEQ ID NO: 243052 - DNA, 25 bp, Mus musculus
cccaggagtgcagtatctctcctct

SEQ ID NO: 243053 - DNA, 25 bp, Mus musculus
cccaggataaagcgattgtccagga

SEQ ID NO: 243054 - DNA, 25 bp, Mus musculus
cccaggatcagttatgagacttcag

SEQ ID NO: 243055 - DNA, 25 bp, Mus musculus
cccaggatcagttatggcagtaatg

SEQ ID NO: 243056 - DNA, 25 bp, Mus musculus
cccaggatcagttatgtttttattt

SEQ ID NO: 243057 - DNA, 25 bp, Mus musculus
cccaggatgcggggtaccgaatgta

SEQ ID NO: 243058 - DNA, 25 bp, Mus musculus
cccaggatggcgacgatttccagag

SEQ ID NO: 243059 - DNA, 25 bp, Mus musculus
cccaggatgtggctggaccgcttcg

SEQ ID NO: 243060 - DNA, 25 bp, Mus musculus
cccaggattcaagggagccccgggc

SEQ ID NO: 243061 - DNA, 25 bp, Mus musculus
cccaggcaactgcgcagttcctggt

SEQ ID NO: 243062 - DNA, 25 bp, Mus musculus
cccaggcaagcctggaagagttgtg

SEQ ID NO: 243063 - DNA, 25 bp, Mus musculus
cccaggcaagggcagtgtatggggt

SEQ ID NO: 243064 - DNA, 25 bp, Mus musculus
cccaggcaagttctgcctgctgagc

SEQ ID NO: 243065 - DNA, 25 bp, Mus musculus
cccaggcaccagaaacctcatccag

SEQ ID NO: 243066 - DNA, 25 bp, Mus musculus
cccaggcaccagccagtaagtgctc

SEQ ID NO: 243067 - DNA, 25 bp, Mus musculus
cccaggcaccaggttgctccaggac

SEQ ID NO: 243068 - DNA, 25 bp, Mus musculus
cccaggcaccagtgtgtccattgtc

SEQ ID NO: 243069 - DNA, 25 bp, Mus musculus
cccaggcactcagagaatgggacac

SEQ ID NO: 243070 - DNA, 25 bp, Mus musculus
cccaggcactcagtttttcagttct

SEQ ID NO: 243071 - DNA, 25 bp, Mus musculus
cccaggcactcggggtcctgagaag

SEQ ID NO: 243072 - DNA, 25 bp, Mus musculus
cccaggcagcttattgatgtcctcg

SEQ ID NO: 243073 - DNA, 25 bp, Mus musculus
cccaggcataggtcacctccaaggt

SEQ ID NO: 243074 - DNA, 25 bp, Mus musculus
cccaggcatcacagagctctgcagg

SEQ ID NO: 243075 - DNA, 25 bp, Mus musculus
cccaggcatctctcccttctgcatg

SEQ ID NO: 243076 - DNA, 25 bp, Mus musculus
cccaggccaaggaggagtcagaaaa

SEQ ID NO: 243077 - DNA, 25 bp, Mus musculus
cccaggccaccccttaaatgtaggt

SEQ ID NO: 243078 - DNA, 25 bp, Mus musculus
cccaggccaccccttcctgcaaggc

SEQ ID NO: 243079 - DNA, 25 bp, Mus musculus
cccaggccacctcgggcaaggtggc

SEQ ID NO: 243080 - DNA, 25 bp, Mus musculus
cccaggccactgagtcttctggccg

SEQ ID NO: 243081 - DNA, 25 bp, Mus musculus
cccaggccagatgaacgatggaccg

SEQ ID NO: 243082 - DNA, 25 bp, Mus musculus
cccaggccagcaggtgtacagtggg

SEQ ID NO: 243083 - DNA, 25 bp, Mus musculus
cccaggccagcagtgggctctggca

SEQ ID NO: 243084 - DNA, 25 bp, Mus musculus
cccaggcccaaatgtaccgtctaac

SEQ ID NO: 243085 - DNA, 25 bp, Mus musculus
cccaggcccaccctgcaactcccac

SEQ ID NO: 243086 - DNA, 25 bp, Mus musculus
cccaggcccaggaagaaacatgtat

SEQ ID NO: 243087 - DNA, 25 bp, Mus musculus
cccaggcccaggaagaagaatgtcc

SEQ ID NO: 243088 - DNA, 25 bp, Mus musculus
cccaggcccaggcgtgctggtcacc

SEQ ID NO: 243089 - DNA, 25 bp, Mus musculus
cccaggcccaggtgttatctgcagc

SEQ ID NO: 243090 - DNA, 25 bp, Mus musculus
cccaggcccattattgtgatcactc

SEQ ID NO: 243091 - DNA, 25 bp, Mus musculus
cccaggccccacaggtgccaaaggc

SEQ ID NO: 243092 - DNA, 25 bp, Mus musculus
cccaggccccggaaggaaaagcgca

SEQ ID NO: 243093 - DNA, 25 bp, Mus musculus
cccaggccctgaatgaagaagagtc

SEQ ID NO: 243094 - DNA, 25 bp, Mus musculus
cccaggccgggaggcccagatgggg

SEQ ID NO: 243095 - DNA, 25 bp, Mus musculus
cccaggccgtgaatgaccagtgcct

SEQ ID NO: 243096 - DNA, 25 bp, Mus musculus
cccaggccgtggactaaagaccagg

SEQ ID NO: 243097 - DNA, 25 bp, Mus musculus
cccaggcctccagttctcccaggcc

SEQ ID NO: 243098 - DNA, 25 bp, Mus musculus
cccaggcctgcgggtggacaaatcc

SEQ ID NO: 243099 - DNA, 25 bp, Mus musculus
cccaggcctggcttcttcacaaaat

SEQ ID NO: 243100 - DNA, 25 bp, Mus musculus
cccaggccttaaggctgccctgccc

SEQ ID NO: 243101 - DNA, 25 bp, Mus musculus
cccaggccttgggaaaagctgtgtt

SEQ ID NO: 243102 - DNA, 25 bp, Mus musculus
cccaggcgagcgggctaaccatttt

SEQ ID NO: 243103 - DNA, 25 bp, Mus musculus
cccaggcgaggcactgggctccctc

SEQ ID NO: 243104 - DNA, 25 bp, Mus musculus
cccaggcggatggcacccttatcac

SEQ ID NO: 243105 - DNA, 25 bp, Mus musculus
cccaggcggcttctgctgcaggagt

SEQ ID NO: 243106 - DNA, 25 bp, Mus musculus
cccaggcgggatccgggagacacgg

SEQ ID NO: 243107 - DNA, 25 bp, Mus musculus
cccaggcgggtatggtggggctccc

SEQ ID NO: 243108 - DNA, 25 bp, Mus musculus
cccaggcgtagaccccgactgcagg

SEQ ID NO: 243109 - DNA, 25 bp, Mus musculus
cccaggcgtcgggattatcgtggcc

SEQ ID NO: 243110 - DNA, 25 bp, Mus musculus
cccaggcgtggcggacccaggcacc

SEQ ID NO: 243111 - DNA, 25 bp, Mus musculus
cccaggctccaccaaacgtggtcct

SEQ ID NO: 243112 - DNA, 25 bp, Mus musculus
cccaggctccagatgatgagaagct

SEQ ID NO: 243113 - DNA, 25 bp, Mus musculus
cccaggctccagatgctgtggccag

SEQ ID NO: 243114 - DNA, 25 bp, Mus musculus
cccaggctcccactggcctcatgtc

SEQ ID NO: 243115 - DNA, 25 bp, Mus musculus
cccaggctcgggggctgcccctgga

SEQ ID NO: 243116 - DNA, 25 bp, Mus musculus
cccaggctcggggggaaagaggagg

SEQ ID NO: 243117 - DNA, 25 bp, Mus musculus
cccaggctctgtgatcgtggccttc

SEQ ID NO: 243118 - DNA, 25 bp, Mus musculus
cccaggctgagtaccagctccaagt

SEQ ID NO: 243119 - DNA, 25 bp, Mus musculus
cccaggctggcaggaaccacacaga

SEQ ID NO: 243120 - DNA, 25 bp, Mus musculus
cccaggctggcaggtgctcaccgag

SEQ ID NO: 243121 - DNA, 25 bp, Mus musculus
cccaggctggggaagaccttgcact

SEQ ID NO: 243122 - DNA, 25 bp, Mus musculus
cccaggctggtaaaggagagaatga

SEQ ID NO: 243123 - DNA, 25 bp, Mus musculus
cccaggctgtgggtcctcccaggaa

SEQ ID NO: 243124 - DNA, 25 bp, Mus musculus
cccaggctgttcagaaggctgtggg

SEQ ID NO: 243125 - DNA, 25 bp, Mus musculus
cccaggctgttcaggtcctgctctc

SEQ ID NO: 243126 - DNA, 25 bp, Mus musculus
cccaggctttggaggaagtggccag

SEQ ID NO: 243127 - DNA, 25 bp, Mus musculus
cccaggctttggagtaggccagact

SEQ ID NO: 243128 - DNA, 25 bp, Mus musculus
cccagggaaaagttattaaatgcaa

SEQ ID NO: 243129 - DNA, 25 bp, Mus musculus
cccagggaacaaggtcagtgacatc

SEQ ID NO: 243130 - DNA, 25 bp, Mus musculus
cccagggaaggtgctgtgggacggg

SEQ ID NO: 243131 - DNA, 25 bp, Mus musculus
cccagggaagtggctacagatgtct

SEQ ID NO: 243132 - DNA, 25 bp, Mus musculus
cccagggacagctgactttaagacc

SEQ ID NO: 243133 - DNA, 25 bp, Mus musculus
cccagggaccagcctgcactggatg

SEQ ID NO: 243134 - DNA, 25 bp, Mus musculus
cccagggaccagtagaacaacagtt

SEQ ID NO: 243135 - DNA, 25 bp, Mus musculus
cccagggacgaaaggagtctgaggg

SEQ ID NO: 243136 - DNA, 25 bp, Mus musculus
cccagggagagcagcaggaggacag

SEQ ID NO: 243137 - DNA, 25 bp, Mus musculus
cccagggatcccaggtcttcctggc

SEQ ID NO: 243138 - DNA, 25 bp, Mus musculus
cccagggcaaggattctgtacccag

SEQ ID NO: 243139 - DNA, 25 bp, Mus musculus
cccagggcaaggtggctgcctttga

SEQ ID NO: 243140 - DNA, 25 bp, Mus musculus
cccagggcagcagagaatcagctgt

SEQ ID NO: 243141 - DNA, 25 bp, Mus musculus
cccagggcagcccagcaagacgcag

SEQ ID NO: 243142 - DNA, 25 bp, Mus musculus
cccagggccaacaggtgaccgaggc

SEQ ID NO: 243143 - DNA, 25 bp, Mus musculus
cccagggccacaaggtgaccgaggc

SEQ ID NO: 243144 - DNA, 25 bp, Mus musculus
cccagggccggagataatagaatct

SEQ ID NO: 243145 - DNA, 25 bp, Mus musculus
cccagggcctgccagggacatcaca

SEQ ID NO: 243146 - DNA, 25 bp, Mus musculus
cccagggcgcaagtgtgagccactg

SEQ ID NO: 243147 - DNA, 25 bp, Mus musculus
cccaggggaaggctactacatgggc

SEQ ID NO: 243148 - DNA, 25 bp, Mus musculus
cccaggggaatcaaagttgctacaa

SEQ ID NO: 243149 - DNA, 25 bp, Mus musculus
cccaggggagatgtataccaggtgg

SEQ ID NO: 243150 - DNA, 25 bp, Mus musculus
cccaggggcacctggcgaggaggaa

SEQ ID NO: 243151 - DNA, 25 bp, Mus musculus
cccaggggcacctggtctcccttcc

SEQ ID NO: 243152 - DNA, 25 bp, Mus musculus
cccaggggcaggatggtgttgctga

SEQ ID NO: 243153 - DNA, 25 bp, Mus musculus
cccaggggttagtgtggagaggatg

SEQ ID NO: 243154 - DNA, 25 bp, Mus musculus
cccagggtccacctggtgctacagg

SEQ ID NO: 243155 - DNA, 25 bp, Mus musculus
cccagggtcccgcaagaatcaaaag

SEQ ID NO: 243156 - DNA, 25 bp, Mus musculus
cccagggtcctgtttgggcttcctg

SEQ ID NO: 243157 - DNA, 25 bp, Mus musculus
cccagggtggtcaggaaggtctata

SEQ ID NO: 243158 - DNA, 25 bp, Mus musculus
cccagggttacagacagggtttctc

SEQ ID NO: 243159 - DNA, 25 bp, Mus musculus
cccagggttacagatgctctctgat

SEQ ID NO: 243160 - DNA, 25 bp, Mus musculus
cccaggtacaagatcaagtctccag

SEQ ID NO: 243161 - DNA, 25 bp, Mus musculus
cccaggtacagatcatattgatcag

SEQ ID NO: 243162 - DNA, 25 bp, Mus musculus
cccaggtcaaggactatgagaaagc

SEQ ID NO: 243163 - DNA, 25 bp, Mus musculus
cccaggtcaaggagtccatgaagat

SEQ ID NO: 243164 - DNA, 25 bp, Mus musculus
cccaggtcaaggatgataatggggg

SEQ ID NO: 243165 - DNA, 25 bp, Mus musculus
cccaggtcagcaggcgctttgccct

SEQ ID NO: 243166 - DNA, 25 bp, Mus musculus
cccaggtccatggtaccaaccaaaa

SEQ ID NO: 243167 - DNA, 25 bp, Mus musculus
cccaggtcccctctggatcataaag

SEQ ID NO: 243168 - DNA, 25 bp, Mus musculus
cccaggtcgctcaggacatcagcaa

SEQ ID NO: 243169 - DNA, 25 bp, Mus musculus
cccaggtcgctcaggcttgcagatg

SEQ ID NO: 243170 - DNA, 25 bp, Mus musculus
cccaggtcgggaccctggtgactgg

SEQ ID NO: 243171 - DNA, 25 bp, Mus musculus
cccaggtcggtgttttatctgctgt

SEQ ID NO: 243172 - DNA, 25 bp, Mus musculus
cccaggtcttccaggcccaaagggt

SEQ ID NO: 243173 - DNA, 25 bp, Mus musculus
cccaggtgagtcagcagattcacaa

SEQ ID NO: 243174 - DNA, 25 bp, Mus musculus
cccaggtgcaaccagagctgcctgc

SEQ ID NO: 243175 - DNA, 25 bp, Mus musculus
cccaggtgcagcctctaggtcgcca

SEQ ID NO: 243176 - DNA, 25 bp, Mus musculus
cccaggtgctaatggcaatcctgga

SEQ ID NO: 243177 - DNA, 25 bp, Mus musculus
cccaggtggagctgcctctgtacaa

SEQ ID NO: 243178 - DNA, 25 bp, Mus musculus
cccaggttcaggaataagactgtca

SEQ ID NO: 243179 - DNA, 25 bp, Mus musculus
cccaggttctcagagccatcgtggc

SEQ ID NO: 243180 - DNA, 25 bp, Mus musculus
cccaggttggaagagcaattctaca

SEQ ID NO: 243181 - DNA, 25 bp, Mus musculus
cccaggtttccaaggtggcgacaga

SEQ ID NO: 243182 - DNA, 25 bp, Mus musculus
cccagtaaaaaccagaatgacccat

SEQ ID NO: 243183 - DNA, 25 bp, Mus musculus
cccagtaaaaaccagaccgacgtga

SEQ ID NO: 243184 - DNA, 25 bp, Mus musculus
cccagtaacaagaggcttcccgagg

SEQ ID NO: 243185 - DNA, 25 bp, Mus musculus
cccagtaagaaccgggacactcttc

SEQ ID NO: 243186 - DNA, 25 bp, Mus musculus
cccagtaaggaaactctcggtgcca

SEQ ID NO: 243187 - DNA, 25 bp, Mus musculus
cccagtaagggacaagcctacacag

SEQ ID NO: 243188 - DNA, 25 bp, Mus musculus
cccagtaatgtgaagctgcagcctg

SEQ ID NO: 243189 - DNA, 25 bp, Mus musculus
cccagtaatgtgaaggcaaagccca

SEQ ID NO: 243190 - DNA, 25 bp, Mus musculus
cccagtaatttgtactataccaact

SEQ ID NO: 243191 - DNA, 25 bp, Mus musculus
cccagtacaaagcccagcacctcac

SEQ ID NO: 243192 - DNA, 25 bp, Mus musculus
cccagtacaaagctgtcttgatatt

SEQ ID NO: 243193 - DNA, 25 bp, Mus musculus
cccagtacaaaggacaaagccaaag

SEQ ID NO: 243194 - DNA, 25 bp, Mus musculus
cccagtacaaagggaagtgtggtcc

SEQ ID NO: 243195 - DNA, 25 bp, Mus musculus
cccagtacaaaggggaccatggaac

SEQ ID NO: 243196 - DNA, 25 bp, Mus musculus
cccagtacaaaggtgtctcttgctc

SEQ ID NO: 243197 - DNA, 25 bp, Mus musculus
cccagtacaaaggtgtggtatcagt

SEQ ID NO: 243198 - DNA, 25 bp, Mus musculus
cccagtaccaaggacctgtgttaca

SEQ ID NO: 243199 - DNA, 25 bp, Mus musculus
cccagtacttagcactcctacagca

SEQ ID NO: 243200 - DNA, 25 bp, Mus musculus
cccagtacttagcactttatttgca

SEQ ID NO: 243201 - DNA, 25 bp, Mus musculus
cccagtagaaatcgcagcctgcagc

SEQ ID NO: 243202 - DNA, 25 bp, Mus musculus
cccagtagcaagatggactgtaaca

SEQ ID NO: 243203 - DNA, 25 bp, Mus musculus
cccagtatagccaggtcatccacag

SEQ ID NO: 243204 - DNA, 25 bp, Mus musculus
cccagtatttcccaggtgcggggtc

SEQ ID NO: 243205 - DNA, 25 bp, Mus musculus
cccagtcaccgacatgtgagccact

SEQ ID NO: 243206 - DNA, 25 bp, Mus musculus
cccagtcacggaggcctcctctgtc

SEQ ID NO: 243207 - DNA, 25 bp, Mus musculus
cccagtcactgcaggaagtatttgt

SEQ ID NO: 243208 - DNA, 25 bp, Mus musculus
cccagtcactgcttgtctcttactt

SEQ ID NO: 243209 - DNA, 25 bp, Mus musculus
cccagtcagggtctggaggtgactg

SEQ ID NO: 243210 - DNA, 25 bp, Mus musculus
cccagtcatcttgatcgactgcggg

SEQ ID NO: 243211 - DNA, 25 bp, Mus musculus
cccagtccaaaagagtacacacgaa

SEQ ID NO: 243212 - DNA, 25 bp, Mus musculus
cccagtccaccatgctgatggggat

SEQ ID NO: 243213 - DNA, 25 bp, Mus musculus
cccagtccattgaggcgcccttgac

SEQ ID NO: 243214 - DNA, 25 bp, Mus musculus
cccagtccccacgggcactatgaac

SEQ ID NO: 243215 - DNA, 25 bp, Mus musculus
cccagtcccgaagatccgcctccga

SEQ ID NO: 243216 - DNA, 25 bp, Mus musculus
cccagtcctcaggttctaagcgcag

SEQ ID NO: 243217 - DNA, 25 bp, Mus musculus
cccagtcctcctaaggtgatcttag

SEQ ID NO: 243218 - DNA, 25 bp, Mus musculus
cccagtcctcctaagtggagggcag

SEQ ID NO: 243219 - DNA, 25 bp, Mus musculus
cccagtcctgcagagtagagctctg

SEQ ID NO: 243220 - DNA, 25 bp, Mus musculus
cccagtcctgcagccctctctcctt

SEQ ID NO: 243221 - DNA, 25 bp, Mus musculus
cccagtcctgttcagcaccaacacc

SEQ ID NO: 243222 - DNA, 25 bp, Mus musculus
cccagtcctgttcagcaccatcagc

SEQ ID NO: 243223 - DNA, 25 bp, Mus musculus
cccagtctaaaatcgatgtccatcg

SEQ ID NO: 243224 - DNA, 25 bp, Mus musculus
cccagtctaacacagaggagattcc

SEQ ID NO: 243225 - DNA, 25 bp, Mus musculus
cccagtcttcctaaatctgcagaag

SEQ ID NO: 243226 - DNA, 25 bp, Mus musculus
cccagtgaactaggtggccttagac

SEQ ID NO: 243227 - DNA, 25 bp, Mus musculus
cccagtgaagagacatcatgtgacc

SEQ ID NO: 243228 - DNA, 25 bp, Mus musculus
cccagtgaaggtcgcaggcatcctc

SEQ ID NO: 243229 - DNA, 25 bp, Mus musculus
cccagtgacacacgttcagcggtgg

SEQ ID NO: 243230 - DNA, 25 bp, Mus musculus
cccagtgacacaggttcagcggtgg

SEQ ID NO: 243231 - DNA, 25 bp, Mus musculus
cccagtgaccaatgggaacagtcct

SEQ ID NO: 243232 - DNA, 25 bp, Mus musculus
cccagtgacgggtgagcctgcaact

SEQ ID NO: 243233 - DNA, 25 bp, Mus musculus
cccagtgagacagtcatcgctccac

SEQ ID NO: 243234 - DNA, 25 bp, Mus musculus
cccagtgagacagtgggggatcttc

SEQ ID NO: 243235 - DNA, 25 bp, Mus musculus
cccagtgagcacttgcaggtggacc

SEQ ID NO: 243236 - DNA, 25 bp, Mus musculus
cccagtgaggaaaggagggcggaaa

SEQ ID NO: 243237 - DNA, 25 bp, Mus musculus
cccagtgatgatgtttttccctagg

SEQ ID NO: 243238 - DNA, 25 bp, Mus musculus
cccagtgcagattaaggttgaggaa

SEQ ID NO: 243239 - DNA, 25 bp, Mus musculus
cccagtgcagcaggccacgcgggga

SEQ ID NO: 243240 - DNA, 25 bp, Mus musculus
cccagtgcagcgctgtagcatccta

SEQ ID NO: 243241 - DNA, 25 bp, Mus musculus
cccagtgcaggatttactaggtcat

SEQ ID NO: 243242 - DNA, 25 bp, Mus musculus
cccagtgcaggcctgccaacatccc

SEQ ID NO: 243243 - DNA, 25 bp, Mus musculus
cccagtgcaggcctgccactggtga

SEQ ID NO: 243244 - DNA, 25 bp, Mus musculus
cccagtgcagggataacaacaccca

SEQ ID NO: 243245 - DNA, 25 bp, Mus musculus
cccagtgccctgggcaaggccacca

SEQ ID NO: 243246 - DNA, 25 bp, Mus musculus
cccagtgcgactgaagcgaaggctg

SEQ ID NO: 243247 - DNA, 25 bp, Mus musculus
cccagtgctgcacatgatggcatcg

SEQ ID NO: 243248 - DNA, 25 bp, Mus musculus
cccagtgctgggtctcttttaaaaa

SEQ ID NO: 243249 - DNA, 25 bp, Mus musculus
cccagtggaaatcacggttatctgc

SEQ ID NO: 243250 - DNA, 25 bp, Mus musculus
cccagtggcaaaccgggaataattc

SEQ ID NO: 243251 - DNA, 25 bp, Mus musculus
cccagtggcacagatgccctaggtc

SEQ ID NO: 243252 - DNA, 25 bp, Mus musculus
cccagtggcacaggtctccaccgct

SEQ ID NO: 243253 - DNA, 25 bp, Mus musculus
cccagtggtggaagaggagaacttt

SEQ ID NO: 243254 - DNA, 25 bp, Mus musculus
cccagtggtggaagtcgtgttcaag

SEQ ID NO: 243255 - DNA, 25 bp, Mus musculus
cccagtggtggccctgtctctctgg

SEQ ID NO: 243256 - DNA, 25 bp, Mus musculus
cccagtgtatgccacatgagtcttt

SEQ ID NO: 243257 - DNA, 25 bp, Mus musculus
cccagtgtcagtatgtggtccagtg

SEQ ID NO: 243258 - DNA, 25 bp, Mus musculus
cccagtgtctgcgagcccagatgcc

SEQ ID NO: 243259 - DNA, 25 bp, Mus musculus
cccagtgtctgcgatggttgtgagc

SEQ ID NO: 243260 - DNA, 25 bp, Mus musculus
cccagtgttccaaggagaccccctc

SEQ ID NO: 243261 - DNA, 25 bp, Mus musculus
cccagtgttccaaggtttggtgccg

SEQ ID NO: 243262 - DNA, 25 bp, Mus musculus
cccagtgttctggtacccactgtgg

SEQ ID NO: 243263 - DNA, 25 bp, Mus musculus
cccagtgttctggtacgctccggaa

SEQ ID NO: 243264 - DNA, 25 bp, Mus musculus
cccagttcagagttccagggacccc

SEQ ID NO: 243265 - DNA, 25 bp, Mus musculus
cccagttcagctggcatctgacccg

SEQ ID NO: 243266 - DNA, 25 bp, Mus musculus
cccagttcccaggtctttcatagta

SEQ ID NO: 243267 - DNA, 25 bp, Mus musculus
cccagttcctgagcggcatcccaga

SEQ ID NO: 243268 - DNA, 25 bp, Mus musculus
cccagttcctggaccctgtattggg

SEQ ID NO: 243269 - DNA, 25 bp, Mus musculus
cccagttcggcaaagagacttctgg

SEQ ID NO: 243270 - DNA, 25 bp, Mus musculus
cccagttcggcaaaggtgacatttg

SEQ ID NO: 243271 - DNA, 25 bp, Mus musculus
cccagttctcagagccccgtattcg

SEQ ID NO: 243272 - DNA, 25 bp, Mus musculus
cccagttctctgagactcgtctgcc

SEQ ID NO: 243273 - DNA, 25 bp, Mus musculus
cccagttgatggtcacccttccttt

SEQ ID NO: 243274 - DNA, 25 bp, Mus musculus
cccagttgatggttggcagaacgag

SEQ ID NO: 243275 - DNA, 25 bp, Mus musculus
cccagttgtccccaaggtcagcatg

SEQ ID NO: 243276 - DNA, 25 bp, Mus musculus
cccagtttgcaggagcattaagaag

SEQ ID NO: 243277 - DNA, 25 bp, Mus musculus
cccagtttgccactgcgctggaata

SEQ ID NO: 243278 - DNA, 25 bp, Mus musculus
cccagttttcggagtctattgcatc

SEQ ID NO: 243279 - DNA, 25 bp, Mus musculus
cccagttttctcaggaaattgggct

SEQ ID NO: 243280 - DNA, 25 bp, Mus musculus
cccagttttgctgagaatggaatca

SEQ ID NO: 243281 - DNA, 25 bp, Mus musculus
cccataaagcccaaactcccacaat

SEQ ID NO: 243282 - DNA, 25 bp, Mus musculus
cccataaagcccaagtggaacggct

SEQ ID NO: 243283 - DNA, 25 bp, Mus musculus
cccataacaattgaagtcagaagga

SEQ ID NO: 243284 - DNA, 25 bp, Mus musculus
cccatacacaggggtctgtatgaag

SEQ ID NO: 243285 - DNA, 25 bp, Mus musculus
cccataccagatgtgagatccaggg

SEQ ID NO: 243286 - DNA, 25 bp, Mus musculus
cccataccagcgaggggtcccgtag

SEQ ID NO: 243287 - DNA, 25 bp, Mus musculus
cccataccagttgtgagatccaggg

SEQ ID NO: 243288 - DNA, 25 bp, Mus musculus
cccataccgcaagagacagataaat

SEQ ID NO: 243289 - DNA, 25 bp, Mus musculus
cccataccgcaagatcgtctacttc

SEQ ID NO: 243290 - DNA, 25 bp, Mus musculus
cccatacctaaggtggagattctag

SEQ ID NO: 243291 - DNA, 25 bp, Mus musculus
cccatacctgctgagggacccaggg

SEQ ID NO: 243292 - DNA, 25 bp, Mus musculus
cccatacctgctgctccagcacgga

SEQ ID NO: 243293 - DNA, 25 bp, Mus musculus
cccatactcggtccctgaatggcat

SEQ ID NO: 243294 - DNA, 25 bp, Mus musculus
cccatacttcccaagacagcatttt

SEQ ID NO: 243295 - DNA, 25 bp, Mus musculus
cccatagacgagaggctcagagccc

SEQ ID NO: 243296 - DNA, 25 bp, Mus musculus
cccatagcagacaacaacagttctg

SEQ ID NO: 243297 - DNA, 25 bp, Mus musculus
cccatagcaggggaagaagaggtga

SEQ ID NO: 243298 - DNA, 25 bp, Mus musculus
cccatagcaggtattccagcatctt

SEQ ID NO: 243299 - DNA, 25 bp, Mus musculus
cccatagtactttccgttgtgtcca

SEQ ID NO: 243300 - DNA, 25 bp, Mus musculus
cccatagtactttttgcatagtaat

SEQ ID NO: 243301 - DNA, 25 bp, Mus musculus
cccatagtgggccaaagagatgtca

SEQ ID NO: 243302 - DNA, 25 bp, Mus musculus
cccatatacatggtggtacaccatg

SEQ ID NO: 243303 - DNA, 25 bp, Mus musculus
cccatatatgtggggccgagcaata

SEQ ID NO: 243304 - DNA, 25 bp, Mus musculus
cccatatcaagaagccctggctgtc

SEQ ID NO: 243305 - DNA, 25 bp, Mus musculus
cccatatcaagaaggagtttgacaa

SEQ ID NO: 243306 - DNA, 25 bp, Mus musculus
cccatatcaagtttcttacttatca

SEQ ID NO: 243307 - DNA, 25 bp, Mus musculus
cccatatgatacaggtctaccgcag

SEQ ID NO: 243308 - DNA, 25 bp, Mus musculus
cccatatgcagaagttgctctgggc

SEQ ID NO: 243309 - DNA, 25 bp, Mus musculus
cccatatgccaatggctggaagcta

SEQ ID NO: 243310 - DNA, 25 bp, Mus musculus
cccatatggaaaaaggaaatatatg

SEQ ID NO: 243311 - DNA, 25 bp, Mus musculus
cccatatgtgaaggaagaagaaatc

SEQ ID NO: 243312 - DNA, 25 bp, Mus musculus
cccatcaaaattcagattgccttct

SEQ ID NO: 243313 - DNA, 25 bp, Mus musculus
cccatcaatcaggtgaatcccccgg

SEQ ID NO: 243314 - DNA, 25 bp, Mus musculus
cccatcaatcaggtgactgtgacga

SEQ ID NO: 243315 - DNA, 25 bp, Mus musculus
cccatcaccaagaacaagaaaacag

SEQ ID NO: 243316 - DNA, 25 bp, Mus musculus
cccatcaccagccaccatcgagaca

SEQ ID NO: 243317 - DNA, 25 bp, Mus musculus
cccatcaccagccagtgtggggcag

SEQ ID NO: 243318 - DNA, 25 bp, Mus musculus
cccatcacctgagggccaacgaggt

SEQ ID NO: 243319 - DNA, 25 bp, Mus musculus
cccatcactcagggaaaccttagcc

SEQ ID NO: 243320 - DNA, 25 bp, Mus musculus
cccatcactcaggtcgctgttattc

SEQ ID NO: 243321 - DNA, 25 bp, Mus musculus
cccatcactgggaaaaggactgtgt

SEQ ID NO: 243322 - DNA, 25 bp, Mus musculus
cccatcactgggtttggtaaaggct

SEQ ID NO: 243323 - DNA, 25 bp, Mus musculus
cccatcagaacagcgcaagaagaga

SEQ ID NO: 243324 - DNA, 25 bp, Mus musculus
cccatcagaagtcctaggtactggt

SEQ ID NO: 243325 - DNA, 25 bp, Mus musculus
cccatcagaagttttcctgacttct

SEQ ID NO: 243326 - DNA, 25 bp, Mus musculus
cccatcagaccagaagctgaccacc

SEQ ID NO: 243327 - DNA, 25 bp, Mus musculus
cccatcagaccaggccagctgttgc

SEQ ID NO: 243328 - DNA, 25 bp, Mus musculus
cccatcagacggaactggtgtcctt

SEQ ID NO: 243329 - DNA, 25 bp, Mus musculus
cccatcagacggtatcgagtggccc

SEQ ID NO: 243330 - DNA, 25 bp, Mus musculus
cccatcagagagccctctccaggcc

SEQ ID NO: 243331 - DNA, 25 bp, Mus musculus
cccatcagcaagccaccaccacgaa

SEQ ID NO: 243332 - DNA, 25 bp, Mus musculus
cccatcagcaccagggacccagggt

SEQ ID NO: 243333 - DNA, 25 bp, Mus musculus
cccatcagcaccctccagcacggaa

SEQ ID NO: 243334 - DNA, 25 bp, Mus musculus
cccatcagcaccggccccccacttc

SEQ ID NO: 243335 - DNA, 25 bp, Mus musculus
cccatcagccagaccacagatgaca

SEQ ID NO: 243336 - DNA, 25 bp, Mus musculus
cccatcagccgagatgaacctctag

SEQ ID NO: 243337 - DNA, 25 bp, Mus musculus
cccatcaggaggaggagatagaaga

SEQ ID NO: 243338 - DNA, 25 bp, Mus musculus
cccatcatcagtttttccagaggcc

SEQ ID NO: 243339 - DNA, 25 bp, Mus musculus
cccatcatctgcactgctctgagag

SEQ ID NO: 243340 - DNA, 25 bp, Mus musculus
cccatcatgaacggacccaagtgtg

SEQ ID NO: 243341 - DNA, 25 bp, Mus musculus
cccatcatgctggggaaacaactgg

SEQ ID NO: 243342 - DNA, 25 bp, Mus musculus
cccatcatgctgggtggaagtgaga

SEQ ID NO: 243343 - DNA, 25 bp, Mus musculus
cccatcattgcaggctcaaacatac

SEQ ID NO: 243344 - DNA, 25 bp, Mus musculus
cccatcatttgaggctctttcacac

SEQ ID NO: 243345 - DNA, 25 bp, Mus musculus
cccatccaggccaggctgggcagca

SEQ ID NO: 243346 - DNA, 25 bp, Mus musculus
cccatcccagaaccaggcagataaa

SEQ ID NO: 243347 - DNA, 25 bp, Mus musculus
cccatcccctcagctaacaatgaag

SEQ ID NO: 243348 - DNA, 25 bp, Mus musculus
cccatccgacagcccgccggagtcc

SEQ ID NO: 243349 - DNA, 25 bp, Mus musculus
cccatccgccaccaggccaaccata

SEQ ID NO: 243350 - DNA, 25 bp, Mus musculus
cccatccgctgagttcctgagcatg

SEQ ID NO: 243351 - DNA, 25 bp, Mus musculus
cccatccgctgtgctttgacctcga

SEQ ID NO: 243352 - DNA, 25 bp, Mus musculus
cccatcctcacaaaagcacttgcaa

SEQ ID NO: 243353 - DNA, 25 bp, Mus musculus
cccatcctcaggctgcgctacatgg

SEQ ID NO: 243354 - DNA, 25 bp, Mus musculus
cccatcctgaagtttatcccgatgc

SEQ ID NO: 243355 - DNA, 25 bp, Mus musculus
cccatcctggacaggccaaccagga

SEQ ID NO: 243356 - DNA, 25 bp, Mus musculus
cccatcctggacagtctgcacctgt

SEQ ID NO: 243357 - DNA, 25 bp, Mus musculus
cccatcctggagggctcctgtgatg

SEQ ID NO: 243358 - DNA, 25 bp, Mus musculus
cccatcctggagtgtacaactctac

SEQ ID NO: 243359 - DNA, 25 bp, Mus musculus
cccatccttaccctatccagcaatc

SEQ ID NO: 243360 - DNA, 25 bp, Mus musculus
cccatcgacctggctgctgcaagaa

SEQ ID NO: 243361 - DNA, 25 bp, Mus musculus
cccatcgataggcccagcagctgta

SEQ ID NO: 243362 - DNA, 25 bp, Mus musculus
cccatcgataggctcaggtattacc

SEQ ID NO: 243363 - DNA, 25 bp, Mus musculus
cccatcgatagtgtgtgcccttgcc

SEQ ID NO: 243364 - DNA, 25 bp, Mus musculus
cccatcgatcagatgttgctttgtg

SEQ ID NO: 243365 - DNA, 25 bp, Mus musculus
cccatcgatcaggcccaatgatgat

SEQ ID NO: 243366 - DNA, 25 bp, Mus musculus
cccatcgatcaggtcaactttgtag

SEQ ID NO: 243367 - DNA, 25 bp, Mus musculus
cccatcgcaggtgcagaccataatg

SEQ ID NO: 243368 - DNA, 25 bp, Mus musculus
cccatcgggtcgtaggtctcaaaag

SEQ ID NO: 243369 - DNA, 25 bp, Mus musculus
cccatcgtcacggattccacactac

SEQ ID NO: 243370 - DNA, 25 bp, Mus musculus
cccatctaagcagccttcctgcagc

SEQ ID NO: 243371 - DNA, 25 bp, Mus musculus
cccatctaagcaggtggcccgacgg

SEQ ID NO: 243372 - DNA, 25 bp, Mus musculus
cccatctacacagaaccagagcatg

SEQ ID NO: 243373 - DNA, 25 bp, Mus musculus
cccatctacagaggctgatccccgg

SEQ ID NO: 243374 - DNA, 25 bp, Mus musculus
cccatctattcctgaataaacactg

SEQ ID NO: 243375 - DNA, 25 bp, Mus musculus
cccatctcagagatgggctttgctg

SEQ ID NO: 243376 - DNA, 25 bp, Mus musculus
cccatctcagagctctcttccggct

SEQ ID NO: 243377 - DNA, 25 bp, Mus musculus
cccatctcagaggctggtgtttgct

SEQ ID NO: 243378 - DNA, 25 bp, Mus musculus
cccatctcagatcttctgcccaatc

SEQ ID NO: 243379 - DNA, 25 bp, Mus musculus
cccatctcagccagcagaggcctcc

SEQ ID NO: 243380 - DNA, 25 bp, Mus musculus
cccatctcagctccggaaaggccca

SEQ ID NO: 243381 - DNA, 25 bp, Mus musculus
cccatctcaggagcaggcgagcagg

SEQ ID NO: 243382 - DNA, 25 bp, Mus musculus
cccatctcccagactgataatggtc

SEQ ID NO: 243383 - DNA, 25 bp, Mus musculus
cccatctccgatggtggaaccaggg

SEQ ID NO: 243384 - DNA, 25 bp, Mus musculus
cccatctcttttaggatggacgaca

SEQ ID NO: 243385 - DNA, 25 bp, Mus musculus
cccatctgattccagctgaccaggg

SEQ ID NO: 243386 - DNA, 25 bp, Mus musculus
cccatctgcagaaaaatatcgtttg

SEQ ID NO: 243387 - DNA, 25 bp, Mus musculus
cccatctgcagaaagtggaagaaaa

SEQ ID NO: 243388 - DNA, 25 bp, Mus musculus
cccatctgcatcagactccgtgctt

SEQ ID NO: 243389 - DNA, 25 bp, Mus musculus
cccatcttagttcgttgtgatgacg

SEQ ID NO: 243390 - DNA, 25 bp, Mus musculus
cccatcttcaaggtgttcgacgcca

SEQ ID NO: 243391 - DNA, 25 bp, Mus musculus
cccatcttcgtctcctgccgtggat

SEQ ID NO: 243392 - DNA, 25 bp, Mus musculus
cccatctttaaaagatgttcctcct

SEQ ID NO: 243393 - DNA, 25 bp, Mus musculus
cccatctttacatatctacgcctgc

SEQ ID NO: 243394 - DNA, 25 bp, Mus musculus
cccatctttacatctggctgagcat

SEQ ID NO: 243395 - DNA, 25 bp, Mus musculus
cccatctttcgactaagatgcttag

SEQ ID NO: 243396 - DNA, 25 bp, Mus musculus
cccatgaaaaacccgtctcgatact

SEQ ID NO: 243397 - DNA, 25 bp, Mus musculus
cccatgaaaaatttggaaatcggta

SEQ ID NO: 243398 - DNA, 25 bp, Mus musculus
cccatgaaactgcatttctaggtcc

SEQ ID NO: 243399 - DNA, 25 bp, Mus musculus
cccatgaaagaggcgccagccacct

SEQ ID NO: 243400 - DNA, 25 bp, Mus musculus
cccatgaacacagctatcgcggtaa

SEQ ID NO: 243401 - DNA, 25 bp, Mus musculus
cccatgaacacagctttttgccttc

SEQ ID NO: 243402 - DNA, 25 bp, Mus musculus
cccatgaaccgcacttgctagtgtg

SEQ ID NO: 243403 - DNA, 25 bp, Mus musculus
cccatgaagaaaaaagatgttggat

SEQ ID NO: 243404 - DNA, 25 bp, Mus musculus
cccatgaagagtctttgcagtttaa

SEQ ID NO: 243405 - DNA, 25 bp, Mus musculus
cccatgacaagctccaccgcacagc

SEQ ID NO: 243406 - DNA, 25 bp, Mus musculus
cccatgacatcagcagcggacagtt

SEQ ID NO: 243407 - DNA, 25 bp, Mus musculus
cccatgaccaaaggactctgatcac

SEQ ID NO: 243408 - DNA, 25 bp, Mus musculus
cccatgaccatacagatcatgtcat

SEQ ID NO: 243409 - DNA, 25 bp, Mus musculus
cccatgacccagaggcaaaactccc

SEQ ID NO: 243410 - DNA, 25 bp, Mus musculus
cccatgacccaggtatacaagagac

SEQ ID NO: 243411 - DNA, 25 bp, Mus musculus
cccatgactctagccagcagggcct

SEQ ID NO: 243412 - DNA, 25 bp, Mus musculus
cccatgacttttgtacaaacaaatt

SEQ ID NO: 243413 - DNA, 25 bp, Mus musculus
cccatgagaaattgccagtagttat

SEQ ID NO: 243414 - DNA, 25 bp, Mus musculus
cccatgagaagctgcccatggtgct

SEQ ID NO: 243415 - DNA, 25 bp, Mus musculus
cccatgagaggtagctaagtgggac

SEQ ID NO: 243416 - DNA, 25 bp, Mus musculus
cccatgagcagaacctcaggttctc

SEQ ID NO: 243417 - DNA, 25 bp, Mus musculus
cccatgagcagatgaacgaattccg

SEQ ID NO: 243418 - DNA, 25 bp, Mus musculus
cccatgagcagggtgtccctgtata

SEQ ID NO: 243419 - DNA, 25 bp, Mus musculus
cccatgagctagggcacgttctcag

SEQ ID NO: 243420 - DNA, 25 bp, Mus musculus
cccatgatcaccagtgattcaggcc

SEQ ID NO: 243421 - DNA, 25 bp, Mus musculus
cccatgatgaccctatcaaggagag

SEQ ID NO: 243422 - DNA, 25 bp, Mus musculus
cccatgatggcggagtgtctggaaa

SEQ ID NO: 243423 - DNA, 25 bp, Mus musculus
cccatgatgggcctggtttggagtt

SEQ ID NO: 243424 - DNA, 25 bp, Mus musculus
cccatgattaatgaattagtagaag

SEQ ID NO: 243425 - DNA, 25 bp, Mus musculus
cccatgcaaacagaacatgttggag

SEQ ID NO: 243426 - DNA, 25 bp, Mus musculus
cccatgcaccaaatgactcgaccga

SEQ ID NO: 243427 - DNA, 25 bp, Mus musculus
cccatgcagcacaacccttccaggc

SEQ ID NO: 243428 - DNA, 25 bp, Mus musculus
cccatgccaaagtctttgaaaccat

SEQ ID NO: 243429 - DNA, 25 bp, Mus musculus
cccatgcccatccgttcaattccac

SEQ ID NO: 243430 - DNA, 25 bp, Mus musculus
cccatgccctgtgatcagaccacct

SEQ ID NO: 243431 - DNA, 25 bp, Mus musculus
cccatgcgagctgatggctttgtgc

SEQ ID NO: 243432 - DNA, 25 bp, Mus musculus
cccatgcgagctggtccctgagttg

SEQ ID NO: 243433 - DNA, 25 bp, Mus musculus
cccatgcgcagctccagacctcttg

SEQ ID NO: 243434 - DNA, 25 bp, Mus musculus
cccatgcgtcaggaaatgtgttttc

SEQ ID NO: 243435 - DNA, 25 bp, Mus musculus
cccatgctaagaggggatgtgaagt

SEQ ID NO: 243436 - DNA, 25 bp, Mus musculus
cccatgctctgcaggcttcgagtac

SEQ ID NO: 243437 - DNA, 25 bp, Mus musculus
cccatggaaaagacgaagagagtat

SEQ ID NO: 243438 - DNA, 25 bp, Mus musculus
cccatggaacaccccatgcttaccg

SEQ ID NO: 243439 - DNA, 25 bp, Mus musculus
cccatggaaccagaaaatgagaaaa

SEQ ID NO: 243440 - DNA, 25 bp, Mus musculus
cccatggaaccagctctgttaagga

SEQ ID NO: 243441 - DNA, 25 bp, Mus musculus
cccatggaagacaaagtctggagct

SEQ ID NO: 243442 - DNA, 25 bp, Mus musculus
cccatggaagcaccccccattggac

SEQ ID NO: 243443 - DNA, 25 bp, Mus musculus
cccatggaagtctgctcgactgatg

SEQ ID NO: 243444 - DNA, 25 bp, Mus musculus
cccatggacactccagcacggaagc

SEQ ID NO: 243445 - DNA, 25 bp, Mus musculus
cccatggagaacgagagtctccatc

SEQ ID NO: 243446 - DNA, 25 bp, Mus musculus
cccatggagaacgagcctggaattg

SEQ ID NO: 243447 - DNA, 25 bp, Mus musculus
cccatggatggagggatcgcttaca

SEQ ID NO: 243448 - DNA, 25 bp, Mus musculus
cccatggattcagagtccagaactt

SEQ ID NO: 243449 - DNA, 25 bp, Mus musculus
cccatggccactgtggcctcctgag

SEQ ID NO: 243450 - DNA, 25 bp, Mus musculus
cccatggccactgtggtctctgtga

SEQ ID NO: 243451 - DNA, 25 bp, Mus musculus
cccatggccagtaactctgaatgtg

SEQ ID NO: 243452 - DNA, 25 bp, Mus musculus
cccatggcctttaagcctggaaagg

SEQ ID NO: 243453 - DNA, 25 bp, Mus musculus
cccatggcctttttgcctccagcgt

SEQ ID NO: 243454 - DNA, 25 bp, Mus musculus
cccatggcgaccagtacaaggccac

SEQ ID NO: 243455 - DNA, 25 bp, Mus musculus
cccatggctactggggatgcacaaa

SEQ ID NO: 243456 - DNA, 25 bp, Mus musculus
cccatggctactggttcaagatggc

SEQ ID NO: 243457 - DNA, 25 bp, Mus musculus
cccatggctcagactccgtggtttc

SEQ ID NO: 243458 - DNA, 25 bp, Mus musculus
cccatggctcgggactcggccagac

SEQ ID NO: 243459 - DNA, 25 bp, Mus musculus
cccatggctgacacgcttccaggtc

SEQ ID NO: 243460 - DNA, 25 bp, Mus musculus
cccatggctgacacggtccgaggag

SEQ ID NO: 243461 - DNA, 25 bp, Mus musculus
cccatgggtttcaagcctggggaaa

SEQ ID NO: 243462 - DNA, 25 bp, Mus musculus
cccatgggtttcaagtcttgtgatg

SEQ ID NO: 243463 - DNA, 25 bp, Mus musculus
cccatggtcaagacgtccgtcctcg

SEQ ID NO: 243464 - DNA, 25 bp, Mus musculus
cccatggtcctagtcaagagaatcc

SEQ ID NO: 243465 - DNA, 25 bp, Mus musculus
cccatggtctcttcccatacatggc

SEQ ID NO: 243466 - DNA, 25 bp, Mus musculus
cccatggttgcaggtctgcaataat

SEQ ID NO: 243467 - DNA, 25 bp, Mus musculus
cccatgtacagactcatcccacctc

SEQ ID NO: 243468 - DNA, 25 bp, Mus musculus
cccatgtacagctcacaaactcaaa

SEQ ID NO: 243469 - DNA, 25 bp, Mus musculus
cccatgtaccaagtgtccccaagga

SEQ ID NO: 243470 - DNA, 25 bp, Mus musculus
cccatgtactaagacctgttcccgt

SEQ ID NO: 243471 - DNA, 25 bp, Mus musculus
cccatgtactaagggatacagtgga

SEQ ID NO: 243472 - DNA, 25 bp, Mus musculus
cccatgtactaaggtatacagtttt

SEQ ID NO: 243473 - DNA, 25 bp, Mus musculus
cccatgtactaagtttccccctgct

SEQ ID NO: 243474 - DNA, 25 bp, Mus musculus
cccatgtcaagaggcctcacacctt

SEQ ID NO: 243475 - DNA, 25 bp, Mus musculus
cccatgtcagtatttcctaaatgac

SEQ ID NO: 243476 - DNA, 25 bp, Mus musculus
cccatgtcatccagttactgctgac

SEQ ID NO: 243477 - DNA, 25 bp, Mus musculus
cccatgtccatccctatcatcccag

SEQ ID NO: 243478 - DNA, 25 bp, Mus musculus
cccatgtcgagtggcctcggatgtg

SEQ ID NO: 243479 - DNA, 25 bp, Mus musculus
cccatgtctgaccttctgccccctg

SEQ ID NO: 243480 - DNA, 25 bp, Mus musculus
cccatgtcttttcttcggtgggtct

SEQ ID NO: 243481 - DNA, 25 bp, Mus musculus
cccatgtcttttcttgccaatgagg

SEQ ID NO: 243482 - DNA, 25 bp, Mus musculus
cccatgtgaccctgctgacatcacc

SEQ ID NO: 243483 - DNA, 25 bp, Mus musculus
cccatgtggcagtggtccccagtgc

SEQ ID NO: 243484 - DNA, 25 bp, Mus musculus
cccatgtgtgcagcttccattgaag

SEQ ID NO: 243485 - DNA, 25 bp, Mus musculus
cccatgtgtgcaggttgtacttgtt

SEQ ID NO: 243486 - DNA, 25 bp, Mus musculus
cccatgttggaggacaagacatttc

SEQ ID NO: 243487 - DNA, 25 bp, Mus musculus
cccatgttggagggagttaaatacc

SEQ ID NO: 243488 - DNA, 25 bp, Mus musculus
cccattaaagctcagagccggccac

SEQ ID NO: 243489 - DNA, 25 bp, Mus musculus
cccattaaagctcagtaccgcacaa

SEQ ID NO: 243490 - DNA, 25 bp, Mus musculus
cccattacctaaatgactgataatg

SEQ ID NO: 243491 - DNA, 25 bp, Mus musculus
cccattacctaaatggacaggatcc

SEQ ID NO: 243492 - DNA, 25 bp, Mus musculus
cccattacctccaggctcggttgtc

SEQ ID NO: 243493 - DNA, 25 bp, Mus musculus
cccattacctccagtgtgacaaata

SEQ ID NO: 243494 - DNA, 25 bp, Mus musculus
cccattagaaacaagccacggaaga

SEQ ID NO: 243495 - DNA, 25 bp, Mus musculus
cccattagaaaccacctaccctcag

SEQ ID NO: 243496 - DNA, 25 bp, Mus musculus
cccattagcaaaggtggattgcact

SEQ ID NO: 243497 - DNA, 25 bp, Mus musculus
cccattaggaagatcaaaggcacag

SEQ ID NO: 243498 - DNA, 25 bp, Mus musculus
cccattataccctctcctaccacca

SEQ ID NO: 243499 - DNA, 25 bp, Mus musculus
cccattcaagaaattggcaccaccg

SEQ ID NO: 243500 - DNA, 25 bp, Mus musculus
cccattcagctgcagagtgctgatc

SEQ ID NO: 243501 - DNA, 25 bp, Mus musculus
cccattccaaggcaacccgcagggt

SEQ ID NO: 243502 - DNA, 25 bp, Mus musculus
cccattccagctgtcgcagagatga

SEQ ID NO: 243503 - DNA, 25 bp, Mus musculus
cccattccccaaagtaatggactca

SEQ ID NO: 243504 - DNA, 25 bp, Mus musculus
cccattcctgcctaaattttaagcg

SEQ ID NO: 243505 - DNA, 25 bp, Mus musculus
cccattctcaaaaatttcaaaggcc

SEQ ID NO: 243506 - DNA, 25 bp, Mus musculus
cccattctcagcatcatgctgggag

SEQ ID NO: 243507 - DNA, 25 bp, Mus musculus
cccattctgtgctgcctgccagccc

SEQ ID NO: 243508 - DNA, 25 bp, Mus musculus
cccattctgtggctttcactttttc

SEQ ID NO: 243509 - DNA, 25 bp, Mus musculus
cccattcttaagattcctttgagag

SEQ ID NO: 243510 - DNA, 25 bp, Mus musculus
cccattcttcaggtgttgggaaacc

SEQ ID NO: 243511 - DNA, 25 bp, Mus musculus
cccattcttcctcggtgtgcagagg

SEQ ID NO: 243512 - DNA, 25 bp, Mus musculus
cccattcttctgggtcggatgctct

SEQ ID NO: 243513 - DNA, 25 bp, Mus musculus
cccattgaccagcaggaatccagcc

SEQ ID NO: 243514 - DNA, 25 bp, Mus musculus
cccattgagaagagatgaggctgtg

SEQ ID NO: 243515 - DNA, 25 bp, Mus musculus
cccattgagtagatttgaaagaagc

SEQ ID NO: 243516 - DNA, 25 bp, Mus musculus
cccattgattaagagtgtcaacagg

SEQ ID NO: 243517 - DNA, 25 bp, Mus musculus
cccattgattaaggcagtagagtgt

SEQ ID NO: 243518 - DNA, 25 bp, Mus musculus
cccattgcaagataaataggattta

SEQ ID NO: 243519 - DNA, 25 bp, Mus musculus
cccattgccgagctcggcttcatga

SEQ ID NO: 243520 - DNA, 25 bp, Mus musculus
cccattgcctcagcaactatcagac

SEQ ID NO: 243521 - DNA, 25 bp, Mus musculus
cccattgcctcagcctctccaaccc

SEQ ID NO: 243522 - DNA, 25 bp, Mus musculus
cccattggaaacaggttcagacaat

SEQ ID NO: 243523 - DNA, 25 bp, Mus musculus
cccattggaaagatggtggaaccag

SEQ ID NO: 243524 - DNA, 25 bp, Mus musculus
cccattggagaggaacctgctttgg

SEQ ID NO: 243525 - DNA, 25 bp, Mus musculus
cccattggagccaaggctgttgtgg

SEQ ID NO: 243526 - DNA, 25 bp, Mus musculus
cccattggctggcaaggtcagcctg

SEQ ID NO: 243527 - DNA, 25 bp, Mus musculus
cccattggctggttttcccatcata

SEQ ID NO: 243528 - DNA, 25 bp, Mus musculus
cccattgtcaggtgcgtgaagctgc

SEQ ID NO: 243529 - DNA, 25 bp, Mus musculus
cccattgtggataagtgctgctaaa

SEQ ID NO: 243530 - DNA, 25 bp, Mus musculus
cccattgtgggagagccaggctact

SEQ ID NO: 243531 - DNA, 25 bp, Mus musculus
cccatttacagggagaagctgggca

SEQ ID NO: 243532 - DNA, 25 bp, Mus musculus
cccatttcacagggagcccgaacca

SEQ ID NO: 243533 - DNA, 25 bp, Mus musculus
cccatttcaggtgctggtggcaaca

SEQ ID NO: 243534 - DNA, 25 bp, Mus musculus
cccatttccctggcaggttcaccgg

SEQ ID NO: 243535 - DNA, 25 bp, Mus musculus
cccatttcggatgttcctgccttct

SEQ ID NO: 243536 - DNA, 25 bp, Mus musculus
cccattttacagaactgtatgaggc

SEQ ID NO: 243537 - DNA, 25 bp, Mus musculus
cccattttctctatgagtattggag

SEQ ID NO: 243538 - DNA, 25 bp, Mus musculus
cccattttgacaccatttggaggtg

SEQ ID NO: 243539 - DNA, 25 bp, Mus musculus
ccccaaaacaggccccagggctggc

SEQ ID NO: 243540 - DNA, 25 bp, Mus musculus
ccccaaaacagtgggaaatgcctgg

SEQ ID NO: 243541 - DNA, 25 bp, Mus musculus
ccccaaaacctgacgtccacgtctg

SEQ ID NO: 243542 - DNA, 25 bp, Mus musculus
ccccaaaacgcagctgcagcactgg

SEQ ID NO: 243543 - DNA, 25 bp, Mus musculus
ccccaaaacgcaggaccatcagaat

SEQ ID NO: 243544 - DNA, 25 bp, Mus musculus
ccccaaaacggacctacgagcagag

SEQ ID NO: 243545 - DNA, 25 bp, Mus musculus
ccccaaaagacctccgtctggattt

SEQ ID NO: 243546 - DNA, 25 bp, Mus musculus
ccccaaaagccaaagatgtgtgcca

SEQ ID NO: 243547 - DNA, 25 bp, Mus musculus
ccccaaaatctcaagaaggtggatt

SEQ ID NO: 243548 - DNA, 25 bp, Mus musculus
ccccaaaatctcaagctgcgagcct

SEQ ID NO: 243549 - DNA, 25 bp, Mus musculus
ccccaaaattaggctgcgggacaaa

SEQ ID NO: 243550 - DNA, 25 bp, Mus musculus
ccccaaacagtgtcaccccgccctg

SEQ ID NO: 243551 - DNA, 25 bp, Mus musculus
ccccaaaccaccctgctgagacagt

SEQ ID NO: 243552 - DNA, 25 bp, Mus musculus
ccccaaacccagacttacagctctg

SEQ ID NO: 243553 - DNA, 25 bp, Mus musculus
ccccaaacccagatcagtggaccat

SEQ ID NO: 243554 - DNA, 25 bp, Mus musculus
ccccaaacccaggtctggaggtgac

SEQ ID NO: 243555 - DNA, 25 bp, Mus musculus
ccccaaacttccagacctgaggtcc

SEQ ID NO: 243556 - DNA, 25 bp, Mus musculus
ccccaaacttccaggcacatctcag

SEQ ID NO: 243557 - DNA, 25 bp, Mus musculus
ccccaaagaaagaagatgtcagccc

SEQ ID NO: 243558 - DNA, 25 bp, Mus musculus
ccccaaagaaaggtcaaatggttag

SEQ ID NO: 243559 - DNA, 25 bp, Mus musculus
ccccaaagagggtcttgagagcaga

SEQ ID NO: 243560 - DNA, 25 bp, Mus musculus
ccccaaagatcagagatggagtctc

SEQ ID NO: 243561 - DNA, 25 bp, Mus musculus
ccccaaagatcaggagatttgtaca

SEQ ID NO: 243562 - DNA, 25 bp, Mus musculus
ccccaaaggagggaccgctgacaaa

SEQ ID NO: 243563 - DNA, 25 bp, Mus musculus
ccccaaaggatggctccatctccat

SEQ ID NO: 243564 - DNA, 25 bp, Mus musculus
ccccaaagtgaaaaagtactgtctg

SEQ ID NO: 243565 - DNA, 25 bp, Mus musculus
ccccaaataatgacctagccctcat

SEQ ID NO: 243566 - DNA, 25 bp, Mus musculus
ccccaaataatgatgtctatactct

SEQ ID NO: 243567 - DNA, 25 bp, Mus musculus
ccccaaatacctctcaaaaatagtg

SEQ ID NO: 243568 - DNA, 25 bp, Mus musculus
ccccaaatctgcagatctcatagga

SEQ ID NO: 243569 - DNA, 25 bp, Mus musculus
ccccaaatctgcagatgtgaatcct

SEQ ID NO: 243570 - DNA, 25 bp, Mus musculus
ccccaaatctgtgctgaagagacct

SEQ ID NO: 243571 - DNA, 25 bp, Mus musculus
ccccaaatgaccactgagattccag

SEQ ID NO: 243572 - DNA, 25 bp, Mus musculus
ccccaaatgaccagagaacttcacc

SEQ ID NO: 243573 - DNA, 25 bp, Mus musculus
ccccaacacggtcggaaactccgtg

SEQ ID NO: 243574 - DNA, 25 bp, Mus musculus
ccccaacactgagggcagggcctac

SEQ ID NO: 243575 - DNA, 25 bp, Mus musculus
ccccaacagaagctgacatcatgtt

SEQ ID NO: 243576 - DNA, 25 bp, Mus musculus
ccccaacagaagctgcatgtctgct

SEQ ID NO: 243577 - DNA, 25 bp, Mus musculus
ccccaacagcgggccacagattgta

SEQ ID NO: 243578 - DNA, 25 bp, Mus musculus
ccccaacagcgggtctggaggaggg

SEQ ID NO: 243579 - DNA, 25 bp, Mus musculus
ccccaacaggtaattggcacgggag

SEQ ID NO: 243580 - DNA, 25 bp, Mus musculus
ccccaacatgcggacctcatgcctg

SEQ ID NO: 243581 - DNA, 25 bp, Mus musculus
ccccaacatgcgggaattcatcctc

SEQ ID NO: 243582 - DNA, 25 bp, Mus musculus
ccccaaccacgctggggtctccaat

SEQ ID NO: 243583 - DNA, 25 bp, Mus musculus
ccccaaccagaccgtggacatgctt

SEQ ID NO: 243584 - DNA, 25 bp, Mus musculus
ccccaacccacgaagggcgaatcgc

SEQ ID NO: 243585 - DNA, 25 bp, Mus musculus
ccccaacctcagctttctgacctgt

SEQ ID NO: 243586 - DNA, 25 bp, Mus musculus
ccccaaccttttgacaaggtcaggg

SEQ ID NO: 243587 - DNA, 25 bp, Mus musculus
ccccaacggctctgcctgcagtggg

SEQ ID NO: 243588 - DNA, 25 bp, Mus musculus
ccccaacggctctgcgttgctgctc

SEQ ID NO: 243589 - DNA, 25 bp, Mus musculus
ccccaactacacgagacctgtgttc

SEQ ID NO: 243590 - DNA, 25 bp, Mus musculus
ccccaactattcacacctcctggag

SEQ ID NO: 243591 - DNA, 25 bp, Mus musculus
ccccaactattcacaggctcagcag

SEQ ID NO: 243592 - DNA, 25 bp, Mus musculus
ccccaactattgtgaccagatggga

SEQ ID NO: 243593 - DNA, 25 bp, Mus musculus
ccccaactccaagggctgggtcttc

SEQ ID NO: 243594 - DNA, 25 bp, Mus musculus
ccccaactccaaggttacagagtca

SEQ ID NO: 243595 - DNA, 25 bp, Mus musculus
ccccaactctcgtggaagcacaagc

SEQ ID NO: 243596 - DNA, 25 bp, Mus musculus
ccccaactgagggcaggctggatat

SEQ ID NO: 243597 - DNA, 25 bp, Mus musculus
ccccaactgctgcaacaccagcaca

SEQ ID NO: 243598 - DNA, 25 bp, Mus musculus
ccccaactgtacgcggagactgcgg

SEQ ID NO: 243599 - DNA, 25 bp, Mus musculus
ccccaacttaaagactgaagtgttg

SEQ ID NO: 243600 - DNA, 25 bp, Mus musculus
ccccaacttcaagggtgctgctcag

SEQ ID NO: 243601 - DNA, 25 bp, Mus musculus
ccccaacttctcggtctactatacc

SEQ ID NO: 243602 - DNA, 25 bp, Mus musculus
ccccaagaaccagacccgagtcaga

SEQ ID NO: 243603 - DNA, 25 bp, Mus musculus
ccccaagacacaattgaattaaaca

SEQ ID NO: 243604 - DNA, 25 bp, Mus musculus
ccccaagaccagtgacagtgggaac

SEQ ID NO: 243605 - DNA, 25 bp, Mus musculus
ccccaagaccatgtgtgccgacaac

SEQ ID NO: 243606 - DNA, 25 bp, Mus musculus
ccccaagagaagggagtggatcaca

SEQ ID NO: 243607 - DNA, 25 bp, Mus musculus
ccccaagagagacaacaatcctctc

SEQ ID NO: 243608 - DNA, 25 bp, Mus musculus
ccccaagagcccacagtcgaaggat

SEQ ID NO: 243609 - DNA, 25 bp, Mus musculus
ccccaagatgctttgtgacgacaaa

SEQ ID NO: 243610 - DNA, 25 bp, Mus musculus
ccccaagcacaaggtgagactgtgg

SEQ ID NO: 243611 - DNA, 25 bp, Mus musculus
ccccaagcaggtgaggaattttaaa

SEQ ID NO: 243612 - DNA, 25 bp, Mus musculus
ccccaagccagccccgcagccctac

SEQ ID NO: 243613 - DNA, 25 bp, Mus musculus
ccccaagccaggaacctctcagtca

SEQ ID NO: 243614 - DNA, 25 bp, Mus musculus
ccccaagccaggaacttctcagcca

SEQ ID NO: 243615 - DNA, 25 bp, Mus musculus
ccccaaggacagtttagagacgtgg

SEQ ID NO: 243616 - DNA, 25 bp, Mus musculus
ccccaaggaggagtcaggcctcgtc

SEQ ID NO: 243617 - DNA, 25 bp, Mus musculus
ccccaaggaggcggacgctcagcgg

SEQ ID NO: 243618 - DNA, 25 bp, Mus musculus
ccccaaggaggtaagcctggactcc

SEQ ID NO: 243619 - DNA, 25 bp, Mus musculus
ccccaaggaggtctctgagtgtgag

SEQ ID NO: 243620 - DNA, 25 bp, Mus musculus
ccccaaggtgccagaggaggatgac

SEQ ID NO: 243621 - DNA, 25 bp, Mus musculus
ccccaagtaagaagactagcagtga

SEQ ID NO: 243622 - DNA, 25 bp, Mus musculus
ccccaagtaagataccaaggtataa

SEQ ID NO: 243623 - DNA, 25 bp, Mus musculus
ccccaagtaatgcaagtgtggcacc

SEQ ID NO: 243624 - DNA, 25 bp, Mus musculus
ccccaagtaatgcatgtgtggcacc

SEQ ID NO: 243625 - DNA, 25 bp, Mus musculus
ccccaagtacccgcctacagtttca

SEQ ID NO: 243626 - DNA, 25 bp, Mus musculus
ccccaagtctgctgccctgctgtcc

SEQ ID NO: 243627 - DNA, 25 bp, Mus musculus
ccccaagtgctgcaggaggctactt

SEQ ID NO: 243628 - DNA, 25 bp, Mus musculus
ccccaagttcaggaagaagcacaca

SEQ ID NO: 243629 - DNA, 25 bp, Mus musculus
ccccaagttcaggagctctgcacac

SEQ ID NO: 243630 - DNA, 25 bp, Mus musculus
ccccaagttcccagaccttgtgacc

SEQ ID NO: 243631 - DNA, 25 bp, Mus musculus
ccccaagttcccagcaagccccgcc

SEQ ID NO: 243632 - DNA, 25 bp, Mus musculus
ccccaatagagataatgcaggggat

SEQ ID NO: 243633 - DNA, 25 bp, Mus musculus
ccccaatagagatggcttgccagta

SEQ ID NO: 243634 - DNA, 25 bp, Mus musculus
ccccaatcagagtgcggagatccaa

SEQ ID NO: 243635 - DNA, 25 bp, Mus musculus
ccccaatcaggaaattaccggacgc

SEQ ID NO: 243636 - DNA, 25 bp, Mus musculus
ccccaatcccactgattttaggtga

SEQ ID NO: 243637 - DNA, 25 bp, Mus musculus
ccccaatcgcaagacggtgcctctg

SEQ ID NO: 243638 - DNA, 25 bp, Mus musculus
ccccaatcgcaaggattcttcttct

SEQ ID NO: 243639 - DNA, 25 bp, Mus musculus
ccccaatcggatctgtgtaagaact

SEQ ID NO: 243640 - DNA, 25 bp, Mus musculus
ccccaatcggggcaccacctgtctg

SEQ ID NO: 243641 - DNA, 25 bp, Mus musculus
ccccaatgacaggttcattttgctg

SEQ ID NO: 243642 - DNA, 25 bp, Mus musculus
ccccaatggggaaggtctaaatgcc

SEQ ID NO: 243643 - DNA, 25 bp, Mus musculus
ccccaatggggctcctcctccaggc

SEQ ID NO: 243644 - DNA, 25 bp, Mus musculus
ccccaatgtatctggtgaccacatt

SEQ ID NO: 243645 - DNA, 25 bp, Mus musculus
ccccaatgtctttgcaccctgtgac

SEQ ID NO: 243646 - DNA, 25 bp, Mus musculus
ccccacaaaatcatgcaaatcaaga

SEQ ID NO: 243647 - DNA, 25 bp, Mus musculus
ccccacaaacctgacgagatgacag

SEQ ID NO: 243648 - DNA, 25 bp, Mus musculus
ccccacaaagaattccagaggcaag

SEQ ID NO: 243649 - DNA, 25 bp, Mus musculus
ccccacaagcctgaaatcaactcca

SEQ ID NO: 243650 - DNA, 25 bp, Mus musculus
ccccacaagcctgagccaggagggc

SEQ ID NO: 243651 - DNA, 25 bp, Mus musculus
ccccacaaggctcagacagcagtga

SEQ ID NO: 243652 - DNA, 25 bp, Mus musculus
ccccacaatcgaagatgcttataaa

SEQ ID NO: 243653 - DNA, 25 bp, Mus musculus
ccccacaatcggcagagttcacggc

SEQ ID NO: 243654 - DNA, 25 bp, Mus musculus
ccccacaatgattcggcagacgggc

SEQ ID NO: 243655 - DNA, 25 bp, Mus musculus
ccccacacaagtcaaaggagccctg

SEQ ID NO: 243656 - DNA, 25 bp, Mus musculus
ccccacacaatgtttagttctgtgt

SEQ ID NO: 243657 - DNA, 25 bp, Mus musculus
ccccacacagcaggaggtcccaggt

SEQ ID NO: 243658 - DNA, 25 bp, Mus musculus
ccccacaccccgtgacccgcagggc

SEQ ID NO: 243659 - DNA, 25 bp, Mus musculus
ccccacagaggtggaagcacttcag

SEQ ID NO: 243660 - DNA, 25 bp, Mus musculus
ccccacagcacgccactggcagatc

SEQ ID NO: 243661 - DNA, 25 bp, Mus musculus
ccccacagcagaaactgcagttggt

SEQ ID NO: 243662 - DNA, 25 bp, Mus musculus
ccccacagcaggagtggacagcatg

SEQ ID NO: 243663 - DNA, 25 bp, Mus musculus
ccccacagcagtcctgtggatcatt

SEQ ID NO: 243664 - DNA, 25 bp, Mus musculus
ccccacagccaacaggtcagaccaa

SEQ ID NO: 243665 - DNA, 25 bp, Mus musculus
ccccacagctaggctttcagtctct

SEQ ID NO: 243666 - DNA, 25 bp, Mus musculus
ccccacagctccttcccagctggtg

SEQ ID NO: 243667 - DNA, 25 bp, Mus musculus
ccccacagctgaacaatgtgggtct

SEQ ID NO: 243668 - DNA, 25 bp, Mus musculus
ccccacaggaaacaggagcagcgtt

SEQ ID NO: 243669 - DNA, 25 bp, Mus musculus
ccccacaggaaaggaatggagagtc

SEQ ID NO: 243670 - DNA, 25 bp, Mus musculus
ccccacaggaaagtacctggccagt

SEQ ID NO: 243671 - DNA, 25 bp, Mus musculus
ccccacagtcagccttttatgtcac

SEQ ID NO: 243672 - DNA, 25 bp, Mus musculus
ccccacattcaacccatggggccgc

SEQ ID NO: 243673 - DNA, 25 bp, Mus musculus
ccccacattcaactccagcgccgtc

SEQ ID NO: 243674 - DNA, 25 bp, Mus musculus
ccccaccaagctcagtaacaagtcc

SEQ ID NO: 243675 - DNA, 25 bp, Mus musculus
ccccaccacagaggcctcaggatga

SEQ ID NO: 243676 - DNA, 25 bp, Mus musculus
ccccaccacagatctgcgatggcgt

SEQ ID NO: 243677 - DNA, 25 bp, Mus musculus
ccccaccagaaggaccctgctctgg

SEQ ID NO: 243678 - DNA, 25 bp, Mus musculus
ccccaccagaaggtggtagccaatt

SEQ ID NO: 243679 - DNA, 25 bp, Mus musculus
ccccaccatcatcaggcaaacaggc

SEQ ID NO: 243680 - DNA, 25 bp, Mus musculus
ccccaccatcatgatttaagcagca

SEQ ID NO: 243681 - DNA, 25 bp, Mus musculus
ccccaccatgaatttgtggccctaa

SEQ ID NO: 243682 - DNA, 25 bp, Mus musculus
ccccacccaggcctggataccacat

SEQ ID NO: 243683 - DNA, 25 bp, Mus musculus
ccccacccaggtggaggatgcggtg

SEQ ID NO: 243684 - DNA, 25 bp, Mus musculus
ccccacccagtttctgtgttgtggg

SEQ ID NO: 243685 - DNA, 25 bp, Mus musculus
ccccaccccatccagaaaatgagga

SEQ ID NO: 243686 - DNA, 25 bp, Mus musculus
ccccaccccccagcaagagccagag

SEQ ID NO: 243687 - DNA, 25 bp, Mus musculus
ccccaccccccaggacatgacagat

SEQ ID NO: 243688 - DNA, 25 bp, Mus musculus
ccccaccccgctggcaaatctcatg

SEQ ID NO: 243689 - DNA, 25 bp, Mus musculus
ccccaccccgctggctgccttcaac

SEQ ID NO: 243690 - DNA, 25 bp, Mus musculus
ccccacccggaggagtgccggcatt

SEQ ID NO: 243691 - DNA, 25 bp, Mus musculus
ccccaccctctgtggatttcctgaa

SEQ ID NO: 243692 - DNA, 25 bp, Mus musculus
ccccaccgccatgcctgtctcctcc

SEQ ID NO: 243693 - DNA, 25 bp, Mus musculus
ccccacctactgagctggtctgtaa

SEQ ID NO: 243694 - DNA, 25 bp, Mus musculus
ccccacctactgggaccagcgggaa

SEQ ID NO: 243695 - DNA, 25 bp, Mus musculus
ccccacctactggggacttctggtc

SEQ ID NO: 243696 - DNA, 25 bp, Mus musculus
ccccacctccagggtgaagttgatt

SEQ ID NO: 243697 - DNA, 25 bp, Mus musculus
ccccacctgatgagccaggtctgga

SEQ ID NO: 243698 - DNA, 25 bp, Mus musculus
ccccaccttgatcagagtattgtta

SEQ ID NO: 243699 - DNA, 25 bp, Mus musculus
ccccacgaactgggtgactttgcca

SEQ ID NO: 243700 - DNA, 25 bp, Mus musculus
ccccacgaactgggtgcagccctgg

SEQ ID NO: 243701 - DNA, 25 bp, Mus musculus
ccccacgccaggattacatcttcta

SEQ ID NO: 243702 - DNA, 25 bp, Mus musculus
ccccacgcctggcctctgccttcgg

SEQ ID NO: 243703 - DNA, 25 bp, Mus musculus
ccccacggagctcgtaccctacggg

SEQ ID NO: 243704 - DNA, 25 bp, Mus musculus
ccccacggctggggactccttttca

SEQ ID NO: 243705 - DNA, 25 bp, Mus musculus
ccccacgtatgcaggctctgcctgg

SEQ ID NO: 243706 - DNA, 25 bp, Mus musculus
ccccacgtgatggagtatcccggca

SEQ ID NO: 243707 - DNA, 25 bp, Mus musculus
ccccacgtgctcctggcccagaatc

SEQ ID NO: 243708 - DNA, 25 bp, Mus musculus
ccccacgttgctctggtcgaatggt

SEQ ID NO: 243709 - DNA, 25 bp, Mus musculus
ccccacgttttctcctcagagctgc

SEQ ID NO: 243710 - DNA, 25 bp, Mus musculus
ccccactaagattgaagattatgat

SEQ ID NO: 243711 - DNA, 25 bp, Mus musculus
ccccactaatgtcgaaagagatgac

SEQ ID NO: 243712 - DNA, 25 bp, Mus musculus
ccccactaatgtcggcacaccattc

SEQ ID NO: 243713 - DNA, 25 bp, Mus musculus
ccccactagagtgcggccaaggatt

SEQ ID NO: 243714 - DNA, 25 bp, Mus musculus
ccccactattggcttaagtttgctg

SEQ ID NO: 243715 - DNA, 25 bp, Mus musculus
ccccactattggggcatctttcatg

SEQ ID NO: 243716 - DNA, 25 bp, Mus musculus
ccccactccaggatcttttccccag

SEQ ID NO: 243717 - DNA, 25 bp, Mus musculus
ccccactccaggcacactggcaacc

SEQ ID NO: 243718 - DNA, 25 bp, Mus musculus
ccccactccggcggccccgcaatct

SEQ ID NO: 243719 - DNA, 25 bp, Mus musculus
ccccactctgcaaagtgacccagac

SEQ ID NO: 243720 - DNA, 25 bp, Mus musculus
ccccactctgcaaagtggcctatga

SEQ ID NO: 243721 - DNA, 25 bp, Mus musculus
ccccactgacccagactctcaggtg

SEQ ID NO: 243722 - DNA, 25 bp, Mus musculus
ccccactgctgaggcggacaaatca

SEQ ID NO: 243723 - DNA, 25 bp, Mus musculus
ccccactggagagaccactgctatt

SEQ ID NO: 243724 - DNA, 25 bp, Mus musculus
ccccactgtaaggcagtggaactca

SEQ ID NO: 243725 - DNA, 25 bp, Mus musculus
ccccactgtggaaggaagtttggca

SEQ ID NO: 243726 - DNA, 25 bp, Mus musculus
ccccacttcagaaggcccgaaagga

SEQ ID NO: 243727 - DNA, 25 bp, Mus musculus
ccccacttcagtgtgtagaaggccc

SEQ ID NO: 243728 - DNA, 25 bp, Mus musculus
ccccacttctgggaggcctggcctt

SEQ ID NO: 243729 - DNA, 25 bp, Mus musculus
ccccagaaagaagagaggagaaggg

SEQ ID NO: 243730 - DNA, 25 bp, Mus musculus
ccccagaacaagagctgaggctgca

SEQ ID NO: 243731 - DNA, 25 bp, Mus musculus
ccccagaagagggctacaggggaag

SEQ ID NO: 243732 - DNA, 25 bp, Mus musculus
ccccagaagagttctcttccttcat

SEQ ID NO: 243733 - DNA, 25 bp, Mus musculus
ccccagaagagtttgtggcagctgg

SEQ ID NO: 243734 - DNA, 25 bp, Mus musculus
ccccagaagcagcccactgagtctc

SEQ ID NO: 243735 - DNA, 25 bp, Mus musculus
ccccagaagcagtaccccaccccag

SEQ ID NO: 243736 - DNA, 25 bp, Mus musculus
ccccagaagtaagattggcctgttc

SEQ ID NO: 243737 - DNA, 25 bp, Mus musculus
ccccagaatggtgggacgctcgtcc

SEQ ID NO: 243738 - DNA, 25 bp, Mus musculus
ccccagacacagaaagccatcacca

SEQ ID NO: 243739 - DNA, 25 bp, Mus musculus
ccccagacaggttcagaacttagaa

SEQ ID NO: 243740 - DNA, 25 bp, Mus musculus
ccccagaccagatcatccagcccct

SEQ ID NO: 243741 - DNA, 25 bp, Mus musculus
ccccagaccaggatgaggaggaggg

SEQ ID NO: 243742 - DNA, 25 bp, Mus musculus
ccccagaccgatatgacagcctgga

SEQ ID NO: 243743 - DNA, 25 bp, Mus musculus
ccccagacctgcagctaaagcaccg

SEQ ID NO: 243744 - DNA, 25 bp, Mus musculus
ccccagacgcttgtcggagctccaa

SEQ ID NO: 243745 - DNA, 25 bp, Mus musculus
ccccagactggtgaatgagagtgaa

SEQ ID NO: 243746 - DNA, 25 bp, Mus musculus
ccccagagagaaccttcttccactc

SEQ ID NO: 243747 - DNA, 25 bp, Mus musculus
ccccagagagatgaggaaagtgagg

SEQ ID NO: 243748 - DNA, 25 bp, Mus musculus
ccccagagagcatttctggctgctt

SEQ ID NO: 243749 - DNA, 25 bp, Mus musculus
ccccagagagctctcatggtaccaa

SEQ ID NO: 243750 - DNA, 25 bp, Mus musculus
ccccagagaggcagagcccctgggc

SEQ ID NO: 243751 - DNA, 25 bp, Mus musculus
ccccagagataagctgacgctgggc

SEQ ID NO: 243752 - DNA, 25 bp, Mus musculus
ccccagagcaggagactctgagttc

SEQ ID NO: 243753 - DNA, 25 bp, Mus musculus
ccccagagcagtgctaccatctcag

SEQ ID NO: 243754 - DNA, 25 bp, Mus musculus
ccccagagccagcagcaatgctact

SEQ ID NO: 243755 - DNA, 25 bp, Mus musculus
ccccagagccaggagcaatgctact

SEQ ID NO: 243756 - DNA, 25 bp, Mus musculus
ccccagagcgaagaggagcatagaa

SEQ ID NO: 243757 - DNA, 25 bp, Mus musculus
ccccagagcgaatggcggaggctgg

SEQ ID NO: 243758 - DNA, 25 bp, Mus musculus
ccccagagcggctccggagttgagc

SEQ ID NO: 243759 - DNA, 25 bp, Mus musculus
ccccagagcgggagctcttggctag

SEQ ID NO: 243760 - DNA, 25 bp, Mus musculus
ccccagagcggttttgctgtattgc

SEQ ID NO: 243761 - DNA, 25 bp, Mus musculus
ccccagagcttcaggaggaatttgg

SEQ ID NO: 243762 - DNA, 25 bp, Mus musculus
ccccagagtacaaagctcccaggag

SEQ ID NO: 243763 - DNA, 25 bp, Mus musculus
ccccagagtacaaaggcgtggtttc

SEQ ID NO: 243764 - DNA, 25 bp, Mus musculus
ccccagagtatacaggatcccaaac

SEQ ID NO: 243765 - DNA, 25 bp, Mus musculus
ccccagagtatacaggtctgtgagt

SEQ ID NO: 243766 - DNA, 25 bp, Mus musculus
ccccagatgcagggctgtagcagtg

SEQ ID NO: 243767 - DNA, 25 bp, Mus musculus
ccccagatgcaggttctgcatttca

SEQ ID NO: 243768 - DNA, 25 bp, Mus musculus
ccccagatgtctgatacatatctga

SEQ ID NO: 243769 - DNA, 25 bp, Mus musculus
ccccagatgtctggagtggatgacc

SEQ ID NO: 243770 - DNA, 25 bp, Mus musculus
ccccagcaaaggctaattctggctt

SEQ ID NO: 243771 - DNA, 25 bp, Mus musculus
ccccagcaacaaacatctctccaac

SEQ ID NO: 243772 - DNA, 25 bp, Mus musculus
ccccagcaacaaagtcacttagaaa

SEQ ID NO: 243773 - DNA, 25 bp, Mus musculus
ccccagcaacaattgaaatggcgat

SEQ ID NO: 243774 - DNA, 25 bp, Mus musculus
ccccagcaacactgcaatggctgct

SEQ ID NO: 243775 - DNA, 25 bp, Mus musculus
ccccagcaagacattcacccccaag

SEQ ID NO: 243776 - DNA, 25 bp, Mus musculus
ccccagcacagcaatcttccctggt

SEQ ID NO: 243777 - DNA, 25 bp, Mus musculus
ccccagcacctggctgacagcctac

SEQ ID NO: 243778 - DNA, 25 bp, Mus musculus
ccccagcactgtgtcgaccccctca

SEQ ID NO: 243779 - DNA, 25 bp, Mus musculus
ccccagcaggactcggatgaggcca

SEQ ID NO: 243780 - DNA, 25 bp, Mus musculus
ccccagcaggcagctgccagaccct

SEQ ID NO: 243781 - DNA, 25 bp, Mus musculus
ccccagcagtcagggcatctgttat

SEQ ID NO: 243782 - DNA, 25 bp, Mus musculus
ccccagcagtggataaaatattttg

SEQ ID NO: 243783 - DNA, 25 bp, Mus musculus
ccccagccacagatgaacgagaccg

SEQ ID NO: 243784 - DNA, 25 bp, Mus musculus
ccccagccacgagcctcccaagctg

SEQ ID NO: 243785 - DNA, 25 bp, Mus musculus
ccccagccaggatgatgtctacaga

SEQ ID NO: 243786 - DNA, 25 bp, Mus musculus
ccccagccaggcccccagcaaagac

SEQ ID NO: 243787 - DNA, 25 bp, Mus musculus
ccccagccaggtcagtggctatctc

SEQ ID NO: 243788 - DNA, 25 bp, Mus musculus
ccccagcccagtgcactaaggggtt

SEQ ID NO: 243789 - DNA, 25 bp, Mus musculus
ccccagccccagcagcctggtagat

SEQ ID NO: 243790 - DNA, 25 bp, Mus musculus
ccccagccccagtccttcaggctcc

SEQ ID NO: 243791 - DNA, 25 bp, Mus musculus
ccccagcccctgatacgacccggac

SEQ ID NO: 243792 - DNA, 25 bp, Mus musculus
ccccagcccctgtcctgcacttctt

SEQ ID NO: 243793 - DNA, 25 bp, Mus musculus
ccccagccctattcaggttattgaa

SEQ ID NO: 243794 - DNA, 25 bp, Mus musculus
ccccagccctcaacttaatgagctg

SEQ ID NO: 243795 - DNA, 25 bp, Mus musculus
ccccagccctttaaggcctccagca

SEQ ID NO: 243796 - DNA, 25 bp, Mus musculus
ccccagcctccgcatgagcatcaag

SEQ ID NO: 243797 - DNA, 25 bp, Mus musculus
ccccagcctcgtgcccagcagcagg

SEQ ID NO: 243798 - DNA, 25 bp, Mus musculus
ccccagcctgacgggaggaaaactt

SEQ ID NO: 243799 - DNA, 25 bp, Mus musculus
ccccagcctgacgtttctcttcagc

SEQ ID NO: 243800 - DNA, 25 bp, Mus musculus
ccccagcgaacatgctcactgttgg

SEQ ID NO: 243801 - DNA, 25 bp, Mus musculus
ccccagcgaacatggcctcaggagt

SEQ ID NO: 243802 - DNA, 25 bp, Mus musculus
ccccagcgagacagaggcttacatc

SEQ ID NO: 243803 - DNA, 25 bp, Mus musculus
ccccagcgagagctagctgagccac

SEQ ID NO: 243804 - DNA, 25 bp, Mus musculus
ccccagcgaggggacaaaggcgttc

SEQ ID NO: 243805 - DNA, 25 bp, Mus musculus
ccccagcgagtccttcggggagcca

SEQ ID NO: 243806 - DNA, 25 bp, Mus musculus
ccccagcgattctgaaggtgaagag

SEQ ID NO: 243807 - DNA, 25 bp, Mus musculus
ccccagcgcctgcaggcttttgagg

SEQ ID NO: 243808 - DNA, 25 bp, Mus musculus
ccccagcgcctgcaggggctccctc

SEQ ID NO: 243809 - DNA, 25 bp, Mus musculus
ccccagcggaggaggttgtaagcat

SEQ ID NO: 243810 - DNA, 25 bp, Mus musculus
ccccagcggatcctgagagaaggct

SEQ ID NO: 243811 - DNA, 25 bp, Mus musculus
ccccagcgtggctggtcttgagacc

SEQ ID NO: 243812 - DNA, 25 bp, Mus musculus
ccccagctacaggtacattactggg

SEQ ID NO: 243813 - DNA, 25 bp, Mus musculus
ccccagctccagtgaggacagcgat

SEQ ID NO: 243814 - DNA, 25 bp, Mus musculus
ccccagctcttcaggttgatcgcct

SEQ ID NO: 243815 - DNA, 25 bp, Mus musculus
ccccagctgagcggcagccgccacc

SEQ ID NO: 243816 - DNA, 25 bp, Mus musculus
ccccagctgagcggtcaaagcagcc

SEQ ID NO: 243817 - DNA, 25 bp, Mus musculus
ccccagctggagaagctccatttct

SEQ ID NO: 243818 - DNA, 25 bp, Mus musculus
ccccagctgtcccagatgaacgggc

SEQ ID NO: 243819 - DNA, 25 bp, Mus musculus
ccccagctgtcccaggggtgacttt

SEQ ID NO: 243820 - DNA, 25 bp, Mus musculus
ccccagctgtggggcagttttggca

SEQ ID NO: 243821 - DNA, 25 bp, Mus musculus
ccccagctgtggtagtcaggagttc

SEQ ID NO: 243822 - DNA, 25 bp, Mus musculus
ccccagctgtggtattcaggctgaa

SEQ ID NO: 243823 - DNA, 25 bp, Mus musculus
ccccagcttcacgctgtccctgaag

SEQ ID NO: 243824 - DNA, 25 bp, Mus musculus
ccccagcttcggcttgttttattgt

SEQ ID NO: 243825 - DNA, 25 bp, Mus musculus
ccccagcttcgggtcttttcacctg

SEQ ID NO: 243826 - DNA, 25 bp, Mus musculus
ccccagcttgccagcgtttttcgtt

SEQ ID NO: 243827 - DNA, 25 bp, Mus musculus
ccccaggaagagcctccacctctcc

SEQ ID NO: 243828 - DNA, 25 bp, Mus musculus
ccccaggaagaggacatgacagatg

SEQ ID NO: 243829 - DNA, 25 bp, Mus musculus
ccccaggaattagtgtcggagctcc

SEQ ID NO: 243830 - DNA, 25 bp, Mus musculus
ccccaggacagagagattgtgacac

SEQ ID NO: 243831 - DNA, 25 bp, Mus musculus
ccccaggacagcaaggccctccttt

SEQ ID NO: 243832 - DNA, 25 bp, Mus musculus
ccccaggagaggactcttcccccca

SEQ ID NO: 243833 - DNA, 25 bp, Mus musculus
ccccaggagctgctggagtgggaac

SEQ ID NO: 243834 - DNA, 25 bp, Mus musculus
ccccaggaggacctggggtcagaca

SEQ ID NO: 243835 - DNA, 25 bp, Mus musculus
ccccaggcagaaagtaaatccgtgg

SEQ ID NO: 243836 - DNA, 25 bp, Mus musculus
ccccaggcagcttattgatgtcctc

SEQ ID NO: 243837 - DNA, 25 bp, Mus musculus
ccccaggccagcaggtgtacagtgg

SEQ ID NO: 243838 - DNA, 25 bp, Mus musculus
ccccaggccagcagtgggctctggc

SEQ ID NO: 243839 - DNA, 25 bp, Mus musculus
ccccaggcccaggcgtgctggtcac

SEQ ID NO: 243840 - DNA, 25 bp, Mus musculus
ccccaggccccacaggtgccaaagg

SEQ ID NO: 243841 - DNA, 25 bp, Mus musculus
ccccaggccgtgaatgaccagtgcc

SEQ ID NO: 243842 - DNA, 25 bp, Mus musculus
ccccaggccgtggactaaagaccag

SEQ ID NO: 243843 - DNA, 25 bp, Mus musculus
ccccaggcgggatccgggagacacg

SEQ ID NO: 243844 - DNA, 25 bp, Mus musculus
ccccaggctggagagaatgaagatg

SEQ ID NO: 243845 - DNA, 25 bp, Mus musculus
ccccaggctggcaggaaccacacag

SEQ ID NO: 243846 - DNA, 25 bp, Mus musculus
ccccaggctggcaggtgctcaccga

SEQ ID NO: 243847 - DNA, 25 bp, Mus musculus
ccccagggaacaaggtcagtgacat

SEQ ID NO: 243848 - DNA, 25 bp, Mus musculus
ccccagggaagaggaacagctcagc

SEQ ID NO: 243849 - DNA, 25 bp, Mus musculus
ccccagggacagctgactttaagac

SEQ ID NO: 243850 - DNA, 25 bp, Mus musculus
ccccagggatcccaggtcttcctgg

SEQ ID NO: 243851 - DNA, 25 bp, Mus musculus
ccccagggcaaggattctgtaccca

SEQ ID NO: 243852 - DNA, 25 bp, Mus musculus
ccccagggcaaggtggctgcctttg

SEQ ID NO: 243853 - DNA, 25 bp, Mus musculus
ccccaggggcacctggcgaggagga

SEQ ID NO: 243854 - DNA, 25 bp, Mus musculus
ccccaggggcacctggtctcccttc

SEQ ID NO: 243855 - DNA, 25 bp, Mus musculus
ccccagggtcccgcaagaatcaaaa

SEQ ID NO: 243856 - DNA, 25 bp, Mus musculus
ccccagggtggtcaggaaggtctat

SEQ ID NO: 243857 - DNA, 25 bp, Mus musculus
ccccaggtcagcaggcgctttgccc

SEQ ID NO: 243858 - DNA, 25 bp, Mus musculus
ccccaggtcttccaggcccaaaggg

SEQ ID NO: 243859 - DNA, 25 bp, Mus musculus
ccccaggtgctaatggcaatcctgg

SEQ ID NO: 243860 - DNA, 25 bp, Mus musculus
ccccaggtggagctgcctctgtaca

SEQ ID NO: 243861 - DNA, 25 bp, Mus musculus
ccccaggttggaagagcaattctac

SEQ ID NO: 243862 - DNA, 25 bp, Mus musculus
ccccaggtttccaaggtggcgacag

SEQ ID NO: 243863 - DNA, 25 bp, Mus musculus
ccccagtaagggacaagcctacaca

SEQ ID NO: 243864 - DNA, 25 bp, Mus musculus
ccccagtacaaagcccagcacctca

SEQ ID NO: 243865 - DNA, 25 bp, Mus musculus
ccccagtacaaagctgtcttgatat

SEQ ID NO: 243866 - DNA, 25 bp, Mus musculus
ccccagtacaaaggacaaagccaaa

SEQ ID NO: 243867 - DNA, 25 bp, Mus musculus
ccccagtacaaagggaagtgtggtc

SEQ ID NO: 243868 - DNA, 25 bp, Mus musculus
ccccagtacaaaggggaccatggaa

SEQ ID NO: 243869 - DNA, 25 bp, Mus musculus
ccccagtacaaaggtgtctcttgct

SEQ ID NO: 243870 - DNA, 25 bp, Mus musculus
ccccagtacaaaggtgtggtatcag

SEQ ID NO: 243871 - DNA, 25 bp, Mus musculus
ccccagtacttagcactcctacagc

SEQ ID NO: 243872 - DNA, 25 bp, Mus musculus
ccccagtacttagcactttatttgc

SEQ ID NO: 243873 - DNA, 25 bp, Mus musculus
ccccagtagaaatcgcagcctgcag

SEQ ID NO: 243874 - DNA, 25 bp, Mus musculus
ccccagtatagccaggtcatccaca

SEQ ID NO: 243875 - DNA, 25 bp, Mus musculus
ccccagtcacggaggcctcctctgt

SEQ ID NO: 243876 - DNA, 25 bp, Mus musculus
ccccagtcactgcttgtctcttact

SEQ ID NO: 243877 - DNA, 25 bp, Mus musculus
ccccagtcagatctgtctcgagagc

SEQ ID NO: 243878 - DNA, 25 bp, Mus musculus
ccccagtcaggccggggctgtgccc

SEQ ID NO: 243879 - DNA, 25 bp, Mus musculus
ccccagtcagggtctggaggtgact

SEQ ID NO: 243880 - DNA, 25 bp, Mus musculus
ccccagtcaggtagcctttccagta

SEQ ID NO: 243881 - DNA, 25 bp, Mus musculus
ccccagtcctcaggttctaagcgca

SEQ ID NO: 243882 - DNA, 25 bp, Mus musculus
ccccagtgaactaggtggccttaga

SEQ ID NO: 243883 - DNA, 25 bp, Mus musculus
ccccagtgagacagtcatcgctcca

SEQ ID NO: 243884 - DNA, 25 bp, Mus musculus
ccccagtgagacagtgggggatctt

SEQ ID NO: 243885 - DNA, 25 bp, Mus musculus
ccccagtgagcctccctctccccat

SEQ ID NO: 243886 - DNA, 25 bp, Mus musculus
ccccagtgcagattaaggttgagga

SEQ ID NO: 243887 - DNA, 25 bp, Mus musculus
ccccagtgccagtggcatcaaataa

SEQ ID NO: 243888 - DNA, 25 bp, Mus musculus
ccccagtgccctgggcaaggccacc

SEQ ID NO: 243889 - DNA, 25 bp, Mus musculus
ccccagtgccgtttgattttacaca

SEQ ID NO: 243890 - DNA, 25 bp, Mus musculus
ccccagtggaaatcacggttatctg

SEQ ID NO: 243891 - DNA, 25 bp, Mus musculus
ccccagtgtctgcgagcccagatgc

SEQ ID NO: 243892 - DNA, 25 bp, Mus musculus
ccccagtgtctgcgatggttgtgag

SEQ ID NO: 243893 - DNA, 25 bp, Mus musculus
ccccagtgttccaaggagaccccct

SEQ ID NO: 243894 - DNA, 25 bp, Mus musculus
ccccagtgttccaaggtttggtgcc

SEQ ID NO: 243895 - DNA, 25 bp, Mus musculus
ccccagttcccaggtctttcatagt

SEQ ID NO: 243896 - DNA, 25 bp, Mus musculus
ccccagttcctggaccctgtattgg

SEQ ID NO: 243897 - DNA, 25 bp, Mus musculus
ccccagttgtccccaaggtcagcat

SEQ ID NO: 243898 - DNA, 25 bp, Mus musculus
ccccagttttgctgagaatggaatc

SEQ ID NO: 243899 - DNA, 25 bp, Mus musculus
ccccatacacaggggtctgtatgaa

SEQ ID NO: 243900 - DNA, 25 bp, Mus musculus
ccccatacctaaggtggagattcta

SEQ ID NO: 243901 - DNA, 25 bp, Mus musculus
ccccatagcagacaacaacagttct

SEQ ID NO: 243902 - DNA, 25 bp, Mus musculus
ccccatagcaggggaagaagaggtg

SEQ ID NO: 243903 - DNA, 25 bp, Mus musculus
ccccatagcaggtattccagcatct

SEQ ID NO: 243904 - DNA, 25 bp, Mus musculus
ccccatagtactttccgttgtgtcc

SEQ ID NO: 243905 - DNA, 25 bp, Mus musculus
ccccatagtactttttgcatagtaa

SEQ ID NO: 243906 - DNA, 25 bp, Mus musculus
ccccatatcaagtttcttacttatc

SEQ ID NO: 243907 - DNA, 25 bp, Mus musculus
ccccatatgatacaggtctaccgca

SEQ ID NO: 243908 - DNA, 25 bp, Mus musculus
ccccatcaagaaatctgaccctgtt

SEQ ID NO: 243909 - DNA, 25 bp, Mus musculus
ccccatcaagatcccacgcaatgat

SEQ ID NO: 243910 - DNA, 25 bp, Mus musculus
ccccatcaccagccaccatcgagac

SEQ ID NO: 243911 - DNA, 25 bp, Mus musculus
ccccatcaccagccagtgtggggca

SEQ ID NO: 243912 - DNA, 25 bp, Mus musculus
ccccatcactgggaaaaggactgtg

SEQ ID NO: 243913 - DNA, 25 bp, Mus musculus
ccccatcactgggtttggtaaaggc

SEQ ID NO: 243914 - DNA, 25 bp, Mus musculus
ccccatcagaacagcgcaagaagag

SEQ ID NO: 243915 - DNA, 25 bp, Mus musculus
ccccatcagaccagaagctgaccac

SEQ ID NO: 243916 - DNA, 25 bp, Mus musculus
ccccatcagaccaggccagctgttg

SEQ ID NO: 243917 - DNA, 25 bp, Mus musculus
ccccatcagacggaactggtgtcct

SEQ ID NO: 243918 - DNA, 25 bp, Mus musculus
ccccatcagacggtatcgagtggcc

SEQ ID NO: 243919 - DNA, 25 bp, Mus musculus
ccccatcatctgcactgctctgaga

SEQ ID NO: 243920 - DNA, 25 bp, Mus musculus
ccccatcatgctggggaaacaactg

SEQ ID NO: 243921 - DNA, 25 bp, Mus musculus
ccccatcatgctgggtggaagtgag

SEQ ID NO: 243922 - DNA, 25 bp, Mus musculus
ccccatcattgcaggctcaaacata

SEQ ID NO: 243923 - DNA, 25 bp, Mus musculus
ccccatccagaaaatgaggaagacc

SEQ ID NO: 243924 - DNA, 25 bp, Mus musculus
ccccatccagaggccatggacggag

SEQ ID NO: 243925 - DNA, 25 bp, Mus musculus
ccccatcccctcagctaacaatgaa

SEQ ID NO: 243926 - DNA, 25 bp, Mus musculus
ccccatcctcaggctgcgctacatg

SEQ ID NO: 243927 - DNA, 25 bp, Mus musculus
ccccatcgacctggctgctgcaaga

SEQ ID NO: 243928 - DNA, 25 bp, Mus musculus
ccccatcgataggcccagcagctgt

SEQ ID NO: 243929 - DNA, 25 bp, Mus musculus
ccccatcgataggctcaggtattac

SEQ ID NO: 243930 - DNA, 25 bp, Mus musculus
ccccatcgatagtgtgtgcccttgc

SEQ ID NO: 243931 - DNA, 25 bp, Mus musculus
ccccatctaagcagccttcctgcag

SEQ ID NO: 243932 - DNA, 25 bp, Mus musculus
ccccatctaagcaggtggcccgacg

SEQ ID NO: 243933 - DNA, 25 bp, Mus musculus
ccccatctcagagatgggctttgct

SEQ ID NO: 243934 - DNA, 25 bp, Mus musculus
ccccatctcagagctctcttccggc

SEQ ID NO: 243935 - DNA, 25 bp, Mus musculus
ccccatctcagaggctggtgtttgc

SEQ ID NO: 243936 - DNA, 25 bp, Mus musculus
ccccatctcagccagcagaggcctc

SEQ ID NO: 243937 - DNA, 25 bp, Mus musculus
ccccatctcagctccggaaaggccc

SEQ ID NO: 243938 - DNA, 25 bp, Mus musculus
ccccatctgcatcagactccgtgct

SEQ ID NO: 243939 - DNA, 25 bp, Mus musculus
ccccatcttcaaggtgttcgacgcc

SEQ ID NO: 243940 - DNA, 25 bp, Mus musculus
ccccatctttacatatctacgcctg

SEQ ID NO: 243941 - DNA, 25 bp, Mus musculus
ccccatctttacatctggctgagca

SEQ ID NO: 243942 - DNA, 25 bp, Mus musculus
ccccatgaaagaggcgccagccacc

SEQ ID NO: 243943 - DNA, 25 bp, Mus musculus
ccccatgaacacagctatcgcggta

SEQ ID NO: 243944 - DNA, 25 bp, Mus musculus
ccccatgaacacagctttttgcctt

SEQ ID NO: 243945 - DNA, 25 bp, Mus musculus
ccccatgaagagtctttgcagttta

SEQ ID NO: 243946 - DNA, 25 bp, Mus musculus
ccccatgaaggtacgggtggttctc

SEQ ID NO: 243947 - DNA, 25 bp, Mus musculus
ccccatgaagtgtttggtgtacaga

SEQ ID NO: 243948 - DNA, 25 bp, Mus musculus
ccccatgacatcagcagcggacagt

SEQ ID NO: 243949 - DNA, 25 bp, Mus musculus
ccccatgacccagaggcaaaactcc

SEQ ID NO: 243950 - DNA, 25 bp, Mus musculus
ccccatgacccaggtatacaagaga

SEQ ID NO: 243951 - DNA, 25 bp, Mus musculus
ccccatgactctagccagcagggcc

SEQ ID NO: 243952 - DNA, 25 bp, Mus musculus
ccccatgagaaattgccagtagtta

SEQ ID NO: 243953 - DNA, 25 bp, Mus musculus
ccccatgagaggtagctaagtggga

SEQ ID NO: 243954 - DNA, 25 bp, Mus musculus
ccccatgatgatactgaggacagca

SEQ ID NO: 243955 - DNA, 25 bp, Mus musculus
ccccatgatgatcgcaaaagatgcc

SEQ ID NO: 243956 - DNA, 25 bp, Mus musculus
ccccatgatggcttcttttcttcag

SEQ ID NO: 243957 - DNA, 25 bp, Mus musculus
ccccatgcagaccagactctgagaa

SEQ ID NO: 243958 - DNA, 25 bp, Mus musculus
ccccatgcagctatctaacttcact

SEQ ID NO: 243959 - DNA, 25 bp, Mus musculus
ccccatgcaggaatctgatgcttct

SEQ ID NO: 243960 - DNA, 25 bp, Mus musculus
ccccatgcaggtttatggtgtgctg

SEQ ID NO: 243961 - DNA, 25 bp, Mus musculus
ccccatgccaaagtctttgaaacca

SEQ ID NO: 243962 - DNA, 25 bp, Mus musculus
ccccatgcccatccgttcaattcca

SEQ ID NO: 243963 - DNA, 25 bp, Mus musculus
ccccatgcgcagctccagacctctt

SEQ ID NO: 243964 - DNA, 25 bp, Mus musculus
ccccatgctctgcaggcttcgagta

SEQ ID NO: 243965 - DNA, 25 bp, Mus musculus
ccccatggaaccagaaaatgagaaa

SEQ ID NO: 243966 - DNA, 25 bp, Mus musculus
ccccatggaaccagctctgttaagg

SEQ ID NO: 243967 - DNA, 25 bp, Mus musculus
ccccatggaagtctgctcgactgat

SEQ ID NO: 243968 - DNA, 25 bp, Mus musculus
ccccatggagacatatgaggaccag

SEQ ID NO: 243969 - DNA, 25 bp, Mus musculus
ccccatggagactcggctgactcta

SEQ ID NO: 243970 - DNA, 25 bp, Mus musculus
ccccatggaggttatttttgaagtt

SEQ ID NO: 243971 - DNA, 25 bp, Mus musculus
ccccatggctactggggatgcacaa

SEQ ID NO: 243972 - DNA, 25 bp, Mus musculus
ccccatggctactggttcaagatgg

SEQ ID NO: 243973 - DNA, 25 bp, Mus musculus
ccccatggctcgggactcggccaga

SEQ ID NO: 243974 - DNA, 25 bp, Mus musculus
ccccatggttgcaggtctgcaataa

SEQ ID NO: 243975 - DNA, 25 bp, Mus musculus
ccccatgtacagactcatcccacct

SEQ ID NO: 243976 - DNA, 25 bp, Mus musculus
ccccatgtacagctcacaaactcaa

SEQ ID NO: 243977 - DNA, 25 bp, Mus musculus
ccccatgtcagggagacagctgtta

SEQ ID NO: 243978 - DNA, 25 bp, Mus musculus
ccccatgtcatccagttactgctga

SEQ ID NO: 243979 - DNA, 25 bp, Mus musculus
ccccatgtggccacagtacacgaac

SEQ ID NO: 243980 - DNA, 25 bp, Mus musculus
ccccattacctccaggctcggttgt

SEQ ID NO: 243981 - DNA, 25 bp, Mus musculus
ccccattacctccagtgtgacaaat

SEQ ID NO: 243982 - DNA, 25 bp, Mus musculus
ccccattagaaacaagccacggaag

SEQ ID NO: 243983 - DNA, 25 bp, Mus musculus
ccccattagaaaccacctaccctca

SEQ ID NO: 243984 - DNA, 25 bp, Mus musculus
ccccattaggaagatcaaaggcaca

SEQ ID NO: 243985 - DNA, 25 bp, Mus musculus
ccccattcaagaaattggcaccacc

SEQ ID NO: 243986 - DNA, 25 bp, Mus musculus
ccccattccaaggcaacccgcaggg

SEQ ID NO: 243987 - DNA, 25 bp, Mus musculus
ccccattcttcctcggtgtgcagag

SEQ ID NO: 243988 - DNA, 25 bp, Mus musculus
ccccattgagctcatgtttgcttct

SEQ ID NO: 243989 - DNA, 25 bp, Mus musculus
ccccattgagctggtggttttccta

SEQ ID NO: 243990 - DNA, 25 bp, Mus musculus
ccccattgaggtgaccagaatggag

SEQ ID NO: 243991 - DNA, 25 bp, Mus musculus
ccccattgattaagagtgtcaacag

SEQ ID NO: 243992 - DNA, 25 bp, Mus musculus
ccccattgattaaggcagtagagtg

SEQ ID NO: 243993 - DNA, 25 bp, Mus musculus
ccccattgccgagctcggcttcatg

SEQ ID NO: 243994 - DNA, 25 bp, Mus musculus
ccccattggagaggaacctgctttg

SEQ ID NO: 243995 - DNA, 25 bp, Mus musculus
ccccattggagccaaggctgttgtg

SEQ ID NO: 243996 - DNA, 25 bp, Mus musculus
ccccatttacagggagaagctgggc

SEQ ID NO: 243997 - DNA, 25 bp, Mus musculus
ccccatttccctggcaggttcaccg

SEQ ID NO: 243998 - DNA, 25 bp, Mus musculus
ccccattttacagaactgtatgagg

SEQ ID NO: 243999 - DNA, 25 bp, Mus musculus
ccccattttgacaccatttggaggt

SEQ ID NO: 244000 - DNA, 25 bp, Mus musculus
cccccaaactgaagaagtagctaaa

SEQ ID NO: 244001 - DNA, 25 bp, Mus musculus
cccccaaagatcagagatggagtct

SEQ ID NO: 244002 - DNA, 25 bp, Mus musculus
cccccaaagatcaggagatttgtac

SEQ ID NO: 244003 - DNA, 25 bp, Mus musculus
cccccaaccacgctggggtctccaa

SEQ ID NO: 244004 - DNA, 25 bp, Mus musculus
cccccaactattgtgaccagatggg

SEQ ID NO: 244005 - DNA, 25 bp, Mus musculus
cccccaactgagggcaggctggata

SEQ ID NO: 244006 - DNA, 25 bp, Mus musculus
cccccaacttaaagactgaagtgtt

SEQ ID NO: 244007 - DNA, 25 bp, Mus musculus
cccccaagaccagtgacagtgggaa

SEQ ID NO: 244008 - DNA, 25 bp, Mus musculus
cccccaagaccatgtgtgccgacaa

SEQ ID NO: 244009 - DNA, 25 bp, Mus musculus
cccccaaggaggagtcaggcctcgt

SEQ ID NO: 244010 - DNA, 25 bp, Mus musculus
cccccaaggaggcggacgctcagcg

SEQ ID NO: 244011 - DNA, 25 bp, Mus musculus
cccccaaggaggtaagcctggactc

SEQ ID NO: 244012 - DNA, 25 bp, Mus musculus
cccccaaggaggtctctgagtgtga

SEQ ID NO: 244013 - DNA, 25 bp, Mus musculus
cccccaagtctgctgccctgctgtc

SEQ ID NO: 244014 - DNA, 25 bp, Mus musculus
cccccaatatgaacattttccctca

SEQ ID NO: 244015 - DNA, 25 bp, Mus musculus
cccccaatcgcaagacggtgcctct

SEQ ID NO: 244016 - DNA, 25 bp, Mus musculus
cccccaatcgcaaggattcttcttc

SEQ ID NO: 244017 - DNA, 25 bp, Mus musculus
cccccaatgacaggttcattttgct

SEQ ID NO: 244018 - DNA, 25 bp, Mus musculus
cccccacaagcctgaaatcaactcc

SEQ ID NO: 244019 - DNA, 25 bp, Mus musculus
cccccacaagcctgagccaggaggg

SEQ ID NO: 244020 - DNA, 25 bp, Mus musculus
cccccacagctaggctttcagtctc

SEQ ID NO: 244021 - DNA, 25 bp, Mus musculus
cccccacagctccttcccagctggt

SEQ ID NO: 244022 - DNA, 25 bp, Mus musculus
cccccaccagaaggaccctgctctg

SEQ ID NO: 244023 - DNA, 25 bp, Mus musculus
cccccaccagaaggtggtagccaat

SEQ ID NO: 244024 - DNA, 25 bp, Mus musculus
cccccaccagcttcccttcagggca

SEQ ID NO: 244025 - DNA, 25 bp, Mus musculus
cccccaccaggagagaaaggacaga

SEQ ID NO: 244026 - DNA, 25 bp, Mus musculus
cccccaccaggcctcggtgtctcca

SEQ ID NO: 244027 - DNA, 25 bp, Mus musculus
cccccaccatgaatttgtggcccta

SEQ ID NO: 244028 - DNA, 25 bp, Mus musculus
cccccaccccccagcaagagccaga

SEQ ID NO: 244029 - DNA, 25 bp, Mus musculus
cccccaccccccaggacatgacaga

SEQ ID NO: 244030 - DNA, 25 bp, Mus musculus
cccccacccgagttctatccaggac

SEQ ID NO: 244031 - DNA, 25 bp, Mus musculus
cccccaccctctgtggatttcctga

SEQ ID NO: 244032 - DNA, 25 bp, Mus musculus
cccccacctactgagctggtctgta

SEQ ID NO: 244033 - DNA, 25 bp, Mus musculus
cccccacctactggggacttctggt

SEQ ID NO: 244034 - DNA, 25 bp, Mus musculus
cccccacgcctggcctctgccttcg

SEQ ID NO: 244035 - DNA, 25 bp, Mus musculus
cccccacgtgattccttagaaactc

SEQ ID NO: 244036 - DNA, 25 bp, Mus musculus
cccccacgtggaagaaaggtcaggc

SEQ ID NO: 244037 - DNA, 25 bp, Mus musculus
cccccactccggcggccccgcaatc

SEQ ID NO: 244038 - DNA, 25 bp, Mus musculus
cccccactgacccagactctcaggt

SEQ ID NO: 244039 - DNA, 25 bp, Mus musculus
cccccactggagagaccactgctat

SEQ ID NO: 244040 - DNA, 25 bp, Mus musculus
cccccagaagagttctcttccttca

SEQ ID NO: 244041 - DNA, 25 bp, Mus musculus
cccccagaatggtgggacgctcgtc

SEQ ID NO: 244042 - DNA, 25 bp, Mus musculus
cccccagaccgatatgacagcctgg

SEQ ID NO: 244043 - DNA, 25 bp, Mus musculus
cccccagagagctctcatggtacca

SEQ ID NO: 244044 - DNA, 25 bp, Mus musculus
cccccagagaggcagagcccctggg

SEQ ID NO: 244045 - DNA, 25 bp, Mus musculus
cccccagagccacgagcaatgctac

SEQ ID NO: 244046 - DNA, 25 bp, Mus musculus
cccccagagccaggagcaatgctac

SEQ ID NO: 244047 - DNA, 25 bp, Mus musculus
cccccagcacctggctgacagccta

SEQ ID NO: 244048 - DNA, 25 bp, Mus musculus
cccccagcactgtgtcgaccccctc

SEQ ID NO: 244049 - DNA, 25 bp, Mus musculus
cccccagcagtctaaggtggtaaac

SEQ ID NO: 244050 - DNA, 25 bp, Mus musculus
cccccagcagtggataaaatatttt

SEQ ID NO: 244051 - DNA, 25 bp, Mus musculus
cccccagccacgagcctcccaagct

SEQ ID NO: 244052 - DNA, 25 bp, Mus musculus
cccccagccaggatgatgtctacag

SEQ ID NO: 244053 - DNA, 25 bp, Mus musculus
cccccagccagtgtgaccccacaac

SEQ ID NO: 244054 - DNA, 25 bp, Mus musculus
cccccagcccagtgcactaaggggt

SEQ ID NO: 244055 - DNA, 25 bp, Mus musculus
cccccagccccagcagcctggtaga

SEQ ID NO: 244056 - DNA, 25 bp, Mus musculus
cccccagccccagtccttcaggctc

SEQ ID NO: 244057 - DNA, 25 bp, Mus musculus
cccccagcccctgatacgacccgga

SEQ ID NO: 244058 - DNA, 25 bp, Mus musculus
cccccagcccctgtcctgcacttct

SEQ ID NO: 244059 - DNA, 25 bp, Mus musculus
cccccagctccagtgaggacagcga

SEQ ID NO: 244060 - DNA, 25 bp, Mus musculus
cccccagctgagcggcagccgccac

SEQ ID NO: 244061 - DNA, 25 bp, Mus musculus
cccccagctgagcggtcaaagcagc

SEQ ID NO: 244062 - DNA, 25 bp, Mus musculus
cccccagctgtggtagtcaggagtt

SEQ ID NO: 244063 - DNA, 25 bp, Mus musculus
cccccagctgtggtattcaggctga

SEQ ID NO: 244064 - DNA, 25 bp, Mus musculus
cccccagcttcggcttgttttattg

SEQ ID NO: 244065 - DNA, 25 bp, Mus musculus
cccccagcttcgggtcttttcacct

SEQ ID NO: 244066 - DNA, 25 bp, Mus musculus
cccccaggaggcatcacagcagaag

SEQ ID NO: 244067 - DNA, 25 bp, Mus musculus
cccccaggagttattcctcataaaa

SEQ ID NO: 244068 - DNA, 25 bp, Mus musculus
cccccaggcagcttattgatgtcct

SEQ ID NO: 244069 - DNA, 25 bp, Mus musculus
cccccaggcccaggcgtgctggtca

SEQ ID NO: 244070 - DNA, 25 bp, Mus musculus
cccccaggctggagagaatgaagat

SEQ ID NO: 244071 - DNA, 25 bp, Mus musculus
cccccagggtcccgcaagaatcaaa

SEQ ID NO: 244072 - DNA, 25 bp, Mus musculus
cccccaggtgctaatggcaatcctg

SEQ ID NO: 244073 - DNA, 25 bp, Mus musculus
cccccaggttggaagagcaattcta

SEQ ID NO: 244074 - DNA, 25 bp, Mus musculus
cccccagtagaaatcgcagcctgca

SEQ ID NO: 244075 - DNA, 25 bp, Mus musculus
cccccagtcacggaggcctcctctg

SEQ ID NO: 244076 - DNA, 25 bp, Mus musculus
cccccagtcagatctgtctcgagag

SEQ ID NO: 244077 - DNA, 25 bp, Mus musculus
cccccagtcaggccggggctgtgcc

SEQ ID NO: 244078 - DNA, 25 bp, Mus musculus
cccccagtgagcctccctctcccca

SEQ ID NO: 244079 - DNA, 25 bp, Mus musculus
cccccagtgccctgggcaaggccac

SEQ ID NO: 244080 - DNA, 25 bp, Mus musculus
cccccatacggtgcctcctgagaag

SEQ ID NO: 244081 - DNA, 25 bp, Mus musculus
cccccatagtactttccgttgtgtc

SEQ ID NO: 244082 - DNA, 25 bp, Mus musculus
cccccatagtactttttgcatagta

SEQ ID NO: 244083 - DNA, 25 bp, Mus musculus
cccccatcagaacagcgcaagaaga

SEQ ID NO: 244084 - DNA, 25 bp, Mus musculus
cccccatctcagagatgggctttgc

SEQ ID NO: 244085 - DNA, 25 bp, Mus musculus
cccccatctcagaggctggtgtttg

SEQ ID NO: 244086 - DNA, 25 bp, Mus musculus
cccccatgaacacagctatcgcggt

SEQ ID NO: 244087 - DNA, 25 bp, Mus musculus
cccccatgaacacagctttttgcct

SEQ ID NO: 244088 - DNA, 25 bp, Mus musculus
cccccatgacccagaggcaaaactc

SEQ ID NO: 244089 - DNA, 25 bp, Mus musculus
cccccatgacccaggtatacaagag

SEQ ID NO: 244090 - DNA, 25 bp, Mus musculus
cccccatgcgcagctccagacctct

SEQ ID NO: 244091 - DNA, 25 bp, Mus musculus
cccccatggaaccagaaaatgagaa

SEQ ID NO: 244092 - DNA, 25 bp, Mus musculus
cccccatggaaccagctctgttaag

SEQ ID NO: 244093 - DNA, 25 bp, Mus musculus
cccccattaggaagatcaaaggcac

SEQ ID NO: 244094 - DNA, 25 bp, Mus musculus
cccccattccaaggcaacccgcagg

SEQ ID NO: 244095 - DNA, 25 bp, Mus musculus
cccccattcttcctcggtgtgcaga

SEQ ID NO: 244096 - DNA, 25 bp, Mus musculus
cccccattggagaggaacctgcttt

SEQ ID NO: 244097 - DNA, 25 bp, Mus musculus
cccccattggagccaaggctgttgt

SEQ ID NO: 244098 - DNA, 25 bp, Mus musculus
cccccattttacagaactgtatgag

SEQ ID NO: 244099 - DNA, 25 bp, Mus musculus
ccccccaactgagggcaggctggat

SEQ ID NO: 244100 - DNA, 25 bp, Mus musculus
ccccccaaggaggagtcaggcctcg

SEQ ID NO: 244101 - DNA, 25 bp, Mus musculus
ccccccacagctaggctttcagtct

SEQ ID NO: 244102 - DNA, 25 bp, Mus musculus
ccccccacaggtcatcctgttcagt

SEQ ID NO: 244103 - DNA, 25 bp, Mus musculus
ccccccagaatggtgggacgctcgt

SEQ ID NO: 244104 - DNA, 25 bp, Mus musculus
ccccccagcacctggctgacagcct

SEQ ID NO: 244105 - DNA, 25 bp, Mus musculus
ccccccagccacgagcctcccaagc

SEQ ID NO: 244106 - DNA, 25 bp, Mus musculus
ccccccagccaggatgatgtctaca

SEQ ID NO: 244107 - DNA, 25 bp, Mus musculus
ccccccagccagtgtgaccccacaa

SEQ ID NO: 244108 - DNA, 25 bp, Mus musculus
ccccccagctccagtgaggacagcg

SEQ ID NO: 244109 - DNA, 25 bp, Mus musculus
ccccccatgacccagaggcaaaact

SEQ ID NO: 244110 - DNA, 25 bp, Mus musculus
ccccccatgacccaggtatacaaga

SEQ ID NO: 244111 - DNA, 25 bp, Mus musculus
ccccccattccaaggcaacccgcag

SEQ ID NO: 244112 - DNA, 25 bp, Mus musculus
cccccccacagctaggctttcagtc

SEQ ID NO: 244113 - DNA, 25 bp, Mus musculus
cccccccacaggtcatcctgttcag

SEQ ID NO: 244114 - DNA, 25 bp, Mus musculus
cccccccctccaactggcttaatgg

SEQ ID NO: 244115 - DNA, 25 bp, Mus musculus
ccccccctccaactggcttaatggt

SEQ ID NO: 244116 - DNA, 25 bp, Mus musculus
ccccccctggacagcaagccccgcc

SEQ ID NO: 244117 - DNA, 25 bp, Mus musculus
ccccccgatctagtgttgacagccc

SEQ ID NO: 244118 - DNA, 25 bp, Mus musculus
ccccccggcagatgagacaccaatt

SEQ ID NO: 244119 - DNA, 25 bp, Mus musculus
ccccccggcaggtaattctgactca

SEQ ID NO: 244120 - DNA, 25 bp, Mus musculus
ccccccggccccagtggacctgctg

SEQ ID NO: 244121 - DNA, 25 bp, Mus musculus
ccccccgggattgcctatcctctac

SEQ ID NO: 244122 - DNA, 25 bp, Mus musculus
ccccccgggctcacattaatatttg

SEQ ID NO: 244123 - DNA, 25 bp, Mus musculus
ccccccgggtctgtctgccaaaatg

SEQ ID NO: 244124 - DNA, 25 bp, Mus musculus
cccccctaagggcagcagcaatgac

SEQ ID NO: 244125 - DNA, 25 bp, Mus musculus
cccccctatggcgagacagctcagc

SEQ ID NO: 244126 - DNA, 25 bp, Mus musculus
cccccctccaactggcttaatggtg

SEQ ID NO: 244127 - DNA, 25 bp, Mus musculus
cccccctccttccaccctcatgcta

SEQ ID NO: 244128 - DNA, 25 bp, Mus musculus
cccccctggaagcaggagcctccag

SEQ ID NO: 244129 - DNA, 25 bp, Mus musculus
cccccctggacagcaagccccgccc

SEQ ID NO: 244130 - DNA, 25 bp, Mus musculus
cccccctgggattaggagtgccagg

SEQ ID NO: 244131 - DNA, 25 bp, Mus musculus
ccccccttttctgaatgaagatatc

SEQ ID NO: 244132 - DNA, 25 bp, Mus musculus
cccccgaaagagggtggtgtcatgg

SEQ ID NO: 244133 - DNA, 25 bp, Mus musculus
cccccgaaataggctgctggcaccc

SEQ ID NO: 244134 - DNA, 25 bp, Mus musculus
cccccgaagttcagagtaaagacat

SEQ ID NO: 244135 - DNA, 25 bp, Mus musculus
cccccgaccagagcagagggctgcg

SEQ ID NO: 244136 - DNA, 25 bp, Mus musculus
cccccgacgacgatcttggatctag

SEQ ID NO: 244137 - DNA, 25 bp, Mus musculus
cccccgacgccttgccaccccgctg

SEQ ID NO: 244138 - DNA, 25 bp, Mus musculus
cccccgacgccttggtcactggcac

SEQ ID NO: 244139 - DNA, 25 bp, Mus musculus
cccccgagctgctcttgtgaagtcc

SEQ ID NO: 244140 - DNA, 25 bp, Mus musculus
cccccgagtacagaaatgctgagct

SEQ ID NO: 244141 - DNA, 25 bp, Mus musculus
cccccgatctagtgttgacagcccc

SEQ ID NO: 244142 - DNA, 25 bp, Mus musculus
cccccgcaagcctcctggaggacca

SEQ ID NO: 244143 - DNA, 25 bp, Mus musculus
cccccgcaaggagatggagttctac

SEQ ID NO: 244144 - DNA, 25 bp, Mus musculus
cccccgcacggagagaagaaaccaa

SEQ ID NO: 244145 - DNA, 25 bp, Mus musculus
cccccgcagccgacatgcgctacgt

SEQ ID NO: 244146 - DNA, 25 bp, Mus musculus
cccccgcaggtgaaggacagcaacc

SEQ ID NO: 244147 - DNA, 25 bp, Mus musculus
cccccgccacattgacagttctcca

SEQ ID NO: 244148 - DNA, 25 bp, Mus musculus
cccccgccatcacaggcttctgtgt

SEQ ID NO: 244149 - DNA, 25 bp, Mus musculus
cccccgcccaggacagtcggcccaa

SEQ ID NO: 244150 - DNA, 25 bp, Mus musculus
cccccgccgcgccttcatcaagtag

SEQ ID NO: 244151 - DNA, 25 bp, Mus musculus
cccccgccgtgtgagcgtcctggga

SEQ ID NO: 244152 - DNA, 25 bp, Mus musculus
cccccgcgggagcagcaccccttgg

SEQ ID NO: 244153 - DNA, 25 bp, Mus musculus
cccccgcgggagcaggccggaagct

SEQ ID NO: 244154 - DNA, 25 bp, Mus musculus
cccccgctcctgggccgcaaacagg

SEQ ID NO: 244155 - DNA, 25 bp, Mus musculus
cccccgctgcacaacacccccgccc

SEQ ID NO: 244156 - DNA, 25 bp, Mus musculus
cccccgctggtaagattgagaaagg

SEQ ID NO: 244157 - DNA, 25 bp, Mus musculus
cccccgcttcggtactctaacaaga

SEQ ID NO: 244158 - DNA, 25 bp, Mus musculus
cccccgcttcggtatgactcaatag

SEQ ID NO: 244159 - DNA, 25 bp, Mus musculus
cccccggaagccgaactgctttgag

SEQ ID NO: 244160 - DNA, 25 bp, Mus musculus
cccccggaaggtatcatccggatat

SEQ ID NO: 244161 - DNA, 25 bp, Mus musculus
cccccggaatggtgaagtgtgtccg

SEQ ID NO: 244162 - DNA, 25 bp, Mus musculus
cccccggcagatgagacaccaatta

SEQ ID NO: 244163 - DNA, 25 bp, Mus musculus
cccccggcagcaggatgaaacgagg

SEQ ID NO: 244164 - DNA, 25 bp, Mus musculus
cccccggcagcagtctcactttatc

SEQ ID NO: 244165 - DNA, 25 bp, Mus musculus
cccccggcaggtaattctgactcaa

SEQ ID NO: 244166 - DNA, 25 bp, Mus musculus
cccccggcagtcaggagatggagga

SEQ ID NO: 244167 - DNA, 25 bp, Mus musculus
cccccggccccagtggacctgctgg

SEQ ID NO: 244168 - DNA, 25 bp, Mus musculus
cccccggcggacagagttgatggtg

SEQ ID NO: 244169 - DNA, 25 bp, Mus musculus
cccccgggattgcctatcctctact

SEQ ID NO: 244170 - DNA, 25 bp, Mus musculus
cccccgggctcacattaatatttgc

SEQ ID NO: 244171 - DNA, 25 bp, Mus musculus
cccccgggtctgtctgccaaaatgt

SEQ ID NO: 244172 - DNA, 25 bp, Mus musculus
cccccgtccagacactactttgctc

SEQ ID NO: 244173 - DNA, 25 bp, Mus musculus
cccccgtgtacgaaggtatggcctc

SEQ ID NO: 244174 - DNA, 25 bp, Mus musculus
cccccgtgttcaaggatgccgccgt

SEQ ID NO: 244175 - DNA, 25 bp, Mus musculus
ccccctaacaaggtcccaggcagtc

SEQ ID NO: 244176 - DNA, 25 bp, Mus musculus
ccccctaacatgcagtacactgcca

SEQ ID NO: 244177 - DNA, 25 bp, Mus musculus
ccccctaactctaggatgaagaggg

SEQ ID NO: 244178 - DNA, 25 bp, Mus musculus
ccccctacaagccaccaatcagagc

SEQ ID NO: 244179 - DNA, 25 bp, Mus musculus
ccccctacaagccagcaatcagagc

SEQ ID NO: 244180 - DNA, 25 bp, Mus musculus
ccccctagaagtggccctgccgcct

SEQ ID NO: 244181 - DNA, 25 bp, Mus musculus
ccccctagacaggataagacgctgt

SEQ ID NO: 244182 - DNA, 25 bp, Mus musculus
ccccctagactggcttaagatactc

SEQ ID NO: 244183 - DNA, 25 bp, Mus musculus
ccccctagattcatcggagaaggaa

SEQ ID NO: 244184 - DNA, 25 bp, Mus musculus
ccccctagattcatcgttttgcgag

SEQ ID NO: 244185 - DNA, 25 bp, Mus musculus
ccccctagcaaagaggaaagcgatt

SEQ ID NO: 244186 - DNA, 25 bp, Mus musculus
ccccctagcaaagaggctcctgaca

SEQ ID NO: 244187 - DNA, 25 bp, Mus musculus
ccccctagcctggtctgggacctgt

SEQ ID NO: 244188 - DNA, 25 bp, Mus musculus
ccccctatacaggaggttcaagttc

SEQ ID NO: 244189 - DNA, 25 bp, Mus musculus
ccccctatctcgtgggccttacgat

SEQ ID NO: 244190 - DNA, 25 bp, Mus musculus
ccccctatggcgagacagctcagct

SEQ ID NO: 244191 - DNA, 25 bp, Mus musculus
ccccctcacagctctcagggcctgt

SEQ ID NO: 244192 - DNA, 25 bp, Mus musculus
ccccctcaccagccccggctgcaca

SEQ ID NO: 244193 - DNA, 25 bp, Mus musculus
ccccctcagcccaggatctagagtc

SEQ ID NO: 244194 - DNA, 25 bp, Mus musculus
ccccctcagcccagggtctccctac

SEQ ID NO: 244195 - DNA, 25 bp, Mus musculus
ccccctcagcccaggtggtgctctg

SEQ ID NO: 244196 - DNA, 25 bp, Mus musculus
ccccctcattcaagatgttcacacg

SEQ ID NO: 244197 - DNA, 25 bp, Mus musculus
ccccctcattcaaggagtagaccca

SEQ ID NO: 244198 - DNA, 25 bp, Mus musculus
ccccctccaactcagatctctcgtc

SEQ ID NO: 244199 - DNA, 25 bp, Mus musculus
ccccctccaactcagccctccagga

SEQ ID NO: 244200 - DNA, 25 bp, Mus musculus
ccccctccaactggcttaatggtga

SEQ ID NO: 244201 - DNA, 25 bp, Mus musculus
ccccctcccagagctctcttccggc

SEQ ID NO: 244202 - DNA, 25 bp, Mus musculus
ccccctccccctgaccagctgtccc

SEQ ID NO: 244203 - DNA, 25 bp, Mus musculus
ccccctcctattccagtatcatttt

SEQ ID NO: 244204 - DNA, 25 bp, Mus musculus
ccccctccttccaccctcatgctag

SEQ ID NO: 244205 - DNA, 25 bp, Mus musculus
ccccctcggtgactctgtgaaccta

SEQ ID NO: 244206 - DNA, 25 bp, Mus musculus
ccccctcgtctgctccacttccacc

SEQ ID NO: 244207 - DNA, 25 bp, Mus musculus
ccccctctagtgagcactcccagtg

SEQ ID NO: 244208 - DNA, 25 bp, Mus musculus
ccccctctccaggtgtctccagtgc

SEQ ID NO: 244209 - DNA, 25 bp, Mus musculus
ccccctcttcaactctggctccagt

SEQ ID NO: 244210 - DNA, 25 bp, Mus musculus
ccccctgaaagcctctggagatgga

SEQ ID NO: 244211 - DNA, 25 bp, Mus musculus
ccccctgattggcaggtctcacatg

SEQ ID NO: 244212 - DNA, 25 bp, Mus musculus
ccccctgcaagctaggtaggaacaa

SEQ ID NO: 244213 - DNA, 25 bp, Mus musculus
ccccctgcagttggacatttggctc

SEQ ID NO: 244214 - DNA, 25 bp, Mus musculus
ccccctgctccaccttctcgagaag

SEQ ID NO: 244215 - DNA, 25 bp, Mus musculus
ccccctggaagcaggagcctccaga

SEQ ID NO: 244216 - DNA, 25 bp, Mus musculus
ccccctggacagcaagccccgccca

SEQ ID NO: 244217 - DNA, 25 bp, Mus musculus
ccccctggaccgggagcagaatgga

SEQ ID NO: 244218 - DNA, 25 bp, Mus musculus
ccccctggagagagaggtgctcctg

SEQ ID NO: 244219 - DNA, 25 bp, Mus musculus
ccccctggagtcctttcactgcacc

SEQ ID NO: 244220 - DNA, 25 bp, Mus musculus
ccccctggcaacagtgatccggagc

SEQ ID NO: 244221 - DNA, 25 bp, Mus musculus
ccccctggcaggttcagagcattgc

SEQ ID NO: 244222 - DNA, 25 bp, Mus musculus
ccccctggcctgagaagcctgtaca

SEQ ID NO: 244223 - DNA, 25 bp, Mus musculus
ccccctggcctgattgcagcccggg

SEQ ID NO: 244224 - DNA, 25 bp, Mus musculus
ccccctgggattaggagtgccagga

SEQ ID NO: 244225 - DNA, 25 bp, Mus musculus
ccccctggggtctggagggagagcc

SEQ ID NO: 244226 - DNA, 25 bp, Mus musculus
ccccctggtcaggagtgctgcaaag

SEQ ID NO: 244227 - DNA, 25 bp, Mus musculus
ccccctggtcaggcactcggacatg

SEQ ID NO: 244228 - DNA, 25 bp, Mus musculus
ccccctggtcctgctggcttccctg

SEQ ID NO: 244229 - DNA, 25 bp, Mus musculus
ccccctggtgcacctggtccacaag

SEQ ID NO: 244230 - DNA, 25 bp, Mus musculus
ccccctgtggagaggagatacttca

SEQ ID NO: 244231 - DNA, 25 bp, Mus musculus
ccccctgtgtgcatcagcatcatcc

SEQ ID NO: 244232 - DNA, 25 bp, Mus musculus
ccccctgtttccaagctctgtccgg

SEQ ID NO: 244233 - DNA, 25 bp, Mus musculus
cccccttctacttcagagccaccag

SEQ ID NO: 244234 - DNA, 25 bp, Mus musculus
cccccttggaacagtctggccagaa

SEQ ID NO: 244235 - DNA, 25 bp, Mus musculus
cccccttgtgaacgaggctgctgcg

SEQ ID NO: 244236 - DNA, 25 bp, Mus musculus
ccccctttcacagagcatgatctcc

SEQ ID NO: 244237 - DNA, 25 bp, Mus musculus
ccccctttcacaggctcctgagcat

SEQ ID NO: 244238 - DNA, 25 bp, Mus musculus
ccccctttcatacctgctactacag

SEQ ID NO: 244239 - DNA, 25 bp, Mus musculus
ccccctttcgccacagcccaactgg

SEQ ID NO: 244240 - DNA, 25 bp, Mus musculus
ccccctttggagacctccacacagc

SEQ ID NO: 244241 - DNA, 25 bp, Mus musculus
cccccttttcctgagagtttggatt

SEQ ID NO: 244242 - DNA, 25 bp, Mus musculus
cccccttttctgaatgaagatatcc

SEQ ID NO: 244243 - DNA, 25 bp, Mus musculus
ccccgaaacagcagagaactgggga

SEQ ID NO: 244244 - DNA, 25 bp, Mus musculus
ccccgaaactcagttccagagcctc

SEQ ID NO: 244245 - DNA, 25 bp, Mus musculus
ccccgaaagagggtggtgtcatgga

SEQ ID NO: 244246 - DNA, 25 bp, Mus musculus
ccccgaaataggctgctggcaccct

SEQ ID NO: 244247 - DNA, 25 bp, Mus musculus
ccccgaacaacagacgagctaaact

SEQ ID NO: 244248 - DNA, 25 bp, Mus musculus
ccccgaacaacaggtcttcacacaa

SEQ ID NO: 244249 - DNA, 25 bp, Mus musculus
ccccgaactttagaccatgccgtcc

SEQ ID NO: 244250 - DNA, 25 bp, Mus musculus
ccccgaagcagaggatgaaggacgc

SEQ ID NO: 244251 - DNA, 25 bp, Mus musculus
ccccgaagccccggccaccatgttc

SEQ ID NO: 244252 - DNA, 25 bp, Mus musculus
ccccgaagccgggctgatgtgatga

SEQ ID NO: 244253 - DNA, 25 bp, Mus musculus
ccccgaagttcagagtaaagacatt

SEQ ID NO: 244254 - DNA, 25 bp, Mus musculus
ccccgaatccagaatcggaagactc

SEQ ID NO: 244255 - DNA, 25 bp, Mus musculus
ccccgaattcctcctccaccgtcgt

SEQ ID NO: 244256 - DNA, 25 bp, Mus musculus
ccccgacacaggtggagaatataaa

SEQ ID NO: 244257 - DNA, 25 bp, Mus musculus
ccccgacacaggtgtgtatccagag

SEQ ID NO: 244258 - DNA, 25 bp, Mus musculus
ccccgaccagagcagagggctgcgg

SEQ ID NO: 244259 - DNA, 25 bp, Mus musculus
ccccgacccagactcattacaggcc

SEQ ID NO: 244260 - DNA, 25 bp, Mus musculus
ccccgacccaggggagcagcgcggt

SEQ ID NO: 244261 - DNA, 25 bp, Mus musculus
ccccgacccagtggctagacctaga

SEQ ID NO: 244262 - DNA, 25 bp, Mus musculus
ccccgaccctgagttctgaggctct

SEQ ID NO: 244263 - DNA, 25 bp, Mus musculus
ccccgacctggagcgtgtatcgaca

SEQ ID NO: 244264 - DNA, 25 bp, Mus musculus
ccccgacgacgatcttggatctagc

SEQ ID NO: 244265 - DNA, 25 bp, Mus musculus
ccccgacgcaggtcctacggcctgg

SEQ ID NO: 244266 - DNA, 25 bp, Mus musculus
ccccgacgcaggtgttctttgacag

SEQ ID NO: 244267 - DNA, 25 bp, Mus musculus
ccccgacgccttccccagctgggcc

SEQ ID NO: 244268 - DNA, 25 bp, Mus musculus
ccccgacgccttgccaccccgctgg

SEQ ID NO: 244269 - DNA, 25 bp, Mus musculus
ccccgacgccttggtcactggcaca

SEQ ID NO: 244270 - DNA, 25 bp, Mus musculus
ccccgacttggtgaaaaattgcatg

SEQ ID NO: 244271 - DNA, 25 bp, Mus musculus
ccccgacttggtgaagactccatta

SEQ ID NO: 244272 - DNA, 25 bp, Mus musculus
ccccgacttggtgataaggtacagt

SEQ ID NO: 244273 - DNA, 25 bp, Mus musculus
ccccgacttggtgatgaaaccatta

SEQ ID NO: 244274 - DNA, 25 bp, Mus musculus
ccccgagaaagaggtgggacttctg

SEQ ID NO: 244275 - DNA, 25 bp, Mus musculus
ccccgagaaagggtatatgtatttt

SEQ ID NO: 244276 - DNA, 25 bp, Mus musculus
ccccgagaacgacccaggttcaagc

SEQ ID NO: 244277 - DNA, 25 bp, Mus musculus
ccccgagagccactgattgccacag

SEQ ID NO: 244278 - DNA, 25 bp, Mus musculus
ccccgagagccactggactgacaga

SEQ ID NO: 244279 - DNA, 25 bp, Mus musculus
ccccgagcaggatggtgaggattca

SEQ ID NO: 244280 - DNA, 25 bp, Mus musculus
ccccgagccagcaagggggaagaaa

SEQ ID NO: 244281 - DNA, 25 bp, Mus musculus
ccccgagcccggaagagaaaagaga

SEQ ID NO: 244282 - DNA, 25 bp, Mus musculus
ccccgagccgcagggccagttcctg

SEQ ID NO: 244283 - DNA, 25 bp, Mus musculus
ccccgagcgcccgcgtccagaggac

SEQ ID NO: 244284 - DNA, 25 bp, Mus musculus
ccccgagctcacagctatccctctc

SEQ ID NO: 244285 - DNA, 25 bp, Mus musculus
ccccgagctgctcttgtgaagtcct

SEQ ID NO: 244286 - DNA, 25 bp, Mus musculus
ccccgaggagatctcccctctggta

SEQ ID NO: 244287 - DNA, 25 bp, Mus musculus
ccccgaggagctacagttttattac

SEQ ID NO: 244288 - DNA, 25 bp, Mus musculus
ccccgaggcagaatctagatcttga

SEQ ID NO: 244289 - DNA, 25 bp, Mus musculus
ccccgaggcagatgtgtccttccgg

SEQ ID NO: 244290 - DNA, 25 bp, Mus musculus
ccccgaggcaggtctctgctgaccc

SEQ ID NO: 244291 - DNA, 25 bp, Mus musculus
ccccgaggcggagtgggtgacccgg

SEQ ID NO: 244292 - DNA, 25 bp, Mus musculus
ccccgaggcggagtggttctctttc

SEQ ID NO: 244293 - DNA, 25 bp, Mus musculus
ccccgaggcggttctcctgattctg

SEQ ID NO: 244294 - DNA, 25 bp, Mus musculus
ccccgagggcggggcagcctgatga

SEQ ID NO: 244295 - DNA, 25 bp, Mus musculus
ccccgagtacagaaatgctgagctt

SEQ ID NO: 244296 - DNA, 25 bp, Mus musculus
ccccgagtagctgggtatcatagtt

SEQ ID NO: 244297 - DNA, 25 bp, Mus musculus
ccccgagtgttgggagcgggatgac

SEQ ID NO: 244298 - DNA, 25 bp, Mus musculus
ccccgatccccagacgagcaccaag

SEQ ID NO: 244299 - DNA, 25 bp, Mus musculus
ccccgatcttggtcattgcctttct

SEQ ID NO: 244300 - DNA, 25 bp, Mus musculus
ccccgatgacaagcttgctcgcctg

SEQ ID NO: 244301 - DNA, 25 bp, Mus musculus
ccccgattacgtgggacgagtccgg

SEQ ID NO: 244302 - DNA, 25 bp, Mus musculus
ccccgatttctagcgtatatggagg

SEQ ID NO: 244303 - DNA, 25 bp, Mus musculus
ccccgcaacagcaatccaaacttcc

SEQ ID NO: 244304 - DNA, 25 bp, Mus musculus
ccccgcacagcaggttctccacatg

SEQ ID NO: 244305 - DNA, 25 bp, Mus musculus
ccccgcaccgatgatattatcaaac

SEQ ID NO: 244306 - DNA, 25 bp, Mus musculus
ccccgcacggagagaagaaaccaaa

SEQ ID NO: 244307 - DNA, 25 bp, Mus musculus
ccccgcagccgacatgcgctacgtc

SEQ ID NO: 244308 - DNA, 25 bp, Mus musculus
ccccgcaggatcacgctcctcctag

SEQ ID NO: 244309 - DNA, 25 bp, Mus musculus
ccccgcaggatcacggcaaaatgaa

SEQ ID NO: 244310 - DNA, 25 bp, Mus musculus
ccccgcagggtatttgtaaagatga

SEQ ID NO: 244311 - DNA, 25 bp, Mus musculus
ccccgcaggtgaaggacagcaacca

SEQ ID NO: 244312 - DNA, 25 bp, Mus musculus
ccccgccaagctctcggggataaaa

SEQ ID NO: 244313 - DNA, 25 bp, Mus musculus
ccccgccacccagatctggaacaac

SEQ ID NO: 244314 - DNA, 25 bp, Mus musculus
ccccgccacccagcggccacatcct

SEQ ID NO: 244315 - DNA, 25 bp, Mus musculus
ccccgccagtcaagggacgcaagcg

SEQ ID NO: 244316 - DNA, 25 bp, Mus musculus
ccccgccatcacaggcttctgtgtc

SEQ ID NO: 244317 - DNA, 25 bp, Mus musculus
ccccgcccaggacagtcggcccaat

SEQ ID NO: 244318 - DNA, 25 bp, Mus musculus
ccccgcccagttcagagttccaggg

SEQ ID NO: 244319 - DNA, 25 bp, Mus musculus
ccccgcccagttcagctggcatctg

SEQ ID NO: 244320 - DNA, 25 bp, Mus musculus
ccccgccccagaaacatcgaatgaa

SEQ ID NO: 244321 - DNA, 25 bp, Mus musculus
ccccgccccagtgcaaacagctacc

SEQ ID NO: 244322 - DNA, 25 bp, Mus musculus
ccccgccccattgaggtgaccagaa

SEQ ID NO: 244323 - DNA, 25 bp, Mus musculus
ccccgcccgaggcactagagcagcc

SEQ ID NO: 244324 - DNA, 25 bp, Mus musculus
ccccgcccgcaggtccattcagaag

SEQ ID NO: 244325 - DNA, 25 bp, Mus musculus
ccccgcccggtggacaccaagggct

SEQ ID NO: 244326 - DNA, 25 bp, Mus musculus
ccccgccgcaggcccggacacagag

SEQ ID NO: 244327 - DNA, 25 bp, Mus musculus
ccccgccgcgccttcatcaagtagt

SEQ ID NO: 244328 - DNA, 25 bp, Mus musculus
ccccgccgctgccggagattggcag

SEQ ID NO: 244329 - DNA, 25 bp, Mus musculus
ccccgccggccaatgggcccagtgc

SEQ ID NO: 244330 - DNA, 25 bp, Mus musculus
ccccgccgtgtgagcgtcctgggag

SEQ ID NO: 244331 - DNA, 25 bp, Mus musculus
ccccgcctcgctggccagatcttcc

SEQ ID NO: 244332 - DNA, 25 bp, Mus musculus
ccccgccttgaacagagaaagcacg

SEQ ID NO: 244333 - DNA, 25 bp, Mus musculus
ccccgcgccacggacaagtgacgca

SEQ ID NO: 244334 - DNA, 25 bp, Mus musculus
ccccgcgcggctaactcaacaaaaa

SEQ ID NO: 244335 - DNA, 25 bp, Mus musculus
ccccgcggacaggtttggccgtcgt

SEQ ID NO: 244336 - DNA, 25 bp, Mus musculus
ccccgcggacggcactgagagtatg

SEQ ID NO: 244337 - DNA, 25 bp, Mus musculus
ccccgcggcacgagacaatgaatat

SEQ ID NO: 244338 - DNA, 25 bp, Mus musculus
ccccgcggccccgagcaggtttcaa

SEQ ID NO: 244339 - DNA, 25 bp, Mus musculus
ccccgcggccccgaggagtcagcat

SEQ ID NO: 244340 - DNA, 25 bp, Mus musculus
ccccgcgggagcagcaccccttggg

SEQ ID NO: 244341 - DNA, 25 bp, Mus musculus
ccccgcgggagcaggccggaagctc

SEQ ID NO: 244342 - DNA, 25 bp, Mus musculus
ccccgcggggacagtaagaagacaa

SEQ ID NO: 244343 - DNA, 25 bp, Mus musculus
ccccgcggggacagtgcctttgacg

SEQ ID NO: 244344 - DNA, 25 bp, Mus musculus
ccccgcgtctcggaagactcttcaa

SEQ ID NO: 244345 - DNA, 25 bp, Mus musculus
ccccgctacggctcaatcgtggatg

SEQ ID NO: 244346 - DNA, 25 bp, Mus musculus
ccccgctagacatccgttacaaact

SEQ ID NO: 244347 - DNA, 25 bp, Mus musculus
ccccgctagacatgaaggatggctt

SEQ ID NO: 244348 - DNA, 25 bp, Mus musculus
ccccgctatgagcttgaggaggcac

SEQ ID NO: 244349 - DNA, 25 bp, Mus musculus
ccccgctcaggccccgcgatcagct

SEQ ID NO: 244350 - DNA, 25 bp, Mus musculus
ccccgctcaggtttccaggcttctg

SEQ ID NO: 244351 - DNA, 25 bp, Mus musculus
ccccgctcctgggccgcaaacagga

SEQ ID NO: 244352 - DNA, 25 bp, Mus musculus
ccccgctctgctgccctgaatctgt

SEQ ID NO: 244353 - DNA, 25 bp, Mus musculus
ccccgctgcacaacacccccgcccc

SEQ ID NO: 244354 - DNA, 25 bp, Mus musculus
ccccgctgcagatttgcaacagcat

SEQ ID NO: 244355 - DNA, 25 bp, Mus musculus
ccccgctggaagtttgtgtgagtga

SEQ ID NO: 244356 - DNA, 25 bp, Mus musculus
ccccgctgggcagagggatctttgg

SEQ ID NO: 244357 - DNA, 25 bp, Mus musculus
ccccgctggtaagattgagaaaggt

SEQ ID NO: 244358 - DNA, 25 bp, Mus musculus
ccccgctgtacttgtccagctctta

SEQ ID NO: 244359 - DNA, 25 bp, Mus musculus
ccccgcttccagcagacatccttct

SEQ ID NO: 244360 - DNA, 25 bp, Mus musculus
ccccgcttccgagcctcgattgaac

SEQ ID NO: 244361 - DNA, 25 bp, Mus musculus
ccccgcttcggtactctaacaagaa

SEQ ID NO: 244362 - DNA, 25 bp, Mus musculus
ccccgcttcggtatgactcaataga

SEQ ID NO: 244363 - DNA, 25 bp, Mus musculus
ccccgctttggacagaaaatcaccg

SEQ ID NO: 244364 - DNA, 25 bp, Mus musculus
ccccgctttggacaggatattgact

SEQ ID NO: 244365 - DNA, 25 bp, Mus musculus
ccccgcttttcagatcctggatggt

SEQ ID NO: 244366 - DNA, 25 bp, Mus musculus
ccccggaaactcaagatgtcggttg

SEQ ID NO: 244367 - DNA, 25 bp, Mus musculus
ccccggaaacttagggaatgacaag

SEQ ID NO: 244368 - DNA, 25 bp, Mus musculus
ccccggaagcaggtgcggtgctacc

SEQ ID NO: 244369 - DNA, 25 bp, Mus musculus
ccccggaagccgaactgctttgagc

SEQ ID NO: 244370 - DNA, 25 bp, Mus musculus
ccccggaatggtgaagtgtgtccga

SEQ ID NO: 244371 - DNA, 25 bp, Mus musculus
ccccggacagagacagggcagggca

SEQ ID NO: 244372 - DNA, 25 bp, Mus musculus
ccccggacccctggttctccacata

SEQ ID NO: 244373 - DNA, 25 bp, Mus musculus
ccccggaccgcgcggccacaaaaag

SEQ ID NO: 244374 - DNA, 25 bp, Mus musculus
ccccggagaagagccctaggcgatg

SEQ ID NO: 244375 - DNA, 25 bp, Mus musculus
ccccggagaaggagtgagagagaga

SEQ ID NO: 244376 - DNA, 25 bp, Mus musculus
ccccggaggacacagattccttctg

SEQ ID NO: 244377 - DNA, 25 bp, Mus musculus
ccccggaggaggtgacagagttagt

SEQ ID NO: 244378 - DNA, 25 bp, Mus musculus
ccccggataacgagcgaccgccttc

SEQ ID NO: 244379 - DNA, 25 bp, Mus musculus
ccccggataacgtggaccatgtgtt

SEQ ID NO: 244380 - DNA, 25 bp, Mus musculus
ccccggatgctgcaggttactcggc

SEQ ID NO: 244381 - DNA, 25 bp, Mus musculus
ccccggatgtaccagaagactctaa

SEQ ID NO: 244382 - DNA, 25 bp, Mus musculus
ccccggatgtaccaggtgatttcag

SEQ ID NO: 244383 - DNA, 25 bp, Mus musculus
ccccggatgtggatggaaaagccga

SEQ ID NO: 244384 - DNA, 25 bp, Mus musculus
ccccggatgtggttgccaaaacaaa

SEQ ID NO: 244385 - DNA, 25 bp, Mus musculus
ccccggcaaacatgacctggctcac

SEQ ID NO: 244386 - DNA, 25 bp, Mus musculus
ccccggcagcaggatgaaacgagga

SEQ ID NO: 244387 - DNA, 25 bp, Mus musculus
ccccggcagcagtctcactttatct

SEQ ID NO: 244388 - DNA, 25 bp, Mus musculus
ccccggcagtcaggagatggaggaa

SEQ ID NO: 244389 - DNA, 25 bp, Mus musculus
ccccggccagacagcaattcctcag

SEQ ID NO: 244390 - DNA, 25 bp, Mus musculus
ccccggccagatgaggacaagcctc

SEQ ID NO: 244391 - DNA, 25 bp, Mus musculus
ccccggccagctgactgctgtccac

SEQ ID NO: 244392 - DNA, 25 bp, Mus musculus
ccccggccagtggctcttgaccgca

SEQ ID NO: 244393 - DNA, 25 bp, Mus musculus
ccccggcccacccggtgtgacttct

SEQ ID NO: 244394 - DNA, 25 bp, Mus musculus
ccccggcccacgaagcatgtaatga

SEQ ID NO: 244395 - DNA, 25 bp, Mus musculus
ccccggccccagctgagtgatcgct

SEQ ID NO: 244396 - DNA, 25 bp, Mus musculus
ccccggccccagggctggctgtggg

SEQ ID NO: 244397 - DNA, 25 bp, Mus musculus
ccccggccccagtggacctgctggt

SEQ ID NO: 244398 - DNA, 25 bp, Mus musculus
ccccggccctctgcgcctgtgtctg

SEQ ID NO: 244399 - DNA, 25 bp, Mus musculus
ccccggcctagatgcagcttcagaa

SEQ ID NO: 244400 - DNA, 25 bp, Mus musculus
ccccggcgccaatgagaaagataag

SEQ ID NO: 244401 - DNA, 25 bp, Mus musculus
ccccggcgctgagcctcaaaatgca

SEQ ID NO: 244402 - DNA, 25 bp, Mus musculus
ccccggcgctggagccccaaactac

SEQ ID NO: 244403 - DNA, 25 bp, Mus musculus
ccccggcggacagagttgatggtgt

SEQ ID NO: 244404 - DNA, 25 bp, Mus musculus
ccccggcggagatgaggaaactgag

SEQ ID NO: 244405 - DNA, 25 bp, Mus musculus
ccccggcggaggtgtgaccccacaa

SEQ ID NO: 244406 - DNA, 25 bp, Mus musculus
ccccggctacacagatttgacataa

SEQ ID NO: 244407 - DNA, 25 bp, Mus musculus
ccccggctacagaactttgtaccta

SEQ ID NO: 244408 - DNA, 25 bp, Mus musculus
ccccggctccaggactactacgtgg

SEQ ID NO: 244409 - DNA, 25 bp, Mus musculus
ccccggctgagagtctccagagcca

SEQ ID NO: 244410 - DNA, 25 bp, Mus musculus
ccccggctgcccactccgccttgat

SEQ ID NO: 244411 - DNA, 25 bp, Mus musculus
ccccggctgccctcaaagcggaggg

SEQ ID NO: 244412 - DNA, 25 bp, Mus musculus
ccccgggaaggaaaagcgcaatggt

SEQ ID NO: 244413 - DNA, 25 bp, Mus musculus
ccccgggacagccaggtggagttgt

SEQ ID NO: 244414 - DNA, 25 bp, Mus musculus
ccccgggacagccagtgcgtccagt

SEQ ID NO: 244415 - DNA, 25 bp, Mus musculus
ccccgggacgaggcaaagatgctgg

SEQ ID NO: 244416 - DNA, 25 bp, Mus musculus
ccccgggacgtggtcaacgtggtgt

SEQ ID NO: 244417 - DNA, 25 bp, Mus musculus
ccccgggatggagatgaggtgccac

SEQ ID NO: 244418 - DNA, 25 bp, Mus musculus
ccccgggattgcctatcctctactc

SEQ ID NO: 244419 - DNA, 25 bp, Mus musculus
ccccgggcaggtttagacacgtgtg

SEQ ID NO: 244420 - DNA, 25 bp, Mus musculus
ccccgggcagtctgggcctgccacc

SEQ ID NO: 244421 - DNA, 25 bp, Mus musculus
ccccgggccagacctcagctcgcat

SEQ ID NO: 244422 - DNA, 25 bp, Mus musculus
ccccgggccgtgggaaatgcagtta

SEQ ID NO: 244423 - DNA, 25 bp, Mus musculus
ccccgggccgtgggctgcccagctg

SEQ ID NO: 244424 - DNA, 25 bp, Mus musculus
ccccgggcggcttggctgcccaccc

SEQ ID NO: 244425 - DNA, 25 bp, Mus musculus
ccccgggcgggagtcaggcctcgtc

SEQ ID NO: 244426 - DNA, 25 bp, Mus musculus
ccccgggctcacattaatatttgcc

SEQ ID NO: 244427 - DNA, 25 bp, Mus musculus
ccccggggatgagtcctcaaatgcc

SEQ ID NO: 244428 - DNA, 25 bp, Mus musculus
ccccggggctacaggctcaccatca

SEQ ID NO: 244429 - DNA, 25 bp, Mus musculus
ccccggggctgagctggctagagat

SEQ ID NO: 244430 - DNA, 25 bp, Mus musculus
ccccgggtctgtctgccaaaatgtc

SEQ ID NO: 244431 - DNA, 25 bp, Mus musculus
ccccgggtgacgttgcacaggcatg

SEQ ID NO: 244432 - DNA, 25 bp, Mus musculus
ccccgggtggcaaggctggagcagc

SEQ ID NO: 244433 - DNA, 25 bp, Mus musculus
ccccggtagaggtatggatggatct

SEQ ID NO: 244434 - DNA, 25 bp, Mus musculus
ccccggtcaatgggtcctaaatgct

SEQ ID NO: 244435 - DNA, 25 bp, Mus musculus
ccccggtcagagaaaatgtcaagga

SEQ ID NO: 244436 - DNA, 25 bp, Mus musculus
ccccggtgaggcatatgctatgatg

SEQ ID NO: 244437 - DNA, 25 bp, Mus musculus
ccccggtgaggtataaagaggaaga

SEQ ID NO: 244438 - DNA, 25 bp, Mus musculus
ccccggtgcatagagaaatccaagg

SEQ ID NO: 244439 - DNA, 25 bp, Mus musculus
ccccggtgcgcggaaagatcaacgg

SEQ ID NO: 244440 - DNA, 25 bp, Mus musculus
ccccggtggcaagagactgcttatg

SEQ ID NO: 244441 - DNA, 25 bp, Mus musculus
ccccggttcggagaagaagtctcag

SEQ ID NO: 244442 - DNA, 25 bp, Mus musculus
ccccggttgtcatgtatcacggtga

SEQ ID NO: 244443 - DNA, 25 bp, Mus musculus
ccccgtaacaggaattattttatat

SEQ ID NO: 244444 - DNA, 25 bp, Mus musculus
ccccgtcaaggtccgatctgaccgg

SEQ ID NO: 244445 - DNA, 25 bp, Mus musculus
ccccgtcagcccggttagctttata

SEQ ID NO: 244446 - DNA, 25 bp, Mus musculus
ccccgtccagacactactttgctct

SEQ ID NO: 244447 - DNA, 25 bp, Mus musculus
ccccgtcctgtgtgtcaccccgccc

SEQ ID NO: 244448 - DNA, 25 bp, Mus musculus
ccccgtctgagggcagtcctttact

SEQ ID NO: 244449 - DNA, 25 bp, Mus musculus
ccccgtcttcccacgaacaagatgc

SEQ ID NO: 244450 - DNA, 25 bp, Mus musculus
ccccgtcttcccacggatgtgatct

SEQ ID NO: 244451 - DNA, 25 bp, Mus musculus
ccccgtgaaggacagtcatggcaac

SEQ ID NO: 244452 - DNA, 25 bp, Mus musculus
ccccgtgacgctgcggatttattca

SEQ ID NO: 244453 - DNA, 25 bp, Mus musculus
ccccgtgcccagtcgagaagccccg

SEQ ID NO: 244454 - DNA, 25 bp, Mus musculus
ccccgtggacaagtccctgctccag

SEQ ID NO: 244455 - DNA, 25 bp, Mus musculus
ccccgtggcttaagagaagagccat

SEQ ID NO: 244456 - DNA, 25 bp, Mus musculus
ccccgtggtacaggccctgttgcat

SEQ ID NO: 244457 - DNA, 25 bp, Mus musculus
ccccgtgtacgaaggtatggcctca

SEQ ID NO: 244458 - DNA, 25 bp, Mus musculus
ccccgtgttcaaggatgccgccgtg

SEQ ID NO: 244459 - DNA, 25 bp, Mus musculus
ccccgttcagcagagagtacttcag

SEQ ID NO: 244460 - DNA, 25 bp, Mus musculus
ccccgttccaaggactcctttatca

SEQ ID NO: 244461 - DNA, 25 bp, Mus musculus
ccccgttccaaggcaagtccttggg

SEQ ID NO: 244462 - DNA, 25 bp, Mus musculus
ccccgttctggagctgagaagggtt

SEQ ID NO: 244463 - DNA, 25 bp, Mus musculus
ccccgtttattagtgcttacagaca

SEQ ID NO: 244464 - DNA, 25 bp, Mus musculus
ccccgtttgctcagaatttcatgcc

SEQ ID NO: 244465 - DNA, 25 bp, Mus musculus
ccccgtttgctcaggtcttggctag

SEQ ID NO: 244466 - DNA, 25 bp, Mus musculus
cccctaacaaggtcccaggcagtca

SEQ ID NO: 244467 - DNA, 25 bp, Mus musculus
cccctaacatgcagtacactgccat

SEQ ID NO: 244468 - DNA, 25 bp, Mus musculus
cccctaactctaggatgaagagggc

SEQ ID NO: 244469 - DNA, 25 bp, Mus musculus
cccctaagtacaggtcaccatcatg

SEQ ID NO: 244470 - DNA, 25 bp, Mus musculus
cccctacaccaatggctggaaatta

SEQ ID NO: 244471 - DNA, 25 bp, Mus musculus
cccctacacccgggtcaatgcaggg

SEQ ID NO: 244472 - DNA, 25 bp, Mus musculus
cccctacacgcatgctgtggatacc

SEQ ID NO: 244473 - DNA, 25 bp, Mus musculus
cccctacacgcatggagtcgcccta

SEQ ID NO: 244474 - DNA, 25 bp, Mus musculus
cccctacagccagggctgatgaaca

SEQ ID NO: 244475 - DNA, 25 bp, Mus musculus
cccctacagccaggtctgtgctgcc

SEQ ID NO: 244476 - DNA, 25 bp, Mus musculus
cccctacagttggagtaaaaatggc

SEQ ID NO: 244477 - DNA, 25 bp, Mus musculus
cccctacagttggcgtaggagtgtg

SEQ ID NO: 244478 - DNA, 25 bp, Mus musculus
cccctacatctggacattggcacct

SEQ ID NO: 244479 - DNA, 25 bp, Mus musculus
cccctacatctggcattcaggacat

SEQ ID NO: 244480 - DNA, 25 bp, Mus musculus
cccctacatctgggctggttaccat

SEQ ID NO: 244481 - DNA, 25 bp, Mus musculus
cccctaccaggcgggatggagagca

SEQ ID NO: 244482 - DNA, 25 bp, Mus musculus
cccctacccttgcagggagactccg

SEQ ID NO: 244483 - DNA, 25 bp, Mus musculus
cccctactcatgatgacgtgtctaa

SEQ ID NO: 244484 - DNA, 25 bp, Mus musculus
cccctacttccctggatcaataagt

SEQ ID NO: 244485 - DNA, 25 bp, Mus musculus
cccctagaaggaagagtcactccag

SEQ ID NO: 244486 - DNA, 25 bp, Mus musculus
cccctagaagtggccctgccgcctg

SEQ ID NO: 244487 - DNA, 25 bp, Mus musculus
cccctagacaggataagacgctgtc

SEQ ID NO: 244488 - DNA, 25 bp, Mus musculus
cccctagactggcttaagatactca

SEQ ID NO: 244489 - DNA, 25 bp, Mus musculus
cccctagattcatcggagaaggaac

SEQ ID NO: 244490 - DNA, 25 bp, Mus musculus
cccctagattcatcgttttgcgagg

SEQ ID NO: 244491 - DNA, 25 bp, Mus musculus
cccctagcaaagaggaaagcgattg

SEQ ID NO: 244492 - DNA, 25 bp, Mus musculus
cccctagcaaagaggctcctgacag

SEQ ID NO: 244493 - DNA, 25 bp, Mus musculus
cccctagcacagcagagtcaattcc

SEQ ID NO: 244494 - DNA, 25 bp, Mus musculus
cccctagcctggtctgggacctgtc

SEQ ID NO: 244495 - DNA, 25 bp, Mus musculus
cccctaggcaagactggacgagtag

SEQ ID NO: 244496 - DNA, 25 bp, Mus musculus
cccctagggcctgcaggtctacagt

SEQ ID NO: 244497 - DNA, 25 bp, Mus musculus
cccctagtggcaagggaaaacgaat

SEQ ID NO: 244498 - DNA, 25 bp, Mus musculus
cccctataaaaactccgatgatcgc

SEQ ID NO: 244499 - DNA, 25 bp, Mus musculus
cccctatacaggaggttcaagttct

SEQ ID NO: 244500 - DNA, 25 bp, Mus musculus
cccctatatcagtgacacaggaaca

SEQ ID NO: 244501 - DNA, 25 bp, Mus musculus
cccctatatttcgcacatcttcatt

SEQ ID NO: 244502 - DNA, 25 bp, Mus musculus
cccctatcccaggaatttgaagcct

SEQ ID NO: 244503 - DNA, 25 bp, Mus musculus
cccctatctcgtgggccttacgatg

SEQ ID NO: 244504 - DNA, 25 bp, Mus musculus
cccctatctgagctgctgttgcacc

SEQ ID NO: 244505 - DNA, 25 bp, Mus musculus
cccctatgaggagctcctagttaaa

SEQ ID NO: 244506 - DNA, 25 bp, Mus musculus
cccctatggcgagacagctcagctc

SEQ ID NO: 244507 - DNA, 25 bp, Mus musculus
cccctatggctggccacagattgta

SEQ ID NO: 244508 - DNA, 25 bp, Mus musculus
cccctcaacagccggagcagctggg

SEQ ID NO: 244509 - DNA, 25 bp, Mus musculus
cccctcaagtctgagtttgtgatcc

SEQ ID NO: 244510 - DNA, 25 bp, Mus musculus
cccctcaatgctaaggttcactaca

SEQ ID NO: 244511 - DNA, 25 bp, Mus musculus
cccctcacagctctcagggcctgtg

SEQ ID NO: 244512 - DNA, 25 bp, Mus musculus
cccctcaccagccccggctgcacaa

SEQ ID NO: 244513 - DNA, 25 bp, Mus musculus
cccctcaccaggaggcaccatgtgg

SEQ ID NO: 244514 - DNA, 25 bp, Mus musculus
cccctcaccgaggaggagaatggcg

SEQ ID NO: 244515 - DNA, 25 bp, Mus musculus
cccctcagcccaggatctagagtca

SEQ ID NO: 244516 - DNA, 25 bp, Mus musculus
cccctcagcccagggtctccctaca

SEQ ID NO: 244517 - DNA, 25 bp, Mus musculus
cccctcagcccaggtggtgctctgg

SEQ ID NO: 244518 - DNA, 25 bp, Mus musculus
cccctcagccccagagcttcggtgc

SEQ ID NO: 244519 - DNA, 25 bp, Mus musculus
cccctcaggctcagcaccaaggaga

SEQ ID NO: 244520 - DNA, 25 bp, Mus musculus
cccctcagtccaaagctgctcagcc

SEQ ID NO: 244521 - DNA, 25 bp, Mus musculus
cccctcatgaaggaagtggagaccc

SEQ ID NO: 244522 - DNA, 25 bp, Mus musculus
cccctcatgaagggtacggattgct

SEQ ID NO: 244523 - DNA, 25 bp, Mus musculus
cccctcattcaagatgttcacacgg

SEQ ID NO: 244524 - DNA, 25 bp, Mus musculus
cccctcattcaaggagtagacccat

SEQ ID NO: 244525 - DNA, 25 bp, Mus musculus
cccctccaactcagatctctcgtct

SEQ ID NO: 244526 - DNA, 25 bp, Mus musculus
cccctccaactcagccctccaggac

SEQ ID NO: 244527 - DNA, 25 bp, Mus musculus
cccctccaagagcaaagctgcagca

SEQ ID NO: 244528 - DNA, 25 bp, Mus musculus
cccctccacatggcttcttctccaa

SEQ ID NO: 244529 - DNA, 25 bp, Mus musculus
cccctccacatgtctctggatttgt

SEQ ID NO: 244530 - DNA, 25 bp, Mus musculus
cccctccactcagcttcccatgctc

SEQ ID NO: 244531 - DNA, 25 bp, Mus musculus
cccctccagcaggaagaactaggaa

SEQ ID NO: 244532 - DNA, 25 bp, Mus musculus
cccctcccaagtttcagattacgat

SEQ ID NO: 244533 - DNA, 25 bp, Mus musculus
cccctcccaccggtgcctgctgtct

SEQ ID NO: 244534 - DNA, 25 bp, Mus musculus
cccctcccagagctctcttccggct

SEQ ID NO: 244535 - DNA, 25 bp, Mus musculus
cccctcccatggagggtgctcgagt

SEQ ID NO: 244536 - DNA, 25 bp, Mus musculus
cccctccccctgaccagctgtcccc

SEQ ID NO: 244537 - DNA, 25 bp, Mus musculus
cccctccccgcttccgctctcggga

SEQ ID NO: 244538 - DNA, 25 bp, Mus musculus
cccctccctcccagctgatggttcc

SEQ ID NO: 244539 - DNA, 25 bp, Mus musculus
cccctccctgaactcggctgcacgg

SEQ ID NO: 244540 - DNA, 25 bp, Mus musculus
cccctccctggaccacctctgccct

SEQ ID NO: 244541 - DNA, 25 bp, Mus musculus
cccctccgaaaatgccatcccgccc

SEQ ID NO: 244542 - DNA, 25 bp, Mus musculus
cccctccgaaactgtctgcccagtt

SEQ ID NO: 244543 - DNA, 25 bp, Mus musculus
cccctcctactcttgtatgtcttcg

SEQ ID NO: 244544 - DNA, 25 bp, Mus musculus
cccctcctattccagtatcattttg

SEQ ID NO: 244545 - DNA, 25 bp, Mus musculus
cccctcctccgggaaggtagactgc

SEQ ID NO: 244546 - DNA, 25 bp, Mus musculus
cccctcctgagacagggttgtgagc

SEQ ID NO: 244547 - DNA, 25 bp, Mus musculus
cccctccttccaccctcatgctagt

SEQ ID NO: 244548 - DNA, 25 bp, Mus musculus
cccctcgccatgaagaagcccattg

SEQ ID NO: 244549 - DNA, 25 bp, Mus musculus
cccctcgccccaggcactgggctcc

SEQ ID NO: 244550 - DNA, 25 bp, Mus musculus
cccctcgccgcctcgatgagcagct

SEQ ID NO: 244551 - DNA, 25 bp, Mus musculus
cccctcgggccaatcccagtggcct

SEQ ID NO: 244552 - DNA, 25 bp, Mus musculus
cccctcggggcagggatgccctgga

SEQ ID NO: 244553 - DNA, 25 bp, Mus musculus
cccctcggtgactctgtgaacctac

SEQ ID NO: 244554 - DNA, 25 bp, Mus musculus
cccctcgtctatcagtcttgtctgt

SEQ ID NO: 244555 - DNA, 25 bp, Mus musculus
cccctcgtctgctccacttccaccc

SEQ ID NO: 244556 - DNA, 25 bp, Mus musculus
cccctctacctcagggccccgccgt

SEQ ID NO: 244557 - DNA, 25 bp, Mus musculus
cccctctactcagttcctcatttga

SEQ ID NO: 244558 - DNA, 25 bp, Mus musculus
cccctctactccgccattttcctgc

SEQ ID NO: 244559 - DNA, 25 bp, Mus musculus
cccctctataaagcattgaggccaa

SEQ ID NO: 244560 - DNA, 25 bp, Mus musculus
cccctctataaagtctttcctgtac

SEQ ID NO: 244561 - DNA, 25 bp, Mus musculus
cccctctcactgggtcttctgggta

SEQ ID NO: 244562 - DNA, 25 bp, Mus musculus
cccctctccaggtgtctccagtgcc

SEQ ID NO: 244563 - DNA, 25 bp, Mus musculus
cccctctccatatcgctgtattgtg

SEQ ID NO: 244564 - DNA, 25 bp, Mus musculus
cccctctctcaggaatttgaagcct

SEQ ID NO: 244565 - DNA, 25 bp, Mus musculus
cccctctctgctcaggaagaacgtt

SEQ ID NO: 244566 - DNA, 25 bp, Mus musculus
cccctctgcacctaccctgtgcccg

SEQ ID NO: 244567 - DNA, 25 bp, Mus musculus
cccctctgcagtgtatgtggctcat

SEQ ID NO: 244568 - DNA, 25 bp, Mus musculus
cccctctgctaatagttcctgcacg

SEQ ID NO: 244569 - DNA, 25 bp, Mus musculus
cccctctgctaatatggatgcaaag

SEQ ID NO: 244570 - DNA, 25 bp, Mus musculus
cccctctggccagacagtctgctag

SEQ ID NO: 244571 - DNA, 25 bp, Mus musculus
cccctctggccaggcagttattcag

SEQ ID NO: 244572 - DNA, 25 bp, Mus musculus
cccctcttcaactctggctccagtg

SEQ ID NO: 244573 - DNA, 25 bp, Mus musculus
cccctcttcagacagagagcctggg

SEQ ID NO: 244574 - DNA, 25 bp, Mus musculus
cccctcttcaggttatccgtgttcg

SEQ ID NO: 244575 - DNA, 25 bp, Mus musculus
cccctcttcctggagttccctgagg

SEQ ID NO: 244576 - DNA, 25 bp, Mus musculus
cccctcttgacccagccctgcagaa

SEQ ID NO: 244577 - DNA, 25 bp, Mus musculus
cccctgaaagcctctggagatggag

SEQ ID NO: 244578 - DNA, 25 bp, Mus musculus
cccctgaaatggcattatccaattg

SEQ ID NO: 244579 - DNA, 25 bp, Mus musculus
cccctgaagcaccagcatcggtgtg

SEQ ID NO: 244580 - DNA, 25 bp, Mus musculus
cccctgaagcaccaggtgaatggga

SEQ ID NO: 244581 - DNA, 25 bp, Mus musculus
cccctgaagcattgaaaaaggcaag

SEQ ID NO: 244582 - DNA, 25 bp, Mus musculus
cccctgaagccaatcatctggggaa

SEQ ID NO: 244583 - DNA, 25 bp, Mus musculus
cccctgaccagttagtcctctattt

SEQ ID NO: 244584 - DNA, 25 bp, Mus musculus
cccctgaccatcacagtccgcacca

SEQ ID NO: 244585 - DNA, 25 bp, Mus musculus
cccctgaccccgcgggtccttcaca

SEQ ID NO: 244586 - DNA, 25 bp, Mus musculus
cccctgactcggaaaagtcatgttg

SEQ ID NO: 244587 - DNA, 25 bp, Mus musculus
cccctgactcggaaagttccatttt

SEQ ID NO: 244588 - DNA, 25 bp, Mus musculus
cccctgactgctcttgtctgaaaac

SEQ ID NO: 244589 - DNA, 25 bp, Mus musculus
cccctgacttgatgtgtcttaccac

SEQ ID NO: 244590 - DNA, 25 bp, Mus musculus
cccctgactttgagcggaggctgct

SEQ ID NO: 244591 - DNA, 25 bp, Mus musculus
cccctgagatctaaacctactgacg

SEQ ID NO: 244592 - DNA, 25 bp, Mus musculus
cccctgagcagggtgttcctgtata

SEQ ID NO: 244593 - DNA, 25 bp, Mus musculus
cccctgagggaggtgaccattgttg

SEQ ID NO: 244594 - DNA, 25 bp, Mus musculus
cccctgataccaggggttccagtgt

SEQ ID NO: 244595 - DNA, 25 bp, Mus musculus
cccctgatatttgacattaacgagc

SEQ ID NO: 244596 - DNA, 25 bp, Mus musculus
cccctgatctctcagtgtaccccga

SEQ ID NO: 244597 - DNA, 25 bp, Mus musculus
cccctgattatcagtaccccacccc

SEQ ID NO: 244598 - DNA, 25 bp, Mus musculus
cccctgattggcaggtctcacatga

SEQ ID NO: 244599 - DNA, 25 bp, Mus musculus
cccctgcaaagataccgaagcaaag

SEQ ID NO: 244600 - DNA, 25 bp, Mus musculus
cccctgcaaaggttttccatctcct

SEQ ID NO: 244601 - DNA, 25 bp, Mus musculus
cccctgcaagctaggtaggaacaac

SEQ ID NO: 244602 - DNA, 25 bp, Mus musculus
cccctgcagcctcgggttcctccat

SEQ ID NO: 244603 - DNA, 25 bp, Mus musculus
cccctgccacagccccggccaccct

SEQ ID NO: 244604 - DNA, 25 bp, Mus musculus
cccctgccagataatcagcctttat

SEQ ID NO: 244605 - DNA, 25 bp, Mus musculus
cccctgccagggctgatggtgaccg

SEQ ID NO: 244606 - DNA, 25 bp, Mus musculus
cccctgccagtctcctggctgctta

SEQ ID NO: 244607 - DNA, 25 bp, Mus musculus
cccctgcccaagctgtgctggatgc

SEQ ID NO: 244608 - DNA, 25 bp, Mus musculus
cccctgccccaggacttctctgtga

SEQ ID NO: 244609 - DNA, 25 bp, Mus musculus
cccctgcccgagcgtttctagagca

SEQ ID NO: 244610 - DNA, 25 bp, Mus musculus
cccctgcccggaattctgatcaaga

SEQ ID NO: 244611 - DNA, 25 bp, Mus musculus
cccctgccctgaaagtcccgagttt

SEQ ID NO: 244612 - DNA, 25 bp, Mus musculus
cccctgcctaagccaaggaagtagc

SEQ ID NO: 244613 - DNA, 25 bp, Mus musculus
cccctgcctccccactaccctccaa

SEQ ID NO: 244614 - DNA, 25 bp, Mus musculus
cccctgcctccctgcccacaaagtg

SEQ ID NO: 244615 - DNA, 25 bp, Mus musculus
cccctgcctgagcaaggggaccagg

SEQ ID NO: 244616 - DNA, 25 bp, Mus musculus
cccctgcgaccaggtgacccaatga

SEQ ID NO: 244617 - DNA, 25 bp, Mus musculus
cccctgcgaggggacatgcttcggg

SEQ ID NO: 244618 - DNA, 25 bp, Mus musculus
cccctgcgagggtggctgctgctag

SEQ ID NO: 244619 - DNA, 25 bp, Mus musculus
cccctgcggagacagggggctcacc

SEQ ID NO: 244620 - DNA, 25 bp, Mus musculus
cccctgcggagacaggtttcggccg

SEQ ID NO: 244621 - DNA, 25 bp, Mus musculus
cccctgctacacgaggtgcagtggg

SEQ ID NO: 244622 - DNA, 25 bp, Mus musculus
cccctgctacacgagtgggtggtgc

SEQ ID NO: 244623 - DNA, 25 bp, Mus musculus
cccctgctccaccttctcgagaagg

SEQ ID NO: 244624 - DNA, 25 bp, Mus musculus
cccctgctcccatgcttatcattgc

SEQ ID NO: 244625 - DNA, 25 bp, Mus musculus
cccctgctttagtttcctgacaggc

SEQ ID NO: 244626 - DNA, 25 bp, Mus musculus
cccctggaacctgatctaacaaaca

SEQ ID NO: 244627 - DNA, 25 bp, Mus musculus
cccctggaagcaggagcctccagac

SEQ ID NO: 244628 - DNA, 25 bp, Mus musculus
cccctggacagcaagccccgcccaa

SEQ ID NO: 244629 - DNA, 25 bp, Mus musculus
cccctggaccccatggcccctcacc

SEQ ID NO: 244630 - DNA, 25 bp, Mus musculus
cccctggaccgggagcagaatggag

SEQ ID NO: 244631 - DNA, 25 bp, Mus musculus
cccctggacgcttgcctttgtctgg

SEQ ID NO: 244632 - DNA, 25 bp, Mus musculus
cccctggacgcttgtcaccagattt

SEQ ID NO: 244633 - DNA, 25 bp, Mus musculus
cccctggacttcagggagaggaaca

SEQ ID NO: 244634 - DNA, 25 bp, Mus musculus
cccctggagaacggggaagtctagg

SEQ ID NO: 244635 - DNA, 25 bp, Mus musculus
cccctggagagagaggtgctcctgg

SEQ ID NO: 244636 - DNA, 25 bp, Mus musculus
cccctggaggctgccacccgtctct

SEQ ID NO: 244637 - DNA, 25 bp, Mus musculus
cccctggatcaaaggcctacagttt

SEQ ID NO: 244638 - DNA, 25 bp, Mus musculus
cccctggcaacagtgatccggagca

SEQ ID NO: 244639 - DNA, 25 bp, Mus musculus
cccctggcaggttcagagcattgcc

SEQ ID NO: 244640 - DNA, 25 bp, Mus musculus
cccctggccagagtcatggatttga

SEQ ID NO: 244641 - DNA, 25 bp, Mus musculus
cccctggcctgagaagcctgtacag

SEQ ID NO: 244642 - DNA, 25 bp, Mus musculus
cccctggcctgattgcagcccggga

SEQ ID NO: 244643 - DNA, 25 bp, Mus musculus
cccctggccttggaggtttgcctgg

SEQ ID NO: 244644 - DNA, 25 bp, Mus musculus
cccctggcgaccaggcttcagatgc

SEQ ID NO: 244645 - DNA, 25 bp, Mus musculus
cccctggcgacggttaccacagtgg

SEQ ID NO: 244646 - DNA, 25 bp, Mus musculus
cccctggctccactgtcttatatcg

SEQ ID NO: 244647 - DNA, 25 bp, Mus musculus
cccctggctgaggcagagcagctga

SEQ ID NO: 244648 - DNA, 25 bp, Mus musculus
cccctgggactagctcaggccctgg

SEQ ID NO: 244649 - DNA, 25 bp, Mus musculus
cccctgggagtgcttacttttctgg

SEQ ID NO: 244650 - DNA, 25 bp, Mus musculus
cccctgggagtgggaggagtgaagg

SEQ ID NO: 244651 - DNA, 25 bp, Mus musculus
cccctgggattaggagtgccaggag

SEQ ID NO: 244652 - DNA, 25 bp, Mus musculus
cccctgggcaggtgttttagctcac

SEQ ID NO: 244653 - DNA, 25 bp, Mus musculus
cccctgggccacagggtcctactgg

SEQ ID NO: 244654 - DNA, 25 bp, Mus musculus
cccctgggccccaagggcttctaga

SEQ ID NO: 244655 - DNA, 25 bp, Mus musculus
cccctgggctggtggctctcgaggg

SEQ ID NO: 244656 - DNA, 25 bp, Mus musculus
cccctggggagagatctccatagta

SEQ ID NO: 244657 - DNA, 25 bp, Mus musculus
cccctgggggccaagtgctcaccga

SEQ ID NO: 244658 - DNA, 25 bp, Mus musculus
cccctggggtctggagggagagccg

SEQ ID NO: 244659 - DNA, 25 bp, Mus musculus
cccctgggtgtcagatgatgcatcc

SEQ ID NO: 244660 - DNA, 25 bp, Mus musculus
cccctggtagcccaggccaccatgg

SEQ ID NO: 244661 - DNA, 25 bp, Mus musculus
cccctggtcaggagtgctgcaaaga

SEQ ID NO: 244662 - DNA, 25 bp, Mus musculus
cccctggtcaggcactcggacatgc

SEQ ID NO: 244663 - DNA, 25 bp, Mus musculus
cccctggtcccccaataccgtgact

SEQ ID NO: 244664 - DNA, 25 bp, Mus musculus
cccctggtcctgctggcttccctgg

SEQ ID NO: 244665 - DNA, 25 bp, Mus musculus
cccctggtgcacctggtccacaagg

SEQ ID NO: 244666 - DNA, 25 bp, Mus musculus
cccctggtggatcagctggaaaaca

SEQ ID NO: 244667 - DNA, 25 bp, Mus musculus
cccctggttaacctgattcctggtt

SEQ ID NO: 244668 - DNA, 25 bp, Mus musculus
cccctggttaacctggatggggagg

SEQ ID NO: 244669 - DNA, 25 bp, Mus musculus
cccctggttaacctgggagtttctg

SEQ ID NO: 244670 - DNA, 25 bp, Mus musculus
cccctgtcatctctcaccctcgcct

SEQ ID NO: 244671 - DNA, 25 bp, Mus musculus
cccctgtcgtatagagtctgaagga

SEQ ID NO: 244672 - DNA, 25 bp, Mus musculus
cccctgtgacacctgttgagggcga

SEQ ID NO: 244673 - DNA, 25 bp, Mus musculus
cccctgtgaccctagtctctcttca

SEQ ID NO: 244674 - DNA, 25 bp, Mus musculus
cccctgtgagctgcaaaaggaagtt

SEQ ID NO: 244675 - DNA, 25 bp, Mus musculus
cccctgtgagggctgaactgaaaaa

SEQ ID NO: 244676 - DNA, 25 bp, Mus musculus
cccctgtgcgctgctcccgccagtg

SEQ ID NO: 244677 - DNA, 25 bp, Mus musculus
cccctgtggagaggagatacttcaa

SEQ ID NO: 244678 - DNA, 25 bp, Mus musculus
cccctgtgtgcatcagcatcatcct

SEQ ID NO: 244679 - DNA, 25 bp, Mus musculus
cccctgttctggtgattgaggctga

SEQ ID NO: 244680 - DNA, 25 bp, Mus musculus
cccctgtttccaagctctgtccggg

SEQ ID NO: 244681 - DNA, 25 bp, Mus musculus
ccccttacaagaagacttgcctaac

SEQ ID NO: 244682 - DNA, 25 bp, Mus musculus
ccccttacaagaaggatgagaacaa

SEQ ID NO: 244683 - DNA, 25 bp, Mus musculus
ccccttagcagctcaagcccacccc

SEQ ID NO: 244684 - DNA, 25 bp, Mus musculus
ccccttatcagagcctgccccagtt

SEQ ID NO: 244685 - DNA, 25 bp, Mus musculus
ccccttatgatcaggaaccagctcc

SEQ ID NO: 244686 - DNA, 25 bp, Mus musculus
ccccttatgatcaggcggcttggat

SEQ ID NO: 244687 - DNA, 25 bp, Mus musculus
ccccttcaaaggtgatcctttccaa

SEQ ID NO: 244688 - DNA, 25 bp, Mus musculus
ccccttcaaatactgaactgtccct

SEQ ID NO: 244689 - DNA, 25 bp, Mus musculus
ccccttcacccagtgctgtcaatcc

SEQ ID NO: 244690 - DNA, 25 bp, Mus musculus
ccccttcacctccagagccagctcc

SEQ ID NO: 244691 - DNA, 25 bp, Mus musculus
ccccttcacggcatatggatcaggc

SEQ ID NO: 244692 - DNA, 25 bp, Mus musculus
ccccttcacggttgcagcttcatat

SEQ ID NO: 244693 - DNA, 25 bp, Mus musculus
ccccttcagccggattacacaggaa

SEQ ID NO: 244694 - DNA, 25 bp, Mus musculus
ccccttcaggtctcggccagaaggt

SEQ ID NO: 244695 - DNA, 25 bp, Mus musculus
ccccttccccaggatgacagaggag

SEQ ID NO: 244696 - DNA, 25 bp, Mus musculus
ccccttcctcaacagtgtctacatt

SEQ ID NO: 244697 - DNA, 25 bp, Mus musculus
ccccttcctcgaaggtcctggccac

SEQ ID NO: 244698 - DNA, 25 bp, Mus musculus
ccccttcctgagcatctgtgggtgg

SEQ ID NO: 244699 - DNA, 25 bp, Mus musculus
ccccttccttacagccctcaagtat

SEQ ID NO: 244700 - DNA, 25 bp, Mus musculus
ccccttccttcccagtggatctgag

SEQ ID NO: 244701 - DNA, 25 bp, Mus musculus
ccccttcgcctgtggaggcgcagcc

SEQ ID NO: 244702 - DNA, 25 bp, Mus musculus
ccccttcgcctgtggtgaagaagtt

SEQ ID NO: 244703 - DNA, 25 bp, Mus musculus
ccccttctacttcagagccaccagc

SEQ ID NO: 244704 - DNA, 25 bp, Mus musculus
ccccttctcaatctgaaattcagca

SEQ ID NO: 244705 - DNA, 25 bp, Mus musculus
ccccttctcaatgtgaaattcagca

SEQ ID NO: 244706 - DNA, 25 bp, Mus musculus
ccccttcttcgcagaatacaaacag

SEQ ID NO: 244707 - DNA, 25 bp, Mus musculus
ccccttcttcgctgattcttttctt

SEQ ID NO: 244708 - DNA, 25 bp, Mus musculus
ccccttgagccataatgaagagtct

SEQ ID NO: 244709 - DNA, 25 bp, Mus musculus
ccccttgcaagtgcccctctcacct

SEQ ID NO: 244710 - DNA, 25 bp, Mus musculus
ccccttgcaagttctgggccaagac

SEQ ID NO: 244711 - DNA, 25 bp, Mus musculus
ccccttggaaagcttttatgaaaca

SEQ ID NO: 244712 - DNA, 25 bp, Mus musculus
ccccttggaacagtctggccagaaa

SEQ ID NO: 244713 - DNA, 25 bp, Mus musculus
ccccttggaagaacttgcaaaagct

SEQ ID NO: 244714 - DNA, 25 bp, Mus musculus
ccccttggaggagaggatgcttaaa

SEQ ID NO: 244715 - DNA, 25 bp, Mus musculus
ccccttggatagactacgagtctgg

SEQ ID NO: 244716 - DNA, 25 bp, Mus musculus
ccccttggatagagcatatttaatt

SEQ ID NO: 244717 - DNA, 25 bp, Mus musculus
ccccttggcctgttgggtcacttcc

SEQ ID NO: 244718 - DNA, 25 bp, Mus musculus
ccccttggttgcaggaagaccgagt

SEQ ID NO: 244719 - DNA, 25 bp, Mus musculus
ccccttggttgcaggtttgcaatac

SEQ ID NO: 244720 - DNA, 25 bp, Mus musculus
ccccttgtatagctgtcagggtgac

SEQ ID NO: 244721 - DNA, 25 bp, Mus musculus
ccccttgtatccagacttcagtact

SEQ ID NO: 244722 - DNA, 25 bp, Mus musculus
ccccttgtccccaagccacagccca

SEQ ID NO: 244723 - DNA, 25 bp, Mus musculus
ccccttgtgaacgaggctgctgcgc

SEQ ID NO: 244724 - DNA, 25 bp, Mus musculus
cccctttaaggctccaggatgactg

SEQ ID NO: 244725 - DNA, 25 bp, Mus musculus
cccctttatcagcgtatcagagcat

SEQ ID NO: 244726 - DNA, 25 bp, Mus musculus
cccctttatcagggtatcagagcat

SEQ ID NO: 244727 - DNA, 25 bp, Mus musculus
cccctttcacagagcatgatctcct

SEQ ID NO: 244728 - DNA, 25 bp, Mus musculus
cccctttcacaggctcctgagcatt

SEQ ID NO: 244729 - DNA, 25 bp, Mus musculus
cccctttcagattgtaagctccttg

SEQ ID NO: 244730 - DNA, 25 bp, Mus musculus
cccctttcaggactccttctaatgg

SEQ ID NO: 244731 - DNA, 25 bp, Mus musculus
cccctttcccatgggtcactgccca

SEQ ID NO: 244732 - DNA, 25 bp, Mus musculus
cccctttcgagagggagaatcccgt

SEQ ID NO: 244733 - DNA, 25 bp, Mus musculus
cccctttgaccaggatgacctcacg

SEQ ID NO: 244734 - DNA, 25 bp, Mus musculus
cccctttgagcagcatatgaagaac

SEQ ID NO: 244735 - DNA, 25 bp, Mus musculus
cccctttggagacctccacacagca

SEQ ID NO: 244736 - DNA, 25 bp, Mus musculus
ccccttttcctgagagtttggattc

SEQ ID NO: 244737 - DNA, 25 bp, Mus musculus
ccccttttctaacaggtctggattt

SEQ ID NO: 244738 - DNA, 25 bp, Mus musculus
ccccttttctgaatgaagatatcct

SEQ ID NO: 244739 - DNA, 25 bp, Mus musculus
ccccttttctgggtaacacaaggca

SEQ ID NO: 244740 - DNA, 25 bp, Mus musculus
cccgaaaacgttctgcagcccacac

SEQ ID NO: 244741 - DNA, 25 bp, Mus musculus
cccgaaacagcagagaactggggaa

SEQ ID NO: 244742 - DNA, 25 bp, Mus musculus
cccgaaaccaagtggagctgattgc

SEQ ID NO: 244743 - DNA, 25 bp, Mus musculus
cccgaaacgcgcacgcggctggaga

SEQ ID NO: 244744 - DNA, 25 bp, Mus musculus
cccgaaactcagttccagagcctct

SEQ ID NO: 244745 - DNA, 25 bp, Mus musculus
cccgaaactccagtgacacgtgcct

SEQ ID NO: 244746 - DNA, 25 bp, Mus musculus
cccgaaactgaccactgcggcacag

SEQ ID NO: 244747 - DNA, 25 bp, Mus musculus
cccgaaactgagaagaccagagccc

SEQ ID NO: 244748 - DNA, 25 bp, Mus musculus
cccgaaagagaggtgaaacggaagg

SEQ ID NO: 244749 - DNA, 25 bp, Mus musculus
cccgaaagagaggtgaggaagaccc

SEQ ID NO: 244750 - DNA, 25 bp, Mus musculus
cccgaaagagaggtgccggcctccg

SEQ ID NO: 244751 - DNA, 25 bp, Mus musculus
cccgaaagagggtggtgtcatggat

SEQ ID NO: 244752 - DNA, 25 bp, Mus musculus
cccgaaagagtctaaagcctgacat

SEQ ID NO: 244753 - DNA, 25 bp, Mus musculus
cccgaaataggctgctggcaccctg

SEQ ID NO: 244754 - DNA, 25 bp, Mus musculus
cccgaaattcctgggcagagctgaa

SEQ ID NO: 244755 - DNA, 25 bp, Mus musculus
cccgaacaacagacgagctaaactc

SEQ ID NO: 244756 - DNA, 25 bp, Mus musculus
cccgaacaacaggtcttcacacaac

SEQ ID NO: 244757 - DNA, 25 bp, Mus musculus
cccgaacgacgatagggtccaggtg

SEQ ID NO: 244758 - DNA, 25 bp, Mus musculus
cccgaactttagaccatgccgtcca

SEQ ID NO: 244759 - DNA, 25 bp, Mus musculus
cccgaagaagagctgtggtttctcc

SEQ ID NO: 244760 - DNA, 25 bp, Mus musculus
cccgaagcagaggatgaaggacgca

SEQ ID NO: 244761 - DNA, 25 bp, Mus musculus
cccgaagccccggccaccatgttca

SEQ ID NO: 244762 - DNA, 25 bp, Mus musculus
cccgaagccgcagccagagccacag

SEQ ID NO: 244763 - DNA, 25 bp, Mus musculus
cccgaagccgggctgatgtgatgat

SEQ ID NO: 244764 - DNA, 25 bp, Mus musculus
cccgaagctacaggactcttccccc

SEQ ID NO: 244765 - DNA, 25 bp, Mus musculus
cccgaaggccgaatgttttggctgg

SEQ ID NO: 244766 - DNA, 25 bp, Mus musculus
cccgaaggccggtcgctgtggttcc

SEQ ID NO: 244767 - DNA, 25 bp, Mus musculus
cccgaaggttaaaacttcagcatct

SEQ ID NO: 244768 - DNA, 25 bp, Mus musculus
cccgaagtatcatgtaccggagctt

SEQ ID NO: 244769 - DNA, 25 bp, Mus musculus
cccgaagtctttaagtgagcccttg

SEQ ID NO: 244770 - DNA, 25 bp, Mus musculus
cccgaagttcagagtaaagacattt

SEQ ID NO: 244771 - DNA, 25 bp, Mus musculus
cccgaagttgctcagtggacaagat

SEQ ID NO: 244772 - DNA, 25 bp, Mus musculus
cccgaatatctcaagtatgcgagac

SEQ ID NO: 244773 - DNA, 25 bp, Mus musculus
cccgaatccagaatcggaagactct

SEQ ID NO: 244774 - DNA, 25 bp, Mus musculus
cccgaattcctcctccaccgtcgtc

SEQ ID NO: 244775 - DNA, 25 bp, Mus musculus
cccgaattctgcagacccatgcaga

SEQ ID NO: 244776 - DNA, 25 bp, Mus musculus
cccgaattctgcaggtatccaacgg

SEQ ID NO: 244777 - DNA, 25 bp, Mus musculus
cccgacaatgcttttgtcaatcttg

SEQ ID NO: 244778 - DNA, 25 bp, Mus musculus
cccgacacaggtggagaatataaat

SEQ ID NO: 244779 - DNA, 25 bp, Mus musculus
cccgacacaggtgtgtatccagagt

SEQ ID NO: 244780 - DNA, 25 bp, Mus musculus
cccgacaggcacagctactatgtgt

SEQ ID NO: 244781 - DNA, 25 bp, Mus musculus
cccgacaggcacaggtcgaggtggc

SEQ ID NO: 244782 - DNA, 25 bp, Mus musculus
cccgaccatgaagacaccgtggaag

SEQ ID NO: 244783 - DNA, 25 bp, Mus musculus
cccgaccatgaagatgaagcggcag

SEQ ID NO: 244784 - DNA, 25 bp, Mus musculus
cccgaccatgaaggtttataagaaa

SEQ ID NO: 244785 - DNA, 25 bp, Mus musculus
cccgaccattgggtttaatgtggag

SEQ ID NO: 244786 - DNA, 25 bp, Mus musculus
cccgacccaaggcatgcgccaaggc

SEQ ID NO: 244787 - DNA, 25 bp, Mus musculus
cccgacccagactcattacaggccc

SEQ ID NO: 244788 - DNA, 25 bp, Mus musculus
cccgacccaggggagcagcgcggtg

SEQ ID NO: 244789 - DNA, 25 bp, Mus musculus
cccgacccagtggctagacctagat

SEQ ID NO: 244790 - DNA, 25 bp, Mus musculus
cccgacccagttaatctctcagtat

SEQ ID NO: 244791 - DNA, 25 bp, Mus musculus
cccgacccctgcgaggggacatgct

SEQ ID NO: 244792 - DNA, 25 bp, Mus musculus
cccgaccctgaagggacctttgacg

SEQ ID NO: 244793 - DNA, 25 bp, Mus musculus
cccgaccctgaaggtggacttgttt

SEQ ID NO: 244794 - DNA, 25 bp, Mus musculus
cccgaccctgagttctgaggctcta

SEQ ID NO: 244795 - DNA, 25 bp, Mus musculus
cccgacctacctcagggaagagtcc

SEQ ID NO: 244796 - DNA, 25 bp, Mus musculus
cccgacctacctcagggagcagaag

SEQ ID NO: 244797 - DNA, 25 bp, Mus musculus
cccgacctggagcgtgtatcgacag

SEQ ID NO: 244798 - DNA, 25 bp, Mus musculus
cccgacgacgatcttggatctagca

SEQ ID NO: 244799 - DNA, 25 bp, Mus musculus
cccgacgatcagaagactcacagtg

SEQ ID NO: 244800 - DNA, 25 bp, Mus musculus
cccgacgatcagaagatgcgctgat

SEQ ID NO: 244801 - DNA, 25 bp, Mus musculus
cccgacgcaggtcctacggcctggg

SEQ ID NO: 244802 - DNA, 25 bp, Mus musculus
cccgacgcaggtgttctttgacagt

SEQ ID NO: 244803 - DNA, 25 bp, Mus musculus
cccgacgccttccccagctgggccg

SEQ ID NO: 244804 - DNA, 25 bp, Mus musculus
cccgacgccttgccaccccgctggg

SEQ ID NO: 244805 - DNA, 25 bp, Mus musculus
cccgacgccttggtcactggcacaa

SEQ ID NO: 244806 - DNA, 25 bp, Mus musculus
cccgacgccttggtctgtgtgtggt

SEQ ID NO: 244807 - DNA, 25 bp, Mus musculus
cccgactgaatgctcggattgggaa

SEQ ID NO: 244808 - DNA, 25 bp, Mus musculus
cccgactgcagaggacccgcgcgca

SEQ ID NO: 244809 - DNA, 25 bp, Mus musculus
cccgactgggattgggctagtgaac

SEQ ID NO: 244810 - DNA, 25 bp, Mus musculus
cccgactgtaccgggctgtcagggg

SEQ ID NO: 244811 - DNA, 25 bp, Mus musculus
cccgacttgccgggtctggaatgtg

SEQ ID NO: 244812 - DNA, 25 bp, Mus musculus
cccgacttggacaacaccatcaaga

SEQ ID NO: 244813 - DNA, 25 bp, Mus musculus
cccgacttggtgaaaaattgcatgt

SEQ ID NO: 244814 - DNA, 25 bp, Mus musculus
cccgacttggtgaagactccattag

SEQ ID NO: 244815 - DNA, 25 bp, Mus musculus
cccgacttggtgataaggtacagtt

SEQ ID NO: 244816 - DNA, 25 bp, Mus musculus
cccgacttggtgatgaaaccattag

SEQ ID NO: 244817 - DNA, 25 bp, Mus musculus
cccgagaaactatgtctgctggttg

SEQ ID NO: 244818 - DNA, 25 bp, Mus musculus
cccgagaaagaggtgggacttctgc

SEQ ID NO: 244819 - DNA, 25 bp, Mus musculus
cccgagaaagattccagagtcagtg

SEQ ID NO: 244820 - DNA, 25 bp, Mus musculus
cccgagaaagggtatatgtatttta

SEQ ID NO: 244821 - DNA, 25 bp, Mus musculus
cccgagaaagtttccagagtcagtg

SEQ ID NO: 244822 - DNA, 25 bp, Mus musculus
cccgagaacccacagagacgtttca

SEQ ID NO: 244823 - DNA, 25 bp, Mus musculus
cccgagaacccacagcagagtcttc

SEQ ID NO: 244824 - DNA, 25 bp, Mus musculus
cccgagaaccccgaaatgccaggca

SEQ ID NO: 244825 - DNA, 25 bp, Mus musculus
cccgagaaccccgaagacatcggca

SEQ ID NO: 244826 - DNA, 25 bp, Mus musculus
cccgagaacgacccaggttcaagcg

SEQ ID NO: 244827 - DNA, 25 bp, Mus musculus
cccgagaaggccgagcctgctaggc

SEQ ID NO: 244828 - DNA, 25 bp, Mus musculus
cccgagacaagagattcagatgcca

SEQ ID NO: 244829 - DNA, 25 bp, Mus musculus
cccgagacaagagtttccttctaga

SEQ ID NO: 244830 - DNA, 25 bp, Mus musculus
cccgagacagggactattccaacaa

SEQ ID NO: 244831 - DNA, 25 bp, Mus musculus
cccgagactgccaagactcactctg

SEQ ID NO: 244832 - DNA, 25 bp, Mus musculus
cccgagactgccaaggaggccgagt

SEQ ID NO: 244833 - DNA, 25 bp, Mus musculus
cccgagagagggaaacaacagtatt

SEQ ID NO: 244834 - DNA, 25 bp, Mus musculus
cccgagagagggtcagcctctcagc

SEQ ID NO: 244835 - DNA, 25 bp, Mus musculus
cccgagagccactgattgccacagc

SEQ ID NO: 244836 - DNA, 25 bp, Mus musculus
cccgagagccactggactgacagac

SEQ ID NO: 244837 - DNA, 25 bp, Mus musculus
cccgagagctgaagaatggctttgc

SEQ ID NO: 244838 - DNA, 25 bp, Mus musculus
cccgagaggcacgcccccattggtc

SEQ ID NO: 244839 - DNA, 25 bp, Mus musculus
cccgagaggcacgggcaatgaggtg

SEQ ID NO: 244840 - DNA, 25 bp, Mus musculus
cccgagaggttcgtctgctttgcct

SEQ ID NO: 244841 - DNA, 25 bp, Mus musculus
cccgagattcggctgctgaactaag

SEQ ID NO: 244842 - DNA, 25 bp, Mus musculus
cccgagcaggatggtgaggattcag

SEQ ID NO: 244843 - DNA, 25 bp, Mus musculus
cccgagccagaggagtacttttgag

SEQ ID NO: 244844 - DNA, 25 bp, Mus musculus
cccgagccagcaagggggaagaaac

SEQ ID NO: 244845 - DNA, 25 bp, Mus musculus
cccgagccaggatcttgtgctgaaa

SEQ ID NO: 244846 - DNA, 25 bp, Mus musculus
cccgagcccggaagagaaaagagaa

SEQ ID NO: 244847 - DNA, 25 bp, Mus musculus
cccgagccgcagggccagttcctga

SEQ ID NO: 244848 - DNA, 25 bp, Mus musculus
cccgagccgctttaggatcgctact

SEQ ID NO: 244849 - DNA, 25 bp, Mus musculus
cccgagcgcccgcgtccagaggacc

SEQ ID NO: 244850 - DNA, 25 bp, Mus musculus
cccgagcggcggggtgaccatggag

SEQ ID NO: 244851 - DNA, 25 bp, Mus musculus
cccgagctaggggaagacacccagt

SEQ ID NO: 244852 - DNA, 25 bp, Mus musculus
cccgagctcacagctatccctctca

SEQ ID NO: 244853 - DNA, 25 bp, Mus musculus
cccgagctcctcgagcctaacccag

SEQ ID NO: 244854 - DNA, 25 bp, Mus musculus
cccgagctcctcgctgtgatcactg

SEQ ID NO: 244855 - DNA, 25 bp, Mus musculus
cccgaggaaagccagtaatggtcag

SEQ ID NO: 244856 - DNA, 25 bp, Mus musculus
cccgaggaagtagagccgccatgac

SEQ ID NO: 244857 - DNA, 25 bp, Mus musculus
cccgaggacgtgccaagccgcaatg

SEQ ID NO: 244858 - DNA, 25 bp, Mus musculus
cccgaggatatcagaaggactcagt

SEQ ID NO: 244859 - DNA, 25 bp, Mus musculus
cccgaggcagaatctagatcttgag

SEQ ID NO: 244860 - DNA, 25 bp, Mus musculus
cccgaggcagaggatttggacgtgg

SEQ ID NO: 244861 - DNA, 25 bp, Mus musculus
cccgaggcagatgtgtccttccggc

SEQ ID NO: 244862 - DNA, 25 bp, Mus musculus
cccgaggcaggtctctgctgacccc

SEQ ID NO: 244863 - DNA, 25 bp, Mus musculus
cccgaggccagagcatcccagcctt

SEQ ID NO: 244864 - DNA, 25 bp, Mus musculus
cccgaggcggagtgggtgacccggg

SEQ ID NO: 244865 - DNA, 25 bp, Mus musculus
cccgaggcggagtggttctctttct

SEQ ID NO: 244866 - DNA, 25 bp, Mus musculus
cccgaggcggttctcctgattctgg

SEQ ID NO: 244867 - DNA, 25 bp, Mus musculus
cccgaggctcaccaggatgtcttcc

SEQ ID NO: 244868 - DNA, 25 bp, Mus musculus
cccgagggaccggacactggccaaa

SEQ ID NO: 244869 - DNA, 25 bp, Mus musculus
cccgagggcggggcagcctgatgac

SEQ ID NO: 244870 - DNA, 25 bp, Mus musculus
cccgaggtcgatacttcccaagaaa

SEQ ID NO: 244871 - DNA, 25 bp, Mus musculus
cccgaggtctcgcagcacccagcag

SEQ ID NO: 244872 - DNA, 25 bp, Mus musculus
cccgagtaacagggattgccggaac

SEQ ID NO: 244873 - DNA, 25 bp, Mus musculus
cccgagtacagaaatgctgagcttc

SEQ ID NO: 244874 - DNA, 25 bp, Mus musculus
cccgagtagctgggtatcatagtta

SEQ ID NO: 244875 - DNA, 25 bp, Mus musculus
cccgagtatccgaggctggttatga

SEQ ID NO: 244876 - DNA, 25 bp, Mus musculus
cccgagtcaaaagagctttggcacc

SEQ ID NO: 244877 - DNA, 25 bp, Mus musculus
cccgagtccagattgaacacatatc

SEQ ID NO: 244878 - DNA, 25 bp, Mus musculus
cccgagtccaggccgacgtggaaag

SEQ ID NO: 244879 - DNA, 25 bp, Mus musculus
cccgagtcgggccggacagaacagt

SEQ ID NO: 244880 - DNA, 25 bp, Mus musculus
cccgagtgcctgtgctggtggagtc

SEQ ID NO: 244881 - DNA, 25 bp, Mus musculus
cccgagtgcgagcgggttgctgttc

SEQ ID NO: 244882 - DNA, 25 bp, Mus musculus
cccgagtggagctggacctcggcct

SEQ ID NO: 244883 - DNA, 25 bp, Mus musculus
cccgagtgttgggagcgggatgacc

SEQ ID NO: 244884 - DNA, 25 bp, Mus musculus
cccgatagaggtccaggtctgttca

SEQ ID NO: 244885 - DNA, 25 bp, Mus musculus
cccgatcaagatcaacaacccctcc

SEQ ID NO: 244886 - DNA, 25 bp, Mus musculus
cccgatcaagatcatactctcctag

SEQ ID NO: 244887 - DNA, 25 bp, Mus musculus
cccgatcatggagtattgataacaa

SEQ ID NO: 244888 - DNA, 25 bp, Mus musculus
cccgatccaggtctctgagtgtgag

SEQ ID NO: 244889 - DNA, 25 bp, Mus musculus
cccgatccccagacgagcaccaagg

SEQ ID NO: 244890 - DNA, 25 bp, Mus musculus
cccgatccgcgtgggatccaaggac

SEQ ID NO: 244891 - DNA, 25 bp, Mus musculus
cccgatcctctccaggacccaagtt

SEQ ID NO: 244892 - DNA, 25 bp, Mus musculus
cccgatcgtgtgcgggcatttcagg

SEQ ID NO: 244893 - DNA, 25 bp, Mus musculus
cccgatcttggtcattgcctttctc

SEQ ID NO: 244894 - DNA, 25 bp, Mus musculus
cccgatgaagaactaagtggaaaag

SEQ ID NO: 244895 - DNA, 25 bp, Mus musculus
cccgatgaagaatggataacgacca

SEQ ID NO: 244896 - DNA, 25 bp, Mus musculus
cccgatgacaagcttgctcgcctga

SEQ ID NO: 244897 - DNA, 25 bp, Mus musculus
cccgatgcaatgctgtcgatcattg

SEQ ID NO: 244898 - DNA, 25 bp, Mus musculus
cccgatgccaaaatccaacaaacca

SEQ ID NO: 244899 - DNA, 25 bp, Mus musculus
cccgatgccaaaattccaccaaaca

SEQ ID NO: 244900 - DNA, 25 bp, Mus musculus
cccgatggagggaccttgccagggc

SEQ ID NO: 244901 - DNA, 25 bp, Mus musculus
cccgatgggggccatctcacccatg

SEQ ID NO: 244902 - DNA, 25 bp, Mus musculus
cccgattacgtgggacgagtccggc

SEQ ID NO: 244903 - DNA, 25 bp, Mus musculus
cccgattctgtggacaggccaaaat

SEQ ID NO: 244904 - DNA, 25 bp, Mus musculus
cccgattgcagcgtgcccttgaagg

SEQ ID NO: 244905 - DNA, 25 bp, Mus musculus
cccgatttcgaggggagggagacga

SEQ ID NO: 244906 - DNA, 25 bp, Mus musculus
cccgatttctagcgtatatggagga

SEQ ID NO: 244907 - DNA, 25 bp, Mus musculus
cccgcaaaagctccctccaacatgc

SEQ ID NO: 244908 - DNA, 25 bp, Mus musculus
cccgcaacagcaatccaaacttccc

SEQ ID NO: 244909 - DNA, 25 bp, Mus musculus
cccgcaacaggtgacccaatgacaa

SEQ ID NO: 244910 - DNA, 25 bp, Mus musculus
cccgcaactctgcggcacatggtga

SEQ ID NO: 244911 - DNA, 25 bp, Mus musculus
cccgcaagcccattacttcacagag

SEQ ID NO: 244912 - DNA, 25 bp, Mus musculus
cccgcaaggacgaactcatcaagta

SEQ ID NO: 244913 - DNA, 25 bp, Mus musculus
cccgcaaggccccagccaagccgca

SEQ ID NO: 244914 - DNA, 25 bp, Mus musculus
cccgcacagcaggttctccacatga

SEQ ID NO: 244915 - DNA, 25 bp, Mus musculus
cccgcaccgtgtcgcgtcaagatgg

SEQ ID NO: 244916 - DNA, 25 bp, Mus musculus
cccgcaccgtgtcgcgtgagatctc

SEQ ID NO: 244917 - DNA, 25 bp, Mus musculus
cccgcacggagagaagaaaccaaaa

SEQ ID NO: 244918 - DNA, 25 bp, Mus musculus
cccgcactatgccaaaaataaagca

SEQ ID NO: 244919 - DNA, 25 bp, Mus musculus
cccgcactcagctgtttgaaataaa

SEQ ID NO: 244920 - DNA, 25 bp, Mus musculus
cccgcactcaggggaaggagccaca

SEQ ID NO: 244921 - DNA, 25 bp, Mus musculus
cccgcactggagcgtgctcttcagg

SEQ ID NO: 244922 - DNA, 25 bp, Mus musculus
cccgcagaatatggagggccccatg

SEQ ID NO: 244923 - DNA, 25 bp, Mus musculus
cccgcagacagacgtgttcttaatt

SEQ ID NO: 244924 - DNA, 25 bp, Mus musculus
cccgcagacagttggagacacatgt

SEQ ID NO: 244925 - DNA, 25 bp, Mus musculus
cccgcagaccatcatgcacatccag

SEQ ID NO: 244926 - DNA, 25 bp, Mus musculus
cccgcagccccgcgaatgctgctgc

SEQ ID NO: 244927 - DNA, 25 bp, Mus musculus
cccgcagccccgcgagttgcacgat

SEQ ID NO: 244928 - DNA, 25 bp, Mus musculus
cccgcagccccgcgatgtggccgtg

SEQ ID NO: 244929 - DNA, 25 bp, Mus musculus
cccgcagccgacatgcgctacgtcg

SEQ ID NO: 244930 - DNA, 25 bp, Mus musculus
cccgcagccgccagaagcggcttta

SEQ ID NO: 244931 - DNA, 25 bp, Mus musculus
cccgcagccgccaggccagaagcgg

SEQ ID NO: 244932 - DNA, 25 bp, Mus musculus
cccgcagcgtgagccagtgggtgtt

SEQ ID NO: 244933 - DNA, 25 bp, Mus musculus
cccgcagcgtgaggtcctggtattt

SEQ ID NO: 244934 - DNA, 25 bp, Mus musculus
cccgcaggacagagagtcgatatgc

SEQ ID NO: 244935 - DNA, 25 bp, Mus musculus
cccgcaggatcacgctcctcctagg

SEQ ID NO: 244936 - DNA, 25 bp, Mus musculus
cccgcaggatcacggcaaaatgaag

SEQ ID NO: 244937 - DNA, 25 bp, Mus musculus
cccgcaggcatacaggcaaagcgag

SEQ ID NO: 244938 - DNA, 25 bp, Mus musculus
cccgcaggcatacaggcctagctct

SEQ ID NO: 244939 - DNA, 25 bp, Mus musculus
cccgcagggtatttgtaaagatgag

SEQ ID NO: 244940 - DNA, 25 bp, Mus musculus
cccgcaggtgaaggacagcaaccat

SEQ ID NO: 244941 - DNA, 25 bp, Mus musculus
cccgcagtaacttggattccaggtg

SEQ ID NO: 244942 - DNA, 25 bp, Mus musculus
cccgcagtgtgagtgcctgctcact

SEQ ID NO: 244943 - DNA, 25 bp, Mus musculus
cccgcagtgtggaggcagttggctg

SEQ ID NO: 244944 - DNA, 25 bp, Mus musculus
cccgcatggtataaggatgacatcg

SEQ ID NO: 244945 - DNA, 25 bp, Mus musculus
cccgccaaaaaggagaactacctct

SEQ ID NO: 244946 - DNA, 25 bp, Mus musculus
cccgccaaaaaggaggtcctgagtt

SEQ ID NO: 244947 - DNA, 25 bp, Mus musculus
cccgccaaacgccatgagaatttcc

SEQ ID NO: 244948 - DNA, 25 bp, Mus musculus
cccgccacagctgagctgctcctct

SEQ ID NO: 244949 - DNA, 25 bp, Mus musculus
cccgccacaggctggagcaggctga

SEQ ID NO: 244950 - DNA, 25 bp, Mus musculus
cccgccacccagatctggaacaacg

SEQ ID NO: 244951 - DNA, 25 bp, Mus musculus
cccgccacccagcggccacatcctg

SEQ ID NO: 244952 - DNA, 25 bp, Mus musculus
cccgccaccccctgtatccctctga

SEQ ID NO: 244953 - DNA, 25 bp, Mus musculus
cccgccagccaggttgcaagtgttg

SEQ ID NO: 244954 - DNA, 25 bp, Mus musculus
cccgccaggtttctttcagcctcca

SEQ ID NO: 244955 - DNA, 25 bp, Mus musculus
cccgccagtcaagggacgcaagcgc

SEQ ID NO: 244956 - DNA, 25 bp, Mus musculus
cccgccatcacaggcttctgtgtca

SEQ ID NO: 244957 - DNA, 25 bp, Mus musculus
cccgccatccatgccagtttgcctt

SEQ ID NO: 244958 - DNA, 25 bp, Mus musculus
cccgccattcagggtgtcctggaca

SEQ ID NO: 244959 - DNA, 25 bp, Mus musculus
cccgcccacaagtatgtcttggctg

SEQ ID NO: 244960 - DNA, 25 bp, Mus musculus
cccgcccagttcagagttccaggga

SEQ ID NO: 244961 - DNA, 25 bp, Mus musculus
cccgcccagttcagctggcatctga

SEQ ID NO: 244962 - DNA, 25 bp, Mus musculus
cccgccccaaagcctgccgacataa

SEQ ID NO: 244963 - DNA, 25 bp, Mus musculus
cccgccccagaaacatcgaatgaat

SEQ ID NO: 244964 - DNA, 25 bp, Mus musculus
cccgccccagtgcaaacagctacca

SEQ ID NO: 244965 - DNA, 25 bp, Mus musculus
cccgccccattgaggtgaccagaat

SEQ ID NO: 244966 - DNA, 25 bp, Mus musculus
cccgcccccagcgcctgctctggcc

SEQ ID NO: 244967 - DNA, 25 bp, Mus musculus
cccgcccccaggccttctgggttgg

SEQ ID NO: 244968 - DNA, 25 bp, Mus musculus
cccgcccccgccgtgtgagcgtcct

SEQ ID NO: 244969 - DNA, 25 bp, Mus musculus
cccgccccgggcggcttggctgccc

SEQ ID NO: 244970 - DNA, 25 bp, Mus musculus
cccgccccgggcgggagtcaggcct

SEQ ID NO: 244971 - DNA, 25 bp, Mus musculus
cccgccccgtccccgccatgggctg

SEQ ID NO: 244972 - DNA, 25 bp, Mus musculus
cccgcccctgcctccctgcccacaa

SEQ ID NO: 244973 - DNA, 25 bp, Mus musculus
cccgcccctggtgtgctaccacccc

SEQ ID NO: 244974 - DNA, 25 bp, Mus musculus
cccgcccgaggcactagagcagcca

SEQ ID NO: 244975 - DNA, 25 bp, Mus musculus
cccgcccgcaggtccattcagaagc

SEQ ID NO: 244976 - DNA, 25 bp, Mus musculus
cccgcccgccgtgaaagccggcggg

SEQ ID NO: 244977 - DNA, 25 bp, Mus musculus
cccgcccgctgaaaaaattgtgcaa

SEQ ID NO: 244978 - DNA, 25 bp, Mus musculus
cccgcccgggtgtgggacttgtgtg

SEQ ID NO: 244979 - DNA, 25 bp, Mus musculus
cccgcccggtggacaccaagggctg

SEQ ID NO: 244980 - DNA, 25 bp, Mus musculus
cccgccctggatgccttttacaact

SEQ ID NO: 244981 - DNA, 25 bp, Mus musculus
cccgccgacagccaccatgcggcgt

SEQ ID NO: 244982 - DNA, 25 bp, Mus musculus
cccgccgagcagagaacggcaggct

SEQ ID NO: 244983 - DNA, 25 bp, Mus musculus
cccgccgagcaggaagttctgacgc

SEQ ID NO: 244984 - DNA, 25 bp, Mus musculus
cccgccgcaggcccggacacagagg

SEQ ID NO: 244985 - DNA, 25 bp, Mus musculus
cccgccgcccgcagagctgtttgga

SEQ ID NO: 244986 - DNA, 25 bp, Mus musculus
cccgccgctcgaaacctcgaccttg

SEQ ID NO: 244987 - DNA, 25 bp, Mus musculus
cccgccgctcgccggccctgctgag

SEQ ID NO: 244988 - DNA, 25 bp, Mus musculus
cccgccgctcggttacctgccttgc

SEQ ID NO: 244989 - DNA, 25 bp, Mus musculus
cccgccgctgccggagattggcaga

SEQ ID NO: 244990 - DNA, 25 bp, Mus musculus
cccgccggccaatgggcccagtgca

SEQ ID NO: 244991 - DNA, 25 bp, Mus musculus
cccgccgggcccatggaatccaaaa

SEQ ID NO: 244992 - DNA, 25 bp, Mus musculus
cccgcctactggaggaatgctggga

SEQ ID NO: 244993 - DNA, 25 bp, Mus musculus
cccgcctatcaaccgtggccttcca

SEQ ID NO: 244994 - DNA, 25 bp, Mus musculus
cccgcctcctcgcggcattggaggc

SEQ ID NO: 244995 - DNA, 25 bp, Mus musculus
cccgcctcctgatccaggaccagcg

SEQ ID NO: 244996 - DNA, 25 bp, Mus musculus
cccgcctcgctggccagatcttcct

SEQ ID NO: 244997 - DNA, 25 bp, Mus musculus
cccgcctcgggttgctgttctggct

SEQ ID NO: 244998 - DNA, 25 bp, Mus musculus
cccgcctctgactgtccctggccac

SEQ ID NO: 244999 - DNA, 25 bp, Mus musculus
cccgcctctggaggaaagagccaga

SEQ ID NO: 245000 - DNA, 25 bp, Mus musculus
cccgcctctggaggctccatctcca

SEQ ID NO: 245001 - DNA, 25 bp, Mus musculus
cccgcctgaccccagaagtagaaat

SEQ ID NO: 245002 - DNA, 25 bp, Mus musculus
cccgcctgaccccagcccagccagt

SEQ ID NO: 245003 - DNA, 25 bp, Mus musculus
cccgcctgccgcggaatcatggccc

SEQ ID NO: 245004 - DNA, 25 bp, Mus musculus
cccgcctgctggagctgctattgtt

SEQ ID NO: 245005 - DNA, 25 bp, Mus musculus
cccgcctgctggaggtacgaggatg

SEQ ID NO: 245006 - DNA, 25 bp, Mus musculus
cccgcctggaaaagctgctaaagct

SEQ ID NO: 245007 - DNA, 25 bp, Mus musculus
cccgcctgggcagggatccctgctg

SEQ ID NO: 245008 - DNA, 25 bp, Mus musculus
cccgcctttggctcccatccaagtc

SEQ ID NO: 245009 - DNA, 25 bp, Mus musculus
cccgcgaaggaggtgtcgcggaaga

SEQ ID NO: 245010 - DNA, 25 bp, Mus musculus
cccgcgagtagcaggaggcgtccgg

SEQ ID NO: 245011 - DNA, 25 bp, Mus musculus
cccgcgatgaagccgcccatttcaa

SEQ ID NO: 245012 - DNA, 25 bp, Mus musculus
cccgcgatgaagccggctacctctg

SEQ ID NO: 245013 - DNA, 25 bp, Mus musculus
cccgcgattgcagggagtcattccc

SEQ ID NO: 245014 - DNA, 25 bp, Mus musculus
cccgcgattgcaggtctgttgtggg

SEQ ID NO: 245015 - DNA, 25 bp, Mus musculus
cccgcgccacggacaagtgacgcag

SEQ ID NO: 245016 - DNA, 25 bp, Mus musculus
cccgcgccagagcagccaacatgag

SEQ ID NO: 245017 - DNA, 25 bp, Mus musculus
cccgcgcctctcagtgctcaggagc

SEQ ID NO: 245018 - DNA, 25 bp, Mus musculus
cccgcgcctctgatgctgagcccag

SEQ ID NO: 245019 - DNA, 25 bp, Mus musculus
cccgcgcgcctgaggcactttgaat

SEQ ID NO: 245020 - DNA, 25 bp, Mus musculus
cccgcgcggctaactcaacaaaaat

SEQ ID NO: 245021 - DNA, 25 bp, Mus musculus
cccgcgcgggctgagctggactggc

SEQ ID NO: 245022 - DNA, 25 bp, Mus musculus
cccgcgcgtaggcgtcaagatcaag

SEQ ID NO: 245023 - DNA, 25 bp, Mus musculus
cccgcgctctcgtagaaattgctcc

SEQ ID NO: 245024 - DNA, 25 bp, Mus musculus
cccgcgctctcgtagatctgccacc

SEQ ID NO: 245025 - DNA, 25 bp, Mus musculus
cccgcgctctcgtaggctgaagagt

SEQ ID NO: 245026 - DNA, 25 bp, Mus musculus
cccgcggacaggtttggccgtcgtg

SEQ ID NO: 245027 - DNA, 25 bp, Mus musculus
cccgcggacggcactgagagtatga

SEQ ID NO: 245028 - DNA, 25 bp, Mus musculus
cccgcggagcatcagacatttccac

SEQ ID NO: 245029 - DNA, 25 bp, Mus musculus
cccgcggcacgagacaatgaatatg

SEQ ID NO: 245030 - DNA, 25 bp, Mus musculus
cccgcggcagatgaggaaacccaga

SEQ ID NO: 245031 - DNA, 25 bp, Mus musculus
cccgcggcagggaatgattttgcat

SEQ ID NO: 245032 - DNA, 25 bp, Mus musculus
cccgcggccccgagcaggtttcaaa

SEQ ID NO: 245033 - DNA, 25 bp, Mus musculus
cccgcggccccgaggagtcagcatt

SEQ ID NO: 245034 - DNA, 25 bp, Mus musculus
cccgcggcctgctgggttcacggct

SEQ ID NO: 245035 - DNA, 25 bp, Mus musculus
cccgcggcggcgccggtgccaagtg

SEQ ID NO: 245036 - DNA, 25 bp, Mus musculus
cccgcggcggggcagactgaagtgt

SEQ ID NO: 245037 - DNA, 25 bp, Mus musculus
cccgcggcggggcaggagcaaaaca

SEQ ID NO: 245038 - DNA, 25 bp, Mus musculus
cccgcggcggggcaggtgtagtaac

SEQ ID NO: 245039 - DNA, 25 bp, Mus musculus
cccgcggcggttcaggaattacaca

SEQ ID NO: 245040 - DNA, 25 bp, Mus musculus
cccgcggcggttcaggggtatggaa

SEQ ID NO: 245041 - DNA, 25 bp, Mus musculus
cccgcggctcctcagatatagccat

SEQ ID NO: 245042 - DNA, 25 bp, Mus musculus
cccgcggctcctcagtattgtggaa

SEQ ID NO: 245043 - DNA, 25 bp, Mus musculus
cccgcggctcctcagtgtcggcggc

SEQ ID NO: 245044 - DNA, 25 bp, Mus musculus
cccgcgggagcagcaccccttgggg

SEQ ID NO: 245045 - DNA, 25 bp, Mus musculus
cccgcgggagcaggccggaagctca

SEQ ID NO: 245046 - DNA, 25 bp, Mus musculus
cccgcggggacagtaagaagacaat

SEQ ID NO: 245047 - DNA, 25 bp, Mus musculus
cccgcggggacagtgcctttgacga

SEQ ID NO: 245048 - DNA, 25 bp, Mus musculus
cccgcgtctcggaagactcttcaag

SEQ ID NO: 245049 - DNA, 25 bp, Mus musculus
cccgcgttagccttcaaaccatgaa

SEQ ID NO: 245050 - DNA, 25 bp, Mus musculus
cccgcgttagccttcggttgtttgt

SEQ ID NO: 245051 - DNA, 25 bp, Mus musculus
cccgctacgcgcggtatgtggcctt

SEQ ID NO: 245052 - DNA, 25 bp, Mus musculus
cccgctacggctcaatcgtggatga

SEQ ID NO: 245053 - DNA, 25 bp, Mus musculus
cccgctactgtatcccttttggcta

SEQ ID NO: 245054 - DNA, 25 bp, Mus musculus
cccgctactttggtgacacacactg

SEQ ID NO: 245055 - DNA, 25 bp, Mus musculus
cccgctagacatccgttacaaactc

SEQ ID NO: 245056 - DNA, 25 bp, Mus musculus
cccgctagacatgaaggatggcttt

SEQ ID NO: 245057 - DNA, 25 bp, Mus musculus
cccgctagaccggtggaacctaggg

SEQ ID NO: 245058 - DNA, 25 bp, Mus musculus
cccgctcaccggctgtaaaaaatgg

SEQ ID NO: 245059 - DNA, 25 bp, Mus musculus
cccgctcagcagcacaaaggcatta

SEQ ID NO: 245060 - DNA, 25 bp, Mus musculus
cccgctccagcattgctgaagtgca

SEQ ID NO: 245061 - DNA, 25 bp, Mus musculus
cccgctccgcagaggtcgcagcgtg

SEQ ID NO: 245062 - DNA, 25 bp, Mus musculus
cccgctcctgcacagattgcgctgg

SEQ ID NO: 245063 - DNA, 25 bp, Mus musculus
cccgctcctgggccgcaaacaggaa

SEQ ID NO: 245064 - DNA, 25 bp, Mus musculus
cccgctctccgtagtgaagctgtgg

SEQ ID NO: 245065 - DNA, 25 bp, Mus musculus
cccgctctgctgccctgaatctgtg

SEQ ID NO: 245066 - DNA, 25 bp, Mus musculus
cccgctctggatctagtgacagcag

SEQ ID NO: 245067 - DNA, 25 bp, Mus musculus
cccgctctggccgacctaatcccca

SEQ ID NO: 245068 - DNA, 25 bp, Mus musculus
cccgctctggccggagtgagagaga

SEQ ID NO: 245069 - DNA, 25 bp, Mus musculus
cccgctgaccctgtgtctcaggggc

SEQ ID NO: 245070 - DNA, 25 bp, Mus musculus
cccgctgagctcaatatggatcaaa

SEQ ID NO: 245071 - DNA, 25 bp, Mus musculus
cccgctgagggaaagaaaaatacct

SEQ ID NO: 245072 - DNA, 25 bp, Mus musculus
cccgctgagggaaagagttcacatg

SEQ ID NO: 245073 - DNA, 25 bp, Mus musculus
cccgctgagggaaagattgacggcg

SEQ ID NO: 245074 - DNA, 25 bp, Mus musculus
cccgctgcagatttgcaacagcatg

SEQ ID NO: 245075 - DNA, 25 bp, Mus musculus
cccgctgccccagggatctttggcc

SEQ ID NO: 245076 - DNA, 25 bp, Mus musculus
cccgctgcccgccgccaatatgcct

SEQ ID NO: 245077 - DNA, 25 bp, Mus musculus
cccgctgcgggcgagatgtatacat

SEQ ID NO: 245078 - DNA, 25 bp, Mus musculus
cccgctgctcctgggtgctggccaa

SEQ ID NO: 245079 - DNA, 25 bp, Mus musculus
cccgctggaagtttgtgtgagtgac

SEQ ID NO: 245080 - DNA, 25 bp, Mus musculus
cccgctggacctccgggtcctgtgg

SEQ ID NO: 245081 - DNA, 25 bp, Mus musculus
cccgctggagcagggccacgtggca

SEQ ID NO: 245082 - DNA, 25 bp, Mus musculus
cccgctggatcaggtattccttttt

SEQ ID NO: 245083 - DNA, 25 bp, Mus musculus
cccgctggatcaggttaactttgtg

SEQ ID NO: 245084 - DNA, 25 bp, Mus musculus
cccgctggatcagtttaggatttaa

SEQ ID NO: 245085 - DNA, 25 bp, Mus musculus
cccgctggccccgagatgaagtgac

SEQ ID NO: 245086 - DNA, 25 bp, Mus musculus
cccgctgggcagagggatctttggc

SEQ ID NO: 245087 - DNA, 25 bp, Mus musculus
cccgctggtaagattgagaaaggtt

SEQ ID NO: 245088 - DNA, 25 bp, Mus musculus
cccgctggtcggtctgggaacgtaa

SEQ ID NO: 245089 - DNA, 25 bp, Mus musculus
cccgctggtggagggtgtcaccgaa

SEQ ID NO: 245090 - DNA, 25 bp, Mus musculus
cccgctgtacttgtccagctcttaa

SEQ ID NO: 245091 - DNA, 25 bp, Mus musculus
cccgctgtcccccacgcgagtttgt

SEQ ID NO: 245092 - DNA, 25 bp, Mus musculus
cccgctgtcccccaggcgagtttgt

SEQ ID NO: 245093 - DNA, 25 bp, Mus musculus
cccgctgtctgggaagagcatggag

SEQ ID NO: 245094 - DNA, 25 bp, Mus musculus
cccgcttccagcagacatccttcta

SEQ ID NO: 245095 - DNA, 25 bp, Mus musculus
cccgcttccgagcctcgattgaact

SEQ ID NO: 245096 - DNA, 25 bp, Mus musculus
cccgcttcggtactctaacaagaaa

SEQ ID NO: 245097 - DNA, 25 bp, Mus musculus
cccgcttcggtatgactcaatagat

SEQ ID NO: 245098 - DNA, 25 bp, Mus musculus
cccgcttggcaggccggcagaggac

SEQ ID NO: 245099 - DNA, 25 bp, Mus musculus
cccgctttggacagaaaatcaccgt

SEQ ID NO: 245100 - DNA, 25 bp, Mus musculus
cccgctttggacaggatattgacta

SEQ ID NO: 245101 - DNA, 25 bp, Mus musculus
cccgcttttcagatcctggatggta

SEQ ID NO: 245102 - DNA, 25 bp, Mus musculus
cccgcttttctcagctgtgacttct

SEQ ID NO: 245103 - DNA, 25 bp, Mus musculus
cccggaaaagcatgccttggactct

SEQ ID NO: 245104 - DNA, 25 bp, Mus musculus
cccggaaaaggagtcaggcggagcg

SEQ ID NO: 245105 - DNA, 25 bp, Mus musculus
cccggaaactcaagatgtcggttgg

SEQ ID NO: 245106 - DNA, 25 bp, Mus musculus
cccggaaacttagggaatgacaagg

SEQ ID NO: 245107 - DNA, 25 bp, Mus musculus
cccggaaattccaaggaacctggtg

SEQ ID NO: 245108 - DNA, 25 bp, Mus musculus
cccggaacaaagtaagaagctgtct

SEQ ID NO: 245109 - DNA, 25 bp, Mus musculus
cccggaacaaggatgtatttatacc

SEQ ID NO: 245110 - DNA, 25 bp, Mus musculus
cccggaacaaggtcctacatctcct

SEQ ID NO: 245111 - DNA, 25 bp, Mus musculus
cccggaaccctgaaggatcctcgct

SEQ ID NO: 245112 - DNA, 25 bp, Mus musculus
cccggaagaatacgtatcaccaaac

SEQ ID NO: 245113 - DNA, 25 bp, Mus musculus
cccggaagcaggtgcggtgctacct

SEQ ID NO: 245114 - DNA, 25 bp, Mus musculus
cccggaagccctacactattaggaa

SEQ ID NO: 245115 - DNA, 25 bp, Mus musculus
cccggaagccctacagaaacctgtg

SEQ ID NO: 245116 - DNA, 25 bp, Mus musculus
cccggaagccgaactgctttgagct

SEQ ID NO: 245117 - DNA, 25 bp, Mus musculus
cccggaaggaaggtcggcagctctg

SEQ ID NO: 245118 - DNA, 25 bp, Mus musculus
cccggaagtcgggtgacagaagaca

SEQ ID NO: 245119 - DNA, 25 bp, Mus musculus
cccggacaacagcaagcccaccaat

SEQ ID NO: 245120 - DNA, 25 bp, Mus musculus
cccggacaaggactggttccacctg

SEQ ID NO: 245121 - DNA, 25 bp, Mus musculus
cccggacacccggaaaccctgatgg

SEQ ID NO: 245122 - DNA, 25 bp, Mus musculus
cccggacatcacttggctgtcggcg

SEQ ID NO: 245123 - DNA, 25 bp, Mus musculus
cccggacccctggttctccacatac

SEQ ID NO: 245124 - DNA, 25 bp, Mus musculus
cccggacccgagatgagcaataaca

SEQ ID NO: 245125 - DNA, 25 bp, Mus musculus
cccggaccgccagattgtgccttct

SEQ ID NO: 245126 - DNA, 25 bp, Mus musculus
cccggaccgcgcggccacaaaaaga

SEQ ID NO: 245127 - DNA, 25 bp, Mus musculus
cccggacctcagcagaaatctcccg

SEQ ID NO: 245128 - DNA, 25 bp, Mus musculus
cccggacctcaggtctctgcctccg

SEQ ID NO: 245129 - DNA, 25 bp, Mus musculus
cccggactcagatcatctttagatg

SEQ ID NO: 245130 - DNA, 25 bp, Mus musculus
cccggactctgagacgccacagggc

SEQ ID NO: 245131 - DNA, 25 bp, Mus musculus
cccggagaaagcaggccaccccttc

SEQ ID NO: 245132 - DNA, 25 bp, Mus musculus
cccggagaactggtgcctcgtctcc

SEQ ID NO: 245133 - DNA, 25 bp, Mus musculus
cccggagaagagccctaggcgatgc

SEQ ID NO: 245134 - DNA, 25 bp, Mus musculus
cccggagaagaggcaatcaagccct

SEQ ID NO: 245135 - DNA, 25 bp, Mus musculus
cccggagaagatggtgaacctggaa

SEQ ID NO: 245136 - DNA, 25 bp, Mus musculus
cccggagaaggagtgagagagagag

SEQ ID NO: 245137 - DNA, 25 bp, Mus musculus
cccggagacaactagctgtgttact

SEQ ID NO: 245138 - DNA, 25 bp, Mus musculus
cccggagacagcccaaggatgtcac

SEQ ID NO: 245139 - DNA, 25 bp, Mus musculus
cccggagagagctctcagggcctgt

SEQ ID NO: 245140 - DNA, 25 bp, Mus musculus
cccggagatgcgggtttgcctgcaa

SEQ ID NO: 245141 - DNA, 25 bp, Mus musculus
cccggagatgctcagcaagccccgc

SEQ ID NO: 245142 - DNA, 25 bp, Mus musculus
cccggagcaagactgtcaaggcctt

SEQ ID NO: 245143 - DNA, 25 bp, Mus musculus
cccggagcaaggacgaaggtgttta

SEQ ID NO: 245144 - DNA, 25 bp, Mus musculus
cccggagcaaggtaacaaataagga

SEQ ID NO: 245145 - DNA, 25 bp, Mus musculus
cccggagcacgcagcccgactcaat

SEQ ID NO: 245146 - DNA, 25 bp, Mus musculus
cccggagccaagatcccattctcag

SEQ ID NO: 245147 - DNA, 25 bp, Mus musculus
cccggagccaagtggttgatcggtt

SEQ ID NO: 245148 - DNA, 25 bp, Mus musculus
cccggagccgcgactgatttcctga

SEQ ID NO: 245149 - DNA, 25 bp, Mus musculus
cccggagccgcgttggaggcctccc

SEQ ID NO: 245150 - DNA, 25 bp, Mus musculus
cccggagccgtgacggagatgctca

SEQ ID NO: 245151 - DNA, 25 bp, Mus musculus
cccggagccgttatcctaggcgtct

SEQ ID NO: 245152 - DNA, 25 bp, Mus musculus
cccggagcgagacactttcctgagc

SEQ ID NO: 245153 - DNA, 25 bp, Mus musculus
cccggagcgaggtagcaaacaagat

SEQ ID NO: 245154 - DNA, 25 bp, Mus musculus
cccggagctactggagaagccagat

SEQ ID NO: 245155 - DNA, 25 bp, Mus musculus
cccggagctgaccaaaccgggctcc

SEQ ID NO: 245156 - DNA, 25 bp, Mus musculus
cccggagctgaccggtctccctatg

SEQ ID NO: 245157 - DNA, 25 bp, Mus musculus
cccggagctgagggttccagaccac

SEQ ID NO: 245158 - DNA, 25 bp, Mus musculus
cccggagctgatcgatttgatctac

SEQ ID NO: 245159 - DNA, 25 bp, Mus musculus
cccggagctggttaagagaaaatcc

SEQ ID NO: 245160 - DNA, 25 bp, Mus musculus
cccggaggaagcctcaagcacagcc

SEQ ID NO: 245161 - DNA, 25 bp, Mus musculus
cccggaggaaggtgttcctggtggc

SEQ ID NO: 245162 - DNA, 25 bp, Mus musculus
cccggaggacaaaggctatgtgctt

SEQ ID NO: 245163 - DNA, 25 bp, Mus musculus
cccggaggacacagattccttctgg

SEQ ID NO: 245164 - DNA, 25 bp, Mus musculus
cccggaggagagtccaccactgcct

SEQ ID NO: 245165 - DNA, 25 bp, Mus musculus
cccggaggagatggacgtggatgag

SEQ ID NO: 245166 - DNA, 25 bp, Mus musculus
cccggaggagatggagcacgcccca

SEQ ID NO: 245167 - DNA, 25 bp, Mus musculus
cccggaggaggtgacagagttagtc

SEQ ID NO: 245168 - DNA, 25 bp, Mus musculus
cccggaggaggttctgctgccttaa

SEQ ID NO: 245169 - DNA, 25 bp, Mus musculus
cccggaggagtgccggcattggcat

SEQ ID NO: 245170 - DNA, 25 bp, Mus musculus
cccggaggagtggagacgtcggatg

SEQ ID NO: 245171 - DNA, 25 bp, Mus musculus
cccggagtcgccatgcctacaacac

SEQ ID NO: 245172 - DNA, 25 bp, Mus musculus
cccggagtcgccatgtcaccccagg

SEQ ID NO: 245173 - DNA, 25 bp, Mus musculus
cccggagtctggcacatccaggacc

SEQ ID NO: 245174 - DNA, 25 bp, Mus musculus
cccggagtggcagtccggctctcca

SEQ ID NO: 245175 - DNA, 25 bp, Mus musculus
cccggataacgagcgaccgccttct

SEQ ID NO: 245176 - DNA, 25 bp, Mus musculus
cccggataacgtggaccatgtgttt

SEQ ID NO: 245177 - DNA, 25 bp, Mus musculus
cccggatatctgaggttcccaatca

SEQ ID NO: 245178 - DNA, 25 bp, Mus musculus
cccggatatggcaggatgttcaact

SEQ ID NO: 245179 - DNA, 25 bp, Mus musculus
cccggatcccgaggccacgtggcac

SEQ ID NO: 245180 - DNA, 25 bp, Mus musculus
cccggatgagcgagctggagcagaa

SEQ ID NO: 245181 - DNA, 25 bp, Mus musculus
cccggatgaggtggctctggtccag

SEQ ID NO: 245182 - DNA, 25 bp, Mus musculus
cccggatgctgcaggttactcggcg

SEQ ID NO: 245183 - DNA, 25 bp, Mus musculus
cccggatggagtgtcgagggggaac

SEQ ID NO: 245184 - DNA, 25 bp, Mus musculus
cccggatgtaccagaagactctaac

SEQ ID NO: 245185 - DNA, 25 bp, Mus musculus
cccggatgtaccaggtgatttcaga

SEQ ID NO: 245186 - DNA, 25 bp, Mus musculus
cccggatgtatccaggctcacccag

SEQ ID NO: 245187 - DNA, 25 bp, Mus musculus
cccggatgtgaaagcacaggtggac

SEQ ID NO: 245188 - DNA, 25 bp, Mus musculus
cccggatgtggatggaaaagccgaa

SEQ ID NO: 245189 - DNA, 25 bp, Mus musculus
cccggatgtggttgccaaaacaaag

SEQ ID NO: 245190 - DNA, 25 bp, Mus musculus
cccggattaaggggacctggctgac

SEQ ID NO: 245191 - DNA, 25 bp, Mus musculus
cccggattacatagccaacaaggag

SEQ ID NO: 245192 - DNA, 25 bp, Mus musculus
cccggattacataggttttactata

SEQ ID NO: 245193 - DNA, 25 bp, Mus musculus
cccggattacatagtgtatccccta

SEQ ID NO: 245194 - DNA, 25 bp, Mus musculus
cccggattgagcggtcctcgtcttt

SEQ ID NO: 245195 - DNA, 25 bp, Mus musculus
cccggatttttgttgaagtactcac

SEQ ID NO: 245196 - DNA, 25 bp, Mus musculus
cccggcaaacatgacctggctcacc

SEQ ID NO: 245197 - DNA, 25 bp, Mus musculus
cccggcaccaggcaatctttggcag

SEQ ID NO: 245198 - DNA, 25 bp, Mus musculus
cccggcagaggagcctggaggaggg

SEQ ID NO: 245199 - DNA, 25 bp, Mus musculus
cccggcagcagaggtggtttgtgca

SEQ ID NO: 245200 - DNA, 25 bp, Mus musculus
cccggcagcaggatgaaacgaggag

SEQ ID NO: 245201 - DNA, 25 bp, Mus musculus
cccggcagcagtctcactttatctc

SEQ ID NO: 245202 - DNA, 25 bp, Mus musculus
cccggcagccgaggttcctgcctca

SEQ ID NO: 245203 - DNA, 25 bp, Mus musculus
cccggcaggtgaaggcctatgagaa

SEQ ID NO: 245204 - DNA, 25 bp, Mus musculus
cccggcagtcaggagatggaggaag

SEQ ID NO: 245205 - DNA, 25 bp, Mus musculus
cccggcatgaccaaactccgatgat

SEQ ID NO: 245206 - DNA, 25 bp, Mus musculus
cccggcatgaccagtgtcagcgcaa

SEQ ID NO: 245207 - DNA, 25 bp, Mus musculus
cccggcatggggcggcgtcgcggct

SEQ ID NO: 245208 - DNA, 25 bp, Mus musculus
cccggccaggccatgccatgggttc

SEQ ID NO: 245209 - DNA, 25 bp, Mus musculus
cccggccatcctacctgcctattgt

SEQ ID NO: 245210 - DNA, 25 bp, Mus musculus
cccggccatcgttgtggagctgaat

SEQ ID NO: 245211 - DNA, 25 bp, Mus musculus
cccggcccacccggtgtgacttctt

SEQ ID NO: 245212 - DNA, 25 bp, Mus musculus
cccggcccacgaagcatgtaatgag

SEQ ID NO: 245213 - DNA, 25 bp, Mus musculus
cccggcccagcccggtcaagcaggt

SEQ ID NO: 245214 - DNA, 25 bp, Mus musculus
cccggcccatcgggtgagcccggca

SEQ ID NO: 245215 - DNA, 25 bp, Mus musculus
cccggccccagcatctgggtggtct

SEQ ID NO: 245216 - DNA, 25 bp, Mus musculus
cccggccccagctgagtgatcgctc

SEQ ID NO: 245217 - DNA, 25 bp, Mus musculus
cccggccccagggctggctgtgggc

SEQ ID NO: 245218 - DNA, 25 bp, Mus musculus
cccggccccagtggacctgctggtg

SEQ ID NO: 245219 - DNA, 25 bp, Mus musculus
cccggccccatgggtcctccaggac

SEQ ID NO: 245220 - DNA, 25 bp, Mus musculus
cccggccctcctgaagccctttttg

SEQ ID NO: 245221 - DNA, 25 bp, Mus musculus
cccggccctctgcgcctgtgtctgg

SEQ ID NO: 245222 - DNA, 25 bp, Mus musculus
cccggccgagagtgactcatgaaat

SEQ ID NO: 245223 - DNA, 25 bp, Mus musculus
cccggccgagttcggactttctgca

SEQ ID NO: 245224 - DNA, 25 bp, Mus musculus
cccggccggccgtcgggactctaat

SEQ ID NO: 245225 - DNA, 25 bp, Mus musculus
cccggccggggaccaatctccgctg

SEQ ID NO: 245226 - DNA, 25 bp, Mus musculus
cccggcctagatgcagcttcagaag

SEQ ID NO: 245227 - DNA, 25 bp, Mus musculus
cccggcctatggcggagtagtgtat

SEQ ID NO: 245228 - DNA, 25 bp, Mus musculus
cccggcctatggcggtgttgtttac

SEQ ID NO: 245229 - DNA, 25 bp, Mus musculus
cccggcctcatgaagacgtcttcat

SEQ ID NO: 245230 - DNA, 25 bp, Mus musculus
cccggcctcatgaaggttcctttgg

SEQ ID NO: 245231 - DNA, 25 bp, Mus musculus
cccggcctcgggtgtttctgtttga

SEQ ID NO: 245232 - DNA, 25 bp, Mus musculus
cccggcctctgatgacccccggagc

SEQ ID NO: 245233 - DNA, 25 bp, Mus musculus
cccggcctctgatgcttgattatac

SEQ ID NO: 245234 - DNA, 25 bp, Mus musculus
cccggcctggcaggtagcagaggca

SEQ ID NO: 245235 - DNA, 25 bp, Mus musculus
cccggcctggcaggtttaagtttct

SEQ ID NO: 245236 - DNA, 25 bp, Mus musculus
cccggcctggcagtttctagtcctg

SEQ ID NO: 245237 - DNA, 25 bp, Mus musculus
cccggcgccaatgagaaagataagg

SEQ ID NO: 245238 - DNA, 25 bp, Mus musculus
cccggcgccccaacagattccacga

SEQ ID NO: 245239 - DNA, 25 bp, Mus musculus
cccggcgccggttcagtcctcgccc

SEQ ID NO: 245240 - DNA, 25 bp, Mus musculus
cccggcgcggcgggagccgctcccg

SEQ ID NO: 245241 - DNA, 25 bp, Mus musculus
cccggcgctgagcctcaaaatgcag

SEQ ID NO: 245242 - DNA, 25 bp, Mus musculus
cccggcgctggagccccaaactact

SEQ ID NO: 245243 - DNA, 25 bp, Mus musculus
cccggcggacagagttgatggtgtc

SEQ ID NO: 245244 - DNA, 25 bp, Mus musculus
cccggcggagatgaggaaactgagg

SEQ ID NO: 245245 - DNA, 25 bp, Mus musculus
cccggcggaggtgtgaccccacaac

SEQ ID NO: 245246 - DNA, 25 bp, Mus musculus
cccggcgggcgggtaaataacagat

SEQ ID NO: 245247 - DNA, 25 bp, Mus musculus
cccggcgtacgctggcccttctgta

SEQ ID NO: 245248 - DNA, 25 bp, Mus musculus
cccggcgtacgctggttatttgctg

SEQ ID NO: 245249 - DNA, 25 bp, Mus musculus
cccggcgtcaggagcctgatgggaa

SEQ ID NO: 245250 - DNA, 25 bp, Mus musculus
cccggcgtcatcaaccctggagaat

SEQ ID NO: 245251 - DNA, 25 bp, Mus musculus
cccggctacacagatttgacataat

SEQ ID NO: 245252 - DNA, 25 bp, Mus musculus
cccggctacagaactttgtacctat

SEQ ID NO: 245253 - DNA, 25 bp, Mus musculus
cccggctacatggcatcagtggatg

SEQ ID NO: 245254 - DNA, 25 bp, Mus musculus
cccggctagagaacatgaatggctt

SEQ ID NO: 245255 - DNA, 25 bp, Mus musculus
cccggctagagatcggaatgtgcgg

SEQ ID NO: 245256 - DNA, 25 bp, Mus musculus
cccggctagagcgccacttagcccc

SEQ ID NO: 245257 - DNA, 25 bp, Mus musculus
cccggctcacctggttccggaagca

SEQ ID NO: 245258 - DNA, 25 bp, Mus musculus
cccggctcaggacaatggattttcc

SEQ ID NO: 245259 - DNA, 25 bp, Mus musculus
cccggctccaggactactacgtggt

SEQ ID NO: 245260 - DNA, 25 bp, Mus musculus
cccggctccctcaggtataagtatt

SEQ ID NO: 245261 - DNA, 25 bp, Mus musculus
cccggctctgtggtgccttagctgg

SEQ ID NO: 245262 - DNA, 25 bp, Mus musculus
cccggctgaagcaggctattgaaga

SEQ ID NO: 245263 - DNA, 25 bp, Mus musculus
cccggctgaagcaggtaaaaaacaa

SEQ ID NO: 245264 - DNA, 25 bp, Mus musculus
cccggctgagagtctccagagccag

SEQ ID NO: 245265 - DNA, 25 bp, Mus musculus
cccggctgcaggcgaatctggtttt

SEQ ID NO: 245266 - DNA, 25 bp, Mus musculus
cccggctgcagggtctgtcaccgct

SEQ ID NO: 245267 - DNA, 25 bp, Mus musculus
cccggctgcccactccgccttgata

SEQ ID NO: 245268 - DNA, 25 bp, Mus musculus
cccggctgtacacttccggcctgct

SEQ ID NO: 245269 - DNA, 25 bp, Mus musculus
cccggcttagaactctccgctggtg

SEQ ID NO: 245270 - DNA, 25 bp, Mus musculus
cccggcttccggagatatgacgtgt

SEQ ID NO: 245271 - DNA, 25 bp, Mus musculus
cccggcttccggagtttgtgatcct

SEQ ID NO: 245272 - DNA, 25 bp, Mus musculus
cccggcttcgtgtatcctcagagat

SEQ ID NO: 245273 - DNA, 25 bp, Mus musculus
cccgggaaagaacgcacagtggtat

SEQ ID NO: 245274 - DNA, 25 bp, Mus musculus
cccgggaaccaagaaatcccaggca

SEQ ID NO: 245275 - DNA, 25 bp, Mus musculus
cccgggaaccaagaaggcacagaca

SEQ ID NO: 245276 - DNA, 25 bp, Mus musculus
cccgggacaaagggtgaagcaggga

SEQ ID NO: 245277 - DNA, 25 bp, Mus musculus
cccgggacaactatgggaagaagaa

SEQ ID NO: 245278 - DNA, 25 bp, Mus musculus
cccgggacagccaggtggagttgtt

SEQ ID NO: 245279 - DNA, 25 bp, Mus musculus
cccgggacagccagtgcgtccagtt

SEQ ID NO: 245280 - DNA, 25 bp, Mus musculus
cccgggacccgcaggtcctaatctg

SEQ ID NO: 245281 - DNA, 25 bp, Mus musculus
cccgggacccttatgacctgatggg

SEQ ID NO: 245282 - DNA, 25 bp, Mus musculus
cccgggacccttctgccactgctgc

SEQ ID NO: 245283 - DNA, 25 bp, Mus musculus
cccgggaccgcaggtgtgggatatg

SEQ ID NO: 245284 - DNA, 25 bp, Mus musculus
cccgggaccgcagttgagtggtgat

SEQ ID NO: 245285 - DNA, 25 bp, Mus musculus
cccgggacgaggcaaagatgctgga

SEQ ID NO: 245286 - DNA, 25 bp, Mus musculus
cccgggacgtggtcaacgtggtgtt

SEQ ID NO: 245287 - DNA, 25 bp, Mus musculus
cccgggactcctgagccgctctgca

SEQ ID NO: 245288 - DNA, 25 bp, Mus musculus
cccgggacttcatgcgattgagaag

SEQ ID NO: 245289 - DNA, 25 bp, Mus musculus
cccgggacttcatgttgatcacagc

SEQ ID NO: 245290 - DNA, 25 bp, Mus musculus
cccgggagagcaatgtcacacttgg

SEQ ID NO: 245291 - DNA, 25 bp, Mus musculus
cccgggagattggaggggactcctt

SEQ ID NO: 245292 - DNA, 25 bp, Mus musculus
cccgggagcagagaagaaagcgagt

SEQ ID NO: 245293 - DNA, 25 bp, Mus musculus
cccgggagcaggctgaagctgaggt

SEQ ID NO: 245294 - DNA, 25 bp, Mus musculus
cccgggagcagtgatgaaaagactg

SEQ ID NO: 245295 - DNA, 25 bp, Mus musculus
cccgggagcccctgatgacccctat

SEQ ID NO: 245296 - DNA, 25 bp, Mus musculus
cccgggagcgacgatgtcaacctac

SEQ ID NO: 245297 - DNA, 25 bp, Mus musculus
cccgggagcgagagctttgtaaatg

SEQ ID NO: 245298 - DNA, 25 bp, Mus musculus
cccgggagcggggcagccacagaac

SEQ ID NO: 245299 - DNA, 25 bp, Mus musculus
cccgggagcggtcgagctagaggag

SEQ ID NO: 245300 - DNA, 25 bp, Mus musculus
cccgggataggcttctgtgtcagtc

SEQ ID NO: 245301 - DNA, 25 bp, Mus musculus
cccgggatggagatgaggtgccact

SEQ ID NO: 245302 - DNA, 25 bp, Mus musculus
cccgggattgcctatcctctactcc

SEQ ID NO: 245303 - DNA, 25 bp, Mus musculus
cccgggcaagacatccacatctttt

SEQ ID NO: 245304 - DNA, 25 bp, Mus musculus
cccgggcaggcagtatgggcttatt

SEQ ID NO: 245305 - DNA, 25 bp, Mus musculus
cccgggcagtctgggcctgccaccc

SEQ ID NO: 245306 - DNA, 25 bp, Mus musculus
cccgggcagttcaagccaaccatct

SEQ ID NO: 245307 - DNA, 25 bp, Mus musculus
cccgggccaaggctagccaacgacc

SEQ ID NO: 245308 - DNA, 25 bp, Mus musculus
cccgggccactcaaggttttgagga

SEQ ID NO: 245309 - DNA, 25 bp, Mus musculus
cccgggccagacctcagctcgcatc

SEQ ID NO: 245310 - DNA, 25 bp, Mus musculus
cccgggcccttgaagccacccgcgg

SEQ ID NO: 245311 - DNA, 25 bp, Mus musculus
cccgggcccttgaagcgcggctggg

SEQ ID NO: 245312 - DNA, 25 bp, Mus musculus
cccgggccgctcgatgaacctctag

SEQ ID NO: 245313 - DNA, 25 bp, Mus musculus
cccgggccgtgggaaatgcagttat

SEQ ID NO: 245314 - DNA, 25 bp, Mus musculus
cccgggccgtgggctgcccagctgg

SEQ ID NO: 245315 - DNA, 25 bp, Mus musculus
cccgggcctcaggaaccaatgacaa

SEQ ID NO: 245316 - DNA, 25 bp, Mus musculus
cccgggcctccccagcagtcctttg

SEQ ID NO: 245317 - DNA, 25 bp, Mus musculus
cccgggcggcaggacctgctagaag

SEQ ID NO: 245318 - DNA, 25 bp, Mus musculus
cccgggctcacattaatatttgcca

SEQ ID NO: 245319 - DNA, 25 bp, Mus musculus
cccgggcttccagacgatactgtat

SEQ ID NO: 245320 - DNA, 25 bp, Mus musculus
cccggggaaacaatggagaagtgta

SEQ ID NO: 245321 - DNA, 25 bp, Mus musculus
cccggggaccagctgggcccccagc

SEQ ID NO: 245322 - DNA, 25 bp, Mus musculus
cccggggagagatactccatgtttc

SEQ ID NO: 245323 - DNA, 25 bp, Mus musculus
cccggggatacagaacatctcccgg

SEQ ID NO: 245324 - DNA, 25 bp, Mus musculus
cccggggatacagctttggggcgat

SEQ ID NO: 245325 - DNA, 25 bp, Mus musculus
cccggggatgagtcctcaaatgcca

SEQ ID NO: 245326 - DNA, 25 bp, Mus musculus
cccggggattacaggttaaaatgag

SEQ ID NO: 245327 - DNA, 25 bp, Mus musculus
cccggggcatagccaccccgctggg

SEQ ID NO: 245328 - DNA, 25 bp, Mus musculus
cccggggcggacagacctacgcaat

SEQ ID NO: 245329 - DNA, 25 bp, Mus musculus
cccggggcggacagatctgacacac

SEQ ID NO: 245330 - DNA, 25 bp, Mus musculus
cccggggcggagtttgatggtgaca

SEQ ID NO: 245331 - DNA, 25 bp, Mus musculus
cccggggcggcctcttgggagacct

SEQ ID NO: 245332 - DNA, 25 bp, Mus musculus
cccggggcggtgatgtggccgtgga

SEQ ID NO: 245333 - DNA, 25 bp, Mus musculus
cccggggctacaggctcaccatcat

SEQ ID NO: 245334 - DNA, 25 bp, Mus musculus
cccggggctgagctggctagagatc

SEQ ID NO: 245335 - DNA, 25 bp, Mus musculus
cccgggggacaaggacccagcatgg

SEQ ID NO: 245336 - DNA, 25 bp, Mus musculus
cccgggggacaagggtgccagtgat

SEQ ID NO: 245337 - DNA, 25 bp, Mus musculus
cccgggggagctgtggccatgttca

SEQ ID NO: 245338 - DNA, 25 bp, Mus musculus
cccggggggaaggattggatggtga

SEQ ID NO: 245339 - DNA, 25 bp, Mus musculus
cccggggtcaggaagattgtcttag

SEQ ID NO: 245340 - DNA, 25 bp, Mus musculus
cccggggtccgcggtactgtgagga

SEQ ID NO: 245341 - DNA, 25 bp, Mus musculus
cccggggtgaaggtgagcctcatgt

SEQ ID NO: 245342 - DNA, 25 bp, Mus musculus
cccggggtgctatggggaagagaca

SEQ ID NO: 245343 - DNA, 25 bp, Mus musculus
cccgggtctccgtgacaagattgta

SEQ ID NO: 245344 - DNA, 25 bp, Mus musculus
cccgggtgacgttgcacaggcatgg

SEQ ID NO: 245345 - DNA, 25 bp, Mus musculus
cccgggtggcaaggctggagcagca

SEQ ID NO: 245346 - DNA, 25 bp, Mus musculus
cccgggtgtgggacttgtgtgagga

SEQ ID NO: 245347 - DNA, 25 bp, Mus musculus
cccgggttctgacaggcctcaagaa

SEQ ID NO: 245348 - DNA, 25 bp, Mus musculus
cccgggttctgctgcagagacagca

SEQ ID NO: 245349 - DNA, 25 bp, Mus musculus
cccgggttctgctgggccactgccg

SEQ ID NO: 245350 - DNA, 25 bp, Mus musculus
cccgggttctgctgtctcagtgcca

SEQ ID NO: 245351 - DNA, 25 bp, Mus musculus
cccggtaaagtgccggcagagcagt

SEQ ID NO: 245352 - DNA, 25 bp, Mus musculus
cccggtagaggtatggatggatctt

SEQ ID NO: 245353 - DNA, 25 bp, Mus musculus
cccggtcaatgggtcctaaatgctc

SEQ ID NO: 245354 - DNA, 25 bp, Mus musculus
cccggtcaccctcacagaacatcta

SEQ ID NO: 245355 - DNA, 25 bp, Mus musculus
cccggtcagagaaaatgtcaaggag

SEQ ID NO: 245356 - DNA, 25 bp, Mus musculus
cccggtccacagcaggattccccct

SEQ ID NO: 245357 - DNA, 25 bp, Mus musculus
cccggtcccacacgcctctgtacaa

SEQ ID NO: 245358 - DNA, 25 bp, Mus musculus
cccggtcccacacggacgtggggct

SEQ ID NO: 245359 - DNA, 25 bp, Mus musculus
cccggtctccgcccggcagaacagt

SEQ ID NO: 245360 - DNA, 25 bp, Mus musculus
cccggtctccgtttgcagcggggcc

SEQ ID NO: 245361 - DNA, 25 bp, Mus musculus
cccggtcttccgctgaaggggatgc

SEQ ID NO: 245362 - DNA, 25 bp, Mus musculus
cccggtgaggagctgtgggaacctt

SEQ ID NO: 245363 - DNA, 25 bp, Mus musculus
cccggtgatcaagaaatgcattgat

SEQ ID NO: 245364 - DNA, 25 bp, Mus musculus
cccggtgcacgatgcccccgaaaaa

SEQ ID NO: 245365 - DNA, 25 bp, Mus musculus
cccggtgcatagagaaatccaaggt

SEQ ID NO: 245366 - DNA, 25 bp, Mus musculus
cccggtgcatcaggtttgcaagtga

SEQ ID NO: 245367 - DNA, 25 bp, Mus musculus
cccggtgcattctgggtttctggtt

SEQ ID NO: 245368 - DNA, 25 bp, Mus musculus
cccggtgcgcggaaagatcaacgga

SEQ ID NO: 245369 - DNA, 25 bp, Mus musculus
cccggtggcaagagactgcttatgt

SEQ ID NO: 245370 - DNA, 25 bp, Mus musculus
cccggtggctcaatgatccttcctt

SEQ ID NO: 245371 - DNA, 25 bp, Mus musculus
cccggtgtgtgcgtgtgcaagagcc

SEQ ID NO: 245372 - DNA, 25 bp, Mus musculus
cccggttagcagcccttggcgatat

SEQ ID NO: 245373 - DNA, 25 bp, Mus musculus
cccggttagcagctgccgcccttgg

SEQ ID NO: 245374 - DNA, 25 bp, Mus musculus
cccggttcccgggctttgatgacag

SEQ ID NO: 245375 - DNA, 25 bp, Mus musculus
cccggttcggagaagaagtctcagc

SEQ ID NO: 245376 - DNA, 25 bp, Mus musculus
cccggttgtcatgtatcacggtgat

SEQ ID NO: 245377 - DNA, 25 bp, Mus musculus
cccgtaacaggaattattttatata

SEQ ID NO: 245378 - DNA, 25 bp, Mus musculus
cccgtaagagccagctggctcgcat

SEQ ID NO: 245379 - DNA, 25 bp, Mus musculus
cccgtaagagccagttgctatgtcc

SEQ ID NO: 245380 - DNA, 25 bp, Mus musculus
cccgtagcctcagagatgctggagt

SEQ ID NO: 245381 - DNA, 25 bp, Mus musculus
cccgtaggacagattgcatctgggt

SEQ ID NO: 245382 - DNA, 25 bp, Mus musculus
cccgtatatgatggagagggataaa

SEQ ID NO: 245383 - DNA, 25 bp, Mus musculus
cccgtatatgatgggcaggatagca

SEQ ID NO: 245384 - DNA, 25 bp, Mus musculus
cccgtatatgatgggttttaaagat

SEQ ID NO: 245385 - DNA, 25 bp, Mus musculus
cccgtatcctgaagctgtttgggta

SEQ ID NO: 245386 - DNA, 25 bp, Mus musculus
cccgtatcctggtgttgggtatgag

SEQ ID NO: 245387 - DNA, 25 bp, Mus musculus
cccgtatccttgaattacatccaag

SEQ ID NO: 245388 - DNA, 25 bp, Mus musculus
cccgtatccttgtgttatccaagat

SEQ ID NO: 245389 - DNA, 25 bp, Mus musculus
cccgtatgaccaggtcacaatcatt

SEQ ID NO: 245390 - DNA, 25 bp, Mus musculus
cccgtattaggagacacagaaggag

SEQ ID NO: 245391 - DNA, 25 bp, Mus musculus
cccgtcaaaagattccaagaaacaa

SEQ ID NO: 245392 - DNA, 25 bp, Mus musculus
cccgtcaaatatgaatacccagatg

SEQ ID NO: 245393 - DNA, 25 bp, Mus musculus
cccgtcacaagggcggtgacgaatg

SEQ ID NO: 245394 - DNA, 25 bp, Mus musculus
cccgtcacaaggttgtcaggaacaa

SEQ ID NO: 245395 - DNA, 25 bp, Mus musculus
cccgtcaccctccgcaagtgtccat

SEQ ID NO: 245396 - DNA, 25 bp, Mus musculus
cccgtcagaacagaaatgctgccaa

SEQ ID NO: 245397 - DNA, 25 bp, Mus musculus
cccgtcagaacagatcattgtgaca

SEQ ID NO: 245398 - DNA, 25 bp, Mus musculus
cccgtcagaagccactccgtgtatc

SEQ ID NO: 245399 - DNA, 25 bp, Mus musculus
cccgtcagccccacaccaaggagat

SEQ ID NO: 245400 - DNA, 25 bp, Mus musculus
cccgtcagcccggttagctttatac

SEQ ID NO: 245401 - DNA, 25 bp, Mus musculus
cccgtcagtgtgggtgctctttcag

SEQ ID NO: 245402 - DNA, 25 bp, Mus musculus
cccgtccagccaaggctgtcttcat

SEQ ID NO: 245403 - DNA, 25 bp, Mus musculus
cccgtcccccagaggttgagaacaa

SEQ ID NO: 245404 - DNA, 25 bp, Mus musculus
cccgtccgaggtacccagactcatg

SEQ ID NO: 245405 - DNA, 25 bp, Mus musculus
cccgtccgaggtgtgaatgacagag

SEQ ID NO: 245406 - DNA, 25 bp, Mus musculus
cccgtcctacgtgggctcgccatac

SEQ ID NO: 245407 - DNA, 25 bp, Mus musculus
cccgtcctgaggagatcatctttct

SEQ ID NO: 245408 - DNA, 25 bp, Mus musculus
cccgtcctgtgccaggaaagcactg

SEQ ID NO: 245409 - DNA, 25 bp, Mus musculus
cccgtcctgtgccaggcaaggtgac

SEQ ID NO: 245410 - DNA, 25 bp, Mus musculus
cccgtcctgtgtgtcaccccgccct

SEQ ID NO: 245411 - DNA, 25 bp, Mus musculus
cccgtcgaaaagacaattgggaaga

SEQ ID NO: 245412 - DNA, 25 bp, Mus musculus
cccgtctccgccggcgctggagaat

SEQ ID NO: 245413 - DNA, 25 bp, Mus musculus
cccgtctgagggcagtcctttacta

SEQ ID NO: 245414 - DNA, 25 bp, Mus musculus
cccgtctgtaactgggatcatggca

SEQ ID NO: 245415 - DNA, 25 bp, Mus musculus
cccgtctgtaactgtcatcagagat

SEQ ID NO: 245416 - DNA, 25 bp, Mus musculus
cccgtcttcccacgaacaagatgcc

SEQ ID NO: 245417 - DNA, 25 bp, Mus musculus
cccgtcttcccacggatgtgatctt

SEQ ID NO: 245418 - DNA, 25 bp, Mus musculus
cccgtgaagagtgtttcccgagaga

SEQ ID NO: 245419 - DNA, 25 bp, Mus musculus
cccgtgaggactatggcaggttcac

SEQ ID NO: 245420 - DNA, 25 bp, Mus musculus
cccgtgaggagaatgtcccagaaat

SEQ ID NO: 245421 - DNA, 25 bp, Mus musculus
cccgtgagtgccaggtgatacttaa

SEQ ID NO: 245422 - DNA, 25 bp, Mus musculus
cccgtgatgactgataaacaagctg

SEQ ID NO: 245423 - DNA, 25 bp, Mus musculus
cccgtgcacccagaaaacgaagaga

SEQ ID NO: 245424 - DNA, 25 bp, Mus musculus
cccgtgcagcccgagggatgagttt

SEQ ID NO: 245425 - DNA, 25 bp, Mus musculus
cccgtgcccagtcgagaagccccgg

SEQ ID NO: 245426 - DNA, 25 bp, Mus musculus
cccgtgcgcagcaggctgcctgctg

SEQ ID NO: 245427 - DNA, 25 bp, Mus musculus
cccgtgctagaggaaccagcagata

SEQ ID NO: 245428 - DNA, 25 bp, Mus musculus
cccgtgctgaaagtgtctgatgcca

SEQ ID NO: 245429 - DNA, 25 bp, Mus musculus
cccgtggaagcagagcgttggtcag

SEQ ID NO: 245430 - DNA, 25 bp, Mus musculus
cccgtggacaagtccctgctccagt

SEQ ID NO: 245431 - DNA, 25 bp, Mus musculus
cccgtggagaagatggttccatatc

SEQ ID NO: 245432 - DNA, 25 bp, Mus musculus
cccgtggagaggaggtggtgtcaga

SEQ ID NO: 245433 - DNA, 25 bp, Mus musculus
cccgtggagaggtctgcaaacagca

SEQ ID NO: 245434 - DNA, 25 bp, Mus musculus
cccgtggagcaagtgtttgccaaga

SEQ ID NO: 245435 - DNA, 25 bp, Mus musculus
cccgtggcaaaggtcttttggctgt

SEQ ID NO: 245436 - DNA, 25 bp, Mus musculus
cccgtggcaatcctggttctcgtgg

SEQ ID NO: 245437 - DNA, 25 bp, Mus musculus
cccgtggccacagagacactggagc

SEQ ID NO: 245438 - DNA, 25 bp, Mus musculus
cccgtggccaggaaggacaggagtc

SEQ ID NO: 245439 - DNA, 25 bp, Mus musculus
cccgtggccttcaaggttgtagccc

SEQ ID NO: 245440 - DNA, 25 bp, Mus musculus
cccgtggcttaagagaagagccatg

SEQ ID NO: 245441 - DNA, 25 bp, Mus musculus
cccgtgggattgcaggccctcaagg

SEQ ID NO: 245442 - DNA, 25 bp, Mus musculus
cccgtgggggcagtaaatgatgctg

SEQ ID NO: 245443 - DNA, 25 bp, Mus musculus
cccgtggtacaggccctgttgcatc

SEQ ID NO: 245444 - DNA, 25 bp, Mus musculus
cccgtggtcccctggagcaccaagg

SEQ ID NO: 245445 - DNA, 25 bp, Mus musculus
cccgtggtgcgaaagaaaaagtcag

SEQ ID NO: 245446 - DNA, 25 bp, Mus musculus
cccgtggtgctggggcctgtgctct

SEQ ID NO: 245447 - DNA, 25 bp, Mus musculus
cccgtggtgtgccccctctagtcct

SEQ ID NO: 245448 - DNA, 25 bp, Mus musculus
cccgtgtacgaaggtatggcctcac

SEQ ID NO: 245449 - DNA, 25 bp, Mus musculus
cccgtgtcatgggtctcagcctggg

SEQ ID NO: 245450 - DNA, 25 bp, Mus musculus
cccgtgtctgcaggtatatccgaat

SEQ ID NO: 245451 - DNA, 25 bp, Mus musculus
cccgtgtgagaaagtcagctctccc

SEQ ID NO: 245452 - DNA, 25 bp, Mus musculus
cccgtgtgaggctgaaaagacccct

SEQ ID NO: 245453 - DNA, 25 bp, Mus musculus
cccgtgtggaagagttcaagctgaa

SEQ ID NO: 245454 - DNA, 25 bp, Mus musculus
cccgtgtggttgcaccctcaggatc

SEQ ID NO: 245455 - DNA, 25 bp, Mus musculus
cccgtgttcaaggatgccgccgtgc

SEQ ID NO: 245456 - DNA, 25 bp, Mus musculus
cccgtgttccagcaccacctctgca

SEQ ID NO: 245457 - DNA, 25 bp, Mus musculus
cccgttatgaaatggcctcaaaccc

SEQ ID NO: 245458 - DNA, 25 bp, Mus musculus
cccgttcacgatcctcagcgtacct

SEQ ID NO: 245459 - DNA, 25 bp, Mus musculus
cccgttcatatcagatgttttccag

SEQ ID NO: 245460 - DNA, 25 bp, Mus musculus
cccgttcatatcagtggaacacatt

SEQ ID NO: 245461 - DNA, 25 bp, Mus musculus
cccgttccaaggactcctttatcac

SEQ ID NO: 245462 - DNA, 25 bp, Mus musculus
cccgttccaaggcaagtccttgggg

SEQ ID NO: 245463 - DNA, 25 bp, Mus musculus
cccgttctagatgagatatgtgaat

SEQ ID NO: 245464 - DNA, 25 bp, Mus musculus
cccgttctgccagcctccgctcctt

SEQ ID NO: 245465 - DNA, 25 bp, Mus musculus
cccgttctgccagttcggataggtc

SEQ ID NO: 245466 - DNA, 25 bp, Mus musculus
cccgttctggagctgagaagggtta

SEQ ID NO: 245467 - DNA, 25 bp, Mus musculus
cccgttgctatcatgcgtgagtgca

SEQ ID NO: 245468 - DNA, 25 bp, Mus musculus
cccgttgtagcccagaaagtcctag

SEQ ID NO: 245469 - DNA, 25 bp, Mus musculus
cccgtttaaacaaagatcctgtgta

SEQ ID NO: 245470 - DNA, 25 bp, Mus musculus
cccgtttaaacaaagatgagtacat

SEQ ID NO: 245471 - DNA, 25 bp, Mus musculus
cccgtttattagtgcttacagacac

SEQ ID NO: 245472 - DNA, 25 bp, Mus musculus
cccgtttgcaggatgccggtgcagc

SEQ ID NO: 245473 - DNA, 25 bp, Mus musculus
cccgtttgctcagaatttcatgcct

SEQ ID NO: 245474 - DNA, 25 bp, Mus musculus
cccgtttgctcaggtcttggctagc

SEQ ID NO: 245475 - DNA, 25 bp, Mus musculus
cccgtttggccacggatccgggagg

SEQ ID NO: 245476 - DNA, 25 bp, Mus musculus
cccgtttggccacgggctccggcca

SEQ ID NO: 245477 - DNA, 25 bp, Mus musculus
cccgttttagcttggctgaagagga

SEQ ID NO: 245478 - DNA, 25 bp, Mus musculus
ccctaaacatctgggacgttaaagg

SEQ ID NO: 245479 - DNA, 25 bp, Mus musculus
ccctaaacggcagaggattcgtaaa

SEQ ID NO: 245480 - DNA, 25 bp, Mus musculus
ccctaaagaaagagtttgacctggt

SEQ ID NO: 245481 - DNA, 25 bp, Mus musculus
ccctaaagaagtattagatggacag

SEQ ID NO: 245482 - DNA, 25 bp, Mus musculus
ccctaaagcaagggagccgagtacc

SEQ ID NO: 245483 - DNA, 25 bp, Mus musculus
ccctaaaggagcggttccagtttgt

SEQ ID NO: 245484 - DNA, 25 bp, Mus musculus
ccctaaatgatggtgagctccagaa

SEQ ID NO: 245485 - DNA, 25 bp, Mus musculus
ccctaacaaaggtgacactcgaggc

SEQ ID NO: 245486 - DNA, 25 bp, Mus musculus
ccctaacaaggtcccaggcagtcag

SEQ ID NO: 245487 - DNA, 25 bp, Mus musculus
ccctaacagtggggagccagctccc

SEQ ID NO: 245488 - DNA, 25 bp, Mus musculus
ccctaacagttgtctacttacagct

SEQ ID NO: 245489 - DNA, 25 bp, Mus musculus
ccctaacatgcagtacactgccatg

SEQ ID NO: 245490 - DNA, 25 bp, Mus musculus
ccctaactctaggatgaagagggcc

SEQ ID NO: 245491 - DNA, 25 bp, Mus musculus
ccctaagaagctatatccaggacca

SEQ ID NO: 245492 - DNA, 25 bp, Mus musculus
ccctaagaagctggggacagcactg

SEQ ID NO: 245493 - DNA, 25 bp, Mus musculus
ccctaagaagggttgtgagccccgg

SEQ ID NO: 245494 - DNA, 25 bp, Mus musculus
ccctaagactctagatattagctca

SEQ ID NO: 245495 - DNA, 25 bp, Mus musculus
ccctaagcaggtgagccctagattg

SEQ ID NO: 245496 - DNA, 25 bp, Mus musculus
ccctaagcttcctggtgcaaatagt

SEQ ID NO: 245497 - DNA, 25 bp, Mus musculus
ccctaagtacaggtcaccatcatga

SEQ ID NO: 245498 - DNA, 25 bp, Mus musculus
ccctaagtctccccatgccctacct

SEQ ID NO: 245499 - DNA, 25 bp, Mus musculus
ccctaatatgaggaactgtactgag

SEQ ID NO: 245500 - DNA, 25 bp, Mus musculus
ccctaatcgcaattggaaggatgca

SEQ ID NO: 245501 - DNA, 25 bp, Mus musculus
ccctaatgacattatgccctacatt

SEQ ID NO: 245502 - DNA, 25 bp, Mus musculus
ccctaatggtccatctctacaacat

SEQ ID NO: 245503 - DNA, 25 bp, Mus musculus
ccctaatggtccattacccaggcaa

SEQ ID NO: 245504 - DNA, 25 bp, Mus musculus
ccctacaagccaccaatcagagcga

SEQ ID NO: 245505 - DNA, 25 bp, Mus musculus
ccctacaagccagcaatcagagcga

SEQ ID NO: 245506 - DNA, 25 bp, Mus musculus
ccctacaccaatggctggaaattaa

SEQ ID NO: 245507 - DNA, 25 bp, Mus musculus
ccctacacccgggtcaatgcagggg

SEQ ID NO: 245508 - DNA, 25 bp, Mus musculus
ccctacacgcatgctgtggataccc

SEQ ID NO: 245509 - DNA, 25 bp, Mus musculus
ccctacacgcatggagtcgccctag

SEQ ID NO: 245510 - DNA, 25 bp, Mus musculus
ccctacagagatgggagaccgttag

SEQ ID NO: 245511 - DNA, 25 bp, Mus musculus
ccctacagaggagaatttagagcta

SEQ ID NO: 245512 - DNA, 25 bp, Mus musculus
ccctacagaggtgtgtcagagctcc

SEQ ID NO: 245513 - DNA, 25 bp, Mus musculus
ccctacagcaggaagggtgagtttt

SEQ ID NO: 245514 - DNA, 25 bp, Mus musculus
ccctacagccagggctgatgaacag

SEQ ID NO: 245515 - DNA, 25 bp, Mus musculus
ccctacagccaggtctgtgctgccg

SEQ ID NO: 245516 - DNA, 25 bp, Mus musculus
ccctacagtaggcttcgagctgtat

SEQ ID NO: 245517 - DNA, 25 bp, Mus musculus
ccctacagtagggtctcactgtgcg

SEQ ID NO: 245518 - DNA, 25 bp, Mus musculus
ccctacagttggagtaaaaatggct

SEQ ID NO: 245519 - DNA, 25 bp, Mus musculus
ccctacagttggcgtaggagtgtgt

SEQ ID NO: 245520 - DNA, 25 bp, Mus musculus
ccctacatctggacattggcaccta

SEQ ID NO: 245521 - DNA, 25 bp, Mus musculus
ccctacatctggcattcaggacatt

SEQ ID NO: 245522 - DNA, 25 bp, Mus musculus
ccctacatctgggctggttaccatc

SEQ ID NO: 245523 - DNA, 25 bp, Mus musculus
ccctacatgctcaggtgcgctggta

SEQ ID NO: 245524 - DNA, 25 bp, Mus musculus
ccctacatggctcctgctgactggg

SEQ ID NO: 245525 - DNA, 25 bp, Mus musculus
ccctacatggcttccttcccagtgg

SEQ ID NO: 245526 - DNA, 25 bp, Mus musculus
ccctacatgtaaaggtcaagtagca

SEQ ID NO: 245527 - DNA, 25 bp, Mus musculus
ccctacattaaagtgacatatgaca

SEQ ID NO: 245528 - DNA, 25 bp, Mus musculus
ccctacattaaagtgcccagccaca

SEQ ID NO: 245529 - DNA, 25 bp, Mus musculus
ccctacattgcaaagattctgaaag

SEQ ID NO: 245530 - DNA, 25 bp, Mus musculus
ccctaccaccaaactggctgatagg

SEQ ID NO: 245531 - DNA, 25 bp, Mus musculus
ccctaccacggagtttgtcacagta

SEQ ID NO: 245532 - DNA, 25 bp, Mus musculus
ccctaccagaggaagtgggtagagg

SEQ ID NO: 245533 - DNA, 25 bp, Mus musculus
ccctaccaggggtttctctgtgtag

SEQ ID NO: 245534 - DNA, 25 bp, Mus musculus
ccctaccagggtgtgggaacaagca

SEQ ID NO: 245535 - DNA, 25 bp, Mus musculus
ccctaccatccccaaggaacctgat

SEQ ID NO: 245536 - DNA, 25 bp, Mus musculus
ccctaccatgtgaagttccgctcgc

SEQ ID NO: 245537 - DNA, 25 bp, Mus musculus
ccctacccaggtggatggaacatga

SEQ ID NO: 245538 - DNA, 25 bp, Mus musculus
ccctaccctaagaacacagatctgt

SEQ ID NO: 245539 - DNA, 25 bp, Mus musculus
ccctaccctagccagatcaatacag

SEQ ID NO: 245540 - DNA, 25 bp, Mus musculus
ccctaccctagccagcccgcttcga

SEQ ID NO: 245541 - DNA, 25 bp, Mus musculus
ccctaccctcgagtctgtagctcgt

SEQ ID NO: 245542 - DNA, 25 bp, Mus musculus
ccctaccctctgggtctggagacat

SEQ ID NO: 245543 - DNA, 25 bp, Mus musculus
ccctacccttcgatgtcgctcacca

SEQ ID NO: 245544 - DNA, 25 bp, Mus musculus
ccctacccttgcagggagactccgg

SEQ ID NO: 245545 - DNA, 25 bp, Mus musculus
ccctaccgcaagcagcagtctctgg

SEQ ID NO: 245546 - DNA, 25 bp, Mus musculus
ccctacctcctcaggacttctagca

SEQ ID NO: 245547 - DNA, 25 bp, Mus musculus
ccctacctcctcaggagccgtctct

SEQ ID NO: 245548 - DNA, 25 bp, Mus musculus
ccctacctggactttgatcctcacc

SEQ ID NO: 245549 - DNA, 25 bp, Mus musculus
ccctaccttcaacaggactgggagg

SEQ ID NO: 245550 - DNA, 25 bp, Mus musculus
ccctaccttcaccaggactgggagg

SEQ ID NO: 245551 - DNA, 25 bp, Mus musculus
ccctacgatagaggactcctacagg

SEQ ID NO: 245552 - DNA, 25 bp, Mus musculus
ccctacgatagagttgttggagttt

SEQ ID NO: 245553 - DNA, 25 bp, Mus musculus
ccctacgcacagagtatgataggct

SEQ ID NO: 245554 - DNA, 25 bp, Mus musculus
ccctacgcagctcccacagatacgt

SEQ ID NO: 245555 - DNA, 25 bp, Mus musculus
ccctacgcaggtcctgtccagagtg

SEQ ID NO: 245556 - DNA, 25 bp, Mus musculus
ccctacgcctggactaacggttatg

SEQ ID NO: 245557 - DNA, 25 bp, Mus musculus
ccctacggcatagtgccgtccagcc

SEQ ID NO: 245558 - DNA, 25 bp, Mus musculus
ccctacggcatgaaacagaagagcg

SEQ ID NO: 245559 - DNA, 25 bp, Mus musculus
ccctactatatcaaccacgagaccc

SEQ ID NO: 245560 - DNA, 25 bp, Mus musculus
ccctactcatgatgacgtgtctaaa

SEQ ID NO: 245561 - DNA, 25 bp, Mus musculus
ccctactccaaggtgaagcagaaag

SEQ ID NO: 245562 - DNA, 25 bp, Mus musculus
ccctactgagtggccaccctttgtg

SEQ ID NO: 245563 - DNA, 25 bp, Mus musculus
ccctacttactctggatccaagaca

SEQ ID NO: 245564 - DNA, 25 bp, Mus musculus
ccctacttccctggatcaataagtc

SEQ ID NO: 245565 - DNA, 25 bp, Mus musculus
ccctagaaagcggcctgacctgctg

SEQ ID NO: 245566 - DNA, 25 bp, Mus musculus
ccctagaaagcgggactttgccagc

SEQ ID NO: 245567 - DNA, 25 bp, Mus musculus
ccctagaacccgataatgctgaggc

SEQ ID NO: 245568 - DNA, 25 bp, Mus musculus
ccctagacaggataagacgctgtcc

SEQ ID NO: 245569 - DNA, 25 bp, Mus musculus
ccctagactggcttaagatactcac

SEQ ID NO: 245570 - DNA, 25 bp, Mus musculus
ccctagagtcccagacaggcctcat

SEQ ID NO: 245571 - DNA, 25 bp, Mus musculus
ccctagagtcccagctgcctgctga

SEQ ID NO: 245572 - DNA, 25 bp, Mus musculus
ccctagatatcaaagtctggatgaa

SEQ ID NO: 245573 - DNA, 25 bp, Mus musculus
ccctagatatgaaagtctggatgaa

SEQ ID NO: 245574 - DNA, 25 bp, Mus musculus
ccctagattcatcggagaaggaact

SEQ ID NO: 245575 - DNA, 25 bp, Mus musculus
ccctagattcatcgttttgcgaggt

SEQ ID NO: 245576 - DNA, 25 bp, Mus musculus
ccctagcaaaactcttccaagtgtg

SEQ ID NO: 245577 - DNA, 25 bp, Mus musculus
ccctagcaaagaggaaagcgattgg

SEQ ID NO: 245578 - DNA, 25 bp, Mus musculus
ccctagcaaagaggctcctgacagt

SEQ ID NO: 245579 - DNA, 25 bp, Mus musculus
ccctagcacagcagagtcaattccc

SEQ ID NO: 245580 - DNA, 25 bp, Mus musculus
ccctagcactcacagcagggaccct

SEQ ID NO: 245581 - DNA, 25 bp, Mus musculus
ccctagccagatcaatacagaatcc

SEQ ID NO: 245582 - DNA, 25 bp, Mus musculus
ccctagccagcataattaaatccag

SEQ ID NO: 245583 - DNA, 25 bp, Mus musculus
ccctagccagcccgcttcgatgact

SEQ ID NO: 245584 - DNA, 25 bp, Mus musculus
ccctagccagggttgatttcttcat

SEQ ID NO: 245585 - DNA, 25 bp, Mus musculus
ccctagccccagtcattgctgagac

SEQ ID NO: 245586 - DNA, 25 bp, Mus musculus
ccctagccccagtgtaagcttcaag

SEQ ID NO: 245587 - DNA, 25 bp, Mus musculus
ccctagcctacccaggaagaagctc

SEQ ID NO: 245588 - DNA, 25 bp, Mus musculus
ccctagcctggtctgggacctgtca

SEQ ID NO: 245589 - DNA, 25 bp, Mus musculus
ccctagcgccacaggcatggggagg

SEQ ID NO: 245590 - DNA, 25 bp, Mus musculus
ccctagcgcggaaacatcatcccac

SEQ ID NO: 245591 - DNA, 25 bp, Mus musculus
ccctagcgcgggctgggaaggtggc

SEQ ID NO: 245592 - DNA, 25 bp, Mus musculus
ccctagctggaaggactgggcaaag

SEQ ID NO: 245593 - DNA, 25 bp, Mus musculus
ccctagcttaagtatacctggcctt

SEQ ID NO: 245594 - DNA, 25 bp, Mus musculus
ccctagcttgggggctttcaggtag

SEQ ID NO: 245595 - DNA, 25 bp, Mus musculus
ccctaggaatgaagaacggcccctc

SEQ ID NO: 245596 - DNA, 25 bp, Mus musculus
ccctaggaatgaagatggccagctg

SEQ ID NO: 245597 - DNA, 25 bp, Mus musculus
ccctaggagaagggaaatatgctgg

SEQ ID NO: 245598 - DNA, 25 bp, Mus musculus
ccctaggagaagggagtaaaggtat

SEQ ID NO: 245599 - DNA, 25 bp, Mus musculus
ccctaggagagattgatgctgcacc

SEQ ID NO: 245600 - DNA, 25 bp, Mus musculus
ccctaggagggattgatgctgcacc

SEQ ID NO: 245601 - DNA, 25 bp, Mus musculus
ccctaggagggattgatgctgcgcc

SEQ ID NO: 245602 - DNA, 25 bp, Mus musculus
ccctaggcaagactggacgagtaga

SEQ ID NO: 245603 - DNA, 25 bp, Mus musculus
ccctaggcaatgacaccctgtactt

SEQ ID NO: 245604 - DNA, 25 bp, Mus musculus
ccctaggcaatgcactactctccgc

SEQ ID NO: 245605 - DNA, 25 bp, Mus musculus
ccctaggccagataaggaattggaa

SEQ ID NO: 245606 - DNA, 25 bp, Mus musculus
ccctaggctcagaggctgatggtga

SEQ ID NO: 245607 - DNA, 25 bp, Mus musculus
ccctagggcagaaaacaaaaatcat

SEQ ID NO: 245608 - DNA, 25 bp, Mus musculus
ccctagggcctgcaggtctacagtg

SEQ ID NO: 245609 - DNA, 25 bp, Mus musculus
ccctaggtcagagtcttgtccaggc

SEQ ID NO: 245610 - DNA, 25 bp, Mus musculus
ccctagtgactggaggattctgtac

SEQ ID NO: 245611 - DNA, 25 bp, Mus musculus
ccctagttcaagaggaagaaatgcc

SEQ ID NO: 245612 - DNA, 25 bp, Mus musculus
ccctagttcaagaggacacaatgta

SEQ ID NO: 245613 - DNA, 25 bp, Mus musculus
ccctataaccgatgagaaccacagt

SEQ ID NO: 245614 - DNA, 25 bp, Mus musculus
ccctataagtaaggaatgaattcga

SEQ ID NO: 245615 - DNA, 25 bp, Mus musculus
ccctataagtaaggctgtagaaaac

SEQ ID NO: 245616 - DNA, 25 bp, Mus musculus
ccctatacaggaggttcaagttctt

SEQ ID NO: 245617 - DNA, 25 bp, Mus musculus
ccctatatcagtgacacaggaacaa

SEQ ID NO: 245618 - DNA, 25 bp, Mus musculus
ccctatatttcgcacatcttcatta

SEQ ID NO: 245619 - DNA, 25 bp, Mus musculus
ccctatcagaacaccatcggggctg

SEQ ID NO: 245620 - DNA, 25 bp, Mus musculus
ccctatcccaggaatttgaagccta

SEQ ID NO: 245621 - DNA, 25 bp, Mus musculus
ccctatcgaagaagaaccgatcgca

SEQ ID NO: 245622 - DNA, 25 bp, Mus musculus
ccctatctacttggaccagaagtgg

SEQ ID NO: 245623 - DNA, 25 bp, Mus musculus
ccctatctcgtgggccttacgatgg

SEQ ID NO: 245624 - DNA, 25 bp, Mus musculus
ccctatctgagctgctgttgcaccc

SEQ ID NO: 245625 - DNA, 25 bp, Mus musculus
ccctatgaagcgaaggacggatctt

SEQ ID NO: 245626 - DNA, 25 bp, Mus musculus
ccctatgaagttgaaaacacagctg

SEQ ID NO: 245627 - DNA, 25 bp, Mus musculus
ccctatgaatacaggagtggaggct

SEQ ID NO: 245628 - DNA, 25 bp, Mus musculus
ccctatgacaagaaaaagcggatgg

SEQ ID NO: 245629 - DNA, 25 bp, Mus musculus
ccctatgagtcccaggtgtattccc

SEQ ID NO: 245630 - DNA, 25 bp, Mus musculus
ccctatggagcagcccaggcctcct

SEQ ID NO: 245631 - DNA, 25 bp, Mus musculus
ccctatggcactggtatctcattca

SEQ ID NO: 245632 - DNA, 25 bp, Mus musculus
ccctatggcgagacagctcagctct

SEQ ID NO: 245633 - DNA, 25 bp, Mus musculus
ccctatggctggccacagattgtac

SEQ ID NO: 245634 - DNA, 25 bp, Mus musculus
ccctatgggaatattcagagcaggc

SEQ ID NO: 245635 - DNA, 25 bp, Mus musculus
ccctatggtgcagtgcatcattgag

SEQ ID NO: 245636 - DNA, 25 bp, Mus musculus
ccctatgtcagggttcggagcgacc

SEQ ID NO: 245637 - DNA, 25 bp, Mus musculus
ccctatgtcccatcttgtcaagttt

SEQ ID NO: 245638 - DNA, 25 bp, Mus musculus
ccctatgttacagaacccaagagtg

SEQ ID NO: 245639 - DNA, 25 bp, Mus musculus
ccctattaatgcctcctcctctatg

SEQ ID NO: 245640 - DNA, 25 bp, Mus musculus
ccctattaatggcttccaggctctg

SEQ ID NO: 245641 - DNA, 25 bp, Mus musculus
ccctattacatcaaccatcaaacac

SEQ ID NO: 245642 - DNA, 25 bp, Mus musculus
ccctattgcagagatggagactcaa

SEQ ID NO: 245643 - DNA, 25 bp, Mus musculus
ccctattgcagagggcaagtttatc

SEQ ID NO: 245644 - DNA, 25 bp, Mus musculus
ccctattgtgagtaccctgggaaaa

SEQ ID NO: 245645 - DNA, 25 bp, Mus musculus
ccctatttcaggaaactcccatctt

SEQ ID NO: 245646 - DNA, 25 bp, Mus musculus
ccctatttcaggttgtctacttttg

SEQ ID NO: 245647 - DNA, 25 bp, Mus musculus
ccctattttgtttcggaagacaaca

SEQ ID NO: 245648 - DNA, 25 bp, Mus musculus
ccctattttgtttcggacaggccag

SEQ ID NO: 245649 - DNA, 25 bp, Mus musculus
ccctcaaaccaggtgatcatgctaa

SEQ ID NO: 245650 - DNA, 25 bp, Mus musculus
ccctcaaaccccggcttcttcacta

SEQ ID NO: 245651 - DNA, 25 bp, Mus musculus
ccctcaaagtggcaggccgcatcca

SEQ ID NO: 245652 - DNA, 25 bp, Mus musculus
ccctcaacagaagggatacttaccg

SEQ ID NO: 245653 - DNA, 25 bp, Mus musculus
ccctcaacagagttcatgttctgtg

SEQ ID NO: 245654 - DNA, 25 bp, Mus musculus
ccctcaacagccggagcagctgggc

SEQ ID NO: 245655 - DNA, 25 bp, Mus musculus
ccctcaactcaagtagtaggcgcag

SEQ ID NO: 245656 - DNA, 25 bp, Mus musculus
ccctcaagaaagaagctgtttgggt

SEQ ID NO: 245657 - DNA, 25 bp, Mus musculus
ccctcaagaaaggtgtggtgaccct

SEQ ID NO: 245658 - DNA, 25 bp, Mus musculus
ccctcaagacaatcattttctctgt

SEQ ID NO: 245659 - DNA, 25 bp, Mus musculus
ccctcaagagtttacaaacctgaag

SEQ ID NO: 245660 - DNA, 25 bp, Mus musculus
ccctcaagtctgagtttgtgatcct

SEQ ID NO: 245661 - DNA, 25 bp, Mus musculus
ccctcaagtgaccacacactggctg

SEQ ID NO: 245662 - DNA, 25 bp, Mus musculus
ccctcaatgcagtgactggatttga

SEQ ID NO: 245663 - DNA, 25 bp, Mus musculus
ccctcaatgctaaggttcactacaa

SEQ ID NO: 245664 - DNA, 25 bp, Mus musculus
ccctcacaaccttgccagaaaacct

SEQ ID NO: 245665 - DNA, 25 bp, Mus musculus
ccctcacaaccttggtaccttcact

SEQ ID NO: 245666 - DNA, 25 bp, Mus musculus
ccctcacacagagaggtctgaagaa

SEQ ID NO: 245667 - DNA, 25 bp, Mus musculus
ccctcacacaggtttccctctgtag

SEQ ID NO: 245668 - DNA, 25 bp, Mus musculus
ccctcacagacagactgtcagtgtt

SEQ ID NO: 245669 - DNA, 25 bp, Mus musculus
ccctcacagaccaagtctgaaacta

SEQ ID NO: 245670 - DNA, 25 bp, Mus musculus
ccctcacagagcacagctgtcccag

SEQ ID NO: 245671 - DNA, 25 bp, Mus musculus
ccctcacatccgtcctgcctctgcc

SEQ ID NO: 245672 - DNA, 25 bp, Mus musculus
ccctcaccaagcttagcaaggagta

SEQ ID NO: 245673 - DNA, 25 bp, Mus musculus
ccctcaccaatgagctgagcaatgt

SEQ ID NO: 245674 - DNA, 25 bp, Mus musculus
ccctcaccaatgcctctgcagggcc

SEQ ID NO: 245675 - DNA, 25 bp, Mus musculus
ccctcaccagacaatccctgttgtt

SEQ ID NO: 245676 - DNA, 25 bp, Mus musculus
ccctcaccagccccggctgcacaac

SEQ ID NO: 245677 - DNA, 25 bp, Mus musculus
ccctcaccaggaggcaccatgtggg

SEQ ID NO: 245678 - DNA, 25 bp, Mus musculus
ccctcaccagtcaatccctgttgtt

SEQ ID NO: 245679 - DNA, 25 bp, Mus musculus
ccctcacccccaggagttcaactag

SEQ ID NO: 245680 - DNA, 25 bp, Mus musculus
ccctcaccgaggaggagaatggcgc

SEQ ID NO: 245681 - DNA, 25 bp, Mus musculus
ccctcacctcaggattctgggtagg

SEQ ID NO: 245682 - DNA, 25 bp, Mus musculus
ccctcacctcagggaagagggattt

SEQ ID NO: 245683 - DNA, 25 bp, Mus musculus
ccctcacctcccagtggcaccaccg

SEQ ID NO: 245684 - DNA, 25 bp, Mus musculus
ccctcacctgaacagtgagacggtt

SEQ ID NO: 245685 - DNA, 25 bp, Mus musculus
ccctcacctgaagaaaaaagcagtc

SEQ ID NO: 245686 - DNA, 25 bp, Mus musculus
ccctcacctgaagggatgtctgaat

SEQ ID NO: 245687 - DNA, 25 bp, Mus musculus
ccctcaccttggcagccatcatggt

SEQ ID NO: 245688 - DNA, 25 bp, Mus musculus
ccctcaccttgggaatcccaatgct

SEQ ID NO: 245689 - DNA, 25 bp, Mus musculus
ccctcaccttgttttctgctcatag

SEQ ID NO: 245690 - DNA, 25 bp, Mus musculus
ccctcagaacatctctgatgtggat

SEQ ID NO: 245691 - DNA, 25 bp, Mus musculus
ccctcagaagacccccgtcagagga

SEQ ID NO: 245692 - DNA, 25 bp, Mus musculus
ccctcagaagcatctccatcgcctg

SEQ ID NO: 245693 - DNA, 25 bp, Mus musculus
ccctcagacatgctggatagtctca

SEQ ID NO: 245694 - DNA, 25 bp, Mus musculus
ccctcagaccagcagaacgagatgg

SEQ ID NO: 245695 - DNA, 25 bp, Mus musculus
ccctcagactcggggtcgcatccct

SEQ ID NO: 245696 - DNA, 25 bp, Mus musculus
ccctcagactcggtacctcggaatc

SEQ ID NO: 245697 - DNA, 25 bp, Mus musculus
ccctcagactcggtcccccagaggt

SEQ ID NO: 245698 - DNA, 25 bp, Mus musculus
ccctcagaggagctggactacagaa

SEQ ID NO: 245699 - DNA, 25 bp, Mus musculus
ccctcagatgcaggaacccagagtg

SEQ ID NO: 245700 - DNA, 25 bp, Mus musculus
ccctcagatggcaggaccccacagg

SEQ ID NO: 245701 - DNA, 25 bp, Mus musculus
ccctcagatggcaggcccaagtatc

SEQ ID NO: 245702 - DNA, 25 bp, Mus musculus
ccctcagcaaagacaagattgagga

SEQ ID NO: 245703 - DNA, 25 bp, Mus musculus
ccctcagcaatggtgacctgctcca

SEQ ID NO: 245704 - DNA, 25 bp, Mus musculus
ccctcagcaatggtgtgaacaaccc

SEQ ID NO: 245705 - DNA, 25 bp, Mus musculus
ccctcagcagcaggtcctgggagcc

SEQ ID NO: 245706 - DNA, 25 bp, Mus musculus
ccctcagcccaggatctagagtcat

SEQ ID NO: 245707 - DNA, 25 bp, Mus musculus
ccctcagcccagggtctccctacag

SEQ ID NO: 245708 - DNA, 25 bp, Mus musculus
ccctcagcccaggtggtgctctggg

SEQ ID NO: 245709 - DNA, 25 bp, Mus musculus
ccctcagccccagagcttcggtgca

SEQ ID NO: 245710 - DNA, 25 bp, Mus musculus
ccctcagcggcccagcgtccgatgc

SEQ ID NO: 245711 - DNA, 25 bp, Mus musculus
ccctcagctgctcctggacttctag

SEQ ID NO: 245712 - DNA, 25 bp, Mus musculus
ccctcaggatatcaaggcctctgtg

SEQ ID NO: 245713 - DNA, 25 bp, Mus musculus
ccctcaggatatcagctcttgcact

SEQ ID NO: 245714 - DNA, 25 bp, Mus musculus
ccctcaggccgcaggcctctctgtc

SEQ ID NO: 245715 - DNA, 25 bp, Mus musculus
ccctcaggcgaaaatatttcttgga

SEQ ID NO: 245716 - DNA, 25 bp, Mus musculus
ccctcaggcgacccaactctactgc

SEQ ID NO: 245717 - DNA, 25 bp, Mus musculus
ccctcaggctcagcaccaaggagat

SEQ ID NO: 245718 - DNA, 25 bp, Mus musculus
ccctcaggggttcagatgccccata

SEQ ID NO: 245719 - DNA, 25 bp, Mus musculus
ccctcaggggttcagccaacaattc

SEQ ID NO: 245720 - DNA, 25 bp, Mus musculus
ccctcagggtggcaaaggtgatgtt

SEQ ID NO: 245721 - DNA, 25 bp, Mus musculus
ccctcaggtatccaacgcttgtatc

SEQ ID NO: 245722 - DNA, 25 bp, Mus musculus
ccctcagtagcccagggcagcgaga

SEQ ID NO: 245723 - DNA, 25 bp, Mus musculus
ccctcagtccaaagctgctcagcca

SEQ ID NO: 245724 - DNA, 25 bp, Mus musculus
ccctcagtctcccagtggtactgcc

SEQ ID NO: 245725 - DNA, 25 bp, Mus musculus
ccctcagtggctcccacagatacgt

SEQ ID NO: 245726 - DNA, 25 bp, Mus musculus
ccctcagtggtcccctttaccacgt

SEQ ID NO: 245727 - DNA, 25 bp, Mus musculus
ccctcatactacaggtgagcgtcct

SEQ ID NO: 245728 - DNA, 25 bp, Mus musculus
ccctcatatagaaaaatactgaatg

SEQ ID NO: 245729 - DNA, 25 bp, Mus musculus
ccctcatcaatggtgaacaacccag

SEQ ID NO: 245730 - DNA, 25 bp, Mus musculus
ccctcatccacgaaggttttgcagg

SEQ ID NO: 245731 - DNA, 25 bp, Mus musculus
ccctcatccacggtttgtggaatct

SEQ ID NO: 245732 - DNA, 25 bp, Mus musculus
ccctcatccagcagaaaaaagatgg

SEQ ID NO: 245733 - DNA, 25 bp, Mus musculus
ccctcatccagcatttccaagctat

SEQ ID NO: 245734 - DNA, 25 bp, Mus musculus
ccctcatcggcagccagctggagga

SEQ ID NO: 245735 - DNA, 25 bp, Mus musculus
ccctcatctgcagggtccacgccat

SEQ ID NO: 245736 - DNA, 25 bp, Mus musculus
ccctcatgaaggaagtggagaccct

SEQ ID NO: 245737 - DNA, 25 bp, Mus musculus
ccctcatgaagggtacggattgctc

SEQ ID NO: 245738 - DNA, 25 bp, Mus musculus
ccctcatgcattaagtcttgtgaaa

SEQ ID NO: 245739 - DNA, 25 bp, Mus musculus
ccctcatgcattaagtcttgtgata

SEQ ID NO: 245740 - DNA, 25 bp, Mus musculus
ccctcatgcattatgaagaagtctt

SEQ ID NO: 245741 - DNA, 25 bp, Mus musculus
ccctcatgcctggtggggcagtggc

SEQ ID NO: 245742 - DNA, 25 bp, Mus musculus
ccctcatgttatgaaagagaatgca

SEQ ID NO: 245743 - DNA, 25 bp, Mus musculus
ccctcatgttatgaaatagaatgca

SEQ ID NO: 245744 - DNA, 25 bp, Mus musculus
ccctcatgttatgactcaacaagga

SEQ ID NO: 245745 - DNA, 25 bp, Mus musculus
ccctcatgttatggttcctccatcc

SEQ ID NO: 245746 - DNA, 25 bp, Mus musculus
ccctcatgttcacagggtacggatt

SEQ ID NO: 245747 - DNA, 25 bp, Mus musculus
ccctcattcaagaggtaatcagcca

SEQ ID NO: 245748 - DNA, 25 bp, Mus musculus
ccctcattcaagatgttcacacgga

SEQ ID NO: 245749 - DNA, 25 bp, Mus musculus
ccctcattcaaggagtagacccatg

SEQ ID NO: 245750 - DNA, 25 bp, Mus musculus
ccctcatttgagaacaagactattg

SEQ ID NO: 245751 - DNA, 25 bp, Mus musculus
ccctccaaagaagaggaatgagttc

SEQ ID NO: 245752 - DNA, 25 bp, Mus musculus
ccctccaaagaatcataacggtttt

SEQ ID NO: 245753 - DNA, 25 bp, Mus musculus
ccctccaaagagatggtcagccgcc

SEQ ID NO: 245754 - DNA, 25 bp, Mus musculus
ccctccaaagcaagagtgaagtgtg

SEQ ID NO: 245755 - DNA, 25 bp, Mus musculus
ccctccaaaggtcctgcttaggatg

SEQ ID NO: 245756 - DNA, 25 bp, Mus musculus
ccctccaaagtgaggaacttctgca

SEQ ID NO: 245757 - DNA, 25 bp, Mus musculus
ccctccaaatccggccaaagataac

SEQ ID NO: 245758 - DNA, 25 bp, Mus musculus
ccctccaaatttgggcagacattat

SEQ ID NO: 245759 - DNA, 25 bp, Mus musculus
ccctccaacatattcgattcttgaa

SEQ ID NO: 245760 - DNA, 25 bp, Mus musculus
ccctccaaccacaggggccagctag

SEQ ID NO: 245761 - DNA, 25 bp, Mus musculus
ccctccaactcagatctctcgtctg

SEQ ID NO: 245762 - DNA, 25 bp, Mus musculus
ccctccaactcagccctccaggacc

SEQ ID NO: 245763 - DNA, 25 bp, Mus musculus
ccctccaagcagaggacaaaatcac

SEQ ID NO: 245764 - DNA, 25 bp, Mus musculus
ccctccaagcagaggtatgtgcagg

SEQ ID NO: 245765 - DNA, 25 bp, Mus musculus
ccctccaaggctgggcgcgggctgg

SEQ ID NO: 245766 - DNA, 25 bp, Mus musculus
ccctccaagtacgtgctccaggcac

SEQ ID NO: 245767 - DNA, 25 bp, Mus musculus
ccctccaagtacgtgctctacaccc

SEQ ID NO: 245768 - DNA, 25 bp, Mus musculus
ccctccaatgaaagtgctaatgctg

SEQ ID NO: 245769 - DNA, 25 bp, Mus musculus
ccctccacagagttccccacacccc

SEQ ID NO: 245770 - DNA, 25 bp, Mus musculus
ccctccacagcccctacttccagaa

SEQ ID NO: 245771 - DNA, 25 bp, Mus musculus
ccctccacaggagcaggcgagcagg

SEQ ID NO: 245772 - DNA, 25 bp, Mus musculus
ccctccacatggcttcttctccaat

SEQ ID NO: 245773 - DNA, 25 bp, Mus musculus
ccctccacatgtctctggatttgtt

SEQ ID NO: 245774 - DNA, 25 bp, Mus musculus
ccctccacgctcaagcagcccacac

SEQ ID NO: 245775 - DNA, 25 bp, Mus musculus
ccctccacgctcaaggtgaccctgc

SEQ ID NO: 245776 - DNA, 25 bp, Mus musculus
ccctccactcagcttcccatgctcc

SEQ ID NO: 245777 - DNA, 25 bp, Mus musculus
ccctccactggttggaagaggctga

SEQ ID NO: 245778 - DNA, 25 bp, Mus musculus
ccctccacttcctgttgtcggtgcc

SEQ ID NO: 245779 - DNA, 25 bp, Mus musculus
ccctccagagaagatacggactctg

SEQ ID NO: 245780 - DNA, 25 bp, Mus musculus
ccctccagcacgcagctttacatgg

SEQ ID NO: 245781 - DNA, 25 bp, Mus musculus
ccctccagcaggaagaactaggaag

SEQ ID NO: 245782 - DNA, 25 bp, Mus musculus
ccctccagcatcgtggccaagatgg

SEQ ID NO: 245783 - DNA, 25 bp, Mus musculus
ccctccagctggaccctggaggagg

SEQ ID NO: 245784 - DNA, 25 bp, Mus musculus
ccctccaggtagtccaggggcagcc

SEQ ID NO: 245785 - DNA, 25 bp, Mus musculus
ccctccagtagagaaataccggtat

SEQ ID NO: 245786 - DNA, 25 bp, Mus musculus
ccctcccaacccaaatcttccacca

SEQ ID NO: 245787 - DNA, 25 bp, Mus musculus
ccctcccaacccaagtgacgttttg

SEQ ID NO: 245788 - DNA, 25 bp, Mus musculus
ccctcccaactgtagtgctggaccc

SEQ ID NO: 245789 - DNA, 25 bp, Mus musculus
ccctcccaagtttcagattacgatt

SEQ ID NO: 245790 - DNA, 25 bp, Mus musculus
ccctcccaatgattttcagaataac

SEQ ID NO: 245791 - DNA, 25 bp, Mus musculus
ccctcccaccggtgcctgctgtctc

SEQ ID NO: 245792 - DNA, 25 bp, Mus musculus
ccctcccagaacacgagcccaagat

SEQ ID NO: 245793 - DNA, 25 bp, Mus musculus
ccctcccagagcctccagagcttcg

SEQ ID NO: 245794 - DNA, 25 bp, Mus musculus
ccctcccagccaccaaaggggaggc

SEQ ID NO: 245795 - DNA, 25 bp, Mus musculus
ccctcccagtgacgtactggattgt

SEQ ID NO: 245796 - DNA, 25 bp, Mus musculus
ccctcccatggagggtgctcgagtc

SEQ ID NO: 245797 - DNA, 25 bp, Mus musculus
ccctccccacagagcgcacgcgatg

SEQ ID NO: 245798 - DNA, 25 bp, Mus musculus
ccctccccagaccagatcatccagc

SEQ ID NO: 245799 - DNA, 25 bp, Mus musculus
ccctccccagaccaggatgaggagg

SEQ ID NO: 245800 - DNA, 25 bp, Mus musculus
ccctccccagcaatctactctcctt

SEQ ID NO: 245801 - DNA, 25 bp, Mus musculus
ccctccccaggaacattgaccatgt

SEQ ID NO: 245802 - DNA, 25 bp, Mus musculus
ccctcccccagagtgctgacctagc

SEQ ID NO: 245803 - DNA, 25 bp, Mus musculus
ccctccccctgaccagctgtcccca

SEQ ID NO: 245804 - DNA, 25 bp, Mus musculus
ccctcccccttctacttcagagcca

SEQ ID NO: 245805 - DNA, 25 bp, Mus musculus
ccctccccgctgcagatttgcaaca

SEQ ID NO: 245806 - DNA, 25 bp, Mus musculus
ccctccccgcttccgctctcgggac

SEQ ID NO: 245807 - DNA, 25 bp, Mus musculus
ccctccccggccagacagcaattcc

SEQ ID NO: 245808 - DNA, 25 bp, Mus musculus
ccctccccggccagatgaggacaag

SEQ ID NO: 245809 - DNA, 25 bp, Mus musculus
ccctccccggccagtggctcttgac

SEQ ID NO: 245810 - DNA, 25 bp, Mus musculus
ccctcccctgcgagggtggctgctg

SEQ ID NO: 245811 - DNA, 25 bp, Mus musculus
ccctcccgcccaagcctaatagacc

SEQ ID NO: 245812 - DNA, 25 bp, Mus musculus
ccctcccgcccccagcgcctgctct

SEQ ID NO: 245813 - DNA, 25 bp, Mus musculus
ccctccctcagacctgggaagatcc

SEQ ID NO: 245814 - DNA, 25 bp, Mus musculus
ccctccctccaactctacaccctcg

SEQ ID NO: 245815 - DNA, 25 bp, Mus musculus
ccctccctcccagctgatggttcct

SEQ ID NO: 245816 - DNA, 25 bp, Mus musculus
ccctccctccgcggaaatctaccag

SEQ ID NO: 245817 - DNA, 25 bp, Mus musculus
ccctccctgaactcggctgcacggc

SEQ ID NO: 245818 - DNA, 25 bp, Mus musculus
ccctccctgacaaacgtgactctcg

SEQ ID NO: 245819 - DNA, 25 bp, Mus musculus
ccctccctgacaaaggtgactctcg

SEQ ID NO: 245820 - DNA, 25 bp, Mus musculus
ccctccctggaccacctctgccctc

SEQ ID NO: 245821 - DNA, 25 bp, Mus musculus
ccctccgaaaatgccatcccgccca

SEQ ID NO: 245822 - DNA, 25 bp, Mus musculus
ccctccgaaactgtctgcccagttg

SEQ ID NO: 245823 - DNA, 25 bp, Mus musculus
ccctccgaagactgaaactgttatg

SEQ ID NO: 245824 - DNA, 25 bp, Mus musculus
ccctccgaagctctggatgggtccc

SEQ ID NO: 245825 - DNA, 25 bp, Mus musculus
ccctccgaccaggagtcaaactgac

SEQ ID NO: 245826 - DNA, 25 bp, Mus musculus
ccctccgcaccacaggcaaatcctc

SEQ ID NO: 245827 - DNA, 25 bp, Mus musculus
ccctccgcctcagatggcagtcaaa

SEQ ID NO: 245828 - DNA, 25 bp, Mus musculus
ccctccgcctcagtaccaaacgtct

SEQ ID NO: 245829 - DNA, 25 bp, Mus musculus
ccctccgcggaaatctaccagagaa

SEQ ID NO: 245830 - DNA, 25 bp, Mus musculus
ccctccggccaggcgattaaatccc

SEQ ID NO: 245831 - DNA, 25 bp, Mus musculus
ccctccggcctcagggggctactcc

SEQ ID NO: 245832 - DNA, 25 bp, Mus musculus
ccctccgggctgtgagcacctcctc

SEQ ID NO: 245833 - DNA, 25 bp, Mus musculus
ccctccgtctggctggttcttctga

SEQ ID NO: 245834 - DNA, 25 bp, Mus musculus
ccctccgttgaaagcaccataccag

SEQ ID NO: 245835 - DNA, 25 bp, Mus musculus
ccctcctaagactgtatcactttcg

SEQ ID NO: 245836 - DNA, 25 bp, Mus musculus
ccctcctactcttgtatgtcttcgt

SEQ ID NO: 245837 - DNA, 25 bp, Mus musculus
ccctcctattccagtatcattttgc

SEQ ID NO: 245838 - DNA, 25 bp, Mus musculus
ccctcctcagaaagcagtgccccct

SEQ ID NO: 245839 - DNA, 25 bp, Mus musculus
ccctcctcagccccctcccgccttc

SEQ ID NO: 245840 - DNA, 25 bp, Mus musculus
ccctcctcaggtggggctcccagag

SEQ ID NO: 245841 - DNA, 25 bp, Mus musculus
ccctcctccgggaaggtagactgcc

SEQ ID NO: 245842 - DNA, 25 bp, Mus musculus
ccctcctctgcagttgttgacctcc

SEQ ID NO: 245843 - DNA, 25 bp, Mus musculus
ccctcctgagacagggttgtgagcc

SEQ ID NO: 245844 - DNA, 25 bp, Mus musculus
ccctcctgcaagcgttctgtcaaca

SEQ ID NO: 245845 - DNA, 25 bp, Mus musculus
ccctcctgcaagtttctccaggagt

SEQ ID NO: 245846 - DNA, 25 bp, Mus musculus
ccctcctgcccaggtttgcacaccc

SEQ ID NO: 245847 - DNA, 25 bp, Mus musculus
ccctcctggtaccagactctcatgg

SEQ ID NO: 245848 - DNA, 25 bp, Mus musculus
ccctccttatggcaggtgctgacct

SEQ ID NO: 245849 - DNA, 25 bp, Mus musculus
ccctccttccaccctcatgctagtg

SEQ ID NO: 245850 - DNA, 25 bp, Mus musculus
ccctccttccttcagaagagttcgc

SEQ ID NO: 245851 - DNA, 25 bp, Mus musculus
ccctccttggacagatgaaaaagag

SEQ ID NO: 245852 - DNA, 25 bp, Mus musculus
ccctccttggacagtaattttatga

SEQ ID NO: 245853 - DNA, 25 bp, Mus musculus
ccctccttgtctgtcttcatctcgg

SEQ ID NO: 245854 - DNA, 25 bp, Mus musculus
ccctccttgtctgttgcggggccac

SEQ ID NO: 245855 - DNA, 25 bp, Mus musculus
ccctcgaaggttgcagctccacccc

SEQ ID NO: 245856 - DNA, 25 bp, Mus musculus
ccctcgacctggaggatgtttcttg

SEQ ID NO: 245857 - DNA, 25 bp, Mus musculus
ccctcgacttagaatattagaagtg

SEQ ID NO: 245858 - DNA, 25 bp, Mus musculus
ccctcgacttaggagcaggctgccc

SEQ ID NO: 245859 - DNA, 25 bp, Mus musculus
ccctcgatcaactcaataaagccgt

SEQ ID NO: 245860 - DNA, 25 bp, Mus musculus
ccctcgatcaactcagccggctcaa

SEQ ID NO: 245861 - DNA, 25 bp, Mus musculus
ccctcgatgagatgtgatcttcgtg

SEQ ID NO: 245862 - DNA, 25 bp, Mus musculus
ccctcgccatgaagaagcccattgg

SEQ ID NO: 245863 - DNA, 25 bp, Mus musculus
ccctcgccccaggcactgggctccc

SEQ ID NO: 245864 - DNA, 25 bp, Mus musculus
ccctcgcccccagagattaatgtgg

SEQ ID NO: 245865 - DNA, 25 bp, Mus musculus
ccctcgcccccagaggtgtcgtgga

SEQ ID NO: 245866 - DNA, 25 bp, Mus musculus
ccctcgccgcctcgatgagcagctc

SEQ ID NO: 245867 - DNA, 25 bp, Mus musculus
ccctcgctcctccctcgagaggagc

SEQ ID NO: 245868 - DNA, 25 bp, Mus musculus
ccctcgctgggatcgctttagaatg

SEQ ID NO: 245869 - DNA, 25 bp, Mus musculus
ccctcgctgggatcggtttttgtga

SEQ ID NO: 245870 - DNA, 25 bp, Mus musculus
ccctcgctgggatcgtttgtttata

SEQ ID NO: 245871 - DNA, 25 bp, Mus musculus
ccctcggagaaaggccagccatgtg

SEQ ID NO: 245872 - DNA, 25 bp, Mus musculus
ccctcggagctgctgctggctttga

SEQ ID NO: 245873 - DNA, 25 bp, Mus musculus
ccctcggatcggagaaacgcttcgt

SEQ ID NO: 245874 - DNA, 25 bp, Mus musculus
ccctcggcgggcatggcccctgcac

SEQ ID NO: 245875 - DNA, 25 bp, Mus musculus
ccctcggctcacagatggctgccag

SEQ ID NO: 245876 - DNA, 25 bp, Mus musculus
ccctcggctcacaggcagaagactt

SEQ ID NO: 245877 - DNA, 25 bp, Mus musculus
ccctcggctcacgcgccctcccgcc

SEQ ID NO: 245878 - DNA, 25 bp, Mus musculus
ccctcggctgtagagagtcagtcgt

SEQ ID NO: 245879 - DNA, 25 bp, Mus musculus
ccctcgggagcaggtttcaacacta

SEQ ID NO: 245880 - DNA, 25 bp, Mus musculus
ccctcgggccaatcccagtggccta

SEQ ID NO: 245881 - DNA, 25 bp, Mus musculus
ccctcggggcagggatgccctggac

SEQ ID NO: 245882 - DNA, 25 bp, Mus musculus
ccctcggtgactctgtgaacctaca

SEQ ID NO: 245883 - DNA, 25 bp, Mus musculus
ccctcgtctatcagtcttgtctgta

SEQ ID NO: 245884 - DNA, 25 bp, Mus musculus
ccctcgtctgctccacttccacccc

SEQ ID NO: 245885 - DNA, 25 bp, Mus musculus
ccctcgtgagagctgcttcagctga

SEQ ID NO: 245886 - DNA, 25 bp, Mus musculus
ccctcgtgagagggtttctctgtgt

SEQ ID NO: 245887 - DNA, 25 bp, Mus musculus
ccctctaaaagaagcgtgcaatcac

SEQ ID NO: 245888 - DNA, 25 bp, Mus musculus
ccctctaaaagcttcctgcagtagc

SEQ ID NO: 245889 - DNA, 25 bp, Mus musculus
ccctctaaagacaagattgaggatg

SEQ ID NO: 245890 - DNA, 25 bp, Mus musculus
ccctctaaagacatcgcctggtggt

SEQ ID NO: 245891 - DNA, 25 bp, Mus musculus
ccctctaacctgcatcccagcctat

SEQ ID NO: 245892 - DNA, 25 bp, Mus musculus
ccctctacagaacaggtgggcactc

SEQ ID NO: 245893 - DNA, 25 bp, Mus musculus
ccctctacagaacagtctatacaac

SEQ ID NO: 245894 - DNA, 25 bp, Mus musculus
ccctctacaggagtgtgcaccgtac

SEQ ID NO: 245895 - DNA, 25 bp, Mus musculus
ccctctacagtttcaggcctggtct

SEQ ID NO: 245896 - DNA, 25 bp, Mus musculus
ccctctaccagcagaacagcacagc

SEQ ID NO: 245897 - DNA, 25 bp, Mus musculus
ccctctaccagcagacccaatggaa

SEQ ID NO: 245898 - DNA, 25 bp, Mus musculus
ccctctacctcagggccccgccgtc

SEQ ID NO: 245899 - DNA, 25 bp, Mus musculus
ccctctactcagttcctcatttgac

SEQ ID NO: 245900 - DNA, 25 bp, Mus musculus
ccctctactccgccattttcctgct

SEQ ID NO: 245901 - DNA, 25 bp, Mus musculus
ccctctactcctaagtccccaggtg

SEQ ID NO: 245902 - DNA, 25 bp, Mus musculus
ccctctactcctaatgtgaaaaact

SEQ ID NO: 245903 - DNA, 25 bp, Mus musculus
ccctctataaagcattgaggccaag

SEQ ID NO: 245904 - DNA, 25 bp, Mus musculus
ccctctataaagtctttcctgtact

SEQ ID NO: 245905 - DNA, 25 bp, Mus musculus
ccctctataaggagggtcactccaa

SEQ ID NO: 245906 - DNA, 25 bp, Mus musculus
ccctctataccagactttgtaccta

SEQ ID NO: 245907 - DNA, 25 bp, Mus musculus
ccctctatcagcaggaatccagcca

SEQ ID NO: 245908 - DNA, 25 bp, Mus musculus
ccctctatccctcttggaggaacca

SEQ ID NO: 245909 - DNA, 25 bp, Mus musculus
ccctctatgcttccggcatcgtgtt

SEQ ID NO: 245910 - DNA, 25 bp, Mus musculus
ccctctcaaccctggctgcactgct

SEQ ID NO: 245911 - DNA, 25 bp, Mus musculus
ccctctcaagctcagccttttcttc

SEQ ID NO: 245912 - DNA, 25 bp, Mus musculus
ccctctcaccgctcggctctgggtg

SEQ ID NO: 245913 - DNA, 25 bp, Mus musculus
ccctctcaccgctcgggcctgtgct

SEQ ID NO: 245914 - DNA, 25 bp, Mus musculus
ccctctcactgggtcttctgggtag

SEQ ID NO: 245915 - DNA, 25 bp, Mus musculus
ccctctcagggtgcgggtagcggca

SEQ ID NO: 245916 - DNA, 25 bp, Mus musculus
ccctctcatctacttccccctttcc

SEQ ID NO: 245917 - DNA, 25 bp, Mus musculus
ccctctccaagtatgtaggaggagt

SEQ ID NO: 245918 - DNA, 25 bp, Mus musculus
ccctctccagaacaaagtctgttca

SEQ ID NO: 245919 - DNA, 25 bp, Mus musculus
ccctctccagcaggcacctccagtc

SEQ ID NO: 245920 - DNA, 25 bp, Mus musculus
ccctctccagcccggttttgaggaa

SEQ ID NO: 245921 - DNA, 25 bp, Mus musculus
ccctctccaggtgtctccagtgcca

SEQ ID NO: 245922 - DNA, 25 bp, Mus musculus
ccctctccatatcgctgtattgtgt

SEQ ID NO: 245923 - DNA, 25 bp, Mus musculus
ccctctcctgaaagcgctgagaagc

SEQ ID NO: 245924 - DNA, 25 bp, Mus musculus
ccctctctcaggaatttgaagccta

SEQ ID NO: 245925 - DNA, 25 bp, Mus musculus
ccctctctctaccctcctgctgact

SEQ ID NO: 245926 - DNA, 25 bp, Mus musculus
ccctctctgctcaggaagaacgttg

SEQ ID NO: 245927 - DNA, 25 bp, Mus musculus
ccctctctgctgcggtcatgtagga

SEQ ID NO: 245928 - DNA, 25 bp, Mus musculus
ccctctctggactctatagctgcaa

SEQ ID NO: 245929 - DNA, 25 bp, Mus musculus
ccctctctggcagaatccatgcgac

SEQ ID NO: 245930 - DNA, 25 bp, Mus musculus
ccctctctggcagcgaaattggaac

SEQ ID NO: 245931 - DNA, 25 bp, Mus musculus
ccctctcttcagctacctcagcttt

SEQ ID NO: 245932 - DNA, 25 bp, Mus musculus
ccctctctttcctcgttgtttttgt

SEQ ID NO: 245933 - DNA, 25 bp, Mus musculus
ccctctctttgccaaggtgaacgtg

SEQ ID NO: 245934 - DNA, 25 bp, Mus musculus
ccctctgaaactgtgccgatcccct

SEQ ID NO: 245935 - DNA, 25 bp, Mus musculus
ccctctgaatgtcaagccccgccca

SEQ ID NO: 245936 - DNA, 25 bp, Mus musculus
ccctctgacacacagggagaaaatc

SEQ ID NO: 245937 - DNA, 25 bp, Mus musculus
ccctctgagaagagatggcgtcaga

SEQ ID NO: 245938 - DNA, 25 bp, Mus musculus
ccctctgagagaagacccatgcttg

SEQ ID NO: 245939 - DNA, 25 bp, Mus musculus
ccctctgaggggcaccatgtactgg

SEQ ID NO: 245940 - DNA, 25 bp, Mus musculus
ccctctgagtccaaccaagtttatt

SEQ ID NO: 245941 - DNA, 25 bp, Mus musculus
ccctctgatgggagagcaagccctc

SEQ ID NO: 245942 - DNA, 25 bp, Mus musculus
ccctctgatgggagaggctttgaag

SEQ ID NO: 245943 - DNA, 25 bp, Mus musculus
ccctctgattgaaattttcttcttc

SEQ ID NO: 245944 - DNA, 25 bp, Mus musculus
ccctctgatttagatcttgaaccag

SEQ ID NO: 245945 - DNA, 25 bp, Mus musculus
ccctctgcagtgtatgtggctcatc

SEQ ID NO: 245946 - DNA, 25 bp, Mus musculus
ccctctgccagagcacaagagacca

SEQ ID NO: 245947 - DNA, 25 bp, Mus musculus
ccctctgccccaaaggcattcgatg

SEQ ID NO: 245948 - DNA, 25 bp, Mus musculus
ccctctgccccaaagttccccagct

SEQ ID NO: 245949 - DNA, 25 bp, Mus musculus
ccctctgccctgctataacggaggc

SEQ ID NO: 245950 - DNA, 25 bp, Mus musculus
ccctctgcgaagatggaatgaaacc

SEQ ID NO: 245951 - DNA, 25 bp, Mus musculus
ccctctgctaatagttcctgcacga

SEQ ID NO: 245952 - DNA, 25 bp, Mus musculus
ccctctgctaatatggatgcaaaga

SEQ ID NO: 245953 - DNA, 25 bp, Mus musculus
ccctctgctgaaggtgtccatcata

SEQ ID NO: 245954 - DNA, 25 bp, Mus musculus
ccctctggaagcagcagccgcagcc

SEQ ID NO: 245955 - DNA, 25 bp, Mus musculus
ccctctggaagtgccgaattcgagg

SEQ ID NO: 245956 - DNA, 25 bp, Mus musculus
ccctctggactatggctggcagagg

SEQ ID NO: 245957 - DNA, 25 bp, Mus musculus
ccctctggatcagaattaaaatgct

SEQ ID NO: 245958 - DNA, 25 bp, Mus musculus
ccctctggatcagatctccatgatc

SEQ ID NO: 245959 - DNA, 25 bp, Mus musculus
ccctctggatcagattgattatgtg

SEQ ID NO: 245960 - DNA, 25 bp, Mus musculus
ccctctggccagacagtctgctagg

SEQ ID NO: 245961 - DNA, 25 bp, Mus musculus
ccctctggccaggcagttattcaga

SEQ ID NO: 245962 - DNA, 25 bp, Mus musculus
ccctctggctcatacatgtctcaga

SEQ ID NO: 245963 - DNA, 25 bp, Mus musculus
ccctctgggaaaggtattctctaag

SEQ ID NO: 245964 - DNA, 25 bp, Mus musculus
ccctctggtatatcgaactcgcact

SEQ ID NO: 245965 - DNA, 25 bp, Mus musculus
ccctctggtatatcgttgtgcagac

SEQ ID NO: 245966 - DNA, 25 bp, Mus musculus
ccctctggtcagtcaatcccatggg

SEQ ID NO: 245967 - DNA, 25 bp, Mus musculus
ccctctgtaaagtgatggctgcagc

SEQ ID NO: 245968 - DNA, 25 bp, Mus musculus
ccctctgtcaagggggtgtcgtttg

SEQ ID NO: 245969 - DNA, 25 bp, Mus musculus
ccctctgtcaagttaacactcacga

SEQ ID NO: 245970 - DNA, 25 bp, Mus musculus
ccctctgtcactgtcacgttcatga

SEQ ID NO: 245971 - DNA, 25 bp, Mus musculus
ccctctgtccccagggaacagactg

SEQ ID NO: 245972 - DNA, 25 bp, Mus musculus
ccctctgtgacctgtataatggtta

SEQ ID NO: 245973 - DNA, 25 bp, Mus musculus
ccctctgtgccgaacatctcatcat

SEQ ID NO: 245974 - DNA, 25 bp, Mus musculus
ccctctgtgccgcccccagaggaac

SEQ ID NO: 245975 - DNA, 25 bp, Mus musculus
ccctctgtgctacagatgtcacagc

SEQ ID NO: 245976 - DNA, 25 bp, Mus musculus
ccctctgtgctacagattacacctt

SEQ ID NO: 245977 - DNA, 25 bp, Mus musculus
ccctctgtggacggaatcttggaga

SEQ ID NO: 245978 - DNA, 25 bp, Mus musculus
ccctctgtgggtgaacgtgggtctg

SEQ ID NO: 245979 - DNA, 25 bp, Mus musculus
ccctctgtttcccagaccaggtcga

SEQ ID NO: 245980 - DNA, 25 bp, Mus musculus
ccctctgtttcccagggtcccaaag

SEQ ID NO: 245981 - DNA, 25 bp, Mus musculus
ccctcttagcagaaatctagatctt

SEQ ID NO: 245982 - DNA, 25 bp, Mus musculus
ccctcttagccatgaaacactctct

SEQ ID NO: 245983 - DNA, 25 bp, Mus musculus
ccctcttatgtcctcagagagtatt

SEQ ID NO: 245984 - DNA, 25 bp, Mus musculus
ccctcttcaacaggttctactcagt

SEQ ID NO: 245985 - DNA, 25 bp, Mus musculus
ccctcttcaactctggctccagtgt

SEQ ID NO: 245986 - DNA, 25 bp, Mus musculus
ccctcttcacctcgctgaggtgaag

SEQ ID NO: 245987 - DNA, 25 bp, Mus musculus
ccctcttcagacagagagcctgggg

SEQ ID NO: 245988 - DNA, 25 bp, Mus musculus
ccctcttcaggttatccgtgttcgg

SEQ ID NO: 245989 - DNA, 25 bp, Mus musculus
ccctcttcctggagttccctgagga

SEQ ID NO: 245990 - DNA, 25 bp, Mus musculus
ccctcttcggctacagcaagtggga

SEQ ID NO: 245991 - DNA, 25 bp, Mus musculus
ccctcttcggggaagaaatagatgg

SEQ ID NO: 245992 - DNA, 25 bp, Mus musculus
ccctcttcgtcaaggctggttatga

SEQ ID NO: 245993 - DNA, 25 bp, Mus musculus
ccctcttctaccactgaggggtttc

SEQ ID NO: 245994 - DNA, 25 bp, Mus musculus
ccctcttctcccctgacagacccgg

SEQ ID NO: 245995 - DNA, 25 bp, Mus musculus
ccctcttctcccctggtttctgtat

SEQ ID NO: 245996 - DNA, 25 bp, Mus musculus
ccctcttctgcacatcgagtcacgt

SEQ ID NO: 245997 - DNA, 25 bp, Mus musculus
ccctcttcttcagatacatgtctca

SEQ ID NO: 245998 - DNA, 25 bp, Mus musculus
ccctcttgacccagccctgcagaac

SEQ ID NO: 245999 - DNA, 25 bp, Mus musculus
ccctcttgcagctcaaatgtcccca

SEQ ID NO: 246000 - DNA, 25 bp, Mus musculus
ccctcttgcccgctggacagttgct

SEQ ID NO: 246001 - DNA, 25 bp, Mus musculus
ccctcttggaagaggccctgggctt

SEQ ID NO: 246002 - DNA, 25 bp, Mus musculus
ccctctttcaagccgtaattgctgg

SEQ ID NO: 246003 - DNA, 25 bp, Mus musculus
ccctgaaaaatcgggttctgcctgt

SEQ ID NO: 246004 - DNA, 25 bp, Mus musculus
ccctgaaaagtgcaggtgtgcattg

SEQ ID NO: 246005 - DNA, 25 bp, Mus musculus
ccctgaaacagatgctgaccttaag

SEQ ID NO: 246006 - DNA, 25 bp, Mus musculus
ccctgaaactcaggtggtgctgatc

SEQ ID NO: 246007 - DNA, 25 bp, Mus musculus
ccctgaaaggaagtcagagaagctt

SEQ ID NO: 246008 - DNA, 25 bp, Mus musculus
ccctgaaaggcaaaggtcagtgtcc

SEQ ID NO: 246009 - DNA, 25 bp, Mus musculus
ccctgaaatggcattatccaattgg

SEQ ID NO: 246010 - DNA, 25 bp, Mus musculus
ccctgaaattatatcattggatact

SEQ ID NO: 246011 - DNA, 25 bp, Mus musculus
ccctgaacagtgccatatgagaaca

SEQ ID NO: 246012 - DNA, 25 bp, Mus musculus
ccctgaacagtgccgcaacataaca

SEQ ID NO: 246013 - DNA, 25 bp, Mus musculus
ccctgaactcaacatggcaaggcac

SEQ ID NO: 246014 - DNA, 25 bp, Mus musculus
ccctgaactcaagttcacgcaaaga

SEQ ID NO: 246015 - DNA, 25 bp, Mus musculus
ccctgaactctatcatattgcagca

SEQ ID NO: 246016 - DNA, 25 bp, Mus musculus
ccctgaactgcacacgccaaagatg

SEQ ID NO: 246017 - DNA, 25 bp, Mus musculus
ccctgaagaagaggtcacgaaagaa

SEQ ID NO: 246018 - DNA, 25 bp, Mus musculus
ccctgaagagacttggttgaaaggc

SEQ ID NO: 246019 - DNA, 25 bp, Mus musculus
ccctgaagagagcagataagattcc

SEQ ID NO: 246020 - DNA, 25 bp, Mus musculus
ccctgaagagatgccacctcggctc

SEQ ID NO: 246021 - DNA, 25 bp, Mus musculus
ccctgaagcaccagcatcggtgtgt

SEQ ID NO: 246022 - DNA, 25 bp, Mus musculus
ccctgaagcaccaggtgaatgggat

SEQ ID NO: 246023 - DNA, 25 bp, Mus musculus
ccctgaagcagaagactctcttctg

SEQ ID NO: 246024 - DNA, 25 bp, Mus musculus
ccctgaagtcaagggcaggcactga

SEQ ID NO: 246025 - DNA, 25 bp, Mus musculus
ccctgaagtcaaggtcggttaggcc

SEQ ID NO: 246026 - DNA, 25 bp, Mus musculus
ccctgaagtcgcagagaaagataag

SEQ ID NO: 246027 - DNA, 25 bp, Mus musculus
ccctgacaacaagagcctggccatc

SEQ ID NO: 246028 - DNA, 25 bp, Mus musculus
ccctgacacgctgagaaatacgaag

SEQ ID NO: 246029 - DNA, 25 bp, Mus musculus
ccctgacacgctgagaatatatcag

SEQ ID NO: 246030 - DNA, 25 bp, Mus musculus
ccctgacagcaggggcttcagtgtg

SEQ ID NO: 246031 - DNA, 25 bp, Mus musculus
ccctgacagcagttcccacagctgc

SEQ ID NO: 246032 - DNA, 25 bp, Mus musculus
ccctgaccacagactactggtgcct

SEQ ID NO: 246033 - DNA, 25 bp, Mus musculus
ccctgaccagttagtcctctatttt

SEQ ID NO: 246034 - DNA, 25 bp, Mus musculus
ccctgaccatcacagtccgcaccaa

SEQ ID NO: 246035 - DNA, 25 bp, Mus musculus
ccctgaccatggacgatctgtttcc

SEQ ID NO: 246036 - DNA, 25 bp, Mus musculus
ccctgacccagccccaccattctcc

SEQ ID NO: 246037 - DNA, 25 bp, Mus musculus
ccctgacccagcttctcgtgtagaa

SEQ ID NO: 246038 - DNA, 25 bp, Mus musculus
ccctgacccaggaacacagtgtgtg

SEQ ID NO: 246039 - DNA, 25 bp, Mus musculus
ccctgacccaggtcaacagctgagc

SEQ ID NO: 246040 - DNA, 25 bp, Mus musculus
ccctgaccccgcgggtccttcacac

SEQ ID NO: 246041 - DNA, 25 bp, Mus musculus
ccctgaccccggtgtgtgatagcac

SEQ ID NO: 246042 - DNA, 25 bp, Mus musculus
ccctgacctaagtcgaatggtatgt

SEQ ID NO: 246043 - DNA, 25 bp, Mus musculus
ccctgacctcaggattggaaaactg

SEQ ID NO: 246044 - DNA, 25 bp, Mus musculus
ccctgacctgtgctgctccgcagaa

SEQ ID NO: 246045 - DNA, 25 bp, Mus musculus
ccctgacctgtggttcctgcacgac

SEQ ID NO: 246046 - DNA, 25 bp, Mus musculus
ccctgactagagttagaatcccttc

SEQ ID NO: 246047 - DNA, 25 bp, Mus musculus
ccctgactatttggttcctgctgct

SEQ ID NO: 246048 - DNA, 25 bp, Mus musculus
ccctgactcatggtggcccgaggca

SEQ ID NO: 246049 - DNA, 25 bp, Mus musculus
ccctgactcgatggcaccgcatgcg

SEQ ID NO: 246050 - DNA, 25 bp, Mus musculus
ccctgactcggaaaagtcatgttgc

SEQ ID NO: 246051 - DNA, 25 bp, Mus musculus
ccctgactcggaaagttccattttg

SEQ ID NO: 246052 - DNA, 25 bp, Mus musculus
ccctgactgctcttgtctgaaaaca

SEQ ID NO: 246053 - DNA, 25 bp, Mus musculus
ccctgactggacatgattttgggca

SEQ ID NO: 246054 - DNA, 25 bp, Mus musculus
ccctgactggacatggggatcctgt

SEQ ID NO: 246055 - DNA, 25 bp, Mus musculus
ccctgacttgatgtgtcttaccact

SEQ ID NO: 246056 - DNA, 25 bp, Mus musculus
ccctgactttactaggacctggccc

SEQ ID NO: 246057 - DNA, 25 bp, Mus musculus
ccctgactttcatgatgcccccacc

SEQ ID NO: 246058 - DNA, 25 bp, Mus musculus
ccctgactttgagcggaggctgctg

SEQ ID NO: 246059 - DNA, 25 bp, Mus musculus
ccctgactttgtggctgttccattg

SEQ ID NO: 246060 - DNA, 25 bp, Mus musculus
ccctgagaaactgggtgctcttctc

SEQ ID NO: 246061 - DNA, 25 bp, Mus musculus
ccctgagaaggagcttcctgtcacg

SEQ ID NO: 246062 - DNA, 25 bp, Mus musculus
ccctgagaaggaggtcactcttatc

SEQ ID NO: 246063 - DNA, 25 bp, Mus musculus
ccctgagacagactcacaccgcttt

SEQ ID NO: 246064 - DNA, 25 bp, Mus musculus
ccctgagacccaggtggtactgata

SEQ ID NO: 246065 - DNA, 25 bp, Mus musculus
ccctgagactgccagcaaattcccc

SEQ ID NO: 246066 - DNA, 25 bp, Mus musculus
ccctgagaggttccacaacttagaa

SEQ ID NO: 246067 - DNA, 25 bp, Mus musculus
ccctgagatctaaacctactgacgg

SEQ ID NO: 246068 - DNA, 25 bp, Mus musculus
ccctgagcagagtcactgagggcca

SEQ ID NO: 246069 - DNA, 25 bp, Mus musculus
ccctgagcagattgaacgggctgcc

SEQ ID NO: 246070 - DNA, 25 bp, Mus musculus
ccctgagcaggagtctgcaggtgct

SEQ ID NO: 246071 - DNA, 25 bp, Mus musculus
ccctgagcaggctcctgctgaaggt

SEQ ID NO: 246072 - DNA, 25 bp, Mus musculus
ccctgagcagggtgttcctgtataa

SEQ ID NO: 246073 - DNA, 25 bp, Mus musculus
ccctgagccccgagggtcctgcggt

SEQ ID NO: 246074 - DNA, 25 bp, Mus musculus
ccctgagccccgtgtactggttccg

SEQ ID NO: 246075 - DNA, 25 bp, Mus musculus
ccctgagccggaggttccaggatgg

SEQ ID NO: 246076 - DNA, 25 bp, Mus musculus
ccctgagcctgaagaaaaagttaaa

SEQ ID NO: 246077 - DNA, 25 bp, Mus musculus
ccctgagcctgaagtggtgttcaac

SEQ ID NO: 246078 - DNA, 25 bp, Mus musculus
ccctgagcgactgaggcaattaaaa

SEQ ID NO: 246079 - DNA, 25 bp, Mus musculus
ccctgagcgactgaggtctgccgac

SEQ ID NO: 246080 - DNA, 25 bp, Mus musculus
ccctgagcgcccccgtggaatggcg

SEQ ID NO: 246081 - DNA, 25 bp, Mus musculus
ccctgagctggacaagtgacgcaga

SEQ ID NO: 246082 - DNA, 25 bp, Mus musculus
ccctgagctggccaaaaggccagat

SEQ ID NO: 246083 - DNA, 25 bp, Mus musculus
ccctgagctggctctctgacaaatg

SEQ ID NO: 246084 - DNA, 25 bp, Mus musculus
ccctgagctgtgaggcgcagcaagc

SEQ ID NO: 246085 - DNA, 25 bp, Mus musculus
ccctgaggaacagaaaatgttaaca

SEQ ID NO: 246086 - DNA, 25 bp, Mus musculus
ccctgaggaacagatcctggagaga

SEQ ID NO: 246087 - DNA, 25 bp, Mus musculus
ccctgaggaccaaggtgagcctgtg

SEQ ID NO: 246088 - DNA, 25 bp, Mus musculus
ccctgaggatcccgagggcatcaga

SEQ ID NO: 246089 - DNA, 25 bp, Mus musculus
ccctgaggatcccgggcgtgattga

SEQ ID NO: 246090 - DNA, 25 bp, Mus musculus
ccctgaggcagaagctccaagatga

SEQ ID NO: 246091 - DNA, 25 bp, Mus musculus
ccctgaggccctttatgctgctggc

SEQ ID NO: 246092 - DNA, 25 bp, Mus musculus
ccctgaggctgcttctttttaaaga

SEQ ID NO: 246093 - DNA, 25 bp, Mus musculus
ccctgaggctgcttgggaaccaaca

SEQ ID NO: 246094 - DNA, 25 bp, Mus musculus
ccctgagggaggtgaccattgttga

SEQ ID NO: 246095 - DNA, 25 bp, Mus musculus
ccctgaggtgagagcagccatggag

SEQ ID NO: 246096 - DNA, 25 bp, Mus musculus
ccctgagtgttggcgggccatccca

SEQ ID NO: 246097 - DNA, 25 bp, Mus musculus
ccctgagtttcaggagcggctgcaa

SEQ ID NO: 246098 - DNA, 25 bp, Mus musculus
ccctgagtttgacgactctgactat

SEQ ID NO: 246099 - DNA, 25 bp, Mus musculus
ccctgataatggcagcccagccatg

SEQ ID NO: 246100 - DNA, 25 bp, Mus musculus
ccctgatacagagcgcctagatgat

SEQ ID NO: 246101 - DNA, 25 bp, Mus musculus
ccctgataccaggggttccagtgtc

SEQ ID NO: 246102 - DNA, 25 bp, Mus musculus
ccctgatagactaggatattttaaa

SEQ ID NO: 246103 - DNA, 25 bp, Mus musculus
ccctgatagactaggttggtttgcc

SEQ ID NO: 246104 - DNA, 25 bp, Mus musculus
ccctgatagagttgcaacatctcgg

SEQ ID NO: 246105 - DNA, 25 bp, Mus musculus
ccctgatatactcatctgccatggt

SEQ ID NO: 246106 - DNA, 25 bp, Mus musculus
ccctgatatcaagtcgcgcattgcc

SEQ ID NO: 246107 - DNA, 25 bp, Mus musculus
ccctgatatttgacattaacgagct

SEQ ID NO: 246108 - DNA, 25 bp, Mus musculus
ccctgatcaagatggactgtaacaa

SEQ ID NO: 246109 - DNA, 25 bp, Mus musculus
ccctgatcacaaagcagacccagga

SEQ ID NO: 246110 - DNA, 25 bp, Mus musculus
ccctgatcatcccggcgcctcccca

SEQ ID NO: 246111 - DNA, 25 bp, Mus musculus
ccctgatcatcccgggagttccgac

SEQ ID NO: 246112 - DNA, 25 bp, Mus musculus
ccctgatcatcccggtatccctgga

SEQ ID NO: 246113 - DNA, 25 bp, Mus musculus
ccctgatccagatctggccgccccg

SEQ ID NO: 246114 - DNA, 25 bp, Mus musculus
ccctgatctctcagtgtaccccgaa

SEQ ID NO: 246115 - DNA, 25 bp, Mus musculus
ccctgatctgcggcggtcagggaaa

SEQ ID NO: 246116 - DNA, 25 bp, Mus musculus
ccctgatgaaaacgttgtatcagag

SEQ ID NO: 246117 - DNA, 25 bp, Mus musculus
ccctgatgcagctccccaccactta

SEQ ID NO: 246118 - DNA, 25 bp, Mus musculus
ccctgatgcgagagaacaagagata

SEQ ID NO: 246119 - DNA, 25 bp, Mus musculus
ccctgatgctgaggcctgacctgga

SEQ ID NO: 246120 - DNA, 25 bp, Mus musculus
ccctgatggattgtcgcgatagagt

SEQ ID NO: 246121 - DNA, 25 bp, Mus musculus
ccctgatgtaggacgaagaatgacc

SEQ ID NO: 246122 - DNA, 25 bp, Mus musculus
ccctgattatcagtaccccacccca

SEQ ID NO: 246123 - DNA, 25 bp, Mus musculus
ccctgattccacgcttcttgccacc

SEQ ID NO: 246124 - DNA, 25 bp, Mus musculus
ccctgattggcaggtctcacatgag

SEQ ID NO: 246125 - DNA, 25 bp, Mus musculus
ccctgcaaagataccgaagcaaagg

SEQ ID NO: 246126 - DNA, 25 bp, Mus musculus
ccctgcaaaggttttccatctcctc

SEQ ID NO: 246127 - DNA, 25 bp, Mus musculus
ccctgcaaccccagcccgcacccgg

SEQ ID NO: 246128 - DNA, 25 bp, Mus musculus
ccctgcaagcctgtatggatggatt

SEQ ID NO: 246129 - DNA, 25 bp, Mus musculus
ccctgcaagctaggtaggaacaacc

SEQ ID NO: 246130 - DNA, 25 bp, Mus musculus
ccctgcacaggctagccctgctcct

SEQ ID NO: 246131 - DNA, 25 bp, Mus musculus
ccctgcacaggggtgacagtccaaa

SEQ ID NO: 246132 - DNA, 25 bp, Mus musculus
ccctgcaccagaatggcatccaggt

SEQ ID NO: 246133 - DNA, 25 bp, Mus musculus
ccctgcaccagagaaatcataaacc

SEQ ID NO: 246134 - DNA, 25 bp, Mus musculus
ccctgcaccaggcctgtattgatga

SEQ ID NO: 246135 - DNA, 25 bp, Mus musculus
ccctgcacccaagcccctccagttc

SEQ ID NO: 246136 - DNA, 25 bp, Mus musculus
ccctgcacccaagggcacagaccgg

SEQ ID NO: 246137 - DNA, 25 bp, Mus musculus
ccctgcacctcccaggaccccaaga

SEQ ID NO: 246138 - DNA, 25 bp, Mus musculus
ccctgcacggctggccaggccaagg

SEQ ID NO: 246139 - DNA, 25 bp, Mus musculus
ccctgcactctatgttttctcagtg

SEQ ID NO: 246140 - DNA, 25 bp, Mus musculus
ccctgcacttgtggatggagaccaa

SEQ ID NO: 246141 - DNA, 25 bp, Mus musculus
ccctgcagaacacagcggagatcca

SEQ ID NO: 246142 - DNA, 25 bp, Mus musculus
ccctgcagaacacaggtgttgaatc

SEQ ID NO: 246143 - DNA, 25 bp, Mus musculus
ccctgcagagaaactcatcaagcaa

SEQ ID NO: 246144 - DNA, 25 bp, Mus musculus
ccctgcagagaaagaacatttcaga

SEQ ID NO: 246145 - DNA, 25 bp, Mus musculus
ccctgcagcagctgattagagtaac

SEQ ID NO: 246146 - DNA, 25 bp, Mus musculus
ccctgcagcccagggcgctgtgagg

SEQ ID NO: 246147 - DNA, 25 bp, Mus musculus
ccctgcagcctcgggttcctccatc

SEQ ID NO: 246148 - DNA, 25 bp, Mus musculus
ccctgcagctaacaggattggtatc

SEQ ID NO: 246149 - DNA, 25 bp, Mus musculus
ccctgcagctaaggcagaaaagata

SEQ ID NO: 246150 - DNA, 25 bp, Mus musculus
ccctgcagctacaggagtcatggct

SEQ ID NO: 246151 - DNA, 25 bp, Mus musculus
ccctgcaggacaggtggcctctgat

SEQ ID NO: 246152 - DNA, 25 bp, Mus musculus
ccctgcaggagaaggaagaacaaaa

SEQ ID NO: 246153 - DNA, 25 bp, Mus musculus
ccctgcaggtggcagttttaggttc

SEQ ID NO: 246154 - DNA, 25 bp, Mus musculus
ccctgcagtgtcagtgctgccctag

SEQ ID NO: 246155 - DNA, 25 bp, Mus musculus
ccctgcagtgtcagttcctttctag

SEQ ID NO: 246156 - DNA, 25 bp, Mus musculus
ccctgcagtttaaaaacggcgtgga

SEQ ID NO: 246157 - DNA, 25 bp, Mus musculus
ccctgcatagaggtagttcctaata

SEQ ID NO: 246158 - DNA, 25 bp, Mus musculus
ccctgcatagaggtgtgaaattgaa

SEQ ID NO: 246159 - DNA, 25 bp, Mus musculus
ccctgcatcaaggagcttgtgtcag

SEQ ID NO: 246160 - DNA, 25 bp, Mus musculus
ccctgcatcaaggtacttgtgtcag

SEQ ID NO: 246161 - DNA, 25 bp, Mus musculus
ccctgcatccttcaggtctccagat

SEQ ID NO: 246162 - DNA, 25 bp, Mus musculus
ccctgcatctgagtgccgtactgtt

SEQ ID NO: 246163 - DNA, 25 bp, Mus musculus
ccctgcatgaagcggtgttcgagga

SEQ ID NO: 246164 - DNA, 25 bp, Mus musculus
ccctgcatgtcaccctgccgtggat

SEQ ID NO: 246165 - DNA, 25 bp, Mus musculus
ccctgcatgtcaccctggactggtg

SEQ ID NO: 246166 - DNA, 25 bp, Mus musculus
ccctgcatgtcaccctgtgctgaag

SEQ ID NO: 246167 - DNA, 25 bp, Mus musculus
ccctgccaagatggctccagctcca

SEQ ID NO: 246168 - DNA, 25 bp, Mus musculus
ccctgccaagatgggtgctcacagt

SEQ ID NO: 246169 - DNA, 25 bp, Mus musculus
ccctgccaagattttcacctgacgg

SEQ ID NO: 246170 - DNA, 25 bp, Mus musculus
ccctgccacagccccggccaccctc

SEQ ID NO: 246171 - DNA, 25 bp, Mus musculus
ccctgccacatcatgacaagaaaaa

SEQ ID NO: 246172 - DNA, 25 bp, Mus musculus
ccctgccacatcattcaaatattgg

SEQ ID NO: 246173 - DNA, 25 bp, Mus musculus
ccctgccacccaggttctgattgga

SEQ ID NO: 246174 - DNA, 25 bp, Mus musculus
ccctgccagaggttgagacagatcc

SEQ ID NO: 246175 - DNA, 25 bp, Mus musculus
ccctgccagatgaggatcatgcggc

SEQ ID NO: 246176 - DNA, 25 bp, Mus musculus
ccctgccagggatggcgcggccgat

SEQ ID NO: 246177 - DNA, 25 bp, Mus musculus
ccctgccagggctgatggtgaccgc

SEQ ID NO: 246178 - DNA, 25 bp, Mus musculus
ccctgccatcagatacaagcggaag

SEQ ID NO: 246179 - DNA, 25 bp, Mus musculus
ccctgccatgttggatgccgccttg

SEQ ID NO: 246180 - DNA, 25 bp, Mus musculus
ccctgccattctagatgtgaaggca

SEQ ID NO: 246181 - DNA, 25 bp, Mus musculus
ccctgccattctgatgaagttcctg

SEQ ID NO: 246182 - DNA, 25 bp, Mus musculus
ccctgccattcttattctgaggaag

SEQ ID NO: 246183 - DNA, 25 bp, Mus musculus
ccctgcccaagctgtgctggatgcc

SEQ ID NO: 246184 - DNA, 25 bp, Mus musculus
ccctgcccagagcctgaccccagga

SEQ ID NO: 246185 - DNA, 25 bp, Mus musculus
ccctgcccagagtgaacctgtgaga

SEQ ID NO: 246186 - DNA, 25 bp, Mus musculus
ccctgcccagatactccccccaggc

SEQ ID NO: 246187 - DNA, 25 bp, Mus musculus
ccctgcccagctgaggcaaaaggtg

SEQ ID NO: 246188 - DNA, 25 bp, Mus musculus
ccctgcccaggtgaggcaaaaggtg

SEQ ID NO: 246189 - DNA, 25 bp, Mus musculus
ccctgcccattgtgtcctggggcag

SEQ ID NO: 246190 - DNA, 25 bp, Mus musculus
ccctgccccagcaccacctaccctg

SEQ ID NO: 246191 - DNA, 25 bp, Mus musculus
ccctgccccagctctgggcgtggag

SEQ ID NO: 246192 - DNA, 25 bp, Mus musculus
ccctgccccaggacttctctgtgaa

SEQ ID NO: 246193 - DNA, 25 bp, Mus musculus
ccctgccccaggtggggaacctggg

SEQ ID NO: 246194 - DNA, 25 bp, Mus musculus
ccctgccccgctatgagcttgagga

SEQ ID NO: 246195 - DNA, 25 bp, Mus musculus
ccctgcccgagcgtttctagagcat

SEQ ID NO: 246196 - DNA, 25 bp, Mus musculus
ccctgcccgcctgtaagttccaggt

SEQ ID NO: 246197 - DNA, 25 bp, Mus musculus
ccctgcccgcctgtcgccttgaagc

SEQ ID NO: 246198 - DNA, 25 bp, Mus musculus
ccctgcccggaattctgatcaagaa

SEQ ID NO: 246199 - DNA, 25 bp, Mus musculus
ccctgccctcaaggtaatggatgac

SEQ ID NO: 246200 - DNA, 25 bp, Mus musculus
ccctgccctcaaggtggtgaagaaa

SEQ ID NO: 246201 - DNA, 25 bp, Mus musculus
ccctgccctgaaagtcccgagttta

SEQ ID NO: 246202 - DNA, 25 bp, Mus musculus
ccctgccgcgacctgaacacatgtc

SEQ ID NO: 246203 - DNA, 25 bp, Mus musculus
ccctgccgggctgtgcctctccttt

SEQ ID NO: 246204 - DNA, 25 bp, Mus musculus
ccctgcctaagccaaggaagtagca

SEQ ID NO: 246205 - DNA, 25 bp, Mus musculus
ccctgcctaccctaacccagaattg

SEQ ID NO: 246206 - DNA, 25 bp, Mus musculus
ccctgcctcagcccatacccagcca

SEQ ID NO: 246207 - DNA, 25 bp, Mus musculus
ccctgcctccagcactgggaagcaa

SEQ ID NO: 246208 - DNA, 25 bp, Mus musculus
ccctgcctccccactaccctccaac

SEQ ID NO: 246209 - DNA, 25 bp, Mus musculus
ccctgcctccctgagactctttgct

SEQ ID NO: 246210 - DNA, 25 bp, Mus musculus
ccctgcctccctgagcctccatgta

SEQ ID NO: 246211 - DNA, 25 bp, Mus musculus
ccctgcctccctgcccacaaagtga

SEQ ID NO: 246212 - DNA, 25 bp, Mus musculus
ccctgcctctcacagaatacatcca

SEQ ID NO: 246213 - DNA, 25 bp, Mus musculus
ccctgcctgagaagctcaaacaggc

SEQ ID NO: 246214 - DNA, 25 bp, Mus musculus
ccctgcctgagcaaggggaccagga

SEQ ID NO: 246215 - DNA, 25 bp, Mus musculus
ccctgcctgaggagctgcagaagtg

SEQ ID NO: 246216 - DNA, 25 bp, Mus musculus
ccctgcctgatgagctgggagacct

SEQ ID NO: 246217 - DNA, 25 bp, Mus musculus
ccctgcctgatgctgcctcacacaa

SEQ ID NO: 246218 - DNA, 25 bp, Mus musculus
ccctgcctggcacacaagccttcag

SEQ ID NO: 246219 - DNA, 25 bp, Mus musculus
ccctgcctggcacagaagccttcag

SEQ ID NO: 246220 - DNA, 25 bp, Mus musculus
ccctgcctgtcaggcttcctgcggg

SEQ ID NO: 246221 - DNA, 25 bp, Mus musculus
ccctgcctgtgggaagtgctttggg

SEQ ID NO: 246222 - DNA, 25 bp, Mus musculus
ccctgcctgtgggctcagtctccac

SEQ ID NO: 246223 - DNA, 25 bp, Mus musculus
ccctgccttcaaacgtgtttggact

SEQ ID NO: 246224 - DNA, 25 bp, Mus musculus
ccctgcgaatcggagccccagatcc

SEQ ID NO: 246225 - DNA, 25 bp, Mus musculus
ccctgcgaccaggtgacccaatgac

SEQ ID NO: 246226 - DNA, 25 bp, Mus musculus
ccctgcgagggtggctgctgctagc

SEQ ID NO: 246227 - DNA, 25 bp, Mus musculus
ccctgcgatgaatgcgtgtatgccc

SEQ ID NO: 246228 - DNA, 25 bp, Mus musculus
ccctgcgatgaatgggtgtatgccc

SEQ ID NO: 246229 - DNA, 25 bp, Mus musculus
ccctgcgcagatggtggacctgctg

SEQ ID NO: 246230 - DNA, 25 bp, Mus musculus
ccctgcgcagctcggcatttcagtc

SEQ ID NO: 246231 - DNA, 25 bp, Mus musculus
ccctgcgcctggagcaggaagggcc

SEQ ID NO: 246232 - DNA, 25 bp, Mus musculus
ccctgcgctgactgacatctactgc

SEQ ID NO: 246233 - DNA, 25 bp, Mus musculus
ccctgcggacacgtcttttgctctg

SEQ ID NO: 246234 - DNA, 25 bp, Mus musculus
ccctgcggacacgtgaatgtctgaa

SEQ ID NO: 246235 - DNA, 25 bp, Mus musculus
ccctgcggacacgtttcatcctatc

SEQ ID NO: 246236 - DNA, 25 bp, Mus musculus
ccctgcggagacagggggctcaccc

SEQ ID NO: 246237 - DNA, 25 bp, Mus musculus
ccctgcggagacaggtttcggccga

SEQ ID NO: 246238 - DNA, 25 bp, Mus musculus
ccctgcggagagaggaccaaatgga

SEQ ID NO: 246239 - DNA, 25 bp, Mus musculus
ccctgcggagagggttcttgaccac

SEQ ID NO: 246240 - DNA, 25 bp, Mus musculus
ccctgcggagagtaagcggaggcct

SEQ ID NO: 246241 - DNA, 25 bp, Mus musculus
ccctgcggccacgaaacgatcagca

SEQ ID NO: 246242 - DNA, 25 bp, Mus musculus
ccctgcggctgccagaaacttcagt

SEQ ID NO: 246243 - DNA, 25 bp, Mus musculus
ccctgcgggcacaggtggacgaccc

SEQ ID NO: 246244 - DNA, 25 bp, Mus musculus
ccctgcgtaccagcatcgagaaggt

SEQ ID NO: 246245 - DNA, 25 bp, Mus musculus
ccctgcgtaccaggtatggcatcag

SEQ ID NO: 246246 - DNA, 25 bp, Mus musculus
ccctgcgtaggagcaatacaccaag

SEQ ID NO: 246247 - DNA, 25 bp, Mus musculus
ccctgctaaatgttaggccggggct

SEQ ID NO: 246248 - DNA, 25 bp, Mus musculus
ccctgctacacgaggtgcagtgggt

SEQ ID NO: 246249 - DNA, 25 bp, Mus musculus
ccctgctacacgagtgggtggtgca

SEQ ID NO: 246250 - DNA, 25 bp, Mus musculus
ccctgctacagcaacttctcctggc

SEQ ID NO: 246251 - DNA, 25 bp, Mus musculus
ccctgctacattaataccctggagc

SEQ ID NO: 246252 - DNA, 25 bp, Mus musculus
ccctgctacctacggctctcttaag

SEQ ID NO: 246253 - DNA, 25 bp, Mus musculus
ccctgctacctacggggaacttgaa

SEQ ID NO: 246254 - DNA, 25 bp, Mus musculus
ccctgctagagacggtcgctcgcat

SEQ ID NO: 246255 - DNA, 25 bp, Mus musculus
ccctgctatgacactggctggaggt

SEQ ID NO: 246256 - DNA, 25 bp, Mus musculus
ccctgctatgggcatattgtattag

SEQ ID NO: 246257 - DNA, 25 bp, Mus musculus
ccctgctatgggcatattgtatttt

SEQ ID NO: 246258 - DNA, 25 bp, Mus musculus
ccctgctcagctgcgcatcctgcct

SEQ ID NO: 246259 - DNA, 25 bp, Mus musculus
ccctgctcagctgcgtcggcaccca

SEQ ID NO: 246260 - DNA, 25 bp, Mus musculus
ccctgctcattattcccccagaacc

SEQ ID NO: 246261 - DNA, 25 bp, Mus musculus
ccctgctccacaggtgttctacact

SEQ ID NO: 246262 - DNA, 25 bp, Mus musculus
ccctgctccaccttctcgagaaggg

SEQ ID NO: 246263 - DNA, 25 bp, Mus musculus
ccctgctcccatgcttatcattgca

SEQ ID NO: 246264 - DNA, 25 bp, Mus musculus
ccctgctccggcaagacattgcttt

SEQ ID NO: 246265 - DNA, 25 bp, Mus musculus
ccctgctcctgggcttgtggagaac

SEQ ID NO: 246266 - DNA, 25 bp, Mus musculus
ccctgctcctggtggcatctttagc

SEQ ID NO: 246267 - DNA, 25 bp, Mus musculus
ccctgctcctggtttctgaacttgg

SEQ ID NO: 246268 - DNA, 25 bp, Mus musculus
ccctgctctgttgtgtatccaggtg

SEQ ID NO: 246269 - DNA, 25 bp, Mus musculus
ccctgctgacgcagatcattaagtg

SEQ ID NO: 246270 - DNA, 25 bp, Mus musculus
ccctgctgacgcaggatcctaccca

SEQ ID NO: 246271 - DNA, 25 bp, Mus musculus
ccctgctgagcaaaggagtgattct

SEQ ID NO: 246272 - DNA, 25 bp, Mus musculus
ccctgctgcagtcagcaaaatatcc

SEQ ID NO: 246273 - DNA, 25 bp, Mus musculus
ccctgctgctagtaacgaaggcagt

SEQ ID NO: 246274 - DNA, 25 bp, Mus musculus
ccctgctgctggctgtcatctactt

SEQ ID NO: 246275 - DNA, 25 bp, Mus musculus
ccctgctgctgtggtgaaaggacaa

SEQ ID NO: 246276 - DNA, 25 bp, Mus musculus
ccctgctggacattcaggagcttct

SEQ ID NO: 246277 - DNA, 25 bp, Mus musculus
ccctgctggacctgttcagcccctc

SEQ ID NO: 246278 - DNA, 25 bp, Mus musculus
ccctgctggagaatgagagagaaaa

SEQ ID NO: 246279 - DNA, 25 bp, Mus musculus
ccctgctggaggagctgatgcactg

SEQ ID NO: 246280 - DNA, 25 bp, Mus musculus
ccctgctgggtcaggactaatgtaa

SEQ ID NO: 246281 - DNA, 25 bp, Mus musculus
ccctgctgggtcagggataaaaaga

SEQ ID NO: 246282 - DNA, 25 bp, Mus musculus
ccctgctgggtcaggtcaggaagca

SEQ ID NO: 246283 - DNA, 25 bp, Mus musculus
ccctgctgtcaacggggtctcattc

SEQ ID NO: 246284 - DNA, 25 bp, Mus musculus
ccctgctgtgggcagggtgcctggc

SEQ ID NO: 246285 - DNA, 25 bp, Mus musculus
ccctgctgttcctgattatctatta

SEQ ID NO: 246286 - DNA, 25 bp, Mus musculus
ccctgcttactggtttctctcgaag

SEQ ID NO: 246287 - DNA, 25 bp, Mus musculus
ccctgcttactggtttctgtctgat

SEQ ID NO: 246288 - DNA, 25 bp, Mus musculus
ccctgcttatgaaagccatcaccaa

SEQ ID NO: 246289 - DNA, 25 bp, Mus musculus
ccctgcttatgagtcagcagtgtat

SEQ ID NO: 246290 - DNA, 25 bp, Mus musculus
ccctgcttcagcaacttgatttctt

SEQ ID NO: 246291 - DNA, 25 bp, Mus musculus
ccctgcttcagcaagcttccctgtt

SEQ ID NO: 246292 - DNA, 25 bp, Mus musculus
ccctgcttccagcccctatgttact

SEQ ID NO: 246293 - DNA, 25 bp, Mus musculus
ccctgcttgcgaggcaggaaacagc

SEQ ID NO: 246294 - DNA, 25 bp, Mus musculus
ccctgcttgcgagggtgacacttcc

SEQ ID NO: 246295 - DNA, 25 bp, Mus musculus
ccctgctttagtttcctgacaggca

SEQ ID NO: 246296 - DNA, 25 bp, Mus musculus
ccctgcttttataagacaggaaaag

SEQ ID NO: 246297 - DNA, 25 bp, Mus musculus
ccctgcttttataagatgaagacag

SEQ ID NO: 246298 - DNA, 25 bp, Mus musculus
ccctgcttttataagtctttgcaga

SEQ ID NO: 246299 - DNA, 25 bp, Mus musculus
ccctgctttttggagaggacgacct

SEQ ID NO: 246300 - DNA, 25 bp, Mus musculus
ccctggaaaagcctgaaaatcagga

SEQ ID NO: 246301 - DNA, 25 bp, Mus musculus
ccctggaacctgatctaacaaacat

SEQ ID NO: 246302 - DNA, 25 bp, Mus musculus
ccctggaacgggtgaagttgattcc

SEQ ID NO: 246303 - DNA, 25 bp, Mus musculus
ccctggaagcaggagcctccagaca

SEQ ID NO: 246304 - DNA, 25 bp, Mus musculus
ccctggaagctgaggacctacctgt

SEQ ID NO: 246305 - DNA, 25 bp, Mus musculus
ccctggaagctgcagactttgtggt

SEQ ID NO: 246306 - DNA, 25 bp, Mus musculus
ccctggaaggaactatgctgttggc

SEQ ID NO: 246307 - DNA, 25 bp, Mus musculus
ccctggaaggggagccccgcaaggt

SEQ ID NO: 246308 - DNA, 25 bp, Mus musculus
ccctggaagtatttgatcctgtgcc

SEQ ID NO: 246309 - DNA, 25 bp, Mus musculus
ccctggaagtatttgccagatcttc

SEQ ID NO: 246310 - DNA, 25 bp, Mus musculus
ccctggacaaatgtcccttcactgt

SEQ ID NO: 246311 - DNA, 25 bp, Mus musculus
ccctggacaacaagaaggggcgaag

SEQ ID NO: 246312 - DNA, 25 bp, Mus musculus
ccctggacaagctgtggccagcgtc

SEQ ID NO: 246313 - DNA, 25 bp, Mus musculus
ccctggacaagttaatcgatggcat

SEQ ID NO: 246314 - DNA, 25 bp, Mus musculus
ccctggacaatggtgaacaacccag

SEQ ID NO: 246315 - DNA, 25 bp, Mus musculus
ccctggacagcaagccccgcccaac

SEQ ID NO: 246316 - DNA, 25 bp, Mus musculus
ccctggacagccccggcagcccaac

SEQ ID NO: 246317 - DNA, 25 bp, Mus musculus
ccctggaccaaggtgcttcacctgg

SEQ ID NO: 246318 - DNA, 25 bp, Mus musculus
ccctggaccacagtgctgccatagt

SEQ ID NO: 246319 - DNA, 25 bp, Mus musculus
ccctggaccacagtgggcctgtgct

SEQ ID NO: 246320 - DNA, 25 bp, Mus musculus
ccctggaccacctctgccctcccaa

SEQ ID NO: 246321 - DNA, 25 bp, Mus musculus
ccctggaccaggtgaaaaaagccct

SEQ ID NO: 246322 - DNA, 25 bp, Mus musculus
ccctggaccattttagactacatcc

SEQ ID NO: 246323 - DNA, 25 bp, Mus musculus
ccctggacccaaaggccctgcctgc

SEQ ID NO: 246324 - DNA, 25 bp, Mus musculus
ccctggacccaggctgccctgccct

SEQ ID NO: 246325 - DNA, 25 bp, Mus musculus
ccctggaccccatggcccctcaccg

SEQ ID NO: 246326 - DNA, 25 bp, Mus musculus
ccctggaccccgagatccagttgga

SEQ ID NO: 246327 - DNA, 25 bp, Mus musculus
ccctggaccccgaggcactgcctct

SEQ ID NO: 246328 - DNA, 25 bp, Mus musculus
ccctggaccgggagcagaatggaga

SEQ ID NO: 246329 - DNA, 25 bp, Mus musculus
ccctggacctgggctcccagaggct

SEQ ID NO: 246330 - DNA, 25 bp, Mus musculus
ccctggacgaccggcgtgtgcagcc

SEQ ID NO: 246331 - DNA, 25 bp, Mus musculus
ccctggacgaccgtatctggactag

SEQ ID NO: 246332 - DNA, 25 bp, Mus musculus
ccctggacgcttgcctttgtctgga

SEQ ID NO: 246333 - DNA, 25 bp, Mus musculus
ccctggacgcttgtcaccagatttc

SEQ ID NO: 246334 - DNA, 25 bp, Mus musculus
ccctggacggcaggtgaagtggaag

SEQ ID NO: 246335 - DNA, 25 bp, Mus musculus
ccctggacgttgagtgtggaaaatg

SEQ ID NO: 246336 - DNA, 25 bp, Mus musculus
ccctggactaaggatcaccactact

SEQ ID NO: 246337 - DNA, 25 bp, Mus musculus
ccctggactccagggctgacagctt

SEQ ID NO: 246338 - DNA, 25 bp, Mus musculus
ccctggactgctgtaagtgtggaca

SEQ ID NO: 246339 - DNA, 25 bp, Mus musculus
ccctggactggaaggaaatctacaa

SEQ ID NO: 246340 - DNA, 25 bp, Mus musculus
ccctggacttcagaaccagcagctg

SEQ ID NO: 246341 - DNA, 25 bp, Mus musculus
ccctggacttcagggagaggaacag

SEQ ID NO: 246342 - DNA, 25 bp, Mus musculus
ccctggagaacggggaagtctagga

SEQ ID NO: 246343 - DNA, 25 bp, Mus musculus
ccctggagaaggatatgaatcagag

SEQ ID NO: 246344 - DNA, 25 bp, Mus musculus
ccctggagaaggcgtgggtgactga

SEQ ID NO: 246345 - DNA, 25 bp, Mus musculus
ccctggagaagtcaaacaggtgact

SEQ ID NO: 246346 - DNA, 25 bp, Mus musculus
ccctggagacctggccaaccgctgc

SEQ ID NO: 246347 - DNA, 25 bp, Mus musculus
ccctggagagagaggtgctcctggc

SEQ ID NO: 246348 - DNA, 25 bp, Mus musculus
ccctggagagcaatatggtacctca

SEQ ID NO: 246349 - DNA, 25 bp, Mus musculus
ccctggagctagcatctcgctctcc

SEQ ID NO: 246350 - DNA, 25 bp, Mus musculus
ccctggagctagcatgctcacgcac

SEQ ID NO: 246351 - DNA, 25 bp, Mus musculus
ccctggagctcagcacaggggatga

SEQ ID NO: 246352 - DNA, 25 bp, Mus musculus
ccctggaggaaggaattctttgtgt

SEQ ID NO: 246353 - DNA, 25 bp, Mus musculus
ccctggaggagcagaattttctaca

SEQ ID NO: 246354 - DNA, 25 bp, Mus musculus
ccctggaggctgccacccgtctcta

SEQ ID NO: 246355 - DNA, 25 bp, Mus musculus
ccctggagtccatgtgtaaagagct

SEQ ID NO: 246356 - DNA, 25 bp, Mus musculus
ccctggatcaaaggcctacagtttc

SEQ ID NO: 246357 - DNA, 25 bp, Mus musculus
ccctggatcaccaggtgttgatgct

SEQ ID NO: 246358 - DNA, 25 bp, Mus musculus
ccctggatccaggcttacaattact

SEQ ID NO: 246359 - DNA, 25 bp, Mus musculus
ccctggatccaggtgaaccttctgc

SEQ ID NO: 246360 - DNA, 25 bp, Mus musculus
ccctggatctggtcttctaggggac

SEQ ID NO: 246361 - DNA, 25 bp, Mus musculus
ccctggatgagcaagaaggagttaa

SEQ ID NO: 246362 - DNA, 25 bp, Mus musculus
ccctggatgatgggctaggccatgg

SEQ ID NO: 246363 - DNA, 25 bp, Mus musculus
ccctggatgatggtgtgattgccag

SEQ ID NO: 246364 - DNA, 25 bp, Mus musculus
ccctggatggggtggtgaagcgagc

SEQ ID NO: 246365 - DNA, 25 bp, Mus musculus
ccctggattcagtcatttgaagact

SEQ ID NO: 246366 - DNA, 25 bp, Mus musculus
ccctggcaaaaggtgcccgaggtga

SEQ ID NO: 246367 - DNA, 25 bp, Mus musculus
ccctggcaacagtgatccggagcat

SEQ ID NO: 246368 - DNA, 25 bp, Mus musculus
ccctggcaagaggtccgtcttccac

SEQ ID NO: 246369 - DNA, 25 bp, Mus musculus
ccctggcaagcaagaacaaggatga

SEQ ID NO: 246370 - DNA, 25 bp, Mus musculus
ccctggcacaaggcaggcgacaagc

SEQ ID NO: 246371 - DNA, 25 bp, Mus musculus
ccctggcacaaggtaacacggaagt

SEQ ID NO: 246372 - DNA, 25 bp, Mus musculus
ccctggcacacgccccaaggaaagt

SEQ ID NO: 246373 - DNA, 25 bp, Mus musculus
ccctggcacagaaacatcatccaag

SEQ ID NO: 246374 - DNA, 25 bp, Mus musculus
ccctggcactgcaagtttccccagc

SEQ ID NO: 246375 - DNA, 25 bp, Mus musculus
ccctggcactgtgaaaattccacct

SEQ ID NO: 246376 - DNA, 25 bp, Mus musculus
ccctggcagcgataggaaggacctg

SEQ ID NO: 246377 - DNA, 25 bp, Mus musculus
ccctggcagcgataggcttcattct

SEQ ID NO: 246378 - DNA, 25 bp, Mus musculus
ccctggcagcgatagggcttaccca

SEQ ID NO: 246379 - DNA, 25 bp, Mus musculus
ccctggcagcgataggtcacttgcc

SEQ ID NO: 246380 - DNA, 25 bp, Mus musculus
ccctggcaggaaggagactgcggcc

SEQ ID NO: 246381 - DNA, 25 bp, Mus musculus
ccctggcaggtgcacaggctgctga

SEQ ID NO: 246382 - DNA, 25 bp, Mus musculus
ccctggcaggtgtccctgccgtgtg

SEQ ID NO: 246383 - DNA, 25 bp, Mus musculus
ccctggcattagggcaggctggata

SEQ ID NO: 246384 - DNA, 25 bp, Mus musculus
ccctggcattagtacactgtagctg

SEQ ID NO: 246385 - DNA, 25 bp, Mus musculus
ccctggccaaggtcctggacaatac

SEQ ID NO: 246386 - DNA, 25 bp, Mus musculus
ccctggccagagtcatggatttgat

SEQ ID NO: 246387 - DNA, 25 bp, Mus musculus
ccctggcccgccaggactgcagtaa

SEQ ID NO: 246388 - DNA, 25 bp, Mus musculus
ccctggccctcacaagtggccaatc

SEQ ID NO: 246389 - DNA, 25 bp, Mus musculus
ccctggcccttagagtaatccatat

SEQ ID NO: 246390 - DNA, 25 bp, Mus musculus
ccctggccgagaggggagcccagag

SEQ ID NO: 246391 - DNA, 25 bp, Mus musculus
ccctggccgaggaagccgagatacc

SEQ ID NO: 246392 - DNA, 25 bp, Mus musculus
ccctggcctccctgggccccaagga

SEQ ID NO: 246393 - DNA, 25 bp, Mus musculus
ccctggcctgagaagcctgtacagc

SEQ ID NO: 246394 - DNA, 25 bp, Mus musculus
ccctggcctgattgcagcccgggag

SEQ ID NO: 246395 - DNA, 25 bp, Mus musculus
ccctggcctgcctgagggatctgag

SEQ ID NO: 246396 - DNA, 25 bp, Mus musculus
ccctggccttggaggtttgcctgga

SEQ ID NO: 246397 - DNA, 25 bp, Mus musculus
ccctggcgaccaggcttcagatgct

SEQ ID NO: 246398 - DNA, 25 bp, Mus musculus
ccctggcgacggttaccacagtgga

SEQ ID NO: 246399 - DNA, 25 bp, Mus musculus
ccctggcgagaggagggctctggtc

SEQ ID NO: 246400 - DNA, 25 bp, Mus musculus
ccctggcgagaggaggtctcgaagt

SEQ ID NO: 246401 - DNA, 25 bp, Mus musculus
ccctggcgcccagggcaaggacagc

SEQ ID NO: 246402 - DNA, 25 bp, Mus musculus
ccctggcgcccagtgagtgaacccc

SEQ ID NO: 246403 - DNA, 25 bp, Mus musculus
ccctggcgggaggcgcaacagcgtg

SEQ ID NO: 246404 - DNA, 25 bp, Mus musculus
ccctggcgggagggctcaggatccg

SEQ ID NO: 246405 - DNA, 25 bp, Mus musculus
ccctggcggttcacaagagcaagat

SEQ ID NO: 246406 - DNA, 25 bp, Mus musculus
ccctggctaagcaagcttccctgtt

SEQ ID NO: 246407 - DNA, 25 bp, Mus musculus
ccctggctagtgcaaagatcagcta

SEQ ID NO: 246408 - DNA, 25 bp, Mus musculus
ccctggctccactgtcttatatcgg

SEQ ID NO: 246409 - DNA, 25 bp, Mus musculus
ccctggctctggaccctcttctagc

SEQ ID NO: 246410 - DNA, 25 bp, Mus musculus
ccctggctgaggcagagcagctgat

SEQ ID NO: 246411 - DNA, 25 bp, Mus musculus
ccctggctgagtatgagcccagagg

SEQ ID NO: 246412 - DNA, 25 bp, Mus musculus
ccctggctgggggatgggctcttcc

SEQ ID NO: 246413 - DNA, 25 bp, Mus musculus
ccctggctgtttatcgcaggaggca

SEQ ID NO: 246414 - DNA, 25 bp, Mus musculus
ccctgggaaaaggacgctattacaa

SEQ ID NO: 246415 - DNA, 25 bp, Mus musculus
ccctgggaaaggtgctgggtgtgtg

SEQ ID NO: 246416 - DNA, 25 bp, Mus musculus
ccctgggaagactaaaatgtcaaaa

SEQ ID NO: 246417 - DNA, 25 bp, Mus musculus
ccctgggacaacagtttacctacgt

SEQ ID NO: 246418 - DNA, 25 bp, Mus musculus
ccctgggactagctcaggccctgga

SEQ ID NO: 246419 - DNA, 25 bp, Mus musculus
ccctgggagcaggaattaccttgca

SEQ ID NO: 246420 - DNA, 25 bp, Mus musculus
ccctgggattaggagtgccaggagg

SEQ ID NO: 246421 - DNA, 25 bp, Mus musculus
ccctgggcagaaaggtgatcgaggg

SEQ ID NO: 246422 - DNA, 25 bp, Mus musculus
ccctgggcaggctgctggttgtcta

SEQ ID NO: 246423 - DNA, 25 bp, Mus musculus
ccctgggcaggtgttttagctcacc

SEQ ID NO: 246424 - DNA, 25 bp, Mus musculus
ccctgggccacagggtcctactgga

SEQ ID NO: 246425 - DNA, 25 bp, Mus musculus
ccctgggccccaagggcttctagac

SEQ ID NO: 246426 - DNA, 25 bp, Mus musculus
ccctgggcctagcagtggcatcttt

SEQ ID NO: 246427 - DNA, 25 bp, Mus musculus
ccctgggccttgtgttttttcagtt

SEQ ID NO: 246428 - DNA, 25 bp, Mus musculus
ccctgggctggtggctctcgagggc

SEQ ID NO: 246429 - DNA, 25 bp, Mus musculus
ccctgggctgtggtggtgagaagct

SEQ ID NO: 246430 - DNA, 25 bp, Mus musculus
ccctgggcttgaagaaccagtagtc

SEQ ID NO: 246431 - DNA, 25 bp, Mus musculus
ccctggggaaagctactgggatgga

SEQ ID NO: 246432 - DNA, 25 bp, Mus musculus
ccctggggaagaagagtctgaggaa

SEQ ID NO: 246433 - DNA, 25 bp, Mus musculus
ccctggggagagatctccatagtag

SEQ ID NO: 246434 - DNA, 25 bp, Mus musculus
ccctggggagccttttgcccttctt

SEQ ID NO: 246435 - DNA, 25 bp, Mus musculus
ccctggggatccgagagactcggga

SEQ ID NO: 246436 - DNA, 25 bp, Mus musculus
ccctggggccgaaggcctgggatgg

SEQ ID NO: 246437 - DNA, 25 bp, Mus musculus
ccctgggggccaagtgctcaccgag

SEQ ID NO: 246438 - DNA, 25 bp, Mus musculus
ccctgggggtcactggagtcgctgg

SEQ ID NO: 246439 - DNA, 25 bp, Mus musculus
ccctggggttatgagggctggagac

SEQ ID NO: 246440 - DNA, 25 bp, Mus musculus
ccctgggtcagaagcatactgagga

SEQ ID NO: 246441 - DNA, 25 bp, Mus musculus
ccctgggtcagaagcatacttagac

SEQ ID NO: 246442 - DNA, 25 bp, Mus musculus
ccctgggtgcagggggaacagctgt

SEQ ID NO: 246443 - DNA, 25 bp, Mus musculus
ccctgggtgcaggggtgtgccccag

SEQ ID NO: 246444 - DNA, 25 bp, Mus musculus
ccctgggtgtcactggtgcagactg

SEQ ID NO: 246445 - DNA, 25 bp, Mus musculus
ccctgggtgtcagatgatgcatccc

SEQ ID NO: 246446 - DNA, 25 bp, Mus musculus
ccctgggtgtgagattctctccaga

SEQ ID NO: 246447 - DNA, 25 bp, Mus musculus
ccctgggttcctagctggaggaaat

SEQ ID NO: 246448 - DNA, 25 bp, Mus musculus
ccctgggttcctaggtccagctgga

SEQ ID NO: 246449 - DNA, 25 bp, Mus musculus
ccctgggtttaaagacagtatttga

SEQ ID NO: 246450 - DNA, 25 bp, Mus musculus
ccctggtaaatgctactgagtgaca

SEQ ID NO: 246451 - DNA, 25 bp, Mus musculus
ccctggtaactgctgggggctctct

SEQ ID NO: 246452 - DNA, 25 bp, Mus musculus
ccctggtacagcaaccttccatggc

SEQ ID NO: 246453 - DNA, 25 bp, Mus musculus
ccctggtacagcaagcttccctgct

SEQ ID NO: 246454 - DNA, 25 bp, Mus musculus
ccctggtacagcaagcttccctggc

SEQ ID NO: 246455 - DNA, 25 bp, Mus musculus
ccctggtacagcaagcttccctgtt

SEQ ID NO: 246456 - DNA, 25 bp, Mus musculus
ccctggtacagcaagctttcctggc

SEQ ID NO: 246457 - DNA, 25 bp, Mus musculus
ccctggtactgtccgcatgagacac

SEQ ID NO: 246458 - DNA, 25 bp, Mus musculus
ccctggtagcccaggccaccatggc

SEQ ID NO: 246459 - DNA, 25 bp, Mus musculus
ccctggtcacaggtgcgggtagcgg

SEQ ID NO: 246460 - DNA, 25 bp, Mus musculus
ccctggtcaggagtgctgcaaagat

SEQ ID NO: 246461 - DNA, 25 bp, Mus musculus
ccctggtcaggcactcggacatgcc

SEQ ID NO: 246462 - DNA, 25 bp, Mus musculus
ccctggtcaggcagttccagggcca

SEQ ID NO: 246463 - DNA, 25 bp, Mus musculus
ccctggtccaggtgaaatcgccctg

SEQ ID NO: 246464 - DNA, 25 bp, Mus musculus
ccctggtcccccaataccgtgactg

SEQ ID NO: 246465 - DNA, 25 bp, Mus musculus
ccctggtcctgctggcttccctggt

SEQ ID NO: 246466 - DNA, 25 bp, Mus musculus
ccctggtcctgtgggtctccctggt

SEQ ID NO: 246467 - DNA, 25 bp, Mus musculus
ccctggtcctgtgggtgaaccaggt

SEQ ID NO: 246468 - DNA, 25 bp, Mus musculus
ccctggtcctgtgggtgagcaaggc

SEQ ID NO: 246469 - DNA, 25 bp, Mus musculus
ccctggtcgtaatggagatagggca

SEQ ID NO: 246470 - DNA, 25 bp, Mus musculus
ccctggtctccctggggcatcagcc

SEQ ID NO: 246471 - DNA, 25 bp, Mus musculus
ccctggtgaatggggtcagtggtga

SEQ ID NO: 246472 - DNA, 25 bp, Mus musculus
ccctggtgattaggacaaagccaaa

SEQ ID NO: 246473 - DNA, 25 bp, Mus musculus
ccctggtgcaagagagtgtccaagc

SEQ ID NO: 246474 - DNA, 25 bp, Mus musculus
ccctggtgcacctggtccacaaggt

SEQ ID NO: 246475 - DNA, 25 bp, Mus musculus
ccctggtgcccagagagaggcagga

SEQ ID NO: 246476 - DNA, 25 bp, Mus musculus
ccctggtggatcagctggaaaacag

SEQ ID NO: 246477 - DNA, 25 bp, Mus musculus
ccctggtggcaggatcaagttctct

SEQ ID NO: 246478 - DNA, 25 bp, Mus musculus
ccctggtgtacagggatcagaacaa

SEQ ID NO: 246479 - DNA, 25 bp, Mus musculus
ccctggttaacctgattcctggttt

SEQ ID NO: 246480 - DNA, 25 bp, Mus musculus
ccctggttaacctggatggggaggt

SEQ ID NO: 246481 - DNA, 25 bp, Mus musculus
ccctggttaacctgggagtttctgc

SEQ ID NO: 246482 - DNA, 25 bp, Mus musculus
ccctggttcctgtctgcagctgtgt

SEQ ID NO: 246483 - DNA, 25 bp, Mus musculus
ccctggttgctgtggccctctgatt

SEQ ID NO: 246484 - DNA, 25 bp, Mus musculus
ccctgtaaaagatttctaacgagcg

SEQ ID NO: 246485 - DNA, 25 bp, Mus musculus
ccctgtaaatggcttgctgaaaggg

SEQ ID NO: 246486 - DNA, 25 bp, Mus musculus
ccctgtaacaagcttaaatccagtg

SEQ ID NO: 246487 - DNA, 25 bp, Mus musculus
ccctgtaacagccaaacaccatgtc

SEQ ID NO: 246488 - DNA, 25 bp, Mus musculus
ccctgtaacaggaatgggctgcttc

SEQ ID NO: 246489 - DNA, 25 bp, Mus musculus
ccctgtacaaaggggcagccacaga

SEQ ID NO: 246490 - DNA, 25 bp, Mus musculus
ccctgtacagagagctccaagtcct

SEQ ID NO: 246491 - DNA, 25 bp, Mus musculus
ccctgtacagagccaccttgtctcc

SEQ ID NO: 246492 - DNA, 25 bp, Mus musculus
ccctgtacccagatgaagttgcctg

SEQ ID NO: 246493 - DNA, 25 bp, Mus musculus
ccctgtacctcccacccttggactc

SEQ ID NO: 246494 - DNA, 25 bp, Mus musculus
ccctgtacgacgatgacgtggcgca

SEQ ID NO: 246495 - DNA, 25 bp, Mus musculus
ccctgtactgcattaacttcagcca

SEQ ID NO: 246496 - DNA, 25 bp, Mus musculus
ccctgtactgtgacaagggcactgt

SEQ ID NO: 246497 - DNA, 25 bp, Mus musculus
ccctgtatattcagggtcacagctt

SEQ ID NO: 246498 - DNA, 25 bp, Mus musculus
ccctgtcaagattgagattcccctc

SEQ ID NO: 246499 - DNA, 25 bp, Mus musculus
ccctgtcacagattgaaatggatgc

SEQ ID NO: 246500 - DNA, 25 bp, Mus musculus
ccctgtcacccctgtatatcaacct

SEQ ID NO: 246501 - DNA, 25 bp, Mus musculus
ccctgtcacctacatggataagaat

SEQ ID NO: 246502 - DNA, 25 bp, Mus musculus
ccctgtcagaatgatcatgcgtcca

SEQ ID NO: 246503 - DNA, 25 bp, Mus musculus
ccctgtcagactttgtagacacgct

SEQ ID NO: 246504 - DNA, 25 bp, Mus musculus
ccctgtcagagtttgtagacacgct

SEQ ID NO: 246505 - DNA, 25 bp, Mus musculus
ccctgtcaggagaagagtctgttca

SEQ ID NO: 246506 - DNA, 25 bp, Mus musculus
ccctgtcaggagaagtggctggtga

SEQ ID NO: 246507 - DNA, 25 bp, Mus musculus
ccctgtcatcagattgatcttttca

SEQ ID NO: 246508 - DNA, 25 bp, Mus musculus
ccctgtccaaagatctcaccacatc

SEQ ID NO: 246509 - DNA, 25 bp, Mus musculus
ccctgtccaaaggaccatgaccttg

SEQ ID NO: 246510 - DNA, 25 bp, Mus musculus
ccctgtccaaaggaggagaccttgg

SEQ ID NO: 246511 - DNA, 25 bp, Mus musculus
ccctgtccaaaggcctcaatctaaa

SEQ ID NO: 246512 - DNA, 25 bp, Mus musculus
ccctgtccaagcccacaggactgca

SEQ ID NO: 246513 - DNA, 25 bp, Mus musculus
ccctgtccaggtagctctggctggc

SEQ ID NO: 246514 - DNA, 25 bp, Mus musculus
ccctgtcccgaggacaagaagatgc

SEQ ID NO: 246515 - DNA, 25 bp, Mus musculus
ccctgtccgtcaagtttggaaatga

SEQ ID NO: 246516 - DNA, 25 bp, Mus musculus
ccctgtcctaggtagcagaggcagc

SEQ ID NO: 246517 - DNA, 25 bp, Mus musculus
ccctgtccttcgggtactatgggtt

SEQ ID NO: 246518 - DNA, 25 bp, Mus musculus
ccctgtcgccattggatcatctgtc

SEQ ID NO: 246519 - DNA, 25 bp, Mus musculus
ccctgtcgcctgtctgccacaactt

SEQ ID NO: 246520 - DNA, 25 bp, Mus musculus
ccctgtcggtgagatgggtgcaagg

SEQ ID NO: 246521 - DNA, 25 bp, Mus musculus
ccctgtcgtatagagtctgaaggaa

SEQ ID NO: 246522 - DNA, 25 bp, Mus musculus
ccctgtctcggtgctcttcaaatgt

SEQ ID NO: 246523 - DNA, 25 bp, Mus musculus
ccctgtctcggtgtccttcccgtcg

SEQ ID NO: 246524 - DNA, 25 bp, Mus musculus
ccctgtctctcagaactgagggggc

SEQ ID NO: 246525 - DNA, 25 bp, Mus musculus
ccctgtctctccggatggacctgat

SEQ ID NO: 246526 - DNA, 25 bp, Mus musculus
ccctgtctctccggcccccgcgcgc

SEQ ID NO: 246527 - DNA, 25 bp, Mus musculus
ccctgtctctttggtcaagacagct

SEQ ID NO: 246528 - DNA, 25 bp, Mus musculus
ccctgtctgaaggatctcacataac

SEQ ID NO: 246529 - DNA, 25 bp, Mus musculus
ccctgtctgaaggcacttctggatc

SEQ ID NO: 246530 - DNA, 25 bp, Mus musculus
ccctgtctgtacctacagccgggtg

SEQ ID NO: 246531 - DNA, 25 bp, Mus musculus
ccctgtctgtggccaggagggccgt

SEQ ID NO: 246532 - DNA, 25 bp, Mus musculus
ccctgtctgttgcggtggcactgct

SEQ ID NO: 246533 - DNA, 25 bp, Mus musculus
ccctgtctttattagatgatgcagt

SEQ ID NO: 246534 - DNA, 25 bp, Mus musculus
ccctgtctttggagatctctgacat

SEQ ID NO: 246535 - DNA, 25 bp, Mus musculus
ccctgtgaacacaagggtcatccaa

SEQ ID NO: 246536 - DNA, 25 bp, Mus musculus
ccctgtgaacctgaaaaatcatgtg

SEQ ID NO: 246537 - DNA, 25 bp, Mus musculus
ccctgtgaacctgacgtggccattc

SEQ ID NO: 246538 - DNA, 25 bp, Mus musculus
ccctgtgacacctgttgagggcgag

SEQ ID NO: 246539 - DNA, 25 bp, Mus musculus
ccctgtgacattctgctgggctttg

SEQ ID NO: 246540 - DNA, 25 bp, Mus musculus
ccctgtgacattgtgctgggctttg

SEQ ID NO: 246541 - DNA, 25 bp, Mus musculus
ccctgtgacgaaagaagaaattaaa

SEQ ID NO: 246542 - DNA, 25 bp, Mus musculus
ccctgtgacgaatggcacacgaaac

SEQ ID NO: 246543 - DNA, 25 bp, Mus musculus
ccctgtgagctgcaaaaggaagttc

SEQ ID NO: 246544 - DNA, 25 bp, Mus musculus
ccctgtgataaagaccagaatatgg

SEQ ID NO: 246545 - DNA, 25 bp, Mus musculus
ccctgtgataaaggtgtccccaagg

SEQ ID NO: 246546 - DNA, 25 bp, Mus musculus
ccctgtgatcctccgcaatgcacgg

SEQ ID NO: 246547 - DNA, 25 bp, Mus musculus
ccctgtgcaccaggtacaagcagtc

SEQ ID NO: 246548 - DNA, 25 bp, Mus musculus
ccctgtgcacctctcctcttgtgtc

SEQ ID NO: 246549 - DNA, 25 bp, Mus musculus
ccctgtgcagatttccctcagggtg

SEQ ID NO: 246550 - DNA, 25 bp, Mus musculus
ccctgtgcagccttgtgacagattt

SEQ ID NO: 246551 - DNA, 25 bp, Mus musculus
ccctgtgcagtatcgtaccgagaag

SEQ ID NO: 246552 - DNA, 25 bp, Mus musculus
ccctgtgccagagaggaccccggag

SEQ ID NO: 246553 - DNA, 25 bp, Mus musculus
ccctgtgcccacaaggttcttgttc

SEQ ID NO: 246554 - DNA, 25 bp, Mus musculus
ccctgtgcgctgctcccgccagtga

SEQ ID NO: 246555 - DNA, 25 bp, Mus musculus
ccctgtgcgggccatcaattaccca

SEQ ID NO: 246556 - DNA, 25 bp, Mus musculus
ccctgtgcgggttgccgatgctgct

SEQ ID NO: 246557 - DNA, 25 bp, Mus musculus
ccctgtgctggtggatattcattag

SEQ ID NO: 246558 - DNA, 25 bp, Mus musculus
ccctgtggaacagccgtgtaggttt

SEQ ID NO: 246559 - DNA, 25 bp, Mus musculus
ccctgtggacttagggctgaccagt

SEQ ID NO: 246560 - DNA, 25 bp, Mus musculus
ccctgtggacttaggtgacaagttc

SEQ ID NO: 246561 - DNA, 25 bp, Mus musculus
ccctgtggagaggagatacttcaag

SEQ ID NO: 246562 - DNA, 25 bp, Mus musculus
ccctgtggaggagtctctatggaag

SEQ ID NO: 246563 - DNA, 25 bp, Mus musculus
ccctgtggcaggtgaccttggacaa

SEQ ID NO: 246564 - DNA, 25 bp, Mus musculus
ccctgtggcagtggaggtgaagccg

SEQ ID NO: 246565 - DNA, 25 bp, Mus musculus
ccctgtggcataaggtgatgttccc

SEQ ID NO: 246566 - DNA, 25 bp, Mus musculus
ccctgtggctatattgctgccttcc

SEQ ID NO: 246567 - DNA, 25 bp, Mus musculus
ccctgtggctgatcgcgtggctgag

SEQ ID NO: 246568 - DNA, 25 bp, Mus musculus
ccctgtggctgatctcttcattggg

SEQ ID NO: 246569 - DNA, 25 bp, Mus musculus
ccctgtggctgatgtatgtgtaagt

SEQ ID NO: 246570 - DNA, 25 bp, Mus musculus
ccctgtggcttcattttccagttcc

SEQ ID NO: 246571 - DNA, 25 bp, Mus musculus
ccctgtgggaagcccccggcagcag

SEQ ID NO: 246572 - DNA, 25 bp, Mus musculus
ccctgtgggtttcaggatccagccg

SEQ ID NO: 246573 - DNA, 25 bp, Mus musculus
ccctgtggtagcagacccaacagtt

SEQ ID NO: 246574 - DNA, 25 bp, Mus musculus
ccctgtgtgaaggagcttctgcgtt

SEQ ID NO: 246575 - DNA, 25 bp, Mus musculus
ccctgtgtgagagtgtggctatctt

SEQ ID NO: 246576 - DNA, 25 bp, Mus musculus
ccctgtgtgcaaagctgtgccaccg

SEQ ID NO: 246577 - DNA, 25 bp, Mus musculus
ccctgtgtttgtggtcctccactct

SEQ ID NO: 246578 - DNA, 25 bp, Mus musculus
ccctgtgtttgtggtctttgctgat

SEQ ID NO: 246579 - DNA, 25 bp, Mus musculus
ccctgttacctcgccgagctggaat

SEQ ID NO: 246580 - DNA, 25 bp, Mus musculus
ccctgttcactcaacagacctgaca

SEQ ID NO: 246581 - DNA, 25 bp, Mus musculus
ccctgttcagagccctgaagacaag

SEQ ID NO: 246582 - DNA, 25 bp, Mus musculus
ccctgttcagagggagagccgagag

SEQ ID NO: 246583 - DNA, 25 bp, Mus musculus
ccctgttcagaggtcctgatagctc

SEQ ID NO: 246584 - DNA, 25 bp, Mus musculus
ccctgttctggtgattgaggctgac

SEQ ID NO: 246585 - DNA, 25 bp, Mus musculus
ccctgttgacaatatctttaatgct

SEQ ID NO: 246586 - DNA, 25 bp, Mus musculus
ccctgttgacgaacctaaaactaat

SEQ ID NO: 246587 - DNA, 25 bp, Mus musculus
ccctgttgagcaggccacagaagga

SEQ ID NO: 246588 - DNA, 25 bp, Mus musculus
ccctgttgaggtttttcatcttgaa

SEQ ID NO: 246589 - DNA, 25 bp, Mus musculus
ccctgttgcagccccaccatggagc

SEQ ID NO: 246590 - DNA, 25 bp, Mus musculus
ccctgttgcaggttctgccaccagc

SEQ ID NO: 246591 - DNA, 25 bp, Mus musculus
ccctgttggagaaacactgaggacg

SEQ ID NO: 246592 - DNA, 25 bp, Mus musculus
ccctgttggagaaactggcagagct

SEQ ID NO: 246593 - DNA, 25 bp, Mus musculus
ccctgtttcagcaaccttccatggc

SEQ ID NO: 246594 - DNA, 25 bp, Mus musculus
ccctgtttcagcaaccttccctgct

SEQ ID NO: 246595 - DNA, 25 bp, Mus musculus
ccctgtttcagcaaccttccctggt

SEQ ID NO: 246596 - DNA, 25 bp, Mus musculus
ccctgtttcagcaagcttccctgct

SEQ ID NO: 246597 - DNA, 25 bp, Mus musculus
ccctgtttcagcaagcttccctgtt

SEQ ID NO: 246598 - DNA, 25 bp, Mus musculus
ccctgtttcagcaagtttccccagc

SEQ ID NO: 246599 - DNA, 25 bp, Mus musculus
ccctgtttcagcaatcttccctggt

SEQ ID NO: 246600 - DNA, 25 bp, Mus musculus
ccctgtttcagcttccctgtttcag

SEQ ID NO: 246601 - DNA, 25 bp, Mus musculus
ccctgtttcaggattatttttcttc

SEQ ID NO: 246602 - DNA, 25 bp, Mus musculus
ccctgtttccaagctctgtccgggc

SEQ ID NO: 246603 - DNA, 25 bp, Mus musculus
ccctgtttgcccagatgggttttga

SEQ ID NO: 246604 - DNA, 25 bp, Mus musculus
ccctgtttgcccagctctctgtgct

SEQ ID NO: 246605 - DNA, 25 bp, Mus musculus
ccctgttttgctttgtttacagacc

SEQ ID NO: 246606 - DNA, 25 bp, Mus musculus
cccttaaacaggaaatctttgagaa

SEQ ID NO: 246607 - DNA, 25 bp, Mus musculus
cccttaaacagttgcaggaaatctt

SEQ ID NO: 246608 - DNA, 25 bp, Mus musculus
cccttaaccaaggacattcactgaa

SEQ ID NO: 246609 - DNA, 25 bp, Mus musculus
cccttaaccaagggatgactggcaa

SEQ ID NO: 246610 - DNA, 25 bp, Mus musculus
cccttaacgtcggctgcccgctttg

SEQ ID NO: 246611 - DNA, 25 bp, Mus musculus
cccttaactgatgtgccggtgaatc

SEQ ID NO: 246612 - DNA, 25 bp, Mus musculus
cccttaagaccattcaaatccctga

SEQ ID NO: 246613 - DNA, 25 bp, Mus musculus
cccttaagttcaggtcagaggaacg

SEQ ID NO: 246614 - DNA, 25 bp, Mus musculus
cccttaatgaaaacattaaccaggt

SEQ ID NO: 246615 - DNA, 25 bp, Mus musculus
cccttacaaaggtgaccgggctgcg

SEQ ID NO: 246616 - DNA, 25 bp, Mus musculus
cccttacaagaagacttgcctaacg

SEQ ID NO: 246617 - DNA, 25 bp, Mus musculus
cccttacaagaaggatgagaacaag

SEQ ID NO: 246618 - DNA, 25 bp, Mus musculus
cccttaccacctatgtgccatggaa

SEQ ID NO: 246619 - DNA, 25 bp, Mus musculus
cccttacccagatgaggctctgtct

SEQ ID NO: 246620 - DNA, 25 bp, Mus musculus
cccttacccagcccagagcccggca

SEQ ID NO: 246621 - DNA, 25 bp, Mus musculus
cccttacgctctcctactccgtggt

SEQ ID NO: 246622 - DNA, 25 bp, Mus musculus
cccttagacttgaaagcacagtggt

SEQ ID NO: 246623 - DNA, 25 bp, Mus musculus
cccttagcagctcaagcccacccct

SEQ ID NO: 246624 - DNA, 25 bp, Mus musculus
cccttaggtttgatcagacctactg

SEQ ID NO: 246625 - DNA, 25 bp, Mus musculus
cccttatcagagcctgccccagttc

SEQ ID NO: 246626 - DNA, 25 bp, Mus musculus
cccttatgatcaggaaccagctcct

SEQ ID NO: 246627 - DNA, 25 bp, Mus musculus
cccttatgatcaggcggcttggatt

SEQ ID NO: 246628 - DNA, 25 bp, Mus musculus
cccttattgagttcattcaggctgg

SEQ ID NO: 246629 - DNA, 25 bp, Mus musculus
cccttcaaagcccgggtatcatccg

SEQ ID NO: 246630 - DNA, 25 bp, Mus musculus
cccttcaaaggtgatcctttccaaa

SEQ ID NO: 246631 - DNA, 25 bp, Mus musculus
cccttcaaatactgaactgtccctg

SEQ ID NO: 246632 - DNA, 25 bp, Mus musculus
cccttcaaccaggtcaggctgttcc

SEQ ID NO: 246633 - DNA, 25 bp, Mus musculus
cccttcacaatgtgatacctgactg

SEQ ID NO: 246634 - DNA, 25 bp, Mus musculus
cccttcacagctgacattatctcta

SEQ ID NO: 246635 - DNA, 25 bp, Mus musculus
cccttcacagtggagattgtggact

SEQ ID NO: 246636 - DNA, 25 bp, Mus musculus
cccttcacccagtgctgtcaatcct

SEQ ID NO: 246637 - DNA, 25 bp, Mus musculus
cccttcacctccagagccagctcca

SEQ ID NO: 246638 - DNA, 25 bp, Mus musculus
cccttcactggccccttcatggctg

SEQ ID NO: 246639 - DNA, 25 bp, Mus musculus
cccttcagaaagtactgtccctgaa

SEQ ID NO: 246640 - DNA, 25 bp, Mus musculus
cccttcagagggaggggcgacatcc

SEQ ID NO: 246641 - DNA, 25 bp, Mus musculus
cccttcagcaccaggagggagctat

SEQ ID NO: 246642 - DNA, 25 bp, Mus musculus
cccttcagcagatgaatggaaactt

SEQ ID NO: 246643 - DNA, 25 bp, Mus musculus
cccttcagccgagaaacatcccaaa

SEQ ID NO: 246644 - DNA, 25 bp, Mus musculus
cccttcagccgagaagaactttgat

SEQ ID NO: 246645 - DNA, 25 bp, Mus musculus
cccttcagccggattacacaggaag

SEQ ID NO: 246646 - DNA, 25 bp, Mus musculus
cccttcagcctggggctgacatgga

SEQ ID NO: 246647 - DNA, 25 bp, Mus musculus
cccttcaggaaagcctgtgggccga

SEQ ID NO: 246648 - DNA, 25 bp, Mus musculus
cccttcaggacttgctgatgtggat

SEQ ID NO: 246649 - DNA, 25 bp, Mus musculus
cccttcaggagccacgtcagtgttc

SEQ ID NO: 246650 - DNA, 25 bp, Mus musculus
cccttcaggaggcagcagaagcttt

SEQ ID NO: 246651 - DNA, 25 bp, Mus musculus
cccttcaggtctcggccagaaggtt

SEQ ID NO: 246652 - DNA, 25 bp, Mus musculus
cccttcagtatgacgttcgcctggc

SEQ ID NO: 246653 - DNA, 25 bp, Mus musculus
cccttcagtcagagatatatttctg

SEQ ID NO: 246654 - DNA, 25 bp, Mus musculus
cccttcagtctctcagtgcctgtgc

SEQ ID NO: 246655 - DNA, 25 bp, Mus musculus
cccttcagtgtaggatctcttcact

SEQ ID NO: 246656 - DNA, 25 bp, Mus musculus
cccttcatcatcaaggtctttcgct

SEQ ID NO: 246657 - DNA, 25 bp, Mus musculus
cccttcatcatcacggtcttctggc

SEQ ID NO: 246658 - DNA, 25 bp, Mus musculus
cccttcatccatcaggcgtggtttc

SEQ ID NO: 246659 - DNA, 25 bp, Mus musculus
cccttcatctgccgactccctgtcc

SEQ ID NO: 246660 - DNA, 25 bp, Mus musculus
cccttcatctgccggaagccgactc

SEQ ID NO: 246661 - DNA, 25 bp, Mus musculus
cccttcatctggctatctacagtga

SEQ ID NO: 246662 - DNA, 25 bp, Mus musculus
cccttcatctgggtatctacagtga

SEQ ID NO: 246663 - DNA, 25 bp, Mus musculus
cccttcatttctcatctcccagcag

SEQ ID NO: 246664 - DNA, 25 bp, Mus musculus
cccttccagaagtcttgtgtgatgc

SEQ ID NO: 246665 - DNA, 25 bp, Mus musculus
cccttccagaatgtcaagtgccccc

SEQ ID NO: 246666 - DNA, 25 bp, Mus musculus
cccttcccaatggtgatgatggtga

SEQ ID NO: 246667 - DNA, 25 bp, Mus musculus
cccttcccagggtctgaatttcctg

SEQ ID NO: 246668 - DNA, 25 bp, Mus musculus
cccttccccaggatgacagaggagt

SEQ ID NO: 246669 - DNA, 25 bp, Mus musculus
cccttccccctgaggaggctgcggg

SEQ ID NO: 246670 - DNA, 25 bp, Mus musculus
cccttcccctcagagttgtctgctg

SEQ ID NO: 246671 - DNA, 25 bp, Mus musculus
cccttcccctcaggagtggagtcaa

SEQ ID NO: 246672 - DNA, 25 bp, Mus musculus
cccttcccctcaggggtgatccatt

SEQ ID NO: 246673 - DNA, 25 bp, Mus musculus
cccttcccgagggcgctgtgaggtt

SEQ ID NO: 246674 - DNA, 25 bp, Mus musculus
cccttcccgccgcggaggagaatgg

SEQ ID NO: 246675 - DNA, 25 bp, Mus musculus
cccttcccgctggctgtaattcaaa

SEQ ID NO: 246676 - DNA, 25 bp, Mus musculus
cccttccctgaaacccaaatatgcc

SEQ ID NO: 246677 - DNA, 25 bp, Mus musculus
cccttccctgagacaatgtctatgt

SEQ ID NO: 246678 - DNA, 25 bp, Mus musculus
cccttccctggaaaatctggatgtg

SEQ ID NO: 246679 - DNA, 25 bp, Mus musculus
cccttcccttggtatgtctacgttg

SEQ ID NO: 246680 - DNA, 25 bp, Mus musculus
cccttccgacaagagcctgaaacct

SEQ ID NO: 246681 - DNA, 25 bp, Mus musculus
cccttccgacaagaggactactgcc

SEQ ID NO: 246682 - DNA, 25 bp, Mus musculus
cccttccgagctatccgggtgacct

SEQ ID NO: 246683 - DNA, 25 bp, Mus musculus
cccttccgaggaagtctgccggctg

SEQ ID NO: 246684 - DNA, 25 bp, Mus musculus
cccttccggcacaattgccaaaatc

SEQ ID NO: 246685 - DNA, 25 bp, Mus musculus
cccttccggctggccacccccatca

SEQ ID NO: 246686 - DNA, 25 bp, Mus musculus
cccttccgggctgtggaaggatcct

SEQ ID NO: 246687 - DNA, 25 bp, Mus musculus
cccttcctcaacagtgtctacattg

SEQ ID NO: 246688 - DNA, 25 bp, Mus musculus
cccttcctcacagaaaataaagcag

SEQ ID NO: 246689 - DNA, 25 bp, Mus musculus
cccttcctccgatggctacagatgt

SEQ ID NO: 246690 - DNA, 25 bp, Mus musculus
cccttcctcgaaggtcctggccaca

SEQ ID NO: 246691 - DNA, 25 bp, Mus musculus
cccttcctgaccaagagtggcaaca

SEQ ID NO: 246692 - DNA, 25 bp, Mus musculus
cccttcctgagcatctgtgggtggg

SEQ ID NO: 246693 - DNA, 25 bp, Mus musculus
cccttccttacagccctcaagtatg

SEQ ID NO: 246694 - DNA, 25 bp, Mus musculus
cccttccttcccagtggatctgagg

SEQ ID NO: 246695 - DNA, 25 bp, Mus musculus
cccttcctttcttaccctcagctgg

SEQ ID NO: 246696 - DNA, 25 bp, Mus musculus
cccttcgagaagcctggaaaggaaa

SEQ ID NO: 246697 - DNA, 25 bp, Mus musculus
cccttcgcctgtggaggcgcagccc

SEQ ID NO: 246698 - DNA, 25 bp, Mus musculus
cccttcgcctgtggtgaagaagttg

SEQ ID NO: 246699 - DNA, 25 bp, Mus musculus
cccttcgcggcgggataaataagga

SEQ ID NO: 246700 - DNA, 25 bp, Mus musculus
cccttcgcggcgggcaaatgaccat

SEQ ID NO: 246701 - DNA, 25 bp, Mus musculus
cccttcggcaaggtcggaacctggc

SEQ ID NO: 246702 - DNA, 25 bp, Mus musculus
cccttcgggagacaaatgtgcgcta

SEQ ID NO: 246703 - DNA, 25 bp, Mus musculus
cccttcgggagccatcaagagtttg

SEQ ID NO: 246704 - DNA, 25 bp, Mus musculus
cccttcggtgttggtctggtcagct

SEQ ID NO: 246705 - DNA, 25 bp, Mus musculus
cccttcgtctccgggctggtttgat

SEQ ID NO: 246706 - DNA, 25 bp, Mus musculus
cccttcgtggcagatctgattgcct

SEQ ID NO: 246707 - DNA, 25 bp, Mus musculus
cccttcgtggcaggttgttcctaca

SEQ ID NO: 246708 - DNA, 25 bp, Mus musculus
cccttctaagttggatcagtgatga

SEQ ID NO: 246709 - DNA, 25 bp, Mus musculus
cccttctagacacagggcccatcat

SEQ ID NO: 246710 - DNA, 25 bp, Mus musculus
cccttctagacacccaggacatgga

SEQ ID NO: 246711 - DNA, 25 bp, Mus musculus
cccttctcaatgagaaattcagcaa

SEQ ID NO: 246712 - DNA, 25 bp, Mus musculus
cccttctcaatgtgaaattcagcaa

SEQ ID NO: 246713 - DNA, 25 bp, Mus musculus
cccttctccacccggacagagtcct

SEQ ID NO: 246714 - DNA, 25 bp, Mus musculus
cccttctccggctggcccaccttgg

SEQ ID NO: 246715 - DNA, 25 bp, Mus musculus
cccttctcttgttaggttcacctgg

SEQ ID NO: 246716 - DNA, 25 bp, Mus musculus
cccttctggtcagtgttcacaccgc

SEQ ID NO: 246717 - DNA, 25 bp, Mus musculus
cccttcttagagagcttcctgccag

SEQ ID NO: 246718 - DNA, 25 bp, Mus musculus
cccttcttagtatcctttagcccag

SEQ ID NO: 246719 - DNA, 25 bp, Mus musculus
cccttcttagtgggtcctgtgtcag

SEQ ID NO: 246720 - DNA, 25 bp, Mus musculus
cccttcttcccacaatattctggat

SEQ ID NO: 246721 - DNA, 25 bp, Mus musculus
cccttcttcccacactcaccgagct

SEQ ID NO: 246722 - DNA, 25 bp, Mus musculus
cccttcttcgacatggctgggctcc

SEQ ID NO: 246723 - DNA, 25 bp, Mus musculus
cccttcttcgcagaatacaaacagc

SEQ ID NO: 246724 - DNA, 25 bp, Mus musculus
cccttcttcgctgattcttttcttg

SEQ ID NO: 246725 - DNA, 25 bp, Mus musculus
cccttcttcgtggatccaggttcaa

SEQ ID NO: 246726 - DNA, 25 bp, Mus musculus
cccttctttaagaagacagagcaca

SEQ ID NO: 246727 - DNA, 25 bp, Mus musculus
cccttgaactgaggaacgggcatgt

SEQ ID NO: 246728 - DNA, 25 bp, Mus musculus
cccttgaaggacgggcagtaccagg

SEQ ID NO: 246729 - DNA, 25 bp, Mus musculus
cccttgaaggacgggctctccctac

SEQ ID NO: 246730 - DNA, 25 bp, Mus musculus
cccttgaaggacgggggatggtgga

SEQ ID NO: 246731 - DNA, 25 bp, Mus musculus
cccttgaagggtaagtggagaaaga

SEQ ID NO: 246732 - DNA, 25 bp, Mus musculus
cccttgacctaccggttcttcagcg

SEQ ID NO: 246733 - DNA, 25 bp, Mus musculus
cccttgactcactgattcatctgaa

SEQ ID NO: 246734 - DNA, 25 bp, Mus musculus
cccttgactggtacagacttacgtt

SEQ ID NO: 246735 - DNA, 25 bp, Mus musculus
cccttgagccataatgaagagtctt

SEQ ID NO: 246736 - DNA, 25 bp, Mus musculus
cccttgatggcaagtatgtctatat

SEQ ID NO: 246737 - DNA, 25 bp, Mus musculus
cccttgcaagtgcccctctcacctg

SEQ ID NO: 246738 - DNA, 25 bp, Mus musculus
cccttgcaagttctgggccaagact

SEQ ID NO: 246739 - DNA, 25 bp, Mus musculus
cccttgcagaaaaaaagatgcagga

SEQ ID NO: 246740 - DNA, 25 bp, Mus musculus
cccttgcagcatgagttcaaagaag

SEQ ID NO: 246741 - DNA, 25 bp, Mus musculus
cccttgcagcatggctgaccaactg

SEQ ID NO: 246742 - DNA, 25 bp, Mus musculus
cccttgcagccactgcaagaaaaat

SEQ ID NO: 246743 - DNA, 25 bp, Mus musculus
cccttgcagccagacgttaggggat

SEQ ID NO: 246744 - DNA, 25 bp, Mus musculus
cccttgcatcctctaccccctcacc

SEQ ID NO: 246745 - DNA, 25 bp, Mus musculus
cccttgccaaaagcggggagcccag

SEQ ID NO: 246746 - DNA, 25 bp, Mus musculus
cccttgccaaggttcccagaagcgg

SEQ ID NO: 246747 - DNA, 25 bp, Mus musculus
cccttgcccaaggagtctctctgct

SEQ ID NO: 246748 - DNA, 25 bp, Mus musculus
cccttgcccaaggatctgggaaact

SEQ ID NO: 246749 - DNA, 25 bp, Mus musculus
cccttgccgtatggtgacagctggc

SEQ ID NO: 246750 - DNA, 25 bp, Mus musculus
cccttgcctccggttcacgctaaag

SEQ ID NO: 246751 - DNA, 25 bp, Mus musculus
cccttgcgagagcaatctgatgatt

SEQ ID NO: 246752 - DNA, 25 bp, Mus musculus
cccttgcgccgccggtgtggccgtg

SEQ ID NO: 246753 - DNA, 25 bp, Mus musculus
cccttgctaaggggcacctggccac

SEQ ID NO: 246754 - DNA, 25 bp, Mus musculus
cccttgctcctgcttgcttcccaga

SEQ ID NO: 246755 - DNA, 25 bp, Mus musculus
cccttgctcctggaggcagtgacat

SEQ ID NO: 246756 - DNA, 25 bp, Mus musculus
cccttgctgtctcaggacactgctg

SEQ ID NO: 246757 - DNA, 25 bp, Mus musculus
cccttgctgtctcagggtgaaagag

SEQ ID NO: 246758 - DNA, 25 bp, Mus musculus
cccttgcttgtcggaatctgatgct

SEQ ID NO: 246759 - DNA, 25 bp, Mus musculus
cccttggaaagcttttatgaaacag

SEQ ID NO: 246760 - DNA, 25 bp, Mus musculus
cccttggaacagtctggccagaaat

SEQ ID NO: 246761 - DNA, 25 bp, Mus musculus
cccttggaagaacttgcaaaagctc

SEQ ID NO: 246762 - DNA, 25 bp, Mus musculus
cccttggaagattggctctttgtgg

SEQ ID NO: 246763 - DNA, 25 bp, Mus musculus
cccttggaccccagggtccattcag

SEQ ID NO: 246764 - DNA, 25 bp, Mus musculus
cccttggagcaggtcaaagctgcaa

SEQ ID NO: 246765 - DNA, 25 bp, Mus musculus
cccttggagccgtcgactctcaggt

SEQ ID NO: 246766 - DNA, 25 bp, Mus musculus
cccttggatagactacgagtctggt

SEQ ID NO: 246767 - DNA, 25 bp, Mus musculus
cccttggatagagcatatttaatta

SEQ ID NO: 246768 - DNA, 25 bp, Mus musculus
cccttggatggagccaaaaacaata

SEQ ID NO: 246769 - DNA, 25 bp, Mus musculus
cccttggcagacagggtcccttgca

SEQ ID NO: 246770 - DNA, 25 bp, Mus musculus
cccttggcagaggttacaaaatgtc

SEQ ID NO: 246771 - DNA, 25 bp, Mus musculus
cccttggcaggagctgtgaaatcag

SEQ ID NO: 246772 - DNA, 25 bp, Mus musculus
cccttggcctgttgggtcacttccc

SEQ ID NO: 246773 - DNA, 25 bp, Mus musculus
cccttggcgttcaacaggtggtgtc

SEQ ID NO: 246774 - DNA, 25 bp, Mus musculus
cccttggggaagcagatggagttcc

SEQ ID NO: 246775 - DNA, 25 bp, Mus musculus
cccttgggtcaaggtcgagtatgcc

SEQ ID NO: 246776 - DNA, 25 bp, Mus musculus
cccttggttgcagatttgcaataca

SEQ ID NO: 246777 - DNA, 25 bp, Mus musculus
cccttggttgcaggaagaccgagta

SEQ ID NO: 246778 - DNA, 25 bp, Mus musculus
cccttggttgcaggtttgcaataca

SEQ ID NO: 246779 - DNA, 25 bp, Mus musculus
cccttgtatacagaggagcattccg

SEQ ID NO: 246780 - DNA, 25 bp, Mus musculus
cccttgtatagctgtcagggtgaca

SEQ ID NO: 246781 - DNA, 25 bp, Mus musculus
cccttgtatccagacttcagtacta

SEQ ID NO: 246782 - DNA, 25 bp, Mus musculus
cccttgtattaaagatccaaaaggt

SEQ ID NO: 246783 - DNA, 25 bp, Mus musculus
cccttgtattaaagggtatgatgtg

SEQ ID NO: 246784 - DNA, 25 bp, Mus musculus
cccttgtccccaagccacagcccaa

SEQ ID NO: 246785 - DNA, 25 bp, Mus musculus
cccttgtccccagcaagtcttctgg

SEQ ID NO: 246786 - DNA, 25 bp, Mus musculus
cccttgtgaacgaggctgctgcgca

SEQ ID NO: 246787 - DNA, 25 bp, Mus musculus
cccttgtgatgtggtgaagactcgg

SEQ ID NO: 246788 - DNA, 25 bp, Mus musculus
cccttgtgcagcacttagctagcct

SEQ ID NO: 246789 - DNA, 25 bp, Mus musculus
cccttgtgcaggaagcatgcattgc

SEQ ID NO: 246790 - DNA, 25 bp, Mus musculus
cccttgttcactgtacctcatcaac

SEQ ID NO: 246791 - DNA, 25 bp, Mus musculus
cccttgttccaagaagaacgttggt

SEQ ID NO: 246792 - DNA, 25 bp, Mus musculus
cccttgttccaagtatctccatact

SEQ ID NO: 246793 - DNA, 25 bp, Mus musculus
ccctttaaagaccaccagtcttgcc

SEQ ID NO: 246794 - DNA, 25 bp, Mus musculus
ccctttaaagaccagcagtcttgcc

SEQ ID NO: 246795 - DNA, 25 bp, Mus musculus
ccctttacccctgcttcctgcctag

SEQ ID NO: 246796 - DNA, 25 bp, Mus musculus
ccctttactgaaattaccatggttg

SEQ ID NO: 246797 - DNA, 25 bp, Mus musculus
ccctttagatgctagtggaggttcc

SEQ ID NO: 246798 - DNA, 25 bp, Mus musculus
ccctttagatggtgtggatccagag

SEQ ID NO: 246799 - DNA, 25 bp, Mus musculus
ccctttaggagagaagatagaggag

SEQ ID NO: 246800 - DNA, 25 bp, Mus musculus
ccctttatctgacttgttggcaagg

SEQ ID NO: 246801 - DNA, 25 bp, Mus musculus
ccctttatctgtagtgcaaagtact

SEQ ID NO: 246802 - DNA, 25 bp, Mus musculus
ccctttatctgtgaggtctgccata

SEQ ID NO: 246803 - DNA, 25 bp, Mus musculus
ccctttatgctatgaaaccactagg

SEQ ID NO: 246804 - DNA, 25 bp, Mus musculus
ccctttatgctcaatatgaagatat

SEQ ID NO: 246805 - DNA, 25 bp, Mus musculus
ccctttatgctgattctctgacctt

SEQ ID NO: 246806 - DNA, 25 bp, Mus musculus
ccctttattacaaggaatcgcctgc

SEQ ID NO: 246807 - DNA, 25 bp, Mus musculus
ccctttattcaggagatgatttggt

SEQ ID NO: 246808 - DNA, 25 bp, Mus musculus
ccctttcacagagcatgatctcctc

SEQ ID NO: 246809 - DNA, 25 bp, Mus musculus
ccctttcacaggctcctgagcattc

SEQ ID NO: 246810 - DNA, 25 bp, Mus musculus
ccctttcacttaaggtccttcagac

SEQ ID NO: 246811 - DNA, 25 bp, Mus musculus
ccctttcatagattaccaaggaaat

SEQ ID NO: 246812 - DNA, 25 bp, Mus musculus
ccctttcatagctatgataagttac

SEQ ID NO: 246813 - DNA, 25 bp, Mus musculus
ccctttcatgccaccctctgcctcc

SEQ ID NO: 246814 - DNA, 25 bp, Mus musculus
ccctttccaccgaaggtttctctgt

SEQ ID NO: 246815 - DNA, 25 bp, Mus musculus
ccctttcccatgggtcactgcccag

SEQ ID NO: 246816 - DNA, 25 bp, Mus musculus
ccctttcctcccaagattcccgtgg

SEQ ID NO: 246817 - DNA, 25 bp, Mus musculus
ccctttcgagagggagaatcccgta

SEQ ID NO: 246818 - DNA, 25 bp, Mus musculus
ccctttctcaggtccaggtggagtt

SEQ ID NO: 246819 - DNA, 25 bp, Mus musculus
ccctttctctggaacttcgagtcaa

SEQ ID NO: 246820 - DNA, 25 bp, Mus musculus
ccctttctctgggagctgaacatcg

SEQ ID NO: 246821 - DNA, 25 bp, Mus musculus
ccctttctgccaaagttgctcacca

SEQ ID NO: 246822 - DNA, 25 bp, Mus musculus
ccctttctgggctaagacctccagt

SEQ ID NO: 246823 - DNA, 25 bp, Mus musculus
ccctttctgtaccgatgcactcccg

SEQ ID NO: 246824 - DNA, 25 bp, Mus musculus
ccctttcttgcatttagtaaagaaa

SEQ ID NO: 246825 - DNA, 25 bp, Mus musculus
ccctttgaacttatattggattttc

SEQ ID NO: 246826 - DNA, 25 bp, Mus musculus
ccctttgaccaggatgacctcacgg

SEQ ID NO: 246827 - DNA, 25 bp, Mus musculus
ccctttgacctcatggtgttcgtga

SEQ ID NO: 246828 - DNA, 25 bp, Mus musculus
ccctttgagcagcatatgaagaaca

SEQ ID NO: 246829 - DNA, 25 bp, Mus musculus
ccctttgaggacaccgctcagtggg

SEQ ID NO: 246830 - DNA, 25 bp, Mus musculus
ccctttgatattcggagctggagcc

SEQ ID NO: 246831 - DNA, 25 bp, Mus musculus
ccctttgatattcggctgaattcat

SEQ ID NO: 246832 - DNA, 25 bp, Mus musculus
ccctttgcctggctccaagatgaaa

SEQ ID NO: 246833 - DNA, 25 bp, Mus musculus
ccctttgcgcagaggttacatcggc

SEQ ID NO: 246834 - DNA, 25 bp, Mus musculus
ccctttgcttggtgggttcaggggt

SEQ ID NO: 246835 - DNA, 25 bp, Mus musculus
ccctttggaaaaatacatttatata

SEQ ID NO: 246836 - DNA, 25 bp, Mus musculus
ccctttggagaatgcagttcctttt

SEQ ID NO: 246837 - DNA, 25 bp, Mus musculus
ccctttggagacctccacacagcac

SEQ ID NO: 246838 - DNA, 25 bp, Mus musculus
ccctttgggaagcgcctgctgaacg

SEQ ID NO: 246839 - DNA, 25 bp, Mus musculus
ccctttggtgacaggcttccccacc

SEQ ID NO: 246840 - DNA, 25 bp, Mus musculus
cccttttacttggcaagtccttggg

SEQ ID NO: 246841 - DNA, 25 bp, Mus musculus
cccttttatagaccagtttgaatat

SEQ ID NO: 246842 - DNA, 25 bp, Mus musculus
cccttttcagactcttgtgtactta

SEQ ID NO: 246843 - DNA, 25 bp, Mus musculus
cccttttcaggtcgtgcatgacaac

SEQ ID NO: 246844 - DNA, 25 bp, Mus musculus
cccttttcagtgagaaagcgctgca

SEQ ID NO: 246845 - DNA, 25 bp, Mus musculus
cccttttcatgcctagtgacctgat

SEQ ID NO: 246846 - DNA, 25 bp, Mus musculus
cccttttcccgtgtgttcagggagg

SEQ ID NO: 246847 - DNA, 25 bp, Mus musculus
cccttttcctgagagtttggattcg

SEQ ID NO: 246848 - DNA, 25 bp, Mus musculus
cccttttcggcgtggttgagaacaa

SEQ ID NO: 246849 - DNA, 25 bp, Mus musculus
cccttttctaacaggtctggatttt

SEQ ID NO: 246850 - DNA, 25 bp, Mus musculus
cccttttctgagtggtccaagccgg

SEQ ID NO: 246851 - DNA, 25 bp, Mus musculus
cccttttctgggtaacacaaggcac

SEQ ID NO: 246852 - DNA, 25 bp, Mus musculus
cccttttctgtagcgctggcgtgga

SEQ ID NO: 246853 - DNA, 25 bp, Mus musculus
cccttttgcatggtaagaccagctg

SEQ ID NO: 246854 - DNA, 25 bp, Mus musculus
ccctttttttcccagatgcattaca

SEQ ID NO: 246855 - DNA, 25 bp, Mus musculus
ccctttttttcccaggaccagatag

SEQ ID NO: 246856 - DNA, 25 bp, Mus musculus
ccgaaaaccccagatctgtgccgct

SEQ ID NO: 246857 - DNA, 25 bp, Mus musculus
ccgaaaacgttctgcagcccacaca

SEQ ID NO: 246858 - DNA, 25 bp, Mus musculus
ccgaaaactggaagtgacccagact

SEQ ID NO: 246859 - DNA, 25 bp, Mus musculus
ccgaaaagagagggggtccactgcg

SEQ ID NO: 246860 - DNA, 25 bp, Mus musculus
ccgaaaatgaaggttctgggctgac

SEQ ID NO: 246861 - DNA, 25 bp, Mus musculus
ccgaaaatgaagtcgagcctgttga

SEQ ID NO: 246862 - DNA, 25 bp, Mus musculus
ccgaaacactcagccctggcaccat

SEQ ID NO: 246863 - DNA, 25 bp, Mus musculus
ccgaaacactctctaatatgtttat

SEQ ID NO: 246864 - DNA, 25 bp, Mus musculus
ccgaaacagcagagaactggggaac

SEQ ID NO: 246865 - DNA, 25 bp, Mus musculus
ccgaaaccaagtggagctgattgca

SEQ ID NO: 246866 - DNA, 25 bp, Mus musculus
ccgaaaccatgcatgggcgcctgaa

SEQ ID NO: 246867 - DNA, 25 bp, Mus musculus
ccgaaacccagatgaggaataactg

SEQ ID NO: 246868 - DNA, 25 bp, Mus musculus
ccgaaaccgcaggcttatgatggag

SEQ ID NO: 246869 - DNA, 25 bp, Mus musculus
ccgaaacgcgcacgcggctggagaa

SEQ ID NO: 246870 - DNA, 25 bp, Mus musculus
ccgaaactcagttccagagcctctg

SEQ ID NO: 246871 - DNA, 25 bp, Mus musculus
ccgaaactccagtgacacgtgcctg

SEQ ID NO: 246872 - DNA, 25 bp, Mus musculus
ccgaaactgagaagaccagagccct

SEQ ID NO: 246873 - DNA, 25 bp, Mus musculus
ccgaaagaccagccaacaattctct

SEQ ID NO: 246874 - DNA, 25 bp, Mus musculus
ccgaaagagaggtgaaacggaaggt

SEQ ID NO: 246875 - DNA, 25 bp, Mus musculus
ccgaaagagaggtgaggaagaccct

SEQ ID NO: 246876 - DNA, 25 bp, Mus musculus
ccgaaagagaggtgccggcctccgc

SEQ ID NO: 246877 - DNA, 25 bp, Mus musculus
ccgaaagagggtggtgtcatggata

SEQ ID NO: 246878 - DNA, 25 bp, Mus musculus
ccgaaagagtctaaagcctgacatt

SEQ ID NO: 246879 - DNA, 25 bp, Mus musculus
ccgaaagcagaggagcaccgggggc

SEQ ID NO: 246880 - DNA, 25 bp, Mus musculus
ccgaaaggtagcatcaccaccgcct

SEQ ID NO: 246881 - DNA, 25 bp, Mus musculus
ccgaaagtcagaaaagtgttacatg

SEQ ID NO: 246882 - DNA, 25 bp, Mus musculus
ccgaaagtggggatgcaaacttggt

SEQ ID NO: 246883 - DNA, 25 bp, Mus musculus
ccgaaatcagatagtcttccccgct

SEQ ID NO: 246884 - DNA, 25 bp, Mus musculus
ccgaaatcaggcagaagaggagctc

SEQ ID NO: 246885 - DNA, 25 bp, Mus musculus
ccgaaatctgcttcttgcaggagcc

SEQ ID NO: 246886 - DNA, 25 bp, Mus musculus
ccgaaatgagctggaattttggagg

SEQ ID NO: 246887 - DNA, 25 bp, Mus musculus
ccgaaatgaggaccagtgggcatgg

SEQ ID NO: 246888 - DNA, 25 bp, Mus musculus
ccgaaattcctgggcagagctgaaa

SEQ ID NO: 246889 - DNA, 25 bp, Mus musculus
ccgaacaacaaagaatctgaagcag

SEQ ID NO: 246890 - DNA, 25 bp, Mus musculus
ccgaacaacaaagaggaagcctgca

SEQ ID NO: 246891 - DNA, 25 bp, Mus musculus
ccgaacaacagacgagctaaactca

SEQ ID NO: 246892 - DNA, 25 bp, Mus musculus
ccgaacaacaggtcttcacacaacg

SEQ ID NO: 246893 - DNA, 25 bp, Mus musculus
ccgaacaagcccaggagacaatcag

SEQ ID NO: 246894 - DNA, 25 bp, Mus musculus
ccgaacacagtgaggatgccatgag

SEQ ID NO: 246895 - DNA, 25 bp, Mus musculus
ccgaacaccggttttgcctcaattc

SEQ ID NO: 246896 - DNA, 25 bp, Mus musculus
ccgaacaccgtgcacttaatgcagc

SEQ ID NO: 246897 - DNA, 25 bp, Mus musculus
ccgaacaggatcgcaatagtcggtg

SEQ ID NO: 246898 - DNA, 25 bp, Mus musculus
ccgaacaggatcggatctaccgtta

SEQ ID NO: 246899 - DNA, 25 bp, Mus musculus
ccgaacaggatcggtctctccagtg

SEQ ID NO: 246900 - DNA, 25 bp, Mus musculus
ccgaaccagaggagattggattcca

SEQ ID NO: 246901 - DNA, 25 bp, Mus musculus
ccgaacgacgatagggtccaggtgg

SEQ ID NO: 246902 - DNA, 25 bp, Mus musculus
ccgaactcacccaagtgcaaaacat

SEQ ID NO: 246903 - DNA, 25 bp, Mus musculus
ccgaactcacccaagtgttgcccac

SEQ ID NO: 246904 - DNA, 25 bp, Mus musculus
ccgaactcagacaggagcagagccc

SEQ ID NO: 246905 - DNA, 25 bp, Mus musculus
ccgaactttagaccatgccgtccat

SEQ ID NO: 246906 - DNA, 25 bp, Mus musculus
ccgaagaagaatgggctctacttga

SEQ ID NO: 246907 - DNA, 25 bp, Mus musculus
ccgaagaagaatgggtctttccttc

SEQ ID NO: 246908 - DNA, 25 bp, Mus musculus
ccgaagaagagctgtggtttctcct

SEQ ID NO: 246909 - DNA, 25 bp, Mus musculus
ccgaagacacaagtagaaggcagtg

SEQ ID NO: 246910 - DNA, 25 bp, Mus musculus
ccgaagaccaagcgctggaaggtag

SEQ ID NO: 246911 - DNA, 25 bp, Mus musculus
ccgaagaccaagcggatctctttcc

SEQ ID NO: 246912 - DNA, 25 bp, Mus musculus
ccgaagacctaaatgactggcttcc

SEQ ID NO: 246913 - DNA, 25 bp, Mus musculus
ccgaagacctaaatggagaactgtt

SEQ ID NO: 246914 - DNA, 25 bp, Mus musculus
ccgaagactgaaactgttatggttt

SEQ ID NO: 246915 - DNA, 25 bp, Mus musculus
ccgaagactggcaggacagtttctt

SEQ ID NO: 246916 - DNA, 25 bp, Mus musculus
ccgaagactgtcgctcctgtgcggc

SEQ ID NO: 246917 - DNA, 25 bp, Mus musculus
ccgaagagaaactggacagagccaa

SEQ ID NO: 246918 - DNA, 25 bp, Mus musculus
ccgaagagcaagatgatttttgaat

SEQ ID NO: 246919 - DNA, 25 bp, Mus musculus
ccgaagagctcaagaagttaagtgt

SEQ ID NO: 246920 - DNA, 25 bp, Mus musculus
ccgaagaggagcttggctttgatct

SEQ ID NO: 246921 - DNA, 25 bp, Mus musculus
ccgaagatggaggagctggagtcag

SEQ ID NO: 246922 - DNA, 25 bp, Mus musculus
ccgaagcaaggtgagatctccagag

SEQ ID NO: 246923 - DNA, 25 bp, Mus musculus
ccgaagcagcagcaaagtctgcatc

SEQ ID NO: 246924 - DNA, 25 bp, Mus musculus
ccgaagcagcagcaacctcattggg

SEQ ID NO: 246925 - DNA, 25 bp, Mus musculus
ccgaagcccaagaaataaatcataa

SEQ ID NO: 246926 - DNA, 25 bp, Mus musculus
ccgaagccccggccaccatgttcaa

SEQ ID NO: 246927 - DNA, 25 bp, Mus musculus
ccgaagccgcagccagagccacagc

SEQ ID NO: 246928 - DNA, 25 bp, Mus musculus
ccgaagccgggctgatgtgatgatt

SEQ ID NO: 246929 - DNA, 25 bp, Mus musculus
ccgaagctaaccccccctggtgcac

SEQ ID NO: 246930 - DNA, 25 bp, Mus musculus
ccgaagctacaggactcttcccccc

SEQ ID NO: 246931 - DNA, 25 bp, Mus musculus
ccgaagctcaatgacaatgtcagtg

SEQ ID NO: 246932 - DNA, 25 bp, Mus musculus
ccgaagctcagccacgggggccgtg

SEQ ID NO: 246933 - DNA, 25 bp, Mus musculus
ccgaagctgagatactccatgtttc

SEQ ID NO: 246934 - DNA, 25 bp, Mus musculus
ccgaagctggaaatggaaccagtga

SEQ ID NO: 246935 - DNA, 25 bp, Mus musculus
ccgaaggacgcgctatgaagtctta

SEQ ID NO: 246936 - DNA, 25 bp, Mus musculus
ccgaaggagcaggagccgctcccgt

SEQ ID NO: 246937 - DNA, 25 bp, Mus musculus
ccgaaggagcaggttgatatgtcag

SEQ ID NO: 246938 - DNA, 25 bp, Mus musculus
ccgaaggcagcttggagaagagagt

SEQ ID NO: 246939 - DNA, 25 bp, Mus musculus
ccgaaggcagtctttcagaaattta

SEQ ID NO: 246940 - DNA, 25 bp, Mus musculus
ccgaaggccgaatgttttggctggt

SEQ ID NO: 246941 - DNA, 25 bp, Mus musculus
ccgaaggccggtcgctgtggttccc

SEQ ID NO: 246942 - DNA, 25 bp, Mus musculus
ccgaaggctgtttatggatgaccag

SEQ ID NO: 246943 - DNA, 25 bp, Mus musculus
ccgaagggtccagggtctcaggtcc

SEQ ID NO: 246944 - DNA, 25 bp, Mus musculus
ccgaaggttaaaacttcagcatctt

SEQ ID NO: 246945 - DNA, 25 bp, Mus musculus
ccgaagtatcatgtaccggagcttt

SEQ ID NO: 246946 - DNA, 25 bp, Mus musculus
ccgaagtcaagcctttcatcaccta

SEQ ID NO: 246947 - DNA, 25 bp, Mus musculus
ccgaagtctttaagtgagcccttga

SEQ ID NO: 246948 - DNA, 25 bp, Mus musculus
ccgaagtgaggggcttgcagatggg

SEQ ID NO: 246949 - DNA, 25 bp, Mus musculus
ccgaagtgtctggagataacaatcg

SEQ ID NO: 246950 - DNA, 25 bp, Mus musculus
ccgaagttacagacccactgtccgt

SEQ ID NO: 246951 - DNA, 25 bp, Mus musculus
ccgaagttacaggcccactgtccgt

SEQ ID NO: 246952 - DNA, 25 bp, Mus musculus
ccgaagttcagagtaaagacatttc

SEQ ID NO: 246953 - DNA, 25 bp, Mus musculus
ccgaagttgcacaaggtcattgaag

SEQ ID NO: 246954 - DNA, 25 bp, Mus musculus
ccgaagttgctcagtggacaagatt

SEQ ID NO: 246955 - DNA, 25 bp, Mus musculus
ccgaataaatgcagtatctctcctc

SEQ ID NO: 246956 - DNA, 25 bp, Mus musculus
ccgaatagcagcttcttcggctgtc

SEQ ID NO: 246957 - DNA, 25 bp, Mus musculus
ccgaatatatatggaagaccaccag

SEQ ID NO: 246958 - DNA, 25 bp, Mus musculus
ccgaatatccacgctttctctgctg

SEQ ID NO: 246959 - DNA, 25 bp, Mus musculus
ccgaatatctcaagtatgcgagacc

SEQ ID NO: 246960 - DNA, 25 bp, Mus musculus
ccgaatcacagctgccttcaccatg

SEQ ID NO: 246961 - DNA, 25 bp, Mus musculus
ccgaatccagaatcggaagactctt

SEQ ID NO: 246962 - DNA, 25 bp, Mus musculus
ccgaatcctatacccacctgtctct

SEQ ID NO: 246963 - DNA, 25 bp, Mus musculus
ccgaatctttgagtgtgagaaactt

SEQ ID NO: 246964 - DNA, 25 bp, Mus musculus
ccgaatgcagaggtgaggcatgaaa

SEQ ID NO: 246965 - DNA, 25 bp, Mus musculus
ccgaatgcagccagcgggtattccc

SEQ ID NO: 246966 - DNA, 25 bp, Mus musculus
ccgaatgcagccagggcctgtgttt

SEQ ID NO: 246967 - DNA, 25 bp, Mus musculus
ccgaatggacagggtaaagaaggaa

SEQ ID NO: 246968 - DNA, 25 bp, Mus musculus
ccgaattccagaaagatggaaccgc

SEQ ID NO: 246969 - DNA, 25 bp, Mus musculus
ccgaattccagaaagtgtctatcgc

SEQ ID NO: 246970 - DNA, 25 bp, Mus musculus
ccgaattcctcctccaccgtcgtcc

SEQ ID NO: 246971 - DNA, 25 bp, Mus musculus
ccgaattctgcagacccatgcagat

SEQ ID NO: 246972 - DNA, 25 bp, Mus musculus
ccgaattctgcaggtatccaacggt

SEQ ID NO: 246973 - DNA, 25 bp, Mus musculus
ccgaattctgcaggtcacgtacagt

SEQ ID NO: 246974 - DNA, 25 bp, Mus musculus
ccgaatttatgttgaaaaacatttt

SEQ ID NO: 246975 - DNA, 25 bp, Mus musculus
ccgaatttcaagcccatctctcacc

SEQ ID NO: 246976 - DNA, 25 bp, Mus musculus
ccgaatttcaaggggacgatttggt

SEQ ID NO: 246977 - DNA, 25 bp, Mus musculus
ccgaatttcaaggtctttaagtgga

SEQ ID NO: 246978 - DNA, 25 bp, Mus musculus
ccgacaaagccaaagctgctcagac

SEQ ID NO: 246979 - DNA, 25 bp, Mus musculus
ccgacaaatgcaggaatgtgctaaa

SEQ ID NO: 246980 - DNA, 25 bp, Mus musculus
ccgacaacatgcagggtgtgttgga

SEQ ID NO: 246981 - DNA, 25 bp, Mus musculus
ccgacaactggaggaagagcagtca

SEQ ID NO: 246982 - DNA, 25 bp, Mus musculus
ccgacaagagcctgaaacctgcttg

SEQ ID NO: 246983 - DNA, 25 bp, Mus musculus
ccgacaagaggactactgcctttgg

SEQ ID NO: 246984 - DNA, 25 bp, Mus musculus
ccgacaatgatagaccaaactgcag

SEQ ID NO: 246985 - DNA, 25 bp, Mus musculus
ccgacaatgatagattcaaacaccg

SEQ ID NO: 246986 - DNA, 25 bp, Mus musculus
ccgacacaggtggagaatataaata

SEQ ID NO: 246987 - DNA, 25 bp, Mus musculus
ccgacacaggtgtgtatccagagtg

SEQ ID NO: 246988 - DNA, 25 bp, Mus musculus
ccgacagaaaaatctcatcagagtt

SEQ ID NO: 246989 - DNA, 25 bp, Mus musculus
ccgacagaaaaatgcatacacagac

SEQ ID NO: 246990 - DNA, 25 bp, Mus musculus
ccgacagatattcagcaagccccgc

SEQ ID NO: 246991 - DNA, 25 bp, Mus musculus
ccgacagcagctcctgagaaatgct

SEQ ID NO: 246992 - DNA, 25 bp, Mus musculus
ccgacagcagtaatctacagtagcc

SEQ ID NO: 246993 - DNA, 25 bp, Mus musculus
ccgacagcatcaaaatgccaggcag

SEQ ID NO: 246994 - DNA, 25 bp, Mus musculus
ccgacagcatcaaggacaattcaag

SEQ ID NO: 246995 - DNA, 25 bp, Mus musculus
ccgacagcatcaaggcctgggagga

SEQ ID NO: 246996 - DNA, 25 bp, Mus musculus
ccgacagcccgaaagaccacaactc

SEQ ID NO: 246997 - DNA, 25 bp, Mus musculus
ccgacagcctgcagccagccaggac

SEQ ID NO: 246998 - DNA, 25 bp, Mus musculus
ccgacagcctgcaggatgctttgct

SEQ ID NO: 246999 - DNA, 25 bp, Mus musculus
ccgacaggagctacgagaggttcac

SEQ ID NO: 247000 - DNA, 25 bp, Mus musculus
ccgacaggaggcgacccagtggaat

SEQ ID NO: 247001 - DNA, 25 bp, Mus musculus
ccgacaggcacagctactatgtgtg

SEQ ID NO: 247002 - DNA, 25 bp, Mus musculus
ccgacaggcacaggtcgaggtggcg

SEQ ID NO: 247003 - DNA, 25 bp, Mus musculus
ccgacaggcttcaagagtggtcttg

SEQ ID NO: 247004 - DNA, 25 bp, Mus musculus
ccgacaggcttcacttcatcttcat

SEQ ID NO: 247005 - DNA, 25 bp, Mus musculus
ccgacagtacagaaccaacgaaacg

SEQ ID NO: 247006 - DNA, 25 bp, Mus musculus
ccgacagtacagggttagctgagtt

SEQ ID NO: 247007 - DNA, 25 bp, Mus musculus
ccgacatctgtagcatatatccggt

SEQ ID NO: 247008 - DNA, 25 bp, Mus musculus
ccgacatgagcctgcctttacccca

SEQ ID NO: 247009 - DNA, 25 bp, Mus musculus
ccgacatggaggatgacttgaaagt

SEQ ID NO: 247010 - DNA, 25 bp, Mus musculus
ccgacattccaacacttcaaactca

SEQ ID NO: 247011 - DNA, 25 bp, Mus musculus
ccgacattccaacgtgtccgatccg

SEQ ID NO: 247012 - DNA, 25 bp, Mus musculus
ccgaccactgctacagctgctccta

SEQ ID NO: 247013 - DNA, 25 bp, Mus musculus
ccgaccatgaagacaccgtggaagg

SEQ ID NO: 247014 - DNA, 25 bp, Mus musculus
ccgaccatgaagatgaagcggcagc

SEQ ID NO: 247015 - DNA, 25 bp, Mus musculus
ccgaccatgaaggtttataagaaac

SEQ ID NO: 247016 - DNA, 25 bp, Mus musculus
ccgaccattagccaagtccaggtgc

SEQ ID NO: 247017 - DNA, 25 bp, Mus musculus
ccgaccattagtcagagaattgtaa

SEQ ID NO: 247018 - DNA, 25 bp, Mus musculus
ccgaccattgggtttaatgtggaga

SEQ ID NO: 247019 - DNA, 25 bp, Mus musculus
ccgacccaaggcatgcgccaaggca

SEQ ID NO: 247020 - DNA, 25 bp, Mus musculus
ccgacccacagagaggccgtgagac

SEQ ID NO: 247021 - DNA, 25 bp, Mus musculus
ccgacccacagagggagcatgactt

SEQ ID NO: 247022 - DNA, 25 bp, Mus musculus
ccgacccacagatccctctagctga

SEQ ID NO: 247023 - DNA, 25 bp, Mus musculus
ccgacccaccacgggagccaggtat

SEQ ID NO: 247024 - DNA, 25 bp, Mus musculus
ccgacccagactcattacaggccca

SEQ ID NO: 247025 - DNA, 25 bp, Mus musculus
ccgacccatgaagactcttgggagg

SEQ ID NO: 247026 - DNA, 25 bp, Mus musculus
ccgacccatgaagatcccaattatc

SEQ ID NO: 247027 - DNA, 25 bp, Mus musculus
ccgacccccaggctcaacagtgtac

SEQ ID NO: 247028 - DNA, 25 bp, Mus musculus
ccgacccctgcaggaagtggccaga

SEQ ID NO: 247029 - DNA, 25 bp, Mus musculus
ccgacccctgcgaggggacatgctt

SEQ ID NO: 247030 - DNA, 25 bp, Mus musculus
ccgacccgttgatgtgacccggttt

SEQ ID NO: 247031 - DNA, 25 bp, Mus musculus
ccgaccctgaagggacctttgacgc

SEQ ID NO: 247032 - DNA, 25 bp, Mus musculus
ccgaccctgaaggtggacttgtttg

SEQ ID NO: 247033 - DNA, 25 bp, Mus musculus
ccgaccctgagttctgaggctctaa

SEQ ID NO: 247034 - DNA, 25 bp, Mus musculus
ccgaccgattcccagcttccaccat

SEQ ID NO: 247035 - DNA, 25 bp, Mus musculus
ccgaccgctccaagtttgttgaaag

SEQ ID NO: 247036 - DNA, 25 bp, Mus musculus
ccgaccggcctctctggaggaaatc

SEQ ID NO: 247037 - DNA, 25 bp, Mus musculus
ccgacctacctcagggaagagtccc

SEQ ID NO: 247038 - DNA, 25 bp, Mus musculus
ccgacctacctcagggagcagaagg

SEQ ID NO: 247039 - DNA, 25 bp, Mus musculus
ccgacctcatctaggtacgtaggtg

SEQ ID NO: 247040 - DNA, 25 bp, Mus musculus
ccgacctgaaagctttacaactcct

SEQ ID NO: 247041 - DNA, 25 bp, Mus musculus
ccgacctgagacttcattgaaccag

SEQ ID NO: 247042 - DNA, 25 bp, Mus musculus
ccgacctgagcaagaaattatcaga

SEQ ID NO: 247043 - DNA, 25 bp, Mus musculus
ccgacctgcacaagcaaaacctgga

SEQ ID NO: 247044 - DNA, 25 bp, Mus musculus
ccgacctggagcgtgtatcgacagt

SEQ ID NO: 247045 - DNA, 25 bp, Mus musculus
ccgacctggtcagtcttacttctcg

SEQ ID NO: 247046 - DNA, 25 bp, Mus musculus
ccgacctttggccacgcttacagtt

SEQ ID NO: 247047 - DNA, 25 bp, Mus musculus
ccgacctttggccaggcttacagtt

SEQ ID NO: 247048 - DNA, 25 bp, Mus musculus
ccgacgaaatcgggaagctctttgt

SEQ ID NO: 247049 - DNA, 25 bp, Mus musculus
ccgacgacgatcttggatctagcaa

SEQ ID NO: 247050 - DNA, 25 bp, Mus musculus
ccgacgagaaaaagctggagagatg

SEQ ID NO: 247051 - DNA, 25 bp, Mus musculus
ccgacgagcccttgctgctcttggg

SEQ ID NO: 247052 - DNA, 25 bp, Mus musculus
ccgacgagctggcgggtgaaaattt

SEQ ID NO: 247053 - DNA, 25 bp, Mus musculus
ccgacgagctggcggttttgtacca

SEQ ID NO: 247054 - DNA, 25 bp, Mus musculus
ccgacgatcagaagactcacagtgg

SEQ ID NO: 247055 - DNA, 25 bp, Mus musculus
ccgacgatcagaagatgcgctgatc

SEQ ID NO: 247056 - DNA, 25 bp, Mus musculus
ccgacgcagcgctagcctaaattgt

SEQ ID NO: 247057 - DNA, 25 bp, Mus musculus
ccgacgcccaaggaccacctaccct

SEQ ID NO: 247058 - DNA, 25 bp, Mus musculus
ccgacgccgcggcagccagtcccgc

SEQ ID NO: 247059 - DNA, 25 bp, Mus musculus
ccgacgccttccccagctgggccgc

SEQ ID NO: 247060 - DNA, 25 bp, Mus musculus
ccgacgccttgccaccccgctgggg

SEQ ID NO: 247061 - DNA, 25 bp, Mus musculus
ccgacgccttggtcactggcacaag

SEQ ID NO: 247062 - DNA, 25 bp, Mus musculus
ccgacgccttggtctgtgtgtggta

SEQ ID NO: 247063 - DNA, 25 bp, Mus musculus
ccgacgcgcctttccctctggagcc

SEQ ID NO: 247064 - DNA, 25 bp, Mus musculus
ccgacgcgcctttcctctctggaga

SEQ ID NO: 247065 - DNA, 25 bp, Mus musculus
ccgacgcgcctttctccaccccagg

SEQ ID NO: 247066 - DNA, 25 bp, Mus musculus
ccgacgctgacatggactgggctgt

SEQ ID NO: 247067 - DNA, 25 bp, Mus musculus
ccgacggcacactgaaaagatccgc

SEQ ID NO: 247068 - DNA, 25 bp, Mus musculus
ccgacggcacactgatgagcgcccc

SEQ ID NO: 247069 - DNA, 25 bp, Mus musculus
ccgacgggaaggagtggaaaagaga

SEQ ID NO: 247070 - DNA, 25 bp, Mus musculus
ccgacgggaaggagttatccagctt

SEQ ID NO: 247071 - DNA, 25 bp, Mus musculus
ccgacgttaatgagtgcaatgctca

SEQ ID NO: 247072 - DNA, 25 bp, Mus musculus
ccgactaaatagctggaccacgttc

SEQ ID NO: 247073 - DNA, 25 bp, Mus musculus
ccgactaccagcaggagtcgcctcc

SEQ ID NO: 247074 - DNA, 25 bp, Mus musculus
ccgactaccagcaggcgttgctgct

SEQ ID NO: 247075 - DNA, 25 bp, Mus musculus
ccgactacgggtggactatagtgga

SEQ ID NO: 247076 - DNA, 25 bp, Mus musculus
ccgactcaataaggtcactcttcag

SEQ ID NO: 247077 - DNA, 25 bp, Mus musculus
ccgactccatgcagcacatttaaaa

SEQ ID NO: 247078 - DNA, 25 bp, Mus musculus
ccgactccatgcaggtattgaggct

SEQ ID NO: 247079 - DNA, 25 bp, Mus musculus
ccgactccatgcaggtctatgaagg

SEQ ID NO: 247080 - DNA, 25 bp, Mus musculus
ccgactcccaggagaggaatgctgt

SEQ ID NO: 247081 - DNA, 25 bp, Mus musculus
ccgactcccaggagagtcccggaga

SEQ ID NO: 247082 - DNA, 25 bp, Mus musculus
ccgactcctatagtggactcgggag

SEQ ID NO: 247083 - DNA, 25 bp, Mus musculus
ccgactcctcagacagcactcaaag

SEQ ID NO: 247084 - DNA, 25 bp, Mus musculus
ccgactctctgcctggcccgatttc

SEQ ID NO: 247085 - DNA, 25 bp, Mus musculus
ccgactcttgaagaacatatcccca

SEQ ID NO: 247086 - DNA, 25 bp, Mus musculus
ccgactcttgaaggacatagatgct

SEQ ID NO: 247087 - DNA, 25 bp, Mus musculus
ccgactgaagcacggtgcaacagaa

SEQ ID NO: 247088 - DNA, 25 bp, Mus musculus
ccgactgaatgctcggattgggaaa

SEQ ID NO: 247089 - DNA, 25 bp, Mus musculus
ccgactgagcgccagagtacagtcg

SEQ ID NO: 247090 - DNA, 25 bp, Mus musculus
ccgactgcagaggacccgcgcgcaa

SEQ ID NO: 247091 - DNA, 25 bp, Mus musculus
ccgactggaggatgctttgctgagc

SEQ ID NO: 247092 - DNA, 25 bp, Mus musculus
ccgactggcagcaccgagtgcccaa

SEQ ID NO: 247093 - DNA, 25 bp, Mus musculus
ccgactgggattgggctagtgaacc

SEQ ID NO: 247094 - DNA, 25 bp, Mus musculus
ccgactggtgggcagcttcatgttg

SEQ ID NO: 247095 - DNA, 25 bp, Mus musculus
ccgactggtgggcagggccttcgta

SEQ ID NO: 247096 - DNA, 25 bp, Mus musculus
ccgactgtaccgggctgtcaggggg

SEQ ID NO: 247097 - DNA, 25 bp, Mus musculus
ccgactgtggggtgtgccttcttca

SEQ ID NO: 247098 - DNA, 25 bp, Mus musculus
ccgacttaaaacttcaggttgtgtt

SEQ ID NO: 247099 - DNA, 25 bp, Mus musculus
ccgacttcacccgaggcaaaggtcc

SEQ ID NO: 247100 - DNA, 25 bp, Mus musculus
ccgacttcacctcttttggcaatga

SEQ ID NO: 247101 - DNA, 25 bp, Mus musculus
ccgacttcctcgctgcacctggtgg

SEQ ID NO: 247102 - DNA, 25 bp, Mus musculus
ccgacttctaggcgtgtgtatagaa

SEQ ID NO: 247103 - DNA, 25 bp, Mus musculus
ccgacttctatgcaggcacggtgct

SEQ ID NO: 247104 - DNA, 25 bp, Mus musculus
ccgacttgccgggtctggaatgtga

SEQ ID NO: 247105 - DNA, 25 bp, Mus musculus
ccgacttggacaacaccatcaagaa

SEQ ID NO: 247106 - DNA, 25 bp, Mus musculus
ccgacttggtgaaaaattgcatgtg

SEQ ID NO: 247107 - DNA, 25 bp, Mus musculus
ccgacttggtgaagactccattaga

SEQ ID NO: 247108 - DNA, 25 bp, Mus musculus
ccgacttggtgataaggtacagttt

SEQ ID NO: 247109 - DNA, 25 bp, Mus musculus
ccgacttggtgatgaaaccattaga

SEQ ID NO: 247110 - DNA, 25 bp, Mus musculus
ccgactttcagccagaccatagtcc

SEQ ID NO: 247111 - DNA, 25 bp, Mus musculus
ccgactttccactgcttaggctcga

SEQ ID NO: 247112 - DNA, 25 bp, Mus musculus
ccgactttgccagtatgttactgag

SEQ ID NO: 247113 - DNA, 25 bp, Mus musculus
ccgacttttcagagccactcagcac

SEQ ID NO: 247114 - DNA, 25 bp, Mus musculus
ccgacttttcagggttcagactggg

SEQ ID NO: 247115 - DNA, 25 bp, Mus musculus
ccgagaaactatgtctgctggttgt

SEQ ID NO: 247116 - DNA, 25 bp, Mus musculus
ccgagaaagaggcagagaaacccgc

SEQ ID NO: 247117 - DNA, 25 bp, Mus musculus
ccgagaaagaggtgggacttctgct

SEQ ID NO: 247118 - DNA, 25 bp, Mus musculus
ccgagaaagggtatatgtattttac

SEQ ID NO: 247119 - DNA, 25 bp, Mus musculus
ccgagaaccagagggcacatctgct

SEQ ID NO: 247120 - DNA, 25 bp, Mus musculus
ccgagaaccagttgataaaattacg

SEQ ID NO: 247121 - DNA, 25 bp, Mus musculus
ccgagaacccacagagacgtttcat

SEQ ID NO: 247122 - DNA, 25 bp, Mus musculus
ccgagaacccacagcagagtcttct

SEQ ID NO: 247123 - DNA, 25 bp, Mus musculus
ccgagaaccccgaaatgccaggcag

SEQ ID NO: 247124 - DNA, 25 bp, Mus musculus
ccgagaaccccgaagacatcggcag

SEQ ID NO: 247125 - DNA, 25 bp, Mus musculus
ccgagaacgacccaggttcaagcgc

SEQ ID NO: 247126 - DNA, 25 bp, Mus musculus
ccgagaacgagccaagttcaagcgc

SEQ ID NO: 247127 - DNA, 25 bp, Mus musculus
ccgagaactgagtgaggccttgttt

SEQ ID NO: 247128 - DNA, 25 bp, Mus musculus
ccgagaactgtgttagactttcctg

SEQ ID NO: 247129 - DNA, 25 bp, Mus musculus
ccgagaagaaggaactcggagagta

SEQ ID NO: 247130 - DNA, 25 bp, Mus musculus
ccgagaagaggatggctgctcccag

SEQ ID NO: 247131 - DNA, 25 bp, Mus musculus
ccgagaagccagctggagattcacg

SEQ ID NO: 247132 - DNA, 25 bp, Mus musculus
ccgagaagccggaggttgagaacaa

SEQ ID NO: 247133 - DNA, 25 bp, Mus musculus
ccgagaagcggcgtagggccacacc

SEQ ID NO: 247134 - DNA, 25 bp, Mus musculus
ccgagaagcggggcctacagcgtag

SEQ ID NO: 247135 - DNA, 25 bp, Mus musculus
ccgagaaggagtttcgaaactgcat

SEQ ID NO: 247136 - DNA, 25 bp, Mus musculus
ccgagaaggccgagcctgctaggcc

SEQ ID NO: 247137 - DNA, 25 bp, Mus musculus
ccgagaagttgacctcctcctctga

SEQ ID NO: 247138 - DNA, 25 bp, Mus musculus
ccgagaagttgacctcgtcctccag

SEQ ID NO: 247139 - DNA, 25 bp, Mus musculus
ccgagaataagtccaagtttggggc

SEQ ID NO: 247140 - DNA, 25 bp, Mus musculus
ccgagacaagagattcagatgccac

SEQ ID NO: 247141 - DNA, 25 bp, Mus musculus
ccgagacaagagtttccttctagat

SEQ ID NO: 247142 - DNA, 25 bp, Mus musculus
ccgagacagagacaaaatcacaaag

SEQ ID NO: 247143 - DNA, 25 bp, Mus musculus
ccgagacagattacttcgcaacctg

SEQ ID NO: 247144 - DNA, 25 bp, Mus musculus
ccgagacagcaacaagcttgtagag

SEQ ID NO: 247145 - DNA, 25 bp, Mus musculus
ccgagacatgatagaagcgatggag

SEQ ID NO: 247146 - DNA, 25 bp, Mus musculus
ccgagacatggagatcgagggcgca

SEQ ID NO: 247147 - DNA, 25 bp, Mus musculus
ccgagaccagacccctgagcagcta

SEQ ID NO: 247148 - DNA, 25 bp, Mus musculus
ccgagaccagatcatcttcatggta

SEQ ID NO: 247149 - DNA, 25 bp, Mus musculus
ccgagacccaactgtcgacgcataa

SEQ ID NO: 247150 - DNA, 25 bp, Mus musculus
ccgagaccccagtggtctctctgga

SEQ ID NO: 247151 - DNA, 25 bp, Mus musculus
ccgagacctacgacttcctcttcaa

SEQ ID NO: 247152 - DNA, 25 bp, Mus musculus
ccgagacctccacagggacaactcc

SEQ ID NO: 247153 - DNA, 25 bp, Mus musculus
ccgagacctgtggggtttggtggtg

SEQ ID NO: 247154 - DNA, 25 bp, Mus musculus
ccgagacgtgatggttaagatctcc

SEQ ID NO: 247155 - DNA, 25 bp, Mus musculus
ccgagactgccaagactcactctgt

SEQ ID NO: 247156 - DNA, 25 bp, Mus musculus
ccgagactgccaaggaggccgagtt

SEQ ID NO: 247157 - DNA, 25 bp, Mus musculus
ccgagagaagacacagctggtatgg

SEQ ID NO: 247158 - DNA, 25 bp, Mus musculus
ccgagagaagaccaccaaggccttt

SEQ ID NO: 247159 - DNA, 25 bp, Mus musculus
ccgagagaaggtgggtgacatcacc

SEQ ID NO: 247160 - DNA, 25 bp, Mus musculus
ccgagagacagaagattgtcacaat

SEQ ID NO: 247161 - DNA, 25 bp, Mus musculus
ccgagagagatacgctccttgctcg

SEQ ID NO: 247162 - DNA, 25 bp, Mus musculus
ccgagagagcaagaaggagcagaga

SEQ ID NO: 247163 - DNA, 25 bp, Mus musculus
ccgagagcaggtctgcctgggctta

SEQ ID NO: 247164 - DNA, 25 bp, Mus musculus
ccgagagcagtggccacagttaagc

SEQ ID NO: 247165 - DNA, 25 bp, Mus musculus
ccgagagcatgaagactccgtggtt

SEQ ID NO: 247166 - DNA, 25 bp, Mus musculus
ccgagagcatgaagggcgttttttc

SEQ ID NO: 247167 - DNA, 25 bp, Mus musculus
ccgagagcatgaagtgggccaatcc

SEQ ID NO: 247168 - DNA, 25 bp, Mus musculus
ccgagagccactgattgccacagca

SEQ ID NO: 247169 - DNA, 25 bp, Mus musculus
ccgagagccactggactgacagacg

SEQ ID NO: 247170 - DNA, 25 bp, Mus musculus
ccgagagccaggcggagcacgcccc

SEQ ID NO: 247171 - DNA, 25 bp, Mus musculus
ccgagagcctggtgggcagcctgga

SEQ ID NO: 247172 - DNA, 25 bp, Mus musculus
ccgagagctgaagaatggctttgct

SEQ ID NO: 247173 - DNA, 25 bp, Mus musculus
ccgagaggcacgcccccattggtcc

SEQ ID NO: 247174 - DNA, 25 bp, Mus musculus
ccgagaggcacgggcaatgaggtgg

SEQ ID NO: 247175 - DNA, 25 bp, Mus musculus
ccgagaggtccaagagaacagaaag

SEQ ID NO: 247176 - DNA, 25 bp, Mus musculus
ccgagaggttcgtctgctttgcctt

SEQ ID NO: 247177 - DNA, 25 bp, Mus musculus
ccgagatatcaaagctgccaacgtg

SEQ ID NO: 247178 - DNA, 25 bp, Mus musculus
ccgagatctgctgcccaccaattcc

SEQ ID NO: 247179 - DNA, 25 bp, Mus musculus
ccgagatgcagctgttgccgcacat

SEQ ID NO: 247180 - DNA, 25 bp, Mus musculus
ccgagatgctaccggtactaaacag

SEQ ID NO: 247181 - DNA, 25 bp, Mus musculus
ccgagatggaatgaagaaaagcaat

SEQ ID NO: 247182 - DNA, 25 bp, Mus musculus
ccgagatgttcagctacgagtcctc

SEQ ID NO: 247183 - DNA, 25 bp, Mus musculus
ccgagatgttcagttatgaggagtc

SEQ ID NO: 247184 - DNA, 25 bp, Mus musculus
ccgagattcggctgctgaactaaga

SEQ ID NO: 247185 - DNA, 25 bp, Mus musculus
ccgagattctggacctgtgtttgga

SEQ ID NO: 247186 - DNA, 25 bp, Mus musculus
ccgagattgatgtggccagcctgcg

SEQ ID NO: 247187 - DNA, 25 bp, Mus musculus
ccgagcaacaggtgtcgttgacatt

SEQ ID NO: 247188 - DNA, 25 bp, Mus musculus
ccgagcaacggcaaggtggttgctg

SEQ ID NO: 247189 - DNA, 25 bp, Mus musculus
ccgagcaagacaatcctaaccagta

SEQ ID NO: 247190 - DNA, 25 bp, Mus musculus
ccgagcaccagagacagccattctg

SEQ ID NO: 247191 - DNA, 25 bp, Mus musculus
ccgagcagaagcaagccatacagga

SEQ ID NO: 247192 - DNA, 25 bp, Mus musculus
ccgagcagagcccacagcaacctca

SEQ ID NO: 247193 - DNA, 25 bp, Mus musculus
ccgagcagcgaacagttgaatagat

SEQ ID NO: 247194 - DNA, 25 bp, Mus musculus
ccgagcagcggatcttcctcctggc

SEQ ID NO: 247195 - DNA, 25 bp, Mus musculus
ccgagcagcggattggccaacggct

SEQ ID NO: 247196 - DNA, 25 bp, Mus musculus
ccgagcagctgacaggattcagttt

SEQ ID NO: 247197 - DNA, 25 bp, Mus musculus
ccgagccaagaaactatgttccaac

SEQ ID NO: 247198 - DNA, 25 bp, Mus musculus
ccgagccaaggattttaaacagttt

SEQ ID NO: 247199 - DNA, 25 bp, Mus musculus
ccgagccaaggtgtgagatgcacag

SEQ ID NO: 247200 - DNA, 25 bp, Mus musculus
ccgagccagaggagtacttttgagg

SEQ ID NO: 247201 - DNA, 25 bp, Mus musculus
ccgagccagcaagggggaagaaacc

SEQ ID NO: 247202 - DNA, 25 bp, Mus musculus
ccgagccatgaggtattactacaaa

SEQ ID NO: 247203 - DNA, 25 bp, Mus musculus
ccgagccgcagggccagttcctgat

SEQ ID NO: 247204 - DNA, 25 bp, Mus musculus
ccgagccgctttaggatcgctactc

SEQ ID NO: 247205 - DNA, 25 bp, Mus musculus
ccgagccggacccctctgaccctct

SEQ ID NO: 247206 - DNA, 25 bp, Mus musculus
ccgagccggaccgattcagactcgg

SEQ ID NO: 247207 - DNA, 25 bp, Mus musculus
ccgagccggaccgccgcaaggtcat

SEQ ID NO: 247208 - DNA, 25 bp, Mus musculus
ccgagcctcaccccgagcaggggag

SEQ ID NO: 247209 - DNA, 25 bp, Mus musculus
ccgagcctcacccgagcgcagaccc

SEQ ID NO: 247210 - DNA, 25 bp, Mus musculus
ccgagcctcatggttcggagcgacc

SEQ ID NO: 247211 - DNA, 25 bp, Mus musculus
ccgagcctggggcgaggaaccaccg

SEQ ID NO: 247212 - DNA, 25 bp, Mus musculus
ccgagcctggggcggagtggcagcc

SEQ ID NO: 247213 - DNA, 25 bp, Mus musculus
ccgagcctggggcggtcagtttaga

SEQ ID NO: 247214 - DNA, 25 bp, Mus musculus
ccgagcgaacgagtatcagcatgtg

SEQ ID NO: 247215 - DNA, 25 bp, Mus musculus
ccgagcgatacgacgaaatggtgga

SEQ ID NO: 247216 - DNA, 25 bp, Mus musculus
ccgagcgatacgacggttgaaactg

SEQ ID NO: 247217 - DNA, 25 bp, Mus musculus
ccgagcgcccgcgtccagaggacca

SEQ ID NO: 247218 - DNA, 25 bp, Mus musculus
ccgagcgccctcagttgagccccac

SEQ ID NO: 247219 - DNA, 25 bp, Mus musculus
ccgagcgcgcaccgggttacacaat

SEQ ID NO: 247220 - DNA, 25 bp, Mus musculus
ccgagcggcggggtgaccatggagg

SEQ ID NO: 247221 - DNA, 25 bp, Mus musculus
ccgagcgtaagatcccctgcttcga

SEQ ID NO: 247222 - DNA, 25 bp, Mus musculus
ccgagcgtaaggctgatggatgtct

SEQ ID NO: 247223 - DNA, 25 bp, Mus musculus
ccgagcgtacctgtgcccacatctg

SEQ ID NO: 247224 - DNA, 25 bp, Mus musculus
ccgagctcacagctatccctctcac

SEQ ID NO: 247225 - DNA, 25 bp, Mus musculus
ccgagctcagcaaagaagttgggat

SEQ ID NO: 247226 - DNA, 25 bp, Mus musculus
ccgagctcagccaaccccaccagag

SEQ ID NO: 247227 - DNA, 25 bp, Mus musculus
ccgagctcctcgagcctaacccagg

SEQ ID NO: 247228 - DNA, 25 bp, Mus musculus
ccgagctcctcgctgtgatcactgc

SEQ ID NO: 247229 - DNA, 25 bp, Mus musculus
ccgagctcgcggcggatagaaggac

SEQ ID NO: 247230 - DNA, 25 bp, Mus musculus
ccgagctcgcggcgggtaccttaac

SEQ ID NO: 247231 - DNA, 25 bp, Mus musculus
ccgagctgaaacagggaccgcgtgg

SEQ ID NO: 247232 - DNA, 25 bp, Mus musculus
ccgagctgatgtgtggagcctggct

SEQ ID NO: 247233 - DNA, 25 bp, Mus musculus
ccgagctgcaggagagcgcacacac

SEQ ID NO: 247234 - DNA, 25 bp, Mus musculus
ccgagctgcctacagataccatggc

SEQ ID NO: 247235 - DNA, 25 bp, Mus musculus
ccgagctgcctacagctcagcagag

SEQ ID NO: 247236 - DNA, 25 bp, Mus musculus
ccgagctgcctacaggaaaaaaaat

SEQ ID NO: 247237 - DNA, 25 bp, Mus musculus
ccgagctgcctacaggtgactggat

SEQ ID NO: 247238 - DNA, 25 bp, Mus musculus
ccgaggaaagccagtaatggtcagc

SEQ ID NO: 247239 - DNA, 25 bp, Mus musculus
ccgaggaaccctggggcatcccccg

SEQ ID NO: 247240 - DNA, 25 bp, Mus musculus
ccgaggaagtagagccgccatgact

SEQ ID NO: 247241 - DNA, 25 bp, Mus musculus
ccgaggacaatcgggtgatccagga

SEQ ID NO: 247242 - DNA, 25 bp, Mus musculus
ccgaggacagagccaccagccatgc

SEQ ID NO: 247243 - DNA, 25 bp, Mus musculus
ccgaggaccagcgcaacaaaaagat

SEQ ID NO: 247244 - DNA, 25 bp, Mus musculus
ccgaggaccccacagtgcaagaatc

SEQ ID NO: 247245 - DNA, 25 bp, Mus musculus
ccgaggaccctgctctgacgtatga

SEQ ID NO: 247246 - DNA, 25 bp, Mus musculus
ccgaggacgaagtgtttgactttgg

SEQ ID NO: 247247 - DNA, 25 bp, Mus musculus
ccgaggacgactccttctatgaaat

SEQ ID NO: 247248 - DNA, 25 bp, Mus musculus
ccgaggacgggaaagaacacatgtc

SEQ ID NO: 247249 - DNA, 25 bp, Mus musculus
ccgaggacgtgccaagccgcaatga

SEQ ID NO: 247250 - DNA, 25 bp, Mus musculus
ccgaggactatgagaccaccatcag

SEQ ID NO: 247251 - DNA, 25 bp, Mus musculus
ccgaggacttcaccatccacgaaaa

SEQ ID NO: 247252 - DNA, 25 bp, Mus musculus
ccgaggagagcactgcctgcacatt

SEQ ID NO: 247253 - DNA, 25 bp, Mus musculus
ccgaggagagccggatggcgcagaa

SEQ ID NO: 247254 - DNA, 25 bp, Mus musculus
ccgaggagcgcaggggccccacctg

SEQ ID NO: 247255 - DNA, 25 bp, Mus musculus
ccgaggagcgcaggttgtgtcacca

SEQ ID NO: 247256 - DNA, 25 bp, Mus musculus
ccgaggagctaatcagtgagatgat

SEQ ID NO: 247257 - DNA, 25 bp, Mus musculus
ccgaggagctaattctgaagtccct

SEQ ID NO: 247258 - DNA, 25 bp, Mus musculus
ccgaggaggggcgtgctggtcacca

SEQ ID NO: 247259 - DNA, 25 bp, Mus musculus
ccgaggaggtgaggggacttcaaaa

SEQ ID NO: 247260 - DNA, 25 bp, Mus musculus
ccgaggatatcagaaggactcagtc

SEQ ID NO: 247261 - DNA, 25 bp, Mus musculus
ccgaggcaagtttccttttagacca

SEQ ID NO: 247262 - DNA, 25 bp, Mus musculus
ccgaggcagaggatttggacgtggc

SEQ ID NO: 247263 - DNA, 25 bp, Mus musculus
ccgaggccaaaactgggtttcacta

SEQ ID NO: 247264 - DNA, 25 bp, Mus musculus
ccgaggccaaagttcaggacatctg

SEQ ID NO: 247265 - DNA, 25 bp, Mus musculus
ccgaggccaaccgtccagaaggatg

SEQ ID NO: 247266 - DNA, 25 bp, Mus musculus
ccgaggccaaccgtgtgctgctgaa

SEQ ID NO: 247267 - DNA, 25 bp, Mus musculus
ccgaggccagagcatcccagccttg

SEQ ID NO: 247268 - DNA, 25 bp, Mus musculus
ccgaggccagggactcagcgatgtc

SEQ ID NO: 247269 - DNA, 25 bp, Mus musculus
ccgaggcccagcgatccctctgtga

SEQ ID NO: 247270 - DNA, 25 bp, Mus musculus
ccgaggcccaggtcagtctggacct

SEQ ID NO: 247271 - DNA, 25 bp, Mus musculus
ccgaggccgaggacatatgggtgat

SEQ ID NO: 247272 - DNA, 25 bp, Mus musculus
ccgaggcctacctcccttttgctag

SEQ ID NO: 247273 - DNA, 25 bp, Mus musculus
ccgaggcctaggatcagttcttaag

SEQ ID NO: 247274 - DNA, 25 bp, Mus musculus
ccgaggcctatgttgatctaaccaa

SEQ ID NO: 247275 - DNA, 25 bp, Mus musculus
ccgaggccttcagaatctgaggaac

SEQ ID NO: 247276 - DNA, 25 bp, Mus musculus
ccgaggccttcaggtggttgagcat

SEQ ID NO: 247277 - DNA, 25 bp, Mus musculus
ccgaggcgcgccggaagcccgacat

SEQ ID NO: 247278 - DNA, 25 bp, Mus musculus
ccgaggcgcgtgagacgcagaggca

SEQ ID NO: 247279 - DNA, 25 bp, Mus musculus
ccgaggcgcgtgagatgcccggaac

SEQ ID NO: 247280 - DNA, 25 bp, Mus musculus
ccgaggcggagtgggtgacccgggg

SEQ ID NO: 247281 - DNA, 25 bp, Mus musculus
ccgaggcggagtggttctctttctg

SEQ ID NO: 247282 - DNA, 25 bp, Mus musculus
ccgaggcgtcccaggcctggaatgc

SEQ ID NO: 247283 - DNA, 25 bp, Mus musculus
ccgaggctcaccaggatgtcttcca

SEQ ID NO: 247284 - DNA, 25 bp, Mus musculus
ccgaggctgacaggtgagatctcca

SEQ ID NO: 247285 - DNA, 25 bp, Mus musculus
ccgagggaccggacactggccaaaa

SEQ ID NO: 247286 - DNA, 25 bp, Mus musculus
ccgagggagaggcaatacagagtgc

SEQ ID NO: 247287 - DNA, 25 bp, Mus musculus
ccgagggagaggcactgatggagga

SEQ ID NO: 247288 - DNA, 25 bp, Mus musculus
ccgagggatgctcaaggacagtgct

SEQ ID NO: 247289 - DNA, 25 bp, Mus musculus
ccgagggcaagaaagatgaacgaga

SEQ ID NO: 247290 - DNA, 25 bp, Mus musculus
ccgagggcagctactgcaagacaaa

SEQ ID NO: 247291 - DNA, 25 bp, Mus musculus
ccgagggcgggcggcgacagcagcg

SEQ ID NO: 247292 - DNA, 25 bp, Mus musculus
ccgagggcggggcagcctgatgacc

SEQ ID NO: 247293 - DNA, 25 bp, Mus musculus
ccgagggcggtggaggaacagaccc

SEQ ID NO: 247294 - DNA, 25 bp, Mus musculus
ccgagggctctacttctgttcgtta

SEQ ID NO: 247295 - DNA, 25 bp, Mus musculus
ccgaggggcggagctacagagactg

SEQ ID NO: 247296 - DNA, 25 bp, Mus musculus
ccgaggggcggatacagagactgca

SEQ ID NO: 247297 - DNA, 25 bp, Mus musculus
ccgaggggtgaggagatttgaaaaa

SEQ ID NO: 247298 - DNA, 25 bp, Mus musculus
ccgaggtaagaaatggcgctcaaac

SEQ ID NO: 247299 - DNA, 25 bp, Mus musculus
ccgaggtaccatttccaaggccgtg

SEQ ID NO: 247300 - DNA, 25 bp, Mus musculus
ccgaggtcacagatgaaattatgga

SEQ ID NO: 247301 - DNA, 25 bp, Mus musculus
ccgaggtcacagttgaaattatgga

SEQ ID NO: 247302 - DNA, 25 bp, Mus musculus
ccgaggtcctcacctccttcacttg

SEQ ID NO: 247303 - DNA, 25 bp, Mus musculus
ccgaggtcgatacttcccaagaaag

SEQ ID NO: 247304 - DNA, 25 bp, Mus musculus
ccgaggtcggcagaggtaaccatgg

SEQ ID NO: 247305 - DNA, 25 bp, Mus musculus
ccgaggtctcgcagcacccagcagg

SEQ ID NO: 247306 - DNA, 25 bp, Mus musculus
ccgaggtgatccgagatcgcctttg

SEQ ID NO: 247307 - DNA, 25 bp, Mus musculus
ccgaggtgcacagaggcataatcaa

SEQ ID NO: 247308 - DNA, 25 bp, Mus musculus
ccgaggtgcgagccgtaacacaagg

SEQ ID NO: 247309 - DNA, 25 bp, Mus musculus
ccgaggttctctagggtgaagagat

SEQ ID NO: 247310 - DNA, 25 bp, Mus musculus
ccgaggttctctagtctgcccgaga

SEQ ID NO: 247311 - DNA, 25 bp, Mus musculus
ccgaggttctgccgcaggagatgct

SEQ ID NO: 247312 - DNA, 25 bp, Mus musculus
ccgagtaacagggattgccggaact

SEQ ID NO: 247313 - DNA, 25 bp, Mus musculus
ccgagtaatcctgtgtcttggtttg

SEQ ID NO: 247314 - DNA, 25 bp, Mus musculus
ccgagtacagaaatgctgagcttcc

SEQ ID NO: 247315 - DNA, 25 bp, Mus musculus
ccgagtaccagagcccacagacgct

SEQ ID NO: 247316 - DNA, 25 bp, Mus musculus
ccgagtaccaggacctgacgttcct

SEQ ID NO: 247317 - DNA, 25 bp, Mus musculus
ccgagtaccaggctaaccctttcaa

SEQ ID NO: 247318 - DNA, 25 bp, Mus musculus
ccgagtagctgggtatcatagttaa

SEQ ID NO: 247319 - DNA, 25 bp, Mus musculus
ccgagtagtgtgtgacggaatggac

SEQ ID NO: 247320 - DNA, 25 bp, Mus musculus
ccgagtataagcaattaaccctgaa

SEQ ID NO: 247321 - DNA, 25 bp, Mus musculus
ccgagtatccgaggctggttatgac

SEQ ID NO: 247322 - DNA, 25 bp, Mus musculus
ccgagtatgggcgggtaatctatgc

SEQ ID NO: 247323 - DNA, 25 bp, Mus musculus
ccgagtcaaaagagctttggcaccg

SEQ ID NO: 247324 - DNA, 25 bp, Mus musculus
ccgagtcaagcaggtctgcggagat

SEQ ID NO: 247325 - DNA, 25 bp, Mus musculus
ccgagtcacacgataagcccctggt

SEQ ID NO: 247326 - DNA, 25 bp, Mus musculus
ccgagtcatcaagacttcataaggg

SEQ ID NO: 247327 - DNA, 25 bp, Mus musculus
ccgagtcatcaaggtaaaccgagag

SEQ ID NO: 247328 - DNA, 25 bp, Mus musculus
ccgagtccagattgaacacatatct

SEQ ID NO: 247329 - DNA, 25 bp, Mus musculus
ccgagtccaggccgacgtggaaaga

SEQ ID NO: 247330 - DNA, 25 bp, Mus musculus
ccgagtccccaagaacacagccaaa

SEQ ID NO: 247331 - DNA, 25 bp, Mus musculus
ccgagtccccaagcacggctggagc

SEQ ID NO: 247332 - DNA, 25 bp, Mus musculus
ccgagtccgacggatcgctactctt

SEQ ID NO: 247333 - DNA, 25 bp, Mus musculus
ccgagtccgagagttcaaaggtgaa

SEQ ID NO: 247334 - DNA, 25 bp, Mus musculus
ccgagtcctcaggccaatgtgcttt

SEQ ID NO: 247335 - DNA, 25 bp, Mus musculus
ccgagtcgctgatgagcgggaccga

SEQ ID NO: 247336 - DNA, 25 bp, Mus musculus
ccgagtcgggccggacagaacagta

SEQ ID NO: 247337 - DNA, 25 bp, Mus musculus
ccgagtctagagctcctccgggatc

SEQ ID NO: 247338 - DNA, 25 bp, Mus musculus
ccgagtctggatcatctctggacag

SEQ ID NO: 247339 - DNA, 25 bp, Mus musculus
ccgagtgatagggtaaaatttatga

SEQ ID NO: 247340 - DNA, 25 bp, Mus musculus
ccgagtgatggggcgttgggcgctc

SEQ ID NO: 247341 - DNA, 25 bp, Mus musculus
ccgagtgcaacatcctccgcaaagc

SEQ ID NO: 247342 - DNA, 25 bp, Mus musculus
ccgagtgcagagagcaaagaccatg

SEQ ID NO: 247343 - DNA, 25 bp, Mus musculus
ccgagtgcctgtgctggtggagtcc

SEQ ID NO: 247344 - DNA, 25 bp, Mus musculus
ccgagtgcgagcgggttgctgttct

SEQ ID NO: 247345 - DNA, 25 bp, Mus musculus
ccgagtggaagagcggagactactg

SEQ ID NO: 247346 - DNA, 25 bp, Mus musculus
ccgagtggagctggacctcggccta

SEQ ID NO: 247347 - DNA, 25 bp, Mus musculus
ccgagtggcagtgatcatgggcagg

SEQ ID NO: 247348 - DNA, 25 bp, Mus musculus
ccgagtgtactgaggaaagcagagg

SEQ ID NO: 247349 - DNA, 25 bp, Mus musculus
ccgagtgtactgaggcatatttaat

SEQ ID NO: 247350 - DNA, 25 bp, Mus musculus
ccgagtgttgggagcgggatgaccc

SEQ ID NO: 247351 - DNA, 25 bp, Mus musculus
ccgagttcaaggtcgcttctccgat

SEQ ID NO: 247352 - DNA, 25 bp, Mus musculus
ccgagttcagattctccgagtcaag

SEQ ID NO: 247353 - DNA, 25 bp, Mus musculus
ccgagttcagcaagctttgcagcca

SEQ ID NO: 247354 - DNA, 25 bp, Mus musculus
ccgagttcagggaacagattctccg

SEQ ID NO: 247355 - DNA, 25 bp, Mus musculus
ccgagttccgggtcatgcatccatc

SEQ ID NO: 247356 - DNA, 25 bp, Mus musculus
ccgagttccgggtgctgggtgtgtg

SEQ ID NO: 247357 - DNA, 25 bp, Mus musculus
ccgagttcggactttctgcactggc

SEQ ID NO: 247358 - DNA, 25 bp, Mus musculus
ccgagtttccagagccctgaagaca

SEQ ID NO: 247359 - DNA, 25 bp, Mus musculus
ccgagtttcttttggaggtgcagtg

SEQ ID NO: 247360 - DNA, 25 bp, Mus musculus
ccgagtttgcagaggatgacgtcag

SEQ ID NO: 247361 - DNA, 25 bp, Mus musculus
ccgagtttgcagaggtgctggaaat

SEQ ID NO: 247362 - DNA, 25 bp, Mus musculus
ccgataagcaccggcctctggaaat

SEQ ID NO: 247363 - DNA, 25 bp, Mus musculus
ccgatacaaaacaactgataaaaga

SEQ ID NO: 247364 - DNA, 25 bp, Mus musculus
ccgatagctctccagacacaagcat

SEQ ID NO: 247365 - DNA, 25 bp, Mus musculus
ccgataggaagtatgaacatcatct

SEQ ID NO: 247366 - DNA, 25 bp, Mus musculus
ccgataggcagagcagctccatcag

SEQ ID NO: 247367 - DNA, 25 bp, Mus musculus
ccgataggcagaggtcagtaccatg

SEQ ID NO: 247368 - DNA, 25 bp, Mus musculus
ccgataggctgcgatgggtggatga

SEQ ID NO: 247369 - DNA, 25 bp, Mus musculus
ccgatagggaggaagcacctctggg

SEQ ID NO: 247370 - DNA, 25 bp, Mus musculus
ccgatatgatgagaggccgggcccc

SEQ ID NO: 247371 - DNA, 25 bp, Mus musculus
ccgatatgatgagaggcgacgtagt

SEQ ID NO: 247372 - DNA, 25 bp, Mus musculus
ccgatcacagggagaacattctgaa

SEQ ID NO: 247373 - DNA, 25 bp, Mus musculus
ccgatcacaggtcacttggcatgag

SEQ ID NO: 247374 - DNA, 25 bp, Mus musculus
ccgatcaccgcaacggccattcccc

SEQ ID NO: 247375 - DNA, 25 bp, Mus musculus
ccgatcaccggggctaccgtgtgat

SEQ ID NO: 247376 - DNA, 25 bp, Mus musculus
ccgatcaggaggcaggttgtcacaa

SEQ ID NO: 247377 - DNA, 25 bp, Mus musculus
ccgatcagtgtgagtatatacactt

SEQ ID NO: 247378 - DNA, 25 bp, Mus musculus
ccgatcatggagtattgataacaac

SEQ ID NO: 247379 - DNA, 25 bp, Mus musculus
ccgatccaacagaccctcaggactt

SEQ ID NO: 247380 - DNA, 25 bp, Mus musculus
ccgatccccagacgagcaccaagga

SEQ ID NO: 247381 - DNA, 25 bp, Mus musculus
ccgatccgcgtgggatccaaggact

SEQ ID NO: 247382 - DNA, 25 bp, Mus musculus
ccgatcctctccaggacccaagttt

SEQ ID NO: 247383 - DNA, 25 bp, Mus musculus
ccgatccttaccagtgaggctgctg

SEQ ID NO: 247384 - DNA, 25 bp, Mus musculus
ccgatcgccaatggttggttttgac

SEQ ID NO: 247385 - DNA, 25 bp, Mus musculus
ccgatcgtgtgcgggcatttcaggg

SEQ ID NO: 247386 - DNA, 25 bp, Mus musculus
ccgatctaatccagggtctgccgtc

SEQ ID NO: 247387 - DNA, 25 bp, Mus musculus
ccgatctagaatacctgaagaaaat

SEQ ID NO: 247388 - DNA, 25 bp, Mus musculus
ccgatctctgccagctttgtttact

SEQ ID NO: 247389 - DNA, 25 bp, Mus musculus
ccgatgaagaacgagccctcgtggg

SEQ ID NO: 247390 - DNA, 25 bp, Mus musculus
ccgatgacaagcttgctcgcctgac

SEQ ID NO: 247391 - DNA, 25 bp, Mus musculus
ccgatgacgtcttggctcatgctgc

SEQ ID NO: 247392 - DNA, 25 bp, Mus musculus
ccgatgagtacaaagcatacgagga

SEQ ID NO: 247393 - DNA, 25 bp, Mus musculus
ccgatgagtcggatgcagaggcctc

SEQ ID NO: 247394 - DNA, 25 bp, Mus musculus
ccgatgatcttggttttgagttctt

SEQ ID NO: 247395 - DNA, 25 bp, Mus musculus
ccgatgatgcgggagggaccttgtg

SEQ ID NO: 247396 - DNA, 25 bp, Mus musculus
ccgatgatgcggggggcctggatcg

SEQ ID NO: 247397 - DNA, 25 bp, Mus musculus
ccgatgatgcgggtttctccggctg

SEQ ID NO: 247398 - DNA, 25 bp, Mus musculus
ccgatgcaatgctgtcgatcattgc

SEQ ID NO: 247399 - DNA, 25 bp, Mus musculus
ccgatgcatgaatatacagagtaag

SEQ ID NO: 247400 - DNA, 25 bp, Mus musculus
ccgatgccaaaatccaacaaaccaa

SEQ ID NO: 247401 - DNA, 25 bp, Mus musculus
ccgatgccaaaattccaccaaacac

SEQ ID NO: 247402 - DNA, 25 bp, Mus musculus
ccgatgccacctaggtttgaagact

SEQ ID NO: 247403 - DNA, 25 bp, Mus musculus
ccgatgccagatgagacatcgttcg

SEQ ID NO: 247404 - DNA, 25 bp, Mus musculus
ccgatgcccactggacttcaggaac

SEQ ID NO: 247405 - DNA, 25 bp, Mus musculus
ccgatgctgcctcaggtacctttga

SEQ ID NO: 247406 - DNA, 25 bp, Mus musculus
ccgatgctgcctcagtttgacagca

SEQ ID NO: 247407 - DNA, 25 bp, Mus musculus
ccgatggagaggatcgcccccaccc

SEQ ID NO: 247408 - DNA, 25 bp, Mus musculus
ccgatggcagaaacttgattgaacc

SEQ ID NO: 247409 - DNA, 25 bp, Mus musculus
ccgatgggggccatctcacccatgg

SEQ ID NO: 247410 - DNA, 25 bp, Mus musculus
ccgatgtaccaggaaacatccgagc

SEQ ID NO: 247411 - DNA, 25 bp, Mus musculus
ccgatgtacgaggaccatcccacac

SEQ ID NO: 247412 - DNA, 25 bp, Mus musculus
ccgatgtacgagggaaggatcatcg

SEQ ID NO: 247413 - DNA, 25 bp, Mus musculus
ccgatgtgacctctgccatgccatg

SEQ ID NO: 247414 - DNA, 25 bp, Mus musculus
ccgatgtgtctgagctgtccagctc

SEQ ID NO: 247415 - DNA, 25 bp, Mus musculus
ccgattacgtgggacgagtccggct

SEQ ID NO: 247416 - DNA, 25 bp, Mus musculus
ccgattagcagaagctcacgctcgc

SEQ ID NO: 247417 - DNA, 25 bp, Mus musculus
ccgattatccagagacagcccaaaa

SEQ ID NO: 247418 - DNA, 25 bp, Mus musculus
ccgattcccagcttccaccatcctc

SEQ ID NO: 247419 - DNA, 25 bp, Mus musculus
ccgattcctaggggtgttattgggc

SEQ ID NO: 247420 - DNA, 25 bp, Mus musculus
ccgattcgcccagagtttgggaaat

SEQ ID NO: 247421 - DNA, 25 bp, Mus musculus
ccgattgcagcgtgcccttgaagga

SEQ ID NO: 247422 - DNA, 25 bp, Mus musculus
ccgattggacaagaggtgcaccatg

SEQ ID NO: 247423 - DNA, 25 bp, Mus musculus
ccgatttcgaggggagggagacgat

SEQ ID NO: 247424 - DNA, 25 bp, Mus musculus
ccgatttctagcgtatatggaggaa

SEQ ID NO: 247425 - DNA, 25 bp, Mus musculus
ccgatttgggacgaggacctattaa

SEQ ID NO: 247426 - DNA, 25 bp, Mus musculus
ccgatttgggcacgatgtataccag

SEQ ID NO: 247427 - DNA, 25 bp, Mus musculus
ccgatttgggcacggactgtcaggg

SEQ ID NO: 247428 - DNA, 25 bp, Mus musculus
ccgattttatgtggggagagaaaag

SEQ ID NO: 247429 - DNA, 25 bp, Mus musculus
ccgcaaacaaaaaatgcagagagaa

SEQ ID NO: 247430 - DNA, 25 bp, Mus musculus
ccgcaaacagggcctggatcctgcc

SEQ ID NO: 247431 - DNA, 25 bp, Mus musculus
ccgcaaagaagttccaccaggtgag

SEQ ID NO: 247432 - DNA, 25 bp, Mus musculus
ccgcaacaacgccatctatgagaaa

SEQ ID NO: 247433 - DNA, 25 bp, Mus musculus
ccgcaacactgaccgaggcaatgac

SEQ ID NO: 247434 - DNA, 25 bp, Mus musculus
ccgcaacagaggcctttcagtcaga

SEQ ID NO: 247435 - DNA, 25 bp, Mus musculus
ccgcaacagagggccttaacaatga

SEQ ID NO: 247436 - DNA, 25 bp, Mus musculus
ccgcaacagcagcttcgagagctgt

SEQ ID NO: 247437 - DNA, 25 bp, Mus musculus
ccgcaacagcagggttctggctgct

SEQ ID NO: 247438 - DNA, 25 bp, Mus musculus
ccgcaacagccatggcttctccatg

SEQ ID NO: 247439 - DNA, 25 bp, Mus musculus
ccgcaacggccccagaaattactgt

SEQ ID NO: 247440 - DNA, 25 bp, Mus musculus
ccgcaacggccccagaagctgactg

SEQ ID NO: 247441 - DNA, 25 bp, Mus musculus
ccgcaactctgcggcacatggtgat

SEQ ID NO: 247442 - DNA, 25 bp, Mus musculus
ccgcaacttacaggaagttgtgcca

SEQ ID NO: 247443 - DNA, 25 bp, Mus musculus
ccgcaagaaaagtatcaaggaggtg

SEQ ID NO: 247444 - DNA, 25 bp, Mus musculus
ccgcaagaaggaggaacaagaattt

SEQ ID NO: 247445 - DNA, 25 bp, Mus musculus
ccgcaagaaggaggttatgaatgaa

SEQ ID NO: 247446 - DNA, 25 bp, Mus musculus
ccgcaagcagcagtctctggtccca

SEQ ID NO: 247447 - DNA, 25 bp, Mus musculus
ccgcaagccaggacccacctgcaca

SEQ ID NO: 247448 - DNA, 25 bp, Mus musculus
ccgcaagccaggtcccacctgcaca

SEQ ID NO: 247449 - DNA, 25 bp, Mus musculus
ccgcaagcccattacttcacagagg

SEQ ID NO: 247450 - DNA, 25 bp, Mus musculus
ccgcaagctgccccccaagtgtcca

SEQ ID NO: 247451 - DNA, 25 bp, Mus musculus
ccgcaagctgtctgatcagtgcaca

SEQ ID NO: 247452 - DNA, 25 bp, Mus musculus
ccgcaaggaaaggctcctagaaggt

SEQ ID NO: 247453 - DNA, 25 bp, Mus musculus
ccgcaaggacgaactcatcaagtag

SEQ ID NO: 247454 - DNA, 25 bp, Mus musculus
ccgcaaggccccagccaagccgcaa

SEQ ID NO: 247455 - DNA, 25 bp, Mus musculus
ccgcaagggcaaggtgctggctcag

SEQ ID NO: 247456 - DNA, 25 bp, Mus musculus
ccgcacaagtacacgacagacggca

SEQ ID NO: 247457 - DNA, 25 bp, Mus musculus
ccgcacaagtacacggaaatgtgtc

SEQ ID NO: 247458 - DNA, 25 bp, Mus musculus
ccgcacagaactgactgtccctttg

SEQ ID NO: 247459 - DNA, 25 bp, Mus musculus
ccgcacagacccgaagtgtggagtc

SEQ ID NO: 247460 - DNA, 25 bp, Mus musculus
ccgcacagacccgttcacgaaccag

SEQ ID NO: 247461 - DNA, 25 bp, Mus musculus
ccgcacagacccgttccaggaggca

SEQ ID NO: 247462 - DNA, 25 bp, Mus musculus
ccgcacagcaggttctccacatgac

SEQ ID NO: 247463 - DNA, 25 bp, Mus musculus
ccgcacagccgggttccatgatgga

SEQ ID NO: 247464 - DNA, 25 bp, Mus musculus
ccgcacagccggtgctggagactga

SEQ ID NO: 247465 - DNA, 25 bp, Mus musculus
ccgcacagcctgctcttcctcctgg

SEQ ID NO: 247466 - DNA, 25 bp, Mus musculus
ccgcacagctgcggatcaccagacc

SEQ ID NO: 247467 - DNA, 25 bp, Mus musculus
ccgcacagtcaaggagctgggcaac

SEQ ID NO: 247468 - DNA, 25 bp, Mus musculus
ccgcaccaaagtggagcccctgctg

SEQ ID NO: 247469 - DNA, 25 bp, Mus musculus
ccgcaccaacgttttgaggacttcg

SEQ ID NO: 247470 - DNA, 25 bp, Mus musculus
ccgcaccaagtgtgaggagataaag

SEQ ID NO: 247471 - DNA, 25 bp, Mus musculus
ccgcaccaagtgtgaggagatgaag

SEQ ID NO: 247472 - DNA, 25 bp, Mus musculus
ccgcaccacaggcaaatcctcctcc

SEQ ID NO: 247473 - DNA, 25 bp, Mus musculus
ccgcaccagaggaacttctgcaggt

SEQ ID NO: 247474 - DNA, 25 bp, Mus musculus
ccgcacccagctcagtggatctggc

SEQ ID NO: 247475 - DNA, 25 bp, Mus musculus
ccgcaccgctacagggcattaggag

SEQ ID NO: 247476 - DNA, 25 bp, Mus musculus
ccgcaccgtgtcgcgtcaagatggg

SEQ ID NO: 247477 - DNA, 25 bp, Mus musculus
ccgcaccgtgtcgcgtgagatctcc

SEQ ID NO: 247478 - DNA, 25 bp, Mus musculus
ccgcacctacctggcaggccatggc

SEQ ID NO: 247479 - DNA, 25 bp, Mus musculus
ccgcacctacgagctcctggaaaca

SEQ ID NO: 247480 - DNA, 25 bp, Mus musculus
ccgcacctgccaggccacagacctc

SEQ ID NO: 247481 - DNA, 25 bp, Mus musculus
ccgcacctgccaggtaagaagaaaa

SEQ ID NO: 247482 - DNA, 25 bp, Mus musculus
ccgcacgaccgtccggtgcgtataa

SEQ ID NO: 247483 - DNA, 25 bp, Mus musculus
ccgcacgaccgtccggtgttctggc

SEQ ID NO: 247484 - DNA, 25 bp, Mus musculus
ccgcacggagagaagaaaccaaaac

SEQ ID NO: 247485 - DNA, 25 bp, Mus musculus
ccgcacggcggacaaatgaagagaa

SEQ ID NO: 247486 - DNA, 25 bp, Mus musculus
ccgcacggcgggaatctcttccttc

SEQ ID NO: 247487 - DNA, 25 bp, Mus musculus
ccgcactatgccaaaaataaagcag

SEQ ID NO: 247488 - DNA, 25 bp, Mus musculus
ccgcactcaccactttgccctgttc

SEQ ID NO: 247489 - DNA, 25 bp, Mus musculus
ccgcactcagctgtttgaaataaaa

SEQ ID NO: 247490 - DNA, 25 bp, Mus musculus
ccgcactcaggggaaggagccacat

SEQ ID NO: 247491 - DNA, 25 bp, Mus musculus
ccgcactcatcatggtggacaatgc

SEQ ID NO: 247492 - DNA, 25 bp, Mus musculus
ccgcactgccaaggagtgtggggcc

SEQ ID NO: 247493 - DNA, 25 bp, Mus musculus
ccgcactgccaaggtttcctgcctt

SEQ ID NO: 247494 - DNA, 25 bp, Mus musculus
ccgcactggagcgtgctcttcagga

SEQ ID NO: 247495 - DNA, 25 bp, Mus musculus
ccgcagaacgcatcccacagctggt

SEQ ID NO: 247496 - DNA, 25 bp, Mus musculus
ccgcagaatatggagggccccatgg

SEQ ID NO: 247497 - DNA, 25 bp, Mus musculus
ccgcagacaagatgccttggatgag

SEQ ID NO: 247498 - DNA, 25 bp, Mus musculus
ccgcagacaagggttctccagacca

SEQ ID NO: 247499 - DNA, 25 bp, Mus musculus
ccgcagacacccgctgtgagcgctt

SEQ ID NO: 247500 - DNA, 25 bp, Mus musculus
ccgcagacaccttccgccaagagaa

SEQ ID NO: 247501 - DNA, 25 bp, Mus musculus
ccgcagacagacctcaagtactaca

SEQ ID NO: 247502 - DNA, 25 bp, Mus musculus
ccgcagacagagtgccctgggcgaa

SEQ ID NO: 247503 - DNA, 25 bp, Mus musculus
ccgcagaccatcatgcacatccagg

SEQ ID NO: 247504 - DNA, 25 bp, Mus musculus
ccgcagacccacaggaaacaccagc

SEQ ID NO: 247505 - DNA, 25 bp, Mus musculus
ccgcagaccccgcagctcttggcaa

SEQ ID NO: 247506 - DNA, 25 bp, Mus musculus
ccgcagaccccgcaggagacatatg

SEQ ID NO: 247507 - DNA, 25 bp, Mus musculus
ccgcagaccggactccagattccaa

SEQ ID NO: 247508 - DNA, 25 bp, Mus musculus
ccgcagacgggaccttcttttggag

SEQ ID NO: 247509 - DNA, 25 bp, Mus musculus
ccgcagacgggagctgcaaagttgg

SEQ ID NO: 247510 - DNA, 25 bp, Mus musculus
ccgcagagacgagaacagagctgac

SEQ ID NO: 247511 - DNA, 25 bp, Mus musculus
ccgcagagacgagctgacatccgat

SEQ ID NO: 247512 - DNA, 25 bp, Mus musculus
ccgcagagagaggttaccctgcatc

SEQ ID NO: 247513 - DNA, 25 bp, Mus musculus
ccgcagagaggaactggcccaaatc

SEQ ID NO: 247514 - DNA, 25 bp, Mus musculus
ccgcagagcgacaggctccgtgaag

SEQ ID NO: 247515 - DNA, 25 bp, Mus musculus
ccgcagcaagatcgaggagctggaa

SEQ ID NO: 247516 - DNA, 25 bp, Mus musculus
ccgcagcaagatcgaggagctggag

SEQ ID NO: 247517 - DNA, 25 bp, Mus musculus
ccgcagcaccggcgtgttgcccacc

SEQ ID NO: 247518 - DNA, 25 bp, Mus musculus
ccgcagcactacacgtacctgaagg

SEQ ID NO: 247519 - DNA, 25 bp, Mus musculus
ccgcagcacttcaagatgtatcgcc

SEQ ID NO: 247520 - DNA, 25 bp, Mus musculus
ccgcagcagccagggccggccctcg

SEQ ID NO: 247521 - DNA, 25 bp, Mus musculus
ccgcagcagccctggtgtctgagag

SEQ ID NO: 247522 - DNA, 25 bp, Mus musculus
ccgcagcagccctgtttgatctgtg

SEQ ID NO: 247523 - DNA, 25 bp, Mus musculus
ccgcagcatggagacaaaaaagcgt

SEQ ID NO: 247524 - DNA, 25 bp, Mus musculus
ccgcagcatgggaaattaagcgaga

SEQ ID NO: 247525 - DNA, 25 bp, Mus musculus
ccgcagccagaggagtatctgatta

SEQ ID NO: 247526 - DNA, 25 bp, Mus musculus
ccgcagccagaggggctcggtctct

SEQ ID NO: 247527 - DNA, 25 bp, Mus musculus
ccgcagcccaaggagatacagaatt

SEQ ID NO: 247528 - DNA, 25 bp, Mus musculus
ccgcagcccccgcagggagctccgc

SEQ ID NO: 247529 - DNA, 25 bp, Mus musculus
ccgcagccccgaggataatagaatc

SEQ ID NO: 247530 - DNA, 25 bp, Mus musculus
ccgcagccccgcgaatgctgctgct

SEQ ID NO: 247531 - DNA, 25 bp, Mus musculus
ccgcagccccgcgagttgcacgatt

SEQ ID NO: 247532 - DNA, 25 bp, Mus musculus
ccgcagccccgcgatgtggccgtgg

SEQ ID NO: 247533 - DNA, 25 bp, Mus musculus
ccgcagcccgaatcctattctattg

SEQ ID NO: 247534 - DNA, 25 bp, Mus musculus
ccgcagccgacatgcgctacgtcgc

SEQ ID NO: 247535 - DNA, 25 bp, Mus musculus
ccgcagccgaggctcgcgctgtatg

SEQ ID NO: 247536 - DNA, 25 bp, Mus musculus
ccgcagccgccagaagcggctttag

SEQ ID NO: 247537 - DNA, 25 bp, Mus musculus
ccgcagccgccaggccagaagcgga

SEQ ID NO: 247538 - DNA, 25 bp, Mus musculus
ccgcagcctggtaacgaaggcagtc

SEQ ID NO: 247539 - DNA, 25 bp, Mus musculus
ccgcagcctgttgggcaaggcgggc

SEQ ID NO: 247540 - DNA, 25 bp, Mus musculus
ccgcagcggcgctggtacaaagtaa

SEQ ID NO: 247541 - DNA, 25 bp, Mus musculus
ccgcagcgtgagccagtgggtgttt

SEQ ID NO: 247542 - DNA, 25 bp, Mus musculus
ccgcagcgtgaggtcctggtatttt

SEQ ID NO: 247543 - DNA, 25 bp, Mus musculus
ccgcagctctgcagccccatgtgca

SEQ ID NO: 247544 - DNA, 25 bp, Mus musculus
ccgcagctgagatcgattatatttt

SEQ ID NO: 247545 - DNA, 25 bp, Mus musculus
ccgcagctgcgaccttgccctcctg

SEQ ID NO: 247546 - DNA, 25 bp, Mus musculus
ccgcaggaatcagccatgcatcatc

SEQ ID NO: 247547 - DNA, 25 bp, Mus musculus
ccgcaggacagagagtcgatatgcg

SEQ ID NO: 247548 - DNA, 25 bp, Mus musculus
ccgcaggacagcaccacgccccact

SEQ ID NO: 247549 - DNA, 25 bp, Mus musculus
ccgcaggacgcggaaccatgtgccc

SEQ ID NO: 247550 - DNA, 25 bp, Mus musculus
ccgcaggacggtgactgtcccagcc

SEQ ID NO: 247551 - DNA, 25 bp, Mus musculus
ccgcaggaggaagcaactgatggtg

SEQ ID NO: 247552 - DNA, 25 bp, Mus musculus
ccgcaggatcacgctcctcctaggt

SEQ ID NO: 247553 - DNA, 25 bp, Mus musculus
ccgcaggatcacggcaaaatgaagg

SEQ ID NO: 247554 - DNA, 25 bp, Mus musculus
ccgcaggatgcaggctggggctgtc

SEQ ID NO: 247555 - DNA, 25 bp, Mus musculus
ccgcaggattgtagcctctatcaca

SEQ ID NO: 247556 - DNA, 25 bp, Mus musculus
ccgcaggcagagacgatagattgct

SEQ ID NO: 247557 - DNA, 25 bp, Mus musculus
ccgcaggcatacaggcaaagcgagt

SEQ ID NO: 247558 - DNA, 25 bp, Mus musculus
ccgcaggcatacaggcctagctctg

SEQ ID NO: 247559 - DNA, 25 bp, Mus musculus
ccgcaggcggaaagtatccattatg

SEQ ID NO: 247560 - DNA, 25 bp, Mus musculus
ccgcagggaagagcgggctaactcc

SEQ ID NO: 247561 - DNA, 25 bp, Mus musculus
ccgcagggacactttacagggagac

SEQ ID NO: 247562 - DNA, 25 bp, Mus musculus
ccgcagggcatcagtgatatgtcaa

SEQ ID NO: 247563 - DNA, 25 bp, Mus musculus
ccgcagggcatcagtgctaatggag

SEQ ID NO: 247564 - DNA, 25 bp, Mus musculus
ccgcagggtatttgtaaagatgagc

SEQ ID NO: 247565 - DNA, 25 bp, Mus musculus
ccgcaggtgaaggacagcaaccatc

SEQ ID NO: 247566 - DNA, 25 bp, Mus musculus
ccgcagtaacttggattccaggtgt

SEQ ID NO: 247567 - DNA, 25 bp, Mus musculus
ccgcagtacccaggacactgtggtc

SEQ ID NO: 247568 - DNA, 25 bp, Mus musculus
ccgcagtgcccagacctgtgttaca

SEQ ID NO: 247569 - DNA, 25 bp, Mus musculus
ccgcagtggacagaagatttcctct

SEQ ID NO: 247570 - DNA, 25 bp, Mus musculus
ccgcagtgtaatgatcgatgaagat

SEQ ID NO: 247571 - DNA, 25 bp, Mus musculus
ccgcagtgtcctggccaagggccgg

SEQ ID NO: 247572 - DNA, 25 bp, Mus musculus
ccgcagtgtgagtgcctgctcactg

SEQ ID NO: 247573 - DNA, 25 bp, Mus musculus
ccgcagtgtggaggcagttggctgc

SEQ ID NO: 247574 - DNA, 25 bp, Mus musculus
ccgcagttgtccagagccaccagcc

SEQ ID NO: 247575 - DNA, 25 bp, Mus musculus
ccgcataacttcctgagaaggactt

SEQ ID NO: 247576 - DNA, 25 bp, Mus musculus
ccgcatatgcgctggtggacgcaga

SEQ ID NO: 247577 - DNA, 25 bp, Mus musculus
ccgcatatgcgctggttccagatgc

SEQ ID NO: 247578 - DNA, 25 bp, Mus musculus
ccgcatcagacatggattgcagtgc

SEQ ID NO: 247579 - DNA, 25 bp, Mus musculus
ccgcatcagaggaaggagatgactc

SEQ ID NO: 247580 - DNA, 25 bp, Mus musculus
ccgcatccagaggatgctgcccaga

SEQ ID NO: 247581 - DNA, 25 bp, Mus musculus
ccgcatccaggtcttggataaatac

SEQ ID NO: 247582 - DNA, 25 bp, Mus musculus
ccgcatccaggttaaacgctcccgg

SEQ ID NO: 247583 - DNA, 25 bp, Mus musculus
ccgcatctcagcaagatggagcggg

SEQ ID NO: 247584 - DNA, 25 bp, Mus musculus
ccgcatctcagcaaggtgatctggg

SEQ ID NO: 247585 - DNA, 25 bp, Mus musculus
ccgcatcttcaggcttctcggctga

SEQ ID NO: 247586 - DNA, 25 bp, Mus musculus
ccgcatgaaggcagagttctttgca

SEQ ID NO: 247587 - DNA, 25 bp, Mus musculus
ccgcatgcaggtggaccctcagaag

SEQ ID NO: 247588 - DNA, 25 bp, Mus musculus
ccgcatggaccagctccatttctga

SEQ ID NO: 247589 - DNA, 25 bp, Mus musculus
ccgcatggtataaggatgacatcgt

SEQ ID NO: 247590 - DNA, 25 bp, Mus musculus
ccgcatggttcctgctctgcacctc

SEQ ID NO: 247591 - DNA, 25 bp, Mus musculus
ccgcatgtttgtcattgcctttctc

SEQ ID NO: 247592 - DNA, 25 bp, Mus musculus
ccgcattgcagatgaacgagaccgt

SEQ ID NO: 247593 - DNA, 25 bp, Mus musculus
ccgccaaaaaggagaactacctctc

SEQ ID NO: 247594 - DNA, 25 bp, Mus musculus
ccgccaaaaaggaggtcctgagttc

SEQ ID NO: 247595 - DNA, 25 bp, Mus musculus
ccgccaaagcagcttcctgccagac

SEQ ID NO: 247596 - DNA, 25 bp, Mus musculus
ccgccaaatggactggaacttcctt

SEQ ID NO: 247597 - DNA, 25 bp, Mus musculus
ccgccaactatgacttttgccaagg

SEQ ID NO: 247598 - DNA, 25 bp, Mus musculus
ccgccaactcctagctacaggcggc

SEQ ID NO: 247599 - DNA, 25 bp, Mus musculus
ccgccaagaaacaggctcgcagcct

SEQ ID NO: 247600 - DNA, 25 bp, Mus musculus
ccgccaagaagcaggctcgcagcct

SEQ ID NO: 247601 - DNA, 25 bp, Mus musculus
ccgccaagtggtttgctggtgcttt

SEQ ID NO: 247602 - DNA, 25 bp, Mus musculus
ccgccacaaagaaaggaaacacggc

SEQ ID NO: 247603 - DNA, 25 bp, Mus musculus
ccgccacagccagaagttgaaatgg

SEQ ID NO: 247604 - DNA, 25 bp, Mus musculus
ccgccacagcggccccgtgtctgaa

SEQ ID NO: 247605 - DNA, 25 bp, Mus musculus
ccgccacagcgtggtgtccttgtcc

SEQ ID NO: 247606 - DNA, 25 bp, Mus musculus
ccgccaccaccgctgacgatgcaga

SEQ ID NO: 247607 - DNA, 25 bp, Mus musculus
ccgccaccaccgctggatgcagatc

SEQ ID NO: 247608 - DNA, 25 bp, Mus musculus
ccgccaccacctggaactggtgagc

SEQ ID NO: 247609 - DNA, 25 bp, Mus musculus
ccgccaccacggcgggcgtccgaaa

SEQ ID NO: 247610 - DNA, 25 bp, Mus musculus
ccgccaccaggccaaccatattctg

SEQ ID NO: 247611 - DNA, 25 bp, Mus musculus
ccgccaccagggccagagcttgagc

SEQ ID NO: 247612 - DNA, 25 bp, Mus musculus
ccgccaccatcgtaggttctgtacc

SEQ ID NO: 247613 - DNA, 25 bp, Mus musculus
ccgccaccatgagcgatcagcagct

SEQ ID NO: 247614 - DNA, 25 bp, Mus musculus
ccgccacccagatctggaacaacga

SEQ ID NO: 247615 - DNA, 25 bp, Mus musculus
ccgccacccagcggccacatcctgg

SEQ ID NO: 247616 - DNA, 25 bp, Mus musculus
ccgccaccccctgtatccctctgaa

SEQ ID NO: 247617 - DNA, 25 bp, Mus musculus
ccgccacccctcaagacggaggagg

SEQ ID NO: 247618 - DNA, 25 bp, Mus musculus
ccgccacccctcaaggagcacttca

SEQ ID NO: 247619 - DNA, 25 bp, Mus musculus
ccgccacctgacaggtcacaaccat

SEQ ID NO: 247620 - DNA, 25 bp, Mus musculus
ccgccacctgcaaggttcactttaa

SEQ ID NO: 247621 - DNA, 25 bp, Mus musculus
ccgccacgaagccagaaggaggctc

SEQ ID NO: 247622 - DNA, 25 bp, Mus musculus
ccgccacgatgtgtgccgtgcaggt

SEQ ID NO: 247623 - DNA, 25 bp, Mus musculus
ccgccacgggaagaagcgcacgttg

SEQ ID NO: 247624 - DNA, 25 bp, Mus musculus
ccgccactggcataaatgcagttcc

SEQ ID NO: 247625 - DNA, 25 bp, Mus musculus
ccgccagaaagacagggtttcatgc

SEQ ID NO: 247626 - DNA, 25 bp, Mus musculus
ccgccagaaaggaacacccctggcg

SEQ ID NO: 247627 - DNA, 25 bp, Mus musculus
ccgccagacacattgatttgaaacc

SEQ ID NO: 247628 - DNA, 25 bp, Mus musculus
ccgccagacacattgtcataacttc

SEQ ID NO: 247629 - DNA, 25 bp, Mus musculus
ccgccagacacattgtgaactgccc

SEQ ID NO: 247630 - DNA, 25 bp, Mus musculus
ccgccagaggatccgtgaagaggtg

SEQ ID NO: 247631 - DNA, 25 bp, Mus musculus
ccgccagagggacagtcggcccaat

SEQ ID NO: 247632 - DNA, 25 bp, Mus musculus
ccgccagagggtgcactattccaac

SEQ ID NO: 247633 - DNA, 25 bp, Mus musculus
ccgccagattgggcctgtcccaggc

SEQ ID NO: 247634 - DNA, 25 bp, Mus musculus
ccgccagcagcccagagcaatcagg

SEQ ID NO: 247635 - DNA, 25 bp, Mus musculus
ccgccagcagcccagatctactctt

SEQ ID NO: 247636 - DNA, 25 bp, Mus musculus
ccgccagcagcccagcccactgagt

SEQ ID NO: 247637 - DNA, 25 bp, Mus musculus
ccgccagcagcccagggttggaagc

SEQ ID NO: 247638 - DNA, 25 bp, Mus musculus
ccgccagccaggattggatccagtg

SEQ ID NO: 247639 - DNA, 25 bp, Mus musculus
ccgccagccaggttgcaagtgttga

SEQ ID NO: 247640 - DNA, 25 bp, Mus musculus
ccgccagcgccgtccgtgacctcgt

SEQ ID NO: 247641 - DNA, 25 bp, Mus musculus
ccgccagcggcgcagaaacatctgt

SEQ ID NO: 247642 - DNA, 25 bp, Mus musculus
ccgccagcggcgcaggtgattcctc

SEQ ID NO: 247643 - DNA, 25 bp, Mus musculus
ccgccagctcccggttgcttcctag

SEQ ID NO: 247644 - DNA, 25 bp, Mus musculus
ccgccagctcgtatgaaaatccatg

SEQ ID NO: 247645 - DNA, 25 bp, Mus musculus
ccgccagctgggtggctttgacact

SEQ ID NO: 247646 - DNA, 25 bp, Mus musculus
ccgccagggaaggctccccagaggt

SEQ ID NO: 247647 - DNA, 25 bp, Mus musculus
ccgccaggtctcagttgtggccgac

SEQ ID NO: 247648 - DNA, 25 bp, Mus musculus
ccgccaggtttctttcagcctccag

SEQ ID NO: 247649 - DNA, 25 bp, Mus musculus
ccgccagtcaacaggagaagtttgg

SEQ ID NO: 247650 - DNA, 25 bp, Mus musculus
ccgccagtcaagggacgcaagcgcc

SEQ ID NO: 247651 - DNA, 25 bp, Mus musculus
ccgccagtgtcaggtcaattaccat

SEQ ID NO: 247652 - DNA, 25 bp, Mus musculus
ccgccagtttcccacttgtcagaaa

SEQ ID NO: 247653 - DNA, 25 bp, Mus musculus
ccgccatattcccgtggcatctttc

SEQ ID NO: 247654 - DNA, 25 bp, Mus musculus
ccgccatcaagcagggtttcaaaga

SEQ ID NO: 247655 - DNA, 25 bp, Mus musculus
ccgccatcacaggcttctgtgtcag

SEQ ID NO: 247656 - DNA, 25 bp, Mus musculus
ccgccatcatgtctgccacaacttc

SEQ ID NO: 247657 - DNA, 25 bp, Mus musculus
ccgccatccacacgttccgccaggt

SEQ ID NO: 247658 - DNA, 25 bp, Mus musculus
ccgccatccacccggctgccaataa

SEQ ID NO: 247659 - DNA, 25 bp, Mus musculus
ccgccatccatgccagtttgccttc

SEQ ID NO: 247660 - DNA, 25 bp, Mus musculus
ccgccatcctcagagatggccgcca

SEQ ID NO: 247661 - DNA, 25 bp, Mus musculus
ccgccatcgtaggtgccgatcccct

SEQ ID NO: 247662 - DNA, 25 bp, Mus musculus
ccgccatgacagatcagacctactg

SEQ ID NO: 247663 - DNA, 25 bp, Mus musculus
ccgccatgactattctcccggggcc

SEQ ID NO: 247664 - DNA, 25 bp, Mus musculus
ccgccatgctcgtgggctccctgct

SEQ ID NO: 247665 - DNA, 25 bp, Mus musculus
ccgccatgctctgcgttgctgctct

SEQ ID NO: 247666 - DNA, 25 bp, Mus musculus
ccgccatggagtcctccaccttcgc

SEQ ID NO: 247667 - DNA, 25 bp, Mus musculus
ccgccattaaggtgtctagtcacat

SEQ ID NO: 247668 - DNA, 25 bp, Mus musculus
ccgccattcagggtgtcctggacac

SEQ ID NO: 247669 - DNA, 25 bp, Mus musculus
ccgccattgaaacggataaggaagg

SEQ ID NO: 247670 - DNA, 25 bp, Mus musculus
ccgccattgaaacgggatgggaact

SEQ ID NO: 247671 - DNA, 25 bp, Mus musculus
ccgcccaacaggcgctgtgaggtta

SEQ ID NO: 247672 - DNA, 25 bp, Mus musculus
ccgcccaacatgccaccttacacca

SEQ ID NO: 247673 - DNA, 25 bp, Mus musculus
ccgcccaagacctccctgggcctcc

SEQ ID NO: 247674 - DNA, 25 bp, Mus musculus
ccgcccacaagtatgtcttggctgt

SEQ ID NO: 247675 - DNA, 25 bp, Mus musculus
ccgcccacaccactggtgatccagc

SEQ ID NO: 247676 - DNA, 25 bp, Mus musculus
ccgcccacagagatgagccgccaga

SEQ ID NO: 247677 - DNA, 25 bp, Mus musculus
ccgcccagagcacaggggcctggat

SEQ ID NO: 247678 - DNA, 25 bp, Mus musculus
ccgcccagcgagcgctgcgaagctg

SEQ ID NO: 247679 - DNA, 25 bp, Mus musculus
ccgcccagcggtcagagtacacctg

SEQ ID NO: 247680 - DNA, 25 bp, Mus musculus
ccgcccaggacactgccactgcaca

SEQ ID NO: 247681 - DNA, 25 bp, Mus musculus
ccgcccaggagtgcagtatctctcc

SEQ ID NO: 247682 - DNA, 25 bp, Mus musculus
ccgcccaggcaactgcgcagttcct

SEQ ID NO: 247683 - DNA, 25 bp, Mus musculus
ccgcccagtgttcctttgaagaccc

SEQ ID NO: 247684 - DNA, 25 bp, Mus musculus
ccgcccagtgttgtcactggaccta

SEQ ID NO: 247685 - DNA, 25 bp, Mus musculus
ccgcccagttcagagttccagggac

SEQ ID NO: 247686 - DNA, 25 bp, Mus musculus
ccgcccagttcagctggcatctgac

SEQ ID NO: 247687 - DNA, 25 bp, Mus musculus
ccgcccatgtaccaagtgtccccaa

SEQ ID NO: 247688 - DNA, 25 bp, Mus musculus
ccgccccaaagcctgccgacataag

SEQ ID NO: 247689 - DNA, 25 bp, Mus musculus
ccgccccacggcggagcctgacccc

SEQ ID NO: 247690 - DNA, 25 bp, Mus musculus
ccgccccacgggccatggaggaagc

SEQ ID NO: 247691 - DNA, 25 bp, Mus musculus
ccgccccactgaagggcagtggaac

SEQ ID NO: 247692 - DNA, 25 bp, Mus musculus
ccgccccactgtaaggcagtggaac

SEQ ID NO: 247693 - DNA, 25 bp, Mus musculus
ccgccccatggctcgggactcggcc

SEQ ID NO: 247694 - DNA, 25 bp, Mus musculus
ccgccccattgaggtgaccagaatg

SEQ ID NO: 247695 - DNA, 25 bp, Mus musculus
ccgcccccaggagttattcctcata

SEQ ID NO: 247696 - DNA, 25 bp, Mus musculus
ccgcccccaggccttctgggttggc

SEQ ID NO: 247697 - DNA, 25 bp, Mus musculus
ccgcccccgccgtgtgagcgtcctg

SEQ ID NO: 247698 - DNA, 25 bp, Mus musculus
ccgccccctcaggagccaacatgtt

SEQ ID NO: 247699 - DNA, 25 bp, Mus musculus
ccgccccgcacagtatcagaaatta

SEQ ID NO: 247700 - DNA, 25 bp, Mus musculus
ccgccccgcccggtggacaccaagg

SEQ ID NO: 247701 - DNA, 25 bp, Mus musculus
ccgccccgccttgaacagagaaagc

SEQ ID NO: 247702 - DNA, 25 bp, Mus musculus
ccgccccgggcggcttggctgccca

SEQ ID NO: 247703 - DNA, 25 bp, Mus musculus
ccgccccgggcgggagtcaggcctc

SEQ ID NO: 247704 - DNA, 25 bp, Mus musculus
ccgccccgtccccgccatgggctgc

SEQ ID NO: 247705 - DNA, 25 bp, Mus musculus
ccgcccctgcctccctgcccacaaa

SEQ ID NO: 247706 - DNA, 25 bp, Mus musculus
ccgcccgaagccctattctgaaaag

SEQ ID NO: 247707 - DNA, 25 bp, Mus musculus
ccgcccgaagcttggtgaggtctgt

SEQ ID NO: 247708 - DNA, 25 bp, Mus musculus
ccgcccgaaggttaacaagcctgct

SEQ ID NO: 247709 - DNA, 25 bp, Mus musculus
ccgcccgatgcaatgctgtcgatca

SEQ ID NO: 247710 - DNA, 25 bp, Mus musculus
ccgcccgcacggagcggcggcatgg

SEQ ID NO: 247711 - DNA, 25 bp, Mus musculus
ccgcccgcagagctgtttggatttg

SEQ ID NO: 247712 - DNA, 25 bp, Mus musculus
ccgcccgcaggtccattcagaagct

SEQ ID NO: 247713 - DNA, 25 bp, Mus musculus
ccgcccgcccggcaatgggaaatcc

SEQ ID NO: 247714 - DNA, 25 bp, Mus musculus
ccgcccgcccggttatgtcattttc

SEQ ID NO: 247715 - DNA, 25 bp, Mus musculus
ccgcccgccgtgaaagccggcggga

SEQ ID NO: 247716 - DNA, 25 bp, Mus musculus
ccgcccgcctggacaggatgtttgc

SEQ ID NO: 247717 - DNA, 25 bp, Mus musculus
ccgcccgcgaaggaggtgtcgcgga

SEQ ID NO: 247718 - DNA, 25 bp, Mus musculus
ccgcccgcgcagagccggctgatct

SEQ ID NO: 247719 - DNA, 25 bp, Mus musculus
ccgcccgcgcaggttggtgggaact

SEQ ID NO: 247720 - DNA, 25 bp, Mus musculus
ccgcccgcgcaggtttggacgtcat

SEQ ID NO: 247721 - DNA, 25 bp, Mus musculus
ccgcccgctgaaaaaattgtgcaag

SEQ ID NO: 247722 - DNA, 25 bp, Mus musculus
ccgcccggaggtgcttgaggcgagc

SEQ ID NO: 247723 - DNA, 25 bp, Mus musculus
ccgcccggccggggaccaatctccg

SEQ ID NO: 247724 - DNA, 25 bp, Mus musculus
ccgcccgggtgtgggacttgtgtga

SEQ ID NO: 247725 - DNA, 25 bp, Mus musculus
ccgcccggtggacaccaagggctga

SEQ ID NO: 247726 - DNA, 25 bp, Mus musculus
ccgccctataggaaatggaatttat

SEQ ID NO: 247727 - DNA, 25 bp, Mus musculus
ccgccctccccactgcgtctctctt

SEQ ID NO: 247728 - DNA, 25 bp, Mus musculus
ccgccctgagaaatccagtaaacct

SEQ ID NO: 247729 - DNA, 25 bp, Mus musculus
ccgccctgagaggtcccgtaaacct

SEQ ID NO: 247730 - DNA, 25 bp, Mus musculus
ccgccctgcggagagaggaccaaat

SEQ ID NO: 247731 - DNA, 25 bp, Mus musculus
ccgccctgcggagagggttcttgac

SEQ ID NO: 247732 - DNA, 25 bp, Mus musculus
ccgccctggatgccttttacaacta

SEQ ID NO: 247733 - DNA, 25 bp, Mus musculus
ccgccctgtcccgaggacaagaaga

SEQ ID NO: 247734 - DNA, 25 bp, Mus musculus
ccgcccttgcctccggttcacgcta

SEQ ID NO: 247735 - DNA, 25 bp, Mus musculus
ccgcccttggcagaggttacaaaat

SEQ ID NO: 247736 - DNA, 25 bp, Mus musculus
ccgccgaaagaccagccaacaattc

SEQ ID NO: 247737 - DNA, 25 bp, Mus musculus
ccgccgaaggagcaggagccgctcc

SEQ ID NO: 247738 - DNA, 25 bp, Mus musculus
ccgccgacagccaccatgcggcgta

SEQ ID NO: 247739 - DNA, 25 bp, Mus musculus
ccgccgaccccgggatggcacacca

SEQ ID NO: 247740 - DNA, 25 bp, Mus musculus
ccgccgaccccgtgggctgttcatc

SEQ ID NO: 247741 - DNA, 25 bp, Mus musculus
ccgccgagcagagaacggcaggctg

SEQ ID NO: 247742 - DNA, 25 bp, Mus musculus
ccgccgagcaggaagttctgacgcc

SEQ ID NO: 247743 - DNA, 25 bp, Mus musculus
ccgccgagccggcgctaactgggat

SEQ ID NO: 247744 - DNA, 25 bp, Mus musculus
ccgccgagctggagaactacgatga

SEQ ID NO: 247745 - DNA, 25 bp, Mus musculus
ccgccgagctggaggtggggcctgg

SEQ ID NO: 247746 - DNA, 25 bp, Mus musculus
ccgccgatcggagaatgtcgtgttc

SEQ ID NO: 247747 - DNA, 25 bp, Mus musculus
ccgccgccaagaaacaggctcgcag

SEQ ID NO: 247748 - DNA, 25 bp, Mus musculus
ccgccgccaaggctgaagctgacgt

SEQ ID NO: 247749 - DNA, 25 bp, Mus musculus
ccgccgccaccatgagcgatcagca

SEQ ID NO: 247750 - DNA, 25 bp, Mus musculus
ccgccgccagctgggtggctttgac

SEQ ID NO: 247751 - DNA, 25 bp, Mus musculus
ccgccgccaggtgtgcaacagaaga

SEQ ID NO: 247752 - DNA, 25 bp, Mus musculus
ccgccgccagtttcccacttgtcag

SEQ ID NO: 247753 - DNA, 25 bp, Mus musculus
ccgccgcccaggtaactatagtcct

SEQ ID NO: 247754 - DNA, 25 bp, Mus musculus
ccgccgcccaggttctgggaaattc

SEQ ID NO: 247755 - DNA, 25 bp, Mus musculus
ccgccgcccgcagagctgtttggat

SEQ ID NO: 247756 - DNA, 25 bp, Mus musculus
ccgccgcccgcccggcaatgggaaa

SEQ ID NO: 247757 - DNA, 25 bp, Mus musculus
ccgccgcccgcccggttatgtcatt

SEQ ID NO: 247758 - DNA, 25 bp, Mus musculus
ccgccgccgcaaccatcagcctgag

SEQ ID NO: 247759 - DNA, 25 bp, Mus musculus
ccgccgccgccgccggtgcataagt

SEQ ID NO: 247760 - DNA, 25 bp, Mus musculus
ccgccgccgccgctttccacccact

SEQ ID NO: 247761 - DNA, 25 bp, Mus musculus
ccgccgccgccggtgcataagtaaa

SEQ ID NO: 247762 - DNA, 25 bp, Mus musculus
ccgccgccgctttccacccactccc

SEQ ID NO: 247763 - DNA, 25 bp, Mus musculus
ccgccgccggagcgacaggtgattt

SEQ ID NO: 247764 - DNA, 25 bp, Mus musculus
ccgccgccgtggaagagcagtatag

SEQ ID NO: 247765 - DNA, 25 bp, Mus musculus
ccgccgccgtggaagagtacagttg

SEQ ID NO: 247766 - DNA, 25 bp, Mus musculus
ccgccgcctcacgggccagcaggtg

SEQ ID NO: 247767 - DNA, 25 bp, Mus musculus
ccgccgcctccctcgctttttcctg

SEQ ID NO: 247768 - DNA, 25 bp, Mus musculus
ccgccgcctccctcgtccagtccac

SEQ ID NO: 247769 - DNA, 25 bp, Mus musculus
ccgccgcctcgggagagaggaagcg

SEQ ID NO: 247770 - DNA, 25 bp, Mus musculus
ccgccgcctctctcggcatcctaca

SEQ ID NO: 247771 - DNA, 25 bp, Mus musculus
ccgccgcgagtaagaccacaggatg

SEQ ID NO: 247772 - DNA, 25 bp, Mus musculus
ccgccgcgagtaagactcccttgta

SEQ ID NO: 247773 - DNA, 25 bp, Mus musculus
ccgccgcgagtaagggcgaatcgcc

SEQ ID NO: 247774 - DNA, 25 bp, Mus musculus
ccgccgcgcgcgttccagggctccg

SEQ ID NO: 247775 - DNA, 25 bp, Mus musculus
ccgccgcggagcaggcatggagagt

SEQ ID NO: 247776 - DNA, 25 bp, Mus musculus
ccgccgcggaggtctttggccagta

SEQ ID NO: 247777 - DNA, 25 bp, Mus musculus
ccgccgcggcccagaattgtaaaac

SEQ ID NO: 247778 - DNA, 25 bp, Mus musculus
ccgccgcggcccaggttaaatggaa

SEQ ID NO: 247779 - DNA, 25 bp, Mus musculus
ccgccgctcgaaacctcgaccttga

SEQ ID NO: 247780 - DNA, 25 bp, Mus musculus
ccgccgctcgccggccctgctgagg

SEQ ID NO: 247781 - DNA, 25 bp, Mus musculus
ccgccgctcggttacctgccttgcg

SEQ ID NO: 247782 - DNA, 25 bp, Mus musculus
ccgccgctgagcgccggagtactgg

SEQ ID NO: 247783 - DNA, 25 bp, Mus musculus
ccgccgctgcagcatggtttattga

SEQ ID NO: 247784 - DNA, 25 bp, Mus musculus
ccgccgctgccggagattggcagac

SEQ ID NO: 247785 - DNA, 25 bp, Mus musculus
ccgccggaagtgaagcccctgcccg

SEQ ID NO: 247786 - DNA, 25 bp, Mus musculus
ccgccggagcgacaggtgatttggc

SEQ ID NO: 247787 - DNA, 25 bp, Mus musculus
ccgccggagctgttttatgaccaga

SEQ ID NO: 247788 - DNA, 25 bp, Mus musculus
ccgccggccaatgggcccagtgcac

SEQ ID NO: 247789 - DNA, 25 bp, Mus musculus
ccgccggccagccagataagtacgg

SEQ ID NO: 247790 - DNA, 25 bp, Mus musculus
ccgccggccgttgtgaacagaccct

SEQ ID NO: 247791 - DNA, 25 bp, Mus musculus
ccgccggccgttgtgctcccatgtg

SEQ ID NO: 247792 - DNA, 25 bp, Mus musculus
ccgccggccgttgtgggcaataccc

SEQ ID NO: 247793 - DNA, 25 bp, Mus musculus
ccgccggcggaggacccagccccca

SEQ ID NO: 247794 - DNA, 25 bp, Mus musculus
ccgccggcgtcgcacccctctctac

SEQ ID NO: 247795 - DNA, 25 bp, Mus musculus
ccgccggcgtcggcctttcttttct

SEQ ID NO: 247796 - DNA, 25 bp, Mus musculus
ccgccgggagatgctgttgacggag

SEQ ID NO: 247797 - DNA, 25 bp, Mus musculus
ccgccgggagggttgatttcttcat

SEQ ID NO: 247798 - DNA, 25 bp, Mus musculus
ccgccgggaggtcatggctgcagct

SEQ ID NO: 247799 - DNA, 25 bp, Mus musculus
ccgccgggcacctggtccgggccat

SEQ ID NO: 247800 - DNA, 25 bp, Mus musculus
ccgccgggcccatggaatccaaaac

SEQ ID NO: 247801 - DNA, 25 bp, Mus musculus
ccgccggggcaaggtctgttcacta

SEQ ID NO: 247802 - DNA, 25 bp, Mus musculus
ccgccgggtcagacgcctcttcgcc

SEQ ID NO: 247803 - DNA, 25 bp, Mus musculus
ccgccggtgacagacgatactgtat

SEQ ID NO: 247804 - DNA, 25 bp, Mus musculus
ccgccgtcaggatctggaagttgga

SEQ ID NO: 247805 - DNA, 25 bp, Mus musculus
ccgccgtcatctgcaaagcagaagc

SEQ ID NO: 247806 - DNA, 25 bp, Mus musculus
ccgccgtcatctgctatagacatag

SEQ ID NO: 247807 - DNA, 25 bp, Mus musculus
ccgccgtcatggccgactactggaa

SEQ ID NO: 247808 - DNA, 25 bp, Mus musculus
ccgccgtctacagaaaacaagcacg

SEQ ID NO: 247809 - DNA, 25 bp, Mus musculus
ccgccgtgagagagtacatcggcat

SEQ ID NO: 247810 - DNA, 25 bp, Mus musculus
ccgccgtgcccgtggtgtgccccct

SEQ ID NO: 247811 - DNA, 25 bp, Mus musculus
ccgccgtgcggggagcagcaatgaa

SEQ ID NO: 247812 - DNA, 25 bp, Mus musculus
ccgccgtgcggggatagctgcccca

SEQ ID NO: 247813 - DNA, 25 bp, Mus musculus
ccgccgtggaagaaaccctgatgga

SEQ ID NO: 247814 - DNA, 25 bp, Mus musculus
ccgccgtggaagagcagtatagctg

SEQ ID NO: 247815 - DNA, 25 bp, Mus musculus
ccgccgtggaagagtacagttgtga

SEQ ID NO: 247816 - DNA, 25 bp, Mus musculus
ccgccgtggacgaggtgtccacaga

SEQ ID NO: 247817 - DNA, 25 bp, Mus musculus
ccgcctacaggattcctgtctagtg

SEQ ID NO: 247818 - DNA, 25 bp, Mus musculus
ccgcctacagtgcagggagactata

SEQ ID NO: 247819 - DNA, 25 bp, Mus musculus
ccgcctacctctggatcgctccttt

SEQ ID NO: 247820 - DNA, 25 bp, Mus musculus
ccgcctacgtggcctataacattca

SEQ ID NO: 247821 - DNA, 25 bp, Mus musculus
ccgcctactggaggaatgctgggac

SEQ ID NO: 247822 - DNA, 25 bp, Mus musculus
ccgcctacttcgggctaacaggcag

SEQ ID NO: 247823 - DNA, 25 bp, Mus musculus
ccgcctagcaggaactgtctacctt

SEQ ID NO: 247824 - DNA, 25 bp, Mus musculus
ccgcctagcagtttgttttgtttag

SEQ ID NO: 247825 - DNA, 25 bp, Mus musculus
ccgcctatcaaccgtggccttccac

SEQ ID NO: 247826 - DNA, 25 bp, Mus musculus
ccgcctcacaggaacaaaaagtttc

SEQ ID NO: 247827 - DNA, 25 bp, Mus musculus
ccgcctcacgggccagcaggtggcc

SEQ ID NO: 247828 - DNA, 25 bp, Mus musculus
ccgcctcactggaatcccagctggc

SEQ ID NO: 247829 - DNA, 25 bp, Mus musculus
ccgcctcagaggtttaaacgcatct

SEQ ID NO: 247830 - DNA, 25 bp, Mus musculus
ccgcctccagatctggggttggtgt

SEQ ID NO: 247831 - DNA, 25 bp, Mus musculus
ccgcctccaggactgaccaaggcca

SEQ ID NO: 247832 - DNA, 25 bp, Mus musculus
ccgcctccagtgccgggagcccgtg

SEQ ID NO: 247833 - DNA, 25 bp, Mus musculus
ccgcctcccaaggttacactgtggc

SEQ ID NO: 247834 - DNA, 25 bp, Mus musculus
ccgcctccccgatcccgcccggagt

SEQ ID NO: 247835 - DNA, 25 bp, Mus musculus
ccgcctccctcgctttttcctgcaa

SEQ ID NO: 247836 - DNA, 25 bp, Mus musculus
ccgcctccctcgtccagtccactag

SEQ ID NO: 247837 - DNA, 25 bp, Mus musculus
ccgcctcctcagtatcaggcaccca

SEQ ID NO: 247838 - DNA, 25 bp, Mus musculus
ccgcctcctccgagcctgaagctac

SEQ ID NO: 247839 - DNA, 25 bp, Mus musculus
ccgcctcctcgcggcattggaggcg

SEQ ID NO: 247840 - DNA, 25 bp, Mus musculus
ccgcctcctgatccaggaccagcgc

SEQ ID NO: 247841 - DNA, 25 bp, Mus musculus
ccgcctcgctggccagatcttcctt

SEQ ID NO: 247842 - DNA, 25 bp, Mus musculus
ccgcctcggccgtggtaagggaaca

SEQ ID NO: 247843 - DNA, 25 bp, Mus musculus
ccgcctcgggagagaggaagcggga

SEQ ID NO: 247844 - DNA, 25 bp, Mus musculus
ccgcctctagctgactggtgagcac

SEQ ID NO: 247845 - DNA, 25 bp, Mus musculus
ccgcctctcgcagagttcgaggagg

SEQ ID NO: 247846 - DNA, 25 bp, Mus musculus
ccgcctctcggggctgctcttctcg

SEQ ID NO: 247847 - DNA, 25 bp, Mus musculus
ccgcctctctcggcatcctacatca

SEQ ID NO: 247848 - DNA, 25 bp, Mus musculus
ccgcctctgactgtccctggccaca

SEQ ID NO: 247849 - DNA, 25 bp, Mus musculus
ccgcctctggaggaaagagccagac

SEQ ID NO: 247850 - DNA, 25 bp, Mus musculus
ccgcctctggaggctccatctccat

SEQ ID NO: 247851 - DNA, 25 bp, Mus musculus
ccgcctcttaagggagatcgccacg

SEQ ID NO: 247852 - DNA, 25 bp, Mus musculus
ccgcctcttgaagaagtttcctgtg

SEQ ID NO: 247853 - DNA, 25 bp, Mus musculus
ccgcctgaccccagaagtagaaatc

SEQ ID NO: 247854 - DNA, 25 bp, Mus musculus
ccgcctgaccccagcccagccagtg

SEQ ID NO: 247855 - DNA, 25 bp, Mus musculus
ccgcctgatcaagatgacagcatgg

SEQ ID NO: 247856 - DNA, 25 bp, Mus musculus
ccgcctgatcaagttctcctactca

SEQ ID NO: 247857 - DNA, 25 bp, Mus musculus
ccgcctgatctccaactaggcggcc

SEQ ID NO: 247858 - DNA, 25 bp, Mus musculus
ccgcctgcagcagagatgctgagcc

SEQ ID NO: 247859 - DNA, 25 bp, Mus musculus
ccgcctgcagcatgtttgtacacca

SEQ ID NO: 247860 - DNA, 25 bp, Mus musculus
ccgcctgcaggtgatttccgatttt

SEQ ID NO: 247861 - DNA, 25 bp, Mus musculus
ccgcctgccgcaacgatgggaagct

SEQ ID NO: 247862 - DNA, 25 bp, Mus musculus
ccgcctgccgcggaatcatggccca

SEQ ID NO: 247863 - DNA, 25 bp, Mus musculus
ccgcctgcgcggctggccagctaag

SEQ ID NO: 247864 - DNA, 25 bp, Mus musculus
ccgcctgcggttaagtgagcaaacc

SEQ ID NO: 247865 - DNA, 25 bp, Mus musculus
ccgcctgctccagacgtcttgagag

SEQ ID NO: 247866 - DNA, 25 bp, Mus musculus
ccgcctgctgctgatgcgtcgagcc

SEQ ID NO: 247867 - DNA, 25 bp, Mus musculus
ccgcctgctgctgatggatgtcgtg

SEQ ID NO: 247868 - DNA, 25 bp, Mus musculus
ccgcctgctggacagcgtgctggaa

SEQ ID NO: 247869 - DNA, 25 bp, Mus musculus
ccgcctgctggagctgctattgttg

SEQ ID NO: 247870 - DNA, 25 bp, Mus musculus
ccgcctgctggaggtacgaggatgt

SEQ ID NO: 247871 - DNA, 25 bp, Mus musculus
ccgcctgctgggaaagtccagatag

SEQ ID NO: 247872 - DNA, 25 bp, Mus musculus
ccgcctggaaaagctgctaaagctg

SEQ ID NO: 247873 - DNA, 25 bp, Mus musculus
ccgcctggaacagctggaagagaag

SEQ ID NO: 247874 - DNA, 25 bp, Mus musculus
ccgcctggctgaagagagggcccgg

SEQ ID NO: 247875 - DNA, 25 bp, Mus musculus
ccgcctgggcagggatccctgctgc

SEQ ID NO: 247876 - DNA, 25 bp, Mus musculus
ccgcctggtcttctgggccgagtgg

SEQ ID NO: 247877 - DNA, 25 bp, Mus musculus
ccgcctggtcttgtgggccgagtgg

SEQ ID NO: 247878 - DNA, 25 bp, Mus musculus
ccgcctgtcgcaggctgttgattca

SEQ ID NO: 247879 - DNA, 25 bp, Mus musculus
ccgcctgtcgcagggagcttatggg

SEQ ID NO: 247880 - DNA, 25 bp, Mus musculus
ccgccttcctagccctcgtggtagc

SEQ ID NO: 247881 - DNA, 25 bp, Mus musculus
ccgccttcgccagttctcaggccgc

SEQ ID NO: 247882 - DNA, 25 bp, Mus musculus
ccgccttgctaggcccggtcggtga

SEQ ID NO: 247883 - DNA, 25 bp, Mus musculus
ccgccttggggcatcatgacaccgg

SEQ ID NO: 247884 - DNA, 25 bp, Mus musculus
ccgccttggtgacaccttcaggtgg

SEQ ID NO: 247885 - DNA, 25 bp, Mus musculus
ccgcctttccaacagagggagacga

SEQ ID NO: 247886 - DNA, 25 bp, Mus musculus
ccgcctttggcaactgcgagtgcta

SEQ ID NO: 247887 - DNA, 25 bp, Mus musculus
ccgcctttggcactgtagctatctc

SEQ ID NO: 247888 - DNA, 25 bp, Mus musculus
ccgcctttggcagtcagaccaagcc

SEQ ID NO: 247889 - DNA, 25 bp, Mus musculus
ccgccttttccagcaatccgaaggt

SEQ ID NO: 247890 - DNA, 25 bp, Mus musculus
ccgcgaacaagaccccctctatggc

SEQ ID NO: 247891 - DNA, 25 bp, Mus musculus
ccgcgaaggaggtgtcgcggaagat

SEQ ID NO: 247892 - DNA, 25 bp, Mus musculus
ccgcgaatcggtgttgagaaactct

SEQ ID NO: 247893 - DNA, 25 bp, Mus musculus
ccgcgacaaacagaacagaaaagaa

SEQ ID NO: 247894 - DNA, 25 bp, Mus musculus
ccgcgacaaacagaatgcaacaagg

SEQ ID NO: 247895 - DNA, 25 bp, Mus musculus
ccgcgacatggactgtcctgtgcag

SEQ ID NO: 247896 - DNA, 25 bp, Mus musculus
ccgcgacatggcctcagtgagcttt

SEQ ID NO: 247897 - DNA, 25 bp, Mus musculus
ccgcgacctagaaggttttaggcta

SEQ ID NO: 247898 - DNA, 25 bp, Mus musculus
ccgcgacctccgcaatttcaccgag

SEQ ID NO: 247899 - DNA, 25 bp, Mus musculus
ccgcgacctccgcagctaggtaatt

SEQ ID NO: 247900 - DNA, 25 bp, Mus musculus
ccgcgacctgaacacatgtcggagg

SEQ ID NO: 247901 - DNA, 25 bp, Mus musculus
ccgcgaccttccagcagcagcatga

SEQ ID NO: 247902 - DNA, 25 bp, Mus musculus
ccgcgacgagaaccccagacagacc

SEQ ID NO: 247903 - DNA, 25 bp, Mus musculus
ccgcgacgagccctgctggtgtggc

SEQ ID NO: 247904 - DNA, 25 bp, Mus musculus
ccgcgacgagctgaggagggcagga

SEQ ID NO: 247905 - DNA, 25 bp, Mus musculus
ccgcgacgccggtgccttcgccggc

SEQ ID NO: 247906 - DNA, 25 bp, Mus musculus
ccgcgactgaggcgccgcccggtta

SEQ ID NO: 247907 - DNA, 25 bp, Mus musculus
ccgcgagatctcaggtctcctgtga

SEQ ID NO: 247908 - DNA, 25 bp, Mus musculus
ccgcgagcaggacgggaaggatgcg

SEQ ID NO: 247909 - DNA, 25 bp, Mus musculus
ccgcgagccgcgaagccaaaaacgg

SEQ ID NO: 247910 - DNA, 25 bp, Mus musculus
ccgcgagccgctggtgcacggcagc

SEQ ID NO: 247911 - DNA, 25 bp, Mus musculus
ccgcgaggaaggcaggaaagaagag

SEQ ID NO: 247912 - DNA, 25 bp, Mus musculus
ccgcgagggtcgcgcagcgtgcagg

SEQ ID NO: 247913 - DNA, 25 bp, Mus musculus
ccgcgagtaagaccacaggatggct

SEQ ID NO: 247914 - DNA, 25 bp, Mus musculus
ccgcgagtaagactcccttgtatcc

SEQ ID NO: 247915 - DNA, 25 bp, Mus musculus
ccgcgagtaagggcgaatcgccagg

SEQ ID NO: 247916 - DNA, 25 bp, Mus musculus
ccgcgagtagcaggaggcgtccggt

SEQ ID NO: 247917 - DNA, 25 bp, Mus musculus
ccgcgagtctactcggaaaaagaga

SEQ ID NO: 247918 - DNA, 25 bp, Mus musculus
ccgcgagtctactgtctgccaaaat

SEQ ID NO: 247919 - DNA, 25 bp, Mus musculus
ccgcgatgaagccgcccatttcaat

SEQ ID NO: 247920 - DNA, 25 bp, Mus musculus
ccgcgatgaagccggctacctctgt

SEQ ID NO: 247921 - DNA, 25 bp, Mus musculus
ccgcgatgagccaaggcatagagat

SEQ ID NO: 247922 - DNA, 25 bp, Mus musculus
ccgcgatggaagagacattgatgga

SEQ ID NO: 247923 - DNA, 25 bp, Mus musculus
ccgcgatggagaaaactttagaaac

SEQ ID NO: 247924 - DNA, 25 bp, Mus musculus
ccgcgatggagagagaaaaggaaca

SEQ ID NO: 247925 - DNA, 25 bp, Mus musculus
ccgcgattgcagggagtcattccca

SEQ ID NO: 247926 - DNA, 25 bp, Mus musculus
ccgcgattgcaggtctgttgtgggg

SEQ ID NO: 247927 - DNA, 25 bp, Mus musculus
ccgcgcacagcattagcagagacac

SEQ ID NO: 247928 - DNA, 25 bp, Mus musculus
ccgcgcagcaggaagaatttcagca

SEQ ID NO: 247929 - DNA, 25 bp, Mus musculus
ccgcgcagcaggaaggtgctgtata

SEQ ID NO: 247930 - DNA, 25 bp, Mus musculus
ccgcgcagccatgagcgagacggtc

SEQ ID NO: 247931 - DNA, 25 bp, Mus musculus
ccgcgcagcccgagctacttcccca

SEQ ID NO: 247932 - DNA, 25 bp, Mus musculus
ccgcgcagtatggacagcattgggc

SEQ ID NO: 247933 - DNA, 25 bp, Mus musculus
ccgcgcagtggttgggaactgtgaa

SEQ ID NO: 247934 - DNA, 25 bp, Mus musculus
ccgcgccaagaacatttaaaagatg

SEQ ID NO: 247935 - DNA, 25 bp, Mus musculus
ccgcgccacggacaagtgacgcaga

SEQ ID NO: 247936 - DNA, 25 bp, Mus musculus
ccgcgccagagcagccaacatgagt

SEQ ID NO: 247937 - DNA, 25 bp, Mus musculus
ccgcgccatcactcggaacccactt

SEQ ID NO: 247938 - DNA, 25 bp, Mus musculus
ccgcgccatggatttggtgagcttt

SEQ ID NO: 247939 - DNA, 25 bp, Mus musculus
ccgcgccatggtctgccaggaactt

SEQ ID NO: 247940 - DNA, 25 bp, Mus musculus
ccgcgccatgtgatctcagcgccct

SEQ ID NO: 247941 - DNA, 25 bp, Mus musculus
ccgcgcccgggaggtgaagggccgg

SEQ ID NO: 247942 - DNA, 25 bp, Mus musculus
ccgcgcccgggagtttcaggcattt

SEQ ID NO: 247943 - DNA, 25 bp, Mus musculus
ccgcgccgagaatcaagaacttaaa

SEQ ID NO: 247944 - DNA, 25 bp, Mus musculus
ccgcgccgagattaaaagaaagttg

SEQ ID NO: 247945 - DNA, 25 bp, Mus musculus
ccgcgccgcagtcgggccgccccac

SEQ ID NO: 247946 - DNA, 25 bp, Mus musculus
ccgcgcctactgactatcaatgtac

SEQ ID NO: 247947 - DNA, 25 bp, Mus musculus
ccgcgcctactgttccaggactatc

SEQ ID NO: 247948 - DNA, 25 bp, Mus musculus
ccgcgcctcgcagggctcaacatat

SEQ ID NO: 247949 - DNA, 25 bp, Mus musculus
ccgcgcctctcagtgctcaggagct

SEQ ID NO: 247950 - DNA, 25 bp, Mus musculus
ccgcgcctctgatgctgagcccagg

SEQ ID NO: 247951 - DNA, 25 bp, Mus musculus
ccgcgcctggagagctccacgcagg

SEQ ID NO: 247952 - DNA, 25 bp, Mus musculus
ccgcgcgccaggaacgttgtgagga

SEQ ID NO: 247953 - DNA, 25 bp, Mus musculus
ccgcgcgcctgaggcactttgaatt

SEQ ID NO: 247954 - DNA, 25 bp, Mus musculus
ccgcgcgcggggtgctgtgagtggc

SEQ ID NO: 247955 - DNA, 25 bp, Mus musculus
ccgcgcggaccccagcccgccggag

SEQ ID NO: 247956 - DNA, 25 bp, Mus musculus
ccgcgcggccatggagcagctgaag

SEQ ID NO: 247957 - DNA, 25 bp, Mus musculus
ccgcgcggcgaagtcaatgaaagga

SEQ ID NO: 247958 - DNA, 25 bp, Mus musculus
ccgcgcggctaactcaacaaaaatc

SEQ ID NO: 247959 - DNA, 25 bp, Mus musculus
ccgcgcgggaccagatgccggcaac

SEQ ID NO: 247960 - DNA, 25 bp, Mus musculus
ccgcgcgggaccaggtactttgtgt

SEQ ID NO: 247961 - DNA, 25 bp, Mus musculus
ccgcgcgggctgagctggactggcc

SEQ ID NO: 247962 - DNA, 25 bp, Mus musculus
ccgcgcgtaggcgtcaagatcaagt

SEQ ID NO: 247963 - DNA, 25 bp, Mus musculus
ccgcgctattcaggcctttggagca

SEQ ID NO: 247964 - DNA, 25 bp, Mus musculus
ccgcgctcaaagatccaggtgctgt

SEQ ID NO: 247965 - DNA, 25 bp, Mus musculus
ccgcgctcaaaggactgtgtattca

SEQ ID NO: 247966 - DNA, 25 bp, Mus musculus
ccgcgctcaaaggcaaaggaggatg

SEQ ID NO: 247967 - DNA, 25 bp, Mus musculus
ccgcgctccctgcactccccaggac

SEQ ID NO: 247968 - DNA, 25 bp, Mus musculus
ccgcgctcgtgcaagttccctggct

SEQ ID NO: 247969 - DNA, 25 bp, Mus musculus
ccgcgctctcgtagaaattgctcca

SEQ ID NO: 247970 - DNA, 25 bp, Mus musculus
ccgcgctctcgtagatctgccacct

SEQ ID NO: 247971 - DNA, 25 bp, Mus musculus
ccgcgctctcgtaggctgaagagtg

SEQ ID NO: 247972 - DNA, 25 bp, Mus musculus
ccgcgctgggaggcatgtcatgtta

SEQ ID NO: 247973 - DNA, 25 bp, Mus musculus
ccgcgctggtgttcgagttcctcag

SEQ ID NO: 247974 - DNA, 25 bp, Mus musculus
ccgcgcttcagggcaactattgatg

SEQ ID NO: 247975 - DNA, 25 bp, Mus musculus
ccgcgcttccgctccggccctcgac

SEQ ID NO: 247976 - DNA, 25 bp, Mus musculus
ccgcgcttggcagagccagacatca

SEQ ID NO: 247977 - DNA, 25 bp, Mus musculus
ccgcggacagagcagactgtatcgt

SEQ ID NO: 247978 - DNA, 25 bp, Mus musculus
ccgcggacaggtttggccgtcgtgg

SEQ ID NO: 247979 - DNA, 25 bp, Mus musculus
ccgcggagacccttccaatctgaac

SEQ ID NO: 247980 - DNA, 25 bp, Mus musculus
ccgcggagcaggcatggagagtaga

SEQ ID NO: 247981 - DNA, 25 bp, Mus musculus
ccgcggagcaggctgccgactacag

SEQ ID NO: 247982 - DNA, 25 bp, Mus musculus
ccgcggagcagggtaaaggccggcg

SEQ ID NO: 247983 - DNA, 25 bp, Mus musculus
ccgcggagcaggtctacaggcttat

SEQ ID NO: 247984 - DNA, 25 bp, Mus musculus
ccgcggagcatcagacatttccact

SEQ ID NO: 247985 - DNA, 25 bp, Mus musculus
ccgcggaggacgtggcctggggagt

SEQ ID NO: 247986 - DNA, 25 bp, Mus musculus
ccgcggatcacgagtgaccgtcttc

SEQ ID NO: 247987 - DNA, 25 bp, Mus musculus
ccgcggatccgcatttgcaggccca

SEQ ID NO: 247988 - DNA, 25 bp, Mus musculus
ccgcggatggccagccttggcctca

SEQ ID NO: 247989 - DNA, 25 bp, Mus musculus
ccgcggattttgcccaggaccagcc

SEQ ID NO: 247990 - DNA, 25 bp, Mus musculus
ccgcggcacaaaatcagcgcctggg

SEQ ID NO: 247991 - DNA, 25 bp, Mus musculus
ccgcggcacgagacaatgaatatgt

SEQ ID NO: 247992 - DNA, 25 bp, Mus musculus
ccgcggcagccactaagccccagtc

SEQ ID NO: 247993 - DNA, 25 bp, Mus musculus
ccgcggcagccgctttcactataca

SEQ ID NO: 247994 - DNA, 25 bp, Mus musculus
ccgcggcccagaattgtaaaaccgg

SEQ ID NO: 247995 - DNA, 25 bp, Mus musculus
ccgcggcccaggttaaatggaatcc

SEQ ID NO: 247996 - DNA, 25 bp, Mus musculus
ccgcggccccccttcacgctcgatt

SEQ ID NO: 247997 - DNA, 25 bp, Mus musculus
ccgcggccccgagcaggtttcaaat

SEQ ID NO: 247998 - DNA, 25 bp, Mus musculus
ccgcggccccgaggagtcagcattg

SEQ ID NO: 247999 - DNA, 25 bp, Mus musculus
ccgcggccgaacatgggtgcaagga

SEQ ID NO: 248000 - DNA, 25 bp, Mus musculus
ccgcggccgaacgacagagactgca

SEQ ID NO: 248001 - DNA, 25 bp, Mus musculus
ccgcggccgcaggcagcaggtgccc

SEQ ID NO: 248002 - DNA, 25 bp, Mus musculus
ccgcggccgcgcagaactgtcatta

SEQ ID NO: 248003 - DNA, 25 bp, Mus musculus
ccgcggccgtgcagttggaattgat

SEQ ID NO: 248004 - DNA, 25 bp, Mus musculus
ccgcggcctgctgggttcacggctc

SEQ ID NO: 248005 - DNA, 25 bp, Mus musculus
ccgcggccttcgggctaacaggcag

SEQ ID NO: 248006 - DNA, 25 bp, Mus musculus
ccgcggcgacgcaggttgatatcaa

SEQ ID NO: 248007 - DNA, 25 bp, Mus musculus
ccgcggcgagcaaggtctgctgaag

SEQ ID NO: 248008 - DNA, 25 bp, Mus musculus
ccgcggcgcaaggaccggctccgag

SEQ ID NO: 248009 - DNA, 25 bp, Mus musculus
ccgcggcgcgcgcagaggtttcata

SEQ ID NO: 248010 - DNA, 25 bp, Mus musculus
ccgcggcggagcagaccatgctcgc

SEQ ID NO: 248011 - DNA, 25 bp, Mus musculus
ccgcggcggcaggattgtcttgaga

SEQ ID NO: 248012 - DNA, 25 bp, Mus musculus
ccgcggcggcaggctcctcctacgc

SEQ ID NO: 248013 - DNA, 25 bp, Mus musculus
ccgcggcggcgccggtgccaagtgc

SEQ ID NO: 248014 - DNA, 25 bp, Mus musculus
ccgcggcggcggagatcctgaggga

SEQ ID NO: 248015 - DNA, 25 bp, Mus musculus
ccgcggcggggcagactgaagtgtt

SEQ ID NO: 248016 - DNA, 25 bp, Mus musculus
ccgcggcggggcaggagcaaaacaa

SEQ ID NO: 248017 - DNA, 25 bp, Mus musculus
ccgcggcggggcaggtgtagtaaca

SEQ ID NO: 248018 - DNA, 25 bp, Mus musculus
ccgcggcggttcaggaattacacag

SEQ ID NO: 248019 - DNA, 25 bp, Mus musculus
ccgcggcggttcaggggtatggaaa

SEQ ID NO: 248020 - DNA, 25 bp, Mus musculus
ccgcggcgtctcagctccgcgtgag

SEQ ID NO: 248021 - DNA, 25 bp, Mus musculus
ccgcggctcctcagatatagccata

SEQ ID NO: 248022 - DNA, 25 bp, Mus musculus
ccgcggctcctcagtattgtggaat

SEQ ID NO: 248023 - DNA, 25 bp, Mus musculus
ccgcggctcctcagtgtcggcggcg

SEQ ID NO: 248024 - DNA, 25 bp, Mus musculus
ccgcggctgcctaggttctggtatt

SEQ ID NO: 248025 - DNA, 25 bp, Mus musculus
ccgcgggaaagagtccagcctctga

SEQ ID NO: 248026 - DNA, 25 bp, Mus musculus
ccgcgggaaaggataaagcatcaga

SEQ ID NO: 248027 - DNA, 25 bp, Mus musculus
ccgcgggacggatttgatctactgt

SEQ ID NO: 248028 - DNA, 25 bp, Mus musculus
ccgcgggacggggagaaagagagag

SEQ ID NO: 248029 - DNA, 25 bp, Mus musculus
ccgcgggagcagcaccccttgggga

SEQ ID NO: 248030 - DNA, 25 bp, Mus musculus
ccgcgggagcaggccggaagctcat

SEQ ID NO: 248031 - DNA, 25 bp, Mus musculus
ccgcgggcgcagataaagaagctga

SEQ ID NO: 248032 - DNA, 25 bp, Mus musculus
ccgcgggctggccctccaagaccat

SEQ ID NO: 248033 - DNA, 25 bp, Mus musculus
ccgcggggacagtaagaagacaatt

SEQ ID NO: 248034 - DNA, 25 bp, Mus musculus
ccgcggggacagtgcctttgacgat

SEQ ID NO: 248035 - DNA, 25 bp, Mus musculus
ccgcggggactggacacctgggctg

SEQ ID NO: 248036 - DNA, 25 bp, Mus musculus
ccgcggggagaggccaacttatttg

SEQ ID NO: 248037 - DNA, 25 bp, Mus musculus
ccgcggggcgatgtgagccccaggt

SEQ ID NO: 248038 - DNA, 25 bp, Mus musculus
ccgcggggcgtgggattgaagtgag

SEQ ID NO: 248039 - DNA, 25 bp, Mus musculus
ccgcgggggaagacgatcacttttt

SEQ ID NO: 248040 - DNA, 25 bp, Mus musculus
ccgcgggggaagacgatgtgtggtg

SEQ ID NO: 248041 - DNA, 25 bp, Mus musculus
ccgcgggggcgaggtggccaggcag

SEQ ID NO: 248042 - DNA, 25 bp, Mus musculus
ccgcgggggcgaggtgtccccatga

SEQ ID NO: 248043 - DNA, 25 bp, Mus musculus
ccgcggggtggccagggctctggct

SEQ ID NO: 248044 - DNA, 25 bp, Mus musculus
ccgcgggttaccgtgcagacatggc

SEQ ID NO: 248045 - DNA, 25 bp, Mus musculus
ccgcggtcactgagcctctgcaggt

SEQ ID NO: 248046 - DNA, 25 bp, Mus musculus
ccgcggtcactgaggtactggcgga

SEQ ID NO: 248047 - DNA, 25 bp, Mus musculus
ccgcggtcgcccagggactttgaat

SEQ ID NO: 248048 - DNA, 25 bp, Mus musculus
ccgcggtgtgcatgttgaccccaac

SEQ ID NO: 248049 - DNA, 25 bp, Mus musculus
ccgcggttacagggcatctgactgg

SEQ ID NO: 248050 - DNA, 25 bp, Mus musculus
ccgcgtcatgggggttaattcctat

SEQ ID NO: 248051 - DNA, 25 bp, Mus musculus
ccgcgtccagaccatttttgccctc

SEQ ID NO: 248052 - DNA, 25 bp, Mus musculus
ccgcgtcccgcaggtcctgcatgtc

SEQ ID NO: 248053 - DNA, 25 bp, Mus musculus
ccgcgtccgggtgatctctgggcta

SEQ ID NO: 248054 - DNA, 25 bp, Mus musculus
ccgcgtcgagatttggtgactgagg

SEQ ID NO: 248055 - DNA, 25 bp, Mus musculus
ccgcgtcgggaccaggatgaggctg

SEQ ID NO: 248056 - DNA, 25 bp, Mus musculus
ccgcgtctcggaagactcttcaaga

SEQ ID NO: 248057 - DNA, 25 bp, Mus musculus
ccgcgtgcgaggatgaaacgaggag

SEQ ID NO: 248058 - DNA, 25 bp, Mus musculus
ccgcgtgcgcaagggtgaaaaattt

SEQ ID NO: 248059 - DNA, 25 bp, Mus musculus
ccgcgtgcgcaaggtacgtgggagc

SEQ ID NO: 248060 - DNA, 25 bp, Mus musculus
ccgcgtgcggtttctagagcatctg

SEQ ID NO: 248061 - DNA, 25 bp, Mus musculus
ccgcgtggacacccttcatggcggc

SEQ ID NO: 248062 - DNA, 25 bp, Mus musculus
ccgcgtggagcaggacctggcaatg

SEQ ID NO: 248063 - DNA, 25 bp, Mus musculus
ccgcgtgggcggccggaggtttgcc

SEQ ID NO: 248064 - DNA, 25 bp, Mus musculus
ccgcgtgggtgtcccagaaatttca

SEQ ID NO: 248065 - DNA, 25 bp, Mus musculus
ccgcgtgtgctcgtggcacggaggt

SEQ ID NO: 248066 - DNA, 25 bp, Mus musculus
ccgcgttagccttcaaaccatgaag

SEQ ID NO: 248067 - DNA, 25 bp, Mus musculus
ccgcgttagccttcggttgtttgtc

SEQ ID NO: 248068 - DNA, 25 bp, Mus musculus
ccgctaacttacagagttgagtggc

SEQ ID NO: 248069 - DNA, 25 bp, Mus musculus
ccgctaacttacaggttctgacggg

SEQ ID NO: 248070 - DNA, 25 bp, Mus musculus
ccgctaatttgtggaacctctgagg

SEQ ID NO: 248071 - DNA, 25 bp, Mus musculus
ccgctaatttgtggccgtctgctga

SEQ ID NO: 248072 - DNA, 25 bp, Mus musculus
ccgctaatttgtgtttacagacctg

SEQ ID NO: 248073 - DNA, 25 bp, Mus musculus
ccgctacaagtgttgatacccataa

SEQ ID NO: 248074 - DNA, 25 bp, Mus musculus
ccgctacaagtgttgttcccatggt

SEQ ID NO: 248075 - DNA, 25 bp, Mus musculus
ccgctacacccaagaatgtggcaat

SEQ ID NO: 248076 - DNA, 25 bp, Mus musculus
ccgctacacccaagcgagcctgtca

SEQ ID NO: 248077 - DNA, 25 bp, Mus musculus
ccgctaccagtattgtacccatgat

SEQ ID NO: 248078 - DNA, 25 bp, Mus musculus
ccgctaccggcagatcaccatccgg

SEQ ID NO: 248079 - DNA, 25 bp, Mus musculus
ccgctacctcaagctgagggcagag

SEQ ID NO: 248080 - DNA, 25 bp, Mus musculus
ccgctacctcaaggagctgagcaag

SEQ ID NO: 248081 - DNA, 25 bp, Mus musculus
ccgctacctcaatcacagttgcagc

SEQ ID NO: 248082 - DNA, 25 bp, Mus musculus
ccgctacgcgcggtatgtggccttt

SEQ ID NO: 248083 - DNA, 25 bp, Mus musculus
ccgctacggaagcctttgcttcctt

SEQ ID NO: 248084 - DNA, 25 bp, Mus musculus
ccgctacggctcaatcgtggatgat

SEQ ID NO: 248085 - DNA, 25 bp, Mus musculus
ccgctacgtgaatgagatcaaggac

SEQ ID NO: 248086 - DNA, 25 bp, Mus musculus
ccgctactctcctcaaaactcagat

SEQ ID NO: 248087 - DNA, 25 bp, Mus musculus
ccgctactctcctcgacccatgagc

SEQ ID NO: 248088 - DNA, 25 bp, Mus musculus
ccgctactgtatcccttttggctag

SEQ ID NO: 248089 - DNA, 25 bp, Mus musculus
ccgctactttggtgacacacactga

SEQ ID NO: 248090 - DNA, 25 bp, Mus musculus
ccgctagacatccgttacaaactcc

SEQ ID NO: 248091 - DNA, 25 bp, Mus musculus
ccgctagacatgaaggatggctttc

SEQ ID NO: 248092 - DNA, 25 bp, Mus musculus
ccgctagacatgtacgatggctttc

SEQ ID NO: 248093 - DNA, 25 bp, Mus musculus
ccgctagaccggtggaacctagggt

SEQ ID NO: 248094 - DNA, 25 bp, Mus musculus
ccgctagcacaggcttctaaaccta

SEQ ID NO: 248095 - DNA, 25 bp, Mus musculus
ccgctagcacaggggttgtgtggtg

SEQ ID NO: 248096 - DNA, 25 bp, Mus musculus
ccgctagctgtcttactcatcagag

SEQ ID NO: 248097 - DNA, 25 bp, Mus musculus
ccgctagtctgaaagaaagactgcg

SEQ ID NO: 248098 - DNA, 25 bp, Mus musculus
ccgctagtgctcagagtgcctgcag

SEQ ID NO: 248099 - DNA, 25 bp, Mus musculus
ccgctagtgctcagctacagcaacg

SEQ ID NO: 248100 - DNA, 25 bp, Mus musculus
ccgctatcagatccatttgggctta

SEQ ID NO: 248101 - DNA, 25 bp, Mus musculus
ccgctcaacaggtttgatggctatg

SEQ ID NO: 248102 - DNA, 25 bp, Mus musculus
ccgctcaacagttcccttcttcggg

SEQ ID NO: 248103 - DNA, 25 bp, Mus musculus
ccgctcaacgaaacggaaggtggag

SEQ ID NO: 248104 - DNA, 25 bp, Mus musculus
ccgctcaactggcaggcgtgaagtg

SEQ ID NO: 248105 - DNA, 25 bp, Mus musculus
ccgctcaccggctgtaaaaaatggt

SEQ ID NO: 248106 - DNA, 25 bp, Mus musculus
ccgctcacctctgagatacttggag

SEQ ID NO: 248107 - DNA, 25 bp, Mus musculus
ccgctcagaacagcatcccctaccc

SEQ ID NO: 248108 - DNA, 25 bp, Mus musculus
ccgctcagaacaggtcttcacatgc

SEQ ID NO: 248109 - DNA, 25 bp, Mus musculus
ccgctcagatgttagaagatgtagc

SEQ ID NO: 248110 - DNA, 25 bp, Mus musculus
ccgctcagatgttagcactagcaac

SEQ ID NO: 248111 - DNA, 25 bp, Mus musculus
ccgctcagcagcacaaaggcattag

SEQ ID NO: 248112 - DNA, 25 bp, Mus musculus
ccgctcagcttactattaccatact

SEQ ID NO: 248113 - DNA, 25 bp, Mus musculus
ccgctccaagaagaggttctcccag

SEQ ID NO: 248114 - DNA, 25 bp, Mus musculus
ccgctccaagtttgttgaaagtgat

SEQ ID NO: 248115 - DNA, 25 bp, Mus musculus
ccgctccacatgcaggcttcccgag

SEQ ID NO: 248116 - DNA, 25 bp, Mus musculus
ccgctccacatgcaggtgtggtaca

SEQ ID NO: 248117 - DNA, 25 bp, Mus musculus
ccgctccagcattgctgaagtgcag

SEQ ID NO: 248118 - DNA, 25 bp, Mus musculus
ccgctccagtgcgactttactggaa

SEQ ID NO: 248119 - DNA, 25 bp, Mus musculus
ccgctccatcagggttccagtgatc

SEQ ID NO: 248120 - DNA, 25 bp, Mus musculus
ccgctccatcagtggctccacgtac

SEQ ID NO: 248121 - DNA, 25 bp, Mus musculus
ccgctcccacacagccttggacaaa

SEQ ID NO: 248122 - DNA, 25 bp, Mus musculus
ccgctcccacacaggtgagaagccc

SEQ ID NO: 248123 - DNA, 25 bp, Mus musculus
ccgctcccactgcttcacacaggct

SEQ ID NO: 248124 - DNA, 25 bp, Mus musculus
ccgctcccactggcatgctagtccc

SEQ ID NO: 248125 - DNA, 25 bp, Mus musculus
ccgctcccagaatggatgtaaccat

SEQ ID NO: 248126 - DNA, 25 bp, Mus musculus
ccgctcccagaatgttatggctgca

SEQ ID NO: 248127 - DNA, 25 bp, Mus musculus
ccgctccgatccctacgtgaaaagc

SEQ ID NO: 248128 - DNA, 25 bp, Mus musculus
ccgctccgcagacacccgctgtgag

SEQ ID NO: 248129 - DNA, 25 bp, Mus musculus
ccgctccgcagacaccttccgccaa

SEQ ID NO: 248130 - DNA, 25 bp, Mus musculus
ccgctccgcagaggtcgcagcgtga

SEQ ID NO: 248131 - DNA, 25 bp, Mus musculus
ccgctccgccagagggacagtcggc

SEQ ID NO: 248132 - DNA, 25 bp, Mus musculus
ccgctccgcccgtgttggtggaatg

SEQ ID NO: 248133 - DNA, 25 bp, Mus musculus
ccgctccgcgggctggccctccaag

SEQ ID NO: 248134 - DNA, 25 bp, Mus musculus
ccgctccgcgtgagaatcaaatacc

SEQ ID NO: 248135 - DNA, 25 bp, Mus musculus
ccgctccgctcacgaaaggcaagct

SEQ ID NO: 248136 - DNA, 25 bp, Mus musculus
ccgctccgctcacgtgctacctgtc

SEQ ID NO: 248137 - DNA, 25 bp, Mus musculus
ccgctccgtagggaagacatctttg

SEQ ID NO: 248138 - DNA, 25 bp, Mus musculus
ccgctcctgcacagattgcgctggc

SEQ ID NO: 248139 - DNA, 25 bp, Mus musculus
ccgctccttctagtggcagacctgt

SEQ ID NO: 248140 - DNA, 25 bp, Mus musculus
ccgctcctttgcagactttgatcct

SEQ ID NO: 248141 - DNA, 25 bp, Mus musculus
ccgctcctttgcagagcctgaccag

SEQ ID NO: 248142 - DNA, 25 bp, Mus musculus
ccgctcctttgcagccacagacagt

SEQ ID NO: 248143 - DNA, 25 bp, Mus musculus
ccgctcgaagtcgctaggacttctc

SEQ ID NO: 248144 - DNA, 25 bp, Mus musculus
ccgctcgagcccgctgcctgtgcct

SEQ ID NO: 248145 - DNA, 25 bp, Mus musculus
ccgctcgagcccggggactttgtgc

SEQ ID NO: 248146 - DNA, 25 bp, Mus musculus
ccgctcgagcccggtacctgggcca

SEQ ID NO: 248147 - DNA, 25 bp, Mus musculus
ccgctcggatgccagatgttgcatg

SEQ ID NO: 248148 - DNA, 25 bp, Mus musculus
ccgctcgtttctggtccatacattg

SEQ ID NO: 248149 - DNA, 25 bp, Mus musculus
ccgctctcagaacccaggaagctta

SEQ ID NO: 248150 - DNA, 25 bp, Mus musculus
ccgctctcaggtcaaatctaagtgg

SEQ ID NO: 248151 - DNA, 25 bp, Mus musculus
ccgctctccctacagccttgcaaaa

SEQ ID NO: 248152 - DNA, 25 bp, Mus musculus
ccgctctccgaatcaagctatagaa

SEQ ID NO: 248153 - DNA, 25 bp, Mus musculus
ccgctctccgtagtgaagctgtggg

SEQ ID NO: 248154 - DNA, 25 bp, Mus musculus
ccgctctgatgtatggatcggaacg

SEQ ID NO: 248155 - DNA, 25 bp, Mus musculus
ccgctctgctgccctgaatctgtgg

SEQ ID NO: 248156 - DNA, 25 bp, Mus musculus
ccgctctggatctagtgacagcagc

SEQ ID NO: 248157 - DNA, 25 bp, Mus musculus
ccgctctggccgacctaatccccag

SEQ ID NO: 248158 - DNA, 25 bp, Mus musculus
ccgctctggccggagtgagagagag

SEQ ID NO: 248159 - DNA, 25 bp, Mus musculus
ccgctctggggatgtcaacctacaa

SEQ ID NO: 248160 - DNA, 25 bp, Mus musculus
ccgctgaacaaccaactgggcagca

SEQ ID NO: 248161 - DNA, 25 bp, Mus musculus
ccgctgaagagcgtattgaagggcg

SEQ ID NO: 248162 - DNA, 25 bp, Mus musculus
ccgctgaatctcacttcaggcccag

SEQ ID NO: 248163 - DNA, 25 bp, Mus musculus
ccgctgaatctcactttagatagtg

SEQ ID NO: 248164 - DNA, 25 bp, Mus musculus
ccgctgaccaaggcgccatggaaaa

SEQ ID NO: 248165 - DNA, 25 bp, Mus musculus
ccgctgaccctgtgtctcaggggcc

SEQ ID NO: 248166 - DNA, 25 bp, Mus musculus
ccgctgactcggatcgagccctaac

SEQ ID NO: 248167 - DNA, 25 bp, Mus musculus
ccgctgactcggccaaccaatggaa

SEQ ID NO: 248168 - DNA, 25 bp, Mus musculus
ccgctgactcgggtcattacaaaga

SEQ ID NO: 248169 - DNA, 25 bp, Mus musculus
ccgctgagaatatgtacttttctca

SEQ ID NO: 248170 - DNA, 25 bp, Mus musculus
ccgctgagcgtggagaaaaagcagc

SEQ ID NO: 248171 - DNA, 25 bp, Mus musculus
ccgctgagctcaatatggatcaaaa

SEQ ID NO: 248172 - DNA, 25 bp, Mus musculus
ccgctgaggcatcagatgcttatac

SEQ ID NO: 248173 - DNA, 25 bp, Mus musculus
ccgctgagggaaagaaaaatacctt

SEQ ID NO: 248174 - DNA, 25 bp, Mus musculus
ccgctgagggaaagagttcacatga

SEQ ID NO: 248175 - DNA, 25 bp, Mus musculus
ccgctgagggaaagattgacggcgg

SEQ ID NO: 248176 - DNA, 25 bp, Mus musculus
ccgctgagtggatacattccaccac

SEQ ID NO: 248177 - DNA, 25 bp, Mus musculus
ccgctgataagaaaaccactgagca

SEQ ID NO: 248178 - DNA, 25 bp, Mus musculus
ccgctgattgggaaggtttggcctg

SEQ ID NO: 248179 - DNA, 25 bp, Mus musculus
ccgctgatttaggaggacaggtgtg

SEQ ID NO: 248180 - DNA, 25 bp, Mus musculus
ccgctgcaccccgtcagtcatatca

SEQ ID NO: 248181 - DNA, 25 bp, Mus musculus
ccgctgcacgatttaccttcaagac

SEQ ID NO: 248182 - DNA, 25 bp, Mus musculus
ccgctgcacgccggcatgtgtttct

SEQ ID NO: 248183 - DNA, 25 bp, Mus musculus
ccgctgcacgccgtaatttctaatg

SEQ ID NO: 248184 - DNA, 25 bp, Mus musculus
ccgctgcagtgtagggtaaacacaa

SEQ ID NO: 248185 - DNA, 25 bp, Mus musculus
ccgctgcatccccagtccatctatg

SEQ ID NO: 248186 - DNA, 25 bp, Mus musculus
ccgctgccaggcacaatggaaggtc

SEQ ID NO: 248187 - DNA, 25 bp, Mus musculus
ccgctgccccagggatctttggcca

SEQ ID NO: 248188 - DNA, 25 bp, Mus musculus
ccgctgcccgccgccaatatgcctg

SEQ ID NO: 248189 - DNA, 25 bp, Mus musculus
ccgctgccgaggaggctagacaaat

SEQ ID NO: 248190 - DNA, 25 bp, Mus musculus
ccgctgccgcgagataaaatcaaag

SEQ ID NO: 248191 - DNA, 25 bp, Mus musculus
ccgctgccgctccagaagctcgaag

SEQ ID NO: 248192 - DNA, 25 bp, Mus musculus
ccgctgccggagattggcagactca

SEQ ID NO: 248193 - DNA, 25 bp, Mus musculus
ccgctgcctcttccaccttccagca

SEQ ID NO: 248194 - DNA, 25 bp, Mus musculus
ccgctgcctgcatctacctttgcag

SEQ ID NO: 248195 - DNA, 25 bp, Mus musculus
ccgctgcctgcatctgtctcttaac

SEQ ID NO: 248196 - DNA, 25 bp, Mus musculus
ccgctgcgagaggagcagcggcccc

SEQ ID NO: 248197 - DNA, 25 bp, Mus musculus
ccgctgcgagaggagggtgctgact

SEQ ID NO: 248198 - DNA, 25 bp, Mus musculus
ccgctgcgagtggccgccccacctt

SEQ ID NO: 248199 - DNA, 25 bp, Mus musculus
ccgctgcggccagagcttcggtgca

SEQ ID NO: 248200 - DNA, 25 bp, Mus musculus
ccgctgcgggcgagatgtatacatc

SEQ ID NO: 248201 - DNA, 25 bp, Mus musculus
ccgctgctcaaccagacgcacctct

SEQ ID NO: 248202 - DNA, 25 bp, Mus musculus
ccgctgctcaaccagtggacatatc

SEQ ID NO: 248203 - DNA, 25 bp, Mus musculus
ccgctgctcctgggtgctggccaaa

SEQ ID NO: 248204 - DNA, 25 bp, Mus musculus
ccgctgctgccatccctcaggccgc

SEQ ID NO: 248205 - DNA, 25 bp, Mus musculus
ccgctgctgctcggcaatgatggca

SEQ ID NO: 248206 - DNA, 25 bp, Mus musculus
ccgctgctgggaataacagacaaaa

SEQ ID NO: 248207 - DNA, 25 bp, Mus musculus
ccgctgctgggtggctgcgttgatg

SEQ ID NO: 248208 - DNA, 25 bp, Mus musculus
ccgctgcttgcaaggagaagttgac

SEQ ID NO: 248209 - DNA, 25 bp, Mus musculus
ccgctggaagatttatacaaaaggt

SEQ ID NO: 248210 - DNA, 25 bp, Mus musculus
ccgctggaagtttgtgtgagtgaca

SEQ ID NO: 248211 - DNA, 25 bp, Mus musculus
ccgctggacctccgggtcctgtggg

SEQ ID NO: 248212 - DNA, 25 bp, Mus musculus
ccgctggacgcaagggcattgaaaa

SEQ ID NO: 248213 - DNA, 25 bp, Mus musculus
ccgctggacgcaagggtttgtgttt

SEQ ID NO: 248214 - DNA, 25 bp, Mus musculus
ccgctggacgcgcggaaaggaaacc

SEQ ID NO: 248215 - DNA, 25 bp, Mus musculus
ccgctggagaattccttctctgaag

SEQ ID NO: 248216 - DNA, 25 bp, Mus musculus
ccgctggagcagggccacgtggcac

SEQ ID NO: 248217 - DNA, 25 bp, Mus musculus
ccgctggagcccgagtggcaccagc

SEQ ID NO: 248218 - DNA, 25 bp, Mus musculus
ccgctggagcccgatggttttcgga

SEQ ID NO: 248219 - DNA, 25 bp, Mus musculus
ccgctggatcaggtattcctttttt

SEQ ID NO: 248220 - DNA, 25 bp, Mus musculus
ccgctggatcaggttaactttgtgg

SEQ ID NO: 248221 - DNA, 25 bp, Mus musculus
ccgctggatcagtttaggatttaag

SEQ ID NO: 248222 - DNA, 25 bp, Mus musculus
ccgctggcatggacagttctgcccc

SEQ ID NO: 248223 - DNA, 25 bp, Mus musculus
ccgctggccagtttcttcagcgaac

SEQ ID NO: 248224 - DNA, 25 bp, Mus musculus
ccgctggcccaagaggcattatcga

SEQ ID NO: 248225 - DNA, 25 bp, Mus musculus
ccgctggccccgagatgaagtgact

SEQ ID NO: 248226 - DNA, 25 bp, Mus musculus
ccgctggcctcaacagttcctgggt

SEQ ID NO: 248227 - DNA, 25 bp, Mus musculus
ccgctggctgaacagacttggcttt

SEQ ID NO: 248228 - DNA, 25 bp, Mus musculus
ccgctggctgaacagagaacagagt

SEQ ID NO: 248229 - DNA, 25 bp, Mus musculus
ccgctggctgaacagtgagcttcac

SEQ ID NO: 248230 - DNA, 25 bp, Mus musculus
ccgctggctgaacagtttccgctgc

SEQ ID NO: 248231 - DNA, 25 bp, Mus musculus
ccgctgggaacaagtaccattaatt

SEQ ID NO: 248232 - DNA, 25 bp, Mus musculus
ccgctgggcagagggatctttggcc

SEQ ID NO: 248233 - DNA, 25 bp, Mus musculus
ccgctgggctcggagttttcaggaa

SEQ ID NO: 248234 - DNA, 25 bp, Mus musculus
ccgctggtaagattgagaaaggttt

SEQ ID NO: 248235 - DNA, 25 bp, Mus musculus
ccgctggtcggtctgggaacgtaat

SEQ ID NO: 248236 - DNA, 25 bp, Mus musculus
ccgctggtggagggtgtcaccgaag

SEQ ID NO: 248237 - DNA, 25 bp, Mus musculus
ccgctgtacgcagttttacagagag

SEQ ID NO: 248238 - DNA, 25 bp, Mus musculus
ccgctgtacttgtccagctcttaag

SEQ ID NO: 248239 - DNA, 25 bp, Mus musculus
ccgctgtcaaaagtcttgcgctcag

SEQ ID NO: 248240 - DNA, 25 bp, Mus musculus
ccgctgtcaagtcgatgagcagttt

SEQ ID NO: 248241 - DNA, 25 bp, Mus musculus
ccgctgtccccaggaggccccactc

SEQ ID NO: 248242 - DNA, 25 bp, Mus musculus
ccgctgtcctccccgttctgatacc

SEQ ID NO: 248243 - DNA, 25 bp, Mus musculus
ccgctgtccttaatgaacctcccac

SEQ ID NO: 248244 - DNA, 25 bp, Mus musculus
ccgctgtctccgcaggggaacagta

SEQ ID NO: 248245 - DNA, 25 bp, Mus musculus
ccgctgtctgagcgcaggctgtgac

SEQ ID NO: 248246 - DNA, 25 bp, Mus musculus
ccgctgtctgggaagagcatggagg

SEQ ID NO: 248247 - DNA, 25 bp, Mus musculus
ccgctgtgacaactgccccctggaa

SEQ ID NO: 248248 - DNA, 25 bp, Mus musculus
ccgctgtgaggtacagtcatgtcgg

SEQ ID NO: 248249 - DNA, 25 bp, Mus musculus
ccgctgtggccacgtgttctgccga

SEQ ID NO: 248250 - DNA, 25 bp, Mus musculus
ccgctgtggtctatgaaaccaatgt

SEQ ID NO: 248251 - DNA, 25 bp, Mus musculus
ccgctgtggtgatgagatggaccaa

SEQ ID NO: 248252 - DNA, 25 bp, Mus musculus
ccgctgttgacagggtctgcagcat

SEQ ID NO: 248253 - DNA, 25 bp, Mus musculus
ccgcttaaaggactggacagactat

SEQ ID NO: 248254 - DNA, 25 bp, Mus musculus
ccgcttatagcccaaggaacagagg

SEQ ID NO: 248255 - DNA, 25 bp, Mus musculus
ccgcttataggcttggggcatatct

SEQ ID NO: 248256 - DNA, 25 bp, Mus musculus
ccgcttatcattaccagttcaagat

SEQ ID NO: 248257 - DNA, 25 bp, Mus musculus
ccgcttcacatacaggagcgacagt

SEQ ID NO: 248258 - DNA, 25 bp, Mus musculus
ccgcttccaccgcagtgtgaagaaa

SEQ ID NO: 248259 - DNA, 25 bp, Mus musculus
ccgcttccagcagacatccttctac

SEQ ID NO: 248260 - DNA, 25 bp, Mus musculus
ccgcttccatcagacctgaggtcca

SEQ ID NO: 248261 - DNA, 25 bp, Mus musculus
ccgcttccgtgatgtgctaacgaaa

SEQ ID NO: 248262 - DNA, 25 bp, Mus musculus
ccgcttcgagaagaatttccgtgtg

SEQ ID NO: 248263 - DNA, 25 bp, Mus musculus
ccgcttcgagaaggtgccgacaatg

SEQ ID NO: 248264 - DNA, 25 bp, Mus musculus
ccgcttcggaatgagaaaaaggaga

SEQ ID NO: 248265 - DNA, 25 bp, Mus musculus
ccgcttcgggcagctgctgattcac

SEQ ID NO: 248266 - DNA, 25 bp, Mus musculus
ccgcttctccaggagagggaagaat

SEQ ID NO: 248267 - DNA, 25 bp, Mus musculus
ccgcttcttcactgactatggttgt

SEQ ID NO: 248268 - DNA, 25 bp, Mus musculus
ccgcttgcggaggtttggattcagg

SEQ ID NO: 248269 - DNA, 25 bp, Mus musculus
ccgcttgcgtggctcggatggcgtc

SEQ ID NO: 248270 - DNA, 25 bp, Mus musculus
ccgcttggatggggtattgacaaat

SEQ ID NO: 248271 - DNA, 25 bp, Mus musculus
ccgcttggcaggccggcagaggact

SEQ ID NO: 248272 - DNA, 25 bp, Mus musculus
ccgcttggccagggttaactttgag

SEQ ID NO: 248273 - DNA, 25 bp, Mus musculus
ccgctttaacttggggtgagtcaga

SEQ ID NO: 248274 - DNA, 25 bp, Mus musculus
ccgctttcaggtagcactttgtatt

SEQ ID NO: 248275 - DNA, 25 bp, Mus musculus
ccgctttccctcagcagacacgcac

SEQ ID NO: 248276 - DNA, 25 bp, Mus musculus
ccgctttggacagaaaatcaccgtg

SEQ ID NO: 248277 - DNA, 25 bp, Mus musculus
ccgctttggacaggatattgactag

SEQ ID NO: 248278 - DNA, 25 bp, Mus musculus
ccgctttgtggcggacgtgacttgt

SEQ ID NO: 248279 - DNA, 25 bp, Mus musculus
ccgcttttcagatcctggatggtat

SEQ ID NO: 248280 - DNA, 25 bp, Mus musculus
ccgcttttctcagctgtgacttctt

SEQ ID NO: 248281 - DNA, 25 bp, Mus musculus
ccgctttttgagcagacctgggccc

SEQ ID NO: 248282 - DNA, 25 bp, Mus musculus
ccgctttttgagcaggtcacaaacc

SEQ ID NO: 248283 - DNA, 25 bp, Mus musculus
ccggaaaaatccatggtgcctgagt

SEQ ID NO: 248284 - DNA, 25 bp, Mus musculus
ccggaaaaatccattaccagtgctt

SEQ ID NO: 248285 - DNA, 25 bp, Mus musculus
ccggaaaacactggaagcaagagaa

SEQ ID NO: 248286 - DNA, 25 bp, Mus musculus
ccggaaaacactggcggaaccagta

SEQ ID NO: 248287 - DNA, 25 bp, Mus musculus
ccggaaaagtttgtcaaagacatag

SEQ ID NO: 248288 - DNA, 25 bp, Mus musculus
ccggaaactcaagatgtcggttgga

SEQ ID NO: 248289 - DNA, 25 bp, Mus musculus
ccggaaacttagggaatgacaaggt

SEQ ID NO: 248290 - DNA, 25 bp, Mus musculus
ccggaaagagacacagcagtccgag

SEQ ID NO: 248291 - DNA, 25 bp, Mus musculus
ccggaaagggctctatcacggactc

SEQ ID NO: 248292 - DNA, 25 bp, Mus musculus
ccggaaataagactgcagctttaga

SEQ ID NO: 248293 - DNA, 25 bp, Mus musculus
ccggaaattccaaggaacctggtgg

SEQ ID NO: 248294 - DNA, 25 bp, Mus musculus
ccggaacaaagtaagaagctgtctt

SEQ ID NO: 248295 - DNA, 25 bp, Mus musculus
ccggaacaacaataggtgtttcacc

SEQ ID NO: 248296 - DNA, 25 bp, Mus musculus
ccggaacaaggatgtatttatacct

SEQ ID NO: 248297 - DNA, 25 bp, Mus musculus
ccggaacaaggtcctacatctcctt

SEQ ID NO: 248298 - DNA, 25 bp, Mus musculus
ccggaacactggccggagaagctgg

SEQ ID NO: 248299 - DNA, 25 bp, Mus musculus
ccggaacactggccggcacaatatg

SEQ ID NO: 248300 - DNA, 25 bp, Mus musculus
ccggaacagcgcaggacccagaagc

SEQ ID NO: 248301 - DNA, 25 bp, Mus musculus
ccggaaccagcctctgacctccagg

SEQ ID NO: 248302 - DNA, 25 bp, Mus musculus
ccggaaccaggtgtcaccctgagga

SEQ ID NO: 248303 - DNA, 25 bp, Mus musculus
ccggaaccctccactagctggcatt

SEQ ID NO: 248304 - DNA, 25 bp, Mus musculus
ccggaaccctgaaggatcctcgctc

SEQ ID NO: 248305 - DNA, 25 bp, Mus musculus
ccggaacctcaaagtcagtggctat

SEQ ID NO: 248306 - DNA, 25 bp, Mus musculus
ccggaacgagccatggaccctctct

SEQ ID NO: 248307 - DNA, 25 bp, Mus musculus
ccggaacgaggcttcatctacccat

SEQ ID NO: 248308 - DNA, 25 bp, Mus musculus
ccggaactatcctgtggtctccatt

SEQ ID NO: 248309 - DNA, 25 bp, Mus musculus
ccggaactcagatttcaactattgc

SEQ ID NO: 248310 - DNA, 25 bp, Mus musculus
ccggaactccatggtccccagtgct

SEQ ID NO: 248311 - DNA, 25 bp, Mus musculus
ccggaacttcaaggatgaagaaaca

SEQ ID NO: 248312 - DNA, 25 bp, Mus musculus
ccggaacttcaagtcctcctgcata

SEQ ID NO: 248313 - DNA, 25 bp, Mus musculus
ccggaagaagaatatgccccagaga

SEQ ID NO: 248314 - DNA, 25 bp, Mus musculus
ccggaagaatacgtatcaccaaact

SEQ ID NO: 248315 - DNA, 25 bp, Mus musculus
ccggaagatgatgccagaccagttt

SEQ ID NO: 248316 - DNA, 25 bp, Mus musculus
ccggaagcagggaggtaaagcgttc

SEQ ID NO: 248317 - DNA, 25 bp, Mus musculus
ccggaagcaggtgcggtgctacctc

SEQ ID NO: 248318 - DNA, 25 bp, Mus musculus
ccggaagcagtagctaagatgcgag

SEQ ID NO: 248319 - DNA, 25 bp, Mus musculus
ccggaagccaggactccccgcggcc

SEQ ID NO: 248320 - DNA, 25 bp, Mus musculus
ccggaagccaggctgggtcctagag

SEQ ID NO: 248321 - DNA, 25 bp, Mus musculus
ccggaagccctacactattaggaaa

SEQ ID NO: 248322 - DNA, 25 bp, Mus musculus
ccggaagccctacagaaacctgtgg

SEQ ID NO: 248323 - DNA, 25 bp, Mus musculus
ccggaagccgaactgctttgagctg

SEQ ID NO: 248324 - DNA, 25 bp, Mus musculus
ccggaaggaaggtcggcagctctgc

SEQ ID NO: 248325 - DNA, 25 bp, Mus musculus
ccggaaggacttccggattaagcaa

SEQ ID NO: 248326 - DNA, 25 bp, Mus musculus
ccggaaggagtcccagccaagcggg

SEQ ID NO: 248327 - DNA, 25 bp, Mus musculus
ccggaaggtcaagtcactggtgacg

SEQ ID NO: 248328 - DNA, 25 bp, Mus musculus
ccggaaggtgctgctggaggcccgg

SEQ ID NO: 248329 - DNA, 25 bp, Mus musculus
ccggaagtaaggacaagaccagtgc

SEQ ID NO: 248330 - DNA, 25 bp, Mus musculus
ccggaagtataagccggaagaggca

SEQ ID NO: 248331 - DNA, 25 bp, Mus musculus
ccggaagtattagccggaagaggca

SEQ ID NO: 248332 - DNA, 25 bp, Mus musculus
ccggaagtcgggtgacagaagacac

SEQ ID NO: 248333 - DNA, 25 bp, Mus musculus
ccggaagtgaagcccctgcccggat

SEQ ID NO: 248334 - DNA, 25 bp, Mus musculus
ccggaagtgacgagagctgtcggcc

SEQ ID NO: 248335 - DNA, 25 bp, Mus musculus
ccggaagtggcagcatgctaattcc

SEQ ID NO: 248336 - DNA, 25 bp, Mus musculus
ccggaagttaaagcacggtttgctc

SEQ ID NO: 248337 - DNA, 25 bp, Mus musculus
ccggaagttccagggatccttgtgg

SEQ ID NO: 248338 - DNA, 25 bp, Mus musculus
ccggaagttccaggtctggaggctc

SEQ ID NO: 248339 - DNA, 25 bp, Mus musculus
ccggaatacacagcctgcataccat

SEQ ID NO: 248340 - DNA, 25 bp, Mus musculus
ccggaatacacaggtgaactgtgtg

SEQ ID NO: 248341 - DNA, 25 bp, Mus musculus
ccggaatacctaagctttctccaga

SEQ ID NO: 248342 - DNA, 25 bp, Mus musculus
ccggaatacctaagtagtgttggag

SEQ ID NO: 248343 - DNA, 25 bp, Mus musculus
ccggaatttccaccggtttgctgag

SEQ ID NO: 248344 - DNA, 25 bp, Mus musculus
ccggaatttggaactcagggcggtg

SEQ ID NO: 248345 - DNA, 25 bp, Mus musculus
ccggaatttgggctctggacctgat

SEQ ID NO: 248346 - DNA, 25 bp, Mus musculus
ccggacaacagcaagcccaccaatt

SEQ ID NO: 248347 - DNA, 25 bp, Mus musculus
ccggacaaggactggttccacctgg

SEQ ID NO: 248348 - DNA, 25 bp, Mus musculus
ccggacacagaatatccagttatgg

SEQ ID NO: 248349 - DNA, 25 bp, Mus musculus
ccggacacagacatggactgtctaa

SEQ ID NO: 248350 - DNA, 25 bp, Mus musculus
ccggacacattttaactgtgacaaa

SEQ ID NO: 248351 - DNA, 25 bp, Mus musculus
ccggacacccggaaaccctgatgga

SEQ ID NO: 248352 - DNA, 25 bp, Mus musculus
ccggacactcagacaggaccccgtc

SEQ ID NO: 248353 - DNA, 25 bp, Mus musculus
ccggacactcagcctgcagcctgat

SEQ ID NO: 248354 - DNA, 25 bp, Mus musculus
ccggacagccagcccaggctatcct

SEQ ID NO: 248355 - DNA, 25 bp, Mus musculus
ccggacagccaggcctctggggacc

SEQ ID NO: 248356 - DNA, 25 bp, Mus musculus
ccggacaggcctccgaatcacatgg

SEQ ID NO: 248357 - DNA, 25 bp, Mus musculus
ccggacatcacttggctgtcggcga

SEQ ID NO: 248358 - DNA, 25 bp, Mus musculus
ccggaccacaggccacaaaaagaag

SEQ ID NO: 248359 - DNA, 25 bp, Mus musculus
ccggaccagcaaagaaaaaatggcg

SEQ ID NO: 248360 - DNA, 25 bp, Mus musculus
ccggaccatcacccttcagagtcag

SEQ ID NO: 248361 - DNA, 25 bp, Mus musculus
ccggacccctggttctccacatacg

SEQ ID NO: 248362 - DNA, 25 bp, Mus musculus
ccggacccgagatgagcaataacag

SEQ ID NO: 248363 - DNA, 25 bp, Mus musculus
ccggaccgccagattgtgccttctg

SEQ ID NO: 248364 - DNA, 25 bp, Mus musculus
ccggaccgcgcggccacaaaaagaa

SEQ ID NO: 248365 - DNA, 25 bp, Mus musculus
ccggaccgggtgccggtcatcgtgg

SEQ ID NO: 248366 - DNA, 25 bp, Mus musculus
ccggacctacaacttctgaaaagca

SEQ ID NO: 248367 - DNA, 25 bp, Mus musculus
ccggacctacactgatgaagagttt

SEQ ID NO: 248368 - DNA, 25 bp, Mus musculus
ccggacctatgagtgtgatccagaa

SEQ ID NO: 248369 - DNA, 25 bp, Mus musculus
ccggacctcaatcaccatgcccacc

SEQ ID NO: 248370 - DNA, 25 bp, Mus musculus
ccggacctcagcagaaatctcccgg

SEQ ID NO: 248371 - DNA, 25 bp, Mus musculus
ccggacctcaggtctctgcctccgc

SEQ ID NO: 248372 - DNA, 25 bp, Mus musculus
ccggacctcttgtctacccagctgg

SEQ ID NO: 248373 - DNA, 25 bp, Mus musculus
ccggacgaggccgagcccctcggag

SEQ ID NO: 248374 - DNA, 25 bp, Mus musculus
ccggacgcagatcgcccacgtccag

SEQ ID NO: 248375 - DNA, 25 bp, Mus musculus
ccggacgccgagatgctccagacct

SEQ ID NO: 248376 - DNA, 25 bp, Mus musculus
ccggacggctcagaaaagggggatt

SEQ ID NO: 248377 - DNA, 25 bp, Mus musculus
ccggactcagatcatctttagatgg

SEQ ID NO: 248378 - DNA, 25 bp, Mus musculus
ccggactcagatttgataatgggct

SEQ ID NO: 248379 - DNA, 25 bp, Mus musculus
ccggactctgagacgccacagggcc

SEQ ID NO: 248380 - DNA, 25 bp, Mus musculus
ccggactgctgtaggtctgaccacc

SEQ ID NO: 248381 - DNA, 25 bp, Mus musculus
ccggacttagcacactcctgggcat

SEQ ID NO: 248382 - DNA, 25 bp, Mus musculus
ccggacttggacaaacacagccagc

SEQ ID NO: 248383 - DNA, 25 bp, Mus musculus
ccggacttggactgacctgaaaaga

SEQ ID NO: 248384 - DNA, 25 bp, Mus musculus
ccggagaaagcaggccaccccttcc

SEQ ID NO: 248385 - DNA, 25 bp, Mus musculus
ccggagaactggtgcctcgtctcca

SEQ ID NO: 248386 - DNA, 25 bp, Mus musculus
ccggagaagacaaggttctttaacg

SEQ ID NO: 248387 - DNA, 25 bp, Mus musculus
ccggagaagaggcaatcaagccctg

SEQ ID NO: 248388 - DNA, 25 bp, Mus musculus
ccggagaagatggtgaacctggaag

SEQ ID NO: 248389 - DNA, 25 bp, Mus musculus
ccggagaagggtgagcaattgtgtt

SEQ ID NO: 248390 - DNA, 25 bp, Mus musculus
ccggagacacagcttggtgacaatg

SEQ ID NO: 248391 - DNA, 25 bp, Mus musculus
ccggagacacaggccccatggggat

SEQ ID NO: 248392 - DNA, 25 bp, Mus musculus
ccggagacagcccaaggatgtcaca

SEQ ID NO: 248393 - DNA, 25 bp, Mus musculus
ccggagagaaggtctaatgcgctct

SEQ ID NO: 248394 - DNA, 25 bp, Mus musculus
ccggagagagctctcagggcctgtg

SEQ ID NO: 248395 - DNA, 25 bp, Mus musculus
ccggagagcctgaaggctagatatg

SEQ ID NO: 248396 - DNA, 25 bp, Mus musculus
ccggagatcacagctgcacgagtta

SEQ ID NO: 248397 - DNA, 25 bp, Mus musculus
ccggagatcattataggtaaaagct

SEQ ID NO: 248398 - DNA, 25 bp, Mus musculus
ccggagatgcgggtttgcctgcaat

SEQ ID NO: 248399 - DNA, 25 bp, Mus musculus
ccggagatgctcagcaagccccgcc

SEQ ID NO: 248400 - DNA, 25 bp, Mus musculus
ccggagcaagactgtcaaggccttc

SEQ ID NO: 248401 - DNA, 25 bp, Mus musculus
ccggagcaagcagctcgaggaggac

SEQ ID NO: 248402 - DNA, 25 bp, Mus musculus
ccggagcaagcagctggaagatgag

SEQ ID NO: 248403 - DNA, 25 bp, Mus musculus
ccggagcaaggacgaaggtgtttat

SEQ ID NO: 248404 - DNA, 25 bp, Mus musculus
ccggagcaaggtaacaaataaggat

SEQ ID NO: 248405 - DNA, 25 bp, Mus musculus
ccggagcaccccagtgcccgaggcg

SEQ ID NO: 248406 - DNA, 25 bp, Mus musculus
ccggagcacgcagcccgactcaatg

SEQ ID NO: 248407 - DNA, 25 bp, Mus musculus
ccggagcacgggattcgagttctga

SEQ ID NO: 248408 - DNA, 25 bp, Mus musculus
ccggagcatgaaagatcagacctgt

SEQ ID NO: 248409 - DNA, 25 bp, Mus musculus
ccggagcatgaaaggacgtccacgt

SEQ ID NO: 248410 - DNA, 25 bp, Mus musculus
ccggagccaagatcccattctcagt

SEQ ID NO: 248411 - DNA, 25 bp, Mus musculus
ccggagccaagtggttgatcggttg

SEQ ID NO: 248412 - DNA, 25 bp, Mus musculus
ccggagccagaatgacagccaagaa

SEQ ID NO: 248413 - DNA, 25 bp, Mus musculus
ccggagccaggacaaagccaacttt

SEQ ID NO: 248414 - DNA, 25 bp, Mus musculus
ccggagccagggctcagattcttta

SEQ ID NO: 248415 - DNA, 25 bp, Mus musculus
ccggagccaggtcatccacgcctgg

SEQ ID NO: 248416 - DNA, 25 bp, Mus musculus
ccggagccccggatggcatggagga

SEQ ID NO: 248417 - DNA, 25 bp, Mus musculus
ccggagccccggatggccgggctcg

SEQ ID NO: 248418 - DNA, 25 bp, Mus musculus
ccggagccgaataagggaagaaagg

SEQ ID NO: 248419 - DNA, 25 bp, Mus musculus
ccggagccgcaaaggatgaaacgag

SEQ ID NO: 248420 - DNA, 25 bp, Mus musculus
ccggagccgcgactgatttcctgaa

SEQ ID NO: 248421 - DNA, 25 bp, Mus musculus
ccggagccgcgttggaggcctccct

SEQ ID NO: 248422 - DNA, 25 bp, Mus musculus
ccggagccgtgacggagatgctcac

SEQ ID NO: 248423 - DNA, 25 bp, Mus musculus
ccggagcctccggttaagcctgatc

SEQ ID NO: 248424 - DNA, 25 bp, Mus musculus
ccggagcgagacactttcctgagcc

SEQ ID NO: 248425 - DNA, 25 bp, Mus musculus
ccggagcgaggtagcaaacaagata

SEQ ID NO: 248426 - DNA, 25 bp, Mus musculus
ccggagcggagcaatgcctaaatca

SEQ ID NO: 248427 - DNA, 25 bp, Mus musculus
ccggagcggctcaggttccagctac

SEQ ID NO: 248428 - DNA, 25 bp, Mus musculus
ccggagctactggagaagccagatg

SEQ ID NO: 248429 - DNA, 25 bp, Mus musculus
ccggagctatgtttcgaaaccagta

SEQ ID NO: 248430 - DNA, 25 bp, Mus musculus
ccggagctcagagaaagcagaagat

SEQ ID NO: 248431 - DNA, 25 bp, Mus musculus
ccggagctcagagggcgggatgtct

SEQ ID NO: 248432 - DNA, 25 bp, Mus musculus
ccggagctcagaggtgttttctatt

SEQ ID NO: 248433 - DNA, 25 bp, Mus musculus
ccggagctcagaggttgactcttca

SEQ ID NO: 248434 - DNA, 25 bp, Mus musculus
ccggagctcgggcggggaccggagc

SEQ ID NO: 248435 - DNA, 25 bp, Mus musculus
ccggagctgaccaaaccgggctcca

SEQ ID NO: 248436 - DNA, 25 bp, Mus musculus
ccggagctgaccggtctccctatgt

SEQ ID NO: 248437 - DNA, 25 bp, Mus musculus
ccggagctgagcatttcagatctgc

SEQ ID NO: 248438 - DNA, 25 bp, Mus musculus
ccggagctgagggttccagaccacc

SEQ ID NO: 248439 - DNA, 25 bp, Mus musculus
ccggagctgatcgatttgatctact

SEQ ID NO: 248440 - DNA, 25 bp, Mus musculus
ccggagctgcgagaatgtctgaagg

SEQ ID NO: 248441 - DNA, 25 bp, Mus musculus
ccggagctgcgagcagagggacctg

SEQ ID NO: 248442 - DNA, 25 bp, Mus musculus
ccggagctgcgaggactgatgacag

SEQ ID NO: 248443 - DNA, 25 bp, Mus musculus
ccggagctgcgagttacagaatgtc

SEQ ID NO: 248444 - DNA, 25 bp, Mus musculus
ccggagctgcgagttacagatttat

SEQ ID NO: 248445 - DNA, 25 bp, Mus musculus
ccggagctgctctggttgaaggttt

SEQ ID NO: 248446 - DNA, 25 bp, Mus musculus
ccggagctgctggacatgctgctgg

SEQ ID NO: 248447 - DNA, 25 bp, Mus musculus
ccggagctggttaagagaaaatccc

SEQ ID NO: 248448 - DNA, 25 bp, Mus musculus
ccggagctgtatgaggaagtaaagc

SEQ ID NO: 248449 - DNA, 25 bp, Mus musculus
ccggagctgtgaggaatgagttcct

SEQ ID NO: 248450 - DNA, 25 bp, Mus musculus
ccggagctgtgaggacagaaaataa

SEQ ID NO: 248451 - DNA, 25 bp, Mus musculus
ccggagctttgagttgctggttgtt

SEQ ID NO: 248452 - DNA, 25 bp, Mus musculus
ccggaggaaagccatcatgttaagg

SEQ ID NO: 248453 - DNA, 25 bp, Mus musculus
ccggaggaaaggatttctccatata

SEQ ID NO: 248454 - DNA, 25 bp, Mus musculus
ccggaggaagagggctgcctctgaa

SEQ ID NO: 248455 - DNA, 25 bp, Mus musculus
ccggaggaagcacagaccagaagcc

SEQ ID NO: 248456 - DNA, 25 bp, Mus musculus
ccggaggaagcacagctctggatgg

SEQ ID NO: 248457 - DNA, 25 bp, Mus musculus
ccggaggaagcctcaagcacagcca

SEQ ID NO: 248458 - DNA, 25 bp, Mus musculus
ccggaggaaggtgttcctggtggca

SEQ ID NO: 248459 - DNA, 25 bp, Mus musculus
ccggaggacaaaggctatgtgcttc

SEQ ID NO: 248460 - DNA, 25 bp, Mus musculus
ccggaggacacagattccttctgga

SEQ ID NO: 248461 - DNA, 25 bp, Mus musculus
ccggaggactgaatagttgcagtaa

SEQ ID NO: 248462 - DNA, 25 bp, Mus musculus
ccggaggagaggtacagacatgaaa

SEQ ID NO: 248463 - DNA, 25 bp, Mus musculus
ccggaggagatggacgtggatgagt

SEQ ID NO: 248464 - DNA, 25 bp, Mus musculus
ccggaggagatggagcacgccccag

SEQ ID NO: 248465 - DNA, 25 bp, Mus musculus
ccggaggagggaagatcctccctca

SEQ ID NO: 248466 - DNA, 25 bp, Mus musculus
ccggaggagggaaggggctggaaag

SEQ ID NO: 248467 - DNA, 25 bp, Mus musculus
ccggaggagtggagacgtcggatgc

SEQ ID NO: 248468 - DNA, 25 bp, Mus musculus
ccggaggagttcaacatagactaca

SEQ ID NO: 248469 - DNA, 25 bp, Mus musculus
ccggaggatcaagacgaaactgcag

SEQ ID NO: 248470 - DNA, 25 bp, Mus musculus
ccggaggatcaagagttgaaagcgc

SEQ ID NO: 248471 - DNA, 25 bp, Mus musculus
ccggaggcgagaggccccacgcatg

SEQ ID NO: 248472 - DNA, 25 bp, Mus musculus
ccggagggcctcgagctgaagggaa

SEQ ID NO: 248473 - DNA, 25 bp, Mus musculus
ccggagggcctcggtcacccagctg

SEQ ID NO: 248474 - DNA, 25 bp, Mus musculus
ccggagggcgagcgggaacagaact

SEQ ID NO: 248475 - DNA, 25 bp, Mus musculus
ccggaggggttggtgatggattcat

SEQ ID NO: 248476 - DNA, 25 bp, Mus musculus
ccggagggtctgcaggtcttgtaga

SEQ ID NO: 248477 - DNA, 25 bp, Mus musculus
ccggaggtgacaacgaaaatatctg

SEQ ID NO: 248478 - DNA, 25 bp, Mus musculus
ccggagtagaggcctttgtgaaaat

SEQ ID NO: 248479 - DNA, 25 bp, Mus musculus
ccggagtcatgggggtctgctgcac

SEQ ID NO: 248480 - DNA, 25 bp, Mus musculus
ccggagtccagggtctccatagagg

SEQ ID NO: 248481 - DNA, 25 bp, Mus musculus
ccggagtcccaagtctccaggtggt

SEQ ID NO: 248482 - DNA, 25 bp, Mus musculus
ccggagtccgtctacagagagccag

SEQ ID NO: 248483 - DNA, 25 bp, Mus musculus
ccggagtcgactatgtgtacaagac

SEQ ID NO: 248484 - DNA, 25 bp, Mus musculus
ccggagtcgccatgcctacaacaca

SEQ ID NO: 248485 - DNA, 25 bp, Mus musculus
ccggagtcgccatgtcaccccagga

SEQ ID NO: 248486 - DNA, 25 bp, Mus musculus
ccggagtctccgggctttggcgttg

SEQ ID NO: 248487 - DNA, 25 bp, Mus musculus
ccggagtctggcacatccaggaccc

SEQ ID NO: 248488 - DNA, 25 bp, Mus musculus
ccggagtgaactgaagttgaaaaga

SEQ ID NO: 248489 - DNA, 25 bp, Mus musculus
ccggagtgcccatgaacgggaagga

SEQ ID NO: 248490 - DNA, 25 bp, Mus musculus
ccggagtgcggagggcgggggcaga

SEQ ID NO: 248491 - DNA, 25 bp, Mus musculus
ccggagtgcggagggggccccccag

SEQ ID NO: 248492 - DNA, 25 bp, Mus musculus
ccggagtggcagtccggctctccaa

SEQ ID NO: 248493 - DNA, 25 bp, Mus musculus
ccggagttcgtgcctccggagccag

SEQ ID NO: 248494 - DNA, 25 bp, Mus musculus
ccggagttgcaagaccatagtctgt

SEQ ID NO: 248495 - DNA, 25 bp, Mus musculus
ccggataacgagcgaccgccttctc

SEQ ID NO: 248496 - DNA, 25 bp, Mus musculus
ccggataacgtggaccatgtgtttc

SEQ ID NO: 248497 - DNA, 25 bp, Mus musculus
ccggataatgacggcgtggagccca

SEQ ID NO: 248498 - DNA, 25 bp, Mus musculus
ccggataatgtgctagaatttgtga

SEQ ID NO: 248499 - DNA, 25 bp, Mus musculus
ccggatactggacatgctggtgtct

SEQ ID NO: 248500 - DNA, 25 bp, Mus musculus
ccggatactggatgaagacagctgg

SEQ ID NO: 248501 - DNA, 25 bp, Mus musculus
ccggatatcatgagctttcccgaaa

SEQ ID NO: 248502 - DNA, 25 bp, Mus musculus
ccggatatctgaggttcccaatcaa

SEQ ID NO: 248503 - DNA, 25 bp, Mus musculus
ccggatatggcaggatgttcaacta

SEQ ID NO: 248504 - DNA, 25 bp, Mus musculus
ccggatcccagggcctagtaactat

SEQ ID NO: 248505 - DNA, 25 bp, Mus musculus
ccggatcccgaggccacgtggcacc

SEQ ID NO: 248506 - DNA, 25 bp, Mus musculus
ccggatccctccagcggaactggct

SEQ ID NO: 248507 - DNA, 25 bp, Mus musculus
ccggatccctccaggaggagcagga

SEQ ID NO: 248508 - DNA, 25 bp, Mus musculus
ccggatctcaccagggcccagtcat

SEQ ID NO: 248509 - DNA, 25 bp, Mus musculus
ccggatctgatcagaacaggacgcg

SEQ ID NO: 248510 - DNA, 25 bp, Mus musculus
ccggatctgatcaggtccagcctga

SEQ ID NO: 248511 - DNA, 25 bp, Mus musculus
ccggatctgatcagtctcggcatct

SEQ ID NO: 248512 - DNA, 25 bp, Mus musculus
ccggatctgtacaagggtgaaaaag

SEQ ID NO: 248513 - DNA, 25 bp, Mus musculus
ccggatcttccggccccggaagctg

SEQ ID NO: 248514 - DNA, 25 bp, Mus musculus
ccggatgacattcacctgctgtctt

SEQ ID NO: 248515 - DNA, 25 bp, Mus musculus
ccggatgagcgagctggagcagaac

SEQ ID NO: 248516 - DNA, 25 bp, Mus musculus
ccggatgctcagcgaggacccgtgg

SEQ ID NO: 248517 - DNA, 25 bp, Mus musculus
ccggatgctgagatggtttttgatc

SEQ ID NO: 248518 - DNA, 25 bp, Mus musculus
ccggatgctgcaggttactcggcgg

SEQ ID NO: 248519 - DNA, 25 bp, Mus musculus
ccggatgctgtcggtggctacagat

SEQ ID NO: 248520 - DNA, 25 bp, Mus musculus
ccggatggagtgtcgagggggaacc

SEQ ID NO: 248521 - DNA, 25 bp, Mus musculus
ccggatgtaccagaagactctaaca

SEQ ID NO: 248522 - DNA, 25 bp, Mus musculus
ccggatgtaccaggtgatttcagac

SEQ ID NO: 248523 - DNA, 25 bp, Mus musculus
ccggatgtatccaggctcacccaga

SEQ ID NO: 248524 - DNA, 25 bp, Mus musculus
ccggatgtatccaggtcacccagat

SEQ ID NO: 248525 - DNA, 25 bp, Mus musculus
ccggatgtgaaagcacaggtggacg

SEQ ID NO: 248526 - DNA, 25 bp, Mus musculus
ccggatgtggacgcctctgcccatt

SEQ ID NO: 248527 - DNA, 25 bp, Mus musculus
ccggatgtggacgcttctgccagac

SEQ ID NO: 248528 - DNA, 25 bp, Mus musculus
ccggatgtggacggccgagctctgc

SEQ ID NO: 248529 - DNA, 25 bp, Mus musculus
ccggatgtggatggaaaagccgaag

SEQ ID NO: 248530 - DNA, 25 bp, Mus musculus
ccggatgtgggttatgttcagggca

SEQ ID NO: 248531 - DNA, 25 bp, Mus musculus
ccggatgtggttgccaaaacaaaga

SEQ ID NO: 248532 - DNA, 25 bp, Mus musculus
ccggattaaggggacctggctgaca

SEQ ID NO: 248533 - DNA, 25 bp, Mus musculus
ccggattacatagccaacaaggaga

SEQ ID NO: 248534 - DNA, 25 bp, Mus musculus
ccggattacataggttttactatat

SEQ ID NO: 248535 - DNA, 25 bp, Mus musculus
ccggattacatagtgtatcccctac

SEQ ID NO: 248536 - DNA, 25 bp, Mus musculus
ccggattcagaaggacattaacgag

SEQ ID NO: 248537 - DNA, 25 bp, Mus musculus
ccggattcaggaggtggatgcccag

SEQ ID NO: 248538 - DNA, 25 bp, Mus musculus
ccggattcagtgcaggtttggatgc

SEQ ID NO: 248539 - DNA, 25 bp, Mus musculus
ccggattcagtggcattgaatccag

SEQ ID NO: 248540 - DNA, 25 bp, Mus musculus
ccggattgagcggtcctcgtctttc

SEQ ID NO: 248541 - DNA, 25 bp, Mus musculus
ccggattgcctggagagtgtgaagg

SEQ ID NO: 248542 - DNA, 25 bp, Mus musculus
ccggatttttgttgaagtactcacc

SEQ ID NO: 248543 - DNA, 25 bp, Mus musculus
ccggcaaacatgacctggctcacct

SEQ ID NO: 248544 - DNA, 25 bp, Mus musculus
ccggcaaatggttgaaactgagctc

SEQ ID NO: 248545 - DNA, 25 bp, Mus musculus
ccggcaaattaggtctgactttgtg

SEQ ID NO: 248546 - DNA, 25 bp, Mus musculus
ccggcaagagacggaagaacgagcc

SEQ ID NO: 248547 - DNA, 25 bp, Mus musculus
ccggcaagcccctgccgacacccat

SEQ ID NO: 248548 - DNA, 25 bp, Mus musculus
ccggcaagcccctgcgacacctgcg

SEQ ID NO: 248549 - DNA, 25 bp, Mus musculus
ccggcacaacccgcggggcgccctg

SEQ ID NO: 248550 - DNA, 25 bp, Mus musculus
ccggcacactcgatctgatttgtac

SEQ ID NO: 248551 - DNA, 25 bp, Mus musculus
ccggcacataaaaaggagacagagt

SEQ ID NO: 248552 - DNA, 25 bp, Mus musculus
ccggcacataaaaaggctgagaagg

SEQ ID NO: 248553 - DNA, 25 bp, Mus musculus
ccggcaccaacagcgccaggcagca

SEQ ID NO: 248554 - DNA, 25 bp, Mus musculus
ccggcaccagccctttgcttatggg

SEQ ID NO: 248555 - DNA, 25 bp, Mus musculus
ccggcaccaggcaatctttggcagc

SEQ ID NO: 248556 - DNA, 25 bp, Mus musculus
ccggcaccgccacacagacagatga

SEQ ID NO: 248557 - DNA, 25 bp, Mus musculus
ccggcacgccgttcggggtctaatg

SEQ ID NO: 248558 - DNA, 25 bp, Mus musculus
ccggcactgggcactgaaagaaagc

SEQ ID NO: 248559 - DNA, 25 bp, Mus musculus
ccggcacttaggagcagttctccga

SEQ ID NO: 248560 - DNA, 25 bp, Mus musculus
ccggcagaaagagtaaataacagat

SEQ ID NO: 248561 - DNA, 25 bp, Mus musculus
ccggcagaacctgggccgcatgtat

SEQ ID NO: 248562 - DNA, 25 bp, Mus musculus
ccggcagaagagcctagattcagat

SEQ ID NO: 248563 - DNA, 25 bp, Mus musculus
ccggcagaagcacagaactgctgag

SEQ ID NO: 248564 - DNA, 25 bp, Mus musculus
ccggcagaagcacagatccatgcat

SEQ ID NO: 248565 - DNA, 25 bp, Mus musculus
ccggcagaagcacagggcatctgtt

SEQ ID NO: 248566 - DNA, 25 bp, Mus musculus
ccggcagaagcttcaaactctccag

SEQ ID NO: 248567 - DNA, 25 bp, Mus musculus
ccggcagacagacagctggtggcac

SEQ ID NO: 248568 - DNA, 25 bp, Mus musculus
ccggcagacagtgaagccagtctcc

SEQ ID NO: 248569 - DNA, 25 bp, Mus musculus
ccggcagactgcagcctaggatgtc

SEQ ID NO: 248570 - DNA, 25 bp, Mus musculus
ccggcagactgcagtttcaggtcag

SEQ ID NO: 248571 - DNA, 25 bp, Mus musculus
ccggcagagcaagccactcaggctc

SEQ ID NO: 248572 - DNA, 25 bp, Mus musculus
ccggcagagcaaggtggagctcacc

SEQ ID NO: 248573 - DNA, 25 bp, Mus musculus
ccggcagaggagcctggaggaggga

SEQ ID NO: 248574 - DNA, 25 bp, Mus musculus
ccggcagcaccggaaaactcaagga

SEQ ID NO: 248575 - DNA, 25 bp, Mus musculus
ccggcagcagaggtggtttgtgcac

SEQ ID NO: 248576 - DNA, 25 bp, Mus musculus
ccggcagcaggagaatcctcattga

SEQ ID NO: 248577 - DNA, 25 bp, Mus musculus
ccggcagcaggagaatgccatcttt

SEQ ID NO: 248578 - DNA, 25 bp, Mus musculus
ccggcagcaggatgaaacgaggagg

SEQ ID NO: 248579 - DNA, 25 bp, Mus musculus
ccggcagcagtctcactttatctct

SEQ ID NO: 248580 - DNA, 25 bp, Mus musculus
ccggcagccgaggttcctgcctcaa

SEQ ID NO: 248581 - DNA, 25 bp, Mus musculus
ccggcagcgtgaaggaaatggaatt

SEQ ID NO: 248582 - DNA, 25 bp, Mus musculus
ccggcaggaactgtgtggacgaccc

SEQ ID NO: 248583 - DNA, 25 bp, Mus musculus
ccggcaggcaccgaggtggtttgtg

SEQ ID NO: 248584 - DNA, 25 bp, Mus musculus
ccggcaggctcagctgcaggctgtg

SEQ ID NO: 248585 - DNA, 25 bp, Mus musculus
ccggcaggctgacattgattctggg

SEQ ID NO: 248586 - DNA, 25 bp, Mus musculus
ccggcaggtgaaggcctatgagaag

SEQ ID NO: 248587 - DNA, 25 bp, Mus musculus
ccggcagtcaggagatggaggaaga

SEQ ID NO: 248588 - DNA, 25 bp, Mus musculus
ccggcagtggcgccgtccagaggac

SEQ ID NO: 248589 - DNA, 25 bp, Mus musculus
ccggcatcagctgatttccaaagag

SEQ ID NO: 248590 - DNA, 25 bp, Mus musculus
ccggcatccacggcggaaccttaga

SEQ ID NO: 248591 - DNA, 25 bp, Mus musculus
ccggcatccacggggctccacctga

SEQ ID NO: 248592 - DNA, 25 bp, Mus musculus
ccggcatccagtcctctctctggct

SEQ ID NO: 248593 - DNA, 25 bp, Mus musculus
ccggcatcctgaaagatcttggtgg

SEQ ID NO: 248594 - DNA, 25 bp, Mus musculus
ccggcatcctgaaagggctgtgcgg

SEQ ID NO: 248595 - DNA, 25 bp, Mus musculus
ccggcatcggaagcctggacaaact

SEQ ID NO: 248596 - DNA, 25 bp, Mus musculus
ccggcatgaccaaactccgatgatc

SEQ ID NO: 248597 - DNA, 25 bp, Mus musculus
ccggcatgaccagtgtcagcgcaag

SEQ ID NO: 248598 - DNA, 25 bp, Mus musculus
ccggcatggggcggcgtcgcggctt

SEQ ID NO: 248599 - DNA, 25 bp, Mus musculus
ccggccaacacaaagatgggtgtta

SEQ ID NO: 248600 - DNA, 25 bp, Mus musculus
ccggccaccagccccttcacagaat

SEQ ID NO: 248601 - DNA, 25 bp, Mus musculus
ccggccaccaggttatcctacacaa

SEQ ID NO: 248602 - DNA, 25 bp, Mus musculus
ccggccaccggcaggggactttgtg

SEQ ID NO: 248603 - DNA, 25 bp, Mus musculus
ccggccagacccggcatcaggaaga

SEQ ID NO: 248604 - DNA, 25 bp, Mus musculus
ccggccagatgggcaagagttcaaa

SEQ ID NO: 248605 - DNA, 25 bp, Mus musculus
ccggccagcagtactattactggac

SEQ ID NO: 248606 - DNA, 25 bp, Mus musculus
ccggccagccagataagtacggttt

SEQ ID NO: 248607 - DNA, 25 bp, Mus musculus
ccggccagctgcttgacatctaggg

SEQ ID NO: 248608 - DNA, 25 bp, Mus musculus
ccggccagctgtctcctgaaggaaa

SEQ ID NO: 248609 - DNA, 25 bp, Mus musculus
ccggccaggccatgccatgggttct

SEQ ID NO: 248610 - DNA, 25 bp, Mus musculus
ccggccatctcagctgtggtcctct

SEQ ID NO: 248611 - DNA, 25 bp, Mus musculus
ccggccatctcaggtgttcctgtat

SEQ ID NO: 248612 - DNA, 25 bp, Mus musculus
ccggccatctcaggttgtactttct

SEQ ID NO: 248613 - DNA, 25 bp, Mus musculus
ccggccatgaaaggcgttaagcatc

SEQ ID NO: 248614 - DNA, 25 bp, Mus musculus
ccggccatgggctgaactacgctgc

SEQ ID NO: 248615 - DNA, 25 bp, Mus musculus
ccggcccacccggtgtgacttcttt

SEQ ID NO: 248616 - DNA, 25 bp, Mus musculus
ccggcccacgaagcatgtaatgagg

SEQ ID NO: 248617 - DNA, 25 bp, Mus musculus
ccggcccagcaatggcaattggcat

SEQ ID NO: 248618 - DNA, 25 bp, Mus musculus
ccggcccagcccggtcaagcaggta

SEQ ID NO: 248619 - DNA, 25 bp, Mus musculus
ccggcccatcgggtgagcccggcaa

SEQ ID NO: 248620 - DNA, 25 bp, Mus musculus
ccggccccagcatctgggtggtcta

SEQ ID NO: 248621 - DNA, 25 bp, Mus musculus
ccggccccagctgagtgatcgctct

SEQ ID NO: 248622 - DNA, 25 bp, Mus musculus
ccggccccagggctggctgtgggct

SEQ ID NO: 248623 - DNA, 25 bp, Mus musculus
ccggccccagtggacctgctggtga

SEQ ID NO: 248624 - DNA, 25 bp, Mus musculus
ccggccccatgggtcctccaggact

SEQ ID NO: 248625 - DNA, 25 bp, Mus musculus
ccggccccgaaacgccagcgatggg

SEQ ID NO: 248626 - DNA, 25 bp, Mus musculus
ccggcccgaggcccggtcggtgagc

SEQ ID NO: 248627 - DNA, 25 bp, Mus musculus
ccggcccgcaagctataagcgagca

SEQ ID NO: 248628 - DNA, 25 bp, Mus musculus
ccggcccgcagactttgtgttgctc

SEQ ID NO: 248629 - DNA, 25 bp, Mus musculus
ccggcccgctcaccggctgtaaaaa

SEQ ID NO: 248630 - DNA, 25 bp, Mus musculus
ccggcccgggacccagtgcaggtcc

SEQ ID NO: 248631 - DNA, 25 bp, Mus musculus
ccggccctacgcagctcccacagat

SEQ ID NO: 248632 - DNA, 25 bp, Mus musculus
ccggccctacgcaggtcctgtccag

SEQ ID NO: 248633 - DNA, 25 bp, Mus musculus
ccggccctctgcgcctgtgtctggc

SEQ ID NO: 248634 - DNA, 25 bp, Mus musculus
ccggccgaaggatcatctgtcccta

SEQ ID NO: 248635 - DNA, 25 bp, Mus musculus
ccggccgaaggttcttgattgtcta

SEQ ID NO: 248636 - DNA, 25 bp, Mus musculus
ccggccgagagtgactcatgaaatg

SEQ ID NO: 248637 - DNA, 25 bp, Mus musculus
ccggccgagttcggactttctgcac

SEQ ID NO: 248638 - DNA, 25 bp, Mus musculus
ccggccgcatgtttgtcattgcctt

SEQ ID NO: 248639 - DNA, 25 bp, Mus musculus
ccggccgccaaggttcgcttatctt

SEQ ID NO: 248640 - DNA, 25 bp, Mus musculus
ccggccgccgtccccagtgacctga

SEQ ID NO: 248641 - DNA, 25 bp, Mus musculus
ccggccgcgcgcgcgttattggaaa

SEQ ID NO: 248642 - DNA, 25 bp, Mus musculus
ccggccgctatcagatccatttggg

SEQ ID NO: 248643 - DNA, 25 bp, Mus musculus
ccggccggacgcagatcgcccacgt

SEQ ID NO: 248644 - DNA, 25 bp, Mus musculus
ccggccggccgtcgggactctaatg

SEQ ID NO: 248645 - DNA, 25 bp, Mus musculus
ccggccggcgggtgcccagatcatt

SEQ ID NO: 248646 - DNA, 25 bp, Mus musculus
ccggccggtcaagacagggtcttac

SEQ ID NO: 248647 - DNA, 25 bp, Mus musculus
ccggccggtcaagagttataccctg

SEQ ID NO: 248648 - DNA, 25 bp, Mus musculus
ccggccggtcaaggtgtaaactctt

SEQ ID NO: 248649 - DNA, 25 bp, Mus musculus
ccggccggtcaagtgcacaaccctg

SEQ ID NO: 248650 - DNA, 25 bp, Mus musculus
ccggccgtaccaccggcatcgtgtt

SEQ ID NO: 248651 - DNA, 25 bp, Mus musculus
ccggccgtcgggactctaatgagct

SEQ ID NO: 248652 - DNA, 25 bp, Mus musculus
ccggccgttgtgaacagaccctgct

SEQ ID NO: 248653 - DNA, 25 bp, Mus musculus
ccggccgttgtgctcccatgtgtga

SEQ ID NO: 248654 - DNA, 25 bp, Mus musculus
ccggccgttgtgggcaatacccttt

SEQ ID NO: 248655 - DNA, 25 bp, Mus musculus
ccggcctaaaaggctgctctttggc

SEQ ID NO: 248656 - DNA, 25 bp, Mus musculus
ccggcctaaaagggctccttctcct

SEQ ID NO: 248657 - DNA, 25 bp, Mus musculus
ccggcctatggcggagtagtgtatc

SEQ ID NO: 248658 - DNA, 25 bp, Mus musculus
ccggcctatggcggtgttgtttacc

SEQ ID NO: 248659 - DNA, 25 bp, Mus musculus
ccggcctcagggggctactccgtcc

SEQ ID NO: 248660 - DNA, 25 bp, Mus musculus
ccggcctcatgaagacgtcttcatc

SEQ ID NO: 248661 - DNA, 25 bp, Mus musculus
ccggcctcatgaaggttcctttggc

SEQ ID NO: 248662 - DNA, 25 bp, Mus musculus
ccggcctccaggtctgtgcacttgt

SEQ ID NO: 248663 - DNA, 25 bp, Mus musculus
ccggcctcgggtgtttctgtttgag

SEQ ID NO: 248664 - DNA, 25 bp, Mus musculus
ccggcctctcagaagacaaaagaga

SEQ ID NO: 248665 - DNA, 25 bp, Mus musculus
ccggcctctcagaagcatcactatt

SEQ ID NO: 248666 - DNA, 25 bp, Mus musculus
ccggcctctgatgacccccggagca

SEQ ID NO: 248667 - DNA, 25 bp, Mus musculus
ccggcctctgatgcttgattataca

SEQ ID NO: 248668 - DNA, 25 bp, Mus musculus
ccggcctcttgcctgctagcagcca

SEQ ID NO: 248669 - DNA, 25 bp, Mus musculus
ccggcctctttggaggctcatccaa

SEQ ID NO: 248670 - DNA, 25 bp, Mus musculus
ccggcctctttggctgctgggaacg

SEQ ID NO: 248671 - DNA, 25 bp, Mus musculus
ccggcctgaccttataaacttcagt

SEQ ID NO: 248672 - DNA, 25 bp, Mus musculus
ccggcctgacggaatgtatcctgtc

SEQ ID NO: 248673 - DNA, 25 bp, Mus musculus
ccggcctgacgttatacaaaaggtt

SEQ ID NO: 248674 - DNA, 25 bp, Mus musculus
ccggcctgcgcaggaatcttgggaa

SEQ ID NO: 248675 - DNA, 25 bp, Mus musculus
ccggcctggcaggtagcagaggcag

SEQ ID NO: 248676 - DNA, 25 bp, Mus musculus
ccggcctggcaggtttaagtttcta

SEQ ID NO: 248677 - DNA, 25 bp, Mus musculus
ccggcctggcagtttctagtcctgg

SEQ ID NO: 248678 - DNA, 25 bp, Mus musculus
ccggcctgtgccaaggtcgagtatg

SEQ ID NO: 248679 - DNA, 25 bp, Mus musculus
ccggccttaatgggcaacgtggttc

SEQ ID NO: 248680 - DNA, 25 bp, Mus musculus
ccggccttcagcacacagcacacct

SEQ ID NO: 248681 - DNA, 25 bp, Mus musculus
ccggcctttatcggatccggaaggg

SEQ ID NO: 248682 - DNA, 25 bp, Mus musculus
ccggcgaccgcccgaaacaagaagc

SEQ ID NO: 248683 - DNA, 25 bp, Mus musculus
ccggcgactctaggttgcagtgtgt

SEQ ID NO: 248684 - DNA, 25 bp, Mus musculus
ccggcgagaaacagcaacattactt

SEQ ID NO: 248685 - DNA, 25 bp, Mus musculus
ccggcgagaaacagcgtcatagcag

SEQ ID NO: 248686 - DNA, 25 bp, Mus musculus
ccggcgcagcccgcgggggagccgc

SEQ ID NO: 248687 - DNA, 25 bp, Mus musculus
ccggcgccaatgagaaagataaggg

SEQ ID NO: 248688 - DNA, 25 bp, Mus musculus
ccggcgccccaacagattccacgag

SEQ ID NO: 248689 - DNA, 25 bp, Mus musculus
ccggcgcccctccttcctgagcatg

SEQ ID NO: 248690 - DNA, 25 bp, Mus musculus
ccggcgccgggagtcctgttgaaga

SEQ ID NO: 248691 - DNA, 25 bp, Mus musculus
ccggcgcgcacagccgttgactact

SEQ ID NO: 248692 - DNA, 25 bp, Mus musculus
ccggcgcggcaggtaccagctggag

SEQ ID NO: 248693 - DNA, 25 bp, Mus musculus
ccggcgcggcagtctgcgagtaaac

SEQ ID NO: 248694 - DNA, 25 bp, Mus musculus
ccggcgcggcgggagccgctcccgt

SEQ ID NO: 248695 - DNA, 25 bp, Mus musculus
ccggcgctgagcctcaaaatgcagc

SEQ ID NO: 248696 - DNA, 25 bp, Mus musculus
ccggcgctggctgtggatctcaggt

SEQ ID NO: 248697 - DNA, 25 bp, Mus musculus
ccggcggaagcagtatccagcatgc

SEQ ID NO: 248698 - DNA, 25 bp, Mus musculus
ccggcggaaggtcatgttagcggct

SEQ ID NO: 248699 - DNA, 25 bp, Mus musculus
ccggcggacagagttgatggtgtca

SEQ ID NO: 248700 - DNA, 25 bp, Mus musculus
ccggcggagagcatggatacgtatt

SEQ ID NO: 248701 - DNA, 25 bp, Mus musculus
ccggcggcacgatgccggtgcagct

SEQ ID NO: 248702 - DNA, 25 bp, Mus musculus
ccggcggcagatgtgatggcaccaa

SEQ ID NO: 248703 - DNA, 25 bp, Mus musculus
ccggcggccgctacaaggtggggtc

SEQ ID NO: 248704 - DNA, 25 bp, Mus musculus
ccggcggctggtcacctttgtatgc

SEQ ID NO: 248705 - DNA, 25 bp, Mus musculus
ccggcgggaggctgacaatttccgg

SEQ ID NO: 248706 - DNA, 25 bp, Mus musculus
ccggcgggcggcctcattgctccgt

SEQ ID NO: 248707 - DNA, 25 bp, Mus musculus
ccggcgggcgggtaaataacagatg

SEQ ID NO: 248708 - DNA, 25 bp, Mus musculus
ccggcgggcggtggtacaggatcta

SEQ ID NO: 248709 - DNA, 25 bp, Mus musculus
ccggcgtacgctggcccttctgtat

SEQ ID NO: 248710 - DNA, 25 bp, Mus musculus
ccggcgtacgctggttatttgctgg

SEQ ID NO: 248711 - DNA, 25 bp, Mus musculus
ccggcgtcaggagcctgatgggaag

SEQ ID NO: 248712 - DNA, 25 bp, Mus musculus
ccggcgtcatcaaccctggagaatg

SEQ ID NO: 248713 - DNA, 25 bp, Mus musculus
ccggcgtcatggggtgtgtgagtgt

SEQ ID NO: 248714 - DNA, 25 bp, Mus musculus
ccggcgtccaagagtaagctaaaaa

SEQ ID NO: 248715 - DNA, 25 bp, Mus musculus
ccggcgtccaagagtccatatgttg

SEQ ID NO: 248716 - DNA, 25 bp, Mus musculus
ccggcgtgacagcatttgacattgt

SEQ ID NO: 248717 - DNA, 25 bp, Mus musculus
ccggcgttgttaggaagatgatcca

SEQ ID NO: 248718 - DNA, 25 bp, Mus musculus
ccggcgttgttaggattatgtactg

SEQ ID NO: 248719 - DNA, 25 bp, Mus musculus
ccggctacacagatttgacataatt

SEQ ID NO: 248720 - DNA, 25 bp, Mus musculus
ccggctacagaactttgtacctatt

SEQ ID NO: 248721 - DNA, 25 bp, Mus musculus
ccggctacatggcatcagtggatgg

SEQ ID NO: 248722 - DNA, 25 bp, Mus musculus
ccggctacgactacagtcagggtag

SEQ ID NO: 248723 - DNA, 25 bp, Mus musculus
ccggctagagaacatgaatggcttt

SEQ ID NO: 248724 - DNA, 25 bp, Mus musculus
ccggctagagatcggaatgtgcggg

SEQ ID NO: 248725 - DNA, 25 bp, Mus musculus
ccggctagagcgccacttagcccca

SEQ ID NO: 248726 - DNA, 25 bp, Mus musculus
ccggctagatcacagtcaagcaggt

SEQ ID NO: 248727 - DNA, 25 bp, Mus musculus
ccggctattctaggaaggctgcctt

SEQ ID NO: 248728 - DNA, 25 bp, Mus musculus
ccggctattctagtgacgccaagag

SEQ ID NO: 248729 - DNA, 25 bp, Mus musculus
ccggctcacctggttccggaagcag

SEQ ID NO: 248730 - DNA, 25 bp, Mus musculus
ccggctcagagggaggaggacagcc

SEQ ID NO: 248731 - DNA, 25 bp, Mus musculus
ccggctccaggactactacgtggtc

SEQ ID NO: 248732 - DNA, 25 bp, Mus musculus
ccggctccaggagagggaaaagatg

SEQ ID NO: 248733 - DNA, 25 bp, Mus musculus
ccggctccccaacagggagttggca

SEQ ID NO: 248734 - DNA, 25 bp, Mus musculus
ccggctcccgccagagctcaggccc

SEQ ID NO: 248735 - DNA, 25 bp, Mus musculus
ccggctcccgccagctcaaggtgat

SEQ ID NO: 248736 - DNA, 25 bp, Mus musculus
ccggctcccgccaggagaatggtgc

SEQ ID NO: 248737 - DNA, 25 bp, Mus musculus
ccggctccctcaggtataagtattg

SEQ ID NO: 248738 - DNA, 25 bp, Mus musculus
ccggctccgactcagatcagctcga

SEQ ID NO: 248739 - DNA, 25 bp, Mus musculus
ccggctccgactcagattctttata

SEQ ID NO: 248740 - DNA, 25 bp, Mus musculus
ccggctccgagccaggattgaaatt

SEQ ID NO: 248741 - DNA, 25 bp, Mus musculus
ccggctcctgtacaggttggcggac

SEQ ID NO: 248742 - DNA, 25 bp, Mus musculus
ccggctcgctaagccacactcattc

SEQ ID NO: 248743 - DNA, 25 bp, Mus musculus
ccggctcgctaagccggctgccctt

SEQ ID NO: 248744 - DNA, 25 bp, Mus musculus
ccggctctaaggccaaagatctcat

SEQ ID NO: 248745 - DNA, 25 bp, Mus musculus
ccggctctggttggtcatgctgcca

SEQ ID NO: 248746 - DNA, 25 bp, Mus musculus
ccggctctgtgaagccgaggaagtg

SEQ ID NO: 248747 - DNA, 25 bp, Mus musculus
ccggctctgtggggctgctgccggc

SEQ ID NO: 248748 - DNA, 25 bp, Mus musculus
ccggctctgtggtgccttagctgga

SEQ ID NO: 248749 - DNA, 25 bp, Mus musculus
ccggctcttcaagtacggggtacag

SEQ ID NO: 248750 - DNA, 25 bp, Mus musculus
ccggctcttggcgcgatgaggaaac

SEQ ID NO: 248751 - DNA, 25 bp, Mus musculus
ccggctgaagcaggctattgaagag

SEQ ID NO: 248752 - DNA, 25 bp, Mus musculus
ccggctgaagcaggtaaaaaacaag

SEQ ID NO: 248753 - DNA, 25 bp, Mus musculus
ccggctgaagccagcatcgagatca

SEQ ID NO: 248754 - DNA, 25 bp, Mus musculus
ccggctgaagccaggagccaaacca

SEQ ID NO: 248755 - DNA, 25 bp, Mus musculus
ccggctgaagctaagccccaagcat

SEQ ID NO: 248756 - DNA, 25 bp, Mus musculus
ccggctgaaggcagacacatctgac

SEQ ID NO: 248757 - DNA, 25 bp, Mus musculus
ccggctgaaggcttgtgaaaaagca

SEQ ID NO: 248758 - DNA, 25 bp, Mus musculus
ccggctgaagggcctctggaaatgt

SEQ ID NO: 248759 - DNA, 25 bp, Mus musculus
ccggctgaagtcatgaactccaatg

SEQ ID NO: 248760 - DNA, 25 bp, Mus musculus
ccggctgacctgcaaatctggttct

SEQ ID NO: 248761 - DNA, 25 bp, Mus musculus
ccggctgacctggccctctgtcctg

SEQ ID NO: 248762 - DNA, 25 bp, Mus musculus
ccggctgacctgttgaacactctga

SEQ ID NO: 248763 - DNA, 25 bp, Mus musculus
ccggctgacgggctcctccccgacg

SEQ ID NO: 248764 - DNA, 25 bp, Mus musculus
ccggctgcaagatgagcctggggcc

SEQ ID NO: 248765 - DNA, 25 bp, Mus musculus
ccggctgcaagggttgttaaacatg

SEQ ID NO: 248766 - DNA, 25 bp, Mus musculus
ccggctgcacagcccatctctgagc

SEQ ID NO: 248767 - DNA, 25 bp, Mus musculus
ccggctgcacaggagcaacacgtcg

SEQ ID NO: 248768 - DNA, 25 bp, Mus musculus
ccggctgcacagtgacatgaaattg

SEQ ID NO: 248769 - DNA, 25 bp, Mus musculus
ccggctgcagaaggactggcccagc

SEQ ID NO: 248770 - DNA, 25 bp, Mus musculus
ccggctgcaggcgaatctggttttg

SEQ ID NO: 248771 - DNA, 25 bp, Mus musculus
ccggctgcagggtctgtcaccgctg

SEQ ID NO: 248772 - DNA, 25 bp, Mus musculus
ccggctgcccactccgccttgatac

SEQ ID NO: 248773 - DNA, 25 bp, Mus musculus
ccggctgctcttcgggaatcatggc

SEQ ID NO: 248774 - DNA, 25 bp, Mus musculus
ccggctggaggcatcatgacaccgg

SEQ ID NO: 248775 - DNA, 25 bp, Mus musculus
ccggctggcagaacacagatctgtt

SEQ ID NO: 248776 - DNA, 25 bp, Mus musculus
ccggctggcagccatggagaacgct

SEQ ID NO: 248777 - DNA, 25 bp, Mus musculus
ccggctggcgactattcttctatga

SEQ ID NO: 248778 - DNA, 25 bp, Mus musculus
ccggctgtacacttccggcctgcta

SEQ ID NO: 248779 - DNA, 25 bp, Mus musculus
ccggctgtcccacctcagcaccagg

SEQ ID NO: 248780 - DNA, 25 bp, Mus musculus
ccggctgtcccaccttgtgcgcccc

SEQ ID NO: 248781 - DNA, 25 bp, Mus musculus
ccggctgtgggaggtgctgtggaca

SEQ ID NO: 248782 - DNA, 25 bp, Mus musculus
ccggcttagaactctccgctggtgt

SEQ ID NO: 248783 - DNA, 25 bp, Mus musculus
ccggcttaggaccagctcgcaggat

SEQ ID NO: 248784 - DNA, 25 bp, Mus musculus
ccggcttccaggtaccaatggggat

SEQ ID NO: 248785 - DNA, 25 bp, Mus musculus
ccggcttccggagatatgacgtgtt

SEQ ID NO: 248786 - DNA, 25 bp, Mus musculus
ccggcttccggagtttgtgatcctg

SEQ ID NO: 248787 - DNA, 25 bp, Mus musculus
ccggcttcgccatggtagcgatggt

SEQ ID NO: 248788 - DNA, 25 bp, Mus musculus
ccggcttctgccccccactgcctca

SEQ ID NO: 248789 - DNA, 25 bp, Mus musculus
ccggcttctggaagtcacctgggca

SEQ ID NO: 248790 - DNA, 25 bp, Mus musculus
ccggcttctttagctctcctcacat

SEQ ID NO: 248791 - DNA, 25 bp, Mus musculus
ccggcttctttaggacgacagccat

SEQ ID NO: 248792 - DNA, 25 bp, Mus musculus
ccggcttctttaggtctcctcacat

SEQ ID NO: 248793 - DNA, 25 bp, Mus musculus
ccggcttgatagtgagattggcaga

SEQ ID NO: 248794 - DNA, 25 bp, Mus musculus
ccggcttggtgcctgttccggagct

SEQ ID NO: 248795 - DNA, 25 bp, Mus musculus
ccggcttttgaaagctctgcggagt

SEQ ID NO: 248796 - DNA, 25 bp, Mus musculus
ccggcttttgaaaggaacagattat

SEQ ID NO: 248797 - DNA, 25 bp, Mus musculus
ccgggaaaaagcaagaccacaccat

SEQ ID NO: 248798 - DNA, 25 bp, Mus musculus
ccgggaaaacaatatggctccttat

SEQ ID NO: 248799 - DNA, 25 bp, Mus musculus
ccgggaaaggattcagatattaaag

SEQ ID NO: 248800 - DNA, 25 bp, Mus musculus
ccgggaaagggctctcttgtgcttc

SEQ ID NO: 248801 - DNA, 25 bp, Mus musculus
ccgggaaccaagaaatcccaggcag

SEQ ID NO: 248802 - DNA, 25 bp, Mus musculus
ccgggaaccaagaaggcacagacag

SEQ ID NO: 248803 - DNA, 25 bp, Mus musculus
ccgggaagagctggcatttcagtcg

SEQ ID NO: 248804 - DNA, 25 bp, Mus musculus
ccgggaagaggtgctgagctatgct

SEQ ID NO: 248805 - DNA, 25 bp, Mus musculus
ccgggaagatgccagtgtacggtca

SEQ ID NO: 248806 - DNA, 25 bp, Mus musculus
ccgggaagcccagcagtattcggag

SEQ ID NO: 248807 - DNA, 25 bp, Mus musculus
ccgggaagttcaggcctggtgatga

SEQ ID NO: 248808 - DNA, 25 bp, Mus musculus
ccgggaatgggcagcacatttaaaa

SEQ ID NO: 248809 - DNA, 25 bp, Mus musculus
ccgggacaaagggtgaagcagggaa

SEQ ID NO: 248810 - DNA, 25 bp, Mus musculus
ccgggacaacgaggagaacatttgt

SEQ ID NO: 248811 - DNA, 25 bp, Mus musculus
ccgggacaactatgggaagaagaag

SEQ ID NO: 248812 - DNA, 25 bp, Mus musculus
ccgggacaaggtaatgttctccttt

SEQ ID NO: 248813 - DNA, 25 bp, Mus musculus
ccgggacactggacatcatcaccac

SEQ ID NO: 248814 - DNA, 25 bp, Mus musculus
ccgggacactgggatcttccttgac

SEQ ID NO: 248815 - DNA, 25 bp, Mus musculus
ccgggacagaatacatgcaagaccc

SEQ ID NO: 248816 - DNA, 25 bp, Mus musculus
ccgggacagagagggtccgtcgtaa

SEQ ID NO: 248817 - DNA, 25 bp, Mus musculus
ccgggacagagcgcctcctcaagcc

SEQ ID NO: 248818 - DNA, 25 bp, Mus musculus
ccgggacagccaggtggagttgtta

SEQ ID NO: 248819 - DNA, 25 bp, Mus musculus
ccgggacagccagtgcgtccagtta

SEQ ID NO: 248820 - DNA, 25 bp, Mus musculus
ccgggacaggcaagcacaagctgct

SEQ ID NO: 248821 - DNA, 25 bp, Mus musculus
ccgggacaggcaccttctgtatttc

SEQ ID NO: 248822 - DNA, 25 bp, Mus musculus
ccgggacccgcaggtcctaatctga

SEQ ID NO: 248823 - DNA, 25 bp, Mus musculus
ccgggacccttatgacctgatgggg

SEQ ID NO: 248824 - DNA, 25 bp, Mus musculus
ccgggacccttctgccactgctgct

SEQ ID NO: 248825 - DNA, 25 bp, Mus musculus
ccgggaccgcaggtgtgggatatgg

SEQ ID NO: 248826 - DNA, 25 bp, Mus musculus
ccgggaccgcagttgagtggtgatt

SEQ ID NO: 248827 - DNA, 25 bp, Mus musculus
ccgggaccgcctgatccggacactg

SEQ ID NO: 248828 - DNA, 25 bp, Mus musculus
ccgggaccgcctggaggaggacatc

SEQ ID NO: 248829 - DNA, 25 bp, Mus musculus
ccgggaccgtaggcgctgaggcatg

SEQ ID NO: 248830 - DNA, 25 bp, Mus musculus
ccgggaccgtcctgtttggagtgct

SEQ ID NO: 248831 - DNA, 25 bp, Mus musculus
ccgggacctgacgtgtgctgtgatc

SEQ ID NO: 248832 - DNA, 25 bp, Mus musculus
ccgggacgaggcaaagatgctggag

SEQ ID NO: 248833 - DNA, 25 bp, Mus musculus
ccgggactcctgagccgctctgcac

SEQ ID NO: 248834 - DNA, 25 bp, Mus musculus
ccgggactcggggctgagcagcaag

SEQ ID NO: 248835 - DNA, 25 bp, Mus musculus
ccgggactcgggggacaggcacgag

SEQ ID NO: 248836 - DNA, 25 bp, Mus musculus
ccgggactgatgcagggtaatcagg

SEQ ID NO: 248837 - DNA, 25 bp, Mus musculus
ccgggacttcatgcgattgagaaga

SEQ ID NO: 248838 - DNA, 25 bp, Mus musculus
ccgggacttcatgttgatcacagcc

SEQ ID NO: 248839 - DNA, 25 bp, Mus musculus
ccgggagaaggatcagtggtgaact

SEQ ID NO: 248840 - DNA, 25 bp, Mus musculus
ccgggagaaggtcctgggcaagttt

SEQ ID NO: 248841 - DNA, 25 bp, Mus musculus
ccgggagacaggcctctctttctga

SEQ ID NO: 248842 - DNA, 25 bp, Mus musculus
ccgggagactcaagggatcctctga

SEQ ID NO: 248843 - DNA, 25 bp, Mus musculus
ccgggagagcaatgtcacacttggt

SEQ ID NO: 248844 - DNA, 25 bp, Mus musculus
ccgggagaggtcggcagacggcgat

SEQ ID NO: 248845 - DNA, 25 bp, Mus musculus
ccgggagatacttgatccttcttac

SEQ ID NO: 248846 - DNA, 25 bp, Mus musculus
ccgggagattggaggggactccttt

SEQ ID NO: 248847 - DNA, 25 bp, Mus musculus
ccgggagcagagaagaaagcgagtg

SEQ ID NO: 248848 - DNA, 25 bp, Mus musculus
ccgggagcaggaggagccaagcaat

SEQ ID NO: 248849 - DNA, 25 bp, Mus musculus
ccgggagcaggaggagccaggagca

SEQ ID NO: 248850 - DNA, 25 bp, Mus musculus
ccgggagcaggctgaagctgaggtg

SEQ ID NO: 248851 - DNA, 25 bp, Mus musculus
ccgggagcagtgatgaaaagactgg

SEQ ID NO: 248852 - DNA, 25 bp, Mus musculus
ccgggagcccctgatgacccctatg

SEQ ID NO: 248853 - DNA, 25 bp, Mus musculus
ccgggagccggcaggcatgccccgg

SEQ ID NO: 248854 - DNA, 25 bp, Mus musculus
ccgggagcgacgatgtcaacctaca

SEQ ID NO: 248855 - DNA, 25 bp, Mus musculus
ccgggagcgagagctttgtaaatgg

SEQ ID NO: 248856 - DNA, 25 bp, Mus musculus
ccgggagctggagtcctttggaacc

SEQ ID NO: 248857 - DNA, 25 bp, Mus musculus
ccgggagcttcagcaggcatccatc

SEQ ID NO: 248858 - DNA, 25 bp, Mus musculus
ccgggagctttcccatcagaaacca

SEQ ID NO: 248859 - DNA, 25 bp, Mus musculus
ccgggagcttttcagcacctttggg

SEQ ID NO: 248860 - DNA, 25 bp, Mus musculus
ccgggaggtccggatgctgttgacg

SEQ ID NO: 248861 - DNA, 25 bp, Mus musculus
ccgggagtcgattttaggtgatggg

SEQ ID NO: 248862 - DNA, 25 bp, Mus musculus
ccgggagtgaagaaatcttccatcc

SEQ ID NO: 248863 - DNA, 25 bp, Mus musculus
ccgggatacacgggacctcactgcg

SEQ ID NO: 248864 - DNA, 25 bp, Mus musculus
ccgggatacaggtgtgaatgaggca

SEQ ID NO: 248865 - DNA, 25 bp, Mus musculus
ccgggatcaaggcagagatgcttta

SEQ ID NO: 248866 - DNA, 25 bp, Mus musculus
ccgggatcaggtggatcaactgagg

SEQ ID NO: 248867 - DNA, 25 bp, Mus musculus
ccgggatgatgccatagcatggaag

SEQ ID NO: 248868 - DNA, 25 bp, Mus musculus
ccgggatgatgccatgtacgcgtct

SEQ ID NO: 248869 - DNA, 25 bp, Mus musculus
ccgggatgcctgatcgtaccgagaa

SEQ ID NO: 248870 - DNA, 25 bp, Mus musculus
ccgggatggagatgaggtgccactt

SEQ ID NO: 248871 - DNA, 25 bp, Mus musculus
ccgggattaaagagcaaaagagagg

SEQ ID NO: 248872 - DNA, 25 bp, Mus musculus
ccgggattaaagagtctattttcat

SEQ ID NO: 248873 - DNA, 25 bp, Mus musculus
ccgggattcagaggaagccaaggga

SEQ ID NO: 248874 - DNA, 25 bp, Mus musculus
ccgggattgtgctttgagcgctgcc

SEQ ID NO: 248875 - DNA, 25 bp, Mus musculus
ccgggcaagacatccacatcttttc

SEQ ID NO: 248876 - DNA, 25 bp, Mus musculus
ccgggcacctggtccgggccatcag

SEQ ID NO: 248877 - DNA, 25 bp, Mus musculus
ccgggcagacaacggttggcatcga

SEQ ID NO: 248878 - DNA, 25 bp, Mus musculus
ccgggcagacaacgttcactttaat

SEQ ID NO: 248879 - DNA, 25 bp, Mus musculus
ccgggcagaccatggtgagcccatt

SEQ ID NO: 248880 - DNA, 25 bp, Mus musculus
ccgggcagagcaggccaaggagatc

SEQ ID NO: 248881 - DNA, 25 bp, Mus musculus
ccgggcagagctcaggatttctggt

SEQ ID NO: 248882 - DNA, 25 bp, Mus musculus
ccgggcagaggcggaacgtgatgtc

SEQ ID NO: 248883 - DNA, 25 bp, Mus musculus
ccgggcagatcctgccccgtcccag

SEQ ID NO: 248884 - DNA, 25 bp, Mus musculus
ccgggcagccaggcaccacctaccc

SEQ ID NO: 248885 - DNA, 25 bp, Mus musculus
ccgggcagcgcaggtatcgccaggc

SEQ ID NO: 248886 - DNA, 25 bp, Mus musculus
ccgggcagcgcaggtgccccgtgct

SEQ ID NO: 248887 - DNA, 25 bp, Mus musculus
ccgggcagcgcgcgcagagacactg

SEQ ID NO: 248888 - DNA, 25 bp, Mus musculus
ccgggcagcggcctggaggagggac

SEQ ID NO: 248889 - DNA, 25 bp, Mus musculus
ccgggcagctgcccacggagcagcc

SEQ ID NO: 248890 - DNA, 25 bp, Mus musculus
ccgggcaggcagtatgggcttattt

SEQ ID NO: 248891 - DNA, 25 bp, Mus musculus
ccgggcagggatttcagccatggct

SEQ ID NO: 248892 - DNA, 25 bp, Mus musculus
ccgggcagtctgggcctgccacccc

SEQ ID NO: 248893 - DNA, 25 bp, Mus musculus
ccgggcagtgtgagctagcccttct

SEQ ID NO: 248894 - DNA, 25 bp, Mus musculus
ccgggcagtgtgagtgatttccggt

SEQ ID NO: 248895 - DNA, 25 bp, Mus musculus
ccgggcagttcaagccaaccatctg

SEQ ID NO: 248896 - DNA, 25 bp, Mus musculus
ccgggcatcggccctgggcagtgac

SEQ ID NO: 248897 - DNA, 25 bp, Mus musculus
ccgggccaaggctagccaacgacca

SEQ ID NO: 248898 - DNA, 25 bp, Mus musculus
ccgggccactcaaggttttgaggac

SEQ ID NO: 248899 - DNA, 25 bp, Mus musculus
ccgggccagacctcagctcgcatcc

SEQ ID NO: 248900 - DNA, 25 bp, Mus musculus
ccgggccagactcaggtatctgcta

SEQ ID NO: 248901 - DNA, 25 bp, Mus musculus
ccgggcccatggaatccaaaactac

SEQ ID NO: 248902 - DNA, 25 bp, Mus musculus
ccgggccccggacagagacagggca

SEQ ID NO: 248903 - DNA, 25 bp, Mus musculus
ccgggccctgcaggaggacctggcg

SEQ ID NO: 248904 - DNA, 25 bp, Mus musculus
ccgggcccttgaagccacccgcggt

SEQ ID NO: 248905 - DNA, 25 bp, Mus musculus
ccgggcccttgaagcgcggctgggt

SEQ ID NO: 248906 - DNA, 25 bp, Mus musculus
ccgggcccttttcagtgagaaagcg

SEQ ID NO: 248907 - DNA, 25 bp, Mus musculus
ccgggccgccaaggtatgccatcat

SEQ ID NO: 248908 - DNA, 25 bp, Mus musculus
ccgggccgccatatgagacggttta

SEQ ID NO: 248909 - DNA, 25 bp, Mus musculus
ccgggccgccatattcattccttgg

SEQ ID NO: 248910 - DNA, 25 bp, Mus musculus
ccgggccgctcgatgaacctctagt

SEQ ID NO: 248911 - DNA, 25 bp, Mus musculus
ccgggccggaccgagaaagggctat

SEQ ID NO: 248912 - DNA, 25 bp, Mus musculus
ccgggccggaccgcacagagaatga

SEQ ID NO: 248913 - DNA, 25 bp, Mus musculus
ccgggccgtgggaaatgcagttatc

SEQ ID NO: 248914 - DNA, 25 bp, Mus musculus
ccgggccgtgggctgcccagctggt

SEQ ID NO: 248915 - DNA, 25 bp, Mus musculus
ccgggcctcaggaaccaatgacaag

SEQ ID NO: 248916 - DNA, 25 bp, Mus musculus
ccgggcctcaggcctcagcatttat

SEQ ID NO: 248917 - DNA, 25 bp, Mus musculus
ccgggcctcagtcttatgacctgaa

SEQ ID NO: 248918 - DNA, 25 bp, Mus musculus
ccgggcctccccagcagtcctttga

SEQ ID NO: 248919 - DNA, 25 bp, Mus musculus
ccgggccttccgctctgtgcctcac

SEQ ID NO: 248920 - DNA, 25 bp, Mus musculus
ccgggcggagccagatttagatgaa

SEQ ID NO: 248921 - DNA, 25 bp, Mus musculus
ccgggcggcaggacctgctagaagt

SEQ ID NO: 248922 - DNA, 25 bp, Mus musculus
ccgggcggcagtgccatggcagaac

SEQ ID NO: 248923 - DNA, 25 bp, Mus musculus
ccgggcggccagccttgcactatgt

SEQ ID NO: 248924 - DNA, 25 bp, Mus musculus
ccgggcgggcgcagagctgagatac

SEQ ID NO: 248925 - DNA, 25 bp, Mus musculus
ccgggcgggcgcagtgttatccaca

SEQ ID NO: 248926 - DNA, 25 bp, Mus musculus
ccgggctaactggactcatgcagtg

SEQ ID NO: 248927 - DNA, 25 bp, Mus musculus
ccgggctatgagatattactacaaa

SEQ ID NO: 248928 - DNA, 25 bp, Mus musculus
ccgggctcacattaatatttgccaa

SEQ ID NO: 248929 - DNA, 25 bp, Mus musculus
ccgggctcaccttgaaaatgaagtc

SEQ ID NO: 248930 - DNA, 25 bp, Mus musculus
ccgggctcaccttgtgttcgacttc

SEQ ID NO: 248931 - DNA, 25 bp, Mus musculus
ccgggctcacggagggaccaacatc

SEQ ID NO: 248932 - DNA, 25 bp, Mus musculus
ccgggctcctgaggcatggaggggt

SEQ ID NO: 248933 - DNA, 25 bp, Mus musculus
ccgggctcggaggtccctgaccctt

SEQ ID NO: 248934 - DNA, 25 bp, Mus musculus
ccgggctgaggagcatgaacggtgc

SEQ ID NO: 248935 - DNA, 25 bp, Mus musculus
ccgggctgaggagccaacatgttgg

SEQ ID NO: 248936 - DNA, 25 bp, Mus musculus
ccgggctgagtcaagtccatcatct

SEQ ID NO: 248937 - DNA, 25 bp, Mus musculus
ccgggctgcgttgagatttggtgac

SEQ ID NO: 248938 - DNA, 25 bp, Mus musculus
ccgggctgttgaggatgtgctcgag

SEQ ID NO: 248939 - DNA, 25 bp, Mus musculus
ccgggcttccagacgatactgtatc

SEQ ID NO: 248940 - DNA, 25 bp, Mus musculus
ccgggctttatcaggtcctcatggg

SEQ ID NO: 248941 - DNA, 25 bp, Mus musculus
ccggggaaacaatggagaagtgtac

SEQ ID NO: 248942 - DNA, 25 bp, Mus musculus
ccggggaaaggaatggatggctgtc

SEQ ID NO: 248943 - DNA, 25 bp, Mus musculus
ccggggaaagggatgattctgagga

SEQ ID NO: 248944 - DNA, 25 bp, Mus musculus
ccggggaaaggtgctctcccaggag

SEQ ID NO: 248945 - DNA, 25 bp, Mus musculus
ccggggaaaggtgtctaaggatgac

SEQ ID NO: 248946 - DNA, 25 bp, Mus musculus
ccggggaagatgtgccagcctgccc

SEQ ID NO: 248947 - DNA, 25 bp, Mus musculus
ccggggaagctggagggaagaagaa

SEQ ID NO: 248948 - DNA, 25 bp, Mus musculus
ccggggaattcactccagatctcta

SEQ ID NO: 248949 - DNA, 25 bp, Mus musculus
ccggggaattcactggaattcctga

SEQ ID NO: 248950 - DNA, 25 bp, Mus musculus
ccggggaccagctgggcccccagca

SEQ ID NO: 248951 - DNA, 25 bp, Mus musculus
ccggggaccaggagcttttccagac

SEQ ID NO: 248952 - DNA, 25 bp, Mus musculus
ccggggacccaggcgatcaaccgag

SEQ ID NO: 248953 - DNA, 25 bp, Mus musculus
ccggggacccgcgaggagttggcat

SEQ ID NO: 248954 - DNA, 25 bp, Mus musculus
ccggggacccgcgaggcaagcagtc

SEQ ID NO: 248955 - DNA, 25 bp, Mus musculus
ccggggaccgaaagtctcctgcttt

SEQ ID NO: 248956 - DNA, 25 bp, Mus musculus
ccggggacctcctgggcattgtcgc

SEQ ID NO: 248957 - DNA, 25 bp, Mus musculus
ccggggacgagatgatttttgatcc

SEQ ID NO: 248958 - DNA, 25 bp, Mus musculus
ccggggactggagggcttcgtggcg

SEQ ID NO: 248959 - DNA, 25 bp, Mus musculus
ccggggactggagggcttctcattc

SEQ ID NO: 248960 - DNA, 25 bp, Mus musculus
ccggggactgtcggatagggactta

SEQ ID NO: 248961 - DNA, 25 bp, Mus musculus
ccggggactgtcggggtacagcatg

SEQ ID NO: 248962 - DNA, 25 bp, Mus musculus
ccggggagaacccagatgagatgga

SEQ ID NO: 248963 - DNA, 25 bp, Mus musculus
ccggggagaagaactggagaatttg

SEQ ID NO: 248964 - DNA, 25 bp, Mus musculus
ccggggagaagacctgtgtagatct

SEQ ID NO: 248965 - DNA, 25 bp, Mus musculus
ccggggagagatactccatgtttcc

SEQ ID NO: 248966 - DNA, 25 bp, Mus musculus
ccggggagagctaggtcacttgtcc

SEQ ID NO: 248967 - DNA, 25 bp, Mus musculus
ccggggagagctagttgctgcttca

SEQ ID NO: 248968 - DNA, 25 bp, Mus musculus
ccggggagaggtgggaaaagcttgt

SEQ ID NO: 248969 - DNA, 25 bp, Mus musculus
ccggggagccgcacgtgtcctgggt

SEQ ID NO: 248970 - DNA, 25 bp, Mus musculus
ccggggagccgggggcactatgaac

SEQ ID NO: 248971 - DNA, 25 bp, Mus musculus
ccggggagctggaggggaacctgat

SEQ ID NO: 248972 - DNA, 25 bp, Mus musculus
ccggggatacagaacatctcccggg

SEQ ID NO: 248973 - DNA, 25 bp, Mus musculus
ccggggatacagctttggggcgatg

SEQ ID NO: 248974 - DNA, 25 bp, Mus musculus
ccggggatcaggaggttgagaacaa

SEQ ID NO: 248975 - DNA, 25 bp, Mus musculus
ccggggattacaggttaaaatgagc

SEQ ID NO: 248976 - DNA, 25 bp, Mus musculus
ccggggcaaggtctgttcactagag

SEQ ID NO: 248977 - DNA, 25 bp, Mus musculus
ccggggcagcggaagaccagactct

SEQ ID NO: 248978 - DNA, 25 bp, Mus musculus
ccggggcatagccaccccgctgggg

SEQ ID NO: 248979 - DNA, 25 bp, Mus musculus
ccggggccactaccgacatctagag

SEQ ID NO: 248980 - DNA, 25 bp, Mus musculus
ccggggccactaccgcacggactcc

SEQ ID NO: 248981 - DNA, 25 bp, Mus musculus
ccggggccagtagagtatagaaata

SEQ ID NO: 248982 - DNA, 25 bp, Mus musculus
ccggggccagtaggtccaatcagca

SEQ ID NO: 248983 - DNA, 25 bp, Mus musculus
ccggggccccagctgtttcagccat

SEQ ID NO: 248984 - DNA, 25 bp, Mus musculus
ccggggccgcaggaggcccagcctc

SEQ ID NO: 248985 - DNA, 25 bp, Mus musculus
ccggggcgagcgaagtaagcggagg

SEQ ID NO: 248986 - DNA, 25 bp, Mus musculus
ccggggcgaggttctctccactatg

SEQ ID NO: 248987 - DNA, 25 bp, Mus musculus
ccggggcggacagacctacgcaatg

SEQ ID NO: 248988 - DNA, 25 bp, Mus musculus
ccggggcggacagatctgacacaca

SEQ ID NO: 248989 - DNA, 25 bp, Mus musculus
ccggggcggagtttgatggtgacag

SEQ ID NO: 248990 - DNA, 25 bp, Mus musculus
ccggggcgggacccagctgacctta

SEQ ID NO: 248991 - DNA, 25 bp, Mus musculus
ccggggctacaggctcaccatcatg

SEQ ID NO: 248992 - DNA, 25 bp, Mus musculus
ccggggctcgatgtctacactacgc

SEQ ID NO: 248993 - DNA, 25 bp, Mus musculus
ccggggctgagctggctagagatct

SEQ ID NO: 248994 - DNA, 25 bp, Mus musculus
ccggggcttgcagaggcctacgtga

SEQ ID NO: 248995 - DNA, 25 bp, Mus musculus
ccgggggaagagtacacacgaagga

SEQ ID NO: 248996 - DNA, 25 bp, Mus musculus
ccgggggacaaggacccagcatggt

SEQ ID NO: 248997 - DNA, 25 bp, Mus musculus
ccgggggacaagggtgccagtgatc

SEQ ID NO: 248998 - DNA, 25 bp, Mus musculus
ccgggggagccgagcactccgccag

SEQ ID NO: 248999 - DNA, 25 bp, Mus musculus
ccgggggagctgtggccatgttcat

SEQ ID NO: 249000 - DNA, 25 bp, Mus musculus
ccgggggcctgaccttccaatctga

SEQ ID NO: 249001 - DNA, 25 bp, Mus musculus
ccggggggaaggattggatggtgag

SEQ ID NO: 249002 - DNA, 25 bp, Mus musculus
ccgggggtctaaggaacgctggcag

SEQ ID NO: 249003 - DNA, 25 bp, Mus musculus
ccgggggtctaaggatcgagagctg

SEQ ID NO: 249004 - DNA, 25 bp, Mus musculus
ccggggtcaggaagattgtcttagc

SEQ ID NO: 249005 - DNA, 25 bp, Mus musculus
ccggggtccgcggtactgtgaggaa

SEQ ID NO: 249006 - DNA, 25 bp, Mus musculus
ccggggtctggacagcattcttcta

SEQ ID NO: 249007 - DNA, 25 bp, Mus musculus
ccggggtctggtggtacttgactgc

SEQ ID NO: 249008 - DNA, 25 bp, Mus musculus
ccggggtgaaggtgagcctcatgtt

SEQ ID NO: 249009 - DNA, 25 bp, Mus musculus
ccggggtgacggtggtcaacatgaa

SEQ ID NO: 249010 - DNA, 25 bp, Mus musculus
ccggggtgagaaggtcatccttttt

SEQ ID NO: 249011 - DNA, 25 bp, Mus musculus
ccggggtgctatggggaagagacac

SEQ ID NO: 249012 - DNA, 25 bp, Mus musculus
ccggggttcatcctgactatgcggc

SEQ ID NO: 249013 - DNA, 25 bp, Mus musculus
ccggggttcatcctgccagagacta

SEQ ID NO: 249014 - DNA, 25 bp, Mus musculus
ccggggttcatttgcatccctggca

SEQ ID NO: 249015 - DNA, 25 bp, Mus musculus
ccgggtaaagaggtgtatgcagttg

SEQ ID NO: 249016 - DNA, 25 bp, Mus musculus
ccgggtaacagaggaaccgatgatg

SEQ ID NO: 249017 - DNA, 25 bp, Mus musculus
ccgggtaactccaggccatccgaac

SEQ ID NO: 249018 - DNA, 25 bp, Mus musculus
ccgggtacttaggtgctggaaagac

SEQ ID NO: 249019 - DNA, 25 bp, Mus musculus
ccgggtaggcggatctgggacgatg

SEQ ID NO: 249020 - DNA, 25 bp, Mus musculus
ccgggtcaaacagaggacagtgtgg

SEQ ID NO: 249021 - DNA, 25 bp, Mus musculus
ccgggtcatcaagggtcacgtgatt

SEQ ID NO: 249022 - DNA, 25 bp, Mus musculus
ccgggtccaggcactttctaggtaa

SEQ ID NO: 249023 - DNA, 25 bp, Mus musculus
ccgggtccttctcgagattttattc

SEQ ID NO: 249024 - DNA, 25 bp, Mus musculus
ccgggtcgcaagcgggctgcctctg

SEQ ID NO: 249025 - DNA, 25 bp, Mus musculus
ccgggtcggagactgcaagtggcaa

SEQ ID NO: 249026 - DNA, 25 bp, Mus musculus
ccgggtctccgtgacaagattgtaa

SEQ ID NO: 249027 - DNA, 25 bp, Mus musculus
ccgggtgacgttgcacaggcatgga

SEQ ID NO: 249028 - DNA, 25 bp, Mus musculus
ccgggtgcagagagacatcccaatg

SEQ ID NO: 249029 - DNA, 25 bp, Mus musculus
ccgggtgcccgcagatgtgcctcat

SEQ ID NO: 249030 - DNA, 25 bp, Mus musculus
ccgggtgccggtcatcgtggagaag

SEQ ID NO: 249031 - DNA, 25 bp, Mus musculus
ccgggtgcgagggaagctgtttact

SEQ ID NO: 249032 - DNA, 25 bp, Mus musculus
ccgggtggaggcagtgtgcaaatag

SEQ ID NO: 249033 - DNA, 25 bp, Mus musculus
ccgggtggaggcagttgtctgctac

SEQ ID NO: 249034 - DNA, 25 bp, Mus musculus
ccgggtggcaaggctggagcagcag

SEQ ID NO: 249035 - DNA, 25 bp, Mus musculus
ccgggtgtcagcgggaacagcagtg

SEQ ID NO: 249036 - DNA, 25 bp, Mus musculus
ccgggtgtgaagggtgagagtggtt

SEQ ID NO: 249037 - DNA, 25 bp, Mus musculus
ccgggtgtgccacggatgaataaaa

SEQ ID NO: 249038 - DNA, 25 bp, Mus musculus
ccgggtgtggagaagaacgctgtgg

SEQ ID NO: 249039 - DNA, 25 bp, Mus musculus
ccgggtgtgggacttgtgtgaggaa

SEQ ID NO: 249040 - DNA, 25 bp, Mus musculus
ccgggttcacagcagcacatcccta

SEQ ID NO: 249041 - DNA, 25 bp, Mus musculus
ccgggttcacagcaggtgcccaggg

SEQ ID NO: 249042 - DNA, 25 bp, Mus musculus
ccgggttctgacaggcctcaagaaa

SEQ ID NO: 249043 - DNA, 25 bp, Mus musculus
ccgggttctgctgcagagacagcac

SEQ ID NO: 249044 - DNA, 25 bp, Mus musculus
ccgggttctgctgggccactgccgg

SEQ ID NO: 249045 - DNA, 25 bp, Mus musculus
ccgggttctgctgtctcagtgccat

SEQ ID NO: 249046 - DNA, 25 bp, Mus musculus
ccgggttttcagatccttaagctgt

SEQ ID NO: 249047 - DNA, 25 bp, Mus musculus
ccgggttttcagcacactgccccat

SEQ ID NO: 249048 - DNA, 25 bp, Mus musculus
ccgggttttcagcctgaataccaag

SEQ ID NO: 249049 - DNA, 25 bp, Mus musculus
ccggtaaagtgccggcagagcagtt

SEQ ID NO: 249050 - DNA, 25 bp, Mus musculus
ccggtaggaagaagccattgctcct

SEQ ID NO: 249051 - DNA, 25 bp, Mus musculus
ccggtcaacaatgcatattcctggt

SEQ ID NO: 249052 - DNA, 25 bp, Mus musculus
ccggtcaatgggtcctaaatgctca

SEQ ID NO: 249053 - DNA, 25 bp, Mus musculus
ccggtcaccctcacagaacatctaa

SEQ ID NO: 249054 - DNA, 25 bp, Mus musculus
ccggtcactatgagtgaaacatctt

SEQ ID NO: 249055 - DNA, 25 bp, Mus musculus
ccggtcactatggtgataaagttac

SEQ ID NO: 249056 - DNA, 25 bp, Mus musculus
ccggtcagagaaaatgtcaaggaga

SEQ ID NO: 249057 - DNA, 25 bp, Mus musculus
ccggtcagatctggcactcgctccc

SEQ ID NO: 249058 - DNA, 25 bp, Mus musculus
ccggtcagatctgtcagtggtgcag

SEQ ID NO: 249059 - DNA, 25 bp, Mus musculus
ccggtcagcggaggggtatctgcta

SEQ ID NO: 249060 - DNA, 25 bp, Mus musculus
ccggtcattaggttcaaccagatgt

SEQ ID NO: 249061 - DNA, 25 bp, Mus musculus
ccggtccacagcaggattccccctc

SEQ ID NO: 249062 - DNA, 25 bp, Mus musculus
ccggtcccacacgcctctgtacaac

SEQ ID NO: 249063 - DNA, 25 bp, Mus musculus
ccggtcccacacggacgtggggctg

SEQ ID NO: 249064 - DNA, 25 bp, Mus musculus
ccggtccctcagggtctggagtatg

SEQ ID NO: 249065 - DNA, 25 bp, Mus musculus
ccggtcctcactgccaaggcagcag

SEQ ID NO: 249066 - DNA, 25 bp, Mus musculus
ccggtccttttcatggttaatttct

SEQ ID NO: 249067 - DNA, 25 bp, Mus musculus
ccggtcgtgtggagagattgctctc

SEQ ID NO: 249068 - DNA, 25 bp, Mus musculus
ccggtctccagcttcctgcgcttcc

SEQ ID NO: 249069 - DNA, 25 bp, Mus musculus
ccggtctccagtgttcacaccgcgg

SEQ ID NO: 249070 - DNA, 25 bp, Mus musculus
ccggtctccgcccggcagaacagtg

SEQ ID NO: 249071 - DNA, 25 bp, Mus musculus
ccggtctccgtttgcagcggggcct

SEQ ID NO: 249072 - DNA, 25 bp, Mus musculus
ccggtctgaaccggctgattatgag

SEQ ID NO: 249073 - DNA, 25 bp, Mus musculus
ccggtctgacacggaacaggaaggc

SEQ ID NO: 249074 - DNA, 25 bp, Mus musculus
ccggtctgtgcagagatattcacaa

SEQ ID NO: 249075 - DNA, 25 bp, Mus musculus
ccggtcttccgctgaaggggatgct

SEQ ID NO: 249076 - DNA, 25 bp, Mus musculus
ccggtgacagacgatactgtatccg

SEQ ID NO: 249077 - DNA, 25 bp, Mus musculus
ccggtgacgccgccgaagatggcgg

SEQ ID NO: 249078 - DNA, 25 bp, Mus musculus
ccggtgagtacgcctgctaagcccc

SEQ ID NO: 249079 - DNA, 25 bp, Mus musculus
ccggtgatcaagaaatgcattgata

SEQ ID NO: 249080 - DNA, 25 bp, Mus musculus
ccggtgcacgatgcccccgaaaaag

SEQ ID NO: 249081 - DNA, 25 bp, Mus musculus
ccggtgcagccagatggagtggccg

SEQ ID NO: 249082 - DNA, 25 bp, Mus musculus
ccggtgcaggctgactttttggggt

SEQ ID NO: 249083 - DNA, 25 bp, Mus musculus
ccggtgcaggctggttaccatggca

SEQ ID NO: 249084 - DNA, 25 bp, Mus musculus
ccggtgcatagagaaatccaaggtc

SEQ ID NO: 249085 - DNA, 25 bp, Mus musculus
ccggtgcatcaggtttgcaagtgag

SEQ ID NO: 249086 - DNA, 25 bp, Mus musculus
ccggtgcattctgggtttctggtta

SEQ ID NO: 249087 - DNA, 25 bp, Mus musculus
ccggtgccagtactgtggtggcttc

SEQ ID NO: 249088 - DNA, 25 bp, Mus musculus
ccggtgcccaggtctgggaacgtaa

SEQ ID NO: 249089 - DNA, 25 bp, Mus musculus
ccggtgcccccggccctcaaggatt

SEQ ID NO: 249090 - DNA, 25 bp, Mus musculus
ccggtgccttgaaggaggggtcatc

SEQ ID NO: 249091 - DNA, 25 bp, Mus musculus
ccggtgcgcggaaagatcaacggaa

SEQ ID NO: 249092 - DNA, 25 bp, Mus musculus
ccggtgctgagttaatatttgccaa

SEQ ID NO: 249093 - DNA, 25 bp, Mus musculus
ccggtgctggacaaggcccgagtcc

SEQ ID NO: 249094 - DNA, 25 bp, Mus musculus
ccggtggagggtcaggatggctgac

SEQ ID NO: 249095 - DNA, 25 bp, Mus musculus
ccggtggagggtgtcccctgcactt

SEQ ID NO: 249096 - DNA, 25 bp, Mus musculus
ccggtggaggtcgactggccaggaa

SEQ ID NO: 249097 - DNA, 25 bp, Mus musculus
ccggtggcaagagactgcttatgtg

SEQ ID NO: 249098 - DNA, 25 bp, Mus musculus
ccggtggctcaatgatccttccttc

SEQ ID NO: 249099 - DNA, 25 bp, Mus musculus
ccggtggtgaagtaggaaacacact

SEQ ID NO: 249100 - DNA, 25 bp, Mus musculus
ccggtgtgctgaagagaactgcttc

SEQ ID NO: 249101 - DNA, 25 bp, Mus musculus
ccggtgtgtgcgtgtgcaagagccg

SEQ ID NO: 249102 - DNA, 25 bp, Mus musculus
ccggttaccttcagaattggataac

SEQ ID NO: 249103 - DNA, 25 bp, Mus musculus
ccggttagaactggtgcaggtcctg

SEQ ID NO: 249104 - DNA, 25 bp, Mus musculus
ccggttagcagcccttggcgatatg

SEQ ID NO: 249105 - DNA, 25 bp, Mus musculus
ccggttagcagctgccgcccttggc

SEQ ID NO: 249106 - DNA, 25 bp, Mus musculus
ccggttagccagggattacgcagcc

SEQ ID NO: 249107 - DNA, 25 bp, Mus musculus
ccggttaggcctgaggctgcttccg

SEQ ID NO: 249108 - DNA, 25 bp, Mus musculus
ccggttagggactgcatgagaagac

SEQ ID NO: 249109 - DNA, 25 bp, Mus musculus
ccggttaggggcgaatggacccgct

SEQ ID NO: 249110 - DNA, 25 bp, Mus musculus
ccggttcactgctcttccgaatcca

SEQ ID NO: 249111 - DNA, 25 bp, Mus musculus
ccggttccaggatccagccgcagcc

SEQ ID NO: 249112 - DNA, 25 bp, Mus musculus
ccggttccccgcagaagacctcctt

SEQ ID NO: 249113 - DNA, 25 bp, Mus musculus
ccggttcccgggctttgatgacagt

SEQ ID NO: 249114 - DNA, 25 bp, Mus musculus
ccggttccgagggaggttcagaagt

SEQ ID NO: 249115 - DNA, 25 bp, Mus musculus
ccggttccgaggtgtgtgaggacga

SEQ ID NO: 249116 - DNA, 25 bp, Mus musculus
ccggttccggttcggattctgtgtc

SEQ ID NO: 249117 - DNA, 25 bp, Mus musculus
ccggttcggagaagaagtctcagcg

SEQ ID NO: 249118 - DNA, 25 bp, Mus musculus
ccggttctcatcaagatcaatgaag

SEQ ID NO: 249119 - DNA, 25 bp, Mus musculus
ccggttctcatgctcctgtggctgt

SEQ ID NO: 249120 - DNA, 25 bp, Mus musculus
ccggttgagagggggcacaatatat

SEQ ID NO: 249121 - DNA, 25 bp, Mus musculus
ccggttgtcatgtatcacggtgatc

SEQ ID NO: 249122 - DNA, 25 bp, Mus musculus
ccggttgtggcggttcccgaggaga

SEQ ID NO: 249123 - DNA, 25 bp, Mus musculus
ccggtttatgctgcgtccctgaccc

SEQ ID NO: 249124 - DNA, 25 bp, Mus musculus
ccggtttcacatgagagcacatgca

SEQ ID NO: 249125 - DNA, 25 bp, Mus musculus
ccggtttcacttgagagcacatgca

SEQ ID NO: 249126 - DNA, 25 bp, Mus musculus
ccggtttgcaagagtctttttggtg

SEQ ID NO: 249127 - DNA, 25 bp, Mus musculus
ccggtttgcaagggcaaatggaaaa

SEQ ID NO: 249128 - DNA, 25 bp, Mus musculus
ccggtttgcaggagagagggagctc

SEQ ID NO: 249129 - DNA, 25 bp, Mus musculus
ccggtttgccaagggtatgtcggag

SEQ ID NO: 249130 - DNA, 25 bp, Mus musculus
ccggtttgtatgaactccagttctc

SEQ ID NO: 249131 - DNA, 25 bp, Mus musculus
ccgtaaaatcgaggttaataatgcg

SEQ ID NO: 249132 - DNA, 25 bp, Mus musculus
ccgtaaacccaaggcagtgggctcc

SEQ ID NO: 249133 - DNA, 25 bp, Mus musculus
ccgtaaagttcgaggtcacgttcat

SEQ ID NO: 249134 - DNA, 25 bp, Mus musculus
ccgtaaccgagccccaatccatgtt

SEQ ID NO: 249135 - DNA, 25 bp, Mus musculus
ccgtaagaacttgaaaactcctcct

SEQ ID NO: 249136 - DNA, 25 bp, Mus musculus
ccgtaagaactttcttttgcatggt

SEQ ID NO: 249137 - DNA, 25 bp, Mus musculus
ccgtaagaatttcatcctatctaag

SEQ ID NO: 249138 - DNA, 25 bp, Mus musculus
ccgtaagagccagctggctcgcata

SEQ ID NO: 249139 - DNA, 25 bp, Mus musculus
ccgtaagagccagttgctatgtcca

SEQ ID NO: 249140 - DNA, 25 bp, Mus musculus
ccgtacaagcagtgagcttatgggg

SEQ ID NO: 249141 - DNA, 25 bp, Mus musculus
ccgtacaatggtggtccatgagaaa

SEQ ID NO: 249142 - DNA, 25 bp, Mus musculus
ccgtacacccagagaacctgtctct

SEQ ID NO: 249143 - DNA, 25 bp, Mus musculus
ccgtacacccagcttccggaataac

SEQ ID NO: 249144 - DNA, 25 bp, Mus musculus
ccgtacagctcagccctgcccacct

SEQ ID NO: 249145 - DNA, 25 bp, Mus musculus
ccgtacatcaggtacttcgtgagct

SEQ ID NO: 249146 - DNA, 25 bp, Mus musculus
ccgtaccaagggatagcccacctca

SEQ ID NO: 249147 - DNA, 25 bp, Mus musculus
ccgtaccaccggcatcgtgttggat

SEQ ID NO: 249148 - DNA, 25 bp, Mus musculus
ccgtacctccaggtgatcaagctcg

SEQ ID NO: 249149 - DNA, 25 bp, Mus musculus
ccgtacggacaggaggcgttgtctg

SEQ ID NO: 249150 - DNA, 25 bp, Mus musculus
ccgtacggacaggaggggagaagag

SEQ ID NO: 249151 - DNA, 25 bp, Mus musculus
ccgtactcaagctccgccctcagtc

SEQ ID NO: 249152 - DNA, 25 bp, Mus musculus
ccgtactcaagctcctgtcttctaa

SEQ ID NO: 249153 - DNA, 25 bp, Mus musculus
ccgtactccaagaggctcgggtctt

SEQ ID NO: 249154 - DNA, 25 bp, Mus musculus
ccgtactctcttaggaaaagaagac

SEQ ID NO: 249155 - DNA, 25 bp, Mus musculus
ccgtacttccgcacctcctctccag

SEQ ID NO: 249156 - DNA, 25 bp, Mus musculus
ccgtagaagaagctggtcccgtcca

SEQ ID NO: 249157 - DNA, 25 bp, Mus musculus
ccgtagacctgaaggtgtccccctt

SEQ ID NO: 249158 - DNA, 25 bp, Mus musculus
ccgtagagaccaagaaaatccagcc

SEQ ID NO: 249159 - DNA, 25 bp, Mus musculus
ccgtagagaccaagatgaagaacca

SEQ ID NO: 249160 - DNA, 25 bp, Mus musculus
ccgtagcccagaaaaatatgaagat

SEQ ID NO: 249161 - DNA, 25 bp, Mus musculus
ccgtagcccagagcaagtccctcca

SEQ ID NO: 249162 - DNA, 25 bp, Mus musculus
ccgtagcctcagagatgctggagtg

SEQ ID NO: 249163 - DNA, 25 bp, Mus musculus
ccgtagcctggatgttgccaaggca

SEQ ID NO: 249164 - DNA, 25 bp, Mus musculus
ccgtaggaagaagtccctctcgtga

SEQ ID NO: 249165 - DNA, 25 bp, Mus musculus
ccgtaggacagattgcatctgggta

SEQ ID NO: 249166 - DNA, 25 bp, Mus musculus
ccgtagggctgttgacctatcaaag

SEQ ID NO: 249167 - DNA, 25 bp, Mus musculus
ccgtaggtgtggctatttcaatgga

SEQ ID NO: 249168 - DNA, 25 bp, Mus musculus
ccgtagtggtgctgacctggacagg

SEQ ID NO: 249169 - DNA, 25 bp, Mus musculus
ccgtagtggtggtcttatgctgact

SEQ ID NO: 249170 - DNA, 25 bp, Mus musculus
ccgtataaagacagggaggtggaca

SEQ ID NO: 249171 - DNA, 25 bp, Mus musculus
ccgtatagaggaagcccagccctgg

SEQ ID NO: 249172 - DNA, 25 bp, Mus musculus
ccgtatataagaagaccctatctaa

SEQ ID NO: 249173 - DNA, 25 bp, Mus musculus
ccgtatataagaaggcactaaccct

SEQ ID NO: 249174 - DNA, 25 bp, Mus musculus
ccgtatatgatggagagggataaag

SEQ ID NO: 249175 - DNA, 25 bp, Mus musculus
ccgtatatgatgggcaggatagcat

SEQ ID NO: 249176 - DNA, 25 bp, Mus musculus
ccgtatatgatgggttttaaagatg

SEQ ID NO: 249177 - DNA, 25 bp, Mus musculus
ccgtatccaggattccctggagatc

SEQ ID NO: 249178 - DNA, 25 bp, Mus musculus
ccgtatcctgaagctgtttgggtat

SEQ ID NO: 249179 - DNA, 25 bp, Mus musculus
ccgtatcctggtgttgggtatgaga

SEQ ID NO: 249180 - DNA, 25 bp, Mus musculus
ccgtatccttgaattacatccaagg

SEQ ID NO: 249181 - DNA, 25 bp, Mus musculus
ccgtatccttgtgttatccaagata

SEQ ID NO: 249182 - DNA, 25 bp, Mus musculus
ccgtatgaaggtggaagatatcaac

SEQ ID NO: 249183 - DNA, 25 bp, Mus musculus
ccgtatgaccaggtcacaatcatta

SEQ ID NO: 249184 - DNA, 25 bp, Mus musculus
ccgtatgtggagaacgttgacaaac

SEQ ID NO: 249185 - DNA, 25 bp, Mus musculus
ccgtattataaccacagtggaagac

SEQ ID NO: 249186 - DNA, 25 bp, Mus musculus
ccgtattataacctcatcgtgttgt

SEQ ID NO: 249187 - DNA, 25 bp, Mus musculus
ccgtattgagagttgcattgtagtg

SEQ ID NO: 249188 - DNA, 25 bp, Mus musculus
ccgtattgaggaacaaaggactctc

SEQ ID NO: 249189 - DNA, 25 bp, Mus musculus
ccgtattgtgcaggcatccagggta

SEQ ID NO: 249190 - DNA, 25 bp, Mus musculus
ccgtcaaaagattccaagaaacaat

SEQ ID NO: 249191 - DNA, 25 bp, Mus musculus
ccgtcaaagacctgatctccaagct

SEQ ID NO: 249192 - DNA, 25 bp, Mus musculus
ccgtcaaagacctgtttctctagat

SEQ ID NO: 249193 - DNA, 25 bp, Mus musculus
ccgtcaaagtcgtgaccccaggctc

SEQ ID NO: 249194 - DNA, 25 bp, Mus musculus
ccgtcaaccctccggagatggcgtc

SEQ ID NO: 249195 - DNA, 25 bp, Mus musculus
ccgtcaagatgcagggttccaagcg

SEQ ID NO: 249196 - DNA, 25 bp, Mus musculus
ccgtcaagatgcagtacccccactt

SEQ ID NO: 249197 - DNA, 25 bp, Mus musculus
ccgtcaatgtctcagatgcactccc

SEQ ID NO: 249198 - DNA, 25 bp, Mus musculus
ccgtcacaaaccacttccattgaag

SEQ ID NO: 249199 - DNA, 25 bp, Mus musculus
ccgtcacaagggcggtgacgaatgc

SEQ ID NO: 249200 - DNA, 25 bp, Mus musculus
ccgtcacaaggttgtcaggaacaat

SEQ ID NO: 249201 - DNA, 25 bp, Mus musculus
ccgtcaccaccaccagagagtcggc

SEQ ID NO: 249202 - DNA, 25 bp, Mus musculus
ccgtcaccatgcccctggctagaga

SEQ ID NO: 249203 - DNA, 25 bp, Mus musculus
ccgtcaccctccgcaagtgtccatt

SEQ ID NO: 249204 - DNA, 25 bp, Mus musculus
ccgtcacctctacagatttcctccc

SEQ ID NO: 249205 - DNA, 25 bp, Mus musculus
ccgtcagaacagaaatgctgccaag

SEQ ID NO: 249206 - DNA, 25 bp, Mus musculus
ccgtcagaacagatcattgtgacag

SEQ ID NO: 249207 - DNA, 25 bp, Mus musculus
ccgtcagaagccactccgtgtatca

SEQ ID NO: 249208 - DNA, 25 bp, Mus musculus
ccgtcagacaaggaggaaggctcaa

SEQ ID NO: 249209 - DNA, 25 bp, Mus musculus
ccgtcagacaaggtaaggaattaca

SEQ ID NO: 249210 - DNA, 25 bp, Mus musculus
ccgtcagagaatgctgactttgcag

SEQ ID NO: 249211 - DNA, 25 bp, Mus musculus
ccgtcagatgagccctaggaccatg

SEQ ID NO: 249212 - DNA, 25 bp, Mus musculus
ccgtcagcccagagctgatttatcc

SEQ ID NO: 249213 - DNA, 25 bp, Mus musculus
ccgtcagccccacaccaaggagatc

SEQ ID NO: 249214 - DNA, 25 bp, Mus musculus
ccgtcagcccggttagctttatacg

SEQ ID NO: 249215 - DNA, 25 bp, Mus musculus
ccgtcaggcttctctgcaagagctg

SEQ ID NO: 249216 - DNA, 25 bp, Mus musculus
ccgtcagggcccagtgggaggagtg

SEQ ID NO: 249217 - DNA, 25 bp, Mus musculus
ccgtcagtcagatcccattgttaac

SEQ ID NO: 249218 - DNA, 25 bp, Mus musculus
ccgtcagtctcggcgtggaaaggag

SEQ ID NO: 249219 - DNA, 25 bp, Mus musculus
ccgtcagtgtgggtgctctttcaga

SEQ ID NO: 249220 - DNA, 25 bp, Mus musculus
ccgtcatagcatcaggcactgttgt

SEQ ID NO: 249221 - DNA, 25 bp, Mus musculus
ccgtcatctgcaaagcagaagcaga

SEQ ID NO: 249222 - DNA, 25 bp, Mus musculus
ccgtcatctgctatagacatagatg

SEQ ID NO: 249223 - DNA, 25 bp, Mus musculus
ccgtcatgacgcaacttcggcacag

SEQ ID NO: 249224 - DNA, 25 bp, Mus musculus
ccgtcattgtcagctggattgtcat

SEQ ID NO: 249225 - DNA, 25 bp, Mus musculus
ccgtcatttatagggttatacaggg

SEQ ID NO: 249226 - DNA, 25 bp, Mus musculus
ccgtccaagaacatgtaccctagtc

SEQ ID NO: 249227 - DNA, 25 bp, Mus musculus
ccgtccaagaggccattgtgagctt

SEQ ID NO: 249228 - DNA, 25 bp, Mus musculus
ccgtccacatgcttgtttatgaatt

SEQ ID NO: 249229 - DNA, 25 bp, Mus musculus
ccgtccactccagggctctctaagt

SEQ ID NO: 249230 - DNA, 25 bp, Mus musculus
ccgtccagaagaaaacacacgtgac

SEQ ID NO: 249231 - DNA, 25 bp, Mus musculus
ccgtccagaagcccacagtcaccag

SEQ ID NO: 249232 - DNA, 25 bp, Mus musculus
ccgtccagaagggtgaacctaagga

SEQ ID NO: 249233 - DNA, 25 bp, Mus musculus
ccgtccagagcctgtgcttgaggcg

SEQ ID NO: 249234 - DNA, 25 bp, Mus musculus
ccgtccagccaaggctgtcttcatg

SEQ ID NO: 249235 - DNA, 25 bp, Mus musculus
ccgtccagggagtgaagccaagaag

SEQ ID NO: 249236 - DNA, 25 bp, Mus musculus
ccgtccagttggttctgaccagaaa

SEQ ID NO: 249237 - DNA, 25 bp, Mus musculus
ccgtccatgaacatatcccgtactc

SEQ ID NO: 249238 - DNA, 25 bp, Mus musculus
ccgtccatgaacatgggtccaggag

SEQ ID NO: 249239 - DNA, 25 bp, Mus musculus
ccgtcccccagaggttgagaacaaa

SEQ ID NO: 249240 - DNA, 25 bp, Mus musculus
ccgtccctgccagatgaggatcatg

SEQ ID NO: 249241 - DNA, 25 bp, Mus musculus
ccgtcccttcactggctcccactac

SEQ ID NO: 249242 - DNA, 25 bp, Mus musculus
ccgtccggcaggggttcatggcatg

SEQ ID NO: 249243 - DNA, 25 bp, Mus musculus
ccgtccggcagtgttctcccgcctg

SEQ ID NO: 249244 - DNA, 25 bp, Mus musculus
ccgtccgggaaaacaatatggctcc

SEQ ID NO: 249245 - DNA, 25 bp, Mus musculus
ccgtcctacgtgggctcgccatacg

SEQ ID NO: 249246 - DNA, 25 bp, Mus musculus
ccgtcctcagctggcagctgtcctc

SEQ ID NO: 249247 - DNA, 25 bp, Mus musculus
ccgtcctgaaactgtaccagttcaa

SEQ ID NO: 249248 - DNA, 25 bp, Mus musculus
ccgtcctgaggagatcatctttctg

SEQ ID NO: 249249 - DNA, 25 bp, Mus musculus
ccgtcctgcaccaacctgcgagcct

SEQ ID NO: 249250 - DNA, 25 bp, Mus musculus
ccgtcctgccgggagctcttaccaa

SEQ ID NO: 249251 - DNA, 25 bp, Mus musculus
ccgtcctgctgcaggctgccaacag

SEQ ID NO: 249252 - DNA, 25 bp, Mus musculus
ccgtcctgtctttgggcagctcaaa

SEQ ID NO: 249253 - DNA, 25 bp, Mus musculus
ccgtcctgtgccaggaaagcactgc

SEQ ID NO: 249254 - DNA, 25 bp, Mus musculus
ccgtcctgtgccaggcaaggtgacc

SEQ ID NO: 249255 - DNA, 25 bp, Mus musculus
ccgtcctgtgtgtcaccccgccctg

SEQ ID NO: 249256 - DNA, 25 bp, Mus musculus
ccgtccttcctccaggagccggcca

SEQ ID NO: 249257 - DNA, 25 bp, Mus musculus
ccgtccttgggaggttctggctgcc

SEQ ID NO: 249258 - DNA, 25 bp, Mus musculus
ccgtcctttaggaaaggtatgctga

SEQ ID NO: 249259 - DNA, 25 bp, Mus musculus
ccgtcgaaaagacaattgggaagaa

SEQ ID NO: 249260 - DNA, 25 bp, Mus musculus
ccgtcgaatgaaaacaagatgagcg

SEQ ID NO: 249261 - DNA, 25 bp, Mus musculus
ccgtcgaatgaaactatccagcaag

SEQ ID NO: 249262 - DNA, 25 bp, Mus musculus
ccgtcgagaaatcgagaacactgtt

SEQ ID NO: 249263 - DNA, 25 bp, Mus musculus
ccgtcgagaaatcgagaacttgatt

SEQ ID NO: 249264 - DNA, 25 bp, Mus musculus
ccgtcgatacctgaggacacgagag

SEQ ID NO: 249265 - DNA, 25 bp, Mus musculus
ccgtcgccatggctccagcacccga

SEQ ID NO: 249266 - DNA, 25 bp, Mus musculus
ccgtcgccccgagagaagtcaatga

SEQ ID NO: 249267 - DNA, 25 bp, Mus musculus
ccgtcgcctgaagctaagctccctt

SEQ ID NO: 249268 - DNA, 25 bp, Mus musculus
ccgtcgcgcacaggattacatcttc

SEQ ID NO: 249269 - DNA, 25 bp, Mus musculus
ccgtcgcgcacaggccctaccgtgg

SEQ ID NO: 249270 - DNA, 25 bp, Mus musculus
ccgtcgctagagttttcaggaagag

SEQ ID NO: 249271 - DNA, 25 bp, Mus musculus
ccgtcgcttaccggtggaagcttgg

SEQ ID NO: 249272 - DNA, 25 bp, Mus musculus
ccgtcgcttaccgttaccgcaggtg

SEQ ID NO: 249273 - DNA, 25 bp, Mus musculus
ccgtcggaaccatggcttccctttc

SEQ ID NO: 249274 - DNA, 25 bp, Mus musculus
ccgtcggagatgaagattcaatgag

SEQ ID NO: 249275 - DNA, 25 bp, Mus musculus
ccgtcgggccgccagatagaaggac

SEQ ID NO: 249276 - DNA, 25 bp, Mus musculus
ccgtcggtgctgcgatccggaggaa

SEQ ID NO: 249277 - DNA, 25 bp, Mus musculus
ccgtcggtgctggccttcccagaac

SEQ ID NO: 249278 - DNA, 25 bp, Mus musculus
ccgtcgtcaggtgggtccgagcctg

SEQ ID NO: 249279 - DNA, 25 bp, Mus musculus
ccgtcgtgtacagtgacaccatctg

SEQ ID NO: 249280 - DNA, 25 bp, Mus musculus
ccgtcgtgtgcacgcagtcagggga

SEQ ID NO: 249281 - DNA, 25 bp, Mus musculus
ccgtcgtgtgcaggcagtcagggga

SEQ ID NO: 249282 - DNA, 25 bp, Mus musculus
ccgtctacagaaaacaagcacgagg

SEQ ID NO: 249283 - DNA, 25 bp, Mus musculus
ccgtctatagccaagcagaagcaaa

SEQ ID NO: 249284 - DNA, 25 bp, Mus musculus
ccgtctataggcggaacatgttccc

SEQ ID NO: 249285 - DNA, 25 bp, Mus musculus
ccgtctcagattggctatgtagtca

SEQ ID NO: 249286 - DNA, 25 bp, Mus musculus
ccgtctccgccggcgctggagaatc

SEQ ID NO: 249287 - DNA, 25 bp, Mus musculus
ccgtctcctcagagagtcagtcctt

SEQ ID NO: 249288 - DNA, 25 bp, Mus musculus
ccgtctcctcagagtctgcgagaaa

SEQ ID NO: 249289 - DNA, 25 bp, Mus musculus
ccgtctcctcagccaaaacaacacc

SEQ ID NO: 249290 - DNA, 25 bp, Mus musculus
ccgtctcctcagccaaaacaacagc

SEQ ID NO: 249291 - DNA, 25 bp, Mus musculus
ccgtctcctcagccaaaacgacacc

SEQ ID NO: 249292 - DNA, 25 bp, Mus musculus
ccgtctcctcagcctctatcaggaa

SEQ ID NO: 249293 - DNA, 25 bp, Mus musculus
ccgtctgaagaactgagtgtgattt

SEQ ID NO: 249294 - DNA, 25 bp, Mus musculus
ccgtctgaagactgctctttgatgg

SEQ ID NO: 249295 - DNA, 25 bp, Mus musculus
ccgtctgcagactcggtcaccactc

SEQ ID NO: 249296 - DNA, 25 bp, Mus musculus
ccgtctgcagcaagatcttggccaa

SEQ ID NO: 249297 - DNA, 25 bp, Mus musculus
ccgtctgcagcaagcacatgcatcc

SEQ ID NO: 249298 - DNA, 25 bp, Mus musculus
ccgtctggatgacagctctgaccag

SEQ ID NO: 249299 - DNA, 25 bp, Mus musculus
ccgtctgtaactgggatcatggcag

SEQ ID NO: 249300 - DNA, 25 bp, Mus musculus
ccgtctgtaactgtcatcagagatc

SEQ ID NO: 249301 - DNA, 25 bp, Mus musculus
ccgtctgtaagaatgacatacggcc

SEQ ID NO: 249302 - DNA, 25 bp, Mus musculus
ccgtcttaaggagctaagggaacaa

SEQ ID NO: 249303 - DNA, 25 bp, Mus musculus
ccgtcttcccacgaacaagatgcca

SEQ ID NO: 249304 - DNA, 25 bp, Mus musculus
ccgtcttcccacggatgtgatcttc

SEQ ID NO: 249305 - DNA, 25 bp, Mus musculus
ccgtcttcctctggaatcaacataa

SEQ ID NO: 249306 - DNA, 25 bp, Mus musculus
ccgtcttctgctgtggaacgacatc

SEQ ID NO: 249307 - DNA, 25 bp, Mus musculus
ccgtctttgcagtatggtggaaccc

SEQ ID NO: 249308 - DNA, 25 bp, Mus musculus
ccgtgaaaactatggattccaaaat

SEQ ID NO: 249309 - DNA, 25 bp, Mus musculus
ccgtgaaaactatggtgacctgctg

SEQ ID NO: 249310 - DNA, 25 bp, Mus musculus
ccgtgaaaatcagatgggatcagtc

SEQ ID NO: 249311 - DNA, 25 bp, Mus musculus
ccgtgaacgccatagaaaagtttca

SEQ ID NO: 249312 - DNA, 25 bp, Mus musculus
ccgtgaacgccatagaagtttcact

SEQ ID NO: 249313 - DNA, 25 bp, Mus musculus
ccgtgaacgccatagcatcaaaaga

SEQ ID NO: 249314 - DNA, 25 bp, Mus musculus
ccgtgaacgccatagtggcattgaa

SEQ ID NO: 249315 - DNA, 25 bp, Mus musculus
ccgtgaagacctgctgccgacaacc

SEQ ID NO: 249316 - DNA, 25 bp, Mus musculus
ccgtgaagagtgtttcccgagagac

SEQ ID NO: 249317 - DNA, 25 bp, Mus musculus
ccgtgaaggaagaggctgtggccct

SEQ ID NO: 249318 - DNA, 25 bp, Mus musculus
ccgtgacaagggtgaagatgggctg

SEQ ID NO: 249319 - DNA, 25 bp, Mus musculus
ccgtgacagtcaaagaacactggtg

SEQ ID NO: 249320 - DNA, 25 bp, Mus musculus
ccgtgacatcaagctggaaaacctt

SEQ ID NO: 249321 - DNA, 25 bp, Mus musculus
ccgtgacatggggggatggacagct

SEQ ID NO: 249322 - DNA, 25 bp, Mus musculus
ccgtgacattgccctcccctttttt

SEQ ID NO: 249323 - DNA, 25 bp, Mus musculus
ccgtgacccagcccgtccgcctcac

SEQ ID NO: 249324 - DNA, 25 bp, Mus musculus
ccgtgacggagatttcttgacctac

SEQ ID NO: 249325 - DNA, 25 bp, Mus musculus
ccgtgactctcaactccgaagtcaa

SEQ ID NO: 249326 - DNA, 25 bp, Mus musculus
ccgtgagagagtacatcggcatcat

SEQ ID NO: 249327 - DNA, 25 bp, Mus musculus
ccgtgagcaagtgtgggacccaagt

SEQ ID NO: 249328 - DNA, 25 bp, Mus musculus
ccgtgagcaggtacctggagtctgt

SEQ ID NO: 249329 - DNA, 25 bp, Mus musculus
ccgtgagcgcctatgacttggtgct

SEQ ID NO: 249330 - DNA, 25 bp, Mus musculus
ccgtgagcttcaggaaaaacataaa

SEQ ID NO: 249331 - DNA, 25 bp, Mus musculus
ccgtgagcttcaggttcatggacac

SEQ ID NO: 249332 - DNA, 25 bp, Mus musculus
ccgtgaggactatggcaggttcacc

SEQ ID NO: 249333 - DNA, 25 bp, Mus musculus
ccgtgaggagaatgtcccagaaatc

SEQ ID NO: 249334 - DNA, 25 bp, Mus musculus
ccgtgaggagccggtccagattatc

SEQ ID NO: 249335 - DNA, 25 bp, Mus musculus
ccgtgagtcagatgttccagcccat

SEQ ID NO: 249336 - DNA, 25 bp, Mus musculus
ccgtgagtgccaggtgatacttaaa

SEQ ID NO: 249337 - DNA, 25 bp, Mus musculus
ccgtgagtttcttgtaatagggccc

SEQ ID NO: 249338 - DNA, 25 bp, Mus musculus
ccgtgagtttttggagttagaacaa

SEQ ID NO: 249339 - DNA, 25 bp, Mus musculus
ccgtgatcagaattgcatttgtaaa

SEQ ID NO: 249340 - DNA, 25 bp, Mus musculus
ccgtgatcagttccgtatctacttc

SEQ ID NO: 249341 - DNA, 25 bp, Mus musculus
ccgtgatccccaagggtgtgctggc

SEQ ID NO: 249342 - DNA, 25 bp, Mus musculus
ccgtgatccccaagtgcctggctga

SEQ ID NO: 249343 - DNA, 25 bp, Mus musculus
ccgtgatctcaagttggagaatttg

SEQ ID NO: 249344 - DNA, 25 bp, Mus musculus
ccgtgatgactgataaacaagctgg

SEQ ID NO: 249345 - DNA, 25 bp, Mus musculus
ccgtgatgggaaggtatggatgtat

SEQ ID NO: 249346 - DNA, 25 bp, Mus musculus
ccgtgcacccagaaaacgaagagat

SEQ ID NO: 249347 - DNA, 25 bp, Mus musculus
ccgtgcacccagaaatgtatgagct

SEQ ID NO: 249348 - DNA, 25 bp, Mus musculus
ccgtgcacccaggggggaagcccta

SEQ ID NO: 249349 - DNA, 25 bp, Mus musculus
ccgtgcactgggttaaaaacgacaa

SEQ ID NO: 249350 - DNA, 25 bp, Mus musculus
ccgtgcagaagaatgccaccagtac

SEQ ID NO: 249351 - DNA, 25 bp, Mus musculus
ccgtgcagacacagatgacgctcct

SEQ ID NO: 249352 - DNA, 25 bp, Mus musculus
ccgtgcagagaaaatttcctgatgt

SEQ ID NO: 249353 - DNA, 25 bp, Mus musculus
ccgtgcagagatcctgtacattcgt

SEQ ID NO: 249354 - DNA, 25 bp, Mus musculus
ccgtgcagagcaagccatacaggag

SEQ ID NO: 249355 - DNA, 25 bp, Mus musculus
ccgtgcagagcatctactgccgagg

SEQ ID NO: 249356 - DNA, 25 bp, Mus musculus
ccgtgcagagtctgtgcggtgacca

SEQ ID NO: 249357 - DNA, 25 bp, Mus musculus
ccgtgcagcaagacccagaagctgg

SEQ ID NO: 249358 - DNA, 25 bp, Mus musculus
ccgtgcagcccgagggatgagtttg

SEQ ID NO: 249359 - DNA, 25 bp, Mus musculus
ccgtgcaggactagcctgagaggga

SEQ ID NO: 249360 - DNA, 25 bp, Mus musculus
ccgtgcaggagcagcctgagaggga

SEQ ID NO: 249361 - DNA, 25 bp, Mus musculus
ccgtgcatattcagggtgacggcct

SEQ ID NO: 249362 - DNA, 25 bp, Mus musculus
ccgtgccaagcgaagagacagggca

SEQ ID NO: 249363 - DNA, 25 bp, Mus musculus
ccgtgccatcatggacatcgataag

SEQ ID NO: 249364 - DNA, 25 bp, Mus musculus
ccgtgcccacagcccaggctatatc

SEQ ID NO: 249365 - DNA, 25 bp, Mus musculus
ccgtgcccagtcgagaagccccggc

SEQ ID NO: 249366 - DNA, 25 bp, Mus musculus
ccgtgcccgagtttcaggtgccatg

SEQ ID NO: 249367 - DNA, 25 bp, Mus musculus
ccgtgcccgggaagagttcagccgg

SEQ ID NO: 249368 - DNA, 25 bp, Mus musculus
ccgtgcccgtatagattacatctcg

SEQ ID NO: 249369 - DNA, 25 bp, Mus musculus
ccgtgcccgtataggcacgtcagct

SEQ ID NO: 249370 - DNA, 25 bp, Mus musculus
ccgtgcccgtggtgtgccccctctc

SEQ ID NO: 249371 - DNA, 25 bp, Mus musculus
ccgtgccgcgggagaggaaaagcag

SEQ ID NO: 249372 - DNA, 25 bp, Mus musculus
ccgtgccgcgggtgtgccaggagag

SEQ ID NO: 249373 - DNA, 25 bp, Mus musculus
ccgtgccgctcttggtttccatcgt

SEQ ID NO: 249374 - DNA, 25 bp, Mus musculus
ccgtgccggcggcctcagcactctt

SEQ ID NO: 249375 - DNA, 25 bp, Mus musculus
ccgtgcctccaggaataacaggcaa

SEQ ID NO: 249376 - DNA, 25 bp, Mus musculus
ccgtgcctccaggagacacaaagca

SEQ ID NO: 249377 - DNA, 25 bp, Mus musculus
ccgtgcctctgagatcccgtttcat

SEQ ID NO: 249378 - DNA, 25 bp, Mus musculus
ccgtgcgaaagaagactttaagaaa

SEQ ID NO: 249379 - DNA, 25 bp, Mus musculus
ccgtgcgcagagcagattttctgca

SEQ ID NO: 249380 - DNA, 25 bp, Mus musculus
ccgtgcgcagcaggctgcctgctgt

SEQ ID NO: 249381 - DNA, 25 bp, Mus musculus
ccgtgcgcgcagggtttcacttagc

SEQ ID NO: 249382 - DNA, 25 bp, Mus musculus
ccgtgcgcgcaggtacagcgcagca

SEQ ID NO: 249383 - DNA, 25 bp, Mus musculus
ccgtgcggccagtgtgtgtgtatgg

SEQ ID NO: 249384 - DNA, 25 bp, Mus musculus
ccgtgcgtaatgacttccctgctgg

SEQ ID NO: 249385 - DNA, 25 bp, Mus musculus
ccgtgctagaggaaccagcagatag

SEQ ID NO: 249386 - DNA, 25 bp, Mus musculus
ccgtgctcaaatgagaaaagttgag

SEQ ID NO: 249387 - DNA, 25 bp, Mus musculus
ccgtgctcaacctgctggttggtgg

SEQ ID NO: 249388 - DNA, 25 bp, Mus musculus
ccgtgctcaagatcaaagaagaaca

SEQ ID NO: 249389 - DNA, 25 bp, Mus musculus
ccgtgctccaaggggagcctccttt

SEQ ID NO: 249390 - DNA, 25 bp, Mus musculus
ccgtgctgaaaggaagcaggtccca

SEQ ID NO: 249391 - DNA, 25 bp, Mus musculus
ccgtgctgaaagtgtctgatgccat

SEQ ID NO: 249392 - DNA, 25 bp, Mus musculus
ccgtgctgctgcaggtactagaaga

SEQ ID NO: 249393 - DNA, 25 bp, Mus musculus
ccgtgctgggcaggtacctggacaa

SEQ ID NO: 249394 - DNA, 25 bp, Mus musculus
ccgtggaagaagggagcagcatcca

SEQ ID NO: 249395 - DNA, 25 bp, Mus musculus
ccgtggaagaaggtgctccttcagc

SEQ ID NO: 249396 - DNA, 25 bp, Mus musculus
ccgtggaagcagagcgttggtcaga

SEQ ID NO: 249397 - DNA, 25 bp, Mus musculus
ccgtggacaacctggacagcttact

SEQ ID NO: 249398 - DNA, 25 bp, Mus musculus
ccgtggacaagtccctgctccagta

SEQ ID NO: 249399 - DNA, 25 bp, Mus musculus
ccgtggacacctatgaacttgcgat

SEQ ID NO: 249400 - DNA, 25 bp, Mus musculus
ccgtggacacctatgttttcaaaga

SEQ ID NO: 249401 - DNA, 25 bp, Mus musculus
ccgtggacatcgttaaccagaatgg

SEQ ID NO: 249402 - DNA, 25 bp, Mus musculus
ccgtggacgagagtttcggggccag

SEQ ID NO: 249403 - DNA, 25 bp, Mus musculus
ccgtggacgaggtgtccacagaact

SEQ ID NO: 249404 - DNA, 25 bp, Mus musculus
ccgtggacttagagcatcactctta

SEQ ID NO: 249405 - DNA, 25 bp, Mus musculus
ccgtggagaagatggttccatatct

SEQ ID NO: 249406 - DNA, 25 bp, Mus musculus
ccgtggagacaggacctcacgcatc

SEQ ID NO: 249407 - DNA, 25 bp, Mus musculus
ccgtggagacagtttgaagaggaca

SEQ ID NO: 249408 - DNA, 25 bp, Mus musculus
ccgtggagagcaagctcgaagagga

SEQ ID NO: 249409 - DNA, 25 bp, Mus musculus
ccgtggagagcaaggtcgaagagga

SEQ ID NO: 249410 - DNA, 25 bp, Mus musculus
ccgtggagaggaggtggtgtcagac

SEQ ID NO: 249411 - DNA, 25 bp, Mus musculus
ccgtggagaggtctgcaaacagcat

SEQ ID NO: 249412 - DNA, 25 bp, Mus musculus
ccgtggagatggagacattgatgga

SEQ ID NO: 249413 - DNA, 25 bp, Mus musculus
ccgtggagcaagtgtttgccaagaa

SEQ ID NO: 249414 - DNA, 25 bp, Mus musculus
ccgtggagcgactatcctgggtgca

SEQ ID NO: 249415 - DNA, 25 bp, Mus musculus
ccgtggagctgctgggaagatgcta

SEQ ID NO: 249416 - DNA, 25 bp, Mus musculus
ccgtggaggatgacttgattatctt

SEQ ID NO: 249417 - DNA, 25 bp, Mus musculus
ccgtggatccagaccaaaaccaaca

SEQ ID NO: 249418 - DNA, 25 bp, Mus musculus
ccgtggatgagttttgaagtgagga

SEQ ID NO: 249419 - DNA, 25 bp, Mus musculus
ccgtggatgctgtggtggaatgcaa

SEQ ID NO: 249420 - DNA, 25 bp, Mus musculus
ccgtggcaatcctggttctcgtggt

SEQ ID NO: 249421 - DNA, 25 bp, Mus musculus
ccgtggcacggcaggattcacagat

SEQ ID NO: 249422 - DNA, 25 bp, Mus musculus
ccgtggcagaggtagttctggtagg

SEQ ID NO: 249423 - DNA, 25 bp, Mus musculus
ccgtggccacagagacactggagct

SEQ ID NO: 249424 - DNA, 25 bp, Mus musculus
ccgtggccagaggcggaggcagcgc

SEQ ID NO: 249425 - DNA, 25 bp, Mus musculus
ccgtggccatacaggtcctgtccag

SEQ ID NO: 249426 - DNA, 25 bp, Mus musculus
ccgtggccattgaggtgaggcacag

SEQ ID NO: 249427 - DNA, 25 bp, Mus musculus
ccgtggcccagacagtgactcaggt

SEQ ID NO: 249428 - DNA, 25 bp, Mus musculus
ccgtggccccagggttgtgagcccc

SEQ ID NO: 249429 - DNA, 25 bp, Mus musculus
ccgtggccgagctagcaacctttcc

SEQ ID NO: 249430 - DNA, 25 bp, Mus musculus
ccgtggccgagctagctgctgcctg

SEQ ID NO: 249431 - DNA, 25 bp, Mus musculus
ccgtggccttcaaggttgtagccct

SEQ ID NO: 249432 - DNA, 25 bp, Mus musculus
ccgtggctaattagcatctgaagtt

SEQ ID NO: 249433 - DNA, 25 bp, Mus musculus
ccgtggctgaggaggcagctgacct

SEQ ID NO: 249434 - DNA, 25 bp, Mus musculus
ccgtggcttaagagaagagccatgg

SEQ ID NO: 249435 - DNA, 25 bp, Mus musculus
ccgtgggaattttatgtaagaccag

SEQ ID NO: 249436 - DNA, 25 bp, Mus musculus
ccgtgggactctctgcgccctttgt

SEQ ID NO: 249437 - DNA, 25 bp, Mus musculus
ccgtgggagcagaggtggagcgacc

SEQ ID NO: 249438 - DNA, 25 bp, Mus musculus
ccgtgggatctagacgaggacctat

SEQ ID NO: 249439 - DNA, 25 bp, Mus musculus
ccgtgggatctaggacgctgcattg

SEQ ID NO: 249440 - DNA, 25 bp, Mus musculus
ccgtgggattgcaggccctcaaggc

SEQ ID NO: 249441 - DNA, 25 bp, Mus musculus
ccgtgggcagagttctctgaacgag

SEQ ID NO: 249442 - DNA, 25 bp, Mus musculus
ccgtgggccacaagccctagcatcc

SEQ ID NO: 249443 - DNA, 25 bp, Mus musculus
ccgtgggctccaaatctgaggttat

SEQ ID NO: 249444 - DNA, 25 bp, Mus musculus
ccgtggggccaggcctcttaggtaa

SEQ ID NO: 249445 - DNA, 25 bp, Mus musculus
ccgtgggggagattttctaccttgc

SEQ ID NO: 249446 - DNA, 25 bp, Mus musculus
ccgtgggggaggatcccatagcctc

SEQ ID NO: 249447 - DNA, 25 bp, Mus musculus
ccgtgggggaggtgacagattatgt

SEQ ID NO: 249448 - DNA, 25 bp, Mus musculus
ccgtgggggcagtaaatgatgctgg

SEQ ID NO: 249449 - DNA, 25 bp, Mus musculus
ccgtgggtcacaagaagccgtctca

SEQ ID NO: 249450 - DNA, 25 bp, Mus musculus
ccgtgggtcacaaggtcaaagcaag

SEQ ID NO: 249451 - DNA, 25 bp, Mus musculus
ccgtgggtgtgtgaaatgcacttag

SEQ ID NO: 249452 - DNA, 25 bp, Mus musculus
ccgtgggtgtgtggactgtgcagca

SEQ ID NO: 249453 - DNA, 25 bp, Mus musculus
ccgtggtacagcgccccgggatgcc

SEQ ID NO: 249454 - DNA, 25 bp, Mus musculus
ccgtggtacaggccctgttgcatcg

SEQ ID NO: 249455 - DNA, 25 bp, Mus musculus
ccgtggtcccctggagcaccaagga

SEQ ID NO: 249456 - DNA, 25 bp, Mus musculus
ccgtggtccctacacgaatgaagtg

SEQ ID NO: 249457 - DNA, 25 bp, Mus musculus
ccgtggtctgggtcaggccctgctg

SEQ ID NO: 249458 - DNA, 25 bp, Mus musculus
ccgtggtgcgaaagaaaaagtcagc

SEQ ID NO: 249459 - DNA, 25 bp, Mus musculus
ccgtggtgctggggcctgtgctctc

SEQ ID NO: 249460 - DNA, 25 bp, Mus musculus
ccgtggtggagggaaaaatggtgaa

SEQ ID NO: 249461 - DNA, 25 bp, Mus musculus
ccgtggtggaggttgaagaaattgt

SEQ ID NO: 249462 - DNA, 25 bp, Mus musculus
ccgtggtgtgccccctctagtcctc

SEQ ID NO: 249463 - DNA, 25 bp, Mus musculus
ccgtggttgtgattgaacgggctgc

SEQ ID NO: 249464 - DNA, 25 bp, Mus musculus
ccgtggttgtgcatgggcgcctgaa

SEQ ID NO: 249465 - DNA, 25 bp, Mus musculus
ccgtgtaaggacaagggagttgtat

SEQ ID NO: 249466 - DNA, 25 bp, Mus musculus
ccgtgtaaggacaaggtagactggg

SEQ ID NO: 249467 - DNA, 25 bp, Mus musculus
ccgtgtacgaaggtatggcctcaca

SEQ ID NO: 249468 - DNA, 25 bp, Mus musculus
ccgtgtagaggagcaggcgagcagg

SEQ ID NO: 249469 - DNA, 25 bp, Mus musculus
ccgtgtaggatacaggtgccctagc

SEQ ID NO: 249470 - DNA, 25 bp, Mus musculus
ccgtgtcatgggtctcagcctggga

SEQ ID NO: 249471 - DNA, 25 bp, Mus musculus
ccgtgtccagcacagaatcgtcctt

SEQ ID NO: 249472 - DNA, 25 bp, Mus musculus
ccgtgtccagcacagccagccatat

SEQ ID NO: 249473 - DNA, 25 bp, Mus musculus
ccgtgtcctctgatgctgaggaata

SEQ ID NO: 249474 - DNA, 25 bp, Mus musculus
ccgtgtcctctgcctgttccagttg

SEQ ID NO: 249475 - DNA, 25 bp, Mus musculus
ccgtgtctgcaggtatatccgaata

SEQ ID NO: 249476 - DNA, 25 bp, Mus musculus
ccgtgtctttatctgcatcccctgt

SEQ ID NO: 249477 - DNA, 25 bp, Mus musculus
ccgtgtgaaagatacttggtaacgt

SEQ ID NO: 249478 - DNA, 25 bp, Mus musculus
ccgtgtgacgcagtgggccatgaac

SEQ ID NO: 249479 - DNA, 25 bp, Mus musculus
ccgtgtgacttctcagacttttcga

SEQ ID NO: 249480 - DNA, 25 bp, Mus musculus
ccgtgtgctggcgattcacttcagc

SEQ ID NO: 249481 - DNA, 25 bp, Mus musculus
ccgtgtggaagagttcaagctgaag

SEQ ID NO: 249482 - DNA, 25 bp, Mus musculus
ccgtgtggttgcaccctcaggatca

SEQ ID NO: 249483 - DNA, 25 bp, Mus musculus
ccgtgtgtctgacgcactgtatcac

SEQ ID NO: 249484 - DNA, 25 bp, Mus musculus
ccgtgtgtggcctggtggatgacta

SEQ ID NO: 249485 - DNA, 25 bp, Mus musculus
ccgtgtgtgtctgctgctgacaagg

SEQ ID NO: 249486 - DNA, 25 bp, Mus musculus
ccgtgttcaaggatgccgccgtgct

SEQ ID NO: 249487 - DNA, 25 bp, Mus musculus
ccgtgttccagcaccacctctgcag

SEQ ID NO: 249488 - DNA, 25 bp, Mus musculus
ccgtgttcggggcgggccaatgatt

SEQ ID NO: 249489 - DNA, 25 bp, Mus musculus
ccgtgtttaagttccgatacttcgc

SEQ ID NO: 249490 - DNA, 25 bp, Mus musculus
ccgtgtttacatcagtggttggaga

SEQ ID NO: 249491 - DNA, 25 bp, Mus musculus
ccgtgtttctcagctcagaggctga

SEQ ID NO: 249492 - DNA, 25 bp, Mus musculus
ccgtgtttgaggccttattcaggat

SEQ ID NO: 249493 - DNA, 25 bp, Mus musculus
ccgtgtttgccgggtgtaatggata

SEQ ID NO: 249494 - DNA, 25 bp, Mus musculus
ccgttaagacagtgggttgtatccc

SEQ ID NO: 249495 - DNA, 25 bp, Mus musculus
ccgttacacatgagagcagcatggc

SEQ ID NO: 249496 - DNA, 25 bp, Mus musculus
ccgttacacatgctatacctgctct

SEQ ID NO: 249497 - DNA, 25 bp, Mus musculus
ccgttaggagtaaagcagtcagtgg

SEQ ID NO: 249498 - DNA, 25 bp, Mus musculus
ccgttaggagtaaagctgcttctaa

SEQ ID NO: 249499 - DNA, 25 bp, Mus musculus
ccgttagtggcggcttgacatctag

SEQ ID NO: 249500 - DNA, 25 bp, Mus musculus
ccgttatatatatggacatacatgt

SEQ ID NO: 249501 - DNA, 25 bp, Mus musculus
ccgttatatatatggatttgttgct

SEQ ID NO: 249502 - DNA, 25 bp, Mus musculus
ccgttatcatgaacacggctctaga

SEQ ID NO: 249503 - DNA, 25 bp, Mus musculus
ccgttatcatgtttgatttgacagt

SEQ ID NO: 249504 - DNA, 25 bp, Mus musculus
ccgttatccagcatttccaggagaa

SEQ ID NO: 249505 - DNA, 25 bp, Mus musculus
ccgttatctcacggcgaactttctg

SEQ ID NO: 249506 - DNA, 25 bp, Mus musculus
ccgttatgaaatggcctcaaacccc

SEQ ID NO: 249507 - DNA, 25 bp, Mus musculus
ccgttattctcgatgaaacggacag

SEQ ID NO: 249508 - DNA, 25 bp, Mus musculus
ccgttcaaacacaagttggaaatct

SEQ ID NO: 249509 - DNA, 25 bp, Mus musculus
ccgttcaaaggtctcaacatggttt

SEQ ID NO: 249510 - DNA, 25 bp, Mus musculus
ccgttcacttttcagtatatatggt

SEQ ID NO: 249511 - DNA, 25 bp, Mus musculus
ccgttcagaaaagttggactacatc

SEQ ID NO: 249512 - DNA, 25 bp, Mus musculus
ccgttcatatcagatgttttccagc

SEQ ID NO: 249513 - DNA, 25 bp, Mus musculus
ccgttcatatcagtggaacacattt

SEQ ID NO: 249514 - DNA, 25 bp, Mus musculus
ccgttcattttcaaaagaaacagca

SEQ ID NO: 249515 - DNA, 25 bp, Mus musculus
ccgttccaaggactcctttatcaca

SEQ ID NO: 249516 - DNA, 25 bp, Mus musculus
ccgttccaaggcaagtccttggggt

SEQ ID NO: 249517 - DNA, 25 bp, Mus musculus
ccgttcccagggcagcccagcaaga

SEQ ID NO: 249518 - DNA, 25 bp, Mus musculus
ccgttccctttgcatcactggctca

SEQ ID NO: 249519 - DNA, 25 bp, Mus musculus
ccgttcgttcaaggggcagaatcct

SEQ ID NO: 249520 - DNA, 25 bp, Mus musculus
ccgttctagatgagatatgtgaatc

SEQ ID NO: 249521 - DNA, 25 bp, Mus musculus
ccgttctctgggttaccacagtgga

SEQ ID NO: 249522 - DNA, 25 bp, Mus musculus
ccgttctgccagcctccgctccttc

SEQ ID NO: 249523 - DNA, 25 bp, Mus musculus
ccgttctgccagttcggataggtcc

SEQ ID NO: 249524 - DNA, 25 bp, Mus musculus
ccgttctggaagccctggaagagag

SEQ ID NO: 249525 - DNA, 25 bp, Mus musculus
ccgttctggagctgagaagggttac

SEQ ID NO: 249526 - DNA, 25 bp, Mus musculus
ccgttcttagccgatctctgagaag

SEQ ID NO: 249527 - DNA, 25 bp, Mus musculus
ccgttcttagccggtaccagacgtt

SEQ ID NO: 249528 - DNA, 25 bp, Mus musculus
ccgttcttagccggtccttcagtag

SEQ ID NO: 249529 - DNA, 25 bp, Mus musculus
ccgttcttcataaaactctgaaggc

SEQ ID NO: 249530 - DNA, 25 bp, Mus musculus
ccgttgcaagatcgatgatgaaaac

SEQ ID NO: 249531 - DNA, 25 bp, Mus musculus
ccgttgctatcatgcgtgagtgcat

SEQ ID NO: 249532 - DNA, 25 bp, Mus musculus
ccgttggcagaagccatcccgatgt

SEQ ID NO: 249533 - DNA, 25 bp, Mus musculus
ccgttggcttcattttaggtttagg

SEQ ID NO: 249534 - DNA, 25 bp, Mus musculus
ccgttggtggcatagctctaattct

SEQ ID NO: 249535 - DNA, 25 bp, Mus musculus
ccgttgtagagtgtgtaatgctgtg

SEQ ID NO: 249536 - DNA, 25 bp, Mus musculus
ccgttgtagcccagaaagtcctagg

SEQ ID NO: 249537 - DNA, 25 bp, Mus musculus
ccgttgtcccagaggtgccccagct

SEQ ID NO: 249538 - DNA, 25 bp, Mus musculus
ccgttgtcccagctgtccctcctcc

SEQ ID NO: 249539 - DNA, 25 bp, Mus musculus
ccgttgttcaagtcagaaaccaaat

SEQ ID NO: 249540 - DNA, 25 bp, Mus musculus
ccgttgttggagccactggcaagct

SEQ ID NO: 249541 - DNA, 25 bp, Mus musculus
ccgtttaaaaaactggtatccagct

SEQ ID NO: 249542 - DNA, 25 bp, Mus musculus
ccgtttaaacaaagatcctgtgtac

SEQ ID NO: 249543 - DNA, 25 bp, Mus musculus
ccgtttaaacaaagatgagtacatt

SEQ ID NO: 249544 - DNA, 25 bp, Mus musculus
ccgtttacaggtgctgggcgttaca

SEQ ID NO: 249545 - DNA, 25 bp, Mus musculus
ccgtttacaggtggtggtcgctatg

SEQ ID NO: 249546 - DNA, 25 bp, Mus musculus
ccgtttagatcagctgaagcttgct

SEQ ID NO: 249547 - DNA, 25 bp, Mus musculus
ccgtttattagtgcttacagacaca

SEQ ID NO: 249548 - DNA, 25 bp, Mus musculus
ccgtttccacggaagatgctaccaa

SEQ ID NO: 249549 - DNA, 25 bp, Mus musculus
ccgtttccgaggctcagtactatgg

SEQ ID NO: 249550 - DNA, 25 bp, Mus musculus
ccgtttcctgttcaggtccgcgaat

SEQ ID NO: 249551 - DNA, 25 bp, Mus musculus
ccgtttctgcatctgaacaccgacc

SEQ ID NO: 249552 - DNA, 25 bp, Mus musculus
ccgtttctgtcaagcctggaatgaa

SEQ ID NO: 249553 - DNA, 25 bp, Mus musculus
ccgtttgcaggatgccggtgcagct

SEQ ID NO: 249554 - DNA, 25 bp, Mus musculus
ccgtttgctcagaatttcatgcctc

SEQ ID NO: 249555 - DNA, 25 bp, Mus musculus
ccgtttgctcaggtcttggctagcc

SEQ ID NO: 249556 - DNA, 25 bp, Mus musculus
ccgtttggccacggatccgggagga

SEQ ID NO: 249557 - DNA, 25 bp, Mus musculus
ccgtttggccacgggctccggccat

SEQ ID NO: 249558 - DNA, 25 bp, Mus musculus
ccgtttggggcggcaacctttggca

SEQ ID NO: 249559 - DNA, 25 bp, Mus musculus
ccgtttggggctacgccttctacga

SEQ ID NO: 249560 - DNA, 25 bp, Mus musculus
ccgtttgtagtggtgacactcgagg

SEQ ID NO: 249561 - DNA, 25 bp, Mus musculus
ccgttttagataagagttgtagtgc

SEQ ID NO: 249562 - DNA, 25 bp, Mus musculus
ccgttttagataagtatgaattact

SEQ ID NO: 249563 - DNA, 25 bp, Mus musculus
ccgttttcagatagcggccattggt

SEQ ID NO: 249564 - DNA, 25 bp, Mus musculus
ccgttttcaggctttctggctcaca

SEQ ID NO: 249565 - DNA, 25 bp, Mus musculus
ccgttttcagttatttgccaggaaa

SEQ ID NO: 249566 - DNA, 25 bp, Mus musculus
ccgttttgagaagattgctgcattc

SEQ ID NO: 249567 - DNA, 25 bp, Mus musculus
ccgttttgaggctttggagaagatt

SEQ ID NO: 249568 - DNA, 25 bp, Mus musculus
ccgtttttgtgatctgccagcttgg

SEQ ID NO: 249569 - DNA, 25 bp, Mus musculus
cctaaaaaaagactgggctatatgc

SEQ ID NO: 249570 - DNA, 25 bp, Mus musculus
cctaaaaaaagtgccgtgatgccgt

SEQ ID NO: 249571 - DNA, 25 bp, Mus musculus
cctaaaaaagagaacgcaccaggag

SEQ ID NO: 249572 - DNA, 25 bp, Mus musculus
cctaaaaaaggtctgtgcaccacgt

SEQ ID NO: 249573 - DNA, 25 bp, Mus musculus
cctaaaactatagaggtgccttgga

SEQ ID NO: 249574 - DNA, 25 bp, Mus musculus
cctaaaagaagtcgttccccatcag

SEQ ID NO: 249575 - DNA, 25 bp, Mus musculus
cctaaaagggaaacaagttctgaca

SEQ ID NO: 249576 - DNA, 25 bp, Mus musculus
cctaaaatcccttgctaacagagaa

SEQ ID NO: 249577 - DNA, 25 bp, Mus musculus
cctaaacacaagatcttctgcccaa

SEQ ID NO: 249578 - DNA, 25 bp, Mus musculus
cctaaacaggtcttgtcaaacacgc

SEQ ID NO: 249579 - DNA, 25 bp, Mus musculus
cctaaacatctgggacgttaaagga

SEQ ID NO: 249580 - DNA, 25 bp, Mus musculus
cctaaacatctgtggatggatggat

SEQ ID NO: 249581 - DNA, 25 bp, Mus musculus
cctaaaccagcagaaaaaattcaag

SEQ ID NO: 249582 - DNA, 25 bp, Mus musculus
cctaaaccagcaggaatccatcagc

SEQ ID NO: 249583 - DNA, 25 bp, Mus musculus
cctaaacccagctggtgccagcttt

SEQ ID NO: 249584 - DNA, 25 bp, Mus musculus
cctaaacctctgggaggatgttgga

SEQ ID NO: 249585 - DNA, 25 bp, Mus musculus
cctaaacctctgggtgaagggagca

SEQ ID NO: 249586 - DNA, 25 bp, Mus musculus
cctaaacctttccagtatactcctg

SEQ ID NO: 249587 - DNA, 25 bp, Mus musculus
cctaaacgccaggagcccttgccca

SEQ ID NO: 249588 - DNA, 25 bp, Mus musculus
cctaaacgccagggaacctttgcac

SEQ ID NO: 249589 - DNA, 25 bp, Mus musculus
cctaaacggcagaggattcgtaaac

SEQ ID NO: 249590 - DNA, 25 bp, Mus musculus
cctaaactttccacatctacatcca

SEQ ID NO: 249591 - DNA, 25 bp, Mus musculus
cctaaagaaagagtttgacctggtg

SEQ ID NO: 249592 - DNA, 25 bp, Mus musculus
cctaaagaagtattagatggacagt

SEQ ID NO: 249593 - DNA, 25 bp, Mus musculus
cctaaagcaagggagccgagtaccc

SEQ ID NO: 249594 - DNA, 25 bp, Mus musculus
cctaaagcaattctggatatgctct

SEQ ID NO: 249595 - DNA, 25 bp, Mus musculus
cctaaagcatgcgaggtccttccac

SEQ ID NO: 249596 - DNA, 25 bp, Mus musculus
cctaaagcatgtttctctagaggac

SEQ ID NO: 249597 - DNA, 25 bp, Mus musculus
cctaaagctacaggtggtaaagcgg

SEQ ID NO: 249598 - DNA, 25 bp, Mus musculus
cctaaaggagatcagggcatcacag

SEQ ID NO: 249599 - DNA, 25 bp, Mus musculus
cctaaaggagcggttccagtttgtg

SEQ ID NO: 249600 - DNA, 25 bp, Mus musculus
cctaaaggatatgttcgcacaactg

SEQ ID NO: 249601 - DNA, 25 bp, Mus musculus
cctaaataagggccacacctagtca

SEQ ID NO: 249602 - DNA, 25 bp, Mus musculus
cctaaatcagctgctgaaatcgtcc

SEQ ID NO: 249603 - DNA, 25 bp, Mus musculus
cctaaatcaggtcatggtttttaca

SEQ ID NO: 249604 - DNA, 25 bp, Mus musculus
cctaaatgatggtgagctccagaaa

SEQ ID NO: 249605 - DNA, 25 bp, Mus musculus
cctaaatggtcgatgaagagtttga

SEQ ID NO: 249606 - DNA, 25 bp, Mus musculus
cctaaatggtcgatggtggatgtac

SEQ ID NO: 249607 - DNA, 25 bp, Mus musculus
cctaaatgtgttgcaacagaccaac

SEQ ID NO: 249608 - DNA, 25 bp, Mus musculus
cctaaatttaagtatgcagtactgt

SEQ ID NO: 249609 - DNA, 25 bp, Mus musculus
cctaacaaaggtgacactcgaggcc

SEQ ID NO: 249610 - DNA, 25 bp, Mus musculus
cctaacacaggtggtgaccgttata

SEQ ID NO: 249611 - DNA, 25 bp, Mus musculus
cctaacactaaggatcatggatata

SEQ ID NO: 249612 - DNA, 25 bp, Mus musculus
cctaacagtggggagccagctcccg

SEQ ID NO: 249613 - DNA, 25 bp, Mus musculus
cctaacagttgtctacttacagctc

SEQ ID NO: 249614 - DNA, 25 bp, Mus musculus
cctaacatgcagtacactgccatgt

SEQ ID NO: 249615 - DNA, 25 bp, Mus musculus
cctaaccaacgtcaatcgctgcctc

SEQ ID NO: 249616 - DNA, 25 bp, Mus musculus
cctaaccaatgtcaatcgctgcctc

SEQ ID NO: 249617 - DNA, 25 bp, Mus musculus
cctaaccagacagatggagaaagac

SEQ ID NO: 249618 - DNA, 25 bp, Mus musculus
cctaacccagaacatgtttgggatg

SEQ ID NO: 249619 - DNA, 25 bp, Mus musculus
cctaacccagttccgcagaggacgt

SEQ ID NO: 249620 - DNA, 25 bp, Mus musculus
cctaaccgtacctggtctgacagag

SEQ ID NO: 249621 - DNA, 25 bp, Mus musculus
cctaacggcctatggtgatgaagct

SEQ ID NO: 249622 - DNA, 25 bp, Mus musculus
cctaacggcctgatgggagccagga

SEQ ID NO: 249623 - DNA, 25 bp, Mus musculus
cctaactactacaggtattaagttc

SEQ ID NO: 249624 - DNA, 25 bp, Mus musculus
cctaactcaggtgaggcacagagtt

SEQ ID NO: 249625 - DNA, 25 bp, Mus musculus
cctaactctaggatgaagagggcca

SEQ ID NO: 249626 - DNA, 25 bp, Mus musculus
cctaacttgtccatggaggtcttca

SEQ ID NO: 249627 - DNA, 25 bp, Mus musculus
cctaacttgtccattttgttgcata

SEQ ID NO: 249628 - DNA, 25 bp, Mus musculus
cctaactttcagttcaaaccggagg

SEQ ID NO: 249629 - DNA, 25 bp, Mus musculus
cctaacttttagtcacagaaaagaa

SEQ ID NO: 249630 - DNA, 25 bp, Mus musculus
cctaagaaaccatcaagaagcgtcc

SEQ ID NO: 249631 - DNA, 25 bp, Mus musculus
cctaagaaacctcgagatcccaaac

SEQ ID NO: 249632 - DNA, 25 bp, Mus musculus
cctaagaaacgagcaaaaaattcca

SEQ ID NO: 249633 - DNA, 25 bp, Mus musculus
cctaagaaacgcaggctccagctgt

SEQ ID NO: 249634 - DNA, 25 bp, Mus musculus
cctaagaagctatatccaggaccag

SEQ ID NO: 249635 - DNA, 25 bp, Mus musculus
cctaagaagctggggacagcactgg

SEQ ID NO: 249636 - DNA, 25 bp, Mus musculus
cctaagaatggctcttaccgcccct

SEQ ID NO: 249637 - DNA, 25 bp, Mus musculus
cctaagaatgggatgcctggaacag

SEQ ID NO: 249638 - DNA, 25 bp, Mus musculus
cctaagacagcgaaggtgtccgagc

SEQ ID NO: 249639 - DNA, 25 bp, Mus musculus
cctaagactctagatattagctcaa

SEQ ID NO: 249640 - DNA, 25 bp, Mus musculus
cctaagcaaaaggctgaggagctgt

SEQ ID NO: 249641 - DNA, 25 bp, Mus musculus
cctaagcacaggcagcagagctttg

SEQ ID NO: 249642 - DNA, 25 bp, Mus musculus
cctaagccaacatgccatatgaaca

SEQ ID NO: 249643 - DNA, 25 bp, Mus musculus
cctaagccacagtgacaacagctac

SEQ ID NO: 249644 - DNA, 25 bp, Mus musculus
cctaagccagatctcaaagccatta

SEQ ID NO: 249645 - DNA, 25 bp, Mus musculus
cctaagccagcaggcctcagggctg

SEQ ID NO: 249646 - DNA, 25 bp, Mus musculus
cctaagccagcagggcctgggctgg

SEQ ID NO: 249647 - DNA, 25 bp, Mus musculus
cctaagcttccagagcagaacatca

SEQ ID NO: 249648 - DNA, 25 bp, Mus musculus
cctaagcttcctggtgcaaatagtc

SEQ ID NO: 249649 - DNA, 25 bp, Mus musculus
cctaaggaaatacagatgctggccc

SEQ ID NO: 249650 - DNA, 25 bp, Mus musculus
cctaaggaagatcctgtctctacag

SEQ ID NO: 249651 - DNA, 25 bp, Mus musculus
cctaaggaagcacctcccttacagg

SEQ ID NO: 249652 - DNA, 25 bp, Mus musculus
cctaaggaaggctcagagaaataat

SEQ ID NO: 249653 - DNA, 25 bp, Mus musculus
cctaaggaagggtacctggaatggg

SEQ ID NO: 249654 - DNA, 25 bp, Mus musculus
cctaaggaatgattggatccagtgt

SEQ ID NO: 249655 - DNA, 25 bp, Mus musculus
cctaaggaatgggtattggcttgct

SEQ ID NO: 249656 - DNA, 25 bp, Mus musculus
cctaaggaccctcaggcattatgag

SEQ ID NO: 249657 - DNA, 25 bp, Mus musculus
cctaaggagacaagaccccagcgca

SEQ ID NO: 249658 - DNA, 25 bp, Mus musculus
cctaaggccggaaggtagcgatggt

SEQ ID NO: 249659 - DNA, 25 bp, Mus musculus
cctaaggcgcagaaggatcgccacg

SEQ ID NO: 249660 - DNA, 25 bp, Mus musculus
cctaagggcgagaagggagatcctg

SEQ ID NO: 249661 - DNA, 25 bp, Mus musculus
cctaagggtgaccgaggtggcatag

SEQ ID NO: 249662 - DNA, 25 bp, Mus musculus
cctaagtaacttgataacaaagttg

SEQ ID NO: 249663 - DNA, 25 bp, Mus musculus
cctaagtacaggtcaccatcatgat

SEQ ID NO: 249664 - DNA, 25 bp, Mus musculus
cctaagtcctggtacgccataccac

SEQ ID NO: 249665 - DNA, 25 bp, Mus musculus
cctaagtcgaaagagttataccctg

SEQ ID NO: 249666 - DNA, 25 bp, Mus musculus
cctaagtctccccatgccctacctg

SEQ ID NO: 249667 - DNA, 25 bp, Mus musculus
cctaagtgcaaagaatggctacatc

SEQ ID NO: 249668 - DNA, 25 bp, Mus musculus
cctaagtgcaaagagagacaggaat

SEQ ID NO: 249669 - DNA, 25 bp, Mus musculus
cctaataggagacaggtggcgacag

SEQ ID NO: 249670 - DNA, 25 bp, Mus musculus
cctaataggagacagtcagtggata

SEQ ID NO: 249671 - DNA, 25 bp, Mus musculus
cctaatatcacagaacagcacttct

SEQ ID NO: 249672 - DNA, 25 bp, Mus musculus
cctaatatgaggaactgtactgagt

SEQ ID NO: 249673 - DNA, 25 bp, Mus musculus
cctaatcaaagagagaatccatgga

SEQ ID NO: 249674 - DNA, 25 bp, Mus musculus
cctaatcagcagaaggaagagcggt

SEQ ID NO: 249675 - DNA, 25 bp, Mus musculus
cctaatcagtgagaccaagtaccgt

SEQ ID NO: 249676 - DNA, 25 bp, Mus musculus
cctaatcagtgagcaagtacaaatc

SEQ ID NO: 249677 - DNA, 25 bp, Mus musculus
cctaatcatgcaggaggatctgctg

SEQ ID NO: 249678 - DNA, 25 bp, Mus musculus
cctaatcatgcagggtcccacctcc

SEQ ID NO: 249679 - DNA, 25 bp, Mus musculus
cctaatccgggagctttctccagac

SEQ ID NO: 249680 - DNA, 25 bp, Mus musculus
cctaatcgattgaggcccaaggggc

SEQ ID NO: 249681 - DNA, 25 bp, Mus musculus
cctaatcgattggattttcaccttg

SEQ ID NO: 249682 - DNA, 25 bp, Mus musculus
cctaatcgcaattggaaggatgcag

SEQ ID NO: 249683 - DNA, 25 bp, Mus musculus
cctaatctttgaggcctgcagcatg

SEQ ID NO: 249684 - DNA, 25 bp, Mus musculus
cctaatctttgagggaaccaatgag

SEQ ID NO: 249685 - DNA, 25 bp, Mus musculus
cctaatgaaaagatctccaagaggg

SEQ ID NO: 249686 - DNA, 25 bp, Mus musculus
cctaatgacagtaattatgccaccc

SEQ ID NO: 249687 - DNA, 25 bp, Mus musculus
cctaatgaccaagccttagggtcag

SEQ ID NO: 249688 - DNA, 25 bp, Mus musculus
cctaatgcaaacaagggcaccctgg

SEQ ID NO: 249689 - DNA, 25 bp, Mus musculus
cctaatgcagtcatccttcctagat

SEQ ID NO: 249690 - DNA, 25 bp, Mus musculus
cctaatggaccagctagtggaaccc

SEQ ID NO: 249691 - DNA, 25 bp, Mus musculus
cctaatggagccatctttaaatcct

SEQ ID NO: 249692 - DNA, 25 bp, Mus musculus
cctaatggaggtaattttgggagga

SEQ ID NO: 249693 - DNA, 25 bp, Mus musculus
cctaatggtccatctctacaacatc

SEQ ID NO: 249694 - DNA, 25 bp, Mus musculus
cctaatggtccattacccaggcaag

SEQ ID NO: 249695 - DNA, 25 bp, Mus musculus
cctaatgtaaaggggctctttcctg

SEQ ID NO: 249696 - DNA, 25 bp, Mus musculus
cctaattcacacagaagtgctgtcg

SEQ ID NO: 249697 - DNA, 25 bp, Mus musculus
cctaatttcttggggcgctttcatc

SEQ ID NO: 249698 - DNA, 25 bp, Mus musculus
cctaatttcttggtgaatgaactca

SEQ ID NO: 249699 - DNA, 25 bp, Mus musculus
cctacaaaaaagtctgttgcaagaa

SEQ ID NO: 249700 - DNA, 25 bp, Mus musculus
cctacaaaaggtgtggcgtggcacc

SEQ ID NO: 249701 - DNA, 25 bp, Mus musculus
cctacaaacctggtctgaagcagca

SEQ ID NO: 249702 - DNA, 25 bp, Mus musculus
cctacaaacctgtcgacttaaaaca

SEQ ID NO: 249703 - DNA, 25 bp, Mus musculus
cctacaaagagaaaaaactggccac

SEQ ID NO: 249704 - DNA, 25 bp, Mus musculus
cctacaaagaggcctttgccagtga

SEQ ID NO: 249705 - DNA, 25 bp, Mus musculus
cctacaaagaggtcttctgggagaa

SEQ ID NO: 249706 - DNA, 25 bp, Mus musculus
cctacaacaagaacattctcaagat

SEQ ID NO: 249707 - DNA, 25 bp, Mus musculus
cctacaacagccggagagacctgga

SEQ ID NO: 249708 - DNA, 25 bp, Mus musculus
cctacaaccaagggtacttcgagaa

SEQ ID NO: 249709 - DNA, 25 bp, Mus musculus
cctacaaccataggtacttcgagaa

SEQ ID NO: 249710 - DNA, 25 bp, Mus musculus
cctacaagagaactctgaaggcatg

SEQ ID NO: 249711 - DNA, 25 bp, Mus musculus
cctacaagaggagagtcaaacacaa

SEQ ID NO: 249712 - DNA, 25 bp, Mus musculus
cctacaagaggtagaaagtccctca

SEQ ID NO: 249713 - DNA, 25 bp, Mus musculus
cctacaagatgtgaagtgggagctg

SEQ ID NO: 249714 - DNA, 25 bp, Mus musculus
cctacaagccagcaatcagagcgaa

SEQ ID NO: 249715 - DNA, 25 bp, Mus musculus
cctacaagccaggaatcagagcgaa

SEQ ID NO: 249716 - DNA, 25 bp, Mus musculus
cctacaaggatctgatttaaattag

SEQ ID NO: 249717 - DNA, 25 bp, Mus musculus
cctacaagtggccatggatcggttc

SEQ ID NO: 249718 - DNA, 25 bp, Mus musculus
cctacaagtgggcccgtgatttgat

SEQ ID NO: 249719 - DNA, 25 bp, Mus musculus
cctacaagttggtcagtgaaatggt

SEQ ID NO: 249720 - DNA, 25 bp, Mus musculus
cctacaatacccttcgagcacatga

SEQ ID NO: 249721 - DNA, 25 bp, Mus musculus
cctacaatctgaatgaagaaagaca

SEQ ID NO: 249722 - DNA, 25 bp, Mus musculus
cctacaatttccccgccgactggcc

SEQ ID NO: 249723 - DNA, 25 bp, Mus musculus
cctacacaaaaagctgttcagcaga

SEQ ID NO: 249724 - DNA, 25 bp, Mus musculus
cctacacaccccccggtcacccgct

SEQ ID NO: 249725 - DNA, 25 bp, Mus musculus
cctacaccaaacagagttattggaa

SEQ ID NO: 249726 - DNA, 25 bp, Mus musculus
cctacaccaaacaggaaggtaccag

SEQ ID NO: 249727 - DNA, 25 bp, Mus musculus
cctacaccaaacaggcaccatcaca

SEQ ID NO: 249728 - DNA, 25 bp, Mus musculus
cctacaccaatggctggaaattaaa

SEQ ID NO: 249729 - DNA, 25 bp, Mus musculus
cctacaccacaaggggaggcaaaat

SEQ ID NO: 249730 - DNA, 25 bp, Mus musculus
cctacacccaaaaacacagatacaa

SEQ ID NO: 249731 - DNA, 25 bp, Mus musculus
cctacacccaatacaagcagctcac

SEQ ID NO: 249732 - DNA, 25 bp, Mus musculus
cctacacccacagttccagggtccc

SEQ ID NO: 249733 - DNA, 25 bp, Mus musculus
cctacacccgggtcaatgcaggggg

SEQ ID NO: 249734 - DNA, 25 bp, Mus musculus
cctacacctcggagacctacctgat

SEQ ID NO: 249735 - DNA, 25 bp, Mus musculus
cctacacgcatgctgtggataccct

SEQ ID NO: 249736 - DNA, 25 bp, Mus musculus
cctacacgcatggagtcgccctagt

SEQ ID NO: 249737 - DNA, 25 bp, Mus musculus
cctacacgtcaaagaagtcttctaa

SEQ ID NO: 249738 - DNA, 25 bp, Mus musculus
cctacacgtcaaagacctaactacc

SEQ ID NO: 249739 - DNA, 25 bp, Mus musculus
cctacactctagatggagtggatgg

SEQ ID NO: 249740 - DNA, 25 bp, Mus musculus
cctacacttcagatttccaaaaggc

SEQ ID NO: 249741 - DNA, 25 bp, Mus musculus
cctacagaagaggaggccactgggg

SEQ ID NO: 249742 - DNA, 25 bp, Mus musculus
cctacagagaggaagaaacttcacc

SEQ ID NO: 249743 - DNA, 25 bp, Mus musculus
cctacagagaggaagatgtttgaga

SEQ ID NO: 249744 - DNA, 25 bp, Mus musculus
cctacagagaggaggcttctcagac

SEQ ID NO: 249745 - DNA, 25 bp, Mus musculus
cctacagagccctgggcccttcctg

SEQ ID NO: 249746 - DNA, 25 bp, Mus musculus
cctacagagtctcagcctactgagg

SEQ ID NO: 249747 - DNA, 25 bp, Mus musculus
cctacagagtctcaggtggtccaca

SEQ ID NO: 249748 - DNA, 25 bp, Mus musculus
cctacagcaccctttcacaccggaa

SEQ ID NO: 249749 - DNA, 25 bp, Mus musculus
cctacagcaggaagggtgagttttt

SEQ ID NO: 249750 - DNA, 25 bp, Mus musculus
cctacagccagggctgatgaacagg

SEQ ID NO: 249751 - DNA, 25 bp, Mus musculus
cctacagccaggtctgtgctgccgc

SEQ ID NO: 249752 - DNA, 25 bp, Mus musculus
cctacagccatcgggtgggaaaatg

SEQ ID NO: 249753 - DNA, 25 bp, Mus musculus
cctacagcgaagccgaagtcttact

SEQ ID NO: 249754 - DNA, 25 bp, Mus musculus
cctacagcgaagccggagactatct

SEQ ID NO: 249755 - DNA, 25 bp, Mus musculus
cctacaggacaagaatgccctggac

SEQ ID NO: 249756 - DNA, 25 bp, Mus musculus
cctacaggacaagctaagcattgag

SEQ ID NO: 249757 - DNA, 25 bp, Mus musculus
cctacaggattgagacaccggtacc

SEQ ID NO: 249758 - DNA, 25 bp, Mus musculus
cctacagggggccaggtgagttgga

SEQ ID NO: 249759 - DNA, 25 bp, Mus musculus
cctacagtaggcttcgagctgtatt

SEQ ID NO: 249760 - DNA, 25 bp, Mus musculus
cctacagtagggtctcactgtgcgg

SEQ ID NO: 249761 - DNA, 25 bp, Mus musculus
cctacagtattcagaggaaatataa

SEQ ID NO: 249762 - DNA, 25 bp, Mus musculus
cctacagtattcagttacggtcttt

SEQ ID NO: 249763 - DNA, 25 bp, Mus musculus
cctacagtattcatgagaacctgca

SEQ ID NO: 249764 - DNA, 25 bp, Mus musculus
cctacagtctgaatgaagaaagaca

SEQ ID NO: 249765 - DNA, 25 bp, Mus musculus
cctacagtgacagaaatcagttcgt

SEQ ID NO: 249766 - DNA, 25 bp, Mus musculus
cctacagtgacagttacggacgagt

SEQ ID NO: 249767 - DNA, 25 bp, Mus musculus
cctacagtgcgcgcgatgaggctgt

SEQ ID NO: 249768 - DNA, 25 bp, Mus musculus
cctacagttaccaggaccgctcctt

SEQ ID NO: 249769 - DNA, 25 bp, Mus musculus
cctacagttaccaggggcacgacca

SEQ ID NO: 249770 - DNA, 25 bp, Mus musculus
cctacagttgcaggcatcccacaaa

SEQ ID NO: 249771 - DNA, 25 bp, Mus musculus
cctacagttggagtaaaaatggctt

SEQ ID NO: 249772 - DNA, 25 bp, Mus musculus
cctacagttggcgtaggagtgtgtt

SEQ ID NO: 249773 - DNA, 25 bp, Mus musculus
cctacatcctcctgagcggagcgtc

SEQ ID NO: 249774 - DNA, 25 bp, Mus musculus
cctacatctgataaggaaggaaagg

SEQ ID NO: 249775 - DNA, 25 bp, Mus musculus
cctacatctggacattggcacctac

SEQ ID NO: 249776 - DNA, 25 bp, Mus musculus
cctacatctggcattcaggacattg

SEQ ID NO: 249777 - DNA, 25 bp, Mus musculus
cctacatctgggctggttaccatca

SEQ ID NO: 249778 - DNA, 25 bp, Mus musculus
cctacatgctaccagaagccagatg

SEQ ID NO: 249779 - DNA, 25 bp, Mus musculus
cctacatgctaccagcatttgatga

SEQ ID NO: 249780 - DNA, 25 bp, Mus musculus
cctacatgctcaggtgcgctggtac

SEQ ID NO: 249781 - DNA, 25 bp, Mus musculus
cctacatggctcctgctgactgggt

SEQ ID NO: 249782 - DNA, 25 bp, Mus musculus
cctacatgtaaaggtcaagtagcat

SEQ ID NO: 249783 - DNA, 25 bp, Mus musculus
cctacattaaagtgacatatgacat

SEQ ID NO: 249784 - DNA, 25 bp, Mus musculus
cctacattaaagtgcccagccacag

SEQ ID NO: 249785 - DNA, 25 bp, Mus musculus
cctacattaacgtggttcattatga

SEQ ID NO: 249786 - DNA, 25 bp, Mus musculus
cctacattaatgattccattggctt

SEQ ID NO: 249787 - DNA, 25 bp, Mus musculus
cctacattaatgctaccgtcttgat

SEQ ID NO: 249788 - DNA, 25 bp, Mus musculus
cctacattgcaaagattctgaaagg

SEQ ID NO: 249789 - DNA, 25 bp, Mus musculus
cctacattgtcttgctgagtatcct

SEQ ID NO: 249790 - DNA, 25 bp, Mus musculus
cctacatttcaaaggtaccaaagca

SEQ ID NO: 249791 - DNA, 25 bp, Mus musculus
cctacatttcaaaggttagcgatgc

SEQ ID NO: 249792 - DNA, 25 bp, Mus musculus
cctaccaaagtcttgtgatttgaac

SEQ ID NO: 249793 - DNA, 25 bp, Mus musculus
cctaccaacttcttaactgacaggc

SEQ ID NO: 249794 - DNA, 25 bp, Mus musculus
cctaccacagggtctgtaccaaaac

SEQ ID NO: 249795 - DNA, 25 bp, Mus musculus
cctaccaccaaactggctgatagga

SEQ ID NO: 249796 - DNA, 25 bp, Mus musculus
cctaccacggagtttgtcacagtaa

SEQ ID NO: 249797 - DNA, 25 bp, Mus musculus
cctaccacggctcgccagaggcctc

SEQ ID NO: 249798 - DNA, 25 bp, Mus musculus
cctaccacggctctacttccccacg

SEQ ID NO: 249799 - DNA, 25 bp, Mus musculus
cctaccacgtcagtcctcgttgcca

SEQ ID NO: 249800 - DNA, 25 bp, Mus musculus
cctaccactgacaaagtctcccctt

SEQ ID NO: 249801 - DNA, 25 bp, Mus musculus
cctaccagaaagccttgtgcctctg

SEQ ID NO: 249802 - DNA, 25 bp, Mus musculus
cctaccagaaagtttgcttacctgg

SEQ ID NO: 249803 - DNA, 25 bp, Mus musculus
cctaccagagcaatttttatatggt

SEQ ID NO: 249804 - DNA, 25 bp, Mus musculus
cctaccagaggaagtgggtagagga

SEQ ID NO: 249805 - DNA, 25 bp, Mus musculus
cctaccagcctgtggaatagtcact

SEQ ID NO: 249806 - DNA, 25 bp, Mus musculus
cctaccagcctgtgggtccgaagca

SEQ ID NO: 249807 - DNA, 25 bp, Mus musculus
cctaccagcggagcatgcacgccta

SEQ ID NO: 249808 - DNA, 25 bp, Mus musculus
cctaccagcggagggtttctctgtg

SEQ ID NO: 249809 - DNA, 25 bp, Mus musculus
cctaccaggagcctgccaccaccac

SEQ ID NO: 249810 - DNA, 25 bp, Mus musculus
cctaccagttccccgaattccgtgt

SEQ ID NO: 249811 - DNA, 25 bp, Mus musculus
cctaccatccccaaggaacctgatg

SEQ ID NO: 249812 - DNA, 25 bp, Mus musculus
cctaccatggggcgcagttctgaaa

SEQ ID NO: 249813 - DNA, 25 bp, Mus musculus
cctaccatgtgaagttccgctcgct

SEQ ID NO: 249814 - DNA, 25 bp, Mus musculus
cctacccaaggaaactgccaggaag

SEQ ID NO: 249815 - DNA, 25 bp, Mus musculus
cctacccaaggaaactgccaggcaa

SEQ ID NO: 249816 - DNA, 25 bp, Mus musculus
cctacccacctatgtgctcccaaga

SEQ ID NO: 249817 - DNA, 25 bp, Mus musculus
cctacccagaaggacggcactagaa

SEQ ID NO: 249818 - DNA, 25 bp, Mus musculus
cctacccagaaggacggcattagaa

SEQ ID NO: 249819 - DNA, 25 bp, Mus musculus
cctacccagagaactggcagaagcc

SEQ ID NO: 249820 - DNA, 25 bp, Mus musculus
cctacccagagataagaagcatttg

SEQ ID NO: 249821 - DNA, 25 bp, Mus musculus
cctacccaggtggatggaacatgaa

SEQ ID NO: 249822 - DNA, 25 bp, Mus musculus
cctacccatctgacagatcacagtg

SEQ ID NO: 249823 - DNA, 25 bp, Mus musculus
cctacccatgttcctgaatgtgttc

SEQ ID NO: 249824 - DNA, 25 bp, Mus musculus
cctaccccaaaaattatggaccctg

SEQ ID NO: 249825 - DNA, 25 bp, Mus musculus
cctaccccggcgctggagccccaaa

SEQ ID NO: 249826 - DNA, 25 bp, Mus musculus
cctacccctcaagaaaagctactgg

SEQ ID NO: 249827 - DNA, 25 bp, Mus musculus
cctacccctcaagccttcctgcctg

SEQ ID NO: 249828 - DNA, 25 bp, Mus musculus
cctacccctgaccatcccctcatct

SEQ ID NO: 249829 - DNA, 25 bp, Mus musculus
cctacccgacagccccataaggcct

SEQ ID NO: 249830 - DNA, 25 bp, Mus musculus
cctacccgacaggaaggtctatatg

SEQ ID NO: 249831 - DNA, 25 bp, Mus musculus
cctacccgcagacagacgtgttctt

SEQ ID NO: 249832 - DNA, 25 bp, Mus musculus
cctacccgcagacagttggagacac

SEQ ID NO: 249833 - DNA, 25 bp, Mus musculus
cctaccctaagaacacagatctgtt

SEQ ID NO: 249834 - DNA, 25 bp, Mus musculus
cctaccctagccagatcaatacaga

SEQ ID NO: 249835 - DNA, 25 bp, Mus musculus
cctaccctagccagcccgcttcgat

SEQ ID NO: 249836 - DNA, 25 bp, Mus musculus
cctaccctcctatgtgctcccaaga

SEQ ID NO: 249837 - DNA, 25 bp, Mus musculus
cctaccctcgagtctgtagctcgtt

SEQ ID NO: 249838 - DNA, 25 bp, Mus musculus
cctaccctctgggtctggagacatg

SEQ ID NO: 249839 - DNA, 25 bp, Mus musculus
cctaccctgaggaagctggaaggtg

SEQ ID NO: 249840 - DNA, 25 bp, Mus musculus
cctacccttcgatgtcgctcaccag

SEQ ID NO: 249841 - DNA, 25 bp, Mus musculus
cctacccttgcagggagactccggc

SEQ ID NO: 249842 - DNA, 25 bp, Mus musculus
cctaccgagtgaccctgagcaagaa

SEQ ID NO: 249843 - DNA, 25 bp, Mus musculus
cctaccgcaacagaggcctttcagt

SEQ ID NO: 249844 - DNA, 25 bp, Mus musculus
cctaccgcaacagagggccttaaca

SEQ ID NO: 249845 - DNA, 25 bp, Mus musculus
cctaccgcaagcagcagtctctggt

SEQ ID NO: 249846 - DNA, 25 bp, Mus musculus
cctaccgctccgcccgtgttggtgg

SEQ ID NO: 249847 - DNA, 25 bp, Mus musculus
cctaccggctgagcatggtggctgt

SEQ ID NO: 249848 - DNA, 25 bp, Mus musculus
cctaccgtgcttgccattcccctag

SEQ ID NO: 249849 - DNA, 25 bp, Mus musculus
cctaccgtgtggataaacgttttgc

SEQ ID NO: 249850 - DNA, 25 bp, Mus musculus
cctaccgtgtggccttcagtggggc

SEQ ID NO: 249851 - DNA, 25 bp, Mus musculus
cctacctacggtgactctggcacca

SEQ ID NO: 249852 - DNA, 25 bp, Mus musculus
cctacctcagggaagagtcccacgg

SEQ ID NO: 249853 - DNA, 25 bp, Mus musculus
cctacctcagggagcagaaggccaa

SEQ ID NO: 249854 - DNA, 25 bp, Mus musculus
cctacctcatctgtggtcaaaatcc

SEQ ID NO: 249855 - DNA, 25 bp, Mus musculus
cctacctccagactttggttctgaa

SEQ ID NO: 249856 - DNA, 25 bp, Mus musculus
cctacctccagaggttggcgatttg

SEQ ID NO: 249857 - DNA, 25 bp, Mus musculus
cctacctccagatttaggtcgctcc

SEQ ID NO: 249858 - DNA, 25 bp, Mus musculus
cctacctccaggcacttagcgctat

SEQ ID NO: 249859 - DNA, 25 bp, Mus musculus
cctacctccagtacctcactgtgga

SEQ ID NO: 249860 - DNA, 25 bp, Mus musculus
cctacctcctcaggacttctagcag

SEQ ID NO: 249861 - DNA, 25 bp, Mus musculus
cctacctcctcaggagccgtctctc

SEQ ID NO: 249862 - DNA, 25 bp, Mus musculus
cctacctctggatcgctcctttgat

SEQ ID NO: 249863 - DNA, 25 bp, Mus musculus
cctacctgaagagcaccaagctgtg

SEQ ID NO: 249864 - DNA, 25 bp, Mus musculus
cctacctgccgcaaatctcccagct

SEQ ID NO: 249865 - DNA, 25 bp, Mus musculus
cctacctggatgacgagttgataga

SEQ ID NO: 249866 - DNA, 25 bp, Mus musculus
cctacctggatgacgttaatgaaat

SEQ ID NO: 249867 - DNA, 25 bp, Mus musculus
cctacctgggcccccgtcacagttt

SEQ ID NO: 249868 - DNA, 25 bp, Mus musculus
cctacctgtgaaaagatcatctgtt

SEQ ID NO: 249869 - DNA, 25 bp, Mus musculus
cctacctgtgaaaatggctctggag

SEQ ID NO: 249870 - DNA, 25 bp, Mus musculus
cctaccttcaacaggactgggaggt

SEQ ID NO: 249871 - DNA, 25 bp, Mus musculus
cctaccttcaaggcctgcacgctgc

SEQ ID NO: 249872 - DNA, 25 bp, Mus musculus
cctaccttcaccaggactgggaggt

SEQ ID NO: 249873 - DNA, 25 bp, Mus musculus
cctaccttcttctgtatatgcacca

SEQ ID NO: 249874 - DNA, 25 bp, Mus musculus
cctaccttgacgtcccacacttgca

SEQ ID NO: 249875 - DNA, 25 bp, Mus musculus
cctacgaaccacactgtaccagcaa

SEQ ID NO: 249876 - DNA, 25 bp, Mus musculus
cctacgaagccgatttttgggaata

SEQ ID NO: 249877 - DNA, 25 bp, Mus musculus
cctacgaagccgtgacactgatgag

SEQ ID NO: 249878 - DNA, 25 bp, Mus musculus
cctacgaccaggttcagaacagcca

SEQ ID NO: 249879 - DNA, 25 bp, Mus musculus
cctacgagcagcgggtgctgacggt

SEQ ID NO: 249880 - DNA, 25 bp, Mus musculus
cctacgagcagggctgtgcgatagc

SEQ ID NO: 249881 - DNA, 25 bp, Mus musculus
cctacgagctgcagaaccagctagc

SEQ ID NO: 249882 - DNA, 25 bp, Mus musculus
cctacgagtccgaaaggcaagagct

SEQ ID NO: 249883 - DNA, 25 bp, Mus musculus
cctacgatagaggactcctacagga

SEQ ID NO: 249884 - DNA, 25 bp, Mus musculus
cctacgatagagttgttggagtttt

SEQ ID NO: 249885 - DNA, 25 bp, Mus musculus
cctacgcacagagtatgataggctg

SEQ ID NO: 249886 - DNA, 25 bp, Mus musculus
cctacgccgcctatgtattgtattc

SEQ ID NO: 249887 - DNA, 25 bp, Mus musculus
cctacgccgcctctgtttggggcaa

SEQ ID NO: 249888 - DNA, 25 bp, Mus musculus
cctacgcctggactaacggttatga

SEQ ID NO: 249889 - DNA, 25 bp, Mus musculus
cctacgcgggacgggcccagttctg

SEQ ID NO: 249890 - DNA, 25 bp, Mus musculus
cctacgcgggacggggcttctgacc

SEQ ID NO: 249891 - DNA, 25 bp, Mus musculus
cctacggacaggatcgagagctgag

SEQ ID NO: 249892 - DNA, 25 bp, Mus musculus
cctacggatcaggtcgtgtcttatg

SEQ ID NO: 249893 - DNA, 25 bp, Mus musculus
cctacggatcagtgacctgagggtg

SEQ ID NO: 249894 - DNA, 25 bp, Mus musculus
cctacgtccagcaggcgggcttgga

SEQ ID NO: 249895 - DNA, 25 bp, Mus musculus
cctacgtcctgcagagcgacgtttt

SEQ ID NO: 249896 - DNA, 25 bp, Mus musculus
cctacgtgctgaagtatgccgcctg

SEQ ID NO: 249897 - DNA, 25 bp, Mus musculus
cctacgtggaccccagacatcacga

SEQ ID NO: 249898 - DNA, 25 bp, Mus musculus
cctacgtggaccccagcggcagctc

SEQ ID NO: 249899 - DNA, 25 bp, Mus musculus
cctactacaacctggactgcagtga

SEQ ID NO: 249900 - DNA, 25 bp, Mus musculus
cctactacaacctggcgtgacggga

SEQ ID NO: 249901 - DNA, 25 bp, Mus musculus
cctactacaaccttgcggagtgtgc

SEQ ID NO: 249902 - DNA, 25 bp, Mus musculus
cctactacagagtgatgctgaggaa

SEQ ID NO: 249903 - DNA, 25 bp, Mus musculus
cctactacagagttggtgaatatgt

SEQ ID NO: 249904 - DNA, 25 bp, Mus musculus
cctactactgctcccagggctgtgg

SEQ ID NO: 249905 - DNA, 25 bp, Mus musculus
cctactagaaacagaaaattcattt

SEQ ID NO: 249906 - DNA, 25 bp, Mus musculus
cctactagagccggagaacagtggt

SEQ ID NO: 249907 - DNA, 25 bp, Mus musculus
cctactagggagagactctacagga

SEQ ID NO: 249908 - DNA, 25 bp, Mus musculus
cctactataagaagatggactaagt

SEQ ID NO: 249909 - DNA, 25 bp, Mus musculus
cctactataagccagattcccctga

SEQ ID NO: 249910 - DNA, 25 bp, Mus musculus
cctactatatcaaccacgagaccca

SEQ ID NO: 249911 - DNA, 25 bp, Mus musculus
cctactatcccagccccccaggttc

SEQ ID NO: 249912 - DNA, 25 bp, Mus musculus
cctactatcccagtatgcaaccgag

SEQ ID NO: 249913 - DNA, 25 bp, Mus musculus
cctactatcccagtgtttgaaagac

SEQ ID NO: 249914 - DNA, 25 bp, Mus musculus
cctactcacgactagggaatgtgtg

SEQ ID NO: 249915 - DNA, 25 bp, Mus musculus
cctactcacgactagggagaaagag

SEQ ID NO: 249916 - DNA, 25 bp, Mus musculus
cctactcagaaagagatcccattcc

SEQ ID NO: 249917 - DNA, 25 bp, Mus musculus
cctactcatgatgacgtgtctaaaa

SEQ ID NO: 249918 - DNA, 25 bp, Mus musculus
cctactccaaggtgaagcagaaaga

SEQ ID NO: 249919 - DNA, 25 bp, Mus musculus
cctactccacgggaggatgctccag

SEQ ID NO: 249920 - DNA, 25 bp, Mus musculus
cctactcccagtgaccttcagaatg

SEQ ID NO: 249921 - DNA, 25 bp, Mus musculus
cctactctagctcaggatgatatcc

SEQ ID NO: 249922 - DNA, 25 bp, Mus musculus
cctactctagctcaggtagcaacaa

SEQ ID NO: 249923 - DNA, 25 bp, Mus musculus
cctactctagctcaggtttctgtag

SEQ ID NO: 249924 - DNA, 25 bp, Mus musculus
cctactctatcgctgcaggtgtgct

SEQ ID NO: 249925 - DNA, 25 bp, Mus musculus
cctactctatgtgtgctcatctgtc

SEQ ID NO: 249926 - DNA, 25 bp, Mus musculus
cctactctcaattagttgacattaa

SEQ ID NO: 249927 - DNA, 25 bp, Mus musculus
cctactctgacaacctgcttggaaa

SEQ ID NO: 249928 - DNA, 25 bp, Mus musculus
cctactctgtccctggcgtggggac

SEQ ID NO: 249929 - DNA, 25 bp, Mus musculus
cctactctgtgaaggcccgagacca

SEQ ID NO: 249930 - DNA, 25 bp, Mus musculus
cctactcttgtatgtcttcgtggat

SEQ ID NO: 249931 - DNA, 25 bp, Mus musculus
cctactgaagatcgacttggagagc

SEQ ID NO: 249932 - DNA, 25 bp, Mus musculus
cctactgaagctcctgcagactgca

SEQ ID NO: 249933 - DNA, 25 bp, Mus musculus
cctactgaagctgtggggattgccc

SEQ ID NO: 249934 - DNA, 25 bp, Mus musculus
cctactgaaggcctcctcaaaagat

SEQ ID NO: 249935 - DNA, 25 bp, Mus musculus
cctactgagtggccaccctttgtgg

SEQ ID NO: 249936 - DNA, 25 bp, Mus musculus
cctactgccagcggactcagaggca

SEQ ID NO: 249937 - DNA, 25 bp, Mus musculus
cctactgccaggctccggtcgaaca

SEQ ID NO: 249938 - DNA, 25 bp, Mus musculus
cctactgcgagcgagaagatgtttg

SEQ ID NO: 249939 - DNA, 25 bp, Mus musculus
cctactgcgagcgagactatgagaa

SEQ ID NO: 249940 - DNA, 25 bp, Mus musculus
cctactgctttaaacctaaacagaa

SEQ ID NO: 249941 - DNA, 25 bp, Mus musculus
cctactgctttaaacgacctgatct

SEQ ID NO: 249942 - DNA, 25 bp, Mus musculus
cctactgctttaaacgtcgattgag

SEQ ID NO: 249943 - DNA, 25 bp, Mus musculus
cctactggaaggtacccagggcatg

SEQ ID NO: 249944 - DNA, 25 bp, Mus musculus
cctactggacatctcccaaacccaa

SEQ ID NO: 249945 - DNA, 25 bp, Mus musculus
cctactggagaaaagggtgaacctg

SEQ ID NO: 249946 - DNA, 25 bp, Mus musculus
cctactggagatggaagtgtaaatg

SEQ ID NO: 249947 - DNA, 25 bp, Mus musculus
cctactggagatggacctcctctgg

SEQ ID NO: 249948 - DNA, 25 bp, Mus musculus
cctactggaggaatgctgggaccca

SEQ ID NO: 249949 - DNA, 25 bp, Mus musculus
cctactgtgccatggaagggtctgt

SEQ ID NO: 249950 - DNA, 25 bp, Mus musculus
cctactgtgtctctggaccaaatca

SEQ ID NO: 249951 - DNA, 25 bp, Mus musculus
cctactgtttacagtacagcaataa

SEQ ID NO: 249952 - DNA, 25 bp, Mus musculus
cctacttaccatggcattgatatga

SEQ ID NO: 249953 - DNA, 25 bp, Mus musculus
cctacttaccatgggaaggtgtctt

SEQ ID NO: 249954 - DNA, 25 bp, Mus musculus
cctacttaccatgggcttcactgta

SEQ ID NO: 249955 - DNA, 25 bp, Mus musculus
cctacttactctggatccaagacac

SEQ ID NO: 249956 - DNA, 25 bp, Mus musculus
cctacttcaagggccaacggcagac

SEQ ID NO: 249957 - DNA, 25 bp, Mus musculus
cctacttcagaaacagacctcgatg

SEQ ID NO: 249958 - DNA, 25 bp, Mus musculus
cctacttcagaaacatctcctttca

SEQ ID NO: 249959 - DNA, 25 bp, Mus musculus
cctacttcagcaggtccctgcatcc

SEQ ID NO: 249960 - DNA, 25 bp, Mus musculus
cctacttccagaacatttaaaagat

SEQ ID NO: 249961 - DNA, 25 bp, Mus musculus
cctacttccctggatcaataagtcg

SEQ ID NO: 249962 - DNA, 25 bp, Mus musculus
cctacttcgggctaacaggcagtga

SEQ ID NO: 249963 - DNA, 25 bp, Mus musculus
cctacttctgtagagatttggccca

SEQ ID NO: 249964 - DNA, 25 bp, Mus musculus
cctacttcttcagctgcagtgttga

SEQ ID NO: 249965 - DNA, 25 bp, Mus musculus
cctacttcttcaggttccggaagca

SEQ ID NO: 249966 - DNA, 25 bp, Mus musculus
cctacttcttcagttaccctgcagt

SEQ ID NO: 249967 - DNA, 25 bp, Mus musculus
cctacttggagccctataataaaga

SEQ ID NO: 249968 - DNA, 25 bp, Mus musculus
cctacttggttcggtacatgggctg

SEQ ID NO: 249969 - DNA, 25 bp, Mus musculus
cctactttacatgctcttcctcatg

SEQ ID NO: 249970 - DNA, 25 bp, Mus musculus
cctagaaaaagaattcttgaagtca

SEQ ID NO: 249971 - DNA, 25 bp, Mus musculus
cctagaaaagatttcacacaccgaa

SEQ ID NO: 249972 - DNA, 25 bp, Mus musculus
cctagaaagcggcctgacctgctga

SEQ ID NO: 249973 - DNA, 25 bp, Mus musculus
cctagaaagcgggactttgccagcg

SEQ ID NO: 249974 - DNA, 25 bp, Mus musculus
cctagaaatatagctcccgttactt

SEQ ID NO: 249975 - DNA, 25 bp, Mus musculus
cctagaaatgacttctgaataagtg

SEQ ID NO: 249976 - DNA, 25 bp, Mus musculus
cctagaaatgcagaccaggaatcct

SEQ ID NO: 249977 - DNA, 25 bp, Mus musculus
cctagaaatgccttctccctagcag

SEQ ID NO: 249978 - DNA, 25 bp, Mus musculus
cctagaacaatagaaagcagtcttc

SEQ ID NO: 249979 - DNA, 25 bp, Mus musculus
cctagaacagatggaaagtgggaag

SEQ ID NO: 249980 - DNA, 25 bp, Mus musculus
cctagaacaggccttcgatatgaaa

SEQ ID NO: 249981 - DNA, 25 bp, Mus musculus
cctagaaccacaacccaccaagcag

SEQ ID NO: 249982 - DNA, 25 bp, Mus musculus
cctagaacccgataatgctgaggct

SEQ ID NO: 249983 - DNA, 25 bp, Mus musculus
cctagaagaaaagaaaaatcaagaa

SEQ ID NO: 249984 - DNA, 25 bp, Mus musculus
cctagaagaaaagtttctgtttcta

SEQ ID NO: 249985 - DNA, 25 bp, Mus musculus
cctagaagaagaggaatgggtacgg

SEQ ID NO: 249986 - DNA, 25 bp, Mus musculus
cctagaagagctccgaggttgcagt

SEQ ID NO: 249987 - DNA, 25 bp, Mus musculus
cctagaagagtatgagcccagagga

SEQ ID NO: 249988 - DNA, 25 bp, Mus musculus
cctagaagcctggcaaaatgaagga

SEQ ID NO: 249989 - DNA, 25 bp, Mus musculus
cctagaagctgagggttcaaggaag

SEQ ID NO: 249990 - DNA, 25 bp, Mus musculus
cctagaaggaaggtatcatgccaaa

SEQ ID NO: 249991 - DNA, 25 bp, Mus musculus
cctagaaggaggattattaattgga

SEQ ID NO: 249992 - DNA, 25 bp, Mus musculus
cctagaaggaggattctgataatca

SEQ ID NO: 249993 - DNA, 25 bp, Mus musculus
cctagacacacagcccatcctcagc

SEQ ID NO: 249994 - DNA, 25 bp, Mus musculus
cctagacactgagggccgatatctc

SEQ ID NO: 249995 - DNA, 25 bp, Mus musculus
cctagacaggataagacgctgtccg

SEQ ID NO: 249996 - DNA, 25 bp, Mus musculus
cctagacctgacgggacatcctgtg

SEQ ID NO: 249997 - DNA, 25 bp, Mus musculus
cctagacctgtcagaggcctgtagg

SEQ ID NO: 249998 - DNA, 25 bp, Mus musculus
cctagactttctgagtaccatggag

SEQ ID NO: 249999 - DNA, 25 bp, Mus musculus
cctagagaagaagcgagatgagcgc

SEQ ID NO: 250000 - DNA, 25 bp, Mus musculus
cctagagaagacggaatggttccat

SEQ ID NO: 250001 - DNA, 25 bp, Mus musculus
cctagagaagcgagatgagcgcagt

SEQ ID NO: 250002 - DNA, 25 bp, Mus musculus
cctagagagaacttacctaaagacg

SEQ ID NO: 250003 - DNA, 25 bp, Mus musculus
cctagagagcaagttcattacagca

SEQ ID NO: 250004 - DNA, 25 bp, Mus musculus
cctagagcgggtgactgagatacta

SEQ ID NO: 250005 - DNA, 25 bp, Mus musculus
cctagaggaggatgccctctgaagc

SEQ ID NO: 250006 - DNA, 25 bp, Mus musculus
cctagagggcagagacaatgaatat

SEQ ID NO: 250007 - DNA, 25 bp, Mus musculus
cctagagtcccagacaggcctcatg

SEQ ID NO: 250008 - DNA, 25 bp, Mus musculus
cctagagtcccagctgcctgctgaa

SEQ ID NO: 250009 - DNA, 25 bp, Mus musculus
cctagataagaaggacttcctaggg

SEQ ID NO: 250010 - DNA, 25 bp, Mus musculus
cctagatctaaggaactaatgaaac

SEQ ID NO: 250011 - DNA, 25 bp, Mus musculus
cctagatctttcctggctagaccac

SEQ ID NO: 250012 - DNA, 25 bp, Mus musculus
cctagatctttcctggtccatcaac

SEQ ID NO: 250013 - DNA, 25 bp, Mus musculus
cctagatgcttacagctcaaaggtg

SEQ ID NO: 250014 - DNA, 25 bp, Mus musculus
cctagattcatcggagaaggaactc

SEQ ID NO: 250015 - DNA, 25 bp, Mus musculus
cctagattcatcgttttgcgaggtg

SEQ ID NO: 250016 - DNA, 25 bp, Mus musculus
cctagcaaaactcttccaagtgtgg

SEQ ID NO: 250017 - DNA, 25 bp, Mus musculus
cctagcaaagaggaaagcgattggc

SEQ ID NO: 250018 - DNA, 25 bp, Mus musculus
cctagcaaagaggctcctgacagtg

SEQ ID NO: 250019 - DNA, 25 bp, Mus musculus
cctagcacagcagagtcaattcccg

SEQ ID NO: 250020 - DNA, 25 bp, Mus musculus
cctagcactcacagcagggaccctg

SEQ ID NO: 250021 - DNA, 25 bp, Mus musculus
cctagcaggtctcaaaagcgctcct

SEQ ID NO: 250022 - DNA, 25 bp, Mus musculus
cctagcatctaggaggctttgatga

SEQ ID NO: 250023 - DNA, 25 bp, Mus musculus
cctagccaaagatatgaggatcaat

SEQ ID NO: 250024 - DNA, 25 bp, Mus musculus
cctagccaagtgcattgttggtgtg

SEQ ID NO: 250025 - DNA, 25 bp, Mus musculus
cctagccccagtcattgctgagaca

SEQ ID NO: 250026 - DNA, 25 bp, Mus musculus
cctagccccagtgtaagcttcaagc

SEQ ID NO: 250027 - DNA, 25 bp, Mus musculus
cctagccctctgattgaaattttct

SEQ ID NO: 250028 - DNA, 25 bp, Mus musculus
cctagccgagggagaggcactgatg

SEQ ID NO: 250029 - DNA, 25 bp, Mus musculus
cctagccgctgtggtgactgggctg

SEQ ID NO: 250030 - DNA, 25 bp, Mus musculus
cctagcctacccaggaagaagctca

SEQ ID NO: 250031 - DNA, 25 bp, Mus musculus
cctagcctcccgttgttctacacag

SEQ ID NO: 250032 - DNA, 25 bp, Mus musculus
cctagcctttcaaaggtagtttaca

SEQ ID NO: 250033 - DNA, 25 bp, Mus musculus
cctagcgccacaggcatggggagga

SEQ ID NO: 250034 - DNA, 25 bp, Mus musculus
cctagcgccgagagatagtgctgga

SEQ ID NO: 250035 - DNA, 25 bp, Mus musculus
cctagcgccgagagattggagaatg

SEQ ID NO: 250036 - DNA, 25 bp, Mus musculus
cctagcggacccagttcagcttgct

SEQ ID NO: 250037 - DNA, 25 bp, Mus musculus
cctagcgtctcagagtgcctggtga

SEQ ID NO: 250038 - DNA, 25 bp, Mus musculus
cctagcgtctcagccaacaagatag

SEQ ID NO: 250039 - DNA, 25 bp, Mus musculus
cctagctacagaactgtgccggatc

SEQ ID NO: 250040 - DNA, 25 bp, Mus musculus
cctagctctcagagctcctcctccc

SEQ ID NO: 250041 - DNA, 25 bp, Mus musculus
cctagctgactatgctcactctttg

SEQ ID NO: 250042 - DNA, 25 bp, Mus musculus
cctagctgagccctacaaaggctgg

SEQ ID NO: 250043 - DNA, 25 bp, Mus musculus
cctagctggaaggactgggcaaagc

SEQ ID NO: 250044 - DNA, 25 bp, Mus musculus
cctagctggggatttgtatacatca

SEQ ID NO: 250045 - DNA, 25 bp, Mus musculus
cctagctgtcatggacagttacttc

SEQ ID NO: 250046 - DNA, 25 bp, Mus musculus
cctagcttaagtatacctggccttg

SEQ ID NO: 250047 - DNA, 25 bp, Mus musculus
cctagcttctgaagttgtaatgatg

SEQ ID NO: 250048 - DNA, 25 bp, Mus musculus
cctagcttgggggctttcaggtagc

SEQ ID NO: 250049 - DNA, 25 bp, Mus musculus
cctaggaagaggatgtacatgctgt

SEQ ID NO: 250050 - DNA, 25 bp, Mus musculus
cctaggaagccagtgacgccaagag

SEQ ID NO: 250051 - DNA, 25 bp, Mus musculus
cctaggaatgaagaacggcccctcc

SEQ ID NO: 250052 - DNA, 25 bp, Mus musculus
cctaggaatgaagatggccagctga

SEQ ID NO: 250053 - DNA, 25 bp, Mus musculus
cctaggacagggcttcgcctctatg

SEQ ID NO: 250054 - DNA, 25 bp, Mus musculus
cctaggaccggaaagcgtctgcacc

SEQ ID NO: 250055 - DNA, 25 bp, Mus musculus
cctaggactgctgatggaattgtca

SEQ ID NO: 250056 - DNA, 25 bp, Mus musculus
cctaggagaagggaaatatgctggc

SEQ ID NO: 250057 - DNA, 25 bp, Mus musculus
cctaggagaagggagtaaaggtatc

SEQ ID NO: 250058 - DNA, 25 bp, Mus musculus
cctaggagagattgatgctgcacct

SEQ ID NO: 250059 - DNA, 25 bp, Mus musculus
cctaggagctgggcttgcaggcaag

SEQ ID NO: 250060 - DNA, 25 bp, Mus musculus
cctaggaggccctggaccttggtgt

SEQ ID NO: 250061 - DNA, 25 bp, Mus musculus
cctaggaggccctgttcacctctgg

SEQ ID NO: 250062 - DNA, 25 bp, Mus musculus
cctaggagggattgatgctgcacct

SEQ ID NO: 250063 - DNA, 25 bp, Mus musculus
cctaggagggattgatgctgcgcct

SEQ ID NO: 250064 - DNA, 25 bp, Mus musculus
cctaggaggttggaggctcggatgg

SEQ ID NO: 250065 - DNA, 25 bp, Mus musculus
cctaggatagagattgttgtggtgg

SEQ ID NO: 250066 - DNA, 25 bp, Mus musculus
cctaggatctacaggtgaaagagct

SEQ ID NO: 250067 - DNA, 25 bp, Mus musculus
cctaggcaagactggacgagtagac

SEQ ID NO: 250068 - DNA, 25 bp, Mus musculus
cctaggcaaggtgctgatagtctgc

SEQ ID NO: 250069 - DNA, 25 bp, Mus musculus
cctaggcaatgacaccctgtacttt

SEQ ID NO: 250070 - DNA, 25 bp, Mus musculus
cctaggcaatgcactactctccgcc

SEQ ID NO: 250071 - DNA, 25 bp, Mus musculus
cctaggccagataaggaattggaac

SEQ ID NO: 250072 - DNA, 25 bp, Mus musculus
cctaggccagtctccctatgagcga

SEQ ID NO: 250073 - DNA, 25 bp, Mus musculus
cctaggcgggaggtgtttctgtttg

SEQ ID NO: 250074 - DNA, 25 bp, Mus musculus
cctaggcgtgcagataaagggagaa

SEQ ID NO: 250075 - DNA, 25 bp, Mus musculus
cctaggcgtgcagtgggagattttt

SEQ ID NO: 250076 - DNA, 25 bp, Mus musculus
cctaggctataaagagcaaaacaat

SEQ ID NO: 250077 - DNA, 25 bp, Mus musculus
cctaggctcagaggctgatggtgac

SEQ ID NO: 250078 - DNA, 25 bp, Mus musculus
cctagggaaagagacagcacggcgg

SEQ ID NO: 250079 - DNA, 25 bp, Mus musculus
cctagggacaagtcactgttctggg

SEQ ID NO: 250080 - DNA, 25 bp, Mus musculus
cctagggagccgtgtggagcaaaaa

SEQ ID NO: 250081 - DNA, 25 bp, Mus musculus
cctagggcctgcaggtctacagtgc

SEQ ID NO: 250082 - DNA, 25 bp, Mus musculus
cctaggggctacctcacttacatca

SEQ ID NO: 250083 - DNA, 25 bp, Mus musculus
cctaggggcttggcaaatggaatct

SEQ ID NO: 250084 - DNA, 25 bp, Mus musculus
cctaggggtggcgaccgtgctgtgt

SEQ ID NO: 250085 - DNA, 25 bp, Mus musculus
cctaggggtggtgacgtgctgtgtg

SEQ ID NO: 250086 - DNA, 25 bp, Mus musculus
cctaggtcagagtcttgtccaggct

SEQ ID NO: 250087 - DNA, 25 bp, Mus musculus
cctaggtgcaggcagtctaaagtca

SEQ ID NO: 250088 - DNA, 25 bp, Mus musculus
cctaggtgccagattgacgtgttgt

SEQ ID NO: 250089 - DNA, 25 bp, Mus musculus
cctaggtgccaggttggctgatgtt

SEQ ID NO: 250090 - DNA, 25 bp, Mus musculus
cctagtactgccaaccccacgggtc

SEQ ID NO: 250091 - DNA, 25 bp, Mus musculus
cctagtactggaggagagttaatat

SEQ ID NO: 250092 - DNA, 25 bp, Mus musculus
cctagtcaacaacagggaaagaagg

SEQ ID NO: 250093 - DNA, 25 bp, Mus musculus
cctagtcacagagggctttaaggaa

SEQ ID NO: 250094 - DNA, 25 bp, Mus musculus
cctagtcacagcaacaacacttgat

SEQ ID NO: 250095 - DNA, 25 bp, Mus musculus
cctagtcatctgcgaacacgactcc

SEQ ID NO: 250096 - DNA, 25 bp, Mus musculus
cctagtccttttcagacccgggtcg

SEQ ID NO: 250097 - DNA, 25 bp, Mus musculus
cctagtcgaagcccagagaagaagg

SEQ ID NO: 250098 - DNA, 25 bp, Mus musculus
cctagtcgaagtgcccccctccttg

SEQ ID NO: 250099 - DNA, 25 bp, Mus musculus
cctagtgactggaggattctgtacc

SEQ ID NO: 250100 - DNA, 25 bp, Mus musculus
cctagtggagtccacgtacaagtat

SEQ ID NO: 250101 - DNA, 25 bp, Mus musculus
cctagtgtcattaagcccacaaggc

SEQ ID NO: 250102 - DNA, 25 bp, Mus musculus
cctagtgtctgccagatctgtggcc

SEQ ID NO: 250103 - DNA, 25 bp, Mus musculus
cctagtgtctgccattgcaggatct

SEQ ID NO: 250104 - DNA, 25 bp, Mus musculus
cctagttagtacagatgcagacagc

SEQ ID NO: 250105 - DNA, 25 bp, Mus musculus
cctagttcaagaggaagaaatgccc

SEQ ID NO: 250106 - DNA, 25 bp, Mus musculus
cctagttcaagaggacacaatgtag

SEQ ID NO: 250107 - DNA, 25 bp, Mus musculus
cctagttcagagcaagaacagaagc

SEQ ID NO: 250108 - DNA, 25 bp, Mus musculus
cctagttgaaggaatttgacaagat

SEQ ID NO: 250109 - DNA, 25 bp, Mus musculus
cctagttgctgccttgcgctggcgc

SEQ ID NO: 250110 - DNA, 25 bp, Mus musculus
cctataacaggataacataaatgtt

SEQ ID NO: 250111 - DNA, 25 bp, Mus musculus
cctataaccagacacgcagtgctga

SEQ ID NO: 250112 - DNA, 25 bp, Mus musculus
cctataaccaggtgcagacacgcag

SEQ ID NO: 250113 - DNA, 25 bp, Mus musculus
cctataaccgatgagaaccacagtg

SEQ ID NO: 250114 - DNA, 25 bp, Mus musculus
cctataaggtcaagcctgtgggccg

SEQ ID NO: 250115 - DNA, 25 bp, Mus musculus
cctataagtaaggaatgaattcgaa

SEQ ID NO: 250116 - DNA, 25 bp, Mus musculus
cctataagtaaggctgtagaaaacc

SEQ ID NO: 250117 - DNA, 25 bp, Mus musculus
cctatacaaactatatatttgtcct

SEQ ID NO: 250118 - DNA, 25 bp, Mus musculus
cctatacaaggctggacgtaaagaa

SEQ ID NO: 250119 - DNA, 25 bp, Mus musculus
cctatacacaaccagtttccgttca

SEQ ID NO: 250120 - DNA, 25 bp, Mus musculus
cctatacaggaggttcaagttcttt

SEQ ID NO: 250121 - DNA, 25 bp, Mus musculus
cctatacgctgccgtgtacccctcc

SEQ ID NO: 250122 - DNA, 25 bp, Mus musculus
cctatactacctacaatacccttcg

SEQ ID NO: 250123 - DNA, 25 bp, Mus musculus
cctatagataagaatagcagagaaa

SEQ ID NO: 250124 - DNA, 25 bp, Mus musculus
cctatagcagggtctacctgctgta

SEQ ID NO: 250125 - DNA, 25 bp, Mus musculus
cctataggcaaaggttctgcctcat

SEQ ID NO: 250126 - DNA, 25 bp, Mus musculus
cctatagggagtcgcgaggaggaaa

SEQ ID NO: 250127 - DNA, 25 bp, Mus musculus
cctatataagtggtaagccaaaagt

SEQ ID NO: 250128 - DNA, 25 bp, Mus musculus
cctatatattgaaaatccctgactc

SEQ ID NO: 250129 - DNA, 25 bp, Mus musculus
cctatatattgaagtgcggtgttta

SEQ ID NO: 250130 - DNA, 25 bp, Mus musculus
cctatatcaagaaggctgctttgcg

SEQ ID NO: 250131 - DNA, 25 bp, Mus musculus
cctatatcagtgacacaggaacaac

SEQ ID NO: 250132 - DNA, 25 bp, Mus musculus
cctatatcatagcaagaggaggcag

SEQ ID NO: 250133 - DNA, 25 bp, Mus musculus
cctatatcgagcttcttcctccagc

SEQ ID NO: 250134 - DNA, 25 bp, Mus musculus
cctatatgaggttggcgcatccttt

SEQ ID NO: 250135 - DNA, 25 bp, Mus musculus
cctatattggtgctggccaacaagc

SEQ ID NO: 250136 - DNA, 25 bp, Mus musculus
cctatatttcgcacatcttcattac

SEQ ID NO: 250137 - DNA, 25 bp, Mus musculus
cctatcaccagctcctcaggttatc

SEQ ID NO: 250138 - DNA, 25 bp, Mus musculus
cctatcaccagtatcatagttaatc

SEQ ID NO: 250139 - DNA, 25 bp, Mus musculus
cctatcaccagttatcctaccttgc

SEQ ID NO: 250140 - DNA, 25 bp, Mus musculus
cctatcagaacaccatcggggctgc

SEQ ID NO: 250141 - DNA, 25 bp, Mus musculus
cctatcagcgggcttatccgctgga

SEQ ID NO: 250142 - DNA, 25 bp, Mus musculus
cctatcagcgggtcatagaagagct

SEQ ID NO: 250143 - DNA, 25 bp, Mus musculus
cctatcagctgcaggtggccaagac

SEQ ID NO: 250144 - DNA, 25 bp, Mus musculus
cctatcagtgagtaccgtggccttc

SEQ ID NO: 250145 - DNA, 25 bp, Mus musculus
cctatcatccggaaggctgtggcag

SEQ ID NO: 250146 - DNA, 25 bp, Mus musculus
cctatcatccggaagtgtgtccctc

SEQ ID NO: 250147 - DNA, 25 bp, Mus musculus
cctatcattaagcaaagcactattg

SEQ ID NO: 250148 - DNA, 25 bp, Mus musculus
cctatccaaaagataggaagtgcag

SEQ ID NO: 250149 - DNA, 25 bp, Mus musculus
cctatccaatgccaatcgctgcctc

SEQ ID NO: 250150 - DNA, 25 bp, Mus musculus
cctatccagagaaccattctgatga

SEQ ID NO: 250151 - DNA, 25 bp, Mus musculus
cctatcccaggaatttgaagcctat

SEQ ID NO: 250152 - DNA, 25 bp, Mus musculus
cctatccctgagagctgctcctttg

SEQ ID NO: 250153 - DNA, 25 bp, Mus musculus
cctatcctacagggaaatgcataga

SEQ ID NO: 250154 - DNA, 25 bp, Mus musculus
cctatcctatgaaggtggtatgtcc

SEQ ID NO: 250155 - DNA, 25 bp, Mus musculus
cctatcgaagaagaaccgatcgcac

SEQ ID NO: 250156 - DNA, 25 bp, Mus musculus
cctatctaatgatgctttcagactt

SEQ ID NO: 250157 - DNA, 25 bp, Mus musculus
cctatctaatgatggaacatgtctc

SEQ ID NO: 250158 - DNA, 25 bp, Mus musculus
cctatctatatggcaccagaggtca

SEQ ID NO: 250159 - DNA, 25 bp, Mus musculus
cctatctcgtgggccttacgatggg

SEQ ID NO: 250160 - DNA, 25 bp, Mus musculus
cctatctgaaagaccccgcttggct

SEQ ID NO: 250161 - DNA, 25 bp, Mus musculus
cctatctgaaagattgctgaagcta

SEQ ID NO: 250162 - DNA, 25 bp, Mus musculus
cctatctgagctgctgttgcaccca

SEQ ID NO: 250163 - DNA, 25 bp, Mus musculus
cctatctgattcaggtacacaactg

SEQ ID NO: 250164 - DNA, 25 bp, Mus musculus
cctatctggaacagggaacaagctt

SEQ ID NO: 250165 - DNA, 25 bp, Mus musculus
cctatctgtttgtctctagataagg

SEQ ID NO: 250166 - DNA, 25 bp, Mus musculus
cctatgaagagaagagccttgttga

SEQ ID NO: 250167 - DNA, 25 bp, Mus musculus
cctatgaagcgaaggacggatcttg

SEQ ID NO: 250168 - DNA, 25 bp, Mus musculus
cctatgaaggaggttccgagttggg

SEQ ID NO: 250169 - DNA, 25 bp, Mus musculus
cctatgaagggctgcaattttgaga

SEQ ID NO: 250170 - DNA, 25 bp, Mus musculus
cctatgaatacaggagtggaggctg

SEQ ID NO: 250171 - DNA, 25 bp, Mus musculus
cctatgaatctgttgatgacattaa

SEQ ID NO: 250172 - DNA, 25 bp, Mus musculus
cctatgacaagaaaaagcggatggt

SEQ ID NO: 250173 - DNA, 25 bp, Mus musculus
cctatgacgagtccatgctggacat

SEQ ID NO: 250174 - DNA, 25 bp, Mus musculus
cctatgacttagcaggttcttgtct

SEQ ID NO: 250175 - DNA, 25 bp, Mus musculus
cctatgacttcaaggctgacatctg

SEQ ID NO: 250176 - DNA, 25 bp, Mus musculus
cctatgagactatggcaggggcagg

SEQ ID NO: 250177 - DNA, 25 bp, Mus musculus
cctatgagatggtagacaaacacat

SEQ ID NO: 250178 - DNA, 25 bp, Mus musculus
cctatgagtcccaggtgtattccct

SEQ ID NO: 250179 - DNA, 25 bp, Mus musculus
cctatgagttagaggtcttgttgcg

SEQ ID NO: 250180 - DNA, 25 bp, Mus musculus
cctatgataatgaaggaattgctat

SEQ ID NO: 250181 - DNA, 25 bp, Mus musculus
cctatgatacatatgagtcaaacgt

SEQ ID NO: 250182 - DNA, 25 bp, Mus musculus
cctatgatcagacaggaaaggatgt

SEQ ID NO: 250183 - DNA, 25 bp, Mus musculus
cctatgatgggaagattaaagtctg

SEQ ID NO: 250184 - DNA, 25 bp, Mus musculus
cctatgatgtcctatatgaactgag

SEQ ID NO: 250185 - DNA, 25 bp, Mus musculus
cctatgatgtgagagaacaagagat

SEQ ID NO: 250186 - DNA, 25 bp, Mus musculus
cctatgcagaagaagtactacaagt

SEQ ID NO: 250187 - DNA, 25 bp, Mus musculus
cctatgcatcactaggaacagcatc

SEQ ID NO: 250188 - DNA, 25 bp, Mus musculus
cctatgccaaggcaggctgtcaggt

SEQ ID NO: 250189 - DNA, 25 bp, Mus musculus
cctatgcgaagcagatttatggtct

SEQ ID NO: 250190 - DNA, 25 bp, Mus musculus
cctatgcgaagcagggtgtgcagat

SEQ ID NO: 250191 - DNA, 25 bp, Mus musculus
cctatgctccttggctgaaccttcg

SEQ ID NO: 250192 - DNA, 25 bp, Mus musculus
cctatgctctcttcattctcataca

SEQ ID NO: 250193 - DNA, 25 bp, Mus musculus
cctatgctggcctggcgttccacgc

SEQ ID NO: 250194 - DNA, 25 bp, Mus musculus
cctatggaccaaggtgttggggcca

SEQ ID NO: 250195 - DNA, 25 bp, Mus musculus
cctatggaccagggatttaaaatcc

SEQ ID NO: 250196 - DNA, 25 bp, Mus musculus
cctatggacttaagaacttttccta

SEQ ID NO: 250197 - DNA, 25 bp, Mus musculus
cctatggacttaagaccatgctcgc

SEQ ID NO: 250198 - DNA, 25 bp, Mus musculus
cctatggagagttcctcaccatgtt

SEQ ID NO: 250199 - DNA, 25 bp, Mus musculus
cctatggagcagcccaggcctcctc

SEQ ID NO: 250200 - DNA, 25 bp, Mus musculus
cctatggagggaggagtgatgggca

SEQ ID NO: 250201 - DNA, 25 bp, Mus musculus
cctatggaggggtggacaaatcctt

SEQ ID NO: 250202 - DNA, 25 bp, Mus musculus
cctatggagtggcaaaaactactct

SEQ ID NO: 250203 - DNA, 25 bp, Mus musculus
cctatggagtgttggcagatatccc

SEQ ID NO: 250204 - DNA, 25 bp, Mus musculus
cctatggataaggttaaaaattttg

SEQ ID NO: 250205 - DNA, 25 bp, Mus musculus
cctatggatgccctcttggcttctg

SEQ ID NO: 250206 - DNA, 25 bp, Mus musculus
cctatggcactggtatctcattcag

SEQ ID NO: 250207 - DNA, 25 bp, Mus musculus
cctatggcagggccaccaaagcact

SEQ ID NO: 250208 - DNA, 25 bp, Mus musculus
cctatggcgagacagctcagctctt

SEQ ID NO: 250209 - DNA, 25 bp, Mus musculus
cctatggcggagtagtgtatcaaga

SEQ ID NO: 250210 - DNA, 25 bp, Mus musculus
cctatggcggtgttgtttaccagga

SEQ ID NO: 250211 - DNA, 25 bp, Mus musculus
cctatggctggaggaatctgcgaag

SEQ ID NO: 250212 - DNA, 25 bp, Mus musculus
cctatgggaatattcagagcaggct

SEQ ID NO: 250213 - DNA, 25 bp, Mus musculus
cctatgggacaccactgtcccaata

SEQ ID NO: 250214 - DNA, 25 bp, Mus musculus
cctatggggcctcagactcatccca

SEQ ID NO: 250215 - DNA, 25 bp, Mus musculus
cctatgggggaaggtgacgccatct

SEQ ID NO: 250216 - DNA, 25 bp, Mus musculus
cctatggtgcagtgcatcattgagg

SEQ ID NO: 250217 - DNA, 25 bp, Mus musculus
cctatgtagctcagaatgtgaagct

SEQ ID NO: 250218 - DNA, 25 bp, Mus musculus
cctatgtagctcaggttcccctcca

SEQ ID NO: 250219 - DNA, 25 bp, Mus musculus
cctatgtcaaaacctgggcaagatc

SEQ ID NO: 250220 - DNA, 25 bp, Mus musculus
cctatgtcagcacagctgtctggga

SEQ ID NO: 250221 - DNA, 25 bp, Mus musculus
cctatgtcagcactttaatgggtgt

SEQ ID NO: 250222 - DNA, 25 bp, Mus musculus
cctatgtcagggttcggagcgaccg

SEQ ID NO: 250223 - DNA, 25 bp, Mus musculus
cctatgtcatgatggtgtttggcct

SEQ ID NO: 250224 - DNA, 25 bp, Mus musculus
cctatgtcccatcttgtcaagttta

SEQ ID NO: 250225 - DNA, 25 bp, Mus musculus
cctatgtgcacaggaaaggaagttc

SEQ ID NO: 250226 - DNA, 25 bp, Mus musculus
cctatgtgcacagggtcgggagaac

SEQ ID NO: 250227 - DNA, 25 bp, Mus musculus
cctatgtggcaggctgggtcctaga

SEQ ID NO: 250228 - DNA, 25 bp, Mus musculus
cctatgtgtcctcagagtctcccat

SEQ ID NO: 250229 - DNA, 25 bp, Mus musculus
cctatgttacagaacccaagagtgt

SEQ ID NO: 250230 - DNA, 25 bp, Mus musculus
cctattaagaatgaggtggcgagtg

SEQ ID NO: 250231 - DNA, 25 bp, Mus musculus
cctattaatgcctcctcctctatgc

SEQ ID NO: 250232 - DNA, 25 bp, Mus musculus
cctattaatggcttccaggctctgg

SEQ ID NO: 250233 - DNA, 25 bp, Mus musculus
cctattacaacctcgaggaatcatg

SEQ ID NO: 250234 - DNA, 25 bp, Mus musculus
cctattacaccgggtgaacctgaat

SEQ ID NO: 250235 - DNA, 25 bp, Mus musculus
cctattacatcaaccatcaaacaca

SEQ ID NO: 250236 - DNA, 25 bp, Mus musculus
cctattacatgccaacaattctctt

SEQ ID NO: 250237 - DNA, 25 bp, Mus musculus
cctattacatggatacatgggcggc

SEQ ID NO: 250238 - DNA, 25 bp, Mus musculus
cctattacctcaatgagatccagag

SEQ ID NO: 250239 - DNA, 25 bp, Mus musculus
cctattacttgaagctggctaagaa

SEQ ID NO: 250240 - DNA, 25 bp, Mus musculus
cctattacttgtcccaaaggaagct

SEQ ID NO: 250241 - DNA, 25 bp, Mus musculus
cctattcaagatctgcacgtttcct

SEQ ID NO: 250242 - DNA, 25 bp, Mus musculus
cctattcacagaagggttgactaca

SEQ ID NO: 250243 - DNA, 25 bp, Mus musculus
cctattcacattcacgtatcacgta

SEQ ID NO: 250244 - DNA, 25 bp, Mus musculus
cctattcacattcaggtatcacgta

SEQ ID NO: 250245 - DNA, 25 bp, Mus musculus
cctattcatccatggaccggcacga

SEQ ID NO: 250246 - DNA, 25 bp, Mus musculus
cctattcccgacataggaggcggtt

SEQ ID NO: 250247 - DNA, 25 bp, Mus musculus
cctattctacaagcatggcctgatt

SEQ ID NO: 250248 - DNA, 25 bp, Mus musculus
cctattctgagaaggggctcctgtt

SEQ ID NO: 250249 - DNA, 25 bp, Mus musculus
cctattctgagaaggttccctgtag

SEQ ID NO: 250250 - DNA, 25 bp, Mus musculus
cctattgagcgcaaggtaatagaac

SEQ ID NO: 250251 - DNA, 25 bp, Mus musculus
cctattgcagagatggagactcaaa

SEQ ID NO: 250252 - DNA, 25 bp, Mus musculus
cctattgcagagggcaagtttatcc

SEQ ID NO: 250253 - DNA, 25 bp, Mus musculus
cctattgctatgaagttgaatctgc

SEQ ID NO: 250254 - DNA, 25 bp, Mus musculus
cctattgtgaggaactaatgaccat

SEQ ID NO: 250255 - DNA, 25 bp, Mus musculus
cctattgtgagtaccctgggaaaag

SEQ ID NO: 250256 - DNA, 25 bp, Mus musculus
cctatttcaagataaacaagctgga

SEQ ID NO: 250257 - DNA, 25 bp, Mus musculus
cctatttcaggaaactcccatcttg

SEQ ID NO: 250258 - DNA, 25 bp, Mus musculus
cctatttcaggttgtctacttttgg

SEQ ID NO: 250259 - DNA, 25 bp, Mus musculus
cctatttccagattggtgccattca

SEQ ID NO: 250260 - DNA, 25 bp, Mus musculus
cctatttccagcagggtgacatgga

SEQ ID NO: 250261 - DNA, 25 bp, Mus musculus
cctatttctttacctgacaaagcca

SEQ ID NO: 250262 - DNA, 25 bp, Mus musculus
cctatttgggtggggagaagagacg

SEQ ID NO: 250263 - DNA, 25 bp, Mus musculus
cctatttgtgggattgttcatcacc

SEQ ID NO: 250264 - DNA, 25 bp, Mus musculus
cctattttgtttcggaagacaacat

SEQ ID NO: 250265 - DNA, 25 bp, Mus musculus
cctattttgtttcggacaggccagg

SEQ ID NO: 250266 - DNA, 25 bp, Mus musculus
cctattttgtttcgggacaactgcc

SEQ ID NO: 250267 - DNA, 25 bp, Mus musculus
cctcaaaaccaaaaatcctgacttt

SEQ ID NO: 250268 - DNA, 25 bp, Mus musculus
cctcaaaaccaagtcactccttgtg

SEQ ID NO: 250269 - DNA, 25 bp, Mus musculus
cctcaaacaagaaaaagagaaaaga

SEQ ID NO: 250270 - DNA, 25 bp, Mus musculus
cctcaaacaagaagaatcctgttgt

SEQ ID NO: 250271 - DNA, 25 bp, Mus musculus
cctcaaacaaggcaccaaggagagg

SEQ ID NO: 250272 - DNA, 25 bp, Mus musculus
cctcaaacacatccacttcagcacc

SEQ ID NO: 250273 - DNA, 25 bp, Mus musculus
cctcaaacacatgtgactctcctat

SEQ ID NO: 250274 - DNA, 25 bp, Mus musculus
cctcaaacaggaaagatcgcaaaag

SEQ ID NO: 250275 - DNA, 25 bp, Mus musculus
cctcaaaccaggtgatcatgctaac

SEQ ID NO: 250276 - DNA, 25 bp, Mus musculus
cctcaaacccagaaccaaggagagc

SEQ ID NO: 250277 - DNA, 25 bp, Mus musculus
cctcaaaccccggcttcttcactac

SEQ ID NO: 250278 - DNA, 25 bp, Mus musculus
cctcaaacccctcatctccccggcc

SEQ ID NO: 250279 - DNA, 25 bp, Mus musculus
cctcaaactcaactctcgatccaca

SEQ ID NO: 250280 - DNA, 25 bp, Mus musculus
cctcaaagaaggtcagctggccgct

SEQ ID NO: 250281 - DNA, 25 bp, Mus musculus
cctcaaagacagaaataaaaataag

SEQ ID NO: 250282 - DNA, 25 bp, Mus musculus
cctcaaagacaggccagttaaattt

SEQ ID NO: 250283 - DNA, 25 bp, Mus musculus
cctcaaagtaaacaaacatggaaga

SEQ ID NO: 250284 - DNA, 25 bp, Mus musculus
cctcaaagtaaacattttctattta

SEQ ID NO: 250285 - DNA, 25 bp, Mus musculus
cctcaaagtggcaggccgcatccac

SEQ ID NO: 250286 - DNA, 25 bp, Mus musculus
cctcaaataaagaagatacattatt

SEQ ID NO: 250287 - DNA, 25 bp, Mus musculus
cctcaaatacacgccttccttcagg

SEQ ID NO: 250288 - DNA, 25 bp, Mus musculus
cctcaaatacacgctgatgttcctc

SEQ ID NO: 250289 - DNA, 25 bp, Mus musculus
cctcaaatcggggaaaaactctcac

SEQ ID NO: 250290 - DNA, 25 bp, Mus musculus
cctcaaatgaagaatcaccgccgcc

SEQ ID NO: 250291 - DNA, 25 bp, Mus musculus
cctcaacaaggacctgatgcaacag

SEQ ID NO: 250292 - DNA, 25 bp, Mus musculus
cctcaacacccatgtgaagcctttg

SEQ ID NO: 250293 - DNA, 25 bp, Mus musculus
cctcaacagaagggatacttaccgc

SEQ ID NO: 250294 - DNA, 25 bp, Mus musculus
cctcaacagacatttgctccaagta

SEQ ID NO: 250295 - DNA, 25 bp, Mus musculus
cctcaacagagttcatgttctgtgg

SEQ ID NO: 250296 - DNA, 25 bp, Mus musculus
cctcaacagccggagcagctgggca

SEQ ID NO: 250297 - DNA, 25 bp, Mus musculus
cctcaacagcttgtgaccttgtttg

SEQ ID NO: 250298 - DNA, 25 bp, Mus musculus
cctcaaccacagtgtggacaagaag

SEQ ID NO: 250299 - DNA, 25 bp, Mus musculus
cctcaacctcagggaaccagctcag

SEQ ID NO: 250300 - DNA, 25 bp, Mus musculus
cctcaacctcccaagactcctacag

SEQ ID NO: 250301 - DNA, 25 bp, Mus musculus
cctcaacctggtcacccatccctga

SEQ ID NO: 250302 - DNA, 25 bp, Mus musculus
cctcaacctggtctatgaaacaact

SEQ ID NO: 250303 - DNA, 25 bp, Mus musculus
cctcaaccttgctggcaccatcggt

SEQ ID NO: 250304 - DNA, 25 bp, Mus musculus
cctcaacgagcaggatgaggtgttg

SEQ ID NO: 250305 - DNA, 25 bp, Mus musculus
cctcaacggagagtatgagagttcc

SEQ ID NO: 250306 - DNA, 25 bp, Mus musculus
cctcaactaatttgtgatcctgtgc

SEQ ID NO: 250307 - DNA, 25 bp, Mus musculus
cctcaactactgcgaggaggcggtg

SEQ ID NO: 250308 - DNA, 25 bp, Mus musculus
cctcaactaggagcttcgatatgat

SEQ ID NO: 250309 - DNA, 25 bp, Mus musculus
cctcaactagggaacatattcaaaa

SEQ ID NO: 250310 - DNA, 25 bp, Mus musculus
cctcaactcaagtagtaggcgcaga

SEQ ID NO: 250311 - DNA, 25 bp, Mus musculus
cctcaactccaccccagcctgctgt

SEQ ID NO: 250312 - DNA, 25 bp, Mus musculus
cctcaactccaccctgaagagcttt

SEQ ID NO: 250313 - DNA, 25 bp, Mus musculus
cctcaactcgaagctcctcccaacc

SEQ ID NO: 250314 - DNA, 25 bp, Mus musculus
cctcaactgatgggaccctgccact

SEQ ID NO: 250315 - DNA, 25 bp, Mus musculus
cctcaactgtgtgtgcaacagaaga

SEQ ID NO: 250316 - DNA, 25 bp, Mus musculus
cctcaacttctccaggtttggagga

SEQ ID NO: 250317 - DNA, 25 bp, Mus musculus
cctcaagaaagaagctgtttgggta

SEQ ID NO: 250318 - DNA, 25 bp, Mus musculus
cctcaagaaaggtgtggtgaccctg

SEQ ID NO: 250319 - DNA, 25 bp, Mus musculus
cctcaagaacaacggctcggaagtg

SEQ ID NO: 250320 - DNA, 25 bp, Mus musculus
cctcaagaacaagctcggaagtggc

SEQ ID NO: 250321 - DNA, 25 bp, Mus musculus
cctcaagaacaatggctcggaagtg

SEQ ID NO: 250322 - DNA, 25 bp, Mus musculus
cctcaagaagcaggttgcctagcag

SEQ ID NO: 250323 - DNA, 25 bp, Mus musculus
cctcaagaagcagtgtgacgtgctg

SEQ ID NO: 250324 - DNA, 25 bp, Mus musculus
cctcaagacaatcattttctctgtt

SEQ ID NO: 250325 - DNA, 25 bp, Mus musculus
cctcaagaggaaggcagtagagtcc

SEQ ID NO: 250326 - DNA, 25 bp, Mus musculus
cctcaagaggaaggccgaggatgag

SEQ ID NO: 250327 - DNA, 25 bp, Mus musculus
cctcaagatcagaggatcccactga

SEQ ID NO: 250328 - DNA, 25 bp, Mus musculus
cctcaagatgaaggtctcagatctg

SEQ ID NO: 250329 - DNA, 25 bp, Mus musculus
cctcaagatggagagacgttagcac

SEQ ID NO: 250330 - DNA, 25 bp, Mus musculus
cctcaagcagccgagcctcgggatg

SEQ ID NO: 250331 - DNA, 25 bp, Mus musculus
cctcaagcgcggtttccgtgagagt

SEQ ID NO: 250332 - DNA, 25 bp, Mus musculus
cctcaaggacgacagggccccaaag

SEQ ID NO: 250333 - DNA, 25 bp, Mus musculus
cctcaaggagctgtaggtggcgatg

SEQ ID NO: 250334 - DNA, 25 bp, Mus musculus
cctcaaggatggacacattcattac

SEQ ID NO: 250335 - DNA, 25 bp, Mus musculus
cctcaagggtggttttgactggaac

SEQ ID NO: 250336 - DNA, 25 bp, Mus musculus
cctcaaggtcaaaagggagaacctg

SEQ ID NO: 250337 - DNA, 25 bp, Mus musculus
cctcaaggtctttgcaaagcccaaa

SEQ ID NO: 250338 - DNA, 25 bp, Mus musculus
cctcaaggttaaggctagatatgga

SEQ ID NO: 250339 - DNA, 25 bp, Mus musculus
cctcaagtagcaaagactctgttac

SEQ ID NO: 250340 - DNA, 25 bp, Mus musculus
cctcaagtagcaaaggtgattggat

SEQ ID NO: 250341 - DNA, 25 bp, Mus musculus
cctcaagtctgagtttgtgatcctg

SEQ ID NO: 250342 - DNA, 25 bp, Mus musculus
cctcaagtgatgaagaagccttcct

SEQ ID NO: 250343 - DNA, 25 bp, Mus musculus
cctcaagtgatgaaggagaggatga

SEQ ID NO: 250344 - DNA, 25 bp, Mus musculus
cctcaatatgccctacacagtcctc

SEQ ID NO: 250345 - DNA, 25 bp, Mus musculus
cctcaatatggaaagtacctaaccc

SEQ ID NO: 250346 - DNA, 25 bp, Mus musculus
cctcaatcaaggacagtcttatgaa

SEQ ID NO: 250347 - DNA, 25 bp, Mus musculus
cctcaatcaaggtcagtcgtatgaa

SEQ ID NO: 250348 - DNA, 25 bp, Mus musculus
cctcaatcaaggtgtggtcccaagc

SEQ ID NO: 250349 - DNA, 25 bp, Mus musculus
cctcaatcaccatgcccaccgccta

SEQ ID NO: 250350 - DNA, 25 bp, Mus musculus
cctcaatcacttggggaaaggcgaa

SEQ ID NO: 250351 - DNA, 25 bp, Mus musculus
cctcaatgcagatgggtggcaagac

SEQ ID NO: 250352 - DNA, 25 bp, Mus musculus
cctcaatgcagtgactggatttgat

SEQ ID NO: 250353 - DNA, 25 bp, Mus musculus
cctcaatgctaaggttcactacaac

SEQ ID NO: 250354 - DNA, 25 bp, Mus musculus
cctcaatgtgttgcaacagaccaac

SEQ ID NO: 250355 - DNA, 25 bp, Mus musculus
cctcacaaccttgccagaaaacctt

SEQ ID NO: 250356 - DNA, 25 bp, Mus musculus
cctcacaaccttggtaccttcactc

SEQ ID NO: 250357 - DNA, 25 bp, Mus musculus
cctcacaagcagaaacacctggtgt

SEQ ID NO: 250358 - DNA, 25 bp, Mus musculus
cctcacaagcagtctttcacagaaa

SEQ ID NO: 250359 - DNA, 25 bp, Mus musculus
cctcacacaagtttaaaaggatgct

SEQ ID NO: 250360 - DNA, 25 bp, Mus musculus
cctcacacagagaggtctgaagaat

SEQ ID NO: 250361 - DNA, 25 bp, Mus musculus
cctcacacagatgccccactgaaac

SEQ ID NO: 250362 - DNA, 25 bp, Mus musculus
cctcacacaggtggctgtgggcaca

SEQ ID NO: 250363 - DNA, 25 bp, Mus musculus
cctcacacaggtttccctctgtagc

SEQ ID NO: 250364 - DNA, 25 bp, Mus musculus
cctcacacagtacagatctcaagtt

SEQ ID NO: 250365 - DNA, 25 bp, Mus musculus
cctcacacagtgtccaacctgtcac

SEQ ID NO: 250366 - DNA, 25 bp, Mus musculus
cctcacactcactgtatgcttccac

SEQ ID NO: 250367 - DNA, 25 bp, Mus musculus
cctcacactcactgtttcttctagt

SEQ ID NO: 250368 - DNA, 25 bp, Mus musculus
cctcacactcagagccttccaagga

SEQ ID NO: 250369 - DNA, 25 bp, Mus musculus
cctcacactgaacaatggtttgcta

SEQ ID NO: 250370 - DNA, 25 bp, Mus musculus
cctcacactgtgatgtggtggaggt

SEQ ID NO: 250371 - DNA, 25 bp, Mus musculus
cctcacagacagactgtcagtgttc

SEQ ID NO: 250372 - DNA, 25 bp, Mus musculus
cctcacagagcacagctgtcccaga

SEQ ID NO: 250373 - DNA, 25 bp, Mus musculus
cctcacagcagagtgccatcttgcc

SEQ ID NO: 250374 - DNA, 25 bp, Mus musculus
cctcacagccatgagcctcagggct

SEQ ID NO: 250375 - DNA, 25 bp, Mus musculus
cctcacaggattgtggcgacaaata

SEQ ID NO: 250376 - DNA, 25 bp, Mus musculus
cctcacaggtccagttgtactgcag

SEQ ID NO: 250377 - DNA, 25 bp, Mus musculus
cctcacagtggaagggttccaatcc

SEQ ID NO: 250378 - DNA, 25 bp, Mus musculus
cctcacatactggctacccaggcgg

SEQ ID NO: 250379 - DNA, 25 bp, Mus musculus
cctcacatccgtcctgcctctgcct

SEQ ID NO: 250380 - DNA, 25 bp, Mus musculus
cctcacatgaaggggcctctgctgt

SEQ ID NO: 250381 - DNA, 25 bp, Mus musculus
cctcacatgcaggatccaaaccaag

SEQ ID NO: 250382 - DNA, 25 bp, Mus musculus
cctcacatgctaggtggagagagcc

SEQ ID NO: 250383 - DNA, 25 bp, Mus musculus
cctcacattgatgagaaaaagaaat

SEQ ID NO: 250384 - DNA, 25 bp, Mus musculus
cctcacattgatgagtatgcacctg

SEQ ID NO: 250385 - DNA, 25 bp, Mus musculus
cctcaccaagatcctccaattctga

SEQ ID NO: 250386 - DNA, 25 bp, Mus musculus
cctcaccaagctgctgtccagagtc

SEQ ID NO: 250387 - DNA, 25 bp, Mus musculus
cctcaccaagcttagcaaggagtat

SEQ ID NO: 250388 - DNA, 25 bp, Mus musculus
cctcaccaaggtttctctggactcc

SEQ ID NO: 250389 - DNA, 25 bp, Mus musculus
cctcaccaatgagctgagcaatgtt

SEQ ID NO: 250390 - DNA, 25 bp, Mus musculus
cctcaccaatgcctctgcagggccc

SEQ ID NO: 250391 - DNA, 25 bp, Mus musculus
cctcaccacagcttccactcagaat

SEQ ID NO: 250392 - DNA, 25 bp, Mus musculus
cctcaccacttgagctcctggccag

SEQ ID NO: 250393 - DNA, 25 bp, Mus musculus
cctcaccacttggtgaacagtgagt

SEQ ID NO: 250394 - DNA, 25 bp, Mus musculus
cctcaccagagcaagaaaattgtgc

SEQ ID NO: 250395 - DNA, 25 bp, Mus musculus
cctcaccagtgaagcggcccctgag

SEQ ID NO: 250396 - DNA, 25 bp, Mus musculus
cctcaccatccatagtgaccatgag

SEQ ID NO: 250397 - DNA, 25 bp, Mus musculus
cctcaccatcctggtatccgtggtc

SEQ ID NO: 250398 - DNA, 25 bp, Mus musculus
cctcaccattgctggggtggagacc

SEQ ID NO: 250399 - DNA, 25 bp, Mus musculus
cctcaccattgctggtcaacgtcct

SEQ ID NO: 250400 - DNA, 25 bp, Mus musculus
cctcacccagcagcaccctcagcgc

SEQ ID NO: 250401 - DNA, 25 bp, Mus musculus
cctcacccccaggagttcaactaga

SEQ ID NO: 250402 - DNA, 25 bp, Mus musculus
cctcaccccccatggcttttcaaga

SEQ ID NO: 250403 - DNA, 25 bp, Mus musculus
cctcaccgaggaggagaatggcgct

SEQ ID NO: 250404 - DNA, 25 bp, Mus musculus
cctcacctagcaccatcggtttgta

SEQ ID NO: 250405 - DNA, 25 bp, Mus musculus
cctcacctcaggattctgggtaggc

SEQ ID NO: 250406 - DNA, 25 bp, Mus musculus
cctcacctcagggaagagggatttc

SEQ ID NO: 250407 - DNA, 25 bp, Mus musculus
cctcacctcccagtggcaccaccga

SEQ ID NO: 250408 - DNA, 25 bp, Mus musculus
cctcacctctcaattgtgggttgaa

SEQ ID NO: 250409 - DNA, 25 bp, Mus musculus
cctcacctgaacagtgagacggttt

SEQ ID NO: 250410 - DNA, 25 bp, Mus musculus
cctcacctgaagaaaaaagcagtca

SEQ ID NO: 250411 - DNA, 25 bp, Mus musculus
cctcacctgaagggatgtctgaatt

SEQ ID NO: 250412 - DNA, 25 bp, Mus musculus
cctcacctgccacgctccagtggct

SEQ ID NO: 250413 - DNA, 25 bp, Mus musculus
cctcacctgcctgcagcaacaagct

SEQ ID NO: 250414 - DNA, 25 bp, Mus musculus
cctcacctgttaggaaagaatcttc

SEQ ID NO: 250415 - DNA, 25 bp, Mus musculus
cctcaccttccttggcggcagaacc

SEQ ID NO: 250416 - DNA, 25 bp, Mus musculus
cctcaccttctacgacggggtggag

SEQ ID NO: 250417 - DNA, 25 bp, Mus musculus
cctcaccttctacgctgtggaggtg

SEQ ID NO: 250418 - DNA, 25 bp, Mus musculus
cctcaccttgctgtgccctcacgct

SEQ ID NO: 250419 - DNA, 25 bp, Mus musculus
cctcaccttggcagccatcatggtg

SEQ ID NO: 250420 - DNA, 25 bp, Mus musculus
cctcaccttgggaatcccaatgctg

SEQ ID NO: 250421 - DNA, 25 bp, Mus musculus
cctcacctttacagattggagctga

SEQ ID NO: 250422 - DNA, 25 bp, Mus musculus
cctcacgcagacagtgtccattctg

SEQ ID NO: 250423 - DNA, 25 bp, Mus musculus
cctcacgctattgtgaggatgaagt

SEQ ID NO: 250424 - DNA, 25 bp, Mus musculus
cctcacgtatttaccgcagaaacag

SEQ ID NO: 250425 - DNA, 25 bp, Mus musculus
cctcacgtgcagatggtggacccag

SEQ ID NO: 250426 - DNA, 25 bp, Mus musculus
cctcactacaggcttccagccagct

SEQ ID NO: 250427 - DNA, 25 bp, Mus musculus
cctcactcacgctgcccaacatgtt

SEQ ID NO: 250428 - DNA, 25 bp, Mus musculus
cctcactcagagccatgatgctggc

SEQ ID NO: 250429 - DNA, 25 bp, Mus musculus
cctcactccaaagacaaatatgaaa

SEQ ID NO: 250430 - DNA, 25 bp, Mus musculus
cctcactccaaagtccccagtcttc

SEQ ID NO: 250431 - DNA, 25 bp, Mus musculus
cctcactccagatgtgtttgggctg

SEQ ID NO: 250432 - DNA, 25 bp, Mus musculus
cctcactccagccggatgtatggaa

SEQ ID NO: 250433 - DNA, 25 bp, Mus musculus
cctcactctagggtgaagcctgctg

SEQ ID NO: 250434 - DNA, 25 bp, Mus musculus
cctcactgaaagctgggaagtcatc

SEQ ID NO: 250435 - DNA, 25 bp, Mus musculus
cctcactgacctggcctctggggac

SEQ ID NO: 250436 - DNA, 25 bp, Mus musculus
cctcactgcattgaaaaaatcccat

SEQ ID NO: 250437 - DNA, 25 bp, Mus musculus
cctcactgcattggacttccttgtg

SEQ ID NO: 250438 - DNA, 25 bp, Mus musculus
cctcactgctataggatacaaattg

SEQ ID NO: 250439 - DNA, 25 bp, Mus musculus
cctcactgctataggttgatcagat

SEQ ID NO: 250440 - DNA, 25 bp, Mus musculus
cctcactggttatgctttccatgaa

SEQ ID NO: 250441 - DNA, 25 bp, Mus musculus
cctcactggttatggatccatctgt

SEQ ID NO: 250442 - DNA, 25 bp, Mus musculus
cctcacttcggtgggctcggatggc

SEQ ID NO: 250443 - DNA, 25 bp, Mus musculus
cctcacttgcttcagccagagtaac

SEQ ID NO: 250444 - DNA, 25 bp, Mus musculus
cctcagaaaagagctctgtcttccc

SEQ ID NO: 250445 - DNA, 25 bp, Mus musculus
cctcagaaacagaacttacacattt

SEQ ID NO: 250446 - DNA, 25 bp, Mus musculus
cctcagaaacatcattcaagactgt

SEQ ID NO: 250447 - DNA, 25 bp, Mus musculus
cctcagaaactgtggcccgaggcag

SEQ ID NO: 250448 - DNA, 25 bp, Mus musculus
cctcagaaaggagattaacaagtgg

SEQ ID NO: 250449 - DNA, 25 bp, Mus musculus
cctcagaaaggaggcatcatagctg

SEQ ID NO: 250450 - DNA, 25 bp, Mus musculus
cctcagaaatgacacacttttgtgt

SEQ ID NO: 250451 - DNA, 25 bp, Mus musculus
cctcagaacatctctgatgtggatg

SEQ ID NO: 250452 - DNA, 25 bp, Mus musculus
cctcagaacccggaggctgtttact

SEQ ID NO: 250453 - DNA, 25 bp, Mus musculus
cctcagaacgcgagcactttcatca

SEQ ID NO: 250454 - DNA, 25 bp, Mus musculus
cctcagaagcatctccatcgcctgg

SEQ ID NO: 250455 - DNA, 25 bp, Mus musculus
cctcagaaggtggccttcccaggac

SEQ ID NO: 250456 - DNA, 25 bp, Mus musculus
cctcagaattcagggaagctacctt

SEQ ID NO: 250457 - DNA, 25 bp, Mus musculus
cctcagaattcaggtgttccatgag

SEQ ID NO: 250458 - DNA, 25 bp, Mus musculus
cctcagaattccaggtctatggaaa

SEQ ID NO: 250459 - DNA, 25 bp, Mus musculus
cctcagacaagaggtaaagaagaag

SEQ ID NO: 250460 - DNA, 25 bp, Mus musculus
cctcagacaggcttccatacacagt

SEQ ID NO: 250461 - DNA, 25 bp, Mus musculus
cctcagacagtgaaaacaaagaact

SEQ ID NO: 250462 - DNA, 25 bp, Mus musculus
cctcagacatgctggatagtctcac

SEQ ID NO: 250463 - DNA, 25 bp, Mus musculus
cctcagacattccagatgtctggcc

SEQ ID NO: 250464 - DNA, 25 bp, Mus musculus
cctcagacattccaggtttcgtctt

SEQ ID NO: 250465 - DNA, 25 bp, Mus musculus
cctcagaccagcagaacgagatggt

SEQ ID NO: 250466 - DNA, 25 bp, Mus musculus
cctcagacgctgactcatcccagga

SEQ ID NO: 250467 - DNA, 25 bp, Mus musculus
cctcagactcagggttgagctccat

SEQ ID NO: 250468 - DNA, 25 bp, Mus musculus
cctcagactcggggtcgcatccctg

SEQ ID NO: 250469 - DNA, 25 bp, Mus musculus
cctcagactcggtacctcggaatcg

SEQ ID NO: 250470 - DNA, 25 bp, Mus musculus
cctcagactcggtcccccagaggtg

SEQ ID NO: 250471 - DNA, 25 bp, Mus musculus
cctcagactgctctacgaagcgctg

SEQ ID NO: 250472 - DNA, 25 bp, Mus musculus
cctcagacttctaaggcctctcctg

SEQ ID NO: 250473 - DNA, 25 bp, Mus musculus
cctcagagaagaagtgtttgaaaga

SEQ ID NO: 250474 - DNA, 25 bp, Mus musculus
cctcagagagtgatgcatggagcag

SEQ ID NO: 250475 - DNA, 25 bp, Mus musculus
cctcagagcaggtcactttgaatgg

SEQ ID NO: 250476 - DNA, 25 bp, Mus musculus
cctcagagccaaaagattcttcagt

SEQ ID NO: 250477 - DNA, 25 bp, Mus musculus
cctcagagccaggttggttcctgta

SEQ ID NO: 250478 - DNA, 25 bp, Mus musculus
cctcagaggaggagtattccaccaa

SEQ ID NO: 250479 - DNA, 25 bp, Mus musculus
cctcagaggccagaagacaccagtg

SEQ ID NO: 250480 - DNA, 25 bp, Mus musculus
cctcagaggccaggaccatccttgc

SEQ ID NO: 250481 - DNA, 25 bp, Mus musculus
cctcagaggtggaagaagagaagtc

SEQ ID NO: 250482 - DNA, 25 bp, Mus musculus
cctcagaggtggtaaaagagaagtc

SEQ ID NO: 250483 - DNA, 25 bp, Mus musculus
cctcagagtctgatgccaagccatg

SEQ ID NO: 250484 - DNA, 25 bp, Mus musculus
cctcagagtctgcaagaaactacat

SEQ ID NO: 250485 - DNA, 25 bp, Mus musculus
cctcagagtttgtcatccgtccttg

SEQ ID NO: 250486 - DNA, 25 bp, Mus musculus
cctcagatatgctcggactcaaccg

SEQ ID NO: 250487 - DNA, 25 bp, Mus musculus
cctcagatcagaaccagtcttcagt

SEQ ID NO: 250488 - DNA, 25 bp, Mus musculus
cctcagatgcaggaacccagagtgg

SEQ ID NO: 250489 - DNA, 25 bp, Mus musculus
cctcagatggcaggaccccacaggc

SEQ ID NO: 250490 - DNA, 25 bp, Mus musculus
cctcagatggcaggcccaagtatct

SEQ ID NO: 250491 - DNA, 25 bp, Mus musculus
cctcagattccagagacactgtact

SEQ ID NO: 250492 - DNA, 25 bp, Mus musculus
cctcagcaaagacaagattgaggat

SEQ ID NO: 250493 - DNA, 25 bp, Mus musculus
cctcagcaaatgtggtaaacagctg

SEQ ID NO: 250494 - DNA, 25 bp, Mus musculus
cctcagcaatggtgacctgctccag

SEQ ID NO: 250495 - DNA, 25 bp, Mus musculus
cctcagcaatggtgtgaacaaccca

SEQ ID NO: 250496 - DNA, 25 bp, Mus musculus
cctcagcacagcaagagtgctgtcg

SEQ ID NO: 250497 - DNA, 25 bp, Mus musculus
cctcagcactgtcagacatagatat

SEQ ID NO: 250498 - DNA, 25 bp, Mus musculus
cctcagcagaacaaaccaaagaaaa

SEQ ID NO: 250499 - DNA, 25 bp, Mus musculus
cctcagcagaagctgggtgccattg

SEQ ID NO: 250500 - DNA, 25 bp, Mus musculus
cctcagcagaccaaaatcacccagg

SEQ ID NO: 250501 - DNA, 25 bp, Mus musculus
cctcagcagcggggttctctggaaa

SEQ ID NO: 250502 - DNA, 25 bp, Mus musculus
cctcagcagggtcagaccacacccg

SEQ ID NO: 250503 - DNA, 25 bp, Mus musculus
cctcagcatccgcctgatctctcaa

SEQ ID NO: 250504 - DNA, 25 bp, Mus musculus
cctcagcatggctggaccgcttcga

SEQ ID NO: 250505 - DNA, 25 bp, Mus musculus
cctcagccaacactgatagggctcc

SEQ ID NO: 250506 - DNA, 25 bp, Mus musculus
cctcagccaagtaccaaaggcttag

SEQ ID NO: 250507 - DNA, 25 bp, Mus musculus
cctcagccagcaaacaggccctggt

SEQ ID NO: 250508 - DNA, 25 bp, Mus musculus
cctcagcccaggatctagagtcatg

SEQ ID NO: 250509 - DNA, 25 bp, Mus musculus
cctcagcccagggtctccctacaga

SEQ ID NO: 250510 - DNA, 25 bp, Mus musculus
cctcagcccaggtggtgctctgggt

SEQ ID NO: 250511 - DNA, 25 bp, Mus musculus
cctcagccccagagcacagaggaca

SEQ ID NO: 250512 - DNA, 25 bp, Mus musculus
cctcagccccagagcttcggtgcaa

SEQ ID NO: 250513 - DNA, 25 bp, Mus musculus
cctcagccccagaggtctcagcaat

SEQ ID NO: 250514 - DNA, 25 bp, Mus musculus
cctcagccccagtttgacggatgaa

SEQ ID NO: 250515 - DNA, 25 bp, Mus musculus
cctcagcccctcctcctccctccct

SEQ ID NO: 250516 - DNA, 25 bp, Mus musculus
cctcagccctcatcaatgaggaact

SEQ ID NO: 250517 - DNA, 25 bp, Mus musculus
cctcagccctgaggttatttcgtca

SEQ ID NO: 250518 - DNA, 25 bp, Mus musculus
cctcagccggcaggctcatagtggc

SEQ ID NO: 250519 - DNA, 25 bp, Mus musculus
cctcagcggcccagcgtccgatgca

SEQ ID NO: 250520 - DNA, 25 bp, Mus musculus
cctcagctacaaaggcaacatctgg

SEQ ID NO: 250521 - DNA, 25 bp, Mus musculus
cctcagctcggaggacaggtcaatg

SEQ ID NO: 250522 - DNA, 25 bp, Mus musculus
cctcagctggttgtgcagacaaaat

SEQ ID NO: 250523 - DNA, 25 bp, Mus musculus
cctcagctggttgtgcagtcaaaat

SEQ ID NO: 250524 - DNA, 25 bp, Mus musculus
cctcaggaagagggttcactgatca

SEQ ID NO: 250525 - DNA, 25 bp, Mus musculus
cctcaggaagctaagctgtggtcct

SEQ ID NO: 250526 - DNA, 25 bp, Mus musculus
cctcaggagagatgacttgtaccag

SEQ ID NO: 250527 - DNA, 25 bp, Mus musculus
cctcaggagagatgagagcaatcac

SEQ ID NO: 250528 - DNA, 25 bp, Mus musculus
cctcaggagagccaggcttagaatc

SEQ ID NO: 250529 - DNA, 25 bp, Mus musculus
cctcaggagctgacaggcagtatct

SEQ ID NO: 250530 - DNA, 25 bp, Mus musculus
cctcaggatatcaaggcctctgtgt

SEQ ID NO: 250531 - DNA, 25 bp, Mus musculus
cctcaggatatcagctcttgcactg

SEQ ID NO: 250532 - DNA, 25 bp, Mus musculus
cctcaggatcttgagactaccaaag

SEQ ID NO: 250533 - DNA, 25 bp, Mus musculus
cctcaggatcttgagtttaccaaat

SEQ ID NO: 250534 - DNA, 25 bp, Mus musculus
cctcaggccgcaggcctctctgtcc

SEQ ID NO: 250535 - DNA, 25 bp, Mus musculus
cctcaggcgacccaactctactgcc

SEQ ID NO: 250536 - DNA, 25 bp, Mus musculus
cctcaggctcagcaccaaggagatc

SEQ ID NO: 250537 - DNA, 25 bp, Mus musculus
cctcagggaaaaggtcattaaaggg

SEQ ID NO: 250538 - DNA, 25 bp, Mus musculus
cctcagggagagatgagcaataaca

SEQ ID NO: 250539 - DNA, 25 bp, Mus musculus
cctcagggagtgcctgcacttctgc

SEQ ID NO: 250540 - DNA, 25 bp, Mus musculus
cctcagggcgtggccatagtgaaca

SEQ ID NO: 250541 - DNA, 25 bp, Mus musculus
cctcaggggttcagatgccccatat

SEQ ID NO: 250542 - DNA, 25 bp, Mus musculus
cctcaggggttcagccaacaattct

SEQ ID NO: 250543 - DNA, 25 bp, Mus musculus
cctcagggtggcaaaggtgatgttc

SEQ ID NO: 250544 - DNA, 25 bp, Mus musculus
cctcaggtaaaccccttgacctcat

SEQ ID NO: 250545 - DNA, 25 bp, Mus musculus
cctcaggtatccaacgcttgtatca

SEQ ID NO: 250546 - DNA, 25 bp, Mus musculus
cctcaggtgagcaggatcggaacgt

SEQ ID NO: 250547 - DNA, 25 bp, Mus musculus
cctcaggttctgccgcctcctgatg

SEQ ID NO: 250548 - DNA, 25 bp, Mus musculus
cctcaggttctgccggggacccctg

SEQ ID NO: 250549 - DNA, 25 bp, Mus musculus
cctcagtaatgaccaattctccaga

SEQ ID NO: 250550 - DNA, 25 bp, Mus musculus
cctcagtacctggtactggtctctt

SEQ ID NO: 250551 - DNA, 25 bp, Mus musculus
cctcagtagcccagggcagcgagat

SEQ ID NO: 250552 - DNA, 25 bp, Mus musculus
cctcagtcaggaggtctccccagaa

SEQ ID NO: 250553 - DNA, 25 bp, Mus musculus
cctcagtcagtgctggggactgatt

SEQ ID NO: 250554 - DNA, 25 bp, Mus musculus
cctcagtcagttgggagaccgtacc

SEQ ID NO: 250555 - DNA, 25 bp, Mus musculus
cctcagtcagttgggagcttgcact

SEQ ID NO: 250556 - DNA, 25 bp, Mus musculus
cctcagtccaaagctgctcagccat

SEQ ID NO: 250557 - DNA, 25 bp, Mus musculus
cctcagtcccagcagactgagcaag

SEQ ID NO: 250558 - DNA, 25 bp, Mus musculus
cctcagtcgtttggacttcaaatct

SEQ ID NO: 250559 - DNA, 25 bp, Mus musculus
cctcagtctcccagtggtactgcca

SEQ ID NO: 250560 - DNA, 25 bp, Mus musculus
cctcagtctgtacaggttcctgcag

SEQ ID NO: 250561 - DNA, 25 bp, Mus musculus
cctcagtgccaacctttttgcccag

SEQ ID NO: 250562 - DNA, 25 bp, Mus musculus
cctcagtgctcccaggggtgatctg

SEQ ID NO: 250563 - DNA, 25 bp, Mus musculus
cctcagtggcaggcggtgtggctac

SEQ ID NO: 250564 - DNA, 25 bp, Mus musculus
cctcagtggcagttgctgcgattgt

SEQ ID NO: 250565 - DNA, 25 bp, Mus musculus
cctcagtggtgggttttttcaggga

SEQ ID NO: 250566 - DNA, 25 bp, Mus musculus
cctcagtggtgtcggcattgctagc

SEQ ID NO: 250567 - DNA, 25 bp, Mus musculus
cctcagtggtgtcggtgttgccagt

SEQ ID NO: 250568 - DNA, 25 bp, Mus musculus
cctcagtgtatgccgcttacaagca

SEQ ID NO: 250569 - DNA, 25 bp, Mus musculus
cctcagtgtcagggagtgttcctgt

SEQ ID NO: 250570 - DNA, 25 bp, Mus musculus
cctcagtgtcagtgattcgggtacc

SEQ ID NO: 250571 - DNA, 25 bp, Mus musculus
cctcagtgtggcctcccctggtttt

SEQ ID NO: 250572 - DNA, 25 bp, Mus musculus
cctcagttctcccaggttgttcctc

SEQ ID NO: 250573 - DNA, 25 bp, Mus musculus
cctcagttctgtgactgatgaagta

SEQ ID NO: 250574 - DNA, 25 bp, Mus musculus
cctcagttgccgattgctgttcttc

SEQ ID NO: 250575 - DNA, 25 bp, Mus musculus
cctcagttttcccaagcaaccctac

SEQ ID NO: 250576 - DNA, 25 bp, Mus musculus
cctcataaaggttgacctatcaaag

SEQ ID NO: 250577 - DNA, 25 bp, Mus musculus
cctcataaattccacatgagatatg

SEQ ID NO: 250578 - DNA, 25 bp, Mus musculus
cctcataagtaccaggctggtaaga

SEQ ID NO: 250579 - DNA, 25 bp, Mus musculus
cctcataatcgcaaaaacatcaaac

SEQ ID NO: 250580 - DNA, 25 bp, Mus musculus
cctcatacagggtggcagtgagccg

SEQ ID NO: 250581 - DNA, 25 bp, Mus musculus
cctcatactacaggtgagcgtcctc

SEQ ID NO: 250582 - DNA, 25 bp, Mus musculus
cctcatagcagaatctggtcaacct

SEQ ID NO: 250583 - DNA, 25 bp, Mus musculus
cctcatatagaaaaatactgaatga

SEQ ID NO: 250584 - DNA, 25 bp, Mus musculus
cctcatcaacagtgagggggactca

SEQ ID NO: 250585 - DNA, 25 bp, Mus musculus
cctcatcaacagtttgcaggacatg

SEQ ID NO: 250586 - DNA, 25 bp, Mus musculus
cctcatcaagagggctgggtcaagg

SEQ ID NO: 250587 - DNA, 25 bp, Mus musculus
cctcatcaatcccagggctccggga

SEQ ID NO: 250588 - DNA, 25 bp, Mus musculus
cctcatcaatggtgaacaacccaga

SEQ ID NO: 250589 - DNA, 25 bp, Mus musculus
cctcatcagcaaatgacatctggat

SEQ ID NO: 250590 - DNA, 25 bp, Mus musculus
cctcatcagtgccaactgtaaagct

SEQ ID NO: 250591 - DNA, 25 bp, Mus musculus
cctcatcagtggccaccaatgaagt

SEQ ID NO: 250592 - DNA, 25 bp, Mus musculus
cctcatcatccagctggatagcagt

SEQ ID NO: 250593 - DNA, 25 bp, Mus musculus
cctcatccacgaaggttttgcaggc

SEQ ID NO: 250594 - DNA, 25 bp, Mus musculus
cctcatccacggtttgtggaatctt

SEQ ID NO: 250595 - DNA, 25 bp, Mus musculus
cctcatccagaagtttggggacctg

SEQ ID NO: 250596 - DNA, 25 bp, Mus musculus
cctcatccagaatggtggccacttg

SEQ ID NO: 250597 - DNA, 25 bp, Mus musculus
cctcatccagaccagagggcctgcc

SEQ ID NO: 250598 - DNA, 25 bp, Mus musculus
cctcatccagcagaaaaaagatgga

SEQ ID NO: 250599 - DNA, 25 bp, Mus musculus
cctcatccagcatttccaagctatg

SEQ ID NO: 250600 - DNA, 25 bp, Mus musculus
cctcatccagcttactggcggtttt

SEQ ID NO: 250601 - DNA, 25 bp, Mus musculus
cctcatcccatgcttccaaactata

SEQ ID NO: 250602 - DNA, 25 bp, Mus musculus
cctcatccccaaggccgcagatcat

SEQ ID NO: 250603 - DNA, 25 bp, Mus musculus
cctcatccccaaggggtcaatcctc

SEQ ID NO: 250604 - DNA, 25 bp, Mus musculus
cctcatccctcctgaggggatccca

SEQ ID NO: 250605 - DNA, 25 bp, Mus musculus
cctcatccctcctgaggggatgctt

SEQ ID NO: 250606 - DNA, 25 bp, Mus musculus
cctcatcctcaatagttgaactttc

SEQ ID NO: 250607 - DNA, 25 bp, Mus musculus
cctcatcgagaagcccatgggcatc

SEQ ID NO: 250608 - DNA, 25 bp, Mus musculus
cctcatcgccatcgacctggaactg

SEQ ID NO: 250609 - DNA, 25 bp, Mus musculus
cctcatcggaaatttgtatgcccgg

SEQ ID NO: 250610 - DNA, 25 bp, Mus musculus
cctcatcggcagccagctggaggag

SEQ ID NO: 250611 - DNA, 25 bp, Mus musculus
cctcatcgtggattactcctgcgcc

SEQ ID NO: 250612 - DNA, 25 bp, Mus musculus
cctcatctaatccaggatgctgggc

SEQ ID NO: 250613 - DNA, 25 bp, Mus musculus
cctcatctaggtacgtaggtgccat

SEQ ID NO: 250614 - DNA, 25 bp, Mus musculus
cctcatctatgagggctacgagggc

SEQ ID NO: 250615 - DNA, 25 bp, Mus musculus
cctcatctccaagagtgaatgtggg

SEQ ID NO: 250616 - DNA, 25 bp, Mus musculus
cctcatctccaagtccttccagggc

SEQ ID NO: 250617 - DNA, 25 bp, Mus musculus
cctcatctctgatcgctggggtgca

SEQ ID NO: 250618 - DNA, 25 bp, Mus musculus
cctcatctctgtgatgggtcactgc

SEQ ID NO: 250619 - DNA, 25 bp, Mus musculus
cctcatctgcagggtccacgccatt

SEQ ID NO: 250620 - DNA, 25 bp, Mus musculus
cctcatctgcatggactcttactcg

SEQ ID NO: 250621 - DNA, 25 bp, Mus musculus
cctcatctgtgctggctgcaaccaa

SEQ ID NO: 250622 - DNA, 25 bp, Mus musculus
cctcatctgtggtcaaaatccagtt

SEQ ID NO: 250623 - DNA, 25 bp, Mus musculus
cctcatcttcaaagggattaacatc

SEQ ID NO: 250624 - DNA, 25 bp, Mus musculus
cctcatcttcaaggccacaggaccc

SEQ ID NO: 250625 - DNA, 25 bp, Mus musculus
cctcatcttctggggggcagctggc

SEQ ID NO: 250626 - DNA, 25 bp, Mus musculus
cctcatcttcttcctgacagctatc

SEQ ID NO: 250627 - DNA, 25 bp, Mus musculus
cctcatgaacgcaaggactttgaat

SEQ ID NO: 250628 - DNA, 25 bp, Mus musculus
cctcatgaacgcaatgtggaccatc

SEQ ID NO: 250629 - DNA, 25 bp, Mus musculus
cctcatgaagacgtcttcatcatgg

SEQ ID NO: 250630 - DNA, 25 bp, Mus musculus
cctcatgaaggaagtggagaccctg

SEQ ID NO: 250631 - DNA, 25 bp, Mus musculus
cctcatgaagggtacggattgctct

SEQ ID NO: 250632 - DNA, 25 bp, Mus musculus
cctcatgaaggttcctttggcttct

SEQ ID NO: 250633 - DNA, 25 bp, Mus musculus
cctcatgaggaaacggctgctcttc

SEQ ID NO: 250634 - DNA, 25 bp, Mus musculus
cctcatgcagaaggtgattaccaca

SEQ ID NO: 250635 - DNA, 25 bp, Mus musculus
cctcatgcaggagtatgcaaaccaa

SEQ ID NO: 250636 - DNA, 25 bp, Mus musculus
cctcatgcattaagtcttgtgaaag

SEQ ID NO: 250637 - DNA, 25 bp, Mus musculus
cctcatgcattaagtcttgtgatat

SEQ ID NO: 250638 - DNA, 25 bp, Mus musculus
cctcatgcattatgaagaagtcttt

SEQ ID NO: 250639 - DNA, 25 bp, Mus musculus
cctcatgccgagcaactgtgggtta

SEQ ID NO: 250640 - DNA, 25 bp, Mus musculus
cctcatgcctggataagagtaaaga

SEQ ID NO: 250641 - DNA, 25 bp, Mus musculus
cctcatgcctggtggggcagtggcc

SEQ ID NO: 250642 - DNA, 25 bp, Mus musculus
cctcatgcctttgggcttggaagtg

SEQ ID NO: 250643 - DNA, 25 bp, Mus musculus
cctcatgctaacaggaaaaattctc

SEQ ID NO: 250644 - DNA, 25 bp, Mus musculus
cctcatgcttaagctgaagtggtgt

SEQ ID NO: 250645 - DNA, 25 bp, Mus musculus
cctcatgcttaaggctctctatctc

SEQ ID NO: 250646 - DNA, 25 bp, Mus musculus
cctcatgcttgtgaccatactctcc

SEQ ID NO: 250647 - DNA, 25 bp, Mus musculus
cctcatgcttgtgagcatactctcc

SEQ ID NO: 250648 - DNA, 25 bp, Mus musculus
cctcatgctttcgaaatgaataaca

SEQ ID NO: 250649 - DNA, 25 bp, Mus musculus
cctcatggaatcagctgctctgccc

SEQ ID NO: 250650 - DNA, 25 bp, Mus musculus
cctcatggaatcaggtgccaacagg

SEQ ID NO: 250651 - DNA, 25 bp, Mus musculus
cctcatggatacaatgagcagcacc

SEQ ID NO: 250652 - DNA, 25 bp, Mus musculus
cctcatggcacagagaagccatcct

SEQ ID NO: 250653 - DNA, 25 bp, Mus musculus
cctcatggcacaggagcttgaagga

SEQ ID NO: 250654 - DNA, 25 bp, Mus musculus
cctcatgtacactaggaagtcagag

SEQ ID NO: 250655 - DNA, 25 bp, Mus musculus
cctcatgttatgaaagagaatgcag

SEQ ID NO: 250656 - DNA, 25 bp, Mus musculus
cctcatgttatgaaatagaatgcag

SEQ ID NO: 250657 - DNA, 25 bp, Mus musculus
cctcatgttatgactcaacaaggac

SEQ ID NO: 250658 - DNA, 25 bp, Mus musculus
cctcatgttatggttcctccatccc

SEQ ID NO: 250659 - DNA, 25 bp, Mus musculus
cctcatgttcacagggtacggattg

SEQ ID NO: 250660 - DNA, 25 bp, Mus musculus
cctcatgtttctgggctttcaggag

SEQ ID NO: 250661 - DNA, 25 bp, Mus musculus
cctcattaaatgaatctcctgtaaa

SEQ ID NO: 250662 - DNA, 25 bp, Mus musculus
cctcattaagaagaacaatcaccat

SEQ ID NO: 250663 - DNA, 25 bp, Mus musculus
cctcattacagtgtgactgcacaga

SEQ ID NO: 250664 - DNA, 25 bp, Mus musculus
cctcattacatcagattacgagctc

SEQ ID NO: 250665 - DNA, 25 bp, Mus musculus
cctcattatccagatacacagacag

SEQ ID NO: 250666 - DNA, 25 bp, Mus musculus
cctcattcaagaggtaatcagccag

SEQ ID NO: 250667 - DNA, 25 bp, Mus musculus
cctcattcaagatgttcacacggaa

SEQ ID NO: 250668 - DNA, 25 bp, Mus musculus
cctcattcaaggagtagacccatgt

SEQ ID NO: 250669 - DNA, 25 bp, Mus musculus
cctcattgagacccccgatggcatt

SEQ ID NO: 250670 - DNA, 25 bp, Mus musculus
cctcattggctttatctcggaccta

SEQ ID NO: 250671 - DNA, 25 bp, Mus musculus
cctcattggtctaatctctgaccgc

SEQ ID NO: 250672 - DNA, 25 bp, Mus musculus
cctcatttacgagcacgagtgcttc

SEQ ID NO: 250673 - DNA, 25 bp, Mus musculus
cctcatttagcaaaggtgtggtggc

SEQ ID NO: 250674 - DNA, 25 bp, Mus musculus
cctcatttatgatcccataaaaact

SEQ ID NO: 250675 - DNA, 25 bp, Mus musculus
cctcatttcaaaggtattttaacca

SEQ ID NO: 250676 - DNA, 25 bp, Mus musculus
cctcatttccccaagtgcgccgcag

SEQ ID NO: 250677 - DNA, 25 bp, Mus musculus
cctcatttccccttggtgcaccatg

SEQ ID NO: 250678 - DNA, 25 bp, Mus musculus
cctcatttccgctgcccgtatggtg

SEQ ID NO: 250679 - DNA, 25 bp, Mus musculus
cctccaaaagccggaaggagaaggg

SEQ ID NO: 250680 - DNA, 25 bp, Mus musculus
cctccaaaagccggtgaagatcgta

SEQ ID NO: 250681 - DNA, 25 bp, Mus musculus
cctccaaacagaagctccctgagtg

SEQ ID NO: 250682 - DNA, 25 bp, Mus musculus
cctccaaacagtgaaggtgagcagg

SEQ ID NO: 250683 - DNA, 25 bp, Mus musculus
cctccaaaccaagcagtcctatgca

SEQ ID NO: 250684 - DNA, 25 bp, Mus musculus
cctccaaagaagaggaatgagttcc

SEQ ID NO: 250685 - DNA, 25 bp, Mus musculus
cctccaaagaagaggtgagtcctga

SEQ ID NO: 250686 - DNA, 25 bp, Mus musculus
cctccaaagacacgagcaccggggg

SEQ ID NO: 250687 - DNA, 25 bp, Mus musculus
cctccaaagagatggtcagccgcct

SEQ ID NO: 250688 - DNA, 25 bp, Mus musculus
cctccaaagattgccatggtggtgc

SEQ ID NO: 250689 - DNA, 25 bp, Mus musculus
cctccaaagcaagagtgaagtgtgt

SEQ ID NO: 250690 - DNA, 25 bp, Mus musculus
cctccaaagcatggaaataaatgcc

SEQ ID NO: 250691 - DNA, 25 bp, Mus musculus
cctccaaagcatggcaatgcttggc

SEQ ID NO: 250692 - DNA, 25 bp, Mus musculus
cctccaaagtgaggaacttctgcag

SEQ ID NO: 250693 - DNA, 25 bp, Mus musculus
cctccaaatccggccaaagataact

SEQ ID NO: 250694 - DNA, 25 bp, Mus musculus
cctccaaatggttctgaatcagacg

SEQ ID NO: 250695 - DNA, 25 bp, Mus musculus
cctccaaatttgggcagacattata

SEQ ID NO: 250696 - DNA, 25 bp, Mus musculus
cctccaacaaagcaaagtaacaatc

SEQ ID NO: 250697 - DNA, 25 bp, Mus musculus
cctccaacaaaggagctgacaaacc

SEQ ID NO: 250698 - DNA, 25 bp, Mus musculus
cctccaacaaaggtcgtcctccttg

SEQ ID NO: 250699 - DNA, 25 bp, Mus musculus
cctccaacaaatgcagaaccccgac

SEQ ID NO: 250700 - DNA, 25 bp, Mus musculus
cctccaacaccaaagtggacatgac

SEQ ID NO: 250701 - DNA, 25 bp, Mus musculus
cctccaacacccgctgcctcaacgg

SEQ ID NO: 250702 - DNA, 25 bp, Mus musculus
cctccaacatattcgattcttgaac

SEQ ID NO: 250703 - DNA, 25 bp, Mus musculus
cctccaacatggcaggtaagaaagt

SEQ ID NO: 250704 - DNA, 25 bp, Mus musculus
cctccaaccacaggggccagctaga

SEQ ID NO: 250705 - DNA, 25 bp, Mus musculus
cctccaacccgggaagcacaggctc

SEQ ID NO: 250706 - DNA, 25 bp, Mus musculus
cctccaacgtatcccaccaaatatt

SEQ ID NO: 250707 - DNA, 25 bp, Mus musculus
cctccaactcagatctctcgtctgc

SEQ ID NO: 250708 - DNA, 25 bp, Mus musculus
cctccaactcagccctccaggacct

SEQ ID NO: 250709 - DNA, 25 bp, Mus musculus
cctccaagagaaggtggacctggca

SEQ ID NO: 250710 - DNA, 25 bp, Mus musculus
cctccaagagctggggtctgatctt

SEQ ID NO: 250711 - DNA, 25 bp, Mus musculus
cctccaagaggcggagtcgccggca

SEQ ID NO: 250712 - DNA, 25 bp, Mus musculus
cctccaagatctcctacctctgcct

SEQ ID NO: 250713 - DNA, 25 bp, Mus musculus
cctccaagcagaggacaaaatcaca

SEQ ID NO: 250714 - DNA, 25 bp, Mus musculus
cctccaagcagaggtatgtgcaggc

SEQ ID NO: 250715 - DNA, 25 bp, Mus musculus
cctccaagcccagcatgtgagggag

SEQ ID NO: 250716 - DNA, 25 bp, Mus musculus
cctccaagcccaggtaactgttcag

SEQ ID NO: 250717 - DNA, 25 bp, Mus musculus
cctccaaggctgggcgcgggctggg

SEQ ID NO: 250718 - DNA, 25 bp, Mus musculus
cctccaagtacgtgctccaggcact

SEQ ID NO: 250719 - DNA, 25 bp, Mus musculus
cctccaagtacgtgctctacaccct

SEQ ID NO: 250720 - DNA, 25 bp, Mus musculus
cctccaagtatgagaaagagctaaa

SEQ ID NO: 250721 - DNA, 25 bp, Mus musculus
cctccaagtccagagtcccggccac

SEQ ID NO: 250722 - DNA, 25 bp, Mus musculus
cctccaagtccccaggagaggagac

SEQ ID NO: 250723 - DNA, 25 bp, Mus musculus
cctccaagtccccaggccggggagc

SEQ ID NO: 250724 - DNA, 25 bp, Mus musculus
cctccaatgaaagtgctaatgctga

SEQ ID NO: 250725 - DNA, 25 bp, Mus musculus
cctccaatgaaggagatgacaaatc

SEQ ID NO: 250726 - DNA, 25 bp, Mus musculus
cctccaatgaaggagctgaaaggcc

SEQ ID NO: 250727 - DNA, 25 bp, Mus musculus
cctccaatgaaggaggaatgtcaag

SEQ ID NO: 250728 - DNA, 25 bp, Mus musculus
cctccaatgaaggaggtgactccaa

SEQ ID NO: 250729 - DNA, 25 bp, Mus musculus
cctccaatggaggaggtgactccaa

SEQ ID NO: 250730 - DNA, 25 bp, Mus musculus
cctccaatgggacaaatgcctggaa

SEQ ID NO: 250731 - DNA, 25 bp, Mus musculus
cctccacagaggttgtgcccaccag

SEQ ID NO: 250732 - DNA, 25 bp, Mus musculus
cctccacagtaaaggacagtctcat

SEQ ID NO: 250733 - DNA, 25 bp, Mus musculus
cctccacagtaaaggttacagatat

SEQ ID NO: 250734 - DNA, 25 bp, Mus musculus
cctccacatcctctgatcggttaag

SEQ ID NO: 250735 - DNA, 25 bp, Mus musculus
cctccaccagctcagttaatggaac

SEQ ID NO: 250736 - DNA, 25 bp, Mus musculus
cctccaccaggtagctgagacctat

SEQ ID NO: 250737 - DNA, 25 bp, Mus musculus
cctccaccatcaagaaccatgagtt

SEQ ID NO: 250738 - DNA, 25 bp, Mus musculus
cctccaccatttcagagtcagcttg

SEQ ID NO: 250739 - DNA, 25 bp, Mus musculus
cctccacccacctctcactccccat

SEQ ID NO: 250740 - DNA, 25 bp, Mus musculus
cctccacccaggtgtcaacacatgt

SEQ ID NO: 250741 - DNA, 25 bp, Mus musculus
cctccacccccagaaacgtgtgccg

SEQ ID NO: 250742 - DNA, 25 bp, Mus musculus
cctccacccccgcctcccagacaga

SEQ ID NO: 250743 - DNA, 25 bp, Mus musculus
cctccacctaccaggagaactatga

SEQ ID NO: 250744 - DNA, 25 bp, Mus musculus
cctccacctaccagtgaaatcaact

SEQ ID NO: 250745 - DNA, 25 bp, Mus musculus
cctccacctcctcagtggcatgcct

SEQ ID NO: 250746 - DNA, 25 bp, Mus musculus
cctccacctcctgagaaattagaag

SEQ ID NO: 250747 - DNA, 25 bp, Mus musculus
cctccacctcctgagaccatggtat

SEQ ID NO: 250748 - DNA, 25 bp, Mus musculus
cctccacctcctgagtctagccgcc

SEQ ID NO: 250749 - DNA, 25 bp, Mus musculus
cctccaccttctctctcttcctcct

SEQ ID NO: 250750 - DNA, 25 bp, Mus musculus
cctccacgaggcgagcctgtcacag

SEQ ID NO: 250751 - DNA, 25 bp, Mus musculus
cctccacgctcaagcagcccacaca

SEQ ID NO: 250752 - DNA, 25 bp, Mus musculus
cctccacgctcaaggtgaccctgcc

SEQ ID NO: 250753 - DNA, 25 bp, Mus musculus
cctccacgctgaatgaaaagtcccc

SEQ ID NO: 250754 - DNA, 25 bp, Mus musculus
cctccacggcggtgcaagttgctcc

SEQ ID NO: 250755 - DNA, 25 bp, Mus musculus
cctccacggcggtgcctggagagca

SEQ ID NO: 250756 - DNA, 25 bp, Mus musculus
cctccacggggtttgacttcatgct

SEQ ID NO: 250757 - DNA, 25 bp, Mus musculus
cctccactcagcttcccatgctcca

SEQ ID NO: 250758 - DNA, 25 bp, Mus musculus
cctccactcaggtctgggaacgtaa

SEQ ID NO: 250759 - DNA, 25 bp, Mus musculus
cctccactccagatcatgtcatcag

SEQ ID NO: 250760 - DNA, 25 bp, Mus musculus
cctccactccagctggtggctggca

SEQ ID NO: 250761 - DNA, 25 bp, Mus musculus
cctccactggttggaagaggctgag

SEQ ID NO: 250762 - DNA, 25 bp, Mus musculus
cctccactgtaaatggagatcgctc

SEQ ID NO: 250763 - DNA, 25 bp, Mus musculus
cctccacttcctgttgtcggtgcct

SEQ ID NO: 250764 - DNA, 25 bp, Mus musculus
cctccagaacacaggctgggaagat

SEQ ID NO: 250765 - DNA, 25 bp, Mus musculus
cctccagaaccgcaaagatgctgga

SEQ ID NO: 250766 - DNA, 25 bp, Mus musculus
cctccagacccacagacttccaaat

SEQ ID NO: 250767 - DNA, 25 bp, Mus musculus
cctccagacccacagaggctcccaa

SEQ ID NO: 250768 - DNA, 25 bp, Mus musculus
cctccagactacctgacctcatctt

SEQ ID NO: 250769 - DNA, 25 bp, Mus musculus
cctccagactcagctggcggtgcag

SEQ ID NO: 250770 - DNA, 25 bp, Mus musculus
cctccagagaaagaggatggaggcc

SEQ ID NO: 250771 - DNA, 25 bp, Mus musculus
cctccagagaagatacggactctga

SEQ ID NO: 250772 - DNA, 25 bp, Mus musculus
cctccagagcagagtgccagctgga

SEQ ID NO: 250773 - DNA, 25 bp, Mus musculus
cctccagagggctagatgtggaaga

SEQ ID NO: 250774 - DNA, 25 bp, Mus musculus
cctccagatatcctgagcagagggg

SEQ ID NO: 250775 - DNA, 25 bp, Mus musculus
cctccagatctggggttggtgtcat

SEQ ID NO: 250776 - DNA, 25 bp, Mus musculus
cctccagatgccttacaagaggagt

SEQ ID NO: 250777 - DNA, 25 bp, Mus musculus
cctccagatgccttacagcacatgt

SEQ ID NO: 250778 - DNA, 25 bp, Mus musculus
cctccagcacctcagggatttgcaa

SEQ ID NO: 250779 - DNA, 25 bp, Mus musculus
cctccagcacctcagggccaataat

SEQ ID NO: 250780 - DNA, 25 bp, Mus musculus
cctccagcacctcagtgccttccca

SEQ ID NO: 250781 - DNA, 25 bp, Mus musculus
cctccagcacgcagctttacatggt

SEQ ID NO: 250782 - DNA, 25 bp, Mus musculus
cctccagcagataagagtaaagaaa

SEQ ID NO: 250783 - DNA, 25 bp, Mus musculus
cctccagcaggaacacagaggaaag

SEQ ID NO: 250784 - DNA, 25 bp, Mus musculus
cctccagcaggaagaactaggaagg

SEQ ID NO: 250785 - DNA, 25 bp, Mus musculus
cctccagcaggcttgtgacatcact

SEQ ID NO: 250786 - DNA, 25 bp, Mus musculus
cctccagcaggggctggattcagga

SEQ ID NO: 250787 - DNA, 25 bp, Mus musculus
cctccagcagtgggtttttcttccg

SEQ ID NO: 250788 - DNA, 25 bp, Mus musculus
cctccagcatcgtggccaagatgga

SEQ ID NO: 250789 - DNA, 25 bp, Mus musculus
cctccagccaccagcccctgcccgg

SEQ ID NO: 250790 - DNA, 25 bp, Mus musculus
cctccagccaggaatggcaagatgt

SEQ ID NO: 250791 - DNA, 25 bp, Mus musculus
cctccagccaggtgatgttctgatt

SEQ ID NO: 250792 - DNA, 25 bp, Mus musculus
cctccagccgggatgctgtccaggc

SEQ ID NO: 250793 - DNA, 25 bp, Mus musculus
cctccagcctcagaggccagaaagg

SEQ ID NO: 250794 - DNA, 25 bp, Mus musculus
cctccagcctcagaggccagaagaa

SEQ ID NO: 250795 - DNA, 25 bp, Mus musculus
cctccagcgacatcgctgacttcag

SEQ ID NO: 250796 - DNA, 25 bp, Mus musculus
cctccagcgggacaggtggtgtccc

SEQ ID NO: 250797 - DNA, 25 bp, Mus musculus
cctccagcgggacagtgacgttgcc

SEQ ID NO: 250798 - DNA, 25 bp, Mus musculus
cctccagcgtctaaggttcctgtgt

SEQ ID NO: 250799 - DNA, 25 bp, Mus musculus
cctccagctcttggcagaagacttt

SEQ ID NO: 250800 - DNA, 25 bp, Mus musculus
cctccagctgcaatggggactctgg

SEQ ID NO: 250801 - DNA, 25 bp, Mus musculus
cctccagctggaccctggaggaggc

SEQ ID NO: 250802 - DNA, 25 bp, Mus musculus
cctccaggaccatgcaaaagcaaaa

SEQ ID NO: 250803 - DNA, 25 bp, Mus musculus
cctccaggacccagtggaacaattg

SEQ ID NO: 250804 - DNA, 25 bp, Mus musculus
cctccaggacgtgtctcccactccc

SEQ ID NO: 250805 - DNA, 25 bp, Mus musculus
cctccaggacgtttctaagctgact

SEQ ID NO: 250806 - DNA, 25 bp, Mus musculus
cctccaggataccaaggctcctgtg

SEQ ID NO: 250807 - DNA, 25 bp, Mus musculus
cctccaggatcctcatccgagagtc

SEQ ID NO: 250808 - DNA, 25 bp, Mus musculus
cctccaggccacaatcggctatcca

SEQ ID NO: 250809 - DNA, 25 bp, Mus musculus
cctccaggccctccggaggacctgg

SEQ ID NO: 250810 - DNA, 25 bp, Mus musculus
cctccaggccctgctggagctccag

SEQ ID NO: 250811 - DNA, 25 bp, Mus musculus
cctccagggccagtttcttctggga

SEQ ID NO: 250812 - DNA, 25 bp, Mus musculus
cctccagggcccctgggcccacctg

SEQ ID NO: 250813 - DNA, 25 bp, Mus musculus
cctccagggtcagcttccaagcaac

SEQ ID NO: 250814 - DNA, 25 bp, Mus musculus
cctccagggtcaggtgaaccaccaa

SEQ ID NO: 250815 - DNA, 25 bp, Mus musculus
cctccaggtagtccaggggcagccg

SEQ ID NO: 250816 - DNA, 25 bp, Mus musculus
cctccagtagagaaataccggtatc

SEQ ID NO: 250817 - DNA, 25 bp, Mus musculus
cctccagtagagaagctgaagggaa

SEQ ID NO: 250818 - DNA, 25 bp, Mus musculus
cctccagtgactccatcaaagagag

SEQ ID NO: 250819 - DNA, 25 bp, Mus musculus
cctccagtgcagaagctgtagctat

SEQ ID NO: 250820 - DNA, 25 bp, Mus musculus
cctccagtgctgcgccattttggct

SEQ ID NO: 250821 - DNA, 25 bp, Mus musculus
cctccagtgctgtaaccctccactg

SEQ ID NO: 250822 - DNA, 25 bp, Mus musculus
cctccagtggatcggaaaaggccta

SEQ ID NO: 250823 - DNA, 25 bp, Mus musculus
cctccagttttccagagccccttcc

SEQ ID NO: 250824 - DNA, 25 bp, Mus musculus
cctccatacagtgctctgtgaagaa

SEQ ID NO: 250825 - DNA, 25 bp, Mus musculus
cctccatcaccttcattcacaacga

SEQ ID NO: 250826 - DNA, 25 bp, Mus musculus
cctccatcaggattccatggacaaa

SEQ ID NO: 250827 - DNA, 25 bp, Mus musculus
cctccatcagttctgtgctcaaaga

SEQ ID NO: 250828 - DNA, 25 bp, Mus musculus
cctccatcccaagcgcctgtgtctg

SEQ ID NO: 250829 - DNA, 25 bp, Mus musculus
cctccatcctgcagaccttatgtga

SEQ ID NO: 250830 - DNA, 25 bp, Mus musculus
cctccatcctgcaggggctggcgag

SEQ ID NO: 250831 - DNA, 25 bp, Mus musculus
cctccatcgctacagatactttatg

SEQ ID NO: 250832 - DNA, 25 bp, Mus musculus
cctccatcgtgagacataggaggcg

SEQ ID NO: 250833 - DNA, 25 bp, Mus musculus
cctccatcgtgaggaactatgaatg

SEQ ID NO: 250834 - DNA, 25 bp, Mus musculus
cctccatcgtgaggtagttgaaatg

SEQ ID NO: 250835 - DNA, 25 bp, Mus musculus
cctccatctacactggaattacact

SEQ ID NO: 250836 - DNA, 25 bp, Mus musculus
cctccatctccgagctgatccacac

SEQ ID NO: 250837 - DNA, 25 bp, Mus musculus
cctccatcttggcatgtgctccact

SEQ ID NO: 250838 - DNA, 25 bp, Mus musculus
cctccatgacgcctgacctgctgaa

SEQ ID NO: 250839 - DNA, 25 bp, Mus musculus
cctccatgagtgaacccacagcttc

SEQ ID NO: 250840 - DNA, 25 bp, Mus musculus
cctccatgccctctttagcagatat

SEQ ID NO: 250841 - DNA, 25 bp, Mus musculus
cctccatggaccctggacttcgggt

SEQ ID NO: 250842 - DNA, 25 bp, Mus musculus
cctccatgtggatataccgctgtgg

SEQ ID NO: 250843 - DNA, 25 bp, Mus musculus
cctccatgtggcatttggcacatcc

SEQ ID NO: 250844 - DNA, 25 bp, Mus musculus
cctccattcacaaggattcagggaa

SEQ ID NO: 250845 - DNA, 25 bp, Mus musculus
cctccattctcgaggtggctgttat

SEQ ID NO: 250846 - DNA, 25 bp, Mus musculus
cctccattttggattcgtaaacttc

SEQ ID NO: 250847 - DNA, 25 bp, Mus musculus
cctcccaaactgagatttgcaacag

SEQ ID NO: 250848 - DNA, 25 bp, Mus musculus
cctcccaaagatactggcattgccc

SEQ ID NO: 250849 - DNA, 25 bp, Mus musculus
cctcccaaagggtatgtgtatttgg

SEQ ID NO: 250850 - DNA, 25 bp, Mus musculus
cctcccaacagatgcagcgaagccc

SEQ ID NO: 250851 - DNA, 25 bp, Mus musculus
cctcccaacccaaatcttccaccac

SEQ ID NO: 250852 - DNA, 25 bp, Mus musculus
cctcccaacccaagtgacgttttga

SEQ ID NO: 250853 - DNA, 25 bp, Mus musculus
cctcccaactgtagtgctggaccca

SEQ ID NO: 250854 - DNA, 25 bp, Mus musculus
cctcccaagcaaggttgaaaggaaa

SEQ ID NO: 250855 - DNA, 25 bp, Mus musculus
cctcccaaggaaggagtctatgaac

SEQ ID NO: 250856 - DNA, 25 bp, Mus musculus
cctcccaaggaagttcatgttctgt

SEQ ID NO: 250857 - DNA, 25 bp, Mus musculus
cctcccaatgattttcagaataacg

SEQ ID NO: 250858 - DNA, 25 bp, Mus musculus
cctcccaatttcaggctcacccatg

SEQ ID NO: 250859 - DNA, 25 bp, Mus musculus
cctcccacacaggcgctctgaaatc

SEQ ID NO: 250860 - DNA, 25 bp, Mus musculus
cctcccacagtgttatctttgttgg

SEQ ID NO: 250861 - DNA, 25 bp, Mus musculus
cctcccacatcaaggtggtggtcgg

SEQ ID NO: 250862 - DNA, 25 bp, Mus musculus
cctcccacattcaggtccaacaaag

SEQ ID NO: 250863 - DNA, 25 bp, Mus musculus
cctcccaccggtgcctgctgtctcc

SEQ ID NO: 250864 - DNA, 25 bp, Mus musculus
cctcccactccccagagcctcaagt

SEQ ID NO: 250865 - DNA, 25 bp, Mus musculus
cctcccactggttatagcactccaa

SEQ ID NO: 250866 - DNA, 25 bp, Mus musculus
cctcccactgtagaagggaccagta

SEQ ID NO: 250867 - DNA, 25 bp, Mus musculus
cctcccagaacacgagcccaagatg

SEQ ID NO: 250868 - DNA, 25 bp, Mus musculus
cctcccagagatcctcttcccagct

SEQ ID NO: 250869 - DNA, 25 bp, Mus musculus
cctcccagagcctccagagcttcgt

SEQ ID NO: 250870 - DNA, 25 bp, Mus musculus
cctcccagatacccagaaatggaac

SEQ ID NO: 250871 - DNA, 25 bp, Mus musculus
cctcccagcacctgtccctcactct

SEQ ID NO: 250872 - DNA, 25 bp, Mus musculus
cctcccagcagaaggagtgtcctct

SEQ ID NO: 250873 - DNA, 25 bp, Mus musculus
cctcccagcagaaggcagcaagcgc

SEQ ID NO: 250874 - DNA, 25 bp, Mus musculus
cctcccagccaccaaaggggaggcg

SEQ ID NO: 250875 - DNA, 25 bp, Mus musculus
cctcccagcgcagggttaatttcta

SEQ ID NO: 250876 - DNA, 25 bp, Mus musculus
cctcccaggaagagagggagaaggc

SEQ ID NO: 250877 - DNA, 25 bp, Mus musculus
cctcccagtgacgtactggattgtg

SEQ ID NO: 250878 - DNA, 25 bp, Mus musculus
cctcccatactcggtccctgaatgg

SEQ ID NO: 250879 - DNA, 25 bp, Mus musculus
cctcccatcagcaagccccgcccaa

SEQ ID NO: 250880 - DNA, 25 bp, Mus musculus
cctcccatcatttgaggctctttca

SEQ ID NO: 250881 - DNA, 25 bp, Mus musculus
cctcccatgatgaccctatcaagga

SEQ ID NO: 250882 - DNA, 25 bp, Mus musculus
cctccccaaaggatggctccatctc

SEQ ID NO: 250883 - DNA, 25 bp, Mus musculus
cctccccaacctcagctttctgacc

SEQ ID NO: 250884 - DNA, 25 bp, Mus musculus
cctccccacagaggtggaagcactt

SEQ ID NO: 250885 - DNA, 25 bp, Mus musculus
cctccccagaagacccagccagcag

SEQ ID NO: 250886 - DNA, 25 bp, Mus musculus
cctccccagaccagatcatccagcc

SEQ ID NO: 250887 - DNA, 25 bp, Mus musculus
cctccccagaccaggatgaggagga

SEQ ID NO: 250888 - DNA, 25 bp, Mus musculus
cctccccagagcaggagactctgag

SEQ ID NO: 250889 - DNA, 25 bp, Mus musculus
cctccccagagcagtgctaccatct

SEQ ID NO: 250890 - DNA, 25 bp, Mus musculus
cctccccagcaacaattgaaatggc

SEQ ID NO: 250891 - DNA, 25 bp, Mus musculus
cctccccagcaacactgcaatggct

SEQ ID NO: 250892 - DNA, 25 bp, Mus musculus
cctccccagcgaggggacaaaggcg

SEQ ID NO: 250893 - DNA, 25 bp, Mus musculus
cctccccatggaagtctgctcgact

SEQ ID NO: 250894 - DNA, 25 bp, Mus musculus
cctcccccaacactacaggcgcctc

SEQ ID NO: 250895 - DNA, 25 bp, Mus musculus
cctcccccaagactacaggcgcctc

SEQ ID NO: 250896 - DNA, 25 bp, Mus musculus
cctcccccagagtgctgacctagct

SEQ ID NO: 250897 - DNA, 25 bp, Mus musculus
cctcccccaggctggagagaatgaa

SEQ ID NO: 250898 - DNA, 25 bp, Mus musculus
cctcccccaggcttcagcaccgtgg

SEQ ID NO: 250899 - DNA, 25 bp, Mus musculus
cctccccctgaccagctgtccccag

SEQ ID NO: 250900 - DNA, 25 bp, Mus musculus
cctcccccttctacttcagagccac

SEQ ID NO: 250901 - DNA, 25 bp, Mus musculus
cctccccgacgcaggtcctacggcc

SEQ ID NO: 250902 - DNA, 25 bp, Mus musculus
cctccccgacgcaggtgttctttga

SEQ ID NO: 250903 - DNA, 25 bp, Mus musculus
cctccccgcgccacggacaagtgac

SEQ ID NO: 250904 - DNA, 25 bp, Mus musculus
cctccccgctgcagatttgcaacag

SEQ ID NO: 250905 - DNA, 25 bp, Mus musculus
cctccccgcttccgctctcgggacc

SEQ ID NO: 250906 - DNA, 25 bp, Mus musculus
cctccccggccagacagcaattcct

SEQ ID NO: 250907 - DNA, 25 bp, Mus musculus
cctccccggccagatgaggacaagc

SEQ ID NO: 250908 - DNA, 25 bp, Mus musculus
cctccccggccagtggctcttgacc

SEQ ID NO: 250909 - DNA, 25 bp, Mus musculus
cctccccgtaatgctggtgagattg

SEQ ID NO: 250910 - DNA, 25 bp, Mus musculus
cctccccgtaattacgctggggagg

SEQ ID NO: 250911 - DNA, 25 bp, Mus musculus
cctcccctacatctggacattggca

SEQ ID NO: 250912 - DNA, 25 bp, Mus musculus
cctcccctacatctggcattcagga

SEQ ID NO: 250913 - DNA, 25 bp, Mus musculus
cctcccctacatctgggctggttac

SEQ ID NO: 250914 - DNA, 25 bp, Mus musculus
cctcccctccgaaaatgccatcccg

SEQ ID NO: 250915 - DNA, 25 bp, Mus musculus
cctcccctccgaaactgtctgccca

SEQ ID NO: 250916 - DNA, 25 bp, Mus musculus
cctcccctgcccaagctgtgctgga

SEQ ID NO: 250917 - DNA, 25 bp, Mus musculus
cctcccctgcgagggtggctgctgc

SEQ ID NO: 250918 - DNA, 25 bp, Mus musculus
cctcccctgctttagtttcctgaca

SEQ ID NO: 250919 - DNA, 25 bp, Mus musculus
cctccccttcaggccagaaggtttg

SEQ ID NO: 250920 - DNA, 25 bp, Mus musculus
cctccccttggggccttctagccct

SEQ ID NO: 250921 - DNA, 25 bp, Mus musculus
cctcccgaaattcctgggcagagct

SEQ ID NO: 250922 - DNA, 25 bp, Mus musculus
cctcccgagcaggcagcaaacagaa

SEQ ID NO: 250923 - DNA, 25 bp, Mus musculus
cctcccgcccccagcgcctgctctg

SEQ ID NO: 250924 - DNA, 25 bp, Mus musculus
cctcccgctgctcctgggtgctggc

SEQ ID NO: 250925 - DNA, 25 bp, Mus musculus
cctcccgctttgggaaattcatcag

SEQ ID NO: 250926 - DNA, 25 bp, Mus musculus
cctcccggaaggaaggtcggcagct

SEQ ID NO: 250927 - DNA, 25 bp, Mus musculus
cctcccggaggaagcctcaagcaca

SEQ ID NO: 250928 - DNA, 25 bp, Mus musculus
cctcccggaggaaggtgttcctggt

SEQ ID NO: 250929 - DNA, 25 bp, Mus musculus
cctcccggatttctgcaccccctgg

SEQ ID NO: 250930 - DNA, 25 bp, Mus musculus
cctccctaccaggaggaagcagtgg

SEQ ID NO: 250931 - DNA, 25 bp, Mus musculus
cctccctatgtcccatcttgtcaag

SEQ ID NO: 250932 - DNA, 25 bp, Mus musculus
cctccctcacagaccaagtctgaaa

SEQ ID NO: 250933 - DNA, 25 bp, Mus musculus
cctccctcaccaagcttagcaagga

SEQ ID NO: 250934 - DNA, 25 bp, Mus musculus
cctccctcactgcactaacctttga

SEQ ID NO: 250935 - DNA, 25 bp, Mus musculus
cctccctcactggtgagaatgtccg

SEQ ID NO: 250936 - DNA, 25 bp, Mus musculus
cctccctcagacctgggaagatcct

SEQ ID NO: 250937 - DNA, 25 bp, Mus musculus
cctccctcagcagcaggtcctggga

SEQ ID NO: 250938 - DNA, 25 bp, Mus musculus
cctccctccaactctacaccctcgc

SEQ ID NO: 250939 - DNA, 25 bp, Mus musculus
cctccctcccagctgatggttcctg

SEQ ID NO: 250940 - DNA, 25 bp, Mus musculus
cctccctcccatgcagccacctgga

SEQ ID NO: 250941 - DNA, 25 bp, Mus musculus
cctccctccctggcagggggaggag

SEQ ID NO: 250942 - DNA, 25 bp, Mus musculus
cctccctccgcggaaatctaccaga

SEQ ID NO: 250943 - DNA, 25 bp, Mus musculus
cctccctcttcatgacacccctgga

SEQ ID NO: 250944 - DNA, 25 bp, Mus musculus
cctccctgaactcggctgcacggct

SEQ ID NO: 250945 - DNA, 25 bp, Mus musculus
cctccctgagactctttgctgattg

SEQ ID NO: 250946 - DNA, 25 bp, Mus musculus
cctccctgagcagattgaacgggct

SEQ ID NO: 250947 - DNA, 25 bp, Mus musculus
cctccctgagcctccatgtactcag

SEQ ID NO: 250948 - DNA, 25 bp, Mus musculus
cctccctgccttcagccatctgcaa

SEQ ID NO: 250949 - DNA, 25 bp, Mus musculus
cctccctggaacgggtgaagttgat

SEQ ID NO: 250950 - DNA, 25 bp, Mus musculus
cctccctggaccacctctgccctcc

SEQ ID NO: 250951 - DNA, 25 bp, Mus musculus
cctccctggaggtggagccttttgc

SEQ ID NO: 250952 - DNA, 25 bp, Mus musculus
cctccctggggaaagctactgggat

SEQ ID NO: 250953 - DNA, 25 bp, Mus musculus
cctccctgtcacagattgaaatgga

SEQ ID NO: 250954 - DNA, 25 bp, Mus musculus
cctcccttgtggtgtgaacattggc

SEQ ID NO: 250955 - DNA, 25 bp, Mus musculus
cctccctttcggcttcgtgagcttc

SEQ ID NO: 250956 - DNA, 25 bp, Mus musculus
cctccgaaaggcccgacgactcttt

SEQ ID NO: 250957 - DNA, 25 bp, Mus musculus
cctccgaacctgattcacagatgga

SEQ ID NO: 250958 - DNA, 25 bp, Mus musculus
cctccgaagactgaaactgttatgg

SEQ ID NO: 250959 - DNA, 25 bp, Mus musculus
cctccgaagtgaggggcttgcagat

SEQ ID NO: 250960 - DNA, 25 bp, Mus musculus
cctccgaatagcagcttcttcggct

SEQ ID NO: 250961 - DNA, 25 bp, Mus musculus
cctccgaatttatgttgaaaaacat

SEQ ID NO: 250962 - DNA, 25 bp, Mus musculus
cctccgaccaggagtcaaactgacc

SEQ ID NO: 250963 - DNA, 25 bp, Mus musculus
cctccgactgctctttgtcaccact

SEQ ID NO: 250964 - DNA, 25 bp, Mus musculus
cctccgactgggaggagaaggagct

SEQ ID NO: 250965 - DNA, 25 bp, Mus musculus
cctccgagaaccagagggcacatct

SEQ ID NO: 250966 - DNA, 25 bp, Mus musculus
cctccgagaaccagttgataaaatt

SEQ ID NO: 250967 - DNA, 25 bp, Mus musculus
cctccgagaagccccggcagcccaa

SEQ ID NO: 250968 - DNA, 25 bp, Mus musculus
cctccgagagaggtgccgttctctg

SEQ ID NO: 250969 - DNA, 25 bp, Mus musculus
cctccgagaggttggcctgcttggg

SEQ ID NO: 250970 - DNA, 25 bp, Mus musculus
cctccgaggacttcaccatccacga

SEQ ID NO: 250971 - DNA, 25 bp, Mus musculus
cctccgagtacatcaccaagctttt

SEQ ID NO: 250972 - DNA, 25 bp, Mus musculus
cctccgcaaaaggttcgaaccttct

SEQ ID NO: 250973 - DNA, 25 bp, Mus musculus
cctccgcaaaaggttggaagcaatc

SEQ ID NO: 250974 - DNA, 25 bp, Mus musculus
cctccgcaccaacgttttgaggact

SEQ ID NO: 250975 - DNA, 25 bp, Mus musculus
cctccgcaccacaggcaaatcctcc

SEQ ID NO: 250976 - DNA, 25 bp, Mus musculus
cctccgccatcgtaggtgccgatcc

SEQ ID NO: 250977 - DNA, 25 bp, Mus musculus
cctccgccatgacagatcagaccta

SEQ ID NO: 250978 - DNA, 25 bp, Mus musculus
cctccgccccagaaaaaggagaaga

SEQ ID NO: 250979 - DNA, 25 bp, Mus musculus
cctccgccgggagggttgatttctt

SEQ ID NO: 250980 - DNA, 25 bp, Mus musculus
cctccgccgggaggtcatggctgca

SEQ ID NO: 250981 - DNA, 25 bp, Mus musculus
cctccgcctcagatggcagtcaaaa

SEQ ID NO: 250982 - DNA, 25 bp, Mus musculus
cctccgcctcagtaccaaacgtcta

SEQ ID NO: 250983 - DNA, 25 bp, Mus musculus
cctccgcggagcaggctgccgacta

SEQ ID NO: 250984 - DNA, 25 bp, Mus musculus
cctccgcggagcagggtaaaggccg

SEQ ID NO: 250985 - DNA, 25 bp, Mus musculus
cctccgcggagcaggtctacaggct

SEQ ID NO: 250986 - DNA, 25 bp, Mus musculus
cctccgctcaggaacgagttcaagt

SEQ ID NO: 250987 - DNA, 25 bp, Mus musculus
cctccgctcaggtaaacagaatctg

SEQ ID NO: 250988 - DNA, 25 bp, Mus musculus
cctccgctcccactgcttcacacag

SEQ ID NO: 250989 - DNA, 25 bp, Mus musculus
cctccgctcccactggcatgctagt

SEQ ID NO: 250990 - DNA, 25 bp, Mus musculus
cctccgctgggtggtaaatgcagtc

SEQ ID NO: 250991 - DNA, 25 bp, Mus musculus
cctccgcttccgtgatgtgctaacg

SEQ ID NO: 250992 - DNA, 25 bp, Mus musculus
cctccggccaggcgagcagactacg

SEQ ID NO: 250993 - DNA, 25 bp, Mus musculus
cctccggccaggcgattaaatcccc

SEQ ID NO: 250994 - DNA, 25 bp, Mus musculus
cctccggcctcagggggctactccg

SEQ ID NO: 250995 - DNA, 25 bp, Mus musculus
cctccggcggaagcagtatccagca

SEQ ID NO: 250996 - DNA, 25 bp, Mus musculus
cctccggcggaaggtcatgttagcg

SEQ ID NO: 250997 - DNA, 25 bp, Mus musculus
cctccgggacactggacatcatcac

SEQ ID NO: 250998 - DNA, 25 bp, Mus musculus
cctccgggacactgggatcttcctt

SEQ ID NO: 250999 - DNA, 25 bp, Mus musculus
cctccgggccctgcaggaggacctg

SEQ ID NO: 251000 - DNA, 25 bp, Mus musculus
cctccgggctgtgagcacctcctcc

SEQ ID NO: 251001 - DNA, 25 bp, Mus musculus
cctccgggtaaagaggtgtatgcag

SEQ ID NO: 251002 - DNA, 25 bp, Mus musculus
cctccggtaaagtgacaaaacataa

SEQ ID NO: 251003 - DNA, 25 bp, Mus musculus
cctccggtgcccaggtctgggaacg

SEQ ID NO: 251004 - DNA, 25 bp, Mus musculus
cctccggttatggtacaaattctga

SEQ ID NO: 251005 - DNA, 25 bp, Mus musculus
cctccgtcaacactgaggccttcac

SEQ ID NO: 251006 - DNA, 25 bp, Mus musculus
cctccgtcagctgcagccgactccg

SEQ ID NO: 251007 - DNA, 25 bp, Mus musculus
cctccgtcatgacgcaacttcggca

SEQ ID NO: 251008 - DNA, 25 bp, Mus musculus
cctccgtcccccacacacctgctct

SEQ ID NO: 251009 - DNA, 25 bp, Mus musculus
cctccgtcgccatggctccagcacc

SEQ ID NO: 251010 - DNA, 25 bp, Mus musculus
cctccgtctttgcagtatggtggaa

SEQ ID NO: 251011 - DNA, 25 bp, Mus musculus
cctccgtgaaaaccaggcgactatc

SEQ ID NO: 251012 - DNA, 25 bp, Mus musculus
cctccgtgctgggggcagaatcctt

SEQ ID NO: 251013 - DNA, 25 bp, Mus musculus
cctccgtggagcgactatcctgggt

SEQ ID NO: 251014 - DNA, 25 bp, Mus musculus
cctccgtgtcctctgatgctgagga

SEQ ID NO: 251015 - DNA, 25 bp, Mus musculus
cctccgtgtcctctgcctgttccag

SEQ ID NO: 251016 - DNA, 25 bp, Mus musculus
cctcctaaagaacagagcctgggaa

SEQ ID NO: 251017 - DNA, 25 bp, Mus musculus
cctcctaaagccgagcgccagcgcc

SEQ ID NO: 251018 - DNA, 25 bp, Mus musculus
cctcctaacccagttccgcagagga

SEQ ID NO: 251019 - DNA, 25 bp, Mus musculus
cctcctaaggaagcacctcccttac

SEQ ID NO: 251020 - DNA, 25 bp, Mus musculus
cctcctaaggaaggctcagagaaat

SEQ ID NO: 251021 - DNA, 25 bp, Mus musculus
cctcctaaggaagggtacctggaat

SEQ ID NO: 251022 - DNA, 25 bp, Mus musculus
cctcctaatggtttctgtagctgga

SEQ ID NO: 251023 - DNA, 25 bp, Mus musculus
cctcctacagagtctcagcctactg

SEQ ID NO: 251024 - DNA, 25 bp, Mus musculus
cctcctactcttgtatgtcttcgtg

SEQ ID NO: 251025 - DNA, 25 bp, Mus musculus
cctcctatcattaagcaaagcacta

SEQ ID NO: 251026 - DNA, 25 bp, Mus musculus
cctcctattccagtatcattttgcc

SEQ ID NO: 251027 - DNA, 25 bp, Mus musculus
cctcctcaagagctttcatcatttg

SEQ ID NO: 251028 - DNA, 25 bp, Mus musculus
cctcctcaagctaaagaacgcttct

SEQ ID NO: 251029 - DNA, 25 bp, Mus musculus
cctcctcaaggttggctcaaaaaca

SEQ ID NO: 251030 - DNA, 25 bp, Mus musculus
cctcctcacacagatgccccactga

SEQ ID NO: 251031 - DNA, 25 bp, Mus musculus
cctcctcaccacagcttccactcag

SEQ ID NO: 251032 - DNA, 25 bp, Mus musculus
cctcctcacctagcaccatcggttt

SEQ ID NO: 251033 - DNA, 25 bp, Mus musculus
cctcctcagaaagcagtgccccctc

SEQ ID NO: 251034 - DNA, 25 bp, Mus musculus
cctcctcagccccctcccgccttcc

SEQ ID NO: 251035 - DNA, 25 bp, Mus musculus
cctcctcaggaagagggttcactga

SEQ ID NO: 251036 - DNA, 25 bp, Mus musculus
cctcctcagtggcaggcggtgtggc

SEQ ID NO: 251037 - DNA, 25 bp, Mus musculus
cctcctcagtggcagttgctgcgat

SEQ ID NO: 251038 - DNA, 25 bp, Mus musculus
cctcctccaacccgggaagcacagg

SEQ ID NO: 251039 - DNA, 25 bp, Mus musculus
cctcctccacggagcaggagcgaga

SEQ ID NO: 251040 - DNA, 25 bp, Mus musculus
cctcctccacggagcgagagggggg

SEQ ID NO: 251041 - DNA, 25 bp, Mus musculus
cctcctccagggagtgagtgctgct

SEQ ID NO: 251042 - DNA, 25 bp, Mus musculus
cctcctccatgaagcttcgtggatc

SEQ ID NO: 251043 - DNA, 25 bp, Mus musculus
cctcctcccaaagatactggcattg

SEQ ID NO: 251044 - DNA, 25 bp, Mus musculus
cctcctcccccaggcttcagcaccg

SEQ ID NO: 251045 - DNA, 25 bp, Mus musculus
cctcctccgagaattatatcagaat

SEQ ID NO: 251046 - DNA, 25 bp, Mus musculus
cctcctccgggaaggtagactgcct

SEQ ID NO: 251047 - DNA, 25 bp, Mus musculus
cctcctcctaccccatcccagcatc

SEQ ID NO: 251048 - DNA, 25 bp, Mus musculus
cctcctcctggcaatcccctggttg

SEQ ID NO: 251049 - DNA, 25 bp, Mus musculus
cctcctcctggcagtaagatcctac

SEQ ID NO: 251050 - DNA, 25 bp, Mus musculus
cctcctccttgggcccattgactcg

SEQ ID NO: 251051 - DNA, 25 bp, Mus musculus
cctcctcgaatgataatctggaggc

SEQ ID NO: 251052 - DNA, 25 bp, Mus musculus
cctcctcgaggctgtgtgactctgg

SEQ ID NO: 251053 - DNA, 25 bp, Mus musculus
cctcctcgcagcaggaagaagtagc

SEQ ID NO: 251054 - DNA, 25 bp, Mus musculus
cctcctcgcggcattggaggcggag

SEQ ID NO: 251055 - DNA, 25 bp, Mus musculus
cctcctcggcatcatgatgacccgg

SEQ ID NO: 251056 - DNA, 25 bp, Mus musculus
cctcctcggcctcacgtttgaagct

SEQ ID NO: 251057 - DNA, 25 bp, Mus musculus
cctcctcggcctcaggtttgaagct

SEQ ID NO: 251058 - DNA, 25 bp, Mus musculus
cctcctcgtcctagccatctgcatc

SEQ ID NO: 251059 - DNA, 25 bp, Mus musculus
cctcctcgtcctaggtattctcatg

SEQ ID NO: 251060 - DNA, 25 bp, Mus musculus
cctcctctgaactggatgccagtaa

SEQ ID NO: 251061 - DNA, 25 bp, Mus musculus
cctcctctgaactgtataaaatggt

SEQ ID NO: 251062 - DNA, 25 bp, Mus musculus
cctcctctgcagttgttgacctcct

SEQ ID NO: 251063 - DNA, 25 bp, Mus musculus
cctcctctggcccagaccgaagcca

SEQ ID NO: 251064 - DNA, 25 bp, Mus musculus
cctcctcttgtgatgaagctcaaca

SEQ ID NO: 251065 - DNA, 25 bp, Mus musculus
cctcctcttttctggacaagatggc

SEQ ID NO: 251066 - DNA, 25 bp, Mus musculus
cctcctgaacaaggtccaggacatc

SEQ ID NO: 251067 - DNA, 25 bp, Mus musculus
cctcctgaatgcagttggaatgcca

SEQ ID NO: 251068 - DNA, 25 bp, Mus musculus
cctcctgacccagaaacaacttgag

SEQ ID NO: 251069 - DNA, 25 bp, Mus musculus
cctcctgacccagccaaggcaggag

SEQ ID NO: 251070 - DNA, 25 bp, Mus musculus
cctcctgacctctagttgggatgaa

SEQ ID NO: 251071 - DNA, 25 bp, Mus musculus
cctcctgagaaaagggcagtcatgg

SEQ ID NO: 251072 - DNA, 25 bp, Mus musculus
cctcctgagaaacagtcatggaagt

SEQ ID NO: 251073 - DNA, 25 bp, Mus musculus
cctcctgagacagggttgtgagccc

SEQ ID NO: 251074 - DNA, 25 bp, Mus musculus
cctcctgatacaggagttccactcc

SEQ ID NO: 251075 - DNA, 25 bp, Mus musculus
cctcctgataggcaacatgtcggca

SEQ ID NO: 251076 - DNA, 25 bp, Mus musculus
cctcctgcaagcgttctgtcaacag

SEQ ID NO: 251077 - DNA, 25 bp, Mus musculus
cctcctgcaagtttctccaggagtg

SEQ ID NO: 251078 - DNA, 25 bp, Mus musculus
cctcctgccagacttggcagcctgg

SEQ ID NO: 251079 - DNA, 25 bp, Mus musculus
cctcctgccagaggccctgcccgcc

SEQ ID NO: 251080 - DNA, 25 bp, Mus musculus
cctcctgccaggccaaaagcaccta

SEQ ID NO: 251081 - DNA, 25 bp, Mus musculus
cctcctgccaggttttttccttgac

SEQ ID NO: 251082 - DNA, 25 bp, Mus musculus
cctcctgcccaggtttgcacaccct

SEQ ID NO: 251083 - DNA, 25 bp, Mus musculus
cctcctgcctcagtaaaggccaaaa

SEQ ID NO: 251084 - DNA, 25 bp, Mus musculus
cctcctgcctttgaggatgacatgc

SEQ ID NO: 251085 - DNA, 25 bp, Mus musculus
cctcctgctctggtggctccttgtg

SEQ ID NO: 251086 - DNA, 25 bp, Mus musculus
cctcctgctgccctggaatcttccg

SEQ ID NO: 251087 - DNA, 25 bp, Mus musculus
cctcctgctgccctggagcctcaaa

SEQ ID NO: 251088 - DNA, 25 bp, Mus musculus
cctcctgctggggtagacagcaaga

SEQ ID NO: 251089 - DNA, 25 bp, Mus musculus
cctcctggaactcaagttggtggga

SEQ ID NO: 251090 - DNA, 25 bp, Mus musculus
cctcctggaactcaagtttggacgt

SEQ ID NO: 251091 - DNA, 25 bp, Mus musculus
cctcctggaatgccgccatgactac

SEQ ID NO: 251092 - DNA, 25 bp, Mus musculus
cctcctggaggagttctcagagtac

SEQ ID NO: 251093 - DNA, 25 bp, Mus musculus
cctcctggatatatctattcttcca

SEQ ID NO: 251094 - DNA, 25 bp, Mus musculus
cctcctggcagcctggtgatcctgc

SEQ ID NO: 251095 - DNA, 25 bp, Mus musculus
cctcctggccaggtggccattgaag

SEQ ID NO: 251096 - DNA, 25 bp, Mus musculus
cctcctggccccaaggtggccattg

SEQ ID NO: 251097 - DNA, 25 bp, Mus musculus
cctcctggccctcagggacctgcag

SEQ ID NO: 251098 - DNA, 25 bp, Mus musculus
cctcctggctccagatgacctcatc

SEQ ID NO: 251099 - DNA, 25 bp, Mus musculus
cctcctggctccagcggacgcccgt

SEQ ID NO: 251100 - DNA, 25 bp, Mus musculus
cctcctggcttgccgggccctccag

SEQ ID NO: 251101 - DNA, 25 bp, Mus musculus
cctcctgggattctgtctcaaacca

SEQ ID NO: 251102 - DNA, 25 bp, Mus musculus
cctcctggggtacagattcccgtgg

SEQ ID NO: 251103 - DNA, 25 bp, Mus musculus
cctcctggtacagaggtatctacac

SEQ ID NO: 251104 - DNA, 25 bp, Mus musculus
cctcctggtaccagactctcatgga

SEQ ID NO: 251105 - DNA, 25 bp, Mus musculus
cctcctggtgctaatacaacctgtg

SEQ ID NO: 251106 - DNA, 25 bp, Mus musculus
cctcctggtgctaatcacagaactg

SEQ ID NO: 251107 - DNA, 25 bp, Mus musculus
cctcctggtgctaatgtctgtgcgt

SEQ ID NO: 251108 - DNA, 25 bp, Mus musculus
cctcctggttcggggccgtcgtgac

SEQ ID NO: 251109 - DNA, 25 bp, Mus musculus
cctcctggtttaggagatcccagcc

SEQ ID NO: 251110 - DNA, 25 bp, Mus musculus
cctcctgtagagagccatatacaga

SEQ ID NO: 251111 - DNA, 25 bp, Mus musculus
cctcctgtagaggtgaggcatgaaa

SEQ ID NO: 251112 - DNA, 25 bp, Mus musculus
cctcctgtagcgatgaagaaagagg

SEQ ID NO: 251113 - DNA, 25 bp, Mus musculus
cctcctgtccagcaaatctcccagc

SEQ ID NO: 251114 - DNA, 25 bp, Mus musculus
cctcctgtctgagcgggaggaagca

SEQ ID NO: 251115 - DNA, 25 bp, Mus musculus
cctcctgtctgagctctttcctgta

SEQ ID NO: 251116 - DNA, 25 bp, Mus musculus
cctcctgtctgagtggacgagcgaa

SEQ ID NO: 251117 - DNA, 25 bp, Mus musculus
cctcctgtgcccacaagcctcccct

SEQ ID NO: 251118 - DNA, 25 bp, Mus musculus
cctcctgtggcaagggagtcatcca

SEQ ID NO: 251119 - DNA, 25 bp, Mus musculus
cctcctgttccaggatggaggtaaa

SEQ ID NO: 251120 - DNA, 25 bp, Mus musculus
cctcctgttggtggtcatcaactcc

SEQ ID NO: 251121 - DNA, 25 bp, Mus musculus
cctccttaaagcctgcggagcccaa

SEQ ID NO: 251122 - DNA, 25 bp, Mus musculus
cctccttaagggtcttgagaccatc

SEQ ID NO: 251123 - DNA, 25 bp, Mus musculus
cctccttagcaaggtcaacaacagt

SEQ ID NO: 251124 - DNA, 25 bp, Mus musculus
cctccttatggcaggtgctgacctg

SEQ ID NO: 251125 - DNA, 25 bp, Mus musculus
cctccttcagatgacggattccacc

SEQ ID NO: 251126 - DNA, 25 bp, Mus musculus
cctccttcagctgataatactagaa

SEQ ID NO: 251127 - DNA, 25 bp, Mus musculus
cctccttcaggcctcaggcttgggg

SEQ ID NO: 251128 - DNA, 25 bp, Mus musculus
cctccttccaccctcatgctagtgg

SEQ ID NO: 251129 - DNA, 25 bp, Mus musculus
cctccttcctggcattggaggcgga

SEQ ID NO: 251130 - DNA, 25 bp, Mus musculus
cctccttccttcagaagagttcgct

SEQ ID NO: 251131 - DNA, 25 bp, Mus musculus
cctccttgactctcggtgtcctcca

SEQ ID NO: 251132 - DNA, 25 bp, Mus musculus
cctccttgaggcagctggaagctgg

SEQ ID NO: 251133 - DNA, 25 bp, Mus musculus
cctccttgcatgagacacacaacct

SEQ ID NO: 251134 - DNA, 25 bp, Mus musculus
cctccttggacagatgaaaaagaga

SEQ ID NO: 251135 - DNA, 25 bp, Mus musculus
cctccttggacagtaattttatgaa

SEQ ID NO: 251136 - DNA, 25 bp, Mus musculus
cctccttggctggcagcacagactc

SEQ ID NO: 251137 - DNA, 25 bp, Mus musculus
cctccttggctgggaaaatgaccca

SEQ ID NO: 251138 - DNA, 25 bp, Mus musculus
cctccttggctgggggaagaacagt

SEQ ID NO: 251139 - DNA, 25 bp, Mus musculus
cctccttgtcaagtggtgtgggcat

SEQ ID NO: 251140 - DNA, 25 bp, Mus musculus
cctccttgtctgtcttcatctcgga

SEQ ID NO: 251141 - DNA, 25 bp, Mus musculus
cctccttgtctgttgcggggccaca

SEQ ID NO: 251142 - DNA, 25 bp, Mus musculus
cctcctttcaggatgctgtgcgcac

SEQ ID NO: 251143 - DNA, 25 bp, Mus musculus
cctcctttcgcttcaagcacaaatg

SEQ ID NO: 251144 - DNA, 25 bp, Mus musculus
cctcctttggtggccgtgcctgcag

SEQ ID NO: 251145 - DNA, 25 bp, Mus musculus
cctcgaaacagaggcgctccagcgg

SEQ ID NO: 251146 - DNA, 25 bp, Mus musculus
cctcgaaacagggtcacgtctctgg

SEQ ID NO: 251147 - DNA, 25 bp, Mus musculus
cctcgaaacatgagcatgcccacaa

SEQ ID NO: 251148 - DNA, 25 bp, Mus musculus
cctcgaaatctgacagatttcatca

SEQ ID NO: 251149 - DNA, 25 bp, Mus musculus
cctcgaaatctgactcagagcaacc

SEQ ID NO: 251150 - DNA, 25 bp, Mus musculus
cctcgaacacctatgtgcccttccc

SEQ ID NO: 251151 - DNA, 25 bp, Mus musculus
cctcgaacacctgagccagcccgca

SEQ ID NO: 251152 - DNA, 25 bp, Mus musculus
cctcgaagctagggtcccaaaggcc

SEQ ID NO: 251153 - DNA, 25 bp, Mus musculus
cctcgaagttcaatatgctcccaag

SEQ ID NO: 251154 - DNA, 25 bp, Mus musculus
cctcgaatacgaaaatggatcgaac

SEQ ID NO: 251155 - DNA, 25 bp, Mus musculus
cctcgaatgacacccatgaaccgca

SEQ ID NO: 251156 - DNA, 25 bp, Mus musculus
cctcgacagcctgatgggggatgag

SEQ ID NO: 251157 - DNA, 25 bp, Mus musculus
cctcgacagcctgattggagatagc

SEQ ID NO: 251158 - DNA, 25 bp, Mus musculus
cctcgaccagagagaagcaaccatt

SEQ ID NO: 251159 - DNA, 25 bp, Mus musculus
cctcgaccagctgcttaaaggatag

SEQ ID NO: 251160 - DNA, 25 bp, Mus musculus
cctcgacctggaggatgtttcttgc

SEQ ID NO: 251161 - DNA, 25 bp, Mus musculus
cctcgacgcagcaggtcttctatca

SEQ ID NO: 251162 - DNA, 25 bp, Mus musculus
cctcgactccgcatatttcagactt

SEQ ID NO: 251163 - DNA, 25 bp, Mus musculus
cctcgactccgcattggaactggaa

SEQ ID NO: 251164 - DNA, 25 bp, Mus musculus
cctcgacttagaatattagaagtgg

SEQ ID NO: 251165 - DNA, 25 bp, Mus musculus
cctcgacttaggagcaggctgccct

SEQ ID NO: 251166 - DNA, 25 bp, Mus musculus
cctcgacttagtgcggctgtgtgga

SEQ ID NO: 251167 - DNA, 25 bp, Mus musculus
cctcgagaaattcgggccaatggtg

SEQ ID NO: 251168 - DNA, 25 bp, Mus musculus
cctcgaggacaagatgctcatgagc

SEQ ID NO: 251169 - DNA, 25 bp, Mus musculus
cctcgaggatgaagaaagaagcatc

SEQ ID NO: 251170 - DNA, 25 bp, Mus musculus
cctcgatcaactcaataaagccgtt

SEQ ID NO: 251171 - DNA, 25 bp, Mus musculus
cctcgatcaactcagccggctcaac

SEQ ID NO: 251172 - DNA, 25 bp, Mus musculus
cctcgatgccctggtcgtgtgcccc

SEQ ID NO: 251173 - DNA, 25 bp, Mus musculus
cctcgatgtcgttgaacggtcacca

SEQ ID NO: 251174 - DNA, 25 bp, Mus musculus
cctcgcaaagagttataccctgact

SEQ ID NO: 251175 - DNA, 25 bp, Mus musculus
cctcgcaaattacgtccacagcaaa

SEQ ID NO: 251176 - DNA, 25 bp, Mus musculus
cctcgcaccggaagaaaagatgtgg

SEQ ID NO: 251177 - DNA, 25 bp, Mus musculus
cctcgcagcaggaagaagtagctaa

SEQ ID NO: 251178 - DNA, 25 bp, Mus musculus
cctcgcatatactaggtcctgtggg

SEQ ID NO: 251179 - DNA, 25 bp, Mus musculus
cctcgcattccggatgattgtaaag

SEQ ID NO: 251180 - DNA, 25 bp, Mus musculus
cctcgccaagagttcctccagcaga

SEQ ID NO: 251181 - DNA, 25 bp, Mus musculus
cctcgccaaggtatgtggaccgagt

SEQ ID NO: 251182 - DNA, 25 bp, Mus musculus
cctcgccaccagtcaactcctagta

SEQ ID NO: 251183 - DNA, 25 bp, Mus musculus
cctcgccaccagtgctgaggatcaa

SEQ ID NO: 251184 - DNA, 25 bp, Mus musculus
cctcgccaccagttaaaaagtatgg

SEQ ID NO: 251185 - DNA, 25 bp, Mus musculus
cctcgccacggcccagttcaatttg

SEQ ID NO: 251186 - DNA, 25 bp, Mus musculus
cctcgccatgaagaagcccattgga

SEQ ID NO: 251187 - DNA, 25 bp, Mus musculus
cctcgccccaggcactgggctccct

SEQ ID NO: 251188 - DNA, 25 bp, Mus musculus
cctcgcccccagagattaatgtggc

SEQ ID NO: 251189 - DNA, 25 bp, Mus musculus
cctcgcccccagaggtgtcgtggag

SEQ ID NO: 251190 - DNA, 25 bp, Mus musculus
cctcgcccgactatctctcacctat

SEQ ID NO: 251191 - DNA, 25 bp, Mus musculus
cctcgccctctcaagctcagccttt

SEQ ID NO: 251192 - DNA, 25 bp, Mus musculus
cctcgccgagcagaacatgccgggg

SEQ ID NO: 251193 - DNA, 25 bp, Mus musculus
cctcgccgagcagcctgtagtgaaa

SEQ ID NO: 251194 - DNA, 25 bp, Mus musculus
cctcgccgccctccccactgcgtct

SEQ ID NO: 251195 - DNA, 25 bp, Mus musculus
cctcgccgcctcgatgagcagctct

SEQ ID NO: 251196 - DNA, 25 bp, Mus musculus
cctcgccgcgcagactgggaagagt

SEQ ID NO: 251197 - DNA, 25 bp, Mus musculus
cctcgccgcgcaggatctaccaagg

SEQ ID NO: 251198 - DNA, 25 bp, Mus musculus
cctcgccgtctggggcctcatttca

SEQ ID NO: 251199 - DNA, 25 bp, Mus musculus
cctcgcctgtgaactcatcagcacc

SEQ ID NO: 251200 - DNA, 25 bp, Mus musculus
cctcgccttccaagagttttcttgg

SEQ ID NO: 251201 - DNA, 25 bp, Mus musculus
cctcgcctttggtaccacgtacaca

SEQ ID NO: 251202 - DNA, 25 bp, Mus musculus
cctcgcgcagcatgaaagatgtatt

SEQ ID NO: 251203 - DNA, 25 bp, Mus musculus
cctcgcgcagcatgtcaaagaaaag

SEQ ID NO: 251204 - DNA, 25 bp, Mus musculus
cctcgcggcttgactaaaatgtcaa

SEQ ID NO: 251205 - DNA, 25 bp, Mus musculus
cctcgcggggcaggtgtccatgttg

SEQ ID NO: 251206 - DNA, 25 bp, Mus musculus
cctcgcggtttgctggaaaggaagc

SEQ ID NO: 251207 - DNA, 25 bp, Mus musculus
cctcgcggtttgctggtacacactg

SEQ ID NO: 251208 - DNA, 25 bp, Mus musculus
cctcgcgtcgctccgaaatcatgtc

SEQ ID NO: 251209 - DNA, 25 bp, Mus musculus
cctcgctacgataggaaacagatgg

SEQ ID NO: 251210 - DNA, 25 bp, Mus musculus
cctcgctacgataggaacacatcaa

SEQ ID NO: 251211 - DNA, 25 bp, Mus musculus
cctcgctacgatagtggttccatgt

SEQ ID NO: 251212 - DNA, 25 bp, Mus musculus
cctcgctcaaaggagaaaggatcct

SEQ ID NO: 251213 - DNA, 25 bp, Mus musculus
cctcgctcaaaggtcgatccttcgg

SEQ ID NO: 251214 - DNA, 25 bp, Mus musculus
cctcgctcctccctcgagaggagct

SEQ ID NO: 251215 - DNA, 25 bp, Mus musculus
cctcgctgacccagcggcgaggacg

SEQ ID NO: 251216 - DNA, 25 bp, Mus musculus
cctcgctggccagtatgtggccttt

SEQ ID NO: 251217 - DNA, 25 bp, Mus musculus
cctcgctgggatcgctttagaatgt

SEQ ID NO: 251218 - DNA, 25 bp, Mus musculus
cctcgctgggatcggtttttgtgaa

SEQ ID NO: 251219 - DNA, 25 bp, Mus musculus
cctcgctgggatcgtttgtttatat

SEQ ID NO: 251220 - DNA, 25 bp, Mus musculus
cctcgctgggcagatcttccttggg

SEQ ID NO: 251221 - DNA, 25 bp, Mus musculus
cctcgctggtggctggaggggtagc

SEQ ID NO: 251222 - DNA, 25 bp, Mus musculus
cctcgctgtgttggacttccttgtg

SEQ ID NO: 251223 - DNA, 25 bp, Mus musculus
cctcgcttctaaggtggtggcctac

SEQ ID NO: 251224 - DNA, 25 bp, Mus musculus
cctcgcttttgagcttggcaaatgg

SEQ ID NO: 251225 - DNA, 25 bp, Mus musculus
cctcgcttttgagtgacagccctgc

SEQ ID NO: 251226 - DNA, 25 bp, Mus musculus
cctcggaaaccatcgagcgtttgga

SEQ ID NO: 251227 - DNA, 25 bp, Mus musculus
cctcggaagcagagatggctatgaa

SEQ ID NO: 251228 - DNA, 25 bp, Mus musculus
cctcggaccatcagccttggggagt

SEQ ID NO: 251229 - DNA, 25 bp, Mus musculus
cctcggagaaaggccagccatgtga

SEQ ID NO: 251230 - DNA, 25 bp, Mus musculus
cctcggagacgcggctcctgtgcgg

SEQ ID NO: 251231 - DNA, 25 bp, Mus musculus
cctcggagagacctccattgctgag

SEQ ID NO: 251232 - DNA, 25 bp, Mus musculus
cctcggagagcagaggtgtggagaa

SEQ ID NO: 251233 - DNA, 25 bp, Mus musculus
cctcggagcagagcgatcagcagct

SEQ ID NO: 251234 - DNA, 25 bp, Mus musculus
cctcggagcgaccgggtcatgtagg

SEQ ID NO: 251235 - DNA, 25 bp, Mus musculus
cctcggagctgctgctggctttgaa

SEQ ID NO: 251236 - DNA, 25 bp, Mus musculus
cctcggagtttgatccattttttag

SEQ ID NO: 251237 - DNA, 25 bp, Mus musculus
cctcggatcggagaaacgcttcgtt

SEQ ID NO: 251238 - DNA, 25 bp, Mus musculus
cctcggcaacaagacgctgccgtcc

SEQ ID NO: 251239 - DNA, 25 bp, Mus musculus
cctcggcaatcagtttggagattct

SEQ ID NO: 251240 - DNA, 25 bp, Mus musculus
cctcggcacctgcagactctgcaga

SEQ ID NO: 251241 - DNA, 25 bp, Mus musculus
cctcggcacctgcagcctgctcccc

SEQ ID NO: 251242 - DNA, 25 bp, Mus musculus
cctcggcatcatgatgacccggaga

SEQ ID NO: 251243 - DNA, 25 bp, Mus musculus
cctcggcatgttcgtgtggacaaat

SEQ ID NO: 251244 - DNA, 25 bp, Mus musculus
cctcggccagaagccaccccagtga

SEQ ID NO: 251245 - DNA, 25 bp, Mus musculus
cctcggccagaagctgaaccttatt

SEQ ID NO: 251246 - DNA, 25 bp, Mus musculus
cctcggccagaagttgcaagttgtt

SEQ ID NO: 251247 - DNA, 25 bp, Mus musculus
cctcggcccagcacagccccccagc

SEQ ID NO: 251248 - DNA, 25 bp, Mus musculus
cctcggccgtggtaagggaacaatt

SEQ ID NO: 251249 - DNA, 25 bp, Mus musculus
cctcggcctcagctttgaagctggc

SEQ ID NO: 251250 - DNA, 25 bp, Mus musculus
cctcggcctcaggaaattccttcac

SEQ ID NO: 251251 - DNA, 25 bp, Mus musculus
cctcggcctcaggtttgaagctggc

SEQ ID NO: 251252 - DNA, 25 bp, Mus musculus
cctcggcctcagtagagtgatgcct

SEQ ID NO: 251253 - DNA, 25 bp, Mus musculus
cctcggcctggcacatgccctggtg

SEQ ID NO: 251254 - DNA, 25 bp, Mus musculus
cctcggcctggtcaccgaagtgaat

SEQ ID NO: 251255 - DNA, 25 bp, Mus musculus
cctcggcgcggatgtggttagaacc

SEQ ID NO: 251256 - DNA, 25 bp, Mus musculus
cctcggcgcgggaactggcatcaaa

SEQ ID NO: 251257 - DNA, 25 bp, Mus musculus
cctcggcgcgggtgaacaccatgtc

SEQ ID NO: 251258 - DNA, 25 bp, Mus musculus
cctcggcgcgggtgagccctatttc

SEQ ID NO: 251259 - DNA, 25 bp, Mus musculus
cctcggcgggcatggcccctgcacc

SEQ ID NO: 251260 - DNA, 25 bp, Mus musculus
cctcggcgtacaggagaatgactca

SEQ ID NO: 251261 - DNA, 25 bp, Mus musculus
cctcggctcacagatggctgccagc

SEQ ID NO: 251262 - DNA, 25 bp, Mus musculus
cctcggctcacaggcagaagacttt

SEQ ID NO: 251263 - DNA, 25 bp, Mus musculus
cctcggctcacgcgccctcccgccg

SEQ ID NO: 251264 - DNA, 25 bp, Mus musculus
cctcggctgcccgggcctgactacc

SEQ ID NO: 251265 - DNA, 25 bp, Mus musculus
cctcggctgtagagagtcagtcgtt

SEQ ID NO: 251266 - DNA, 25 bp, Mus musculus
cctcgggaaacatacccagagaaat

SEQ ID NO: 251267 - DNA, 25 bp, Mus musculus
cctcgggaaacatcacagaagtacc

SEQ ID NO: 251268 - DNA, 25 bp, Mus musculus
cctcgggagagaaattttaagcggc

SEQ ID NO: 251269 - DNA, 25 bp, Mus musculus
cctcgggagcaggtttcaacactaa

SEQ ID NO: 251270 - DNA, 25 bp, Mus musculus
cctcgggcctgaagccggtcgacaa

SEQ ID NO: 251271 - DNA, 25 bp, Mus musculus
cctcgggcggcggagagttgtctgc

SEQ ID NO: 251272 - DNA, 25 bp, Mus musculus
cctcgggctccactctcgctcacag

SEQ ID NO: 251273 - DNA, 25 bp, Mus musculus
cctcggggcagaaaatatctgcaga

SEQ ID NO: 251274 - DNA, 25 bp, Mus musculus
cctcggggcagatcgtaatgtaaat

SEQ ID NO: 251275 - DNA, 25 bp, Mus musculus
cctcggggcagggatgccctggacc

SEQ ID NO: 251276 - DNA, 25 bp, Mus musculus
cctcgggggactggcaatgtttgcc

SEQ ID NO: 251277 - DNA, 25 bp, Mus musculus
cctcgggggactggccatgtttgcc

SEQ ID NO: 251278 - DNA, 25 bp, Mus musculus
cctcgggtctccagacacagtttct

SEQ ID NO: 251279 - DNA, 25 bp, Mus musculus
cctcgggtctccaggacacagccca

SEQ ID NO: 251280 - DNA, 25 bp, Mus musculus
cctcgggtctccaggtgtcctatct

SEQ ID NO: 251281 - DNA, 25 bp, Mus musculus
cctcgggtctgaggaacagtctgag

SEQ ID NO: 251282 - DNA, 25 bp, Mus musculus
cctcggtacatgcaggtgcatattt

SEQ ID NO: 251283 - DNA, 25 bp, Mus musculus
cctcggtcagtcaacacagtgttca

SEQ ID NO: 251284 - DNA, 25 bp, Mus musculus
cctcggtctctcagaaaacatctcg

SEQ ID NO: 251285 - DNA, 25 bp, Mus musculus
cctcggtgacagaacaaatcagttg

SEQ ID NO: 251286 - DNA, 25 bp, Mus musculus
cctcggtgacaggtttggggcctta

SEQ ID NO: 251287 - DNA, 25 bp, Mus musculus
cctcggtgactctgtgaacctacac

SEQ ID NO: 251288 - DNA, 25 bp, Mus musculus
cctcggtgcaggctatctatgtgcc

SEQ ID NO: 251289 - DNA, 25 bp, Mus musculus
cctcggtgctggcgccggagtactg

SEQ ID NO: 251290 - DNA, 25 bp, Mus musculus
cctcgtaagcatcagggaaacctca

SEQ ID NO: 251291 - DNA, 25 bp, Mus musculus
cctcgtactcagaaacgaaagctgc

SEQ ID NO: 251292 - DNA, 25 bp, Mus musculus
cctcgtccagcagcaaagccgaccc

SEQ ID NO: 251293 - DNA, 25 bp, Mus musculus
cctcgtcctagccatctgcatcatc

SEQ ID NO: 251294 - DNA, 25 bp, Mus musculus
cctcgtcctaggtattctcatggga

SEQ ID NO: 251295 - DNA, 25 bp, Mus musculus
cctcgtcctcctcttcttctaatgg

SEQ ID NO: 251296 - DNA, 25 bp, Mus musculus
cctcgtccttgagagatgccaaagg

SEQ ID NO: 251297 - DNA, 25 bp, Mus musculus
cctcgtctatcagtcttgtctgtat

SEQ ID NO: 251298 - DNA, 25 bp, Mus musculus
cctcgtctgctccacttccacccct

SEQ ID NO: 251299 - DNA, 25 bp, Mus musculus
cctcgtgagagctgcttcagctgac

SEQ ID NO: 251300 - DNA, 25 bp, Mus musculus
cctcgtgagagggtttctctgtgta

SEQ ID NO: 251301 - DNA, 25 bp, Mus musculus
cctcgtgatcaggaagaaaagcaac

SEQ ID NO: 251302 - DNA, 25 bp, Mus musculus
cctcgtgatcaggaggaatctgaga

SEQ ID NO: 251303 - DNA, 25 bp, Mus musculus
cctcgtgatcagtagcaagattgac

SEQ ID NO: 251304 - DNA, 25 bp, Mus musculus
cctcgtgtataactaagaatgtctt

SEQ ID NO: 251305 - DNA, 25 bp, Mus musculus
cctcgtgtctttggctaattctggc

SEQ ID NO: 251306 - DNA, 25 bp, Mus musculus
cctcgtgtctttgtaaagtcgggca

SEQ ID NO: 251307 - DNA, 25 bp, Mus musculus
cctcgtgtgcggattcctttgtttc

SEQ ID NO: 251308 - DNA, 25 bp, Mus musculus
cctcgtgtgcggtgcacgatctgat

SEQ ID NO: 251309 - DNA, 25 bp, Mus musculus
cctcgtgtttgaccttgttaccgga

SEQ ID NO: 251310 - DNA, 25 bp, Mus musculus
cctcgttaggatcgcaccagagtat

SEQ ID NO: 251311 - DNA, 25 bp, Mus musculus
cctcgttcactccaatgatggcact

SEQ ID NO: 251312 - DNA, 25 bp, Mus musculus
cctcgttcctcaagatggccgactc

SEQ ID NO: 251313 - DNA, 25 bp, Mus musculus
cctcgttctctgaaccttcagctgc

SEQ ID NO: 251314 - DNA, 25 bp, Mus musculus
cctcgttgcccagatcctgtgggcc

SEQ ID NO: 251315 - DNA, 25 bp, Mus musculus
cctcgttggagtgacatcgtcttta

SEQ ID NO: 251316 - DNA, 25 bp, Mus musculus
cctctaaaaacccacaactccttga

SEQ ID NO: 251317 - DNA, 25 bp, Mus musculus
cctctaaaaagaggttgtggatgtg

SEQ ID NO: 251318 - DNA, 25 bp, Mus musculus
cctctaaaagaagcgtgcaatcacc

SEQ ID NO: 251319 - DNA, 25 bp, Mus musculus
cctctaaaagcttcctgcagtagcc

SEQ ID NO: 251320 - DNA, 25 bp, Mus musculus
cctctaaaaggcaacaactctacat

SEQ ID NO: 251321 - DNA, 25 bp, Mus musculus
cctctaaaagggccgcgcctgcgca

SEQ ID NO: 251322 - DNA, 25 bp, Mus musculus
cctctaaaatggtgcacctccgctc

SEQ ID NO: 251323 - DNA, 25 bp, Mus musculus
cctctaaacaagacgggccgcattg

SEQ ID NO: 251324 - DNA, 25 bp, Mus musculus
cctctaaagaccggaaagcactgcc

SEQ ID NO: 251325 - DNA, 25 bp, Mus musculus
cctctaacaccgcaagccccgccca

SEQ ID NO: 251326 - DNA, 25 bp, Mus musculus
cctctaacatcacagattgctgaaa

SEQ ID NO: 251327 - DNA, 25 bp, Mus musculus
cctctaaccagatggactatccatc

SEQ ID NO: 251328 - DNA, 25 bp, Mus musculus
cctctaacctgcatcccagcctatg

SEQ ID NO: 251329 - DNA, 25 bp, Mus musculus
cctctaagcaggtaaacgagttgta

SEQ ID NO: 251330 - DNA, 25 bp, Mus musculus
cctctaagcaggtttctaccccagg

SEQ ID NO: 251331 - DNA, 25 bp, Mus musculus
cctctaagcttacaggagtgccagg

SEQ ID NO: 251332 - DNA, 25 bp, Mus musculus
cctctaagtgacaagaaaatgacaa

SEQ ID NO: 251333 - DNA, 25 bp, Mus musculus
cctctaagtgacaagaatatagaac

SEQ ID NO: 251334 - DNA, 25 bp, Mus musculus
cctctaattaagctgtctcctaaga

SEQ ID NO: 251335 - DNA, 25 bp, Mus musculus
cctctacaagacaatgttctattgc

SEQ ID NO: 251336 - DNA, 25 bp, Mus musculus
cctctacaagactgtgtacagtgct

SEQ ID NO: 251337 - DNA, 25 bp, Mus musculus
cctctacaagtgacatcttgaaagc

SEQ ID NO: 251338 - DNA, 25 bp, Mus musculus
cctctacaatgggcacctgggttag

SEQ ID NO: 251339 - DNA, 25 bp, Mus musculus
cctctacagaacaggtgggcactct

SEQ ID NO: 251340 - DNA, 25 bp, Mus musculus
cctctacagaacagtctatacaacc

SEQ ID NO: 251341 - DNA, 25 bp, Mus musculus
cctctacagcaatgggatacggaca

SEQ ID NO: 251342 - DNA, 25 bp, Mus musculus
cctctacagcctgggctgcgccttc

SEQ ID NO: 251343 - DNA, 25 bp, Mus musculus
cctctacatgggtaaaaagcaagat

SEQ ID NO: 251344 - DNA, 25 bp, Mus musculus
cctctaccagcagaacagcacagcc

SEQ ID NO: 251345 - DNA, 25 bp, Mus musculus
cctctaccagcagacccaatggaac

SEQ ID NO: 251346 - DNA, 25 bp, Mus musculus
cctctaccagcaggcttccccacca

SEQ ID NO: 251347 - DNA, 25 bp, Mus musculus
cctctaccccctgctgaatgaggcc

SEQ ID NO: 251348 - DNA, 25 bp, Mus musculus
cctctaccctcaaccagcaagcctg

SEQ ID NO: 251349 - DNA, 25 bp, Mus musculus
cctctaccggacacacctgctctca

SEQ ID NO: 251350 - DNA, 25 bp, Mus musculus
cctctacctcagggccccgccgtca

SEQ ID NO: 251351 - DNA, 25 bp, Mus musculus
cctctactcaatagtcaaggaggtt

SEQ ID NO: 251352 - DNA, 25 bp, Mus musculus
cctctactcagttcctcatttgact

SEQ ID NO: 251353 - DNA, 25 bp, Mus musculus
cctctactccaggatggaggcctcc

SEQ ID NO: 251354 - DNA, 25 bp, Mus musculus
cctctactccgccattttcctgctg

SEQ ID NO: 251355 - DNA, 25 bp, Mus musculus
cctctactcctaagtccccaggtgc

SEQ ID NO: 251356 - DNA, 25 bp, Mus musculus
cctctactcctaatgtgaaaaactc

SEQ ID NO: 251357 - DNA, 25 bp, Mus musculus
cctctactgccacagtggttccgga

SEQ ID NO: 251358 - DNA, 25 bp, Mus musculus
cctctactgtcccggtgtgccagcc

SEQ ID NO: 251359 - DNA, 25 bp, Mus musculus
cctctagaacagatgcaaaatcgta

SEQ ID NO: 251360 - DNA, 25 bp, Mus musculus
cctctagaacaggagagcctgacaa

SEQ ID NO: 251361 - DNA, 25 bp, Mus musculus
cctctagaagagcagtcgggtgctc

SEQ ID NO: 251362 - DNA, 25 bp, Mus musculus
cctctagaagcgaaggaatacacag

SEQ ID NO: 251363 - DNA, 25 bp, Mus musculus
cctctagacacctttctctcccttc

SEQ ID NO: 251364 - DNA, 25 bp, Mus musculus
cctctagcaacaaggaatcaaaaat

SEQ ID NO: 251365 - DNA, 25 bp, Mus musculus
cctctagctgactggtgagcaccga

SEQ ID NO: 251366 - DNA, 25 bp, Mus musculus
cctctaggaaggtatggcctcacaa

SEQ ID NO: 251367 - DNA, 25 bp, Mus musculus
cctctaggagaacttaggcttcttt

SEQ ID NO: 251368 - DNA, 25 bp, Mus musculus
cctctataaagcattgaggccaagc

SEQ ID NO: 251369 - DNA, 25 bp, Mus musculus
cctctataaaggactgattgtgaat

SEQ ID NO: 251370 - DNA, 25 bp, Mus musculus
cctctataaagtctttcctgtactc

SEQ ID NO: 251371 - DNA, 25 bp, Mus musculus
cctctataaggagggtcactccaaa

SEQ ID NO: 251372 - DNA, 25 bp, Mus musculus
cctctataattagcacagagaatga

SEQ ID NO: 251373 - DNA, 25 bp, Mus musculus
cctctataccagactttgtacctat

SEQ ID NO: 251374 - DNA, 25 bp, Mus musculus
cctctatcagcaggaatccagccat

SEQ ID NO: 251375 - DNA, 25 bp, Mus musculus
cctctatccaagggaaggaaaatac

SEQ ID NO: 251376 - DNA, 25 bp, Mus musculus
cctctatcccacagatggtatggtg

SEQ ID NO: 251377 - DNA, 25 bp, Mus musculus
cctctatccctcttggaggaaccac

SEQ ID NO: 251378 - DNA, 25 bp, Mus musculus
cctctatctcaccagttgtgtgaat

SEQ ID NO: 251379 - DNA, 25 bp, Mus musculus
cctctatctgagaaaacaggtctta

SEQ ID NO: 251380 - DNA, 25 bp, Mus musculus
cctctatctggggactgcctccaga

SEQ ID NO: 251381 - DNA, 25 bp, Mus musculus
cctctatctgggttggacctcgagg

SEQ ID NO: 251382 - DNA, 25 bp, Mus musculus
cctctatgcttccggcatcgtgttg

SEQ ID NO: 251383 - DNA, 25 bp, Mus musculus
cctctatggcggaacctaaggaagg

SEQ ID NO: 251384 - DNA, 25 bp, Mus musculus
cctctatggcggatcctgtctctac

SEQ ID NO: 251385 - DNA, 25 bp, Mus musculus
cctctatgggtcgcgggtctactct

SEQ ID NO: 251386 - DNA, 25 bp, Mus musculus
cctctatgggtcggttccgggagcg

SEQ ID NO: 251387 - DNA, 25 bp, Mus musculus
cctctatgtaactgtcaccgtttct

SEQ ID NO: 251388 - DNA, 25 bp, Mus musculus
cctctatttaagaagagaaggtggc

SEQ ID NO: 251389 - DNA, 25 bp, Mus musculus
cctctatttaagaagatgaaaccag

SEQ ID NO: 251390 - DNA, 25 bp, Mus musculus
cctctatttcgccatgagctacaac

SEQ ID NO: 251391 - DNA, 25 bp, Mus musculus
cctctcaaaggacagtgaacttttg

SEQ ID NO: 251392 - DNA, 25 bp, Mus musculus
cctctcaaagggacagccagcccct

SEQ ID NO: 251393 - DNA, 25 bp, Mus musculus
cctctcaaaggtttattttatttat

SEQ ID NO: 251394 - DNA, 25 bp, Mus musculus
cctctcaaccctggctgcactgctg

SEQ ID NO: 251395 - DNA, 25 bp, Mus musculus
cctctcaacctctcttcaggcccag

SEQ ID NO: 251396 - DNA, 25 bp, Mus musculus
cctctcaacctgtctgcaaacagca

SEQ ID NO: 251397 - DNA, 25 bp, Mus musculus
cctctcaacgattcccacgcctacc

SEQ ID NO: 251398 - DNA, 25 bp, Mus musculus
cctctcaactggctgatgcttgact

SEQ ID NO: 251399 - DNA, 25 bp, Mus musculus
cctctcaactggtgtggtgtggatg

SEQ ID NO: 251400 - DNA, 25 bp, Mus musculus
cctctcaagaaagatgcgccaggag

SEQ ID NO: 251401 - DNA, 25 bp, Mus musculus
cctctcaagaaaggacagatcgtta

SEQ ID NO: 251402 - DNA, 25 bp, Mus musculus
cctctcaagcctgcggacttgactg

SEQ ID NO: 251403 - DNA, 25 bp, Mus musculus
cctctcaatgaattcctggaggaga

SEQ ID NO: 251404 - DNA, 25 bp, Mus musculus
cctctcaatgggtgttcaggataaa

SEQ ID NO: 251405 - DNA, 25 bp, Mus musculus
cctctcacagaatacatccagccag

SEQ ID NO: 251406 - DNA, 25 bp, Mus musculus
cctctcacagacagctcagctcttt

SEQ ID NO: 251407 - DNA, 25 bp, Mus musculus
cctctcacagatgaatcagcagatg

SEQ ID NO: 251408 - DNA, 25 bp, Mus musculus
cctctcacagtgatagaatgcctga

SEQ ID NO: 251409 - DNA, 25 bp, Mus musculus
cctctcacagtgatgagaattttaa

SEQ ID NO: 251410 - DNA, 25 bp, Mus musculus
cctctcaccgctcggctctgggtgc

SEQ ID NO: 251411 - DNA, 25 bp, Mus musculus
cctctcaccgctcgggcctgtgctc

SEQ ID NO: 251412 - DNA, 25 bp, Mus musculus
cctctcactgggtcttctgggtagg

SEQ ID NO: 251413 - DNA, 25 bp, Mus musculus
cctctcagaagacaaaagagagcat

SEQ ID NO: 251414 - DNA, 25 bp, Mus musculus
cctctcagaagcatcactatttcat

SEQ ID NO: 251415 - DNA, 25 bp, Mus musculus
cctctcagagataaaatcaaagaca

SEQ ID NO: 251416 - DNA, 25 bp, Mus musculus
cctctcaggccgcctctagacgtcc

SEQ ID NO: 251417 - DNA, 25 bp, Mus musculus
cctctcaggccgggttcgagtgagc

SEQ ID NO: 251418 - DNA, 25 bp, Mus musculus
cctctcaggccggtgacgctgactg

SEQ ID NO: 251419 - DNA, 25 bp, Mus musculus
cctctcagtgcaagacagtattgga

SEQ ID NO: 251420 - DNA, 25 bp, Mus musculus
cctctcagtgcaagtcatggggacc

SEQ ID NO: 251421 - DNA, 25 bp, Mus musculus
cctctcagtggccccagggcccgga

SEQ ID NO: 251422 - DNA, 25 bp, Mus musculus
cctctcatctacttccccctttccc

SEQ ID NO: 251423 - DNA, 25 bp, Mus musculus
cctctcatctccgacttcttcgcca

SEQ ID NO: 251424 - DNA, 25 bp, Mus musculus
cctctcattgtgcaggcggctctcc

SEQ ID NO: 251425 - DNA, 25 bp, Mus musculus
cctctcattgtgcagttctgtgcca

SEQ ID NO: 251426 - DNA, 25 bp, Mus musculus
cctctccaaccaaggcatcctcgga

SEQ ID NO: 251427 - DNA, 25 bp, Mus musculus
cctctccaaccaaggtatcatgttt

SEQ ID NO: 251428 - DNA, 25 bp, Mus musculus
cctctccaaggtggcccagctgccc

SEQ ID NO: 251429 - DNA, 25 bp, Mus musculus
cctctccaagtatgtaggaggagta

SEQ ID NO: 251430 - DNA, 25 bp, Mus musculus
cctctccacgtgctttagctctgga

SEQ ID NO: 251431 - DNA, 25 bp, Mus musculus
cctctccagaacaaagtctgttcaa

SEQ ID NO: 251432 - DNA, 25 bp, Mus musculus
cctctccagcccggttttgaggaaa

SEQ ID NO: 251433 - DNA, 25 bp, Mus musculus
cctctccaggatgttctgaggagga

SEQ ID NO: 251434 - DNA, 25 bp, Mus musculus
cctctccagggccctgacgtcaaga

SEQ ID NO: 251435 - DNA, 25 bp, Mus musculus
cctctccattgtagggatgtttctt

SEQ ID NO: 251436 - DNA, 25 bp, Mus musculus
cctctcccaatcctgtgatagtcct

SEQ ID NO: 251437 - DNA, 25 bp, Mus musculus
cctctcccaccatcccaaatttatt

SEQ ID NO: 251438 - DNA, 25 bp, Mus musculus
cctctcccaccatgaaacaaaagga

SEQ ID NO: 251439 - DNA, 25 bp, Mus musculus
cctctcccagattataagtttccag

SEQ ID NO: 251440 - DNA, 25 bp, Mus musculus
cctctcccagattatgcacaggacc

SEQ ID NO: 251441 - DNA, 25 bp, Mus musculus
cctctcccagctccctggctgagcc

SEQ ID NO: 251442 - DNA, 25 bp, Mus musculus
cctctcccaggtgtgtgacgggaag

SEQ ID NO: 251443 - DNA, 25 bp, Mus musculus
cctctcccggagaggtgtcgcggaa

SEQ ID NO: 251444 - DNA, 25 bp, Mus musculus
cctctccgacatcacccatgctgga

SEQ ID NO: 251445 - DNA, 25 bp, Mus musculus
cctctccgcgcacagcattagcaga

SEQ ID NO: 251446 - DNA, 25 bp, Mus musculus
cctctccggctggatgagcctgccc

SEQ ID NO: 251447 - DNA, 25 bp, Mus musculus
cctctccgtacagatcttcgtccct

SEQ ID NO: 251448 - DNA, 25 bp, Mus musculus
cctctccgtacagcgccatggctac

SEQ ID NO: 251449 - DNA, 25 bp, Mus musculus
cctctcctctatgctcctttcctgg

SEQ ID NO: 251450 - DNA, 25 bp, Mus musculus
cctctcctctatggctcagcactgc

SEQ ID NO: 251451 - DNA, 25 bp, Mus musculus
cctctcctgaaagcgctgagaagca

SEQ ID NO: 251452 - DNA, 25 bp, Mus musculus
cctctcctgaagtaggtgtaattat

SEQ ID NO: 251453 - DNA, 25 bp, Mus musculus
cctctcctggagtgtctgtgaggat

SEQ ID NO: 251454 - DNA, 25 bp, Mus musculus
cctctcctgggcctctgatacctct

SEQ ID NO: 251455 - DNA, 25 bp, Mus musculus
cctctcctggttacggtcatttggt

SEQ ID NO: 251456 - DNA, 25 bp, Mus musculus
cctctcctgtcctgagctttcccga

SEQ ID NO: 251457 - DNA, 25 bp, Mus musculus
cctctcctgtcgcagcctcggcctg

SEQ ID NO: 251458 - DNA, 25 bp, Mus musculus
cctctccttttaaagatcagccaga

SEQ ID NO: 251459 - DNA, 25 bp, Mus musculus
cctctcgcagagttcgaggaggggt

SEQ ID NO: 251460 - DNA, 25 bp, Mus musculus
cctctcggacaggagagtgaagtgt

SEQ ID NO: 251461 - DNA, 25 bp, Mus musculus
cctctcgggacggagatactactcg

SEQ ID NO: 251462 - DNA, 25 bp, Mus musculus
cctctcgggacgggccctggtggtg

SEQ ID NO: 251463 - DNA, 25 bp, Mus musculus
cctctcgggacggttcaatgtatct

SEQ ID NO: 251464 - DNA, 25 bp, Mus musculus
cctctcggggctgctcttctcgggg

SEQ ID NO: 251465 - DNA, 25 bp, Mus musculus
cctctcgtcagatgtcgtcaccgtc

SEQ ID NO: 251466 - DNA, 25 bp, Mus musculus
cctctcgtcaggactgcaagaggct

SEQ ID NO: 251467 - DNA, 25 bp, Mus musculus
cctctctatgctgtggtttgccact

SEQ ID NO: 251468 - DNA, 25 bp, Mus musculus
cctctctcaggaatttgaagcctat

SEQ ID NO: 251469 - DNA, 25 bp, Mus musculus
cctctctcatgctagttcagcaatc

SEQ ID NO: 251470 - DNA, 25 bp, Mus musculus
cctctctctaccctcctgctgactg

SEQ ID NO: 251471 - DNA, 25 bp, Mus musculus
cctctctctggaccctactttcagg

SEQ ID NO: 251472 - DNA, 25 bp, Mus musculus
cctctctgaagaagtcttagggaaa

SEQ ID NO: 251473 - DNA, 25 bp, Mus musculus
cctctctgactcagattccaccata

SEQ ID NO: 251474 - DNA, 25 bp, Mus musculus
cctctctgagcagtggtagtgtgaa

SEQ ID NO: 251475 - DNA, 25 bp, Mus musculus
cctctctgatattagggaggtgccc

SEQ ID NO: 251476 - DNA, 25 bp, Mus musculus
cctctctgcattctgggagcctagg

SEQ ID NO: 251477 - DNA, 25 bp, Mus musculus
cctctctgcccactcagccagttgt

SEQ ID NO: 251478 - DNA, 25 bp, Mus musculus
cctctctgcctgtttttgagccacg

SEQ ID NO: 251479 - DNA, 25 bp, Mus musculus
cctctctgctcaggaagaacgttgg

SEQ ID NO: 251480 - DNA, 25 bp, Mus musculus
cctctctgctgcggtcatgtaggaa

SEQ ID NO: 251481 - DNA, 25 bp, Mus musculus
cctctctgcttgaggaagaagctca

SEQ ID NO: 251482 - DNA, 25 bp, Mus musculus
cctctctggcagaatccatgcgacg

SEQ ID NO: 251483 - DNA, 25 bp, Mus musculus
cctctctggcagcgaaattggaaca

SEQ ID NO: 251484 - DNA, 25 bp, Mus musculus
cctctctgtgcagcacgatggcctg

SEQ ID NO: 251485 - DNA, 25 bp, Mus musculus
cctctctgtgcgcggcaatacagag

SEQ ID NO: 251486 - DNA, 25 bp, Mus musculus
cctctcttaccagtctccactcagc

SEQ ID NO: 251487 - DNA, 25 bp, Mus musculus
cctctcttagactatcccccgaatc

SEQ ID NO: 251488 - DNA, 25 bp, Mus musculus
cctctcttcagctacctcagcttta

SEQ ID NO: 251489 - DNA, 25 bp, Mus musculus
cctctcttggtcaaactacaactcc

SEQ ID NO: 251490 - DNA, 25 bp, Mus musculus
cctctctttcctcgttgtttttgtt

SEQ ID NO: 251491 - DNA, 25 bp, Mus musculus
cctctctttgccaaggtgaacgtga

SEQ ID NO: 251492 - DNA, 25 bp, Mus musculus
cctctgaaacccgctgtacgctgga

SEQ ID NO: 251493 - DNA, 25 bp, Mus musculus
cctctgaaacccggtagtgcaactt

SEQ ID NO: 251494 - DNA, 25 bp, Mus musculus
cctctgaaactataattttattccc

SEQ ID NO: 251495 - DNA, 25 bp, Mus musculus
cctctgaaactgaactttctaagct

SEQ ID NO: 251496 - DNA, 25 bp, Mus musculus
cctctgaaactgtagcttctttgtt

SEQ ID NO: 251497 - DNA, 25 bp, Mus musculus
cctctgaaactgtgccgatcccctt

SEQ ID NO: 251498 - DNA, 25 bp, Mus musculus
cctctgaacctaacacagaagaatc

SEQ ID NO: 251499 - DNA, 25 bp, Mus musculus
cctctgaacctacactttcctgagc

SEQ ID NO: 251500 - DNA, 25 bp, Mus musculus
cctctgaacctagtgctacaataac

SEQ ID NO: 251501 - DNA, 25 bp, Mus musculus
cctctgaacctataattttattccc

SEQ ID NO: 251502 - DNA, 25 bp, Mus musculus
cctctgaacctatactttggcaaaa

SEQ ID NO: 251503 - DNA, 25 bp, Mus musculus
cctctgaacctcatagttttgggaa

SEQ ID NO: 251504 - DNA, 25 bp, Mus musculus
cctctgaacctccaccactggtcca

SEQ ID NO: 251505 - DNA, 25 bp, Mus musculus
cctctgaacctctccttcttctacg

SEQ ID NO: 251506 - DNA, 25 bp, Mus musculus
cctctgaacctgacagagatttcct

SEQ ID NO: 251507 - DNA, 25 bp, Mus musculus
cctctgaacctgacccagaagctgg

SEQ ID NO: 251508 - DNA, 25 bp, Mus musculus
cctctgaacctgccgaattcgagga

SEQ ID NO: 251509 - DNA, 25 bp, Mus musculus
cctctgaacctgctccgcccccacg

SEQ ID NO: 251510 - DNA, 25 bp, Mus musculus
cctctgaacctgtggatattgtcct

SEQ ID NO: 251511 - DNA, 25 bp, Mus musculus
cctctgaactatgcctgtgtcttga

SEQ ID NO: 251512 - DNA, 25 bp, Mus musculus
cctctgaactcagactactcgctgc

SEQ ID NO: 251513 - DNA, 25 bp, Mus musculus
cctctgaactggaaatcccacctgg

SEQ ID NO: 251514 - DNA, 25 bp, Mus musculus
cctctgaactggatgccagtaaagc

SEQ ID NO: 251515 - DNA, 25 bp, Mus musculus
cctctgaactgtataaaatggttta

SEQ ID NO: 251516 - DNA, 25 bp, Mus musculus
cctctgaacttgtggcagggctgag

SEQ ID NO: 251517 - DNA, 25 bp, Mus musculus
cctctgaatgtcaagccccgcccaa

SEQ ID NO: 251518 - DNA, 25 bp, Mus musculus
cctctgacaaacagttgctcagaca

SEQ ID NO: 251519 - DNA, 25 bp, Mus musculus
cctctgacacacagggagaaaatcc

SEQ ID NO: 251520 - DNA, 25 bp, Mus musculus
cctctgacagtctcatctttggact

SEQ ID NO: 251521 - DNA, 25 bp, Mus musculus
cctctgacagtgaagaaaatgctga

SEQ ID NO: 251522 - DNA, 25 bp, Mus musculus
cctctgacagtggtgggtgtgtgca

SEQ ID NO: 251523 - DNA, 25 bp, Mus musculus
cctctgacccactcttggaactgaa

SEQ ID NO: 251524 - DNA, 25 bp, Mus musculus
cctctgacctaccagggtacgagcc

SEQ ID NO: 251525 - DNA, 25 bp, Mus musculus
cctctgacctccagaaaggtgctgg

SEQ ID NO: 251526 - DNA, 25 bp, Mus musculus
cctctgacggggcatatctgctgtt

SEQ ID NO: 251527 - DNA, 25 bp, Mus musculus
cctctgactacccgtgatacttaaa

SEQ ID NO: 251528 - DNA, 25 bp, Mus musculus
cctctgactgaaccttatcaagcac

SEQ ID NO: 251529 - DNA, 25 bp, Mus musculus
cctctgactgtccctggccacatct

SEQ ID NO: 251530 - DNA, 25 bp, Mus musculus
cctctgagaagagatggcgtcagac

SEQ ID NO: 251531 - DNA, 25 bp, Mus musculus
cctctgagaaggagcgcagaccctg

SEQ ID NO: 251532 - DNA, 25 bp, Mus musculus
cctctgagaaggtctgcgaatggaa

SEQ ID NO: 251533 - DNA, 25 bp, Mus musculus
cctctgagagaagacccatgcttgt

SEQ ID NO: 251534 - DNA, 25 bp, Mus musculus
cctctgagagatggatttataactt

SEQ ID NO: 251535 - DNA, 25 bp, Mus musculus
cctctgagagctcccaggaggcaaa

SEQ ID NO: 251536 - DNA, 25 bp, Mus musculus
cctctgagaggacagccctgactcc

SEQ ID NO: 251537 - DNA, 25 bp, Mus musculus
cctctgagaggacaggcattgttat

SEQ ID NO: 251538 - DNA, 25 bp, Mus musculus
cctctgagcccctccccccgccatg

SEQ ID NO: 251539 - DNA, 25 bp, Mus musculus
cctctgagctgcaagataagcagac

SEQ ID NO: 251540 - DNA, 25 bp, Mus musculus
cctctgagctgcaaggaactcatta

SEQ ID NO: 251541 - DNA, 25 bp, Mus musculus
cctctgaggacagaacttatttgtc

SEQ ID NO: 251542 - DNA, 25 bp, Mus musculus
cctctgaggaggcccactgagtgtt

SEQ ID NO: 251543 - DNA, 25 bp, Mus musculus
cctctgaggctgcaggtgccctacg

SEQ ID NO: 251544 - DNA, 25 bp, Mus musculus
cctctgaggggcaccatgtactggt

SEQ ID NO: 251545 - DNA, 25 bp, Mus musculus
cctctgagtccaaccaagtttattg

SEQ ID NO: 251546 - DNA, 25 bp, Mus musculus
cctctgataaaggcaactgttggat

SEQ ID NO: 251547 - DNA, 25 bp, Mus musculus
cctctgatcttggggagtgggaggt

SEQ ID NO: 251548 - DNA, 25 bp, Mus musculus
cctctgatgaactgaatccaaatcc

SEQ ID NO: 251549 - DNA, 25 bp, Mus musculus
cctctgatgaccacggctccttcac

SEQ ID NO: 251550 - DNA, 25 bp, Mus musculus
cctctgatgctggctggggacatct

SEQ ID NO: 251551 - DNA, 25 bp, Mus musculus
cctctgatgggagagcaagccctca

SEQ ID NO: 251552 - DNA, 25 bp, Mus musculus
cctctgatgggagaggctttgaaga

SEQ ID NO: 251553 - DNA, 25 bp, Mus musculus
cctctgattgcagttccaactacct

SEQ ID NO: 251554 - DNA, 25 bp, Mus musculus
cctctgatttagatcttgaaccaga

SEQ ID NO: 251555 - DNA, 25 bp, Mus musculus
cctctgcaaaagattcacagtctcc

SEQ ID NO: 251556 - DNA, 25 bp, Mus musculus
cctctgcaaaagcaatgtcttcaat

SEQ ID NO: 251557 - DNA, 25 bp, Mus musculus
cctctgcaaatggcgaaagtcctag

SEQ ID NO: 251558 - DNA, 25 bp, Mus musculus
cctctgcaaggtttgtctgggcacc

SEQ ID NO: 251559 - DNA, 25 bp, Mus musculus
cctctgcaatcgaggtcatgcttct

SEQ ID NO: 251560 - DNA, 25 bp, Mus musculus
cctctgcacgaagatctgttagcaa

SEQ ID NO: 251561 - DNA, 25 bp, Mus musculus
cctctgcactgctctcaggagaagt

SEQ ID NO: 251562 - DNA, 25 bp, Mus musculus
cctctgcagacacagggctctgctc

SEQ ID NO: 251563 - DNA, 25 bp, Mus musculus
cctctgcagcttgcactgaggccaa

SEQ ID NO: 251564 - DNA, 25 bp, Mus musculus
cctctgcagtgtatgtggctcatct

SEQ ID NO: 251565 - DNA, 25 bp, Mus musculus
cctctgcatcgcggggtggcgggac

SEQ ID NO: 251566 - DNA, 25 bp, Mus musculus
cctctgcatgccccagagtggccat

SEQ ID NO: 251567 - DNA, 25 bp, Mus musculus
cctctgcatgccgcagagtggccat

SEQ ID NO: 251568 - DNA, 25 bp, Mus musculus
cctctgccagagcacaagagaccag

SEQ ID NO: 251569 - DNA, 25 bp, Mus musculus
cctctgcccacagagagcccagacg

SEQ ID NO: 251570 - DNA, 25 bp, Mus musculus
cctctgcccaccaggcttggaaggg

SEQ ID NO: 251571 - DNA, 25 bp, Mus musculus
cctctgccccaaaggcattcgatgg

SEQ ID NO: 251572 - DNA, 25 bp, Mus musculus
cctctgccccaaagttccccagctc

SEQ ID NO: 251573 - DNA, 25 bp, Mus musculus
cctctgccccccaattattaagaaa

SEQ ID NO: 251574 - DNA, 25 bp, Mus musculus
cctctgccctgaaggctggataatc

SEQ ID NO: 251575 - DNA, 25 bp, Mus musculus
cctctgccctgctataacggaggca

SEQ ID NO: 251576 - DNA, 25 bp, Mus musculus
cctctgccgcccgagcagttgcccc

SEQ ID NO: 251577 - DNA, 25 bp, Mus musculus
cctctgcctgctccggctcctgctc

SEQ ID NO: 251578 - DNA, 25 bp, Mus musculus
cctctgccttcctggattcaccggc

SEQ ID NO: 251579 - DNA, 25 bp, Mus musculus
cctctgcgaaccaaacacactgggt

SEQ ID NO: 251580 - DNA, 25 bp, Mus musculus
cctctgcgaaccaactgccagggga

SEQ ID NO: 251581 - DNA, 25 bp, Mus musculus
cctctgcgaagatggaatgaaacct

SEQ ID NO: 251582 - DNA, 25 bp, Mus musculus
cctctgcgcagacaggtgtcagctg

SEQ ID NO: 251583 - DNA, 25 bp, Mus musculus
cctctgcgcccccagccactggccc

SEQ ID NO: 251584 - DNA, 25 bp, Mus musculus
cctctgcggcccggctagttcattg

SEQ ID NO: 251585 - DNA, 25 bp, Mus musculus
cctctgcgtacagatgtggagattg

SEQ ID NO: 251586 - DNA, 25 bp, Mus musculus
cctctgctaatagttcctgcacgac

SEQ ID NO: 251587 - DNA, 25 bp, Mus musculus
cctctgctaatatggatgcaaagac

SEQ ID NO: 251588 - DNA, 25 bp, Mus musculus
cctctgctacaaggctttcttctgt

SEQ ID NO: 251589 - DNA, 25 bp, Mus musculus
cctctgctacaagtgactacttccg

SEQ ID NO: 251590 - DNA, 25 bp, Mus musculus
cctctgctaccttcaagatgctgtc

SEQ ID NO: 251591 - DNA, 25 bp, Mus musculus
cctctgctcagcagccactctctac

SEQ ID NO: 251592 - DNA, 25 bp, Mus musculus
cctctgctcagcagggataactctc

SEQ ID NO: 251593 - DNA, 25 bp, Mus musculus
cctctgctcagcctgaaggacttct

SEQ ID NO: 251594 - DNA, 25 bp, Mus musculus
cctctgctccgaggtctccaaaaat

SEQ ID NO: 251595 - DNA, 25 bp, Mus musculus
cctctgctcttccaggtgacagtca

SEQ ID NO: 251596 - DNA, 25 bp, Mus musculus
cctctgctcttccagtgggaaacat

SEQ ID NO: 251597 - DNA, 25 bp, Mus musculus
cctctgctgaaggtgtccatcatac

SEQ ID NO: 251598 - DNA, 25 bp, Mus musculus
cctctgctgaccaagcccactcccc

SEQ ID NO: 251599 - DNA, 25 bp, Mus musculus
cctctgctgtctgtgaacaaatcta

SEQ ID NO: 251600 - DNA, 25 bp, Mus musculus
cctctgctgtctgtgcagtactcca

SEQ ID NO: 251601 - DNA, 25 bp, Mus musculus
cctctgctgtgctgaaatggaggcg

SEQ ID NO: 251602 - DNA, 25 bp, Mus musculus
cctctgctgttcagccagggacagt

SEQ ID NO: 251603 - DNA, 25 bp, Mus musculus
cctctgcttgtaaggcatctcagaa

SEQ ID NO: 251604 - DNA, 25 bp, Mus musculus
cctctggaaacagaaaggacttcat

SEQ ID NO: 251605 - DNA, 25 bp, Mus musculus
cctctggaaagacccccctttgtgt

SEQ ID NO: 251606 - DNA, 25 bp, Mus musculus
cctctggaaagccccggcagcccaa

SEQ ID NO: 251607 - DNA, 25 bp, Mus musculus
cctctggaagagaacctgtggacaa

SEQ ID NO: 251608 - DNA, 25 bp, Mus musculus
cctctggaagcagcagccgcagcct

SEQ ID NO: 251609 - DNA, 25 bp, Mus musculus
cctctggaagggagagacgacatgc

SEQ ID NO: 251610 - DNA, 25 bp, Mus musculus
cctctggaaggggcgtatgatcctg

SEQ ID NO: 251611 - DNA, 25 bp, Mus musculus
cctctggaagtgccgaattcgagga

SEQ ID NO: 251612 - DNA, 25 bp, Mus musculus
cctctggacagcggaggctgctgaa

SEQ ID NO: 251613 - DNA, 25 bp, Mus musculus
cctctggactatggctggcagaggg

SEQ ID NO: 251614 - DNA, 25 bp, Mus musculus
cctctggagaccggtggaggatctg

SEQ ID NO: 251615 - DNA, 25 bp, Mus musculus
cctctggagatccaggcttccgtgg

SEQ ID NO: 251616 - DNA, 25 bp, Mus musculus
cctctggagccgattcaaaaggtga

SEQ ID NO: 251617 - DNA, 25 bp, Mus musculus
cctctggagtcgagctcctggggcc

SEQ ID NO: 251618 - DNA, 25 bp, Mus musculus
cctctggagtcgatgaggatccaga

SEQ ID NO: 251619 - DNA, 25 bp, Mus musculus
cctctggatcagaattaaaatgctc

SEQ ID NO: 251620 - DNA, 25 bp, Mus musculus
cctctggatcagatctccatgatca

SEQ ID NO: 251621 - DNA, 25 bp, Mus musculus
cctctggatcagattgattatgtgt

SEQ ID NO: 251622 - DNA, 25 bp, Mus musculus
cctctggatcaggctgctccactac

SEQ ID NO: 251623 - DNA, 25 bp, Mus musculus
cctctggatcagggtttgaggagta

SEQ ID NO: 251624 - DNA, 25 bp, Mus musculus
cctctggatgaacaacactttcatg

SEQ ID NO: 251625 - DNA, 25 bp, Mus musculus
cctctggatggagagggccctggat

SEQ ID NO: 251626 - DNA, 25 bp, Mus musculus
cctctggatgtcgtcacgctggccg

SEQ ID NO: 251627 - DNA, 25 bp, Mus musculus
cctctggatgtgtcttcggagcctc

SEQ ID NO: 251628 - DNA, 25 bp, Mus musculus
cctctggatgttgaacagcgtcacg

SEQ ID NO: 251629 - DNA, 25 bp, Mus musculus
cctctggatttatcactttttaatt

SEQ ID NO: 251630 - DNA, 25 bp, Mus musculus
cctctggcaaaatgcgtgcccacac

SEQ ID NO: 251631 - DNA, 25 bp, Mus musculus
cctctggcactactggcctgcccaa

SEQ ID NO: 251632 - DNA, 25 bp, Mus musculus
cctctggcagaaggttctctctctt

SEQ ID NO: 251633 - DNA, 25 bp, Mus musculus
cctctggcagagcctgccccagttc

SEQ ID NO: 251634 - DNA, 25 bp, Mus musculus
cctctggcatccaggtgcgctacct

SEQ ID NO: 251635 - DNA, 25 bp, Mus musculus
cctctggcatgaacctctcaggagc

SEQ ID NO: 251636 - DNA, 25 bp, Mus musculus
cctctggccagacagtctgctaggg

SEQ ID NO: 251637 - DNA, 25 bp, Mus musculus
cctctggccaggcagttattcagaa

SEQ ID NO: 251638 - DNA, 25 bp, Mus musculus
cctctggcccagaccgaagccagga

SEQ ID NO: 251639 - DNA, 25 bp, Mus musculus
cctctggccctggggatgtgacaag

SEQ ID NO: 251640 - DNA, 25 bp, Mus musculus
cctctggcctcaggtaaccatggag

SEQ ID NO: 251641 - DNA, 25 bp, Mus musculus
cctctggcgggatggactcctgtca

SEQ ID NO: 251642 - DNA, 25 bp, Mus musculus
cctctggcggggctgcagtatggcg

SEQ ID NO: 251643 - DNA, 25 bp, Mus musculus
cctctggctcatacatgtctcagag

SEQ ID NO: 251644 - DNA, 25 bp, Mus musculus
cctctggctctgaatttctcttctt

SEQ ID NO: 251645 - DNA, 25 bp, Mus musculus
cctctggctctgacagcgacgaacc

SEQ ID NO: 251646 - DNA, 25 bp, Mus musculus
cctctgggaaaagggtcaatgctag

SEQ ID NO: 251647 - DNA, 25 bp, Mus musculus
cctctgggaaaggtattctctaaga

SEQ ID NO: 251648 - DNA, 25 bp, Mus musculus
cctctgggagccagcagaggcctcc

SEQ ID NO: 251649 - DNA, 25 bp, Mus musculus
cctctgggagcccacagagagtcaa

SEQ ID NO: 251650 - DNA, 25 bp, Mus musculus
cctctgggaggacactgtgtgggtg

SEQ ID NO: 251651 - DNA, 25 bp, Mus musculus
cctctgggagtttgtcctgggcact

SEQ ID NO: 251652 - DNA, 25 bp, Mus musculus
cctctggggagaaaacaccagctac

SEQ ID NO: 251653 - DNA, 25 bp, Mus musculus
cctctggggctacaggtggccttgc

SEQ ID NO: 251654 - DNA, 25 bp, Mus musculus
cctctgggtgtccagacgctgcggc

SEQ ID NO: 251655 - DNA, 25 bp, Mus musculus
cctctggtatatcgaactcgcactt

SEQ ID NO: 251656 - DNA, 25 bp, Mus musculus
cctctggtatatcgttgtgcagact

SEQ ID NO: 251657 - DNA, 25 bp, Mus musculus
cctctggtcagtcaatcccatggga

SEQ ID NO: 251658 - DNA, 25 bp, Mus musculus
cctctgtaaagtgatggctgcagca

SEQ ID NO: 251659 - DNA, 25 bp, Mus musculus
cctctgtacacgtccggatagcttc

SEQ ID NO: 251660 - DNA, 25 bp, Mus musculus
cctctgtaccagttgctgtgattgg

SEQ ID NO: 251661 - DNA, 25 bp, Mus musculus
cctctgtcaagggggtgtcgtttga

SEQ ID NO: 251662 - DNA, 25 bp, Mus musculus
cctctgtcaagttaacactcacgat

SEQ ID NO: 251663 - DNA, 25 bp, Mus musculus
cctctgtcacatgggaccatctggg

SEQ ID NO: 251664 - DNA, 25 bp, Mus musculus
cctctgtcactgtcacgttcatgaa

SEQ ID NO: 251665 - DNA, 25 bp, Mus musculus
cctctgtcagatgatgatcattttt

SEQ ID NO: 251666 - DNA, 25 bp, Mus musculus
cctctgtccaccattccaaggaaca

SEQ ID NO: 251667 - DNA, 25 bp, Mus musculus
cctctgtccccagggaacagactgc

SEQ ID NO: 251668 - DNA, 25 bp, Mus musculus
cctctgtcccccaggtttcacgggg

SEQ ID NO: 251669 - DNA, 25 bp, Mus musculus
cctctgtcctcataccagaatctgg

SEQ ID NO: 251670 - DNA, 25 bp, Mus musculus
cctctgtctacccttatgagctacc

SEQ ID NO: 251671 - DNA, 25 bp, Mus musculus
cctctgtctgggcggcaatctgctc

SEQ ID NO: 251672 - DNA, 25 bp, Mus musculus
cctctgtcttaaaggccgttgatgc

SEQ ID NO: 251673 - DNA, 25 bp, Mus musculus
cctctgtcttaaaggtatctcattc

SEQ ID NO: 251674 - DNA, 25 bp, Mus musculus
cctctgtgaagctgtttgttcagga

SEQ ID NO: 251675 - DNA, 25 bp, Mus musculus
cctctgtgaaggcaatggtgctcca

SEQ ID NO: 251676 - DNA, 25 bp, Mus musculus
cctctgtgaaggtcacagtaatgaa

SEQ ID NO: 251677 - DNA, 25 bp, Mus musculus
cctctgtgacctgtataatggttac

SEQ ID NO: 251678 - DNA, 25 bp, Mus musculus
cctctgtgaccttggtctgccttga

SEQ ID NO: 251679 - DNA, 25 bp, Mus musculus
cctctgtgagctagagaagatccag

SEQ ID NO: 251680 - DNA, 25 bp, Mus musculus
cctctgtgagctaggaaccggagtg

SEQ ID NO: 251681 - DNA, 25 bp, Mus musculus
cctctgtgaggtttttcaagacaga

SEQ ID NO: 251682 - DNA, 25 bp, Mus musculus
cctctgtgcaatgaaggtaaccgag

SEQ ID NO: 251683 - DNA, 25 bp, Mus musculus
cctctgtgcccataggttacaacca

SEQ ID NO: 251684 - DNA, 25 bp, Mus musculus
cctctgtgccgaacatctcatcatt

SEQ ID NO: 251685 - DNA, 25 bp, Mus musculus
cctctgtgccgcccccagaggaact

SEQ ID NO: 251686 - DNA, 25 bp, Mus musculus
cctctgtgcctctctgtgagcaaag

SEQ ID NO: 251687 - DNA, 25 bp, Mus musculus
cctctgtgctacagatgtcacagcc

SEQ ID NO: 251688 - DNA, 25 bp, Mus musculus
cctctgtgctacagattacaccttt

SEQ ID NO: 251689 - DNA, 25 bp, Mus musculus
cctctgtggaaagcagatgagaaat

SEQ ID NO: 251690 - DNA, 25 bp, Mus musculus
cctctgtggacggaatcttggagag

SEQ ID NO: 251691 - DNA, 25 bp, Mus musculus
cctctgtggaggaaatcctgaagaa

SEQ ID NO: 251692 - DNA, 25 bp, Mus musculus
cctctgtggatgaggtcactacttc

SEQ ID NO: 251693 - DNA, 25 bp, Mus musculus
cctctgtggtaacatggccaaccta

SEQ ID NO: 251694 - DNA, 25 bp, Mus musculus
cctctgtggttgagctagaaaatta

SEQ ID NO: 251695 - DNA, 25 bp, Mus musculus
cctctgtgtctcactaatgctcata

SEQ ID NO: 251696 - DNA, 25 bp, Mus musculus
cctctgtgtctcgtttaaaaagctt

SEQ ID NO: 251697 - DNA, 25 bp, Mus musculus
cctctgtgtggagaaatctgacgtt

SEQ ID NO: 251698 - DNA, 25 bp, Mus musculus
cctctgtgtggatgccttcaaagga

SEQ ID NO: 251699 - DNA, 25 bp, Mus musculus
cctctgtgtgggtactatcttggcc

SEQ ID NO: 251700 - DNA, 25 bp, Mus musculus
cctctgttaccgtaaagccttgggg

SEQ ID NO: 251701 - DNA, 25 bp, Mus musculus
cctctgtttcccagaccaggtcgac

SEQ ID NO: 251702 - DNA, 25 bp, Mus musculus
cctctgtttcccagggtcccaaagg

SEQ ID NO: 251703 - DNA, 25 bp, Mus musculus
cctctgtttctgtgaggaccttgag

SEQ ID NO: 251704 - DNA, 25 bp, Mus musculus
cctctgtttcttggaggatctggag

SEQ ID NO: 251705 - DNA, 25 bp, Mus musculus
cctcttaaagaaaaatcaagaactc

SEQ ID NO: 251706 - DNA, 25 bp, Mus musculus
cctcttaagggagatcgccacgact

SEQ ID NO: 251707 - DNA, 25 bp, Mus musculus
cctcttacttaaggaactcagagaa

SEQ ID NO: 251708 - DNA, 25 bp, Mus musculus
cctcttagcagaaatctagatcttg

SEQ ID NO: 251709 - DNA, 25 bp, Mus musculus
cctcttagccatgaaacactctctg

SEQ ID NO: 251710 - DNA, 25 bp, Mus musculus
cctcttatgaaggtctacggcttga

SEQ ID NO: 251711 - DNA, 25 bp, Mus musculus
cctcttatgacagctggaacgcttt

SEQ ID NO: 251712 - DNA, 25 bp, Mus musculus
cctcttatgacaggtggctgtctgc

SEQ ID NO: 251713 - DNA, 25 bp, Mus musculus
cctcttatgtcctcagagagtattg

SEQ ID NO: 251714 - DNA, 25 bp, Mus musculus
cctcttcaacaggttctactcagtt

SEQ ID NO: 251715 - DNA, 25 bp, Mus musculus
cctcttcaactctgtagtgaatgtg

SEQ ID NO: 251716 - DNA, 25 bp, Mus musculus
cctcttcaagccctctccaggccat

SEQ ID NO: 251717 - DNA, 25 bp, Mus musculus
cctcttcaatgaggggaagcgcttg

SEQ ID NO: 251718 - DNA, 25 bp, Mus musculus
cctcttcacaattacgctcgatttg

SEQ ID NO: 251719 - DNA, 25 bp, Mus musculus
cctcttcacccggaggtttcagaaa

SEQ ID NO: 251720 - DNA, 25 bp, Mus musculus
cctcttcagaaaggccggagcctca

SEQ ID NO: 251721 - DNA, 25 bp, Mus musculus
cctcttcagctgctctgtccgggcc

SEQ ID NO: 251722 - DNA, 25 bp, Mus musculus
cctcttcaggcccgcactttgcgct

SEQ ID NO: 251723 - DNA, 25 bp, Mus musculus
cctcttcaggctctgtgttccgagg

SEQ ID NO: 251724 - DNA, 25 bp, Mus musculus
cctcttcagtggaaggtaaacagaa

SEQ ID NO: 251725 - DNA, 25 bp, Mus musculus
cctcttcatcaccacgtatcacgta

SEQ ID NO: 251726 - DNA, 25 bp, Mus musculus
cctcttcatcaccaggtatcacgta

SEQ ID NO: 251727 - DNA, 25 bp, Mus musculus
cctcttcatcaggatgctgcacaac

SEQ ID NO: 251728 - DNA, 25 bp, Mus musculus
cctcttcatgcgcatggacttggac

SEQ ID NO: 251729 - DNA, 25 bp, Mus musculus
cctcttcattgctggctttgcggtg

SEQ ID NO: 251730 - DNA, 25 bp, Mus musculus
cctcttccaaggaatttgaaatcag

SEQ ID NO: 251731 - DNA, 25 bp, Mus musculus
cctcttccaaggagtgccggtgcgt

SEQ ID NO: 251732 - DNA, 25 bp, Mus musculus
cctcttccactggggtgtgtctgca

SEQ ID NO: 251733 - DNA, 25 bp, Mus musculus
cctcttccagacgctgaatcgcacg

SEQ ID NO: 251734 - DNA, 25 bp, Mus musculus
cctcttcccacccaggaatccaaac

SEQ ID NO: 251735 - DNA, 25 bp, Mus musculus
cctcttcccacccagtgatgactac

SEQ ID NO: 251736 - DNA, 25 bp, Mus musculus
cctcttccgaggacccacactcagg

SEQ ID NO: 251737 - DNA, 25 bp, Mus musculus
cctcttcctggagttccctgaggat

SEQ ID NO: 251738 - DNA, 25 bp, Mus musculus
cctcttcgaacggcacccaccaggt

SEQ ID NO: 251739 - DNA, 25 bp, Mus musculus
cctcttcgccgccattgctcctgtg

SEQ ID NO: 251740 - DNA, 25 bp, Mus musculus
cctcttcgcttggggtgcacacagt

SEQ ID NO: 251741 - DNA, 25 bp, Mus musculus
cctcttcggctacagcaagtgggaa

SEQ ID NO: 251742 - DNA, 25 bp, Mus musculus
cctcttcggggaagaaatagatgga

SEQ ID NO: 251743 - DNA, 25 bp, Mus musculus
cctcttcgtcaaggctggttatgac

SEQ ID NO: 251744 - DNA, 25 bp, Mus musculus
cctcttctaccactgaggggtttca

SEQ ID NO: 251745 - DNA, 25 bp, Mus musculus
cctcttctagtctcaacagatcacc

SEQ ID NO: 251746 - DNA, 25 bp, Mus musculus
cctcttctcagcatttgccctggtt

SEQ ID NO: 251747 - DNA, 25 bp, Mus musculus
cctcttctcccctgacagacccgga

SEQ ID NO: 251748 - DNA, 25 bp, Mus musculus
cctcttctcccctggtttctgtatg

SEQ ID NO: 251749 - DNA, 25 bp, Mus musculus
cctcttctctgagtttctcagtgta

SEQ ID NO: 251750 - DNA, 25 bp, Mus musculus
cctcttctctggggcctggaatgag

SEQ ID NO: 251751 - DNA, 25 bp, Mus musculus
cctcttctctgtgcctttcttcctg

SEQ ID NO: 251752 - DNA, 25 bp, Mus musculus
cctcttctgcagaactgggagtcct

SEQ ID NO: 251753 - DNA, 25 bp, Mus musculus
cctcttctgcagtctacctgtgccc

SEQ ID NO: 251754 - DNA, 25 bp, Mus musculus
cctcttctggaaggactaccacctt

SEQ ID NO: 251755 - DNA, 25 bp, Mus musculus
cctcttctggaaggactcgggacac

SEQ ID NO: 251756 - DNA, 25 bp, Mus musculus
cctcttctggcctccgatggtgaca

SEQ ID NO: 251757 - DNA, 25 bp, Mus musculus
cctcttcttcagatacatgtctcag

SEQ ID NO: 251758 - DNA, 25 bp, Mus musculus
cctcttcttctttgtactaggcggc

SEQ ID NO: 251759 - DNA, 25 bp, Mus musculus
cctcttgaaaatgtggagtgtgaca

SEQ ID NO: 251760 - DNA, 25 bp, Mus musculus
cctcttgaagaagtggatgacctgc

SEQ ID NO: 251761 - DNA, 25 bp, Mus musculus
cctcttgaagaagtttcctgtggcc

SEQ ID NO: 251762 - DNA, 25 bp, Mus musculus
cctcttgaagtcagtttcagaggag

SEQ ID NO: 251763 - DNA, 25 bp, Mus musculus
cctcttgacccagccctgcagaacc

SEQ ID NO: 251764 - DNA, 25 bp, Mus musculus
cctcttgacctggaagggaacatgc

SEQ ID NO: 251765 - DNA, 25 bp, Mus musculus
cctcttgcaaaggtgacccttaccc

SEQ ID NO: 251766 - DNA, 25 bp, Mus musculus
cctcttgcaaggagtcagcattggc

SEQ ID NO: 251767 - DNA, 25 bp, Mus musculus
cctcttgcagatactggagtgtgga

SEQ ID NO: 251768 - DNA, 25 bp, Mus musculus
cctcttgcagctcaaatgtccccag

SEQ ID NO: 251769 - DNA, 25 bp, Mus musculus
cctcttgccatgctggccgaggcgg

SEQ ID NO: 251770 - DNA, 25 bp, Mus musculus
cctcttgcccgctggacagttgctg

SEQ ID NO: 251771 - DNA, 25 bp, Mus musculus
cctcttgcctcagtgacatcaggct

SEQ ID NO: 251772 - DNA, 25 bp, Mus musculus
cctcttgcctgctagcagccacata

SEQ ID NO: 251773 - DNA, 25 bp, Mus musculus
cctcttgctcagccacagaacatcc

SEQ ID NO: 251774 - DNA, 25 bp, Mus musculus
cctcttgctcagggtcctcttaaaa

SEQ ID NO: 251775 - DNA, 25 bp, Mus musculus
cctcttggaagaggccctgggcttc

SEQ ID NO: 251776 - DNA, 25 bp, Mus musculus
cctcttgggaataggccctttggag

SEQ ID NO: 251777 - DNA, 25 bp, Mus musculus
cctcttggtccttgaggatttcaaa

SEQ ID NO: 251778 - DNA, 25 bp, Mus musculus
cctcttggtccttgttccaccctcc

SEQ ID NO: 251779 - DNA, 25 bp, Mus musculus
cctcttgtaccagagaactgaaaag

SEQ ID NO: 251780 - DNA, 25 bp, Mus musculus
cctcttgtggaagtgcggcttcttc

SEQ ID NO: 251781 - DNA, 25 bp, Mus musculus
cctcttgtggaagtgtgacttcttt

SEQ ID NO: 251782 - DNA, 25 bp, Mus musculus
cctcttgttacacaggttacaaccc

SEQ ID NO: 251783 - DNA, 25 bp, Mus musculus
cctctttaaaagaacagatgcacaa

SEQ ID NO: 251784 - DNA, 25 bp, Mus musculus
cctctttaaagatactatcgtggag

SEQ ID NO: 251785 - DNA, 25 bp, Mus musculus
cctctttaaaggattggtgaccagg

SEQ ID NO: 251786 - DNA, 25 bp, Mus musculus
cctctttaaattgaaaatacagaac

SEQ ID NO: 251787 - DNA, 25 bp, Mus musculus
cctctttaagaagtttgatgaaggc

SEQ ID NO: 251788 - DNA, 25 bp, Mus musculus
cctctttaaggcgtaccttctcatt

SEQ ID NO: 251789 - DNA, 25 bp, Mus musculus
cctctttaagtatgcagcagatcct

SEQ ID NO: 251790 - DNA, 25 bp, Mus musculus
cctctttacagcaaatgcaacaaat

SEQ ID NO: 251791 - DNA, 25 bp, Mus musculus
cctctttacagcaagccttttctga

SEQ ID NO: 251792 - DNA, 25 bp, Mus musculus
cctctttaccagtaaccaggtgact

SEQ ID NO: 251793 - DNA, 25 bp, Mus musculus
cctctttactctcagatagcctttc

SEQ ID NO: 251794 - DNA, 25 bp, Mus musculus
cctctttcaagccgtaattgctggc

SEQ ID NO: 251795 - DNA, 25 bp, Mus musculus
cctctttcatagccggaaccctctg

SEQ ID NO: 251796 - DNA, 25 bp, Mus musculus
cctctttcatagcgattttgataaa

SEQ ID NO: 251797 - DNA, 25 bp, Mus musculus
cctctttcataggcggaaccctctg

SEQ ID NO: 251798 - DNA, 25 bp, Mus musculus
cctctttcatagggattttgataaa

SEQ ID NO: 251799 - DNA, 25 bp, Mus musculus
cctctttcttctggaaccagctatt

SEQ ID NO: 251800 - DNA, 25 bp, Mus musculus
cctctttgaagacctttgcacagaa

SEQ ID NO: 251801 - DNA, 25 bp, Mus musculus
cctctttgacactctcgtgggcgcc

SEQ ID NO: 251802 - DNA, 25 bp, Mus musculus
cctctttgacacttttctcaacaga

SEQ ID NO: 251803 - DNA, 25 bp, Mus musculus
cctctttgaggaactttgatgtttc

SEQ ID NO: 251804 - DNA, 25 bp, Mus musculus
cctctttgagggaagaagccagctg

SEQ ID NO: 251805 - DNA, 25 bp, Mus musculus
cctctttgattccagctactcccga

SEQ ID NO: 251806 - DNA, 25 bp, Mus musculus
cctctttgcagatcttgatatggaa

SEQ ID NO: 251807 - DNA, 25 bp, Mus musculus
cctctttggacagagccagtataca

SEQ ID NO: 251808 - DNA, 25 bp, Mus musculus
cctcttttctggacaagatggcaac

SEQ ID NO: 251809 - DNA, 25 bp, Mus musculus
cctcttttgctatgctcagcacatt

SEQ ID NO: 251810 - DNA, 25 bp, Mus musculus
cctctttttccagcagttggaattg

SEQ ID NO: 251811 - DNA, 25 bp, Mus musculus
cctgaaaaagaggcggcgggccagc

SEQ ID NO: 251812 - DNA, 25 bp, Mus musculus
cctgaaaaaggtactgttggatgtc

SEQ ID NO: 251813 - DNA, 25 bp, Mus musculus
cctgaaaaatcgggttctgcctgtg

SEQ ID NO: 251814 - DNA, 25 bp, Mus musculus
cctgaaaaatgggagattatgttta

SEQ ID NO: 251815 - DNA, 25 bp, Mus musculus
cctgaaaacaaccaggtattgacca

SEQ ID NO: 251816 - DNA, 25 bp, Mus musculus
cctgaaaacatacatgttgccagga

SEQ ID NO: 251817 - DNA, 25 bp, Mus musculus
cctgaaaagagattcatctgtttgt

SEQ ID NO: 251818 - DNA, 25 bp, Mus musculus
cctgaaaagagatttcgatagtgac

SEQ ID NO: 251819 - DNA, 25 bp, Mus musculus
cctgaaacagagaagcccgtgcttc

SEQ ID NO: 251820 - DNA, 25 bp, Mus musculus
cctgaaacagatgctgaccttaaga

SEQ ID NO: 251821 - DNA, 25 bp, Mus musculus
cctgaaacaggtactacttgtcctc

SEQ ID NO: 251822 - DNA, 25 bp, Mus musculus
cctgaaactcaggtggtgctgatca

SEQ ID NO: 251823 - DNA, 25 bp, Mus musculus
cctgaaactcaggttatgaggtgac

SEQ ID NO: 251824 - DNA, 25 bp, Mus musculus
cctgaaagatcaatgggcagcagca

SEQ ID NO: 251825 - DNA, 25 bp, Mus musculus
cctgaaagcagaacctggtccacgt

SEQ ID NO: 251826 - DNA, 25 bp, Mus musculus
cctgaaagcatccagtttgtgctcg

SEQ ID NO: 251827 - DNA, 25 bp, Mus musculus
cctgaaagcccaagtggccgcacga

SEQ ID NO: 251828 - DNA, 25 bp, Mus musculus
cctgaaaggaagtcagagaagcttc

SEQ ID NO: 251829 - DNA, 25 bp, Mus musculus
cctgaaaggcaaaggtcagtgtcct

SEQ ID NO: 251830 - DNA, 25 bp, Mus musculus
cctgaaatctgcctccaacattgac

SEQ ID NO: 251831 - DNA, 25 bp, Mus musculus
cctgaaatgtgagctcactctgcag

SEQ ID NO: 251832 - DNA, 25 bp, Mus musculus
cctgaaattagatggcttccctttc

SEQ ID NO: 251833 - DNA, 25 bp, Mus musculus
cctgaaattatatcattggatactt

SEQ ID NO: 251834 - DNA, 25 bp, Mus musculus
cctgaacaagatgcactcccatcct

SEQ ID NO: 251835 - DNA, 25 bp, Mus musculus
cctgaacaagctcagccctggggag

SEQ ID NO: 251836 - DNA, 25 bp, Mus musculus
cctgaacaaggctcttcctcctggc

SEQ ID NO: 251837 - DNA, 25 bp, Mus musculus
cctgaacaaggtccaggacatcttg

SEQ ID NO: 251838 - DNA, 25 bp, Mus musculus
cctgaacacagtaaggtagattacg

SEQ ID NO: 251839 - DNA, 25 bp, Mus musculus
cctgaacaccttgcagaacattcca

SEQ ID NO: 251840 - DNA, 25 bp, Mus musculus
cctgaacaccttgcatcccacgagt

SEQ ID NO: 251841 - DNA, 25 bp, Mus musculus
cctgaacagaaaggtcaaatcatta

SEQ ID NO: 251842 - DNA, 25 bp, Mus musculus
cctgaacaggatgctgccagccctg

SEQ ID NO: 251843 - DNA, 25 bp, Mus musculus
cctgaacagtgccatatgagaacat

SEQ ID NO: 251844 - DNA, 25 bp, Mus musculus
cctgaacagtgccgcaacataacat

SEQ ID NO: 251845 - DNA, 25 bp, Mus musculus
cctgaacatcaacggttctcccatg

SEQ ID NO: 251846 - DNA, 25 bp, Mus musculus
cctgaacatgccaggcacgagccac

SEQ ID NO: 251847 - DNA, 25 bp, Mus musculus
cctgaaccagctggtccctgagaag

SEQ ID NO: 251848 - DNA, 25 bp, Mus musculus
cctgaaccctggcggaggctgctga

SEQ ID NO: 251849 - DNA, 25 bp, Mus musculus
cctgaacctattttggaagagcagt

SEQ ID NO: 251850 - DNA, 25 bp, Mus musculus
cctgaacctattttggttgataatc

SEQ ID NO: 251851 - DNA, 25 bp, Mus musculus
cctgaaccttggcatgaataggttg

SEQ ID NO: 251852 - DNA, 25 bp, Mus musculus
cctgaaccttgggtggcttgtccct

SEQ ID NO: 251853 - DNA, 25 bp, Mus musculus
cctgaactcaacatggcaaggcact

SEQ ID NO: 251854 - DNA, 25 bp, Mus musculus
cctgaactcaagttcacgcaaagaa

SEQ ID NO: 251855 - DNA, 25 bp, Mus musculus
cctgaactcgcaggcaccttttgtg

SEQ ID NO: 251856 - DNA, 25 bp, Mus musculus
cctgaactcgcaggttctggctgga

SEQ ID NO: 251857 - DNA, 25 bp, Mus musculus
cctgaactctatcatattgcagcac

SEQ ID NO: 251858 - DNA, 25 bp, Mus musculus
cctgaacttggatcctttctctatc

SEQ ID NO: 251859 - DNA, 25 bp, Mus musculus
cctgaagaaaggaactgtcgtccat

SEQ ID NO: 251860 - DNA, 25 bp, Mus musculus
cctgaagaaagtggtatcccgccac

SEQ ID NO: 251861 - DNA, 25 bp, Mus musculus
cctgaagaacaaggcagctgcagga

SEQ ID NO: 251862 - DNA, 25 bp, Mus musculus
cctgaagaacggtatcactgaggag

SEQ ID NO: 251863 - DNA, 25 bp, Mus musculus
cctgaagaagaggtcacgaaagaag

SEQ ID NO: 251864 - DNA, 25 bp, Mus musculus
cctgaagaagatgactttgaaaaag

SEQ ID NO: 251865 - DNA, 25 bp, Mus musculus
cctgaagaagatggattatgacaat

SEQ ID NO: 251866 - DNA, 25 bp, Mus musculus
cctgaagaagattaacttgagtatt

SEQ ID NO: 251867 - DNA, 25 bp, Mus musculus
cctgaagaagcacgcccactggaag

SEQ ID NO: 251868 - DNA, 25 bp, Mus musculus
cctgaagaaggagctgcgggagctc

SEQ ID NO: 251869 - DNA, 25 bp, Mus musculus
cctgaagacagcccaggacccaggc

SEQ ID NO: 251870 - DNA, 25 bp, Mus musculus
cctgaagacccagaggacacaaaga

SEQ ID NO: 251871 - DNA, 25 bp, Mus musculus
cctgaagacccagaggaggaagagt

SEQ ID NO: 251872 - DNA, 25 bp, Mus musculus
cctgaagaccctcacctccacgccc

SEQ ID NO: 251873 - DNA, 25 bp, Mus musculus
cctgaagacctcccataacacgaca

SEQ ID NO: 251874 - DNA, 25 bp, Mus musculus
cctgaagacgcatttagtaaagaaa

SEQ ID NO: 251875 - DNA, 25 bp, Mus musculus
cctgaagacttggagcactttgagg

SEQ ID NO: 251876 - DNA, 25 bp, Mus musculus
cctgaagagaagccttccagcaccc

SEQ ID NO: 251877 - DNA, 25 bp, Mus musculus
cctgaagagacttggttgaaaggcc

SEQ ID NO: 251878 - DNA, 25 bp, Mus musculus
cctgaagagcaagatcctggcagcc

SEQ ID NO: 251879 - DNA, 25 bp, Mus musculus
cctgaagatctagtgcgccgtcatg

SEQ ID NO: 251880 - DNA, 25 bp, Mus musculus
cctgaagcaaggtattggttttcgc

SEQ ID NO: 251881 - DNA, 25 bp, Mus musculus
cctgaagcaccagcatcggtgtgtg

SEQ ID NO: 251882 - DNA, 25 bp, Mus musculus
cctgaagcaccaggtgaatgggatt

SEQ ID NO: 251883 - DNA, 25 bp, Mus musculus
cctgaagcagaagactctcttctgc

SEQ ID NO: 251884 - DNA, 25 bp, Mus musculus
cctgaagcggtgctcactcctggcc

SEQ ID NO: 251885 - DNA, 25 bp, Mus musculus
cctgaagctgcgacaagggtctgat

SEQ ID NO: 251886 - DNA, 25 bp, Mus musculus
cctgaaggagaacagcaaacctctg

SEQ ID NO: 251887 - DNA, 25 bp, Mus musculus
cctgaaggaggaggttggaagtcgg

SEQ ID NO: 251888 - DNA, 25 bp, Mus musculus
cctgaaggaggtactgtctgagcca

SEQ ID NO: 251889 - DNA, 25 bp, Mus musculus
cctgaaggagtaggccctgtattgg

SEQ ID NO: 251890 - DNA, 25 bp, Mus musculus
cctgaaggagtgtggcatgttcatc

SEQ ID NO: 251891 - DNA, 25 bp, Mus musculus
cctgaagggaatactaagatgctta

SEQ ID NO: 251892 - DNA, 25 bp, Mus musculus
cctgaagggcagacaagatgaacct

SEQ ID NO: 251893 - DNA, 25 bp, Mus musculus
cctgaagggcagggacattagtcat

SEQ ID NO: 251894 - DNA, 25 bp, Mus musculus
cctgaagggcaggtttggcatagaa

SEQ ID NO: 251895 - DNA, 25 bp, Mus musculus
cctgaaggggaagaggaatattgaa

SEQ ID NO: 251896 - DNA, 25 bp, Mus musculus
cctgaaggttgggccttacatcaca

SEQ ID NO: 251897 - DNA, 25 bp, Mus musculus
cctgaagtaggtgtaattattgaga

SEQ ID NO: 251898 - DNA, 25 bp, Mus musculus
cctgaagtcaagggcaggcactgat

SEQ ID NO: 251899 - DNA, 25 bp, Mus musculus
cctgaagtcaaggtcggttaggccc

SEQ ID NO: 251900 - DNA, 25 bp, Mus musculus
cctgaagtcgcagagaaagataagg

SEQ ID NO: 251901 - DNA, 25 bp, Mus musculus
cctgaagtgtcagcttgatactcat

SEQ ID NO: 251902 - DNA, 25 bp, Mus musculus
cctgaagtgtcaggcgtttgcacat

SEQ ID NO: 251903 - DNA, 25 bp, Mus musculus
cctgaatacacaggccccagtgcct

SEQ ID NO: 251904 - DNA, 25 bp, Mus musculus
cctgaatagcgtgcctcaggagccg

SEQ ID NO: 251905 - DNA, 25 bp, Mus musculus
cctgaatatccgtcgaaaagcggca

SEQ ID NO: 251906 - DNA, 25 bp, Mus musculus
cctgaatcagggcagcgctgtattt

SEQ ID NO: 251907 - DNA, 25 bp, Mus musculus
cctgaatcgccacagagcctacaga

SEQ ID NO: 251908 - DNA, 25 bp, Mus musculus
cctgaatctcctggagaaagaaaca

SEQ ID NO: 251909 - DNA, 25 bp, Mus musculus
cctgaatgaacagcttctacctaag

SEQ ID NO: 251910 - DNA, 25 bp, Mus musculus
cctgaatgacaagctccccgaggct

SEQ ID NO: 251911 - DNA, 25 bp, Mus musculus
cctgaatgacaaggtggaggagcgg

SEQ ID NO: 251912 - DNA, 25 bp, Mus musculus
cctgaatgcagattgaggatgggta

SEQ ID NO: 251913 - DNA, 25 bp, Mus musculus
cctgaatgcagtgacaagcatcagt

SEQ ID NO: 251914 - DNA, 25 bp, Mus musculus
cctgaatgcagttggaatgccaaga

SEQ ID NO: 251915 - DNA, 25 bp, Mus musculus
cctgaatggcaggaaatctcaccac

SEQ ID NO: 251916 - DNA, 25 bp, Mus musculus
cctgaatgtgagaagattacagtag

SEQ ID NO: 251917 - DNA, 25 bp, Mus musculus
cctgaattcttcaaggactggggat

SEQ ID NO: 251918 - DNA, 25 bp, Mus musculus
cctgaattcttcaaggtggtacctc

SEQ ID NO: 251919 - DNA, 25 bp, Mus musculus
cctgaatttatcaggaaacaaaagg

SEQ ID NO: 251920 - DNA, 25 bp, Mus musculus
cctgacaaagctgactctcgggctg

SEQ ID NO: 251921 - DNA, 25 bp, Mus musculus
cctgacaaaggtgactctcgggctg

SEQ ID NO: 251922 - DNA, 25 bp, Mus musculus
cctgacaaaggttctgggagaggtg

SEQ ID NO: 251923 - DNA, 25 bp, Mus musculus
cctgacaacaagagcctggccatcc

SEQ ID NO: 251924 - DNA, 25 bp, Mus musculus
cctgacaactttgaactctgcactt

SEQ ID NO: 251925 - DNA, 25 bp, Mus musculus
cctgacaagaaagctgttcttccta

SEQ ID NO: 251926 - DNA, 25 bp, Mus musculus
cctgacaagaaagcttgatccggag

SEQ ID NO: 251927 - DNA, 25 bp, Mus musculus
cctgacaaggagaatacacctctca

SEQ ID NO: 251928 - DNA, 25 bp, Mus musculus
cctgacaaggagaatgtcccttcag

SEQ ID NO: 251929 - DNA, 25 bp, Mus musculus
cctgacaatgcaagtgcaccttcca

SEQ ID NO: 251930 - DNA, 25 bp, Mus musculus
cctgacaatgctcaagagtatagtc

SEQ ID NO: 251931 - DNA, 25 bp, Mus musculus
cctgacacacccctgtctgcaggca

SEQ ID NO: 251932 - DNA, 25 bp, Mus musculus
cctgacacagctaacttcacagcca

SEQ ID NO: 251933 - DNA, 25 bp, Mus musculus
cctgacacagctaagttcacagcca

SEQ ID NO: 251934 - DNA, 25 bp, Mus musculus
cctgacaccaccaagatcccatggt

SEQ ID NO: 251935 - DNA, 25 bp, Mus musculus
cctgacaccgatggcagactttctg

SEQ ID NO: 251936 - DNA, 25 bp, Mus musculus
cctgacacgctgagaaatacgaaga

SEQ ID NO: 251937 - DNA, 25 bp, Mus musculus
cctgacacgctgagaatatatcaga

SEQ ID NO: 251938 - DNA, 25 bp, Mus musculus
cctgacactgactctcatggtacca

SEQ ID NO: 251939 - DNA, 25 bp, Mus musculus
cctgacacttccgtgttaggcacgg

SEQ ID NO: 251940 - DNA, 25 bp, Mus musculus
cctgacagaaacacataaacctcag

SEQ ID NO: 251941 - DNA, 25 bp, Mus musculus
cctgacagaagatgattctgaggat

SEQ ID NO: 251942 - DNA, 25 bp, Mus musculus
cctgacagaaggtctccgggcacaa

SEQ ID NO: 251943 - DNA, 25 bp, Mus musculus
cctgacagactgagccccttaggtg

SEQ ID NO: 251944 - DNA, 25 bp, Mus musculus
cctgacagcaggggcttcagtgtga

SEQ ID NO: 251945 - DNA, 25 bp, Mus musculus
cctgacagcagttcccacagctgca

SEQ ID NO: 251946 - DNA, 25 bp, Mus musculus
cctgacagccagatgaatagagaag

SEQ ID NO: 251947 - DNA, 25 bp, Mus musculus
cctgacagctgggatctccatcttt

SEQ ID NO: 251948 - DNA, 25 bp, Mus musculus
cctgacaggcaggccaggagtgtgc

SEQ ID NO: 251949 - DNA, 25 bp, Mus musculus
cctgacaggtagccaggcttggcac

SEQ ID NO: 251950 - DNA, 25 bp, Mus musculus
cctgacagtgaggatccaaaggagg

SEQ ID NO: 251951 - DNA, 25 bp, Mus musculus
cctgacagtgcagggtcaccatcat

SEQ ID NO: 251952 - DNA, 25 bp, Mus musculus
cctgacatctggcctacacagagag

SEQ ID NO: 251953 - DNA, 25 bp, Mus musculus
cctgacatgggattctctccaacga

SEQ ID NO: 251954 - DNA, 25 bp, Mus musculus
cctgacatgggcctccttgaatctt

SEQ ID NO: 251955 - DNA, 25 bp, Mus musculus
cctgacatggtaaagggaatgcagt

SEQ ID NO: 251956 - DNA, 25 bp, Mus musculus
cctgacattccccaggattgggttt

SEQ ID NO: 251957 - DNA, 25 bp, Mus musculus
cctgaccaaaaataaggtacaagtt

SEQ ID NO: 251958 - DNA, 25 bp, Mus musculus
cctgaccaagagtggcaacagcatc

SEQ ID NO: 251959 - DNA, 25 bp, Mus musculus
cctgaccaaggagcaggcggagctg

SEQ ID NO: 251960 - DNA, 25 bp, Mus musculus
cctgaccacagactactggtgccta

SEQ ID NO: 251961 - DNA, 25 bp, Mus musculus
cctgaccacagccaactttccagat

SEQ ID NO: 251962 - DNA, 25 bp, Mus musculus
cctgaccaccacacccagtgttggg

SEQ ID NO: 251963 - DNA, 25 bp, Mus musculus
cctgaccacggtgattgggatacta

SEQ ID NO: 251964 - DNA, 25 bp, Mus musculus
cctgaccacggtttggctccttccg

SEQ ID NO: 251965 - DNA, 25 bp, Mus musculus
cctgaccagagagcttctgtgtgga

SEQ ID NO: 251966 - DNA, 25 bp, Mus musculus
cctgaccagtctatatatattgggg

SEQ ID NO: 251967 - DNA, 25 bp, Mus musculus
cctgaccatagacgagttggagtgg

SEQ ID NO: 251968 - DNA, 25 bp, Mus musculus
cctgaccatagacgtggaaactgtc

SEQ ID NO: 251969 - DNA, 25 bp, Mus musculus
cctgaccatcaagctgacccctgcc

SEQ ID NO: 251970 - DNA, 25 bp, Mus musculus
cctgaccatcacagtccgcaccaag

SEQ ID NO: 251971 - DNA, 25 bp, Mus musculus
cctgaccatggacgatctgtttccc

SEQ ID NO: 251972 - DNA, 25 bp, Mus musculus
cctgacccagaaacaacttgagccg

SEQ ID NO: 251973 - DNA, 25 bp, Mus musculus
cctgacccagaggtctttgacccac

SEQ ID NO: 251974 - DNA, 25 bp, Mus musculus
cctgacccagccaaggcaggagcag

SEQ ID NO: 251975 - DNA, 25 bp, Mus musculus
cctgacccagccccaccattctccc

SEQ ID NO: 251976 - DNA, 25 bp, Mus musculus
cctgacccagcttctcgtgtagaag

SEQ ID NO: 251977 - DNA, 25 bp, Mus musculus
cctgacccaggaacacagtgtgtga

SEQ ID NO: 251978 - DNA, 25 bp, Mus musculus
cctgacccaggtcaacagctgagcc

SEQ ID NO: 251979 - DNA, 25 bp, Mus musculus
cctgaccccagaagtagaaatccag

SEQ ID NO: 251980 - DNA, 25 bp, Mus musculus
cctgaccccagcccagccagtggtt

SEQ ID NO: 251981 - DNA, 25 bp, Mus musculus
cctgaccccgaagcttgatggtgtg

SEQ ID NO: 251982 - DNA, 25 bp, Mus musculus
cctgaccccgaagttgatgaaacat

SEQ ID NO: 251983 - DNA, 25 bp, Mus musculus
cctgaccccgcgggtccttcacaca

SEQ ID NO: 251984 - DNA, 25 bp, Mus musculus
cctgaccccggtgtgtgatagcacg

SEQ ID NO: 251985 - DNA, 25 bp, Mus musculus
cctgacccggccatcctacctgcct

SEQ ID NO: 251986 - DNA, 25 bp, Mus musculus
cctgacccggccatcgttgtggagc

SEQ ID NO: 251987 - DNA, 25 bp, Mus musculus
cctgacctaagtcgaatggtatgtg

SEQ ID NO: 251988 - DNA, 25 bp, Mus musculus
cctgacctatctcgacgtcggatgc

SEQ ID NO: 251989 - DNA, 25 bp, Mus musculus
cctgacctcaatgtctttacatcca

SEQ ID NO: 251990 - DNA, 25 bp, Mus musculus
cctgacctcaggattggaaaactga

SEQ ID NO: 251991 - DNA, 25 bp, Mus musculus
cctgacctctagttgggatgaatgg

SEQ ID NO: 251992 - DNA, 25 bp, Mus musculus
cctgacctgagataccatggccaaa

SEQ ID NO: 251993 - DNA, 25 bp, Mus musculus
cctgacctgcgtgcatcagagtctt

SEQ ID NO: 251994 - DNA, 25 bp, Mus musculus
cctgacctgtgctgctccgcagaag

SEQ ID NO: 251995 - DNA, 25 bp, Mus musculus
cctgacctgtggttcctgcacgacc

SEQ ID NO: 251996 - DNA, 25 bp, Mus musculus
cctgaccttataaacttcagtgccc

SEQ ID NO: 251997 - DNA, 25 bp, Mus musculus
cctgaccttcacaccctcagaacag

SEQ ID NO: 251998 - DNA, 25 bp, Mus musculus
cctgaccttgcacgggctgcaggat

SEQ ID NO: 251999 - DNA, 25 bp, Mus musculus
cctgacgaggggtctccgggcacaa

SEQ ID NO: 252000 - DNA, 25 bp, Mus musculus
cctgacgcaggcaaaacccatttat

SEQ ID NO: 252001 - DNA, 25 bp, Mus musculus
cctgacgcctcaagcacttgtctct

SEQ ID NO: 252002 - DNA, 25 bp, Mus musculus
cctgacgcctcaagggttgagacat

SEQ ID NO: 252003 - DNA, 25 bp, Mus musculus
cctgacggagcaggcctgtctcgtc

SEQ ID NO: 252004 - DNA, 25 bp, Mus musculus
cctgactacagaggatgcgtccgaa

SEQ ID NO: 252005 - DNA, 25 bp, Mus musculus
cctgactacaggtacaatagaggaa

SEQ ID NO: 252006 - DNA, 25 bp, Mus musculus
cctgactacgagctaaggaggctcg

SEQ ID NO: 252007 - DNA, 25 bp, Mus musculus
cctgactacgagcttaagtacccac

SEQ ID NO: 252008 - DNA, 25 bp, Mus musculus
cctgactagagttagaatcccttcg

SEQ ID NO: 252009 - DNA, 25 bp, Mus musculus
cctgactatatgatggggctgtgtt

SEQ ID NO: 252010 - DNA, 25 bp, Mus musculus
cctgactatttggttcctgctgctc

SEQ ID NO: 252011 - DNA, 25 bp, Mus musculus
cctgactcagaacaggtgagaactc

SEQ ID NO: 252012 - DNA, 25 bp, Mus musculus
cctgactcagaagaaccaatcactg

SEQ ID NO: 252013 - DNA, 25 bp, Mus musculus
cctgactcagaaggtgtacagactc

SEQ ID NO: 252014 - DNA, 25 bp, Mus musculus
cctgactcagactggttgggcgcta

SEQ ID NO: 252015 - DNA, 25 bp, Mus musculus
cctgactcagagaggaagaacctgt

SEQ ID NO: 252016 - DNA, 25 bp, Mus musculus
cctgactcaggcaggccagctttcc

SEQ ID NO: 252017 - DNA, 25 bp, Mus musculus
cctgactcaggtaggcctgtcaacc

SEQ ID NO: 252018 - DNA, 25 bp, Mus musculus
cctgactcaggtctgctggcaggac

SEQ ID NO: 252019 - DNA, 25 bp, Mus musculus
cctgactcatggtggcccgaggcag

SEQ ID NO: 252020 - DNA, 25 bp, Mus musculus
cctgactccgttcaacacacagaat

SEQ ID NO: 252021 - DNA, 25 bp, Mus musculus
cctgactcgatggcaccgcatgcgt

SEQ ID NO: 252022 - DNA, 25 bp, Mus musculus
cctgactcggaaaagtcatgttgca

SEQ ID NO: 252023 - DNA, 25 bp, Mus musculus
cctgactcggaaagttccattttgg

SEQ ID NO: 252024 - DNA, 25 bp, Mus musculus
cctgactctggacaaactgtcctgt

SEQ ID NO: 252025 - DNA, 25 bp, Mus musculus
cctgactgacccattgaagaagccg

SEQ ID NO: 252026 - DNA, 25 bp, Mus musculus
cctgactgcagcaggcaccagagtt

SEQ ID NO: 252027 - DNA, 25 bp, Mus musculus
cctgactgctcttgtctgaaaacag

SEQ ID NO: 252028 - DNA, 25 bp, Mus musculus
cctgactgcttctgtatcaagatat

SEQ ID NO: 252029 - DNA, 25 bp, Mus musculus
cctgactggacatgattttgggcat

SEQ ID NO: 252030 - DNA, 25 bp, Mus musculus
cctgactggacatggggatcctgtg

SEQ ID NO: 252031 - DNA, 25 bp, Mus musculus
cctgactggctggtttttcaacgac

SEQ ID NO: 252032 - DNA, 25 bp, Mus musculus
cctgactgtctacagtgtctagctg

SEQ ID NO: 252033 - DNA, 25 bp, Mus musculus
cctgactgtcttgagtgtctagctg

SEQ ID NO: 252034 - DNA, 25 bp, Mus musculus
cctgactgttaatagcccacaggtc

SEQ ID NO: 252035 - DNA, 25 bp, Mus musculus
cctgactgttaataggtcctgcctc

SEQ ID NO: 252036 - DNA, 25 bp, Mus musculus
cctgacttagccgagttcaatctca

SEQ ID NO: 252037 - DNA, 25 bp, Mus musculus
cctgacttcacagtggaaggacatt

SEQ ID NO: 252038 - DNA, 25 bp, Mus musculus
cctgacttcccaggagctgatgcac

SEQ ID NO: 252039 - DNA, 25 bp, Mus musculus
cctgacttctggatggacagtctga

SEQ ID NO: 252040 - DNA, 25 bp, Mus musculus
cctgacttgagaggcccaggatggg

SEQ ID NO: 252041 - DNA, 25 bp, Mus musculus
cctgacttgagggagtgcccagctg

SEQ ID NO: 252042 - DNA, 25 bp, Mus musculus
cctgacttgagggtcctgagggagg

SEQ ID NO: 252043 - DNA, 25 bp, Mus musculus
cctgacttgatgtgtcttaccactg

SEQ ID NO: 252044 - DNA, 25 bp, Mus musculus
cctgactttaatcaaagcaatggaa

SEQ ID NO: 252045 - DNA, 25 bp, Mus musculus
cctgactttcatgatgcccccacca

SEQ ID NO: 252046 - DNA, 25 bp, Mus musculus
cctgactttgagcggaggctgctga

SEQ ID NO: 252047 - DNA, 25 bp, Mus musculus
cctgactttgggtaatgttctcctt

SEQ ID NO: 252048 - DNA, 25 bp, Mus musculus
cctgactttttcgctgccttggggt

SEQ ID NO: 252049 - DNA, 25 bp, Mus musculus
cctgactttttcggtgcctcctgag

SEQ ID NO: 252050 - DNA, 25 bp, Mus musculus
cctgagaaaagggcagtcatggaag

SEQ ID NO: 252051 - DNA, 25 bp, Mus musculus
cctgagaaactgggtgctcttctct

SEQ ID NO: 252052 - DNA, 25 bp, Mus musculus
cctgagaaaggtataaatgggtcgg

SEQ ID NO: 252053 - DNA, 25 bp, Mus musculus
cctgagaaataccagtccctggcct

SEQ ID NO: 252054 - DNA, 25 bp, Mus musculus
cctgagaacttcaggctcctgggca

SEQ ID NO: 252055 - DNA, 25 bp, Mus musculus
cctgagaagcaggctgtgcagctat

SEQ ID NO: 252056 - DNA, 25 bp, Mus musculus
cctgagaagcaggtctgttctcctg

SEQ ID NO: 252057 - DNA, 25 bp, Mus musculus
cctgagaaggagacaatcccagaca

SEQ ID NO: 252058 - DNA, 25 bp, Mus musculus
cctgagaaggagcttcctgtcacgg

SEQ ID NO: 252059 - DNA, 25 bp, Mus musculus
cctgagaaggaggtcactcttatcc

SEQ ID NO: 252060 - DNA, 25 bp, Mus musculus
cctgagaagtctggagaaatctggg

SEQ ID NO: 252061 - DNA, 25 bp, Mus musculus
cctgagaatgaatgaacaaaaccaa

SEQ ID NO: 252062 - DNA, 25 bp, Mus musculus
cctgagaatggtctctctgggatcc

SEQ ID NO: 252063 - DNA, 25 bp, Mus musculus
cctgagaattgattcatctgtttgt

SEQ ID NO: 252064 - DNA, 25 bp, Mus musculus
cctgagacaagcaaggaggtgagtg

SEQ ID NO: 252065 - DNA, 25 bp, Mus musculus
cctgagacaagcaagggctctgtaa

SEQ ID NO: 252066 - DNA, 25 bp, Mus musculus
cctgagacaggctccgtccatgcca

SEQ ID NO: 252067 - DNA, 25 bp, Mus musculus
cctgagacagggttgtgagccccgg

SEQ ID NO: 252068 - DNA, 25 bp, Mus musculus
cctgagacccaacagaaaaatggct

SEQ ID NO: 252069 - DNA, 25 bp, Mus musculus
cctgagacccaggtggtactgataa

SEQ ID NO: 252070 - DNA, 25 bp, Mus musculus
cctgagacttacagattgccaaaat

SEQ ID NO: 252071 - DNA, 25 bp, Mus musculus
cctgagagccagagctgttctgcca

SEQ ID NO: 252072 - DNA, 25 bp, Mus musculus
cctgagagccagatatccattgaat

SEQ ID NO: 252073 - DNA, 25 bp, Mus musculus
cctgagagctagcagacatctctgt

SEQ ID NO: 252074 - DNA, 25 bp, Mus musculus
cctgagagctagcagttccagtgca

SEQ ID NO: 252075 - DNA, 25 bp, Mus musculus
cctgagaggttccacaacttagaag

SEQ ID NO: 252076 - DNA, 25 bp, Mus musculus
cctgagagtgaatgggcaagagaag

SEQ ID NO: 252077 - DNA, 25 bp, Mus musculus
cctgagagtggcaggaagaagtccc

SEQ ID NO: 252078 - DNA, 25 bp, Mus musculus
cctgagagtggtaatcttttggtaa

SEQ ID NO: 252079 - DNA, 25 bp, Mus musculus
cctgagatacaaggaaagaaaggag

SEQ ID NO: 252080 - DNA, 25 bp, Mus musculus
cctgagatctaaacctactgacggg

SEQ ID NO: 252081 - DNA, 25 bp, Mus musculus
cctgagattaaagcattggataccc

SEQ ID NO: 252082 - DNA, 25 bp, Mus musculus
cctgagattaaaggacaaccctcca

SEQ ID NO: 252083 - DNA, 25 bp, Mus musculus
cctgagcaaaggctacaacaaggct

SEQ ID NO: 252084 - DNA, 25 bp, Mus musculus
cctgagcaaggaggacttcgtggag

SEQ ID NO: 252085 - DNA, 25 bp, Mus musculus
cctgagcaaggagtggctccgcggg

SEQ ID NO: 252086 - DNA, 25 bp, Mus musculus
cctgagcaataagagcggtctcacc

SEQ ID NO: 252087 - DNA, 25 bp, Mus musculus
cctgagcacagtgagcatgtttttg

SEQ ID NO: 252088 - DNA, 25 bp, Mus musculus
cctgagcagagtcactgagggccag

SEQ ID NO: 252089 - DNA, 25 bp, Mus musculus
cctgagcagggtgttcctgtataaa

SEQ ID NO: 252090 - DNA, 25 bp, Mus musculus
cctgagcatccagggtgagtgtcca

SEQ ID NO: 252091 - DNA, 25 bp, Mus musculus
cctgagcattggaaacaagctccca

SEQ ID NO: 252092 - DNA, 25 bp, Mus musculus
cctgagccaggttgatgtaggagtg

SEQ ID NO: 252093 - DNA, 25 bp, Mus musculus
cctgagccccgagcctttgacatgt

SEQ ID NO: 252094 - DNA, 25 bp, Mus musculus
cctgagccccgagggtcctgcggtg

SEQ ID NO: 252095 - DNA, 25 bp, Mus musculus
cctgagccccgtgtactggttccgc

SEQ ID NO: 252096 - DNA, 25 bp, Mus musculus
cctgagcccggctgtgctggatgcc

SEQ ID NO: 252097 - DNA, 25 bp, Mus musculus
cctgagccctgaagattttctgcat

SEQ ID NO: 252098 - DNA, 25 bp, Mus musculus
cctgagccggaggttccaggatggc

SEQ ID NO: 252099 - DNA, 25 bp, Mus musculus
cctgagcctccagtgttgagtggag

SEQ ID NO: 252100 - DNA, 25 bp, Mus musculus
cctgagcctcgttccagggtcacat

SEQ ID NO: 252101 - DNA, 25 bp, Mus musculus
cctgagcctcttaaggtcattttct

SEQ ID NO: 252102 - DNA, 25 bp, Mus musculus
cctgagcctgaagaaaaagttaaac

SEQ ID NO: 252103 - DNA, 25 bp, Mus musculus
cctgagcctgaagtggtgttcaaca

SEQ ID NO: 252104 - DNA, 25 bp, Mus musculus
cctgagcctgctgctccagcctcgg

SEQ ID NO: 252105 - DNA, 25 bp, Mus musculus
cctgagcgactgaggcaattaaaaa

SEQ ID NO: 252106 - DNA, 25 bp, Mus musculus
cctgagcgactgaggtctgccgacg

SEQ ID NO: 252107 - DNA, 25 bp, Mus musculus
cctgagcgcattgaggaaagcggga

SEQ ID NO: 252108 - DNA, 25 bp, Mus musculus
cctgagcgcccccgtggaatggcgt

SEQ ID NO: 252109 - DNA, 25 bp, Mus musculus
cctgagcggcggaagggttaccctc

SEQ ID NO: 252110 - DNA, 25 bp, Mus musculus
cctgagcgtgttggggacaaagaga

SEQ ID NO: 252111 - DNA, 25 bp, Mus musculus
cctgagctaggattggtagcttatg

SEQ ID NO: 252112 - DNA, 25 bp, Mus musculus
cctgagctcaccaagctactccatt

SEQ ID NO: 252113 - DNA, 25 bp, Mus musculus
cctgagctcgatgtcggttggaccc

SEQ ID NO: 252114 - DNA, 25 bp, Mus musculus
cctgagctcgctggcttctccccct

SEQ ID NO: 252115 - DNA, 25 bp, Mus musculus
cctgagctctgcaggggactccttt

SEQ ID NO: 252116 - DNA, 25 bp, Mus musculus
cctgagctggaagatttcatcctga

SEQ ID NO: 252117 - DNA, 25 bp, Mus musculus
cctgagctggccaaaaggccagata

SEQ ID NO: 252118 - DNA, 25 bp, Mus musculus
cctgagctggctctctgacaaatgg

SEQ ID NO: 252119 - DNA, 25 bp, Mus musculus
cctgagctgtgaggcgcagcaagca

SEQ ID NO: 252120 - DNA, 25 bp, Mus musculus
cctgagctttcggagcattttctgc

SEQ ID NO: 252121 - DNA, 25 bp, Mus musculus
cctgaggaaagaggaagaagtcgtc

SEQ ID NO: 252122 - DNA, 25 bp, Mus musculus
cctgaggaacagaaaatgttaacaa

SEQ ID NO: 252123 - DNA, 25 bp, Mus musculus
cctgaggaacagatcctggagagaa

SEQ ID NO: 252124 - DNA, 25 bp, Mus musculus
cctgaggaacagcgcatcgccatgg

SEQ ID NO: 252125 - DNA, 25 bp, Mus musculus
cctgaggaagcagatataaagactt

SEQ ID NO: 252126 - DNA, 25 bp, Mus musculus
cctgaggaatagacttttcactgag

SEQ ID NO: 252127 - DNA, 25 bp, Mus musculus
cctgaggaatagccctggctttcct

SEQ ID NO: 252128 - DNA, 25 bp, Mus musculus
cctgaggaatagcttctggaatttc

SEQ ID NO: 252129 - DNA, 25 bp, Mus musculus
cctgaggacagagaaagagctaaag

SEQ ID NO: 252130 - DNA, 25 bp, Mus musculus
cctgaggaccaaggtgagcctgtga

SEQ ID NO: 252131 - DNA, 25 bp, Mus musculus
cctgaggaccgtgttcgtaagcaga

SEQ ID NO: 252132 - DNA, 25 bp, Mus musculus
cctgaggactcaaggtaagaaatcc

SEQ ID NO: 252133 - DNA, 25 bp, Mus musculus
cctgaggactcaagtttcagagtga

SEQ ID NO: 252134 - DNA, 25 bp, Mus musculus
cctgaggactttgcaactgctgctg

SEQ ID NO: 252135 - DNA, 25 bp, Mus musculus
cctgaggagagagaacctggtccac

SEQ ID NO: 252136 - DNA, 25 bp, Mus musculus
cctgaggagagagtgttccagaagg

SEQ ID NO: 252137 - DNA, 25 bp, Mus musculus
cctgaggagtcccggcgtggagcgt

SEQ ID NO: 252138 - DNA, 25 bp, Mus musculus
cctgaggagtcccggctcatcactc

SEQ ID NO: 252139 - DNA, 25 bp, Mus musculus
cctgaggagtcggagatggcagcca

SEQ ID NO: 252140 - DNA, 25 bp, Mus musculus
cctgaggatcccgagggcatcagat

SEQ ID NO: 252141 - DNA, 25 bp, Mus musculus
cctgaggatcccgggcgtgattgag

SEQ ID NO: 252142 - DNA, 25 bp, Mus musculus
cctgaggatcttcgggtatttggct

SEQ ID NO: 252143 - DNA, 25 bp, Mus musculus
cctgaggcagaagctccaagatgaa

SEQ ID NO: 252144 - DNA, 25 bp, Mus musculus
cctgaggccaaacagctcaggcctg

SEQ ID NO: 252145 - DNA, 25 bp, Mus musculus
cctgaggcccgccaggaattgtgga

SEQ ID NO: 252146 - DNA, 25 bp, Mus musculus
cctgaggcccgccaggatatgaatt

SEQ ID NO: 252147 - DNA, 25 bp, Mus musculus
cctgaggccctttatgctgctggca

SEQ ID NO: 252148 - DNA, 25 bp, Mus musculus
cctgaggcgagcagctggtggcccc

SEQ ID NO: 252149 - DNA, 25 bp, Mus musculus
cctgaggcgagcagctgtggcccct

SEQ ID NO: 252150 - DNA, 25 bp, Mus musculus
cctgaggctgcttctttttaaagat

SEQ ID NO: 252151 - DNA, 25 bp, Mus musculus
cctgaggctgcttgggaaccaacag

SEQ ID NO: 252152 - DNA, 25 bp, Mus musculus
cctgaggctgtaagcaatggcttcg

SEQ ID NO: 252153 - DNA, 25 bp, Mus musculus
cctgagggagacagaggcattcaag

SEQ ID NO: 252154 - DNA, 25 bp, Mus musculus
cctgagggaggtgaccattgttgaa

SEQ ID NO: 252155 - DNA, 25 bp, Mus musculus
cctgagggcaccaagcactgaaaac

SEQ ID NO: 252156 - DNA, 25 bp, Mus musculus
cctgaggtacaaggtgaactgtgga

SEQ ID NO: 252157 - DNA, 25 bp, Mus musculus
cctgaggtccagatgggctcctcag

SEQ ID NO: 252158 - DNA, 25 bp, Mus musculus
cctgaggtccaggaactgttaagac

SEQ ID NO: 252159 - DNA, 25 bp, Mus musculus
cctgaggtcctgggctcttctctca

SEQ ID NO: 252160 - DNA, 25 bp, Mus musculus
cctgaggtgagagcagccatggagc

SEQ ID NO: 252161 - DNA, 25 bp, Mus musculus
cctgaggtggagcagccctgttccc

SEQ ID NO: 252162 - DNA, 25 bp, Mus musculus
cctgaggtggagcaggtgaggggtc

SEQ ID NO: 252163 - DNA, 25 bp, Mus musculus
cctgaggtggatgtgtgggtgcagg

SEQ ID NO: 252164 - DNA, 25 bp, Mus musculus
cctgaggtgggccaggtccacctcc

SEQ ID NO: 252165 - DNA, 25 bp, Mus musculus
cctgaggtggtgcaggagatccccc

SEQ ID NO: 252166 - DNA, 25 bp, Mus musculus
cctgagtacagacgtgacttgtagc

SEQ ID NO: 252167 - DNA, 25 bp, Mus musculus
cctgagtacgaggaggaaatctcca

SEQ ID NO: 252168 - DNA, 25 bp, Mus musculus
cctgagtccctagaagcaagacgac

SEQ ID NO: 252169 - DNA, 25 bp, Mus musculus
cctgagtcctgtgagacagtgtttc

SEQ ID NO: 252170 - DNA, 25 bp, Mus musculus
cctgagtcctgtgagagatggatgt

SEQ ID NO: 252171 - DNA, 25 bp, Mus musculus
cctgagtccttaaaggtttatggga

SEQ ID NO: 252172 - DNA, 25 bp, Mus musculus
cctgagtctcaagagccaaggacat

SEQ ID NO: 252173 - DNA, 25 bp, Mus musculus
cctgagtgactctgccgaccccttc

SEQ ID NO: 252174 - DNA, 25 bp, Mus musculus
cctgagtgactctgctcttctagat

SEQ ID NO: 252175 - DNA, 25 bp, Mus musculus
cctgagtgagatggaaatagggaca

SEQ ID NO: 252176 - DNA, 25 bp, Mus musculus
cctgagtgagcagaaaatgcgacca

SEQ ID NO: 252177 - DNA, 25 bp, Mus musculus
cctgagtgagctcatccactggaac

SEQ ID NO: 252178 - DNA, 25 bp, Mus musculus
cctgagtgaggatcatggctgctgt

SEQ ID NO: 252179 - DNA, 25 bp, Mus musculus
cctgagtgaggtagataaagatttt

SEQ ID NO: 252180 - DNA, 25 bp, Mus musculus
cctgagtgaggtcatccactggaac

SEQ ID NO: 252181 - DNA, 25 bp, Mus musculus
cctgagtgagttggaaatagggaca

SEQ ID NO: 252182 - DNA, 25 bp, Mus musculus
cctgagtgatgatggaatcagcgtg

SEQ ID NO: 252183 - DNA, 25 bp, Mus musculus
cctgagtgccagtgcccgccccata

SEQ ID NO: 252184 - DNA, 25 bp, Mus musculus
cctgagtgccatggattggcgtctc

SEQ ID NO: 252185 - DNA, 25 bp, Mus musculus
cctgagtgcgcaagcaaaagaaagt

SEQ ID NO: 252186 - DNA, 25 bp, Mus musculus
cctgagtgcgcgtggaacctagggt

SEQ ID NO: 252187 - DNA, 25 bp, Mus musculus
cctgagtgtctctgatcaagagcac

SEQ ID NO: 252188 - DNA, 25 bp, Mus musculus
cctgagtgttggcgggccatcccag

SEQ ID NO: 252189 - DNA, 25 bp, Mus musculus
cctgagttcacagagcatgcaaccc

SEQ ID NO: 252190 - DNA, 25 bp, Mus musculus
cctgagtttcaggagcggctgcaaa

SEQ ID NO: 252191 - DNA, 25 bp, Mus musculus
cctgagtttgacgactctgactatg

SEQ ID NO: 252192 - DNA, 25 bp, Mus musculus
cctgataaaaagtatgtctacgttg

SEQ ID NO: 252193 - DNA, 25 bp, Mus musculus
cctgataaacttcccacgacagcag

SEQ ID NO: 252194 - DNA, 25 bp, Mus musculus
cctgataaataggagctccacccca

SEQ ID NO: 252195 - DNA, 25 bp, Mus musculus
cctgataagaagattatttccaagt

SEQ ID NO: 252196 - DNA, 25 bp, Mus musculus
cctgataagtttgaggtattctgct

SEQ ID NO: 252197 - DNA, 25 bp, Mus musculus
cctgataatggcagcccagccatga

SEQ ID NO: 252198 - DNA, 25 bp, Mus musculus
cctgatacagagcgcctagatgatt

SEQ ID NO: 252199 - DNA, 25 bp, Mus musculus
cctgatacaggagttccactccagc

SEQ ID NO: 252200 - DNA, 25 bp, Mus musculus
cctgataccaggggttccagtgtcc

SEQ ID NO: 252201 - DNA, 25 bp, Mus musculus
cctgatagaagagcttcggaaatgt

SEQ ID NO: 252202 - DNA, 25 bp, Mus musculus
cctgatagaagagtggtagatgacc

SEQ ID NO: 252203 - DNA, 25 bp, Mus musculus
cctgatagactaggatattttaaag

SEQ ID NO: 252204 - DNA, 25 bp, Mus musculus
cctgatagactaggttggtttgcca

SEQ ID NO: 252205 - DNA, 25 bp, Mus musculus
cctgatagagttgcaacatctcgga

SEQ ID NO: 252206 - DNA, 25 bp, Mus musculus
cctgatagcagctgtgagtaccaga

SEQ ID NO: 252207 - DNA, 25 bp, Mus musculus
cctgataggcaggagatgagccgct

SEQ ID NO: 252208 - DNA, 25 bp, Mus musculus
cctgatatactcatctgccatggtg

SEQ ID NO: 252209 - DNA, 25 bp, Mus musculus
cctgatatcaagtcgcgcattgcca

SEQ ID NO: 252210 - DNA, 25 bp, Mus musculus
cctgatatctaatagcattcctttc

SEQ ID NO: 252211 - DNA, 25 bp, Mus musculus
cctgatatttgacattaacgagctg

SEQ ID NO: 252212 - DNA, 25 bp, Mus musculus
cctgatcaagatgacagcatggagt

SEQ ID NO: 252213 - DNA, 25 bp, Mus musculus
cctgatcaagatggactgtaacaaa

SEQ ID NO: 252214 - DNA, 25 bp, Mus musculus
cctgatcaagttctcctactcagcc

SEQ ID NO: 252215 - DNA, 25 bp, Mus musculus
cctgatcacaaagcagacccaggag

SEQ ID NO: 252216 - DNA, 25 bp, Mus musculus
cctgatcacaggacagctccctctc

SEQ ID NO: 252217 - DNA, 25 bp, Mus musculus
cctgatcatcacaggagttggtgac

SEQ ID NO: 252218 - DNA, 25 bp, Mus musculus
cctgatcatcccggcgcctccccat

SEQ ID NO: 252219 - DNA, 25 bp, Mus musculus
cctgatcatcccgggagttccgact

SEQ ID NO: 252220 - DNA, 25 bp, Mus musculus
cctgatcatcccggtatccctggaa

SEQ ID NO: 252221 - DNA, 25 bp, Mus musculus
cctgatccagatctggccgccccgg

SEQ ID NO: 252222 - DNA, 25 bp, Mus musculus
cctgatctaaggagattacctggag

SEQ ID NO: 252223 - DNA, 25 bp, Mus musculus
cctgatctccaactaggcggccgtc

SEQ ID NO: 252224 - DNA, 25 bp, Mus musculus
cctgatctccgcatctcttcgccga

SEQ ID NO: 252225 - DNA, 25 bp, Mus musculus
cctgatctctcagtgtaccccgaag

SEQ ID NO: 252226 - DNA, 25 bp, Mus musculus
cctgatctgcggcggtcagggaaac

SEQ ID NO: 252227 - DNA, 25 bp, Mus musculus
cctgatctgtgtgggcgggtgcatg

SEQ ID NO: 252228 - DNA, 25 bp, Mus musculus
cctgatctttaggaggagcaggctg

SEQ ID NO: 252229 - DNA, 25 bp, Mus musculus
cctgatgaaaacgttgtatcagagt

SEQ ID NO: 252230 - DNA, 25 bp, Mus musculus
cctgatgaaaatgcctttgagtaat

SEQ ID NO: 252231 - DNA, 25 bp, Mus musculus
cctgatgaaagcatctgtggcaagg

SEQ ID NO: 252232 - DNA, 25 bp, Mus musculus
cctgatgaaatgctttgaaccctga

SEQ ID NO: 252233 - DNA, 25 bp, Mus musculus
cctgatgaaatggaaaaactctgat

SEQ ID NO: 252234 - DNA, 25 bp, Mus musculus
cctgatgaaatggtcttcttcccgt

SEQ ID NO: 252235 - DNA, 25 bp, Mus musculus
cctgatgaagaccctcttgtgagga

SEQ ID NO: 252236 - DNA, 25 bp, Mus musculus
cctgatgaaggactatgtgctggct

SEQ ID NO: 252237 - DNA, 25 bp, Mus musculus
cctgatgaatcccaaaggccctgcc

SEQ ID NO: 252238 - DNA, 25 bp, Mus musculus
cctgatgaatgaggtgtgtactttg

SEQ ID NO: 252239 - DNA, 25 bp, Mus musculus
cctgatgagagtgttcgaggaatat

SEQ ID NO: 252240 - DNA, 25 bp, Mus musculus
cctgatgagccagtcccgcatcctt

SEQ ID NO: 252241 - DNA, 25 bp, Mus musculus
cctgatgaggagatactggagtgtg

SEQ ID NO: 252242 - DNA, 25 bp, Mus musculus
cctgatgagttctcccataccctcc

SEQ ID NO: 252243 - DNA, 25 bp, Mus musculus
cctgatgatggagaggtggacatgg

SEQ ID NO: 252244 - DNA, 25 bp, Mus musculus
cctgatgcagctccccaccacttac

SEQ ID NO: 252245 - DNA, 25 bp, Mus musculus
cctgatgcattcacagggtgatctt

SEQ ID NO: 252246 - DNA, 25 bp, Mus musculus
cctgatgcctccgctggaaaccatg

SEQ ID NO: 252247 - DNA, 25 bp, Mus musculus
cctgatgcgggagcacagtcggaca

SEQ ID NO: 252248 - DNA, 25 bp, Mus musculus
cctgatgctgacggtcacagagctg

SEQ ID NO: 252249 - DNA, 25 bp, Mus musculus
cctgatgctgaggcctgacctggag

SEQ ID NO: 252250 - DNA, 25 bp, Mus musculus
cctgatgctgcctcacacaagaaaa

SEQ ID NO: 252251 - DNA, 25 bp, Mus musculus
cctgatgctggccagccggtttaag

SEQ ID NO: 252252 - DNA, 25 bp, Mus musculus
cctgatggaaagaacagacaaggtg

SEQ ID NO: 252253 - DNA, 25 bp, Mus musculus
cctgatggaggtgcttgtcctggcc

SEQ ID NO: 252254 - DNA, 25 bp, Mus musculus
cctgatggattgtcgcgatagagta

SEQ ID NO: 252255 - DNA, 25 bp, Mus musculus
cctgatgggcaaggctgggtgggtg

SEQ ID NO: 252256 - DNA, 25 bp, Mus musculus
cctgatgggcaggcaccaggagagc

SEQ ID NO: 252257 - DNA, 25 bp, Mus musculus
cctgatggtccaaagggcaacccag

SEQ ID NO: 252258 - DNA, 25 bp, Mus musculus
cctgatgtaggacgaagaatgacca

SEQ ID NO: 252259 - DNA, 25 bp, Mus musculus
cctgatgtatgaggcttcctgcggg

SEQ ID NO: 252260 - DNA, 25 bp, Mus musculus
cctgatgtccgggcactagagcagc

SEQ ID NO: 252261 - DNA, 25 bp, Mus musculus
cctgatgtgaggctcctcatagtcc

SEQ ID NO: 252262 - DNA, 25 bp, Mus musculus
cctgatgtttcccagaatcatacga

SEQ ID NO: 252263 - DNA, 25 bp, Mus musculus
cctgattatcagtaccccaccccag

SEQ ID NO: 252264 - DNA, 25 bp, Mus musculus
cctgattccacgcttcttgccacct

SEQ ID NO: 252265 - DNA, 25 bp, Mus musculus
cctgattccgggactgcaggctaca

SEQ ID NO: 252266 - DNA, 25 bp, Mus musculus
cctgattgaaagtaatcacccaatt

SEQ ID NO: 252267 - DNA, 25 bp, Mus musculus
cctgattgaaagtataattgcagaa

SEQ ID NO: 252268 - DNA, 25 bp, Mus musculus
cctgattgagggccgcaaacaggaa

SEQ ID NO: 252269 - DNA, 25 bp, Mus musculus
cctgattgataatcctgctaccagc

SEQ ID NO: 252270 - DNA, 25 bp, Mus musculus
cctgattgccttttcccagtgttgt

SEQ ID NO: 252271 - DNA, 25 bp, Mus musculus
cctgattggcaggtctcacatgagt

SEQ ID NO: 252272 - DNA, 25 bp, Mus musculus
cctgattggttatgtcacaaacata

SEQ ID NO: 252273 - DNA, 25 bp, Mus musculus
cctgattggttatgtggcagcagaa

SEQ ID NO: 252274 - DNA, 25 bp, Mus musculus
cctgattgtggcaggacgaagaatg

SEQ ID NO: 252275 - DNA, 25 bp, Mus musculus
cctgattgtggcaggtatcacgagc

SEQ ID NO: 252276 - DNA, 25 bp, Mus musculus
cctgcaaaaggaggtgttcctgctc

SEQ ID NO: 252277 - DNA, 25 bp, Mus musculus
cctgcaaaaggctctgagtttctga

SEQ ID NO: 252278 - DNA, 25 bp, Mus musculus
cctgcaaaatggcaggagctcgacg

SEQ ID NO: 252279 - DNA, 25 bp, Mus musculus
cctgcaaaatgtaactgcggatccc

SEQ ID NO: 252280 - DNA, 25 bp, Mus musculus
cctgcaaactttatgatcctggggc

SEQ ID NO: 252281 - DNA, 25 bp, Mus musculus
cctgcaaagctgaaggctccgagta

SEQ ID NO: 252282 - DNA, 25 bp, Mus musculus
cctgcaacaggctaggtgctggtgt

SEQ ID NO: 252283 - DNA, 25 bp, Mus musculus
cctgcaacaggctaggttgcaggaa

SEQ ID NO: 252284 - DNA, 25 bp, Mus musculus
cctgcaaccaagatgagtccttcca

SEQ ID NO: 252285 - DNA, 25 bp, Mus musculus
cctgcaaccaagatttaaacgagtg

SEQ ID NO: 252286 - DNA, 25 bp, Mus musculus
cctgcaacccagagaccttcccctt

SEQ ID NO: 252287 - DNA, 25 bp, Mus musculus
cctgcaaccccagcccgcacccgga

SEQ ID NO: 252288 - DNA, 25 bp, Mus musculus
cctgcaaccctggagctgccgcagt

SEQ ID NO: 252289 - DNA, 25 bp, Mus musculus
cctgcaacctgccgaataaggccag

SEQ ID NO: 252290 - DNA, 25 bp, Mus musculus
cctgcaacctgccgagaaacccttt

SEQ ID NO: 252291 - DNA, 25 bp, Mus musculus
cctgcaacgcacgacgcagtggaag

SEQ ID NO: 252292 - DNA, 25 bp, Mus musculus
cctgcaactcaaggatggatgccct

SEQ ID NO: 252293 - DNA, 25 bp, Mus musculus
cctgcaactcaaggtctaaggtaca

SEQ ID NO: 252294 - DNA, 25 bp, Mus musculus
cctgcaagccaggccattccccagt

SEQ ID NO: 252295 - DNA, 25 bp, Mus musculus
cctgcaagccaggtggagcagccaa

SEQ ID NO: 252296 - DNA, 25 bp, Mus musculus
cctgcaagccaggttccttaaaaga

SEQ ID NO: 252297 - DNA, 25 bp, Mus musculus
cctgcaagcctgtatggatggattc

SEQ ID NO: 252298 - DNA, 25 bp, Mus musculus
cctgcaagctaggtaggaacaacct

SEQ ID NO: 252299 - DNA, 25 bp, Mus musculus
cctgcaagctcagatgtatagactc

SEQ ID NO: 252300 - DNA, 25 bp, Mus musculus
cctgcaagctgcaggttgcttctat

SEQ ID NO: 252301 - DNA, 25 bp, Mus musculus
cctgcaaggcatggcccagttcaat

SEQ ID NO: 252302 - DNA, 25 bp, Mus musculus
cctgcaaggccagtggatgcgccta

SEQ ID NO: 252303 - DNA, 25 bp, Mus musculus
cctgcaagttataccacatcacagc

SEQ ID NO: 252304 - DNA, 25 bp, Mus musculus
cctgcaattacaaaggtggctttga

SEQ ID NO: 252305 - DNA, 25 bp, Mus musculus
cctgcacaagcaaaacctggaaatt

SEQ ID NO: 252306 - DNA, 25 bp, Mus musculus
cctgcacaagctgactcatcatgtc

SEQ ID NO: 252307 - DNA, 25 bp, Mus musculus
cctgcacaaggttctgaaccagctg

SEQ ID NO: 252308 - DNA, 25 bp, Mus musculus
cctgcacacataacaccaatgactg

SEQ ID NO: 252309 - DNA, 25 bp, Mus musculus
cctgcacagcgggctgacggctgag

SEQ ID NO: 252310 - DNA, 25 bp, Mus musculus
cctgcacaggagaagggagttggca

SEQ ID NO: 252311 - DNA, 25 bp, Mus musculus
cctgcacaggagaaggtgaaggagg

SEQ ID NO: 252312 - DNA, 25 bp, Mus musculus
cctgcacatctctgatgtggaaggg

SEQ ID NO: 252313 - DNA, 25 bp, Mus musculus
cctgcaccagaatggcatccaggtg

SEQ ID NO: 252314 - DNA, 25 bp, Mus musculus
cctgcaccagagaaatcataaacca

SEQ ID NO: 252315 - DNA, 25 bp, Mus musculus
cctgcaccagagacggaaaaccctc

SEQ ID NO: 252316 - DNA, 25 bp, Mus musculus
cctgcaccagagcaatgttcttctg

SEQ ID NO: 252317 - DNA, 25 bp, Mus musculus
cctgcaccaggaagagttgggctgt

SEQ ID NO: 252318 - DNA, 25 bp, Mus musculus
cctgcaccaggattctaatcccttt

SEQ ID NO: 252319 - DNA, 25 bp, Mus musculus
cctgcaccaggcctgtattgatgaa

SEQ ID NO: 252320 - DNA, 25 bp, Mus musculus
cctgcaccatcgccaagaacagcag

SEQ ID NO: 252321 - DNA, 25 bp, Mus musculus
cctgcacccaagcccctccagttct

SEQ ID NO: 252322 - DNA, 25 bp, Mus musculus
cctgcacccaagggcacagaccggc

SEQ ID NO: 252323 - DNA, 25 bp, Mus musculus
cctgcacccagaggcatcagaaaag

SEQ ID NO: 252324 - DNA, 25 bp, Mus musculus
cctgcaccccggagtatgatcccaa

SEQ ID NO: 252325 - DNA, 25 bp, Mus musculus
cctgcaccgcggaggctctgcagaa

SEQ ID NO: 252326 - DNA, 25 bp, Mus musculus
cctgcacctaccaaactggcattat

SEQ ID NO: 252327 - DNA, 25 bp, Mus musculus
cctgcacctcccaggaccccaagac

SEQ ID NO: 252328 - DNA, 25 bp, Mus musculus
cctgcacctcctgtgctttcgttgg

SEQ ID NO: 252329 - DNA, 25 bp, Mus musculus
cctgcacctggatgcaccctgctct

SEQ ID NO: 252330 - DNA, 25 bp, Mus musculus
cctgcacctggatgcattttgttcc

SEQ ID NO: 252331 - DNA, 25 bp, Mus musculus
cctgcacgcaaggtggccgaaggcc

SEQ ID NO: 252332 - DNA, 25 bp, Mus musculus
cctgcacgcaggatggacctctcta

SEQ ID NO: 252333 - DNA, 25 bp, Mus musculus
cctgcacgcaggatgtgtatccatc

SEQ ID NO: 252334 - DNA, 25 bp, Mus musculus
cctgcacgcgcttgccgacccttcc

SEQ ID NO: 252335 - DNA, 25 bp, Mus musculus
cctgcacggctggccaggccaagga

SEQ ID NO: 252336 - DNA, 25 bp, Mus musculus
cctgcacgtgacagtgggctccctg

SEQ ID NO: 252337 - DNA, 25 bp, Mus musculus
cctgcacgtggaccacagtgaactg

SEQ ID NO: 252338 - DNA, 25 bp, Mus musculus
cctgcacgtgggtccctggaggctg

SEQ ID NO: 252339 - DNA, 25 bp, Mus musculus
cctgcactcaggtagtgacatggta

SEQ ID NO: 252340 - DNA, 25 bp, Mus musculus
cctgcactctatgttttctcagtgc

SEQ ID NO: 252341 - DNA, 25 bp, Mus musculus
cctgcactgggaaatatggctttgt

SEQ ID NO: 252342 - DNA, 25 bp, Mus musculus
cctgcactgggaaggcttgtcgctt

SEQ ID NO: 252343 - DNA, 25 bp, Mus musculus
cctgcactgtgtgtggagtgctgac

SEQ ID NO: 252344 - DNA, 25 bp, Mus musculus
cctgcactgtgtgtggcatattctc

SEQ ID NO: 252345 - DNA, 25 bp, Mus musculus
cctgcacttgtggatggagaccaag

SEQ ID NO: 252346 - DNA, 25 bp, Mus musculus
cctgcactttacaggtggctttgca

SEQ ID NO: 252347 - DNA, 25 bp, Mus musculus
cctgcactttgaggaggaagagatc

SEQ ID NO: 252348 - DNA, 25 bp, Mus musculus
cctgcagaaaatcaaactgcagctt

SEQ ID NO: 252349 - DNA, 25 bp, Mus musculus
cctgcagaaagaaaagcccttatgt

SEQ ID NO: 252350 - DNA, 25 bp, Mus musculus
cctgcagaaagaggtacataatgct

SEQ ID NO: 252351 - DNA, 25 bp, Mus musculus
cctgcagaaagaggtgaaaaaactg

SEQ ID NO: 252352 - DNA, 25 bp, Mus musculus
cctgcagaacacagcggagatccag

SEQ ID NO: 252353 - DNA, 25 bp, Mus musculus
cctgcagaacacaggtgttgaatca

SEQ ID NO: 252354 - DNA, 25 bp, Mus musculus
cctgcagaaggcccaggtcgtggac

SEQ ID NO: 252355 - DNA, 25 bp, Mus musculus
cctgcagaatcggccagcgcccgag

SEQ ID NO: 252356 - DNA, 25 bp, Mus musculus
cctgcagaatctggaggctggtgag

SEQ ID NO: 252357 - DNA, 25 bp, Mus musculus
cctgcagaccagaggctgcctggag

SEQ ID NO: 252358 - DNA, 25 bp, Mus musculus
cctgcagaccccggaaagccagaac

SEQ ID NO: 252359 - DNA, 25 bp, Mus musculus
cctgcagacctctgacaaggatgag

SEQ ID NO: 252360 - DNA, 25 bp, Mus musculus
cctgcagacctctgagcgaacatcc

SEQ ID NO: 252361 - DNA, 25 bp, Mus musculus
cctgcagagaaactcatcaagcaat

SEQ ID NO: 252362 - DNA, 25 bp, Mus musculus
cctgcagagaaagaacatttcagaa

SEQ ID NO: 252363 - DNA, 25 bp, Mus musculus
cctgcagagaccccgatcctcgtgg

SEQ ID NO: 252364 - DNA, 25 bp, Mus musculus
cctgcagagaccccggaccaatctc

SEQ ID NO: 252365 - DNA, 25 bp, Mus musculus
cctgcagagaccccgggtccagcac

SEQ ID NO: 252366 - DNA, 25 bp, Mus musculus
cctgcagagaggaaaaccaaagaag

SEQ ID NO: 252367 - DNA, 25 bp, Mus musculus
cctgcagagccacggtcaagatgct

SEQ ID NO: 252368 - DNA, 25 bp, Mus musculus
cctgcagagccagagccagctgacc

SEQ ID NO: 252369 - DNA, 25 bp, Mus musculus
cctgcagagccagagtctgcagaca

SEQ ID NO: 252370 - DNA, 25 bp, Mus musculus
cctgcagaggcacatataatggaac

SEQ ID NO: 252371 - DNA, 25 bp, Mus musculus
cctgcagaggcagatataatggaac

SEQ ID NO: 252372 - DNA, 25 bp, Mus musculus
cctgcagatggctaggagtaaaaat

SEQ ID NO: 252373 - DNA, 25 bp, Mus musculus
cctgcagatggctagggaatgtgga

SEQ ID NO: 252374 - DNA, 25 bp, Mus musculus
cctgcagatgtccctgtccattgcc

SEQ ID NO: 252375 - DNA, 25 bp, Mus musculus
cctgcagcaaagccaccatgccaat

SEQ ID NO: 252376 - DNA, 25 bp, Mus musculus
cctgcagcaaaggccgatacaaagc

SEQ ID NO: 252377 - DNA, 25 bp, Mus musculus
cctgcagcagctgattagagtaacc

SEQ ID NO: 252378 - DNA, 25 bp, Mus musculus
cctgcagcaggaattggggaattcc

SEQ ID NO: 252379 - DNA, 25 bp, Mus musculus
cctgcagcaggtgatagagggaaag

SEQ ID NO: 252380 - DNA, 25 bp, Mus musculus
cctgcagccacgatggacagtctga

SEQ ID NO: 252381 - DNA, 25 bp, Mus musculus
cctgcagccagaagaatatccagtt

SEQ ID NO: 252382 - DNA, 25 bp, Mus musculus
cctgcagcccagggcgctgtgaggt

SEQ ID NO: 252383 - DNA, 25 bp, Mus musculus
cctgcagccgcccggccatctgctt

SEQ ID NO: 252384 - DNA, 25 bp, Mus musculus
cctgcagccgcccgggacaggccat

SEQ ID NO: 252385 - DNA, 25 bp, Mus musculus
cctgcagcctcgggttcctccatct

SEQ ID NO: 252386 - DNA, 25 bp, Mus musculus
cctgcagcctgtggtatcctgtggc

SEQ ID NO: 252387 - DNA, 25 bp, Mus musculus
cctgcagcggcatgaagatgagcta

SEQ ID NO: 252388 - DNA, 25 bp, Mus musculus
cctgcagcggcatggtgatgaatct

SEQ ID NO: 252389 - DNA, 25 bp, Mus musculus
cctgcagctaacaggattggtatca

SEQ ID NO: 252390 - DNA, 25 bp, Mus musculus
cctgcagctaaggcagaaaagatag

SEQ ID NO: 252391 - DNA, 25 bp, Mus musculus
cctgcagctacaggagtcatggctg

SEQ ID NO: 252392 - DNA, 25 bp, Mus musculus
cctgcagctgcacgggcaggtggta

SEQ ID NO: 252393 - DNA, 25 bp, Mus musculus
cctgcaggaaccaggttggtctggg

SEQ ID NO: 252394 - DNA, 25 bp, Mus musculus
cctgcaggaaccagttggaaggacc

SEQ ID NO: 252395 - DNA, 25 bp, Mus musculus
cctgcaggacaggtggcctctgatg

SEQ ID NO: 252396 - DNA, 25 bp, Mus musculus
cctgcaggaccaggtgtcatttgga

SEQ ID NO: 252397 - DNA, 25 bp, Mus musculus
cctgcaggaccaggtgtctgatctg

SEQ ID NO: 252398 - DNA, 25 bp, Mus musculus
cctgcaggagaagatcacaagaggg

SEQ ID NO: 252399 - DNA, 25 bp, Mus musculus
cctgcaggagaagatggtggatcgc

SEQ ID NO: 252400 - DNA, 25 bp, Mus musculus
cctgcaggagaaggaagaacaaaaa

SEQ ID NO: 252401 - DNA, 25 bp, Mus musculus
cctgcaggagagctgggtcgcccaa

SEQ ID NO: 252402 - DNA, 25 bp, Mus musculus
cctgcaggaggcagcgggccgtgaa

SEQ ID NO: 252403 - DNA, 25 bp, Mus musculus
cctgcaggcctttgagttgtccagg

SEQ ID NO: 252404 - DNA, 25 bp, Mus musculus
cctgcaggcctttgctggagcatgt

SEQ ID NO: 252405 - DNA, 25 bp, Mus musculus
cctgcaggcctttgggaaggaatgt

SEQ ID NO: 252406 - DNA, 25 bp, Mus musculus
cctgcaggcgtgaggaaactgctgt

SEQ ID NO: 252407 - DNA, 25 bp, Mus musculus
cctgcaggtgcttctggtaacccag

SEQ ID NO: 252408 - DNA, 25 bp, Mus musculus
cctgcaggtggcagttttaggttct

SEQ ID NO: 252409 - DNA, 25 bp, Mus musculus
cctgcagtcaaaatcaagcactgca

SEQ ID NO: 252410 - DNA, 25 bp, Mus musculus
cctgcagtcaaatggatctggcttc

SEQ ID NO: 252411 - DNA, 25 bp, Mus musculus
cctgcagtccagagtggaccagatt

SEQ ID NO: 252412 - DNA, 25 bp, Mus musculus
cctgcagtccaggatagatatgatt

SEQ ID NO: 252413 - DNA, 25 bp, Mus musculus
cctgcagtccaggtcctgcgactgg

SEQ ID NO: 252414 - DNA, 25 bp, Mus musculus
cctgcagtggatacattgttgcaat

SEQ ID NO: 252415 - DNA, 25 bp, Mus musculus
cctgcagtgtcagtgctgccctagg

SEQ ID NO: 252416 - DNA, 25 bp, Mus musculus
cctgcagtgtcagttcctttctaga

SEQ ID NO: 252417 - DNA, 25 bp, Mus musculus
cctgcagtgtgcaatggtgctccac

SEQ ID NO: 252418 - DNA, 25 bp, Mus musculus
cctgcagttccacaggctcagggaa

SEQ ID NO: 252419 - DNA, 25 bp, Mus musculus
cctgcagttctgtttctctctgtag

SEQ ID NO: 252420 - DNA, 25 bp, Mus musculus
cctgcagttcttccacttgatccca

SEQ ID NO: 252421 - DNA, 25 bp, Mus musculus
cctgcagtttaaaaacggcgtggag

SEQ ID NO: 252422 - DNA, 25 bp, Mus musculus
cctgcataaggctgcggagaagggt

SEQ ID NO: 252423 - DNA, 25 bp, Mus musculus
cctgcataaggttataagtacatgg

SEQ ID NO: 252424 - DNA, 25 bp, Mus musculus
cctgcataagtgagcaactgttcat

SEQ ID NO: 252425 - DNA, 25 bp, Mus musculus
cctgcatagaccaggtgagacggaa

SEQ ID NO: 252426 - DNA, 25 bp, Mus musculus
cctgcatagaggtagttcctaatat

SEQ ID NO: 252427 - DNA, 25 bp, Mus musculus
cctgcatagaggtgtgaaattgaaa

SEQ ID NO: 252428 - DNA, 25 bp, Mus musculus
cctgcatcaaggagcttgtgtcaga

SEQ ID NO: 252429 - DNA, 25 bp, Mus musculus
cctgcatcaaggtacttgtgtcaga

SEQ ID NO: 252430 - DNA, 25 bp, Mus musculus
cctgcatcaggtcctagaccaaagc

SEQ ID NO: 252431 - DNA, 25 bp, Mus musculus
cctgcatcatggtatttgatgtcca

SEQ ID NO: 252432 - DNA, 25 bp, Mus musculus
cctgcatccagaacaatggagacac

SEQ ID NO: 252433 - DNA, 25 bp, Mus musculus
cctgcatcccttgaggagttaccaa

SEQ ID NO: 252434 - DNA, 25 bp, Mus musculus
cctgcatcctcaagaggaagcccgt

SEQ ID NO: 252435 - DNA, 25 bp, Mus musculus
cctgcatccttcaggtctccagatg

SEQ ID NO: 252436 - DNA, 25 bp, Mus musculus
cctgcatctgaagaggtggccatgg

SEQ ID NO: 252437 - DNA, 25 bp, Mus musculus
cctgcatctgagtgccgtactgttc

SEQ ID NO: 252438 - DNA, 25 bp, Mus musculus
cctgcatcttccttcctaggcatcg

SEQ ID NO: 252439 - DNA, 25 bp, Mus musculus
cctgcatctttggaatgcacaagcc

SEQ ID NO: 252440 - DNA, 25 bp, Mus musculus
cctgcatgaagcggtgttcgaggaa

SEQ ID NO: 252441 - DNA, 25 bp, Mus musculus
cctgcatgatatagataccaagtgg

SEQ ID NO: 252442 - DNA, 25 bp, Mus musculus
cctgcatgatataggacagaaattg

SEQ ID NO: 252443 - DNA, 25 bp, Mus musculus
cctgcatgcagtcagacttctccaa

SEQ ID NO: 252444 - DNA, 25 bp, Mus musculus
cctgcatgcagtcagtgcagccctt

SEQ ID NO: 252445 - DNA, 25 bp, Mus musculus
cctgcatgcatgcatgtggtcaacc

SEQ ID NO: 252446 - DNA, 25 bp, Mus musculus
cctgcatgctgaccctgttggcctt

SEQ ID NO: 252447 - DNA, 25 bp, Mus musculus
cctgcatgctgatgccttagacttg

SEQ ID NO: 252448 - DNA, 25 bp, Mus musculus
cctgcatgctggctcttcatagcct

SEQ ID NO: 252449 - DNA, 25 bp, Mus musculus
cctgcatgctgggtccttcaggacc

SEQ ID NO: 252450 - DNA, 25 bp, Mus musculus
cctgcatgtcaccctgatggtgccc

SEQ ID NO: 252451 - DNA, 25 bp, Mus musculus
cctgcatgtcaccctgccgtggatg

SEQ ID NO: 252452 - DNA, 25 bp, Mus musculus
cctgcatgtcaccctggactggtgg

SEQ ID NO: 252453 - DNA, 25 bp, Mus musculus
cctgcatgtcaccctgtgctgaagg

SEQ ID NO: 252454 - DNA, 25 bp, Mus musculus
cctgcatttggggttcctgctggac

SEQ ID NO: 252455 - DNA, 25 bp, Mus musculus
cctgcattttaaggagtgcatgcgg

SEQ ID NO: 252456 - DNA, 25 bp, Mus musculus
cctgccaaaagttgtggagctcctg

SEQ ID NO: 252457 - DNA, 25 bp, Mus musculus
cctgccaactctgaaaagaagaaaa

SEQ ID NO: 252458 - DNA, 25 bp, Mus musculus
cctgccaagatggctccagctccag

SEQ ID NO: 252459 - DNA, 25 bp, Mus musculus
cctgccaagatgggtgctcacagta

SEQ ID NO: 252460 - DNA, 25 bp, Mus musculus
cctgccaagcatgatgtcaaagtct

SEQ ID NO: 252461 - DNA, 25 bp, Mus musculus
cctgccaagcattgtggcagatgtg

SEQ ID NO: 252462 - DNA, 25 bp, Mus musculus
cctgccaagcatttccctccaggct

SEQ ID NO: 252463 - DNA, 25 bp, Mus musculus
cctgccaaggcaacggccacgtacc

SEQ ID NO: 252464 - DNA, 25 bp, Mus musculus
cctgccaagtttgatgaagcggagc

SEQ ID NO: 252465 - DNA, 25 bp, Mus musculus
cctgccaatcccatctctcccgcag

SEQ ID NO: 252466 - DNA, 25 bp, Mus musculus
cctgccacactggggtagcctttgt

SEQ ID NO: 252467 - DNA, 25 bp, Mus musculus
cctgccacagacagggccactgccg

SEQ ID NO: 252468 - DNA, 25 bp, Mus musculus
cctgccacagccccggccaccctcc

SEQ ID NO: 252469 - DNA, 25 bp, Mus musculus
cctgccacaggaagagagctcagag

SEQ ID NO: 252470 - DNA, 25 bp, Mus musculus
cctgccacaggtactactgggcctt

SEQ ID NO: 252471 - DNA, 25 bp, Mus musculus
cctgccacatcatgacaagaaaaag

SEQ ID NO: 252472 - DNA, 25 bp, Mus musculus
cctgccacatcattcaaatattgga

SEQ ID NO: 252473 - DNA, 25 bp, Mus musculus
cctgccaccaaaggtcgggtcattc

SEQ ID NO: 252474 - DNA, 25 bp, Mus musculus
cctgccaccactcaggagcccttgc

SEQ ID NO: 252475 - DNA, 25 bp, Mus musculus
cctgccaccagcagccaggccaaaa

SEQ ID NO: 252476 - DNA, 25 bp, Mus musculus
cctgccacccaggttctgattggaa

SEQ ID NO: 252477 - DNA, 25 bp, Mus musculus
cctgccacctgcgagcccactcggc

SEQ ID NO: 252478 - DNA, 25 bp, Mus musculus
cctgccacctggagatggtgtttcc

SEQ ID NO: 252479 - DNA, 25 bp, Mus musculus
cctgccactcacgcgagttccagtg

SEQ ID NO: 252480 - DNA, 25 bp, Mus musculus
cctgccactggtgcggaagattgca

SEQ ID NO: 252481 - DNA, 25 bp, Mus musculus
cctgccactggtgtagatacaggcc

SEQ ID NO: 252482 - DNA, 25 bp, Mus musculus
cctgccagaaccacctgtagctctt

SEQ ID NO: 252483 - DNA, 25 bp, Mus musculus
cctgccagacgcacagccgagcctt

SEQ ID NO: 252484 - DNA, 25 bp, Mus musculus
cctgccagaggccctgcccgcctgg

SEQ ID NO: 252485 - DNA, 25 bp, Mus musculus
cctgccagaggttgagacagatcct

SEQ ID NO: 252486 - DNA, 25 bp, Mus musculus
cctgccagatgaggatcatgcggca

SEQ ID NO: 252487 - DNA, 25 bp, Mus musculus
cctgccaggctctagttcattgaaa

SEQ ID NO: 252488 - DNA, 25 bp, Mus musculus
cctgccagggatggcgcggccgatc

SEQ ID NO: 252489 - DNA, 25 bp, Mus musculus
cctgccatcagatacaagcggaagg

SEQ ID NO: 252490 - DNA, 25 bp, Mus musculus
cctgccatcctcaggttcaggcagc

SEQ ID NO: 252491 - DNA, 25 bp, Mus musculus
cctgccatccttgctcggcgtccta

SEQ ID NO: 252492 - DNA, 25 bp, Mus musculus
cctgccatccttggtgaggctttcc

SEQ ID NO: 252493 - DNA, 25 bp, Mus musculus
cctgccatgaaatggccctgcggat

SEQ ID NO: 252494 - DNA, 25 bp, Mus musculus
cctgccatgagacgaaagtaggtgg

SEQ ID NO: 252495 - DNA, 25 bp, Mus musculus
cctgccatgaggaattcttctactt

SEQ ID NO: 252496 - DNA, 25 bp, Mus musculus
cctgccatgtccaagcggggtgcca

SEQ ID NO: 252497 - DNA, 25 bp, Mus musculus
cctgccatgttggatgccgccttgg

SEQ ID NO: 252498 - DNA, 25 bp, Mus musculus
cctgccattctagatgtgaaggcac

SEQ ID NO: 252499 - DNA, 25 bp, Mus musculus
cctgccattctgatgaagttcctga

SEQ ID NO: 252500 - DNA, 25 bp, Mus musculus
cctgccattcttattctgaggaagc

SEQ ID NO: 252501 - DNA, 25 bp, Mus musculus
cctgccattgctgctctgacagttg

SEQ ID NO: 252502 - DNA, 25 bp, Mus musculus
cctgccattgctgctgattactctg

SEQ ID NO: 252503 - DNA, 25 bp, Mus musculus
cctgccattgttaagaccgagaatt

SEQ ID NO: 252504 - DNA, 25 bp, Mus musculus
cctgcccaaacgtgtgcccaattac

SEQ ID NO: 252505 - DNA, 25 bp, Mus musculus
cctgcccaagctgtgctggatgccc

SEQ ID NO: 252506 - DNA, 25 bp, Mus musculus
cctgcccaaggagctggagggtggg

SEQ ID NO: 252507 - DNA, 25 bp, Mus musculus
cctgcccacctggtacttcctgtgg

SEQ ID NO: 252508 - DNA, 25 bp, Mus musculus
cctgcccacctggttcccagagcta

SEQ ID NO: 252509 - DNA, 25 bp, Mus musculus
cctgcccagaaagtgcttctctcct

SEQ ID NO: 252510 - DNA, 25 bp, Mus musculus
cctgcccagaaagtggtcacgcccg

SEQ ID NO: 252511 - DNA, 25 bp, Mus musculus
cctgcccagagcctgaccccaggac

SEQ ID NO: 252512 - DNA, 25 bp, Mus musculus
cctgcccagagtgaacctgtgagaa

SEQ ID NO: 252513 - DNA, 25 bp, Mus musculus
cctgcccagatactccccccaggcc

SEQ ID NO: 252514 - DNA, 25 bp, Mus musculus
cctgcccaggatgtggctggaccgc

SEQ ID NO: 252515 - DNA, 25 bp, Mus musculus
cctgcccagtgttgaagaaattgta

SEQ ID NO: 252516 - DNA, 25 bp, Mus musculus
cctgcccatatgcagaagttgctct

SEQ ID NO: 252517 - DNA, 25 bp, Mus musculus
cctgcccatcatcagtttttccaga

SEQ ID NO: 252518 - DNA, 25 bp, Mus musculus
cctgccccaaagacattctgcccaa

SEQ ID NO: 252519 - DNA, 25 bp, Mus musculus
cctgccccacgggcttcagcagcgt

SEQ ID NO: 252520 - DNA, 25 bp, Mus musculus
cctgccccactaagattgaagatta

SEQ ID NO: 252521 - DNA, 25 bp, Mus musculus
cctgccccagaaaacatcggaccag

SEQ ID NO: 252522 - DNA, 25 bp, Mus musculus
cctgccccagctctgggcgtggagc

SEQ ID NO: 252523 - DNA, 25 bp, Mus musculus
cctgccccaggacttctctgtgaag

SEQ ID NO: 252524 - DNA, 25 bp, Mus musculus
cctgccccaggtggggaacctggga

SEQ ID NO: 252525 - DNA, 25 bp, Mus musculus
cctgcccccaagaggacgagtcttg

SEQ ID NO: 252526 - DNA, 25 bp, Mus musculus
cctgcccccaaggtggtgttcgtag

SEQ ID NO: 252527 - DNA, 25 bp, Mus musculus
cctgcccccagaacctggacccttt

SEQ ID NO: 252528 - DNA, 25 bp, Mus musculus
cctgcccccagaggctgaagatgga

SEQ ID NO: 252529 - DNA, 25 bp, Mus musculus
cctgcccccagagggagaaggggag

SEQ ID NO: 252530 - DNA, 25 bp, Mus musculus
cctgccccgctatgagcttgaggag

SEQ ID NO: 252531 - DNA, 25 bp, Mus musculus
cctgccccgtgaactgtgacaaacg

SEQ ID NO: 252532 - DNA, 25 bp, Mus musculus
cctgcccctgccagggctgatggtg

SEQ ID NO: 252533 - DNA, 25 bp, Mus musculus
cctgcccgaaagagtctaaagcctg

SEQ ID NO: 252534 - DNA, 25 bp, Mus musculus
cctgcccgaaagagtctaaagcgcc

SEQ ID NO: 252535 - DNA, 25 bp, Mus musculus
cctgcccgagcgtttctagagcatc

SEQ ID NO: 252536 - DNA, 25 bp, Mus musculus
cctgcccgcaggagcgcagcaatct

SEQ ID NO: 252537 - DNA, 25 bp, Mus musculus
cctgcccgcctgtaagttccaggtg

SEQ ID NO: 252538 - DNA, 25 bp, Mus musculus
cctgcccgcctgtcgccttgaagct

SEQ ID NO: 252539 - DNA, 25 bp, Mus musculus
cctgcccggtcttccgctgaagggg

SEQ ID NO: 252540 - DNA, 25 bp, Mus musculus
cctgccctcaaggtaatggatgact

SEQ ID NO: 252541 - DNA, 25 bp, Mus musculus
cctgccctcaaggtggtgaagaaag

SEQ ID NO: 252542 - DNA, 25 bp, Mus musculus
cctgccctcactcggccgccgcgtg

SEQ ID NO: 252543 - DNA, 25 bp, Mus musculus
cctgccctccgttgaaagcaccata

SEQ ID NO: 252544 - DNA, 25 bp, Mus musculus
cctgccctcgctagttctgacggtt

SEQ ID NO: 252545 - DNA, 25 bp, Mus musculus
cctgccctgaaagtcccgagtttat

SEQ ID NO: 252546 - DNA, 25 bp, Mus musculus
cctgccctgcagccagacagtgacc

SEQ ID NO: 252547 - DNA, 25 bp, Mus musculus
cctgccctgtgcaagtgccctctgt

SEQ ID NO: 252548 - DNA, 25 bp, Mus musculus
cctgccgcaacgatgggaagctcct

SEQ ID NO: 252549 - DNA, 25 bp, Mus musculus
cctgccgcgacctgaacacatgtcg

SEQ ID NO: 252550 - DNA, 25 bp, Mus musculus
cctgccgcgacgagaaccccagaca

SEQ ID NO: 252551 - DNA, 25 bp, Mus musculus
cctgccgcgacgagccctgctggtg

SEQ ID NO: 252552 - DNA, 25 bp, Mus musculus
cctgccgcgacgagctgaggagggc

SEQ ID NO: 252553 - DNA, 25 bp, Mus musculus
cctgccgctgctgggtggctgcgtt

SEQ ID NO: 252554 - DNA, 25 bp, Mus musculus
cctgccgctgggcgtccgacctccc

SEQ ID NO: 252555 - DNA, 25 bp, Mus musculus
cctgccgctggtaagactttgaacc

SEQ ID NO: 252556 - DNA, 25 bp, Mus musculus
cctgccggaggagaggtacagacat

SEQ ID NO: 252557 - DNA, 25 bp, Mus musculus
cctgccggcctccaggtctgtgcac

SEQ ID NO: 252558 - DNA, 25 bp, Mus musculus
cctgccggcggggtctcctgtgagc

SEQ ID NO: 252559 - DNA, 25 bp, Mus musculus
cctgccggctgaggagaaacaacaa

SEQ ID NO: 252560 - DNA, 25 bp, Mus musculus
cctgccgggcagcgagtcatcctcc

SEQ ID NO: 252561 - DNA, 25 bp, Mus musculus
cctgccgggctgtgcctctcctttc

SEQ ID NO: 252562 - DNA, 25 bp, Mus musculus
cctgccggtgcccccggccctcaag

SEQ ID NO: 252563 - DNA, 25 bp, Mus musculus
cctgcctaacaggtcgctgttattc

SEQ ID NO: 252564 - DNA, 25 bp, Mus musculus
cctgcctaagaatggctcttaccgc

SEQ ID NO: 252565 - DNA, 25 bp, Mus musculus
cctgcctaagaatgggatgcctgga

SEQ ID NO: 252566 - DNA, 25 bp, Mus musculus
cctgcctacaggttaggccggggct

SEQ ID NO: 252567 - DNA, 25 bp, Mus musculus
cctgcctagctttgtatagtccaga

SEQ ID NO: 252568 - DNA, 25 bp, Mus musculus
cctgcctatgcaacccccagtcccc

SEQ ID NO: 252569 - DNA, 25 bp, Mus musculus
cctgcctatgcaagactcatttcac

SEQ ID NO: 252570 - DNA, 25 bp, Mus musculus
cctgcctattcaagatctgcacgtt

SEQ ID NO: 252571 - DNA, 25 bp, Mus musculus
cctgcctcacaagggactcatgcag

SEQ ID NO: 252572 - DNA, 25 bp, Mus musculus
cctgcctcagcccatacccagccat

SEQ ID NO: 252573 - DNA, 25 bp, Mus musculus
cctgcctcagtaaaggccaaaaatc

SEQ ID NO: 252574 - DNA, 25 bp, Mus musculus
cctgcctccagcactgggaagcaaa

SEQ ID NO: 252575 - DNA, 25 bp, Mus musculus
cctgcctcccaaggttgttaaacat

SEQ ID NO: 252576 - DNA, 25 bp, Mus musculus
cctgcctccccactaccctccaact

SEQ ID NO: 252577 - DNA, 25 bp, Mus musculus
cctgcctccctgagactctttgctg

SEQ ID NO: 252578 - DNA, 25 bp, Mus musculus
cctgcctccctgagcctccatgtac

SEQ ID NO: 252579 - DNA, 25 bp, Mus musculus
cctgcctcctcagaagactcagaaa

SEQ ID NO: 252580 - DNA, 25 bp, Mus musculus
cctgcctccttcagatgacggattc

SEQ ID NO: 252581 - DNA, 25 bp, Mus musculus
cctgcctcgggtgagccctagattg

SEQ ID NO: 252582 - DNA, 25 bp, Mus musculus
cctgcctcggttcctgtaaagctgg

SEQ ID NO: 252583 - DNA, 25 bp, Mus musculus
cctgcctctcacagaatacatccag

SEQ ID NO: 252584 - DNA, 25 bp, Mus musculus
cctgcctctgagtgctgcacccact

SEQ ID NO: 252585 - DNA, 25 bp, Mus musculus
cctgcctctgggcggaaaaactgat

SEQ ID NO: 252586 - DNA, 25 bp, Mus musculus
cctgcctctgggttaacaatcaaga

SEQ ID NO: 252587 - DNA, 25 bp, Mus musculus
cctgcctgacctggagctgcagttt

SEQ ID NO: 252588 - DNA, 25 bp, Mus musculus
cctgcctgagaagctcaaacaggcc

SEQ ID NO: 252589 - DNA, 25 bp, Mus musculus
cctgcctgagcaaggggaccaggat

SEQ ID NO: 252590 - DNA, 25 bp, Mus musculus
cctgcctgaggagctgcagaagtgc

SEQ ID NO: 252591 - DNA, 25 bp, Mus musculus
cctgcctgagtgcgcaagcaaaaga

SEQ ID NO: 252592 - DNA, 25 bp, Mus musculus
cctgcctgagtgcgcgtggaaccta

SEQ ID NO: 252593 - DNA, 25 bp, Mus musculus
cctgcctgatgagctgggagacctt

SEQ ID NO: 252594 - DNA, 25 bp, Mus musculus
cctgcctgatgctgcctcacacaag

SEQ ID NO: 252595 - DNA, 25 bp, Mus musculus
cctgcctgcagccactacctcctcc

SEQ ID NO: 252596 - DNA, 25 bp, Mus musculus
cctgcctgccgagcaatgccaagtg

SEQ ID NO: 252597 - DNA, 25 bp, Mus musculus
cctgcctgcctgcagccactacctc

SEQ ID NO: 252598 - DNA, 25 bp, Mus musculus
cctgcctggaatctgcgacccatac

SEQ ID NO: 252599 - DNA, 25 bp, Mus musculus
cctgcctggagaatagctcctgtat

SEQ ID NO: 252600 - DNA, 25 bp, Mus musculus
cctgcctgggcgcaggaagatttgg

SEQ ID NO: 252601 - DNA, 25 bp, Mus musculus
cctgcctggggaatgaattccacag

SEQ ID NO: 252602 - DNA, 25 bp, Mus musculus
cctgcctggtcagtgtcagctggtc

SEQ ID NO: 252603 - DNA, 25 bp, Mus musculus
cctgcctgtcaggcttcctgcgggc

SEQ ID NO: 252604 - DNA, 25 bp, Mus musculus
cctgcctgtgccggcctttaatgtg

SEQ ID NO: 252605 - DNA, 25 bp, Mus musculus
cctgcctgtgggaagtgctttgggg

SEQ ID NO: 252606 - DNA, 25 bp, Mus musculus
cctgcctgtgggctcagtctccaca

SEQ ID NO: 252607 - DNA, 25 bp, Mus musculus
cctgcctgttacaggtctgcagcat

SEQ ID NO: 252608 - DNA, 25 bp, Mus musculus
cctgccttcaaacgtgtttggactt

SEQ ID NO: 252609 - DNA, 25 bp, Mus musculus
cctgccttcaggctttgcagggacc

SEQ ID NO: 252610 - DNA, 25 bp, Mus musculus
cctgccttccagtgtgtggacagcc

SEQ ID NO: 252611 - DNA, 25 bp, Mus musculus
cctgccttccagtgtgtggtgtccc

SEQ ID NO: 252612 - DNA, 25 bp, Mus musculus
cctgccttcctatgtagcactcagc

SEQ ID NO: 252613 - DNA, 25 bp, Mus musculus
cctgccttgagagcttacccctcat

SEQ ID NO: 252614 - DNA, 25 bp, Mus musculus
cctgccttgaggacgggcagaaccc

SEQ ID NO: 252615 - DNA, 25 bp, Mus musculus
cctgccttgaggatgacaagatcca

SEQ ID NO: 252616 - DNA, 25 bp, Mus musculus
cctgccttgaggctggctactgttt

SEQ ID NO: 252617 - DNA, 25 bp, Mus musculus
cctgccttgaggttcctagacaact

SEQ ID NO: 252618 - DNA, 25 bp, Mus musculus
cctgccttgatgacagggtcccttg

SEQ ID NO: 252619 - DNA, 25 bp, Mus musculus
cctgccttgattggccctccttttt

SEQ ID NO: 252620 - DNA, 25 bp, Mus musculus
cctgcctttgaggatgacatgcaca

SEQ ID NO: 252621 - DNA, 25 bp, Mus musculus
cctgccttttgacagccacacctgc

SEQ ID NO: 252622 - DNA, 25 bp, Mus musculus
cctgcgaatcggagccccagatcct

SEQ ID NO: 252623 - DNA, 25 bp, Mus musculus
cctgcgaccaggtgacccaatgaca

SEQ ID NO: 252624 - DNA, 25 bp, Mus musculus
cctgcgacccagccattcattgaga

SEQ ID NO: 252625 - DNA, 25 bp, Mus musculus
cctgcgacccaggtgcctggctgca

SEQ ID NO: 252626 - DNA, 25 bp, Mus musculus
cctgcgaccgtggctcctaatgtac

SEQ ID NO: 252627 - DNA, 25 bp, Mus musculus
cctgcgacggccagggtggaactac

SEQ ID NO: 252628 - DNA, 25 bp, Mus musculus
cctgcgagcaagggtctctgatatg

SEQ ID NO: 252629 - DNA, 25 bp, Mus musculus
cctgcgagcaaggtccttccatagt

SEQ ID NO: 252630 - DNA, 25 bp, Mus musculus
cctgcgagctccagcaagaaaaatt

SEQ ID NO: 252631 - DNA, 25 bp, Mus musculus
cctgcgagtcccaggtttgaagagt

SEQ ID NO: 252632 - DNA, 25 bp, Mus musculus
cctgcgagtcccagtgctgtaatta

SEQ ID NO: 252633 - DNA, 25 bp, Mus musculus
cctgcgatctgggtggaaatggaat

SEQ ID NO: 252634 - DNA, 25 bp, Mus musculus
cctgcgattcaaccctcctgggatc

SEQ ID NO: 252635 - DNA, 25 bp, Mus musculus
cctgcgattgaagagtcttttcaca

SEQ ID NO: 252636 - DNA, 25 bp, Mus musculus
cctgcgattgtgtcgaacaaatagt

SEQ ID NO: 252637 - DNA, 25 bp, Mus musculus
cctgcgattgtgtcggacggtggga

SEQ ID NO: 252638 - DNA, 25 bp, Mus musculus
cctgcgcaaaatcacgcttaaagga

SEQ ID NO: 252639 - DNA, 25 bp, Mus musculus
cctgcgcagctcggcatttcagtcg

SEQ ID NO: 252640 - DNA, 25 bp, Mus musculus
cctgcgcagctgcagcctgacagag

SEQ ID NO: 252641 - DNA, 25 bp, Mus musculus
cctgcgcagctgcagggaggggaac

SEQ ID NO: 252642 - DNA, 25 bp, Mus musculus
cctgcgccagcacgcagggattgga

SEQ ID NO: 252643 - DNA, 25 bp, Mus musculus
cctgcgccaggtgaccatctcggtg

SEQ ID NO: 252644 - DNA, 25 bp, Mus musculus
cctgcgccgagagatcccgatgtgt

SEQ ID NO: 252645 - DNA, 25 bp, Mus musculus
cctgcgcctggagcaggaagggcca

SEQ ID NO: 252646 - DNA, 25 bp, Mus musculus
cctgcgcgacaggttttggctcgtg

SEQ ID NO: 252647 - DNA, 25 bp, Mus musculus
cctgcgcgcgcccggcctggccatg

SEQ ID NO: 252648 - DNA, 25 bp, Mus musculus
cctgcgcggcggcgggcaccatcca

SEQ ID NO: 252649 - DNA, 25 bp, Mus musculus
cctgcgcggcggctggtttcctcaa

SEQ ID NO: 252650 - DNA, 25 bp, Mus musculus
cctgcgcgtcacgccttggcccatt

SEQ ID NO: 252651 - DNA, 25 bp, Mus musculus
cctgcgctgactgacatctactgcc

SEQ ID NO: 252652 - DNA, 25 bp, Mus musculus
cctgcgctgccctggggctgtgtct

SEQ ID NO: 252653 - DNA, 25 bp, Mus musculus
cctgcggacacgtcttttgctctgc

SEQ ID NO: 252654 - DNA, 25 bp, Mus musculus
cctgcggacacgtgaatgtctgaag

SEQ ID NO: 252655 - DNA, 25 bp, Mus musculus
cctgcggacacgtttcatcctatct

SEQ ID NO: 252656 - DNA, 25 bp, Mus musculus
cctgcggacagacaactgaggataa

SEQ ID NO: 252657 - DNA, 25 bp, Mus musculus
cctgcggacagtctcctgccctgag

SEQ ID NO: 252658 - DNA, 25 bp, Mus musculus
cctgcggagacagggggctcaccct

SEQ ID NO: 252659 - DNA, 25 bp, Mus musculus
cctgcggagacaggtttcggccgag

SEQ ID NO: 252660 - DNA, 25 bp, Mus musculus
cctgcggagagaggaccaaatggat

SEQ ID NO: 252661 - DNA, 25 bp, Mus musculus
cctgcggagagggttcttgaccacc

SEQ ID NO: 252662 - DNA, 25 bp, Mus musculus
cctgcggagagtaagcggaggcctg

SEQ ID NO: 252663 - DNA, 25 bp, Mus musculus
cctgcggagctcgcgactcactgtg

SEQ ID NO: 252664 - DNA, 25 bp, Mus musculus
cctgcggaggataagacctctgaac

SEQ ID NO: 252665 - DNA, 25 bp, Mus musculus
cctgcggcagaatggacagttgctc

SEQ ID NO: 252666 - DNA, 25 bp, Mus musculus
cctgcggcagaatgggtgcagacct

SEQ ID NO: 252667 - DNA, 25 bp, Mus musculus
cctgcggccacgaaacgatcagcag

SEQ ID NO: 252668 - DNA, 25 bp, Mus musculus
cctgcggccaggaggtggcttacaa

SEQ ID NO: 252669 - DNA, 25 bp, Mus musculus
cctgcggcgctagctaggcggccgt

SEQ ID NO: 252670 - DNA, 25 bp, Mus musculus
cctgcggctgcagaagcgtctcctg

SEQ ID NO: 252671 - DNA, 25 bp, Mus musculus
cctgcggctgccagaaacttcagtg

SEQ ID NO: 252672 - DNA, 25 bp, Mus musculus
cctgcgggcacaggtggacgacccc

SEQ ID NO: 252673 - DNA, 25 bp, Mus musculus
cctgcgggcgcggattgtgccttct

SEQ ID NO: 252674 - DNA, 25 bp, Mus musculus
cctgcgggggagttttacagagagc

SEQ ID NO: 252675 - DNA, 25 bp, Mus musculus
cctgcgggttttgctggaccgcagc

SEQ ID NO: 252676 - DNA, 25 bp, Mus musculus
cctgcggtagaaaaagcagacggag

SEQ ID NO: 252677 - DNA, 25 bp, Mus musculus
cctgcggttaagtgagcaaaccaac

SEQ ID NO: 252678 - DNA, 25 bp, Mus musculus
cctgcgtaccagcatcgagaaggtg

SEQ ID NO: 252679 - DNA, 25 bp, Mus musculus
cctgcgtaccaggtatggcatcagc

SEQ ID NO: 252680 - DNA, 25 bp, Mus musculus
cctgcgtaggagcaatacaccaagt

SEQ ID NO: 252681 - DNA, 25 bp, Mus musculus
cctgcgtctgctgcatctctgagct

SEQ ID NO: 252682 - DNA, 25 bp, Mus musculus
cctgcgtctgctgcggtttctttgc

SEQ ID NO: 252683 - DNA, 25 bp, Mus musculus
cctgcgtctgtttgctttgagcgct

SEQ ID NO: 252684 - DNA, 25 bp, Mus musculus
cctgcgtgacgtgtcacgatgtctg

SEQ ID NO: 252685 - DNA, 25 bp, Mus musculus
cctgcgtgcaattagagaaagataa

SEQ ID NO: 252686 - DNA, 25 bp, Mus musculus
cctgcgtgcaattaggcgtgcagcc

SEQ ID NO: 252687 - DNA, 25 bp, Mus musculus
cctgcgtgcagtgatcgtttcagct

SEQ ID NO: 252688 - DNA, 25 bp, Mus musculus
cctgcgtggagctcaggcctgcatg

SEQ ID NO: 252689 - DNA, 25 bp, Mus musculus
cctgcgtggagtgttcagccaagca

SEQ ID NO: 252690 - DNA, 25 bp, Mus musculus
cctgctaaatgttaggccggggctt

SEQ ID NO: 252691 - DNA, 25 bp, Mus musculus
cctgctaacaggtgatatttttgaa

SEQ ID NO: 252692 - DNA, 25 bp, Mus musculus
cctgctacaacaaaactacagacag

SEQ ID NO: 252693 - DNA, 25 bp, Mus musculus
cctgctacaaggtgcagcagaaaga

SEQ ID NO: 252694 - DNA, 25 bp, Mus musculus
cctgctacacgaggtgcagtgggtg

SEQ ID NO: 252695 - DNA, 25 bp, Mus musculus
cctgctacacgagtgggtggtgcaa

SEQ ID NO: 252696 - DNA, 25 bp, Mus musculus
cctgctacagaggttgcaagtgttg

SEQ ID NO: 252697 - DNA, 25 bp, Mus musculus
cctgctacagcaacttctcctggcc

SEQ ID NO: 252698 - DNA, 25 bp, Mus musculus
cctgctacattaataccctggagca

SEQ ID NO: 252699 - DNA, 25 bp, Mus musculus
cctgctaccataggagactacacgg

SEQ ID NO: 252700 - DNA, 25 bp, Mus musculus
cctgctaccataggctccacttacc

SEQ ID NO: 252701 - DNA, 25 bp, Mus musculus
cctgctaccccggcaaagctgttgc

SEQ ID NO: 252702 - DNA, 25 bp, Mus musculus
cctgctacctacggctctcttaaga

SEQ ID NO: 252703 - DNA, 25 bp, Mus musculus
cctgctacctacggggaacttgaaa

SEQ ID NO: 252704 - DNA, 25 bp, Mus musculus
cctgctacctggaagagtgcctgct

SEQ ID NO: 252705 - DNA, 25 bp, Mus musculus
cctgctacggccgcactcggaaccc

SEQ ID NO: 252706 - DNA, 25 bp, Mus musculus
cctgctactccaggtttcttgaact

SEQ ID NO: 252707 - DNA, 25 bp, Mus musculus
cctgctactcgcggttcccagagct

SEQ ID NO: 252708 - DNA, 25 bp, Mus musculus
cctgctagagacggtcgctcgcatt

SEQ ID NO: 252709 - DNA, 25 bp, Mus musculus
cctgctagagcgcatcccagccttt

SEQ ID NO: 252710 - DNA, 25 bp, Mus musculus
cctgctaggagcagagatcaagttc

SEQ ID NO: 252711 - DNA, 25 bp, Mus musculus
cctgctataaagaaactacataaag

SEQ ID NO: 252712 - DNA, 25 bp, Mus musculus
cctgctataaaggacttagaagtct

SEQ ID NO: 252713 - DNA, 25 bp, Mus musculus
cctgctatcctaagtgatgtgccag

SEQ ID NO: 252714 - DNA, 25 bp, Mus musculus
cctgctatgagaaactccccaactt

SEQ ID NO: 252715 - DNA, 25 bp, Mus musculus
cctgctatgaggagggtattcctac

SEQ ID NO: 252716 - DNA, 25 bp, Mus musculus
cctgctatgggcatattgtattaga

SEQ ID NO: 252717 - DNA, 25 bp, Mus musculus
cctgctatgggcatattgtatttta

SEQ ID NO: 252718 - DNA, 25 bp, Mus musculus
cctgctattcaaaacagcgtggaag

SEQ ID NO: 252719 - DNA, 25 bp, Mus musculus
cctgctattctacaggaaaaatccg

SEQ ID NO: 252720 - DNA, 25 bp, Mus musculus
cctgctcaagttcgattggatccga

SEQ ID NO: 252721 - DNA, 25 bp, Mus musculus
cctgctcaagttcttctctgtgttc

SEQ ID NO: 252722 - DNA, 25 bp, Mus musculus
cctgctcagcagaatcgggttgaga

SEQ ID NO: 252723 - DNA, 25 bp, Mus musculus
cctgctcagctcaggtactagaaga

SEQ ID NO: 252724 - DNA, 25 bp, Mus musculus
cctgctcagctgcgcatcctgcctc

SEQ ID NO: 252725 - DNA, 25 bp, Mus musculus
cctgctcagctgcgtcggcacccag

SEQ ID NO: 252726 - DNA, 25 bp, Mus musculus
cctgctcattcgaagatgttttcgg

SEQ ID NO: 252727 - DNA, 25 bp, Mus musculus
cctgctccaaggctacagctccccc

SEQ ID NO: 252728 - DNA, 25 bp, Mus musculus
cctgctccaaggctacagctctcaa

SEQ ID NO: 252729 - DNA, 25 bp, Mus musculus
cctgctccacaggtgttctacactc

SEQ ID NO: 252730 - DNA, 25 bp, Mus musculus
cctgctccaccttcaagcttcagaa

SEQ ID NO: 252731 - DNA, 25 bp, Mus musculus
cctgctccaccttcaatttggaagg

SEQ ID NO: 252732 - DNA, 25 bp, Mus musculus
cctgctccaccttctcgagaagggc

SEQ ID NO: 252733 - DNA, 25 bp, Mus musculus
cctgctccagacgtcttgagagcag

SEQ ID NO: 252734 - DNA, 25 bp, Mus musculus
cctgctccagcctgggagggcctag

SEQ ID NO: 252735 - DNA, 25 bp, Mus musculus
cctgctccagcggggactctggcgg

SEQ ID NO: 252736 - DNA, 25 bp, Mus musculus
cctgctcccaagcccttggacatcc

SEQ ID NO: 252737 - DNA, 25 bp, Mus musculus
cctgctcccatgcttatcattgcaa

SEQ ID NO: 252738 - DNA, 25 bp, Mus musculus
cctgctccgtggagggtacactagc

SEQ ID NO: 252739 - DNA, 25 bp, Mus musculus
cctgctcctcagccctaaagaacca

SEQ ID NO: 252740 - DNA, 25 bp, Mus musculus
cctgctcctccacaggctctggtca

SEQ ID NO: 252741 - DNA, 25 bp, Mus musculus
cctgctcctgggcttgtggagaaca

SEQ ID NO: 252742 - DNA, 25 bp, Mus musculus
cctgctcctggtggcatctttagcc

SEQ ID NO: 252743 - DNA, 25 bp, Mus musculus
cctgctcctggtttctgaacttggc

SEQ ID NO: 252744 - DNA, 25 bp, Mus musculus
cctgctcgaaacagatcagccagca

SEQ ID NO: 252745 - DNA, 25 bp, Mus musculus
cctgctcgaaacagtagtttagtat

SEQ ID NO: 252746 - DNA, 25 bp, Mus musculus
cctgctctacagaaaataaatcata

SEQ ID NO: 252747 - DNA, 25 bp, Mus musculus
cctgctctatgtgctgatggagctg

SEQ ID NO: 252748 - DNA, 25 bp, Mus musculus
cctgctctctcagcgcatctcctcc

SEQ ID NO: 252749 - DNA, 25 bp, Mus musculus
cctgctctctcttgacccaagccac

SEQ ID NO: 252750 - DNA, 25 bp, Mus musculus
cctgctctgaaagcttactgataag

SEQ ID NO: 252751 - DNA, 25 bp, Mus musculus
cctgctctgctctgcctcggcaaca

SEQ ID NO: 252752 - DNA, 25 bp, Mus musculus
cctgctctggatgagagggagatga

SEQ ID NO: 252753 - DNA, 25 bp, Mus musculus
cctgctgaacgagggttcagccgac

SEQ ID NO: 252754 - DNA, 25 bp, Mus musculus
cctgctgaagaagagagggactcaa

SEQ ID NO: 252755 - DNA, 25 bp, Mus musculus
cctgctgaagaagagcagtttccgg

SEQ ID NO: 252756 - DNA, 25 bp, Mus musculus
cctgctgaagattcagatattaaag

SEQ ID NO: 252757 - DNA, 25 bp, Mus musculus
cctgctgaagggagcatttccagct

SEQ ID NO: 252758 - DNA, 25 bp, Mus musculus
cctgctgacaagccgatacacctcc

SEQ ID NO: 252759 - DNA, 25 bp, Mus musculus
cctgctgaccgacaggctctgcgcg

SEQ ID NO: 252760 - DNA, 25 bp, Mus musculus
cctgctgaccgatttctgcatgaac

SEQ ID NO: 252761 - DNA, 25 bp, Mus musculus
cctgctgacgcagatcattaagtgt

SEQ ID NO: 252762 - DNA, 25 bp, Mus musculus
cctgctgacgcaggatcctacccag

SEQ ID NO: 252763 - DNA, 25 bp, Mus musculus
cctgctgagcaaaggagtgattctc

SEQ ID NO: 252764 - DNA, 25 bp, Mus musculus
cctgctgcaaagcctgcctggggct

SEQ ID NO: 252765 - DNA, 25 bp, Mus musculus
cctgctgcagaacgagtttgttgta

SEQ ID NO: 252766 - DNA, 25 bp, Mus musculus
cctgctgcagaatcaagctatagaa

SEQ ID NO: 252767 - DNA, 25 bp, Mus musculus
cctgctgcagctggacccaacatcc

SEQ ID NO: 252768 - DNA, 25 bp, Mus musculus
cctgctgcagcttcgctcttgtgga

SEQ ID NO: 252769 - DNA, 25 bp, Mus musculus
cctgctgcaggctctggtccaagaa

SEQ ID NO: 252770 - DNA, 25 bp, Mus musculus
cctgctgcaggctgccaacagctac

SEQ ID NO: 252771 - DNA, 25 bp, Mus musculus
cctgctgcagtcagcaaaatatcca

SEQ ID NO: 252772 - DNA, 25 bp, Mus musculus
cctgctgcagtgtggggaaatccca

SEQ ID NO: 252773 - DNA, 25 bp, Mus musculus
cctgctgcccctctcctgggaagga

SEQ ID NO: 252774 - DNA, 25 bp, Mus musculus
cctgctgccctggaatcttccgaca

SEQ ID NO: 252775 - DNA, 25 bp, Mus musculus
cctgctgccctggagcctcaaacca

SEQ ID NO: 252776 - DNA, 25 bp, Mus musculus
cctgctgccgatctcagtctctggt

SEQ ID NO: 252777 - DNA, 25 bp, Mus musculus
cctgctgcgctctgtgccaacgcgt

SEQ ID NO: 252778 - DNA, 25 bp, Mus musculus
cctgctgcggaagaacgcagaggtg

SEQ ID NO: 252779 - DNA, 25 bp, Mus musculus
cctgctgctaaagcttattgagcgg

SEQ ID NO: 252780 - DNA, 25 bp, Mus musculus
cctgctgctaaagggttatcacaca

SEQ ID NO: 252781 - DNA, 25 bp, Mus musculus
cctgctgctagcccgggccccatat

SEQ ID NO: 252782 - DNA, 25 bp, Mus musculus
cctgctgctagccctgctcttggac

SEQ ID NO: 252783 - DNA, 25 bp, Mus musculus
cctgctgctagtaacgaaggcagtc

SEQ ID NO: 252784 - DNA, 25 bp, Mus musculus
cctgctgctcacacacacacacaca

SEQ ID NO: 252785 - DNA, 25 bp, Mus musculus
cctgctgctccaggaaattgccaaa

SEQ ID NO: 252786 - DNA, 25 bp, Mus musculus
cctgctgctgaagaacttttccagt

SEQ ID NO: 252787 - DNA, 25 bp, Mus musculus
cctgctgctgatgcgtcgagccctt

SEQ ID NO: 252788 - DNA, 25 bp, Mus musculus
cctgctgctgatggatgtcgtggat

SEQ ID NO: 252789 - DNA, 25 bp, Mus musculus
cctgctgctgcctccaggtggagga

SEQ ID NO: 252790 - DNA, 25 bp, Mus musculus
cctgctgctgctgggtgctggagag

SEQ ID NO: 252791 - DNA, 25 bp, Mus musculus
cctgctgcttctaggtgctggagag

SEQ ID NO: 252792 - DNA, 25 bp, Mus musculus
cctgctgcttctcagtcaggatggc

SEQ ID NO: 252793 - DNA, 25 bp, Mus musculus
cctgctggaaagagattgctctctc

SEQ ID NO: 252794 - DNA, 25 bp, Mus musculus
cctgctggaaggagcagcggtcagc

SEQ ID NO: 252795 - DNA, 25 bp, Mus musculus
cctgctggaaggtgtgaccccacaa

SEQ ID NO: 252796 - DNA, 25 bp, Mus musculus
cctgctggaagtctctaataaagaa

SEQ ID NO: 252797 - DNA, 25 bp, Mus musculus
cctgctggacattcaggagcttctg

SEQ ID NO: 252798 - DNA, 25 bp, Mus musculus
cctgctggacctgttcagcccctcg

SEQ ID NO: 252799 - DNA, 25 bp, Mus musculus
cctgctggagaatgagagagaaaac

SEQ ID NO: 252800 - DNA, 25 bp, Mus musculus
cctgctggagccagaagaacagaca

SEQ ID NO: 252801 - DNA, 25 bp, Mus musculus
cctgctggagccagaaggtttggat

SEQ ID NO: 252802 - DNA, 25 bp, Mus musculus
cctgctggagccagaggctgcattg

SEQ ID NO: 252803 - DNA, 25 bp, Mus musculus
cctgctggagctgctattgttgatg

SEQ ID NO: 252804 - DNA, 25 bp, Mus musculus
cctgctggaggagctgatgcactga

SEQ ID NO: 252805 - DNA, 25 bp, Mus musculus
cctgctggaggtacgaggatgtcgt

SEQ ID NO: 252806 - DNA, 25 bp, Mus musculus
cctgctggagtgaggcctgccaccc

SEQ ID NO: 252807 - DNA, 25 bp, Mus musculus
cctgctggcagcctccggacccctc

SEQ ID NO: 252808 - DNA, 25 bp, Mus musculus
cctgctggcaggtcgcttctccgat

SEQ ID NO: 252809 - DNA, 25 bp, Mus musculus
cctgctggccaaaataccgactgga

SEQ ID NO: 252810 - DNA, 25 bp, Mus musculus
cctgctggccaatgacactctgaac

SEQ ID NO: 252811 - DNA, 25 bp, Mus musculus
cctgctggccagatagacaggaaaa

SEQ ID NO: 252812 - DNA, 25 bp, Mus musculus
cctgctggccggcattgaatgtccc

SEQ ID NO: 252813 - DNA, 25 bp, Mus musculus
cctgctggctggcggggtgccacgg

SEQ ID NO: 252814 - DNA, 25 bp, Mus musculus
cctgctgggaaagtccagatagtat

SEQ ID NO: 252815 - DNA, 25 bp, Mus musculus
cctgctgggatccagaatttggggt

SEQ ID NO: 252816 - DNA, 25 bp, Mus musculus
cctgctgggcttgtgtcttccaaaa

SEQ ID NO: 252817 - DNA, 25 bp, Mus musculus
cctgctgggtcaggactaatgtaat

SEQ ID NO: 252818 - DNA, 25 bp, Mus musculus
cctgctgggtcagggataaaaagag

SEQ ID NO: 252819 - DNA, 25 bp, Mus musculus
cctgctgggtcaggtcaggaagcag

SEQ ID NO: 252820 - DNA, 25 bp, Mus musculus
cctgctggtgctgctggtgctcggg

SEQ ID NO: 252821 - DNA, 25 bp, Mus musculus
cctgctggtggtgaactaaagcacc

SEQ ID NO: 252822 - DNA, 25 bp, Mus musculus
cctgctggtggtgaactgctgtatc

SEQ ID NO: 252823 - DNA, 25 bp, Mus musculus
cctgctggtggtgaagtatatcatg

SEQ ID NO: 252824 - DNA, 25 bp, Mus musculus
cctgctggtgtcagtgtctgaaagg

SEQ ID NO: 252825 - DNA, 25 bp, Mus musculus
cctgctgtaaaggctggctactgtt

SEQ ID NO: 252826 - DNA, 25 bp, Mus musculus
cctgctgtataccctggtcagcctg

SEQ ID NO: 252827 - DNA, 25 bp, Mus musculus
cctgctgtataccggtcagctgctg

SEQ ID NO: 252828 - DNA, 25 bp, Mus musculus
cctgctgtcaacggggtctcattct

SEQ ID NO: 252829 - DNA, 25 bp, Mus musculus
cctgctgtcccaggtgctcctggtc

SEQ ID NO: 252830 - DNA, 25 bp, Mus musculus
cctgctgtcctatgcttcccatgat

SEQ ID NO: 252831 - DNA, 25 bp, Mus musculus
cctgctgtcctgaggattcggccct

SEQ ID NO: 252832 - DNA, 25 bp, Mus musculus
cctgctgtgaaatcttctattccaa

SEQ ID NO: 252833 - DNA, 25 bp, Mus musculus
cctgctgtgggcagggtgcctggct

SEQ ID NO: 252834 - DNA, 25 bp, Mus musculus
cctgctgttcctgattatctattat

SEQ ID NO: 252835 - DNA, 25 bp, Mus musculus
cctgctgttctggctagccggatca

SEQ ID NO: 252836 - DNA, 25 bp, Mus musculus
cctgcttacaggaagccgagatacc

SEQ ID NO: 252837 - DNA, 25 bp, Mus musculus
cctgcttaccggtatgacccatatg

SEQ ID NO: 252838 - DNA, 25 bp, Mus musculus
cctgcttactggtttctctcgaaga

SEQ ID NO: 252839 - DNA, 25 bp, Mus musculus
cctgcttactggtttctgtctgatg

SEQ ID NO: 252840 - DNA, 25 bp, Mus musculus
cctgcttcagcaacttgatttctta

SEQ ID NO: 252841 - DNA, 25 bp, Mus musculus
cctgcttcagcaagcttccctgttt

SEQ ID NO: 252842 - DNA, 25 bp, Mus musculus
cctgcttcatctgtggcctggagag

SEQ ID NO: 252843 - DNA, 25 bp, Mus musculus
cctgcttcatgtctggatgtgtcta

SEQ ID NO: 252844 - DNA, 25 bp, Mus musculus
cctgcttccagcccctatgttacta

SEQ ID NO: 252845 - DNA, 25 bp, Mus musculus
cctgcttccggtgttccgaatgcca

SEQ ID NO: 252846 - DNA, 25 bp, Mus musculus
cctgcttcctgccacagcacccaca

SEQ ID NO: 252847 - DNA, 25 bp, Mus musculus
cctgcttctcggttcagcatgggct

SEQ ID NO: 252848 - DNA, 25 bp, Mus musculus
cctgcttctggagggtgatgcccac

SEQ ID NO: 252849 - DNA, 25 bp, Mus musculus
cctgcttctgtgctaacctcaggag

SEQ ID NO: 252850 - DNA, 25 bp, Mus musculus
cctgcttgagcgcggcatccagcca

SEQ ID NO: 252851 - DNA, 25 bp, Mus musculus
cctgcttgcagacctgatgcaacag

SEQ ID NO: 252852 - DNA, 25 bp, Mus musculus
cctgcttgcaggcgatcctaaagag

SEQ ID NO: 252853 - DNA, 25 bp, Mus musculus
cctgcttgcaggtggctttgctgag

SEQ ID NO: 252854 - DNA, 25 bp, Mus musculus
cctgcttgcgaggcaggaaacagcc

SEQ ID NO: 252855 - DNA, 25 bp, Mus musculus
cctgcttgcgagggtgacacttccc

SEQ ID NO: 252856 - DNA, 25 bp, Mus musculus
cctgcttgcggtcacctctgtcttc

SEQ ID NO: 252857 - DNA, 25 bp, Mus musculus
cctgcttggagtacaaggttctgct

SEQ ID NO: 252858 - DNA, 25 bp, Mus musculus
cctgcttggggtttgcccagatggg

SEQ ID NO: 252859 - DNA, 25 bp, Mus musculus
cctgcttgtcaacaggaggagccat

SEQ ID NO: 252860 - DNA, 25 bp, Mus musculus
cctgcttgtcaacagggtccaggtg

SEQ ID NO: 252861 - DNA, 25 bp, Mus musculus
cctgcttgtgagaagaaatggaaat

SEQ ID NO: 252862 - DNA, 25 bp, Mus musculus
cctgcttgtgatatatgttgggtaa

SEQ ID NO: 252863 - DNA, 25 bp, Mus musculus
cctgctttacagatcgctgtggaga

SEQ ID NO: 252864 - DNA, 25 bp, Mus musculus
cctgctttacagctgacttggagct

SEQ ID NO: 252865 - DNA, 25 bp, Mus musculus
cctgctttagtttcctgacaggcaa

SEQ ID NO: 252866 - DNA, 25 bp, Mus musculus
cctgctttatgaccctctggagatc

SEQ ID NO: 252867 - DNA, 25 bp, Mus musculus
cctgcttttataagacaggaaaaga

SEQ ID NO: 252868 - DNA, 25 bp, Mus musculus
cctgcttttataagatgaagacagg

SEQ ID NO: 252869 - DNA, 25 bp, Mus musculus
cctgcttttataagtctttgcagat

SEQ ID NO: 252870 - DNA, 25 bp, Mus musculus
cctgcttttgaggagttccactcca

SEQ ID NO: 252871 - DNA, 25 bp, Mus musculus
cctgcttttgccctctccgctccct

SEQ ID NO: 252872 - DNA, 25 bp, Mus musculus
cctgctttttggagaggacgaccta

SEQ ID NO: 252873 - DNA, 25 bp, Mus musculus
cctggaaaaattaaccacatgagat

SEQ ID NO: 252874 - DNA, 25 bp, Mus musculus
cctggaaaagctgctaaagctgggt

SEQ ID NO: 252875 - DNA, 25 bp, Mus musculus
cctggaaaatacagagcatacgatg

SEQ ID NO: 252876 - DNA, 25 bp, Mus musculus
cctggaaaatacagatctgtgtcag

SEQ ID NO: 252877 - DNA, 25 bp, Mus musculus
cctggaaaatatcaggaagcagtgc

SEQ ID NO: 252878 - DNA, 25 bp, Mus musculus
cctggaaaatgccatcgagacacag

SEQ ID NO: 252879 - DNA, 25 bp, Mus musculus
cctggaaaccaacctgaccttcctt

SEQ ID NO: 252880 - DNA, 25 bp, Mus musculus
cctggaaaccactaagaaacttcag

SEQ ID NO: 252881 - DNA, 25 bp, Mus musculus
cctggaaaccagggatcctggtagg

SEQ ID NO: 252882 - DNA, 25 bp, Mus musculus
cctggaaacgactacatcgaccagc

SEQ ID NO: 252883 - DNA, 25 bp, Mus musculus
cctggaaacgacttgtaccaggggc

SEQ ID NO: 252884 - DNA, 25 bp, Mus musculus
cctggaaagccaggaataagatgtc

SEQ ID NO: 252885 - DNA, 25 bp, Mus musculus
cctggaaagccaggacgttaaagga

SEQ ID NO: 252886 - DNA, 25 bp, Mus musculus
cctggaaagttaggaagaagagctg

SEQ ID NO: 252887 - DNA, 25 bp, Mus musculus
cctggaacaacagaaaatcaatctt

SEQ ID NO: 252888 - DNA, 25 bp, Mus musculus
cctggaacaacaggtcctcagaatg

SEQ ID NO: 252889 - DNA, 25 bp, Mus musculus
cctggaacaacccgcaatactggag

SEQ ID NO: 252890 - DNA, 25 bp, Mus musculus
cctggaacagactaaggctggacca

SEQ ID NO: 252891 - DNA, 25 bp, Mus musculus
cctggaacagctggaagagaagact

SEQ ID NO: 252892 - DNA, 25 bp, Mus musculus
cctggaacaggaacgttggcgggtg

SEQ ID NO: 252893 - DNA, 25 bp, Mus musculus
cctggaacaggtgacatgtatgaag

SEQ ID NO: 252894 - DNA, 25 bp, Mus musculus
cctggaacatattggctccctgacc

SEQ ID NO: 252895 - DNA, 25 bp, Mus musculus
cctggaaccaaggtgatgaatcttt

SEQ ID NO: 252896 - DNA, 25 bp, Mus musculus
cctggaaccaggcacggctggagcg

SEQ ID NO: 252897 - DNA, 25 bp, Mus musculus
cctggaacccaaaagatcttcccct

SEQ ID NO: 252898 - DNA, 25 bp, Mus musculus
cctggaacccatcagatcttcccct

SEQ ID NO: 252899 - DNA, 25 bp, Mus musculus
cctggaaccgcccagggttcgctga

SEQ ID NO: 252900 - DNA, 25 bp, Mus musculus
cctggaaccgcccaggtgctttttg

SEQ ID NO: 252901 - DNA, 25 bp, Mus musculus
cctggaacctgatctaacaaacatg

SEQ ID NO: 252902 - DNA, 25 bp, Mus musculus
cctggaacctgatgaagagctggaa

SEQ ID NO: 252903 - DNA, 25 bp, Mus musculus
cctggaaccttccagggctcactga

SEQ ID NO: 252904 - DNA, 25 bp, Mus musculus
cctggaacggcagatcacagagcag

SEQ ID NO: 252905 - DNA, 25 bp, Mus musculus
cctggaacggcagcgtgttgaggag

SEQ ID NO: 252906 - DNA, 25 bp, Mus musculus
cctggaacggcaggtagagatgacc

SEQ ID NO: 252907 - DNA, 25 bp, Mus musculus
cctggaactcaagttggtgggaact

SEQ ID NO: 252908 - DNA, 25 bp, Mus musculus
cctggaactcaagtttggacgtcat

SEQ ID NO: 252909 - DNA, 25 bp, Mus musculus
cctggaactgctggcctctggagta

SEQ ID NO: 252910 - DNA, 25 bp, Mus musculus
cctggaagaaggtcaagcactctcc

SEQ ID NO: 252911 - DNA, 25 bp, Mus musculus
cctggaagaagtgcatgctttctct

SEQ ID NO: 252912 - DNA, 25 bp, Mus musculus
cctggaagacaaggggctgcactgg

SEQ ID NO: 252913 - DNA, 25 bp, Mus musculus
cctggaagacaagtgcctggagctg

SEQ ID NO: 252914 - DNA, 25 bp, Mus musculus
cctggaagacaagttgctgtctcac

SEQ ID NO: 252915 - DNA, 25 bp, Mus musculus
cctggaagacctggataactggact

SEQ ID NO: 252916 - DNA, 25 bp, Mus musculus
cctggaagcaagaggttgcagaatt

SEQ ID NO: 252917 - DNA, 25 bp, Mus musculus
cctggaagcaggagcctccagacag

SEQ ID NO: 252918 - DNA, 25 bp, Mus musculus
cctggaagcccagaagaaactgtgg

SEQ ID NO: 252919 - DNA, 25 bp, Mus musculus
cctggaagccctcgatgccaattct

SEQ ID NO: 252920 - DNA, 25 bp, Mus musculus
cctggaagcgcagaaccctgttctg

SEQ ID NO: 252921 - DNA, 25 bp, Mus musculus
cctggaagctatttaacattgaggc

SEQ ID NO: 252922 - DNA, 25 bp, Mus musculus
cctggaagctgaggacctacctgtg

SEQ ID NO: 252923 - DNA, 25 bp, Mus musculus
cctggaagctgcagactttgtggtg

SEQ ID NO: 252924 - DNA, 25 bp, Mus musculus
cctggaaggaactatgctgttggct

SEQ ID NO: 252925 - DNA, 25 bp, Mus musculus
cctggaaggctgggttcctgaatgc

SEQ ID NO: 252926 - DNA, 25 bp, Mus musculus
cctggaagggctcagccagagtaac

SEQ ID NO: 252927 - DNA, 25 bp, Mus musculus
cctggaaggtcccggagcatgcaaa

SEQ ID NO: 252928 - DNA, 25 bp, Mus musculus
cctggaaggtcccggagcatgcatt

SEQ ID NO: 252929 - DNA, 25 bp, Mus musculus
cctggaaggtcccggattgaaaaga

SEQ ID NO: 252930 - DNA, 25 bp, Mus musculus
cctggaagtatttgatcctgtgccc

SEQ ID NO: 252931 - DNA, 25 bp, Mus musculus
cctggaagtatttgccagatcttct

SEQ ID NO: 252932 - DNA, 25 bp, Mus musculus
cctggaatcagcagccagtgaggag

SEQ ID NO: 252933 - DNA, 25 bp, Mus musculus
cctggaatctcaggcaaaacccatt

SEQ ID NO: 252934 - DNA, 25 bp, Mus musculus
cctggaatctgcgacccatacgtga

SEQ ID NO: 252935 - DNA, 25 bp, Mus musculus
cctggaatgaagggagaagcaggtc

SEQ ID NO: 252936 - DNA, 25 bp, Mus musculus
cctggaatgtcatggccttatcaca

SEQ ID NO: 252937 - DNA, 25 bp, Mus musculus
cctggacaacaagaaggggcgaagc

SEQ ID NO: 252938 - DNA, 25 bp, Mus musculus
cctggacaacctatgtcttttgtgc

SEQ ID NO: 252939 - DNA, 25 bp, Mus musculus
cctggacaagaggggaagtccctga

SEQ ID NO: 252940 - DNA, 25 bp, Mus musculus
cctggacaagcctccattaacctgt

SEQ ID NO: 252941 - DNA, 25 bp, Mus musculus
cctggacaagcctggacaaactact

SEQ ID NO: 252942 - DNA, 25 bp, Mus musculus
cctggacaagctgatgccttcacac

SEQ ID NO: 252943 - DNA, 25 bp, Mus musculus
cctggacaagctgtggccagcgtca

SEQ ID NO: 252944 - DNA, 25 bp, Mus musculus
cctggacaaggtagagcctcaggcc

SEQ ID NO: 252945 - DNA, 25 bp, Mus musculus
cctggacaatggtgaacaacccaga

SEQ ID NO: 252946 - DNA, 25 bp, Mus musculus
cctggacaccacagagctccttggt

SEQ ID NO: 252947 - DNA, 25 bp, Mus musculus
cctggacaccacaggaaagaatgtt

SEQ ID NO: 252948 - DNA, 25 bp, Mus musculus
cctggacagaaggtctgtgtgtggt

SEQ ID NO: 252949 - DNA, 25 bp, Mus musculus
cctggacatcacgggttatatattt

SEQ ID NO: 252950 - DNA, 25 bp, Mus musculus
cctggacatgaaatggtgccacatc

SEQ ID NO: 252951 - DNA, 25 bp, Mus musculus
cctggacattactggccagttcaca

SEQ ID NO: 252952 - DNA, 25 bp, Mus musculus
cctggacattcggatttccatttcc

SEQ ID NO: 252953 - DNA, 25 bp, Mus musculus
cctggacattcggtcacagtctctg

SEQ ID NO: 252954 - DNA, 25 bp, Mus musculus
cctggaccaaagggtgctcagggag

SEQ ID NO: 252955 - DNA, 25 bp, Mus musculus
cctggaccaaggtgcttcacctggg

SEQ ID NO: 252956 - DNA, 25 bp, Mus musculus
cctggaccaatgggtccaattggtt

SEQ ID NO: 252957 - DNA, 25 bp, Mus musculus
cctggaccaatgggtcctcttggga

SEQ ID NO: 252958 - DNA, 25 bp, Mus musculus
cctggaccacagtgctgccatagtg

SEQ ID NO: 252959 - DNA, 25 bp, Mus musculus
cctggaccacagtgggcctgtgctt

SEQ ID NO: 252960 - DNA, 25 bp, Mus musculus
cctggaccactggcagcattagcag

SEQ ID NO: 252961 - DNA, 25 bp, Mus musculus
cctggaccagaggagccccaggatg

SEQ ID NO: 252962 - DNA, 25 bp, Mus musculus
cctggaccagatggcttcctgtttg

SEQ ID NO: 252963 - DNA, 25 bp, Mus musculus
cctggaccagcaacagtatcaaagt

SEQ ID NO: 252964 - DNA, 25 bp, Mus musculus
cctggaccagggcagtgccctgcag

SEQ ID NO: 252965 - DNA, 25 bp, Mus musculus
cctggaccaggtgaaaaaagccctt

SEQ ID NO: 252966 - DNA, 25 bp, Mus musculus
cctggaccattttagactacatcca

SEQ ID NO: 252967 - DNA, 25 bp, Mus musculus
cctggacccaaaggccctgcctgcc

SEQ ID NO: 252968 - DNA, 25 bp, Mus musculus
cctggacccagacaggtgcgtggtc

SEQ ID NO: 252969 - DNA, 25 bp, Mus musculus
cctggacccaggctgccctgccctc

SEQ ID NO: 252970 - DNA, 25 bp, Mus musculus
cctggaccccatggcccctcaccgt

SEQ ID NO: 252971 - DNA, 25 bp, Mus musculus
cctggaccccgagagccccaaggac

SEQ ID NO: 252972 - DNA, 25 bp, Mus musculus
cctggaccccgagatccagttggac

SEQ ID NO: 252973 - DNA, 25 bp, Mus musculus
cctggaccccgaggcactgcctctg

SEQ ID NO: 252974 - DNA, 25 bp, Mus musculus
cctggaccgagagaaagtccctgag

SEQ ID NO: 252975 - DNA, 25 bp, Mus musculus
cctggaccgcagaggagagcccccc

SEQ ID NO: 252976 - DNA, 25 bp, Mus musculus
cctggaccgggagcagaatggagag

SEQ ID NO: 252977 - DNA, 25 bp, Mus musculus
cctggacctaaagcctgagaatatc

SEQ ID NO: 252978 - DNA, 25 bp, Mus musculus
cctggacctacaacaccacctctgc

SEQ ID NO: 252979 - DNA, 25 bp, Mus musculus
cctggacctagaggcctttatccag

SEQ ID NO: 252980 - DNA, 25 bp, Mus musculus
cctggacctcctggtccaaatggtg

SEQ ID NO: 252981 - DNA, 25 bp, Mus musculus
cctggacctcggagaacttccaggt

SEQ ID NO: 252982 - DNA, 25 bp, Mus musculus
cctggacctcggagccacagagatc

SEQ ID NO: 252983 - DNA, 25 bp, Mus musculus
cctggacctcggagctgcccagacc

SEQ ID NO: 252984 - DNA, 25 bp, Mus musculus
cctggacctcggagggatgactcga

SEQ ID NO: 252985 - DNA, 25 bp, Mus musculus
cctggacctgggctcccagaggcta

SEQ ID NO: 252986 - DNA, 25 bp, Mus musculus
cctggacgaccggcgtgtgcagcct

SEQ ID NO: 252987 - DNA, 25 bp, Mus musculus
cctggacgaccgtatctggactaga

SEQ ID NO: 252988 - DNA, 25 bp, Mus musculus
cctggacgagagggcagccctggtg

SEQ ID NO: 252989 - DNA, 25 bp, Mus musculus
cctggacgcacaggcctcctgtgcc

SEQ ID NO: 252990 - DNA, 25 bp, Mus musculus
cctggacgccattcccccactttgt

SEQ ID NO: 252991 - DNA, 25 bp, Mus musculus
cctggacgctcagccttcaaacagt

SEQ ID NO: 252992 - DNA, 25 bp, Mus musculus
cctggacgctcaggacccaccagag

SEQ ID NO: 252993 - DNA, 25 bp, Mus musculus
cctggacgcttgcctttgtctggaa

SEQ ID NO: 252994 - DNA, 25 bp, Mus musculus
cctggacgcttgtcaccagatttcg

SEQ ID NO: 252995 - DNA, 25 bp, Mus musculus
cctggacggcaggtgaagtggaaga

SEQ ID NO: 252996 - DNA, 25 bp, Mus musculus
cctggacgttgagtgtggaaaatgc

SEQ ID NO: 252997 - DNA, 25 bp, Mus musculus
cctggactaaggatcaccactactt

SEQ ID NO: 252998 - DNA, 25 bp, Mus musculus
cctggactccagggctgacagcttc

SEQ ID NO: 252999 - DNA, 25 bp, Mus musculus
cctggactcccacagccagcgtttc

SEQ ID NO: 253000 - DNA, 25 bp, Mus musculus
cctggactctctcaaaccccttatc

SEQ ID NO: 253001 - DNA, 25 bp, Mus musculus
cctggactgatgggaaggaggccat

SEQ ID NO: 253002 - DNA, 25 bp, Mus musculus
cctggactgctgtaagtgtggacat

SEQ ID NO: 253003 - DNA, 25 bp, Mus musculus
cctggactggaaggaaatctacaag

SEQ ID NO: 253004 - DNA, 25 bp, Mus musculus
cctggactgggaggtaggggtccat

SEQ ID NO: 253005 - DNA, 25 bp, Mus musculus
cctggacttaactgtgccaccacca

SEQ ID NO: 253006 - DNA, 25 bp, Mus musculus
cctggacttcagaaccagcagctgc

SEQ ID NO: 253007 - DNA, 25 bp, Mus musculus
cctggacttcagggagaggaacagg

SEQ ID NO: 253008 - DNA, 25 bp, Mus musculus
cctggacttcgggtcagtgaatgct

SEQ ID NO: 253009 - DNA, 25 bp, Mus musculus
cctggacttcggtatatccaaagcc

SEQ ID NO: 253010 - DNA, 25 bp, Mus musculus
cctggagaaaaacagtaccaaggag

SEQ ID NO: 253011 - DNA, 25 bp, Mus musculus
cctggagaaaaaggggaccatggcc

SEQ ID NO: 253012 - DNA, 25 bp, Mus musculus
cctggagaaagaggctgccactcgc

SEQ ID NO: 253013 - DNA, 25 bp, Mus musculus
cctggagaaagaggtggaggtgatt

SEQ ID NO: 253014 - DNA, 25 bp, Mus musculus
cctggagaaagagtggaggtgattg

SEQ ID NO: 253015 - DNA, 25 bp, Mus musculus
cctggagaacggggaagtctaggac

SEQ ID NO: 253016 - DNA, 25 bp, Mus musculus
cctggagaagacaagtccatctacc

SEQ ID NO: 253017 - DNA, 25 bp, Mus musculus
cctggagaagacctgtgccgtgtga

SEQ ID NO: 253018 - DNA, 25 bp, Mus musculus
cctggagaagctgacctctctctct

SEQ ID NO: 253019 - DNA, 25 bp, Mus musculus
cctggagaaggatatgaatcagaga

SEQ ID NO: 253020 - DNA, 25 bp, Mus musculus
cctggagaaggcgtgggtgactgat

SEQ ID NO: 253021 - DNA, 25 bp, Mus musculus
cctggagaaggtcccacctgctcgc

SEQ ID NO: 253022 - DNA, 25 bp, Mus musculus
cctggagaagtcaaacaggtgactc

SEQ ID NO: 253023 - DNA, 25 bp, Mus musculus
cctggagaatagctcctgtatcagc

SEQ ID NO: 253024 - DNA, 25 bp, Mus musculus
cctggagaatgtgctagagatcaat

SEQ ID NO: 253025 - DNA, 25 bp, Mus musculus
cctggagacaagctacgcatggagt

SEQ ID NO: 253026 - DNA, 25 bp, Mus musculus
cctggagacaagtagtcttttacag

SEQ ID NO: 253027 - DNA, 25 bp, Mus musculus
cctggagacaatacgcatggagtac

SEQ ID NO: 253028 - DNA, 25 bp, Mus musculus
cctggagacctggccaaccgctgca

SEQ ID NO: 253029 - DNA, 25 bp, Mus musculus
cctggagacgagagctggcattcct

SEQ ID NO: 253030 - DNA, 25 bp, Mus musculus
cctggagacgctcaaatcatgcact

SEQ ID NO: 253031 - DNA, 25 bp, Mus musculus
cctggagacgctcaacttgtcccaa

SEQ ID NO: 253032 - DNA, 25 bp, Mus musculus
cctggagagaaagacggtcgctgag

SEQ ID NO: 253033 - DNA, 25 bp, Mus musculus
cctggagagagaggtgctcctggca

SEQ ID NO: 253034 - DNA, 25 bp, Mus musculus
cctggagagaggagcaccgtgagag

SEQ ID NO: 253035 - DNA, 25 bp, Mus musculus
cctggagagagttcaccttttccac

SEQ ID NO: 253036 - DNA, 25 bp, Mus musculus
cctggagagcaatatggtacctcac

SEQ ID NO: 253037 - DNA, 25 bp, Mus musculus
cctggagaggagggtctagagacat

SEQ ID NO: 253038 - DNA, 25 bp, Mus musculus
cctggagataggacgagtgaccaaa

SEQ ID NO: 253039 - DNA, 25 bp, Mus musculus
cctggagatgagaaataaagatttc

SEQ ID NO: 253040 - DNA, 25 bp, Mus musculus
cctggagatgagtcacagcccagca

SEQ ID NO: 253041 - DNA, 25 bp, Mus musculus
cctggagatgttccgagaacaagtg

SEQ ID NO: 253042 - DNA, 25 bp, Mus musculus
cctggagcagacaggattatggaaa

SEQ ID NO: 253043 - DNA, 25 bp, Mus musculus
cctggagcagcctgactctgactcc

SEQ ID NO: 253044 - DNA, 25 bp, Mus musculus
cctggagcatcagctgctgacctga

SEQ ID NO: 253045 - DNA, 25 bp, Mus musculus
cctggagcatcagctgtggtcctct

SEQ ID NO: 253046 - DNA, 25 bp, Mus musculus
cctggagcatgagagcgtagcagga

SEQ ID NO: 253047 - DNA, 25 bp, Mus musculus
cctggagcatgaggagtggtggaga

SEQ ID NO: 253048 - DNA, 25 bp, Mus musculus
cctggagcattgctgaatatgcttt

SEQ ID NO: 253049 - DNA, 25 bp, Mus musculus
cctggagccaggggtcttaccggtc

SEQ ID NO: 253050 - DNA, 25 bp, Mus musculus
cctggagccgaaatcatgtccacac

SEQ ID NO: 253051 - DNA, 25 bp, Mus musculus
cctggagcgttcactgtgagccttg

SEQ ID NO: 253052 - DNA, 25 bp, Mus musculus
cctggagctagcatctagtgctttt

SEQ ID NO: 253053 - DNA, 25 bp, Mus musculus
cctggagctagcatctcgctctcca

SEQ ID NO: 253054 - DNA, 25 bp, Mus musculus
cctggagctagcatgctcacgcaca

SEQ ID NO: 253055 - DNA, 25 bp, Mus musculus
cctggagctaggtcattttacctgg

SEQ ID NO: 253056 - DNA, 25 bp, Mus musculus
cctggagctcagcacaggggatgaa

SEQ ID NO: 253057 - DNA, 25 bp, Mus musculus
cctggagctcagcttttccagacct

SEQ ID NO: 253058 - DNA, 25 bp, Mus musculus
cctggagctgaacaaggagcaagca

SEQ ID NO: 253059 - DNA, 25 bp, Mus musculus
cctggagctgatggaacacccattc

SEQ ID NO: 253060 - DNA, 25 bp, Mus musculus
cctggagctgcaggttcggggtgaa

SEQ ID NO: 253061 - DNA, 25 bp, Mus musculus
cctggagctgtgcatccttttatac

SEQ ID NO: 253062 - DNA, 25 bp, Mus musculus
cctggagctgtggttcgttctccca

SEQ ID NO: 253063 - DNA, 25 bp, Mus musculus
cctggagctttgatgctgcattccg

SEQ ID NO: 253064 - DNA, 25 bp, Mus musculus
cctggaggaaggaattctttgtgtg

SEQ ID NO: 253065 - DNA, 25 bp, Mus musculus
cctggaggacaatgtctgttctgag

SEQ ID NO: 253066 - DNA, 25 bp, Mus musculus
cctggaggacaatgttttgatgagt

SEQ ID NO: 253067 - DNA, 25 bp, Mus musculus
cctggaggagcagaattttctacag

SEQ ID NO: 253068 - DNA, 25 bp, Mus musculus
cctggaggagctgaattttctgaag

SEQ ID NO: 253069 - DNA, 25 bp, Mus musculus
cctggaggagctgttttctgaagag

SEQ ID NO: 253070 - DNA, 25 bp, Mus musculus
cctggaggaggagctgcagttctcc

SEQ ID NO: 253071 - DNA, 25 bp, Mus musculus
cctggaggaggccgggccaaagtag

SEQ ID NO: 253072 - DNA, 25 bp, Mus musculus
cctggaggaggccgggtccagatag

SEQ ID NO: 253073 - DNA, 25 bp, Mus musculus
cctggaggaggccgggttcagattc

SEQ ID NO: 253074 - DNA, 25 bp, Mus musculus
cctggaggagttctcagagtacatt

SEQ ID NO: 253075 - DNA, 25 bp, Mus musculus
cctggaggagttgagttaaaagaag

SEQ ID NO: 253076 - DNA, 25 bp, Mus musculus
cctggaggatcagttggcaaagctc

SEQ ID NO: 253077 - DNA, 25 bp, Mus musculus
cctggaggatgggctaggaaatcaa

SEQ ID NO: 253078 - DNA, 25 bp, Mus musculus
cctggaggccagcatattcaggagg

SEQ ID NO: 253079 - DNA, 25 bp, Mus musculus
cctggaggctgccacccgtctctag

SEQ ID NO: 253080 - DNA, 25 bp, Mus musculus
cctggagggcatatcctttttactg

SEQ ID NO: 253081 - DNA, 25 bp, Mus musculus
cctggaggtccgagcacaccctgaa

SEQ ID NO: 253082 - DNA, 25 bp, Mus musculus
cctggaggtccgaggcgagtgagct

SEQ ID NO: 253083 - DNA, 25 bp, Mus musculus
cctggaggtggcaatgttcagattc

SEQ ID NO: 253084 - DNA, 25 bp, Mus musculus
cctggagtagcctctccaggcagaa

SEQ ID NO: 253085 - DNA, 25 bp, Mus musculus
cctggagtagtcccaggcactctgc

SEQ ID NO: 253086 - DNA, 25 bp, Mus musculus
cctggagtcaagctggaaccacctg

SEQ ID NO: 253087 - DNA, 25 bp, Mus musculus
cctggagtcatcaggggtttcctga

SEQ ID NO: 253088 - DNA, 25 bp, Mus musculus
cctggagtcattagagtgttcagtg

SEQ ID NO: 253089 - DNA, 25 bp, Mus musculus
cctggagtcattaggggccctggga

SEQ ID NO: 253090 - DNA, 25 bp, Mus musculus
cctggagtccatgtgtaaagagctg

SEQ ID NO: 253091 - DNA, 25 bp, Mus musculus
cctggagtgcagccaccaggacgca

SEQ ID NO: 253092 - DNA, 25 bp, Mus musculus
cctggagtgcggacacccggcctgg

SEQ ID NO: 253093 - DNA, 25 bp, Mus musculus
cctggagtgtccacagtacctgaga

SEQ ID NO: 253094 - DNA, 25 bp, Mus musculus
cctggagttgcagctgttccatcgg

SEQ ID NO: 253095 - DNA, 25 bp, Mus musculus
cctggagttgcagtcctatcttcag

SEQ ID NO: 253096 - DNA, 25 bp, Mus musculus
cctggagtttctagcctcaaagcgg

SEQ ID NO: 253097 - DNA, 25 bp, Mus musculus
cctggagtttctcagtgacatcact

SEQ ID NO: 253098 - DNA, 25 bp, Mus musculus
cctggataaagccgatcacgcgtcc

SEQ ID NO: 253099 - DNA, 25 bp, Mus musculus
cctggatagcatgtacatcatgtta

SEQ ID NO: 253100 - DNA, 25 bp, Mus musculus
cctggatcaaaggcctacagtttca

SEQ ID NO: 253101 - DNA, 25 bp, Mus musculus
cctggatcacactggatgcagccta

SEQ ID NO: 253102 - DNA, 25 bp, Mus musculus
cctggatcaccaggtgttgatgctc

SEQ ID NO: 253103 - DNA, 25 bp, Mus musculus
cctggatcaggaagcatatattcaa

SEQ ID NO: 253104 - DNA, 25 bp, Mus musculus
cctggatccaggcttacaattactt

SEQ ID NO: 253105 - DNA, 25 bp, Mus musculus
cctggatccaggtgaaccttctgcg

SEQ ID NO: 253106 - DNA, 25 bp, Mus musculus
cctggatcccaagacagaccctgtg

SEQ ID NO: 253107 - DNA, 25 bp, Mus musculus
cctggatcctcccagccactggtgt

SEQ ID NO: 253108 - DNA, 25 bp, Mus musculus
cctggatcctcccagggttcactga

SEQ ID NO: 253109 - DNA, 25 bp, Mus musculus
cctggatctgagggaaatctgctcc

SEQ ID NO: 253110 - DNA, 25 bp, Mus musculus
cctggatctggagcctgatctctca

SEQ ID NO: 253111 - DNA, 25 bp, Mus musculus
cctggatctggtcttctaggggact

SEQ ID NO: 253112 - DNA, 25 bp, Mus musculus
cctggatgaaaggtcgagatttcag

SEQ ID NO: 253113 - DNA, 25 bp, Mus musculus
cctggatgaaagtgaggcagcagca

SEQ ID NO: 253114 - DNA, 25 bp, Mus musculus
cctggatgacgagttgatagacaca

SEQ ID NO: 253115 - DNA, 25 bp, Mus musculus
cctggatgacgttaatgaaatcatc

SEQ ID NO: 253116 - DNA, 25 bp, Mus musculus
cctggatgagagggtttaccagccc

SEQ ID NO: 253117 - DNA, 25 bp, Mus musculus
cctggatgaggagaaacttgaacag

SEQ ID NO: 253118 - DNA, 25 bp, Mus musculus
cctggatgaggagaactttgtgaaa

SEQ ID NO: 253119 - DNA, 25 bp, Mus musculus
cctggatgatctatacctactcagg

SEQ ID NO: 253120 - DNA, 25 bp, Mus musculus
cctggatgatgggctaggccatggc

SEQ ID NO: 253121 - DNA, 25 bp, Mus musculus
cctggatgatggtgtgattgccagc

SEQ ID NO: 253122 - DNA, 25 bp, Mus musculus
cctggatgccaggcgcaagcggcgg

SEQ ID NO: 253123 - DNA, 25 bp, Mus musculus
cctggatgcctatgctgaacaccct

SEQ ID NO: 253124 - DNA, 25 bp, Mus musculus
cctggatgcgtctaggtcttccaag

SEQ ID NO: 253125 - DNA, 25 bp, Mus musculus
cctggatgctagaggtctgtgagga

SEQ ID NO: 253126 - DNA, 25 bp, Mus musculus
cctggatgctcagacatggtgcctg

SEQ ID NO: 253127 - DNA, 25 bp, Mus musculus
cctggatgctcagagacaatgtcta

SEQ ID NO: 253128 - DNA, 25 bp, Mus musculus
cctggatggaccaagggccaagtgt

SEQ ID NO: 253129 - DNA, 25 bp, Mus musculus
cctggatggcttttatgatcatttt

SEQ ID NO: 253130 - DNA, 25 bp, Mus musculus
cctggatggggtggtgaagcgagct

SEQ ID NO: 253131 - DNA, 25 bp, Mus musculus
cctggatgttcaaattggggaatgg

SEQ ID NO: 253132 - DNA, 25 bp, Mus musculus
cctggattaaaaaggatcagttctt

SEQ ID NO: 253133 - DNA, 25 bp, Mus musculus
cctggattaaaaagggccaaatcct

SEQ ID NO: 253134 - DNA, 25 bp, Mus musculus
cctggattaaaaagtgcctgcaccc

SEQ ID NO: 253135 - DNA, 25 bp, Mus musculus
cctggattcacaggaattcactgtg

SEQ ID NO: 253136 - DNA, 25 bp, Mus musculus
cctggattcagaagaataccacaac

SEQ ID NO: 253137 - DNA, 25 bp, Mus musculus
cctggattcagtcatttgaagactg

SEQ ID NO: 253138 - DNA, 25 bp, Mus musculus
cctggattcagtggcgccgacatcg

SEQ ID NO: 253139 - DNA, 25 bp, Mus musculus
cctggattcagtgggcagagccagc

SEQ ID NO: 253140 - DNA, 25 bp, Mus musculus
cctggattgggtttatgcagaactc

SEQ ID NO: 253141 - DNA, 25 bp, Mus musculus
cctggattgggtttgaactcggaga

SEQ ID NO: 253142 - DNA, 25 bp, Mus musculus
cctggattgtggaaggggaggagcg

SEQ ID NO: 253143 - DNA, 25 bp, Mus musculus
cctggatttaaccagagctgtctgt

SEQ ID NO: 253144 - DNA, 25 bp, Mus musculus
cctggatttaaccaggtgccagatt

SEQ ID NO: 253145 - DNA, 25 bp, Mus musculus
cctggatttaagattgagatttttt

SEQ ID NO: 253146 - DNA, 25 bp, Mus musculus
cctggatttggggaatacacatgcc

SEQ ID NO: 253147 - DNA, 25 bp, Mus musculus
cctggatttgggggtcctgttacag

SEQ ID NO: 253148 - DNA, 25 bp, Mus musculus
cctggcaaaaggtgcccgaggtgac

SEQ ID NO: 253149 - DNA, 25 bp, Mus musculus
cctggcaaaccctatgtttgatgac

SEQ ID NO: 253150 - DNA, 25 bp, Mus musculus
cctggcaacagtgatccggagcatc

SEQ ID NO: 253151 - DNA, 25 bp, Mus musculus
cctggcaagagaaatgtctcaggct

SEQ ID NO: 253152 - DNA, 25 bp, Mus musculus
cctggcaagaggagcactcacccct

SEQ ID NO: 253153 - DNA, 25 bp, Mus musculus
cctggcaagaggtccgtcttccacg

SEQ ID NO: 253154 - DNA, 25 bp, Mus musculus
cctggcaagcaagaacaaggatgag

SEQ ID NO: 253155 - DNA, 25 bp, Mus musculus
cctggcaatggtctgccaggaactt

SEQ ID NO: 253156 - DNA, 25 bp, Mus musculus
cctggcacaaggcaggcgacaagca

SEQ ID NO: 253157 - DNA, 25 bp, Mus musculus
cctggcacaaggtaacacggaagtc

SEQ ID NO: 253158 - DNA, 25 bp, Mus musculus
cctggcacaaggtgatagagggaaa

SEQ ID NO: 253159 - DNA, 25 bp, Mus musculus
cctggcacacgccccaaggaaagta

SEQ ID NO: 253160 - DNA, 25 bp, Mus musculus
cctggcacagaaacatcatccaaga

SEQ ID NO: 253161 - DNA, 25 bp, Mus musculus
cctggcacagaagccttcagggaga

SEQ ID NO: 253162 - DNA, 25 bp, Mus musculus
cctggcacagagaacctgtgctcaa

SEQ ID NO: 253163 - DNA, 25 bp, Mus musculus
cctggcacagcaagcttccctggca

SEQ ID NO: 253164 - DNA, 25 bp, Mus musculus
cctggcacaggtacaaagtgaaata

SEQ ID NO: 253165 - DNA, 25 bp, Mus musculus
cctggcacagtagccttcagggaga

SEQ ID NO: 253166 - DNA, 25 bp, Mus musculus
cctggcaccagaggtattagaagat

SEQ ID NO: 253167 - DNA, 25 bp, Mus musculus
cctggcacccagaaggacctcttaa

SEQ ID NO: 253168 - DNA, 25 bp, Mus musculus
cctggcactgcaagtttccccagca

SEQ ID NO: 253169 - DNA, 25 bp, Mus musculus
cctggcactgcagagcaaaaaaaca

SEQ ID NO: 253170 - DNA, 25 bp, Mus musculus
cctggcactgcagtggagaaagcat

SEQ ID NO: 253171 - DNA, 25 bp, Mus musculus
cctggcactgcctagagacttcctg

SEQ ID NO: 253172 - DNA, 25 bp, Mus musculus
cctggcactgtgaaaattccaccta

SEQ ID NO: 253173 - DNA, 25 bp, Mus musculus
cctggcagaaagggctgaggccacg

SEQ ID NO: 253174 - DNA, 25 bp, Mus musculus
cctggcagagacggagggcatgctc

SEQ ID NO: 253175 - DNA, 25 bp, Mus musculus
cctggcagagatggacatgctagtg

SEQ ID NO: 253176 - DNA, 25 bp, Mus musculus
cctggcagagccgctgatggactcg

SEQ ID NO: 253177 - DNA, 25 bp, Mus musculus
cctggcagaggaaaactccagggat

SEQ ID NO: 253178 - DNA, 25 bp, Mus musculus
cctggcagaggtgatatgtaaagtc

SEQ ID NO: 253179 - DNA, 25 bp, Mus musculus
cctggcagcagacttttcacagatt

SEQ ID NO: 253180 - DNA, 25 bp, Mus musculus
cctggcagccagatgaggatgatgc

SEQ ID NO: 253181 - DNA, 25 bp, Mus musculus
cctggcagcgataggaaggacctgg

SEQ ID NO: 253182 - DNA, 25 bp, Mus musculus
cctggcagcgataggcttcattctc

SEQ ID NO: 253183 - DNA, 25 bp, Mus musculus
cctggcagcgatagggcttacccac

SEQ ID NO: 253184 - DNA, 25 bp, Mus musculus
cctggcagcgataggtcacttgccc

SEQ ID NO: 253185 - DNA, 25 bp, Mus musculus
cctggcaggaaggagactgcggccc

SEQ ID NO: 253186 - DNA, 25 bp, Mus musculus
cctggcaggagacctagaacttcat

SEQ ID NO: 253187 - DNA, 25 bp, Mus musculus
cctggcaggatgggagcctcctgcc

SEQ ID NO: 253188 - DNA, 25 bp, Mus musculus
cctggcaggatgggccaccgctgac

SEQ ID NO: 253189 - DNA, 25 bp, Mus musculus
cctggcagggactggtccagcacct

SEQ ID NO: 253190 - DNA, 25 bp, Mus musculus
cctggcaggtgtccctgccgtgtgt

SEQ ID NO: 253191 - DNA, 25 bp, Mus musculus
cctggcagtaccgagaggtcgactc

SEQ ID NO: 253192 - DNA, 25 bp, Mus musculus
cctggcagtcagcaaacaaaaccgg

SEQ ID NO: 253193 - DNA, 25 bp, Mus musculus
cctggcagtcagcaaccaccctccc

SEQ ID NO: 253194 - DNA, 25 bp, Mus musculus
cctggcataaggatgctttcattgg

SEQ ID NO: 253195 - DNA, 25 bp, Mus musculus
cctggcataaggccactcagaaggg

SEQ ID NO: 253196 - DNA, 25 bp, Mus musculus
cctggcataagggagctggtaagcc

SEQ ID NO: 253197 - DNA, 25 bp, Mus musculus
cctggcatgcggcctcctcctccag

SEQ ID NO: 253198 - DNA, 25 bp, Mus musculus
cctggcattagggcaggctggatat

SEQ ID NO: 253199 - DNA, 25 bp, Mus musculus
cctggcattagtacactgtagctgt

SEQ ID NO: 253200 - DNA, 25 bp, Mus musculus
cctggccaaagggtcattatcgtta

SEQ ID NO: 253201 - DNA, 25 bp, Mus musculus
cctggccaaaggtcagcctccaaga

SEQ ID NO: 253202 - DNA, 25 bp, Mus musculus
cctggccaaaggtcggacatcaaat

SEQ ID NO: 253203 - DNA, 25 bp, Mus musculus
cctggccaagaaggggatgaggtgt

SEQ ID NO: 253204 - DNA, 25 bp, Mus musculus
cctggccaagcctaccaggtaccac

SEQ ID NO: 253205 - DNA, 25 bp, Mus musculus
cctggccaaggtaccacggttcgtg

SEQ ID NO: 253206 - DNA, 25 bp, Mus musculus
cctggccaaggtcctggacaatact

SEQ ID NO: 253207 - DNA, 25 bp, Mus musculus
cctggccaccagccccactctgccc

SEQ ID NO: 253208 - DNA, 25 bp, Mus musculus
cctggccaccaggataaagcatgag

SEQ ID NO: 253209 - DNA, 25 bp, Mus musculus
cctggccacgaaacactctctggag

SEQ ID NO: 253210 - DNA, 25 bp, Mus musculus
cctggccagagtcatggatttgata

SEQ ID NO: 253211 - DNA, 25 bp, Mus musculus
cctggccagcattcaggagcttctg

SEQ ID NO: 253212 - DNA, 25 bp, Mus musculus
cctggccaggagtgaattggaggaa

SEQ ID NO: 253213 - DNA, 25 bp, Mus musculus
cctggccaggagtgagaagacataa

SEQ ID NO: 253214 - DNA, 25 bp, Mus musculus
cctggccagggagaggagatcgagg

SEQ ID NO: 253215 - DNA, 25 bp, Mus musculus
cctggccagtgatcttctagagtgg

SEQ ID NO: 253216 - DNA, 25 bp, Mus musculus
cctggccatacatagggaaaggcag

SEQ ID NO: 253217 - DNA, 25 bp, Mus musculus
cctggccataggcttcttccctggg

SEQ ID NO: 253218 - DNA, 25 bp, Mus musculus
cctggccatctcaggtgagttggag

SEQ ID NO: 253219 - DNA, 25 bp, Mus musculus
cctggccatgaagcacgagaacgag

SEQ ID NO: 253220 - DNA, 25 bp, Mus musculus
cctggcccacagaattacggcagcg

SEQ ID NO: 253221 - DNA, 25 bp, Mus musculus
cctggcccacagactgacccttggt

SEQ ID NO: 253222 - DNA, 25 bp, Mus musculus
cctggcccagcaaccttccctggca

SEQ ID NO: 253223 - DNA, 25 bp, Mus musculus
cctggcccagcaatcttccctggta

SEQ ID NO: 253224 - DNA, 25 bp, Mus musculus
cctggcccagcgggtacaccaggaa

SEQ ID NO: 253225 - DNA, 25 bp, Mus musculus
cctggccccaaggtggccattgaag

SEQ ID NO: 253226 - DNA, 25 bp, Mus musculus
cctggccccagacaggttcagaact

SEQ ID NO: 253227 - DNA, 25 bp, Mus musculus
cctggccccatgggtccttctggtc

SEQ ID NO: 253228 - DNA, 25 bp, Mus musculus
cctggcccccaaggccatgaagaag

SEQ ID NO: 253229 - DNA, 25 bp, Mus musculus
cctggccccccgcggacttccaata

SEQ ID NO: 253230 - DNA, 25 bp, Mus musculus
cctggccccccgggcgatggcatca

SEQ ID NO: 253231 - DNA, 25 bp, Mus musculus
cctggccccgtgggagcccttggac

SEQ ID NO: 253232 - DNA, 25 bp, Mus musculus
cctggcccctacataaaatggttcc

SEQ ID NO: 253233 - DNA, 25 bp, Mus musculus
cctggcccgccaggactgcagtaat

SEQ ID NO: 253234 - DNA, 25 bp, Mus musculus
cctggcccggccctcctgaagccct

SEQ ID NO: 253235 - DNA, 25 bp, Mus musculus
cctggccctaagggcaactccggag

SEQ ID NO: 253236 - DNA, 25 bp, Mus musculus
cctggccctcacaagtggccaatca

SEQ ID NO: 253237 - DNA, 25 bp, Mus musculus
cctggccctcacggtatatgctatg

SEQ ID NO: 253238 - DNA, 25 bp, Mus musculus
cctggccctcagggacctgcaggtg

SEQ ID NO: 253239 - DNA, 25 bp, Mus musculus
cctggccctccgggtccttctggag

SEQ ID NO: 253240 - DNA, 25 bp, Mus musculus
cctggccctggcaggtctccctgca

SEQ ID NO: 253241 - DNA, 25 bp, Mus musculus
cctggcccttagagtaatccatatg

SEQ ID NO: 253242 - DNA, 25 bp, Mus musculus
cctggccgaagcatgacccgccggg

SEQ ID NO: 253243 - DNA, 25 bp, Mus musculus
cctggccgagaggggagcccagagg

SEQ ID NO: 253244 - DNA, 25 bp, Mus musculus
cctggccgaggaagccgagataccc

SEQ ID NO: 253245 - DNA, 25 bp, Mus musculus
cctggccgatgaggtaatcactgtg

SEQ ID NO: 253246 - DNA, 25 bp, Mus musculus
cctggccgatgagtaatatgcagac

SEQ ID NO: 253247 - DNA, 25 bp, Mus musculus
cctggccgctcagaaaagatgtctt

SEQ ID NO: 253248 - DNA, 25 bp, Mus musculus
cctggccgctcagtgtcttaaaaca

SEQ ID NO: 253249 - DNA, 25 bp, Mus musculus
cctggccgctgtagaattggaaaag

SEQ ID NO: 253250 - DNA, 25 bp, Mus musculus
cctggccgggcaagctgccaaaagc

SEQ ID NO: 253251 - DNA, 25 bp, Mus musculus
cctggcctatctcgacgtcggatgc

SEQ ID NO: 253252 - DNA, 25 bp, Mus musculus
cctggcctcagacctcacagtggat

SEQ ID NO: 253253 - DNA, 25 bp, Mus musculus
cctggcctccctgggccccaaggac

SEQ ID NO: 253254 - DNA, 25 bp, Mus musculus
cctggcctccggataaagatagaga

SEQ ID NO: 253255 - DNA, 25 bp, Mus musculus
cctggcctccgggtttgtattgagg

SEQ ID NO: 253256 - DNA, 25 bp, Mus musculus
cctggcctcctcctaccccatccca

SEQ ID NO: 253257 - DNA, 25 bp, Mus musculus
cctggcctgcttgaaatggaattta

SEQ ID NO: 253258 - DNA, 25 bp, Mus musculus
cctggccttggaggaaactttgctt

SEQ ID NO: 253259 - DNA, 25 bp, Mus musculus
cctggccttggaggtttgcctggag

SEQ ID NO: 253260 - DNA, 25 bp, Mus musculus
cctggccttgtcgggtgtgatcatg

SEQ ID NO: 253261 - DNA, 25 bp, Mus musculus
cctggcgaccaggcttcagatgcta

SEQ ID NO: 253262 - DNA, 25 bp, Mus musculus
cctggcgacggttaccacagtggag

SEQ ID NO: 253263 - DNA, 25 bp, Mus musculus
cctggcgagaggagggctctggtct

SEQ ID NO: 253264 - DNA, 25 bp, Mus musculus
cctggcgagaggaggtctcgaagtc

SEQ ID NO: 253265 - DNA, 25 bp, Mus musculus
cctggcgagcggatctacgaagtag

SEQ ID NO: 253266 - DNA, 25 bp, Mus musculus
cctggcgaggctcaaagcccgattt

SEQ ID NO: 253267 - DNA, 25 bp, Mus musculus
cctggcgcccagggcaaggacagcc

SEQ ID NO: 253268 - DNA, 25 bp, Mus musculus
cctggcgcccagtgagtgaaccccc

SEQ ID NO: 253269 - DNA, 25 bp, Mus musculus
cctggcgccccacagcttgaggagg

SEQ ID NO: 253270 - DNA, 25 bp, Mus musculus
cctggcgctcgagcacgggtcgtga

SEQ ID NO: 253271 - DNA, 25 bp, Mus musculus
cctggcggacaggctgggccgtcgg

SEQ ID NO: 253272 - DNA, 25 bp, Mus musculus
cctggcggcttaaaaggcagtatga

SEQ ID NO: 253273 - DNA, 25 bp, Mus musculus
cctggcgggaggcgcaacagcgtga

SEQ ID NO: 253274 - DNA, 25 bp, Mus musculus
cctggcgggagggctcaggatccga

SEQ ID NO: 253275 - DNA, 25 bp, Mus musculus
cctggcgggcgaaggggaactgatc

SEQ ID NO: 253276 - DNA, 25 bp, Mus musculus
cctggcggttcacaagagcaagatg

SEQ ID NO: 253277 - DNA, 25 bp, Mus musculus
cctggcgttcatggaatatgaagac

SEQ ID NO: 253278 - DNA, 25 bp, Mus musculus
cctggcgttggagggtgctgagtac

SEQ ID NO: 253279 - DNA, 25 bp, Mus musculus
cctggctaagagggaaggctcctgc

SEQ ID NO: 253280 - DNA, 25 bp, Mus musculus
cctggctaagcaagcttccctgttt

SEQ ID NO: 253281 - DNA, 25 bp, Mus musculus
cctggctaagtggctctgtatttct

SEQ ID NO: 253282 - DNA, 25 bp, Mus musculus
cctggctaagtggctgagccaaacc

SEQ ID NO: 253283 - DNA, 25 bp, Mus musculus
cctggctacaaggctgagggaaaat

SEQ ID NO: 253284 - DNA, 25 bp, Mus musculus
cctggctacaagggatgggcataat

SEQ ID NO: 253285 - DNA, 25 bp, Mus musculus
cctggctacactgggcgccctgtgc

SEQ ID NO: 253286 - DNA, 25 bp, Mus musculus
cctggctagcatgagaacaaatata

SEQ ID NO: 253287 - DNA, 25 bp, Mus musculus
cctggctagcatgagcatcagttgg

SEQ ID NO: 253288 - DNA, 25 bp, Mus musculus
cctggctagtgcaaagatcagctac

SEQ ID NO: 253289 - DNA, 25 bp, Mus musculus
cctggctattgacaagaaggcttgg

SEQ ID NO: 253290 - DNA, 25 bp, Mus musculus
cctggctattgactccacggctgac

SEQ ID NO: 253291 - DNA, 25 bp, Mus musculus
cctggctcaaactaagtggcctgct

SEQ ID NO: 253292 - DNA, 25 bp, Mus musculus
cctggctcaaggctttggctccctc

SEQ ID NO: 253293 - DNA, 25 bp, Mus musculus
cctggctcacctctgctattgtaga

SEQ ID NO: 253294 - DNA, 25 bp, Mus musculus
cctggctccactgtcttatatcgga

SEQ ID NO: 253295 - DNA, 25 bp, Mus musculus
cctggctccagatgacctcatccca

SEQ ID NO: 253296 - DNA, 25 bp, Mus musculus
cctggctccagcggacgcccgtggt

SEQ ID NO: 253297 - DNA, 25 bp, Mus musculus
cctggctccagtctgttctcctggc

SEQ ID NO: 253298 - DNA, 25 bp, Mus musculus
cctggctccattccatgaggcgccc

SEQ ID NO: 253299 - DNA, 25 bp, Mus musculus
cctggctcgtgaaagattcaactgg

SEQ ID NO: 253300 - DNA, 25 bp, Mus musculus
cctggctcgtgaaagtgcattgttg

SEQ ID NO: 253301 - DNA, 25 bp, Mus musculus
cctggctctggaccctcttctagcc

SEQ ID NO: 253302 - DNA, 25 bp, Mus musculus
cctggctgagcagcaaaggtgaatg

SEQ ID NO: 253303 - DNA, 25 bp, Mus musculus
cctggctgaggacctcctttcttat

SEQ ID NO: 253304 - DNA, 25 bp, Mus musculus
cctggctgaggacctcggatgggtc

SEQ ID NO: 253305 - DNA, 25 bp, Mus musculus
cctggctgaggcagagcagctgatg

SEQ ID NO: 253306 - DNA, 25 bp, Mus musculus
cctggctgaggtactttctgaaccc

SEQ ID NO: 253307 - DNA, 25 bp, Mus musculus
cctggctgagtatgagcccagagga

SEQ ID NO: 253308 - DNA, 25 bp, Mus musculus
cctggctgtgggtggtgagaagcta

SEQ ID NO: 253309 - DNA, 25 bp, Mus musculus
cctggctgttgctcgtcttggggat

SEQ ID NO: 253310 - DNA, 25 bp, Mus musculus
cctggctgtttatcgcaggaggcag

SEQ ID NO: 253311 - DNA, 25 bp, Mus musculus
cctggcttatctgaggtggggaaag

SEQ ID NO: 253312 - DNA, 25 bp, Mus musculus
cctggcttgagtgggccttcccgct

SEQ ID NO: 253313 - DNA, 25 bp, Mus musculus
cctggcttgcacaccggggccctgg

SEQ ID NO: 253314 - DNA, 25 bp, Mus musculus
cctggcttgcagtgtgcctgcagtc

SEQ ID NO: 253315 - DNA, 25 bp, Mus musculus
cctggcttgccgggccctccaggtc

SEQ ID NO: 253316 - DNA, 25 bp, Mus musculus
cctggctttgtctgttgctgtggag

SEQ ID NO: 253317 - DNA, 25 bp, Mus musculus
cctgggaaaaggacgctattacaag

SEQ ID NO: 253318 - DNA, 25 bp, Mus musculus
cctgggaaagcaggggagaagtcaa

SEQ ID NO: 253319 - DNA, 25 bp, Mus musculus
cctgggaaaggtgctgggtgtgtgg

SEQ ID NO: 253320 - DNA, 25 bp, Mus musculus
cctgggaaaggtgtggtatctcttg

SEQ ID NO: 253321 - DNA, 25 bp, Mus musculus
cctgggaacaaaggaggaggacatc

SEQ ID NO: 253322 - DNA, 25 bp, Mus musculus
cctgggaactccagcccttttacac

SEQ ID NO: 253323 - DNA, 25 bp, Mus musculus
cctgggaactgcaggtaaggaactg

SEQ ID NO: 253324 - DNA, 25 bp, Mus musculus
cctgggaactgcagtttccctgcag

SEQ ID NO: 253325 - DNA, 25 bp, Mus musculus
cctgggacaacagtttacctacgtt

SEQ ID NO: 253326 - DNA, 25 bp, Mus musculus
cctgggacacacaggagagtactaa

SEQ ID NO: 253327 - DNA, 25 bp, Mus musculus
cctgggacacagagtcttcaagcag

SEQ ID NO: 253328 - DNA, 25 bp, Mus musculus
cctgggaccaactcagtacctgtgg

SEQ ID NO: 253329 - DNA, 25 bp, Mus musculus
cctgggacctaaaactttgcagatt

SEQ ID NO: 253330 - DNA, 25 bp, Mus musculus
cctgggacctggtcactcctgtccc

SEQ ID NO: 253331 - DNA, 25 bp, Mus musculus
cctgggactcagatggaccacacag

SEQ ID NO: 253332 - DNA, 25 bp, Mus musculus
cctgggactgaagactcggatgacg

SEQ ID NO: 253333 - DNA, 25 bp, Mus musculus
cctgggagaacagatacaaaggatg

SEQ ID NO: 253334 - DNA, 25 bp, Mus musculus
cctgggagagagggttgaaaactag

SEQ ID NO: 253335 - DNA, 25 bp, Mus musculus
cctgggagcaggaattaccttgcat

SEQ ID NO: 253336 - DNA, 25 bp, Mus musculus
cctgggagccatcgagggaatgggc

SEQ ID NO: 253337 - DNA, 25 bp, Mus musculus
cctgggagcgagttaagagaaaatg

SEQ ID NO: 253338 - DNA, 25 bp, Mus musculus
cctgggaggccaggattgataagta

SEQ ID NO: 253339 - DNA, 25 bp, Mus musculus
cctgggaggccaggctttttgatca

SEQ ID NO: 253340 - DNA, 25 bp, Mus musculus
cctgggaggctcaagcactgctaca

SEQ ID NO: 253341 - DNA, 25 bp, Mus musculus
cctgggagtccttttgtcctctgct

SEQ ID NO: 253342 - DNA, 25 bp, Mus musculus
cctgggagtgaacggtctcaggagc

SEQ ID NO: 253343 - DNA, 25 bp, Mus musculus
cctgggagttcgctatctgcaggtg

SEQ ID NO: 253344 - DNA, 25 bp, Mus musculus
cctgggatagaagggcttcttggta

SEQ ID NO: 253345 - DNA, 25 bp, Mus musculus
cctgggatcctataaatttgaaaat

SEQ ID NO: 253346 - DNA, 25 bp, Mus musculus
cctgggatcctgggagaatttagag

SEQ ID NO: 253347 - DNA, 25 bp, Mus musculus
cctgggatctcagagggatttgacc

SEQ ID NO: 253348 - DNA, 25 bp, Mus musculus
cctgggatctgaacttcactggacc

SEQ ID NO: 253349 - DNA, 25 bp, Mus musculus
cctgggatctgctgtgtcccaggaa

SEQ ID NO: 253350 - DNA, 25 bp, Mus musculus
cctgggatgggaggtcccacgtgat

SEQ ID NO: 253351 - DNA, 25 bp, Mus musculus
cctgggatgtgccgacggtggttcc

SEQ ID NO: 253352 - DNA, 25 bp, Mus musculus
cctgggatgtgccggaatgcaggct

SEQ ID NO: 253353 - DNA, 25 bp, Mus musculus
cctgggatgttgggtagcggaaaga

SEQ ID NO: 253354 - DNA, 25 bp, Mus musculus
cctgggattaaagattcatcagtgg

SEQ ID NO: 253355 - DNA, 25 bp, Mus musculus
cctgggattaggagtgccaggaggt

SEQ ID NO: 253356 - DNA, 25 bp, Mus musculus
cctgggattctgtctcaaaccatga

SEQ ID NO: 253357 - DNA, 25 bp, Mus musculus
cctgggatttgtcgccagagagaca

SEQ ID NO: 253358 - DNA, 25 bp, Mus musculus
cctgggcaaaggggggctcctggca

SEQ ID NO: 253359 - DNA, 25 bp, Mus musculus
cctgggcaagctggtggtaacggaa

SEQ ID NO: 253360 - DNA, 25 bp, Mus musculus
cctgggcaaggagatccacgatttg

SEQ ID NO: 253361 - DNA, 25 bp, Mus musculus
cctgggcacacaggccagcggtgtg

SEQ ID NO: 253362 - DNA, 25 bp, Mus musculus
cctgggcacacagggttttgaaggc

SEQ ID NO: 253363 - DNA, 25 bp, Mus musculus
cctgggcacagaccgcgggacagtg

SEQ ID NO: 253364 - DNA, 25 bp, Mus musculus
cctgggcacagcattgatctggtgg

SEQ ID NO: 253365 - DNA, 25 bp, Mus musculus
cctgggcacctgactcagcgtgaag

SEQ ID NO: 253366 - DNA, 25 bp, Mus musculus
cctgggcagaaaggtgatcgagggt

SEQ ID NO: 253367 - DNA, 25 bp, Mus musculus
cctgggcagagccagagaatgttgc

SEQ ID NO: 253368 - DNA, 25 bp, Mus musculus
cctgggcagcatcagcccccggcag

SEQ ID NO: 253369 - DNA, 25 bp, Mus musculus
cctgggcagggatccctgctgcctt

SEQ ID NO: 253370 - DNA, 25 bp, Mus musculus
cctgggccaagatgaaagcttgcgg

SEQ ID NO: 253371 - DNA, 25 bp, Mus musculus
cctgggccacagggacttggatgtt

SEQ ID NO: 253372 - DNA, 25 bp, Mus musculus
cctgggccacagggtcctactggag

SEQ ID NO: 253373 - DNA, 25 bp, Mus musculus
cctgggccacggagcagctgaaggc

SEQ ID NO: 253374 - DNA, 25 bp, Mus musculus
cctgggccagaaggtccggctggta

SEQ ID NO: 253375 - DNA, 25 bp, Mus musculus
cctgggccaggacctgtgtgctccc

SEQ ID NO: 253376 - DNA, 25 bp, Mus musculus
cctgggcccaagaggcctcaaagag

SEQ ID NO: 253377 - DNA, 25 bp, Mus musculus
cctgggcccaagaggcctcgtggag

SEQ ID NO: 253378 - DNA, 25 bp, Mus musculus
cctgggccccaagggcttctagact

SEQ ID NO: 253379 - DNA, 25 bp, Mus musculus
cctgggcccccgtcacagtttgcac

SEQ ID NO: 253380 - DNA, 25 bp, Mus musculus
cctgggcctaagttatgaggagtcc

SEQ ID NO: 253381 - DNA, 25 bp, Mus musculus
cctgggcctagcagtggcatctttc

SEQ ID NO: 253382 - DNA, 25 bp, Mus musculus
cctgggcctcaagtccccaagactt

SEQ ID NO: 253383 - DNA, 25 bp, Mus musculus
cctgggccttccagccatgctgcaa

SEQ ID NO: 253384 - DNA, 25 bp, Mus musculus
cctgggccttgtgttttttcagttc

SEQ ID NO: 253385 - DNA, 25 bp, Mus musculus
cctgggcgcaggaagatttggaaaa

SEQ ID NO: 253386 - DNA, 25 bp, Mus musculus
cctgggcgcgctcggagacattcca

SEQ ID NO: 253387 - DNA, 25 bp, Mus musculus
cctgggcggagccccttaggtgagg

SEQ ID NO: 253388 - DNA, 25 bp, Mus musculus
cctgggcggagtagcgctggggacc

SEQ ID NO: 253389 - DNA, 25 bp, Mus musculus
cctgggcgggagagatggatgcgag

SEQ ID NO: 253390 - DNA, 25 bp, Mus musculus
cctgggctacaaagctgctgatgag

SEQ ID NO: 253391 - DNA, 25 bp, Mus musculus
cctgggctacagagctcaccatgcc

SEQ ID NO: 253392 - DNA, 25 bp, Mus musculus
cctgggctctgtgggggcagctggc

SEQ ID NO: 253393 - DNA, 25 bp, Mus musculus
cctgggctgaagctaggcggccgtc

SEQ ID NO: 253394 - DNA, 25 bp, Mus musculus
cctgggctgaaggagacagaggaag

SEQ ID NO: 253395 - DNA, 25 bp, Mus musculus
cctgggctgaaggggagcttctgga

SEQ ID NO: 253396 - DNA, 25 bp, Mus musculus
cctgggctgagatgaggtgccactt

SEQ ID NO: 253397 - DNA, 25 bp, Mus musculus
cctgggctgcatgcattgtggctgg

SEQ ID NO: 253398 - DNA, 25 bp, Mus musculus
cctgggctgcgggagccaatgtccc

SEQ ID NO: 253399 - DNA, 25 bp, Mus musculus
cctgggctgcgggtttgttttctgc

SEQ ID NO: 253400 - DNA, 25 bp, Mus musculus
cctgggctgtggtggtgagaagcta

SEQ ID NO: 253401 - DNA, 25 bp, Mus musculus
cctgggcttcaggtgctgtgggacg

SEQ ID NO: 253402 - DNA, 25 bp, Mus musculus
cctgggcttggggaagtcccagatc

SEQ ID NO: 253403 - DNA, 25 bp, Mus musculus
cctgggctttgctgggacccatgtt

SEQ ID NO: 253404 - DNA, 25 bp, Mus musculus
cctggggaaagcattgtggaatttc

SEQ ID NO: 253405 - DNA, 25 bp, Mus musculus
cctggggaaagctactgggatggag

SEQ ID NO: 253406 - DNA, 25 bp, Mus musculus
cctggggaagaagagtctgaggaag

SEQ ID NO: 253407 - DNA, 25 bp, Mus musculus
cctggggaagactcaagggcaaatt

SEQ ID NO: 253408 - DNA, 25 bp, Mus musculus
cctggggaaggtgactttccagtgc

SEQ ID NO: 253409 - DNA, 25 bp, Mus musculus
cctggggacagaattgccctagaag

SEQ ID NO: 253410 - DNA, 25 bp, Mus musculus
cctggggacgtgcagaattaccatg

SEQ ID NO: 253411 - DNA, 25 bp, Mus musculus
cctggggacgtgcagaccatcccat

SEQ ID NO: 253412 - DNA, 25 bp, Mus musculus
cctggggagaataagtgttttgcag

SEQ ID NO: 253413 - DNA, 25 bp, Mus musculus
cctggggagagatctccatagtaga

SEQ ID NO: 253414 - DNA, 25 bp, Mus musculus
cctggggagaggccgacccgtggaa

SEQ ID NO: 253415 - DNA, 25 bp, Mus musculus
cctggggagccttttgcccttcttt

SEQ ID NO: 253416 - DNA, 25 bp, Mus musculus
cctggggataattggcctgtggaag

SEQ ID NO: 253417 - DNA, 25 bp, Mus musculus
cctggggataattgggtctggcaac

SEQ ID NO: 253418 - DNA, 25 bp, Mus musculus
cctggggatccgagagactcgggaa

SEQ ID NO: 253419 - DNA, 25 bp, Mus musculus
cctggggatgcaggttctccgccat

SEQ ID NO: 253420 - DNA, 25 bp, Mus musculus
cctggggatgggagtgagtgctgct

SEQ ID NO: 253421 - DNA, 25 bp, Mus musculus
cctggggatggtgtgaccccacaac

SEQ ID NO: 253422 - DNA, 25 bp, Mus musculus
cctggggcagggaagaggtgccagc

SEQ ID NO: 253423 - DNA, 25 bp, Mus musculus
cctggggcagggcgggagagtattg

SEQ ID NO: 253424 - DNA, 25 bp, Mus musculus
cctggggcaggtcacctagcattgg

SEQ ID NO: 253425 - DNA, 25 bp, Mus musculus
cctggggcatgcaggcttcctgctt

SEQ ID NO: 253426 - DNA, 25 bp, Mus musculus
cctggggccagctcgcaagcaggct

SEQ ID NO: 253427 - DNA, 25 bp, Mus musculus
cctggggccagctcgcttgaagctc

SEQ ID NO: 253428 - DNA, 25 bp, Mus musculus
cctggggccatgatgagtacctata

SEQ ID NO: 253429 - DNA, 25 bp, Mus musculus
cctggggccccatcggaagctcaga

SEQ ID NO: 253430 - DNA, 25 bp, Mus musculus
cctggggccgaaggcctgggatggg

SEQ ID NO: 253431 - DNA, 25 bp, Mus musculus
cctggggcggagtggcagcccagcc

SEQ ID NO: 253432 - DNA, 25 bp, Mus musculus
cctggggctgatggcttccctagga

SEQ ID NO: 253433 - DNA, 25 bp, Mus musculus
cctggggctgcgccggagcgcagag

SEQ ID NO: 253434 - DNA, 25 bp, Mus musculus
cctgggggacctcagaaggtctata

SEQ ID NO: 253435 - DNA, 25 bp, Mus musculus
cctgggggacgctgcaagtgtggag

SEQ ID NO: 253436 - DNA, 25 bp, Mus musculus
cctgggggacgctgggatttgaact

SEQ ID NO: 253437 - DNA, 25 bp, Mus musculus
cctgggggagtctcttgtacagagg

SEQ ID NO: 253438 - DNA, 25 bp, Mus musculus
cctgggggcagcagcaccatggcca

SEQ ID NO: 253439 - DNA, 25 bp, Mus musculus
cctgggggcagcagcttcctggccc

SEQ ID NO: 253440 - DNA, 25 bp, Mus musculus
cctgggggcagcaggatcccagtgt

SEQ ID NO: 253441 - DNA, 25 bp, Mus musculus
cctgggggcagccgaggaagtggag

SEQ ID NO: 253442 - DNA, 25 bp, Mus musculus
cctgggggccaagtgctcaccgagt

SEQ ID NO: 253443 - DNA, 25 bp, Mus musculus
cctggggggtccctggtgtcgcgga

SEQ ID NO: 253444 - DNA, 25 bp, Mus musculus
cctgggggtcactggagtcgctggg

SEQ ID NO: 253445 - DNA, 25 bp, Mus musculus
cctggggtacagattcccgtggggc

SEQ ID NO: 253446 - DNA, 25 bp, Mus musculus
cctggggtcatcccgtactcactgg

SEQ ID NO: 253447 - DNA, 25 bp, Mus musculus
cctggggtcattgaatacaaaggtg

SEQ ID NO: 253448 - DNA, 25 bp, Mus musculus
cctggggtccccagaatcactatca

SEQ ID NO: 253449 - DNA, 25 bp, Mus musculus
cctggggtccccagcaggaagggcc

SEQ ID NO: 253450 - DNA, 25 bp, Mus musculus
cctggggtccccagccgatcgggtc

SEQ ID NO: 253451 - DNA, 25 bp, Mus musculus
cctggggtcccggacaagagtacat

SEQ ID NO: 253452 - DNA, 25 bp, Mus musculus
cctggggtcccggatatttggaaga

SEQ ID NO: 253453 - DNA, 25 bp, Mus musculus
cctggggtgagaagggcgttctctc

SEQ ID NO: 253454 - DNA, 25 bp, Mus musculus
cctggggttatgagggctggagaca

SEQ ID NO: 253455 - DNA, 25 bp, Mus musculus
cctggggttgggcgacagagagaga

SEQ ID NO: 253456 - DNA, 25 bp, Mus musculus
cctgggtacaggcaaccaagaacgg

SEQ ID NO: 253457 - DNA, 25 bp, Mus musculus
cctgggtacaggtcggccagtgagg

SEQ ID NO: 253458 - DNA, 25 bp, Mus musculus
cctgggtacgatatatcacacagaa

SEQ ID NO: 253459 - DNA, 25 bp, Mus musculus
cctgggtagcccgtgtcccatcact

SEQ ID NO: 253460 - DNA, 25 bp, Mus musculus
cctgggtagcccgttacatcttcaa

SEQ ID NO: 253461 - DNA, 25 bp, Mus musculus
cctgggtcagaacatctttgcctgg

SEQ ID NO: 253462 - DNA, 25 bp, Mus musculus
cctgggtcagaagcatactgaggat

SEQ ID NO: 253463 - DNA, 25 bp, Mus musculus
cctgggtcagaagcatacttagacg

SEQ ID NO: 253464 - DNA, 25 bp, Mus musculus
cctgggtctcagattatacagacac

SEQ ID NO: 253465 - DNA, 25 bp, Mus musculus
cctgggtctcccagtttgtcactct

SEQ ID NO: 253466 - DNA, 25 bp, Mus musculus
cctgggtctttcgaatccttcgaaa

SEQ ID NO: 253467 - DNA, 25 bp, Mus musculus
cctgggtgatgttttcagctttgtg

SEQ ID NO: 253468 - DNA, 25 bp, Mus musculus
cctgggtgcagggggaacagctgtg

SEQ ID NO: 253469 - DNA, 25 bp, Mus musculus
cctgggtgcaggggtgtgccccaga

SEQ ID NO: 253470 - DNA, 25 bp, Mus musculus
cctgggtgcccgggatgaaagtggg

SEQ ID NO: 253471 - DNA, 25 bp, Mus musculus
cctgggtggacaggtgagcaatgcc

SEQ ID NO: 253472 - DNA, 25 bp, Mus musculus
cctgggtggctctcccagggtgggg

SEQ ID NO: 253473 - DNA, 25 bp, Mus musculus
cctgggtgtcagatgatgcatccca

SEQ ID NO: 253474 - DNA, 25 bp, Mus musculus
cctgggtgtgagattctctccagag

SEQ ID NO: 253475 - DNA, 25 bp, Mus musculus
cctgggtgtggccagatcagactcc

SEQ ID NO: 253476 - DNA, 25 bp, Mus musculus
cctgggtgtggccagcgttttacca

SEQ ID NO: 253477 - DNA, 25 bp, Mus musculus
cctgggtgtggtcaacagctgagcc

SEQ ID NO: 253478 - DNA, 25 bp, Mus musculus
cctgggttaaggagagcacacagct

SEQ ID NO: 253479 - DNA, 25 bp, Mus musculus
cctgggttcacacaggagtgccagg

SEQ ID NO: 253480 - DNA, 25 bp, Mus musculus
cctgggttcaggcatcagaaacaca

SEQ ID NO: 253481 - DNA, 25 bp, Mus musculus
cctgggttcaggtgtttccaggaca

SEQ ID NO: 253482 - DNA, 25 bp, Mus musculus
cctgggttccagaccagccacgatg

SEQ ID NO: 253483 - DNA, 25 bp, Mus musculus
cctgggttcctagctggaggaaatc

SEQ ID NO: 253484 - DNA, 25 bp, Mus musculus
cctgggttcctaggtccagctggag

SEQ ID NO: 253485 - DNA, 25 bp, Mus musculus
cctgggttgcagcccagaggacttc

SEQ ID NO: 253486 - DNA, 25 bp, Mus musculus
cctgggttgcagttataataaagac

SEQ ID NO: 253487 - DNA, 25 bp, Mus musculus
cctgggtttaaagacagtatttgaa

SEQ ID NO: 253488 - DNA, 25 bp, Mus musculus
cctggtaaagtggttcatcggaacc

SEQ ID NO: 253489 - DNA, 25 bp, Mus musculus
cctggtaaatgctactgagtgacac

SEQ ID NO: 253490 - DNA, 25 bp, Mus musculus
cctggtaactgctgggggctctctt

SEQ ID NO: 253491 - DNA, 25 bp, Mus musculus
cctggtacagaccatattaaccagc

SEQ ID NO: 253492 - DNA, 25 bp, Mus musculus
cctggtacagaccatattgatcagt

SEQ ID NO: 253493 - DNA, 25 bp, Mus musculus
cctggtacagaggtatctacacaag

SEQ ID NO: 253494 - DNA, 25 bp, Mus musculus
cctggtacagcaaccttccatggct

SEQ ID NO: 253495 - DNA, 25 bp, Mus musculus
cctggtacagcaagcttccctgcta

SEQ ID NO: 253496 - DNA, 25 bp, Mus musculus
cctggtacagcaagcttccctggca

SEQ ID NO: 253497 - DNA, 25 bp, Mus musculus
cctggtacagcaagcttccctgttt

SEQ ID NO: 253498 - DNA, 25 bp, Mus musculus
cctggtacagcaagctttcctggca

SEQ ID NO: 253499 - DNA, 25 bp, Mus musculus
cctggtacagtgacagctcttactt

SEQ ID NO: 253500 - DNA, 25 bp, Mus musculus
cctggtacatggtggtcaacctgtt

SEQ ID NO: 253501 - DNA, 25 bp, Mus musculus
cctggtaccccgtcggcaatgatgg

SEQ ID NO: 253502 - DNA, 25 bp, Mus musculus
cctggtactaatggatagatgcctg

SEQ ID NO: 253503 - DNA, 25 bp, Mus musculus
cctggtactaatgtgccagtattag

SEQ ID NO: 253504 - DNA, 25 bp, Mus musculus
cctggtactggagcagagggtcccc

SEQ ID NO: 253505 - DNA, 25 bp, Mus musculus
cctggtactgtccgcatgagacact

SEQ ID NO: 253506 - DNA, 25 bp, Mus musculus
cctggtagcccaggcaagcgcttcc

SEQ ID NO: 253507 - DNA, 25 bp, Mus musculus
cctggtagcccaggccaccatggca

SEQ ID NO: 253508 - DNA, 25 bp, Mus musculus
cctggtaggaaagagaaaatccctg

SEQ ID NO: 253509 - DNA, 25 bp, Mus musculus
cctggtaggaaaggtccagcaagac

SEQ ID NO: 253510 - DNA, 25 bp, Mus musculus
cctggtagtagatgtcccatattat

SEQ ID NO: 253511 - DNA, 25 bp, Mus musculus
cctggtataactatggtatcgctgg

SEQ ID NO: 253512 - DNA, 25 bp, Mus musculus
cctggtatatgctcccggcaacttc

SEQ ID NO: 253513 - DNA, 25 bp, Mus musculus
cctggtatccttggggcactgcgtg

SEQ ID NO: 253514 - DNA, 25 bp, Mus musculus
cctggtatctggttggcagatattc

SEQ ID NO: 253515 - DNA, 25 bp, Mus musculus
cctggtatgcatgcggtctcccact

SEQ ID NO: 253516 - DNA, 25 bp, Mus musculus
cctggtatgcatgcggtgtgagcat

SEQ ID NO: 253517 - DNA, 25 bp, Mus musculus
cctggtcacaaggctccgacatgaa

SEQ ID NO: 253518 - DNA, 25 bp, Mus musculus
cctggtcacaagtgcgaatctgtcc

SEQ ID NO: 253519 - DNA, 25 bp, Mus musculus
cctggtcacaggtgcgggtagcggc

SEQ ID NO: 253520 - DNA, 25 bp, Mus musculus
cctggtcaggagtgctgcaaagatg

SEQ ID NO: 253521 - DNA, 25 bp, Mus musculus
cctggtcaggcactcggacatgcca

SEQ ID NO: 253522 - DNA, 25 bp, Mus musculus
cctggtcaggtgagcagattgatga

SEQ ID NO: 253523 - DNA, 25 bp, Mus musculus
cctggtcatgagaggagaaagagtc

SEQ ID NO: 253524 - DNA, 25 bp, Mus musculus
cctggtcatgagaggagggcaggtt

SEQ ID NO: 253525 - DNA, 25 bp, Mus musculus
cctggtccagaacagcctgcacttc

SEQ ID NO: 253526 - DNA, 25 bp, Mus musculus
cctggtccagaacagctggaggtgg

SEQ ID NO: 253527 - DNA, 25 bp, Mus musculus
cctggtccaggataaataggattta

SEQ ID NO: 253528 - DNA, 25 bp, Mus musculus
cctggtccaggtgaaatcgccctgt

SEQ ID NO: 253529 - DNA, 25 bp, Mus musculus
cctggtcccagcgcaggagcctgtt

SEQ ID NO: 253530 - DNA, 25 bp, Mus musculus
cctggtcccccaataccgtgactgt

SEQ ID NO: 253531 - DNA, 25 bp, Mus musculus
cctggtcctacgatcccaggctccg

SEQ ID NO: 253532 - DNA, 25 bp, Mus musculus
cctggtcctacggctgtgtggtgaa

SEQ ID NO: 253533 - DNA, 25 bp, Mus musculus
cctggtcctgctggcttccctggtg

SEQ ID NO: 253534 - DNA, 25 bp, Mus musculus
cctggtcctgtgggtctccctggtc

SEQ ID NO: 253535 - DNA, 25 bp, Mus musculus
cctggtcctgtgggtgaaccaggtc

SEQ ID NO: 253536 - DNA, 25 bp, Mus musculus
cctggtcctgtgggtgagcaaggcc

SEQ ID NO: 253537 - DNA, 25 bp, Mus musculus
cctggtcgaagctgggttgaaaact

SEQ ID NO: 253538 - DNA, 25 bp, Mus musculus
cctggtcgtaatggagatagggcac

SEQ ID NO: 253539 - DNA, 25 bp, Mus musculus
cctggtctaaagaatcagaagtact

SEQ ID NO: 253540 - DNA, 25 bp, Mus musculus
cctggtctacaaagaaatgttctgc

SEQ ID NO: 253541 - DNA, 25 bp, Mus musculus
cctggtctacaaagtggatcccact

SEQ ID NO: 253542 - DNA, 25 bp, Mus musculus
cctggtctacaagatcacagagcag

SEQ ID NO: 253543 - DNA, 25 bp, Mus musculus
cctggtctacagaatagacatgcta

SEQ ID NO: 253544 - DNA, 25 bp, Mus musculus
cctggtctacagagctctcagacac

SEQ ID NO: 253545 - DNA, 25 bp, Mus musculus
cctggtctacagatacaaatataga

SEQ ID NO: 253546 - DNA, 25 bp, Mus musculus
cctggtctacatagggctccaacac

SEQ ID NO: 253547 - DNA, 25 bp, Mus musculus
cctggtctatcctggccgcctggga

SEQ ID NO: 253548 - DNA, 25 bp, Mus musculus
cctggtctatcctggggacctaaaa

SEQ ID NO: 253549 - DNA, 25 bp, Mus musculus
cctggtctatcctggtgatccactg

SEQ ID NO: 253550 - DNA, 25 bp, Mus musculus
cctggtctcaggaatctatgaatac

SEQ ID NO: 253551 - DNA, 25 bp, Mus musculus
cctggtctcaggtaatctccaaaaa

SEQ ID NO: 253552 - DNA, 25 bp, Mus musculus
cctggtctccctggggcatcagccg

SEQ ID NO: 253553 - DNA, 25 bp, Mus musculus
cctggtctcgctctggcttcccatt

SEQ ID NO: 253554 - DNA, 25 bp, Mus musculus
cctggtctctgtggagaactactgc

SEQ ID NO: 253555 - DNA, 25 bp, Mus musculus
cctggtctgagaggtcttcctggaa

SEQ ID NO: 253556 - DNA, 25 bp, Mus musculus
cctggtcttcacagggacctgtggg

SEQ ID NO: 253557 - DNA, 25 bp, Mus musculus
cctggtcttcagagtggaattgggc

SEQ ID NO: 253558 - DNA, 25 bp, Mus musculus
cctggtcttgagggccgagtggtca

SEQ ID NO: 253559 - DNA, 25 bp, Mus musculus
cctggtcttgtgggccgagtggtca

SEQ ID NO: 253560 - DNA, 25 bp, Mus musculus
cctggtctttggagatatggaaggc

SEQ ID NO: 253561 - DNA, 25 bp, Mus musculus
cctggtgaatggggtcagtggtgag

SEQ ID NO: 253562 - DNA, 25 bp, Mus musculus
cctggtgacaagaagactagcagtg

SEQ ID NO: 253563 - DNA, 25 bp, Mus musculus
cctggtgacaagggagaccagggcc

SEQ ID NO: 253564 - DNA, 25 bp, Mus musculus
cctggtgacaggatggctgggcaca

SEQ ID NO: 253565 - DNA, 25 bp, Mus musculus
cctggtgacaggatgttggtgttgg

SEQ ID NO: 253566 - DNA, 25 bp, Mus musculus
cctggtgacccacaaccgcacttac

SEQ ID NO: 253567 - DNA, 25 bp, Mus musculus
cctggtgacgacggtgaagctggga

SEQ ID NO: 253568 - DNA, 25 bp, Mus musculus
cctggtgatccctgcagacggctct

SEQ ID NO: 253569 - DNA, 25 bp, Mus musculus
cctggtgattaggacaaagccaaag

SEQ ID NO: 253570 - DNA, 25 bp, Mus musculus
cctggtgcaagagagtgtccaagca

SEQ ID NO: 253571 - DNA, 25 bp, Mus musculus
cctggtgcacctggtccacaaggtt

SEQ ID NO: 253572 - DNA, 25 bp, Mus musculus
cctggtgcagctggtgctgctggct

SEQ ID NO: 253573 - DNA, 25 bp, Mus musculus
cctggtgccaagggcgaagctggtc

SEQ ID NO: 253574 - DNA, 25 bp, Mus musculus
cctggtgcccagagagaggcaggaa

SEQ ID NO: 253575 - DNA, 25 bp, Mus musculus
cctggtgcctagatgctgaatgctc

SEQ ID NO: 253576 - DNA, 25 bp, Mus musculus
cctggtgcgagacaccccccaggcc

SEQ ID NO: 253577 - DNA, 25 bp, Mus musculus
cctggtgcgagagtcacccagcaca

SEQ ID NO: 253578 - DNA, 25 bp, Mus musculus
cctggtgctaagggtgaagctggcc

SEQ ID NO: 253579 - DNA, 25 bp, Mus musculus
cctggtgctaatacaacctgtgggt

SEQ ID NO: 253580 - DNA, 25 bp, Mus musculus
cctggtgctaatcacagaactgtta

SEQ ID NO: 253581 - DNA, 25 bp, Mus musculus
cctggtgctaatgtctgtgcgtcct

SEQ ID NO: 253582 - DNA, 25 bp, Mus musculus
cctggtgctacctttttttgatcct

SEQ ID NO: 253583 - DNA, 25 bp, Mus musculus
cctggtgctagcacaggttagtgtc

SEQ ID NO: 253584 - DNA, 25 bp, Mus musculus
cctggtgctagcaggttttatgacc

SEQ ID NO: 253585 - DNA, 25 bp, Mus musculus
cctggtgctagctggtgaagacaca

SEQ ID NO: 253586 - DNA, 25 bp, Mus musculus
cctggtgctaggagtggcctgcagt

SEQ ID NO: 253587 - DNA, 25 bp, Mus musculus
cctggtgctccgcagctggctcctc

SEQ ID NO: 253588 - DNA, 25 bp, Mus musculus
cctggtgctccgcaggtatctgaat

SEQ ID NO: 253589 - DNA, 25 bp, Mus musculus
cctggtgctccgcaggttgaactgg

SEQ ID NO: 253590 - DNA, 25 bp, Mus musculus
cctggtgctctgaagggggtacttc

SEQ ID NO: 253591 - DNA, 25 bp, Mus musculus
cctggtgctctgaaggtcagcaagt

SEQ ID NO: 253592 - DNA, 25 bp, Mus musculus
cctggtgctggagagcaaaaaaaca

SEQ ID NO: 253593 - DNA, 25 bp, Mus musculus
cctggtgctggagtggagaaagcat

SEQ ID NO: 253594 - DNA, 25 bp, Mus musculus
cctggtggaaagacagctggaacaa

SEQ ID NO: 253595 - DNA, 25 bp, Mus musculus
cctggtggaagctccatggttattc

SEQ ID NO: 253596 - DNA, 25 bp, Mus musculus
cctggtggaaggggagcaaactgga

SEQ ID NO: 253597 - DNA, 25 bp, Mus musculus
cctggtggagagaggcaaactgctc

SEQ ID NO: 253598 - DNA, 25 bp, Mus musculus
cctggtggaggcggacctatgtggg

SEQ ID NO: 253599 - DNA, 25 bp, Mus musculus
cctggtggatcagctggaaaacagg

SEQ ID NO: 253600 - DNA, 25 bp, Mus musculus
cctggtggatgactatgggctcaga

SEQ ID NO: 253601 - DNA, 25 bp, Mus musculus
cctggtggcaggatcaagttctctg

SEQ ID NO: 253602 - DNA, 25 bp, Mus musculus
cctggtggccaattggagcatctct

SEQ ID NO: 253603 - DNA, 25 bp, Mus musculus
cctggtggccacaggctcccataat

SEQ ID NO: 253604 - DNA, 25 bp, Mus musculus
cctggtggccacaggttggttttat

SEQ ID NO: 253605 - DNA, 25 bp, Mus musculus
cctggtggccagcaaccttcctgct

SEQ ID NO: 253606 - DNA, 25 bp, Mus musculus
cctggtggcgacagatgtgaaggca

SEQ ID NO: 253607 - DNA, 25 bp, Mus musculus
cctggtggcgggagcctttttctgg

SEQ ID NO: 253608 - DNA, 25 bp, Mus musculus
cctggtggcggggaaggcagatgag

SEQ ID NO: 253609 - DNA, 25 bp, Mus musculus
cctggtggctcaagttttcctgact

SEQ ID NO: 253610 - DNA, 25 bp, Mus musculus
cctggtggctcagtttctacagtta

SEQ ID NO: 253611 - DNA, 25 bp, Mus musculus
cctggtgggcaccccaggtgaaagc

SEQ ID NO: 253612 - DNA, 25 bp, Mus musculus
cctggtggtgaccgcagggaggcct

SEQ ID NO: 253613 - DNA, 25 bp, Mus musculus
cctggtggtgcacaatcctggagga

SEQ ID NO: 253614 - DNA, 25 bp, Mus musculus
cctggtggtgcgtcttctgggacct

SEQ ID NO: 253615 - DNA, 25 bp, Mus musculus
cctggtgtaaagggagatcgaggcc

SEQ ID NO: 253616 - DNA, 25 bp, Mus musculus
cctggtgtaaaggtagatcgaggcc

SEQ ID NO: 253617 - DNA, 25 bp, Mus musculus
cctggtgtacagggatcagaacaag

SEQ ID NO: 253618 - DNA, 25 bp, Mus musculus
cctggtgtcaaaggagaccaaggtg

SEQ ID NO: 253619 - DNA, 25 bp, Mus musculus
cctggtgtcccgggatgccaagcct

SEQ ID NO: 253620 - DNA, 25 bp, Mus musculus
cctggtgtcgctcgagttcctgagg

SEQ ID NO: 253621 - DNA, 25 bp, Mus musculus
cctggtgtcgctcgggtatcaagtc

SEQ ID NO: 253622 - DNA, 25 bp, Mus musculus
cctggtgtctctggtcccatgggtc

SEQ ID NO: 253623 - DNA, 25 bp, Mus musculus
cctggtgtgggctaaattggttcca

SEQ ID NO: 253624 - DNA, 25 bp, Mus musculus
cctggtgttggagcccctgggaaca

SEQ ID NO: 253625 - DNA, 25 bp, Mus musculus
cctggtgttggagctctgtgataca

SEQ ID NO: 253626 - DNA, 25 bp, Mus musculus
cctggtgttggaggaagtaaagctc

SEQ ID NO: 253627 - DNA, 25 bp, Mus musculus
cctggttaacctgattcctggtttg

SEQ ID NO: 253628 - DNA, 25 bp, Mus musculus
cctggttaacctggatggggaggtg

SEQ ID NO: 253629 - DNA, 25 bp, Mus musculus
cctggttaacctgggagtttctgca

SEQ ID NO: 253630 - DNA, 25 bp, Mus musculus
cctggttacggtcatttggtgtcta

SEQ ID NO: 253631 - DNA, 25 bp, Mus musculus
cctggttcccaaggacttgtactgg

SEQ ID NO: 253632 - DNA, 25 bp, Mus musculus
cctggttcctgtctgcagctgtgtt

SEQ ID NO: 253633 - DNA, 25 bp, Mus musculus
cctggttcgcctgggtggcggctga

SEQ ID NO: 253634 - DNA, 25 bp, Mus musculus
cctggttcggggccgtcgtgaccct

SEQ ID NO: 253635 - DNA, 25 bp, Mus musculus
cctggttctggaaatcctgagaata

SEQ ID NO: 253636 - DNA, 25 bp, Mus musculus
cctggttctggaaatggctgaccaa

SEQ ID NO: 253637 - DNA, 25 bp, Mus musculus
cctggttcttcaagatctggagacc

SEQ ID NO: 253638 - DNA, 25 bp, Mus musculus
cctggttcttcaaggccacgaaaga

SEQ ID NO: 253639 - DNA, 25 bp, Mus musculus
cctggttgccaaggctacataaact

SEQ ID NO: 253640 - DNA, 25 bp, Mus musculus
cctggttgccaaggtccaaggacct

SEQ ID NO: 253641 - DNA, 25 bp, Mus musculus
cctggttgctgtggccctctgattg

SEQ ID NO: 253642 - DNA, 25 bp, Mus musculus
cctggttgcttctggggtcacagga

SEQ ID NO: 253643 - DNA, 25 bp, Mus musculus
cctggtttagattctcaaaccatga

SEQ ID NO: 253644 - DNA, 25 bp, Mus musculus
cctggtttaggagatcccagccatc

SEQ ID NO: 253645 - DNA, 25 bp, Mus musculus
cctggtttcacaggtcaactttgtg

SEQ ID NO: 253646 - DNA, 25 bp, Mus musculus
cctggtttcaggccttcccctgaag

SEQ ID NO: 253647 - DNA, 25 bp, Mus musculus
cctggtttcagggcagcccctggaa

SEQ ID NO: 253648 - DNA, 25 bp, Mus musculus
cctggtttccactgagtccttagcc

SEQ ID NO: 253649 - DNA, 25 bp, Mus musculus
cctggtttccactgcacctcctggc

SEQ ID NO: 253650 - DNA, 25 bp, Mus musculus
cctggtttccctggatcaggacatg

SEQ ID NO: 253651 - DNA, 25 bp, Mus musculus
cctggtttgaagatcccaatacttc

SEQ ID NO: 253652 - DNA, 25 bp, Mus musculus
cctggtttgaaggtttggagtcgag

SEQ ID NO: 253653 - DNA, 25 bp, Mus musculus
cctggtttgggtccgtgttcacctt

SEQ ID NO: 253654 - DNA, 25 bp, Mus musculus
cctgtaaaagatttctaacgagcgt

SEQ ID NO: 253655 - DNA, 25 bp, Mus musculus
cctgtaaagatcatgagacagaact

SEQ ID NO: 253656 - DNA, 25 bp, Mus musculus
cctgtaaatggcttgctgaaagggc

SEQ ID NO: 253657 - DNA, 25 bp, Mus musculus
cctgtaacaagcttaaatccagtga

SEQ ID NO: 253658 - DNA, 25 bp, Mus musculus
cctgtaacagccaaacaccatgtca

SEQ ID NO: 253659 - DNA, 25 bp, Mus musculus
cctgtaacaggaatgggctgcttct

SEQ ID NO: 253660 - DNA, 25 bp, Mus musculus
cctgtaagagcttgtgccattcctg

SEQ ID NO: 253661 - DNA, 25 bp, Mus musculus
cctgtaagagcttgtgttattggat

SEQ ID NO: 253662 - DNA, 25 bp, Mus musculus
cctgtaaggacttaaatattttatg

SEQ ID NO: 253663 - DNA, 25 bp, Mus musculus
cctgtaaggagacgttcatttgaat

SEQ ID NO: 253664 - DNA, 25 bp, Mus musculus
cctgtacaaaggggcagccacagaa

SEQ ID NO: 253665 - DNA, 25 bp, Mus musculus
cctgtacagagacaggttgctttta

SEQ ID NO: 253666 - DNA, 25 bp, Mus musculus
cctgtaccattgcctatggcctggg

SEQ ID NO: 253667 - DNA, 25 bp, Mus musculus
cctgtacccagatgaagttgcctgt

SEQ ID NO: 253668 - DNA, 25 bp, Mus musculus
cctgtacccttgtggaccagcagag

SEQ ID NO: 253669 - DNA, 25 bp, Mus musculus
cctgtacctcccacccttggactct

SEQ ID NO: 253670 - DNA, 25 bp, Mus musculus
cctgtaccttcattacgtgcgaccc

SEQ ID NO: 253671 - DNA, 25 bp, Mus musculus
cctgtaccttcattgaactccaaga

SEQ ID NO: 253672 - DNA, 25 bp, Mus musculus
cctgtacgacgatgacgtggcgcag

SEQ ID NO: 253673 - DNA, 25 bp, Mus musculus
cctgtactgccaaggtcaaggctgg

SEQ ID NO: 253674 - DNA, 25 bp, Mus musculus
cctgtactgcgtggtgacatctccc

SEQ ID NO: 253675 - DNA, 25 bp, Mus musculus
cctgtactgtaagaggcttctcagg

SEQ ID NO: 253676 - DNA, 25 bp, Mus musculus
cctgtacttgcgaaagcagttgacg

SEQ ID NO: 253677 - DNA, 25 bp, Mus musculus
cctgtacttggagaggctccggctc

SEQ ID NO: 253678 - DNA, 25 bp, Mus musculus
cctgtacttggttcgtcaatgcatc

SEQ ID NO: 253679 - DNA, 25 bp, Mus musculus
cctgtagaagttgtcctagaatcga

SEQ ID NO: 253680 - DNA, 25 bp, Mus musculus
cctgtagagaacctccatgtactca

SEQ ID NO: 253681 - DNA, 25 bp, Mus musculus
cctgtagcaccactctcgctcacag

SEQ ID NO: 253682 - DNA, 25 bp, Mus musculus
cctgtagcacccctctactcaatag

SEQ ID NO: 253683 - DNA, 25 bp, Mus musculus
cctgtagccaagaccacatccttca

SEQ ID NO: 253684 - DNA, 25 bp, Mus musculus
cctgtagccaaggtcagattacctg

SEQ ID NO: 253685 - DNA, 25 bp, Mus musculus
cctgtagcgatgaagaaagaggaac

SEQ ID NO: 253686 - DNA, 25 bp, Mus musculus
cctgtagtctggggggtcagcagcc

SEQ ID NO: 253687 - DNA, 25 bp, Mus musculus
cctgtagttctgtgcatctgggtgg

SEQ ID NO: 253688 - DNA, 25 bp, Mus musculus
cctgtataagagccctgaagacaag

SEQ ID NO: 253689 - DNA, 25 bp, Mus musculus
cctgtataaggtaggtgcacgcctc

SEQ ID NO: 253690 - DNA, 25 bp, Mus musculus
cctgtatacaggccgcttggacatc

SEQ ID NO: 253691 - DNA, 25 bp, Mus musculus
cctgtatagaagtgggaagatgccc

SEQ ID NO: 253692 - DNA, 25 bp, Mus musculus
cctgtatattcagggtcacagcttc

SEQ ID NO: 253693 - DNA, 25 bp, Mus musculus
cctgtatcagacacctctgcacttg

SEQ ID NO: 253694 - DNA, 25 bp, Mus musculus
cctgtatcagggtgcgcaggcttgt

SEQ ID NO: 253695 - DNA, 25 bp, Mus musculus
cctgtatgagaagctgaagcagtcg

SEQ ID NO: 253696 - DNA, 25 bp, Mus musculus
cctgtatgcactcctcccagcagtt

SEQ ID NO: 253697 - DNA, 25 bp, Mus musculus
cctgtatgcactcctggatatccgg

SEQ ID NO: 253698 - DNA, 25 bp, Mus musculus
cctgtatgtgttgaggaggagagaa

SEQ ID NO: 253699 - DNA, 25 bp, Mus musculus
cctgtattcacgtagggtgatatgg

SEQ ID NO: 253700 - DNA, 25 bp, Mus musculus
cctgtatttaagaatgcaccaaaca

SEQ ID NO: 253701 - DNA, 25 bp, Mus musculus
cctgtatttaaggcccatctccgag

SEQ ID NO: 253702 - DNA, 25 bp, Mus musculus
cctgtatttaaggttcttggacttg

SEQ ID NO: 253703 - DNA, 25 bp, Mus musculus
cctgtcaaaccagggttctctaaat

SEQ ID NO: 253704 - DNA, 25 bp, Mus musculus
cctgtcaaaccaggttaaggagctc

SEQ ID NO: 253705 - DNA, 25 bp, Mus musculus
cctgtcaactgacaggccataaaat

SEQ ID NO: 253706 - DNA, 25 bp, Mus musculus
cctgtcaagattgagattcccctct

SEQ ID NO: 253707 - DNA, 25 bp, Mus musculus
cctgtcaatgcagcccagatggagc

SEQ ID NO: 253708 - DNA, 25 bp, Mus musculus
cctgtcaatgcagcttgttttagcc

SEQ ID NO: 253709 - DNA, 25 bp, Mus musculus
cctgtcaatgcaggcgacctggcat

SEQ ID NO: 253710 - DNA, 25 bp, Mus musculus
cctgtcaatggactatctcatcgga

SEQ ID NO: 253711 - DNA, 25 bp, Mus musculus
cctgtcaatggtacggatgaaatcc

SEQ ID NO: 253712 - DNA, 25 bp, Mus musculus
cctgtcacagattgaaatggatgca

SEQ ID NO: 253713 - DNA, 25 bp, Mus musculus
cctgtcacccagactaagaaacttc

SEQ ID NO: 253714 - DNA, 25 bp, Mus musculus
cctgtcacccctgtatatcaacctg

SEQ ID NO: 253715 - DNA, 25 bp, Mus musculus
cctgtcacctacatggataagaatg

SEQ ID NO: 253716 - DNA, 25 bp, Mus musculus
cctgtcacctcggaggtcccaccca

SEQ ID NO: 253717 - DNA, 25 bp, Mus musculus
cctgtcactgcagcgacggctccgg

SEQ ID NO: 253718 - DNA, 25 bp, Mus musculus
cctgtcactgcagcgctgctgtggc

SEQ ID NO: 253719 - DNA, 25 bp, Mus musculus
cctgtcagaatgatcatgcgtccag

SEQ ID NO: 253720 - DNA, 25 bp, Mus musculus
cctgtcagaggaggatacgggaagc

SEQ ID NO: 253721 - DNA, 25 bp, Mus musculus
cctgtcagcaaagttatttcgcttg

SEQ ID NO: 253722 - DNA, 25 bp, Mus musculus
cctgtcagccggggcctcccccagc

SEQ ID NO: 253723 - DNA, 25 bp, Mus musculus
cctgtcagccggtaacctccgtgct

SEQ ID NO: 253724 - DNA, 25 bp, Mus musculus
cctgtcaggagaacagccagtccta

SEQ ID NO: 253725 - DNA, 25 bp, Mus musculus
cctgtcaggagaagagtctgttcaa

SEQ ID NO: 253726 - DNA, 25 bp, Mus musculus
cctgtcaggagaagtggctggtgag

SEQ ID NO: 253727 - DNA, 25 bp, Mus musculus
cctgtcaggagatcttcctgtggct

SEQ ID NO: 253728 - DNA, 25 bp, Mus musculus
cctgtcaggtgctgatttcaacgtt

SEQ ID NO: 253729 - DNA, 25 bp, Mus musculus
cctgtcagtcccaggtcctgcccac

SEQ ID NO: 253730 - DNA, 25 bp, Mus musculus
cctgtcatcagatgacctcatccca

SEQ ID NO: 253731 - DNA, 25 bp, Mus musculus
cctgtcatcagattgatcttttcaa

SEQ ID NO: 253732 - DNA, 25 bp, Mus musculus
cctgtcatccagaatgccttattgt

SEQ ID NO: 253733 - DNA, 25 bp, Mus musculus
cctgtcatccagggcttcctactat

SEQ ID NO: 253734 - DNA, 25 bp, Mus musculus
cctgtcatccggaagctggcaaaaa

SEQ ID NO: 253735 - DNA, 25 bp, Mus musculus
cctgtcatcctcgaagccaagctgg

SEQ ID NO: 253736 - DNA, 25 bp, Mus musculus
cctgtcatcctcgtgcctggctgct

SEQ ID NO: 253737 - DNA, 25 bp, Mus musculus
cctgtcatcctggacatggcccgtg

SEQ ID NO: 253738 - DNA, 25 bp, Mus musculus
cctgtcatgaggaactcagaaatcc

SEQ ID NO: 253739 - DNA, 25 bp, Mus musculus
cctgtcatgaggaactcagccacct

SEQ ID NO: 253740 - DNA, 25 bp, Mus musculus
cctgtccaaagatctcaccacatct

SEQ ID NO: 253741 - DNA, 25 bp, Mus musculus
cctgtccaaaggaccatgaccttgg

SEQ ID NO: 253742 - DNA, 25 bp, Mus musculus
cctgtccaaaggaggagaccttggt

SEQ ID NO: 253743 - DNA, 25 bp, Mus musculus
cctgtccaaaggcctcaatctaaac

SEQ ID NO: 253744 - DNA, 25 bp, Mus musculus
cctgtccacacaggtttatgaagct

SEQ ID NO: 253745 - DNA, 25 bp, Mus musculus
cctgtccacgcggttctatggtaca

SEQ ID NO: 253746 - DNA, 25 bp, Mus musculus
cctgtccacgcgtgcagtctgcatc

SEQ ID NO: 253747 - DNA, 25 bp, Mus musculus
cctgtccatcaaagccctgtgccca

SEQ ID NO: 253748 - DNA, 25 bp, Mus musculus
cctgtccatcaaagggtcgtcttct

SEQ ID NO: 253749 - DNA, 25 bp, Mus musculus
cctgtcccacaggcggaatgtgccc

SEQ ID NO: 253750 - DNA, 25 bp, Mus musculus
cctgtcccgaggacaagaagatgcc

SEQ ID NO: 253751 - DNA, 25 bp, Mus musculus
cctgtccgaggatggatgccctgag

SEQ ID NO: 253752 - DNA, 25 bp, Mus musculus
cctgtccgggcagccaaggagatcc

SEQ ID NO: 253753 - DNA, 25 bp, Mus musculus
cctgtccgtcaagtttggaaatgat

SEQ ID NO: 253754 - DNA, 25 bp, Mus musculus
cctgtcctaagaaaccatcaagaag

SEQ ID NO: 253755 - DNA, 25 bp, Mus musculus
cctgtcctaagaaacgcaggctcca

SEQ ID NO: 253756 - DNA, 25 bp, Mus musculus
cctgtcctacaatgatgatgtgctg

SEQ ID NO: 253757 - DNA, 25 bp, Mus musculus
cctgtcctaggtagcagaggcagca

SEQ ID NO: 253758 - DNA, 25 bp, Mus musculus
cctgtcctcagaggtgtgctcctgc

SEQ ID NO: 253759 - DNA, 25 bp, Mus musculus
cctgtcctcagggaccgcagcagcc

SEQ ID NO: 253760 - DNA, 25 bp, Mus musculus
cctgtcctcagggccttcagggacc

SEQ ID NO: 253761 - DNA, 25 bp, Mus musculus
cctgtcctcctgctgatgctttcat

SEQ ID NO: 253762 - DNA, 25 bp, Mus musculus
cctgtcctctcaaggctcaaactca

SEQ ID NO: 253763 - DNA, 25 bp, Mus musculus
cctgtcctgaggttgctacaggcac

SEQ ID NO: 253764 - DNA, 25 bp, Mus musculus
cctgtccttcctgccccttccatca

SEQ ID NO: 253765 - DNA, 25 bp, Mus musculus
cctgtccttcgggtactatgggttg

SEQ ID NO: 253766 - DNA, 25 bp, Mus musculus
cctgtcgcaggctgttgattcagaa

SEQ ID NO: 253767 - DNA, 25 bp, Mus musculus
cctgtcgcagggagcttatgggggc

SEQ ID NO: 253768 - DNA, 25 bp, Mus musculus
cctgtcgccattggatcatctgtcc

SEQ ID NO: 253769 - DNA, 25 bp, Mus musculus
cctgtcgcccatattttaatatccc

SEQ ID NO: 253770 - DNA, 25 bp, Mus musculus
cctgtcgcccctgagtgcaatatcc

SEQ ID NO: 253771 - DNA, 25 bp, Mus musculus
cctgtcgcctgtagttgcagcccca

SEQ ID NO: 253772 - DNA, 25 bp, Mus musculus
cctgtcgcctgtctgccacaacttc

SEQ ID NO: 253773 - DNA, 25 bp, Mus musculus
cctgtcgctgtggctacgtgttctg

SEQ ID NO: 253774 - DNA, 25 bp, Mus musculus
cctgtcggataaccagtggcatcct

SEQ ID NO: 253775 - DNA, 25 bp, Mus musculus
cctgtcggcatggcagcccacccaa

SEQ ID NO: 253776 - DNA, 25 bp, Mus musculus
cctgtcggtgagatgggtgcaagga

SEQ ID NO: 253777 - DNA, 25 bp, Mus musculus
cctgtcgtacacaaatgaagagaga

SEQ ID NO: 253778 - DNA, 25 bp, Mus musculus
cctgtcgtatagagtctgaaggaag

SEQ ID NO: 253779 - DNA, 25 bp, Mus musculus
cctgtctacaaccgctcccaccaac

SEQ ID NO: 253780 - DNA, 25 bp, Mus musculus
cctgtctacaaccggtggcaggatc

SEQ ID NO: 253781 - DNA, 25 bp, Mus musculus
cctgtctagaatacgcgtctgatgg

SEQ ID NO: 253782 - DNA, 25 bp, Mus musculus
cctgtctcaacaaaagggctctact

SEQ ID NO: 253783 - DNA, 25 bp, Mus musculus
cctgtctcagagagcctgggcacag

SEQ ID NO: 253784 - DNA, 25 bp, Mus musculus
cctgtctcagatgtcttcagtacct

SEQ ID NO: 253785 - DNA, 25 bp, Mus musculus
cctgtctcggtgctcttcaaatgtc

SEQ ID NO: 253786 - DNA, 25 bp, Mus musculus
cctgtctcggtgtccttcccgtcga

SEQ ID NO: 253787 - DNA, 25 bp, Mus musculus
cctgtctctccggatggacctgatc

SEQ ID NO: 253788 - DNA, 25 bp, Mus musculus
cctgtctctccggcccccgcgcgcc

SEQ ID NO: 253789 - DNA, 25 bp, Mus musculus
cctgtctgaaaagggccggcaggag

SEQ ID NO: 253790 - DNA, 25 bp, Mus musculus
cctgtctgaaggatctcacataacc

SEQ ID NO: 253791 - DNA, 25 bp, Mus musculus
cctgtctgaaggcacttctggatcc

SEQ ID NO: 253792 - DNA, 25 bp, Mus musculus
cctgtctgaccaggaaaagaaagat

SEQ ID NO: 253793 - DNA, 25 bp, Mus musculus
cctgtctgagccgctacagaacctg

SEQ ID NO: 253794 - DNA, 25 bp, Mus musculus
cctgtctgagcgggaggaagcactg

SEQ ID NO: 253795 - DNA, 25 bp, Mus musculus
cctgtctgagctctttcctgtaata

SEQ ID NO: 253796 - DNA, 25 bp, Mus musculus
cctgtctgaggccctggccagatgt

SEQ ID NO: 253797 - DNA, 25 bp, Mus musculus
cctgtctgagtggacgagcgaaggg

SEQ ID NO: 253798 - DNA, 25 bp, Mus musculus
cctgtctgcaagagaccgggctcat

SEQ ID NO: 253799 - DNA, 25 bp, Mus musculus
cctgtctgcactggtgaccatgtac

SEQ ID NO: 253800 - DNA, 25 bp, Mus musculus
cctgtctgcaggaagggtccccctg

SEQ ID NO: 253801 - DNA, 25 bp, Mus musculus
cctgtctgccccatgtccatcatca

SEQ ID NO: 253802 - DNA, 25 bp, Mus musculus
cctgtctgctcctggccttcccaga

SEQ ID NO: 253803 - DNA, 25 bp, Mus musculus
cctgtctgcttggagccctgcacta

SEQ ID NO: 253804 - DNA, 25 bp, Mus musculus
cctgtctgtattgagaaacctgaaa

SEQ ID NO: 253805 - DNA, 25 bp, Mus musculus
cctgtctgtgactggattggccgca

SEQ ID NO: 253806 - DNA, 25 bp, Mus musculus
cctgtctgtggccaggagggccgta

SEQ ID NO: 253807 - DNA, 25 bp, Mus musculus
cctgtctgttgcggtggcactgctt

SEQ ID NO: 253808 - DNA, 25 bp, Mus musculus
cctgtcttaagaccttcacagcctg

SEQ ID NO: 253809 - DNA, 25 bp, Mus musculus
cctgtcttcaaggtgccgccatgct

SEQ ID NO: 253810 - DNA, 25 bp, Mus musculus
cctgtcttgtaaccctgagataaca

SEQ ID NO: 253811 - DNA, 25 bp, Mus musculus
cctgtctttattagatgatgcagtc

SEQ ID NO: 253812 - DNA, 25 bp, Mus musculus
cctgtctttggagagctcaaagaga

SEQ ID NO: 253813 - DNA, 25 bp, Mus musculus
cctgtctttggagatctctgacatc

SEQ ID NO: 253814 - DNA, 25 bp, Mus musculus
cctgtctttgggcagctcaaagaga

SEQ ID NO: 253815 - DNA, 25 bp, Mus musculus
cctgtcttttttgaaattggcaccg

SEQ ID NO: 253816 - DNA, 25 bp, Mus musculus
cctgtcttttttgctgagaaagtga

SEQ ID NO: 253817 - DNA, 25 bp, Mus musculus
cctgtgaaaagagtggacaagatta

SEQ ID NO: 253818 - DNA, 25 bp, Mus musculus
cctgtgaacacaagggtcatccaaa

SEQ ID NO: 253819 - DNA, 25 bp, Mus musculus
cctgtgaacactgagcctacacagg

SEQ ID NO: 253820 - DNA, 25 bp, Mus musculus
cctgtgaacactgcgaaattgccca

SEQ ID NO: 253821 - DNA, 25 bp, Mus musculus
cctgtgaacaggttgatcgtgtcct

SEQ ID NO: 253822 - DNA, 25 bp, Mus musculus
cctgtgaacctgaaaaatcatgtgg

SEQ ID NO: 253823 - DNA, 25 bp, Mus musculus
cctgtgaacctgacgtggccattcg

SEQ ID NO: 253824 - DNA, 25 bp, Mus musculus
cctgtgaagaaccagggccagtgcg

SEQ ID NO: 253825 - DNA, 25 bp, Mus musculus
cctgtgaagacagggccagtgcggg

SEQ ID NO: 253826 - DNA, 25 bp, Mus musculus
cctgtgaagcgagcgcagcaatcta

SEQ ID NO: 253827 - DNA, 25 bp, Mus musculus
cctgtgaagcgcctcagtgggctcg

SEQ ID NO: 253828 - DNA, 25 bp, Mus musculus
cctgtgaagggtcagatttctcagc

SEQ ID NO: 253829 - DNA, 25 bp, Mus musculus
cctgtgaagtccaagctggaggcat

SEQ ID NO: 253830 - DNA, 25 bp, Mus musculus
cctgtgaattttgaggtggcccggg

SEQ ID NO: 253831 - DNA, 25 bp, Mus musculus
cctgtgaattttgagtctttccttc

SEQ ID NO: 253832 - DNA, 25 bp, Mus musculus
cctgtgacacctgttgagggcgagg

SEQ ID NO: 253833 - DNA, 25 bp, Mus musculus
cctgtgacattgagctgggctttga

SEQ ID NO: 253834 - DNA, 25 bp, Mus musculus
cctgtgacattgtgctgggctttga

SEQ ID NO: 253835 - DNA, 25 bp, Mus musculus
cctgtgacgcgggtctgcaccggtg

SEQ ID NO: 253836 - DNA, 25 bp, Mus musculus
cctgtgactcaggattctctacctg

SEQ ID NO: 253837 - DNA, 25 bp, Mus musculus
cctgtgagaacgacctcagtgggca

SEQ ID NO: 253838 - DNA, 25 bp, Mus musculus
cctgtgagaacgtcctcagtgggca

SEQ ID NO: 253839 - DNA, 25 bp, Mus musculus
cctgtgagcaaaaacctgtgctggc

SEQ ID NO: 253840 - DNA, 25 bp, Mus musculus
cctgtgagcaaagaggcaagagaca

SEQ ID NO: 253841 - DNA, 25 bp, Mus musculus
cctgtgagcaagaggaagcttttct

SEQ ID NO: 253842 - DNA, 25 bp, Mus musculus
cctgtgagcaggagccagaggaaga

SEQ ID NO: 253843 - DNA, 25 bp, Mus musculus
cctgtgagcgactgcatcgtcaacg

SEQ ID NO: 253844 - DNA, 25 bp, Mus musculus
cctgtgagctgcaaaaggaagttcg

SEQ ID NO: 253845 - DNA, 25 bp, Mus musculus
cctgtgagttagagttccagttact

SEQ ID NO: 253846 - DNA, 25 bp, Mus musculus
cctgtgataaagaccagaatatggt

SEQ ID NO: 253847 - DNA, 25 bp, Mus musculus
cctgtgataaaggtgtccccaagga

SEQ ID NO: 253848 - DNA, 25 bp, Mus musculus
cctgtgatccgcccagtgggggcag

SEQ ID NO: 253849 - DNA, 25 bp, Mus musculus
cctgtgatcctccgcaatgcacggc

SEQ ID NO: 253850 - DNA, 25 bp, Mus musculus
cctgtgatgataagaacaaattgga

SEQ ID NO: 253851 - DNA, 25 bp, Mus musculus
cctgtgatgcactgaccctgcagtt

SEQ ID NO: 253852 - DNA, 25 bp, Mus musculus
cctgtgatggtaaaaatactggctc

SEQ ID NO: 253853 - DNA, 25 bp, Mus musculus
cctgtgcaatgaccggggtcgctgt

SEQ ID NO: 253854 - DNA, 25 bp, Mus musculus
cctgtgcaccaggtacaagcagtca

SEQ ID NO: 253855 - DNA, 25 bp, Mus musculus
cctgtgcagaagattgataagtatc

SEQ ID NO: 253856 - DNA, 25 bp, Mus musculus
cctgtgcagcccagagaagagttta

SEQ ID NO: 253857 - DNA, 25 bp, Mus musculus
cctgtgcagtatcgtaccgagaagc

SEQ ID NO: 253858 - DNA, 25 bp, Mus musculus
cctgtgcagtggcactccaaagtcc

SEQ ID NO: 253859 - DNA, 25 bp, Mus musculus
cctgtgcatgccatgacccccgagg

SEQ ID NO: 253860 - DNA, 25 bp, Mus musculus
cctgtgccaaggtcgagtatgccta

SEQ ID NO: 253861 - DNA, 25 bp, Mus musculus
cctgtgccactaccccacagcggca

SEQ ID NO: 253862 - DNA, 25 bp, Mus musculus
cctgtgccagagaggaccccggagc

SEQ ID NO: 253863 - DNA, 25 bp, Mus musculus
cctgtgccaggaaagcactgccacc

SEQ ID NO: 253864 - DNA, 25 bp, Mus musculus
cctgtgccaggcaaggtgacccatg

SEQ ID NO: 253865 - DNA, 25 bp, Mus musculus
cctgtgccagggtgtgagggtaagg

SEQ ID NO: 253866 - DNA, 25 bp, Mus musculus
cctgtgccagtgttctttccagggt

SEQ ID NO: 253867 - DNA, 25 bp, Mus musculus
cctgtgcccacaagcctcccctcgc

SEQ ID NO: 253868 - DNA, 25 bp, Mus musculus
cctgtgcccacaaggttcttgttca

SEQ ID NO: 253869 - DNA, 25 bp, Mus musculus
cctgtgccctcggaaccaccatctg

SEQ ID NO: 253870 - DNA, 25 bp, Mus musculus
cctgtgcctcagggtgacagaactg

SEQ ID NO: 253871 - DNA, 25 bp, Mus musculus
cctgtgcctcagggttgcagtaatg

SEQ ID NO: 253872 - DNA, 25 bp, Mus musculus
cctgtgcctcaggttgccctctgtc

SEQ ID NO: 253873 - DNA, 25 bp, Mus musculus
cctgtgcctcctagatgccctttga

SEQ ID NO: 253874 - DNA, 25 bp, Mus musculus
cctgtgcctggaggaccagctctct

SEQ ID NO: 253875 - DNA, 25 bp, Mus musculus
cctgtgccttggacggctgttctca

SEQ ID NO: 253876 - DNA, 25 bp, Mus musculus
cctgtgcgctgctcccgccagtgaa

SEQ ID NO: 253877 - DNA, 25 bp, Mus musculus
cctgtgctacaaaaaactgagacgt

SEQ ID NO: 253878 - DNA, 25 bp, Mus musculus
cctgtgctacaagtccacacacgtt

SEQ ID NO: 253879 - DNA, 25 bp, Mus musculus
cctgtgctagacagtgtgctcaatg

SEQ ID NO: 253880 - DNA, 25 bp, Mus musculus
cctgtgctagtttcgcatttggctc

SEQ ID NO: 253881 - DNA, 25 bp, Mus musculus
cctgtgctcaagttactgggcctgg

SEQ ID NO: 253882 - DNA, 25 bp, Mus musculus
cctgtgctcaggggagaaaggcctt

SEQ ID NO: 253883 - DNA, 25 bp, Mus musculus
cctgtgctcaggtaatggaaaaggt

SEQ ID NO: 253884 - DNA, 25 bp, Mus musculus
cctgtgctcaggtcgcaggcatcct

SEQ ID NO: 253885 - DNA, 25 bp, Mus musculus
cctgtgctcctgcgggcggcatcgc

SEQ ID NO: 253886 - DNA, 25 bp, Mus musculus
cctgtgctggtggatattcattagc

SEQ ID NO: 253887 - DNA, 25 bp, Mus musculus
cctgtgcttagagctcctcctccca

SEQ ID NO: 253888 - DNA, 25 bp, Mus musculus
cctgtgcttcagagtctgaaagggt

SEQ ID NO: 253889 - DNA, 25 bp, Mus musculus
cctgtgcttgccaggggctgacaag

SEQ ID NO: 253890 - DNA, 25 bp, Mus musculus
cctgtggaaagcaagatatattttg

SEQ ID NO: 253891 - DNA, 25 bp, Mus musculus
cctgtggaacagccgtgtaggtttc

SEQ ID NO: 253892 - DNA, 25 bp, Mus musculus
cctgtggaagtcggtgatggcatgc

SEQ ID NO: 253893 - DNA, 25 bp, Mus musculus
cctgtggaccgtgggagaactacta

SEQ ID NO: 253894 - DNA, 25 bp, Mus musculus
cctgtggacttagggctgaccagtt

SEQ ID NO: 253895 - DNA, 25 bp, Mus musculus
cctgtggacttaggtgacaagttcc

SEQ ID NO: 253896 - DNA, 25 bp, Mus musculus
cctgtggagaggagatacttcaagc

SEQ ID NO: 253897 - DNA, 25 bp, Mus musculus
cctgtggaggagtctctatggaaga

SEQ ID NO: 253898 - DNA, 25 bp, Mus musculus
cctgtggagtgtggattttatggat

SEQ ID NO: 253899 - DNA, 25 bp, Mus musculus
cctgtggatcaagtgtttgcaaaaa

SEQ ID NO: 253900 - DNA, 25 bp, Mus musculus
cctgtggattttcggcctggccgag

SEQ ID NO: 253901 - DNA, 25 bp, Mus musculus
cctgtggcaaaagactgctggagtt

SEQ ID NO: 253902 - DNA, 25 bp, Mus musculus
cctgtggcaaaagccctggaagaga

SEQ ID NO: 253903 - DNA, 25 bp, Mus musculus
cctgtggcaagggagtcatccaggg

SEQ ID NO: 253904 - DNA, 25 bp, Mus musculus
cctgtggcagcaatggaagccccta

SEQ ID NO: 253905 - DNA, 25 bp, Mus musculus
cctgtggcaggtgaccttggacaag

SEQ ID NO: 253906 - DNA, 25 bp, Mus musculus
cctgtggcagtggaggtgaagccgg

SEQ ID NO: 253907 - DNA, 25 bp, Mus musculus
cctgtggcataaggtgatgttccct

SEQ ID NO: 253908 - DNA, 25 bp, Mus musculus
cctgtggcatgccaggtactgctgg

SEQ ID NO: 253909 - DNA, 25 bp, Mus musculus
cctgtggcatgccagtgaagagaga

SEQ ID NO: 253910 - DNA, 25 bp, Mus musculus
cctgtggctaagactctagccttgt

SEQ ID NO: 253911 - DNA, 25 bp, Mus musculus
cctgtggctaagctaccgatttatt

SEQ ID NO: 253912 - DNA, 25 bp, Mus musculus
cctgtggctaagtaagaaatccagt

SEQ ID NO: 253913 - DNA, 25 bp, Mus musculus
cctgtggctaagtgactaataaaca

SEQ ID NO: 253914 - DNA, 25 bp, Mus musculus
cctgtggctaatcctgtctgtagac

SEQ ID NO: 253915 - DNA, 25 bp, Mus musculus
cctgtggctaatttcagagtgataa

SEQ ID NO: 253916 - DNA, 25 bp, Mus musculus
cctgtggctgatcgcgtggctgagg

SEQ ID NO: 253917 - DNA, 25 bp, Mus musculus
cctgtggctgatctcttcattggga

SEQ ID NO: 253918 - DNA, 25 bp, Mus musculus
cctgtggctgatgtatgtgtaagtg

SEQ ID NO: 253919 - DNA, 25 bp, Mus musculus
cctgtggctggaggggagtggggcc

SEQ ID NO: 253920 - DNA, 25 bp, Mus musculus
cctgtgggaagcccccggcagcagc

SEQ ID NO: 253921 - DNA, 25 bp, Mus musculus
cctgtgggacccgaacaatttcgaa

SEQ ID NO: 253922 - DNA, 25 bp, Mus musculus
cctgtgggacctccgggcctagctg

SEQ ID NO: 253923 - DNA, 25 bp, Mus musculus
cctgtggggaaaaccagttgggtct

SEQ ID NO: 253924 - DNA, 25 bp, Mus musculus
cctgtggggaaagcatctgaactac

SEQ ID NO: 253925 - DNA, 25 bp, Mus musculus
cctgtgggggcctgcatggcctgat

SEQ ID NO: 253926 - DNA, 25 bp, Mus musculus
cctgtgggtcgggcacattgcctct

SEQ ID NO: 253927 - DNA, 25 bp, Mus musculus
cctgtgggtcggggaagagttgggc

SEQ ID NO: 253928 - DNA, 25 bp, Mus musculus
cctgtgggtttcaggatccagccgc

SEQ ID NO: 253929 - DNA, 25 bp, Mus musculus
cctgtggtagcagacccaacagttc

SEQ ID NO: 253930 - DNA, 25 bp, Mus musculus
cctgtggtcatgaaggcatttgagc

SEQ ID NO: 253931 - DNA, 25 bp, Mus musculus
cctgtggtgatcaggatctgcacct

SEQ ID NO: 253932 - DNA, 25 bp, Mus musculus
cctgtggtggccatggtctgggaag

SEQ ID NO: 253933 - DNA, 25 bp, Mus musculus
cctgtgtcacccaaggtccagtttg

SEQ ID NO: 253934 - DNA, 25 bp, Mus musculus
cctgtgtcagatcgaaccttgttca

SEQ ID NO: 253935 - DNA, 25 bp, Mus musculus
cctgtgtcaggagcatatgcaggaa

SEQ ID NO: 253936 - DNA, 25 bp, Mus musculus
cctgtgtccctcatacaactagacc

SEQ ID NO: 253937 - DNA, 25 bp, Mus musculus
cctgtgtccttgaggcccatctgaa

SEQ ID NO: 253938 - DNA, 25 bp, Mus musculus
cctgtgtctaaggaaacagcaagac

SEQ ID NO: 253939 - DNA, 25 bp, Mus musculus
cctgtgtctaagtgtctgtgcttgg

SEQ ID NO: 253940 - DNA, 25 bp, Mus musculus
cctgtgtctccaatcgtggatgatg

SEQ ID NO: 253941 - DNA, 25 bp, Mus musculus
cctgtgtctgccagaatggggaggt

SEQ ID NO: 253942 - DNA, 25 bp, Mus musculus
cctgtgtgaaggagcttctgcgttc

SEQ ID NO: 253943 - DNA, 25 bp, Mus musculus
cctgtgtgagagtgtggctatcttg

SEQ ID NO: 253944 - DNA, 25 bp, Mus musculus
cctgtgtgaggtccctccagctata

SEQ ID NO: 253945 - DNA, 25 bp, Mus musculus
cctgtgtgatctcagtaagttctat

SEQ ID NO: 253946 - DNA, 25 bp, Mus musculus
cctgtgtgcaaagctgtgccaccgc

SEQ ID NO: 253947 - DNA, 25 bp, Mus musculus
cctgtgtggacgagagagactcggg

SEQ ID NO: 253948 - DNA, 25 bp, Mus musculus
cctgtgtggagtgttcagcaaaaaa

SEQ ID NO: 253949 - DNA, 25 bp, Mus musculus
cctgtgtgtagccccatgtggaacc

SEQ ID NO: 253950 - DNA, 25 bp, Mus musculus
cctgtgtgtataaagtacaacctga

SEQ ID NO: 253951 - DNA, 25 bp, Mus musculus
cctgtgtgtctcagcctcagcttta

SEQ ID NO: 253952 - DNA, 25 bp, Mus musculus
cctgtgttacaagctaatggcactg

SEQ ID NO: 253953 - DNA, 25 bp, Mus musculus
cctgtgttacaagggactgagtggg

SEQ ID NO: 253954 - DNA, 25 bp, Mus musculus
cctgtgttcatcaaactttcatgga

SEQ ID NO: 253955 - DNA, 25 bp, Mus musculus
cctgtgttcggcaggttcgcagacc

SEQ ID NO: 253956 - DNA, 25 bp, Mus musculus
cctgtgttctgatatagatgagtgt

SEQ ID NO: 253957 - DNA, 25 bp, Mus musculus
cctgtgtttgctagagggcaatgcg

SEQ ID NO: 253958 - DNA, 25 bp, Mus musculus
cctgtgtttgtggtcctccactctt

SEQ ID NO: 253959 - DNA, 25 bp, Mus musculus
cctgtgtttgtggtctttgctgatt

SEQ ID NO: 253960 - DNA, 25 bp, Mus musculus
cctgttacacagcccagggaatatt

SEQ ID NO: 253961 - DNA, 25 bp, Mus musculus
cctgttacctcgccgagctggaatt

SEQ ID NO: 253962 - DNA, 25 bp, Mus musculus
cctgttacctgggcccccagattgc

SEQ ID NO: 253963 - DNA, 25 bp, Mus musculus
cctgttacgcttgtacttcatcctg

SEQ ID NO: 253964 - DNA, 25 bp, Mus musculus
cctgttagacattggatgccgcctt

SEQ ID NO: 253965 - DNA, 25 bp, Mus musculus
cctgttagacattggctgcggttct

SEQ ID NO: 253966 - DNA, 25 bp, Mus musculus
cctgttagctgaggtgccgacaatg

SEQ ID NO: 253967 - DNA, 25 bp, Mus musculus
cctgttatctccagaagtgacagac

SEQ ID NO: 253968 - DNA, 25 bp, Mus musculus
cctgttatgacaagcccgtctcgat

SEQ ID NO: 253969 - DNA, 25 bp, Mus musculus
cctgttattgaaggacctctcttgc

SEQ ID NO: 253970 - DNA, 25 bp, Mus musculus
cctgttcaaccctgactctaagggg

SEQ ID NO: 253971 - DNA, 25 bp, Mus musculus
cctgttcaagaaatcaacatgcaga

SEQ ID NO: 253972 - DNA, 25 bp, Mus musculus
cctgttcaaggttcgcccagagacc

SEQ ID NO: 253973 - DNA, 25 bp, Mus musculus
cctgttcactcagaggcagccatgg

SEQ ID NO: 253974 - DNA, 25 bp, Mus musculus
cctgttcagagggagagccgagagc

SEQ ID NO: 253975 - DNA, 25 bp, Mus musculus
cctgttcagaggtcctgatagctcc

SEQ ID NO: 253976 - DNA, 25 bp, Mus musculus
cctgttcagtagacagtataacaaa

SEQ ID NO: 253977 - DNA, 25 bp, Mus musculus
cctgttccaccatagccatcatagc

SEQ ID NO: 253978 - DNA, 25 bp, Mus musculus
cctgttccaggatggaggtaaaggt

SEQ ID NO: 253979 - DNA, 25 bp, Mus musculus
cctgttccgcccaagttggtcacaa

SEQ ID NO: 253980 - DNA, 25 bp, Mus musculus
cctgttcctaacactaatgagcgag

SEQ ID NO: 253981 - DNA, 25 bp, Mus musculus
cctgttcctctgaaaaggaaaagaa

SEQ ID NO: 253982 - DNA, 25 bp, Mus musculus
cctgttctgcagaccatcctgtcag

SEQ ID NO: 253983 - DNA, 25 bp, Mus musculus
cctgttctgcagacgaagacatggg

SEQ ID NO: 253984 - DNA, 25 bp, Mus musculus
cctgttctgcatctcaccagccccc

SEQ ID NO: 253985 - DNA, 25 bp, Mus musculus
cctgttcttatgcctgaaaaagacc

SEQ ID NO: 253986 - DNA, 25 bp, Mus musculus
cctgttcttcagaaacaacatgcca

SEQ ID NO: 253987 - DNA, 25 bp, Mus musculus
cctgttcttcagaaacagacatcta

SEQ ID NO: 253988 - DNA, 25 bp, Mus musculus
cctgttcttgtggctcaggggactc

SEQ ID NO: 253989 - DNA, 25 bp, Mus musculus
cctgttgaaactttagccacttaca

SEQ ID NO: 253990 - DNA, 25 bp, Mus musculus
cctgttgaatgaccctcttccattt

SEQ ID NO: 253991 - DNA, 25 bp, Mus musculus
cctgttgagcaggccacagaaggac

SEQ ID NO: 253992 - DNA, 25 bp, Mus musculus
cctgttgagcgaagaacaaattacc

SEQ ID NO: 253993 - DNA, 25 bp, Mus musculus
cctgttgagcgaagacccttaccag

SEQ ID NO: 253994 - DNA, 25 bp, Mus musculus
cctgttgcaagagggtgaagaagct

SEQ ID NO: 253995 - DNA, 25 bp, Mus musculus
cctgttgcagccccaccatggagcc

SEQ ID NO: 253996 - DNA, 25 bp, Mus musculus
cctgttgcaggcatgatgggtggct

SEQ ID NO: 253997 - DNA, 25 bp, Mus musculus
cctgttgcagggccacaatacccac

SEQ ID NO: 253998 - DNA, 25 bp, Mus musculus
cctgttgcaggttctgccaccagct

SEQ ID NO: 253999 - DNA, 25 bp, Mus musculus
cctgttgcgcagcgtctcctgtaac

SEQ ID NO: 254000 - DNA, 25 bp, Mus musculus
cctgttgctgctgttatttccgaga

SEQ ID NO: 254001 - DNA, 25 bp, Mus musculus
cctgttggagaaacactgaggacgg

SEQ ID NO: 254002 - DNA, 25 bp, Mus musculus
cctgttggagaaactggcagagctg

SEQ ID NO: 254003 - DNA, 25 bp, Mus musculus
cctgttggagcgggcggcaggaaat

SEQ ID NO: 254004 - DNA, 25 bp, Mus musculus
cctgttggataaaggataaggtagc

SEQ ID NO: 254005 - DNA, 25 bp, Mus musculus
cctgttggctaatggagcccgctgt

SEQ ID NO: 254006 - DNA, 25 bp, Mus musculus
cctgttggtggtcatcaactccagg

SEQ ID NO: 254007 - DNA, 25 bp, Mus musculus
cctgttgtgaataggatggagacaa

SEQ ID NO: 254008 - DNA, 25 bp, Mus musculus
cctgttgttctgaggactctcattg

SEQ ID NO: 254009 - DNA, 25 bp, Mus musculus
cctgttgttctggattccacccaga

SEQ ID NO: 254010 - DNA, 25 bp, Mus musculus
cctgtttagaagtaacagcctccac

SEQ ID NO: 254011 - DNA, 25 bp, Mus musculus
cctgtttcagcaaccttccatggct

SEQ ID NO: 254012 - DNA, 25 bp, Mus musculus
cctgtttcagcaaccttccctgctt

SEQ ID NO: 254013 - DNA, 25 bp, Mus musculus
cctgtttcagcaaccttccctggta

SEQ ID NO: 254014 - DNA, 25 bp, Mus musculus
cctgtttcagcaagcttccctgcta

SEQ ID NO: 254015 - DNA, 25 bp, Mus musculus
cctgtttcagcaagcttccctgttt

SEQ ID NO: 254016 - DNA, 25 bp, Mus musculus
cctgtttcagcaagtttccccagca

SEQ ID NO: 254017 - DNA, 25 bp, Mus musculus
cctgtttcagcaatcttccctggta

SEQ ID NO: 254018 - DNA, 25 bp, Mus musculus
cctgtttcagcttccctgtttcagg

SEQ ID NO: 254019 - DNA, 25 bp, Mus musculus
cctgtttcaggattatttttcttcc

SEQ ID NO: 254020 - DNA, 25 bp, Mus musculus
cctgtttcatttgggagaaccatgg

SEQ ID NO: 254021 - DNA, 25 bp, Mus musculus
cctgtttccaagctctgtccgggcc

SEQ ID NO: 254022 - DNA, 25 bp, Mus musculus
cctgtttgacccaagacaaggtctc

SEQ ID NO: 254023 - DNA, 25 bp, Mus musculus
cctgtttgcagtatgatctggacac

SEQ ID NO: 254024 - DNA, 25 bp, Mus musculus
cctgtttgcccagatgggttttgat

SEQ ID NO: 254025 - DNA, 25 bp, Mus musculus
cctgtttgcccagctctctgtgcta

SEQ ID NO: 254026 - DNA, 25 bp, Mus musculus
cctgtttggtcaggtggtacgtggg

SEQ ID NO: 254027 - DNA, 25 bp, Mus musculus
cctgtttgtaaaagtaaaggagtga

SEQ ID NO: 254028 - DNA, 25 bp, Mus musculus
cctgtttgtaaaattccttctgatg

SEQ ID NO: 254029 - DNA, 25 bp, Mus musculus
cctgttttagaaccaaccgatgtta

SEQ ID NO: 254030 - DNA, 25 bp, Mus musculus
cctgttttatggctggcctggtctg

SEQ ID NO: 254031 - DNA, 25 bp, Mus musculus
cctgttttcagacagctggttcgat

SEQ ID NO: 254032 - DNA, 25 bp, Mus musculus
cctgttttccccttctgttgtactt

SEQ ID NO: 254033 - DNA, 25 bp, Mus musculus
cctgttttgctttgtttacagacct

SEQ ID NO: 254034 - DNA, 25 bp, Mus musculus
cctgtttttccaaggagtgtggggc

SEQ ID NO: 254035 - DNA, 25 bp, Mus musculus
cctgtttttcctcagagcccagatg

SEQ ID NO: 254036 - DNA, 25 bp, Mus musculus
ccttaaaaaagaatccatgcccaga

SEQ ID NO: 254037 - DNA, 25 bp, Mus musculus
ccttaaaaaaggatgctcatgtgga

SEQ ID NO: 254038 - DNA, 25 bp, Mus musculus
ccttaaaaagacttggtgattggga

SEQ ID NO: 254039 - DNA, 25 bp, Mus musculus
ccttaaaactctgcgaggcagaggc

SEQ ID NO: 254040 - DNA, 25 bp, Mus musculus
ccttaaaagaatgctgatgctgttt

SEQ ID NO: 254041 - DNA, 25 bp, Mus musculus
ccttaaacaagatccatgcatacaa

SEQ ID NO: 254042 - DNA, 25 bp, Mus musculus
ccttaaacaggaaatctttgagaac

SEQ ID NO: 254043 - DNA, 25 bp, Mus musculus
ccttaaacagttgcaggaaatcttt

SEQ ID NO: 254044 - DNA, 25 bp, Mus musculus
ccttaaagacgatgaacgtgtcgtg

SEQ ID NO: 254045 - DNA, 25 bp, Mus musculus
ccttaaagagcatgaaagccaaagc

SEQ ID NO: 254046 - DNA, 25 bp, Mus musculus
ccttaaagagcatggacggagatta

SEQ ID NO: 254047 - DNA, 25 bp, Mus musculus
ccttaaagggattggagctggagga

SEQ ID NO: 254048 - DNA, 25 bp, Mus musculus
ccttaaaggggcgacctggcattca

SEQ ID NO: 254049 - DNA, 25 bp, Mus musculus
ccttaaatcagtgtcggtgacgttt

SEQ ID NO: 254050 - DNA, 25 bp, Mus musculus
ccttaaattgggaagatgctggtgg

SEQ ID NO: 254051 - DNA, 25 bp, Mus musculus
ccttaaattgggtgcttccaatagt

SEQ ID NO: 254052 - DNA, 25 bp, Mus musculus
ccttaaattggttctactagtgctc

SEQ ID NO: 254053 - DNA, 25 bp, Mus musculus
ccttaacacctgcagatgcaagttg

SEQ ID NO: 254054 - DNA, 25 bp, Mus musculus
ccttaaccaaggacattcactgaac

SEQ ID NO: 254055 - DNA, 25 bp, Mus musculus
ccttaaccaagggatgactggcaat

SEQ ID NO: 254056 - DNA, 25 bp, Mus musculus
ccttaacctgggatcgcttacactt

SEQ ID NO: 254057 - DNA, 25 bp, Mus musculus
ccttaacgctgttggtcagaaaaca

SEQ ID NO: 254058 - DNA, 25 bp, Mus musculus
ccttaacgtcggctgcccgctttga

SEQ ID NO: 254059 - DNA, 25 bp, Mus musculus
ccttaactgatgtgccggtgaatcc

SEQ ID NO: 254060 - DNA, 25 bp, Mus musculus
ccttaagaaagaatgggaaacagca

SEQ ID NO: 254061 - DNA, 25 bp, Mus musculus
ccttaagaccagagtagcttatcta

SEQ ID NO: 254062 - DNA, 25 bp, Mus musculus
ccttaagaccattcaaatccctgag

SEQ ID NO: 254063 - DNA, 25 bp, Mus musculus
ccttaaggatgtggtccttctggct

SEQ ID NO: 254064 - DNA, 25 bp, Mus musculus
ccttaagttcaggtcagaggaacgc

SEQ ID NO: 254065 - DNA, 25 bp, Mus musculus
ccttaatccaggaagcatttgtcaa

SEQ ID NO: 254066 - DNA, 25 bp, Mus musculus
ccttaatgaaaacattaaccaggtc

SEQ ID NO: 254067 - DNA, 25 bp, Mus musculus
ccttaatgagatcctcacattagct

SEQ ID NO: 254068 - DNA, 25 bp, Mus musculus
ccttaatgggtctggttctccacat

SEQ ID NO: 254069 - DNA, 25 bp, Mus musculus
ccttacaaaggtgaccgggctgcgt

SEQ ID NO: 254070 - DNA, 25 bp, Mus musculus
ccttacaagaagacttgcctaacga

SEQ ID NO: 254071 - DNA, 25 bp, Mus musculus
ccttacaagaaggatgagaacaagt

SEQ ID NO: 254072 - DNA, 25 bp, Mus musculus
ccttacaagtggatgaacagccagt

SEQ ID NO: 254073 - DNA, 25 bp, Mus musculus
ccttacaatcaacatttctgaccga

SEQ ID NO: 254074 - DNA, 25 bp, Mus musculus
ccttacaatcaagatttctgaccga

SEQ ID NO: 254075 - DNA, 25 bp, Mus musculus
ccttacacaggtcaccactcaagat

SEQ ID NO: 254076 - DNA, 25 bp, Mus musculus
ccttacacatacagagttcgttatc

SEQ ID NO: 254077 - DNA, 25 bp, Mus musculus
ccttacacattgcggatagagacat

SEQ ID NO: 254078 - DNA, 25 bp, Mus musculus
ccttacactacttctaaagatggca

SEQ ID NO: 254079 - DNA, 25 bp, Mus musculus
ccttacagatccagggagcatggca

SEQ ID NO: 254080 - DNA, 25 bp, Mus musculus
ccttacagcacacaggcagaggtgt

SEQ ID NO: 254081 - DNA, 25 bp, Mus musculus
ccttacagcaggtggccccttctgc

SEQ ID NO: 254082 - DNA, 25 bp, Mus musculus
ccttacagcccaagcagccacctag

SEQ ID NO: 254083 - DNA, 25 bp, Mus musculus
ccttacagctcaccaacaagaagaa

SEQ ID NO: 254084 - DNA, 25 bp, Mus musculus
ccttacagctcacgaaatggagaca

SEQ ID NO: 254085 - DNA, 25 bp, Mus musculus
ccttacagctcagcaacaagaagaa

SEQ ID NO: 254086 - DNA, 25 bp, Mus musculus
ccttacagctcaggaaatggagaca

SEQ ID NO: 254087 - DNA, 25 bp, Mus musculus
ccttacaggagccaggccacagagg

SEQ ID NO: 254088 - DNA, 25 bp, Mus musculus
ccttacaggtaaacagggattcgat

SEQ ID NO: 254089 - DNA, 25 bp, Mus musculus
ccttacagttaaggaagctgtgctg

SEQ ID NO: 254090 - DNA, 25 bp, Mus musculus
ccttacataggcaaggatagttcat

SEQ ID NO: 254091 - DNA, 25 bp, Mus musculus
ccttaccaaggaccgtagcctggca

SEQ ID NO: 254092 - DNA, 25 bp, Mus musculus
ccttaccaatcccagtgactctgga

SEQ ID NO: 254093 - DNA, 25 bp, Mus musculus
ccttaccacagaatccagattctct

SEQ ID NO: 254094 - DNA, 25 bp, Mus musculus
ccttaccacaggctccaagatttta

SEQ ID NO: 254095 - DNA, 25 bp, Mus musculus
ccttaccacaggtgctacttttcca

SEQ ID NO: 254096 - DNA, 25 bp, Mus musculus
ccttaccagaagcagtgcgatgact

SEQ ID NO: 254097 - DNA, 25 bp, Mus musculus
ccttaccagtgaggctgtgtctact

SEQ ID NO: 254098 - DNA, 25 bp, Mus musculus
ccttaccatgtgccctggggggcag

SEQ ID NO: 254099 - DNA, 25 bp, Mus musculus
ccttacccagatgaggctctgtctg

SEQ ID NO: 254100 - DNA, 25 bp, Mus musculus
ccttacccagcccagagcccggcag

SEQ ID NO: 254101 - DNA, 25 bp, Mus musculus
ccttaccccatggaggttatttttg

SEQ ID NO: 254102 - DNA, 25 bp, Mus musculus
ccttaccctagccagcataattaaa

SEQ ID NO: 254103 - DNA, 25 bp, Mus musculus
ccttaccctagccagggttgatttc

SEQ ID NO: 254104 - DNA, 25 bp, Mus musculus
ccttaccctccgaagctctggatgg

SEQ ID NO: 254105 - DNA, 25 bp, Mus musculus
ccttacctccagaacccgctcagtt

SEQ ID NO: 254106 - DNA, 25 bp, Mus musculus
ccttacctgcctggaaagccaacag

SEQ ID NO: 254107 - DNA, 25 bp, Mus musculus
ccttacctgcctgggtctgggatct

SEQ ID NO: 254108 - DNA, 25 bp, Mus musculus
ccttacgctctcctactccgtggtg

SEQ ID NO: 254109 - DNA, 25 bp, Mus musculus
ccttacggcaaagtctcatacatcc

SEQ ID NO: 254110 - DNA, 25 bp, Mus musculus
ccttactatgaggtctacaccatcc

SEQ ID NO: 254111 - DNA, 25 bp, Mus musculus
ccttactatggagaaggaagcattg

SEQ ID NO: 254112 - DNA, 25 bp, Mus musculus
ccttactgtcccgagaaggtgtagg

SEQ ID NO: 254113 - DNA, 25 bp, Mus musculus
ccttacttcagaggagctggctctg

SEQ ID NO: 254114 - DNA, 25 bp, Mus musculus
ccttacttcagtacaggtcaagttc

SEQ ID NO: 254115 - DNA, 25 bp, Mus musculus
ccttacttctttcaggtactcatgt

SEQ ID NO: 254116 - DNA, 25 bp, Mus musculus
ccttactttgataagaatggcaatc

SEQ ID NO: 254117 - DNA, 25 bp, Mus musculus
ccttactttgataaggatggcattg

SEQ ID NO: 254118 - DNA, 25 bp, Mus musculus
ccttagaacaagatttaccggacag

SEQ ID NO: 254119 - DNA, 25 bp, Mus musculus
ccttagaagaaagttggggctgtgc

SEQ ID NO: 254120 - DNA, 25 bp, Mus musculus
ccttagaagatggagatcagccaga

SEQ ID NO: 254121 - DNA, 25 bp, Mus musculus
ccttagaagatggagatggctcttg

SEQ ID NO: 254122 - DNA, 25 bp, Mus musculus
ccttagactccatgtgctcggcgct

SEQ ID NO: 254123 - DNA, 25 bp, Mus musculus
ccttagacttgaaagcacagtggtt

SEQ ID NO: 254124 - DNA, 25 bp, Mus musculus
ccttagagcagaacatctggcccta

SEQ ID NO: 254125 - DNA, 25 bp, Mus musculus
ccttagagcagcaggtatggacaac

SEQ ID NO: 254126 - DNA, 25 bp, Mus musculus
ccttagagctggtgtgtctccaggc

SEQ ID NO: 254127 - DNA, 25 bp, Mus musculus
ccttagaggcctcactagggcaggg

SEQ ID NO: 254128 - DNA, 25 bp, Mus musculus
ccttagatgatgtgaacgagattat

SEQ ID NO: 254129 - DNA, 25 bp, Mus musculus
ccttagatgcctgagggcaggatgg

SEQ ID NO: 254130 - DNA, 25 bp, Mus musculus
ccttagcaaccttccatggctcagg

SEQ ID NO: 254131 - DNA, 25 bp, Mus musculus
ccttagcaagcataaacagattccg

SEQ ID NO: 254132 - DNA, 25 bp, Mus musculus
ccttagcaaggtcaacaacagtcct

SEQ ID NO: 254133 - DNA, 25 bp, Mus musculus
ccttagcatccagtgggtgtataac

SEQ ID NO: 254134 - DNA, 25 bp, Mus musculus
ccttagccaagagctgtcccgacca

SEQ ID NO: 254135 - DNA, 25 bp, Mus musculus
ccttagcgatttccgggacctcatg

SEQ ID NO: 254136 - DNA, 25 bp, Mus musculus
ccttagctaccgccaccagaagcac

SEQ ID NO: 254137 - DNA, 25 bp, Mus musculus
ccttagctgaccgtgctattcactg

SEQ ID NO: 254138 - DNA, 25 bp, Mus musculus
ccttaggaggaatgccctgctggag

SEQ ID NO: 254139 - DNA, 25 bp, Mus musculus
ccttaggaggaatggcctactgaac

SEQ ID NO: 254140 - DNA, 25 bp, Mus musculus
ccttagggcaagattctcagccacc

SEQ ID NO: 254141 - DNA, 25 bp, Mus musculus
ccttaggtttgatcagacctactgt

SEQ ID NO: 254142 - DNA, 25 bp, Mus musculus
ccttaggtttgcagatgatacgtat

SEQ ID NO: 254143 - DNA, 25 bp, Mus musculus
ccttaggtttgcatgggacacagca

SEQ ID NO: 254144 - DNA, 25 bp, Mus musculus
ccttagtaaaacttacctcactgtg

SEQ ID NO: 254145 - DNA, 25 bp, Mus musculus
ccttagtataggtgattgaagcctc

SEQ ID NO: 254146 - DNA, 25 bp, Mus musculus
ccttagtataggtgtcctcagatag

SEQ ID NO: 254147 - DNA, 25 bp, Mus musculus
ccttagtcaccagtgccagcggatt

SEQ ID NO: 254148 - DNA, 25 bp, Mus musculus
ccttagtcagacgcgcacggaccat

SEQ ID NO: 254149 - DNA, 25 bp, Mus musculus
ccttagtccgagccgccatgggctg

SEQ ID NO: 254150 - DNA, 25 bp, Mus musculus
ccttagtcctgatgctgtctatgta

SEQ ID NO: 254151 - DNA, 25 bp, Mus musculus
ccttagtcctgtcccccagctctca

SEQ ID NO: 254152 - DNA, 25 bp, Mus musculus
ccttagtctgctacatagcccatct

SEQ ID NO: 254153 - DNA, 25 bp, Mus musculus
ccttagtctggtacatagcccatct

SEQ ID NO: 254154 - DNA, 25 bp, Mus musculus
ccttagtgcaggaaacttcgcggct

SEQ ID NO: 254155 - DNA, 25 bp, Mus musculus
ccttagttcagaatgtgattctgct

SEQ ID NO: 254156 - DNA, 25 bp, Mus musculus
ccttagttcagatcctagcccgatg

SEQ ID NO: 254157 - DNA, 25 bp, Mus musculus
ccttatacccggagagagaagcgct

SEQ ID NO: 254158 - DNA, 25 bp, Mus musculus
ccttatacttgctagctgccgacta

SEQ ID NO: 254159 - DNA, 25 bp, Mus musculus
ccttatagtctgattcctttctcct

SEQ ID NO: 254160 - DNA, 25 bp, Mus musculus
ccttatattaaaaggtgtccagtgt

SEQ ID NO: 254161 - DNA, 25 bp, Mus musculus
ccttatcaagcactggagggcagag

SEQ ID NO: 254162 - DNA, 25 bp, Mus musculus
ccttatcaaggctcagaggcacatc

SEQ ID NO: 254163 - DNA, 25 bp, Mus musculus
ccttatcacgaagaaaaacgtgaac

SEQ ID NO: 254164 - DNA, 25 bp, Mus musculus
ccttatcagtcaggattctgaatca

SEQ ID NO: 254165 - DNA, 25 bp, Mus musculus
ccttatcagtcagggttacagagtc

SEQ ID NO: 254166 - DNA, 25 bp, Mus musculus
ccttatcatccttagcaagagatgt

SEQ ID NO: 254167 - DNA, 25 bp, Mus musculus
ccttatcccaatgtggaagaagctc

SEQ ID NO: 254168 - DNA, 25 bp, Mus musculus
ccttatcccactctgcccgacctct

SEQ ID NO: 254169 - DNA, 25 bp, Mus musculus
ccttatctacgagaccctcctctgg

SEQ ID NO: 254170 - DNA, 25 bp, Mus musculus
ccttatgaaaactggtgaagggccg

SEQ ID NO: 254171 - DNA, 25 bp, Mus musculus
ccttatgaacatggtgaagtatttg

SEQ ID NO: 254172 - DNA, 25 bp, Mus musculus
ccttatgacaggttctgtccattct

SEQ ID NO: 254173 - DNA, 25 bp, Mus musculus
ccttatgatcaggaaccagctcctg

SEQ ID NO: 254174 - DNA, 25 bp, Mus musculus
ccttatgatcaggcggcttggattt

SEQ ID NO: 254175 - DNA, 25 bp, Mus musculus
ccttatgcagacacgagatcttgta

SEQ ID NO: 254176 - DNA, 25 bp, Mus musculus
ccttatggaggaaggtcgtggactt

SEQ ID NO: 254177 - DNA, 25 bp, Mus musculus
ccttatggcaggtgctgacctgagc

SEQ ID NO: 254178 - DNA, 25 bp, Mus musculus
ccttatggccaatgaggtcactcgt

SEQ ID NO: 254179 - DNA, 25 bp, Mus musculus
ccttatggccaatggtcagttggtg

SEQ ID NO: 254180 - DNA, 25 bp, Mus musculus
ccttatggcgaggagccatcaagca

SEQ ID NO: 254181 - DNA, 25 bp, Mus musculus
ccttatggcgaggaggaggtgtagc

SEQ ID NO: 254182 - DNA, 25 bp, Mus musculus
ccttattaccacagcgtttatgttt

SEQ ID NO: 254183 - DNA, 25 bp, Mus musculus
ccttattaccacaggaactgcatga

SEQ ID NO: 254184 - DNA, 25 bp, Mus musculus
ccttattcaaggcctggtgtgtgcc

SEQ ID NO: 254185 - DNA, 25 bp, Mus musculus
ccttattcaaggggtgtggaatatt

SEQ ID NO: 254186 - DNA, 25 bp, Mus musculus
ccttattccagaactttgtgccctg

SEQ ID NO: 254187 - DNA, 25 bp, Mus musculus
ccttattgaaaggatgaagaaacac

SEQ ID NO: 254188 - DNA, 25 bp, Mus musculus
ccttattgagttcattcaggctggt

SEQ ID NO: 254189 - DNA, 25 bp, Mus musculus
ccttatttctgtgacagctatattg

SEQ ID NO: 254190 - DNA, 25 bp, Mus musculus
ccttattttacagtgaaaatgtgct

SEQ ID NO: 254191 - DNA, 25 bp, Mus musculus
ccttcaaaaagtcaaggtgattctg

SEQ ID NO: 254192 - DNA, 25 bp, Mus musculus
ccttcaaaagaatggcagtctgcag

SEQ ID NO: 254193 - DNA, 25 bp, Mus musculus
ccttcaaaagtgtgctggggaacac

SEQ ID NO: 254194 - DNA, 25 bp, Mus musculus
ccttcaaaatgcgtttcaagcacca

SEQ ID NO: 254195 - DNA, 25 bp, Mus musculus
ccttcaaacctggtgcgttcattcc

SEQ ID NO: 254196 - DNA, 25 bp, Mus musculus
ccttcaaagacctactgaaagccaa

SEQ ID NO: 254197 - DNA, 25 bp, Mus musculus
ccttcaaagcagaagcctcctgcca

SEQ ID NO: 254198 - DNA, 25 bp, Mus musculus
ccttcaaagcccgggtatcatccgg

SEQ ID NO: 254199 - DNA, 25 bp, Mus musculus
ccttcaaagtaccaggaaaggacac

SEQ ID NO: 254200 - DNA, 25 bp, Mus musculus
ccttcaaatactgaactgtccctga

SEQ ID NO: 254201 - DNA, 25 bp, Mus musculus
ccttcaacaatcatggctgcttgtg

SEQ ID NO: 254202 - DNA, 25 bp, Mus musculus
ccttcaaccaggtcaggctgttcct

SEQ ID NO: 254203 - DNA, 25 bp, Mus musculus
ccttcaacctgacgctgtccatgct

SEQ ID NO: 254204 - DNA, 25 bp, Mus musculus
ccttcaacctggatgccctccacac

SEQ ID NO: 254205 - DNA, 25 bp, Mus musculus
ccttcaacggaggtactgtattggc

SEQ ID NO: 254206 - DNA, 25 bp, Mus musculus
ccttcaactacagccttacctgcct

SEQ ID NO: 254207 - DNA, 25 bp, Mus musculus
ccttcaagaaagatgtccttggctc

SEQ ID NO: 254208 - DNA, 25 bp, Mus musculus
ccttcaagacagatcctcaagaatg

SEQ ID NO: 254209 - DNA, 25 bp, Mus musculus
ccttcaagacagcgtgggtgggctc

SEQ ID NO: 254210 - DNA, 25 bp, Mus musculus
ccttcaagctggatcttctatcggg

SEQ ID NO: 254211 - DNA, 25 bp, Mus musculus
ccttcaagctgggtgcgcatggtga

SEQ ID NO: 254212 - DNA, 25 bp, Mus musculus
ccttcaaggcctgacaacatcgctg

SEQ ID NO: 254213 - DNA, 25 bp, Mus musculus
ccttcaagggatttaaacgagtgtg

SEQ ID NO: 254214 - DNA, 25 bp, Mus musculus
ccttcaagtacagagatgaactcaa

SEQ ID NO: 254215 - DNA, 25 bp, Mus musculus
ccttcaagtacaggtatgaactcaa

SEQ ID NO: 254216 - DNA, 25 bp, Mus musculus
ccttcaatcttcctagtgacggctc

SEQ ID NO: 254217 - DNA, 25 bp, Mus musculus
ccttcaatcttcctagtgagccccg

SEQ ID NO: 254218 - DNA, 25 bp, Mus musculus
ccttcaatgagaagtgaacatgtat

SEQ ID NO: 254219 - DNA, 25 bp, Mus musculus
ccttcaattaccagggtgaaagaat

SEQ ID NO: 254220 - DNA, 25 bp, Mus musculus
ccttcacaacagcgaggtgtaccac

SEQ ID NO: 254221 - DNA, 25 bp, Mus musculus
ccttcacaatctccagaactacagc

SEQ ID NO: 254222 - DNA, 25 bp, Mus musculus
ccttcacaatgtgatacctgactgt

SEQ ID NO: 254223 - DNA, 25 bp, Mus musculus
ccttcacaccctcagaacagcaacc

SEQ ID NO: 254224 - DNA, 25 bp, Mus musculus
ccttcacagcctcatcattacagat

SEQ ID NO: 254225 - DNA, 25 bp, Mus musculus
ccttcacaggagagatagacccagt

SEQ ID NO: 254226 - DNA, 25 bp, Mus musculus
ccttcacatggtctcttcagatgga

SEQ ID NO: 254227 - DNA, 25 bp, Mus musculus
ccttcaccaatttatcaaaagttta

SEQ ID NO: 254228 - DNA, 25 bp, Mus musculus
ccttcaccactaacgactctgacac

SEQ ID NO: 254229 - DNA, 25 bp, Mus musculus
ccttcaccactaacgggactcagaa

SEQ ID NO: 254230 - DNA, 25 bp, Mus musculus
ccttcaccaggactgggaggtacag

SEQ ID NO: 254231 - DNA, 25 bp, Mus musculus
ccttcaccagggatgactctgttcc

SEQ ID NO: 254232 - DNA, 25 bp, Mus musculus
ccttcaccagtttgggctcaagagt

SEQ ID NO: 254233 - DNA, 25 bp, Mus musculus
ccttcacccagtgctgtcaatcctg

SEQ ID NO: 254234 - DNA, 25 bp, Mus musculus
ccttcacccgggaggaagctgatga

SEQ ID NO: 254235 - DNA, 25 bp, Mus musculus
ccttcacctccagagccagctccag

SEQ ID NO: 254236 - DNA, 25 bp, Mus musculus
ccttcacctggcaagcttcacatgg

SEQ ID NO: 254237 - DNA, 25 bp, Mus musculus
ccttcacgaaagaacttatttgtcc

SEQ ID NO: 254238 - DNA, 25 bp, Mus musculus
ccttcacggcggagtgttcctgtat

SEQ ID NO: 254239 - DNA, 25 bp, Mus musculus
ccttcacggtccaagtgtgggactt

SEQ ID NO: 254240 - DNA, 25 bp, Mus musculus
ccttcacgtggttggaaattgatgg

SEQ ID NO: 254241 - DNA, 25 bp, Mus musculus
ccttcacgtggttggaatgtggtgt

SEQ ID NO: 254242 - DNA, 25 bp, Mus musculus
ccttcacgttgggttcgccaagcag

SEQ ID NO: 254243 - DNA, 25 bp, Mus musculus
ccttcactaaacaagacctcctaag

SEQ ID NO: 254244 - DNA, 25 bp, Mus musculus
ccttcactctagcccatccagtccc

SEQ ID NO: 254245 - DNA, 25 bp, Mus musculus
ccttcactggggcactcagaaagaa

SEQ ID NO: 254246 - DNA, 25 bp, Mus musculus
ccttcacttggtgcatcgggagcaa

SEQ ID NO: 254247 - DNA, 25 bp, Mus musculus
ccttcacttttggttccacaccctc

SEQ ID NO: 254248 - DNA, 25 bp, Mus musculus
ccttcagaaagtactgtccctgaag

SEQ ID NO: 254249 - DNA, 25 bp, Mus musculus
ccttcagaaggaagacaacatggcc

SEQ ID NO: 254250 - DNA, 25 bp, Mus musculus
ccttcagacagaaaacgaagtccat

SEQ ID NO: 254251 - DNA, 25 bp, Mus musculus
ccttcagacctctcctgagatgggg

SEQ ID NO: 254252 - DNA, 25 bp, Mus musculus
ccttcagagagttaggctgccaaca

SEQ ID NO: 254253 - DNA, 25 bp, Mus musculus
ccttcagagcgagggagcccgaacc

SEQ ID NO: 254254 - DNA, 25 bp, Mus musculus
ccttcagcaccaggagggagctatg

SEQ ID NO: 254255 - DNA, 25 bp, Mus musculus
ccttcagcactgaggttcaagaatt

SEQ ID NO: 254256 - DNA, 25 bp, Mus musculus
ccttcagcagagcaggaagatcctt

SEQ ID NO: 254257 - DNA, 25 bp, Mus musculus
ccttcagcagatgaatggaaacttt

SEQ ID NO: 254258 - DNA, 25 bp, Mus musculus
ccttcagccgagaaacatcccaaac

SEQ ID NO: 254259 - DNA, 25 bp, Mus musculus
ccttcagccgagaagaactttgatc

SEQ ID NO: 254260 - DNA, 25 bp, Mus musculus
ccttcagccggattacacaggaagc

SEQ ID NO: 254261 - DNA, 25 bp, Mus musculus
ccttcagcctcagaaccgcaaattt

SEQ ID NO: 254262 - DNA, 25 bp, Mus musculus
ccttcagcctcagcccagcgtaagc

SEQ ID NO: 254263 - DNA, 25 bp, Mus musculus
ccttcagcctcaggttatgaaaatg

SEQ ID NO: 254264 - DNA, 25 bp, Mus musculus
ccttcagcctcagtggtgacccaag

SEQ ID NO: 254265 - DNA, 25 bp, Mus musculus
ccttcagcctggggctgacatggac

SEQ ID NO: 254266 - DNA, 25 bp, Mus musculus
ccttcagcgaggaagatgaggacga

SEQ ID NO: 254267 - DNA, 25 bp, Mus musculus
ccttcagctacgaaccaaaaaccac

SEQ ID NO: 254268 - DNA, 25 bp, Mus musculus
ccttcagctcacgaggcgcataccc

SEQ ID NO: 254269 - DNA, 25 bp, Mus musculus
ccttcagctgctgaggttatttaaa

SEQ ID NO: 254270 - DNA, 25 bp, Mus musculus
ccttcaggaaagcctgtgggccgaa

SEQ ID NO: 254271 - DNA, 25 bp, Mus musculus
ccttcaggaaccatatcctaggcaa

SEQ ID NO: 254272 - DNA, 25 bp, Mus musculus
ccttcaggaaccatatgactgctta

SEQ ID NO: 254273 - DNA, 25 bp, Mus musculus
ccttcaggaaccatattctgtttta

SEQ ID NO: 254274 - DNA, 25 bp, Mus musculus
ccttcaggaaggcagcctcctatcc

SEQ ID NO: 254275 - DNA, 25 bp, Mus musculus
ccttcaggaaggtggtcagcgcgct

SEQ ID NO: 254276 - DNA, 25 bp, Mus musculus
ccttcaggacaaggttttcaaaata

SEQ ID NO: 254277 - DNA, 25 bp, Mus musculus
ccttcaggaccccaaggtcatgatg

SEQ ID NO: 254278 - DNA, 25 bp, Mus musculus
ccttcaggacttgctgatgtggatg

SEQ ID NO: 254279 - DNA, 25 bp, Mus musculus
ccttcaggagccacgtcagtgttct

SEQ ID NO: 254280 - DNA, 25 bp, Mus musculus
ccttcaggagcgggcctgtgtgata

SEQ ID NO: 254281 - DNA, 25 bp, Mus musculus
ccttcaggaggaggacttactgtgt

SEQ ID NO: 254282 - DNA, 25 bp, Mus musculus
ccttcaggaggaggtggcaaaccct

SEQ ID NO: 254283 - DNA, 25 bp, Mus musculus
ccttcaggaggcagcagaagctttc

SEQ ID NO: 254284 - DNA, 25 bp, Mus musculus
ccttcaggaggtatgctgcttggga

SEQ ID NO: 254285 - DNA, 25 bp, Mus musculus
ccttcaggagtacagacagcaccct

SEQ ID NO: 254286 - DNA, 25 bp, Mus musculus
ccttcaggctttgcagggacccttc

SEQ ID NO: 254287 - DNA, 25 bp, Mus musculus
ccttcaggtctcggccagaaggttt

SEQ ID NO: 254288 - DNA, 25 bp, Mus musculus
ccttcaggtggacacctccctttcc

SEQ ID NO: 254289 - DNA, 25 bp, Mus musculus
ccttcaggtgtactcctccctttcc

SEQ ID NO: 254290 - DNA, 25 bp, Mus musculus
ccttcaggtgtactcctctcttttc

SEQ ID NO: 254291 - DNA, 25 bp, Mus musculus
ccttcagtatcctgatcacatttga

SEQ ID NO: 254292 - DNA, 25 bp, Mus musculus
ccttcagtatgacgttcgcctggct

SEQ ID NO: 254293 - DNA, 25 bp, Mus musculus
ccttcagtcagagatatatttctga

SEQ ID NO: 254294 - DNA, 25 bp, Mus musculus
ccttcagtctctcagtgcctgtgct

SEQ ID NO: 254295 - DNA, 25 bp, Mus musculus
ccttcagtgaggaggcttacatccc

SEQ ID NO: 254296 - DNA, 25 bp, Mus musculus
ccttcagtggctcggatgttcagca

SEQ ID NO: 254297 - DNA, 25 bp, Mus musculus
ccttcagtgtaggatctcttcactg

SEQ ID NO: 254298 - DNA, 25 bp, Mus musculus
ccttcataagaagtgtttccacgat

SEQ ID NO: 254299 - DNA, 25 bp, Mus musculus
ccttcatagaagatcaagatgtaga

SEQ ID NO: 254300 - DNA, 25 bp, Mus musculus
ccttcatagaaggtacttcaagagt

SEQ ID NO: 254301 - DNA, 25 bp, Mus musculus
ccttcatagaaggttctcattgtgt

SEQ ID NO: 254302 - DNA, 25 bp, Mus musculus
ccttcatatctaccgtcgacttaaa

SEQ ID NO: 254303 - DNA, 25 bp, Mus musculus
ccttcatcatcaaggtctttcgctt

SEQ ID NO: 254304 - DNA, 25 bp, Mus musculus
ccttcatcatcacggtcttctggcc

SEQ ID NO: 254305 - DNA, 25 bp, Mus musculus
ccttcatccatcaggcgtggtttct

SEQ ID NO: 254306 - DNA, 25 bp, Mus musculus
ccttcatcgacaaggtgcgcttcct

SEQ ID NO: 254307 - DNA, 25 bp, Mus musculus
ccttcatcgtcgcagaaagtaagcc

SEQ ID NO: 254308 - DNA, 25 bp, Mus musculus
ccttcatcgtcgcagacagctgagt

SEQ ID NO: 254309 - DNA, 25 bp, Mus musculus
ccttcatcgtgaagagcctccccag

SEQ ID NO: 254310 - DNA, 25 bp, Mus musculus
ccttcatctgccgactccctgtcct

SEQ ID NO: 254311 - DNA, 25 bp, Mus musculus
ccttcatctgccggaagccgactct

SEQ ID NO: 254312 - DNA, 25 bp, Mus musculus
ccttcatctgggaatctacagtgat

SEQ ID NO: 254313 - DNA, 25 bp, Mus musculus
ccttcatctgggtatctacagtgat

SEQ ID NO: 254314 - DNA, 25 bp, Mus musculus
ccttcatcttccagagaggaggctc

SEQ ID NO: 254315 - DNA, 25 bp, Mus musculus
ccttcatgaaaggaatacagatgtt

SEQ ID NO: 254316 - DNA, 25 bp, Mus musculus
ccttcatgaaagttccgacgagata

SEQ ID NO: 254317 - DNA, 25 bp, Mus musculus
ccttcatgacagaggacatttgaca

SEQ ID NO: 254318 - DNA, 25 bp, Mus musculus
ccttcatgacagatttctcaggaat

SEQ ID NO: 254319 - DNA, 25 bp, Mus musculus
ccttcatgccatttcagtgcccgat

SEQ ID NO: 254320 - DNA, 25 bp, Mus musculus
ccttcatggagaaggtgcaccgtgg

SEQ ID NO: 254321 - DNA, 25 bp, Mus musculus
ccttcatggagcaggtgcaccgtgg

SEQ ID NO: 254322 - DNA, 25 bp, Mus musculus
ccttcatgtgccaggctggcgactt

SEQ ID NO: 254323 - DNA, 25 bp, Mus musculus
ccttcatgtttgagggccatgacac

SEQ ID NO: 254324 - DNA, 25 bp, Mus musculus
ccttcattcaacgtgatgaaaggag

SEQ ID NO: 254325 - DNA, 25 bp, Mus musculus
ccttcattcaagggttttatggaca

SEQ ID NO: 254326 - DNA, 25 bp, Mus musculus
ccttcattgatctggttatccaggc

SEQ ID NO: 254327 - DNA, 25 bp, Mus musculus
ccttcatttctcatctcccagcagg

SEQ ID NO: 254328 - DNA, 25 bp, Mus musculus
ccttccaaaaggcccacagcagcag

SEQ ID NO: 254329 - DNA, 25 bp, Mus musculus
ccttccaaacagaacctttccctga

SEQ ID NO: 254330 - DNA, 25 bp, Mus musculus
ccttccaaacagtttcaaagaggca

SEQ ID NO: 254331 - DNA, 25 bp, Mus musculus
ccttccaaagggtgatgtcttccca

SEQ ID NO: 254332 - DNA, 25 bp, Mus musculus
ccttccaacaagacgatccacgcag

SEQ ID NO: 254333 - DNA, 25 bp, Mus musculus
ccttccaacatctgagcagctcaaa

SEQ ID NO: 254334 - DNA, 25 bp, Mus musculus
ccttccaactcaggctgcttctgat

SEQ ID NO: 254335 - DNA, 25 bp, Mus musculus
ccttccaagtacattcacttcttcc

SEQ ID NO: 254336 - DNA, 25 bp, Mus musculus
ccttccaatgctaatgccagtgact

SEQ ID NO: 254337 - DNA, 25 bp, Mus musculus
ccttccacaaagagcgcctggccat

SEQ ID NO: 254338 - DNA, 25 bp, Mus musculus
ccttccacaagaagaacgagacgat

SEQ ID NO: 254339 - DNA, 25 bp, Mus musculus
ccttccacaagtttcctcttactcg

SEQ ID NO: 254340 - DNA, 25 bp, Mus musculus
ccttccacaatcggtattaccagag

SEQ ID NO: 254341 - DNA, 25 bp, Mus musculus
ccttccacagacttcccaagaaaga

SEQ ID NO: 254342 - DNA, 25 bp, Mus musculus
ccttccacagctgctccgaaagaca

SEQ ID NO: 254343 - DNA, 25 bp, Mus musculus
ccttccagaacagggaaaggcagga

SEQ ID NO: 254344 - DNA, 25 bp, Mus musculus
ccttccagaagtcttgtgtgatgcc

SEQ ID NO: 254345 - DNA, 25 bp, Mus musculus
ccttccagaatgtcaagtgccccca

SEQ ID NO: 254346 - DNA, 25 bp, Mus musculus
ccttccagaccacagggatcaccca

SEQ ID NO: 254347 - DNA, 25 bp, Mus musculus
ccttccagaccacaggtccctgtgg

SEQ ID NO: 254348 - DNA, 25 bp, Mus musculus
ccttccagaccggtggcagacatgg

SEQ ID NO: 254349 - DNA, 25 bp, Mus musculus
ccttccagaggagaggtggtgaagg

SEQ ID NO: 254350 - DNA, 25 bp, Mus musculus
ccttccagatacattgacatcagca

SEQ ID NO: 254351 - DNA, 25 bp, Mus musculus
ccttccagatacgtcttccaagttg

SEQ ID NO: 254352 - DNA, 25 bp, Mus musculus
ccttccaggaccacgatgtccctgg

SEQ ID NO: 254353 - DNA, 25 bp, Mus musculus
ccttccaggagatggagttgctatg

SEQ ID NO: 254354 - DNA, 25 bp, Mus musculus
ccttccaggaggggctggagggtca

SEQ ID NO: 254355 - DNA, 25 bp, Mus musculus
ccttccagtacaggaaattaaaatg

SEQ ID NO: 254356 - DNA, 25 bp, Mus musculus
ccttccagtacaggtcagaggaacg

SEQ ID NO: 254357 - DNA, 25 bp, Mus musculus
ccttccagtgagcttgcttcccaga

SEQ ID NO: 254358 - DNA, 25 bp, Mus musculus
ccttccagtgggatgatctggccca

SEQ ID NO: 254359 - DNA, 25 bp, Mus musculus
ccttccagtttggagagtgtgactt

SEQ ID NO: 254360 - DNA, 25 bp, Mus musculus
ccttccagtttggagggtttctctg

SEQ ID NO: 254361 - DNA, 25 bp, Mus musculus
ccttccatatgaccaaaggctacta

SEQ ID NO: 254362 - DNA, 25 bp, Mus musculus
ccttccatcaccagcatccatgtct

SEQ ID NO: 254363 - DNA, 25 bp, Mus musculus
ccttccatcaccaggtgcgtgatga

SEQ ID NO: 254364 - DNA, 25 bp, Mus musculus
ccttccatcatgaggaaatttgccc

SEQ ID NO: 254365 - DNA, 25 bp, Mus musculus
ccttccatcctatatagtctacatg

SEQ ID NO: 254366 - DNA, 25 bp, Mus musculus
ccttccatggctcagcaagcttccc

SEQ ID NO: 254367 - DNA, 25 bp, Mus musculus
ccttccattatgtatagcagtgttt

SEQ ID NO: 254368 - DNA, 25 bp, Mus musculus
ccttcccaactctgctcctgacatc

SEQ ID NO: 254369 - DNA, 25 bp, Mus musculus
ccttcccaatggtgatgatggtgaa

SEQ ID NO: 254370 - DNA, 25 bp, Mus musculus
ccttcccacagcatcgccaaatgcc

SEQ ID NO: 254371 - DNA, 25 bp, Mus musculus
ccttcccacaggtctgcctctcttg

SEQ ID NO: 254372 - DNA, 25 bp, Mus musculus
ccttcccaccttcaaaactggtgaa

SEQ ID NO: 254373 - DNA, 25 bp, Mus musculus
ccttcccagaagaaaacatgaatta

SEQ ID NO: 254374 - DNA, 25 bp, Mus musculus
ccttcccagagaaaggatgcaagct

SEQ ID NO: 254375 - DNA, 25 bp, Mus musculus
ccttcccaggagtacacggtcatta

SEQ ID NO: 254376 - DNA, 25 bp, Mus musculus
ccttcccagggtctgaatttcctgt

SEQ ID NO: 254377 - DNA, 25 bp, Mus musculus
ccttcccagtggggctcaagagtgt

SEQ ID NO: 254378 - DNA, 25 bp, Mus musculus
ccttcccagtggggtacatgtaccc

SEQ ID NO: 254379 - DNA, 25 bp, Mus musculus
ccttcccatttgattgagaaatgtg

SEQ ID NO: 254380 - DNA, 25 bp, Mus musculus
ccttccccaggatgacagaggagtt

SEQ ID NO: 254381 - DNA, 25 bp, Mus musculus
ccttccccccggcagatgagacacc

SEQ ID NO: 254382 - DNA, 25 bp, Mus musculus
ccttccccccggcaggtaattctga

SEQ ID NO: 254383 - DNA, 25 bp, Mus musculus
ccttccccctgaggaggctgcgggg

SEQ ID NO: 254384 - DNA, 25 bp, Mus musculus
ccttcccccttggttgcctctctgc

SEQ ID NO: 254385 - DNA, 25 bp, Mus musculus
ccttcccctcagagttgtctgctgg

SEQ ID NO: 254386 - DNA, 25 bp, Mus musculus
ccttcccctcaggagtggagtcaac

SEQ ID NO: 254387 - DNA, 25 bp, Mus musculus
ccttcccctcaggggtgatccattc

SEQ ID NO: 254388 - DNA, 25 bp, Mus musculus
ccttccccttagctcagagctctgg

SEQ ID NO: 254389 - DNA, 25 bp, Mus musculus
ccttccccttgtgctttgatgacca

SEQ ID NO: 254390 - DNA, 25 bp, Mus musculus
ccttccccttgtgctttggtctcct

SEQ ID NO: 254391 - DNA, 25 bp, Mus musculus
ccttcccgagggcgctgtgaggtta

SEQ ID NO: 254392 - DNA, 25 bp, Mus musculus
ccttcccgccgcggaggagaatggc

SEQ ID NO: 254393 - DNA, 25 bp, Mus musculus
ccttcccgctggctgtaattcaaaa

SEQ ID NO: 254394 - DNA, 25 bp, Mus musculus
ccttccctcaggacatcaatgcaag

SEQ ID NO: 254395 - DNA, 25 bp, Mus musculus
ccttccctcaggtgtcagatcccct

SEQ ID NO: 254396 - DNA, 25 bp, Mus musculus
ccttccctgaaacccaaatatgcca

SEQ ID NO: 254397 - DNA, 25 bp, Mus musculus
ccttccctgagcatagtaacattcc

SEQ ID NO: 254398 - DNA, 25 bp, Mus musculus
ccttccctgatgcgagagaacaaga

SEQ ID NO: 254399 - DNA, 25 bp, Mus musculus
ccttccctgcttcagcaagcttccc

SEQ ID NO: 254400 - DNA, 25 bp, Mus musculus
ccttccctggcacagcaagcttccc

SEQ ID NO: 254401 - DNA, 25 bp, Mus musculus
ccttccctggcactgcaagtttccc

SEQ ID NO: 254402 - DNA, 25 bp, Mus musculus
ccttccctggtacagcaaccttcca

SEQ ID NO: 254403 - DNA, 25 bp, Mus musculus
ccttccctggtacagcaagcttccc

SEQ ID NO: 254404 - DNA, 25 bp, Mus musculus
ccttcccttacatgaagtcgatggc

SEQ ID NO: 254405 - DNA, 25 bp, Mus musculus
ccttcccttggtatgtctacgttgc

SEQ ID NO: 254406 - DNA, 25 bp, Mus musculus
ccttccgacaagagcctgaaacctg

SEQ ID NO: 254407 - DNA, 25 bp, Mus musculus
ccttccgacaagaggactactgcct

SEQ ID NO: 254408 - DNA, 25 bp, Mus musculus
ccttccgacccctacttcagcaccc

SEQ ID NO: 254409 - DNA, 25 bp, Mus musculus
ccttccgccaaatggactggaactt

SEQ ID NO: 254410 - DNA, 25 bp, Mus musculus
ccttccgccagtttcgtgatcctga

SEQ ID NO: 254411 - DNA, 25 bp, Mus musculus
ccttccgcctggggtgactgtccca

SEQ ID NO: 254412 - DNA, 25 bp, Mus musculus
ccttccgcgggacggatttgatcta

SEQ ID NO: 254413 - DNA, 25 bp, Mus musculus
ccttccgcgggacggggagaaagag

SEQ ID NO: 254414 - DNA, 25 bp, Mus musculus
ccttccggaatttggaactcagggc

SEQ ID NO: 254415 - DNA, 25 bp, Mus musculus
ccttccggaatttgggctctggacc

SEQ ID NO: 254416 - DNA, 25 bp, Mus musculus
ccttccggcacaattgccaaaatca

SEQ ID NO: 254417 - DNA, 25 bp, Mus musculus
ccttccggcaggcagttcctccatc

SEQ ID NO: 254418 - DNA, 25 bp, Mus musculus
ccttccggctggccacccccatcag

SEQ ID NO: 254419 - DNA, 25 bp, Mus musculus
ccttccgggctccctggtcctgagg

SEQ ID NO: 254420 - DNA, 25 bp, Mus musculus
ccttccgtctatagccaagcagaag

SEQ ID NO: 254421 - DNA, 25 bp, Mus musculus
ccttccgtctataggcggaacatgt

SEQ ID NO: 254422 - DNA, 25 bp, Mus musculus
ccttccgtgagaagtttatgcagca

SEQ ID NO: 254423 - DNA, 25 bp, Mus musculus
ccttccgttcagcggacgccgcggg

SEQ ID NO: 254424 - DNA, 25 bp, Mus musculus
ccttcctactactgctcccagggct

SEQ ID NO: 254425 - DNA, 25 bp, Mus musculus
ccttcctatgggctggtggaatatg

SEQ ID NO: 254426 - DNA, 25 bp, Mus musculus
ccttcctatgtagcactcagcatgg

SEQ ID NO: 254427 - DNA, 25 bp, Mus musculus
ccttcctcaacagtgtctacattgg

SEQ ID NO: 254428 - DNA, 25 bp, Mus musculus
ccttcctcaagcagtataattcgtt

SEQ ID NO: 254429 - DNA, 25 bp, Mus musculus
ccttcctcaatcacctctcccagta

SEQ ID NO: 254430 - DNA, 25 bp, Mus musculus
ccttcctcaatcacttatcacagtt

SEQ ID NO: 254431 - DNA, 25 bp, Mus musculus
ccttcctcacagaaaataaagcagt

SEQ ID NO: 254432 - DNA, 25 bp, Mus musculus
ccttcctcagcccaggtcctgagga

SEQ ID NO: 254433 - DNA, 25 bp, Mus musculus
ccttcctcagcgagctggagccccc

SEQ ID NO: 254434 - DNA, 25 bp, Mus musculus
ccttcctcagctactgtgactacta

SEQ ID NO: 254435 - DNA, 25 bp, Mus musculus
ccttcctcagtaatgaccaattctc

SEQ ID NO: 254436 - DNA, 25 bp, Mus musculus
ccttcctcataaattccacatgaga

SEQ ID NO: 254437 - DNA, 25 bp, Mus musculus
ccttcctccaggagccggccacccc

SEQ ID NO: 254438 - DNA, 25 bp, Mus musculus
ccttcctcccctgctacaaaaaatt

SEQ ID NO: 254439 - DNA, 25 bp, Mus musculus
ccttcctccgatggctacagatgtc

SEQ ID NO: 254440 - DNA, 25 bp, Mus musculus
ccttcctcctaaggcgcctgtgtct

SEQ ID NO: 254441 - DNA, 25 bp, Mus musculus
ccttcctcctgccaggccaaaagca

SEQ ID NO: 254442 - DNA, 25 bp, Mus musculus
ccttcctcctggcaggccaaaagca

SEQ ID NO: 254443 - DNA, 25 bp, Mus musculus
ccttcctcgaaggtcctggccacac

SEQ ID NO: 254444 - DNA, 25 bp, Mus musculus
ccttcctctttaaaggattggtgac

SEQ ID NO: 254445 - DNA, 25 bp, Mus musculus
ccttcctgaccaagagtggcaacag

SEQ ID NO: 254446 - DNA, 25 bp, Mus musculus
ccttcctgagatactgcagcctctg

SEQ ID NO: 254447 - DNA, 25 bp, Mus musculus
ccttcctgagtgagctcattgccca

SEQ ID NO: 254448 - DNA, 25 bp, Mus musculus
ccttcctgccccttccatcaagatt

SEQ ID NO: 254449 - DNA, 25 bp, Mus musculus
ccttcctgctggccggcattgaatg

SEQ ID NO: 254450 - DNA, 25 bp, Mus musculus
ccttcctgctggtgtcagtgtctga

SEQ ID NO: 254451 - DNA, 25 bp, Mus musculus
ccttcctggagcatgcagacggagg

SEQ ID NO: 254452 - DNA, 25 bp, Mus musculus
ccttcctggcagcagacttttcaca

SEQ ID NO: 254453 - DNA, 25 bp, Mus musculus
ccttcctgggtgatgttttcagctt

SEQ ID NO: 254454 - DNA, 25 bp, Mus musculus
ccttcctggtgctacctttttttga

SEQ ID NO: 254455 - DNA, 25 bp, Mus musculus
ccttcctggtgctagcacaggttag

SEQ ID NO: 254456 - DNA, 25 bp, Mus musculus
ccttcctggtgctagctggtgaaga

SEQ ID NO: 254457 - DNA, 25 bp, Mus musculus
ccttcctggtgctaggagtggcctg

SEQ ID NO: 254458 - DNA, 25 bp, Mus musculus
ccttcctgtcagggattgtgccatc

SEQ ID NO: 254459 - DNA, 25 bp, Mus musculus
ccttcctgtcagtgctctggatgtt

SEQ ID NO: 254460 - DNA, 25 bp, Mus musculus
ccttcctgtcgatccccagcctcag

SEQ ID NO: 254461 - DNA, 25 bp, Mus musculus
ccttcctgtgccccacagattaccg

SEQ ID NO: 254462 - DNA, 25 bp, Mus musculus
ccttcctgtgtgccctgctttcccc

SEQ ID NO: 254463 - DNA, 25 bp, Mus musculus
ccttcctgtgtggaacaacgaagcc

SEQ ID NO: 254464 - DNA, 25 bp, Mus musculus
ccttcctgttggcaaccgtgtcttc

SEQ ID NO: 254465 - DNA, 25 bp, Mus musculus
ccttcctgttgggcatctcctatgt

SEQ ID NO: 254466 - DNA, 25 bp, Mus musculus
ccttccttacagccctcaagtatgc

SEQ ID NO: 254467 - DNA, 25 bp, Mus musculus
ccttccttatcagaggtcgactcat

SEQ ID NO: 254468 - DNA, 25 bp, Mus musculus
ccttccttatcaggaactcaataaa

SEQ ID NO: 254469 - DNA, 25 bp, Mus musculus
ccttccttatcagtgtagcccagtg

SEQ ID NO: 254470 - DNA, 25 bp, Mus musculus
ccttccttcagaagagttcgctccg

SEQ ID NO: 254471 - DNA, 25 bp, Mus musculus
ccttccttggcggcagaacccgggg

SEQ ID NO: 254472 - DNA, 25 bp, Mus musculus
ccttccttgttcatagggcggcggg

SEQ ID NO: 254473 - DNA, 25 bp, Mus musculus
ccttccttgttcatccgaacaaaaa

SEQ ID NO: 254474 - DNA, 25 bp, Mus musculus
ccttcctttcttaccctcagctgga

SEQ ID NO: 254475 - DNA, 25 bp, Mus musculus
ccttcctttgaggagagtactaaat

SEQ ID NO: 254476 - DNA, 25 bp, Mus musculus
ccttccttttgggcagcaaggcgaa

SEQ ID NO: 254477 - DNA, 25 bp, Mus musculus
ccttccttttgtgagatttttttga

SEQ ID NO: 254478 - DNA, 25 bp, Mus musculus
ccttccttttgttttcagctttgtg

SEQ ID NO: 254479 - DNA, 25 bp, Mus musculus
ccttcgagaaatgagtcctctctgg

SEQ ID NO: 254480 - DNA, 25 bp, Mus musculus
ccttcgagaagcctggaaaggaaat

SEQ ID NO: 254481 - DNA, 25 bp, Mus musculus
ccttcgagaggtgctgagcttgtga

SEQ ID NO: 254482 - DNA, 25 bp, Mus musculus
ccttcgagcacatgcccttaggccc

SEQ ID NO: 254483 - DNA, 25 bp, Mus musculus
ccttcgagcacatgggagtgttgtg

SEQ ID NO: 254484 - DNA, 25 bp, Mus musculus
ccttcgaggcgtggtgcaagatttg

SEQ ID NO: 254485 - DNA, 25 bp, Mus musculus
ccttcgataccgacatccatgctgt

SEQ ID NO: 254486 - DNA, 25 bp, Mus musculus
ccttcgccacagaaatggcctccac

SEQ ID NO: 254487 - DNA, 25 bp, Mus musculus
ccttcgccagttctcaggccgcctg

SEQ ID NO: 254488 - DNA, 25 bp, Mus musculus
ccttcgccatgtccttatgtgggaa

SEQ ID NO: 254489 - DNA, 25 bp, Mus musculus
ccttcgcctcagaggtcgagcccag

SEQ ID NO: 254490 - DNA, 25 bp, Mus musculus
ccttcgcctcagaggtggcatgcag

SEQ ID NO: 254491 - DNA, 25 bp, Mus musculus
ccttcgcctctacctaacaccccaa

SEQ ID NO: 254492 - DNA, 25 bp, Mus musculus
ccttcgcctctacctctttctagta

SEQ ID NO: 254493 - DNA, 25 bp, Mus musculus
ccttcgcctgtggaggcgcagcccg

SEQ ID NO: 254494 - DNA, 25 bp, Mus musculus
ccttcgcctgtggtgaagaagttgc

SEQ ID NO: 254495 - DNA, 25 bp, Mus musculus
ccttcgcgaggtggtggctgagccg

SEQ ID NO: 254496 - DNA, 25 bp, Mus musculus
ccttcgcgccgacgaaatggctacc

SEQ ID NO: 254497 - DNA, 25 bp, Mus musculus
ccttcgcggcgggataaataaggaa

SEQ ID NO: 254498 - DNA, 25 bp, Mus musculus
ccttcgcggcgggcaaatgaccatg

SEQ ID NO: 254499 - DNA, 25 bp, Mus musculus
ccttcgcgtcacggtcttgttgcag

SEQ ID NO: 254500 - DNA, 25 bp, Mus musculus
ccttcgctaggtatatatggtctgg

SEQ ID NO: 254501 - DNA, 25 bp, Mus musculus
ccttcggaggagccagttcttgcct

SEQ ID NO: 254502 - DNA, 25 bp, Mus musculus
ccttcggcaaggtcggaacctggcg

SEQ ID NO: 254503 - DNA, 25 bp, Mus musculus
ccttcggccttgtggtaccaatggg

SEQ ID NO: 254504 - DNA, 25 bp, Mus musculus
ccttcggctccagaccaaagattca

SEQ ID NO: 254505 - DNA, 25 bp, Mus musculus
ccttcggctccaggccaactggaat

SEQ ID NO: 254506 - DNA, 25 bp, Mus musculus
ccttcgggaatctgggtggtactgg

SEQ ID NO: 254507 - DNA, 25 bp, Mus musculus
ccttcgggagacaaatgtgcgctac

SEQ ID NO: 254508 - DNA, 25 bp, Mus musculus
ccttcgggagactagcgtggcgact

SEQ ID NO: 254509 - DNA, 25 bp, Mus musculus
ccttcgggagactaggtcacgagcc

SEQ ID NO: 254510 - DNA, 25 bp, Mus musculus
ccttcgggagccatcaagagtttgg

SEQ ID NO: 254511 - DNA, 25 bp, Mus musculus
ccttcgggcagaagctgcgagacgc

SEQ ID NO: 254512 - DNA, 25 bp, Mus musculus
ccttcggtgacatgaccaatgagga

SEQ ID NO: 254513 - DNA, 25 bp, Mus musculus
ccttcggtgttggtctggtcagcta

SEQ ID NO: 254514 - DNA, 25 bp, Mus musculus
ccttcgtctccgggctggtttgata

SEQ ID NO: 254515 - DNA, 25 bp, Mus musculus
ccttcgtctctcaggtgccgcacca

SEQ ID NO: 254516 - DNA, 25 bp, Mus musculus
ccttcgtggcagatctgattgcctt

SEQ ID NO: 254517 - DNA, 25 bp, Mus musculus
ccttcgtggcaggttgttcctacat

SEQ ID NO: 254518 - DNA, 25 bp, Mus musculus
ccttcgtgttcactttagaacaccc

SEQ ID NO: 254519 - DNA, 25 bp, Mus musculus
ccttcgttgccaggagatggcctga

SEQ ID NO: 254520 - DNA, 25 bp, Mus musculus
ccttctaacagtgctgctgaagctc

SEQ ID NO: 254521 - DNA, 25 bp, Mus musculus
ccttctaagattggtgtcccttttc

SEQ ID NO: 254522 - DNA, 25 bp, Mus musculus
ccttctaagttggatcagtgatgat

SEQ ID NO: 254523 - DNA, 25 bp, Mus musculus
ccttctaatcccaagcacggtagat

SEQ ID NO: 254524 - DNA, 25 bp, Mus musculus
ccttctacagaaaaccgtcaaggaa

SEQ ID NO: 254525 - DNA, 25 bp, Mus musculus
ccttctacagagccttggggattca

SEQ ID NO: 254526 - DNA, 25 bp, Mus musculus
ccttctacagtgctcctttgtcctc

SEQ ID NO: 254527 - DNA, 25 bp, Mus musculus
ccttctacatcctggtgtttgtggt

SEQ ID NO: 254528 - DNA, 25 bp, Mus musculus
ccttctaccggtttcagacacccta

SEQ ID NO: 254529 - DNA, 25 bp, Mus musculus
ccttctacgtggcagatggcagcct

SEQ ID NO: 254530 - DNA, 25 bp, Mus musculus
ccttctagaagctcttctgtgccaa

SEQ ID NO: 254531 - DNA, 25 bp, Mus musculus
ccttctagacaaggcaggttcaccg

SEQ ID NO: 254532 - DNA, 25 bp, Mus musculus
ccttctagacacagggcccatcatg

SEQ ID NO: 254533 - DNA, 25 bp, Mus musculus
ccttctagacacccaggacatggag

SEQ ID NO: 254534 - DNA, 25 bp, Mus musculus
ccttctagcaggcctgcctactttg

SEQ ID NO: 254535 - DNA, 25 bp, Mus musculus
ccttctagccagctgcagacggagc

SEQ ID NO: 254536 - DNA, 25 bp, Mus musculus
ccttctatagcccgtgtgattgatg

SEQ ID NO: 254537 - DNA, 25 bp, Mus musculus
ccttctataggcctctgctcgatga

SEQ ID NO: 254538 - DNA, 25 bp, Mus musculus
ccttctatagtgagattatatagta

SEQ ID NO: 254539 - DNA, 25 bp, Mus musculus
ccttctatgagaaagtccctccagg

SEQ ID NO: 254540 - DNA, 25 bp, Mus musculus
ccttctatgtcatggtggggttttt

SEQ ID NO: 254541 - DNA, 25 bp, Mus musculus
ccttctcaaggcaggttgtaaaagt

SEQ ID NO: 254542 - DNA, 25 bp, Mus musculus
ccttctcagagagacctgcttctgg

SEQ ID NO: 254543 - DNA, 25 bp, Mus musculus
ccttctcaggaagtaaaccaggttc

SEQ ID NO: 254544 - DNA, 25 bp, Mus musculus
ccttctcaggaagttctgatccaga

SEQ ID NO: 254545 - DNA, 25 bp, Mus musculus
ccttctcatcttgagaacccagcag

SEQ ID NO: 254546 - DNA, 25 bp, Mus musculus
ccttctccaaattatgtgccaccaa

SEQ ID NO: 254547 - DNA, 25 bp, Mus musculus
ccttctccaagtatgaaggaggagt

SEQ ID NO: 254548 - DNA, 25 bp, Mus musculus
ccttctccacccggacagagtcctt

SEQ ID NO: 254549 - DNA, 25 bp, Mus musculus
ccttctccactacctcctccacctc

SEQ ID NO: 254550 - DNA, 25 bp, Mus musculus
ccttctccacttcaggtactaaaca

SEQ ID NO: 254551 - DNA, 25 bp, Mus musculus
ccttctccagattatctgcaatgct

SEQ ID NO: 254552 - DNA, 25 bp, Mus musculus
ccttctccagcagcaagagccagag

SEQ ID NO: 254553 - DNA, 25 bp, Mus musculus
ccttctccagcaggacccaacctcc

SEQ ID NO: 254554 - DNA, 25 bp, Mus musculus
ccttctcccagaggaactctgtgcc

SEQ ID NO: 254555 - DNA, 25 bp, Mus musculus
ccttctcccaggaagtgatcccaac

SEQ ID NO: 254556 - DNA, 25 bp, Mus musculus
ccttctccggctggcccaccttggg

SEQ ID NO: 254557 - DNA, 25 bp, Mus musculus
ccttctcctgaaacactgtgcccca

SEQ ID NO: 254558 - DNA, 25 bp, Mus musculus
ccttctcctgaaatgcctaacatac

SEQ ID NO: 254559 - DNA, 25 bp, Mus musculus
ccttctcctgtcaggccagatttgg

SEQ ID NO: 254560 - DNA, 25 bp, Mus musculus
ccttctcgtgggctgtgccggcatt

SEQ ID NO: 254561 - DNA, 25 bp, Mus musculus
ccttctctagcacaggttggtctgg

SEQ ID NO: 254562 - DNA, 25 bp, Mus musculus
ccttctctaggaacaatgtgttcta

SEQ ID NO: 254563 - DNA, 25 bp, Mus musculus
ccttctctcgtcaagtgagccccag

SEQ ID NO: 254564 - DNA, 25 bp, Mus musculus
ccttctctctccagtacccccactt

SEQ ID NO: 254565 - DNA, 25 bp, Mus musculus
ccttctctctgaaggtgttcctcat

SEQ ID NO: 254566 - DNA, 25 bp, Mus musculus
ccttctctctgtctggtatctatcc

SEQ ID NO: 254567 - DNA, 25 bp, Mus musculus
ccttctcttgttaggttcacctgga

SEQ ID NO: 254568 - DNA, 25 bp, Mus musculus
ccttctgaaagacccggccatgctc

SEQ ID NO: 254569 - DNA, 25 bp, Mus musculus
ccttctgaagattccgagaggcaaa

SEQ ID NO: 254570 - DNA, 25 bp, Mus musculus
ccttctgagatagcaagcagattgg

SEQ ID NO: 254571 - DNA, 25 bp, Mus musculus
ccttctgaggaagcactggattgcc

SEQ ID NO: 254572 - DNA, 25 bp, Mus musculus
ccttctgaggaaggtattcggcacc

SEQ ID NO: 254573 - DNA, 25 bp, Mus musculus
ccttctgagtaaaggtgaacatcag

SEQ ID NO: 254574 - DNA, 25 bp, Mus musculus
ccttctgagtaaaggtgaacgacga

SEQ ID NO: 254575 - DNA, 25 bp, Mus musculus
ccttctgagtggagagggcgaggcc

SEQ ID NO: 254576 - DNA, 25 bp, Mus musculus
ccttctgagttaatatgacagatac

SEQ ID NO: 254577 - DNA, 25 bp, Mus musculus
ccttctgagttattgcggaagcaga

SEQ ID NO: 254578 - DNA, 25 bp, Mus musculus
ccttctgagttgtagttagcgcctt

SEQ ID NO: 254579 - DNA, 25 bp, Mus musculus
ccttctgagttttcctcttgctcct

SEQ ID NO: 254580 - DNA, 25 bp, Mus musculus
ccttctgataatagtgttatccaag

SEQ ID NO: 254581 - DNA, 25 bp, Mus musculus
ccttctgcaagaaggagatctggaa

SEQ ID NO: 254582 - DNA, 25 bp, Mus musculus
ccttctgcagcaaatctcccggaaa

SEQ ID NO: 254583 - DNA, 25 bp, Mus musculus
ccttctgcctgacaaattgacatca

SEQ ID NO: 254584 - DNA, 25 bp, Mus musculus
ccttctgcctgacaattggcagctt

SEQ ID NO: 254585 - DNA, 25 bp, Mus musculus
ccttctgcggaatggggtgagtgag

SEQ ID NO: 254586 - DNA, 25 bp, Mus musculus
ccttctgcggagaacgttttagagg

SEQ ID NO: 254587 - DNA, 25 bp, Mus musculus
ccttctggagcacatcttatactgc

SEQ ID NO: 254588 - DNA, 25 bp, Mus musculus
ccttctggattcttggcgcccgtgt

SEQ ID NO: 254589 - DNA, 25 bp, Mus musculus
ccttctggcagggtccctgcatgtg

SEQ ID NO: 254590 - DNA, 25 bp, Mus musculus
ccttctggccctagaggtccacctg

SEQ ID NO: 254591 - DNA, 25 bp, Mus musculus
ccttctggcttctggctccaggccg

SEQ ID NO: 254592 - DNA, 25 bp, Mus musculus
ccttctgggataaaaagaagcaagg

SEQ ID NO: 254593 - DNA, 25 bp, Mus musculus
ccttctggtcagtgttcacaccgcg

SEQ ID NO: 254594 - DNA, 25 bp, Mus musculus
ccttctggtgccagctctaggaatg

SEQ ID NO: 254595 - DNA, 25 bp, Mus musculus
ccttctggttctggctgatctcttc

SEQ ID NO: 254596 - DNA, 25 bp, Mus musculus
ccttctgtaggtgtgctgatgatga

SEQ ID NO: 254597 - DNA, 25 bp, Mus musculus
ccttctgtcagacatgtgtaattat

SEQ ID NO: 254598 - DNA, 25 bp, Mus musculus
ccttctgtcagctggcatgtggcca

SEQ ID NO: 254599 - DNA, 25 bp, Mus musculus
ccttctgtcaggtccccctggccgc

SEQ ID NO: 254600 - DNA, 25 bp, Mus musculus
ccttctgtcaggtgagcgtcctcac

SEQ ID NO: 254601 - DNA, 25 bp, Mus musculus
ccttctgtccctcccctttctccct

SEQ ID NO: 254602 - DNA, 25 bp, Mus musculus
ccttctgtggagcggatgtgggtgg

SEQ ID NO: 254603 - DNA, 25 bp, Mus musculus
ccttctgttgccttgaagtttgcag

SEQ ID NO: 254604 - DNA, 25 bp, Mus musculus
ccttcttaacaaggcacctaattac

SEQ ID NO: 254605 - DNA, 25 bp, Mus musculus
ccttcttaacaaggtgcagatcact

SEQ ID NO: 254606 - DNA, 25 bp, Mus musculus
ccttcttactgtgtcctactgaaac

SEQ ID NO: 254607 - DNA, 25 bp, Mus musculus
ccttcttagagagcttcctgccagc

SEQ ID NO: 254608 - DNA, 25 bp, Mus musculus
ccttcttattgtcgctctattctct

SEQ ID NO: 254609 - DNA, 25 bp, Mus musculus
ccttcttattgtcggttggtgatga

SEQ ID NO: 254610 - DNA, 25 bp, Mus musculus
ccttcttcacctgggtgctacagaa

SEQ ID NO: 254611 - DNA, 25 bp, Mus musculus
ccttcttcccacaatattctggata

SEQ ID NO: 254612 - DNA, 25 bp, Mus musculus
ccttcttcccacactcaccgagctc

SEQ ID NO: 254613 - DNA, 25 bp, Mus musculus
ccttcttccttcaggtccttcattt

SEQ ID NO: 254614 - DNA, 25 bp, Mus musculus
ccttcttcgcagaatacaaacagct

SEQ ID NO: 254615 - DNA, 25 bp, Mus musculus
ccttcttcgctgattcttttcttgc

SEQ ID NO: 254616 - DNA, 25 bp, Mus musculus
ccttcttctatccagggatgaactc

SEQ ID NO: 254617 - DNA, 25 bp, Mus musculus
ccttcttctatccagggcccattgt

SEQ ID NO: 254618 - DNA, 25 bp, Mus musculus
ccttcttctgggagaagtttgaaag

SEQ ID NO: 254619 - DNA, 25 bp, Mus musculus
ccttcttcttatagcaggttcttgt

SEQ ID NO: 254620 - DNA, 25 bp, Mus musculus
ccttcttcttcaggcaacagacttt

SEQ ID NO: 254621 - DNA, 25 bp, Mus musculus
ccttcttcttcaggttgccagtcac

SEQ ID NO: 254622 - DNA, 25 bp, Mus musculus
ccttcttgaaccaccaggcctcagc

SEQ ID NO: 254623 - DNA, 25 bp, Mus musculus
ccttcttgagctgaaaattgagaag

SEQ ID NO: 254624 - DNA, 25 bp, Mus musculus
ccttcttgagggccttcttgaagta

SEQ ID NO: 254625 - DNA, 25 bp, Mus musculus
ccttcttgcagcaggtctgctttgc

SEQ ID NO: 254626 - DNA, 25 bp, Mus musculus
ccttcttggagaggtaaccccaggt

SEQ ID NO: 254627 - DNA, 25 bp, Mus musculus
ccttcttgtggccctattgtgtgcc

SEQ ID NO: 254628 - DNA, 25 bp, Mus musculus
ccttctttaagaagacagagcacac

SEQ ID NO: 254629 - DNA, 25 bp, Mus musculus
ccttctttaagagaagaatgtggcc

SEQ ID NO: 254630 - DNA, 25 bp, Mus musculus
ccttctttcaggaaatgctgtcatt

SEQ ID NO: 254631 - DNA, 25 bp, Mus musculus
ccttctttctgcccttgcagaactg

SEQ ID NO: 254632 - DNA, 25 bp, Mus musculus
ccttctttgaaagacactacgcaca

SEQ ID NO: 254633 - DNA, 25 bp, Mus musculus
ccttctttgatgtgaagacaacacg

SEQ ID NO: 254634 - DNA, 25 bp, Mus musculus
ccttctttggggttccttgtggaga

SEQ ID NO: 254635 - DNA, 25 bp, Mus musculus
ccttcttttgcttctgcagtgagag

SEQ ID NO: 254636 - DNA, 25 bp, Mus musculus
ccttcttttggcgtgcccacacttt

SEQ ID NO: 254637 - DNA, 25 bp, Mus musculus
ccttgaaaacaaaacagaccagaac

SEQ ID NO: 254638 - DNA, 25 bp, Mus musculus
ccttgaaaacaaaacgaaccagctg

SEQ ID NO: 254639 - DNA, 25 bp, Mus musculus
ccttgaaaaccagatacaatggaga

SEQ ID NO: 254640 - DNA, 25 bp, Mus musculus
ccttgaaaagatgaatgagaacagc

SEQ ID NO: 254641 - DNA, 25 bp, Mus musculus
ccttgaaaagattggccacctgctt

SEQ ID NO: 254642 - DNA, 25 bp, Mus musculus
ccttgaaaaggtagacccacaactt

SEQ ID NO: 254643 - DNA, 25 bp, Mus musculus
ccttgaaaatcttagattttgtcca

SEQ ID NO: 254644 - DNA, 25 bp, Mus musculus
ccttgaaaatcttagcaaagagatg

SEQ ID NO: 254645 - DNA, 25 bp, Mus musculus
ccttgaaagcagccgctaacgtcct

SEQ ID NO: 254646 - DNA, 25 bp, Mus musculus
ccttgaaccagaatgtctgtaaggc

SEQ ID NO: 254647 - DNA, 25 bp, Mus musculus
ccttgaagaggagcagacagatctt

SEQ ID NO: 254648 - DNA, 25 bp, Mus musculus
ccttgaagaggatcccagtcctcct

SEQ ID NO: 254649 - DNA, 25 bp, Mus musculus
ccttgaagaggttgcccacggaccc

SEQ ID NO: 254650 - DNA, 25 bp, Mus musculus
ccttgaagcactgagccctccagag

SEQ ID NO: 254651 - DNA, 25 bp, Mus musculus
ccttgaagcactgagccctccccac

SEQ ID NO: 254652 - DNA, 25 bp, Mus musculus
ccttgaaggacgggcagtaccaggc

SEQ ID NO: 254653 - DNA, 25 bp, Mus musculus
ccttgaaggacgggctctccctacg

SEQ ID NO: 254654 - DNA, 25 bp, Mus musculus
ccttgaaggacgggggatggtggac

SEQ ID NO: 254655 - DNA, 25 bp, Mus musculus
ccttgacaatatcaacatgacacac

SEQ ID NO: 254656 - DNA, 25 bp, Mus musculus
ccttgacacactgcagcgtgctctg

SEQ ID NO: 254657 - DNA, 25 bp, Mus musculus
ccttgacaccagggtggacccagtg

SEQ ID NO: 254658 - DNA, 25 bp, Mus musculus
ccttgaccagctcttcattgggacc

SEQ ID NO: 254659 - DNA, 25 bp, Mus musculus
ccttgaccatcaggactcttccccc

SEQ ID NO: 254660 - DNA, 25 bp, Mus musculus
ccttgacccttcctgaaggagcaga

SEQ ID NO: 254661 - DNA, 25 bp, Mus musculus
ccttgacctaccggttcttcagcga

SEQ ID NO: 254662 - DNA, 25 bp, Mus musculus
ccttgacctgttgaggagacttctg

SEQ ID NO: 254663 - DNA, 25 bp, Mus musculus
ccttgacgagatgctgttggctgct

SEQ ID NO: 254664 - DNA, 25 bp, Mus musculus
ccttgacgaggggatgagagagtcc

SEQ ID NO: 254665 - DNA, 25 bp, Mus musculus
ccttgacgtcccacacttgcatggg

SEQ ID NO: 254666 - DNA, 25 bp, Mus musculus
ccttgacgtctaagattcctgctct

SEQ ID NO: 254667 - DNA, 25 bp, Mus musculus
ccttgactcactgattcatctgaaa

SEQ ID NO: 254668 - DNA, 25 bp, Mus musculus
ccttgactcagtacgtcaagtggac

SEQ ID NO: 254669 - DNA, 25 bp, Mus musculus
ccttgactctcggtgtcctccacca

SEQ ID NO: 254670 - DNA, 25 bp, Mus musculus
ccttgactggtacagacttacgttc

SEQ ID NO: 254671 - DNA, 25 bp, Mus musculus
ccttgacttggcggccatcgagtaa

SEQ ID NO: 254672 - DNA, 25 bp, Mus musculus
ccttgactttgaaggttgtcttgac

SEQ ID NO: 254673 - DNA, 25 bp, Mus musculus
ccttgagacaccgagagtgtgggtt

SEQ ID NO: 254674 - DNA, 25 bp, Mus musculus
ccttgagagcaggtttaaacgcatc

SEQ ID NO: 254675 - DNA, 25 bp, Mus musculus
ccttgagagtctatcaccactactt

SEQ ID NO: 254676 - DNA, 25 bp, Mus musculus
ccttgagcagcccaaagaagtgcag

SEQ ID NO: 254677 - DNA, 25 bp, Mus musculus
ccttgagcaggaggcttctcagaca

SEQ ID NO: 254678 - DNA, 25 bp, Mus musculus
ccttgagcatgatgttgccatccca

SEQ ID NO: 254679 - DNA, 25 bp, Mus musculus
ccttgagcatgcaccagccacaacg

SEQ ID NO: 254680 - DNA, 25 bp, Mus musculus
ccttgagccaaagccctgttttcta

SEQ ID NO: 254681 - DNA, 25 bp, Mus musculus
ccttgagccataatgaagagtcttt

SEQ ID NO: 254682 - DNA, 25 bp, Mus musculus
ccttgaggcagctggaagctggcca

SEQ ID NO: 254683 - DNA, 25 bp, Mus musculus
ccttgaggcaggtgcaagctggcca

SEQ ID NO: 254684 - DNA, 25 bp, Mus musculus
ccttgagggatgctgactgtgcacc

SEQ ID NO: 254685 - DNA, 25 bp, Mus musculus
ccttgagtcgatgtgcctgagacgt

SEQ ID NO: 254686 - DNA, 25 bp, Mus musculus
ccttgagtgagcataatgaagctga

SEQ ID NO: 254687 - DNA, 25 bp, Mus musculus
ccttgagtgaggcatttcatgagga

SEQ ID NO: 254688 - DNA, 25 bp, Mus musculus
ccttgagtggggactgtcagggcag

SEQ ID NO: 254689 - DNA, 25 bp, Mus musculus
ccttgataagctcgttggcgagttc

SEQ ID NO: 254690 - DNA, 25 bp, Mus musculus
ccttgatacgtttggaaagctggtc

SEQ ID NO: 254691 - DNA, 25 bp, Mus musculus
ccttgatacgtttggaaatgttcct

SEQ ID NO: 254692 - DNA, 25 bp, Mus musculus
ccttgatatgtcgaccggaagaaag

SEQ ID NO: 254693 - DNA, 25 bp, Mus musculus
ccttgatcagagtattgttacagtc

SEQ ID NO: 254694 - DNA, 25 bp, Mus musculus
ccttgatcaggatcttcccaacaac

SEQ ID NO: 254695 - DNA, 25 bp, Mus musculus
ccttgatctcagatctgcagactct

SEQ ID NO: 254696 - DNA, 25 bp, Mus musculus
ccttgatctcaggtgattactgacg

SEQ ID NO: 254697 - DNA, 25 bp, Mus musculus
ccttgatggatatagacaacagaaa

SEQ ID NO: 254698 - DNA, 25 bp, Mus musculus
ccttgatggcaagtatgtctatata

SEQ ID NO: 254699 - DNA, 25 bp, Mus musculus
ccttgatgtcggtggcgcccagggg

SEQ ID NO: 254700 - DNA, 25 bp, Mus musculus
ccttgatgtgagccatgagcctcat

SEQ ID NO: 254701 - DNA, 25 bp, Mus musculus
ccttgattgccagaggcatgaatcc

SEQ ID NO: 254702 - DNA, 25 bp, Mus musculus
ccttgatttgaaggagccaagcaat

SEQ ID NO: 254703 - DNA, 25 bp, Mus musculus
ccttgcaaagaatccaaaacctgtg

SEQ ID NO: 254704 - DNA, 25 bp, Mus musculus
ccttgcaaaggagtggccgtccacc

SEQ ID NO: 254705 - DNA, 25 bp, Mus musculus
ccttgcaaagtgcaatacgaggatt

SEQ ID NO: 254706 - DNA, 25 bp, Mus musculus
ccttgcaaagtgccacagttgaggc

SEQ ID NO: 254707 - DNA, 25 bp, Mus musculus
ccttgcaacactctgggttatgaca

SEQ ID NO: 254708 - DNA, 25 bp, Mus musculus
ccttgcaagatgaggagcctcagag

SEQ ID NO: 254709 - DNA, 25 bp, Mus musculus
ccttgcaagatgaggcagagaaggt

SEQ ID NO: 254710 - DNA, 25 bp, Mus musculus
ccttgcaccaagaagttaagtgtta

SEQ ID NO: 254711 - DNA, 25 bp, Mus musculus
ccttgcagaaaaaaagatgcaggag

SEQ ID NO: 254712 - DNA, 25 bp, Mus musculus
ccttgcagaaagcaggccgtctact

SEQ ID NO: 254713 - DNA, 25 bp, Mus musculus
ccttgcagaaagcagggctgactgt

SEQ ID NO: 254714 - DNA, 25 bp, Mus musculus
ccttgcagagacattttgagcagca

SEQ ID NO: 254715 - DNA, 25 bp, Mus musculus
ccttgcagagcatggtctagtctcc

SEQ ID NO: 254716 - DNA, 25 bp, Mus musculus
ccttgcagatgatgggagaattctg

SEQ ID NO: 254717 - DNA, 25 bp, Mus musculus
ccttgcagatgatgggtgcagtttg

SEQ ID NO: 254718 - DNA, 25 bp, Mus musculus
ccttgcagcatgagttcaaagaagc

SEQ ID NO: 254719 - DNA, 25 bp, Mus musculus
ccttgcagcatggctgaccaactga

SEQ ID NO: 254720 - DNA, 25 bp, Mus musculus
ccttgcagccactgcaagaaaaatg

SEQ ID NO: 254721 - DNA, 25 bp, Mus musculus
ccttgcagccagacgttaggggata

SEQ ID NO: 254722 - DNA, 25 bp, Mus musculus
ccttgcaggaaaagagttcctggtc

SEQ ID NO: 254723 - DNA, 25 bp, Mus musculus
ccttgcagtaagcagcttaacagga

SEQ ID NO: 254724 - DNA, 25 bp, Mus musculus
ccttgcatccagggatgcaggcagc

SEQ ID NO: 254725 - DNA, 25 bp, Mus musculus
ccttgcatccagggatgttaatttt

SEQ ID NO: 254726 - DNA, 25 bp, Mus musculus
ccttgcatccagtgatgtggccgtg

SEQ ID NO: 254727 - DNA, 25 bp, Mus musculus
ccttgcatgagacacacaacctttt

SEQ ID NO: 254728 - DNA, 25 bp, Mus musculus
ccttgcatgagtggtgtgacggctg

SEQ ID NO: 254729 - DNA, 25 bp, Mus musculus
ccttgccaaggtccacccgactcca

SEQ ID NO: 254730 - DNA, 25 bp, Mus musculus
ccttgcccaacacagagggtgaaca

SEQ ID NO: 254731 - DNA, 25 bp, Mus musculus
ccttgcccaacacagtggggctgtg

SEQ ID NO: 254732 - DNA, 25 bp, Mus musculus
ccttgcccaaggagtctctctgctg

SEQ ID NO: 254733 - DNA, 25 bp, Mus musculus
ccttgcccaaggatctgggaaactc

SEQ ID NO: 254734 - DNA, 25 bp, Mus musculus
ccttgcccgaaacaaccacaacatg

SEQ ID NO: 254735 - DNA, 25 bp, Mus musculus
ccttgccgtatggtgacagctggcc

SEQ ID NO: 254736 - DNA, 25 bp, Mus musculus
ccttgcctccggttcacgctaaaga

SEQ ID NO: 254737 - DNA, 25 bp, Mus musculus
ccttgcctgaacaagatgcactccc

SEQ ID NO: 254738 - DNA, 25 bp, Mus musculus
ccttgcctgaacaagctcagccctg

SEQ ID NO: 254739 - DNA, 25 bp, Mus musculus
ccttgcctgaacaaggctcttcctc

SEQ ID NO: 254740 - DNA, 25 bp, Mus musculus
ccttgcctgctggaagtctctaata

SEQ ID NO: 254741 - DNA, 25 bp, Mus musculus
ccttgccttctgaaagacccggcca

SEQ ID NO: 254742 - DNA, 25 bp, Mus musculus
ccttgcgacaacagatggagaagtc

SEQ ID NO: 254743 - DNA, 25 bp, Mus musculus
ccttgcgagagcaatctgatgattc

SEQ ID NO: 254744 - DNA, 25 bp, Mus musculus
ccttgcgatggcggtacagagactc

SEQ ID NO: 254745 - DNA, 25 bp, Mus musculus
ccttgcgccacagactcttccaagc

SEQ ID NO: 254746 - DNA, 25 bp, Mus musculus
ccttgcgccgccggtgtggccgtgg

SEQ ID NO: 254747 - DNA, 25 bp, Mus musculus
ccttgcgctgccttgactgtggaaa

SEQ ID NO: 254748 - DNA, 25 bp, Mus musculus
ccttgcggcgccggacaggatgttt

SEQ ID NO: 254749 - DNA, 25 bp, Mus musculus
ccttgctaaggggcacctggccaca

SEQ ID NO: 254750 - DNA, 25 bp, Mus musculus
ccttgctaatccgaataatttaaaa

SEQ ID NO: 254751 - DNA, 25 bp, Mus musculus
ccttgctatgaacacccctggctac

SEQ ID NO: 254752 - DNA, 25 bp, Mus musculus
ccttgctattgctcctgggcctgct

SEQ ID NO: 254753 - DNA, 25 bp, Mus musculus
ccttgctcaggagtatcccggcaag

SEQ ID NO: 254754 - DNA, 25 bp, Mus musculus
ccttgctcaggtttcccttcctcac

SEQ ID NO: 254755 - DNA, 25 bp, Mus musculus
ccttgctccctccagactccatctg

SEQ ID NO: 254756 - DNA, 25 bp, Mus musculus
ccttgctccctccagcgccaacgtc

SEQ ID NO: 254757 - DNA, 25 bp, Mus musculus
ccttgctcctgcttgcttcccagag

SEQ ID NO: 254758 - DNA, 25 bp, Mus musculus
ccttgctcctggaggcagtgacatt

SEQ ID NO: 254759 - DNA, 25 bp, Mus musculus
ccttgctgaggaagagaagtttatt

SEQ ID NO: 254760 - DNA, 25 bp, Mus musculus
ccttgctgcgcagatgatgctgaat

SEQ ID NO: 254761 - DNA, 25 bp, Mus musculus
ccttgctgcgcagatgcagaacccc

SEQ ID NO: 254762 - DNA, 25 bp, Mus musculus
ccttgctgctcctggtaacttcaat

SEQ ID NO: 254763 - DNA, 25 bp, Mus musculus
ccttgctgtctcaggacactgctgg

SEQ ID NO: 254764 - DNA, 25 bp, Mus musculus
ccttgctgtctcagggtgaaagagc

SEQ ID NO: 254765 - DNA, 25 bp, Mus musculus
ccttgctgtgatggagtcctcatgg

SEQ ID NO: 254766 - DNA, 25 bp, Mus musculus
ccttgctgtttatggaccttgagat

SEQ ID NO: 254767 - DNA, 25 bp, Mus musculus
ccttgcttaatagacttggtcccct

SEQ ID NO: 254768 - DNA, 25 bp, Mus musculus
ccttgcttaataggtgtgtcctctg

SEQ ID NO: 254769 - DNA, 25 bp, Mus musculus
ccttgcttaccctagaagccgttgt

SEQ ID NO: 254770 - DNA, 25 bp, Mus musculus
ccttgcttgtcggaatctgatgctt

SEQ ID NO: 254771 - DNA, 25 bp, Mus musculus
ccttgcttgtgggattcacagcctc

SEQ ID NO: 254772 - DNA, 25 bp, Mus musculus
ccttgctttcaaagaacagcatgtt

SEQ ID NO: 254773 - DNA, 25 bp, Mus musculus
ccttggaaagctgcggcctcagcct

SEQ ID NO: 254774 - DNA, 25 bp, Mus musculus
ccttggaaagctgcgtctcgcggca

SEQ ID NO: 254775 - DNA, 25 bp, Mus musculus
ccttggaaagcttttatgaaacaga

SEQ ID NO: 254776 - DNA, 25 bp, Mus musculus
ccttggaacagtctggccagaaata

SEQ ID NO: 254777 - DNA, 25 bp, Mus musculus
ccttggaactggtcaaggcctggca

SEQ ID NO: 254778 - DNA, 25 bp, Mus musculus
ccttggaatcgcagttactgtggga

SEQ ID NO: 254779 - DNA, 25 bp, Mus musculus
ccttggaattgaagatggatcacct

SEQ ID NO: 254780 - DNA, 25 bp, Mus musculus
ccttggacaagatagccaaggactt

SEQ ID NO: 254781 - DNA, 25 bp, Mus musculus
ccttggacaaggagcagatagccaa

SEQ ID NO: 254782 - DNA, 25 bp, Mus musculus
ccttggacagatgaaaaagagaaat

SEQ ID NO: 254783 - DNA, 25 bp, Mus musculus
ccttggacagtaattttatgaataa

SEQ ID NO: 254784 - DNA, 25 bp, Mus musculus
ccttggaccaagaagttggtgtcct

SEQ ID NO: 254785 - DNA, 25 bp, Mus musculus
ccttggaccccagggtccattcaga

SEQ ID NO: 254786 - DNA, 25 bp, Mus musculus
ccttggacctgaggtggcatcttta

SEQ ID NO: 254787 - DNA, 25 bp, Mus musculus
ccttggaccttaagatttcctatta

SEQ ID NO: 254788 - DNA, 25 bp, Mus musculus
ccttggagaagataaaaatatatac

SEQ ID NO: 254789 - DNA, 25 bp, Mus musculus
ccttggagaatggttataagtacat

SEQ ID NO: 254790 - DNA, 25 bp, Mus musculus
ccttggagagacagaacaaggattt

SEQ ID NO: 254791 - DNA, 25 bp, Mus musculus
ccttggagagtctccaaggactttg

SEQ ID NO: 254792 - DNA, 25 bp, Mus musculus
ccttggagcaggtcaaagctgcaat

SEQ ID NO: 254793 - DNA, 25 bp, Mus musculus
ccttggagccgggagttgatacaaa

SEQ ID NO: 254794 - DNA, 25 bp, Mus musculus
ccttggagccgtcgactctcaggtg

SEQ ID NO: 254795 - DNA, 25 bp, Mus musculus
ccttggaggaaactttgcttcccag

SEQ ID NO: 254796 - DNA, 25 bp, Mus musculus
ccttggaggacagatgccctgctgg

SEQ ID NO: 254797 - DNA, 25 bp, Mus musculus
ccttggatagactacgagtctggtc

SEQ ID NO: 254798 - DNA, 25 bp, Mus musculus
ccttggatagagcatatttaattag

SEQ ID NO: 254799 - DNA, 25 bp, Mus musculus
ccttggatggagccaaaaacaatac

SEQ ID NO: 254800 - DNA, 25 bp, Mus musculus
ccttggatggcagctgtccggcaga

SEQ ID NO: 254801 - DNA, 25 bp, Mus musculus
ccttggattgacaggtcccaggtcg

SEQ ID NO: 254802 - DNA, 25 bp, Mus musculus
ccttggattgacaggtctgaacggc

SEQ ID NO: 254803 - DNA, 25 bp, Mus musculus
ccttggcaacagaccccaatatcct

SEQ ID NO: 254804 - DNA, 25 bp, Mus musculus
ccttggcagaagctctgcagatcca

SEQ ID NO: 254805 - DNA, 25 bp, Mus musculus
ccttggcagaaggtagcacggcttc

SEQ ID NO: 254806 - DNA, 25 bp, Mus musculus
ccttggcagaggtgagtaaaaagaa

SEQ ID NO: 254807 - DNA, 25 bp, Mus musculus
ccttggcagaggtggataactgcac

SEQ ID NO: 254808 - DNA, 25 bp, Mus musculus
ccttggcagaggttacaaaatgtcc

SEQ ID NO: 254809 - DNA, 25 bp, Mus musculus
ccttggcaggagccaacagagaaac

SEQ ID NO: 254810 - DNA, 25 bp, Mus musculus
ccttggcaggggaatcaaagactcc

SEQ ID NO: 254811 - DNA, 25 bp, Mus musculus
ccttggccaccacacagagtcattc

SEQ ID NO: 254812 - DNA, 25 bp, Mus musculus
ccttggccaccactcctaatagtac

SEQ ID NO: 254813 - DNA, 25 bp, Mus musculus
ccttggccaccagagatcgagactc

SEQ ID NO: 254814 - DNA, 25 bp, Mus musculus
ccttggccaccattgcaagtactcc

SEQ ID NO: 254815 - DNA, 25 bp, Mus musculus
ccttggccaccattgcctcaactgt

SEQ ID NO: 254816 - DNA, 25 bp, Mus musculus
ccttggcccacgcctgtgtaggctt

SEQ ID NO: 254817 - DNA, 25 bp, Mus musculus
ccttggcctgtggtcaaaatccagt

SEQ ID NO: 254818 - DNA, 25 bp, Mus musculus
ccttggcctgttgggtcacttccct

SEQ ID NO: 254819 - DNA, 25 bp, Mus musculus
ccttggccttcagagctccagatac

SEQ ID NO: 254820 - DNA, 25 bp, Mus musculus
ccttggcctttacagagatgagcat

SEQ ID NO: 254821 - DNA, 25 bp, Mus musculus
ccttggcgcggactggtatccggtt

SEQ ID NO: 254822 - DNA, 25 bp, Mus musculus
ccttggcgttcaacaggtggtgtcc

SEQ ID NO: 254823 - DNA, 25 bp, Mus musculus
ccttggctcatcagcagttattcaa

SEQ ID NO: 254824 - DNA, 25 bp, Mus musculus
ccttggctggcgtatgaggagtggg

SEQ ID NO: 254825 - DNA, 25 bp, Mus musculus
ccttggctggcgtgaggccaaagca

SEQ ID NO: 254826 - DNA, 25 bp, Mus musculus
ccttggctgggggatgggctcttgc

SEQ ID NO: 254827 - DNA, 25 bp, Mus musculus
ccttggcttcttcagcactggagac

SEQ ID NO: 254828 - DNA, 25 bp, Mus musculus
ccttggcttcttcaggactctttca

SEQ ID NO: 254829 - DNA, 25 bp, Mus musculus
ccttggcttgcagataaaaatatat

SEQ ID NO: 254830 - DNA, 25 bp, Mus musculus
ccttggctttggagctcctgatggt

SEQ ID NO: 254831 - DNA, 25 bp, Mus musculus
ccttggctttggaggtcggtgagct

SEQ ID NO: 254832 - DNA, 25 bp, Mus musculus
ccttgggaaacaagaaagacagagt

SEQ ID NO: 254833 - DNA, 25 bp, Mus musculus
ccttgggaagatgctgctctttggc

SEQ ID NO: 254834 - DNA, 25 bp, Mus musculus
ccttgggaagatgctggagacctag

SEQ ID NO: 254835 - DNA, 25 bp, Mus musculus
ccttgggaagatggctccttctcct

SEQ ID NO: 254836 - DNA, 25 bp, Mus musculus
ccttgggatctttgctttctcatga

SEQ ID NO: 254837 - DNA, 25 bp, Mus musculus
ccttgggcacgtaagagatgatgat

SEQ ID NO: 254838 - DNA, 25 bp, Mus musculus
ccttgggccaacacctgaatctcct

SEQ ID NO: 254839 - DNA, 25 bp, Mus musculus
ccttgggccagattgtgtcacaaac

SEQ ID NO: 254840 - DNA, 25 bp, Mus musculus
ccttgggccaggctgctgtagaaat

SEQ ID NO: 254841 - DNA, 25 bp, Mus musculus
ccttgggcttgacgacaatggaggt

SEQ ID NO: 254842 - DNA, 25 bp, Mus musculus
ccttgggcttgacgtgtccaacctg

SEQ ID NO: 254843 - DNA, 25 bp, Mus musculus
ccttggggaagcagatggagttcca

SEQ ID NO: 254844 - DNA, 25 bp, Mus musculus
ccttggggcgcagacatgtcttttc

SEQ ID NO: 254845 - DNA, 25 bp, Mus musculus
ccttggggcgcaggacccaagtttc

SEQ ID NO: 254846 - DNA, 25 bp, Mus musculus
ccttggggctcggatggtaaaacac

SEQ ID NO: 254847 - DNA, 25 bp, Mus musculus
ccttggggctcggcatctatattgg

SEQ ID NO: 254848 - DNA, 25 bp, Mus musculus
ccttgggtcaaggtcgagtatgcct

SEQ ID NO: 254849 - DNA, 25 bp, Mus musculus
ccttggtaaatgatgtggcaccatt

SEQ ID NO: 254850 - DNA, 25 bp, Mus musculus
ccttggtacaggcagcagttatggg

SEQ ID NO: 254851 - DNA, 25 bp, Mus musculus
ccttggtcccagctgtgcagtgcct

SEQ ID NO: 254852 - DNA, 25 bp, Mus musculus
ccttggtccggagaaacattcatgc

SEQ ID NO: 254853 - DNA, 25 bp, Mus musculus
ccttggtctgctggacgcctttaga

SEQ ID NO: 254854 - DNA, 25 bp, Mus musculus
ccttggtctgctgggaagcggaaca

SEQ ID NO: 254855 - DNA, 25 bp, Mus musculus
ccttggtgacaccttcaggtggaag

SEQ ID NO: 254856 - DNA, 25 bp, Mus musculus
ccttggtgagaccatagcccagtgg

SEQ ID NO: 254857 - DNA, 25 bp, Mus musculus
ccttggtgatgagaggaagctttgt

SEQ ID NO: 254858 - DNA, 25 bp, Mus musculus
ccttggtgcagacaacatcgctgtc

SEQ ID NO: 254859 - DNA, 25 bp, Mus musculus
ccttggtggaggaaccagagtctat

SEQ ID NO: 254860 - DNA, 25 bp, Mus musculus
ccttggtggctggagccctcagctg

SEQ ID NO: 254861 - DNA, 25 bp, Mus musculus
ccttggttgcagatttgcaatacat

SEQ ID NO: 254862 - DNA, 25 bp, Mus musculus
ccttggttgcaggaagaccgagtag

SEQ ID NO: 254863 - DNA, 25 bp, Mus musculus
ccttggttgcaggtttgcaatacat

SEQ ID NO: 254864 - DNA, 25 bp, Mus musculus
ccttggtttcctccgcaccaccacc

SEQ ID NO: 254865 - DNA, 25 bp, Mus musculus
ccttgtaaaaaggtatatcatgtat

SEQ ID NO: 254866 - DNA, 25 bp, Mus musculus
ccttgtaaacatcagctgcgggcag

SEQ ID NO: 254867 - DNA, 25 bp, Mus musculus
ccttgtaacaagcttaaatccagtg

SEQ ID NO: 254868 - DNA, 25 bp, Mus musculus
ccttgtaacaaggctgtgtctgctt

SEQ ID NO: 254869 - DNA, 25 bp, Mus musculus
ccttgtaacaaggtacactttttgt

SEQ ID NO: 254870 - DNA, 25 bp, Mus musculus
ccttgtacaaaactgtgggaacctg

SEQ ID NO: 254871 - DNA, 25 bp, Mus musculus
ccttgtacaaaggtctctggtaaga

SEQ ID NO: 254872 - DNA, 25 bp, Mus musculus
ccttgtacaaaggttggtgttcagc

SEQ ID NO: 254873 - DNA, 25 bp, Mus musculus
ccttgtacagcaggcaggcaacctt

SEQ ID NO: 254874 - DNA, 25 bp, Mus musculus
ccttgtacaggtatcacaaggctgc

SEQ ID NO: 254875 - DNA, 25 bp, Mus musculus
ccttgtataaagtacactggacact

SEQ ID NO: 254876 - DNA, 25 bp, Mus musculus
ccttgtatacagaggagcattccgg

SEQ ID NO: 254877 - DNA, 25 bp, Mus musculus
ccttgtatagctgtcagggtgacat

SEQ ID NO: 254878 - DNA, 25 bp, Mus musculus
ccttgtatccagacttcagtactac

SEQ ID NO: 254879 - DNA, 25 bp, Mus musculus
ccttgtattaaagatccaaaaggta

SEQ ID NO: 254880 - DNA, 25 bp, Mus musculus
ccttgtattaaagggtatgatgtga

SEQ ID NO: 254881 - DNA, 25 bp, Mus musculus
ccttgtcaaagatcgactgtgccgc

SEQ ID NO: 254882 - DNA, 25 bp, Mus musculus
ccttgtcaaagtctacaaaataccc

SEQ ID NO: 254883 - DNA, 25 bp, Mus musculus
ccttgtcaagctcgaaccagcccct

SEQ ID NO: 254884 - DNA, 25 bp, Mus musculus
ccttgtcaagtggtgtgggcatatt

SEQ ID NO: 254885 - DNA, 25 bp, Mus musculus
ccttgtcacaaaggaagttgttcaa

SEQ ID NO: 254886 - DNA, 25 bp, Mus musculus
ccttgtcacaggggcgggacaggaa

SEQ ID NO: 254887 - DNA, 25 bp, Mus musculus
ccttgtcacagggggtgagaaccct

SEQ ID NO: 254888 - DNA, 25 bp, Mus musculus
ccttgtcacagggggtggaaagctt

SEQ ID NO: 254889 - DNA, 25 bp, Mus musculus
ccttgtcagaacctggcaccaccga

SEQ ID NO: 254890 - DNA, 25 bp, Mus musculus
ccttgtcaggggtgacacccctgga

SEQ ID NO: 254891 - DNA, 25 bp, Mus musculus
ccttgtccaagatcgagcggtccac

SEQ ID NO: 254892 - DNA, 25 bp, Mus musculus
ccttgtccagattatgaagtatgca

SEQ ID NO: 254893 - DNA, 25 bp, Mus musculus
ccttgtccagtggttttaggtgatc

SEQ ID NO: 254894 - DNA, 25 bp, Mus musculus
ccttgtccatgcagtatgctgcctg

SEQ ID NO: 254895 - DNA, 25 bp, Mus musculus
ccttgtccatgcagtcccccagcct

SEQ ID NO: 254896 - DNA, 25 bp, Mus musculus
ccttgtccccaagccacagcccaac

SEQ ID NO: 254897 - DNA, 25 bp, Mus musculus
ccttgtccccagcaagtcttctggc

SEQ ID NO: 254898 - DNA, 25 bp, Mus musculus
ccttgtccccaggaggcccccaagg

SEQ ID NO: 254899 - DNA, 25 bp, Mus musculus
ccttgtcctctgcgagtggcagtgt

SEQ ID NO: 254900 - DNA, 25 bp, Mus musculus
ccttgtccttaaaaggttatggctt

SEQ ID NO: 254901 - DNA, 25 bp, Mus musculus
ccttgtcgttcgaggtaaaaagaga

SEQ ID NO: 254902 - DNA, 25 bp, Mus musculus
ccttgtctagttcaggccagctgct

SEQ ID NO: 254903 - DNA, 25 bp, Mus musculus
ccttgtctgtcttcatctcggagcc

SEQ ID NO: 254904 - DNA, 25 bp, Mus musculus
ccttgtctgttgcggggccacagcg

SEQ ID NO: 254905 - DNA, 25 bp, Mus musculus
ccttgtgaagaagggaagtgtgttt

SEQ ID NO: 254906 - DNA, 25 bp, Mus musculus
ccttgtgaatgtgagagacctctca

SEQ ID NO: 254907 - DNA, 25 bp, Mus musculus
ccttgtgaatgtgaggcctcagtga

SEQ ID NO: 254908 - DNA, 25 bp, Mus musculus
ccttgtgagcatgaggttgtctatt

SEQ ID NO: 254909 - DNA, 25 bp, Mus musculus
ccttgtgagcatgagttggatatac

SEQ ID NO: 254910 - DNA, 25 bp, Mus musculus
ccttgtgatctagccagatcttctg

SEQ ID NO: 254911 - DNA, 25 bp, Mus musculus
ccttgtgatgtggtgaagactcggc

SEQ ID NO: 254912 - DNA, 25 bp, Mus musculus
ccttgtgcagcacttagctagcctg

SEQ ID NO: 254913 - DNA, 25 bp, Mus musculus
ccttgtgcaggaagcatgcattgcg

SEQ ID NO: 254914 - DNA, 25 bp, Mus musculus
ccttgtgcaggcaccttttgtgtcc

SEQ ID NO: 254915 - DNA, 25 bp, Mus musculus
ccttgtgcctacttgagcatcgatg

SEQ ID NO: 254916 - DNA, 25 bp, Mus musculus
ccttgtgcttaggacgggttcccga

SEQ ID NO: 254917 - DNA, 25 bp, Mus musculus
ccttgtgcttgctaggggtcatgat

SEQ ID NO: 254918 - DNA, 25 bp, Mus musculus
ccttgtggaaaacaacaggtttaca

SEQ ID NO: 254919 - DNA, 25 bp, Mus musculus
ccttgtggaaaagaaccagcgggtc

SEQ ID NO: 254920 - DNA, 25 bp, Mus musculus
ccttgtggaaaagctgacaacgtat

SEQ ID NO: 254921 - DNA, 25 bp, Mus musculus
ccttgtggaactgtaccttcactca

SEQ ID NO: 254922 - DNA, 25 bp, Mus musculus
ccttgtggagcgggtaatggatgac

SEQ ID NO: 254923 - DNA, 25 bp, Mus musculus
ccttgtggaggaactacttcatccc

SEQ ID NO: 254924 - DNA, 25 bp, Mus musculus
ccttgtggaggtcttccaagttgct

SEQ ID NO: 254925 - DNA, 25 bp, Mus musculus
ccttgtggtaatcagggtaacacgc

SEQ ID NO: 254926 - DNA, 25 bp, Mus musculus
ccttgtgtattggcattggaggtga

SEQ ID NO: 254927 - DNA, 25 bp, Mus musculus
ccttgtgtcaaaagcctatgtcccc

SEQ ID NO: 254928 - DNA, 25 bp, Mus musculus
ccttgtgtcaaaagggaagatggaa

SEQ ID NO: 254929 - DNA, 25 bp, Mus musculus
ccttgtgtcaagggaaaagatgccg

SEQ ID NO: 254930 - DNA, 25 bp, Mus musculus
ccttgtgtgttgaggatgggagtca

SEQ ID NO: 254931 - DNA, 25 bp, Mus musculus
ccttgtgttcctgggtcttgctgtc

SEQ ID NO: 254932 - DNA, 25 bp, Mus musculus
ccttgttaatacaaaagaagttatt

SEQ ID NO: 254933 - DNA, 25 bp, Mus musculus
ccttgttagaagtccctccgctcca

SEQ ID NO: 254934 - DNA, 25 bp, Mus musculus
ccttgttaggtgccgcattgcacca

SEQ ID NO: 254935 - DNA, 25 bp, Mus musculus
ccttgttagtaagcacagtacagaa

SEQ ID NO: 254936 - DNA, 25 bp, Mus musculus
ccttgttcaacagaacaagtaagaa

SEQ ID NO: 254937 - DNA, 25 bp, Mus musculus
ccttgttcaacaggtttatggtcgg

SEQ ID NO: 254938 - DNA, 25 bp, Mus musculus
ccttgttcaacagttgttggtcttg

SEQ ID NO: 254939 - DNA, 25 bp, Mus musculus
ccttgttcactgtacctcatcaact

SEQ ID NO: 254940 - DNA, 25 bp, Mus musculus
ccttgttcaggacgcacccctctct

SEQ ID NO: 254941 - DNA, 25 bp, Mus musculus
ccttgttcagggggagctggtgacg

SEQ ID NO: 254942 - DNA, 25 bp, Mus musculus
ccttgttcataaacttgttcaagcc

SEQ ID NO: 254943 - DNA, 25 bp, Mus musculus
ccttgttcatagggcggcggggcct

SEQ ID NO: 254944 - DNA, 25 bp, Mus musculus
ccttgttcatccgaacaaaaaaggc

SEQ ID NO: 254945 - DNA, 25 bp, Mus musculus
ccttgttccaagaagaacgttggtg

SEQ ID NO: 254946 - DNA, 25 bp, Mus musculus
ccttgttccaagtatctccatactt

SEQ ID NO: 254947 - DNA, 25 bp, Mus musculus
ccttgttcgtgctgggtgatagcac

SEQ ID NO: 254948 - DNA, 25 bp, Mus musculus
ccttgttctctaaagggcctgggga

SEQ ID NO: 254949 - DNA, 25 bp, Mus musculus
ccttgttctctaaagttacaaatta

SEQ ID NO: 254950 - DNA, 25 bp, Mus musculus
ccttgtttgctgaagaccaaggact

SEQ ID NO: 254951 - DNA, 25 bp, Mus musculus
ccttgttttaaaaggtgtccagtgt

SEQ ID NO: 254952 - DNA, 25 bp, Mus musculus
ccttgttttctgtcaagacaccatg

SEQ ID NO: 254953 - DNA, 25 bp, Mus musculus
cctttaacagcccttagggccatca

SEQ ID NO: 254954 - DNA, 25 bp, Mus musculus
cctttaacagcctctttccaggccc

SEQ ID NO: 254955 - DNA, 25 bp, Mus musculus
cctttaacaggattccagtcttagc

SEQ ID NO: 254956 - DNA, 25 bp, Mus musculus
cctttaacagggccatcatggagaa

SEQ ID NO: 254957 - DNA, 25 bp, Mus musculus
cctttaaccaacaacctccagagtc

SEQ ID NO: 254958 - DNA, 25 bp, Mus musculus
cctttaaccagcaagccccgcccaa

SEQ ID NO: 254959 - DNA, 25 bp, Mus musculus
cctttaacccaggtgactcatattc

SEQ ID NO: 254960 - DNA, 25 bp, Mus musculus
cctttaagccacgaggaaagcgtca

SEQ ID NO: 254961 - DNA, 25 bp, Mus musculus
cctttaatctgagaggccagtcacc

SEQ ID NO: 254962 - DNA, 25 bp, Mus musculus
cctttaatgatccagattatatcag

SEQ ID NO: 254963 - DNA, 25 bp, Mus musculus
cctttaatgatgaagatgcagatag

SEQ ID NO: 254964 - DNA, 25 bp, Mus musculus
cctttaatttccgagtggacaagat

SEQ ID NO: 254965 - DNA, 25 bp, Mus musculus
cctttacaagcccttgtcccagcag

SEQ ID NO: 254966 - DNA, 25 bp, Mus musculus
cctttacagcaaggtgaataaatct

SEQ ID NO: 254967 - DNA, 25 bp, Mus musculus
cctttacagcttcagaagggtcatg

SEQ ID NO: 254968 - DNA, 25 bp, Mus musculus
cctttacagcttcagcagctctatg

SEQ ID NO: 254969 - DNA, 25 bp, Mus musculus
cctttacaggcgagatgatttttga

SEQ ID NO: 254970 - DNA, 25 bp, Mus musculus
cctttacatggaaagatcagtactg

SEQ ID NO: 254971 - DNA, 25 bp, Mus musculus
cctttacatggaaagggatcagtaa

SEQ ID NO: 254972 - DNA, 25 bp, Mus musculus
cctttaccaagagctgggtcgacga

SEQ ID NO: 254973 - DNA, 25 bp, Mus musculus
cctttaccagcctgccgacataaga

SEQ ID NO: 254974 - DNA, 25 bp, Mus musculus
cctttaccagcggcactcagtccca

SEQ ID NO: 254975 - DNA, 25 bp, Mus musculus
cctttaccaggacagccacttccaa

SEQ ID NO: 254976 - DNA, 25 bp, Mus musculus
cctttaccagggtctcagcactgcc

SEQ ID NO: 254977 - DNA, 25 bp, Mus musculus
cctttacccctacaggaaggcccag

SEQ ID NO: 254978 - DNA, 25 bp, Mus musculus
cctttacgacagtgtgaactggact

SEQ ID NO: 254979 - DNA, 25 bp, Mus musculus
cctttacgagcagagggagccaaat

SEQ ID NO: 254980 - DNA, 25 bp, Mus musculus
cctttacgcagaagatgttggacaa

SEQ ID NO: 254981 - DNA, 25 bp, Mus musculus
cctttacgcaggcccagatgacacc

SEQ ID NO: 254982 - DNA, 25 bp, Mus musculus
cctttacgcagttcacacagaagat

SEQ ID NO: 254983 - DNA, 25 bp, Mus musculus
cctttactccagacaaatcgccatc

SEQ ID NO: 254984 - DNA, 25 bp, Mus musculus
cctttactccagtgcctatgactcc

SEQ ID NO: 254985 - DNA, 25 bp, Mus musculus
cctttactgacagcttttgcctacc

SEQ ID NO: 254986 - DNA, 25 bp, Mus musculus
cctttactgcccttggctctggtca

SEQ ID NO: 254987 - DNA, 25 bp, Mus musculus
cctttactttcaacatcaaagtggc

SEQ ID NO: 254988 - DNA, 25 bp, Mus musculus
cctttagagggtctgatatgccgag

SEQ ID NO: 254989 - DNA, 25 bp, Mus musculus
cctttagatgctagtggaggttcca

SEQ ID NO: 254990 - DNA, 25 bp, Mus musculus
cctttagatggtgtggatccagagt

SEQ ID NO: 254991 - DNA, 25 bp, Mus musculus
cctttagcaagcagtccatctcagt

SEQ ID NO: 254992 - DNA, 25 bp, Mus musculus
cctttagcaccagttcctctttcca

SEQ ID NO: 254993 - DNA, 25 bp, Mus musculus
cctttagccccagtggatctaaagg

SEQ ID NO: 254994 - DNA, 25 bp, Mus musculus
cctttaggagagaagatagaggaga

SEQ ID NO: 254995 - DNA, 25 bp, Mus musculus
cctttaggtcgctgatctgccagga

SEQ ID NO: 254996 - DNA, 25 bp, Mus musculus
cctttaggtcgctgcacacagggcc

SEQ ID NO: 254997 - DNA, 25 bp, Mus musculus
cctttataagcaaatgggggaagcc

SEQ ID NO: 254998 - DNA, 25 bp, Mus musculus
cctttatacctggggttttgtatga

SEQ ID NO: 254999 - DNA, 25 bp, Mus musculus
cctttatagaggacaaggaatatgt

SEQ ID NO: 255000 - DNA, 25 bp, Mus musculus
cctttatcagaaagctgtcggtgac

SEQ ID NO: 255001 - DNA, 25 bp, Mus musculus
cctttatcagcgtatcagagcatcg

SEQ ID NO: 255002 - DNA, 25 bp, Mus musculus
cctttatcagggtatcagagcatcg

SEQ ID NO: 255003 - DNA, 25 bp, Mus musculus
cctttatcggatccggaagggggtg

SEQ ID NO: 255004 - DNA, 25 bp, Mus musculus
cctttatctcaggcttcctgctttt

SEQ ID NO: 255005 - DNA, 25 bp, Mus musculus
cctttatctgtagtgcaaagtacta

SEQ ID NO: 255006 - DNA, 25 bp, Mus musculus
cctttatgctatgaaaccactaggc

SEQ ID NO: 255007 - DNA, 25 bp, Mus musculus
cctttatgctcaatatgaagatata

SEQ ID NO: 255008 - DNA, 25 bp, Mus musculus
cctttatgctgattctctgaccttt

SEQ ID NO: 255009 - DNA, 25 bp, Mus musculus
cctttattacaaggaatcgcctgct

SEQ ID NO: 255010 - DNA, 25 bp, Mus musculus
cctttattcaggagatgatttggta

SEQ ID NO: 255011 - DNA, 25 bp, Mus musculus
cctttcaaaggtagtttacaaatga

SEQ ID NO: 255012 - DNA, 25 bp, Mus musculus
cctttcaacaaacgaactccaatgt

SEQ ID NO: 255013 - DNA, 25 bp, Mus musculus
cctttcaaccctcaggaatccaaac

SEQ ID NO: 255014 - DNA, 25 bp, Mus musculus
cctttcacagaaggagacattctgg

SEQ ID NO: 255015 - DNA, 25 bp, Mus musculus
cctttcacagagcatgatctcctcc

SEQ ID NO: 255016 - DNA, 25 bp, Mus musculus
cctttcacaggctcctgagcattcc

SEQ ID NO: 255017 - DNA, 25 bp, Mus musculus
cctttcacaggtgctgggcgttaca

SEQ ID NO: 255018 - DNA, 25 bp, Mus musculus
cctttcaccgccgctttgacctcga

SEQ ID NO: 255019 - DNA, 25 bp, Mus musculus
cctttcacttaaggtccttcagacc

SEQ ID NO: 255020 - DNA, 25 bp, Mus musculus
cctttcatagattaccaaggaaatg

SEQ ID NO: 255021 - DNA, 25 bp, Mus musculus
cctttcatagctatgataagttaca

SEQ ID NO: 255022 - DNA, 25 bp, Mus musculus
cctttcatcttccaattctcctctg

SEQ ID NO: 255023 - DNA, 25 bp, Mus musculus
cctttcatgattatagtgcagcagc

SEQ ID NO: 255024 - DNA, 25 bp, Mus musculus
cctttcatgccaaaggcctctggct

SEQ ID NO: 255025 - DNA, 25 bp, Mus musculus
cctttcatgccaaaggtcagttcac

SEQ ID NO: 255026 - DNA, 25 bp, Mus musculus
cctttcatgccaccctctgcctccc

SEQ ID NO: 255027 - DNA, 25 bp, Mus musculus
cctttccaaaggagttgaagcagaa

SEQ ID NO: 255028 - DNA, 25 bp, Mus musculus
cctttccaacagagggagacgatgg

SEQ ID NO: 255029 - DNA, 25 bp, Mus musculus
cctttccacagcacggagctcgaag

SEQ ID NO: 255030 - DNA, 25 bp, Mus musculus
cctttccaccgaaggtttctctgta

SEQ ID NO: 255031 - DNA, 25 bp, Mus musculus
cctttccactttcaggaccatggta

SEQ ID NO: 255032 - DNA, 25 bp, Mus musculus
cctttccattgtaaatcttagtgta

SEQ ID NO: 255033 - DNA, 25 bp, Mus musculus
cctttcccagaaaaatatgcccaaa

SEQ ID NO: 255034 - DNA, 25 bp, Mus musculus
cctttcccagctcacttcttccccg

SEQ ID NO: 255035 - DNA, 25 bp, Mus musculus
cctttcccatgggtcactgcccagc

SEQ ID NO: 255036 - DNA, 25 bp, Mus musculus
cctttccccagagcccgactctgag

SEQ ID NO: 255037 - DNA, 25 bp, Mus musculus
cctttccccaggcccggagcattct

SEQ ID NO: 255038 - DNA, 25 bp, Mus musculus
cctttccgatacgttctggaccctt

SEQ ID NO: 255039 - DNA, 25 bp, Mus musculus
cctttccgcgacagagactaggcct

SEQ ID NO: 255040 - DNA, 25 bp, Mus musculus
cctttccgcgacaggcaggagactg

SEQ ID NO: 255041 - DNA, 25 bp, Mus musculus
cctttccgcgacaggggtccctcca

SEQ ID NO: 255042 - DNA, 25 bp, Mus musculus
cctttccgcgacaggtcagggtatt

SEQ ID NO: 255043 - DNA, 25 bp, Mus musculus
cctttcctaacgctgctgcattttt

SEQ ID NO: 255044 - DNA, 25 bp, Mus musculus
cctttcctaagaaccaagacaacta

SEQ ID NO: 255045 - DNA, 25 bp, Mus musculus
cctttcctactggctggacccatga

SEQ ID NO: 255046 - DNA, 25 bp, Mus musculus
cctttcctcagatttcctccctcct

SEQ ID NO: 255047 - DNA, 25 bp, Mus musculus
cctttcctcccaagattcccgtggg

SEQ ID NO: 255048 - DNA, 25 bp, Mus musculus
cctttcctgaaggaggtactgtctg

SEQ ID NO: 255049 - DNA, 25 bp, Mus musculus
cctttcctgcaagcatttgacattg

SEQ ID NO: 255050 - DNA, 25 bp, Mus musculus
cctttcctgcagtatcaggagtgcg

SEQ ID NO: 255051 - DNA, 25 bp, Mus musculus
cctttcctgcctgacctggagctgc

SEQ ID NO: 255052 - DNA, 25 bp, Mus musculus
cctttcctggctgaggtactttctg

SEQ ID NO: 255053 - DNA, 25 bp, Mus musculus
cctttcctttcaggcctcagggctg

SEQ ID NO: 255054 - DNA, 25 bp, Mus musculus
cctttcgagagggagaatcccgtat

SEQ ID NO: 255055 - DNA, 25 bp, Mus musculus
cctttcggtccaagaggtcctccag

SEQ ID NO: 255056 - DNA, 25 bp, Mus musculus
cctttctaaacagggaacagcagtg

SEQ ID NO: 255057 - DNA, 25 bp, Mus musculus
cctttctacaacaggccattctttg

SEQ ID NO: 255058 - DNA, 25 bp, Mus musculus
cctttctacaacagggcatccgtcc

SEQ ID NO: 255059 - DNA, 25 bp, Mus musculus
cctttctactcaggaactgctgaag

SEQ ID NO: 255060 - DNA, 25 bp, Mus musculus
cctttctactttctgctttcatctc

SEQ ID NO: 255061 - DNA, 25 bp, Mus musculus
cctttctcagtcagggtgacaaggg

SEQ ID NO: 255062 - DNA, 25 bp, Mus musculus
cctttctcataggtggaattgggct

SEQ ID NO: 255063 - DNA, 25 bp, Mus musculus
cctttctctacacaggaaatccacc

SEQ ID NO: 255064 - DNA, 25 bp, Mus musculus
cctttctctacacaggctgacaaga

SEQ ID NO: 255065 - DNA, 25 bp, Mus musculus
cctttctctagatagggtgagcgtg

SEQ ID NO: 255066 - DNA, 25 bp, Mus musculus
cctttctctggaacttcgagtcaaa

SEQ ID NO: 255067 - DNA, 25 bp, Mus musculus
cctttctctgggagctgaacatcga

SEQ ID NO: 255068 - DNA, 25 bp, Mus musculus
cctttctgagggagacttcctgagc

SEQ ID NO: 255069 - DNA, 25 bp, Mus musculus
cctttctgccaaagttgctcaccaa

SEQ ID NO: 255070 - DNA, 25 bp, Mus musculus
cctttctgccagggacatgaaatgg

SEQ ID NO: 255071 - DNA, 25 bp, Mus musculus
cctttctgctttcaggttctcagaa

SEQ ID NO: 255072 - DNA, 25 bp, Mus musculus
cctttctgctttcaggttctgcagc

SEQ ID NO: 255073 - DNA, 25 bp, Mus musculus
cctttctgctttcaggttgggagaa

SEQ ID NO: 255074 - DNA, 25 bp, Mus musculus
cctttctggaaagaatatccagtta

SEQ ID NO: 255075 - DNA, 25 bp, Mus musculus
cctttctggagaaaaacaaaatgta

SEQ ID NO: 255076 - DNA, 25 bp, Mus musculus
cctttctgggctaagacctccagtc

SEQ ID NO: 255077 - DNA, 25 bp, Mus musculus
cctttctgtaccgatgcactcccgc

SEQ ID NO: 255078 - DNA, 25 bp, Mus musculus
cctttctgtccttggggatgggccc

SEQ ID NO: 255079 - DNA, 25 bp, Mus musculus
cctttctgtgaagaaaagacatgct

SEQ ID NO: 255080 - DNA, 25 bp, Mus musculus
cctttcttaccctcagctggatagg

SEQ ID NO: 255081 - DNA, 25 bp, Mus musculus
cctttcttagacacatgcagccgct

SEQ ID NO: 255082 - DNA, 25 bp, Mus musculus
cctttcttgagtttgacagtgtcat

SEQ ID NO: 255083 - DNA, 25 bp, Mus musculus
cctttcttgggagaggaagaagaaa

SEQ ID NO: 255084 - DNA, 25 bp, Mus musculus
cctttctttagtgtacactcttttc

SEQ ID NO: 255085 - DNA, 25 bp, Mus musculus
cctttctttctgccctgtttcacct

SEQ ID NO: 255086 - DNA, 25 bp, Mus musculus
cctttgaaaaagcgctctccagtgt

SEQ ID NO: 255087 - DNA, 25 bp, Mus musculus
cctttgaaaaagctgtcaagagcag

SEQ ID NO: 255088 - DNA, 25 bp, Mus musculus
cctttgaaaagctttctccagacca

SEQ ID NO: 255089 - DNA, 25 bp, Mus musculus
cctttgaacgaatcccgctcaagaa

SEQ ID NO: 255090 - DNA, 25 bp, Mus musculus
cctttgaacttatattggattttct

SEQ ID NO: 255091 - DNA, 25 bp, Mus musculus
cctttgaagagcagatggcccagtg

SEQ ID NO: 255092 - DNA, 25 bp, Mus musculus
cctttgaagagcaggttgcttccat

SEQ ID NO: 255093 - DNA, 25 bp, Mus musculus
cctttgaagccaggtgtttggcctt

SEQ ID NO: 255094 - DNA, 25 bp, Mus musculus
cctttgaatggtaaccaatggagtt

SEQ ID NO: 255095 - DNA, 25 bp, Mus musculus
cctttgacaaaaaatcagctgcccg

SEQ ID NO: 255096 - DNA, 25 bp, Mus musculus
cctttgacaacagctacagtagggg

SEQ ID NO: 255097 - DNA, 25 bp, Mus musculus
cctttgacaacaggggaggcactta

SEQ ID NO: 255098 - DNA, 25 bp, Mus musculus
cctttgaccaggaacttagcccagc

SEQ ID NO: 255099 - DNA, 25 bp, Mus musculus
cctttgaccaggatgacctcacggt

SEQ ID NO: 255100 - DNA, 25 bp, Mus musculus
cctttgaccaggtaaccggtgtggt

SEQ ID NO: 255101 - DNA, 25 bp, Mus musculus
cctttgaccatgcggatccttccat

SEQ ID NO: 255102 - DNA, 25 bp, Mus musculus
cctttgaccgcacaggtactgagac

SEQ ID NO: 255103 - DNA, 25 bp, Mus musculus
cctttgacctcatggtgttcgtgac

SEQ ID NO: 255104 - DNA, 25 bp, Mus musculus
cctttgacctgggaattcctcaagc

SEQ ID NO: 255105 - DNA, 25 bp, Mus musculus
cctttgactggaatggtatttccaa

SEQ ID NO: 255106 - DNA, 25 bp, Mus musculus
cctttgactgtggcagccacagcag

SEQ ID NO: 255107 - DNA, 25 bp, Mus musculus
cctttgagaagcatgtggatggcag

SEQ ID NO: 255108 - DNA, 25 bp, Mus musculus
cctttgagaggaacaaatgtggtat

SEQ ID NO: 255109 - DNA, 25 bp, Mus musculus
cctttgagcagcatatgaagaacag

SEQ ID NO: 255110 - DNA, 25 bp, Mus musculus
cctttgaggaaagggaacgggagat

SEQ ID NO: 255111 - DNA, 25 bp, Mus musculus
cctttgaggacaccgctcagtgggt

SEQ ID NO: 255112 - DNA, 25 bp, Mus musculus
cctttgaggtcttgctgatcctaca

SEQ ID NO: 255113 - DNA, 25 bp, Mus musculus
cctttgagtacaggtctgtaccaca

SEQ ID NO: 255114 - DNA, 25 bp, Mus musculus
cctttgagtacaggtgatttgaact

SEQ ID NO: 255115 - DNA, 25 bp, Mus musculus
cctttgagtgacgggtttagctttt

SEQ ID NO: 255116 - DNA, 25 bp, Mus musculus
cctttgatattcggagctggagccc

SEQ ID NO: 255117 - DNA, 25 bp, Mus musculus
cctttgatattcggctgaattcatc

SEQ ID NO: 255118 - DNA, 25 bp, Mus musculus
cctttgatctgaaggaaggcgaagt

SEQ ID NO: 255119 - DNA, 25 bp, Mus musculus
cctttgatgagatatgtgtcacaaa

SEQ ID NO: 255120 - DNA, 25 bp, Mus musculus
cctttgatgtcctgggtcatggtag

SEQ ID NO: 255121 - DNA, 25 bp, Mus musculus
cctttgatgtgcatgtgtgggcata

SEQ ID NO: 255122 - DNA, 25 bp, Mus musculus
cctttgattcaaaaggatggccagg

SEQ ID NO: 255123 - DNA, 25 bp, Mus musculus
cctttgatttttacatggacttgac

SEQ ID NO: 255124 - DNA, 25 bp, Mus musculus
cctttgcaaaacatggcagaagaag

SEQ ID NO: 255125 - DNA, 25 bp, Mus musculus
cctttgcaaaagactggctggaaca

SEQ ID NO: 255126 - DNA, 25 bp, Mus musculus
cctttgcaaaagtgatctgcaattc

SEQ ID NO: 255127 - DNA, 25 bp, Mus musculus
cctttgcaaagtgcattgaggtcat

SEQ ID NO: 255128 - DNA, 25 bp, Mus musculus
cctttgcaagtcaggccgtctactg

SEQ ID NO: 255129 - DNA, 25 bp, Mus musculus
cctttgcaatcgatggcagctcaac

SEQ ID NO: 255130 - DNA, 25 bp, Mus musculus
cctttgcacaggtgacgccatctgg

SEQ ID NO: 255131 - DNA, 25 bp, Mus musculus
cctttgcctggctccaagatgaaac

SEQ ID NO: 255132 - DNA, 25 bp, Mus musculus
cctttgcgcagaggttacatcggcg

SEQ ID NO: 255133 - DNA, 25 bp, Mus musculus
cctttgcgtacagggatcttgtcct

SEQ ID NO: 255134 - DNA, 25 bp, Mus musculus
cctttgcgtacagggggtggtactg

SEQ ID NO: 255135 - DNA, 25 bp, Mus musculus
cctttgctgtaccagatcccacaac

SEQ ID NO: 255136 - DNA, 25 bp, Mus musculus
cctttgcttggccacagacaagcgg

SEQ ID NO: 255137 - DNA, 25 bp, Mus musculus
cctttgcttggtgggttcaggggtg

SEQ ID NO: 255138 - DNA, 25 bp, Mus musculus
cctttgctttagggatcagtctgct

SEQ ID NO: 255139 - DNA, 25 bp, Mus musculus
cctttgctttccagaatgggcaaag

SEQ ID NO: 255140 - DNA, 25 bp, Mus musculus
cctttgctttccatgggtcccacat

SEQ ID NO: 255141 - DNA, 25 bp, Mus musculus
cctttgctttgacactggccaaaag

SEQ ID NO: 255142 - DNA, 25 bp, Mus musculus
cctttgctttgattctttcagcccg

SEQ ID NO: 255143 - DNA, 25 bp, Mus musculus
cctttgctttgtattacgtgcactc

SEQ ID NO: 255144 - DNA, 25 bp, Mus musculus
cctttggaaaaatacatttatataa

SEQ ID NO: 255145 - DNA, 25 bp, Mus musculus
cctttggaaaagttgctgtggttcc

SEQ ID NO: 255146 - DNA, 25 bp, Mus musculus
cctttggaaagtgacactgatgaga

SEQ ID NO: 255147 - DNA, 25 bp, Mus musculus
cctttggaagagatggagagagaac

SEQ ID NO: 255148 - DNA, 25 bp, Mus musculus
cctttggaaggttattatgttgtgg

SEQ ID NO: 255149 - DNA, 25 bp, Mus musculus
cctttggaccacctggtccaagagg

SEQ ID NO: 255150 - DNA, 25 bp, Mus musculus
cctttggagaatgcagttcctttta

SEQ ID NO: 255151 - DNA, 25 bp, Mus musculus
cctttggagaattgcagtactgttt

SEQ ID NO: 255152 - DNA, 25 bp, Mus musculus
cctttggagggagttatggggggat

SEQ ID NO: 255153 - DNA, 25 bp, Mus musculus
cctttggatactcaggaatgggcaa

SEQ ID NO: 255154 - DNA, 25 bp, Mus musculus
cctttggccaaatggcaccgctcca

SEQ ID NO: 255155 - DNA, 25 bp, Mus musculus
cctttggccaggcttacagttcctc

SEQ ID NO: 255156 - DNA, 25 bp, Mus musculus
cctttggcttccctcatcagcgaaa

SEQ ID NO: 255157 - DNA, 25 bp, Mus musculus
cctttgggaagcgcctgctgaacga

SEQ ID NO: 255158 - DNA, 25 bp, Mus musculus
cctttgggaaggcgacagacttatt

SEQ ID NO: 255159 - DNA, 25 bp, Mus musculus
cctttgggaggagagaaggaagaat

SEQ ID NO: 255160 - DNA, 25 bp, Mus musculus
cctttggtagactctggctggaggc

SEQ ID NO: 255161 - DNA, 25 bp, Mus musculus
cctttggtgacaggcttccccacct

SEQ ID NO: 255162 - DNA, 25 bp, Mus musculus
cctttggtgccacaagccccgccca

SEQ ID NO: 255163 - DNA, 25 bp, Mus musculus
cctttggtgtcacaggcggcacgtt

SEQ ID NO: 255164 - DNA, 25 bp, Mus musculus
cctttggttcctcaagccccgccca

SEQ ID NO: 255165 - DNA, 25 bp, Mus musculus
cctttggtttgcgaggctggagcaa

SEQ ID NO: 255166 - DNA, 25 bp, Mus musculus
cctttgtaaaagaatgatagagaca

SEQ ID NO: 255167 - DNA, 25 bp, Mus musculus
cctttgtaatcagcttggcttaccc

SEQ ID NO: 255168 - DNA, 25 bp, Mus musculus
cctttgtagaccaaagcccatggcc

SEQ ID NO: 255169 - DNA, 25 bp, Mus musculus
cctttgtagaccaagtggtgtctac

SEQ ID NO: 255170 - DNA, 25 bp, Mus musculus
cctttgtcaaagaggtacagcaggg

SEQ ID NO: 255171 - DNA, 25 bp, Mus musculus
cctttgtcaatctggtacaccaggg

SEQ ID NO: 255172 - DNA, 25 bp, Mus musculus
cctttgtcatcaaaggcctctccct

SEQ ID NO: 255173 - DNA, 25 bp, Mus musculus
cctttgtcatcaaaggtccagatgt

SEQ ID NO: 255174 - DNA, 25 bp, Mus musculus
cctttgtccagcggctcgaggactt

SEQ ID NO: 255175 - DNA, 25 bp, Mus musculus
cctttgtctggaagcggcctctgga

SEQ ID NO: 255176 - DNA, 25 bp, Mus musculus
cctttgtctggtcccccttcctgtg

SEQ ID NO: 255177 - DNA, 25 bp, Mus musculus
cctttgtgaacaagggttcccgaga

SEQ ID NO: 255178 - DNA, 25 bp, Mus musculus
cctttgtgagtgtgagagcccgctg

SEQ ID NO: 255179 - DNA, 25 bp, Mus musculus
cctttgtgcgagacggcccccttga

SEQ ID NO: 255180 - DNA, 25 bp, Mus musculus
cctttgtgctccacggggaggcaca

SEQ ID NO: 255181 - DNA, 25 bp, Mus musculus
cctttgtggcagtcttcccaggcca

SEQ ID NO: 255182 - DNA, 25 bp, Mus musculus
cctttgtggcagtctttcagccaac

SEQ ID NO: 255183 - DNA, 25 bp, Mus musculus
cctttgtgtggttcttcttgctttg

SEQ ID NO: 255184 - DNA, 25 bp, Mus musculus
cctttgtgttgaaggtgcaggacca

SEQ ID NO: 255185 - DNA, 25 bp, Mus musculus
cctttgttcaggaatatcgttcaga

SEQ ID NO: 255186 - DNA, 25 bp, Mus musculus
cctttgttcctggggcctgtgtttt

SEQ ID NO: 255187 - DNA, 25 bp, Mus musculus
cctttgttctttaagatcgctccag

SEQ ID NO: 255188 - DNA, 25 bp, Mus musculus
cctttgttctttaaggatcctatgt

SEQ ID NO: 255189 - DNA, 25 bp, Mus musculus
cctttgtttccccagatcctgtctt

SEQ ID NO: 255190 - DNA, 25 bp, Mus musculus
cctttgtttggtgctcctaaaagga

SEQ ID NO: 255191 - DNA, 25 bp, Mus musculus
cctttgtttggtgttaggcaggaac

SEQ ID NO: 255192 - DNA, 25 bp, Mus musculus
ccttttaaaactatcacttgtggaa

SEQ ID NO: 255193 - DNA, 25 bp, Mus musculus
ccttttaaagatcagccagatgcta

SEQ ID NO: 255194 - DNA, 25 bp, Mus musculus
ccttttaaaggctgctggcaccctg

SEQ ID NO: 255195 - DNA, 25 bp, Mus musculus
ccttttacaatgctcatgacctgac

SEQ ID NO: 255196 - DNA, 25 bp, Mus musculus
ccttttacctattcatcgctccacc

SEQ ID NO: 255197 - DNA, 25 bp, Mus musculus
ccttttacttggcaagtccttgggg

SEQ ID NO: 255198 - DNA, 25 bp, Mus musculus
ccttttatagaccagtttgaatatt

SEQ ID NO: 255199 - DNA, 25 bp, Mus musculus
ccttttatcaggttccttagctggc

SEQ ID NO: 255200 - DNA, 25 bp, Mus musculus
ccttttattcctacgccagagatgc

SEQ ID NO: 255201 - DNA, 25 bp, Mus musculus
ccttttattcctacggatctcatag

SEQ ID NO: 255202 - DNA, 25 bp, Mus musculus
ccttttcataggttggatgatacat

SEQ ID NO: 255203 - DNA, 25 bp, Mus musculus
ccttttcatgcctagtgacctgatt

SEQ ID NO: 255204 - DNA, 25 bp, Mus musculus
ccttttccagacagtccaggatggc

SEQ ID NO: 255205 - DNA, 25 bp, Mus musculus
ccttttccagcaatccgaaggtcca

SEQ ID NO: 255206 - DNA, 25 bp, Mus musculus
ccttttcccatcaacctgctgtcct

SEQ ID NO: 255207 - DNA, 25 bp, Mus musculus
ccttttcctcatggctgtgacattg

SEQ ID NO: 255208 - DNA, 25 bp, Mus musculus
ccttttcctgagagtttggattcga

SEQ ID NO: 255209 - DNA, 25 bp, Mus musculus
ccttttcggcgtggttgagaacaaa

SEQ ID NO: 255210 - DNA, 25 bp, Mus musculus
ccttttctaacaggtctggatttta

SEQ ID NO: 255211 - DNA, 25 bp, Mus musculus
ccttttctctaggcaagaatcaaaa

SEQ ID NO: 255212 - DNA, 25 bp, Mus musculus
ccttttctctgagcaaagaacgttc

SEQ ID NO: 255213 - DNA, 25 bp, Mus musculus
ccttttctctgcagtcaatcgcagg

SEQ ID NO: 255214 - DNA, 25 bp, Mus musculus
ccttttctgaaggtgtagaagccac

SEQ ID NO: 255215 - DNA, 25 bp, Mus musculus
ccttttctgagtggtccaagccggc

SEQ ID NO: 255216 - DNA, 25 bp, Mus musculus
ccttttctgggtaacacaaggcaca

SEQ ID NO: 255217 - DNA, 25 bp, Mus musculus
ccttttctgtagcgctggcgtggat

SEQ ID NO: 255218 - DNA, 25 bp, Mus musculus
ccttttgaaggtcaattcttcaaag

SEQ ID NO: 255219 - DNA, 25 bp, Mus musculus
ccttttgaaggtgaattcttcaaag

SEQ ID NO: 255220 - DNA, 25 bp, Mus musculus
ccttttgacagccacacctgcgccc

SEQ ID NO: 255221 - DNA, 25 bp, Mus musculus
ccttttgagcaggtagaagagaact

SEQ ID NO: 255222 - DNA, 25 bp, Mus musculus
ccttttgcagatggagggaagactc

SEQ ID NO: 255223 - DNA, 25 bp, Mus musculus
ccttttgcagatggtagaaggacaa

SEQ ID NO: 255224 - DNA, 25 bp, Mus musculus
ccttttgcatggtaagaccagctgt

SEQ ID NO: 255225 - DNA, 25 bp, Mus musculus
ccttttgctagaggtagaagagcca

SEQ ID NO: 255226 - DNA, 25 bp, Mus musculus
ccttttggacatggactgaagccct

SEQ ID NO: 255227 - DNA, 25 bp, Mus musculus
ccttttggacatggcccttagatgt

SEQ ID NO: 255228 - DNA, 25 bp, Mus musculus
ccttttggccctgagatgacaaatc

SEQ ID NO: 255229 - DNA, 25 bp, Mus musculus
ccttttgggaaagcttcaccacgac

SEQ ID NO: 255230 - DNA, 25 bp, Mus musculus
ccttttgggaccagctggaagatgg

SEQ ID NO: 255231 - DNA, 25 bp, Mus musculus
ccttttgtaacagttggatgaaaaa

SEQ ID NO: 255232 - DNA, 25 bp, Mus musculus
ccttttgtcagggattcgataaaca

SEQ ID NO: 255233 - DNA, 25 bp, Mus musculus
ccttttgtctacaggcttcctgaag

SEQ ID NO: 255234 - DNA, 25 bp, Mus musculus
ccttttgtgaagatcatcacagttg

SEQ ID NO: 255235 - DNA, 25 bp, Mus musculus
cctttttcaagaccaacagcaacca

SEQ ID NO: 255236 - DNA, 25 bp, Mus musculus
cctttttcctaactcttggcaagta

SEQ ID NO: 255237 - DNA, 25 bp, Mus musculus
cctttttcctatattgttgatcttt

SEQ ID NO: 255238 - DNA, 25 bp, Mus musculus
cctttttcctattcttctgccctag

SEQ ID NO: 255239 - DNA, 25 bp, Mus musculus
cctttttcctccctatctgagctct

SEQ ID NO: 255240 - DNA, 25 bp, Mus musculus
cctttttgcctcaggtgacactgga

SEQ ID NO: 255241 - DNA, 25 bp, Mus musculus
cctttttgctgttcactttggaaag

SEQ ID NO: 255242 - DNA, 25 bp, Mus musculus
cctttttgttggaggtccagatggc

SEQ ID NO: 255243 - DNA, 25 bp, Mus musculus
ccttttttcaagctatcagagatgc

SEQ ID NO: 255244 - DNA, 25 bp, Mus musculus
ccttttttcaaggatgttaattatg

SEQ ID NO: 255245 - DNA, 25 bp, Mus musculus
ccttttttgaaggagcacatggatg

SEQ ID NO: 255246 - DNA, 25 bp, Mus musculus
ccttttttgaaggattcactagcaa

SEQ ID NO: 255247 - DNA, 25 bp, Mus musculus
cctttttttcccagatgcattacac

SEQ ID NO: 255248 - DNA, 25 bp, Mus musculus
cctttttttcccaggaccagatagc

SEQ ID NO: 255249 - DNA, 25 bp, Mus musculus
cgaaaaaacatgcagagatctcttt

SEQ ID NO: 255250 - DNA, 25 bp, Mus musculus
cgaaaaaatcagcccccgactctca

SEQ ID NO: 255251 - DNA, 25 bp, Mus musculus
cgaaaaaatcaggccccgactctca

SEQ ID NO: 255252 - DNA, 25 bp, Mus musculus
cgaaaaacaaggacactgctggccg

SEQ ID NO: 255253 - DNA, 25 bp, Mus musculus
cgaaaaactatgagattaaaacaag

SEQ ID NO: 255254 - DNA, 25 bp, Mus musculus
cgaaaaactatgagttctgaatttc

SEQ ID NO: 255255 - DNA, 25 bp, Mus musculus
cgaaaacatcactgtcgtcactgcg

SEQ ID NO: 255256 - DNA, 25 bp, Mus musculus
cgaaaaccccagatctgtgccgctg

SEQ ID NO: 255257 - DNA, 25 bp, Mus musculus
cgaaaaccgatccagagaaggccta

SEQ ID NO: 255258 - DNA, 25 bp, Mus musculus
cgaaaaccgatccagtggaagaggc

SEQ ID NO: 255259 - DNA, 25 bp, Mus musculus
cgaaaacgttctgcagcccacacac

SEQ ID NO: 255260 - DNA, 25 bp, Mus musculus
cgaaaactacaagaaatatgtggaa

SEQ ID NO: 255261 - DNA, 25 bp, Mus musculus
cgaaaactccaggatgtgtttgaaa

SEQ ID NO: 255262 - DNA, 25 bp, Mus musculus
cgaaaactggaagtgacccagacta

SEQ ID NO: 255263 - DNA, 25 bp, Mus musculus
cgaaaagagagggggtccactgcgt

SEQ ID NO: 255264 - DNA, 25 bp, Mus musculus
cgaaaagagagtgtatctgtcagaa

SEQ ID NO: 255265 - DNA, 25 bp, Mus musculus
cgaaaaggatgaaaagcttattcgt

SEQ ID NO: 255266 - DNA, 25 bp, Mus musculus
cgaaaaggccaagattcttcaggag

SEQ ID NO: 255267 - DNA, 25 bp, Mus musculus
cgaaaaggctgtaatttggcctcag

SEQ ID NO: 255268 - DNA, 25 bp, Mus musculus
cgaaaatcagatcaaagatgagaag

SEQ ID NO: 255269 - DNA, 25 bp, Mus musculus
cgaaaatctatgaaagccctggttt

SEQ ID NO: 255270 - DNA, 25 bp, Mus musculus
cgaaaatctatgaaatcagcaaccg

SEQ ID NO: 255271 - DNA, 25 bp, Mus musculus
cgaaaatgaaggttctgggctgaca

SEQ ID NO: 255272 - DNA, 25 bp, Mus musculus
cgaaaatgaagtcgagcctgttgac

SEQ ID NO: 255273 - DNA, 25 bp, Mus musculus
cgaaaatggggtccaagggtagcca

SEQ ID NO: 255274 - DNA, 25 bp, Mus musculus
cgaaacaaaagtggtccatgccgtg

SEQ ID NO: 255275 - DNA, 25 bp, Mus musculus
cgaaacaagtgcctgctttttctct

SEQ ID NO: 255276 - DNA, 25 bp, Mus musculus
cgaaacaccagctgcgatactatga

SEQ ID NO: 255277 - DNA, 25 bp, Mus musculus
cgaaacactcagccctggcaccatc

SEQ ID NO: 255278 - DNA, 25 bp, Mus musculus
cgaaacactctctaatatgtttatg

SEQ ID NO: 255279 - DNA, 25 bp, Mus musculus
cgaaacagcagagaactggggaacc

SEQ ID NO: 255280 - DNA, 25 bp, Mus musculus
cgaaacagcagtgaccagctcacta

SEQ ID NO: 255281 - DNA, 25 bp, Mus musculus
cgaaacagccaaggcttccaagcag

SEQ ID NO: 255282 - DNA, 25 bp, Mus musculus
cgaaacatcttcaaaaactgcacct

SEQ ID NO: 255283 - DNA, 25 bp, Mus musculus
cgaaaccaagtggagctgattgcag

SEQ ID NO: 255284 - DNA, 25 bp, Mus musculus
cgaaaccacgaaccgcatgcacgaa

SEQ ID NO: 255285 - DNA, 25 bp, Mus musculus
cgaaaccacgaaccgcatgcacgag

SEQ ID NO: 255286 - DNA, 25 bp, Mus musculus
cgaaaccatgcatgggcgcctgaag

SEQ ID NO: 255287 - DNA, 25 bp, Mus musculus
cgaaacccagatgaggaataactga

SEQ ID NO: 255288 - DNA, 25 bp, Mus musculus
cgaaaccgcaggcttatgatggagc

SEQ ID NO: 255289 - DNA, 25 bp, Mus musculus
cgaaacctgcgccagcacgcaggga

SEQ ID NO: 255290 - DNA, 25 bp, Mus musculus
cgaaacctgcgccaggtgaccatct

SEQ ID NO: 255291 - DNA, 25 bp, Mus musculus
cgaaacgagaaaggtgagatctcaa

SEQ ID NO: 255292 - DNA, 25 bp, Mus musculus
cgaaacgatatcatgcctctgacag

SEQ ID NO: 255293 - DNA, 25 bp, Mus musculus
cgaaacgcgcacgcggctggagaag

SEQ ID NO: 255294 - DNA, 25 bp, Mus musculus
cgaaactcagttccagagcctctgc

SEQ ID NO: 255295 - DNA, 25 bp, Mus musculus
cgaaactccagtgacacgtgcctga

SEQ ID NO: 255296 - DNA, 25 bp, Mus musculus
cgaaactgagaagaccagagccctg

SEQ ID NO: 255297 - DNA, 25 bp, Mus musculus
cgaaactgcatgttgcgggatgaca

SEQ ID NO: 255298 - DNA, 25 bp, Mus musculus
cgaaactggagggctctctgggatg

SEQ ID NO: 255299 - DNA, 25 bp, Mus musculus
cgaaactggaggtgacccctgtaaa

SEQ ID NO: 255300 - DNA, 25 bp, Mus musculus
cgaaactggagttacctcgctgagc

SEQ ID NO: 255301 - DNA, 25 bp, Mus musculus
cgaaacttaacagtgaaagatttcc

SEQ ID NO: 255302 - DNA, 25 bp, Mus musculus
cgaaacttaacagtgaggaatgata

SEQ ID NO: 255303 - DNA, 25 bp, Mus musculus
cgaaagaaagatcttcctcagaact

SEQ ID NO: 255304 - DNA, 25 bp, Mus musculus
cgaaagaaagctgattcaagcatct

SEQ ID NO: 255305 - DNA, 25 bp, Mus musculus
cgaaagaaatgcaaaatccgggagg

SEQ ID NO: 255306 - DNA, 25 bp, Mus musculus
cgaaagaagagtggaggaaccacaa

SEQ ID NO: 255307 - DNA, 25 bp, Mus musculus
cgaaagaaggcacaggaagcatttc

SEQ ID NO: 255308 - DNA, 25 bp, Mus musculus
cgaaagacatgtattcgtaacaata

SEQ ID NO: 255309 - DNA, 25 bp, Mus musculus
cgaaagaccagccaacaattctctt

SEQ ID NO: 255310 - DNA, 25 bp, Mus musculus
cgaaagagaggtgaaacggaaggtg

SEQ ID NO: 255311 - DNA, 25 bp, Mus musculus
cgaaagagaggtgaggaagaccctg

SEQ ID NO: 255312 - DNA, 25 bp, Mus musculus
cgaaagagaggtgccggcctccgcc

SEQ ID NO: 255313 - DNA, 25 bp, Mus musculus
cgaaagaggcacagatcttagatga

SEQ ID NO: 255314 - DNA, 25 bp, Mus musculus
cgaaagcaaagtggccaaagtgagg

SEQ ID NO: 255315 - DNA, 25 bp, Mus musculus
cgaaagcaagtctcgttacatcagg

SEQ ID NO: 255316 - DNA, 25 bp, Mus musculus
cgaaagcacagaatactattacaaa

SEQ ID NO: 255317 - DNA, 25 bp, Mus musculus
cgaaagcacagcaactttctccggc

SEQ ID NO: 255318 - DNA, 25 bp, Mus musculus
cgaaagcacaggttttgcactgatt

SEQ ID NO: 255319 - DNA, 25 bp, Mus musculus
cgaaagcacgaggatggatgcgagt

SEQ ID NO: 255320 - DNA, 25 bp, Mus musculus
cgaaagcagaggagcaccgggggct

SEQ ID NO: 255321 - DNA, 25 bp, Mus musculus
cgaaagcaggtccccagcctggcag

SEQ ID NO: 255322 - DNA, 25 bp, Mus musculus
cgaaagcattgcattggtctctgcc

SEQ ID NO: 255323 - DNA, 25 bp, Mus musculus
cgaaagctcagcccagtgtcgtgtg

SEQ ID NO: 255324 - DNA, 25 bp, Mus musculus
cgaaaggaacagagtgacttaacca

SEQ ID NO: 255325 - DNA, 25 bp, Mus musculus
cgaaaggcactccagatgaaagctt

SEQ ID NO: 255326 - DNA, 25 bp, Mus musculus
cgaaaggcactccagtcaatgggtc

SEQ ID NO: 255327 - DNA, 25 bp, Mus musculus
cgaaaggctccaggggtgatggaca

SEQ ID NO: 255328 - DNA, 25 bp, Mus musculus
cgaaaggtagcatcaccaccgcctc

SEQ ID NO: 255329 - DNA, 25 bp, Mus musculus
cgaaagtcagaaaagtgttacatgt

SEQ ID NO: 255330 - DNA, 25 bp, Mus musculus
cgaaagtcaggaaactgaagctcaa

SEQ ID NO: 255331 - DNA, 25 bp, Mus musculus
cgaaagtccaaggtgccccgagccc

SEQ ID NO: 255332 - DNA, 25 bp, Mus musculus
cgaaagtcccagcactccgtcctct

SEQ ID NO: 255333 - DNA, 25 bp, Mus musculus
cgaaagtgaagatatggagtctgga

SEQ ID NO: 255334 - DNA, 25 bp, Mus musculus
cgaaagttgcaggatgtgtttgagt

SEQ ID NO: 255335 - DNA, 25 bp, Mus musculus
cgaaataaaaaaggggcctgctgac

SEQ ID NO: 255336 - DNA, 25 bp, Mus musculus
cgaaataattcactgctaaaataca

SEQ ID NO: 255337 - DNA, 25 bp, Mus musculus
cgaaatagaccagatctcacaggaa

SEQ ID NO: 255338 - DNA, 25 bp, Mus musculus
cgaaatcagatagtcttccccgctg

SEQ ID NO: 255339 - DNA, 25 bp, Mus musculus
cgaaatctgacagatttcatcataa

SEQ ID NO: 255340 - DNA, 25 bp, Mus musculus
cgaaatctgactcagagcaacccag

SEQ ID NO: 255341 - DNA, 25 bp, Mus musculus
cgaaatgaggaccagtgggcatggg

SEQ ID NO: 255342 - DNA, 25 bp, Mus musculus
cgaaatgtgtaagctgctggctcta

SEQ ID NO: 255343 - DNA, 25 bp, Mus musculus
cgaaattacaggaagctctcgtaga

SEQ ID NO: 255344 - DNA, 25 bp, Mus musculus
cgaaattcacgacgggatgtttcgg

SEQ ID NO: 255345 - DNA, 25 bp, Mus musculus
cgaaattcctgggcagagctgaaaa

SEQ ID NO: 255346 - DNA, 25 bp, Mus musculus
cgaaatttacaatctttaagaaata

SEQ ID NO: 255347 - DNA, 25 bp, Mus musculus
cgaacaaagtcagctttctctggtc

SEQ ID NO: 255348 - DNA, 25 bp, Mus musculus
cgaacaacaaagaatctgaagcagg

SEQ ID NO: 255349 - DNA, 25 bp, Mus musculus
cgaacaacaaagaggaagcctgcac

SEQ ID NO: 255350 - DNA, 25 bp, Mus musculus
cgaacaacagacgagctaaactcag

SEQ ID NO: 255351 - DNA, 25 bp, Mus musculus
cgaacaacaggtcttcacacaacga

SEQ ID NO: 255352 - DNA, 25 bp, Mus musculus
cgaacaagcccaggagacaatcagg

SEQ ID NO: 255353 - DNA, 25 bp, Mus musculus
cgaacaagccgtggcaaggagatga

SEQ ID NO: 255354 - DNA, 25 bp, Mus musculus
cgaacaagccgtggcattaaaaaaa

SEQ ID NO: 255355 - DNA, 25 bp, Mus musculus
cgaacaatacaggtggccaagaagg

SEQ ID NO: 255356 - DNA, 25 bp, Mus musculus
cgaacaatacagtcaggatggctaa

SEQ ID NO: 255357 - DNA, 25 bp, Mus musculus
cgaacacgcgcaagccctgaggtgc

SEQ ID NO: 255358 - DNA, 25 bp, Mus musculus
cgaacagaaacaagctccttgctcg

SEQ ID NO: 255359 - DNA, 25 bp, Mus musculus
cgaacagacaagcctttgaggacct

SEQ ID NO: 255360 - DNA, 25 bp, Mus musculus
cgaacagacaagggtgtgtctgcag

SEQ ID NO: 255361 - DNA, 25 bp, Mus musculus
cgaacaggatcgcaatagtcggtgc

SEQ ID NO: 255362 - DNA, 25 bp, Mus musculus
cgaacaggatcggatctaccgttac

SEQ ID NO: 255363 - DNA, 25 bp, Mus musculus
cgaacaggatcggtctctccagtgt

SEQ ID NO: 255364 - DNA, 25 bp, Mus musculus
cgaacatatttgagaagatagatga

SEQ ID NO: 255365 - DNA, 25 bp, Mus musculus
cgaaccacactgtaccagcaaggtg

SEQ ID NO: 255366 - DNA, 25 bp, Mus musculus
cgaaccacagaaagcgtccatcctg

SEQ ID NO: 255367 - DNA, 25 bp, Mus musculus
cgaaccagaggagattggattccag

SEQ ID NO: 255368 - DNA, 25 bp, Mus musculus
cgaaccagtggcaacactggcagcc

SEQ ID NO: 255369 - DNA, 25 bp, Mus musculus
cgaaccatgggaccggtccaacggg

SEQ ID NO: 255370 - DNA, 25 bp, Mus musculus
cgaacccaggctccaccaaacgtgg

SEQ ID NO: 255371 - DNA, 25 bp, Mus musculus
cgaacccaggctcccactggcctca

SEQ ID NO: 255372 - DNA, 25 bp, Mus musculus
cgaaccccaagctttgtgacgacaa

SEQ ID NO: 255373 - DNA, 25 bp, Mus musculus
cgaaccccaagggaaccatcagcgt

SEQ ID NO: 255374 - DNA, 25 bp, Mus musculus
cgaacccctggaattgtggaggcac

SEQ ID NO: 255375 - DNA, 25 bp, Mus musculus
cgaaccgggcagctgcccacggagc

SEQ ID NO: 255376 - DNA, 25 bp, Mus musculus
cgaaccgggcggcagtgccatggca

SEQ ID NO: 255377 - DNA, 25 bp, Mus musculus
cgaacctaacagcaaatgggaagta

SEQ ID NO: 255378 - DNA, 25 bp, Mus musculus
cgaacctggaacaaggcctgagtac

SEQ ID NO: 255379 - DNA, 25 bp, Mus musculus
cgaacctggacaagcctggacaaac

SEQ ID NO: 255380 - DNA, 25 bp, Mus musculus
cgaacctggtagcctataacattca

SEQ ID NO: 255381 - DNA, 25 bp, Mus musculus
cgaacgaaccccaagctttgtgacg

SEQ ID NO: 255382 - DNA, 25 bp, Mus musculus
cgaacgaaccccaagggaaccatca

SEQ ID NO: 255383 - DNA, 25 bp, Mus musculus
cgaacgacgatagggtccaggtgga

SEQ ID NO: 255384 - DNA, 25 bp, Mus musculus
cgaacgagagagctgttctctacca

SEQ ID NO: 255385 - DNA, 25 bp, Mus musculus
cgaacgagagatgctcccttcggag

SEQ ID NO: 255386 - DNA, 25 bp, Mus musculus
cgaacgcagggcactgcagaagtac

SEQ ID NO: 255387 - DNA, 25 bp, Mus musculus
cgaacggaaaaatggaagtatagtc

SEQ ID NO: 255388 - DNA, 25 bp, Mus musculus
cgaacggaaaaatgtgctccagctg

SEQ ID NO: 255389 - DNA, 25 bp, Mus musculus
cgaacggacaaggagatcagcaggc

SEQ ID NO: 255390 - DNA, 25 bp, Mus musculus
cgaacggccaggtgtcgtgattaaa

SEQ ID NO: 255391 - DNA, 25 bp, Mus musculus
cgaacggcggccgaggtctgtctgc

SEQ ID NO: 255392 - DNA, 25 bp, Mus musculus
cgaacggtcagaagctccccgcagg

SEQ ID NO: 255393 - DNA, 25 bp, Mus musculus
cgaacgtgccacggtcagggaaact

SEQ ID NO: 255394 - DNA, 25 bp, Mus musculus
cgaacgtgttcttgacagctaccag

SEQ ID NO: 255395 - DNA, 25 bp, Mus musculus
cgaacgtgttcttggtttctgccag

SEQ ID NO: 255396 - DNA, 25 bp, Mus musculus
cgaactacaggaagagagagtcatg

SEQ ID NO: 255397 - DNA, 25 bp, Mus musculus
cgaactacttaaagaaagatcacag

SEQ ID NO: 255398 - DNA, 25 bp, Mus musculus
cgaactagaaaccagtgctgttgca

SEQ ID NO: 255399 - DNA, 25 bp, Mus musculus
cgaactagaacaccagcagtgcttg

SEQ ID NO: 255400 - DNA, 25 bp, Mus musculus
cgaactcacccaagtgcaaaacatg

SEQ ID NO: 255401 - DNA, 25 bp, Mus musculus
cgaactcacccaagtgttgcccacc

SEQ ID NO: 255402 - DNA, 25 bp, Mus musculus
cgaactcagacaggagcagagcccg

SEQ ID NO: 255403 - DNA, 25 bp, Mus musculus
cgaactcagcgtcagggccgcgttg

SEQ ID NO: 255404 - DNA, 25 bp, Mus musculus
cgaactcgggcagagatgggtggcc

SEQ ID NO: 255405 - DNA, 25 bp, Mus musculus
cgaactcttcaacaatgccatgagg

SEQ ID NO: 255406 - DNA, 25 bp, Mus musculus
cgaactcttcaagaatgccatgagg

SEQ ID NO: 255407 - DNA, 25 bp, Mus musculus
cgaactgagaaaagttttgctcatg

SEQ ID NO: 255408 - DNA, 25 bp, Mus musculus
cgaactgcctgatgtaaagaatgtc

SEQ ID NO: 255409 - DNA, 25 bp, Mus musculus
cgaacttcgaggaatgtttaaatgg

SEQ ID NO: 255410 - DNA, 25 bp, Mus musculus
cgaactttagaccatgccgtccatc

SEQ ID NO: 255411 - DNA, 25 bp, Mus musculus
cgaagaaaacagtgctctgcagttt

SEQ ID NO: 255412 - DNA, 25 bp, Mus musculus
cgaagaaacatggatgtaaacagaa

SEQ ID NO: 255413 - DNA, 25 bp, Mus musculus
cgaagaaccaagccggccctgggca

SEQ ID NO: 255414 - DNA, 25 bp, Mus musculus
cgaagaagaaaacaggctatggtga

SEQ ID NO: 255415 - DNA, 25 bp, Mus musculus
cgaagaagaagcaggtcacgatcta

SEQ ID NO: 255416 - DNA, 25 bp, Mus musculus
cgaagaagaagcaggtttcttcgtt

SEQ ID NO: 255417 - DNA, 25 bp, Mus musculus
cgaagaagaatgggctctacttgaa

SEQ ID NO: 255418 - DNA, 25 bp, Mus musculus
cgaagaagaatgggtctttccttcc

SEQ ID NO: 255419 - DNA, 25 bp, Mus musculus
cgaagaagagctgtggtttctccta

SEQ ID NO: 255420 - DNA, 25 bp, Mus musculus
cgaagaagcaatgatggagcaggaa

SEQ ID NO: 255421 - DNA, 25 bp, Mus musculus
cgaagaaggcaaatagcacccagga

SEQ ID NO: 255422 - DNA, 25 bp, Mus musculus
cgaagaataggtgtgatgaatgcag

SEQ ID NO: 255423 - DNA, 25 bp, Mus musculus
cgaagaatgtgctggaattgtctgt

SEQ ID NO: 255424 - DNA, 25 bp, Mus musculus
cgaagaatgtgctgggttttctgtc

SEQ ID NO: 255425 - DNA, 25 bp, Mus musculus
cgaagacacaaaaaaaaggcagtgg

SEQ ID NO: 255426 - DNA, 25 bp, Mus musculus
cgaagacacaagtagaaggcagtgg

SEQ ID NO: 255427 - DNA, 25 bp, Mus musculus
cgaagacacagtgaagcatgactgg

SEQ ID NO: 255428 - DNA, 25 bp, Mus musculus
cgaagaccaagcgctggaaggtagg

SEQ ID NO: 255429 - DNA, 25 bp, Mus musculus
cgaagaccaagcggatctctttcct

SEQ ID NO: 255430 - DNA, 25 bp, Mus musculus
cgaagacctaaatgactggcttccc

SEQ ID NO: 255431 - DNA, 25 bp, Mus musculus
cgaagacctaaatggagaactgttc

SEQ ID NO: 255432 - DNA, 25 bp, Mus musculus
cgaagacgacaaaggtcccccctgt

SEQ ID NO: 255433 - DNA, 25 bp, Mus musculus
cgaagactaagtggactaaagagga

SEQ ID NO: 255434 - DNA, 25 bp, Mus musculus
cgaagactgcgagcacgtagaagac

SEQ ID NO: 255435 - DNA, 25 bp, Mus musculus
cgaagactgcgaggaccgtcacgac

SEQ ID NO: 255436 - DNA, 25 bp, Mus musculus
cgaagactggcaggacagtttcttg

SEQ ID NO: 255437 - DNA, 25 bp, Mus musculus
cgaagactgtcgctcctgtgcggca

SEQ ID NO: 255438 - DNA, 25 bp, Mus musculus
cgaagagaaactggacagagccaat

SEQ ID NO: 255439 - DNA, 25 bp, Mus musculus
cgaagagataggtgatttcagactg

SEQ ID NO: 255440 - DNA, 25 bp, Mus musculus
cgaagagcaagatgatttttgaatg

SEQ ID NO: 255441 - DNA, 25 bp, Mus musculus
cgaagagcaccagaattcatcctac

SEQ ID NO: 255442 - DNA, 25 bp, Mus musculus
cgaagagctcaagaagttaagtgtt

SEQ ID NO: 255443 - DNA, 25 bp, Mus musculus
cgaagagctggaccgtgctggaatc

SEQ ID NO: 255444 - DNA, 25 bp, Mus musculus
cgaagagcttcgcctgaaacctcag

SEQ ID NO: 255445 - DNA, 25 bp, Mus musculus
cgaagaggaagaggaggcccaagag

SEQ ID NO: 255446 - DNA, 25 bp, Mus musculus
cgaagaggagcttggctttgatctg

SEQ ID NO: 255447 - DNA, 25 bp, Mus musculus
cgaagaggataaattaggaatcccc

SEQ ID NO: 255448 - DNA, 25 bp, Mus musculus
cgaagaggcccaggtgcgggcgagt

SEQ ID NO: 255449 - DNA, 25 bp, Mus musculus
cgaagaggctgggctggagaaagag

SEQ ID NO: 255450 - DNA, 25 bp, Mus musculus
cgaagagtgggaagaacttccatta

SEQ ID NO: 255451 - DNA, 25 bp, Mus musculus
cgaagatagagatctggccgccccg

SEQ ID NO: 255452 - DNA, 25 bp, Mus musculus
cgaagatctcaaagtgagaaaacaa

SEQ ID NO: 255453 - DNA, 25 bp, Mus musculus
cgaagatgaaggtcaaactgggctc

SEQ ID NO: 255454 - DNA, 25 bp, Mus musculus
cgaagatgcaggagaagattcgatg

SEQ ID NO: 255455 - DNA, 25 bp, Mus musculus
cgaagatgcctggtacggagtcaaa

SEQ ID NO: 255456 - DNA, 25 bp, Mus musculus
cgaagatggaggagctggagtcaga

SEQ ID NO: 255457 - DNA, 25 bp, Mus musculus
cgaagatgtgcagaaagacgctcct

SEQ ID NO: 255458 - DNA, 25 bp, Mus musculus
cgaagatgtgcaggtcttgcctcag

SEQ ID NO: 255459 - DNA, 25 bp, Mus musculus
cgaagcagaggagttttttgagctc

SEQ ID NO: 255460 - DNA, 25 bp, Mus musculus
cgaagcagcagcaaagtctgcatct

SEQ ID NO: 255461 - DNA, 25 bp, Mus musculus
cgaagcagcagcaacctcattgggc

SEQ ID NO: 255462 - DNA, 25 bp, Mus musculus
cgaagcaggagtgcactgcccccca

SEQ ID NO: 255463 - DNA, 25 bp, Mus musculus
cgaagccaaggcccaggccttgtca

SEQ ID NO: 255464 - DNA, 25 bp, Mus musculus
cgaagccacctccagtcgcagatat

SEQ ID NO: 255465 - DNA, 25 bp, Mus musculus
cgaagccataccggcgaacgcccgt

SEQ ID NO: 255466 - DNA, 25 bp, Mus musculus
cgaagcccaagaaataaatcataat

SEQ ID NO: 255467 - DNA, 25 bp, Mus musculus
cgaagccccggccaccatgttcaac

SEQ ID NO: 255468 - DNA, 25 bp, Mus musculus
cgaagccctaccaggggtttctctg

SEQ ID NO: 255469 - DNA, 25 bp, Mus musculus
cgaagccctaccagggtgtgggaac

SEQ ID NO: 255470 - DNA, 25 bp, Mus musculus
cgaagcccttggtccagaatagcgt

SEQ ID NO: 255471 - DNA, 25 bp, Mus musculus
cgaagccgcagccagagccacagcc

SEQ ID NO: 255472 - DNA, 25 bp, Mus musculus
cgaagcggaccgaggacttgtgtga

SEQ ID NO: 255473 - DNA, 25 bp, Mus musculus
cgaagcgggcagtcagaaaatgggt

SEQ ID NO: 255474 - DNA, 25 bp, Mus musculus
cgaagcgtttgatgactccggaaag

SEQ ID NO: 255475 - DNA, 25 bp, Mus musculus
cgaagcgtttgcaatcccggaagga

SEQ ID NO: 255476 - DNA, 25 bp, Mus musculus
cgaagcgtttggctccttccgctcc

SEQ ID NO: 255477 - DNA, 25 bp, Mus musculus
cgaagctaaccccccctggtgcacc

SEQ ID NO: 255478 - DNA, 25 bp, Mus musculus
cgaagctaacggggaataaaagctg

SEQ ID NO: 255479 - DNA, 25 bp, Mus musculus
cgaagctacaggactcttcccccca

SEQ ID NO: 255480 - DNA, 25 bp, Mus musculus
cgaagctcaaggccacttcttactc

SEQ ID NO: 255481 - DNA, 25 bp, Mus musculus
cgaagctcaatgacaatgtcagtgc

SEQ ID NO: 255482 - DNA, 25 bp, Mus musculus
cgaagctcagagggatcagaaacat

SEQ ID NO: 255483 - DNA, 25 bp, Mus musculus
cgaagctcagccacgggggccgtga

SEQ ID NO: 255484 - DNA, 25 bp, Mus musculus
cgaagctcccgccatgagaatttcc

SEQ ID NO: 255485 - DNA, 25 bp, Mus musculus
cgaagctgagatactccatgtttcc

SEQ ID NO: 255486 - DNA, 25 bp, Mus musculus
cgaagctgctgagggccttgcgggt

SEQ ID NO: 255487 - DNA, 25 bp, Mus musculus
cgaagctggaaatggaaccagtgac

SEQ ID NO: 255488 - DNA, 25 bp, Mus musculus
cgaaggacgcgctatgaagtcttac

SEQ ID NO: 255489 - DNA, 25 bp, Mus musculus
cgaaggagacgaagagatgagacca

SEQ ID NO: 255490 - DNA, 25 bp, Mus musculus
cgaaggagcaggagccgctcccgtt

SEQ ID NO: 255491 - DNA, 25 bp, Mus musculus
cgaaggagcaggttgatatgtcaga

SEQ ID NO: 255492 - DNA, 25 bp, Mus musculus
cgaaggagcagtctcatggagccag

SEQ ID NO: 255493 - DNA, 25 bp, Mus musculus
cgaaggagcggacgtgacgtatgac

SEQ ID NO: 255494 - DNA, 25 bp, Mus musculus
cgaaggatcttaccaatcctgggat

SEQ ID NO: 255495 - DNA, 25 bp, Mus musculus
cgaaggatcttttttgctccagact

SEQ ID NO: 255496 - DNA, 25 bp, Mus musculus
cgaaggcaagaagtcctgccacact

SEQ ID NO: 255497 - DNA, 25 bp, Mus musculus
cgaaggcaaggcgacccctctgagg

SEQ ID NO: 255498 - DNA, 25 bp, Mus musculus
cgaaggcactacagatgttcatcta

SEQ ID NO: 255499 - DNA, 25 bp, Mus musculus
cgaaggccagcagctctgcggagtc

SEQ ID NO: 255500 - DNA, 25 bp, Mus musculus
cgaaggcctcgccagaagcccccca

SEQ ID NO: 255501 - DNA, 25 bp, Mus musculus
cgaaggcctgcaagacgacaaggaa

SEQ ID NO: 255502 - DNA, 25 bp, Mus musculus
cgaaggcctggtcattcaatattaa

SEQ ID NO: 255503 - DNA, 25 bp, Mus musculus
cgaaggcgagatctgcatcaaaggt

SEQ ID NO: 255504 - DNA, 25 bp, Mus musculus
cgaaggcggaagtggttctgctgcc

SEQ ID NO: 255505 - DNA, 25 bp, Mus musculus
cgaaggctggacagatctgctcatt

SEQ ID NO: 255506 - DNA, 25 bp, Mus musculus
cgaaggctggacagattcagataac

SEQ ID NO: 255507 - DNA, 25 bp, Mus musculus
cgaaggctgtttatggatgaccagg

SEQ ID NO: 255508 - DNA, 25 bp, Mus musculus
cgaaggctttgcaaggaagccatca

SEQ ID NO: 255509 - DNA, 25 bp, Mus musculus
cgaagggagatgatgatgaggaatc

SEQ ID NO: 255510 - DNA, 25 bp, Mus musculus
cgaagggagcgctgatcatggctcc

SEQ ID NO: 255511 - DNA, 25 bp, Mus musculus
cgaagggccggggtgtgcacatgga

SEQ ID NO: 255512 - DNA, 25 bp, Mus musculus
cgaagggctgccatgcctgtgactg

SEQ ID NO: 255513 - DNA, 25 bp, Mus musculus
cgaaggggatgcatgtggatggcag

SEQ ID NO: 255514 - DNA, 25 bp, Mus musculus
cgaaggggatgttgtggaagtgact

SEQ ID NO: 255515 - DNA, 25 bp, Mus musculus
cgaagggtccagggtctcaggtccc

SEQ ID NO: 255516 - DNA, 25 bp, Mus musculus
cgaaggtaagaaggcaatggcaagc

SEQ ID NO: 255517 - DNA, 25 bp, Mus musculus
cgaaggtcaagcacccctattgagc

SEQ ID NO: 255518 - DNA, 25 bp, Mus musculus
cgaaggtcaaggccacaggcctctg

SEQ ID NO: 255519 - DNA, 25 bp, Mus musculus
cgaaggtctcctcagatgaggaaac

SEQ ID NO: 255520 - DNA, 25 bp, Mus musculus
cgaaggttaaaacttcagcatcttc

SEQ ID NO: 255521 - DNA, 25 bp, Mus musculus
cgaagtaaggagagatgcctctgga

SEQ ID NO: 255522 - DNA, 25 bp, Mus musculus
cgaagtaaggagagttttagatgcc

SEQ ID NO: 255523 - DNA, 25 bp, Mus musculus
cgaagtacgcccgaggacttcagga

SEQ ID NO: 255524 - DNA, 25 bp, Mus musculus
cgaagtagtttttgacagaaaatct

SEQ ID NO: 255525 - DNA, 25 bp, Mus musculus
cgaagtatcatgtaccggagctttc

SEQ ID NO: 255526 - DNA, 25 bp, Mus musculus
cgaagtcaagcctttcatcacctat

SEQ ID NO: 255527 - DNA, 25 bp, Mus musculus
cgaagtcagtgaaggcaggagctgg

SEQ ID NO: 255528 - DNA, 25 bp, Mus musculus
cgaagtcgctgacatcaatgcaagc

SEQ ID NO: 255529 - DNA, 25 bp, Mus musculus
cgaagtctgtgattcgtaagacaga

SEQ ID NO: 255530 - DNA, 25 bp, Mus musculus
cgaagtcttcgtgggacctcgcaag

SEQ ID NO: 255531 - DNA, 25 bp, Mus musculus
cgaagtctttaagtgagcccttgaa

SEQ ID NO: 255532 - DNA, 25 bp, Mus musculus
cgaagtgaggggcttgcagatgggt

SEQ ID NO: 255533 - DNA, 25 bp, Mus musculus
cgaagtgcagctgaggagcagctgc

SEQ ID NO: 255534 - DNA, 25 bp, Mus musculus
cgaagtgctgagcagtaacttgaat

SEQ ID NO: 255535 - DNA, 25 bp, Mus musculus
cgaagtggagagcgtgaaagagttt

SEQ ID NO: 255536 - DNA, 25 bp, Mus musculus
cgaagtggtcggaattctgcctttg

SEQ ID NO: 255537 - DNA, 25 bp, Mus musculus
cgaagtgtctggagataacaatcga

SEQ ID NO: 255538 - DNA, 25 bp, Mus musculus
cgaagttacagacccactgtccgtg

SEQ ID NO: 255539 - DNA, 25 bp, Mus musculus
cgaagttacaggcccactgtccgtg

SEQ ID NO: 255540 - DNA, 25 bp, Mus musculus
cgaagttcaatatgctcccaagctc

SEQ ID NO: 255541 - DNA, 25 bp, Mus musculus
cgaagttcagagtaaagacatttcc

SEQ ID NO: 255542 - DNA, 25 bp, Mus musculus
cgaagttccgacagcagcccaacac

SEQ ID NO: 255543 - DNA, 25 bp, Mus musculus
cgaagttctctgacaggaatgaatt

SEQ ID NO: 255544 - DNA, 25 bp, Mus musculus
cgaagttgcacaaggtcattgaagc

SEQ ID NO: 255545 - DNA, 25 bp, Mus musculus
cgaagttgctcagtggacaagattg

SEQ ID NO: 255546 - DNA, 25 bp, Mus musculus
cgaagtttccagactcaaactgtca

SEQ ID NO: 255547 - DNA, 25 bp, Mus musculus
cgaagtttccagcctcctctggtaa

SEQ ID NO: 255548 - DNA, 25 bp, Mus musculus
cgaataaagtcagagatccagaaat

SEQ ID NO: 255549 - DNA, 25 bp, Mus musculus
cgaataaagtcaggtatcttttgga

SEQ ID NO: 255550 - DNA, 25 bp, Mus musculus
cgaataaagtcaggttttgatattt

SEQ ID NO: 255551 - DNA, 25 bp, Mus musculus
cgaataaatgcagtatctctcctct

SEQ ID NO: 255552 - DNA, 25 bp, Mus musculus
cgaataatggcctcggtcactttca

SEQ ID NO: 255553 - DNA, 25 bp, Mus musculus
cgaatacccgactcagccctagaca

SEQ ID NO: 255554 - DNA, 25 bp, Mus musculus
cgaatacccgagttggattgtccag

SEQ ID NO: 255555 - DNA, 25 bp, Mus musculus
cgaataccctgcagcatagcatctc

SEQ ID NO: 255556 - DNA, 25 bp, Mus musculus
cgaataccctgcaggtgatctgtct

SEQ ID NO: 255557 - DNA, 25 bp, Mus musculus
cgaatagcagcttcttcggctgtca

SEQ ID NO: 255558 - DNA, 25 bp, Mus musculus
cgaatatatatggaagaccaccaga

SEQ ID NO: 255559 - DNA, 25 bp, Mus musculus
cgaatatccacgctttctctgctgc

SEQ ID NO: 255560 - DNA, 25 bp, Mus musculus
cgaatatctcaagtatgcgagacca

SEQ ID NO: 255561 - DNA, 25 bp, Mus musculus
cgaatcaaagagatggatctgtccg

SEQ ID NO: 255562 - DNA, 25 bp, Mus musculus
cgaatcaaagaggatgtatatacaa

SEQ ID NO: 255563 - DNA, 25 bp, Mus musculus
cgaatcaagccaaatctgaagtgga

SEQ ID NO: 255564 - DNA, 25 bp, Mus musculus
cgaatcaagccaatccataggaatc

SEQ ID NO: 255565 - DNA, 25 bp, Mus musculus
cgaatcacagctgccttcaccatga

SEQ ID NO: 255566 - DNA, 25 bp, Mus musculus
cgaatcacaggattagtcgtatcta

SEQ ID NO: 255567 - DNA, 25 bp, Mus musculus
cgaatcacgtggagtgaactcagtg

SEQ ID NO: 255568 - DNA, 25 bp, Mus musculus
cgaatcacgtggatggaatgaaacc

SEQ ID NO: 255569 - DNA, 25 bp, Mus musculus
cgaatcattacagacacacctgcaa

SEQ ID NO: 255570 - DNA, 25 bp, Mus musculus
cgaatcattacaggtcctgagataa

SEQ ID NO: 255571 - DNA, 25 bp, Mus musculus
cgaatccccaggcacagaaggagct

SEQ ID NO: 255572 - DNA, 25 bp, Mus musculus
cgaatccccagtatgcagtgtatag

SEQ ID NO: 255573 - DNA, 25 bp, Mus musculus
cgaatcctatacccacctgtctctc

SEQ ID NO: 255574 - DNA, 25 bp, Mus musculus
cgaatcctgtgaagatgtggatgag

SEQ ID NO: 255575 - DNA, 25 bp, Mus musculus
cgaatccttagtggccaataggttg

SEQ ID NO: 255576 - DNA, 25 bp, Mus musculus
cgaatcctttgtcatctacatcatg

SEQ ID NO: 255577 - DNA, 25 bp, Mus musculus
cgaatcgaaggcctggacatacgca

SEQ ID NO: 255578 - DNA, 25 bp, Mus musculus
cgaatcggtgttgagaaactctctg

SEQ ID NO: 255579 - DNA, 25 bp, Mus musculus
cgaatctacagggatgaatggatcc

SEQ ID NO: 255580 - DNA, 25 bp, Mus musculus
cgaatctacaggttatacaatggtc

SEQ ID NO: 255581 - DNA, 25 bp, Mus musculus
cgaatctatggggagacaccagagg

SEQ ID NO: 255582 - DNA, 25 bp, Mus musculus
cgaatctccctggcgagtgactcag

SEQ ID NO: 255583 - DNA, 25 bp, Mus musculus
cgaatctgatgaggttgtcttgaag

SEQ ID NO: 255584 - DNA, 25 bp, Mus musculus
cgaatcttcgaggtgctggaaagac

SEQ ID NO: 255585 - DNA, 25 bp, Mus musculus
cgaatctttgagtgtgagaaacttt

SEQ ID NO: 255586 - DNA, 25 bp, Mus musculus
cgaatgaacggacaagaagtatttt

SEQ ID NO: 255587 - DNA, 25 bp, Mus musculus
cgaatgaacggacaagttgtgtgcg

SEQ ID NO: 255588 - DNA, 25 bp, Mus musculus
cgaatgacacccatgaaccgcacac

SEQ ID NO: 255589 - DNA, 25 bp, Mus musculus
cgaatgatcagatgagaggctgtaa

SEQ ID NO: 255590 - DNA, 25 bp, Mus musculus
cgaatgcaaggcaccaacagagaga

SEQ ID NO: 255591 - DNA, 25 bp, Mus musculus
cgaatgcaaggtgagagcacagagc

SEQ ID NO: 255592 - DNA, 25 bp, Mus musculus
cgaatgcagaggtgaggcatgaaat

SEQ ID NO: 255593 - DNA, 25 bp, Mus musculus
cgaatgcagccagcgggtattcccc

SEQ ID NO: 255594 - DNA, 25 bp, Mus musculus
cgaatgcagccagggcctgtgtttg

SEQ ID NO: 255595 - DNA, 25 bp, Mus musculus
cgaatgccctgcagggtttgtccgc

SEQ ID NO: 255596 - DNA, 25 bp, Mus musculus
cgaatgcctggtgcagccggatgtg

SEQ ID NO: 255597 - DNA, 25 bp, Mus musculus
cgaatggaaggagagtccagattac

SEQ ID NO: 255598 - DNA, 25 bp, Mus musculus
cgaatggacagggtaaagaaggaat

SEQ ID NO: 255599 - DNA, 25 bp, Mus musculus
cgaatggagggtggagcttttgtgg

SEQ ID NO: 255600 - DNA, 25 bp, Mus musculus
cgaatggatagccaggtgccagaac

SEQ ID NO: 255601 - DNA, 25 bp, Mus musculus
cgaatggtttttggtctcagtgtgt

SEQ ID NO: 255602 - DNA, 25 bp, Mus musculus
cgaatgtttcctgcaatcctgaacc

SEQ ID NO: 255603 - DNA, 25 bp, Mus musculus
cgaattacctattgaagtggacctt

SEQ ID NO: 255604 - DNA, 25 bp, Mus musculus
cgaattcatgcagcactatgccttc

SEQ ID NO: 255605 - DNA, 25 bp, Mus musculus
cgaattccagaaagatggaaccgcc

SEQ ID NO: 255606 - DNA, 25 bp, Mus musculus
cgaattccagaaagtgtctatcgca

SEQ ID NO: 255607 - DNA, 25 bp, Mus musculus
cgaattccggagctggactgaactt

SEQ ID NO: 255608 - DNA, 25 bp, Mus musculus
cgaattctgcagacccatgcagatg

SEQ ID NO: 255609 - DNA, 25 bp, Mus musculus
cgaattctgcaggtatccaacggtt

SEQ ID NO: 255610 - DNA, 25 bp, Mus musculus
cgaattctgcaggtcacgtacagtg

SEQ ID NO: 255611 - DNA, 25 bp, Mus musculus
cgaattgcagcatttgctgatgctg

SEQ ID NO: 255612 - DNA, 25 bp, Mus musculus
cgaattggggactttgcttgtggcc

SEQ ID NO: 255613 - DNA, 25 bp, Mus musculus
cgaattgtcaagcaataccaagacg

SEQ ID NO: 255614 - DNA, 25 bp, Mus musculus
cgaattgttgggatgattgcgaagg

SEQ ID NO: 255615 - DNA, 25 bp, Mus musculus
cgaatttaacacagtgttgctggcg

SEQ ID NO: 255616 - DNA, 25 bp, Mus musculus
cgaatttaagcgtctagccagctca

SEQ ID NO: 255617 - DNA, 25 bp, Mus musculus
cgaatttacccaaaggaagcctcaa

SEQ ID NO: 255618 - DNA, 25 bp, Mus musculus
cgaatttcaagcccatctctcacct

SEQ ID NO: 255619 - DNA, 25 bp, Mus musculus
cgaatttcaaggggacgatttggtc

SEQ ID NO: 255620 - DNA, 25 bp, Mus musculus
cgaatttcaaggtctttaagtggag

SEQ ID NO: 255621 - DNA, 25 bp, Mus musculus
cgacaaaactaatatccaggggatg

SEQ ID NO: 255622 - DNA, 25 bp, Mus musculus
cgacaaaactgctaacccagtagag

SEQ ID NO: 255623 - DNA, 25 bp, Mus musculus
cgacaaacaaaaagtactacaagaa

SEQ ID NO: 255624 - DNA, 25 bp, Mus musculus
cgacaaacagaacagaaaagaaatg

SEQ ID NO: 255625 - DNA, 25 bp, Mus musculus
cgacaaacagaatgcaacaaggatg

SEQ ID NO: 255626 - DNA, 25 bp, Mus musculus
cgacaaagccaaagctgctcagact

SEQ ID NO: 255627 - DNA, 25 bp, Mus musculus
cgacaaagtcaaggtgtatgagatg

SEQ ID NO: 255628 - DNA, 25 bp, Mus musculus
cgacaaataagatgcacgccatccc

SEQ ID NO: 255629 - DNA, 25 bp, Mus musculus
cgacaaatgcaggaatgtgctaaaa

SEQ ID NO: 255630 - DNA, 25 bp, Mus musculus
cgacaaatgtttggtcaatttggta

SEQ ID NO: 255631 - DNA, 25 bp, Mus musculus
cgacaacacagagtttcaaggcaaa

SEQ ID NO: 255632 - DNA, 25 bp, Mus musculus
cgacaacagcacaggcgtggtgact

SEQ ID NO: 255633 - DNA, 25 bp, Mus musculus
cgacaacagcccaaggagctcggat

SEQ ID NO: 255634 - DNA, 25 bp, Mus musculus
cgacaacatcctaggcttcatcgcc

SEQ ID NO: 255635 - DNA, 25 bp, Mus musculus
cgacaacatctggagagagacttgc

SEQ ID NO: 255636 - DNA, 25 bp, Mus musculus
cgacaacatgaatgaatctgagctc

SEQ ID NO: 255637 - DNA, 25 bp, Mus musculus
cgacaacatgcagggtgtgttggag

SEQ ID NO: 255638 - DNA, 25 bp, Mus musculus
cgacaactggaggaagagcagtcag

SEQ ID NO: 255639 - DNA, 25 bp, Mus musculus
cgacaagaactgctgagaagaagcc

SEQ ID NO: 255640 - DNA, 25 bp, Mus musculus
cgacaagatgcctggccgagtggtg

SEQ ID NO: 255641 - DNA, 25 bp, Mus musculus
cgacaagcagccagtctcaatggaa

SEQ ID NO: 255642 - DNA, 25 bp, Mus musculus
cgacaaggactccagaaaacatctc

SEQ ID NO: 255643 - DNA, 25 bp, Mus musculus
cgacaaggagatggacagtacagac

SEQ ID NO: 255644 - DNA, 25 bp, Mus musculus
cgacaaggcggcagactttctgcac

SEQ ID NO: 255645 - DNA, 25 bp, Mus musculus
cgacaaggtaaaagaagaaatgaaa

SEQ ID NO: 255646 - DNA, 25 bp, Mus musculus
cgacaagtaaagaatctgctggatg

SEQ ID NO: 255647 - DNA, 25 bp, Mus musculus
cgacaagttctccaccccctccacc

SEQ ID NO: 255648 - DNA, 25 bp, Mus musculus
cgacaatgacgatagaaagatcctc

SEQ ID NO: 255649 - DNA, 25 bp, Mus musculus
cgacaatgacgattctgactgccca

SEQ ID NO: 255650 - DNA, 25 bp, Mus musculus
cgacaatgatagaccaaactgcagc

SEQ ID NO: 255651 - DNA, 25 bp, Mus musculus
cgacaatgatagattcaaacaccga

SEQ ID NO: 255652 - DNA, 25 bp, Mus musculus
cgacaatgatgaagactctaaaata

SEQ ID NO: 255653 - DNA, 25 bp, Mus musculus
cgacaatgatgaaggaaagaagaaa

SEQ ID NO: 255654 - DNA, 25 bp, Mus musculus
cgacaatgcagctataaaaccattt

SEQ ID NO: 255655 - DNA, 25 bp, Mus musculus
cgacacaatacaaaagaaagaaaat

SEQ ID NO: 255656 - DNA, 25 bp, Mus musculus
cgacacaggtggagaatataaatat

SEQ ID NO: 255657 - DNA, 25 bp, Mus musculus
cgacacaggtgtgtatccagagtgt

SEQ ID NO: 255658 - DNA, 25 bp, Mus musculus
cgacaccaaaagggctcaggatgct

SEQ ID NO: 255659 - DNA, 25 bp, Mus musculus
cgacaccaaggagtcagtccgaccg

SEQ ID NO: 255660 - DNA, 25 bp, Mus musculus
cgacaccggcagaaaaagttacgtc

SEQ ID NO: 255661 - DNA, 25 bp, Mus musculus
cgacaccggcagttccagttactat

SEQ ID NO: 255662 - DNA, 25 bp, Mus musculus
cgacacctccgactgctctttgtca

SEQ ID NO: 255663 - DNA, 25 bp, Mus musculus
cgacacctccgactgggaggagaag

SEQ ID NO: 255664 - DNA, 25 bp, Mus musculus
cgacaccttggggcaacctatccaa

SEQ ID NO: 255665 - DNA, 25 bp, Mus musculus
cgacacgccagataacacaactgga

SEQ ID NO: 255666 - DNA, 25 bp, Mus musculus
cgacacgccggagtctgagggtggc

SEQ ID NO: 255667 - DNA, 25 bp, Mus musculus
cgacacggagacgaccatgccgtcc

SEQ ID NO: 255668 - DNA, 25 bp, Mus musculus
cgacacgttttttgccattggtgtc

SEQ ID NO: 255669 - DNA, 25 bp, Mus musculus
cgacactcacagaaggtggcttaaa

SEQ ID NO: 255670 - DNA, 25 bp, Mus musculus
cgacactcacagaaggtgtaacacg

SEQ ID NO: 255671 - DNA, 25 bp, Mus musculus
cgacactcattcccagacccagtga

SEQ ID NO: 255672 - DNA, 25 bp, Mus musculus
cgacactgccaggtgtggcgctaat

SEQ ID NO: 255673 - DNA, 25 bp, Mus musculus
cgacactgtacttcgcagatatggc

SEQ ID NO: 255674 - DNA, 25 bp, Mus musculus
cgacactgtagccacgcgagttgtt

SEQ ID NO: 255675 - DNA, 25 bp, Mus musculus
cgacacttacgagcatacatctttg

SEQ ID NO: 255676 - DNA, 25 bp, Mus musculus
cgacacttacgataaactttataat

SEQ ID NO: 255677 - DNA, 25 bp, Mus musculus
cgacacttggacgttcatgagggat

SEQ ID NO: 255678 - DNA, 25 bp, Mus musculus
cgacagaaaaatctcatcagagttg

SEQ ID NO: 255679 - DNA, 25 bp, Mus musculus
cgacagaaaaatgcatacacagact

SEQ ID NO: 255680 - DNA, 25 bp, Mus musculus
cgacagaaagatgtccgaccccgga

SEQ ID NO: 255681 - DNA, 25 bp, Mus musculus
cgacagaaaggaatcccaatgctga

SEQ ID NO: 255682 - DNA, 25 bp, Mus musculus
cgacagacagctattatctggaaag

SEQ ID NO: 255683 - DNA, 25 bp, Mus musculus
cgacagagcccaggagcacctcaac

SEQ ID NO: 255684 - DNA, 25 bp, Mus musculus
cgacagagcccaggtctgctgcctt

SEQ ID NO: 255685 - DNA, 25 bp, Mus musculus
cgacagagtgtgtggaggagtgatg

SEQ ID NO: 255686 - DNA, 25 bp, Mus musculus
cgacagatattcagcaagccccgcc

SEQ ID NO: 255687 - DNA, 25 bp, Mus musculus
cgacagattggttctaggtcttata

SEQ ID NO: 255688 - DNA, 25 bp, Mus musculus
cgacagcaaattcaactacagtggg

SEQ ID NO: 255689 - DNA, 25 bp, Mus musculus
cgacagcagacagaagtgggagcag

SEQ ID NO: 255690 - DNA, 25 bp, Mus musculus
cgacagcagagaaacatggcttagt

SEQ ID NO: 255691 - DNA, 25 bp, Mus musculus
cgacagcagagagagggagttgagg

SEQ ID NO: 255692 - DNA, 25 bp, Mus musculus
cgacagcagagagagttggatgaaa

SEQ ID NO: 255693 - DNA, 25 bp, Mus musculus
cgacagcagatgctggacatccagg

SEQ ID NO: 255694 - DNA, 25 bp, Mus musculus
cgacagcaggaagacaggaagatct

SEQ ID NO: 255695 - DNA, 25 bp, Mus musculus
cgacagcaggaaggaaagaaaggag

SEQ ID NO: 255696 - DNA, 25 bp, Mus musculus
cgacagcatcaaaatgccaggcagg

SEQ ID NO: 255697 - DNA, 25 bp, Mus musculus
cgacagcatcaaggacaattcaagc

SEQ ID NO: 255698 - DNA, 25 bp, Mus musculus
cgacagcatcaaggcctgggaggag

SEQ ID NO: 255699 - DNA, 25 bp, Mus musculus
cgacagcattgtgagagctgtggaa

SEQ ID NO: 255700 - DNA, 25 bp, Mus musculus
cgacagcattgtgagagtgaaaagc

SEQ ID NO: 255701 - DNA, 25 bp, Mus musculus
cgacagccaggtatgccatcatgcc

SEQ ID NO: 255702 - DNA, 25 bp, Mus musculus
cgacagccaggtccccctggagcct

SEQ ID NO: 255703 - DNA, 25 bp, Mus musculus
cgacagcccaagcgaaccccagctg

SEQ ID NO: 255704 - DNA, 25 bp, Mus musculus
cgacagcccatctgctgctcctgca

SEQ ID NO: 255705 - DNA, 25 bp, Mus musculus
cgacagcccgaaagaccacaactcg

SEQ ID NO: 255706 - DNA, 25 bp, Mus musculus
cgacagcctgatgggggatgagtct

SEQ ID NO: 255707 - DNA, 25 bp, Mus musculus
cgacagcctgattggagatagcaac

SEQ ID NO: 255708 - DNA, 25 bp, Mus musculus
cgacagcctgcagccagccaggacc

SEQ ID NO: 255709 - DNA, 25 bp, Mus musculus
cgacagcctgcaggatgctttgctg

SEQ ID NO: 255710 - DNA, 25 bp, Mus musculus
cgacagcggcaaaatagtgtttcta

SEQ ID NO: 255711 - DNA, 25 bp, Mus musculus
cgacagcgggcgggattcccgaagc

SEQ ID NO: 255712 - DNA, 25 bp, Mus musculus
cgacagctgatggttccagcatctt

SEQ ID NO: 255713 - DNA, 25 bp, Mus musculus
cgacaggaaatgcttgcccctaagc

SEQ ID NO: 255714 - DNA, 25 bp, Mus musculus
cgacaggaaatggctctctgctacc

SEQ ID NO: 255715 - DNA, 25 bp, Mus musculus
cgacaggaatacgagaaagccctgc

SEQ ID NO: 255716 - DNA, 25 bp, Mus musculus
cgacaggcacagctactatgtgtgt

SEQ ID NO: 255717 - DNA, 25 bp, Mus musculus
cgacaggcacaggtcgaggtggcgc

SEQ ID NO: 255718 - DNA, 25 bp, Mus musculus
cgacaggcctaagtgtccaccatca

SEQ ID NO: 255719 - DNA, 25 bp, Mus musculus
cgacaggcttcaagagtggtcttgt

SEQ ID NO: 255720 - DNA, 25 bp, Mus musculus
cgacaggcttcacttcatcttcatg

SEQ ID NO: 255721 - DNA, 25 bp, Mus musculus
cgacagtaagtacagttgatacact

SEQ ID NO: 255722 - DNA, 25 bp, Mus musculus
cgacagtacagaaccaacgaaacgt

SEQ ID NO: 255723 - DNA, 25 bp, Mus musculus
cgacagtacagggttagctgagttg

SEQ ID NO: 255724 - DNA, 25 bp, Mus musculus
cgacagtacctggaggagctgcagt

SEQ ID NO: 255725 - DNA, 25 bp, Mus musculus
cgacagtcctgcagatcgtcctgct

SEQ ID NO: 255726 - DNA, 25 bp, Mus musculus
cgacagtgagcgggggctgagtgtc

SEQ ID NO: 255727 - DNA, 25 bp, Mus musculus
cgacagtgcgaaaattttgccaaag

SEQ ID NO: 255728 - DNA, 25 bp, Mus musculus
cgacagtggatccagatctcggacg

SEQ ID NO: 255729 - DNA, 25 bp, Mus musculus
cgacagtggtgaacattagcaacaa

SEQ ID NO: 255730 - DNA, 25 bp, Mus musculus
cgacagtggtgaagggacacgcctg

SEQ ID NO: 255731 - DNA, 25 bp, Mus musculus
cgacagttcacagggaaccccaata

SEQ ID NO: 255732 - DNA, 25 bp, Mus musculus
cgacagttcatcagaggagaaatgg

SEQ ID NO: 255733 - DNA, 25 bp, Mus musculus
cgacatagaaaggccaccttagggg

SEQ ID NO: 255734 - DNA, 25 bp, Mus musculus
cgacatagaaagggagccacccagc

SEQ ID NO: 255735 - DNA, 25 bp, Mus musculus
cgacatcacaagagccccatgctaa

SEQ ID NO: 255736 - DNA, 25 bp, Mus musculus
cgacatcacaaggatgatgagggtg

SEQ ID NO: 255737 - DNA, 25 bp, Mus musculus
cgacatcactcagctttccactgcc

SEQ ID NO: 255738 - DNA, 25 bp, Mus musculus
cgacatcctcgcccaaggagagctc

SEQ ID NO: 255739 - DNA, 25 bp, Mus musculus
cgacatccttcaggctggtggctgg

SEQ ID NO: 255740 - DNA, 25 bp, Mus musculus
cgacatcgaagacatgctccagctc

SEQ ID NO: 255741 - DNA, 25 bp, Mus musculus
cgacatcgacatcaagatcatcgcc

SEQ ID NO: 255742 - DNA, 25 bp, Mus musculus
cgacatcgatttcgggacctacccc

SEQ ID NO: 255743 - DNA, 25 bp, Mus musculus
cgacatctcaggtgtcgttgacatt

SEQ ID NO: 255744 - DNA, 25 bp, Mus musculus
cgacatctgtagcatatatccggtc

SEQ ID NO: 255745 - DNA, 25 bp, Mus musculus
cgacatgactgccaagattcatgaa

SEQ ID NO: 255746 - DNA, 25 bp, Mus musculus
cgacatgagcaaggtctttgaagta

SEQ ID NO: 255747 - DNA, 25 bp, Mus musculus
cgacatgagcctgcctttaccccag

SEQ ID NO: 255748 - DNA, 25 bp, Mus musculus
cgacatgccccccaggagagtgtgc

SEQ ID NO: 255749 - DNA, 25 bp, Mus musculus
cgacatggaagcaagtgtggaggca

SEQ ID NO: 255750 - DNA, 25 bp, Mus musculus
cgacatggagatgagtgtgaatgtc

SEQ ID NO: 255751 - DNA, 25 bp, Mus musculus
cgacatggagcggagcctctctgcc

SEQ ID NO: 255752 - DNA, 25 bp, Mus musculus
cgacatggagcggaggtctcattgg

SEQ ID NO: 255753 - DNA, 25 bp, Mus musculus
cgacatggaggaccctctgtcattt

SEQ ID NO: 255754 - DNA, 25 bp, Mus musculus
cgacatggaggatgacttgaaagta

SEQ ID NO: 255755 - DNA, 25 bp, Mus musculus
cgacatggctgcaagaaaatgccag

SEQ ID NO: 255756 - DNA, 25 bp, Mus musculus
cgacatgttcaaggtaattcagaga

SEQ ID NO: 255757 - DNA, 25 bp, Mus musculus
cgacattacctcagagctgtggaac

SEQ ID NO: 255758 - DNA, 25 bp, Mus musculus
cgacattccaacacttcaaactcaa

SEQ ID NO: 255759 - DNA, 25 bp, Mus musculus
cgacattccaacgtgtccgatccgt

SEQ ID NO: 255760 - DNA, 25 bp, Mus musculus
cgacattgataatccgctggctcgg

SEQ ID NO: 255761 - DNA, 25 bp, Mus musculus
cgacattttactaagagatgtggct

SEQ ID NO: 255762 - DNA, 25 bp, Mus musculus
cgacatttttaacagaagcaaaccc

SEQ ID NO: 255763 - DNA, 25 bp, Mus musculus
cgacatttttaacagattagttcat

SEQ ID NO: 255764 - DNA, 25 bp, Mus musculus
cgaccaaagaccacgtggatgaagg

SEQ ID NO: 255765 - DNA, 25 bp, Mus musculus
cgaccaacagaaaacaagcacgagg

SEQ ID NO: 255766 - DNA, 25 bp, Mus musculus
cgaccaacagattcctgttgcgtgt

SEQ ID NO: 255767 - DNA, 25 bp, Mus musculus
cgaccaagaagcagccgatcaaaat

SEQ ID NO: 255768 - DNA, 25 bp, Mus musculus
cgaccaagaagcagtcgttccccat

SEQ ID NO: 255769 - DNA, 25 bp, Mus musculus
cgaccaagaagcttcgttacactaa

SEQ ID NO: 255770 - DNA, 25 bp, Mus musculus
cgaccaagacgcaaatggaacttcc

SEQ ID NO: 255771 - DNA, 25 bp, Mus musculus
cgaccaatgagggagagcccatgag

SEQ ID NO: 255772 - DNA, 25 bp, Mus musculus
cgaccacacagcggggagaaggttg

SEQ ID NO: 255773 - DNA, 25 bp, Mus musculus
cgaccacacagcggtcgctatgcat

SEQ ID NO: 255774 - DNA, 25 bp, Mus musculus
cgaccactgctacagctgctcctac

SEQ ID NO: 255775 - DNA, 25 bp, Mus musculus
cgaccagaagagagccaagcctccc

SEQ ID NO: 255776 - DNA, 25 bp, Mus musculus
cgaccagaggcagagtgaagaaatc

SEQ ID NO: 255777 - DNA, 25 bp, Mus musculus
cgaccagatgcggtggtagcaaagg

SEQ ID NO: 255778 - DNA, 25 bp, Mus musculus
cgaccaggatgttgacctaaagatt

SEQ ID NO: 255779 - DNA, 25 bp, Mus musculus
cgaccaggatgttgagaaagcaact

SEQ ID NO: 255780 - DNA, 25 bp, Mus musculus
cgaccaggcctgtcttcagtcccct

SEQ ID NO: 255781 - DNA, 25 bp, Mus musculus
cgaccagtggggagtggagctgggg

SEQ ID NO: 255782 - DNA, 25 bp, Mus musculus
cgaccagtggggctggggaagcagc

SEQ ID NO: 255783 - DNA, 25 bp, Mus musculus
cgaccatgaagacaccgtggaaggt

SEQ ID NO: 255784 - DNA, 25 bp, Mus musculus
cgaccatgaagatgaagcggcagct

SEQ ID NO: 255785 - DNA, 25 bp, Mus musculus
cgaccatgaaggtttataagaaaca

SEQ ID NO: 255786 - DNA, 25 bp, Mus musculus
cgaccattagtcagagaattgtaag

SEQ ID NO: 255787 - DNA, 25 bp, Mus musculus
cgacccaagttgcatttaaatatta

SEQ ID NO: 255788 - DNA, 25 bp, Mus musculus
cgacccaagttgctggacaaatttg

SEQ ID NO: 255789 - DNA, 25 bp, Mus musculus
cgacccaatacagtgttatttctgc

SEQ ID NO: 255790 - DNA, 25 bp, Mus musculus
cgacccacacgtcaaactacaactc

SEQ ID NO: 255791 - DNA, 25 bp, Mus musculus
cgacccacagagaggccgtgagacc

SEQ ID NO: 255792 - DNA, 25 bp, Mus musculus
cgacccacagagggagcatgacttc

SEQ ID NO: 255793 - DNA, 25 bp, Mus musculus
cgacccacagatccctctagctgag

SEQ ID NO: 255794 - DNA, 25 bp, Mus musculus
cgacccaccacgggagccaggtatg

SEQ ID NO: 255795 - DNA, 25 bp, Mus musculus
cgacccagagcttagttcacaagcc

SEQ ID NO: 255796 - DNA, 25 bp, Mus musculus
cgacccaggacgagggcttcatcac

SEQ ID NO: 255797 - DNA, 25 bp, Mus musculus
cgacccaggccagatgaacgatgga

SEQ ID NO: 255798 - DNA, 25 bp, Mus musculus
cgacccatgaagactcttgggagga

SEQ ID NO: 255799 - DNA, 25 bp, Mus musculus
cgacccatgaagatcccaattatct

SEQ ID NO: 255800 - DNA, 25 bp, Mus musculus
cgaccccaaaccaccctgctgagac

SEQ ID NO: 255801 - DNA, 25 bp, Mus musculus
cgaccccacaatcgaagatgcttat

SEQ ID NO: 255802 - DNA, 25 bp, Mus musculus
cgaccccacaatcggcagagttcac

SEQ ID NO: 255803 - DNA, 25 bp, Mus musculus
cgaccccacgtgctcctggcccaga

SEQ ID NO: 255804 - DNA, 25 bp, Mus musculus
cgaccccaggaagagcctccacctc

SEQ ID NO: 255805 - DNA, 25 bp, Mus musculus
cgaccccaggaagaggacatgacag

SEQ ID NO: 255806 - DNA, 25 bp, Mus musculus
cgacccccaggctcaacagtgtaca

SEQ ID NO: 255807 - DNA, 25 bp, Mus musculus
cgacccccagggagaggcagagttt

SEQ ID NO: 255808 - DNA, 25 bp, Mus musculus
cgaccccggcaggtcagaagacatg

SEQ ID NO: 255809 - DNA, 25 bp, Mus musculus
cgacccctgcaggaagtggccagat

SEQ ID NO: 255810 - DNA, 25 bp, Mus musculus
cgacccctgcgaggggacatgcttc

SEQ ID NO: 255811 - DNA, 25 bp, Mus musculus
cgaccccttggaagaacttgcaaaa

SEQ ID NO: 255812 - DNA, 25 bp, Mus musculus
cgacccgaagagtacagtcgttttg

SEQ ID NO: 255813 - DNA, 25 bp, Mus musculus
cgacccgaaggtcgttttgaagcta

SEQ ID NO: 255814 - DNA, 25 bp, Mus musculus
cgacccgacccaaggcatgcgccaa

SEQ ID NO: 255815 - DNA, 25 bp, Mus musculus
cgacccgttgatgtgacccggtttg

SEQ ID NO: 255816 - DNA, 25 bp, Mus musculus
cgaccctaggccagataaggaattg

SEQ ID NO: 255817 - DNA, 25 bp, Mus musculus
cgaccctcaagtgccctgtgatgct

SEQ ID NO: 255818 - DNA, 25 bp, Mus musculus
cgaccctctaaagacaagattgagg

SEQ ID NO: 255819 - DNA, 25 bp, Mus musculus
cgaccctctaaagacatcgcctggt

SEQ ID NO: 255820 - DNA, 25 bp, Mus musculus
cgaccctctaaggatatgctgtcat

SEQ ID NO: 255821 - DNA, 25 bp, Mus musculus
cgaccctgaagggacctttgacgcg

SEQ ID NO: 255822 - DNA, 25 bp, Mus musculus
cgaccctgaaggtggacttgtttgt

SEQ ID NO: 255823 - DNA, 25 bp, Mus musculus
cgaccctgacagagtcatgtggctg

SEQ ID NO: 255824 - DNA, 25 bp, Mus musculus
cgaccctgagcttgcaagatacctc

SEQ ID NO: 255825 - DNA, 25 bp, Mus musculus
cgaccctgagttctgaggctctaag

SEQ ID NO: 255826 - DNA, 25 bp, Mus musculus
cgaccctgcaagagttctttttgca

SEQ ID NO: 255827 - DNA, 25 bp, Mus musculus
cgaccctgcaagatggagggggcag

SEQ ID NO: 255828 - DNA, 25 bp, Mus musculus
cgaccgactggaggatgctttgctg

SEQ ID NO: 255829 - DNA, 25 bp, Mus musculus
cgaccgattcccagcttccaccatc

SEQ ID NO: 255830 - DNA, 25 bp, Mus musculus
cgaccgcaaggtcaactcctggagt

SEQ ID NO: 255831 - DNA, 25 bp, Mus musculus
cgaccgcagacgggaccttcttttg

SEQ ID NO: 255832 - DNA, 25 bp, Mus musculus
cgaccgcagacgggagctgcaaagt

SEQ ID NO: 255833 - DNA, 25 bp, Mus musculus
cgaccgcccgaaacaagaagcacta

SEQ ID NO: 255834 - DNA, 25 bp, Mus musculus
cgaccgcccggtagtgtctctattg

SEQ ID NO: 255835 - DNA, 25 bp, Mus musculus
cgaccgcccggtgttgcttctgctg

SEQ ID NO: 255836 - DNA, 25 bp, Mus musculus
cgaccgctccaagtttgttgaaagt

SEQ ID NO: 255837 - DNA, 25 bp, Mus musculus
cgaccgctgactcggatcgagccct

SEQ ID NO: 255838 - DNA, 25 bp, Mus musculus
cgaccgctgactcggccaaccaatg

SEQ ID NO: 255839 - DNA, 25 bp, Mus musculus
cgaccgctgactcgggtcattacaa

SEQ ID NO: 255840 - DNA, 25 bp, Mus musculus
cgaccgctgcaccccgtcagtcata

SEQ ID NO: 255841 - DNA, 25 bp, Mus musculus
cgaccgctgcacgccggcatgtgtt

SEQ ID NO: 255842 - DNA, 25 bp, Mus musculus
cgaccgctgcacgccgtaatttcta

SEQ ID NO: 255843 - DNA, 25 bp, Mus musculus
cgaccggcctctctggaggaaatcc

SEQ ID NO: 255844 - DNA, 25 bp, Mus musculus
cgaccggcgcggcaggtaccagctg

SEQ ID NO: 255845 - DNA, 25 bp, Mus musculus
cgaccggcgcggcagtctgcgagta

SEQ ID NO: 255846 - DNA, 25 bp, Mus musculus
cgaccggctgaaggcagacacatct

SEQ ID NO: 255847 - DNA, 25 bp, Mus musculus
cgaccggctgaaggcttgtgaaaaa

SEQ ID NO: 255848 - DNA, 25 bp, Mus musculus
cgaccggctgaagggcctctggaaa

SEQ ID NO: 255849 - DNA, 25 bp, Mus musculus
cgaccgggacaggcaagcacaagct

SEQ ID NO: 255850 - DNA, 25 bp, Mus musculus
cgaccgggacaggcaccttctgtat

SEQ ID NO: 255851 - DNA, 25 bp, Mus musculus
cgaccgggcagaggcggaacgtgat

SEQ ID NO: 255852 - DNA, 25 bp, Mus musculus
cgaccggttccaggatccagccgca

SEQ ID NO: 255853 - DNA, 25 bp, Mus musculus
cgaccgtccggtgcgtataactgtg

SEQ ID NO: 255854 - DNA, 25 bp, Mus musculus
cgaccgtccggtgttctggctgatg

SEQ ID NO: 255855 - DNA, 25 bp, Mus musculus
cgaccgtgatggtaacaaatcacaa

SEQ ID NO: 255856 - DNA, 25 bp, Mus musculus
cgacctacaggacagctatacagct

SEQ ID NO: 255857 - DNA, 25 bp, Mus musculus
cgacctacaggaggggcccggcctt

SEQ ID NO: 255858 - DNA, 25 bp, Mus musculus
cgacctacctcagggaagagtccca

SEQ ID NO: 255859 - DNA, 25 bp, Mus musculus
cgacctacctcagggagcagaaggc

SEQ ID NO: 255860 - DNA, 25 bp, Mus musculus
cgacctagaaggttttaggctagcc

SEQ ID NO: 255861 - DNA, 25 bp, Mus musculus
cgacctatctgaaagaccccgcttg

SEQ ID NO: 255862 - DNA, 25 bp, Mus musculus
cgacctatctgaaagattgctgaag

SEQ ID NO: 255863 - DNA, 25 bp, Mus musculus
cgacctcacaaggtgactggacaga

SEQ ID NO: 255864 - DNA, 25 bp, Mus musculus
cgacctcacaagtgcacgatctgat

SEQ ID NO: 255865 - DNA, 25 bp, Mus musculus
cgacctcagagcaggtcactttgaa

SEQ ID NO: 255866 - DNA, 25 bp, Mus musculus
cgacctcatctaggtacgtaggtgc

SEQ ID NO: 255867 - DNA, 25 bp, Mus musculus
cgacctcattatccagatacacaga

SEQ ID NO: 255868 - DNA, 25 bp, Mus musculus
cgacctccaaatggttctgaatcag

SEQ ID NO: 255869 - DNA, 25 bp, Mus musculus
cgacctccctaggattctcaaagct

SEQ ID NO: 255870 - DNA, 25 bp, Mus musculus
cgacctccctaggtgaggattatga

SEQ ID NO: 255871 - DNA, 25 bp, Mus musculus
cgacctccgcaatttcaccgagatg

SEQ ID NO: 255872 - DNA, 25 bp, Mus musculus
cgacctccgcagctaggtaattttt

SEQ ID NO: 255873 - DNA, 25 bp, Mus musculus
cgacctcctgagaaacagtcatgga

SEQ ID NO: 255874 - DNA, 25 bp, Mus musculus
cgacctcctgataggcaacatgtcg

SEQ ID NO: 255875 - DNA, 25 bp, Mus musculus
cgacctctagaagcgaaggaataca

SEQ ID NO: 255876 - DNA, 25 bp, Mus musculus
cgacctctgtggtaacatggccaac

SEQ ID NO: 255877 - DNA, 25 bp, Mus musculus
cgacctgaaagctttacaactcctg

SEQ ID NO: 255878 - DNA, 25 bp, Mus musculus
cgacctgagccccgagcctttgaca

SEQ ID NO: 255879 - DNA, 25 bp, Mus musculus
cgacctgattgaaagtaatcaccca

SEQ ID NO: 255880 - DNA, 25 bp, Mus musculus
cgacctgattgaaagtataattgca

SEQ ID NO: 255881 - DNA, 25 bp, Mus musculus
cgacctgcacaagcaaaacctggaa

SEQ ID NO: 255882 - DNA, 25 bp, Mus musculus
cgacctgcagctttcctgcctgtga

SEQ ID NO: 255883 - DNA, 25 bp, Mus musculus
cgacctgcagggattgctgatggaa

SEQ ID NO: 255884 - DNA, 25 bp, Mus musculus
cgacctgccggcggggtctcctgtg

SEQ ID NO: 255885 - DNA, 25 bp, Mus musculus
cgacctggagcgtgtatcgacagtg

SEQ ID NO: 255886 - DNA, 25 bp, Mus musculus
cgacctggcagaaagggctgaggcc

SEQ ID NO: 255887 - DNA, 25 bp, Mus musculus
cgacctggccagtaaaagctggcag

SEQ ID NO: 255888 - DNA, 25 bp, Mus musculus
cgacctggtcagtcttacttctcgc

SEQ ID NO: 255889 - DNA, 25 bp, Mus musculus
cgacctggtgacccacaaccgcact

SEQ ID NO: 255890 - DNA, 25 bp, Mus musculus
cgacctgtcatcagatgacctcatc

SEQ ID NO: 255891 - DNA, 25 bp, Mus musculus
cgaccttactatgaggtctacacca

SEQ ID NO: 255892 - DNA, 25 bp, Mus musculus
cgaccttactatggagaaggaagca

SEQ ID NO: 255893 - DNA, 25 bp, Mus musculus
cgaccttcagggaaaatgccaagtg

SEQ ID NO: 255894 - DNA, 25 bp, Mus musculus
cgaccttccagcagcagcatgaagc

SEQ ID NO: 255895 - DNA, 25 bp, Mus musculus
cgaccttccaggagatcctgaacac

SEQ ID NO: 255896 - DNA, 25 bp, Mus musculus
cgaccttccaggttttgggaactca

SEQ ID NO: 255897 - DNA, 25 bp, Mus musculus
cgacctttggccaggcttacagttc

SEQ ID NO: 255898 - DNA, 25 bp, Mus musculus
cgacctttgtaaaagaatgatagag

SEQ ID NO: 255899 - DNA, 25 bp, Mus musculus
cgacgaaatcgggaagctctttgtg

SEQ ID NO: 255900 - DNA, 25 bp, Mus musculus
cgacgaactccaggatgtgtttgtc

SEQ ID NO: 255901 - DNA, 25 bp, Mus musculus
cgacgaagtggtcggaattctgcct

SEQ ID NO: 255902 - DNA, 25 bp, Mus musculus
cgacgacctccacaaggttctgaat

SEQ ID NO: 255903 - DNA, 25 bp, Mus musculus
cgacgacgacagtttcagccctctt

SEQ ID NO: 255904 - DNA, 25 bp, Mus musculus
cgacgacgacgagattttccagggc

SEQ ID NO: 255905 - DNA, 25 bp, Mus musculus
cgacgacgacgagctagacgagacc

SEQ ID NO: 255906 - DNA, 25 bp, Mus musculus
cgacgacgagattttccagggcagc

SEQ ID NO: 255907 - DNA, 25 bp, Mus musculus
cgacgacgagctagacgagaccctg

SEQ ID NO: 255908 - DNA, 25 bp, Mus musculus
cgacgacgatcttggatctagcaat

SEQ ID NO: 255909 - DNA, 25 bp, Mus musculus
cgacgacggcgaagagttcatatgg

SEQ ID NO: 255910 - DNA, 25 bp, Mus musculus
cgacgagaaaaagctggagagatgt

SEQ ID NO: 255911 - DNA, 25 bp, Mus musculus
cgacgagctggcgggtgaaaatttt

SEQ ID NO: 255912 - DNA, 25 bp, Mus musculus
cgacgagctggcggttttgtaccaa

SEQ ID NO: 255913 - DNA, 25 bp, Mus musculus
cgacgagtccagattgctgaagcta

SEQ ID NO: 255914 - DNA, 25 bp, Mus musculus
cgacgatcagaagactcacagtggt

SEQ ID NO: 255915 - DNA, 25 bp, Mus musculus
cgacgatcagaagatgcgctgatcc

SEQ ID NO: 255916 - DNA, 25 bp, Mus musculus
cgacgatgactcccctgcaactgtg

SEQ ID NO: 255917 - DNA, 25 bp, Mus musculus
cgacgatttcagaatgctccccggg

SEQ ID NO: 255918 - DNA, 25 bp, Mus musculus
cgacgcagcaggtcttctatcagaa

SEQ ID NO: 255919 - DNA, 25 bp, Mus musculus
cgacgcagcgctagcctaaattgta

SEQ ID NO: 255920 - DNA, 25 bp, Mus musculus
cgacgcatgctggcgatgcccctag

SEQ ID NO: 255921 - DNA, 25 bp, Mus musculus
cgacgcccaaggaccacctaccctg

SEQ ID NO: 255922 - DNA, 25 bp, Mus musculus
cgacgccgcgaggatctaagatgtc

SEQ ID NO: 255923 - DNA, 25 bp, Mus musculus
cgacgccgcggcagccagtcccgct

SEQ ID NO: 255924 - DNA, 25 bp, Mus musculus
cgacgccttccccagctgggccgcg

SEQ ID NO: 255925 - DNA, 25 bp, Mus musculus
cgacgccttgccaccccgctggggt

SEQ ID NO: 255926 - DNA, 25 bp, Mus musculus
cgacgccttggtcactggcacaagc

SEQ ID NO: 255927 - DNA, 25 bp, Mus musculus
cgacgccttggtctgtgtgtggtat

SEQ ID NO: 255928 - DNA, 25 bp, Mus musculus
cgacgcgcctttccctctggagccc

SEQ ID NO: 255929 - DNA, 25 bp, Mus musculus
cgacgcgcctttcctctctggagag

SEQ ID NO: 255930 - DNA, 25 bp, Mus musculus
cgacgcgcctttctccaccccaggc

SEQ ID NO: 255931 - DNA, 25 bp, Mus musculus
cgacgcgcggaggaaaacttggtta

SEQ ID NO: 255932 - DNA, 25 bp, Mus musculus
cgacgctgacatggactgggctgtg

SEQ ID NO: 255933 - DNA, 25 bp, Mus musculus
cgacgctggctctctcttggcctgt

SEQ ID NO: 255934 - DNA, 25 bp, Mus musculus
cgacgctttggatgagtgtgaactg

SEQ ID NO: 255935 - DNA, 25 bp, Mus musculus
cgacgctttggatggctcccggacc

SEQ ID NO: 255936 - DNA, 25 bp, Mus musculus
cgacgctttggatggtgatgatgaa

SEQ ID NO: 255937 - DNA, 25 bp, Mus musculus
cgacgctttggatgtgccttcggag

SEQ ID NO: 255938 - DNA, 25 bp, Mus musculus
cgacggaagctgagccagacccagg

SEQ ID NO: 255939 - DNA, 25 bp, Mus musculus
cgacggaagctgatcctcttcccag

SEQ ID NO: 255940 - DNA, 25 bp, Mus musculus
cgacggaggcagcatctgcatctct

SEQ ID NO: 255941 - DNA, 25 bp, Mus musculus
cgacggcacactgaaaagatccgct

SEQ ID NO: 255942 - DNA, 25 bp, Mus musculus
cgacggcacactgatgagcgcccct

SEQ ID NO: 255943 - DNA, 25 bp, Mus musculus
cgacggcacagagctcctggccagt

SEQ ID NO: 255944 - DNA, 25 bp, Mus musculus
cgacggcccaagcctactcgcccag

SEQ ID NO: 255945 - DNA, 25 bp, Mus musculus
cgacggccctaagggtggaactact

SEQ ID NO: 255946 - DNA, 25 bp, Mus musculus
cgacggccctaaggtttgaggattg

SEQ ID NO: 255947 - DNA, 25 bp, Mus musculus
cgacggccctaagtgggagccggtg

SEQ ID NO: 255948 - DNA, 25 bp, Mus musculus
cgacggcctggtagtattaaaggaa

SEQ ID NO: 255949 - DNA, 25 bp, Mus musculus
cgacggcgaagagttcatatgggaa

SEQ ID NO: 255950 - DNA, 25 bp, Mus musculus
cgacggcgctatggtggattgtcca

SEQ ID NO: 255951 - DNA, 25 bp, Mus musculus
cgacggcgtgacctccaactacatt

SEQ ID NO: 255952 - DNA, 25 bp, Mus musculus
cgacgggaaggagtggaaaagagag

SEQ ID NO: 255953 - DNA, 25 bp, Mus musculus
cgacgggaaggagttatccagcttg

SEQ ID NO: 255954 - DNA, 25 bp, Mus musculus
cgacgggcgggactggtctccaaaa

SEQ ID NO: 255955 - DNA, 25 bp, Mus musculus
cgacggttccgagctgtagccctca

SEQ ID NO: 255956 - DNA, 25 bp, Mus musculus
cgacgtctggagaatgctgggaccc

SEQ ID NO: 255957 - DNA, 25 bp, Mus musculus
cgacgtctggagcttcggggttctt

SEQ ID NO: 255958 - DNA, 25 bp, Mus musculus
cgacgtgaaagactggaggccagca

SEQ ID NO: 255959 - DNA, 25 bp, Mus musculus
cgacgtgctcaccagtttgacttcg

SEQ ID NO: 255960 - DNA, 25 bp, Mus musculus
cgacgtgctggtaggcccacagaac

SEQ ID NO: 255961 - DNA, 25 bp, Mus musculus
cgacgtggactacaagatgtcccac

SEQ ID NO: 255962 - DNA, 25 bp, Mus musculus
cgacgtggaggaggtattcacagaa

SEQ ID NO: 255963 - DNA, 25 bp, Mus musculus
cgacgtgggccagaggcttcatgtg

SEQ ID NO: 255964 - DNA, 25 bp, Mus musculus
cgacgtgggccagagggtccaggtg

SEQ ID NO: 255965 - DNA, 25 bp, Mus musculus
cgacgtggtcaagacccagagaaca

SEQ ID NO: 255966 - DNA, 25 bp, Mus musculus
cgacgtggtcaagattgactttgaa

SEQ ID NO: 255967 - DNA, 25 bp, Mus musculus
cgacgttaagcagattttgaagcat

SEQ ID NO: 255968 - DNA, 25 bp, Mus musculus
cgacgttaagcagatttttcattac

SEQ ID NO: 255969 - DNA, 25 bp, Mus musculus
cgacgttaatgagtgcaatgctcac

SEQ ID NO: 255970 - DNA, 25 bp, Mus musculus
cgactaaatagctggaccacgttca

SEQ ID NO: 255971 - DNA, 25 bp, Mus musculus
cgactaagcaggaagggatggaagg

SEQ ID NO: 255972 - DNA, 25 bp, Mus musculus
cgactaagtactttggcagcccggg

SEQ ID NO: 255973 - DNA, 25 bp, Mus musculus
cgactacagaagtgacctctaggga

SEQ ID NO: 255974 - DNA, 25 bp, Mus musculus
cgactacagaagtgacctctggtcc

SEQ ID NO: 255975 - DNA, 25 bp, Mus musculus
cgactacatggccatccacaaggag

SEQ ID NO: 255976 - DNA, 25 bp, Mus musculus
cgactaccagcagacttttgatttc

SEQ ID NO: 255977 - DNA, 25 bp, Mus musculus
cgactaccagcaggagtcgcctccc

SEQ ID NO: 255978 - DNA, 25 bp, Mus musculus
cgactaccagcaggcgttgctgctg

SEQ ID NO: 255979 - DNA, 25 bp, Mus musculus
cgactactgagggtgtgacttcttt

SEQ ID NO: 255980 - DNA, 25 bp, Mus musculus
cgactacttcaaagccaaggactac

SEQ ID NO: 255981 - DNA, 25 bp, Mus musculus
cgactacttcaaaggtggtgaaagt

SEQ ID NO: 255982 - DNA, 25 bp, Mus musculus
cgactacttggggctcgtgagctga

SEQ ID NO: 255983 - DNA, 25 bp, Mus musculus
cgactagccagaaaggtccacacca

SEQ ID NO: 255984 - DNA, 25 bp, Mus musculus
cgactagccagaaagtttcaggcca

SEQ ID NO: 255985 - DNA, 25 bp, Mus musculus
cgactatacgaaaaggaacttacac

SEQ ID NO: 255986 - DNA, 25 bp, Mus musculus
cgactatacgaaaaggctctacctc

SEQ ID NO: 255987 - DNA, 25 bp, Mus musculus
cgactatagctctccaggtcaatgg

SEQ ID NO: 255988 - DNA, 25 bp, Mus musculus
cgactatagctctctgctcagtaca

SEQ ID NO: 255989 - DNA, 25 bp, Mus musculus
cgactcaataaggtcactcttcagc

SEQ ID NO: 255990 - DNA, 25 bp, Mus musculus
cgactcattaaagagtggccgagcg

SEQ ID NO: 255991 - DNA, 25 bp, Mus musculus
cgactccaacgacccgtgcccaggg

SEQ ID NO: 255992 - DNA, 25 bp, Mus musculus
cgactccagctgcctttttcaacat

SEQ ID NO: 255993 - DNA, 25 bp, Mus musculus
cgactccatgcagcacatttaaaat

SEQ ID NO: 255994 - DNA, 25 bp, Mus musculus
cgactccatgcaggtattgaggctc

SEQ ID NO: 255995 - DNA, 25 bp, Mus musculus
cgactccatgcaggtctatgaaggg

SEQ ID NO: 255996 - DNA, 25 bp, Mus musculus
cgactcccaggagaggaatgctgtg

SEQ ID NO: 255997 - DNA, 25 bp, Mus musculus
cgactcccaggagagtcccggagag

SEQ ID NO: 255998 - DNA, 25 bp, Mus musculus
cgactccgcatatttcagacttcaa

SEQ ID NO: 255999 - DNA, 25 bp, Mus musculus
cgactccgcattggaactggaacac

SEQ ID NO: 256000 - DNA, 25 bp, Mus musculus
cgactccgtgaacgctctcactctt

SEQ ID NO: 256001 - DNA, 25 bp, Mus musculus
cgactcctatagtggactcgggagg

SEQ ID NO: 256002 - DNA, 25 bp, Mus musculus
cgactcctcagacagcactcaaaga

SEQ ID NO: 256003 - DNA, 25 bp, Mus musculus
cgactcctctcaaagggacagccag

SEQ ID NO: 256004 - DNA, 25 bp, Mus musculus
cgactcctctcaaaggtttatttta

SEQ ID NO: 256005 - DNA, 25 bp, Mus musculus
cgactcgcggagccgagtaaagaca

SEQ ID NO: 256006 - DNA, 25 bp, Mus musculus
cgactctataaattggagctggcct

SEQ ID NO: 256007 - DNA, 25 bp, Mus musculus
cgactctctgcctggcccgatttcc

SEQ ID NO: 256008 - DNA, 25 bp, Mus musculus
cgactctgagacagactgcatgtat

SEQ ID NO: 256009 - DNA, 25 bp, Mus musculus
cgactctgagagcagaggggcaggc

SEQ ID NO: 256010 - DNA, 25 bp, Mus musculus
cgactctgctgacagacactgtcct

SEQ ID NO: 256011 - DNA, 25 bp, Mus musculus
cgactctgttggttcactttaattg

SEQ ID NO: 256012 - DNA, 25 bp, Mus musculus
cgactcttcttcacggtgccttgga

SEQ ID NO: 256013 - DNA, 25 bp, Mus musculus
cgactcttgaagaacatatccccaa

SEQ ID NO: 256014 - DNA, 25 bp, Mus musculus
cgactcttgaaggacatagatgctg

SEQ ID NO: 256015 - DNA, 25 bp, Mus musculus
cgactgaaaaatgagttcattgaga

SEQ ID NO: 256016 - DNA, 25 bp, Mus musculus
cgactgaatgctcggattgggaaaa

SEQ ID NO: 256017 - DNA, 25 bp, Mus musculus
cgactgaccttggcatgcttgctcg

SEQ ID NO: 256018 - DNA, 25 bp, Mus musculus
cgactgactggggatggaggtaaag

SEQ ID NO: 256019 - DNA, 25 bp, Mus musculus
cgactgactgggtgatgcccacgct

SEQ ID NO: 256020 - DNA, 25 bp, Mus musculus
cgactgagagatcctgagcaagcag

SEQ ID NO: 256021 - DNA, 25 bp, Mus musculus
cgactgagcacacctgaggagaggt

SEQ ID NO: 256022 - DNA, 25 bp, Mus musculus
cgactgagcgccagagtacagtcgc

SEQ ID NO: 256023 - DNA, 25 bp, Mus musculus
cgactgaggcgccgcccggttaacc

SEQ ID NO: 256024 - DNA, 25 bp, Mus musculus
cgactgcagaggacccgcgcgcaag

SEQ ID NO: 256025 - DNA, 25 bp, Mus musculus
cgactgcagttgcagctctaagaac

SEQ ID NO: 256026 - DNA, 25 bp, Mus musculus
cgactgcagttgcaggtttcttcgg

SEQ ID NO: 256027 - DNA, 25 bp, Mus musculus
cgactgccagtctccctatgagcga

SEQ ID NO: 256028 - DNA, 25 bp, Mus musculus
cgactgcccgacttgggcaggtaaa

SEQ ID NO: 256029 - DNA, 25 bp, Mus musculus
cgactgccgtgttagatgagaacca

SEQ ID NO: 256030 - DNA, 25 bp, Mus musculus
cgactgccgtgttagtccctataac

SEQ ID NO: 256031 - DNA, 25 bp, Mus musculus
cgactgcgtcaagacccggatgcag

SEQ ID NO: 256032 - DNA, 25 bp, Mus musculus
cgactgcgtcaaggtgcagccggat

SEQ ID NO: 256033 - DNA, 25 bp, Mus musculus
cgactgctccgagctcacaggaagg

SEQ ID NO: 256034 - DNA, 25 bp, Mus musculus
cgactggaaaaaggacaggtgcagt

SEQ ID NO: 256035 - DNA, 25 bp, Mus musculus
cgactggaaaaaggataggtgcggt

SEQ ID NO: 256036 - DNA, 25 bp, Mus musculus
cgactggaacatggtgcagcccgga

SEQ ID NO: 256037 - DNA, 25 bp, Mus musculus
cgactggagaaggtcttcgcttatg

SEQ ID NO: 256038 - DNA, 25 bp, Mus musculus
cgactggagaagtatgtgggtgccc

SEQ ID NO: 256039 - DNA, 25 bp, Mus musculus
cgactggcagcaccgagtgcccaag

SEQ ID NO: 256040 - DNA, 25 bp, Mus musculus
cgactggctatcccagatggatgac

SEQ ID NO: 256041 - DNA, 25 bp, Mus musculus
cgactgggattgggctagtgaaccg

SEQ ID NO: 256042 - DNA, 25 bp, Mus musculus
cgactgggcacgaggctggaaggct

SEQ ID NO: 256043 - DNA, 25 bp, Mus musculus
cgactggtgggcagcttcatgttgt

SEQ ID NO: 256044 - DNA, 25 bp, Mus musculus
cgactggtgggcagggccttcgtat

SEQ ID NO: 256045 - DNA, 25 bp, Mus musculus
cgactgtaccgggctgtcagggggt

SEQ ID NO: 256046 - DNA, 25 bp, Mus musculus
cgactgtccctcaagttgcctgcag

SEQ ID NO: 256047 - DNA, 25 bp, Mus musculus
cgactgtccctcaatggcacgctcc

SEQ ID NO: 256048 - DNA, 25 bp, Mus musculus
cgactgtccctcaatttcgaggact

SEQ ID NO: 256049 - DNA, 25 bp, Mus musculus
cgactgtctcagatcttgtaggact

SEQ ID NO: 256050 - DNA, 25 bp, Mus musculus
cgactgtgaagggaagacatgtgaa

SEQ ID NO: 256051 - DNA, 25 bp, Mus musculus
cgactgtgaagttagtagaaaaagg

SEQ ID NO: 256052 - DNA, 25 bp, Mus musculus
cgactgtgaatctaggtgtagaagc

SEQ ID NO: 256053 - DNA, 25 bp, Mus musculus
cgactgtgcccggaatcccagtcag

SEQ ID NO: 256054 - DNA, 25 bp, Mus musculus
cgactgtggacgaagcaatggcaag

SEQ ID NO: 256055 - DNA, 25 bp, Mus musculus
cgactgtggagagagatggtatggt

SEQ ID NO: 256056 - DNA, 25 bp, Mus musculus
cgactgtggagtgtgcacagccccc

SEQ ID NO: 256057 - DNA, 25 bp, Mus musculus
cgactgtggggtgtgccttcttcac

SEQ ID NO: 256058 - DNA, 25 bp, Mus musculus
cgactgtgtttgaggaattatttta

SEQ ID NO: 256059 - DNA, 25 bp, Mus musculus
cgactgttccattgagatctgtgcc

SEQ ID NO: 256060 - DNA, 25 bp, Mus musculus
cgacttaccaaagaggaattcaagg

SEQ ID NO: 256061 - DNA, 25 bp, Mus musculus
cgacttagacagagctgaggaccga

SEQ ID NO: 256062 - DNA, 25 bp, Mus musculus
cgacttagacaggtgctgccagact

SEQ ID NO: 256063 - DNA, 25 bp, Mus musculus
cgacttagtgcggctgtgtggagat

SEQ ID NO: 256064 - DNA, 25 bp, Mus musculus
cgacttatcaaaggtgtggcccacc

SEQ ID NO: 256065 - DNA, 25 bp, Mus musculus
cgacttcaacctctaaaagcccgat

SEQ ID NO: 256066 - DNA, 25 bp, Mus musculus
cgacttcaacctctatgtgacggac

SEQ ID NO: 256067 - DNA, 25 bp, Mus musculus
cgacttcaagcccagctatgggacc

SEQ ID NO: 256068 - DNA, 25 bp, Mus musculus
cgacttcaagcccagtcttgcctcc

SEQ ID NO: 256069 - DNA, 25 bp, Mus musculus
cgacttcaaggacacagcaggccag

SEQ ID NO: 256070 - DNA, 25 bp, Mus musculus
cgacttcacaacaaaccgagaaagg

SEQ ID NO: 256071 - DNA, 25 bp, Mus musculus
cgacttcacagacttctacctggtg

SEQ ID NO: 256072 - DNA, 25 bp, Mus musculus
cgacttcacccgaggcaaaggtcca

SEQ ID NO: 256073 - DNA, 25 bp, Mus musculus
cgacttcacctcttttggcaatgag

SEQ ID NO: 256074 - DNA, 25 bp, Mus musculus
cgacttccaccaaggcctcctatct

SEQ ID NO: 256075 - DNA, 25 bp, Mus musculus
cgacttccaccaaggtatggtgtgg

SEQ ID NO: 256076 - DNA, 25 bp, Mus musculus
cgacttcccaaacaggtgcagttaa

SEQ ID NO: 256077 - DNA, 25 bp, Mus musculus
cgacttccctgagctcaccatggag

SEQ ID NO: 256078 - DNA, 25 bp, Mus musculus
cgacttcctcgctgcacctggtgga

SEQ ID NO: 256079 - DNA, 25 bp, Mus musculus
cgacttcctctttagaacctgggtg

SEQ ID NO: 256080 - DNA, 25 bp, Mus musculus
cgacttcgagcaggacaatcccaga

SEQ ID NO: 256081 - DNA, 25 bp, Mus musculus
cgacttcggactaggggctctgaga

SEQ ID NO: 256082 - DNA, 25 bp, Mus musculus
cgacttctaggcgtgtgtatagaac

SEQ ID NO: 256083 - DNA, 25 bp, Mus musculus
cgacttctatgcaggcacggtgctg

SEQ ID NO: 256084 - DNA, 25 bp, Mus musculus
cgacttctgcagctaatgggaatga

SEQ ID NO: 256085 - DNA, 25 bp, Mus musculus
cgacttgaaacaaggggttataatg

SEQ ID NO: 256086 - DNA, 25 bp, Mus musculus
cgacttgccgggtctggaatgtgac

SEQ ID NO: 256087 - DNA, 25 bp, Mus musculus
cgacttggacaacaccatcaagaaa

SEQ ID NO: 256088 - DNA, 25 bp, Mus musculus
cgacttggagccccacgcaatcatt

SEQ ID NO: 256089 - DNA, 25 bp, Mus musculus
cgacttggaggaagtccgccagttc

SEQ ID NO: 256090 - DNA, 25 bp, Mus musculus
cgacttggtgaaaaattgcatgtgt

SEQ ID NO: 256091 - DNA, 25 bp, Mus musculus
cgacttggtgaagactccattagag

SEQ ID NO: 256092 - DNA, 25 bp, Mus musculus
cgacttggtgataaggtacagtttt

SEQ ID NO: 256093 - DNA, 25 bp, Mus musculus
cgacttggtgatgaaaccattagag

SEQ ID NO: 256094 - DNA, 25 bp, Mus musculus
cgacttgtgagttcgactgtgattt

SEQ ID NO: 256095 - DNA, 25 bp, Mus musculus
cgactttacttctgtggagtcaatt

SEQ ID NO: 256096 - DNA, 25 bp, Mus musculus
cgactttcagccagaccatagtcct

SEQ ID NO: 256097 - DNA, 25 bp, Mus musculus
cgactttccactgcttaggctcgac

SEQ ID NO: 256098 - DNA, 25 bp, Mus musculus
cgactttcctcaggacccctcatgc

SEQ ID NO: 256099 - DNA, 25 bp, Mus musculus
cgactttgaaggacaaattgcacat

SEQ ID NO: 256100 - DNA, 25 bp, Mus musculus
cgactttgaaggtccttgctgccaa

SEQ ID NO: 256101 - DNA, 25 bp, Mus musculus
cgactttgccagaaagtgagccacg

SEQ ID NO: 256102 - DNA, 25 bp, Mus musculus
cgactttggaggtctcccagtggac

SEQ ID NO: 256103 - DNA, 25 bp, Mus musculus
cgacttttcagagccactcagcacg

SEQ ID NO: 256104 - DNA, 25 bp, Mus musculus
cgacttttcagggttcagactgggc

SEQ ID NO: 256105 - DNA, 25 bp, Mus musculus
cgacttttgcagagttctctgtcat

SEQ ID NO: 256106 - DNA, 25 bp, Mus musculus
cgagaaaaagctggagagatgtctg

SEQ ID NO: 256107 - DNA, 25 bp, Mus musculus
cgagaaaaccctggcgtttagagaa

SEQ ID NO: 256108 - DNA, 25 bp, Mus musculus
cgagaaacagcaacattacttcaca

SEQ ID NO: 256109 - DNA, 25 bp, Mus musculus
cgagaaacagcgtcatagcaggagt

SEQ ID NO: 256110 - DNA, 25 bp, Mus musculus
cgagaaactatgtctgctggttgtg

SEQ ID NO: 256111 - DNA, 25 bp, Mus musculus
cgagaaactgatgaagtgactgaga

SEQ ID NO: 256112 - DNA, 25 bp, Mus musculus
cgagaaagaagcctcaggtacagtg

SEQ ID NO: 256113 - DNA, 25 bp, Mus musculus
cgagaaagaggcagagaaacccgca

SEQ ID NO: 256114 - DNA, 25 bp, Mus musculus
cgagaaagaggtgggacttctgctg

SEQ ID NO: 256115 - DNA, 25 bp, Mus musculus
cgagaaatagaagggaacaagtcat

SEQ ID NO: 256116 - DNA, 25 bp, Mus musculus
cgagaaatcgagaacactgttatga

SEQ ID NO: 256117 - DNA, 25 bp, Mus musculus
cgagaaatcgagaacttgattctga

SEQ ID NO: 256118 - DNA, 25 bp, Mus musculus
cgagaaatgaaatgtctggatgcta

SEQ ID NO: 256119 - DNA, 25 bp, Mus musculus
cgagaaatgaaatgtgcagagccag

SEQ ID NO: 256120 - DNA, 25 bp, Mus musculus
cgagaaatgaaggactgcagtaatg

SEQ ID NO: 256121 - DNA, 25 bp, Mus musculus
cgagaaatgagtcctctctgggaga

SEQ ID NO: 256122 - DNA, 25 bp, Mus musculus
cgagaaattcgggccaatggtggct

SEQ ID NO: 256123 - DNA, 25 bp, Mus musculus
cgagaacaagcccatctggctcttg

SEQ ID NO: 256124 - DNA, 25 bp, Mus musculus
cgagaacaccagaagggccggccca

SEQ ID NO: 256125 - DNA, 25 bp, Mus musculus
cgagaacattccagatacacttcag

SEQ ID NO: 256126 - DNA, 25 bp, Mus musculus
cgagaaccagagggcacatctgctg

SEQ ID NO: 256127 - DNA, 25 bp, Mus musculus
cgagaaccagttgataaaattacgt

SEQ ID NO: 256128 - DNA, 25 bp, Mus musculus
cgagaacccacagagacgtttcatg

SEQ ID NO: 256129 - DNA, 25 bp, Mus musculus
cgagaacccacagcagagtcttctg

SEQ ID NO: 256130 - DNA, 25 bp, Mus musculus
cgagaaccccgaaatgccaggcaga

SEQ ID NO: 256131 - DNA, 25 bp, Mus musculus
cgagaaccccgaagacatcggcaga

SEQ ID NO: 256132 - DNA, 25 bp, Mus musculus
cgagaacgagccaagttcaagcgca

SEQ ID NO: 256133 - DNA, 25 bp, Mus musculus
cgagaactgagtgaggccttgtttt

SEQ ID NO: 256134 - DNA, 25 bp, Mus musculus
cgagaactggcagggagatctgctg

SEQ ID NO: 256135 - DNA, 25 bp, Mus musculus
cgagaactgtgttagactttcctgg

SEQ ID NO: 256136 - DNA, 25 bp, Mus musculus
cgagaagaaagaagtgttgccggga

SEQ ID NO: 256137 - DNA, 25 bp, Mus musculus
cgagaagaacgaggccatccaggcg

SEQ ID NO: 256138 - DNA, 25 bp, Mus musculus
cgagaagaacgaggcggcccatgac

SEQ ID NO: 256139 - DNA, 25 bp, Mus musculus
cgagaagaagagctgaagggtctgg

SEQ ID NO: 256140 - DNA, 25 bp, Mus musculus
cgagaagaaggaactcggagagtaa

SEQ ID NO: 256141 - DNA, 25 bp, Mus musculus
cgagaagaaggagaaaatcacttct

SEQ ID NO: 256142 - DNA, 25 bp, Mus musculus
cgagaagaaggagccagctattcac

SEQ ID NO: 256143 - DNA, 25 bp, Mus musculus
cgagaagaaggtgatggatggggag

SEQ ID NO: 256144 - DNA, 25 bp, Mus musculus
cgagaagaggatggctgctcccagg

SEQ ID NO: 256145 - DNA, 25 bp, Mus musculus
cgagaagcacatcaaggtgaacctg

SEQ ID NO: 256146 - DNA, 25 bp, Mus musculus
cgagaagcagagattttattccctc

SEQ ID NO: 256147 - DNA, 25 bp, Mus musculus
cgagaagccagaaagaaagatcaca

SEQ ID NO: 256148 - DNA, 25 bp, Mus musculus
cgagaagccagctggagattcacgt

SEQ ID NO: 256149 - DNA, 25 bp, Mus musculus
cgagaagccaggagaaactacaact

SEQ ID NO: 256150 - DNA, 25 bp, Mus musculus
cgagaagccaggtggtgaccataga

SEQ ID NO: 256151 - DNA, 25 bp, Mus musculus
cgagaagccattacaatgtgagatc

SEQ ID NO: 256152 - DNA, 25 bp, Mus musculus
cgagaagccggaggttgagaacaaa

SEQ ID NO: 256153 - DNA, 25 bp, Mus musculus
cgagaagcggcgtagggccacacct

SEQ ID NO: 256154 - DNA, 25 bp, Mus musculus
cgagaagcggggcctacagcgtagg

SEQ ID NO: 256155 - DNA, 25 bp, Mus musculus
cgagaaggaatgccaaccaggcagc

SEQ ID NO: 256156 - DNA, 25 bp, Mus musculus
cgagaaggaatgccccaaagcaaaa

SEQ ID NO: 256157 - DNA, 25 bp, Mus musculus
cgagaaggagctgatcgaagcgttg

SEQ ID NO: 256158 - DNA, 25 bp, Mus musculus
cgagaaggagctgccaaggcggcaa

SEQ ID NO: 256159 - DNA, 25 bp, Mus musculus
cgagaaggagtttcgaaactgcatc

SEQ ID NO: 256160 - DNA, 25 bp, Mus musculus
cgagaaggatctggtgaaactagct

SEQ ID NO: 256161 - DNA, 25 bp, Mus musculus
cgagaaggccgagcctgctaggcct

SEQ ID NO: 256162 - DNA, 25 bp, Mus musculus
cgagaagtgcagcagccccaccagt

SEQ ID NO: 256163 - DNA, 25 bp, Mus musculus
cgagaagtgcagcagggcaagcttc

SEQ ID NO: 256164 - DNA, 25 bp, Mus musculus
cgagaagttgacctcctcctctgaa

SEQ ID NO: 256165 - DNA, 25 bp, Mus musculus
cgagaagttgacctcgtcctccaga

SEQ ID NO: 256166 - DNA, 25 bp, Mus musculus
cgagaataagtccaagtttggggcc

SEQ ID NO: 256167 - DNA, 25 bp, Mus musculus
cgagaatgacatgggatacaaactg

SEQ ID NO: 256168 - DNA, 25 bp, Mus musculus
cgagaatgagatgagctgcccgacg

SEQ ID NO: 256169 - DNA, 25 bp, Mus musculus
cgagaatgctttcagccccagccgt

SEQ ID NO: 256170 - DNA, 25 bp, Mus musculus
cgagaattaatagctaaaaggacaa

SEQ ID NO: 256171 - DNA, 25 bp, Mus musculus
cgagaattctcaggtcctctttcag

SEQ ID NO: 256172 - DNA, 25 bp, Mus musculus
cgagacaactaaattttccaatgag

SEQ ID NO: 256173 - DNA, 25 bp, Mus musculus
cgagacaactggaacccacagttcc

SEQ ID NO: 256174 - DNA, 25 bp, Mus musculus
cgagacaagagattcagatgccacc

SEQ ID NO: 256175 - DNA, 25 bp, Mus musculus
cgagacaagagtttccttctagatc

SEQ ID NO: 256176 - DNA, 25 bp, Mus musculus
cgagacaagccaaggtcttcttctc

SEQ ID NO: 256177 - DNA, 25 bp, Mus musculus
cgagacactacaggagagcacacag

SEQ ID NO: 256178 - DNA, 25 bp, Mus musculus
cgagacagaagcaccattgcaagaa

SEQ ID NO: 256179 - DNA, 25 bp, Mus musculus
cgagacagattacttcgcaacctgg

SEQ ID NO: 256180 - DNA, 25 bp, Mus musculus
cgagacagcaacaagcttgtagagg

SEQ ID NO: 256181 - DNA, 25 bp, Mus musculus
cgagacatgcactccaccacgcagc

SEQ ID NO: 256182 - DNA, 25 bp, Mus musculus
cgagacatgcactccgcttacaagc

SEQ ID NO: 256183 - DNA, 25 bp, Mus musculus
cgagacatggatctggtgtgagtgt

SEQ ID NO: 256184 - DNA, 25 bp, Mus musculus
cgagacatttccctgatagattgct

SEQ ID NO: 256185 - DNA, 25 bp, Mus musculus
cgagaccagcaaaaaatgctatcag

SEQ ID NO: 256186 - DNA, 25 bp, Mus musculus
cgagacccaaatcttggtgggctgt

SEQ ID NO: 256187 - DNA, 25 bp, Mus musculus
cgagacccaactgtcgacgcataat

SEQ ID NO: 256188 - DNA, 25 bp, Mus musculus
cgagaccccagtggtctctctggac

SEQ ID NO: 256189 - DNA, 25 bp, Mus musculus
cgagaccctgatctgggggatggga

SEQ ID NO: 256190 - DNA, 25 bp, Mus musculus
cgagaccgaggcttacttctttgat

SEQ ID NO: 256191 - DNA, 25 bp, Mus musculus
cgagaccgaggtctttgacagaata

SEQ ID NO: 256192 - DNA, 25 bp, Mus musculus
cgagaccgagttacttgccggtcag

SEQ ID NO: 256193 - DNA, 25 bp, Mus musculus
cgagaccggcggcaagtacattgcc

SEQ ID NO: 256194 - DNA, 25 bp, Mus musculus
cgagacctaagaagagatccagagt

SEQ ID NO: 256195 - DNA, 25 bp, Mus musculus
cgagacctacgacttcctcttcaaa

SEQ ID NO: 256196 - DNA, 25 bp, Mus musculus
cgagacctccacagggacaactccc

SEQ ID NO: 256197 - DNA, 25 bp, Mus musculus
cgagacctgtatagcagaacatcat

SEQ ID NO: 256198 - DNA, 25 bp, Mus musculus
cgagacctgtggggtttggtggtga

SEQ ID NO: 256199 - DNA, 25 bp, Mus musculus
cgagacgaaagcagcttttaatata

SEQ ID NO: 256200 - DNA, 25 bp, Mus musculus
cgagacgactgccagtctccctatg

SEQ ID NO: 256201 - DNA, 25 bp, Mus musculus
cgagacgagagtgatctcagcgccc

SEQ ID NO: 256202 - DNA, 25 bp, Mus musculus
cgagacgagctccagatgctctcca

SEQ ID NO: 256203 - DNA, 25 bp, Mus musculus
cgagacgagctccagggtttctcag

SEQ ID NO: 256204 - DNA, 25 bp, Mus musculus
cgagacgcgcctcgataaggaaaag

SEQ ID NO: 256205 - DNA, 25 bp, Mus musculus
cgagacgctcaaggatgaagaaaca

SEQ ID NO: 256206 - DNA, 25 bp, Mus musculus
cgagacgctcaagtcctcctgcata

SEQ ID NO: 256207 - DNA, 25 bp, Mus musculus
cgagacgtctgtcagccatcgtcta

SEQ ID NO: 256208 - DNA, 25 bp, Mus musculus
cgagacgtgatggttaagatctcca

SEQ ID NO: 256209 - DNA, 25 bp, Mus musculus
cgagacgtggaggtactatgcctgc

SEQ ID NO: 256210 - DNA, 25 bp, Mus musculus
cgagactaaagaaacgtgttcctgg

SEQ ID NO: 256211 - DNA, 25 bp, Mus musculus
cgagactaagaccatggccaaagtt

SEQ ID NO: 256212 - DNA, 25 bp, Mus musculus
cgagactaagagccccactgctgcc

SEQ ID NO: 256213 - DNA, 25 bp, Mus musculus
cgagactcaaggtcaacatggccat

SEQ ID NO: 256214 - DNA, 25 bp, Mus musculus
cgagactcaagtttagctgttaact

SEQ ID NO: 256215 - DNA, 25 bp, Mus musculus
cgagactcagggtgaaatggtcaac

SEQ ID NO: 256216 - DNA, 25 bp, Mus musculus
cgagactctgcggcactctgtccag

SEQ ID NO: 256217 - DNA, 25 bp, Mus musculus
cgagactgagagccctgagcccgga

SEQ ID NO: 256218 - DNA, 25 bp, Mus musculus
cgagactgagaggctatcagggcgt

SEQ ID NO: 256219 - DNA, 25 bp, Mus musculus
cgagactgaggaagattgacttcta

SEQ ID NO: 256220 - DNA, 25 bp, Mus musculus
cgagactgccaagactcactctgtg

SEQ ID NO: 256221 - DNA, 25 bp, Mus musculus
cgagactgccaaggaggccgagtta

SEQ ID NO: 256222 - DNA, 25 bp, Mus musculus
cgagacttacatcacggagaatgta

SEQ ID NO: 256223 - DNA, 25 bp, Mus musculus
cgagacttgcaaaaggtgctggatc

SEQ ID NO: 256224 - DNA, 25 bp, Mus musculus
cgagagacagaagattgtcacaatg

SEQ ID NO: 256225 - DNA, 25 bp, Mus musculus
cgagagactgacctagtctggcttg

SEQ ID NO: 256226 - DNA, 25 bp, Mus musculus
cgagagagaaaaaatcaaccactca

SEQ ID NO: 256227 - DNA, 25 bp, Mus musculus
cgagagagaaaaaatcaatccagga

SEQ ID NO: 256228 - DNA, 25 bp, Mus musculus
cgagagagatacgctccttgctcgg

SEQ ID NO: 256229 - DNA, 25 bp, Mus musculus
cgagagagcaagaaggagcagagag

SEQ ID NO: 256230 - DNA, 25 bp, Mus musculus
cgagagattaggttccaaggagcag

SEQ ID NO: 256231 - DNA, 25 bp, Mus musculus
cgagagcagaaggaacttgacctca

SEQ ID NO: 256232 - DNA, 25 bp, Mus musculus
cgagagcatgaagactccgtggttt

SEQ ID NO: 256233 - DNA, 25 bp, Mus musculus
cgagagcatgaagggcgttttttct

SEQ ID NO: 256234 - DNA, 25 bp, Mus musculus
cgagagcatgaagtgggccaatccg

SEQ ID NO: 256235 - DNA, 25 bp, Mus musculus
cgagagccactgattgccacagcag

SEQ ID NO: 256236 - DNA, 25 bp, Mus musculus
cgagagccactggactgacagacga

SEQ ID NO: 256237 - DNA, 25 bp, Mus musculus
cgagagccaggcggagcacgcccca

SEQ ID NO: 256238 - DNA, 25 bp, Mus musculus
cgagagcccgcgcaggatccaagac

SEQ ID NO: 256239 - DNA, 25 bp, Mus musculus
cgagagccggcccgcgtacggcatc

SEQ ID NO: 256240 - DNA, 25 bp, Mus musculus
cgagagcctggtgggcagcctggag

SEQ ID NO: 256241 - DNA, 25 bp, Mus musculus
cgagagctgaagaatggctttgctg

SEQ ID NO: 256242 - DNA, 25 bp, Mus musculus
cgagagctgctacgatgcagacaga

SEQ ID NO: 256243 - DNA, 25 bp, Mus musculus
cgagagctgctacgccacacagtct

SEQ ID NO: 256244 - DNA, 25 bp, Mus musculus
cgagagcttccaaagccacccgcgg

SEQ ID NO: 256245 - DNA, 25 bp, Mus musculus
cgagagcttccaaagcgcggctggg

SEQ ID NO: 256246 - DNA, 25 bp, Mus musculus
cgagagctttaattttgccaaaaag

SEQ ID NO: 256247 - DNA, 25 bp, Mus musculus
cgagagctttggtctctttgctgtt

SEQ ID NO: 256248 - DNA, 25 bp, Mus musculus
cgagaggaactatcggctctttcta

SEQ ID NO: 256249 - DNA, 25 bp, Mus musculus
cgagaggaactatcgtcttgaagaa

SEQ ID NO: 256250 - DNA, 25 bp, Mus musculus
cgagaggacaatagccttaaagaag

SEQ ID NO: 256251 - DNA, 25 bp, Mus musculus
cgagaggaccttcggggctgggctt

SEQ ID NO: 256252 - DNA, 25 bp, Mus musculus
cgagaggaccttcgggtaaatggcc

SEQ ID NO: 256253 - DNA, 25 bp, Mus musculus
cgagaggagaaccgggtgagcccta

SEQ ID NO: 256254 - DNA, 25 bp, Mus musculus
cgagaggatgaggagaacaacgaga

SEQ ID NO: 256255 - DNA, 25 bp, Mus musculus
cgagaggcacgcccccattggtcca

SEQ ID NO: 256256 - DNA, 25 bp, Mus musculus
cgagaggcacgggcaatgaggtggc

SEQ ID NO: 256257 - DNA, 25 bp, Mus musculus
cgagaggcgcgaggccgcaaaacgg

SEQ ID NO: 256258 - DNA, 25 bp, Mus musculus
cgagaggctgcaggctacagaacct

SEQ ID NO: 256259 - DNA, 25 bp, Mus musculus
cgagagggatggcagaggagctggc

SEQ ID NO: 256260 - DNA, 25 bp, Mus musculus
cgagagggatggcaggtagaagagg

SEQ ID NO: 256261 - DNA, 25 bp, Mus musculus
cgagagggtggtccggtgagcaaca

SEQ ID NO: 256262 - DNA, 25 bp, Mus musculus
cgagaggtcaaggccccacgcatgg

SEQ ID NO: 256263 - DNA, 25 bp, Mus musculus
cgagaggtccaagagaacagaaaga

SEQ ID NO: 256264 - DNA, 25 bp, Mus musculus
cgagaggttcgtctgctttgccttg

SEQ ID NO: 256265 - DNA, 25 bp, Mus musculus
cgagagtcaacaaggtgatcattgg

SEQ ID NO: 256266 - DNA, 25 bp, Mus musculus
cgagagtccacgagaaatggaagat

SEQ ID NO: 256267 - DNA, 25 bp, Mus musculus
cgagagtccacgatatgttttcttc

SEQ ID NO: 256268 - DNA, 25 bp, Mus musculus
cgagagtccacggttttctctgtgt

SEQ ID NO: 256269 - DNA, 25 bp, Mus musculus
cgagagtgagttccaggacagccag

SEQ ID NO: 256270 - DNA, 25 bp, Mus musculus
cgagagtgtcaaaggatcaatgtga

SEQ ID NO: 256271 - DNA, 25 bp, Mus musculus
cgagagtgtcaaagtacttcaactc

SEQ ID NO: 256272 - DNA, 25 bp, Mus musculus
cgagagttctctagaaccaggcagc

SEQ ID NO: 256273 - DNA, 25 bp, Mus musculus
cgagatatcaaagctgccaacgtgc

SEQ ID NO: 256274 - DNA, 25 bp, Mus musculus
cgagatatcactctgggaggcccgg

SEQ ID NO: 256275 - DNA, 25 bp, Mus musculus
cgagatatcactctgttccatgcca

SEQ ID NO: 256276 - DNA, 25 bp, Mus musculus
cgagatcaaagcactggcgcctgcg

SEQ ID NO: 256277 - DNA, 25 bp, Mus musculus
cgagatcaaagcactgggggagctg

SEQ ID NO: 256278 - DNA, 25 bp, Mus musculus
cgagatcatcaaaccagaagatttc

SEQ ID NO: 256279 - DNA, 25 bp, Mus musculus
cgagatccgcagtatgttccggaag

SEQ ID NO: 256280 - DNA, 25 bp, Mus musculus
cgagatccgcagtggtttctctgta

SEQ ID NO: 256281 - DNA, 25 bp, Mus musculus
cgagatcctcaaggggaaactgttt

SEQ ID NO: 256282 - DNA, 25 bp, Mus musculus
cgagatctcaggtctcctgtgagca

SEQ ID NO: 256283 - DNA, 25 bp, Mus musculus
cgagatctgctgcccaccaattcct

SEQ ID NO: 256284 - DNA, 25 bp, Mus musculus
cgagatcttaaggacctggggattc

SEQ ID NO: 256285 - DNA, 25 bp, Mus musculus
cgagatgatgcagaacatgttggag

SEQ ID NO: 256286 - DNA, 25 bp, Mus musculus
cgagatgatggattatctattatct

SEQ ID NO: 256287 - DNA, 25 bp, Mus musculus
cgagatgcacaaccaggcggaaatt

SEQ ID NO: 256288 - DNA, 25 bp, Mus musculus
cgagatgcagctgttgccgcacatc

SEQ ID NO: 256289 - DNA, 25 bp, Mus musculus
cgagatgctaccggtactaaacaga

SEQ ID NO: 256290 - DNA, 25 bp, Mus musculus
cgagatggaatgaagaaaagcaatg

SEQ ID NO: 256291 - DNA, 25 bp, Mus musculus
cgagatgttcagctacgagtcctcg

SEQ ID NO: 256292 - DNA, 25 bp, Mus musculus
cgagatgttcagttatgaggagtcc

SEQ ID NO: 256293 - DNA, 25 bp, Mus musculus
cgagattcctcccagatgatgggcg

SEQ ID NO: 256294 - DNA, 25 bp, Mus musculus
cgagattcggctgctgaactaagaa

SEQ ID NO: 256295 - DNA, 25 bp, Mus musculus
cgagattctggacctgtgtttggag

SEQ ID NO: 256296 - DNA, 25 bp, Mus musculus
cgagattgatgtggccagcctgcgg

SEQ ID NO: 256297 - DNA, 25 bp, Mus musculus
cgagattgcaaaggtcatttggtgt

SEQ ID NO: 256298 - DNA, 25 bp, Mus musculus
cgagattgtcactggggtgcggcta

SEQ ID NO: 256299 - DNA, 25 bp, Mus musculus
cgagattgtcactgggttttacctg

SEQ ID NO: 256300 - DNA, 25 bp, Mus musculus
cgagatttcccagaccacgaactgt

SEQ ID NO: 256301 - DNA, 25 bp, Mus musculus
cgagatttcccagggatccggcact

SEQ ID NO: 256302 - DNA, 25 bp, Mus musculus
cgagcaaaaagatttaaggcaagaa

SEQ ID NO: 256303 - DNA, 25 bp, Mus musculus
cgagcaaaaagggcaacaatagttt

SEQ ID NO: 256304 - DNA, 25 bp, Mus musculus
cgagcaaaatctcaaattgctctta

SEQ ID NO: 256305 - DNA, 25 bp, Mus musculus
cgagcaacaggtgtcgttgacattt

SEQ ID NO: 256306 - DNA, 25 bp, Mus musculus
cgagcaacggcaaggtggttgctgt

SEQ ID NO: 256307 - DNA, 25 bp, Mus musculus
cgagcaagacaatcctaaccagtac

SEQ ID NO: 256308 - DNA, 25 bp, Mus musculus
cgagcaagatgtggaaaaagccaaa

SEQ ID NO: 256309 - DNA, 25 bp, Mus musculus
cgagcaagatgtggaaaaagccaca

SEQ ID NO: 256310 - DNA, 25 bp, Mus musculus
cgagcaagatgtggcaatccccaga

SEQ ID NO: 256311 - DNA, 25 bp, Mus musculus
cgagcaattggcgaggactttgtgt

SEQ ID NO: 256312 - DNA, 25 bp, Mus musculus
cgagcacacagatggagtgatcaag

SEQ ID NO: 256313 - DNA, 25 bp, Mus musculus
cgagcacacaggagagaccttctgg

SEQ ID NO: 256314 - DNA, 25 bp, Mus musculus
cgagcacatgcccttaggcccagga

SEQ ID NO: 256315 - DNA, 25 bp, Mus musculus
cgagcacatgggagtgttgtgaaga

SEQ ID NO: 256316 - DNA, 25 bp, Mus musculus
cgagcaccagagacagccattctgc

SEQ ID NO: 256317 - DNA, 25 bp, Mus musculus
cgagcacccgggatacacttttggc

SEQ ID NO: 256318 - DNA, 25 bp, Mus musculus
cgagcacccggggaggcagagtaag

SEQ ID NO: 256319 - DNA, 25 bp, Mus musculus
cgagcacctccgggacctgtttcag

SEQ ID NO: 256320 - DNA, 25 bp, Mus musculus
cgagcacggttcagatcctgaggga

SEQ ID NO: 256321 - DNA, 25 bp, Mus musculus
cgagcactcaggagttttgggaatg

SEQ ID NO: 256322 - DNA, 25 bp, Mus musculus
cgagcacttccggtggacactgcac

SEQ ID NO: 256323 - DNA, 25 bp, Mus musculus
cgagcacttccgtgtctgtctctct

SEQ ID NO: 256324 - DNA, 25 bp, Mus musculus
cgagcagaaacttggacccttctga

SEQ ID NO: 256325 - DNA, 25 bp, Mus musculus
cgagcagaagcaagccatacaggag

SEQ ID NO: 256326 - DNA, 25 bp, Mus musculus
cgagcagagcccacagcaacctcaa

SEQ ID NO: 256327 - DNA, 25 bp, Mus musculus
cgagcagagcgaggggtccgtctcc

SEQ ID NO: 256328 - DNA, 25 bp, Mus musculus
cgagcagatccaatactgcagcaat

SEQ ID NO: 256329 - DNA, 25 bp, Mus musculus
cgagcagatccaatcacgagaccag

SEQ ID NO: 256330 - DNA, 25 bp, Mus musculus
cgagcagatgagggcgctgtgtgcc

SEQ ID NO: 256331 - DNA, 25 bp, Mus musculus
cgagcagatgctcgggctgtcattt

SEQ ID NO: 256332 - DNA, 25 bp, Mus musculus
cgagcagcaagtggtggaatctggc

SEQ ID NO: 256333 - DNA, 25 bp, Mus musculus
cgagcagccatgatgagtctcctcc

SEQ ID NO: 256334 - DNA, 25 bp, Mus musculus
cgagcagcggatcttcctcctggcc

SEQ ID NO: 256335 - DNA, 25 bp, Mus musculus
cgagcagcggattggccaacggctc

SEQ ID NO: 256336 - DNA, 25 bp, Mus musculus
cgagcagcgtccttgagctgaggct

SEQ ID NO: 256337 - DNA, 25 bp, Mus musculus
cgagcagctgacaggattcagtttg

SEQ ID NO: 256338 - DNA, 25 bp, Mus musculus
cgagcagctggagaatcctggggac

SEQ ID NO: 256339 - DNA, 25 bp, Mus musculus
cgagcaggacgggaaggatgcgaac

SEQ ID NO: 256340 - DNA, 25 bp, Mus musculus
cgagcaggagagcgtgaaagagttc

SEQ ID NO: 256341 - DNA, 25 bp, Mus musculus
cgagcagtagcgagccacaggttgt

SEQ ID NO: 256342 - DNA, 25 bp, Mus musculus
cgagcagtcagagagaacgtgaggc

SEQ ID NO: 256343 - DNA, 25 bp, Mus musculus
cgagcagtcagagagactcaagaac

SEQ ID NO: 256344 - DNA, 25 bp, Mus musculus
cgagcagtgagcgagatgcagcacc

SEQ ID NO: 256345 - DNA, 25 bp, Mus musculus
cgagcagtggatggaagacagcgag

SEQ ID NO: 256346 - DNA, 25 bp, Mus musculus
cgagcagttaaccagtgctgagcct

SEQ ID NO: 256347 - DNA, 25 bp, Mus musculus
cgagcatctacttacggctggcccg

SEQ ID NO: 256348 - DNA, 25 bp, Mus musculus
cgagcatctacttcagctgcgtgca

SEQ ID NO: 256349 - DNA, 25 bp, Mus musculus
cgagcatgagaggaggagcttggtg

SEQ ID NO: 256350 - DNA, 25 bp, Mus musculus
cgagcatgagcttagcagcctgggt

SEQ ID NO: 256351 - DNA, 25 bp, Mus musculus
cgagcatgagtggggtccggccagg

SEQ ID NO: 256352 - DNA, 25 bp, Mus musculus
cgagccaaaatgggctccgggcctt

SEQ ID NO: 256353 - DNA, 25 bp, Mus musculus
cgagccaaaatgggttttatggaag

SEQ ID NO: 256354 - DNA, 25 bp, Mus musculus
cgagccacatttgccaaaaagcagg

SEQ ID NO: 256355 - DNA, 25 bp, Mus musculus
cgagccagaatacaatattggccag

SEQ ID NO: 256356 - DNA, 25 bp, Mus musculus
cgagccagaggagtacttttgagga

SEQ ID NO: 256357 - DNA, 25 bp, Mus musculus
cgagccagcaagggggaagaaaccg

SEQ ID NO: 256358 - DNA, 25 bp, Mus musculus
cgagccagcagctctgaactccaac

SEQ ID NO: 256359 - DNA, 25 bp, Mus musculus
cgagccagcataggtgcaacaagca

SEQ ID NO: 256360 - DNA, 25 bp, Mus musculus
cgagccaggctgtgctggccagctc

SEQ ID NO: 256361 - DNA, 25 bp, Mus musculus
cgagccatcacaggccggatcccag

SEQ ID NO: 256362 - DNA, 25 bp, Mus musculus
cgagccatgaggtattactacaaac

SEQ ID NO: 256363 - DNA, 25 bp, Mus musculus
cgagcccaagatctataacaatctg

SEQ ID NO: 256364 - DNA, 25 bp, Mus musculus
cgagccccaaatgaaaacgggccct

SEQ ID NO: 256365 - DNA, 25 bp, Mus musculus
cgagccccaacggcagccacaagtc

SEQ ID NO: 256366 - DNA, 25 bp, Mus musculus
cgagcccccatgattcagtaaccta

SEQ ID NO: 256367 - DNA, 25 bp, Mus musculus
cgagcccccatggctccatacccaa

SEQ ID NO: 256368 - DNA, 25 bp, Mus musculus
cgagccccgaggcagaatctagatc

SEQ ID NO: 256369 - DNA, 25 bp, Mus musculus
cgagccccgaggcagatgtgtcctt

SEQ ID NO: 256370 - DNA, 25 bp, Mus musculus
cgagccccgaggcaggtctctgctg

SEQ ID NO: 256371 - DNA, 25 bp, Mus musculus
cgagcccctcggtcttcaaagcttc

SEQ ID NO: 256372 - DNA, 25 bp, Mus musculus
cgagcccgcatggattccaggtgtg

SEQ ID NO: 256373 - DNA, 25 bp, Mus musculus
cgagcccgcgaggtcactatcgtct

SEQ ID NO: 256374 - DNA, 25 bp, Mus musculus
cgagcccggcaccaggcaatctttg

SEQ ID NO: 256375 - DNA, 25 bp, Mus musculus
cgagcccgggcaggtaaatttaaca

SEQ ID NO: 256376 - DNA, 25 bp, Mus musculus
cgagcccgtggttgtgccccctctc

SEQ ID NO: 256377 - DNA, 25 bp, Mus musculus
cgagccgcacggcggacaaatgaag

SEQ ID NO: 256378 - DNA, 25 bp, Mus musculus
cgagccgcacggcgggaatctcttc

SEQ ID NO: 256379 - DNA, 25 bp, Mus musculus
cgagccgcagggccagttcctgatc

SEQ ID NO: 256380 - DNA, 25 bp, Mus musculus
cgagccgcagtggttttatgaagag

SEQ ID NO: 256381 - DNA, 25 bp, Mus musculus
cgagccgccgcccaggtaactatag

SEQ ID NO: 256382 - DNA, 25 bp, Mus musculus
cgagccgccgcccaggttctgggaa

SEQ ID NO: 256383 - DNA, 25 bp, Mus musculus
cgagccgccgggagatgctgttgac

SEQ ID NO: 256384 - DNA, 25 bp, Mus musculus
cgagccgcggatccgcatttgcagg

SEQ ID NO: 256385 - DNA, 25 bp, Mus musculus
cgagccgcgtgcgaggatgaaacga

SEQ ID NO: 256386 - DNA, 25 bp, Mus musculus
cgagccgctttaggatcgctactct

SEQ ID NO: 256387 - DNA, 25 bp, Mus musculus
cgagccggacccctctgaccctctg

SEQ ID NO: 256388 - DNA, 25 bp, Mus musculus
cgagccggaccgattcagactcgga

SEQ ID NO: 256389 - DNA, 25 bp, Mus musculus
cgagccggaccgccgcaaggtcatc

SEQ ID NO: 256390 - DNA, 25 bp, Mus musculus
cgagccgggcagcggcctggaggag

SEQ ID NO: 256391 - DNA, 25 bp, Mus musculus
cgagcctaaagaacatcaaactgaa

SEQ ID NO: 256392 - DNA, 25 bp, Mus musculus
cgagcctaagtcctggtacgccata

SEQ ID NO: 256393 - DNA, 25 bp, Mus musculus
cgagcctagccaaagatatgaggat

SEQ ID NO: 256394 - DNA, 25 bp, Mus musculus
cgagcctcaccccgagcaggggaga

SEQ ID NO: 256395 - DNA, 25 bp, Mus musculus
cgagcctcacccgagcgcagaccct

SEQ ID NO: 256396 - DNA, 25 bp, Mus musculus
cgagcctcatggttcggagcgaccg

SEQ ID NO: 256397 - DNA, 25 bp, Mus musculus
cgagcctggaaaatgccatcgagac

SEQ ID NO: 256398 - DNA, 25 bp, Mus musculus
cgagcctggcttctaataacatgct

SEQ ID NO: 256399 - DNA, 25 bp, Mus musculus
cgagcctggggcgaggaaccaccga

SEQ ID NO: 256400 - DNA, 25 bp, Mus musculus
cgagcctggggcggagtggcagccc

SEQ ID NO: 256401 - DNA, 25 bp, Mus musculus
cgagcctggggcggtcagtttagaa

SEQ ID NO: 256402 - DNA, 25 bp, Mus musculus
cgagcgaacgagtatcagcatgtgt

SEQ ID NO: 256403 - DNA, 25 bp, Mus musculus
cgagcgagatgaagcacacaggcat

SEQ ID NO: 256404 - DNA, 25 bp, Mus musculus
cgagcgagcgtgacctacagcactg

SEQ ID NO: 256405 - DNA, 25 bp, Mus musculus
cgagcgatacgacgaaatggtggaa

SEQ ID NO: 256406 - DNA, 25 bp, Mus musculus
cgagcgatacgacggttgaaactga

SEQ ID NO: 256407 - DNA, 25 bp, Mus musculus
cgagcgcccgagcagcttggccgac

SEQ ID NO: 256408 - DNA, 25 bp, Mus musculus
cgagcgcccgcgtccagaggaccag

SEQ ID NO: 256409 - DNA, 25 bp, Mus musculus
cgagcgccctcagttgagccccaca

SEQ ID NO: 256410 - DNA, 25 bp, Mus musculus
cgagcgcgcaccgggttacacaata

SEQ ID NO: 256411 - DNA, 25 bp, Mus musculus
cgagcgcggggccgcaagcagtgca

SEQ ID NO: 256412 - DNA, 25 bp, Mus musculus
cgagcgctcaggagaaatatgaacc

SEQ ID NO: 256413 - DNA, 25 bp, Mus musculus
cgagcggaaactcacaggctaagct

SEQ ID NO: 256414 - DNA, 25 bp, Mus musculus
cgagcggaaactggatcgcttcaag

SEQ ID NO: 256415 - DNA, 25 bp, Mus musculus
cgagcggactcagacggtcagcgtc

SEQ ID NO: 256416 - DNA, 25 bp, Mus musculus
cgagcggcagaggagaaccctcttg

SEQ ID NO: 256417 - DNA, 25 bp, Mus musculus
cgagcggcggggtgaccatggagga

SEQ ID NO: 256418 - DNA, 25 bp, Mus musculus
cgagcggtccatgagcaatggcaac

SEQ ID NO: 256419 - DNA, 25 bp, Mus musculus
cgagcggtccatgagtgaattagta

SEQ ID NO: 256420 - DNA, 25 bp, Mus musculus
cgagcggtcctaacatttaaaaagc

SEQ ID NO: 256421 - DNA, 25 bp, Mus musculus
cgagcggtcctagtcttctcagtac

SEQ ID NO: 256422 - DNA, 25 bp, Mus musculus
cgagcgtaagatcccctgcttcgag

SEQ ID NO: 256423 - DNA, 25 bp, Mus musculus
cgagcgtaaggctgatggatgtctg

SEQ ID NO: 256424 - DNA, 25 bp, Mus musculus
cgagcgtacctgtgcccacatctgc

SEQ ID NO: 256425 - DNA, 25 bp, Mus musculus
cgagcgtctggcaggtccaagggta

SEQ ID NO: 256426 - DNA, 25 bp, Mus musculus
cgagctaacctgagattacaagagc

SEQ ID NO: 256427 - DNA, 25 bp, Mus musculus
cgagctaacctgaggcatgtctagg

SEQ ID NO: 256428 - DNA, 25 bp, Mus musculus
cgagctacaagtattctgaggaagc

SEQ ID NO: 256429 - DNA, 25 bp, Mus musculus
cgagctattttggattactataaga

SEQ ID NO: 256430 - DNA, 25 bp, Mus musculus
cgagctcacagctatccctctcacg

SEQ ID NO: 256431 - DNA, 25 bp, Mus musculus
cgagctcagcaaagaagttgggata

SEQ ID NO: 256432 - DNA, 25 bp, Mus musculus
cgagctcatcgagaaacatggctta

SEQ ID NO: 256433 - DNA, 25 bp, Mus musculus
cgagctcatcgaggagaatcagcgc

SEQ ID NO: 256434 - DNA, 25 bp, Mus musculus
cgagctcatgaacacttcagttatg

SEQ ID NO: 256435 - DNA, 25 bp, Mus musculus
cgagctcatgatcagtaatggaacg

SEQ ID NO: 256436 - DNA, 25 bp, Mus musculus
cgagctcatgtgttctgtgccaagg

SEQ ID NO: 256437 - DNA, 25 bp, Mus musculus
cgagctcatgttaccgaagtgcatg

SEQ ID NO: 256438 - DNA, 25 bp, Mus musculus
cgagctccagatgctctccaagttc

SEQ ID NO: 256439 - DNA, 25 bp, Mus musculus
cgagctccagcaagaaaaattccta

SEQ ID NO: 256440 - DNA, 25 bp, Mus musculus
cgagctccagggtttctcagtgtgg

SEQ ID NO: 256441 - DNA, 25 bp, Mus musculus
cgagctccgcaaagagaggcagatg

SEQ ID NO: 256442 - DNA, 25 bp, Mus musculus
cgagctccgcaaagccaaatcaaat

SEQ ID NO: 256443 - DNA, 25 bp, Mus musculus
cgagctccggaaaattgtgcaagca

SEQ ID NO: 256444 - DNA, 25 bp, Mus musculus
cgagctcctcgagcctaacccaggg

SEQ ID NO: 256445 - DNA, 25 bp, Mus musculus
cgagctcctcgctgtgatcactgct

SEQ ID NO: 256446 - DNA, 25 bp, Mus musculus
cgagctcgcggcggatagaaggaca

SEQ ID NO: 256447 - DNA, 25 bp, Mus musculus
cgagctcgcggcgggtaccttaaca

SEQ ID NO: 256448 - DNA, 25 bp, Mus musculus
cgagctctgcttgctggttgttgga

SEQ ID NO: 256449 - DNA, 25 bp, Mus musculus
cgagctctggagttgctttttgcaa

SEQ ID NO: 256450 - DNA, 25 bp, Mus musculus
cgagctctggagttggctgcaacag

SEQ ID NO: 256451 - DNA, 25 bp, Mus musculus
cgagctcttgaaggatctgcagcag

SEQ ID NO: 256452 - DNA, 25 bp, Mus musculus
cgagctgaaacagggaccgcgtggc

SEQ ID NO: 256453 - DNA, 25 bp, Mus musculus
cgagctgaagggaagtgaccaagcc

SEQ ID NO: 256454 - DNA, 25 bp, Mus musculus
cgagctgaagggctctcctgctgcc

SEQ ID NO: 256455 - DNA, 25 bp, Mus musculus
cgagctgatgtgtggagcctggctg

SEQ ID NO: 256456 - DNA, 25 bp, Mus musculus
cgagctgcaaataacgtgaactgtg

SEQ ID NO: 256457 - DNA, 25 bp, Mus musculus
cgagctgcagaaccagctagctgcc

SEQ ID NO: 256458 - DNA, 25 bp, Mus musculus
cgagctgcagcaggagttaaaaata

SEQ ID NO: 256459 - DNA, 25 bp, Mus musculus
cgagctgcaggagagcgcacacacg

SEQ ID NO: 256460 - DNA, 25 bp, Mus musculus
cgagctgccgtgggttgaaaaatac

SEQ ID NO: 256461 - DNA, 25 bp, Mus musculus
cgagctgcctacagataccatggcg

SEQ ID NO: 256462 - DNA, 25 bp, Mus musculus
cgagctgcctacagctcagcagaga

SEQ ID NO: 256463 - DNA, 25 bp, Mus musculus
cgagctgcctacaggaaaaaaaatc

SEQ ID NO: 256464 - DNA, 25 bp, Mus musculus
cgagctgcctacaggtgactggatg

SEQ ID NO: 256465 - DNA, 25 bp, Mus musculus
cgagctgctggatgagattctggac

SEQ ID NO: 256466 - DNA, 25 bp, Mus musculus
cgagctggactgttatccaactgag

SEQ ID NO: 256467 - DNA, 25 bp, Mus musculus
cgagctggagtgagcaaaccaacat

SEQ ID NO: 256468 - DNA, 25 bp, Mus musculus
cgagctggcgggtgaaaattttgat

SEQ ID NO: 256469 - DNA, 25 bp, Mus musculus
cgagctggcggttttgtaccaatgg

SEQ ID NO: 256470 - DNA, 25 bp, Mus musculus
cgagctggggcccgagttctctggg

SEQ ID NO: 256471 - DNA, 25 bp, Mus musculus
cgagctggtgtcagacatggctaaa

SEQ ID NO: 256472 - DNA, 25 bp, Mus musculus
cgagctggtgtcagtctctgcttcc

SEQ ID NO: 256473 - DNA, 25 bp, Mus musculus
cgagctgtaaggtgacagaagacca

SEQ ID NO: 256474 - DNA, 25 bp, Mus musculus
cgagctgtaagtgagcttcactaga

SEQ ID NO: 256475 - DNA, 25 bp, Mus musculus
cgagctgtcggcattatgccagtac

SEQ ID NO: 256476 - DNA, 25 bp, Mus musculus
cgagctgtcgggagaaaattttgag

SEQ ID NO: 256477 - DNA, 25 bp, Mus musculus
cgagctgtgtggaaaaaatgtgggg

SEQ ID NO: 256478 - DNA, 25 bp, Mus musculus
cgagctgtgtggtgacttaccaatt

SEQ ID NO: 256479 - DNA, 25 bp, Mus musculus
cgagctgttgatgtgatggcaccaa

SEQ ID NO: 256480 - DNA, 25 bp, Mus musculus
cgagctgttgggaagatttctgggc

SEQ ID NO: 256481 - DNA, 25 bp, Mus musculus
cgagctgttgggaagggtctctcat

SEQ ID NO: 256482 - DNA, 25 bp, Mus musculus
cgagcttaaagatcgatcccgcaga

SEQ ID NO: 256483 - DNA, 25 bp, Mus musculus
cgagcttacaaagaatggaattgct

SEQ ID NO: 256484 - DNA, 25 bp, Mus musculus
cgagcttctgcaaggttctgtcccc

SEQ ID NO: 256485 - DNA, 25 bp, Mus musculus
cgagctttcctttgaagcacctaaa

SEQ ID NO: 256486 - DNA, 25 bp, Mus musculus
cgaggaaacaggcactctcgatttg

SEQ ID NO: 256487 - DNA, 25 bp, Mus musculus
cgaggaaagccagtaatggtcagca

SEQ ID NO: 256488 - DNA, 25 bp, Mus musculus
cgaggaaccctggggcatcccccgc

SEQ ID NO: 256489 - DNA, 25 bp, Mus musculus
cgaggaacctttcacgatgacagag

SEQ ID NO: 256490 - DNA, 25 bp, Mus musculus
cgaggaactatccgcaaagaagata

SEQ ID NO: 256491 - DNA, 25 bp, Mus musculus
cgaggaagagaaagggcggtctggt

SEQ ID NO: 256492 - DNA, 25 bp, Mus musculus
cgaggaagagaaggctgaggcagac

SEQ ID NO: 256493 - DNA, 25 bp, Mus musculus
cgaggaaggcaggaaagaagaggtt

SEQ ID NO: 256494 - DNA, 25 bp, Mus musculus
cgaggaagtagagccgccatgacta

SEQ ID NO: 256495 - DNA, 25 bp, Mus musculus
cgaggacaaccacagcgacccatac

SEQ ID NO: 256496 - DNA, 25 bp, Mus musculus
cgaggacaagatgctcatgagcagc

SEQ ID NO: 256497 - DNA, 25 bp, Mus musculus
cgaggacaaggaaccttacagcact

SEQ ID NO: 256498 - DNA, 25 bp, Mus musculus
cgaggacaagtgccaatgcaagacc

SEQ ID NO: 256499 - DNA, 25 bp, Mus musculus
cgaggacaatcgggtgatccaggag

SEQ ID NO: 256500 - DNA, 25 bp, Mus musculus
cgaggacagacaagaaattgcaaat

SEQ ID NO: 256501 - DNA, 25 bp, Mus musculus
cgaggacagacctgcaaatctccca

SEQ ID NO: 256502 - DNA, 25 bp, Mus musculus
cgaggacagagccaccagccatgcc

SEQ ID NO: 256503 - DNA, 25 bp, Mus musculus
cgaggacagcgactttgaagattct

SEQ ID NO: 256504 - DNA, 25 bp, Mus musculus
cgaggacagcggctggaatggtctg

SEQ ID NO: 256505 - DNA, 25 bp, Mus musculus
cgaggaccagcgcaacaaaaagatc

SEQ ID NO: 256506 - DNA, 25 bp, Mus musculus
cgaggaccccacagtgcaagaatcc

SEQ ID NO: 256507 - DNA, 25 bp, Mus musculus
cgaggacccgcgagatgctgaggat

SEQ ID NO: 256508 - DNA, 25 bp, Mus musculus
cgaggaccctcaggtttgatgaaga

SEQ ID NO: 256509 - DNA, 25 bp, Mus musculus
cgaggaccctgctctgacgtatgac

SEQ ID NO: 256510 - DNA, 25 bp, Mus musculus
cgaggacgaagtgtttgactttggc

SEQ ID NO: 256511 - DNA, 25 bp, Mus musculus
cgaggacgactccttctatgaaatc

SEQ ID NO: 256512 - DNA, 25 bp, Mus musculus
cgaggacgactgccccaagaggacc

SEQ ID NO: 256513 - DNA, 25 bp, Mus musculus
cgaggacgagagctctatttcagtg

SEQ ID NO: 256514 - DNA, 25 bp, Mus musculus
cgaggacgagagctctggtgcaagt

SEQ ID NO: 256515 - DNA, 25 bp, Mus musculus
cgaggacgagctaaagcggctgctg

SEQ ID NO: 256516 - DNA, 25 bp, Mus musculus
cgaggacgagctacagccctacacg

SEQ ID NO: 256517 - DNA, 25 bp, Mus musculus
cgaggacgatccactgcaacacacc

SEQ ID NO: 256518 - DNA, 25 bp, Mus musculus
cgaggacgggaaagaacacatgtcg

SEQ ID NO: 256519 - DNA, 25 bp, Mus musculus
cgaggacgtcccgcacgtagaagac

SEQ ID NO: 256520 - DNA, 25 bp, Mus musculus
cgaggacgtgccaagccgcaatgaa

SEQ ID NO: 256521 - DNA, 25 bp, Mus musculus
cgaggactagtgttacaggtgggag

SEQ ID NO: 256522 - DNA, 25 bp, Mus musculus
cgaggactatgagaccaccatcagc

SEQ ID NO: 256523 - DNA, 25 bp, Mus musculus
cgaggactgcaagctaccttgcaac

SEQ ID NO: 256524 - DNA, 25 bp, Mus musculus
cgaggactgcaagctgccctgcaac

SEQ ID NO: 256525 - DNA, 25 bp, Mus musculus
cgaggacttcaccatccacgaaaat

SEQ ID NO: 256526 - DNA, 25 bp, Mus musculus
cgaggacttcaggtggaccagcaca

SEQ ID NO: 256527 - DNA, 25 bp, Mus musculus
cgaggagaaattggtccttacccta

SEQ ID NO: 256528 - DNA, 25 bp, Mus musculus
cgaggagaactgcacagcgaacccc

SEQ ID NO: 256529 - DNA, 25 bp, Mus musculus
cgaggagagcaaggataagcgccgg

SEQ ID NO: 256530 - DNA, 25 bp, Mus musculus
cgaggagatcgagggcctgatctca

SEQ ID NO: 256531 - DNA, 25 bp, Mus musculus
cgaggagcagaggctgtgtgaaggc

SEQ ID NO: 256532 - DNA, 25 bp, Mus musculus
cgaggagcagatatggcctccatcc

SEQ ID NO: 256533 - DNA, 25 bp, Mus musculus
cgaggagcaggttgctatcggctgg

SEQ ID NO: 256534 - DNA, 25 bp, Mus musculus
cgaggagcgcaggggccccacctgt

SEQ ID NO: 256535 - DNA, 25 bp, Mus musculus
cgaggagcgcaggttgtgtcaccaa

SEQ ID NO: 256536 - DNA, 25 bp, Mus musculus
cgaggagctaatcagtgagatgatt

SEQ ID NO: 256537 - DNA, 25 bp, Mus musculus
cgaggagctaattctgaagtcccta

SEQ ID NO: 256538 - DNA, 25 bp, Mus musculus
cgaggagctgggccaggagctgaag

SEQ ID NO: 256539 - DNA, 25 bp, Mus musculus
cgaggaggagctggagcacagccag

SEQ ID NO: 256540 - DNA, 25 bp, Mus musculus
cgaggaggaggccctgcgggcgctg

SEQ ID NO: 256541 - DNA, 25 bp, Mus musculus
cgaggaggaggcgcgggctgtggag

SEQ ID NO: 256542 - DNA, 25 bp, Mus musculus
cgaggaggatgaaggccattcaaac

SEQ ID NO: 256543 - DNA, 25 bp, Mus musculus
cgaggaggatgaagggaaaatgttt

SEQ ID NO: 256544 - DNA, 25 bp, Mus musculus
cgaggaggcaaagatttttatcacc

SEQ ID NO: 256545 - DNA, 25 bp, Mus musculus
cgaggagggcatgggcaacaggacc

SEQ ID NO: 256546 - DNA, 25 bp, Mus musculus
cgaggagggcatgggcgttaagatc

SEQ ID NO: 256547 - DNA, 25 bp, Mus musculus
cgaggagggttcagcccttcccctg

SEQ ID NO: 256548 - DNA, 25 bp, Mus musculus
cgaggagggttcagctcggatgtgg

SEQ ID NO: 256549 - DNA, 25 bp, Mus musculus
cgaggaggtgaggggacttcaaaac

SEQ ID NO: 256550 - DNA, 25 bp, Mus musculus
cgaggaggtggaggacctcatggaa

SEQ ID NO: 256551 - DNA, 25 bp, Mus musculus
cgaggaggtgtaccacagcagcctg

SEQ ID NO: 256552 - DNA, 25 bp, Mus musculus
cgaggagtctggctcgggtctttaa

SEQ ID NO: 256553 - DNA, 25 bp, Mus musculus
cgaggagtctggtggaggctccaac

SEQ ID NO: 256554 - DNA, 25 bp, Mus musculus
cgaggagtcttcctgtagaaatgcc

SEQ ID NO: 256555 - DNA, 25 bp, Mus musculus
cgaggagttcgcccccatggctgcc

SEQ ID NO: 256556 - DNA, 25 bp, Mus musculus
cgaggatatcagaaggactcagtct

SEQ ID NO: 256557 - DNA, 25 bp, Mus musculus
cgaggatattggagctccagccaca

SEQ ID NO: 256558 - DNA, 25 bp, Mus musculus
cgaggatcacagaaggtccctagca

SEQ ID NO: 256559 - DNA, 25 bp, Mus musculus
cgaggatcccaggaaagaaaagttt

SEQ ID NO: 256560 - DNA, 25 bp, Mus musculus
cgaggatcccagtcaggaaccagca

SEQ ID NO: 256561 - DNA, 25 bp, Mus musculus
cgaggatcctcaggaggaagaacct

SEQ ID NO: 256562 - DNA, 25 bp, Mus musculus
cgaggatgaagaaagaagcatcggt

SEQ ID NO: 256563 - DNA, 25 bp, Mus musculus
cgaggatgaggactcgtccagtgga

SEQ ID NO: 256564 - DNA, 25 bp, Mus musculus
cgaggatgatcggggaatcatcact

SEQ ID NO: 256565 - DNA, 25 bp, Mus musculus
cgaggatgcacatagaagccgtatc

SEQ ID NO: 256566 - DNA, 25 bp, Mus musculus
cgaggatttagctggtccaaagccc

SEQ ID NO: 256567 - DNA, 25 bp, Mus musculus
cgaggcaaaggtgtacagtgccacc

SEQ ID NO: 256568 - DNA, 25 bp, Mus musculus
cgaggcaaatggaaggaaacttcat

SEQ ID NO: 256569 - DNA, 25 bp, Mus musculus
cgaggcaataaattggagagaggtc

SEQ ID NO: 256570 - DNA, 25 bp, Mus musculus
cgaggcaatcaagtattctgagaga

SEQ ID NO: 256571 - DNA, 25 bp, Mus musculus
cgaggcagaggatttggacgtggca

SEQ ID NO: 256572 - DNA, 25 bp, Mus musculus
cgaggcagccacacgaatctgcaga

SEQ ID NO: 256573 - DNA, 25 bp, Mus musculus
cgaggcagccacacggaatacccgg

SEQ ID NO: 256574 - DNA, 25 bp, Mus musculus
cgaggcagccacacggtgcagcaca

SEQ ID NO: 256575 - DNA, 25 bp, Mus musculus
cgaggcatggccagtaatgttaaag

SEQ ID NO: 256576 - DNA, 25 bp, Mus musculus
cgaggcatgggtgaacggcctttcc

SEQ ID NO: 256577 - DNA, 25 bp, Mus musculus
cgaggcatgtggctctggtttccag

SEQ ID NO: 256578 - DNA, 25 bp, Mus musculus
cgaggccaaaactgggtttcactag

SEQ ID NO: 256579 - DNA, 25 bp, Mus musculus
cgaggccaaagttcaggacatctgt

SEQ ID NO: 256580 - DNA, 25 bp, Mus musculus
cgaggccaaccgtccagaaggatgc

SEQ ID NO: 256581 - DNA, 25 bp, Mus musculus
cgaggccaaccgtgtgctgctgaaa

SEQ ID NO: 256582 - DNA, 25 bp, Mus musculus
cgaggccacactgctatcatccagc

SEQ ID NO: 256583 - DNA, 25 bp, Mus musculus
cgaggccacgcatcctccacctgtc

SEQ ID NO: 256584 - DNA, 25 bp, Mus musculus
cgaggccagccggctacacagagaa

SEQ ID NO: 256585 - DNA, 25 bp, Mus musculus
cgaggccaggcgggctgggaaggtg

SEQ ID NO: 256586 - DNA, 25 bp, Mus musculus
cgaggccattgccaagaagaacgct

SEQ ID NO: 256587 - DNA, 25 bp, Mus musculus
cgaggcccagcgatccctctgtgag

SEQ ID NO: 256588 - DNA, 25 bp, Mus musculus
cgaggcccaggtcagtctggacctg

SEQ ID NO: 256589 - DNA, 25 bp, Mus musculus
cgaggccctggtcacaggctctcct

SEQ ID NO: 256590 - DNA, 25 bp, Mus musculus
cgaggccctggtcacaggctctgtt

SEQ ID NO: 256591 - DNA, 25 bp, Mus musculus
cgaggccgactgctcaccaggaccc

SEQ ID NO: 256592 - DNA, 25 bp, Mus musculus
cgaggccgagatctgtcgctttatc

SEQ ID NO: 256593 - DNA, 25 bp, Mus musculus
cgaggccgagccaagaaactatgtt

SEQ ID NO: 256594 - DNA, 25 bp, Mus musculus
cgaggccgagccaaggattttaaac

SEQ ID NO: 256595 - DNA, 25 bp, Mus musculus
cgaggccgagccaaggtgtgagatg

SEQ ID NO: 256596 - DNA, 25 bp, Mus musculus
cgaggccgagcccctcggagccctg

SEQ ID NO: 256597 - DNA, 25 bp, Mus musculus
cgaggccgaggacatatgggtgatt

SEQ ID NO: 256598 - DNA, 25 bp, Mus musculus
cgaggccgaggttgcttcctagaaa

SEQ ID NO: 256599 - DNA, 25 bp, Mus musculus
cgaggccgcaatctgtcgctttatc

SEQ ID NO: 256600 - DNA, 25 bp, Mus musculus
cgaggcctaccaggtcagcttgcaa

SEQ ID NO: 256601 - DNA, 25 bp, Mus musculus
cgaggcctaggatcagttcttaaga

SEQ ID NO: 256602 - DNA, 25 bp, Mus musculus
cgaggcctccacagagctggtggtt

SEQ ID NO: 256603 - DNA, 25 bp, Mus musculus
cgaggccttcagaatctgaggaaca

SEQ ID NO: 256604 - DNA, 25 bp, Mus musculus
cgaggccttcaggtggttgagcatg

SEQ ID NO: 256605 - DNA, 25 bp, Mus musculus
cgaggccttctggagcacatcttat

SEQ ID NO: 256606 - DNA, 25 bp, Mus musculus
cgaggccttggtcgatccactctct

SEQ ID NO: 256607 - DNA, 25 bp, Mus musculus
cgaggcgccacgacctgtgctacca

SEQ ID NO: 256608 - DNA, 25 bp, Mus musculus
cgaggcgccacggtagcgcctggca

SEQ ID NO: 256609 - DNA, 25 bp, Mus musculus
cgaggcgcgccggaagcccgacatc

SEQ ID NO: 256610 - DNA, 25 bp, Mus musculus
cgaggcgcgtgagacgcagaggcag

SEQ ID NO: 256611 - DNA, 25 bp, Mus musculus
cgaggcgcgtgagatgcccggaacc

SEQ ID NO: 256612 - DNA, 25 bp, Mus musculus
cgaggcgctcaagcggctcacccag

SEQ ID NO: 256613 - DNA, 25 bp, Mus musculus
cgaggcgctttcaggtaaaatggaa

SEQ ID NO: 256614 - DNA, 25 bp, Mus musculus
cgaggcggagtgggtgacccggggg

SEQ ID NO: 256615 - DNA, 25 bp, Mus musculus
cgaggcggagtggttctctttctgc

SEQ ID NO: 256616 - DNA, 25 bp, Mus musculus
cgaggcgtcccaggcctggaatgct

SEQ ID NO: 256617 - DNA, 25 bp, Mus musculus
cgaggcgtgagcacctccgcacctg

SEQ ID NO: 256618 - DNA, 25 bp, Mus musculus
cgaggcgtgtctgagaaccttctcc

SEQ ID NO: 256619 - DNA, 25 bp, Mus musculus
cgaggctaactgaggggttggcaaa

SEQ ID NO: 256620 - DNA, 25 bp, Mus musculus
cgaggctaatgaggaagcattaggg

SEQ ID NO: 256621 - DNA, 25 bp, Mus musculus
cgaggctaatgaggtttctggctcc

SEQ ID NO: 256622 - DNA, 25 bp, Mus musculus
cgaggctcaccaggatgtcttccaa

SEQ ID NO: 256623 - DNA, 25 bp, Mus musculus
cgaggctccaagggatttggtttcg

SEQ ID NO: 256624 - DNA, 25 bp, Mus musculus
cgaggctccaaggttaataatgcga

SEQ ID NO: 256625 - DNA, 25 bp, Mus musculus
cgaggctcgtcaggcacagaaggag

SEQ ID NO: 256626 - DNA, 25 bp, Mus musculus
cgaggctcttcaggtgctccaatga

SEQ ID NO: 256627 - DNA, 25 bp, Mus musculus
cgaggctgacaggtgagatctccag

SEQ ID NO: 256628 - DNA, 25 bp, Mus musculus
cgaggctggaggcaccatgagccag

SEQ ID NO: 256629 - DNA, 25 bp, Mus musculus
cgaggcttccagctccagaaatctt

SEQ ID NO: 256630 - DNA, 25 bp, Mus musculus
cgaggcttccgatcaattcgaagcc

SEQ ID NO: 256631 - DNA, 25 bp, Mus musculus
cgaggcttccgatcaggagagaaaa

SEQ ID NO: 256632 - DNA, 25 bp, Mus musculus
cgaggcttgaagaaagaacaagtta

SEQ ID NO: 256633 - DNA, 25 bp, Mus musculus
cgagggaaagtgtccacagacaaac

SEQ ID NO: 256634 - DNA, 25 bp, Mus musculus
cgagggaccggacactggccaaaag

SEQ ID NO: 256635 - DNA, 25 bp, Mus musculus
cgagggactgcaggtgtgagagtgt

SEQ ID NO: 256636 - DNA, 25 bp, Mus musculus
cgagggagaggcaatacagagtgct

SEQ ID NO: 256637 - DNA, 25 bp, Mus musculus
cgagggagctagcaaaatcggaaat

SEQ ID NO: 256638 - DNA, 25 bp, Mus musculus
cgagggagctaggaggccacgcagt

SEQ ID NO: 256639 - DNA, 25 bp, Mus musculus
cgagggatacagatgtatgagtctg

SEQ ID NO: 256640 - DNA, 25 bp, Mus musculus
cgagggatacaggatggtgttgctg

SEQ ID NO: 256641 - DNA, 25 bp, Mus musculus
cgagggatgctcaaggacagtgcta

SEQ ID NO: 256642 - DNA, 25 bp, Mus musculus
cgagggcaaaatctgtctccagtag

SEQ ID NO: 256643 - DNA, 25 bp, Mus musculus
cgagggcaaaatctgtgagaaggac

SEQ ID NO: 256644 - DNA, 25 bp, Mus musculus
cgagggcaagaaagatgaacgagac

SEQ ID NO: 256645 - DNA, 25 bp, Mus musculus
cgagggcacaggcggacctatgtgg

SEQ ID NO: 256646 - DNA, 25 bp, Mus musculus
cgagggcagagagtctcgctctcag

SEQ ID NO: 256647 - DNA, 25 bp, Mus musculus
cgagggcagagttaatgttcgtgaa

SEQ ID NO: 256648 - DNA, 25 bp, Mus musculus
cgagggcccgttcagggctgggctt

SEQ ID NO: 256649 - DNA, 25 bp, Mus musculus
cgagggccttcaggaagatgctacc

SEQ ID NO: 256650 - DNA, 25 bp, Mus musculus
cgagggcgaggatcatctgtctgga

SEQ ID NO: 256651 - DNA, 25 bp, Mus musculus
cgagggcgaggctcggctattagcc

SEQ ID NO: 256652 - DNA, 25 bp, Mus musculus
cgagggcgcggtgtggacaaatgtc

SEQ ID NO: 256653 - DNA, 25 bp, Mus musculus
cgagggcggcagacgccagtgctgt

SEQ ID NO: 256654 - DNA, 25 bp, Mus musculus
cgagggcggggcagcctgatgaccg

SEQ ID NO: 256655 - DNA, 25 bp, Mus musculus
cgagggctctacttctgttcgttaa

SEQ ID NO: 256656 - DNA, 25 bp, Mus musculus
cgaggggaaagaaagaatggaatct

SEQ ID NO: 256657 - DNA, 25 bp, Mus musculus
cgaggggaagattgcatctgggtat

SEQ ID NO: 256658 - DNA, 25 bp, Mus musculus
cgaggggaaggtgaagtatttgttt

SEQ ID NO: 256659 - DNA, 25 bp, Mus musculus
cgaggggacctggagacagccttcc

SEQ ID NO: 256660 - DNA, 25 bp, Mus musculus
cgaggggagaagtgatgccttattg

SEQ ID NO: 256661 - DNA, 25 bp, Mus musculus
cgaggggcggagctacagagactgc

SEQ ID NO: 256662 - DNA, 25 bp, Mus musculus
cgaggggcggatacagagactgcaa

SEQ ID NO: 256663 - DNA, 25 bp, Mus musculus
cgaggggtgagctgaacccccgttt

SEQ ID NO: 256664 - DNA, 25 bp, Mus musculus
cgaggggtgaggagatttgaaaaat

SEQ ID NO: 256665 - DNA, 25 bp, Mus musculus
cgagggtcgcgcagcgtgcagggtc

SEQ ID NO: 256666 - DNA, 25 bp, Mus musculus
cgagggtggatcgagaacactgtag

SEQ ID NO: 256667 - DNA, 25 bp, Mus musculus
cgagggtggatcgagatggttgtga

SEQ ID NO: 256668 - DNA, 25 bp, Mus musculus
cgagggttccctgatctatgaggac

SEQ ID NO: 256669 - DNA, 25 bp, Mus musculus
cgaggtaagaaatggcgctcaaaca

SEQ ID NO: 256670 - DNA, 25 bp, Mus musculus
cgaggtaccatttccaaggccgtgc

SEQ ID NO: 256671 - DNA, 25 bp, Mus musculus
cgaggtatttccaatcccgctcaag

SEQ ID NO: 256672 - DNA, 25 bp, Mus musculus
cgaggtcattctgtcagacccgcca

SEQ ID NO: 256673 - DNA, 25 bp, Mus musculus
cgaggtcctcacctccttcacttgg

SEQ ID NO: 256674 - DNA, 25 bp, Mus musculus
cgaggtcgatacttcccaagaaaga

SEQ ID NO: 256675 - DNA, 25 bp, Mus musculus
cgaggtcggcagaggtaaccatgga

SEQ ID NO: 256676 - DNA, 25 bp, Mus musculus
cgaggtctcgcagcacccagcaggc

SEQ ID NO: 256677 - DNA, 25 bp, Mus musculus
cgaggtcttcgaaagaaccaagcag

SEQ ID NO: 256678 - DNA, 25 bp, Mus musculus
cgaggtcttcggccttcccaggaca

SEQ ID NO: 256679 - DNA, 25 bp, Mus musculus
cgaggtgactgtgtgtttgatcctg

SEQ ID NO: 256680 - DNA, 25 bp, Mus musculus
cgaggtgatccgagatcgcctttgt

SEQ ID NO: 256681 - DNA, 25 bp, Mus musculus
cgaggtgcacagaggcataatcaac

SEQ ID NO: 256682 - DNA, 25 bp, Mus musculus
cgaggtgcactgccaacctaggcgc

SEQ ID NO: 256683 - DNA, 25 bp, Mus musculus
cgaggtgccccgggtgaacgcggag

SEQ ID NO: 256684 - DNA, 25 bp, Mus musculus
cgaggtgcctgggtccaagccggcc

SEQ ID NO: 256685 - DNA, 25 bp, Mus musculus
cgaggtgcctgttaaagtccgcggg

SEQ ID NO: 256686 - DNA, 25 bp, Mus musculus
cgaggtgcgagccgtaacacaaggc

SEQ ID NO: 256687 - DNA, 25 bp, Mus musculus
cgaggtggaactcagagtttgctat

SEQ ID NO: 256688 - DNA, 25 bp, Mus musculus
cgaggtggaactcaggtagcacttt

SEQ ID NO: 256689 - DNA, 25 bp, Mus musculus
cgaggtggagcatacatccatcctt

SEQ ID NO: 256690 - DNA, 25 bp, Mus musculus
cgaggtggaggagagaacattgaaa

SEQ ID NO: 256691 - DNA, 25 bp, Mus musculus
cgaggtggaggtggcctggggagtt

SEQ ID NO: 256692 - DNA, 25 bp, Mus musculus
cgaggtggcaggccccactgaaact

SEQ ID NO: 256693 - DNA, 25 bp, Mus musculus
cgaggtggccgtgggaccgtggcta

SEQ ID NO: 256694 - DNA, 25 bp, Mus musculus
cgaggtggctgagagccgagccaga

SEQ ID NO: 256695 - DNA, 25 bp, Mus musculus
cgaggtggctgagagtaaatgtggg

SEQ ID NO: 256696 - DNA, 25 bp, Mus musculus
cgaggttctctagggtgaagagatg

SEQ ID NO: 256697 - DNA, 25 bp, Mus musculus
cgaggttctctagtctgcccgagag

SEQ ID NO: 256698 - DNA, 25 bp, Mus musculus
cgaggttctgccgcaggagatgctg

SEQ ID NO: 256699 - DNA, 25 bp, Mus musculus
cgaggttgttaagactactgggaat

SEQ ID NO: 256700 - DNA, 25 bp, Mus musculus
cgaggttgttaagatcctggaccgc

SEQ ID NO: 256701 - DNA, 25 bp, Mus musculus
cgagtaaaatcgataaacaacccag

SEQ ID NO: 256702 - DNA, 25 bp, Mus musculus
cgagtaacagggattgccggaactt

SEQ ID NO: 256703 - DNA, 25 bp, Mus musculus
cgagtaacctggagtttctgacatg

SEQ ID NO: 256704 - DNA, 25 bp, Mus musculus
cgagtaagaggaattctggctgaaa

SEQ ID NO: 256705 - DNA, 25 bp, Mus musculus
cgagtaagtccagatctgatttgta

SEQ ID NO: 256706 - DNA, 25 bp, Mus musculus
cgagtaatcctgtgtcttggtttgc

SEQ ID NO: 256707 - DNA, 25 bp, Mus musculus
cgagtacatggggagatcctttctc

SEQ ID NO: 256708 - DNA, 25 bp, Mus musculus
cgagtacatggggaggattcagtcc

SEQ ID NO: 256709 - DNA, 25 bp, Mus musculus
cgagtaccagaaagctcagcccagg

SEQ ID NO: 256710 - DNA, 25 bp, Mus musculus
cgagtaccagagcccacagacgctt

SEQ ID NO: 256711 - DNA, 25 bp, Mus musculus
cgagtaccaggacctgacgttcctg

SEQ ID NO: 256712 - DNA, 25 bp, Mus musculus
cgagtaccaggctaaccctttcaag

SEQ ID NO: 256713 - DNA, 25 bp, Mus musculus
cgagtaccaggttggagtgggtgga

SEQ ID NO: 256714 - DNA, 25 bp, Mus musculus
cgagtagaagatgaaagtctggata

SEQ ID NO: 256715 - DNA, 25 bp, Mus musculus
cgagtagcaggaataaacacgtttg

SEQ ID NO: 256716 - DNA, 25 bp, Mus musculus
cgagtagcaggaggcgtccggtcgc

SEQ ID NO: 256717 - DNA, 25 bp, Mus musculus
cgagtagctgggtatcatagttaat

SEQ ID NO: 256718 - DNA, 25 bp, Mus musculus
cgagtaggccctattggagaccctg

SEQ ID NO: 256719 - DNA, 25 bp, Mus musculus
cgagtataagcaattaaccctgaat

SEQ ID NO: 256720 - DNA, 25 bp, Mus musculus
cgagtatccgaggctggttatgacg

SEQ ID NO: 256721 - DNA, 25 bp, Mus musculus
cgagtatctcagtggaggagaacta

SEQ ID NO: 256722 - DNA, 25 bp, Mus musculus
cgagtatctggaagtacaaaggagc

SEQ ID NO: 256723 - DNA, 25 bp, Mus musculus
cgagtatctggacatgtcctcacgt

SEQ ID NO: 256724 - DNA, 25 bp, Mus musculus
cgagtatctggctcagagacatgtc

SEQ ID NO: 256725 - DNA, 25 bp, Mus musculus
cgagtatctggttttaacagcgtat

SEQ ID NO: 256726 - DNA, 25 bp, Mus musculus
cgagtatgaattggagctactgctt

SEQ ID NO: 256727 - DNA, 25 bp, Mus musculus
cgagtatgggcgggtaatctatgcc

SEQ ID NO: 256728 - DNA, 25 bp, Mus musculus
cgagtatttgctggtgctgtagccc

SEQ ID NO: 256729 - DNA, 25 bp, Mus musculus
cgagtcaaaagagctttggcaccga

SEQ ID NO: 256730 - DNA, 25 bp, Mus musculus
cgagtcaagcaggtctgcggagatt

SEQ ID NO: 256731 - DNA, 25 bp, Mus musculus
cgagtcacacgataagcccctggtc

SEQ ID NO: 256732 - DNA, 25 bp, Mus musculus
cgagtcacaggcctgagggccagcc

SEQ ID NO: 256733 - DNA, 25 bp, Mus musculus
cgagtcacagggggtgacatggcag

SEQ ID NO: 256734 - DNA, 25 bp, Mus musculus
cgagtcaccgtttgccatctctgga

SEQ ID NO: 256735 - DNA, 25 bp, Mus musculus
cgagtcacctgctgtaattggcaac

SEQ ID NO: 256736 - DNA, 25 bp, Mus musculus
cgagtcatcaacctaatgcctgaac

SEQ ID NO: 256737 - DNA, 25 bp, Mus musculus
cgagtcatcaagacttcataagggc

SEQ ID NO: 256738 - DNA, 25 bp, Mus musculus
cgagtcatcaaggtaaaccgagagt

SEQ ID NO: 256739 - DNA, 25 bp, Mus musculus
cgagtcccaagccccacccacaaac

SEQ ID NO: 256740 - DNA, 25 bp, Mus musculus
cgagtcccaggtttgaagagtggca

SEQ ID NO: 256741 - DNA, 25 bp, Mus musculus
cgagtcccagtgctgtaattacagg

SEQ ID NO: 256742 - DNA, 25 bp, Mus musculus
cgagtccccaagaacacagccaaaa

SEQ ID NO: 256743 - DNA, 25 bp, Mus musculus
cgagtccccaagcacggctggagcg

SEQ ID NO: 256744 - DNA, 25 bp, Mus musculus
cgagtccgacggatcgctactctta

SEQ ID NO: 256745 - DNA, 25 bp, Mus musculus
cgagtccgagagttcaaaggtgaag

SEQ ID NO: 256746 - DNA, 25 bp, Mus musculus
cgagtcctatggtgaaggctgcatt

SEQ ID NO: 256747 - DNA, 25 bp, Mus musculus
cgagtcctcaggccaatgtgctttg

SEQ ID NO: 256748 - DNA, 25 bp, Mus musculus
cgagtccttatgacacgtccccatc

SEQ ID NO: 256749 - DNA, 25 bp, Mus musculus
cgagtcgccctagagttgaggccgg

SEQ ID NO: 256750 - DNA, 25 bp, Mus musculus
cgagtcgccggaggacacagagctg

SEQ ID NO: 256751 - DNA, 25 bp, Mus musculus
cgagtcgctgatgagcgggaccgag

SEQ ID NO: 256752 - DNA, 25 bp, Mus musculus
cgagtcggagacccggatttcccag

SEQ ID NO: 256753 - DNA, 25 bp, Mus musculus
cgagtcgggccggacagaacagtaa

SEQ ID NO: 256754 - DNA, 25 bp, Mus musculus
cgagtctactcggaaaaagagagga

SEQ ID NO: 256755 - DNA, 25 bp, Mus musculus
cgagtctactgtctgccaaaatgtc

SEQ ID NO: 256756 - DNA, 25 bp, Mus musculus
cgagtctagagctcctccgggatct

SEQ ID NO: 256757 - DNA, 25 bp, Mus musculus
cgagtctcggcaaagtctactgacc

SEQ ID NO: 256758 - DNA, 25 bp, Mus musculus
cgagtctcgggactgaggctcagca

SEQ ID NO: 256759 - DNA, 25 bp, Mus musculus
cgagtctgaggctgcttatgatccc

SEQ ID NO: 256760 - DNA, 25 bp, Mus musculus
cgagtctgatagctgctgcttccag

SEQ ID NO: 256761 - DNA, 25 bp, Mus musculus
cgagtctgatatctgctgcttccag

SEQ ID NO: 256762 - DNA, 25 bp, Mus musculus
cgagtcttcggggccctctgtcctg

SEQ ID NO: 256763 - DNA, 25 bp, Mus musculus
cgagtctttcaggaagaagaccttc

SEQ ID NO: 256764 - DNA, 25 bp, Mus musculus
cgagtgaccagtggagtgaagccag

SEQ ID NO: 256765 - DNA, 25 bp, Mus musculus
cgagtgactgtgtaacggagcacct

SEQ ID NO: 256766 - DNA, 25 bp, Mus musculus
cgagtgagccccagaccacctcatc

SEQ ID NO: 256767 - DNA, 25 bp, Mus musculus
cgagtgagccccaggtctgtctccg

SEQ ID NO: 256768 - DNA, 25 bp, Mus musculus
cgagtgatagggtaaaatttatgaa

SEQ ID NO: 256769 - DNA, 25 bp, Mus musculus
cgagtgatcatgtgcctctcctttc

SEQ ID NO: 256770 - DNA, 25 bp, Mus musculus
cgagtgatgctgaccagcacgtaac

SEQ ID NO: 256771 - DNA, 25 bp, Mus musculus
cgagtgatgctgaccgagatccctg

SEQ ID NO: 256772 - DNA, 25 bp, Mus musculus
cgagtgatgcttattctttgggagc

SEQ ID NO: 256773 - DNA, 25 bp, Mus musculus
cgagtgatggggcgttgggcgctca

SEQ ID NO: 256774 - DNA, 25 bp, Mus musculus
cgagtgcaactacagccttgatgac

SEQ ID NO: 256775 - DNA, 25 bp, Mus musculus
cgagtgcaaggctgatatagaattg

SEQ ID NO: 256776 - DNA, 25 bp, Mus musculus
cgagtgcaaggtttgacttttgcca

SEQ ID NO: 256777 - DNA, 25 bp, Mus musculus
cgagtgcagcgggagggcagcagag

SEQ ID NO: 256778 - DNA, 25 bp, Mus musculus
cgagtgccaaaggtgtgactgcaat

SEQ ID NO: 256779 - DNA, 25 bp, Mus musculus
cgagtgcctgcaggatcggaacgtc

SEQ ID NO: 256780 - DNA, 25 bp, Mus musculus
cgagtgcctgtgctggtggagtcca

SEQ ID NO: 256781 - DNA, 25 bp, Mus musculus
cgagtgcgagcgggttgctgttctg

SEQ ID NO: 256782 - DNA, 25 bp, Mus musculus
cgagtgcggacgggaatctggtcgg

SEQ ID NO: 256783 - DNA, 25 bp, Mus musculus
cgagtgcgtccagtatcagcatgtg

SEQ ID NO: 256784 - DNA, 25 bp, Mus musculus
cgagtgctgaagccgagagaaatgt

SEQ ID NO: 256785 - DNA, 25 bp, Mus musculus
cgagtgctgaagccgggaggggctt

SEQ ID NO: 256786 - DNA, 25 bp, Mus musculus
cgagtgctgaagccgtaagggttgg

SEQ ID NO: 256787 - DNA, 25 bp, Mus musculus
cgagtggaagagcggagactactgg

SEQ ID NO: 256788 - DNA, 25 bp, Mus musculus
cgagtggaaggtcctcatcatggat

SEQ ID NO: 256789 - DNA, 25 bp, Mus musculus
cgagtggaagtcgtggaagacatca

SEQ ID NO: 256790 - DNA, 25 bp, Mus musculus
cgagtggacccagaggagacttgtg

SEQ ID NO: 256791 - DNA, 25 bp, Mus musculus
cgagtggacccagccccgggaacac

SEQ ID NO: 256792 - DNA, 25 bp, Mus musculus
cgagtggacccagggctgttgggag

SEQ ID NO: 256793 - DNA, 25 bp, Mus musculus
cgagtggagaaaaacgaaaatcttc

SEQ ID NO: 256794 - DNA, 25 bp, Mus musculus
cgagtggagctggacctcggcctag

SEQ ID NO: 256795 - DNA, 25 bp, Mus musculus
cgagtggatgttcaattggcttcgt

SEQ ID NO: 256796 - DNA, 25 bp, Mus musculus
cgagtggcagagttgcacagcaaat

SEQ ID NO: 256797 - DNA, 25 bp, Mus musculus
cgagtggcaggagaaacccaagcct

SEQ ID NO: 256798 - DNA, 25 bp, Mus musculus
cgagtggcaggaggtccggagttca

SEQ ID NO: 256799 - DNA, 25 bp, Mus musculus
cgagtggcagtgatcatgggcaggg

SEQ ID NO: 256800 - DNA, 25 bp, Mus musculus
cgagtggtgaaggacctcagtgcag

SEQ ID NO: 256801 - DNA, 25 bp, Mus musculus
cgagtgtactgaggaaagcagagga

SEQ ID NO: 256802 - DNA, 25 bp, Mus musculus
cgagtgtactgaggcatatttaatt

SEQ ID NO: 256803 - DNA, 25 bp, Mus musculus
cgagtgtagtaggtctgttcctgcg

SEQ ID NO: 256804 - DNA, 25 bp, Mus musculus
cgagtgtcaagactgtgatttaccg

SEQ ID NO: 256805 - DNA, 25 bp, Mus musculus
cgagtgtctcccaggctttgaaggg

SEQ ID NO: 256806 - DNA, 25 bp, Mus musculus
cgagtgtttggacggtgtgccggac

SEQ ID NO: 256807 - DNA, 25 bp, Mus musculus
cgagttaaagcacatggtgatgagt

SEQ ID NO: 256808 - DNA, 25 bp, Mus musculus
cgagttacaggagggaatcttgact

SEQ ID NO: 256809 - DNA, 25 bp, Mus musculus
cgagttagaaaagccatagattgta

SEQ ID NO: 256810 - DNA, 25 bp, Mus musculus
cgagttagaaaagctatagagaagt

SEQ ID NO: 256811 - DNA, 25 bp, Mus musculus
cgagttattaggatgcctggtgtgc

SEQ ID NO: 256812 - DNA, 25 bp, Mus musculus
cgagttattaggcacatgactcagg

SEQ ID NO: 256813 - DNA, 25 bp, Mus musculus
cgagttcaagaacctggacatcact

SEQ ID NO: 256814 - DNA, 25 bp, Mus musculus
cgagttcaagctgatcatggctcct

SEQ ID NO: 256815 - DNA, 25 bp, Mus musculus
cgagttcaagggcagagaacatgga

SEQ ID NO: 256816 - DNA, 25 bp, Mus musculus
cgagttcaaggtcgcttctccgatt

SEQ ID NO: 256817 - DNA, 25 bp, Mus musculus
cgagttcagcaagctttgcagccag

SEQ ID NO: 256818 - DNA, 25 bp, Mus musculus
cgagttcatgaaagatcgattatat

SEQ ID NO: 256819 - DNA, 25 bp, Mus musculus
cgagttcatgaaggaagcgggtgca

SEQ ID NO: 256820 - DNA, 25 bp, Mus musculus
cgagttcatgaaggaggatttcgat

SEQ ID NO: 256821 - DNA, 25 bp, Mus musculus
cgagttccgggtcatgcatccatcc

SEQ ID NO: 256822 - DNA, 25 bp, Mus musculus
cgagttccgggtgctgggtgtgtgg

SEQ ID NO: 256823 - DNA, 25 bp, Mus musculus
cgagttctgggagaacaaagtattg

SEQ ID NO: 256824 - DNA, 25 bp, Mus musculus
cgagttcttctggcaccagcccatc

SEQ ID NO: 256825 - DNA, 25 bp, Mus musculus
cgagttgctccttcctctccactag

SEQ ID NO: 256826 - DNA, 25 bp, Mus musculus
cgagttggtcaagtgcatcgaggag

SEQ ID NO: 256827 - DNA, 25 bp, Mus musculus
cgagtttcaggctccatttggaatc

SEQ ID NO: 256828 - DNA, 25 bp, Mus musculus
cgagtttccagagccctgaagacaa

SEQ ID NO: 256829 - DNA, 25 bp, Mus musculus
cgagtttcttttggaggtgcagtgt

SEQ ID NO: 256830 - DNA, 25 bp, Mus musculus
cgagtttgaaattcctatcacatat

SEQ ID NO: 256831 - DNA, 25 bp, Mus musculus
cgagtttgacaagatgaatgaccag

SEQ ID NO: 256832 - DNA, 25 bp, Mus musculus
cgagtttgcagaggatgacgtcagt

SEQ ID NO: 256833 - DNA, 25 bp, Mus musculus
cgagtttgcagaggtgctggaaatg

SEQ ID NO: 256834 - DNA, 25 bp, Mus musculus
cgagtttgcattccgcttgcttccc

SEQ ID NO: 256835 - DNA, 25 bp, Mus musculus
cgagtttgttgtcacaatgcttata

SEQ ID NO: 256836 - DNA, 25 bp, Mus musculus
cgagttttctgccagattcaagaac

SEQ ID NO: 256837 - DNA, 25 bp, Mus musculus
cgataaaccattgttgaggaccagg

SEQ ID NO: 256838 - DNA, 25 bp, Mus musculus
cgataaccagagccaacctttgggc

SEQ ID NO: 256839 - DNA, 25 bp, Mus musculus
cgataaccaggtgagaaaggcagag

SEQ ID NO: 256840 - DNA, 25 bp, Mus musculus
cgataagaaatcttggccaggaccc

SEQ ID NO: 256841 - DNA, 25 bp, Mus musculus
cgataagcaccggcctctggaaatg

SEQ ID NO: 256842 - DNA, 25 bp, Mus musculus
cgataataagatcagcaccagtgat

SEQ ID NO: 256843 - DNA, 25 bp, Mus musculus
cgataatctttcaaggaccctgatt

SEQ ID NO: 256844 - DNA, 25 bp, Mus musculus
cgataatctttcaaggtttgaccaa

SEQ ID NO: 256845 - DNA, 25 bp, Mus musculus
cgataatttcaatgtccttggctcc

SEQ ID NO: 256846 - DNA, 25 bp, Mus musculus
cgatacaaaacaactgataaaagag

SEQ ID NO: 256847 - DNA, 25 bp, Mus musculus
cgatacaagtgaccttattcaatcc

SEQ ID NO: 256848 - DNA, 25 bp, Mus musculus
cgatacagaaagagtctttctcctt

SEQ ID NO: 256849 - DNA, 25 bp, Mus musculus
cgatacagacaggttaactgaggga

SEQ ID NO: 256850 - DNA, 25 bp, Mus musculus
cgataccaacgtggtccactgacaa

SEQ ID NO: 256851 - DNA, 25 bp, Mus musculus
cgatacccccgccacattgacagtt

SEQ ID NO: 256852 - DNA, 25 bp, Mus musculus
cgatacctgaggacacgagaggaca

SEQ ID NO: 256853 - DNA, 25 bp, Mus musculus
cgatacgacgaaatggtggaatcaa

SEQ ID NO: 256854 - DNA, 25 bp, Mus musculus
cgatacgacggttgaaactgagctc

SEQ ID NO: 256855 - DNA, 25 bp, Mus musculus
cgatactgtggagactatgacagtt

SEQ ID NO: 256856 - DNA, 25 bp, Mus musculus
cgatactgtggagggctccacctga

SEQ ID NO: 256857 - DNA, 25 bp, Mus musculus
cgatagcaacgggggcatctgcaac

SEQ ID NO: 256858 - DNA, 25 bp, Mus musculus
cgatagcatacctgtatgaccggtt

SEQ ID NO: 256859 - DNA, 25 bp, Mus musculus
cgatagctccctccgatgtcatatg

SEQ ID NO: 256860 - DNA, 25 bp, Mus musculus
cgatagctctccagacacaagcatc

SEQ ID NO: 256861 - DNA, 25 bp, Mus musculus
cgatagctgagagtcgacaattaga

SEQ ID NO: 256862 - DNA, 25 bp, Mus musculus
cgataggaagtatgaacatcatctc

SEQ ID NO: 256863 - DNA, 25 bp, Mus musculus
cgataggaatacaacttctcgccga

SEQ ID NO: 256864 - DNA, 25 bp, Mus musculus
cgataggaatacaagagaggactag

SEQ ID NO: 256865 - DNA, 25 bp, Mus musculus
cgataggaatacaagttgactgcat

SEQ ID NO: 256866 - DNA, 25 bp, Mus musculus
cgataggcagagcagctccatcagc

SEQ ID NO: 256867 - DNA, 25 bp, Mus musculus
cgataggcagaggtcagtaccatga

SEQ ID NO: 256868 - DNA, 25 bp, Mus musculus
cgataggctgcgatgggtggatgag

SEQ ID NO: 256869 - DNA, 25 bp, Mus musculus
cgatagggaggaagcacctctggga

SEQ ID NO: 256870 - DNA, 25 bp, Mus musculus
cgataggtacagttctgacacaaca

SEQ ID NO: 256871 - DNA, 25 bp, Mus musculus
cgataggtataatggcctcggccct

SEQ ID NO: 256872 - DNA, 25 bp, Mus musculus
cgatataaacctgaaggcatcagtt

SEQ ID NO: 256873 - DNA, 25 bp, Mus musculus
cgatataaagactcggtaccccatg

SEQ ID NO: 256874 - DNA, 25 bp, Mus musculus
cgatataaagattgccctgaccgcc

SEQ ID NO: 256875 - DNA, 25 bp, Mus musculus
cgatatatacagatttgcaacagca

SEQ ID NO: 256876 - DNA, 25 bp, Mus musculus
cgatatcacaaatgttaactcattc

SEQ ID NO: 256877 - DNA, 25 bp, Mus musculus
cgatatcatgcctctgacagctgga

SEQ ID NO: 256878 - DNA, 25 bp, Mus musculus
cgatatcccaagagggtgtagcccg

SEQ ID NO: 256879 - DNA, 25 bp, Mus musculus
cgatatcgtcccagttttcgcatac

SEQ ID NO: 256880 - DNA, 25 bp, Mus musculus
cgatatcttactcagaaaaatttcc

SEQ ID NO: 256881 - DNA, 25 bp, Mus musculus
cgatatcttactcagggcattacac

SEQ ID NO: 256882 - DNA, 25 bp, Mus musculus
cgatatcttctttctcatctttggg

SEQ ID NO: 256883 - DNA, 25 bp, Mus musculus
cgatatgacgaatgggtgaagaccg

SEQ ID NO: 256884 - DNA, 25 bp, Mus musculus
cgatatgacgtgggcgacccagccc

SEQ ID NO: 256885 - DNA, 25 bp, Mus musculus
cgatatgacttccatataagtttct

SEQ ID NO: 256886 - DNA, 25 bp, Mus musculus
cgatatgatgagaggccgggcccct

SEQ ID NO: 256887 - DNA, 25 bp, Mus musculus
cgatatgatgagaggcgacgtagtc

SEQ ID NO: 256888 - DNA, 25 bp, Mus musculus
cgatatgtccctggatgatattatc

SEQ ID NO: 256889 - DNA, 25 bp, Mus musculus
cgatattccctgactgctgcccgaa

SEQ ID NO: 256890 - DNA, 25 bp, Mus musculus
cgatattccctgatgttgcattgat

SEQ ID NO: 256891 - DNA, 25 bp, Mus musculus
cgatcaaaaagacaggttagaaagc

SEQ ID NO: 256892 - DNA, 25 bp, Mus musculus
cgatcaactcaataaagccgttgtg

SEQ ID NO: 256893 - DNA, 25 bp, Mus musculus
cgatcaactcagccggctcaacatt

SEQ ID NO: 256894 - DNA, 25 bp, Mus musculus
cgatcacaacccctgaccataggtc

SEQ ID NO: 256895 - DNA, 25 bp, Mus musculus
cgatcacaacccctgggtggagttt

SEQ ID NO: 256896 - DNA, 25 bp, Mus musculus
cgatcacaagatgtctggtcagcca

SEQ ID NO: 256897 - DNA, 25 bp, Mus musculus
cgatcacaagattggcgaaagacaa

SEQ ID NO: 256898 - DNA, 25 bp, Mus musculus
cgatcagaagactcacagtggtgag

SEQ ID NO: 256899 - DNA, 25 bp, Mus musculus
cgatcagaagatgcgctgatcctgc

SEQ ID NO: 256900 - DNA, 25 bp, Mus musculus
cgatcagctgctgagcagctgcagc

SEQ ID NO: 256901 - DNA, 25 bp, Mus musculus
cgatcaggaggcaggttgtcacaac

SEQ ID NO: 256902 - DNA, 25 bp, Mus musculus
cgatcaggtctgaggatatgacatt

SEQ ID NO: 256903 - DNA, 25 bp, Mus musculus
cgatcagtgagctcctgctgttcta

SEQ ID NO: 256904 - DNA, 25 bp, Mus musculus
cgatcagtgtgagtatatacacttc

SEQ ID NO: 256905 - DNA, 25 bp, Mus musculus
cgatcatggagtattgataacaaca

SEQ ID NO: 256906 - DNA, 25 bp, Mus musculus
cgatccaaacgggaacaatataagc

SEQ ID NO: 256907 - DNA, 25 bp, Mus musculus
cgatccaacagaccctcaggacttg

SEQ ID NO: 256908 - DNA, 25 bp, Mus musculus
cgatccaaccctcgaatcaacctac

SEQ ID NO: 256909 - DNA, 25 bp, Mus musculus
cgatccaagagtcggccacaggttg

SEQ ID NO: 256910 - DNA, 25 bp, Mus musculus
cgatccaagtgagttacaagactta

SEQ ID NO: 256911 - DNA, 25 bp, Mus musculus
cgatccaccaggtttgaggagttcc

SEQ ID NO: 256912 - DNA, 25 bp, Mus musculus
cgatccagcttacattgcagtttta

SEQ ID NO: 256913 - DNA, 25 bp, Mus musculus
cgatccagcttgtattgcagtttta

SEQ ID NO: 256914 - DNA, 25 bp, Mus musculus
cgatcccacagatccaacttttaca

SEQ ID NO: 256915 - DNA, 25 bp, Mus musculus
cgatcccacagtgcaatttggtctg

SEQ ID NO: 256916 - DNA, 25 bp, Mus musculus
cgatcccagagccaaaaaccaaaga

SEQ ID NO: 256917 - DNA, 25 bp, Mus musculus
cgatcccagagccaaaacttccacg

SEQ ID NO: 256918 - DNA, 25 bp, Mus musculus
cgatccccagacgagcaccaaggaa

SEQ ID NO: 256919 - DNA, 25 bp, Mus musculus
cgatccctgtaacagccaaacacca

SEQ ID NO: 256920 - DNA, 25 bp, Mus musculus
cgatccctgtaacaggaatgggctg

SEQ ID NO: 256921 - DNA, 25 bp, Mus musculus
cgatccgcagaagacctaaccgatg

SEQ ID NO: 256922 - DNA, 25 bp, Mus musculus
cgatccgcagagcagcttaagaaac

SEQ ID NO: 256923 - DNA, 25 bp, Mus musculus
cgatccgcccaagagctcaaagccc

SEQ ID NO: 256924 - DNA, 25 bp, Mus musculus
cgatccgcgtgggatccaaggactg

SEQ ID NO: 256925 - DNA, 25 bp, Mus musculus
cgatccgtgacagactcaaactaga

SEQ ID NO: 256926 - DNA, 25 bp, Mus musculus
cgatccgtgacaggccctttgaacg

SEQ ID NO: 256927 - DNA, 25 bp, Mus musculus
cgatcctctccaggacccaagtttc

SEQ ID NO: 256928 - DNA, 25 bp, Mus musculus
cgatcctgacatgactgacttacag

SEQ ID NO: 256929 - DNA, 25 bp, Mus musculus
cgatcctgagacaggctccgtccat

SEQ ID NO: 256930 - DNA, 25 bp, Mus musculus
cgatcctgccagaaccacctgtagc

SEQ ID NO: 256931 - DNA, 25 bp, Mus musculus
cgatcctgccttgacactagttgct

SEQ ID NO: 256932 - DNA, 25 bp, Mus musculus
cgatcctgtaagactttaacccatg

SEQ ID NO: 256933 - DNA, 25 bp, Mus musculus
cgatcctgtaaggcactggtgaagt

SEQ ID NO: 256934 - DNA, 25 bp, Mus musculus
cgatccttaccagtgaggctgctgg

SEQ ID NO: 256935 - DNA, 25 bp, Mus musculus
cgatccttgtggacttctgggatac

SEQ ID NO: 256936 - DNA, 25 bp, Mus musculus
cgatccttgtgggtatttgatgtcc

SEQ ID NO: 256937 - DNA, 25 bp, Mus musculus
cgatcgatcgagtcagtccgaccgc

SEQ ID NO: 256938 - DNA, 25 bp, Mus musculus
cgatcgccaatggttggttttgacc

SEQ ID NO: 256939 - DNA, 25 bp, Mus musculus
cgatcggaagagaccaagcaaaatg

SEQ ID NO: 256940 - DNA, 25 bp, Mus musculus
cgatcgtgtgcgggcatttcaggga

SEQ ID NO: 256941 - DNA, 25 bp, Mus musculus
cgatctaatccagggtctgccgtca

SEQ ID NO: 256942 - DNA, 25 bp, Mus musculus
cgatctagaatacctgaagaaaatt

SEQ ID NO: 256943 - DNA, 25 bp, Mus musculus
cgatctcatcaagaccctgaagaca

SEQ ID NO: 256944 - DNA, 25 bp, Mus musculus
cgatctcatcaaggcacataccatg

SEQ ID NO: 256945 - DNA, 25 bp, Mus musculus
cgatctccgagaaaattttgccaaa

SEQ ID NO: 256946 - DNA, 25 bp, Mus musculus
cgatctctgccagctttgtttacta

SEQ ID NO: 256947 - DNA, 25 bp, Mus musculus
cgatctctttgggtccattttctag

SEQ ID NO: 256948 - DNA, 25 bp, Mus musculus
cgatctgcgccccgggctccagcat

SEQ ID NO: 256949 - DNA, 25 bp, Mus musculus
cgatctggagccccgcaagtgccac

SEQ ID NO: 256950 - DNA, 25 bp, Mus musculus
cgatctggagctgcagcgctcacca

SEQ ID NO: 256951 - DNA, 25 bp, Mus musculus
cgatctgggtggaaatggaatttat

SEQ ID NO: 256952 - DNA, 25 bp, Mus musculus
cgatcttgagcaaaagagcccgatt

SEQ ID NO: 256953 - DNA, 25 bp, Mus musculus
cgatcttgaggtggctaccgtctca

SEQ ID NO: 256954 - DNA, 25 bp, Mus musculus
cgatgaaatcaaggaacaagcaatg

SEQ ID NO: 256955 - DNA, 25 bp, Mus musculus
cgatgaaatcaaggaagactcttca

SEQ ID NO: 256956 - DNA, 25 bp, Mus musculus
cgatgaaatcaaggtaactatggat

SEQ ID NO: 256957 - DNA, 25 bp, Mus musculus
cgatgaacttggtaagttctcgtcc

SEQ ID NO: 256958 - DNA, 25 bp, Mus musculus
cgatgaagaacgagccctcgtgggt

SEQ ID NO: 256959 - DNA, 25 bp, Mus musculus
cgatgaagcagaactgcggacatcc

SEQ ID NO: 256960 - DNA, 25 bp, Mus musculus
cgatgaagcagtatcaggaggaaat

SEQ ID NO: 256961 - DNA, 25 bp, Mus musculus
cgatgaagccgcccatttcaataca

SEQ ID NO: 256962 - DNA, 25 bp, Mus musculus
cgatgaagccggctacctctgtcgc

SEQ ID NO: 256963 - DNA, 25 bp, Mus musculus
cgatgaatcacaggacctggagttg

SEQ ID NO: 256964 - DNA, 25 bp, Mus musculus
cgatgaatggctgtatgcccagctg

SEQ ID NO: 256965 - DNA, 25 bp, Mus musculus
cgatgaatgggtgtatgcccagctg

SEQ ID NO: 256966 - DNA, 25 bp, Mus musculus
cgatgacaacccgatagaggagcat

SEQ ID NO: 256967 - DNA, 25 bp, Mus musculus
cgatgacaagcttgctcgcctgacc

SEQ ID NO: 256968 - DNA, 25 bp, Mus musculus
cgatgacactgcaccatctgtggcg

SEQ ID NO: 256969 - DNA, 25 bp, Mus musculus
cgatgacagctatgtccccagtgac

SEQ ID NO: 256970 - DNA, 25 bp, Mus musculus
cgatgacagtgaagatccagccata

SEQ ID NO: 256971 - DNA, 25 bp, Mus musculus
cgatgacagtgaaggtatgctgcaa

SEQ ID NO: 256972 - DNA, 25 bp, Mus musculus
cgatgacagtgaagtgtaacaacta

SEQ ID NO: 256973 - DNA, 25 bp, Mus musculus
cgatgaccccagtgtcctttatttc

SEQ ID NO: 256974 - DNA, 25 bp, Mus musculus
cgatgacccctggaggaaactctga

SEQ ID NO: 256975 - DNA, 25 bp, Mus musculus
cgatgacccctggaggtggagacag

SEQ ID NO: 256976 - DNA, 25 bp, Mus musculus
cgatgacgagaacagaaaatactct

SEQ ID NO: 256977 - DNA, 25 bp, Mus musculus
cgatgacgatagtggttccggaagc

SEQ ID NO: 256978 - DNA, 25 bp, Mus musculus
cgatgacgtcttggctcatgctgcc

SEQ ID NO: 256979 - DNA, 25 bp, Mus musculus
cgatgacgtgaaaagacaccgaagt

SEQ ID NO: 256980 - DNA, 25 bp, Mus musculus
cgatgactgaggtgcttcacctttt

SEQ ID NO: 256981 - DNA, 25 bp, Mus musculus
cgatgagaaagatgtctcaacccta

SEQ ID NO: 256982 - DNA, 25 bp, Mus musculus
cgatgagaaccggaagaaagccgaa

SEQ ID NO: 256983 - DNA, 25 bp, Mus musculus
cgatgagacaagaagactgctggac

SEQ ID NO: 256984 - DNA, 25 bp, Mus musculus
cgatgagacaagatcttcaagcaac

SEQ ID NO: 256985 - DNA, 25 bp, Mus musculus
cgatgagcactctagttctgacagt

SEQ ID NO: 256986 - DNA, 25 bp, Mus musculus
cgatgagcactcttgtccctttaaa

SEQ ID NO: 256987 - DNA, 25 bp, Mus musculus
cgatgagccaaggcatagagatctc

SEQ ID NO: 256988 - DNA, 25 bp, Mus musculus
cgatgagcgcattttaaagcccaac

SEQ ID NO: 256989 - DNA, 25 bp, Mus musculus
cgatgaggaagaggaacacgcagca

SEQ ID NO: 256990 - DNA, 25 bp, Mus musculus
cgatgaggacaatctcctcaactgt

SEQ ID NO: 256991 - DNA, 25 bp, Mus musculus
cgatgaggaccaggtggtagttaat

SEQ ID NO: 256992 - DNA, 25 bp, Mus musculus
cgatgagtacaaagcatacgaggaa

SEQ ID NO: 256993 - DNA, 25 bp, Mus musculus
cgatgagtccaaattttatattggc

SEQ ID NO: 256994 - DNA, 25 bp, Mus musculus
cgatgagtccaagttctatattggc

SEQ ID NO: 256995 - DNA, 25 bp, Mus musculus
cgatgagtcggatgcagaggcctcc

SEQ ID NO: 256996 - DNA, 25 bp, Mus musculus
cgatgataaagagaaacttttagcg

SEQ ID NO: 256997 - DNA, 25 bp, Mus musculus
cgatgataaagagatgagacctgct

SEQ ID NO: 256998 - DNA, 25 bp, Mus musculus
cgatgataactttgtgatgtctggc

SEQ ID NO: 256999 - DNA, 25 bp, Mus musculus
cgatgatattcaagcgtctgttgcg

SEQ ID NO: 257000 - DNA, 25 bp, Mus musculus
cgatgatattcaaggaacagcgtct

SEQ ID NO: 257001 - DNA, 25 bp, Mus musculus
cgatgatcttggttttgagttcttt

SEQ ID NO: 257002 - DNA, 25 bp, Mus musculus
cgatgatgcgggagggaccttgtgc

SEQ ID NO: 257003 - DNA, 25 bp, Mus musculus
cgatgatgcggggggcctggatcgt

SEQ ID NO: 257004 - DNA, 25 bp, Mus musculus
cgatgatgcgggtttctccggctgt

SEQ ID NO: 257005 - DNA, 25 bp, Mus musculus
cgatgatttttttggaatgggcaaa

SEQ ID NO: 257006 - DNA, 25 bp, Mus musculus
cgatgcacaggccatagaagccaac

SEQ ID NO: 257007 - DNA, 25 bp, Mus musculus
cgatgcaggaagcgctgctccgaaa

SEQ ID NO: 257008 - DNA, 25 bp, Mus musculus
cgatgcatgaatatacagagtaagt

SEQ ID NO: 257009 - DNA, 25 bp, Mus musculus
cgatgccacctaggtttgaagactc

SEQ ID NO: 257010 - DNA, 25 bp, Mus musculus
cgatgccatcagtgaatcaaaggat

SEQ ID NO: 257011 - DNA, 25 bp, Mus musculus
cgatgccatcgtgaccatgctcaag

SEQ ID NO: 257012 - DNA, 25 bp, Mus musculus
cgatgccatggacgtgactgcaccc

SEQ ID NO: 257013 - DNA, 25 bp, Mus musculus
cgatgcccactggacttcaggaacc

SEQ ID NO: 257014 - DNA, 25 bp, Mus musculus
cgatgcccttttcccgtgtgttcag

SEQ ID NO: 257015 - DNA, 25 bp, Mus musculus
cgatgcctaccccaaaaattatgga

SEQ ID NO: 257016 - DNA, 25 bp, Mus musculus
cgatgcctctaaaaagccacaactc

SEQ ID NO: 257017 - DNA, 25 bp, Mus musculus
cgatgcggagtacatgaagcacaca

SEQ ID NO: 257018 - DNA, 25 bp, Mus musculus
cgatgctccagattctgtcccctct

SEQ ID NO: 257019 - DNA, 25 bp, Mus musculus
cgatgctccaggaggagcctgatct

SEQ ID NO: 257020 - DNA, 25 bp, Mus musculus
cgatgctcctccgggaagaatggga

SEQ ID NO: 257021 - DNA, 25 bp, Mus musculus
cgatgctcctccggtgccagtgacc

SEQ ID NO: 257022 - DNA, 25 bp, Mus musculus
cgatgctcgggctgttgacagctag

SEQ ID NO: 257023 - DNA, 25 bp, Mus musculus
cgatgctgcctcaggtacctttgac

SEQ ID NO: 257024 - DNA, 25 bp, Mus musculus
cgatgctgcctcagtttgacagcag

SEQ ID NO: 257025 - DNA, 25 bp, Mus musculus
cgatgctgctacgaaatccatactt

SEQ ID NO: 257026 - DNA, 25 bp, Mus musculus
cgatgctgctacgaggaggaagatg

SEQ ID NO: 257027 - DNA, 25 bp, Mus musculus
cgatgcttcttcagtacaggctatg

SEQ ID NO: 257028 - DNA, 25 bp, Mus musculus
cgatgcttgccagggtgacagtggg

SEQ ID NO: 257029 - DNA, 25 bp, Mus musculus
cgatgcttgccagtgggggaccgct

SEQ ID NO: 257030 - DNA, 25 bp, Mus musculus
cgatgctttccctaacatcgagaag

SEQ ID NO: 257031 - DNA, 25 bp, Mus musculus
cgatggaaaatgaagatgctagaaa

SEQ ID NO: 257032 - DNA, 25 bp, Mus musculus
cgatggaaaatgaaggttgcacgat

SEQ ID NO: 257033 - DNA, 25 bp, Mus musculus
cgatggaagcagggaggctgcaaag

SEQ ID NO: 257034 - DNA, 25 bp, Mus musculus
cgatggaccaaacacgtgaagaaga

SEQ ID NO: 257035 - DNA, 25 bp, Mus musculus
cgatggacccaggtaaacagttgcc

SEQ ID NO: 257036 - DNA, 25 bp, Mus musculus
cgatggacccaggttactccagtga

SEQ ID NO: 257037 - DNA, 25 bp, Mus musculus
cgatggagaggatcgcccccacccc

SEQ ID NO: 257038 - DNA, 25 bp, Mus musculus
cgatggaggtagaaaatcttctgga

SEQ ID NO: 257039 - DNA, 25 bp, Mus musculus
cgatggatcataattgggtttcttc

SEQ ID NO: 257040 - DNA, 25 bp, Mus musculus
cgatggcactgcagctgctcctggc

SEQ ID NO: 257041 - DNA, 25 bp, Mus musculus
cgatggcatcaagttcatgggcggt

SEQ ID NO: 257042 - DNA, 25 bp, Mus musculus
cgatggcatgtggctcctacccagg

SEQ ID NO: 257043 - DNA, 25 bp, Mus musculus
cgatggcctctgcaggtggcgacct

SEQ ID NO: 257044 - DNA, 25 bp, Mus musculus
cgatggcgtgacctcctcttgcttc

SEQ ID NO: 257045 - DNA, 25 bp, Mus musculus
cgatgggatccctgctttgtggaag

SEQ ID NO: 257046 - DNA, 25 bp, Mus musculus
cgatgggcctgaggctcttcgcggc

SEQ ID NO: 257047 - DNA, 25 bp, Mus musculus
cgatgggggccatctcacccatggc

SEQ ID NO: 257048 - DNA, 25 bp, Mus musculus
cgatgggtcatgcagccctcaggaa

SEQ ID NO: 257049 - DNA, 25 bp, Mus musculus
cgatggtagccgctgccgtgactta

SEQ ID NO: 257050 - DNA, 25 bp, Mus musculus
cgatggtagccggaagctgtgctga

SEQ ID NO: 257051 - DNA, 25 bp, Mus musculus
cgatggtgtgaagaaaagaaagtcc

SEQ ID NO: 257052 - DNA, 25 bp, Mus musculus
cgatggtgtgaaggaatcttctgag

SEQ ID NO: 257053 - DNA, 25 bp, Mus musculus
cgatgtaccaggaaacatccgagcc

SEQ ID NO: 257054 - DNA, 25 bp, Mus musculus
cgatgtacgaggaccatcccacaca

SEQ ID NO: 257055 - DNA, 25 bp, Mus musculus
cgatgtacgagggaaggatcatcga

SEQ ID NO: 257056 - DNA, 25 bp, Mus musculus
cgatgtactgaaggtctttgacgat

SEQ ID NO: 257057 - DNA, 25 bp, Mus musculus
cgatgtccccaagaggtacttttct

SEQ ID NO: 257058 - DNA, 25 bp, Mus musculus
cgatgtcgccagcgcccctccagca

SEQ ID NO: 257059 - DNA, 25 bp, Mus musculus
cgatgtcgttgaacggtcaccacac

SEQ ID NO: 257060 - DNA, 25 bp, Mus musculus
cgatgtctgccctggatgacttgaa

SEQ ID NO: 257061 - DNA, 25 bp, Mus musculus
cgatgtgacctctgccatgccatga

SEQ ID NO: 257062 - DNA, 25 bp, Mus musculus
cgatgtgcacatgctggtagctgag

SEQ ID NO: 257063 - DNA, 25 bp, Mus musculus
cgatgtgcgagattgtgaagggaag

SEQ ID NO: 257064 - DNA, 25 bp, Mus musculus
cgatgtgcgagggaaggttgtgaag

SEQ ID NO: 257065 - DNA, 25 bp, Mus musculus
cgatgtgctggatttccacttaaac

SEQ ID NO: 257066 - DNA, 25 bp, Mus musculus
cgatgtggagaggtggagaatctaa

SEQ ID NO: 257067 - DNA, 25 bp, Mus musculus
cgatgtgggaacaggtgtcacagca

SEQ ID NO: 257068 - DNA, 25 bp, Mus musculus
cgatgtgtctgagctgtccagctcg

SEQ ID NO: 257069 - DNA, 25 bp, Mus musculus
cgatgtgtgatcttttggagtgctc

SEQ ID NO: 257070 - DNA, 25 bp, Mus musculus
cgatgtgtgcctgtaatgaatggta

SEQ ID NO: 257071 - DNA, 25 bp, Mus musculus
cgatgtgtggaaattctctgcacac

SEQ ID NO: 257072 - DNA, 25 bp, Mus musculus
cgatgtgttttcagtggataatgaa

SEQ ID NO: 257073 - DNA, 25 bp, Mus musculus
cgatgttaaagctgtctgctcccag

SEQ ID NO: 257074 - DNA, 25 bp, Mus musculus
cgatgttatccaggccctggacctc

SEQ ID NO: 257075 - DNA, 25 bp, Mus musculus
cgatgttatccaggctccctgtcca

SEQ ID NO: 257076 - DNA, 25 bp, Mus musculus
cgatgttcaggagcaggatattgag

SEQ ID NO: 257077 - DNA, 25 bp, Mus musculus
cgatgttcagggcaaccgtcctgtc

SEQ ID NO: 257078 - DNA, 25 bp, Mus musculus
cgatgttccactcgctctttgccat

SEQ ID NO: 257079 - DNA, 25 bp, Mus musculus
cgatgttccactcggatcaagtttg

SEQ ID NO: 257080 - DNA, 25 bp, Mus musculus
cgattaaagcaaaaagtcaaagctt

SEQ ID NO: 257081 - DNA, 25 bp, Mus musculus
cgattaataaaaagacctcacagtg

SEQ ID NO: 257082 - DNA, 25 bp, Mus musculus
cgattacccccaagtgctgcaggag

SEQ ID NO: 257083 - DNA, 25 bp, Mus musculus
cgattacgtgggacgagtccggctg

SEQ ID NO: 257084 - DNA, 25 bp, Mus musculus
cgattacttaaaaagagtgtgtaag

SEQ ID NO: 257085 - DNA, 25 bp, Mus musculus
cgattactttgaataccctggagca

SEQ ID NO: 257086 - DNA, 25 bp, Mus musculus
cgattactttggccgttgtgcccgc

SEQ ID NO: 257087 - DNA, 25 bp, Mus musculus
cgattagcagaagctcacgctcgcc

SEQ ID NO: 257088 - DNA, 25 bp, Mus musculus
cgattatcagaatccctctgcgcaa

SEQ ID NO: 257089 - DNA, 25 bp, Mus musculus
cgattatcagagtccagtagaggaa

SEQ ID NO: 257090 - DNA, 25 bp, Mus musculus
cgattatccagagacagcccaaaac

SEQ ID NO: 257091 - DNA, 25 bp, Mus musculus
cgattatccagagtggagctgtaat

SEQ ID NO: 257092 - DNA, 25 bp, Mus musculus
cgattattcagaagcagaacagagt

SEQ ID NO: 257093 - DNA, 25 bp, Mus musculus
cgattcaaccacaatgacggattcc

SEQ ID NO: 257094 - DNA, 25 bp, Mus musculus
cgattcaaccctcctgggatcagcc

SEQ ID NO: 257095 - DNA, 25 bp, Mus musculus
cgattcaccgtatggctccatggtg

SEQ ID NO: 257096 - DNA, 25 bp, Mus musculus
cgattcagaggatcgacgagaatgt

SEQ ID NO: 257097 - DNA, 25 bp, Mus musculus
cgattcatctaaatggtgccatgac

SEQ ID NO: 257098 - DNA, 25 bp, Mus musculus
cgattcatgaagaaggctggatacc

SEQ ID NO: 257099 - DNA, 25 bp, Mus musculus
cgattccagcgtctcaaagggtaaa

SEQ ID NO: 257100 - DNA, 25 bp, Mus musculus
cgattccagcgtttcatgaaccatc

SEQ ID NO: 257101 - DNA, 25 bp, Mus musculus
cgattcccagcttccaccatcctca

SEQ ID NO: 257102 - DNA, 25 bp, Mus musculus
cgattcctaggggtgttattgggca

SEQ ID NO: 257103 - DNA, 25 bp, Mus musculus
cgattcgcccagagtttgggaaatg

SEQ ID NO: 257104 - DNA, 25 bp, Mus musculus
cgattctcatcgcttttatgaaaca

SEQ ID NO: 257105 - DNA, 25 bp, Mus musculus
cgattctccacagtcgctggagagt

SEQ ID NO: 257106 - DNA, 25 bp, Mus musculus
cgattctccgcggaggaccctagga

SEQ ID NO: 257107 - DNA, 25 bp, Mus musculus
cgattctccgcggaggtattacttg

SEQ ID NO: 257108 - DNA, 25 bp, Mus musculus
cgattgaagagtcttttcacagagc

SEQ ID NO: 257109 - DNA, 25 bp, Mus musculus
cgattgatcacagttttcattgaaa

SEQ ID NO: 257110 - DNA, 25 bp, Mus musculus
cgattgcagcgtgcccttgaaggag

SEQ ID NO: 257111 - DNA, 25 bp, Mus musculus
cgattgccaaccagacgtaccacca

SEQ ID NO: 257112 - DNA, 25 bp, Mus musculus
cgattggaagaaatcaagaagttgg

SEQ ID NO: 257113 - DNA, 25 bp, Mus musculus
cgattggaagaagaatgaagacctg

SEQ ID NO: 257114 - DNA, 25 bp, Mus musculus
cgattggaatgaccgagagtgggac

SEQ ID NO: 257115 - DNA, 25 bp, Mus musculus
cgattggacaagaggtgcaccatgg

SEQ ID NO: 257116 - DNA, 25 bp, Mus musculus
cgattgtgtcgaacaaatagtggag

SEQ ID NO: 257117 - DNA, 25 bp, Mus musculus
cgattgtgtcggacggtgggagtgg

SEQ ID NO: 257118 - DNA, 25 bp, Mus musculus
cgattgtgtctgaggtcaactgaag

SEQ ID NO: 257119 - DNA, 25 bp, Mus musculus
cgatttcagaatgctccccgggaga

SEQ ID NO: 257120 - DNA, 25 bp, Mus musculus
cgatttcgaggggagggagacgatg

SEQ ID NO: 257121 - DNA, 25 bp, Mus musculus
cgatttcgttctgtgatgccagcag

SEQ ID NO: 257122 - DNA, 25 bp, Mus musculus
cgatttctagcgtatatggaggaac

SEQ ID NO: 257123 - DNA, 25 bp, Mus musculus
cgatttgatgctgtgcaaagtgcac

SEQ ID NO: 257124 - DNA, 25 bp, Mus musculus
cgatttgatgctgtggacaaggtct

SEQ ID NO: 257125 - DNA, 25 bp, Mus musculus
cgatttgatgctgtggactgtgttt

SEQ ID NO: 257126 - DNA, 25 bp, Mus musculus
cgatttggaataattgatgtgactg

SEQ ID NO: 257127 - DNA, 25 bp, Mus musculus
cgatttggaatattcgatgttacag

SEQ ID NO: 257128 - DNA, 25 bp, Mus musculus
cgatttgggcacgatgtataccagg

SEQ ID NO: 257129 - DNA, 25 bp, Mus musculus
cgatttgggcacggactgtcagggc

SEQ ID NO: 257130 - DNA, 25 bp, Mus musculus
cgatttgggctgctggcaactatcg

SEQ ID NO: 257131 - DNA, 25 bp, Mus musculus
cgatttgtgaagatatagatgagtg

SEQ ID NO: 257132 - DNA, 25 bp, Mus musculus
cgattttatgtggggagagaaaaga

SEQ ID NO: 257133 - DNA, 25 bp, Mus musculus
cgatttttaatagatggagagcatc

SEQ ID NO: 257134 - DNA, 25 bp, Mus musculus
cgatttttgagaactgatagtgcat

SEQ ID NO: 257135 - DNA, 25 bp, Mus musculus
cgcaaaaagcaggcctgttgctggg

SEQ ID NO: 257136 - DNA, 25 bp, Mus musculus
cgcaaaagagtgtgaagattgctcc

SEQ ID NO: 257137 - DNA, 25 bp, Mus musculus
cgcaaaaggagcaggtgcttttgga

SEQ ID NO: 257138 - DNA, 25 bp, Mus musculus
cgcaaaaggcagagggacagttaaa

SEQ ID NO: 257139 - DNA, 25 bp, Mus musculus
cgcaaaatagaagaggtagtagaag

SEQ ID NO: 257140 - DNA, 25 bp, Mus musculus
cgcaaacaaaaaatgcagagagaaa

SEQ ID NO: 257141 - DNA, 25 bp, Mus musculus
cgcaaacacaggtgaaaatctggtt

SEQ ID NO: 257142 - DNA, 25 bp, Mus musculus
cgcaaacacatgaaggttcatgaat

SEQ ID NO: 257143 - DNA, 25 bp, Mus musculus
cgcaaacacatgaagtgttgtcctg

SEQ ID NO: 257144 - DNA, 25 bp, Mus musculus
cgcaaacagaaaactcagaactttc

SEQ ID NO: 257145 - DNA, 25 bp, Mus musculus
cgcaaaccagctccttaattgatgg

SEQ ID NO: 257146 - DNA, 25 bp, Mus musculus
cgcaaacgtccagcgtttggagcag

SEQ ID NO: 257147 - DNA, 25 bp, Mus musculus
cgcaaacgtccaggagcaggcctcg

SEQ ID NO: 257148 - DNA, 25 bp, Mus musculus
cgcaaagaagaaaaggaagagcatg

SEQ ID NO: 257149 - DNA, 25 bp, Mus musculus
cgcaaagaagaaaaggaatagtctc

SEQ ID NO: 257150 - DNA, 25 bp, Mus musculus
cgcaaagaagttccaccaggtgaga

SEQ ID NO: 257151 - DNA, 25 bp, Mus musculus
cgcaaagacggaaggactggaaatg

SEQ ID NO: 257152 - DNA, 25 bp, Mus musculus
cgcaaagactctcacccaggtgaca

SEQ ID NO: 257153 - DNA, 25 bp, Mus musculus
cgcaaagactggcggaggccaggct

SEQ ID NO: 257154 - DNA, 25 bp, Mus musculus
cgcaaagagaacttggtctctgggc

SEQ ID NO: 257155 - DNA, 25 bp, Mus musculus
cgcaaagagatggagtcatgcactt

SEQ ID NO: 257156 - DNA, 25 bp, Mus musculus
cgcaaagcattagaagtcttcccag

SEQ ID NO: 257157 - DNA, 25 bp, Mus musculus
cgcaaagtggccaggagcttgcaag

SEQ ID NO: 257158 - DNA, 25 bp, Mus musculus
cgcaaatatgaggagcaccagctag

SEQ ID NO: 257159 - DNA, 25 bp, Mus musculus
cgcaaatccttcctgaaacttcatg

SEQ ID NO: 257160 - DNA, 25 bp, Mus musculus
cgcaaattacctgagcacccagttg

SEQ ID NO: 257161 - DNA, 25 bp, Mus musculus
cgcaaattacgtccacagcaaagga

SEQ ID NO: 257162 - DNA, 25 bp, Mus musculus
cgcaacaacgccatctatgagaaaa

SEQ ID NO: 257163 - DNA, 25 bp, Mus musculus
cgcaacactgaccgaggcaatgaca

SEQ ID NO: 257164 - DNA, 25 bp, Mus musculus
cgcaacagaggcctttcagtcagaa

SEQ ID NO: 257165 - DNA, 25 bp, Mus musculus
cgcaacagagggccttaacaatgag

SEQ ID NO: 257166 - DNA, 25 bp, Mus musculus
cgcaacagcagcttcgagagctgtg

SEQ ID NO: 257167 - DNA, 25 bp, Mus musculus
cgcaacagcagggttctggctgctt

SEQ ID NO: 257168 - DNA, 25 bp, Mus musculus
cgcaacagccatggcttctccatga

SEQ ID NO: 257169 - DNA, 25 bp, Mus musculus
cgcaacatgctcaagccaaaccaac

SEQ ID NO: 257170 - DNA, 25 bp, Mus musculus
cgcaacgaggtgcactgccaaccta

SEQ ID NO: 257171 - DNA, 25 bp, Mus musculus
cgcaacggccccagaaattactgtg

SEQ ID NO: 257172 - DNA, 25 bp, Mus musculus
cgcaacggccccagaagctgactgc

SEQ ID NO: 257173 - DNA, 25 bp, Mus musculus
cgcaacgtcatccccgctggcattt

SEQ ID NO: 257174 - DNA, 25 bp, Mus musculus
cgcaactatcagcccttgtttcttc

SEQ ID NO: 257175 - DNA, 25 bp, Mus musculus
cgcaactatcaggctcggaacttcc

SEQ ID NO: 257176 - DNA, 25 bp, Mus musculus
cgcaactcaaggtaggtgtacatga

SEQ ID NO: 257177 - DNA, 25 bp, Mus musculus
cgcaactcaaggtcctttcccataa

SEQ ID NO: 257178 - DNA, 25 bp, Mus musculus
cgcaactcagatggctccagatgct

SEQ ID NO: 257179 - DNA, 25 bp, Mus musculus
cgcaactcaggctgactcccctata

SEQ ID NO: 257180 - DNA, 25 bp, Mus musculus
cgcaactctgcggcacatggtgatg

SEQ ID NO: 257181 - DNA, 25 bp, Mus musculus
cgcaactggcaagcctctatggaag

SEQ ID NO: 257182 - DNA, 25 bp, Mus musculus
cgcaactggcaagtttacaggctgg

SEQ ID NO: 257183 - DNA, 25 bp, Mus musculus
cgcaacttacaggaagttgtgccag

SEQ ID NO: 257184 - DNA, 25 bp, Mus musculus
cgcaagaaaaagtctgatgccaacg

SEQ ID NO: 257185 - DNA, 25 bp, Mus musculus
cgcaagaaaagtatcaaggaggtgg

SEQ ID NO: 257186 - DNA, 25 bp, Mus musculus
cgcaagaaatgggaaccccaacagt

SEQ ID NO: 257187 - DNA, 25 bp, Mus musculus
cgcaagaaatgtatatgcccccaag

SEQ ID NO: 257188 - DNA, 25 bp, Mus musculus
cgcaagaagaagaaggtgccatcag

SEQ ID NO: 257189 - DNA, 25 bp, Mus musculus
cgcaagaagaagcaccccactggct

SEQ ID NO: 257190 - DNA, 25 bp, Mus musculus
cgcaagaaggaggaacaagaatttg

SEQ ID NO: 257191 - DNA, 25 bp, Mus musculus
cgcaagaaggaggttatgaatgaag

SEQ ID NO: 257192 - DNA, 25 bp, Mus musculus
cgcaagatgcgccagcgcactgcca

SEQ ID NO: 257193 - DNA, 25 bp, Mus musculus
cgcaagcactatcccgctcgggcaa

SEQ ID NO: 257194 - DNA, 25 bp, Mus musculus
cgcaagcagcctccgaaagagccca

SEQ ID NO: 257195 - DNA, 25 bp, Mus musculus
cgcaagcagtgggaacagcgcttct

SEQ ID NO: 257196 - DNA, 25 bp, Mus musculus
cgcaagccagaacagcaccgggttg

SEQ ID NO: 257197 - DNA, 25 bp, Mus musculus
cgcaagcccaagtatgatcagggag

SEQ ID NO: 257198 - DNA, 25 bp, Mus musculus
cgcaagctctccccgatggctcatt

SEQ ID NO: 257199 - DNA, 25 bp, Mus musculus
cgcaagctctccccggattgacttg

SEQ ID NO: 257200 - DNA, 25 bp, Mus musculus
cgcaagctctccccgtctaaaagtt

SEQ ID NO: 257201 - DNA, 25 bp, Mus musculus
cgcaaggaaaggctcctagaaggtg

SEQ ID NO: 257202 - DNA, 25 bp, Mus musculus
cgcaaggaagcagagatgcccggaa

SEQ ID NO: 257203 - DNA, 25 bp, Mus musculus
cgcaaggacgaactcatcaagtaga

SEQ ID NO: 257204 - DNA, 25 bp, Mus musculus
cgcaaggagatgctgtggggcctgt

SEQ ID NO: 257205 - DNA, 25 bp, Mus musculus
cgcaaggagatggtggggctgcgac

SEQ ID NO: 257206 - DNA, 25 bp, Mus musculus
cgcaaggagatgttgtctgtaggtg

SEQ ID NO: 257207 - DNA, 25 bp, Mus musculus
cgcaaggagctagactctgaggacc

SEQ ID NO: 257208 - DNA, 25 bp, Mus musculus
cgcaaggagctagactctgagtaca

SEQ ID NO: 257209 - DNA, 25 bp, Mus musculus
cgcaaggccaagagcacggacgagc

SEQ ID NO: 257210 - DNA, 25 bp, Mus musculus
cgcaaggccaagctattacaagcca

SEQ ID NO: 257211 - DNA, 25 bp, Mus musculus
cgcaaggccccagccaagccgcaat

SEQ ID NO: 257212 - DNA, 25 bp, Mus musculus
cgcaagggcaaggtgctggctcagc

SEQ ID NO: 257213 - DNA, 25 bp, Mus musculus
cgcaaggttgcagcacgcagcagaa

SEQ ID NO: 257214 - DNA, 25 bp, Mus musculus
cgcaagtacactcaggctgaagctc

SEQ ID NO: 257215 - DNA, 25 bp, Mus musculus
cgcaagtacactcaggctgagggta

SEQ ID NO: 257216 - DNA, 25 bp, Mus musculus
cgcaagtcgaaaagatatcccctgt

SEQ ID NO: 257217 - DNA, 25 bp, Mus musculus
cgcaagttcacagatgtgaccttga

SEQ ID NO: 257218 - DNA, 25 bp, Mus musculus
cgcaataacgttacaaattataata

SEQ ID NO: 257219 - DNA, 25 bp, Mus musculus
cgcaatctgagctgccgaacaaaaa

SEQ ID NO: 257220 - DNA, 25 bp, Mus musculus
cgcaatgcccctgttggaattcgac

SEQ ID NO: 257221 - DNA, 25 bp, Mus musculus
cgcaattcagtcaggatggctaaag

SEQ ID NO: 257222 - DNA, 25 bp, Mus musculus
cgcaattcccaccaaatatacgagc

SEQ ID NO: 257223 - DNA, 25 bp, Mus musculus
cgcaattccttggggtaatgatgtg

SEQ ID NO: 257224 - DNA, 25 bp, Mus musculus
cgcacaagaaatatggggtgtgcct

SEQ ID NO: 257225 - DNA, 25 bp, Mus musculus
cgcacaagaagatctctcgtctgct

SEQ ID NO: 257226 - DNA, 25 bp, Mus musculus
cgcacaagacaagatctggagcacc

SEQ ID NO: 257227 - DNA, 25 bp, Mus musculus
cgcacaaggccccgaaatgggaccc

SEQ ID NO: 257228 - DNA, 25 bp, Mus musculus
cgcacaagtacacgacagacggcaa

SEQ ID NO: 257229 - DNA, 25 bp, Mus musculus
cgcacaagtacacggaaatgtgtca

SEQ ID NO: 257230 - DNA, 25 bp, Mus musculus
cgcacaatctcagaatggcttcaca

SEQ ID NO: 257231 - DNA, 25 bp, Mus musculus
cgcacaccgagatatgaggatcaat

SEQ ID NO: 257232 - DNA, 25 bp, Mus musculus
cgcacacggaagtgaatccagcagc

SEQ ID NO: 257233 - DNA, 25 bp, Mus musculus
cgcacacggaagtgatcagctctga

SEQ ID NO: 257234 - DNA, 25 bp, Mus musculus
cgcacagacccgaagtgtggagtcc

SEQ ID NO: 257235 - DNA, 25 bp, Mus musculus
cgcacagacccgttcacgaaccaga

SEQ ID NO: 257236 - DNA, 25 bp, Mus musculus
cgcacagacccgttccaggaggcag

SEQ ID NO: 257237 - DNA, 25 bp, Mus musculus
cgcacagacgattcctcagatgttg

SEQ ID NO: 257238 - DNA, 25 bp, Mus musculus
cgcacagcaaacagagccctttgcc

SEQ ID NO: 257239 - DNA, 25 bp, Mus musculus
cgcacagcaactaggcatgaagcac

SEQ ID NO: 257240 - DNA, 25 bp, Mus musculus
cgcacagcaggttctccacatgaca

SEQ ID NO: 257241 - DNA, 25 bp, Mus musculus
cgcacagcatgatcaacaggccccc

SEQ ID NO: 257242 - DNA, 25 bp, Mus musculus
cgcacagccgggttccatgatggag

SEQ ID NO: 257243 - DNA, 25 bp, Mus musculus
cgcacagccggtgctggagactgaa

SEQ ID NO: 257244 - DNA, 25 bp, Mus musculus
cgcacagcctgctcttcctcctggc

SEQ ID NO: 257245 - DNA, 25 bp, Mus musculus
cgcacagcgacccagcgtctgatgg

SEQ ID NO: 257246 - DNA, 25 bp, Mus musculus
cgcacagctgcggatcaccagacca

SEQ ID NO: 257247 - DNA, 25 bp, Mus musculus
cgcacaggaagggactgagactatg

SEQ ID NO: 257248 - DNA, 25 bp, Mus musculus
cgcacaggctaggtatgacggagag

SEQ ID NO: 257249 - DNA, 25 bp, Mus musculus
cgcacagtcaaggagctgggcaaca

SEQ ID NO: 257250 - DNA, 25 bp, Mus musculus
cgcacagtgcccctgcttgttctcc

SEQ ID NO: 257251 - DNA, 25 bp, Mus musculus
cgcacatcgctcgaggaatcaaaag

SEQ ID NO: 257252 - DNA, 25 bp, Mus musculus
cgcacatggagagggctcctcgctg

SEQ ID NO: 257253 - DNA, 25 bp, Mus musculus
cgcacattacaaggacatgggcaag

SEQ ID NO: 257254 - DNA, 25 bp, Mus musculus
cgcaccaaaggtgtgactttgaggt

SEQ ID NO: 257255 - DNA, 25 bp, Mus musculus
cgcaccaaccaccaggggacctatg

SEQ ID NO: 257256 - DNA, 25 bp, Mus musculus
cgcaccaaccaccagttcctggcct

SEQ ID NO: 257257 - DNA, 25 bp, Mus musculus
cgcaccaaggagcaggtcatgcttc

SEQ ID NO: 257258 - DNA, 25 bp, Mus musculus
cgcaccacaggcaaatcctcctcca

SEQ ID NO: 257259 - DNA, 25 bp, Mus musculus
cgcaccacgagcagataagaggagt

SEQ ID NO: 257260 - DNA, 25 bp, Mus musculus
cgcaccacgagcagttgttccaagt

SEQ ID NO: 257261 - DNA, 25 bp, Mus musculus
cgcaccagaggaacttctgcaggtg

SEQ ID NO: 257262 - DNA, 25 bp, Mus musculus
cgcaccagctatagacccatgcttg

SEQ ID NO: 257263 - DNA, 25 bp, Mus musculus
cgcaccagtcacagtttgtggggac

SEQ ID NO: 257264 - DNA, 25 bp, Mus musculus
cgcaccatacaggatactgggaacc

SEQ ID NO: 257265 - DNA, 25 bp, Mus musculus
cgcaccattaatctgtacccgctta

SEQ ID NO: 257266 - DNA, 25 bp, Mus musculus
cgcacccaaatagcgctggcgtgga

SEQ ID NO: 257267 - DNA, 25 bp, Mus musculus
cgcacccacactcgactgcagaagg

SEQ ID NO: 257268 - DNA, 25 bp, Mus musculus
cgcacccacactcgtgagaagccat

SEQ ID NO: 257269 - DNA, 25 bp, Mus musculus
cgcacccacactggactgcagaagg

SEQ ID NO: 257270 - DNA, 25 bp, Mus musculus
cgcacccacactggtgagaagccat

SEQ ID NO: 257271 - DNA, 25 bp, Mus musculus
cgcacccagctcagtggatctggcg

SEQ ID NO: 257272 - DNA, 25 bp, Mus musculus
cgcacccgccgctcgccggccctgc

SEQ ID NO: 257273 - DNA, 25 bp, Mus musculus
cgcacccgccgctcggttacctgcc

SEQ ID NO: 257274 - DNA, 25 bp, Mus musculus
cgcacccttcagtacaagcccacca

SEQ ID NO: 257275 - DNA, 25 bp, Mus musculus
cgcaccgatggagggtccgaagtac

SEQ ID NO: 257276 - DNA, 25 bp, Mus musculus
cgcaccgcagacagacctcaagtac

SEQ ID NO: 257277 - DNA, 25 bp, Mus musculus
cgcaccgctacagggcattaggaga

SEQ ID NO: 257278 - DNA, 25 bp, Mus musculus
cgcaccggtaaaggtagctggagtt

SEQ ID NO: 257279 - DNA, 25 bp, Mus musculus
cgcaccgtgtcgcgtcaagatgggg

SEQ ID NO: 257280 - DNA, 25 bp, Mus musculus
cgcaccgtgtcgcgtgagatctcca

SEQ ID NO: 257281 - DNA, 25 bp, Mus musculus
cgcacctacctggcaggccatggct

SEQ ID NO: 257282 - DNA, 25 bp, Mus musculus
cgcacctacgggctgactcctcact

SEQ ID NO: 257283 - DNA, 25 bp, Mus musculus
cgcacctatatcgagcttcttcctc

SEQ ID NO: 257284 - DNA, 25 bp, Mus musculus
cgcacctccaggacgtgtctcccac

SEQ ID NO: 257285 - DNA, 25 bp, Mus musculus
cgcacctccaggacgtttctaagct

SEQ ID NO: 257286 - DNA, 25 bp, Mus musculus
cgcacctgccaggccacagacctcc

SEQ ID NO: 257287 - DNA, 25 bp, Mus musculus
cgcacctgccaggtaagaagaaaat

SEQ ID NO: 257288 - DNA, 25 bp, Mus musculus
cgcacctgccggctgcgaccgaggg

SEQ ID NO: 257289 - DNA, 25 bp, Mus musculus
cgcacctggggcagggaagaggtgc

SEQ ID NO: 257290 - DNA, 25 bp, Mus musculus
cgcacctgtgagcaggagccagagg

SEQ ID NO: 257291 - DNA, 25 bp, Mus musculus
cgcaccttcctccggcatgagatcg

SEQ ID NO: 257292 - DNA, 25 bp, Mus musculus
cgcaccttcctcctgcaacagaatg

SEQ ID NO: 257293 - DNA, 25 bp, Mus musculus
cgcaccttggagaagattgctggcc

SEQ ID NO: 257294 - DNA, 25 bp, Mus musculus
cgcaccttggagagaatatgtttga

SEQ ID NO: 257295 - DNA, 25 bp, Mus musculus
cgcaccttggtggaacactctggac

SEQ ID NO: 257296 - DNA, 25 bp, Mus musculus
cgcacctttggaaggttattatgtt

SEQ ID NO: 257297 - DNA, 25 bp, Mus musculus
cgcacgaagaagactggaaacagca

SEQ ID NO: 257298 - DNA, 25 bp, Mus musculus
cgcacgaagaagcctcagcaaaaga

SEQ ID NO: 257299 - DNA, 25 bp, Mus musculus
cgcacgaccggtggcttgttggcag

SEQ ID NO: 257300 - DNA, 25 bp, Mus musculus
cgcacgaccgtccggtgcgtataac

SEQ ID NO: 257301 - DNA, 25 bp, Mus musculus
cgcacgaccgtccggtgttctggct

SEQ ID NO: 257302 - DNA, 25 bp, Mus musculus
cgcacgactgctgatgaagtgactg

SEQ ID NO: 257303 - DNA, 25 bp, Mus musculus
cgcacgagggcgcggtgtggacaaa

SEQ ID NO: 257304 - DNA, 25 bp, Mus musculus
cgcacgagtccggggaagtgtgttt

SEQ ID NO: 257305 - DNA, 25 bp, Mus musculus
cgcacgccatgtatgtttccaccgg

SEQ ID NO: 257306 - DNA, 25 bp, Mus musculus
cgcacgccgtggtgcgcagttcctg

SEQ ID NO: 257307 - DNA, 25 bp, Mus musculus
cgcacgcgtgagcatgcgctacgtc

SEQ ID NO: 257308 - DNA, 25 bp, Mus musculus
cgcacggagagaagaaaccaaaacc

SEQ ID NO: 257309 - DNA, 25 bp, Mus musculus
cgcacggcatctataatgtcaccca

SEQ ID NO: 257310 - DNA, 25 bp, Mus musculus
cgcacggcatctatgcggagctgac

SEQ ID NO: 257311 - DNA, 25 bp, Mus musculus
cgcacggcatctatgtacgtgccct

SEQ ID NO: 257312 - DNA, 25 bp, Mus musculus
cgcacggcggacaaatgaagagaaa

SEQ ID NO: 257313 - DNA, 25 bp, Mus musculus
cgcacggcgggaatctcttccttct

SEQ ID NO: 257314 - DNA, 25 bp, Mus musculus
cgcacggctccagaaagatgacagg

SEQ ID NO: 257315 - DNA, 25 bp, Mus musculus
cgcacgggtgagtttcacggagaaa

SEQ ID NO: 257316 - DNA, 25 bp, Mus musculus
cgcacggttcagcaactgcgctcca

SEQ ID NO: 257317 - DNA, 25 bp, Mus musculus
cgcacgtagtggacaagctactgca

SEQ ID NO: 257318 - DNA, 25 bp, Mus musculus
cgcacgtagtggtcacaggaggctc

SEQ ID NO: 257319 - DNA, 25 bp, Mus musculus
cgcacgtctcagaaggtggacactg

SEQ ID NO: 257320 - DNA, 25 bp, Mus musculus
cgcacgtgcatagatacctgctgct

SEQ ID NO: 257321 - DNA, 25 bp, Mus musculus
cgcactagatatcaaaatcgggtca

SEQ ID NO: 257322 - DNA, 25 bp, Mus musculus
cgcactagatatcaatctgtggttc

SEQ ID NO: 257323 - DNA, 25 bp, Mus musculus
cgcactagggaaggtcccggatgtt

SEQ ID NO: 257324 - DNA, 25 bp, Mus musculus
cgcactatgccaaaaataaagcagt

SEQ ID NO: 257325 - DNA, 25 bp, Mus musculus
cgcactcaccactttgccctgttct

SEQ ID NO: 257326 - DNA, 25 bp, Mus musculus
cgcactcactgtcctgagagggttg

SEQ ID NO: 257327 - DNA, 25 bp, Mus musculus
cgcactcatcatggtggacaatgcc

SEQ ID NO: 257328 - DNA, 25 bp, Mus musculus
cgcactcctattcagaccctcagtg

SEQ ID NO: 257329 - DNA, 25 bp, Mus musculus
cgcactctgagatcttggcatatac

SEQ ID NO: 257330 - DNA, 25 bp, Mus musculus
cgcactctgtgggtcatttctctgc

SEQ ID NO: 257331 - DNA, 25 bp, Mus musculus
cgcactgcaagaaaacgaggaggac

SEQ ID NO: 257332 - DNA, 25 bp, Mus musculus
cgcactgcaagatctagatggcgcc

SEQ ID NO: 257333 - DNA, 25 bp, Mus musculus
cgcactgcagacaattgcctatagc

SEQ ID NO: 257334 - DNA, 25 bp, Mus musculus
cgcactgccaaggagtgtggggccg

SEQ ID NO: 257335 - DNA, 25 bp, Mus musculus
cgcactgccaaggtttcctgccttt

SEQ ID NO: 257336 - DNA, 25 bp, Mus musculus
cgcactggagcgtgctcttcaggat

SEQ ID NO: 257337 - DNA, 25 bp, Mus musculus
cgcactgtcagatgtagaaatccct

SEQ ID NO: 257338 - DNA, 25 bp, Mus musculus
cgcactgtcaggtaaatccatttct

SEQ ID NO: 257339 - DNA, 25 bp, Mus musculus
cgcactgtgcgagaaaaagcggatg

SEQ ID NO: 257340 - DNA, 25 bp, Mus musculus
cgcactgtgcgaggcatgctgcccc

SEQ ID NO: 257341 - DNA, 25 bp, Mus musculus
cgcactgttaacaggcagcaaacag

SEQ ID NO: 257342 - DNA, 25 bp, Mus musculus
cgcacttcagaggctgggcaaagtc

SEQ ID NO: 257343 - DNA, 25 bp, Mus musculus
cgcacttcggcaagttggagtgctt

SEQ ID NO: 257344 - DNA, 25 bp, Mus musculus
cgcacttttcgcggattctttggga

SEQ ID NO: 257345 - DNA, 25 bp, Mus musculus
cgcagaaagtgggtttcccgtcttt

SEQ ID NO: 257346 - DNA, 25 bp, Mus musculus
cgcagaacgcatcccacagctggtg

SEQ ID NO: 257347 - DNA, 25 bp, Mus musculus
cgcagaactgggattgtctttctga

SEQ ID NO: 257348 - DNA, 25 bp, Mus musculus
cgcagaactgggggatgcagagagc

SEQ ID NO: 257349 - DNA, 25 bp, Mus musculus
cgcagaactggttcttccccagagg

SEQ ID NO: 257350 - DNA, 25 bp, Mus musculus
cgcagaagagactgagaggaatcag

SEQ ID NO: 257351 - DNA, 25 bp, Mus musculus
cgcagaagagcctaccgaggacgaa

SEQ ID NO: 257352 - DNA, 25 bp, Mus musculus
cgcagaagagtttgactttggcgac

SEQ ID NO: 257353 - DNA, 25 bp, Mus musculus
cgcagaatatggagggccccatggt

SEQ ID NO: 257354 - DNA, 25 bp, Mus musculus
cgcagacaagatgccttggatgagt

SEQ ID NO: 257355 - DNA, 25 bp, Mus musculus
cgcagacaagggttctccagaccag

SEQ ID NO: 257356 - DNA, 25 bp, Mus musculus
cgcagacagacctcaagtactacag

SEQ ID NO: 257357 - DNA, 25 bp, Mus musculus
cgcagacaggtaacagtgtcagctg

SEQ ID NO: 257358 - DNA, 25 bp, Mus musculus
cgcagacatggcggagtcttctgag

SEQ ID NO: 257359 - DNA, 25 bp, Mus musculus
cgcagaccaggatggctgcccaagt

SEQ ID NO: 257360 - DNA, 25 bp, Mus musculus
cgcagaccatcatgcacatccagga

SEQ ID NO: 257361 - DNA, 25 bp, Mus musculus
cgcagaccattgcccagactcggca

SEQ ID NO: 257362 - DNA, 25 bp, Mus musculus
cgcagacccacaggaaacaccagct

SEQ ID NO: 257363 - DNA, 25 bp, Mus musculus
cgcagaccccgcagctcttggcaag

SEQ ID NO: 257364 - DNA, 25 bp, Mus musculus
cgcagaccccgcaggagacatatga

SEQ ID NO: 257365 - DNA, 25 bp, Mus musculus
cgcagacgagagtctcggccaccat

SEQ ID NO: 257366 - DNA, 25 bp, Mus musculus
cgcagacgcaccagctcccttcccc

SEQ ID NO: 257367 - DNA, 25 bp, Mus musculus
cgcagacgcaccagggggactccct

SEQ ID NO: 257368 - DNA, 25 bp, Mus musculus
cgcagacgcaccaggtcacacacac

SEQ ID NO: 257369 - DNA, 25 bp, Mus musculus
cgcagacgcttccattgtctaaagc

SEQ ID NO: 257370 - DNA, 25 bp, Mus musculus
cgcagactagcatttcagatctgct

SEQ ID NO: 257371 - DNA, 25 bp, Mus musculus
cgcagactcagcccgtcacaatcat

SEQ ID NO: 257372 - DNA, 25 bp, Mus musculus
cgcagagaagaaaaggagttggaac

SEQ ID NO: 257373 - DNA, 25 bp, Mus musculus
cgcagagaagagcaccctccaagcc

SEQ ID NO: 257374 - DNA, 25 bp, Mus musculus
cgcagagaagggcccagtgtgcatc

SEQ ID NO: 257375 - DNA, 25 bp, Mus musculus
cgcagagaaggtcctaaaggggtgg

SEQ ID NO: 257376 - DNA, 25 bp, Mus musculus
cgcagagacagaggaggccatgtca

SEQ ID NO: 257377 - DNA, 25 bp, Mus musculus
cgcagagacgagaacagagctgaca

SEQ ID NO: 257378 - DNA, 25 bp, Mus musculus
cgcagagacgagctgacatccgata

SEQ ID NO: 257379 - DNA, 25 bp, Mus musculus
cgcagagagaggttaccctgcatct

SEQ ID NO: 257380 - DNA, 25 bp, Mus musculus
cgcagagaggtccaggatgccttat

SEQ ID NO: 257381 - DNA, 25 bp, Mus musculus
cgcagagatggttggcctgctatgt

SEQ ID NO: 257382 - DNA, 25 bp, Mus musculus
cgcagagcagattttctgcatttat

SEQ ID NO: 257383 - DNA, 25 bp, Mus musculus
cgcagagcgacaggctccgtgaaga

SEQ ID NO: 257384 - DNA, 25 bp, Mus musculus
cgcagagcgcgggtgatgtgaacag

SEQ ID NO: 257385 - DNA, 25 bp, Mus musculus
cgcagagcgggcgatactgcagcct

SEQ ID NO: 257386 - DNA, 25 bp, Mus musculus
cgcagagctagaggtcacctggagg

SEQ ID NO: 257387 - DNA, 25 bp, Mus musculus
cgcagagctcagaggagaattctgt

SEQ ID NO: 257388 - DNA, 25 bp, Mus musculus
cgcagagctcagagggtgctctgtg

SEQ ID NO: 257389 - DNA, 25 bp, Mus musculus
cgcagagctgctcagggtgccgccg

SEQ ID NO: 257390 - DNA, 25 bp, Mus musculus
cgcagagctggctcccgcgtatgcc

SEQ ID NO: 257391 - DNA, 25 bp, Mus musculus
cgcagagctgtcagtgacccaccct

SEQ ID NO: 257392 - DNA, 25 bp, Mus musculus
cgcagaggctggggacagtacttat

SEQ ID NO: 257393 - DNA, 25 bp, Mus musculus
cgcagaggtgtcccaggaagtcacc

SEQ ID NO: 257394 - DNA, 25 bp, Mus musculus
cgcagagtctgtactcccacaatct

SEQ ID NO: 257395 - DNA, 25 bp, Mus musculus
cgcagagtgacatggaagctatgga

SEQ ID NO: 257396 - DNA, 25 bp, Mus musculus
cgcagagtgacatggccgcagccac

SEQ ID NO: 257397 - DNA, 25 bp, Mus musculus
cgcagagtgacatgtgcgaccaaga

SEQ ID NO: 257398 - DNA, 25 bp, Mus musculus
cgcagatgacagggcggaacttgcc

SEQ ID NO: 257399 - DNA, 25 bp, Mus musculus
cgcagatgagaggatgcctcctgga

SEQ ID NO: 257400 - DNA, 25 bp, Mus musculus
cgcagatgaggattgagctccgggc

SEQ ID NO: 257401 - DNA, 25 bp, Mus musculus
cgcagatgatggctctgtggccttg

SEQ ID NO: 257402 - DNA, 25 bp, Mus musculus
cgcagattgcccaatgagctgctaa

SEQ ID NO: 257403 - DNA, 25 bp, Mus musculus
cgcagatttggatgactttttttcc

SEQ ID NO: 257404 - DNA, 25 bp, Mus musculus
cgcagatttgggattttgaacttct

SEQ ID NO: 257405 - DNA, 25 bp, Mus musculus
cgcagcaaacgatcatcccagcagc

SEQ ID NO: 257406 - DNA, 25 bp, Mus musculus
cgcagcaagcaggaggcagacaaaa

SEQ ID NO: 257407 - DNA, 25 bp, Mus musculus
cgcagcacaagcgagggaagctaac

SEQ ID NO: 257408 - DNA, 25 bp, Mus musculus
cgcagcaccggcgtgttgcccacca

SEQ ID NO: 257409 - DNA, 25 bp, Mus musculus
cgcagcacgccatcaatgatgatgt

SEQ ID NO: 257410 - DNA, 25 bp, Mus musculus
cgcagcacgccgggcaggcctcagc

SEQ ID NO: 257411 - DNA, 25 bp, Mus musculus
cgcagcacgccgtatgtgcaggagt

SEQ ID NO: 257412 - DNA, 25 bp, Mus musculus
cgcagcactacacgtacctgaagga

SEQ ID NO: 257413 - DNA, 25 bp, Mus musculus
cgcagcactggcaggtgcaggacgt

SEQ ID NO: 257414 - DNA, 25 bp, Mus musculus
cgcagcactggcaggtgtcagcgga

SEQ ID NO: 257415 - DNA, 25 bp, Mus musculus
cgcagcacttcaagatgtatcgcct

SEQ ID NO: 257416 - DNA, 25 bp, Mus musculus
cgcagcagccagggccggccctcga

SEQ ID NO: 257417 - DNA, 25 bp, Mus musculus
cgcagcagccagggtcggccctcga

SEQ ID NO: 257418 - DNA, 25 bp, Mus musculus
cgcagcagccctggtgtctgagagc

SEQ ID NO: 257419 - DNA, 25 bp, Mus musculus
cgcagcagccctgtttgatctgtgg

SEQ ID NO: 257420 - DNA, 25 bp, Mus musculus
cgcagcaggaagaatttcagcatat

SEQ ID NO: 257421 - DNA, 25 bp, Mus musculus
cgcagcaggaaggtgctgtataatg

SEQ ID NO: 257422 - DNA, 25 bp, Mus musculus
cgcagcagggaagttggggggactc

SEQ ID NO: 257423 - DNA, 25 bp, Mus musculus
cgcagcataatgctaaagaagtaaa

SEQ ID NO: 257424 - DNA, 25 bp, Mus musculus
cgcagcatggagacaaaaaagcgtc

SEQ ID NO: 257425 - DNA, 25 bp, Mus musculus
cgcagcatgggaaattaagcgagag

SEQ ID NO: 257426 - DNA, 25 bp, Mus musculus
cgcagccaaggcatgagacactgcc

SEQ ID NO: 257427 - DNA, 25 bp, Mus musculus
cgcagccaaggcatggtcttttccc

SEQ ID NO: 257428 - DNA, 25 bp, Mus musculus
cgcagccaccccgaggtcaggacga

SEQ ID NO: 257429 - DNA, 25 bp, Mus musculus
cgcagccaccgcacctgcgggaggc

SEQ ID NO: 257430 - DNA, 25 bp, Mus musculus
cgcagccaccgcgctcatgcgtgct

SEQ ID NO: 257431 - DNA, 25 bp, Mus musculus
cgcagccagagagggaaactgaggc

SEQ ID NO: 257432 - DNA, 25 bp, Mus musculus
cgcagccagagcttgtccaggtgac

SEQ ID NO: 257433 - DNA, 25 bp, Mus musculus
cgcagccagaggagtatctgattac

SEQ ID NO: 257434 - DNA, 25 bp, Mus musculus
cgcagccagaggggctcggtctctg

SEQ ID NO: 257435 - DNA, 25 bp, Mus musculus
cgcagccatgagcgagacggtcatc

SEQ ID NO: 257436 - DNA, 25 bp, Mus musculus
cgcagcccaagaagaaccaagagcc

SEQ ID NO: 257437 - DNA, 25 bp, Mus musculus
cgcagcccaagaagacgcaaatcca

SEQ ID NO: 257438 - DNA, 25 bp, Mus musculus
cgcagcccaagagactgaattccct

SEQ ID NO: 257439 - DNA, 25 bp, Mus musculus
cgcagcccaaggagatacagaatta

SEQ ID NO: 257440 - DNA, 25 bp, Mus musculus
cgcagcccacacaggtgatccagca

SEQ ID NO: 257441 - DNA, 25 bp, Mus musculus
cgcagcccccgcagggagctccgct

SEQ ID NO: 257442 - DNA, 25 bp, Mus musculus
cgcagccccgaggataatagaatct

SEQ ID NO: 257443 - DNA, 25 bp, Mus musculus
cgcagccccgcgaatgctgctgcta

SEQ ID NO: 257444 - DNA, 25 bp, Mus musculus
cgcagccccgcgagttgcacgattt

SEQ ID NO: 257445 - DNA, 25 bp, Mus musculus
cgcagccccgcgatgtggccgtggc

SEQ ID NO: 257446 - DNA, 25 bp, Mus musculus
cgcagcccgagctacttccccacga

SEQ ID NO: 257447 - DNA, 25 bp, Mus musculus
cgcagcccgcgggggagccgccgcc

SEQ ID NO: 257448 - DNA, 25 bp, Mus musculus
cgcagcccgggaaagaacgcacagt

SEQ ID NO: 257449 - DNA, 25 bp, Mus musculus
cgcagccgaggctcgcgctgtatgt

SEQ ID NO: 257450 - DNA, 25 bp, Mus musculus
cgcagccgcaaacagggcctggatc

SEQ ID NO: 257451 - DNA, 25 bp, Mus musculus
cgcagccgcaaagaatggctataca

SEQ ID NO: 257452 - DNA, 25 bp, Mus musculus
cgcagccgccagaagcggctttagc

SEQ ID NO: 257453 - DNA, 25 bp, Mus musculus
cgcagccgccaggccagaagcggac

SEQ ID NO: 257454 - DNA, 25 bp, Mus musculus
cgcagccgctctgaggtcgaatggt

SEQ ID NO: 257455 - DNA, 25 bp, Mus musculus
cgcagcctccaggaggcaaggatcg

SEQ ID NO: 257456 - DNA, 25 bp, Mus musculus
cgcagcctcttcaagccctctccag

SEQ ID NO: 257457 - DNA, 25 bp, Mus musculus
cgcagccttcaggctcagttctgac

SEQ ID NO: 257458 - DNA, 25 bp, Mus musculus
cgcagccttcgccatgtccttatgt

SEQ ID NO: 257459 - DNA, 25 bp, Mus musculus
cgcagcgacaatggaggtgaattgt

SEQ ID NO: 257460 - DNA, 25 bp, Mus musculus
cgcagcgacacttgtccttcacaca

SEQ ID NO: 257461 - DNA, 25 bp, Mus musculus
cgcagcgacattgtgtgttccagat

SEQ ID NO: 257462 - DNA, 25 bp, Mus musculus
cgcagcgagcggagagtcatggatg

SEQ ID NO: 257463 - DNA, 25 bp, Mus musculus
cgcagcgagcggggtgctgagttct

SEQ ID NO: 257464 - DNA, 25 bp, Mus musculus
cgcagcgaggccgagatctgtcgct

SEQ ID NO: 257465 - DNA, 25 bp, Mus musculus
cgcagcgccgcacaggtcccacaca

SEQ ID NO: 257466 - DNA, 25 bp, Mus musculus
cgcagcgcgggccggtgtacattgg

SEQ ID NO: 257467 - DNA, 25 bp, Mus musculus
cgcagcgctagcctaaattgtatag

SEQ ID NO: 257468 - DNA, 25 bp, Mus musculus
cgcagcgctcgaaagaatagacttt

SEQ ID NO: 257469 - DNA, 25 bp, Mus musculus
cgcagcggaagaaatggcaaaatgt

SEQ ID NO: 257470 - DNA, 25 bp, Mus musculus
cgcagcggcgctggtacaaagtaag

SEQ ID NO: 257471 - DNA, 25 bp, Mus musculus
cgcagcgggcgacaggaagaactag

SEQ ID NO: 257472 - DNA, 25 bp, Mus musculus
cgcagcgggcgacaggtggtttcac

SEQ ID NO: 257473 - DNA, 25 bp, Mus musculus
cgcagcgtgagccagtgggtgtttg

SEQ ID NO: 257474 - DNA, 25 bp, Mus musculus
cgcagcgtgaggtcctggtattttg

SEQ ID NO: 257475 - DNA, 25 bp, Mus musculus
cgcagctagcaggtgccttccaacc

SEQ ID NO: 257476 - DNA, 25 bp, Mus musculus
cgcagctcccggaaagtgaattata

SEQ ID NO: 257477 - DNA, 25 bp, Mus musculus
cgcagctcctcaccgcagcaccccc

SEQ ID NO: 257478 - DNA, 25 bp, Mus musculus
cgcagctcctcaccggaacaaggag

SEQ ID NO: 257479 - DNA, 25 bp, Mus musculus
cgcagctcgaacgatcgccggggct

SEQ ID NO: 257480 - DNA, 25 bp, Mus musculus
cgcagctctacccactccgagcaag

SEQ ID NO: 257481 - DNA, 25 bp, Mus musculus
cgcagctctgcagccccatgtgcat

SEQ ID NO: 257482 - DNA, 25 bp, Mus musculus
cgcagctgaaggtgatcaactggga

SEQ ID NO: 257483 - DNA, 25 bp, Mus musculus
cgcagctgagatcgattatattttg

SEQ ID NO: 257484 - DNA, 25 bp, Mus musculus
cgcagctgcagcctgacagagctga

SEQ ID NO: 257485 - DNA, 25 bp, Mus musculus
cgcagctgcagctcctcctaggtgc

SEQ ID NO: 257486 - DNA, 25 bp, Mus musculus
cgcagctgcaggcaaaatgaaggat

SEQ ID NO: 257487 - DNA, 25 bp, Mus musculus
cgcagctgcagggaggggaactaca

SEQ ID NO: 257488 - DNA, 25 bp, Mus musculus
cgcagctgcgaccttgccctcctgc

SEQ ID NO: 257489 - DNA, 25 bp, Mus musculus
cgcagctgggagagacttcataagg

SEQ ID NO: 257490 - DNA, 25 bp, Mus musculus
cgcagctgttcttgcgacatttgtg

SEQ ID NO: 257491 - DNA, 25 bp, Mus musculus
cgcagcttgggatcctggtatctca

SEQ ID NO: 257492 - DNA, 25 bp, Mus musculus
cgcaggaactcaaggaatgactatt

SEQ ID NO: 257493 - DNA, 25 bp, Mus musculus
cgcaggaactcaagggagctaagaa

SEQ ID NO: 257494 - DNA, 25 bp, Mus musculus
cgcaggaactcaagttgaccgcctt

SEQ ID NO: 257495 - DNA, 25 bp, Mus musculus
cgcaggaagccagcgagtcatcctc

SEQ ID NO: 257496 - DNA, 25 bp, Mus musculus
cgcaggaatcagccatgcatcatca

SEQ ID NO: 257497 - DNA, 25 bp, Mus musculus
cgcaggacacgaaaactgtccttgg

SEQ ID NO: 257498 - DNA, 25 bp, Mus musculus
cgcaggacagagagtcgatatgcgt

SEQ ID NO: 257499 - DNA, 25 bp, Mus musculus
cgcaggacagcaccacgccccactc

SEQ ID NO: 257500 - DNA, 25 bp, Mus musculus
cgcaggacatagaaattgcttttct

SEQ ID NO: 257501 - DNA, 25 bp, Mus musculus
cgcaggacataggttgaatgctatg

SEQ ID NO: 257502 - DNA, 25 bp, Mus musculus
cgcaggacccggaactgaaagcaaa

SEQ ID NO: 257503 - DNA, 25 bp, Mus musculus
cgcaggagaagaaccaccaccaacc

SEQ ID NO: 257504 - DNA, 25 bp, Mus musculus
cgcaggagaagcacatcatgcaacg

SEQ ID NO: 257505 - DNA, 25 bp, Mus musculus
cgcaggagagcgagatttcaacaag

SEQ ID NO: 257506 - DNA, 25 bp, Mus musculus
cgcaggagagcgagtctgcggtgtg

SEQ ID NO: 257507 - DNA, 25 bp, Mus musculus
cgcaggagatggacttccagctgcc

SEQ ID NO: 257508 - DNA, 25 bp, Mus musculus
cgcaggagcgtggattggtgaccag

SEQ ID NO: 257509 - DNA, 25 bp, Mus musculus
cgcaggaggaaaggacccaggagag

SEQ ID NO: 257510 - DNA, 25 bp, Mus musculus
cgcaggaggaagcaactgatggtgt

SEQ ID NO: 257511 - DNA, 25 bp, Mus musculus
cgcaggaggcgcgaggggacaaagg

SEQ ID NO: 257512 - DNA, 25 bp, Mus musculus
cgcaggagggtatgagcgaagagaa

SEQ ID NO: 257513 - DNA, 25 bp, Mus musculus
cgcaggagtcccagttcttgcttca

SEQ ID NO: 257514 - DNA, 25 bp, Mus musculus
cgcaggatcacgctcctcctaggtg

SEQ ID NO: 257515 - DNA, 25 bp, Mus musculus
cgcaggatcacggcaaaatgaagga

SEQ ID NO: 257516 - DNA, 25 bp, Mus musculus
cgcaggatcttaaagagcaaatccc

SEQ ID NO: 257517 - DNA, 25 bp, Mus musculus
cgcaggatgatgtctggcaggactg

SEQ ID NO: 257518 - DNA, 25 bp, Mus musculus
cgcaggatgcaggagttcctcaggt

SEQ ID NO: 257519 - DNA, 25 bp, Mus musculus
cgcaggatgcaggctggggctgtct

SEQ ID NO: 257520 - DNA, 25 bp, Mus musculus
cgcaggattgtagcctctatcacac

SEQ ID NO: 257521 - DNA, 25 bp, Mus musculus
cgcaggcaaaggttcagaacttaga

SEQ ID NO: 257522 - DNA, 25 bp, Mus musculus
cgcaggcagagacgatagattgcta

SEQ ID NO: 257523 - DNA, 25 bp, Mus musculus
cgcaggcaggggggacctgaaccac

SEQ ID NO: 257524 - DNA, 25 bp, Mus musculus
cgcaggcatacaggcaaagcgagtg

SEQ ID NO: 257525 - DNA, 25 bp, Mus musculus
cgcaggcatacaggcctagctctgc

SEQ ID NO: 257526 - DNA, 25 bp, Mus musculus
cgcaggccaagttggtggaaggccg

SEQ ID NO: 257527 - DNA, 25 bp, Mus musculus
cgcaggccatcctgggttgctcttc

SEQ ID NO: 257528 - DNA, 25 bp, Mus musculus
cgcaggccgggcccgaaccctcttg

SEQ ID NO: 257529 - DNA, 25 bp, Mus musculus
cgcaggccgggcccgggccaccaag

SEQ ID NO: 257530 - DNA, 25 bp, Mus musculus
cgcaggcgcgcagtgaaagccggcg

SEQ ID NO: 257531 - DNA, 25 bp, Mus musculus
cgcaggcggaaagtatccattatga

SEQ ID NO: 257532 - DNA, 25 bp, Mus musculus
cgcaggcggattcgggttcgggagc

SEQ ID NO: 257533 - DNA, 25 bp, Mus musculus
cgcagggaagagcgggctaactcca

SEQ ID NO: 257534 - DNA, 25 bp, Mus musculus
cgcagggacactttacagggagact

SEQ ID NO: 257535 - DNA, 25 bp, Mus musculus
cgcagggacttacaaagagctttct

SEQ ID NO: 257536 - DNA, 25 bp, Mus musculus
cgcagggagatcggctttgaattca

SEQ ID NO: 257537 - DNA, 25 bp, Mus musculus
cgcagggagcgagagtgtgaacatg

SEQ ID NO: 257538 - DNA, 25 bp, Mus musculus
cgcagggaggcaatggcagctacaa

SEQ ID NO: 257539 - DNA, 25 bp, Mus musculus
cgcagggcatcagtgatatgtcaag

SEQ ID NO: 257540 - DNA, 25 bp, Mus musculus
cgcagggcatcagtgctaatggagg

SEQ ID NO: 257541 - DNA, 25 bp, Mus musculus
cgcagggccggctgcacaatctgcc

SEQ ID NO: 257542 - DNA, 25 bp, Mus musculus
cgcagggccggctgtgtggcctctt

SEQ ID NO: 257543 - DNA, 25 bp, Mus musculus
cgcaggggacaagatcacctttgtg

SEQ ID NO: 257544 - DNA, 25 bp, Mus musculus
cgcaggggtgccctgtggtaagcga

SEQ ID NO: 257545 - DNA, 25 bp, Mus musculus
cgcagggtatttgtaaagatgagcc

SEQ ID NO: 257546 - DNA, 25 bp, Mus musculus
cgcaggtaaggtaagatctcaagca

SEQ ID NO: 257547 - DNA, 25 bp, Mus musculus
cgcaggtcattggcgacagggttcc

SEQ ID NO: 257548 - DNA, 25 bp, Mus musculus
cgcaggtcattggggttccccagtg

SEQ ID NO: 257549 - DNA, 25 bp, Mus musculus
cgcaggtctctgaaggaacagtctg

SEQ ID NO: 257550 - DNA, 25 bp, Mus musculus
cgcaggtgaaggacagcaaccatct

SEQ ID NO: 257551 - DNA, 25 bp, Mus musculus
cgcaggtgacgctgggttgccccgg

SEQ ID NO: 257552 - DNA, 25 bp, Mus musculus
cgcaggtgagtggatgatcacttga

SEQ ID NO: 257553 - DNA, 25 bp, Mus musculus
cgcagtaacttggattccaggtgtg

SEQ ID NO: 257554 - DNA, 25 bp, Mus musculus
cgcagtacccaggacactgtggtca

SEQ ID NO: 257555 - DNA, 25 bp, Mus musculus
cgcagtaggtcccttcccactgacc

SEQ ID NO: 257556 - DNA, 25 bp, Mus musculus
cgcagtatcacagcctgaagctgga

SEQ ID NO: 257557 - DNA, 25 bp, Mus musculus
cgcagtatggacagcattgggccct

SEQ ID NO: 257558 - DNA, 25 bp, Mus musculus
cgcagtatggagagcatcgagattg

SEQ ID NO: 257559 - DNA, 25 bp, Mus musculus
cgcagtccgaggtcgccatggatcg

SEQ ID NO: 257560 - DNA, 25 bp, Mus musculus
cgcagtcctaaatggtggccctccg

SEQ ID NO: 257561 - DNA, 25 bp, Mus musculus
cgcagtcctaggactgcatttaccc

SEQ ID NO: 257562 - DNA, 25 bp, Mus musculus
cgcagtcctagggcctggtggcctc

SEQ ID NO: 257563 - DNA, 25 bp, Mus musculus
cgcagtcctaggtgaagaagactca

SEQ ID NO: 257564 - DNA, 25 bp, Mus musculus
cgcagtcgtctcctggccagagttc

SEQ ID NO: 257565 - DNA, 25 bp, Mus musculus
cgcagtcgtctcctgggacagaaga

SEQ ID NO: 257566 - DNA, 25 bp, Mus musculus
cgcagtctatgggacgcctcagaaa

SEQ ID NO: 257567 - DNA, 25 bp, Mus musculus
cgcagtctgacctctacaagaagac

SEQ ID NO: 257568 - DNA, 25 bp, Mus musculus
cgcagtcttgcagggtcagtcatat

SEQ ID NO: 257569 - DNA, 25 bp, Mus musculus
cgcagtgacgtgggctggcgcttgt

SEQ ID NO: 257570 - DNA, 25 bp, Mus musculus
cgcagtgaggcagaggtcccgtcag

SEQ ID NO: 257571 - DNA, 25 bp, Mus musculus
cgcagtgcacagagcatatgaaact

SEQ ID NO: 257572 - DNA, 25 bp, Mus musculus
cgcagtgcccagacctgtgttacat

SEQ ID NO: 257573 - DNA, 25 bp, Mus musculus
cgcagtgcgaaagagaacctgctcc

SEQ ID NO: 257574 - DNA, 25 bp, Mus musculus
cgcagtgcgaaagagattacaggac

SEQ ID NO: 257575 - DNA, 25 bp, Mus musculus
cgcagtgctcagtgtggctgaggaa

SEQ ID NO: 257576 - DNA, 25 bp, Mus musculus
cgcagtgcttagagaacgatgtgga

SEQ ID NO: 257577 - DNA, 25 bp, Mus musculus
cgcagtgcttagctcttctgtcgga

SEQ ID NO: 257578 - DNA, 25 bp, Mus musculus
cgcagtggacagaagatttcctctg

SEQ ID NO: 257579 - DNA, 25 bp, Mus musculus
cgcagtggtgcaggcagtgcaggct

SEQ ID NO: 257580 - DNA, 25 bp, Mus musculus
cgcagtggttgggaactgtgaagca

SEQ ID NO: 257581 - DNA, 25 bp, Mus musculus
cgcagtgtaatgatcgatgaagata

SEQ ID NO: 257582 - DNA, 25 bp, Mus musculus
cgcagtgtcctggccaagggccgga

SEQ ID NO: 257583 - DNA, 25 bp, Mus musculus
cgcagtgtctgaaatgacacggaga

SEQ ID NO: 257584 - DNA, 25 bp, Mus musculus
cgcagtgttgcatgatcaaaaggaa

SEQ ID NO: 257585 - DNA, 25 bp, Mus musculus
cgcagttcaaggagatgccagacca

SEQ ID NO: 257586 - DNA, 25 bp, Mus musculus
cgcagttcgcaccacccctgccact

SEQ ID NO: 257587 - DNA, 25 bp, Mus musculus
cgcagttgcctcagcaccaaggaga

SEQ ID NO: 257588 - DNA, 25 bp, Mus musculus
cgcagttgtccagagccaccagcca

SEQ ID NO: 257589 - DNA, 25 bp, Mus musculus
cgcataacttcctgagaaggacttg

SEQ ID NO: 257590 - DNA, 25 bp, Mus musculus
cgcataccggccaggtgtatgatga

SEQ ID NO: 257591 - DNA, 25 bp, Mus musculus
cgcatacctgtggcagcaccgggac

SEQ ID NO: 257592 - DNA, 25 bp, Mus musculus
cgcatacctgtggtctcaccagctc

SEQ ID NO: 257593 - DNA, 25 bp, Mus musculus
cgcataggagagcgggctgagcggc

SEQ ID NO: 257594 - DNA, 25 bp, Mus musculus
cgcataggcagttctcccagatggt

SEQ ID NO: 257595 - DNA, 25 bp, Mus musculus
cgcatatactaggtcctgtgggaat

SEQ ID NO: 257596 - DNA, 25 bp, Mus musculus
cgcatatctaccaggtaagattaaa

SEQ ID NO: 257597 - DNA, 25 bp, Mus musculus
cgcatatgcgctggtggacgcagac

SEQ ID NO: 257598 - DNA, 25 bp, Mus musculus
cgcatatgcgctggttccagatgcc

SEQ ID NO: 257599 - DNA, 25 bp, Mus musculus
cgcatcaacagagaggtgataggtg

SEQ ID NO: 257600 - DNA, 25 bp, Mus musculus
cgcatcaacagagaggtttatttcc

SEQ ID NO: 257601 - DNA, 25 bp, Mus musculus
cgcatcaactgcagccaggctatgc

SEQ ID NO: 257602 - DNA, 25 bp, Mus musculus
cgcatcaaggagctcccctcccacc

SEQ ID NO: 257603 - DNA, 25 bp, Mus musculus
cgcatcagacatggattgcagtgct

SEQ ID NO: 257604 - DNA, 25 bp, Mus musculus
cgcatcagaggaaggagatgactca

SEQ ID NO: 257605 - DNA, 25 bp, Mus musculus
cgcatcagccgtggatgaacaggcc

SEQ ID NO: 257606 - DNA, 25 bp, Mus musculus
cgcatcaggaccaagcccttcccct

SEQ ID NO: 257607 - DNA, 25 bp, Mus musculus
cgcatcagtttagtgctgacagtag

SEQ ID NO: 257608 - DNA, 25 bp, Mus musculus
cgcatcatagccaaggaaggtgggg

SEQ ID NO: 257609 - DNA, 25 bp, Mus musculus
cgcatcatagccaaggtggacggta

SEQ ID NO: 257610 - DNA, 25 bp, Mus musculus
cgcatcatccccaggcgctttgccc

SEQ ID NO: 257611 - DNA, 25 bp, Mus musculus
cgcatccagaggatgctgcccagaa

SEQ ID NO: 257612 - DNA, 25 bp, Mus musculus
cgcatccatctacaggcctgtccac

SEQ ID NO: 257613 - DNA, 25 bp, Mus musculus
cgcatccatgttcgacaccacgccc

SEQ ID NO: 257614 - DNA, 25 bp, Mus musculus
cgcatccatgttcgagtgctaagga

SEQ ID NO: 257615 - DNA, 25 bp, Mus musculus
cgcatcccagggttctgcctgtgcc

SEQ ID NO: 257616 - DNA, 25 bp, Mus musculus
cgcatcccgtttcaagaaagtatga

SEQ ID NO: 257617 - DNA, 25 bp, Mus musculus
cgcatccctgagaacacaccagtgg

SEQ ID NO: 257618 - DNA, 25 bp, Mus musculus
cgcatccctgaggtcttccacaccc

SEQ ID NO: 257619 - DNA, 25 bp, Mus musculus
cgcatccctgcaggggcctgtgtat

SEQ ID NO: 257620 - DNA, 25 bp, Mus musculus
cgcatccgagggcggtggaggaaca

SEQ ID NO: 257621 - DNA, 25 bp, Mus musculus
cgcatcctctcctggtggagagagc

SEQ ID NO: 257622 - DNA, 25 bp, Mus musculus
cgcatcgaccgcaaggtcaactcct

SEQ ID NO: 257623 - DNA, 25 bp, Mus musculus
cgcatcgagggggctacccgactct

SEQ ID NO: 257624 - DNA, 25 bp, Mus musculus
cgcatcgcagagttgacatcctgct

SEQ ID NO: 257625 - DNA, 25 bp, Mus musculus
cgcatcgcggcctcaaagcggaggg

SEQ ID NO: 257626 - DNA, 25 bp, Mus musculus
cgcatcggcaagctggtcgtttgat

SEQ ID NO: 257627 - DNA, 25 bp, Mus musculus
cgcatcgtgaaggagatgctccgct

SEQ ID NO: 257628 - DNA, 25 bp, Mus musculus
cgcatctcagcaagatggagcgggt

SEQ ID NO: 257629 - DNA, 25 bp, Mus musculus
cgcatctcagcaaggtgatctgggg

SEQ ID NO: 257630 - DNA, 25 bp, Mus musculus
cgcatctgagaacggtgatgctagc

SEQ ID NO: 257631 - DNA, 25 bp, Mus musculus
cgcatctgtgagatggcagcctact

SEQ ID NO: 257632 - DNA, 25 bp, Mus musculus
cgcatcttcaggcttctcggctgat

SEQ ID NO: 257633 - DNA, 25 bp, Mus musculus
cgcatcttgcagaccatgctcaagc

SEQ ID NO: 257634 - DNA, 25 bp, Mus musculus
cgcatgaaacggccttcctgggacc

SEQ ID NO: 257635 - DNA, 25 bp, Mus musculus
cgcatgaaagggtctggtgagaagg

SEQ ID NO: 257636 - DNA, 25 bp, Mus musculus
cgcatgaaggcagagttctttgcag

SEQ ID NO: 257637 - DNA, 25 bp, Mus musculus
cgcatgacctcaccgactctgcaaa

SEQ ID NO: 257638 - DNA, 25 bp, Mus musculus
cgcatgacctcaccgtgatcaactt

SEQ ID NO: 257639 - DNA, 25 bp, Mus musculus
cgcatgatgagaaaggggaggagcg

SEQ ID NO: 257640 - DNA, 25 bp, Mus musculus
cgcatgcagagcagggtgggccagc

SEQ ID NO: 257641 - DNA, 25 bp, Mus musculus
cgcatgcagcacctgatagctcggg

SEQ ID NO: 257642 - DNA, 25 bp, Mus musculus
cgcatgccaggttggcctgcttggg

SEQ ID NO: 257643 - DNA, 25 bp, Mus musculus
cgcatgcccagctcaagaaggggaa

SEQ ID NO: 257644 - DNA, 25 bp, Mus musculus
cgcatgcccaggctcctgctcctca

SEQ ID NO: 257645 - DNA, 25 bp, Mus musculus
cgcatgcgtcagtggtcgcagacac

SEQ ID NO: 257646 - DNA, 25 bp, Mus musculus
cgcatgctctacgagaaataccgac

SEQ ID NO: 257647 - DNA, 25 bp, Mus musculus
cgcatgctgccccagggttctttta

SEQ ID NO: 257648 - DNA, 25 bp, Mus musculus
cgcatgctgccccaggttgtgtgga

SEQ ID NO: 257649 - DNA, 25 bp, Mus musculus
cgcatgctggcgatgcccctagacc

SEQ ID NO: 257650 - DNA, 25 bp, Mus musculus
cgcatggaccagctccatttctgac

SEQ ID NO: 257651 - DNA, 25 bp, Mus musculus
cgcatggagtacgtgtttgactacg

SEQ ID NO: 257652 - DNA, 25 bp, Mus musculus
cgcatggtataaggatgacatcgtt

SEQ ID NO: 257653 - DNA, 25 bp, Mus musculus
cgcatggtgacatggtcccggaaga

SEQ ID NO: 257654 - DNA, 25 bp, Mus musculus
cgcatggtgcagtctgttgtctact

SEQ ID NO: 257655 - DNA, 25 bp, Mus musculus
cgcatggttcctgctctgcacctca

SEQ ID NO: 257656 - DNA, 25 bp, Mus musculus
cgcatgtttggaaaggatcgtgaac

SEQ ID NO: 257657 - DNA, 25 bp, Mus musculus
cgcattccggatgattgtaaagtcc

SEQ ID NO: 257658 - DNA, 25 bp, Mus musculus
cgcattcgcaaaggaacgggagatg

SEQ ID NO: 257659 - DNA, 25 bp, Mus musculus
cgcattcgcaaaggacgcatggaat

SEQ ID NO: 257660 - DNA, 25 bp, Mus musculus
cgcattcgccgagccgagatactac

SEQ ID NO: 257661 - DNA, 25 bp, Mus musculus
cgcattgaagtggtggaagaactgc

SEQ ID NO: 257662 - DNA, 25 bp, Mus musculus
cgcattgcagatgaacgagaccgtg

SEQ ID NO: 257663 - DNA, 25 bp, Mus musculus
cgcattgcctgctccccacactcct

SEQ ID NO: 257664 - DNA, 25 bp, Mus musculus
cgcatttaaatcgttctgatgaaca

SEQ ID NO: 257665 - DNA, 25 bp, Mus musculus
cgcatttcctggcagcactgtccat

SEQ ID NO: 257666 - DNA, 25 bp, Mus musculus
cgcatttcctggcagcctcgggatg

SEQ ID NO: 257667 - DNA, 25 bp, Mus musculus
cgcatttctatcgcaggcacatcaa

SEQ ID NO: 257668 - DNA, 25 bp, Mus musculus
cgcatttctatcgcatgaagataag

SEQ ID NO: 257669 - DNA, 25 bp, Mus musculus
cgcatttctatcgggttcatagtgg

SEQ ID NO: 257670 - DNA, 25 bp, Mus musculus
cgcatttctatcggtatccgccccc

SEQ ID NO: 257671 - DNA, 25 bp, Mus musculus
cgcatttgctgtccgctacagagcg

SEQ ID NO: 257672 - DNA, 25 bp, Mus musculus
cgcatttggatgaggatggaagact

SEQ ID NO: 257673 - DNA, 25 bp, Mus musculus
cgcattttcacagggaacaagttta

SEQ ID NO: 257674 - DNA, 25 bp, Mus musculus
cgcattttgccggaacccagataat

SEQ ID NO: 257675 - DNA, 25 bp, Mus musculus
cgcatttttcaataatgtatattta

SEQ ID NO: 257676 - DNA, 25 bp, Mus musculus
cgcatttttgacagagctgtcgcag

SEQ ID NO: 257677 - DNA, 25 bp, Mus musculus
cgccaaaaaaaggagctgggggaca

SEQ ID NO: 257678 - DNA, 25 bp, Mus musculus
cgccaaaaaggagaactacctctcg

SEQ ID NO: 257679 - DNA, 25 bp, Mus musculus
cgccaaaaaggaggtcctgagttca

SEQ ID NO: 257680 - DNA, 25 bp, Mus musculus
cgccaaactctggtggataccctcc

SEQ ID NO: 257681 - DNA, 25 bp, Mus musculus
cgccaaactctggttcttctggttc

SEQ ID NO: 257682 - DNA, 25 bp, Mus musculus
cgccaaagaaaaaggaagactccac

SEQ ID NO: 257683 - DNA, 25 bp, Mus musculus
cgccaaagagtggagttggagaaaa

SEQ ID NO: 257684 - DNA, 25 bp, Mus musculus
cgccaaagagtggtgggcttatgct

SEQ ID NO: 257685 - DNA, 25 bp, Mus musculus
cgccaaagcaaggacgtccacgtct

SEQ ID NO: 257686 - DNA, 25 bp, Mus musculus
cgccaaagcagcttcctgccagacc

SEQ ID NO: 257687 - DNA, 25 bp, Mus musculus
cgccaaagcccatgaaatgattgaa

SEQ ID NO: 257688 - DNA, 25 bp, Mus musculus
cgccaaaggggccaaggagaagatg

SEQ ID NO: 257689 - DNA, 25 bp, Mus musculus
cgccaaataagaacaactaggctga

SEQ ID NO: 257690 - DNA, 25 bp, Mus musculus
cgccaaataagacagtgaaatcggc

SEQ ID NO: 257691 - DNA, 25 bp, Mus musculus
cgccaacaccctgggaaacaaggga

SEQ ID NO: 257692 - DNA, 25 bp, Mus musculus
cgccaacagctccagcagagtcagg

SEQ ID NO: 257693 - DNA, 25 bp, Mus musculus
cgccaactatgacttttgccaagga

SEQ ID NO: 257694 - DNA, 25 bp, Mus musculus
cgccaactcctagctacaggcggcc

SEQ ID NO: 257695 - DNA, 25 bp, Mus musculus
cgccaagaaatcattcatcgaccca

SEQ ID NO: 257696 - DNA, 25 bp, Mus musculus
cgccaagaagcaggctcgcagcctt

SEQ ID NO: 257697 - DNA, 25 bp, Mus musculus
cgccaagactatgcgcaagaaagga

SEQ ID NO: 257698 - DNA, 25 bp, Mus musculus
cgccaagagctcagctttgggattc

SEQ ID NO: 257699 - DNA, 25 bp, Mus musculus
cgccaagaggagggggcatgaatcc

SEQ ID NO: 257700 - DNA, 25 bp, Mus musculus
cgccaagaggaggggttatcatgct

SEQ ID NO: 257701 - DNA, 25 bp, Mus musculus
cgccaagattaagagctgggccagc

SEQ ID NO: 257702 - DNA, 25 bp, Mus musculus
cgccaagatttggattcaagtcaat

SEQ ID NO: 257703 - DNA, 25 bp, Mus musculus
cgccaagcacatcaaggaacagaga

SEQ ID NO: 257704 - DNA, 25 bp, Mus musculus
cgccaagcagactgggattgtcttg

SEQ ID NO: 257705 - DNA, 25 bp, Mus musculus
cgccaagcaggtagggccttcctga

SEQ ID NO: 257706 - DNA, 25 bp, Mus musculus
cgccaagccgaggtatctccagaca

SEQ ID NO: 257707 - DNA, 25 bp, Mus musculus
cgccaagccgagtgccaggtcacca

SEQ ID NO: 257708 - DNA, 25 bp, Mus musculus
cgccaagcgctacactcaagatgac

SEQ ID NO: 257709 - DNA, 25 bp, Mus musculus
cgccaaggagtgggtatggaggagc

SEQ ID NO: 257710 - DNA, 25 bp, Mus musculus
cgccaaggcagaggttgtatggaga

SEQ ID NO: 257711 - DNA, 25 bp, Mus musculus
cgccaagtacagacttctggaggat

SEQ ID NO: 257712 - DNA, 25 bp, Mus musculus
cgccaagtgagagtcagcttgcgaa

SEQ ID NO: 257713 - DNA, 25 bp, Mus musculus
cgccaagtgctcaagtatgatgact

SEQ ID NO: 257714 - DNA, 25 bp, Mus musculus
cgccaatgaaacttccatagagact

SEQ ID NO: 257715 - DNA, 25 bp, Mus musculus
cgccaatgaaagctcaaaacattca

SEQ ID NO: 257716 - DNA, 25 bp, Mus musculus
cgccaatgaaagctgacttaaaaac

SEQ ID NO: 257717 - DNA, 25 bp, Mus musculus
cgccaatggaagcagaaaattgtgc

SEQ ID NO: 257718 - DNA, 25 bp, Mus musculus
cgccaatggccaaatcaaagaaatc

SEQ ID NO: 257719 - DNA, 25 bp, Mus musculus
cgccaatgtgtccgacttcccggag

SEQ ID NO: 257720 - DNA, 25 bp, Mus musculus
cgccacaaagaaaggaaacacggcc

SEQ ID NO: 257721 - DNA, 25 bp, Mus musculus
cgccacacccaggagcatgttaatg

SEQ ID NO: 257722 - DNA, 25 bp, Mus musculus
cgccacagcatgcgggaggaggact

SEQ ID NO: 257723 - DNA, 25 bp, Mus musculus
cgccacagccagaagttgaaatgga

SEQ ID NO: 257724 - DNA, 25 bp, Mus musculus
cgccacagcggccccgtgtctgaag

SEQ ID NO: 257725 - DNA, 25 bp, Mus musculus
cgccaccaccgctgacgatgcagat

SEQ ID NO: 257726 - DNA, 25 bp, Mus musculus
cgccaccaccgctggatgcagatct

SEQ ID NO: 257727 - DNA, 25 bp, Mus musculus
cgccaccacctggaactggtgagca

SEQ ID NO: 257728 - DNA, 25 bp, Mus musculus
cgccaccacggcgggcgtccgaaac

SEQ ID NO: 257729 - DNA, 25 bp, Mus musculus
cgccaccatcgtaggttctgtacct

SEQ ID NO: 257730 - DNA, 25 bp, Mus musculus
cgccaccatgagcgatcagcagctg

SEQ ID NO: 257731 - DNA, 25 bp, Mus musculus
cgccacccaagttggagtcattcga

SEQ ID NO: 257732 - DNA, 25 bp, Mus musculus
cgccacccagatctggaacaacgac

SEQ ID NO: 257733 - DNA, 25 bp, Mus musculus
cgccacccagcggccacatcctggt

SEQ ID NO: 257734 - DNA, 25 bp, Mus musculus
cgccaccccctgtatccctctgaag

SEQ ID NO: 257735 - DNA, 25 bp, Mus musculus
cgccacccctcaagacggaggagga

SEQ ID NO: 257736 - DNA, 25 bp, Mus musculus
cgccacccctcaaggagcacttcaa

SEQ ID NO: 257737 - DNA, 25 bp, Mus musculus
cgccacctgacaggtcacaaccatg

SEQ ID NO: 257738 - DNA, 25 bp, Mus musculus
cgccacctgagaaaagaaaagaaga

SEQ ID NO: 257739 - DNA, 25 bp, Mus musculus
cgccacctgagaagagaagagaaga

SEQ ID NO: 257740 - DNA, 25 bp, Mus musculus
cgccacctgagagatctcaggtttg

SEQ ID NO: 257741 - DNA, 25 bp, Mus musculus
cgccacctgaggcctcccagcatag

SEQ ID NO: 257742 - DNA, 25 bp, Mus musculus
cgccacctgcaaggttcactttaat

SEQ ID NO: 257743 - DNA, 25 bp, Mus musculus
cgccaccttctaacagtgctgctga

SEQ ID NO: 257744 - DNA, 25 bp, Mus musculus
cgccacgaagccagaaggaggctcg

SEQ ID NO: 257745 - DNA, 25 bp, Mus musculus
cgccacgagaacgtcattgggctac

SEQ ID NO: 257746 - DNA, 25 bp, Mus musculus
cgccacgagaactggacatttggtc

SEQ ID NO: 257747 - DNA, 25 bp, Mus musculus
cgccacgatgtgtgccgtgcaggtg

SEQ ID NO: 257748 - DNA, 25 bp, Mus musculus
cgccacgccgatccggtaatatcct

SEQ ID NO: 257749 - DNA, 25 bp, Mus musculus
cgccacgcttagactagctgtgtta

SEQ ID NO: 257750 - DNA, 25 bp, Mus musculus
cgccacgtacctagaacaccacgct

SEQ ID NO: 257751 - DNA, 25 bp, Mus musculus
cgccactaaatagtgaggatgaccc

SEQ ID NO: 257752 - DNA, 25 bp, Mus musculus
cgccactgcacagattgcatctggg

SEQ ID NO: 257753 - DNA, 25 bp, Mus musculus
cgccactgccaggtcagatgctgct

SEQ ID NO: 257754 - DNA, 25 bp, Mus musculus
cgccactgccagtggccaaacgaaa

SEQ ID NO: 257755 - DNA, 25 bp, Mus musculus
cgccagaaagacagggtttcatgca

SEQ ID NO: 257756 - DNA, 25 bp, Mus musculus
cgccagaaaggaacacccctggcgc

SEQ ID NO: 257757 - DNA, 25 bp, Mus musculus
cgccagaagaagcgagtacttactc

SEQ ID NO: 257758 - DNA, 25 bp, Mus musculus
cgccagacacattgatttgaaacca

SEQ ID NO: 257759 - DNA, 25 bp, Mus musculus
cgccagacacattgtcataacttcc

SEQ ID NO: 257760 - DNA, 25 bp, Mus musculus
cgccagacacattgtgaactgccct

SEQ ID NO: 257761 - DNA, 25 bp, Mus musculus
cgccagaccccagcctatggtatcg

SEQ ID NO: 257762 - DNA, 25 bp, Mus musculus
cgccagagcagccaacatgagtctg

SEQ ID NO: 257763 - DNA, 25 bp, Mus musculus
cgccagagccggtggcggtgggatc

SEQ ID NO: 257764 - DNA, 25 bp, Mus musculus
cgccagaggcaggcaatgatacagg

SEQ ID NO: 257765 - DNA, 25 bp, Mus musculus
cgccagaggcaggtaacctcggccg

SEQ ID NO: 257766 - DNA, 25 bp, Mus musculus
cgccagataccctaactcagattag

SEQ ID NO: 257767 - DNA, 25 bp, Mus musculus
cgccagattgggcctgtcccaggct

SEQ ID NO: 257768 - DNA, 25 bp, Mus musculus
cgccagcaacatctccagcacctgc

SEQ ID NO: 257769 - DNA, 25 bp, Mus musculus
cgccagcacatctgcagagaaaacc

SEQ ID NO: 257770 - DNA, 25 bp, Mus musculus
cgccagcaccttctgcttcccggac

SEQ ID NO: 257771 - DNA, 25 bp, Mus musculus
cgccagcagcccagagcaatcaggt

SEQ ID NO: 257772 - DNA, 25 bp, Mus musculus
cgccagcagcccagatctactcttc

SEQ ID NO: 257773 - DNA, 25 bp, Mus musculus
cgccagcagcccagcccactgagtg

SEQ ID NO: 257774 - DNA, 25 bp, Mus musculus
cgccagcagcccagggttggaagct

SEQ ID NO: 257775 - DNA, 25 bp, Mus musculus
cgccagccaagaagaagatgaagct

SEQ ID NO: 257776 - DNA, 25 bp, Mus musculus
cgccagccaaggtggggctgcagtt

SEQ ID NO: 257777 - DNA, 25 bp, Mus musculus
cgccagccaggagcatagaagacat

SEQ ID NO: 257778 - DNA, 25 bp, Mus musculus
cgccagccaggattggatccagtgt

SEQ ID NO: 257779 - DNA, 25 bp, Mus musculus
cgccagccaggttgcaagtgttgat

SEQ ID NO: 257780 - DNA, 25 bp, Mus musculus
cgccagcccgtcccaggtaaatcac

SEQ ID NO: 257781 - DNA, 25 bp, Mus musculus
cgccagcctctgaaactagacacca

SEQ ID NO: 257782 - DNA, 25 bp, Mus musculus
cgccagcgccgtccgtgacctcgtg

SEQ ID NO: 257783 - DNA, 25 bp, Mus musculus
cgccagcggcgcagaaacatctgtg

SEQ ID NO: 257784 - DNA, 25 bp, Mus musculus
cgccagcggcgcaggtgattcctcc

SEQ ID NO: 257785 - DNA, 25 bp, Mus musculus
cgccagcgtcctaacgggcaatgtc

SEQ ID NO: 257786 - DNA, 25 bp, Mus musculus
cgccagctcagaggcaggtttttcc

SEQ ID NO: 257787 - DNA, 25 bp, Mus musculus
cgccagctcaggcaccttaaggatg

SEQ ID NO: 257788 - DNA, 25 bp, Mus musculus
cgccagctcccggttgcttcctaga

SEQ ID NO: 257789 - DNA, 25 bp, Mus musculus
cgccagctcgtatgaaaatccatgg

SEQ ID NO: 257790 - DNA, 25 bp, Mus musculus
cgccagctgggtggctttgacactg

SEQ ID NO: 257791 - DNA, 25 bp, Mus musculus
cgccagcttagagtgcgatgcggtg

SEQ ID NO: 257792 - DNA, 25 bp, Mus musculus
cgccagcttgtgcggctagaagagg

SEQ ID NO: 257793 - DNA, 25 bp, Mus musculus
cgccagcttgtgcgtgatattgtgg

SEQ ID NO: 257794 - DNA, 25 bp, Mus musculus
cgccaggaacgtctttggaaagtca

SEQ ID NO: 257795 - DNA, 25 bp, Mus musculus
cgccaggaacgttgtgaggactgag

SEQ ID NO: 257796 - DNA, 25 bp, Mus musculus
cgccaggacaccaagagggaagctg

SEQ ID NO: 257797 - DNA, 25 bp, Mus musculus
cgccaggagttctaggaaacagctc

SEQ ID NO: 257798 - DNA, 25 bp, Mus musculus
cgccaggagttctagggtatccctc

SEQ ID NO: 257799 - DNA, 25 bp, Mus musculus
cgccaggccagaaatcacaaacttc

SEQ ID NO: 257800 - DNA, 25 bp, Mus musculus
cgccaggctcagccgagatgccgcg

SEQ ID NO: 257801 - DNA, 25 bp, Mus musculus
cgccaggctgaggagggaggagcag

SEQ ID NO: 257802 - DNA, 25 bp, Mus musculus
cgccagggaaggctccccagaggtc

SEQ ID NO: 257803 - DNA, 25 bp, Mus musculus
cgccagggcaaggaggtcagacctg

SEQ ID NO: 257804 - DNA, 25 bp, Mus musculus
cgccagggccaggtcctgtgcgcag

SEQ ID NO: 257805 - DNA, 25 bp, Mus musculus
cgccaggtcgtggggttgtgctggg

SEQ ID NO: 257806 - DNA, 25 bp, Mus musculus
cgccaggtttctttcagcctccagg

SEQ ID NO: 257807 - DNA, 25 bp, Mus musculus
cgccagtaaagcagtggtggcagca

SEQ ID NO: 257808 - DNA, 25 bp, Mus musculus
cgccagtaaagcagttttcctttgg

SEQ ID NO: 257809 - DNA, 25 bp, Mus musculus
cgccagtcaagggacgcaagcgccg

SEQ ID NO: 257810 - DNA, 25 bp, Mus musculus
cgccagtgatttccggtacaaagag

SEQ ID NO: 257811 - DNA, 25 bp, Mus musculus
cgccagtggagaagatctcttcact

SEQ ID NO: 257812 - DNA, 25 bp, Mus musculus
cgccagtgtcaggtcaattaccatg

SEQ ID NO: 257813 - DNA, 25 bp, Mus musculus
cgccagtttagaggtctttcagcaa

SEQ ID NO: 257814 - DNA, 25 bp, Mus musculus
cgccagtttagaggttatctggaat

SEQ ID NO: 257815 - DNA, 25 bp, Mus musculus
cgccatacggacttggacattaagg

SEQ ID NO: 257816 - DNA, 25 bp, Mus musculus
cgccataggtaacattgccaagact

SEQ ID NO: 257817 - DNA, 25 bp, Mus musculus
cgccatagtgggacaatatcccagc

SEQ ID NO: 257818 - DNA, 25 bp, Mus musculus
cgccatattcccgtggcatctttct

SEQ ID NO: 257819 - DNA, 25 bp, Mus musculus
cgccatcaaacaggttactatgaaa

SEQ ID NO: 257820 - DNA, 25 bp, Mus musculus
cgccatcaaacagtcaaaatatctg

SEQ ID NO: 257821 - DNA, 25 bp, Mus musculus
cgccatcaaccaggaaagccgggtg

SEQ ID NO: 257822 - DNA, 25 bp, Mus musculus
cgccatcaagcagggtttcaaagat

SEQ ID NO: 257823 - DNA, 25 bp, Mus musculus
cgccatcacaggcttctgtgtcagt

SEQ ID NO: 257824 - DNA, 25 bp, Mus musculus
cgccatcagccaggtcaggaatcta

SEQ ID NO: 257825 - DNA, 25 bp, Mus musculus
cgccatcatcagatggcaaggtcag

SEQ ID NO: 257826 - DNA, 25 bp, Mus musculus
cgccatcatcagctctaggagttcc

SEQ ID NO: 257827 - DNA, 25 bp, Mus musculus
cgccatcatcggagaagcttctgag

SEQ ID NO: 257828 - DNA, 25 bp, Mus musculus
cgccatcatcggcgctggcgagaac

SEQ ID NO: 257829 - DNA, 25 bp, Mus musculus
cgccatcatgtctgccacaacttct

SEQ ID NO: 257830 - DNA, 25 bp, Mus musculus
cgccatccacacgttccgccaggta

SEQ ID NO: 257831 - DNA, 25 bp, Mus musculus
cgccatccacccggctgccaataac

SEQ ID NO: 257832 - DNA, 25 bp, Mus musculus
cgccatccagggtggagcttttgaa

SEQ ID NO: 257833 - DNA, 25 bp, Mus musculus
cgccatccaggtccctaagcctttt

SEQ ID NO: 257834 - DNA, 25 bp, Mus musculus
cgccatccatgccagtttgccttct

SEQ ID NO: 257835 - DNA, 25 bp, Mus musculus
cgccatcccagggaacaggaagaag

SEQ ID NO: 257836 - DNA, 25 bp, Mus musculus
cgccatcctcagagatggccgccaa

SEQ ID NO: 257837 - DNA, 25 bp, Mus musculus
cgccatcctggcgatcattacaggg

SEQ ID NO: 257838 - DNA, 25 bp, Mus musculus
cgccatcctggcggggaattctacc

SEQ ID NO: 257839 - DNA, 25 bp, Mus musculus
cgccatccttgaaattttctgaatt

SEQ ID NO: 257840 - DNA, 25 bp, Mus musculus
cgccatccttgaatgtccagtttca

SEQ ID NO: 257841 - DNA, 25 bp, Mus musculus
cgccatcgagcaggtattcccaagc

SEQ ID NO: 257842 - DNA, 25 bp, Mus musculus
cgccatcgagcaggtgtcaccggat

SEQ ID NO: 257843 - DNA, 25 bp, Mus musculus
cgccatcgtaggtgccgatcccctt

SEQ ID NO: 257844 - DNA, 25 bp, Mus musculus
cgccatctacgaggtagatgcacgg

SEQ ID NO: 257845 - DNA, 25 bp, Mus musculus
cgccatctacgaggttcccaaagag

SEQ ID NO: 257846 - DNA, 25 bp, Mus musculus
cgccatgaagaagcccattggaata

SEQ ID NO: 257847 - DNA, 25 bp, Mus musculus
cgccatgacaagatcgtgattgtgc

SEQ ID NO: 257848 - DNA, 25 bp, Mus musculus
cgccatgacagatcagacctactgt

SEQ ID NO: 257849 - DNA, 25 bp, Mus musculus
cgccatgactattctcccggggccg

SEQ ID NO: 257850 - DNA, 25 bp, Mus musculus
cgccatgactttggcaccaggaagc

SEQ ID NO: 257851 - DNA, 25 bp, Mus musculus
cgccatgattagagggggacatgtc

SEQ ID NO: 257852 - DNA, 25 bp, Mus musculus
cgccatgcacggagttgtgggaccg

SEQ ID NO: 257853 - DNA, 25 bp, Mus musculus
cgccatgccaggtatgcaggacatg

SEQ ID NO: 257854 - DNA, 25 bp, Mus musculus
cgccatgccaggtgtgtttgatcac

SEQ ID NO: 257855 - DNA, 25 bp, Mus musculus
cgccatgctcgtgggctccctgctg

SEQ ID NO: 257856 - DNA, 25 bp, Mus musculus
cgccatgctctgcgttgctgctctc

SEQ ID NO: 257857 - DNA, 25 bp, Mus musculus
cgccatgctgttctgaatgaaggga

SEQ ID NO: 257858 - DNA, 25 bp, Mus musculus
cgccatggctgacaagatcctgagg

SEQ ID NO: 257859 - DNA, 25 bp, Mus musculus
cgccatgggctcccggccccgtggg

SEQ ID NO: 257860 - DNA, 25 bp, Mus musculus
cgccatgggctggcgccaccctcag

SEQ ID NO: 257861 - DNA, 25 bp, Mus musculus
cgccatggttggcaggtgaatttgg

SEQ ID NO: 257862 - DNA, 25 bp, Mus musculus
cgccatgtactattttacctatgac

SEQ ID NO: 257863 - DNA, 25 bp, Mus musculus
cgccatgtatgtttccaccggctcc

SEQ ID NO: 257864 - DNA, 25 bp, Mus musculus
cgccatgtcaaaaaggtatggttcc

SEQ ID NO: 257865 - DNA, 25 bp, Mus musculus
cgccatgtctgcaagcatcctggtc

SEQ ID NO: 257866 - DNA, 25 bp, Mus musculus
cgccatgtggttcatcggctggact

SEQ ID NO: 257867 - DNA, 25 bp, Mus musculus
cgccattaaggtgtctagtcacatt

SEQ ID NO: 257868 - DNA, 25 bp, Mus musculus
cgccattacaaacagtggccagttt

SEQ ID NO: 257869 - DNA, 25 bp, Mus musculus
cgccattcagggtgtcctggacact

SEQ ID NO: 257870 - DNA, 25 bp, Mus musculus
cgccattgaaacggataaggaaggc

SEQ ID NO: 257871 - DNA, 25 bp, Mus musculus
cgccattgaaacgggatgggaactc

SEQ ID NO: 257872 - DNA, 25 bp, Mus musculus
cgccattgaagtgtggggctttggg

SEQ ID NO: 257873 - DNA, 25 bp, Mus musculus
cgccattggtgagctgaaaaatgaa

SEQ ID NO: 257874 - DNA, 25 bp, Mus musculus
cgcccaaaagacctagtggtttatt

SEQ ID NO: 257875 - DNA, 25 bp, Mus musculus
cgcccaagaaaggtggcaggagatc

SEQ ID NO: 257876 - DNA, 25 bp, Mus musculus
cgcccaagaaggtggagtttgtcca

SEQ ID NO: 257877 - DNA, 25 bp, Mus musculus
cgcccaagacctccctgggcctcca

SEQ ID NO: 257878 - DNA, 25 bp, Mus musculus
cgcccacaagtatgtcttggctgtc

SEQ ID NO: 257879 - DNA, 25 bp, Mus musculus
cgcccacaccactggtgatccagca

SEQ ID NO: 257880 - DNA, 25 bp, Mus musculus
cgcccacagcagagtctgtgcgccc

SEQ ID NO: 257881 - DNA, 25 bp, Mus musculus
cgcccacccaggaaatcctgaagaa

SEQ ID NO: 257882 - DNA, 25 bp, Mus musculus
cgcccacccaggaatccatcagcac

SEQ ID NO: 257883 - DNA, 25 bp, Mus musculus
cgcccacctggacaggacaatgtat

SEQ ID NO: 257884 - DNA, 25 bp, Mus musculus
cgcccacgactgcactgggccctgc

SEQ ID NO: 257885 - DNA, 25 bp, Mus musculus
cgcccacgccggtgtctgcagctac

SEQ ID NO: 257886 - DNA, 25 bp, Mus musculus
cgcccacgccgtatatcaaggcctt

SEQ ID NO: 257887 - DNA, 25 bp, Mus musculus
cgcccacgttgggatctgaaccaat

SEQ ID NO: 257888 - DNA, 25 bp, Mus musculus
cgcccagaagcaggtactctatcta

SEQ ID NO: 257889 - DNA, 25 bp, Mus musculus
cgcccagacttccacacgcgcacgg

SEQ ID NO: 257890 - DNA, 25 bp, Mus musculus
cgcccagagcaatagactgatgatg

SEQ ID NO: 257891 - DNA, 25 bp, Mus musculus
cgcccagagcacaggggcctggatc

SEQ ID NO: 257892 - DNA, 25 bp, Mus musculus
cgcccagcactggggatgtccagct

SEQ ID NO: 257893 - DNA, 25 bp, Mus musculus
cgcccagccctgagggccatggcgg

SEQ ID NO: 257894 - DNA, 25 bp, Mus musculus
cgcccagcgagcgctgcgaagctgg

SEQ ID NO: 257895 - DNA, 25 bp, Mus musculus
cgcccaggacactgccactgcacag

SEQ ID NO: 257896 - DNA, 25 bp, Mus musculus
cgcccaggagcaggtgtagctactt

SEQ ID NO: 257897 - DNA, 25 bp, Mus musculus
cgcccaggagctctcaggtctacgc

SEQ ID NO: 257898 - DNA, 25 bp, Mus musculus
cgcccaggagctctgaggtctacgc

SEQ ID NO: 257899 - DNA, 25 bp, Mus musculus
cgcccaggagtgcagtatctctcct

SEQ ID NO: 257900 - DNA, 25 bp, Mus musculus
cgcccaggataaagcgattgtccag

SEQ ID NO: 257901 - DNA, 25 bp, Mus musculus
cgcccaggcaactgcgcagttcctg

SEQ ID NO: 257902 - DNA, 25 bp, Mus musculus
cgcccaggccggtcccggatgttgc

SEQ ID NO: 257903 - DNA, 25 bp, Mus musculus
cgcccaggcgaggcactgggctccc

SEQ ID NO: 257904 - DNA, 25 bp, Mus musculus
cgcccaggcggatggcacccttatc

SEQ ID NO: 257905 - DNA, 25 bp, Mus musculus
cgcccaggcgtagaccccgactgca

SEQ ID NO: 257906 - DNA, 25 bp, Mus musculus
cgcccagggaccagcctgcactgga

SEQ ID NO: 257907 - DNA, 25 bp, Mus musculus
cgcccagggaccagtagaacaacag

SEQ ID NO: 257908 - DNA, 25 bp, Mus musculus
cgcccaggggagatgtataccaggt

SEQ ID NO: 257909 - DNA, 25 bp, Mus musculus
cgcccaggtcaaggactatgagaaa

SEQ ID NO: 257910 - DNA, 25 bp, Mus musculus
cgcccaggtcaaggagtccatgaag

SEQ ID NO: 257911 - DNA, 25 bp, Mus musculus
cgcccaggtcaaggatgataatggg

SEQ ID NO: 257912 - DNA, 25 bp, Mus musculus
cgcccaggttctcagagccatcgtg

SEQ ID NO: 257913 - DNA, 25 bp, Mus musculus
cgcccagtctgatacacttttggcg

SEQ ID NO: 257914 - DNA, 25 bp, Mus musculus
cgcccagtgttcctttgaagaccct

SEQ ID NO: 257915 - DNA, 25 bp, Mus musculus
cgcccagtgttgtcactggacctat

SEQ ID NO: 257916 - DNA, 25 bp, Mus musculus
cgcccagttcagagttccagggacc

SEQ ID NO: 257917 - DNA, 25 bp, Mus musculus
cgcccagttcagctggcatctgacc

SEQ ID NO: 257918 - DNA, 25 bp, Mus musculus
cgcccagttcctgagcggcatccca

SEQ ID NO: 257919 - DNA, 25 bp, Mus musculus
cgcccatcaagataagtgggcagag

SEQ ID NO: 257920 - DNA, 25 bp, Mus musculus
cgcccatcaagggaaaactcgatgc

SEQ ID NO: 257921 - DNA, 25 bp, Mus musculus
cgcccatgcagatggcctctgcaca

SEQ ID NO: 257922 - DNA, 25 bp, Mus musculus
cgcccatgtaccaagtgtccccaag

SEQ ID NO: 257923 - DNA, 25 bp, Mus musculus
cgcccatgtcaagaggcctcacacc

SEQ ID NO: 257924 - DNA, 25 bp, Mus musculus
cgcccatgtcagtatttcctaaatg

SEQ ID NO: 257925 - DNA, 25 bp, Mus musculus
cgcccattcaggtgcgctgctcaga

SEQ ID NO: 257926 - DNA, 25 bp, Mus musculus
cgccccaaagagggtcttgagagca

SEQ ID NO: 257927 - DNA, 25 bp, Mus musculus
cgccccaaagcctgccgacataaga

SEQ ID NO: 257928 - DNA, 25 bp, Mus musculus
cgccccaacagattccacgaggacc

SEQ ID NO: 257929 - DNA, 25 bp, Mus musculus
cgccccacaaagaattccagaggca

SEQ ID NO: 257930 - DNA, 25 bp, Mus musculus
cgccccaccagaaaacgaggaggac

SEQ ID NO: 257931 - DNA, 25 bp, Mus musculus
cgccccactgtaaggcagtggaact

SEQ ID NO: 257932 - DNA, 25 bp, Mus musculus
cgccccagaggtcacccggcctgct

SEQ ID NO: 257933 - DNA, 25 bp, Mus musculus
cgccccagaggtgacccttaccctg

SEQ ID NO: 257934 - DNA, 25 bp, Mus musculus
cgccccagcagatggtaacaaaaga

SEQ ID NO: 257935 - DNA, 25 bp, Mus musculus
cgccccagcctccaccatgccaatc

SEQ ID NO: 257936 - DNA, 25 bp, Mus musculus
cgccccagctgtggggcagttttgg

SEQ ID NO: 257937 - DNA, 25 bp, Mus musculus
cgccccatacacaggggtctgtatg

SEQ ID NO: 257938 - DNA, 25 bp, Mus musculus
cgccccatggctcgggactcggcca

SEQ ID NO: 257939 - DNA, 25 bp, Mus musculus
cgccccattgaggtgaccagaatgg

SEQ ID NO: 257940 - DNA, 25 bp, Mus musculus
cgcccccagagattaatgtggctgc

SEQ ID NO: 257941 - DNA, 25 bp, Mus musculus
cgcccccagaggtgtcgtggaggtg

SEQ ID NO: 257942 - DNA, 25 bp, Mus musculus
cgcccccaggagttattcctcataa

SEQ ID NO: 257943 - DNA, 25 bp, Mus musculus
cgcccccgaccagagcagagggctg

SEQ ID NO: 257944 - DNA, 25 bp, Mus musculus
cgcccccgccgcgccttcatcaagt

SEQ ID NO: 257945 - DNA, 25 bp, Mus musculus
cgcccccgccgtgtgagcgtcctgg

SEQ ID NO: 257946 - DNA, 25 bp, Mus musculus
cgcccccggatgatggtcactttgc

SEQ ID NO: 257947 - DNA, 25 bp, Mus musculus
cgcccccggcagcaggatgaaacga

SEQ ID NO: 257948 - DNA, 25 bp, Mus musculus
cgcccccggcagcagtctcacttta

SEQ ID NO: 257949 - DNA, 25 bp, Mus musculus
cgccccctcaggagccaacatgttg

SEQ ID NO: 257950 - DNA, 25 bp, Mus musculus
cgccccctccggtcgccatggatcg

SEQ ID NO: 257951 - DNA, 25 bp, Mus musculus
cgccccctgcagttggacatttggc

SEQ ID NO: 257952 - DNA, 25 bp, Mus musculus
cgccccgagagaagtcaatgaaagg

SEQ ID NO: 257953 - DNA, 25 bp, Mus musculus
cgccccgcacagtatcagaaattat

SEQ ID NO: 257954 - DNA, 25 bp, Mus musculus
cgccccgcaccgatgatattatcaa

SEQ ID NO: 257955 - DNA, 25 bp, Mus musculus
cgccccgcccggtggacaccaaggg

SEQ ID NO: 257956 - DNA, 25 bp, Mus musculus
cgccccgccttgaacagagaaagca

SEQ ID NO: 257957 - DNA, 25 bp, Mus musculus
cgccccggcgctgagcctcaaaatg

SEQ ID NO: 257958 - DNA, 25 bp, Mus musculus
cgccccggctgccctcaaagcggag

SEQ ID NO: 257959 - DNA, 25 bp, Mus musculus
cgccccgggccgtgggaaatgcagt

SEQ ID NO: 257960 - DNA, 25 bp, Mus musculus
cgccccgggccgtgggctgcccagc

SEQ ID NO: 257961 - DNA, 25 bp, Mus musculus
cgccccgggcggcttggctgcccac

SEQ ID NO: 257962 - DNA, 25 bp, Mus musculus
cgccccgggcgggagtcaggcctcg

SEQ ID NO: 257963 - DNA, 25 bp, Mus musculus
cgccccgtccccgccatgggctgcc

SEQ ID NO: 257964 - DNA, 25 bp, Mus musculus
cgcccctaagccttcaagatggtca

SEQ ID NO: 257965 - DNA, 25 bp, Mus musculus
cgcccctaaggtaagttctcgtcca

SEQ ID NO: 257966 - DNA, 25 bp, Mus musculus
cgcccctgaagatggagagaagagg

SEQ ID NO: 257967 - DNA, 25 bp, Mus musculus
cgcccctgagaaaaatgttttacaa

SEQ ID NO: 257968 - DNA, 25 bp, Mus musculus
cgcccctgcctccctgcccacaaag

SEQ ID NO: 257969 - DNA, 25 bp, Mus musculus
cgcccctgcgaccaggtgacccaat

SEQ ID NO: 257970 - DNA, 25 bp, Mus musculus
cgcccgaccatgaagacaccgtgga

SEQ ID NO: 257971 - DNA, 25 bp, Mus musculus
cgcccgaccatgaagatgaagcggc

SEQ ID NO: 257972 - DNA, 25 bp, Mus musculus
cgcccgaccatgaaggtttataaga

SEQ ID NO: 257973 - DNA, 25 bp, Mus musculus
cgcccgaccctaggtacccaggtga

SEQ ID NO: 257974 - DNA, 25 bp, Mus musculus
cgcccgagcagcttggccgacagga

SEQ ID NO: 257975 - DNA, 25 bp, Mus musculus
cgcccgatgcaatgctgtcgatcat

SEQ ID NO: 257976 - DNA, 25 bp, Mus musculus
cgcccgcacggagcggcggcatgga

SEQ ID NO: 257977 - DNA, 25 bp, Mus musculus
cgcccgccagccaggttgcaagtgt

SEQ ID NO: 257978 - DNA, 25 bp, Mus musculus
cgcccgccccgtccccgccatgggc

SEQ ID NO: 257979 - DNA, 25 bp, Mus musculus
cgcccgcccggcaatgggaaatcca

SEQ ID NO: 257980 - DNA, 25 bp, Mus musculus
cgcccgcccggttatgtcattttct

SEQ ID NO: 257981 - DNA, 25 bp, Mus musculus
cgcccgccgagcagagaacggcagg

SEQ ID NO: 257982 - DNA, 25 bp, Mus musculus
cgcccgccgagcaggaagttctgac

SEQ ID NO: 257983 - DNA, 25 bp, Mus musculus
cgcccgcctgccgcggaatcatggc

SEQ ID NO: 257984 - DNA, 25 bp, Mus musculus
cgcccgcctggacaggatgtttgct

SEQ ID NO: 257985 - DNA, 25 bp, Mus musculus
cgcccgcgaaggaggtgtcgcggaa

SEQ ID NO: 257986 - DNA, 25 bp, Mus musculus
cgcccgcgatgactgccactctccg

SEQ ID NO: 257987 - DNA, 25 bp, Mus musculus
cgcccgcgcagagccggctgatctt

SEQ ID NO: 257988 - DNA, 25 bp, Mus musculus
cgcccgcgcaggttggtgggaactc

SEQ ID NO: 257989 - DNA, 25 bp, Mus musculus
cgcccgcgcaggtttggacgtcatg

SEQ ID NO: 257990 - DNA, 25 bp, Mus musculus
cgcccgcgcgggtcgcccaatgagg

SEQ ID NO: 257991 - DNA, 25 bp, Mus musculus
cgcccgctgaaaaaattgtgcaagc

SEQ ID NO: 257992 - DNA, 25 bp, Mus musculus
cgcccgctgccccagggatctttgg

SEQ ID NO: 257993 - DNA, 25 bp, Mus musculus
cgcccggaccgccagattgtgcctt

SEQ ID NO: 257994 - DNA, 25 bp, Mus musculus
cgcccggacctcagcagaaatctcc

SEQ ID NO: 257995 - DNA, 25 bp, Mus musculus
cgcccggacctcaggtctctgcctc

SEQ ID NO: 257996 - DNA, 25 bp, Mus musculus
cgcccggagatgcgggtttgcctgc

SEQ ID NO: 257997 - DNA, 25 bp, Mus musculus
cgcccggagcaagactgtcaaggcc

SEQ ID NO: 257998 - DNA, 25 bp, Mus musculus
cgcccggagcaaggacgaaggtgtt

SEQ ID NO: 257999 - DNA, 25 bp, Mus musculus
cgcccggagcaaggtaacaaataag

SEQ ID NO: 258000 - DNA, 25 bp, Mus musculus
cgcccggcaggcctatgagaagcag

SEQ ID NO: 258001 - DNA, 25 bp, Mus musculus
cgcccggccggggaccaatctccgc

SEQ ID NO: 258002 - DNA, 25 bp, Mus musculus
cgcccgggacccttatgacctgatg

SEQ ID NO: 258003 - DNA, 25 bp, Mus musculus
cgcccgggacccttctgccactgct

SEQ ID NO: 258004 - DNA, 25 bp, Mus musculus
cgcccgggaccgcaggtgtgggata

SEQ ID NO: 258005 - DNA, 25 bp, Mus musculus
cgcccgggaccgcagttgagtggtg

SEQ ID NO: 258006 - DNA, 25 bp, Mus musculus
cgcccgggaggcgctggcggtggtg

SEQ ID NO: 258007 - DNA, 25 bp, Mus musculus
cgcccgggaggtgaagggccggatg

SEQ ID NO: 258008 - DNA, 25 bp, Mus musculus
cgcccgggagtttcaggcatttgca

SEQ ID NO: 258009 - DNA, 25 bp, Mus musculus
cgcccgggccgctcgatgaacctct

SEQ ID NO: 258010 - DNA, 25 bp, Mus musculus
cgcccgggcctcaggaaccaatgac

SEQ ID NO: 258011 - DNA, 25 bp, Mus musculus
cgcccggggagagatactccatgtt

SEQ ID NO: 258012 - DNA, 25 bp, Mus musculus
cgcccgggtgtgggacttgtgtgag

SEQ ID NO: 258013 - DNA, 25 bp, Mus musculus
cgcccggttagcagcccttggcgat

SEQ ID NO: 258014 - DNA, 25 bp, Mus musculus
cgcccggttagcagctgccgccctt

SEQ ID NO: 258015 - DNA, 25 bp, Mus musculus
cgcccgtcacaagggcggtgacgaa

SEQ ID NO: 258016 - DNA, 25 bp, Mus musculus
cgcccgtcacaaggttgtcaggaac

SEQ ID NO: 258017 - DNA, 25 bp, Mus musculus
cgcccgttcacgatcctcagcgtac

SEQ ID NO: 258018 - DNA, 25 bp, Mus musculus
cgccctaagcaggtgagccctagat

SEQ ID NO: 258019 - DNA, 25 bp, Mus musculus
cgccctagagttgaggccggcgctg

SEQ ID NO: 258020 - DNA, 25 bp, Mus musculus
cgccctagccccagtcattgctgag

SEQ ID NO: 258021 - DNA, 25 bp, Mus musculus
cgccctagccccagtgtaagcttca

SEQ ID NO: 258022 - DNA, 25 bp, Mus musculus
cgccctataggaaatggaatttatc

SEQ ID NO: 258023 - DNA, 25 bp, Mus musculus
cgccctcaccaatgagctgagcaat

SEQ ID NO: 258024 - DNA, 25 bp, Mus musculus
cgccctcaccaatgcctctgcaggg

SEQ ID NO: 258025 - DNA, 25 bp, Mus musculus
cgccctcatgttatgaaatagaatg

SEQ ID NO: 258026 - DNA, 25 bp, Mus musculus
cgccctcctcagaaagcagtgcccc

SEQ ID NO: 258027 - DNA, 25 bp, Mus musculus
cgccctcctgcccaggtttgcacac

SEQ ID NO: 258028 - DNA, 25 bp, Mus musculus
cgccctctcaagctcagccttttct

SEQ ID NO: 258029 - DNA, 25 bp, Mus musculus
cgccctctgatgtgaaagagctggt

SEQ ID NO: 258030 - DNA, 25 bp, Mus musculus
cgccctgagctggacaagtgacgca

SEQ ID NO: 258031 - DNA, 25 bp, Mus musculus
cgccctgccaagattttcacctgac

SEQ ID NO: 258032 - DNA, 25 bp, Mus musculus
cgccctgccgggagccctgcaggcc

SEQ ID NO: 258033 - DNA, 25 bp, Mus musculus
cgccctgcggagagaggaccaaatg

SEQ ID NO: 258034 - DNA, 25 bp, Mus musculus
cgccctgcggagagggttcttgacc

SEQ ID NO: 258035 - DNA, 25 bp, Mus musculus
cgccctggacctgggctcccagagg

SEQ ID NO: 258036 - DNA, 25 bp, Mus musculus
cgccctggatgccttttacaactac

SEQ ID NO: 258037 - DNA, 25 bp, Mus musculus
cgccctggctctggaccctcttcta

SEQ ID NO: 258038 - DNA, 25 bp, Mus musculus
cgccctggtgaatggggtcagtggt

SEQ ID NO: 258039 - DNA, 25 bp, Mus musculus
cgccctggtggggttggtggctgtg

SEQ ID NO: 258040 - DNA, 25 bp, Mus musculus
cgccctggtgggtccaagtacagca

SEQ ID NO: 258041 - DNA, 25 bp, Mus musculus
cgccctgtccaaagatctcaccaca

SEQ ID NO: 258042 - DNA, 25 bp, Mus musculus
cgccctgtccaaaggaccatgacct

SEQ ID NO: 258043 - DNA, 25 bp, Mus musculus
cgccctgtccaaaggaggagacctt

SEQ ID NO: 258044 - DNA, 25 bp, Mus musculus
cgccctgtccaaaggcctcaatcta

SEQ ID NO: 258045 - DNA, 25 bp, Mus musculus
cgccctgtcccgaggacaagaagat

SEQ ID NO: 258046 - DNA, 25 bp, Mus musculus
cgcccttccaggtgactggttatcc

SEQ ID NO: 258047 - DNA, 25 bp, Mus musculus
cgcccttcctccgatggctacagat

SEQ ID NO: 258048 - DNA, 25 bp, Mus musculus
cgcccttgcctccggttcacgctaa

SEQ ID NO: 258049 - DNA, 25 bp, Mus musculus
cgcccttgctcctgcttgcttccca

SEQ ID NO: 258050 - DNA, 25 bp, Mus musculus
cgcccttgctcctggaggcagtgac

SEQ ID NO: 258051 - DNA, 25 bp, Mus musculus
cgcccttggcagaggttacaaaatg

SEQ ID NO: 258052 - DNA, 25 bp, Mus musculus
cgccctttgaacttatattggattt

SEQ ID NO: 258053 - DNA, 25 bp, Mus musculus
cgcccttttctgtagcgctggcgtg

SEQ ID NO: 258054 - DNA, 25 bp, Mus musculus
cgccgaaaagaaatggaagatagtg

SEQ ID NO: 258055 - DNA, 25 bp, Mus musculus
cgccgaaagaccagccaacaattct

SEQ ID NO: 258056 - DNA, 25 bp, Mus musculus
cgccgaacagcagcgggcggggacc

SEQ ID NO: 258057 - DNA, 25 bp, Mus musculus
cgccgaacaggatcgcaatagtcgg

SEQ ID NO: 258058 - DNA, 25 bp, Mus musculus
cgccgaacaggatcggatctaccgt

SEQ ID NO: 258059 - DNA, 25 bp, Mus musculus
cgccgaacaggatcggtctctccag

SEQ ID NO: 258060 - DNA, 25 bp, Mus musculus
cgccgaaggagcaggagccgctccc

SEQ ID NO: 258061 - DNA, 25 bp, Mus musculus
cgccgaagttacagacccactgtcc

SEQ ID NO: 258062 - DNA, 25 bp, Mus musculus
cgccgaagttacaggcccactgtcc

SEQ ID NO: 258063 - DNA, 25 bp, Mus musculus
cgccgacaggagctacgagaggttc

SEQ ID NO: 258064 - DNA, 25 bp, Mus musculus
cgccgacaggaggcgacccagtgga

SEQ ID NO: 258065 - DNA, 25 bp, Mus musculus
cgccgaccccgggatggcacaccat

SEQ ID NO: 258066 - DNA, 25 bp, Mus musculus
cgccgaccccgtgggctgttcatca

SEQ ID NO: 258067 - DNA, 25 bp, Mus musculus
cgccgacgaaatcgggaagctcttt

SEQ ID NO: 258068 - DNA, 25 bp, Mus musculus
cgccgagaagaaggaactcggagag

SEQ ID NO: 258069 - DNA, 25 bp, Mus musculus
cgccgagacgtgatggttaagatct

SEQ ID NO: 258070 - DNA, 25 bp, Mus musculus
cgccgagagcctggtgggcagcctg

SEQ ID NO: 258071 - DNA, 25 bp, Mus musculus
cgccgagcactagcgctggggacct

SEQ ID NO: 258072 - DNA, 25 bp, Mus musculus
cgccgagcagaacatgccggggtga

SEQ ID NO: 258073 - DNA, 25 bp, Mus musculus
cgccgagcagagaacggcaggctgt

SEQ ID NO: 258074 - DNA, 25 bp, Mus musculus
cgccgagcagcctgtagtgaaagtg

SEQ ID NO: 258075 - DNA, 25 bp, Mus musculus
cgccgagcaggaagttctgacgcct

SEQ ID NO: 258076 - DNA, 25 bp, Mus musculus
cgccgagccggcgctaactgggatc

SEQ ID NO: 258077 - DNA, 25 bp, Mus musculus
cgccgagcctcaccccgagcagggg

SEQ ID NO: 258078 - DNA, 25 bp, Mus musculus
cgccgagcctcacccgagcgcagac

SEQ ID NO: 258079 - DNA, 25 bp, Mus musculus
cgccgagcgccctcagttgagcccc

SEQ ID NO: 258080 - DNA, 25 bp, Mus musculus
cgccgagcggggcgaggtggcactt

SEQ ID NO: 258081 - DNA, 25 bp, Mus musculus
cgccgagcgggtcctcaggactcct

SEQ ID NO: 258082 - DNA, 25 bp, Mus musculus
cgccgagctggagaactacgatgac

SEQ ID NO: 258083 - DNA, 25 bp, Mus musculus
cgccgagctggaggtggggcctggc

SEQ ID NO: 258084 - DNA, 25 bp, Mus musculus
cgccgaggcccagcgatccctctgt

SEQ ID NO: 258085 - DNA, 25 bp, Mus musculus
cgccgaggcccaggtcagtctggac

SEQ ID NO: 258086 - DNA, 25 bp, Mus musculus
cgccgagtgcagagagcaaagacca

SEQ ID NO: 258087 - DNA, 25 bp, Mus musculus
cgccgataagcaccggcctctggaa

SEQ ID NO: 258088 - DNA, 25 bp, Mus musculus
cgccgatcaggttaaagatcgaggt

SEQ ID NO: 258089 - DNA, 25 bp, Mus musculus
cgccgatccggtaatatccttgttc

SEQ ID NO: 258090 - DNA, 25 bp, Mus musculus
cgccgatgatcttggttttgagttc

SEQ ID NO: 258091 - DNA, 25 bp, Mus musculus
cgccgatgtacgaggaccatcccac

SEQ ID NO: 258092 - DNA, 25 bp, Mus musculus
cgccgatgtacgagggaaggatcat

SEQ ID NO: 258093 - DNA, 25 bp, Mus musculus
cgccgattcgcccagagtttgggaa

SEQ ID NO: 258094 - DNA, 25 bp, Mus musculus
cgccgcaacagcagcttcgagagct

SEQ ID NO: 258095 - DNA, 25 bp, Mus musculus
cgccgcaacagcagggttctggctg

SEQ ID NO: 258096 - DNA, 25 bp, Mus musculus
cgccgcacagccgggttccatgatg

SEQ ID NO: 258097 - DNA, 25 bp, Mus musculus
cgccgcacagccggtgctggagact

SEQ ID NO: 258098 - DNA, 25 bp, Mus musculus
cgccgcacaggtcccacacagcagc

SEQ ID NO: 258099 - DNA, 25 bp, Mus musculus
cgccgcaggacggtgactgtcccag

SEQ ID NO: 258100 - DNA, 25 bp, Mus musculus
cgccgcaggcggaaagtatccatta

SEQ ID NO: 258101 - DNA, 25 bp, Mus musculus
cgccgcagtcgggccgccccacctt

SEQ ID NO: 258102 - DNA, 25 bp, Mus musculus
cgccgccaagaaacaggctcgcagc

SEQ ID NO: 258103 - DNA, 25 bp, Mus musculus
cgccgccaaggctgaagctgacgta

SEQ ID NO: 258104 - DNA, 25 bp, Mus musculus
cgccgccacagagttctgtccttgg

SEQ ID NO: 258105 - DNA, 25 bp, Mus musculus
cgccgccaccatgagcgatcagcag

SEQ ID NO: 258106 - DNA, 25 bp, Mus musculus
cgccgccagctcgtatgaaaatcca

SEQ ID NO: 258107 - DNA, 25 bp, Mus musculus
cgccgccagctgggtggctttgaca

SEQ ID NO: 258108 - DNA, 25 bp, Mus musculus
cgccgccagtgtcaggtcaattacc

SEQ ID NO: 258109 - DNA, 25 bp, Mus musculus
cgccgccagtttcccacttgtcaga

SEQ ID NO: 258110 - DNA, 25 bp, Mus musculus
cgccgccatgctcgtgggctccctg

SEQ ID NO: 258111 - DNA, 25 bp, Mus musculus
cgccgccatggagtcctccaccttc

SEQ ID NO: 258112 - DNA, 25 bp, Mus musculus
cgccgcccaggtaactatagtcctc

SEQ ID NO: 258113 - DNA, 25 bp, Mus musculus
cgccgcccaggttctgggaaattct

SEQ ID NO: 258114 - DNA, 25 bp, Mus musculus
cgccgccccactgaagggcagtgga

SEQ ID NO: 258115 - DNA, 25 bp, Mus musculus
cgccgccccctcaggagccaacatg

SEQ ID NO: 258116 - DNA, 25 bp, Mus musculus
cgccgcccgcagagctgtttggatt

SEQ ID NO: 258117 - DNA, 25 bp, Mus musculus
cgccgcccgcccggcaatgggaaat

SEQ ID NO: 258118 - DNA, 25 bp, Mus musculus
cgccgcccgcccggttatgtcattt

SEQ ID NO: 258119 - DNA, 25 bp, Mus musculus
cgccgcccggccggggaccaatctc

SEQ ID NO: 258120 - DNA, 25 bp, Mus musculus
cgccgccctccccactgcgtctctc

SEQ ID NO: 258121 - DNA, 25 bp, Mus musculus
cgccgccgagccggcgctaactggg

SEQ ID NO: 258122 - DNA, 25 bp, Mus musculus
cgccgccgagctggagaactacgat

SEQ ID NO: 258123 - DNA, 25 bp, Mus musculus
cgccgccgagctggaggtggggcct

SEQ ID NO: 258124 - DNA, 25 bp, Mus musculus
cgccgccgccgccgctttccaccca

SEQ ID NO: 258125 - DNA, 25 bp, Mus musculus
cgccgccgccgccggtgcataagta

SEQ ID NO: 258126 - DNA, 25 bp, Mus musculus
cgccgccgccgctttccacccactc

SEQ ID NO: 258127 - DNA, 25 bp, Mus musculus
cgccgccgccggtgcataagtaaag

SEQ ID NO: 258128 - DNA, 25 bp, Mus musculus
cgccgccggagcgacaggtgatttg

SEQ ID NO: 258129 - DNA, 25 bp, Mus musculus
cgccgccgggtcagacgcctcttcg

SEQ ID NO: 258130 - DNA, 25 bp, Mus musculus
cgccgccgtggaagagcagtatagc

SEQ ID NO: 258131 - DNA, 25 bp, Mus musculus
cgccgccgtggaagagtacagttgt

SEQ ID NO: 258132 - DNA, 25 bp, Mus musculus
cgccgcctcacgggccagcaggtgg

SEQ ID NO: 258133 - DNA, 25 bp, Mus musculus
cgccgcctccctcgctttttcctgc

SEQ ID NO: 258134 - DNA, 25 bp, Mus musculus
cgccgcctccctcgtccagtccact

SEQ ID NO: 258135 - DNA, 25 bp, Mus musculus
cgccgcctcgatgagcagctctcaa

SEQ ID NO: 258136 - DNA, 25 bp, Mus musculus
cgccgcctcgggagagaggaagcgg

SEQ ID NO: 258137 - DNA, 25 bp, Mus musculus
cgccgcctctctcggcatcctacat

SEQ ID NO: 258138 - DNA, 25 bp, Mus musculus
cgccgcctgatcaagatgacagcat

SEQ ID NO: 258139 - DNA, 25 bp, Mus musculus
cgccgcctgatcaagttctcctact

SEQ ID NO: 258140 - DNA, 25 bp, Mus musculus
cgccgccttggggcatcatgacacc

SEQ ID NO: 258141 - DNA, 25 bp, Mus musculus
cgccgcgagtaagaccacaggatgg

SEQ ID NO: 258142 - DNA, 25 bp, Mus musculus
cgccgcgagtaagactcccttgtat

SEQ ID NO: 258143 - DNA, 25 bp, Mus musculus
cgccgcgagtaagggcgaatcgcca

SEQ ID NO: 258144 - DNA, 25 bp, Mus musculus
cgccgcgcagactgggaagagtgtg

SEQ ID NO: 258145 - DNA, 25 bp, Mus musculus
cgccgcgcaggatctaccaaggcca

SEQ ID NO: 258146 - DNA, 25 bp, Mus musculus
cgccgcgcgcgttccagggctccgg

SEQ ID NO: 258147 - DNA, 25 bp, Mus musculus
cgccgcgcttcagggcaactattga

SEQ ID NO: 258148 - DNA, 25 bp, Mus musculus
cgccgcggagcaggcatggagagta

SEQ ID NO: 258149 - DNA, 25 bp, Mus musculus
cgccgcggaggtctttggccagtat

SEQ ID NO: 258150 - DNA, 25 bp, Mus musculus
cgccgcggcagccactaagccccag

SEQ ID NO: 258151 - DNA, 25 bp, Mus musculus
cgccgcggcagccagtcccgctcgg

SEQ ID NO: 258152 - DNA, 25 bp, Mus musculus
cgccgcggcagccgctttcactata

SEQ ID NO: 258153 - DNA, 25 bp, Mus musculus
cgccgcggcccagaattgtaaaacc

SEQ ID NO: 258154 - DNA, 25 bp, Mus musculus
cgccgcggcccaggttaaatggaat

SEQ ID NO: 258155 - DNA, 25 bp, Mus musculus
cgccgcggccccccttcacgctcga

SEQ ID NO: 258156 - DNA, 25 bp, Mus musculus
cgccgcgtctggtgacttctgtgac

SEQ ID NO: 258157 - DNA, 25 bp, Mus musculus
cgccgcgtgcgcaagggtgaaaaat

SEQ ID NO: 258158 - DNA, 25 bp, Mus musculus
cgccgcgtgcgcaaggtacgtggga

SEQ ID NO: 258159 - DNA, 25 bp, Mus musculus
cgccgcgtggacacccttcatggcg

SEQ ID NO: 258160 - DNA, 25 bp, Mus musculus
cgccgctaccggcagatcaccatcc

SEQ ID NO: 258161 - DNA, 25 bp, Mus musculus
cgccgctacctcaagctgagggcag

SEQ ID NO: 258162 - DNA, 25 bp, Mus musculus
cgccgctacctcaaggagctgagca

SEQ ID NO: 258163 - DNA, 25 bp, Mus musculus
cgccgctccgatccctacgtgaaaa

SEQ ID NO: 258164 - DNA, 25 bp, Mus musculus
cgccgctcgaagtcgctaggacttc

SEQ ID NO: 258165 - DNA, 25 bp, Mus musculus
cgccgctctcagaacccaggaagct

SEQ ID NO: 258166 - DNA, 25 bp, Mus musculus
cgccgctctcaggtcaaatctaagt

SEQ ID NO: 258167 - DNA, 25 bp, Mus musculus
cgccgctgagcgccggagtactgga

SEQ ID NO: 258168 - DNA, 25 bp, Mus musculus
cgccgctgcagcatggtttattgaa

SEQ ID NO: 258169 - DNA, 25 bp, Mus musculus
cgccgctgcatccccagtccatcta

SEQ ID NO: 258170 - DNA, 25 bp, Mus musculus
cgccgctgccggagattggcagact

SEQ ID NO: 258171 - DNA, 25 bp, Mus musculus
cgccgctgcgagtggccgccccacc

SEQ ID NO: 258172 - DNA, 25 bp, Mus musculus
cgccgctgcggttctccagaccagc

SEQ ID NO: 258173 - DNA, 25 bp, Mus musculus
cgccgctgtacgcagttttacagag

SEQ ID NO: 258174 - DNA, 25 bp, Mus musculus
cgccgctgtgaggtacagtcatgtc

SEQ ID NO: 258175 - DNA, 25 bp, Mus musculus
cgccgcttggatggggtattgacaa

SEQ ID NO: 258176 - DNA, 25 bp, Mus musculus
cgccgctttccctcagcagacacgc

SEQ ID NO: 258177 - DNA, 25 bp, Mus musculus
cgccggaaagagacacagcagtccg

SEQ ID NO: 258178 - DNA, 25 bp, Mus musculus
cgccggaagatgatgccagaccagt

SEQ ID NO: 258179 - DNA, 25 bp, Mus musculus
cgccggaagtgaagcccctgcccgg

SEQ ID NO: 258180 - DNA, 25 bp, Mus musculus
cgccggagcagggtccccagaagca

SEQ ID NO: 258181 - DNA, 25 bp, Mus musculus
cgccggagcgacaggtgatttggct

SEQ ID NO: 258182 - DNA, 25 bp, Mus musculus
cgccggagctatgtttcgaaaccag

SEQ ID NO: 258183 - DNA, 25 bp, Mus musculus
cgccggagctcagagaaagcagaag

SEQ ID NO: 258184 - DNA, 25 bp, Mus musculus
cgccggagctcagaggtgttttcta

SEQ ID NO: 258185 - DNA, 25 bp, Mus musculus
cgccggagctcagaggttgactctt

SEQ ID NO: 258186 - DNA, 25 bp, Mus musculus
cgccggagctgttttatgaccagaa

SEQ ID NO: 258187 - DNA, 25 bp, Mus musculus
cgccggccacggcccggacacagag

SEQ ID NO: 258188 - DNA, 25 bp, Mus musculus
cgccggccagccagataagtacggt

SEQ ID NO: 258189 - DNA, 25 bp, Mus musculus
cgccggcccgtgtggatctgcagca

SEQ ID NO: 258190 - DNA, 25 bp, Mus musculus
cgccggccgccgtccccagtgacct

SEQ ID NO: 258191 - DNA, 25 bp, Mus musculus
cgccggccgttgtgaacagaccctg

SEQ ID NO: 258192 - DNA, 25 bp, Mus musculus
cgccggccgttgtgctcccatgtgt

SEQ ID NO: 258193 - DNA, 25 bp, Mus musculus
cgccggccgttgtgggcaataccct

SEQ ID NO: 258194 - DNA, 25 bp, Mus musculus
cgccggcctgcgcaggaatcttggg

SEQ ID NO: 258195 - DNA, 25 bp, Mus musculus
cgccggcggaggacccagcccccag

SEQ ID NO: 258196 - DNA, 25 bp, Mus musculus
cgccggcgtcgcacccctctctacc

SEQ ID NO: 258197 - DNA, 25 bp, Mus musculus
cgccggcgtcggcctttcttttctc

SEQ ID NO: 258198 - DNA, 25 bp, Mus musculus
cgccggctcgctaagccacactcat

SEQ ID NO: 258199 - DNA, 25 bp, Mus musculus
cgccggctcgctaagccggctgccc

SEQ ID NO: 258200 - DNA, 25 bp, Mus musculus
cgccggcttccaggtaccaatgggg

SEQ ID NO: 258201 - DNA, 25 bp, Mus musculus
cgccggcttggtgcctgttccggag

SEQ ID NO: 258202 - DNA, 25 bp, Mus musculus
cgccgggaaaggtaatgatgtgggc

SEQ ID NO: 258203 - DNA, 25 bp, Mus musculus
cgccgggaagagctggcatttcagt

SEQ ID NO: 258204 - DNA, 25 bp, Mus musculus
cgccgggaccgacgccacagggcct

SEQ ID NO: 258205 - DNA, 25 bp, Mus musculus
cgccgggactcggggctgagcagca

SEQ ID NO: 258206 - DNA, 25 bp, Mus musculus
cgccgggactcgggggacaggcacg

SEQ ID NO: 258207 - DNA, 25 bp, Mus musculus
cgccgggagccggcaggcatgcccc

SEQ ID NO: 258208 - DNA, 25 bp, Mus musculus
cgccgggaggtccggatgctgttga

SEQ ID NO: 258209 - DNA, 25 bp, Mus musculus
cgccgggagtcgattttaggtgatg

SEQ ID NO: 258210 - DNA, 25 bp, Mus musculus
cgccgggatacacgggacctcactg

SEQ ID NO: 258211 - DNA, 25 bp, Mus musculus
cgccgggcacctggtccgggccatc

SEQ ID NO: 258212 - DNA, 25 bp, Mus musculus
cgccgggcccatggaatccaaaact

SEQ ID NO: 258213 - DNA, 25 bp, Mus musculus
cgccgggccgcagtgcctggtgaag

SEQ ID NO: 258214 - DNA, 25 bp, Mus musculus
cgccgggccgcccaacaagatagct

SEQ ID NO: 258215 - DNA, 25 bp, Mus musculus
cgccgggcctcaggcctcagcattt

SEQ ID NO: 258216 - DNA, 25 bp, Mus musculus
cgccgggcctcagtcttatgacctg

SEQ ID NO: 258217 - DNA, 25 bp, Mus musculus
cgccggggcaaggtctgttcactag

SEQ ID NO: 258218 - DNA, 25 bp, Mus musculus
cgccgggggaagagtacacacgaag

SEQ ID NO: 258219 - DNA, 25 bp, Mus musculus
cgccggggtgacggtggtcaacatg

SEQ ID NO: 258220 - DNA, 25 bp, Mus musculus
cgccgggtcagacgcctcttcgccc

SEQ ID NO: 258221 - DNA, 25 bp, Mus musculus
cgccggtgacagacgatactgtatc

SEQ ID NO: 258222 - DNA, 25 bp, Mus musculus
cgccggtgcagccagatggagtggc

SEQ ID NO: 258223 - DNA, 25 bp, Mus musculus
cgccggtgctgagttaatatttgcc

SEQ ID NO: 258224 - DNA, 25 bp, Mus musculus
cgccggtggagggtcaggatggctg

SEQ ID NO: 258225 - DNA, 25 bp, Mus musculus
cgccggtggagggtgtcccctgcac

SEQ ID NO: 258226 - DNA, 25 bp, Mus musculus
cgccggtggaggtcgactggccagg

SEQ ID NO: 258227 - DNA, 25 bp, Mus musculus
cgccgtcaggatctggaagttggag

SEQ ID NO: 258228 - DNA, 25 bp, Mus musculus
cgccgtcagtctcggcgtggaaagg

SEQ ID NO: 258229 - DNA, 25 bp, Mus musculus
cgccgtcatctgcaaagcagaagca

SEQ ID NO: 258230 - DNA, 25 bp, Mus musculus
cgccgtcatctgctatagacataga

SEQ ID NO: 258231 - DNA, 25 bp, Mus musculus
cgccgtccaagaggccattgtgagc

SEQ ID NO: 258232 - DNA, 25 bp, Mus musculus
cgccgtccagggagtgaagccaaga

SEQ ID NO: 258233 - DNA, 25 bp, Mus musculus
cgccgtctacagaaaacaagcacga

SEQ ID NO: 258234 - DNA, 25 bp, Mus musculus
cgccgtctctggcaggcactgtaac

SEQ ID NO: 258235 - DNA, 25 bp, Mus musculus
cgccgtgagagagtacatcggcatc

SEQ ID NO: 258236 - DNA, 25 bp, Mus musculus
cgccgtgcagaagaatgccaccagt

SEQ ID NO: 258237 - DNA, 25 bp, Mus musculus
cgccgtgcccgtggtgtgccccctc

SEQ ID NO: 258238 - DNA, 25 bp, Mus musculus
cgccgtgccgcgggagaggaaaagc

SEQ ID NO: 258239 - DNA, 25 bp, Mus musculus
cgccgtgccgcgggtgtgccaggag

SEQ ID NO: 258240 - DNA, 25 bp, Mus musculus
cgccgtgcggggagcagcaatgaat

SEQ ID NO: 258241 - DNA, 25 bp, Mus musculus
cgccgtgcggggatagctgccccag

SEQ ID NO: 258242 - DNA, 25 bp, Mus musculus
cgccgtggaagaaaccctgatggac

SEQ ID NO: 258243 - DNA, 25 bp, Mus musculus
cgccgtggaagagcagtatagctgt

SEQ ID NO: 258244 - DNA, 25 bp, Mus musculus
cgccgtggaagagtacagttgtgaa

SEQ ID NO: 258245 - DNA, 25 bp, Mus musculus
cgccgtggacgaggtgtccacagaa

SEQ ID NO: 258246 - DNA, 25 bp, Mus musculus
cgccgtgggatctagacgaggacct

SEQ ID NO: 258247 - DNA, 25 bp, Mus musculus
cgccgtgggatctaggacgctgcat

SEQ ID NO: 258248 - DNA, 25 bp, Mus musculus
cgccgtggggctgcagcagcctcac

SEQ ID NO: 258249 - DNA, 25 bp, Mus musculus
cgccgtggtctgggtcaggccctgc

SEQ ID NO: 258250 - DNA, 25 bp, Mus musculus
cgccgttcattttcaaaagaaacag

SEQ ID NO: 258251 - DNA, 25 bp, Mus musculus
cgccgttccctttgcatcactggct

SEQ ID NO: 258252 - DNA, 25 bp, Mus musculus
cgcctaaaaaaggtctgtgcaccac

SEQ ID NO: 258253 - DNA, 25 bp, Mus musculus
cgcctacaacagccggagagacctg

SEQ ID NO: 258254 - DNA, 25 bp, Mus musculus
cgcctaccctgggagtttttcgtag

SEQ ID NO: 258255 - DNA, 25 bp, Mus musculus
cgcctacctctggatcgctcctttg

SEQ ID NO: 258256 - DNA, 25 bp, Mus musculus
cgcctacgaagccgatttttgggaa

SEQ ID NO: 258257 - DNA, 25 bp, Mus musculus
cgcctacgaagccgtgacactgatg

SEQ ID NO: 258258 - DNA, 25 bp, Mus musculus
cgcctacgccgcctatgtattgtat

SEQ ID NO: 258259 - DNA, 25 bp, Mus musculus
cgcctacgccgcctctgtttggggc

SEQ ID NO: 258260 - DNA, 25 bp, Mus musculus
cgcctacgtggcctataacattcac

SEQ ID NO: 258261 - DNA, 25 bp, Mus musculus
cgcctactcagggctaacatcaggg

SEQ ID NO: 258262 - DNA, 25 bp, Mus musculus
cgcctactctatcgctgcaggtgtg

SEQ ID NO: 258263 - DNA, 25 bp, Mus musculus
cgcctactctatgtgtgctcatctg

SEQ ID NO: 258264 - DNA, 25 bp, Mus musculus
cgcctactgcagtcagctggccgct

SEQ ID NO: 258265 - DNA, 25 bp, Mus musculus
cgcctactgccagcggactcagagg

SEQ ID NO: 258266 - DNA, 25 bp, Mus musculus
cgcctactgccaggctccggtcgaa

SEQ ID NO: 258267 - DNA, 25 bp, Mus musculus
cgcctactggaggaatgctgggacc

SEQ ID NO: 258268 - DNA, 25 bp, Mus musculus
cgcctacttcgggctaacaggcagt

SEQ ID NO: 258269 - DNA, 25 bp, Mus musculus
cgcctagaaaaagaattcttgaagt

SEQ ID NO: 258270 - DNA, 25 bp, Mus musculus
cgcctagagggcagagacaatgaat

SEQ ID NO: 258271 - DNA, 25 bp, Mus musculus
cgcctagcaggaactgtctaccttg

SEQ ID NO: 258272 - DNA, 25 bp, Mus musculus
cgcctagcagtttgttttgtttagg

SEQ ID NO: 258273 - DNA, 25 bp, Mus musculus
cgcctaggcgggaggtgtttctgtt

SEQ ID NO: 258274 - DNA, 25 bp, Mus musculus
cgcctagttgaaggaatttgacaag

SEQ ID NO: 258275 - DNA, 25 bp, Mus musculus
cgcctatcaccagctcctcaggtta

SEQ ID NO: 258276 - DNA, 25 bp, Mus musculus
cgcctatcaccagttatcctacctt

SEQ ID NO: 258277 - DNA, 25 bp, Mus musculus
cgcctatcagtgagtaccgtggcct

SEQ ID NO: 258278 - DNA, 25 bp, Mus musculus
cgcctatgatgggaagattaaagtc

SEQ ID NO: 258279 - DNA, 25 bp, Mus musculus
cgcctattctacaagcatggcctga

SEQ ID NO: 258280 - DNA, 25 bp, Mus musculus
cgcctattgtggcaagtggtttgtg

SEQ ID NO: 258281 - DNA, 25 bp, Mus musculus
cgcctatttcaagataaacaagctg

SEQ ID NO: 258282 - DNA, 25 bp, Mus musculus
cgcctatttgggtggggagaagaga

SEQ ID NO: 258283 - DNA, 25 bp, Mus musculus
cgcctcaaaaccaaaaatcctgact

SEQ ID NO: 258284 - DNA, 25 bp, Mus musculus
cgcctcaaaaccaagtcactccttg

SEQ ID NO: 258285 - DNA, 25 bp, Mus musculus
cgcctcaaacacatccacttcagca

SEQ ID NO: 258286 - DNA, 25 bp, Mus musculus
cgcctcaaacacatgtgactctcct

SEQ ID NO: 258287 - DNA, 25 bp, Mus musculus
cgcctcaacacccatgtgaagcctt

SEQ ID NO: 258288 - DNA, 25 bp, Mus musculus
cgcctcacaggaacaaaaagtttcc

SEQ ID NO: 258289 - DNA, 25 bp, Mus musculus
cgcctcacgggccagcaggtggcca

SEQ ID NO: 258290 - DNA, 25 bp, Mus musculus
cgcctcactggaatcccagctggct

SEQ ID NO: 258291 - DNA, 25 bp, Mus musculus
cgcctcagagaacttctgcagccga

SEQ ID NO: 258292 - DNA, 25 bp, Mus musculus
cgcctcagagatactacggaggagc

SEQ ID NO: 258293 - DNA, 25 bp, Mus musculus
cgcctcagaggtcgagcccagtgac

SEQ ID NO: 258294 - DNA, 25 bp, Mus musculus
cgcctcagaggtggcatgcagatct

SEQ ID NO: 258295 - DNA, 25 bp, Mus musculus
cgcctcagaggtttaaacgcatctc

SEQ ID NO: 258296 - DNA, 25 bp, Mus musculus
cgcctcagagtgtgttcagttccct

SEQ ID NO: 258297 - DNA, 25 bp, Mus musculus
cgcctcagagttccctggcagctca

SEQ ID NO: 258298 - DNA, 25 bp, Mus musculus
cgcctcagcagaacaaaccaaagaa

SEQ ID NO: 258299 - DNA, 25 bp, Mus musculus
cgcctcagctgcacactgccccatt

SEQ ID NO: 258300 - DNA, 25 bp, Mus musculus
cgcctcatcgggggcacagagatgg

SEQ ID NO: 258301 - DNA, 25 bp, Mus musculus
cgcctcatcgtggattactcctgcg

SEQ ID NO: 258302 - DNA, 25 bp, Mus musculus
cgcctcatcttcttcctgacagcta

SEQ ID NO: 258303 - DNA, 25 bp, Mus musculus
cgcctccaaaagccggaaggagaag

SEQ ID NO: 258304 - DNA, 25 bp, Mus musculus
cgcctccaaaagccggtgaagatcg

SEQ ID NO: 258305 - DNA, 25 bp, Mus musculus
cgcctccacggcggtgcaagttgct

SEQ ID NO: 258306 - DNA, 25 bp, Mus musculus
cgcctccacggcggtgcctggagag

SEQ ID NO: 258307 - DNA, 25 bp, Mus musculus
cgcctccacggggtttgacttcatg

SEQ ID NO: 258308 - DNA, 25 bp, Mus musculus
cgcctccagatctggggttggtgtc

SEQ ID NO: 258309 - DNA, 25 bp, Mus musculus
cgcctccatcgtgagacataggagg

SEQ ID NO: 258310 - DNA, 25 bp, Mus musculus
cgcctccatcgtgaggaactatgaa

SEQ ID NO: 258311 - DNA, 25 bp, Mus musculus
cgcctccatcgtgaggtagttgaaa

SEQ ID NO: 258312 - DNA, 25 bp, Mus musculus
cgcctcccaaggaaggagtctatga

SEQ ID NO: 258313 - DNA, 25 bp, Mus musculus
cgcctcccaaggaagttcatgttct

SEQ ID NO: 258314 - DNA, 25 bp, Mus musculus
cgcctcccaaggttacactgtggct

SEQ ID NO: 258315 - DNA, 25 bp, Mus musculus
cgcctcccccggcccacaatgtcct

SEQ ID NO: 258316 - DNA, 25 bp, Mus musculus
cgcctccccgatcccgcccggagtg

SEQ ID NO: 258317 - DNA, 25 bp, Mus musculus
cgcctccctcgctttttcctgcaat

SEQ ID NO: 258318 - DNA, 25 bp, Mus musculus
cgcctccctcgtccagtccactagc

SEQ ID NO: 258319 - DNA, 25 bp, Mus musculus
cgcctccgccccagaaaaaggagaa

SEQ ID NO: 258320 - DNA, 25 bp, Mus musculus
cgcctcctcagtatcaggcacccag

SEQ ID NO: 258321 - DNA, 25 bp, Mus musculus
cgcctcctccgagcctgaagctacc

SEQ ID NO: 258322 - DNA, 25 bp, Mus musculus
cgcctcctcgcggcattggaggcgg

SEQ ID NO: 258323 - DNA, 25 bp, Mus musculus
cgcctcctgatacaggagttccact

SEQ ID NO: 258324 - DNA, 25 bp, Mus musculus
cgcctcgcagggctcaacatatgca

SEQ ID NO: 258325 - DNA, 25 bp, Mus musculus
cgcctcgccaccagtcaactcctag

SEQ ID NO: 258326 - DNA, 25 bp, Mus musculus
cgcctcgccaccagtgctgaggatc

SEQ ID NO: 258327 - DNA, 25 bp, Mus musculus
cgcctcgccaccagttaaaaagtat

SEQ ID NO: 258328 - DNA, 25 bp, Mus musculus
cgcctcgctggccagatcttccttg

SEQ ID NO: 258329 - DNA, 25 bp, Mus musculus
cgcctcgctgggcagatcttccttg

SEQ ID NO: 258330 - DNA, 25 bp, Mus musculus
cgcctcggccgtggtaagggaacaa

SEQ ID NO: 258331 - DNA, 25 bp, Mus musculus
cgcctcggcgtacaggagaatgact

SEQ ID NO: 258332 - DNA, 25 bp, Mus musculus
cgcctcgggagagaggaagcgggag

SEQ ID NO: 258333 - DNA, 25 bp, Mus musculus
cgcctctacctaacaccccaattcc

SEQ ID NO: 258334 - DNA, 25 bp, Mus musculus
cgcctctacctctttctagtaacaa

SEQ ID NO: 258335 - DNA, 25 bp, Mus musculus
cgcctctactccaggatggaggcct

SEQ ID NO: 258336 - DNA, 25 bp, Mus musculus
cgcctctagctgactggtgagcacc

SEQ ID NO: 258337 - DNA, 25 bp, Mus musculus
cgcctctatgggtcgcgggtctact

SEQ ID NO: 258338 - DNA, 25 bp, Mus musculus
cgcctctatgggtcggttccgggag

SEQ ID NO: 258339 - DNA, 25 bp, Mus musculus
cgcctctcagtgctcaggagctgtc

SEQ ID NO: 258340 - DNA, 25 bp, Mus musculus
cgcctctcatggtcgctgtcttaaa

SEQ ID NO: 258341 - DNA, 25 bp, Mus musculus
cgcctctcgcagagttcgaggaggg

SEQ ID NO: 258342 - DNA, 25 bp, Mus musculus
cgcctctcggggctgctcttctcgg

SEQ ID NO: 258343 - DNA, 25 bp, Mus musculus
cgcctctctcggcatcctacatcaa

SEQ ID NO: 258344 - DNA, 25 bp, Mus musculus
cgcctctgacggggcatatctgctg

SEQ ID NO: 258345 - DNA, 25 bp, Mus musculus
cgcctctgactacccgtgatactta

SEQ ID NO: 258346 - DNA, 25 bp, Mus musculus
cgcctctgactgtccctggccacat

SEQ ID NO: 258347 - DNA, 25 bp, Mus musculus
cgcctctgatgctgagcccaggaag

SEQ ID NO: 258348 - DNA, 25 bp, Mus musculus
cgcctctgctcagcctgaaggactt

SEQ ID NO: 258349 - DNA, 25 bp, Mus musculus
cgcctctggaccaacggtcccattg

SEQ ID NO: 258350 - DNA, 25 bp, Mus musculus
cgcctctggaggaaagagccagact

SEQ ID NO: 258351 - DNA, 25 bp, Mus musculus
cgcctctggaggctccatctccatt

SEQ ID NO: 258352 - DNA, 25 bp, Mus musculus
cgcctctgtgtggagaaatctgacg

SEQ ID NO: 258353 - DNA, 25 bp, Mus musculus
cgcctcttaagggagatcgccacga

SEQ ID NO: 258354 - DNA, 25 bp, Mus musculus
cgcctcttgaagaagtttcctgtgg

SEQ ID NO: 258355 - DNA, 25 bp, Mus musculus
cgcctgaacggctccaggactggga

SEQ ID NO: 258356 - DNA, 25 bp, Mus musculus
cgcctgaagaggacatggatgacac

SEQ ID NO: 258357 - DNA, 25 bp, Mus musculus
cgcctgaagctaagctcccttcgaa

SEQ ID NO: 258358 - DNA, 25 bp, Mus musculus
cgcctgaagggaatactaagatgct

SEQ ID NO: 258359 - DNA, 25 bp, Mus musculus
cgcctgacattatcctggatgactt

SEQ ID NO: 258360 - DNA, 25 bp, Mus musculus
cgcctgaccatcaagctgacccctg

SEQ ID NO: 258361 - DNA, 25 bp, Mus musculus
cgcctgaccccagaagtagaaatcc

SEQ ID NO: 258362 - DNA, 25 bp, Mus musculus
cgcctgaccccagcccagccagtgg

SEQ ID NO: 258363 - DNA, 25 bp, Mus musculus
cgcctgacggagcaggcctgtctcg

SEQ ID NO: 258364 - DNA, 25 bp, Mus musculus
cgcctgagctaggattggtagctta

SEQ ID NO: 258365 - DNA, 25 bp, Mus musculus
cgcctgagtacagacgtgacttgta

SEQ ID NO: 258366 - DNA, 25 bp, Mus musculus
cgcctgatcaagatgacagcatgga

SEQ ID NO: 258367 - DNA, 25 bp, Mus musculus
cgcctgatcaagttctcctactcag

SEQ ID NO: 258368 - DNA, 25 bp, Mus musculus
cgcctgatctccaactaggcggccg

SEQ ID NO: 258369 - DNA, 25 bp, Mus musculus
cgcctgcaaggttcctgctgctgtc

SEQ ID NO: 258370 - DNA, 25 bp, Mus musculus
cgcctgcaagtgtctcactttacag

SEQ ID NO: 258371 - DNA, 25 bp, Mus musculus
cgcctgcagcaggaattggggaatt

SEQ ID NO: 258372 - DNA, 25 bp, Mus musculus
cgcctgcatcatggtatttgatgtc

SEQ ID NO: 258373 - DNA, 25 bp, Mus musculus
cgcctgcatcgagggagtagaactg

SEQ ID NO: 258374 - DNA, 25 bp, Mus musculus
cgcctgccccgaaatcacactgtgg

SEQ ID NO: 258375 - DNA, 25 bp, Mus musculus
cgcctgccccgccaaatgcagagaa

SEQ ID NO: 258376 - DNA, 25 bp, Mus musculus
cgcctgccgcaacgatgggaagctc

SEQ ID NO: 258377 - DNA, 25 bp, Mus musculus
cgcctgccgcggaatcatggcccaa

SEQ ID NO: 258378 - DNA, 25 bp, Mus musculus
cgcctgccggctgaggagaaacaac

SEQ ID NO: 258379 - DNA, 25 bp, Mus musculus
cgcctgcctggggaatgaattccac

SEQ ID NO: 258380 - DNA, 25 bp, Mus musculus
cgcctgcgcggcggcgggcaccatc

SEQ ID NO: 258381 - DNA, 25 bp, Mus musculus
cgcctgcgcggcggctggtttcctc

SEQ ID NO: 258382 - DNA, 25 bp, Mus musculus
cgcctgcgcggctggccagctaagc

SEQ ID NO: 258383 - DNA, 25 bp, Mus musculus
cgcctgcgcgtcacgccttggccca

SEQ ID NO: 258384 - DNA, 25 bp, Mus musculus
cgcctgcgggcgcggattgtgcctt

SEQ ID NO: 258385 - DNA, 25 bp, Mus musculus
cgcctgcgggggagttttacagaga

SEQ ID NO: 258386 - DNA, 25 bp, Mus musculus
cgcctgcggttaagtgagcaaacca

SEQ ID NO: 258387 - DNA, 25 bp, Mus musculus
cgcctgcgtgacgtgtcacgatgtc

SEQ ID NO: 258388 - DNA, 25 bp, Mus musculus
cgcctgctccagacgtcttgagagc

SEQ ID NO: 258389 - DNA, 25 bp, Mus musculus
cgcctgctcggtcagtcagcagtgt

SEQ ID NO: 258390 - DNA, 25 bp, Mus musculus
cgcctgctcgtgtgtataagctgcg

SEQ ID NO: 258391 - DNA, 25 bp, Mus musculus
cgcctgctgcagctggacccaacat

SEQ ID NO: 258392 - DNA, 25 bp, Mus musculus
cgcctgctgctgatgcgtcgagccc

SEQ ID NO: 258393 - DNA, 25 bp, Mus musculus
cgcctgctgctgatggatgtcgtgg

SEQ ID NO: 258394 - DNA, 25 bp, Mus musculus
cgcctgctggacagcgtgctggaag

SEQ ID NO: 258395 - DNA, 25 bp, Mus musculus
cgcctgctggagctgctattgttga

SEQ ID NO: 258396 - DNA, 25 bp, Mus musculus
cgcctgctggaggtacgaggatgtc

SEQ ID NO: 258397 - DNA, 25 bp, Mus musculus
cgcctgctgggaaagtccagatagt

SEQ ID NO: 258398 - DNA, 25 bp, Mus musculus
cgcctggaaaagctgctaaagctgg

SEQ ID NO: 258399 - DNA, 25 bp, Mus musculus
cgcctggaaagccaggaataagatg

SEQ ID NO: 258400 - DNA, 25 bp, Mus musculus
cgcctggaaagccaggacgttaaag

SEQ ID NO: 258401 - DNA, 25 bp, Mus musculus
cgcctggaacagctggaagagaaga

SEQ ID NO: 258402 - DNA, 25 bp, Mus musculus
cgcctggagagaggagcaccgtgag

SEQ ID NO: 258403 - DNA, 25 bp, Mus musculus
cgcctggagccgaaatcatgtccac

SEQ ID NO: 258404 - DNA, 25 bp, Mus musculus
cgcctggaggatgggctaggaaatc

SEQ ID NO: 258405 - DNA, 25 bp, Mus musculus
cgcctggccaggatccattttctca

SEQ ID NO: 258406 - DNA, 25 bp, Mus musculus
cgcctggccaggtctggcatattct

SEQ ID NO: 258407 - DNA, 25 bp, Mus musculus
cgcctggccagtgatcttctagagt

SEQ ID NO: 258408 - DNA, 25 bp, Mus musculus
cgcctggccataggcttcttccctg

SEQ ID NO: 258409 - DNA, 25 bp, Mus musculus
cgcctggcctccggataaagataga

SEQ ID NO: 258410 - DNA, 25 bp, Mus musculus
cgcctggcctccgggtttgtattga

SEQ ID NO: 258411 - DNA, 25 bp, Mus musculus
cgcctggcctgcttgaaatggaatt

SEQ ID NO: 258412 - DNA, 25 bp, Mus musculus
cgcctgggagagagggttgaaaact

SEQ ID NO: 258413 - DNA, 25 bp, Mus musculus
cgcctgggcagggatccctgctgcc

SEQ ID NO: 258414 - DNA, 25 bp, Mus musculus
cgcctggtactggagcagagggtcc

SEQ ID NO: 258415 - DNA, 25 bp, Mus musculus
cgcctggtagcccaggcaagcgctt

SEQ ID NO: 258416 - DNA, 25 bp, Mus musculus
cgcctggtcttcagagtggaattgg

SEQ ID NO: 258417 - DNA, 25 bp, Mus musculus
cgcctggtcttgagggccgagtggt

SEQ ID NO: 258418 - DNA, 25 bp, Mus musculus
cgcctggtcttgtgggccgagtggt

SEQ ID NO: 258419 - DNA, 25 bp, Mus musculus
cgcctggtgatccctgcagacggct

SEQ ID NO: 258420 - DNA, 25 bp, Mus musculus
cgcctgtcgcaggctgttgattcag

SEQ ID NO: 258421 - DNA, 25 bp, Mus musculus
cgcctgtcgcagggagcttatgggg

SEQ ID NO: 258422 - DNA, 25 bp, Mus musculus
cgcctgtgaagcgagcgcagcaatc

SEQ ID NO: 258423 - DNA, 25 bp, Mus musculus
cgcctgtgaagcgcctcagtgggct

SEQ ID NO: 258424 - DNA, 25 bp, Mus musculus
cgcctgtgaggtctgtgcattttcc

SEQ ID NO: 258425 - DNA, 25 bp, Mus musculus
cgcctgtgtcaggagcatatgcagg

SEQ ID NO: 258426 - DNA, 25 bp, Mus musculus
cgcctgtttagaagtaacagcctcc

SEQ ID NO: 258427 - DNA, 25 bp, Mus musculus
cgccttcaccagggatgactctgtt

SEQ ID NO: 258428 - DNA, 25 bp, Mus musculus
cgccttcagcctcagaaccgcaaat

SEQ ID NO: 258429 - DNA, 25 bp, Mus musculus
cgccttcagcctcagcccagcgtaa

SEQ ID NO: 258430 - DNA, 25 bp, Mus musculus
cgccttcagcctcaggttatgaaaa

SEQ ID NO: 258431 - DNA, 25 bp, Mus musculus
cgccttcagcctcagtggtgaccca

SEQ ID NO: 258432 - DNA, 25 bp, Mus musculus
cgccttcaggaaggcagcctcctat

SEQ ID NO: 258433 - DNA, 25 bp, Mus musculus
cgccttcaggaggaggacttactgt

SEQ ID NO: 258434 - DNA, 25 bp, Mus musculus
cgccttcaggaggaggtggcaaacc

SEQ ID NO: 258435 - DNA, 25 bp, Mus musculus
cgccttccaagagttttcttggagg

SEQ ID NO: 258436 - DNA, 25 bp, Mus musculus
cgccttccagaacagggaaaggcag

SEQ ID NO: 258437 - DNA, 25 bp, Mus musculus
cgccttcccgaactacgctgccatg

SEQ ID NO: 258438 - DNA, 25 bp, Mus musculus
cgccttccctcaggacatcaatgca

SEQ ID NO: 258439 - DNA, 25 bp, Mus musculus
cgccttccctcaggtgtcagatccc

SEQ ID NO: 258440 - DNA, 25 bp, Mus musculus
cgccttccgcctggggtgactgtcc

SEQ ID NO: 258441 - DNA, 25 bp, Mus musculus
cgccttcctagccctcgtggtagct

SEQ ID NO: 258442 - DNA, 25 bp, Mus musculus
cgccttcgccagttctcaggccgcc

SEQ ID NO: 258443 - DNA, 25 bp, Mus musculus
cgccttctctaggaacaatgtgttc

SEQ ID NO: 258444 - DNA, 25 bp, Mus musculus
cgccttcttctgggagaagtttgaa

SEQ ID NO: 258445 - DNA, 25 bp, Mus musculus
cgccttctttcaggaaatgctgtca

SEQ ID NO: 258446 - DNA, 25 bp, Mus musculus
cgccttgccttctctcaaactcctg

SEQ ID NO: 258447 - DNA, 25 bp, Mus musculus
cgccttgctaggcccggtcggtgag

SEQ ID NO: 258448 - DNA, 25 bp, Mus musculus
cgccttggacctgaggtggcatctt

SEQ ID NO: 258449 - DNA, 25 bp, Mus musculus
cgccttgggatctttgctttctcat

SEQ ID NO: 258450 - DNA, 25 bp, Mus musculus
cgccttggtgacaccttcaggtgga

SEQ ID NO: 258451 - DNA, 25 bp, Mus musculus
cgcctttccaacagagggagacgat

SEQ ID NO: 258452 - DNA, 25 bp, Mus musculus
cgcctttcctttcaggcctcagggc

SEQ ID NO: 258453 - DNA, 25 bp, Mus musculus
cgcctttctttagtgtacactcttt

SEQ ID NO: 258454 - DNA, 25 bp, Mus musculus
cgcctttgaaaagctttctccagac

SEQ ID NO: 258455 - DNA, 25 bp, Mus musculus
cgcctttgaccaggaacttagccca

SEQ ID NO: 258456 - DNA, 25 bp, Mus musculus
cgcctttgaccaggtaaccggtgtg

SEQ ID NO: 258457 - DNA, 25 bp, Mus musculus
cgcctttgagatggctgtctcaaat

SEQ ID NO: 258458 - DNA, 25 bp, Mus musculus
cgcctttgaggtcttgctgatccta

SEQ ID NO: 258459 - DNA, 25 bp, Mus musculus
cgcctttggaagagatggagagaga

SEQ ID NO: 258460 - DNA, 25 bp, Mus musculus
cgcctttggcaactgcgagtgctac

SEQ ID NO: 258461 - DNA, 25 bp, Mus musculus
cgcctttggcactgtagctatctct

SEQ ID NO: 258462 - DNA, 25 bp, Mus musculus
cgcctttggcagtcagaccaagcca

SEQ ID NO: 258463 - DNA, 25 bp, Mus musculus
cgcctttgtctggaagcggcctctg

SEQ ID NO: 258464 - DNA, 25 bp, Mus musculus
cgcctttgtctggtcccccttcctg

SEQ ID NO: 258465 - DNA, 25 bp, Mus musculus
cgcctttgtgcgagacggccccctt

SEQ ID NO: 258466 - DNA, 25 bp, Mus musculus
cgccttttatgcatcttggcatggc

SEQ ID NO: 258467 - DNA, 25 bp, Mus musculus
cgccttttccagcaatccgaaggtc

SEQ ID NO: 258468 - DNA, 25 bp, Mus musculus
cgcgaaagcaggtccccagcctggc

SEQ ID NO: 258469 - DNA, 25 bp, Mus musculus
cgcgaaccttgcccatggcgaattg

SEQ ID NO: 258470 - DNA, 25 bp, Mus musculus
cgcgaaccttgggaattcgacaccg

SEQ ID NO: 258471 - DNA, 25 bp, Mus musculus
cgcgaaggaggtgtcgcggaagatg

SEQ ID NO: 258472 - DNA, 25 bp, Mus musculus
cgcgaagtctgtgattcgtaagaca

SEQ ID NO: 258473 - DNA, 25 bp, Mus musculus
cgcgaatcggtgttgagaaactctc

SEQ ID NO: 258474 - DNA, 25 bp, Mus musculus
cgcgacaaacagaacagaaaagaaa

SEQ ID NO: 258475 - DNA, 25 bp, Mus musculus
cgcgacaaacagaatgcaacaagga

SEQ ID NO: 258476 - DNA, 25 bp, Mus musculus
cgcgacaagccgaactgctttgagc

SEQ ID NO: 258477 - DNA, 25 bp, Mus musculus
cgcgaccccagctctatttcagaat

SEQ ID NO: 258478 - DNA, 25 bp, Mus musculus
cgcgaccccaggaccagctctctcc

SEQ ID NO: 258479 - DNA, 25 bp, Mus musculus
cgcgaccgcagacgggaccttcttt

SEQ ID NO: 258480 - DNA, 25 bp, Mus musculus
cgcgaccgcagacgggagctgcaaa

SEQ ID NO: 258481 - DNA, 25 bp, Mus musculus
cgcgacctagaaggttttaggctag

SEQ ID NO: 258482 - DNA, 25 bp, Mus musculus
cgcgacctccgcaatttcaccgaga

SEQ ID NO: 258483 - DNA, 25 bp, Mus musculus
cgcgacctccgcagctaggtaattt

SEQ ID NO: 258484 - DNA, 25 bp, Mus musculus
cgcgaccttccagcagcagcatgaa

SEQ ID NO: 258485 - DNA, 25 bp, Mus musculus
cgcgacgccggtgccttcgccggct

SEQ ID NO: 258486 - DNA, 25 bp, Mus musculus
cgcgacgcgcggaggaaaacttggt

SEQ ID NO: 258487 - DNA, 25 bp, Mus musculus
cgcgacgtcagacacttagctgcct

SEQ ID NO: 258488 - DNA, 25 bp, Mus musculus
cgcgacgtcaggtactcaatgcaag

SEQ ID NO: 258489 - DNA, 25 bp, Mus musculus
cgcgactcagtaattggcaactgga

SEQ ID NO: 258490 - DNA, 25 bp, Mus musculus
cgcgactgaggcgccgcccggttaa

SEQ ID NO: 258491 - DNA, 25 bp, Mus musculus
cgcgacttccctgagctcaccatgg

SEQ ID NO: 258492 - DNA, 25 bp, Mus musculus
cgcgagaacagttcaagggcagacg

SEQ ID NO: 258493 - DNA, 25 bp, Mus musculus
cgcgagactaagaccatggccaaag

SEQ ID NO: 258494 - DNA, 25 bp, Mus musculus
cgcgagactaagagccccactgctg

SEQ ID NO: 258495 - DNA, 25 bp, Mus musculus
cgcgagatcctcaaggggaaactgt

SEQ ID NO: 258496 - DNA, 25 bp, Mus musculus
cgcgagatctcaggtctcctgtgag

SEQ ID NO: 258497 - DNA, 25 bp, Mus musculus
cgcgagatttcccagaccacgaact

SEQ ID NO: 258498 - DNA, 25 bp, Mus musculus
cgcgagatttcccagggatccggca

SEQ ID NO: 258499 - DNA, 25 bp, Mus musculus
cgcgagcaggacgggaaggatgcga

SEQ ID NO: 258500 - DNA, 25 bp, Mus musculus
cgcgagccgcgaagccaaaaacggg

SEQ ID NO: 258501 - DNA, 25 bp, Mus musculus
cgcgagccgctggtgcacggcagct

SEQ ID NO: 258502 - DNA, 25 bp, Mus musculus
cgcgagcgagcgtgacctacagcac

SEQ ID NO: 258503 - DNA, 25 bp, Mus musculus
cgcgagcggaaactcacaggctaag

SEQ ID NO: 258504 - DNA, 25 bp, Mus musculus
cgcgagcggaaactggatcgcttca

SEQ ID NO: 258505 - DNA, 25 bp, Mus musculus
cgcgagctttcctttgaagcaccta

SEQ ID NO: 258506 - DNA, 25 bp, Mus musculus
cgcgaggaaggcaggaaagaagagg

SEQ ID NO: 258507 - DNA, 25 bp, Mus musculus
cgcgaggacgatccactgcaacaca

SEQ ID NO: 258508 - DNA, 25 bp, Mus musculus
cgcgaggagagcaaggataagcgcc

SEQ ID NO: 258509 - DNA, 25 bp, Mus musculus
cgcgaggaggaggccctgcgggcgc

SEQ ID NO: 258510 - DNA, 25 bp, Mus musculus
cgcgaggagttcgcccccatggctg

SEQ ID NO: 258511 - DNA, 25 bp, Mus musculus
cgcgaggcagcatggtctgagacgg

SEQ ID NO: 258512 - DNA, 25 bp, Mus musculus
cgcgagggtcgcgcagcgtgcaggg

SEQ ID NO: 258513 - DNA, 25 bp, Mus musculus
cgcgaggtcttcgaaagaaccaagc

SEQ ID NO: 258514 - DNA, 25 bp, Mus musculus
cgcgaggtcttcggccttcccagga

SEQ ID NO: 258515 - DNA, 25 bp, Mus musculus
cgcgaggtggagcatacatccatcc

SEQ ID NO: 258516 - DNA, 25 bp, Mus musculus
cgcgaggtggaggagagaacattga

SEQ ID NO: 258517 - DNA, 25 bp, Mus musculus
cgcgaggtggaggtggcctggggag

SEQ ID NO: 258518 - DNA, 25 bp, Mus musculus
cgcgagtaagaccacaggatggctc

SEQ ID NO: 258519 - DNA, 25 bp, Mus musculus
cgcgagtaagactcccttgtatcct

SEQ ID NO: 258520 - DNA, 25 bp, Mus musculus
cgcgagtaagggcgaatcgccagga

SEQ ID NO: 258521 - DNA, 25 bp, Mus musculus
cgcgagtagcaggaggcgtccggtc

SEQ ID NO: 258522 - DNA, 25 bp, Mus musculus
cgcgagtcccaagccccacccacaa

SEQ ID NO: 258523 - DNA, 25 bp, Mus musculus
cgcgagtctactcggaaaaagagag

SEQ ID NO: 258524 - DNA, 25 bp, Mus musculus
cgcgagtctactgtctgccaaaatg

SEQ ID NO: 258525 - DNA, 25 bp, Mus musculus
cgcgataggtacagttctgacacaa

SEQ ID NO: 258526 - DNA, 25 bp, Mus musculus
cgcgatccgcagaagacctaaccga

SEQ ID NO: 258527 - DNA, 25 bp, Mus musculus
cgcgatccgcagagcagcttaagaa

SEQ ID NO: 258528 - DNA, 25 bp, Mus musculus
cgcgatgaagccgcccatttcaata

SEQ ID NO: 258529 - DNA, 25 bp, Mus musculus
cgcgatgaagccggctacctctgtc

SEQ ID NO: 258530 - DNA, 25 bp, Mus musculus
cgcgatgagccaaggcatagagatc

SEQ ID NO: 258531 - DNA, 25 bp, Mus musculus
cgcgatggaagagacattgatggac

SEQ ID NO: 258532 - DNA, 25 bp, Mus musculus
cgcgatggagaaaactttagaaact

SEQ ID NO: 258533 - DNA, 25 bp, Mus musculus
cgcgatggagagagaaaaggaacag

SEQ ID NO: 258534 - DNA, 25 bp, Mus musculus
cgcgatgggcctgaggctcttcgcg

SEQ ID NO: 258535 - DNA, 25 bp, Mus musculus
cgcgattatcagaatccctctgcgc

SEQ ID NO: 258536 - DNA, 25 bp, Mus musculus
cgcgattatcagagtccagtagagg

SEQ ID NO: 258537 - DNA, 25 bp, Mus musculus
cgcgattgcagggagtcattcccag

SEQ ID NO: 258538 - DNA, 25 bp, Mus musculus
cgcgattgcaggtctgttgtggggg

SEQ ID NO: 258539 - DNA, 25 bp, Mus musculus
cgcgatttacgaaatctaccagaga

SEQ ID NO: 258540 - DNA, 25 bp, Mus musculus
cgcgcaagcagtgggaacagcgctt

SEQ ID NO: 258541 - DNA, 25 bp, Mus musculus
cgcgcaattcccaccaaatatacga

SEQ ID NO: 258542 - DNA, 25 bp, Mus musculus
cgcgcacaagaaatatggggtgtgc

SEQ ID NO: 258543 - DNA, 25 bp, Mus musculus
cgcgcacaagaagatctctcgtctg

SEQ ID NO: 258544 - DNA, 25 bp, Mus musculus
cgcgcaccgggttacacaataaatc

SEQ ID NO: 258545 - DNA, 25 bp, Mus musculus
cgcgcacctgccggctgcgaccgag

SEQ ID NO: 258546 - DNA, 25 bp, Mus musculus
cgcgcaccttcctccggcatgagat

SEQ ID NO: 258547 - DNA, 25 bp, Mus musculus
cgcgcaccttcctcctgcaacagaa

SEQ ID NO: 258548 - DNA, 25 bp, Mus musculus
cgcgcaccttggagaagattgctgg

SEQ ID NO: 258549 - DNA, 25 bp, Mus musculus
cgcgcaccttggagagaatatgttt

SEQ ID NO: 258550 - DNA, 25 bp, Mus musculus
cgcgcacgactgctgatgaagtgac

SEQ ID NO: 258551 - DNA, 25 bp, Mus musculus
cgcgcacgccgtggtgcgcagttcc

SEQ ID NO: 258552 - DNA, 25 bp, Mus musculus
cgcgcacggctccagaaagatgaca

SEQ ID NO: 258553 - DNA, 25 bp, Mus musculus
cgcgcacgtagtggacaagctactg

SEQ ID NO: 258554 - DNA, 25 bp, Mus musculus
cgcgcacgtagtggtcacaggaggc

SEQ ID NO: 258555 - DNA, 25 bp, Mus musculus
cgcgcactctgtgggtcatttctct

SEQ ID NO: 258556 - DNA, 25 bp, Mus musculus
cgcgcagaactgggattgtctttct

SEQ ID NO: 258557 - DNA, 25 bp, Mus musculus
cgcgcagaactgggggatgcagaga

SEQ ID NO: 258558 - DNA, 25 bp, Mus musculus
cgcgcagaactggttcttccccaga

SEQ ID NO: 258559 - DNA, 25 bp, Mus musculus
cgcgcagacgcttccattgtctaaa

SEQ ID NO: 258560 - DNA, 25 bp, Mus musculus
cgcgcagcaggaagaatttcagcat

SEQ ID NO: 258561 - DNA, 25 bp, Mus musculus
cgcgcagcaggaaggtgctgtataa

SEQ ID NO: 258562 - DNA, 25 bp, Mus musculus
cgcgcagcatgaaagatgtattcca

SEQ ID NO: 258563 - DNA, 25 bp, Mus musculus
cgcgcagcatgtcaaagaaaagagg

SEQ ID NO: 258564 - DNA, 25 bp, Mus musculus
cgcgcagccatgagcgagacggtca

SEQ ID NO: 258565 - DNA, 25 bp, Mus musculus
cgcgcagcccaagagactgaattcc

SEQ ID NO: 258566 - DNA, 25 bp, Mus musculus
cgcgcagcccgagctacttccccac

SEQ ID NO: 258567 - DNA, 25 bp, Mus musculus
cgcgcagcgacaatggaggtgaatt

SEQ ID NO: 258568 - DNA, 25 bp, Mus musculus
cgcgcagcgacattgtgtgttccag

SEQ ID NO: 258569 - DNA, 25 bp, Mus musculus
cgcgcagcggaagaaatggcaaaat

SEQ ID NO: 258570 - DNA, 25 bp, Mus musculus
cgcgcagctctacccactccgagca

SEQ ID NO: 258571 - DNA, 25 bp, Mus musculus
cgcgcagctggggtcatgatatact

SEQ ID NO: 258572 - DNA, 25 bp, Mus musculus
cgcgcaggaggaaaggacccaggag

SEQ ID NO: 258573 - DNA, 25 bp, Mus musculus
cgcgcagtatggacagcattgggcc

SEQ ID NO: 258574 - DNA, 25 bp, Mus musculus
cgcgcagtggttgggaactgtgaag

SEQ ID NO: 258575 - DNA, 25 bp, Mus musculus
cgcgcatccaggtcatccttcgggc

SEQ ID NO: 258576 - DNA, 25 bp, Mus musculus
cgcgcatggagtacgtgtttgacta

SEQ ID NO: 258577 - DNA, 25 bp, Mus musculus
cgcgccaagagaaaattcaggacgc

SEQ ID NO: 258578 - DNA, 25 bp, Mus musculus
cgcgccaagagacgaggatggccgc

SEQ ID NO: 258579 - DNA, 25 bp, Mus musculus
cgcgccaagccgaggtatctccaga

SEQ ID NO: 258580 - DNA, 25 bp, Mus musculus
cgcgccaagccgagtgccaggtcac

SEQ ID NO: 258581 - DNA, 25 bp, Mus musculus
cgcgccacacctggccgccgccgcc

SEQ ID NO: 258582 - DNA, 25 bp, Mus musculus
cgcgccagagcagccaacatgagtc

SEQ ID NO: 258583 - DNA, 25 bp, Mus musculus
cgcgccagaggaaggtgggagtcaa

SEQ ID NO: 258584 - DNA, 25 bp, Mus musculus
cgcgccagagtttgtgatcctgtgc

SEQ ID NO: 258585 - DNA, 25 bp, Mus musculus
cgcgccaggaacgtctttggaaagt

SEQ ID NO: 258586 - DNA, 25 bp, Mus musculus
cgcgccaggaacgttgtgaggactg

SEQ ID NO: 258587 - DNA, 25 bp, Mus musculus
cgcgccatcagccaggtcaggaatc

SEQ ID NO: 258588 - DNA, 25 bp, Mus musculus
cgcgcccacgccggtgtctgcagct

SEQ ID NO: 258589 - DNA, 25 bp, Mus musculus
cgcgcccacgccgtatatcaaggcc

SEQ ID NO: 258590 - DNA, 25 bp, Mus musculus
cgcgcccaggcgaggcactgggctc

SEQ ID NO: 258591 - DNA, 25 bp, Mus musculus
cgcgcccatcaagataagtgggcag

SEQ ID NO: 258592 - DNA, 25 bp, Mus musculus
cgcgccccctccggtcgccatggat

SEQ ID NO: 258593 - DNA, 25 bp, Mus musculus
cgcgcccgggaggtgaagggccgga

SEQ ID NO: 258594 - DNA, 25 bp, Mus musculus
cgcgcccgggagtttcaggcatttg

SEQ ID NO: 258595 - DNA, 25 bp, Mus musculus
cgcgccctaagcaggtgagccctag

SEQ ID NO: 258596 - DNA, 25 bp, Mus musculus
cgcgccctcagatgtcacctgtacg

SEQ ID NO: 258597 - DNA, 25 bp, Mus musculus
cgcgccctcagtgggaagatgcccg

SEQ ID NO: 258598 - DNA, 25 bp, Mus musculus
cgcgccgacgaaatggctaccaaga

SEQ ID NO: 258599 - DNA, 25 bp, Mus musculus
cgcgccgagaatcaagaacttaaaa

SEQ ID NO: 258600 - DNA, 25 bp, Mus musculus
cgcgccgagattaaaagaaagttga

SEQ ID NO: 258601 - DNA, 25 bp, Mus musculus
cgcgccgcagtcgggccgccccacc

SEQ ID NO: 258602 - DNA, 25 bp, Mus musculus
cgcgccgccgagccggcgctaactg

SEQ ID NO: 258603 - DNA, 25 bp, Mus musculus
cgcgccgcggccttagaagaaatct

SEQ ID NO: 258604 - DNA, 25 bp, Mus musculus
cgcgccgcggctccatgttctacga

SEQ ID NO: 258605 - DNA, 25 bp, Mus musculus
cgcgccgctgcgagtggccgcccca

SEQ ID NO: 258606 - DNA, 25 bp, Mus musculus
cgcgccgctgcggttctccagacca

SEQ ID NO: 258607 - DNA, 25 bp, Mus musculus
cgcgccgctgtgaggtacagtcatg

SEQ ID NO: 258608 - DNA, 25 bp, Mus musculus
cgcgccgggccgcagtgcctggtga

SEQ ID NO: 258609 - DNA, 25 bp, Mus musculus
cgcgccgggccgcccaacaagatag

SEQ ID NO: 258610 - DNA, 25 bp, Mus musculus
cgcgccggtgctgagttaatatttg

SEQ ID NO: 258611 - DNA, 25 bp, Mus musculus
cgcgccgtggtctgggtcaggccct

SEQ ID NO: 258612 - DNA, 25 bp, Mus musculus
cgcgcctactgactatcaatgtact

SEQ ID NO: 258613 - DNA, 25 bp, Mus musculus
cgcgcctactgttccaggactatca

SEQ ID NO: 258614 - DNA, 25 bp, Mus musculus
cgcgcctagaaaaagaattcttgaa

SEQ ID NO: 258615 - DNA, 25 bp, Mus musculus
cgcgcctcagagtttgctattgcga

SEQ ID NO: 258616 - DNA, 25 bp, Mus musculus
cgcgcctcaggtagcactttgtatt

SEQ ID NO: 258617 - DNA, 25 bp, Mus musculus
cgcgcctccagtgaccaaagacttg

SEQ ID NO: 258618 - DNA, 25 bp, Mus musculus
cgcgcctccagtttttggctttcac

SEQ ID NO: 258619 - DNA, 25 bp, Mus musculus
cgcgcctcgcagggctcaacatatg

SEQ ID NO: 258620 - DNA, 25 bp, Mus musculus
cgcgcctctcagtgctcaggagctg

SEQ ID NO: 258621 - DNA, 25 bp, Mus musculus
cgcgcctctgatgctgagcccagga

SEQ ID NO: 258622 - DNA, 25 bp, Mus musculus
cgcgcctctgtaaaacccagaaccc

SEQ ID NO: 258623 - DNA, 25 bp, Mus musculus
cgcgcctgaggcactttgaattgct

SEQ ID NO: 258624 - DNA, 25 bp, Mus musculus
cgcgcctgcaggactttaagctcga

SEQ ID NO: 258625 - DNA, 25 bp, Mus musculus
cgcgcctgcaggcaagaaggagtta

SEQ ID NO: 258626 - DNA, 25 bp, Mus musculus
cgcgcctggagagctccacgcagga

SEQ ID NO: 258627 - DNA, 25 bp, Mus musculus
cgcgcctggagtctcactgttagag

SEQ ID NO: 258628 - DNA, 25 bp, Mus musculus
cgcgccttctctaggaacaatgtgt

SEQ ID NO: 258629 - DNA, 25 bp, Mus musculus
cgcgcgacgtcagacacttagctgc

SEQ ID NO: 258630 - DNA, 25 bp, Mus musculus
cgcgcgacgtcaggtactcaatgca

SEQ ID NO: 258631 - DNA, 25 bp, Mus musculus
cgcgcgagaagctcgcgctgtatgt

SEQ ID NO: 258632 - DNA, 25 bp, Mus musculus
cgcgcgaggagttcgcccccatggc

SEQ ID NO: 258633 - DNA, 25 bp, Mus musculus
cgcgcgaggtggagcatacatccat

SEQ ID NO: 258634 - DNA, 25 bp, Mus musculus
cgcgcgaggtggaggagagaacatt

SEQ ID NO: 258635 - DNA, 25 bp, Mus musculus
cgcgcgaggtggaggtggcctgggg

SEQ ID NO: 258636 - DNA, 25 bp, Mus musculus
cgcgcgcagcggaagaaatggcaaa

SEQ ID NO: 258637 - DNA, 25 bp, Mus musculus
cgcgcgccaggaacgtctttggaaa

SEQ ID NO: 258638 - DNA, 25 bp, Mus musculus
cgcgcgccaggaacgttgtgaggac

SEQ ID NO: 258639 - DNA, 25 bp, Mus musculus
cgcgcgccagttggacatttggctc

SEQ ID NO: 258640 - DNA, 25 bp, Mus musculus
cgcgcgccccctccggtcgccatgg

SEQ ID NO: 258641 - DNA, 25 bp, Mus musculus
cgcgcgccgctgcggttctccagac

SEQ ID NO: 258642 - DNA, 25 bp, Mus musculus
cgcgcgcctgaggcactttgaattg

SEQ ID NO: 258643 - DNA, 25 bp, Mus musculus
cgcgcgcgaggcggaggccaggctc

SEQ ID NO: 258644 - DNA, 25 bp, Mus musculus
cgcgcgcggggtgctgtgagtggct

SEQ ID NO: 258645 - DNA, 25 bp, Mus musculus
cgcgcggacagagacactgtactac

SEQ ID NO: 258646 - DNA, 25 bp, Mus musculus
cgcgcggacccagagtgcttgggat

SEQ ID NO: 258647 - DNA, 25 bp, Mus musculus
cgcgcggaccccagcccgccggagt

SEQ ID NO: 258648 - DNA, 25 bp, Mus musculus
cgcgcggagcagactgtcgctaacc

SEQ ID NO: 258649 - DNA, 25 bp, Mus musculus
cgcgcggagcagccctctctatagc

SEQ ID NO: 258650 - DNA, 25 bp, Mus musculus
cgcgcggccaggtcttggtttccta

SEQ ID NO: 258651 - DNA, 25 bp, Mus musculus
cgcgcggccaggtgagttggagtga

SEQ ID NO: 258652 - DNA, 25 bp, Mus musculus
cgcgcggccatggagcagctgaagg

SEQ ID NO: 258653 - DNA, 25 bp, Mus musculus
cgcgcggcccaggggatccaaagcc

SEQ ID NO: 258654 - DNA, 25 bp, Mus musculus
cgcgcggcccaggtttggatctcct

SEQ ID NO: 258655 - DNA, 25 bp, Mus musculus
cgcgcggcgcggagcttagcagatc

SEQ ID NO: 258656 - DNA, 25 bp, Mus musculus
cgcgcggcgcggagtcacattagct

SEQ ID NO: 258657 - DNA, 25 bp, Mus musculus
cgcgcggcggcaagagcaaccttca

SEQ ID NO: 258658 - DNA, 25 bp, Mus musculus
cgcgcggcttggagctccttcctga

SEQ ID NO: 258659 - DNA, 25 bp, Mus musculus
cgcgcgggaccagatgccggcaaca

SEQ ID NO: 258660 - DNA, 25 bp, Mus musculus
cgcgcgggaccaggtactttgtgtt

SEQ ID NO: 258661 - DNA, 25 bp, Mus musculus
cgcgcgggctgagctggactggcca

SEQ ID NO: 258662 - DNA, 25 bp, Mus musculus
cgcgcggggaagagtcttgcgctca

SEQ ID NO: 258663 - DNA, 25 bp, Mus musculus
cgcgcggggtttctcggccgcgcgc

SEQ ID NO: 258664 - DNA, 25 bp, Mus musculus
cgcgcggtgccgcagtctcaaacca

SEQ ID NO: 258665 - DNA, 25 bp, Mus musculus
cgcgcggttggagagagtgtgaaca

SEQ ID NO: 258666 - DNA, 25 bp, Mus musculus
cgcgcgtaggcgtcaagatcaagtt

SEQ ID NO: 258667 - DNA, 25 bp, Mus musculus
cgcgcgtagtgattgaggatggtgt

SEQ ID NO: 258668 - DNA, 25 bp, Mus musculus
cgcgcgtccgaaatgctgagcttcc

SEQ ID NO: 258669 - DNA, 25 bp, Mus musculus
cgcgcgttgcgccaggcaggacact

SEQ ID NO: 258670 - DNA, 25 bp, Mus musculus
cgcgcgttgcgccaggtgtagctcc

SEQ ID NO: 258671 - DNA, 25 bp, Mus musculus
cgcgctaaaaatgcttgtttctggg

SEQ ID NO: 258672 - DNA, 25 bp, Mus musculus
cgcgctagaagatgttaaagaacca

SEQ ID NO: 258673 - DNA, 25 bp, Mus musculus
cgcgctagaagctactcaggtgcaa

SEQ ID NO: 258674 - DNA, 25 bp, Mus musculus
cgcgctattcaggcctttggagcag

SEQ ID NO: 258675 - DNA, 25 bp, Mus musculus
cgcgctcaaagatccaggtgctgtg

SEQ ID NO: 258676 - DNA, 25 bp, Mus musculus
cgcgctcaaaggactgtgtattcag

SEQ ID NO: 258677 - DNA, 25 bp, Mus musculus
cgcgctcaaaggcaaaggaggatgg

SEQ ID NO: 258678 - DNA, 25 bp, Mus musculus
cgcgctcaagaatttgtcttcggca

SEQ ID NO: 258679 - DNA, 25 bp, Mus musculus
cgcgctcaagccgcgacttttgcca

SEQ ID NO: 258680 - DNA, 25 bp, Mus musculus
cgcgctcaagccgcggcttctacaa

SEQ ID NO: 258681 - DNA, 25 bp, Mus musculus
cgcgctccctgcactccccaggacc

SEQ ID NO: 258682 - DNA, 25 bp, Mus musculus
cgcgctccgggccagagcctgagcc

SEQ ID NO: 258683 - DNA, 25 bp, Mus musculus
cgcgctccgtcaagaatccggagat

SEQ ID NO: 258684 - DNA, 25 bp, Mus musculus
cgcgctccgtcaaggtgtcggacga

SEQ ID NO: 258685 - DNA, 25 bp, Mus musculus
cgcgctccttcccgggcttttcgca

SEQ ID NO: 258686 - DNA, 25 bp, Mus musculus
cgcgctcgcaacgaggagactccag

SEQ ID NO: 258687 - DNA, 25 bp, Mus musculus
cgcgctcgtgcaagttccctggctc

SEQ ID NO: 258688 - DNA, 25 bp, Mus musculus
cgcgctctcaggaggaggcaaaaaa

SEQ ID NO: 258689 - DNA, 25 bp, Mus musculus
cgcgctctcaggctagagttcacgt

SEQ ID NO: 258690 - DNA, 25 bp, Mus musculus
cgcgctctcgtagaaattgctccaa

SEQ ID NO: 258691 - DNA, 25 bp, Mus musculus
cgcgctctcgtagatctgccacctc

SEQ ID NO: 258692 - DNA, 25 bp, Mus musculus
cgcgctctcgtaggctgaagagtga

SEQ ID NO: 258693 - DNA, 25 bp, Mus musculus
cgcgctgcgctcggtgagtgcagga

SEQ ID NO: 258694 - DNA, 25 bp, Mus musculus
cgcgctgggaggcatgtcatgttac

SEQ ID NO: 258695 - DNA, 25 bp, Mus musculus
cgcgctgggccgaggctcttctgcg

SEQ ID NO: 258696 - DNA, 25 bp, Mus musculus
cgcgctggtgttcgagttcctcagg

SEQ ID NO: 258697 - DNA, 25 bp, Mus musculus
cgcgctgtccttctcctccgcctct

SEQ ID NO: 258698 - DNA, 25 bp, Mus musculus
cgcgcttcagggcaactattgatga

SEQ ID NO: 258699 - DNA, 25 bp, Mus musculus
cgcgcttccgctccggccctcgaca

SEQ ID NO: 258700 - DNA, 25 bp, Mus musculus
cgcgcttggcagagccagacatcag

SEQ ID NO: 258701 - DNA, 25 bp, Mus musculus
cgcgctttgagggcctgaagaagat

SEQ ID NO: 258702 - DNA, 25 bp, Mus musculus
cgcgctttggaggtgacaaacttga

SEQ ID NO: 258703 - DNA, 25 bp, Mus musculus
cgcggaaattagggcaagagccaga

SEQ ID NO: 258704 - DNA, 25 bp, Mus musculus
cgcggaaccggagctggactggcca

SEQ ID NO: 258705 - DNA, 25 bp, Mus musculus
cgcggacacagcatgcccatttcca

SEQ ID NO: 258706 - DNA, 25 bp, Mus musculus
cgcggacagagcagactgtatcgtg

SEQ ID NO: 258707 - DNA, 25 bp, Mus musculus
cgcggacattgtttactccctgaag

SEQ ID NO: 258708 - DNA, 25 bp, Mus musculus
cgcggacccagagtgcttgggatcc

SEQ ID NO: 258709 - DNA, 25 bp, Mus musculus
cgcggaccccagcccgccggagtcc

SEQ ID NO: 258710 - DNA, 25 bp, Mus musculus
cgcggacgagaatggaaacttgagt

SEQ ID NO: 258711 - DNA, 25 bp, Mus musculus
cgcggacgagaatgggcaattgctt

SEQ ID NO: 258712 - DNA, 25 bp, Mus musculus
cgcggacgcggagacgtttgaatta

SEQ ID NO: 258713 - DNA, 25 bp, Mus musculus
cgcggacgcggagtctggtccatcg

SEQ ID NO: 258714 - DNA, 25 bp, Mus musculus
cgcggacggacccctggacttcgtc

SEQ ID NO: 258715 - DNA, 25 bp, Mus musculus
cgcggacggacttgatgtggatgac

SEQ ID NO: 258716 - DNA, 25 bp, Mus musculus
cgcggagacccttccaatctgaaca

SEQ ID NO: 258717 - DNA, 25 bp, Mus musculus
cgcggagactgaggtgctgggtgtg

SEQ ID NO: 258718 - DNA, 25 bp, Mus musculus
cgcggagagagaactgctctgatgg

SEQ ID NO: 258719 - DNA, 25 bp, Mus musculus
cgcggagagagaaggaaccaacaca

SEQ ID NO: 258720 - DNA, 25 bp, Mus musculus
cgcggagagaggcctgctgaaaatg

SEQ ID NO: 258721 - DNA, 25 bp, Mus musculus
cgcggagagcggtcccgtaggcctc

SEQ ID NO: 258722 - DNA, 25 bp, Mus musculus
cgcggagagtagattggatccagtg

SEQ ID NO: 258723 - DNA, 25 bp, Mus musculus
cgcggagcagactgtcgctaaccat

SEQ ID NO: 258724 - DNA, 25 bp, Mus musculus
cgcggagcagccctctctatagcct

SEQ ID NO: 258725 - DNA, 25 bp, Mus musculus
cgcggagcaggcatggagagtagaa

SEQ ID NO: 258726 - DNA, 25 bp, Mus musculus
cgcggagcaggctgccgactacagg

SEQ ID NO: 258727 - DNA, 25 bp, Mus musculus
cgcggagcagggcggcgagtccacg

SEQ ID NO: 258728 - DNA, 25 bp, Mus musculus
cgcggagcagggtaaaggccggcga

SEQ ID NO: 258729 - DNA, 25 bp, Mus musculus
cgcggagcaggtctacaggcttatg

SEQ ID NO: 258730 - DNA, 25 bp, Mus musculus
cgcggagcatcagacatttccactg

SEQ ID NO: 258731 - DNA, 25 bp, Mus musculus
cgcggagcccgagggctactcttcc

SEQ ID NO: 258732 - DNA, 25 bp, Mus musculus
cgcggagccgagtaaagacatttcc

SEQ ID NO: 258733 - DNA, 25 bp, Mus musculus
cgcggagccggttcgaggagcagaa

SEQ ID NO: 258734 - DNA, 25 bp, Mus musculus
cgcggagctgccgccttcagggccg

SEQ ID NO: 258735 - DNA, 25 bp, Mus musculus
cgcggaggacgtggcctggggagtt

SEQ ID NO: 258736 - DNA, 25 bp, Mus musculus
cgcggagggccgcaacaccaagaag

SEQ ID NO: 258737 - DNA, 25 bp, Mus musculus
cgcggagtcagaaggtagcaggtgc

SEQ ID NO: 258738 - DNA, 25 bp, Mus musculus
cgcggagtcaggctcttgtctgggg

SEQ ID NO: 258739 - DNA, 25 bp, Mus musculus
cgcggatcacgagtgaccgtcttct

SEQ ID NO: 258740 - DNA, 25 bp, Mus musculus
cgcggatccgcatttgcaggcccaa

SEQ ID NO: 258741 - DNA, 25 bp, Mus musculus
cgcggatgagcatcaccctggaatg

SEQ ID NO: 258742 - DNA, 25 bp, Mus musculus
cgcggatggccagccttggcctcac

SEQ ID NO: 258743 - DNA, 25 bp, Mus musculus
cgcggatttctggagccctgcttta

SEQ ID NO: 258744 - DNA, 25 bp, Mus musculus
cgcggattttgcccaggaccagcca

SEQ ID NO: 258745 - DNA, 25 bp, Mus musculus
cgcggcaaagcagctcctggaggag

SEQ ID NO: 258746 - DNA, 25 bp, Mus musculus
cgcggcaaccaaccgtctggatctt

SEQ ID NO: 258747 - DNA, 25 bp, Mus musculus
cgcggcacaaaatcagcgcctggga

SEQ ID NO: 258748 - DNA, 25 bp, Mus musculus
cgcggcacagcccatgcagcctgcc

SEQ ID NO: 258749 - DNA, 25 bp, Mus musculus
cgcggcacagccccctgcgggtgtt

SEQ ID NO: 258750 - DNA, 25 bp, Mus musculus
cgcggcagactcagctgtgctggat

SEQ ID NO: 258751 - DNA, 25 bp, Mus musculus
cgcggcagactcaggcacctctgtc

SEQ ID NO: 258752 - DNA, 25 bp, Mus musculus
cgcggcagagccaggctagtgaacc

SEQ ID NO: 258753 - DNA, 25 bp, Mus musculus
cgcggcagccactaagccccagtct

SEQ ID NO: 258754 - DNA, 25 bp, Mus musculus
cgcggcagccgacgatacagacggc

SEQ ID NO: 258755 - DNA, 25 bp, Mus musculus
cgcggcagccgacggaggacccgct

SEQ ID NO: 258756 - DNA, 25 bp, Mus musculus
cgcggcagccgacggcaccagagtt

SEQ ID NO: 258757 - DNA, 25 bp, Mus musculus
cgcggcagccgctttcactatacag

SEQ ID NO: 258758 - DNA, 25 bp, Mus musculus
cgcggcagcctaaggactaacggtt

SEQ ID NO: 258759 - DNA, 25 bp, Mus musculus
cgcggcagcctaagggcacagcccg

SEQ ID NO: 258760 - DNA, 25 bp, Mus musculus
cgcggcaggctcaggccaccccaca

SEQ ID NO: 258761 - DNA, 25 bp, Mus musculus
cgcggcaggctcaggctaccgagtc

SEQ ID NO: 258762 - DNA, 25 bp, Mus musculus
cgcggcataggccttcagaagtatt

SEQ ID NO: 258763 - DNA, 25 bp, Mus musculus
cgcggccaaaaggcggacgccgcgg

SEQ ID NO: 258764 - DNA, 25 bp, Mus musculus
cgcggccagcggggacaatcccaga

SEQ ID NO: 258765 - DNA, 25 bp, Mus musculus
cgcggccagcgggttcccgaggaga

SEQ ID NO: 258766 - DNA, 25 bp, Mus musculus
cgcggccagggcaaagtgcaaacag

SEQ ID NO: 258767 - DNA, 25 bp, Mus musculus
cgcggccatctgccggctctggggg

SEQ ID NO: 258768 - DNA, 25 bp, Mus musculus
cgcggccatctgccgggaaggaagc

SEQ ID NO: 258769 - DNA, 25 bp, Mus musculus
cgcggccatgaagcatgtctgctgt

SEQ ID NO: 258770 - DNA, 25 bp, Mus musculus
cgcggccatgaaggcgggtgctact

SEQ ID NO: 258771 - DNA, 25 bp, Mus musculus
cgcggccatggagcagctgaaggcc

SEQ ID NO: 258772 - DNA, 25 bp, Mus musculus
cgcggccatggcggggcccctaacg

SEQ ID NO: 258773 - DNA, 25 bp, Mus musculus
cgcggcccagaattgtaaaaccggt

SEQ ID NO: 258774 - DNA, 25 bp, Mus musculus
cgcggcccaggggatccaaagccct

SEQ ID NO: 258775 - DNA, 25 bp, Mus musculus
cgcggcccaggttaaatggaatcca

SEQ ID NO: 258776 - DNA, 25 bp, Mus musculus
cgcggcccaggtttggatctcctgc

SEQ ID NO: 258777 - DNA, 25 bp, Mus musculus
cgcggccccccttcacgctcgattt

SEQ ID NO: 258778 - DNA, 25 bp, Mus musculus
cgcggccccgagcaggtttcaaatg

SEQ ID NO: 258779 - DNA, 25 bp, Mus musculus
cgcggccccgaggagtcagcattgg

SEQ ID NO: 258780 - DNA, 25 bp, Mus musculus
cgcggccctaagaagggttgtgagc

SEQ ID NO: 258781 - DNA, 25 bp, Mus musculus
cgcggccctgcagatcaccagcaaa

SEQ ID NO: 258782 - DNA, 25 bp, Mus musculus
cgcggccctgcaggagtgactagca

SEQ ID NO: 258783 - DNA, 25 bp, Mus musculus
cgcggccgaacatgggtgcaaggat

SEQ ID NO: 258784 - DNA, 25 bp, Mus musculus
cgcggccgaacgacagagactgcag

SEQ ID NO: 258785 - DNA, 25 bp, Mus musculus
cgcggccgagggtacttgtggaagg

SEQ ID NO: 258786 - DNA, 25 bp, Mus musculus
cgcggccgaggtacaatgtcacgca

SEQ ID NO: 258787 - DNA, 25 bp, Mus musculus
cgcggccgcaggcagcaggtgcccg

SEQ ID NO: 258788 - DNA, 25 bp, Mus musculus
cgcggccgcgcagaactgtcattat

SEQ ID NO: 258789 - DNA, 25 bp, Mus musculus
cgcggccgtgcagttggaattgatc

SEQ ID NO: 258790 - DNA, 25 bp, Mus musculus
cgcggcctaaactccagtctttccc

SEQ ID NO: 258791 - DNA, 25 bp, Mus musculus
cgcggcctgcagatcttgaaccaga

SEQ ID NO: 258792 - DNA, 25 bp, Mus musculus
cgcggcctgcagcacatcttcatta

SEQ ID NO: 258793 - DNA, 25 bp, Mus musculus
cgcggcctgctgggttcacggctca

SEQ ID NO: 258794 - DNA, 25 bp, Mus musculus
cgcggcctggtggtgcacaatcctg

SEQ ID NO: 258795 - DNA, 25 bp, Mus musculus
cgcggccttcgggctaacaggcagt

SEQ ID NO: 258796 - DNA, 25 bp, Mus musculus
cgcggccttgacgagatgctgttgg

SEQ ID NO: 258797 - DNA, 25 bp, Mus musculus
cgcggccttgacgaggggatgagag

SEQ ID NO: 258798 - DNA, 25 bp, Mus musculus
cgcggcgacaggtcttctacttaca

SEQ ID NO: 258799 - DNA, 25 bp, Mus musculus
cgcggcgacgcaggttgatatcaaa

SEQ ID NO: 258800 - DNA, 25 bp, Mus musculus
cgcggcgagcaaggtctgctgaaga

SEQ ID NO: 258801 - DNA, 25 bp, Mus musculus
cgcggcgcaaggaccggctccgagc

SEQ ID NO: 258802 - DNA, 25 bp, Mus musculus
cgcggcgcaataacgttacaaatta

SEQ ID NO: 258803 - DNA, 25 bp, Mus musculus
cgcggcgcgcgcagaggtttcatag

SEQ ID NO: 258804 - DNA, 25 bp, Mus musculus
cgcggcgcggagcttagcagatcat

SEQ ID NO: 258805 - DNA, 25 bp, Mus musculus
cgcggcgcggagtcacattagcttt

SEQ ID NO: 258806 - DNA, 25 bp, Mus musculus
cgcggcgcggggagagttaagaatc

SEQ ID NO: 258807 - DNA, 25 bp, Mus musculus
cgcggcgctgcggagagctcagagc

SEQ ID NO: 258808 - DNA, 25 bp, Mus musculus
cgcggcgctgcggcaatgccaagtg

SEQ ID NO: 258809 - DNA, 25 bp, Mus musculus
cgcggcgctggagcctggaatgctt

SEQ ID NO: 258810 - DNA, 25 bp, Mus musculus
cgcggcggagcagaccatgctcgca

SEQ ID NO: 258811 - DNA, 25 bp, Mus musculus
cgcggcggaggttgccccggaggcc

SEQ ID NO: 258812 - DNA, 25 bp, Mus musculus
cgcggcggagtctggagccgccatg

SEQ ID NO: 258813 - DNA, 25 bp, Mus musculus
cgcggcggcaagagcaaccttcaaa

SEQ ID NO: 258814 - DNA, 25 bp, Mus musculus
cgcggcggcaggattgtcttgagaa

SEQ ID NO: 258815 - DNA, 25 bp, Mus musculus
cgcggcggcaggctcctcctacgct

SEQ ID NO: 258816 - DNA, 25 bp, Mus musculus
cgcggcggcccgacgctgcggccag

SEQ ID NO: 258817 - DNA, 25 bp, Mus musculus
cgcggcggcgccggtgccaagtgct

SEQ ID NO: 258818 - DNA, 25 bp, Mus musculus
cgcggcggcggagatcctgagggaa

SEQ ID NO: 258819 - DNA, 25 bp, Mus musculus
cgcggcgggacccgggtcctgataa

SEQ ID NO: 258820 - DNA, 25 bp, Mus musculus
cgcggcggggcagactgaagtgttg

SEQ ID NO: 258821 - DNA, 25 bp, Mus musculus
cgcggcggggcaggagcaaaacaat

SEQ ID NO: 258822 - DNA, 25 bp, Mus musculus
cgcggcggggcaggtgtagtaacat

SEQ ID NO: 258823 - DNA, 25 bp, Mus musculus
cgcggcgggggcggcagttctggca

SEQ ID NO: 258824 - DNA, 25 bp, Mus musculus
cgcggcggttcaggaattacacagt

SEQ ID NO: 258825 - DNA, 25 bp, Mus musculus
cgcggcggttcaggggtatggaaac

SEQ ID NO: 258826 - DNA, 25 bp, Mus musculus
cgcggcgtccggacactgcagaagg

SEQ ID NO: 258827 - DNA, 25 bp, Mus musculus
cgcggcgtcctcagatatagccata

SEQ ID NO: 258828 - DNA, 25 bp, Mus musculus
cgcggcgtctcagctccgcgtgagt

SEQ ID NO: 258829 - DNA, 25 bp, Mus musculus
cgcggcgtggctggtcgggatggtg

SEQ ID NO: 258830 - DNA, 25 bp, Mus musculus
cgcggcgttctgatgagtgacccac

SEQ ID NO: 258831 - DNA, 25 bp, Mus musculus
cgcggcgttctggttttttgcattg

SEQ ID NO: 258832 - DNA, 25 bp, Mus musculus
cgcggctcccgatggaaatcctatg

SEQ ID NO: 258833 - DNA, 25 bp, Mus musculus
cgcggctcctcagatatagccatat

SEQ ID NO: 258834 - DNA, 25 bp, Mus musculus
cgcggctcctcagtattgtggaatg

SEQ ID NO: 258835 - DNA, 25 bp, Mus musculus
cgcggctcctcagtgtcggcggcgg

SEQ ID NO: 258836 - DNA, 25 bp, Mus musculus
cgcggctcggcctggtgtctccaaa

SEQ ID NO: 258837 - DNA, 25 bp, Mus musculus
cgcggctctcaagcagaaaaatggc

SEQ ID NO: 258838 - DNA, 25 bp, Mus musculus
cgcggctctcaaggaggccaaagca

SEQ ID NO: 258839 - DNA, 25 bp, Mus musculus
cgcggctgacggaggtgtcccctga

SEQ ID NO: 258840 - DNA, 25 bp, Mus musculus
cgcggctgcagtctttaagaaatag

SEQ ID NO: 258841 - DNA, 25 bp, Mus musculus
cgcggctgccaaaagcggaggccaa

SEQ ID NO: 258842 - DNA, 25 bp, Mus musculus
cgcggctgcctaggttctggtattg

SEQ ID NO: 258843 - DNA, 25 bp, Mus musculus
cgcggctggttggcgagaatctgct

SEQ ID NO: 258844 - DNA, 25 bp, Mus musculus
cgcggctggttgggaatgtgactat

SEQ ID NO: 258845 - DNA, 25 bp, Mus musculus
cgcgggaaagagtccagcctctgaa

SEQ ID NO: 258846 - DNA, 25 bp, Mus musculus
cgcgggaaaggataaagcatcagac

SEQ ID NO: 258847 - DNA, 25 bp, Mus musculus
cgcgggaagcctcaggaactcaccc

SEQ ID NO: 258848 - DNA, 25 bp, Mus musculus
cgcgggaagcctcaggctgtgggcg

SEQ ID NO: 258849 - DNA, 25 bp, Mus musculus
cgcgggaagcctcagtgccactaag

SEQ ID NO: 258850 - DNA, 25 bp, Mus musculus
cgcgggaccagatgccggcaacaga

SEQ ID NO: 258851 - DNA, 25 bp, Mus musculus
cgcgggaccaggtactttgtgttct

SEQ ID NO: 258852 - DNA, 25 bp, Mus musculus
cgcgggaccccgagatcgccggggc

SEQ ID NO: 258853 - DNA, 25 bp, Mus musculus
cgcgggacggatttgatctactgtg

SEQ ID NO: 258854 - DNA, 25 bp, Mus musculus
cgcgggacgggcccagttctgcgct

SEQ ID NO: 258855 - DNA, 25 bp, Mus musculus
cgcgggacggggagaaagagagagc

SEQ ID NO: 258856 - DNA, 25 bp, Mus musculus
cgcgggacggggcttctgaccccat

SEQ ID NO: 258857 - DNA, 25 bp, Mus musculus
cgcgggactagggagtgttcagtca

SEQ ID NO: 258858 - DNA, 25 bp, Mus musculus
cgcgggagaagcagcttatggcaaa

SEQ ID NO: 258859 - DNA, 25 bp, Mus musculus
cgcgggagaagcagggatctgggca

SEQ ID NO: 258860 - DNA, 25 bp, Mus musculus
cgcgggagaggtaaggctgacctct

SEQ ID NO: 258861 - DNA, 25 bp, Mus musculus
cgcgggagagttttctctgtcatcc

SEQ ID NO: 258862 - DNA, 25 bp, Mus musculus
cgcgggagcagcaccccttggggaa

SEQ ID NO: 258863 - DNA, 25 bp, Mus musculus
cgcgggagcaggccggaagctcatt

SEQ ID NO: 258864 - DNA, 25 bp, Mus musculus
cgcgggaggcggagagtgtcactga

SEQ ID NO: 258865 - DNA, 25 bp, Mus musculus
cgcgggaggcggctctagatggcac

SEQ ID NO: 258866 - DNA, 25 bp, Mus musculus
cgcgggaggcgtacgagatgagaac

SEQ ID NO: 258867 - DNA, 25 bp, Mus musculus
cgcgggattccggtcacagtttgca

SEQ ID NO: 258868 - DNA, 25 bp, Mus musculus
cgcgggcactcaggttcgagtgacg

SEQ ID NO: 258869 - DNA, 25 bp, Mus musculus
cgcgggcagcagcttggcaaatggt

SEQ ID NO: 258870 - DNA, 25 bp, Mus musculus
cgcgggcagcaggtcactacgttca

SEQ ID NO: 258871 - DNA, 25 bp, Mus musculus
cgcgggcagcagtgacagccctgct

SEQ ID NO: 258872 - DNA, 25 bp, Mus musculus
cgcgggcagccatgaggcggcaggc

SEQ ID NO: 258873 - DNA, 25 bp, Mus musculus
cgcgggcagcggtaaaatgtcggct

SEQ ID NO: 258874 - DNA, 25 bp, Mus musculus
cgcgggccatcctggccctcatctt

SEQ ID NO: 258875 - DNA, 25 bp, Mus musculus
cgcgggcccgtgaggtggtgatgct

SEQ ID NO: 258876 - DNA, 25 bp, Mus musculus
cgcgggcccgtgagttcatattctt

SEQ ID NO: 258877 - DNA, 25 bp, Mus musculus
cgcgggcgcagataaagaagctgag

SEQ ID NO: 258878 - DNA, 25 bp, Mus musculus
cgcgggcgctgcaggggctgacatg

SEQ ID NO: 258879 - DNA, 25 bp, Mus musculus
cgcgggctccagaggcgtccggtcg

SEQ ID NO: 258880 - DNA, 25 bp, Mus musculus
cgcgggcttcaggtagaagccactc

SEQ ID NO: 258881 - DNA, 25 bp, Mus musculus
cgcgggcttcaggtgaggatcccat

SEQ ID NO: 258882 - DNA, 25 bp, Mus musculus
cgcgggcttcagtgctggaggaggc

SEQ ID NO: 258883 - DNA, 25 bp, Mus musculus
cgcggggaaatggactcagtggctt

SEQ ID NO: 258884 - DNA, 25 bp, Mus musculus
cgcggggaagagtcttgcgctcagg

SEQ ID NO: 258885 - DNA, 25 bp, Mus musculus
cgcggggacagtaagaagacaattc

SEQ ID NO: 258886 - DNA, 25 bp, Mus musculus
cgcggggacagtgcctttgacgatg

SEQ ID NO: 258887 - DNA, 25 bp, Mus musculus
cgcggggactggacacctgggctgt

SEQ ID NO: 258888 - DNA, 25 bp, Mus musculus
cgcggggagaggccaacttatttgt

SEQ ID NO: 258889 - DNA, 25 bp, Mus musculus
cgcggggagatggtggcctggagag

SEQ ID NO: 258890 - DNA, 25 bp, Mus musculus
cgcggggatcagggcagagatggcc

SEQ ID NO: 258891 - DNA, 25 bp, Mus musculus
cgcggggcaaggaggaggagtttga

SEQ ID NO: 258892 - DNA, 25 bp, Mus musculus
cgcggggcaagtgtggtccccgcag

SEQ ID NO: 258893 - DNA, 25 bp, Mus musculus
cgcggggcaggtgcccatgttggaa

SEQ ID NO: 258894 - DNA, 25 bp, Mus musculus
cgcggggcaggtgtccatgttggaa

SEQ ID NO: 258895 - DNA, 25 bp, Mus musculus
cgcggggcgatgtgagccccaggtg

SEQ ID NO: 258896 - DNA, 25 bp, Mus musculus
cgcggggcgtgggattgaagtgagt

SEQ ID NO: 258897 - DNA, 25 bp, Mus musculus
cgcgggggaagacgatcacttttta

SEQ ID NO: 258898 - DNA, 25 bp, Mus musculus
cgcgggggaagacgatgtgtggtgt

SEQ ID NO: 258899 - DNA, 25 bp, Mus musculus
cgcgggggcgaggtggccaggcaga

SEQ ID NO: 258900 - DNA, 25 bp, Mus musculus
cgcgggggcgaggtgtccccatgac

SEQ ID NO: 258901 - DNA, 25 bp, Mus musculus
cgcggggtcagcacatggtttggga

SEQ ID NO: 258902 - DNA, 25 bp, Mus musculus
cgcggggtgcagaggtctctgtgtt

SEQ ID NO: 258903 - DNA, 25 bp, Mus musculus
cgcggggtgcggaggtcgctcatcc

SEQ ID NO: 258904 - DNA, 25 bp, Mus musculus
cgcggggtggccagggctctggctg

SEQ ID NO: 258905 - DNA, 25 bp, Mus musculus
cgcggggtttctcggccgcgcgcgg

SEQ ID NO: 258906 - DNA, 25 bp, Mus musculus
cgcgggtcctactgtattatggaga

SEQ ID NO: 258907 - DNA, 25 bp, Mus musculus
cgcgggtggtgtaagaataaacgag

SEQ ID NO: 258908 - DNA, 25 bp, Mus musculus
cgcgggttaccgtgcagacatggcc

SEQ ID NO: 258909 - DNA, 25 bp, Mus musculus
cgcggtagaacgagccatttattga

SEQ ID NO: 258910 - DNA, 25 bp, Mus musculus
cgcggtagcggtgaacgctgttgct

SEQ ID NO: 258911 - DNA, 25 bp, Mus musculus
cgcggtagcggtgccttctctccgt

SEQ ID NO: 258912 - DNA, 25 bp, Mus musculus
cgcggtagcggtgggtgtcaccgaa

SEQ ID NO: 258913 - DNA, 25 bp, Mus musculus
cgcggtagcggtgtatgtgggatcc

SEQ ID NO: 258914 - DNA, 25 bp, Mus musculus
cgcggtcaagaaaggctctggagct

SEQ ID NO: 258915 - DNA, 25 bp, Mus musculus
cgcggtcaaggatcatctgcttcgg

SEQ ID NO: 258916 - DNA, 25 bp, Mus musculus
cgcggtcaatgggtgggtgaggtgg

SEQ ID NO: 258917 - DNA, 25 bp, Mus musculus
cgcggtcaatggtcagcaagatcca

SEQ ID NO: 258918 - DNA, 25 bp, Mus musculus
cgcggtcactgagcctctgcaggtg

SEQ ID NO: 258919 - DNA, 25 bp, Mus musculus
cgcggtcactgaggtactggcggag

SEQ ID NO: 258920 - DNA, 25 bp, Mus musculus
cgcggtcgcccagggactttgaata

SEQ ID NO: 258921 - DNA, 25 bp, Mus musculus
cgcggtcgcggcggtgacctacagc

SEQ ID NO: 258922 - DNA, 25 bp, Mus musculus
cgcggtctggatcagaccttgtgac

SEQ ID NO: 258923 - DNA, 25 bp, Mus musculus
cgcggtgcaggactgggctacacag

SEQ ID NO: 258924 - DNA, 25 bp, Mus musculus
cgcggtgcaggactgggctacgcag

SEQ ID NO: 258925 - DNA, 25 bp, Mus musculus
cgcggtgccgcagtctcaaaccatg

SEQ ID NO: 258926 - DNA, 25 bp, Mus musculus
cgcggtgctcagggaggttacagcc

SEQ ID NO: 258927 - DNA, 25 bp, Mus musculus
cgcggtgctcagtgtctggagacat

SEQ ID NO: 258928 - DNA, 25 bp, Mus musculus
cgcggtggactgggcgctggagagc

SEQ ID NO: 258929 - DNA, 25 bp, Mus musculus
cgcggtgtgcatgttgaccccaaca

SEQ ID NO: 258930 - DNA, 25 bp, Mus musculus
cgcggtgttcgcggggctcgtgctc

SEQ ID NO: 258931 - DNA, 25 bp, Mus musculus
cgcggttacagggcatctgactgga

SEQ ID NO: 258932 - DNA, 25 bp, Mus musculus
cgcggttgcaggaattggccaacgg

SEQ ID NO: 258933 - DNA, 25 bp, Mus musculus
cgcggttggagagagtgtgaacatg

SEQ ID NO: 258934 - DNA, 25 bp, Mus musculus
cgcggtttgctggaaaggaagcaga

SEQ ID NO: 258935 - DNA, 25 bp, Mus musculus
cgcggtttgctggtacacactggtg

SEQ ID NO: 258936 - DNA, 25 bp, Mus musculus
cgcgtcagaggtccctctgtcacct

SEQ ID NO: 258937 - DNA, 25 bp, Mus musculus
cgcgtcagtgggtacccagaaaggg

SEQ ID NO: 258938 - DNA, 25 bp, Mus musculus
cgcgtcatgggggttaattcctata

SEQ ID NO: 258939 - DNA, 25 bp, Mus musculus
cgcgtcccagggacccagctgaagc

SEQ ID NO: 258940 - DNA, 25 bp, Mus musculus
cgcgtcccgcaggtcctgcatgtcc

SEQ ID NO: 258941 - DNA, 25 bp, Mus musculus
cgcgtcccggcccagggccttgctg

SEQ ID NO: 258942 - DNA, 25 bp, Mus musculus
cgcgtccgggtgatctctgggctag

SEQ ID NO: 258943 - DNA, 25 bp, Mus musculus
cgcgtcgctccgaaatcatgtccac

SEQ ID NO: 258944 - DNA, 25 bp, Mus musculus
cgcgtcgggaccaggatgaggctgt

SEQ ID NO: 258945 - DNA, 25 bp, Mus musculus
cgcgtcgtgtcttgggtcttctcca

SEQ ID NO: 258946 - DNA, 25 bp, Mus musculus
cgcgtctagggagtagaacagaggc

SEQ ID NO: 258947 - DNA, 25 bp, Mus musculus
cgcgtctcagggaactgagccgtgg

SEQ ID NO: 258948 - DNA, 25 bp, Mus musculus
cgcgtctggagcaggtgtgccacag

SEQ ID NO: 258949 - DNA, 25 bp, Mus musculus
cgcgtgcagaagcagaaagaagaag

SEQ ID NO: 258950 - DNA, 25 bp, Mus musculus
cgcgtgcgaggatgaaacgaggagg

SEQ ID NO: 258951 - DNA, 25 bp, Mus musculus
cgcgtgcgcaagggtgaaaaatttg

SEQ ID NO: 258952 - DNA, 25 bp, Mus musculus
cgcgtgcgcaaggtacgtgggagca

SEQ ID NO: 258953 - DNA, 25 bp, Mus musculus
cgcgtgcgcagactttcctcttcat

SEQ ID NO: 258954 - DNA, 25 bp, Mus musculus
cgcgtgcgttcaggaggcagactcc

SEQ ID NO: 258955 - DNA, 25 bp, Mus musculus
cgcgtggaaaacatggggcttctca

SEQ ID NO: 258956 - DNA, 25 bp, Mus musculus
cgcgtggacacccttcatggcggct

SEQ ID NO: 258957 - DNA, 25 bp, Mus musculus
cgcgtggagcaggacctggcaatgg

SEQ ID NO: 258958 - DNA, 25 bp, Mus musculus
cgcgtggatcggaactccagcgacc

SEQ ID NO: 258959 - DNA, 25 bp, Mus musculus
cgcgtggatcggcggttcattacag

SEQ ID NO: 258960 - DNA, 25 bp, Mus musculus
cgcgtggatcggttcgccttgcgcc

SEQ ID NO: 258961 - DNA, 25 bp, Mus musculus
cgcgtggatgactgaagctggcccc

SEQ ID NO: 258962 - DNA, 25 bp, Mus musculus
cgcgtggatgactgggcagccacgc

SEQ ID NO: 258963 - DNA, 25 bp, Mus musculus
cgcgtggattggccggctatggggc

SEQ ID NO: 258964 - DNA, 25 bp, Mus musculus
cgcgtgggcggccggaggtttgcca

SEQ ID NO: 258965 - DNA, 25 bp, Mus musculus
cgcgtgggtgtcccagaaatttcag

SEQ ID NO: 258966 - DNA, 25 bp, Mus musculus
cgcgtggtgctggaggtgtcctgtc

SEQ ID NO: 258967 - DNA, 25 bp, Mus musculus
cgcgtggtgctggagttaaaggcag

SEQ ID NO: 258968 - DNA, 25 bp, Mus musculus
cgcgtgtgctcgtggcacggaggtg

SEQ ID NO: 258969 - DNA, 25 bp, Mus musculus
cgcgttagccttcaaaccatgaagt

SEQ ID NO: 258970 - DNA, 25 bp, Mus musculus
cgcgttagccttcggttgtttgtct

SEQ ID NO: 258971 - DNA, 25 bp, Mus musculus
cgcgttcattccggctagccctgct

SEQ ID NO: 258972 - DNA, 25 bp, Mus musculus
cgcgttccgaagcgcctccctcttg

SEQ ID NO: 258973 - DNA, 25 bp, Mus musculus
cgcgttccgaagcgcggtcaacatg

SEQ ID NO: 258974 - DNA, 25 bp, Mus musculus
cgcgttgaagaacagagcatttagc

SEQ ID NO: 258975 - DNA, 25 bp, Mus musculus
cgcgttgaagaacagggagtgcttg

SEQ ID NO: 258976 - DNA, 25 bp, Mus musculus
cgcgttgcgccaggcaggacactgc

SEQ ID NO: 258977 - DNA, 25 bp, Mus musculus
cgcgttgcgccaggtgtagctccac

SEQ ID NO: 258978 - DNA, 25 bp, Mus musculus
cgcgttgctggtacaattaccagaa

SEQ ID NO: 258979 - DNA, 25 bp, Mus musculus
cgcgtttcgggtccccggctacagc

SEQ ID NO: 258980 - DNA, 25 bp, Mus musculus
cgcgttttcctcaggcgcagacact

SEQ ID NO: 258981 - DNA, 25 bp, Mus musculus
cgctaaaaatgcttgtttctggggc

SEQ ID NO: 258982 - DNA, 25 bp, Mus musculus
cgctaaactttgtgacttgcactaa

SEQ ID NO: 258983 - DNA, 25 bp, Mus musculus
cgctaacccaggagaacgtcagctg

SEQ ID NO: 258984 - DNA, 25 bp, Mus musculus
cgctaacccctctcctccataagca

SEQ ID NO: 258985 - DNA, 25 bp, Mus musculus
cgctaacttacagagttgagtggcc

SEQ ID NO: 258986 - DNA, 25 bp, Mus musculus
cgctaacttacaggttctgacggga

SEQ ID NO: 258987 - DNA, 25 bp, Mus musculus
cgctaagaaaggaccctcaacacct

SEQ ID NO: 258988 - DNA, 25 bp, Mus musculus
cgctaagcagccagatttagatcat

SEQ ID NO: 258989 - DNA, 25 bp, Mus musculus
cgctaagctgccgggcatgtctagg

SEQ ID NO: 258990 - DNA, 25 bp, Mus musculus
cgctaatttgtggaacctctgaggg

SEQ ID NO: 258991 - DNA, 25 bp, Mus musculus
cgctaatttgtggccgtctgctgac

SEQ ID NO: 258992 - DNA, 25 bp, Mus musculus
cgctaatttgtgtttacagacctgc

SEQ ID NO: 258993 - DNA, 25 bp, Mus musculus
cgctacaaagatgagcgggaccgag

SEQ ID NO: 258994 - DNA, 25 bp, Mus musculus
cgctacaagtgttgatacccataat

SEQ ID NO: 258995 - DNA, 25 bp, Mus musculus
cgctacaagtgttgttcccatggtg

SEQ ID NO: 258996 - DNA, 25 bp, Mus musculus
cgctacacaggacatcatgcctatg

SEQ ID NO: 258997 - DNA, 25 bp, Mus musculus
cgctacacaggagatcatgcctatg

SEQ ID NO: 258998 - DNA, 25 bp, Mus musculus
cgctacacccaagaatgtggcaatc

SEQ ID NO: 258999 - DNA, 25 bp, Mus musculus
cgctacacccaagcgagcctgtcag

SEQ ID NO: 259000 - DNA, 25 bp, Mus musculus
cgctacagtatgagggagtggggcc

SEQ ID NO: 259001 - DNA, 25 bp, Mus musculus
cgctacataaggtatctttccgacc

SEQ ID NO: 259002 - DNA, 25 bp, Mus musculus
cgctacatcgtggtggacagtgaac

SEQ ID NO: 259003 - DNA, 25 bp, Mus musculus
cgctacatcgtggtgtatgttgtat

SEQ ID NO: 259004 - DNA, 25 bp, Mus musculus
cgctacattgcccccacagtgctgg

SEQ ID NO: 259005 - DNA, 25 bp, Mus musculus
cgctacattggtcatcaaacaggtg

SEQ ID NO: 259006 - DNA, 25 bp, Mus musculus
cgctaccaggagtttgttcaggaag

SEQ ID NO: 259007 - DNA, 25 bp, Mus musculus
cgctaccaggttcccagtcttctca

SEQ ID NO: 259008 - DNA, 25 bp, Mus musculus
cgctaccagtattgtacccatgatg

SEQ ID NO: 259009 - DNA, 25 bp, Mus musculus
cgctaccagtgtagcctatgcccat

SEQ ID NO: 259010 - DNA, 25 bp, Mus musculus
cgctaccggcagatcaccatccgga

SEQ ID NO: 259011 - DNA, 25 bp, Mus musculus
cgctaccgggcatcggccctgggca

SEQ ID NO: 259012 - DNA, 25 bp, Mus musculus
cgctacctcaagctgagggcagagc

SEQ ID NO: 259013 - DNA, 25 bp, Mus musculus
cgctacctcaaggagctgagcaagc

SEQ ID NO: 259014 - DNA, 25 bp, Mus musculus
cgctacctcaatcacagttgcagcc

SEQ ID NO: 259015 - DNA, 25 bp, Mus musculus
cgctacctttgaacgaatcccgctc

SEQ ID NO: 259016 - DNA, 25 bp, Mus musculus
cgctacgataggaaacagatgggaa

SEQ ID NO: 259017 - DNA, 25 bp, Mus musculus
cgctacgataggaacacatcaagag

SEQ ID NO: 259018 - DNA, 25 bp, Mus musculus
cgctacgatagtggttccatgtcag

SEQ ID NO: 259019 - DNA, 25 bp, Mus musculus
cgctacgcgcggtatgtggcctttg

SEQ ID NO: 259020 - DNA, 25 bp, Mus musculus
cgctacggaagcctttgcttcctta

SEQ ID NO: 259021 - DNA, 25 bp, Mus musculus
cgctacggctcaatcgtggatgatg

SEQ ID NO: 259022 - DNA, 25 bp, Mus musculus
cgctactacaagaaacatggcatca

SEQ ID NO: 259023 - DNA, 25 bp, Mus musculus
cgctactcagggatgttcccttctc

SEQ ID NO: 259024 - DNA, 25 bp, Mus musculus
cgctactcccaccccgggatcgctc

SEQ ID NO: 259025 - DNA, 25 bp, Mus musculus
cgctactctcctcaaaactcagatt

SEQ ID NO: 259026 - DNA, 25 bp, Mus musculus
cgctactctcctcgacccatgagct

SEQ ID NO: 259027 - DNA, 25 bp, Mus musculus
cgctactctgggcctcaggagttca

SEQ ID NO: 259028 - DNA, 25 bp, Mus musculus
cgctactgcccactcaacatcagaa

SEQ ID NO: 259029 - DNA, 25 bp, Mus musculus
cgctactgcccattgaaaaatctgg

SEQ ID NO: 259030 - DNA, 25 bp, Mus musculus
cgctactgtatcccttttggctagg

SEQ ID NO: 259031 - DNA, 25 bp, Mus musculus
cgctacttagccccaaccatactta

SEQ ID NO: 259032 - DNA, 25 bp, Mus musculus
cgctacttaggtgatgcaagaagaa

SEQ ID NO: 259033 - DNA, 25 bp, Mus musculus
cgctactttggtgacacacactgag

SEQ ID NO: 259034 - DNA, 25 bp, Mus musculus
cgctacttttaagatttttgaagac

SEQ ID NO: 259035 - DNA, 25 bp, Mus musculus
cgctagacatccgttacaaactcca

SEQ ID NO: 259036 - DNA, 25 bp, Mus musculus
cgctagacatgaaggatggctttct

SEQ ID NO: 259037 - DNA, 25 bp, Mus musculus
cgctagacatgtacgatggctttct

SEQ ID NO: 259038 - DNA, 25 bp, Mus musculus
cgctagaccggtggaacctagggtc

SEQ ID NO: 259039 - DNA, 25 bp, Mus musculus
cgctagagcggcgagagtaatccat

SEQ ID NO: 259040 - DNA, 25 bp, Mus musculus
cgctagcacaggcttctaaacctac

SEQ ID NO: 259041 - DNA, 25 bp, Mus musculus
cgctagcacaggggttgtgtggtga

SEQ ID NO: 259042 - DNA, 25 bp, Mus musculus
cgctagcactaacgtgaccctggct

SEQ ID NO: 259043 - DNA, 25 bp, Mus musculus
cgctagcactaactgacctgggcct

SEQ ID NO: 259044 - DNA, 25 bp, Mus musculus
cgctagcgaggacagaaccatccga

SEQ ID NO: 259045 - DNA, 25 bp, Mus musculus
cgctagcgaggacagccccttgctc

SEQ ID NO: 259046 - DNA, 25 bp, Mus musculus
cgctagctgtcttactcatcagagt

SEQ ID NO: 259047 - DNA, 25 bp, Mus musculus
cgctaggctgtaagctgtacttctt

SEQ ID NO: 259048 - DNA, 25 bp, Mus musculus
cgctagtcagggacaagaagaccta

SEQ ID NO: 259049 - DNA, 25 bp, Mus musculus
cgctagtctgaaagaaagactgcgt

SEQ ID NO: 259050 - DNA, 25 bp, Mus musculus
cgctagtgctcagagtgcctgcagt

SEQ ID NO: 259051 - DNA, 25 bp, Mus musculus
cgctagtgctcagctacagcaacgt

SEQ ID NO: 259052 - DNA, 25 bp, Mus musculus
cgctataaccgagactggtacaagc

SEQ ID NO: 259053 - DNA, 25 bp, Mus musculus
cgctataaccgggctgggcctggga

SEQ ID NO: 259054 - DNA, 25 bp, Mus musculus
cgctatcatgagggtccatgccttc

SEQ ID NO: 259055 - DNA, 25 bp, Mus musculus
cgctatccccctcacagtaattctt

SEQ ID NO: 259056 - DNA, 25 bp, Mus musculus
cgctatcttcgagataagacagtga

SEQ ID NO: 259057 - DNA, 25 bp, Mus musculus
cgctatgaccttactgtcccttttg

SEQ ID NO: 259058 - DNA, 25 bp, Mus musculus
cgctatgagaaaattattttcgcct

SEQ ID NO: 259059 - DNA, 25 bp, Mus musculus
cgctatgagaaattactcttctgcg

SEQ ID NO: 259060 - DNA, 25 bp, Mus musculus
cgctatggcggtggacatcatcctg

SEQ ID NO: 259061 - DNA, 25 bp, Mus musculus
cgctatgggtcaggtagtgggcagc

SEQ ID NO: 259062 - DNA, 25 bp, Mus musculus
cgctattcagattcttctggaataa

SEQ ID NO: 259063 - DNA, 25 bp, Mus musculus
cgctattcaggcctttggagcagcg

SEQ ID NO: 259064 - DNA, 25 bp, Mus musculus
cgctattgtgaggatgaagtttctg

SEQ ID NO: 259065 - DNA, 25 bp, Mus musculus
cgctcaaacacagctcaaagattag

SEQ ID NO: 259066 - DNA, 25 bp, Mus musculus
cgctcaaagcatggggacattcaat

SEQ ID NO: 259067 - DNA, 25 bp, Mus musculus
cgctcaaagggcaagcttctactca

SEQ ID NO: 259068 - DNA, 25 bp, Mus musculus
cgctcaacaagagagaaggctttgg

SEQ ID NO: 259069 - DNA, 25 bp, Mus musculus
cgctcaacaaggacccctcatgcct

SEQ ID NO: 259070 - DNA, 25 bp, Mus musculus
cgctcaacaggtttgatggctatga

SEQ ID NO: 259071 - DNA, 25 bp, Mus musculus
cgctcaacagttcccttcttcggga

SEQ ID NO: 259072 - DNA, 25 bp, Mus musculus
cgctcaactggcaggcgtgaagtgc

SEQ ID NO: 259073 - DNA, 25 bp, Mus musculus
cgctcaagccgcgacttttgccatg

SEQ ID NO: 259074 - DNA, 25 bp, Mus musculus
cgctcaagccgcggcttctacaaac

SEQ ID NO: 259075 - DNA, 25 bp, Mus musculus
cgctcaagcggctcacccaggaatg

SEQ ID NO: 259076 - DNA, 25 bp, Mus musculus
cgctcaccagctgatggttcctggg

SEQ ID NO: 259077 - DNA, 25 bp, Mus musculus
cgctcaccctgattgactcgtggtg

SEQ ID NO: 259078 - DNA, 25 bp, Mus musculus
cgctcaccctgcgactactgtgaag

SEQ ID NO: 259079 - DNA, 25 bp, Mus musculus
cgctcacctctgagatacttggaga

SEQ ID NO: 259080 - DNA, 25 bp, Mus musculus
cgctcagaacagcatcccctacccc

SEQ ID NO: 259081 - DNA, 25 bp, Mus musculus
cgctcagaacaggtcttcacatgct

SEQ ID NO: 259082 - DNA, 25 bp, Mus musculus
cgctcagatccgtatgtaaagacct

SEQ ID NO: 259083 - DNA, 25 bp, Mus musculus
cgctcagatgttagaagatgtagct

SEQ ID NO: 259084 - DNA, 25 bp, Mus musculus
cgctcagatgttagcactagcaaca

SEQ ID NO: 259085 - DNA, 25 bp, Mus musculus
cgctcagcagcacaaaggcattagc

SEQ ID NO: 259086 - DNA, 25 bp, Mus musculus
cgctcagccatgaagatgagggtgt

SEQ ID NO: 259087 - DNA, 25 bp, Mus musculus
cgctcagcttactattaccatactg

SEQ ID NO: 259088 - DNA, 25 bp, Mus musculus
cgctcagtggcagcactccgccaga

SEQ ID NO: 259089 - DNA, 25 bp, Mus musculus
cgctcatcatgctccgtcgggaggc

SEQ ID NO: 259090 - DNA, 25 bp, Mus musculus
cgctcatcatggctcgcctgcgccg

SEQ ID NO: 259091 - DNA, 25 bp, Mus musculus
cgctcatcctccccctcaagttcaa

SEQ ID NO: 259092 - DNA, 25 bp, Mus musculus
cgctccaaaaaaggcaaattgaaga

SEQ ID NO: 259093 - DNA, 25 bp, Mus musculus
cgctccaaagaacctaaggaaggta

SEQ ID NO: 259094 - DNA, 25 bp, Mus musculus
cgctccaaagagaaaacggccccga

SEQ ID NO: 259095 - DNA, 25 bp, Mus musculus
cgctccaaagatcctgtctctacag

SEQ ID NO: 259096 - DNA, 25 bp, Mus musculus
cgctccaaaggctgcctgcttctgt

SEQ ID NO: 259097 - DNA, 25 bp, Mus musculus
cgctccaagaagaggttctcccaga

SEQ ID NO: 259098 - DNA, 25 bp, Mus musculus
cgctccacatgcaggcttcccgagg

SEQ ID NO: 259099 - DNA, 25 bp, Mus musculus
cgctccacatgcaggtgtggtacat

SEQ ID NO: 259100 - DNA, 25 bp, Mus musculus
cgctccagaggctttgctgacggag

SEQ ID NO: 259101 - DNA, 25 bp, Mus musculus
cgctccagagtgtgcactctcctca

SEQ ID NO: 259102 - DNA, 25 bp, Mus musculus
cgctccagcagattgctttattcac

SEQ ID NO: 259103 - DNA, 25 bp, Mus musculus
cgctccagcagcactctgttttcta

SEQ ID NO: 259104 - DNA, 25 bp, Mus musculus
cgctccagcagggagagcagagacg

SEQ ID NO: 259105 - DNA, 25 bp, Mus musculus
cgctccagcatagccccacggcctg

SEQ ID NO: 259106 - DNA, 25 bp, Mus musculus
cgctccagcattgctgaagtgcaga

SEQ ID NO: 259107 - DNA, 25 bp, Mus musculus
cgctccagtgcgactttactggaaa

SEQ ID NO: 259108 - DNA, 25 bp, Mus musculus
cgctccatcagggttccagtgatct

SEQ ID NO: 259109 - DNA, 25 bp, Mus musculus
cgctccatcagtggctccacgtaca

SEQ ID NO: 259110 - DNA, 25 bp, Mus musculus
cgctcccacacagccttggacaaat

SEQ ID NO: 259111 - DNA, 25 bp, Mus musculus
cgctcccacacaggtgagaagccct

SEQ ID NO: 259112 - DNA, 25 bp, Mus musculus
cgctcccactgcttcacacaggcta

SEQ ID NO: 259113 - DNA, 25 bp, Mus musculus
cgctcccactggcatgctagtccca

SEQ ID NO: 259114 - DNA, 25 bp, Mus musculus
cgctcccagaatggatgtaaccatt

SEQ ID NO: 259115 - DNA, 25 bp, Mus musculus
cgctcccagaatgttatggctgcag

SEQ ID NO: 259116 - DNA, 25 bp, Mus musculus
cgctccccaaggaggtattccccac

SEQ ID NO: 259117 - DNA, 25 bp, Mus musculus
cgctcccccttagacactactttgc

SEQ ID NO: 259118 - DNA, 25 bp, Mus musculus
cgctccccgaggtgtgaatgaggca

SEQ ID NO: 259119 - DNA, 25 bp, Mus musculus
cgctccccggcggagatgaggaaac

SEQ ID NO: 259120 - DNA, 25 bp, Mus musculus
cgctccccggcggaggtgtgacccc

SEQ ID NO: 259121 - DNA, 25 bp, Mus musculus
cgctcccgcctcgggttgctgttct

SEQ ID NO: 259122 - DNA, 25 bp, Mus musculus
cgctccctgcactccccaggacccc

SEQ ID NO: 259123 - DNA, 25 bp, Mus musculus
cgctccgatccctacgtgaaaagct

SEQ ID NO: 259124 - DNA, 25 bp, Mus musculus
cgctccgcagacacccgctgtgagc

SEQ ID NO: 259125 - DNA, 25 bp, Mus musculus
cgctccgcagacaccttccgccaag

SEQ ID NO: 259126 - DNA, 25 bp, Mus musculus
cgctccgcagaggtcgcagcgtgag

SEQ ID NO: 259127 - DNA, 25 bp, Mus musculus
cgctccgccagagggacagtcggcc

SEQ ID NO: 259128 - DNA, 25 bp, Mus musculus
cgctccgcccgtgttggtggaatga

SEQ ID NO: 259129 - DNA, 25 bp, Mus musculus
cgctccgccgattcctttgtgatcg

SEQ ID NO: 259130 - DNA, 25 bp, Mus musculus
cgctccgccggtgagcacgagcctg

SEQ ID NO: 259131 - DNA, 25 bp, Mus musculus
cgctccgcgggctggccctccaaga

SEQ ID NO: 259132 - DNA, 25 bp, Mus musculus
cgctccgcgtgagaatcaaatacct

SEQ ID NO: 259133 - DNA, 25 bp, Mus musculus
cgctccgctagccaacatgagtctg

SEQ ID NO: 259134 - DNA, 25 bp, Mus musculus
cgctccgctcacgaaaggcaagctg

SEQ ID NO: 259135 - DNA, 25 bp, Mus musculus
cgctccgctcacgtgctacctgtcc

SEQ ID NO: 259136 - DNA, 25 bp, Mus musculus
cgctccgggccagagcctgagcctt

SEQ ID NO: 259137 - DNA, 25 bp, Mus musculus
cgctccgtagggaagacatctttgg

SEQ ID NO: 259138 - DNA, 25 bp, Mus musculus
cgctccgtcaagaatccggagatcg

SEQ ID NO: 259139 - DNA, 25 bp, Mus musculus
cgctccgtcaaggtgtcggacgaca

SEQ ID NO: 259140 - DNA, 25 bp, Mus musculus
cgctcctaggggtggcgaccgtgct

SEQ ID NO: 259141 - DNA, 25 bp, Mus musculus
cgctcctatggcatgtgggcacatt

SEQ ID NO: 259142 - DNA, 25 bp, Mus musculus
cgctcctcgagggcataacctgggt

SEQ ID NO: 259143 - DNA, 25 bp, Mus musculus
cgctcctgcacagattgcgctggct

SEQ ID NO: 259144 - DNA, 25 bp, Mus musculus
cgctcctgcgcgcgcccggcctggc

SEQ ID NO: 259145 - DNA, 25 bp, Mus musculus
cgctcctggaatcagcagccagtga

SEQ ID NO: 259146 - DNA, 25 bp, Mus musculus
cgctcctggcaggaaggcctgcgct

SEQ ID NO: 259147 - DNA, 25 bp, Mus musculus
cgctccttcccgggcttttcgcagt

SEQ ID NO: 259148 - DNA, 25 bp, Mus musculus
cgctccttctagtggcagacctgtt

SEQ ID NO: 259149 - DNA, 25 bp, Mus musculus
cgctcctttgcagactttgatcctc

SEQ ID NO: 259150 - DNA, 25 bp, Mus musculus
cgctcctttgcagagcctgaccaga

SEQ ID NO: 259151 - DNA, 25 bp, Mus musculus
cgctcctttgcagccacagacagta

SEQ ID NO: 259152 - DNA, 25 bp, Mus musculus
cgctcgaacggccaggtgtcgtgat

SEQ ID NO: 259153 - DNA, 25 bp, Mus musculus
cgctcgaagtcgctaggacttctct

SEQ ID NO: 259154 - DNA, 25 bp, Mus musculus
cgctcgacatggagatgagtgtgaa

SEQ ID NO: 259155 - DNA, 25 bp, Mus musculus
cgctcgacatggaggaccctctgtc

SEQ ID NO: 259156 - DNA, 25 bp, Mus musculus
cgctcgagcccgctgcctgtgccta

SEQ ID NO: 259157 - DNA, 25 bp, Mus musculus
cgctcgagcccggggactttgtgca

SEQ ID NO: 259158 - DNA, 25 bp, Mus musculus
cgctcgagcccggtacctgggccag

SEQ ID NO: 259159 - DNA, 25 bp, Mus musculus
cgctcgatgcggccaaagagatgtc

SEQ ID NO: 259160 - DNA, 25 bp, Mus musculus
cgctcgatgcgggtggtaggaatgt

SEQ ID NO: 259161 - DNA, 25 bp, Mus musculus
cgctcgatgcgttcacaatcttcta

SEQ ID NO: 259162 - DNA, 25 bp, Mus musculus
cgctcgcaacgaggagactccagaa

SEQ ID NO: 259163 - DNA, 25 bp, Mus musculus
cgctcgcacaccgagatatgaggat

SEQ ID NO: 259164 - DNA, 25 bp, Mus musculus
cgctcgcacacggcctctgtgctcg

SEQ ID NO: 259165 - DNA, 25 bp, Mus musculus
cgctcgcacacggcctggaggtgtg

SEQ ID NO: 259166 - DNA, 25 bp, Mus musculus
cgctcgcacacgggggacgccccct

SEQ ID NO: 259167 - DNA, 25 bp, Mus musculus
cgctcgccttgccttctctcaaact

SEQ ID NO: 259168 - DNA, 25 bp, Mus musculus
cgctcgcgaaccttgcccatggcga

SEQ ID NO: 259169 - DNA, 25 bp, Mus musculus
cgctcgcgaaccttgggaattcgac

SEQ ID NO: 259170 - DNA, 25 bp, Mus musculus
cgctcggaactgtgtcgtgattaaa

SEQ ID NO: 259171 - DNA, 25 bp, Mus musculus
cgctcggagatcgcttttgtggcta

SEQ ID NO: 259172 - DNA, 25 bp, Mus musculus
cgctcggagatcgtatacttgaagg

SEQ ID NO: 259173 - DNA, 25 bp, Mus musculus
cgctcggatgccagatgttgcatgt

SEQ ID NO: 259174 - DNA, 25 bp, Mus musculus
cgctcggccagagaggccggggccc

SEQ ID NO: 259175 - DNA, 25 bp, Mus musculus
cgctcggcccaggataagtacggtt

SEQ ID NO: 259176 - DNA, 25 bp, Mus musculus
cgctcggctgcagggtaagaccagc

SEQ ID NO: 259177 - DNA, 25 bp, Mus musculus
cgctcggctgcgcagctgcccctgt

SEQ ID NO: 259178 - DNA, 25 bp, Mus musculus
cgctcggctgcgcaggaaagtgccc

SEQ ID NO: 259179 - DNA, 25 bp, Mus musculus
cgctcgggaaggctcctcgccgtct

SEQ ID NO: 259180 - DNA, 25 bp, Mus musculus
cgctcgggaaggcttttgacccgct

SEQ ID NO: 259181 - DNA, 25 bp, Mus musculus
cgctcggtgagttgcaggatccagc

SEQ ID NO: 259182 - DNA, 25 bp, Mus musculus
cgctcgtgcaagttccctggctcct

SEQ ID NO: 259183 - DNA, 25 bp, Mus musculus
cgctcgtgccaagtctcacacaggt

SEQ ID NO: 259184 - DNA, 25 bp, Mus musculus
cgctcgtttctggtccatacattgt

SEQ ID NO: 259185 - DNA, 25 bp, Mus musculus
cgctctaatacagactcagccatgg

SEQ ID NO: 259186 - DNA, 25 bp, Mus musculus
cgctctaatacagtggcttctttct

SEQ ID NO: 259187 - DNA, 25 bp, Mus musculus
cgctctacacgatgcggccgaaagt

SEQ ID NO: 259188 - DNA, 25 bp, Mus musculus
cgctctacacgtatgaagtacacag

SEQ ID NO: 259189 - DNA, 25 bp, Mus musculus
cgctctacatagaagttgaccagat

SEQ ID NO: 259190 - DNA, 25 bp, Mus musculus
cgctctatttgatgttcatgcagaa

SEQ ID NO: 259191 - DNA, 25 bp, Mus musculus
cgctctcaaggccgagtacaacagg

SEQ ID NO: 259192 - DNA, 25 bp, Mus musculus
cgctctcaaggtatagtcctagcac

SEQ ID NO: 259193 - DNA, 25 bp, Mus musculus
cgctctccgtagtgaagctgtgggc

SEQ ID NO: 259194 - DNA, 25 bp, Mus musculus
cgctctccttgccgaatgcctaaat

SEQ ID NO: 259195 - DNA, 25 bp, Mus musculus
cgctctcgtagaaattgctccaaag

SEQ ID NO: 259196 - DNA, 25 bp, Mus musculus
cgctctcgtagatctgccacctccc

SEQ ID NO: 259197 - DNA, 25 bp, Mus musculus
cgctctcgtaggctgaagagtgaac

SEQ ID NO: 259198 - DNA, 25 bp, Mus musculus
cgctctctgctgacctatgaggaga

SEQ ID NO: 259199 - DNA, 25 bp, Mus musculus
cgctctctgctgagtctgaagatgc

SEQ ID NO: 259200 - DNA, 25 bp, Mus musculus
cgctctgaagtcaccctgccagcaa

SEQ ID NO: 259201 - DNA, 25 bp, Mus musculus
cgctctgagaagtactctcaagttc

SEQ ID NO: 259202 - DNA, 25 bp, Mus musculus
cgctctgagaatgtatgactcggtg

SEQ ID NO: 259203 - DNA, 25 bp, Mus musculus
cgctctgagggttccaattggttcc

SEQ ID NO: 259204 - DNA, 25 bp, Mus musculus
cgctctgatgtatggatcggaacgt

SEQ ID NO: 259205 - DNA, 25 bp, Mus musculus
cgctctgcagctggtcacagctctg

SEQ ID NO: 259206 - DNA, 25 bp, Mus musculus
cgctctgcagctgtatgttgtatgg

SEQ ID NO: 259207 - DNA, 25 bp, Mus musculus
cgctctgcatccggggacagagtcc

SEQ ID NO: 259208 - DNA, 25 bp, Mus musculus
cgctctgccctgattccttctggaa

SEQ ID NO: 259209 - DNA, 25 bp, Mus musculus
cgctctgcgaccagctcccaagtac

SEQ ID NO: 259210 - DNA, 25 bp, Mus musculus
cgctctgctgccctgaatctgtgga

SEQ ID NO: 259211 - DNA, 25 bp, Mus musculus
cgctctggaggcgagaaccatgtgt

SEQ ID NO: 259212 - DNA, 25 bp, Mus musculus
cgctctggaggcgagtatttcctaa

SEQ ID NO: 259213 - DNA, 25 bp, Mus musculus
cgctctggatctagtgacagcagct

SEQ ID NO: 259214 - DNA, 25 bp, Mus musculus
cgctctggccgacctaatccccagg

SEQ ID NO: 259215 - DNA, 25 bp, Mus musculus
cgctctggccggagtgagagagaga

SEQ ID NO: 259216 - DNA, 25 bp, Mus musculus
cgctctgggaccggattcccgaagc

SEQ ID NO: 259217 - DNA, 25 bp, Mus musculus
cgctctggggatgtcaacctacaag

SEQ ID NO: 259218 - DNA, 25 bp, Mus musculus
cgctctgtcatccgaaaactccagg

SEQ ID NO: 259219 - DNA, 25 bp, Mus musculus
cgctctgtcatccgccctagcacaa

SEQ ID NO: 259220 - DNA, 25 bp, Mus musculus
cgctctgtgttagcggggtgccacg

SEQ ID NO: 259221 - DNA, 25 bp, Mus musculus
cgctcttccatacagatgatattga

SEQ ID NO: 259222 - DNA, 25 bp, Mus musculus
cgctcttctccaccaagtcaaagta

SEQ ID NO: 259223 - DNA, 25 bp, Mus musculus
cgctcttgtcacaggtggtgagatt

SEQ ID NO: 259224 - DNA, 25 bp, Mus musculus
cgctcttttttgctggatagagaga

SEQ ID NO: 259225 - DNA, 25 bp, Mus musculus
cgctgaacaaccaactgggcagcaa

SEQ ID NO: 259226 - DNA, 25 bp, Mus musculus
cgctgaaccgagcctgttcctgcgc

SEQ ID NO: 259227 - DNA, 25 bp, Mus musculus
cgctgaagaagatcggtcagcacct

SEQ ID NO: 259228 - DNA, 25 bp, Mus musculus
cgctgaagaagattcgccggtacaa

SEQ ID NO: 259229 - DNA, 25 bp, Mus musculus
cgctgaagagcatccgtgcagcccg

SEQ ID NO: 259230 - DNA, 25 bp, Mus musculus
cgctgaagagcgtattgaagggcga

SEQ ID NO: 259231 - DNA, 25 bp, Mus musculus
cgctgaagcaggcttccagccagct

SEQ ID NO: 259232 - DNA, 25 bp, Mus musculus
cgctgaagcaggtcataaagccccg

SEQ ID NO: 259233 - DNA, 25 bp, Mus musculus
cgctgaagccagagagtcatggatg

SEQ ID NO: 259234 - DNA, 25 bp, Mus musculus
cgctgaatatgaactctcatcctta

SEQ ID NO: 259235 - DNA, 25 bp, Mus musculus
cgctgaatctcacttcaggcccaga

SEQ ID NO: 259236 - DNA, 25 bp, Mus musculus
cgctgaatctcactttagatagtga

SEQ ID NO: 259237 - DNA, 25 bp, Mus musculus
cgctgaatgtcaaagattgtaacat

SEQ ID NO: 259238 - DNA, 25 bp, Mus musculus
cgctgaatgtcatgtatttcaacaa

SEQ ID NO: 259239 - DNA, 25 bp, Mus musculus
cgctgaatttacggtcaccattctt

SEQ ID NO: 259240 - DNA, 25 bp, Mus musculus
cgctgaatttacggtggctctccca

SEQ ID NO: 259241 - DNA, 25 bp, Mus musculus
cgctgacagacgaggtaaacagccc

SEQ ID NO: 259242 - DNA, 25 bp, Mus musculus
cgctgacattcagagttgaaactgt

SEQ ID NO: 259243 - DNA, 25 bp, Mus musculus
cgctgacattcaggtgcagtctttg

SEQ ID NO: 259244 - DNA, 25 bp, Mus musculus
cgctgaccaaggcgccatggaaaag

SEQ ID NO: 259245 - DNA, 25 bp, Mus musculus
cgctgaccagtgactccaatatgcc

SEQ ID NO: 259246 - DNA, 25 bp, Mus musculus
cgctgaccatactggacaccctttc

SEQ ID NO: 259247 - DNA, 25 bp, Mus musculus
cgctgacccagcggcgaggacgagg

SEQ ID NO: 259248 - DNA, 25 bp, Mus musculus
cgctgaccctgtgtctcaggggcct

SEQ ID NO: 259249 - DNA, 25 bp, Mus musculus
cgctgaccgacaaaaagatcaggca

SEQ ID NO: 259250 - DNA, 25 bp, Mus musculus
cgctgacgtagaggaaatgctgtca

SEQ ID NO: 259251 - DNA, 25 bp, Mus musculus
cgctgactcggatcgagccctaacg

SEQ ID NO: 259252 - DNA, 25 bp, Mus musculus
cgctgactcggccaaccaatggaat

SEQ ID NO: 259253 - DNA, 25 bp, Mus musculus
cgctgactcgggtcattacaaagaa

SEQ ID NO: 259254 - DNA, 25 bp, Mus musculus
cgctgactgacatctactgccgagg

SEQ ID NO: 259255 - DNA, 25 bp, Mus musculus
cgctgactgctgcggacaagttttt

SEQ ID NO: 259256 - DNA, 25 bp, Mus musculus
cgctgactggaaggatctgcgatgg

SEQ ID NO: 259257 - DNA, 25 bp, Mus musculus
cgctgactttgagaaacggaagcca

SEQ ID NO: 259258 - DNA, 25 bp, Mus musculus
cgctgactttgagaagctgaagcca

SEQ ID NO: 259259 - DNA, 25 bp, Mus musculus
cgctgactttggcctgcatgagggt

SEQ ID NO: 259260 - DNA, 25 bp, Mus musculus
cgctgagaatatgtacttttctcac

SEQ ID NO: 259261 - DNA, 25 bp, Mus musculus
cgctgagaatccagatccagggttc

SEQ ID NO: 259262 - DNA, 25 bp, Mus musculus
cgctgagaatccaggtctcccggac

SEQ ID NO: 259263 - DNA, 25 bp, Mus musculus
cgctgagactaaagtctttaagaaa

SEQ ID NO: 259264 - DNA, 25 bp, Mus musculus
cgctgagattaaaggcctctgggga

SEQ ID NO: 259265 - DNA, 25 bp, Mus musculus
cgctgagcccatgagtggaaacaag

SEQ ID NO: 259266 - DNA, 25 bp, Mus musculus
cgctgagcgtggagaaaaagcagcg

SEQ ID NO: 259267 - DNA, 25 bp, Mus musculus
cgctgagctcaatatggatcaaaat

SEQ ID NO: 259268 - DNA, 25 bp, Mus musculus
cgctgaggaagccgccactggagaa

SEQ ID NO: 259269 - DNA, 25 bp, Mus musculus
cgctgaggcatcagatgcttatacc

SEQ ID NO: 259270 - DNA, 25 bp, Mus musculus
cgctgagggaaagaaaaataccttg

SEQ ID NO: 259271 - DNA, 25 bp, Mus musculus
cgctgagggaaagagttcacatgag

SEQ ID NO: 259272 - DNA, 25 bp, Mus musculus
cgctgagggaaagattgacggcggg

SEQ ID NO: 259273 - DNA, 25 bp, Mus musculus
cgctgagggtcgagaatacaagaaa

SEQ ID NO: 259274 - DNA, 25 bp, Mus musculus
cgctgagggtcggtgccagcacatc

SEQ ID NO: 259275 - DNA, 25 bp, Mus musculus
cgctgaggtggtatataaccgttcc

SEQ ID NO: 259276 - DNA, 25 bp, Mus musculus
cgctgagtggatacattccaccact

SEQ ID NO: 259277 - DNA, 25 bp, Mus musculus
cgctgagttctggaatacagtgagt

SEQ ID NO: 259278 - DNA, 25 bp, Mus musculus
cgctgataagaaaaccactgagcaa

SEQ ID NO: 259279 - DNA, 25 bp, Mus musculus
cgctgatatggagaaccttcacacc

SEQ ID NO: 259280 - DNA, 25 bp, Mus musculus
cgctgatgaccctgactatatagtg

SEQ ID NO: 259281 - DNA, 25 bp, Mus musculus
cgctgatgaccgacccttgggtagg

SEQ ID NO: 259282 - DNA, 25 bp, Mus musculus
cgctgatgcagacggagaagcagtt

SEQ ID NO: 259283 - DNA, 25 bp, Mus musculus
cgctgatggcggtgaagacaaagta

SEQ ID NO: 259284 - DNA, 25 bp, Mus musculus
cgctgatggtgaagatcccatacat

SEQ ID NO: 259285 - DNA, 25 bp, Mus musculus
cgctgatgtgggtgtagcactcctg

SEQ ID NO: 259286 - DNA, 25 bp, Mus musculus
cgctgattgggaaggtttggcctgg

SEQ ID NO: 259287 - DNA, 25 bp, Mus musculus
cgctgatttaggaggacaggtgtga

SEQ ID NO: 259288 - DNA, 25 bp, Mus musculus
cgctgcaacaatgaatggcatgcat

SEQ ID NO: 259289 - DNA, 25 bp, Mus musculus
cgctgcaacaatggcgccccctgta

SEQ ID NO: 259290 - DNA, 25 bp, Mus musculus
cgctgcacagtgatgactcttccac

SEQ ID NO: 259291 - DNA, 25 bp, Mus musculus
cgctgcaccccgtcagtcatatcat

SEQ ID NO: 259292 - DNA, 25 bp, Mus musculus
cgctgcacccgcaaagcctccaggt

SEQ ID NO: 259293 - DNA, 25 bp, Mus musculus
cgctgcacgatagtatgaccggttg

SEQ ID NO: 259294 - DNA, 25 bp, Mus musculus
cgctgcacgccggcatgtgtttctt

SEQ ID NO: 259295 - DNA, 25 bp, Mus musculus
cgctgcacgccgtaatttctaatgc

SEQ ID NO: 259296 - DNA, 25 bp, Mus musculus
cgctgcacgccttcagagacggcaa

SEQ ID NO: 259297 - DNA, 25 bp, Mus musculus
cgctgcagaatgcagcagtttgcaa

SEQ ID NO: 259298 - DNA, 25 bp, Mus musculus
cgctgcagaatgcaggtgtaatgtc

SEQ ID NO: 259299 - DNA, 25 bp, Mus musculus
cgctgcagtcaggcatcaaggagtc

SEQ ID NO: 259300 - DNA, 25 bp, Mus musculus
cgctgcagtgtagggtaaacacaag

SEQ ID NO: 259301 - DNA, 25 bp, Mus musculus
cgctgcatccccagtccatctatga

SEQ ID NO: 259302 - DNA, 25 bp, Mus musculus
cgctgccacagcgctgtgtagttct

SEQ ID NO: 259303 - DNA, 25 bp, Mus musculus
cgctgccaccatgaaaggagaagcg

SEQ ID NO: 259304 - DNA, 25 bp, Mus musculus
cgctgccagccggaacagtgagcag

SEQ ID NO: 259305 - DNA, 25 bp, Mus musculus
cgctgccattcaagtggcagccaca

SEQ ID NO: 259306 - DNA, 25 bp, Mus musculus
cgctgcccaagcgccggagtactgg

SEQ ID NO: 259307 - DNA, 25 bp, Mus musculus
cgctgcccacacgctgattctctac

SEQ ID NO: 259308 - DNA, 25 bp, Mus musculus
cgctgcccacacgctgcaggtgctg

SEQ ID NO: 259309 - DNA, 25 bp, Mus musculus
cgctgcccaggctgaaggcatccca

SEQ ID NO: 259310 - DNA, 25 bp, Mus musculus
cgctgcccaggtccgcacgctcact

SEQ ID NO: 259311 - DNA, 25 bp, Mus musculus
cgctgccccagggatctttggccag

SEQ ID NO: 259312 - DNA, 25 bp, Mus musculus
cgctgcccgccgccaatatgcctga

SEQ ID NO: 259313 - DNA, 25 bp, Mus musculus
cgctgcccgggatctccatctttcc

SEQ ID NO: 259314 - DNA, 25 bp, Mus musculus
cgctgccctggggctgtgtctggct

SEQ ID NO: 259315 - DNA, 25 bp, Mus musculus
cgctgcccttcttcgacatggctgg

SEQ ID NO: 259316 - DNA, 25 bp, Mus musculus
cgctgcccttcttcgtggatccagg

SEQ ID NO: 259317 - DNA, 25 bp, Mus musculus
cgctgccgaggaggctagacaaatg

SEQ ID NO: 259318 - DNA, 25 bp, Mus musculus
cgctgccgcctccagtgccgggagc

SEQ ID NO: 259319 - DNA, 25 bp, Mus musculus
cgctgccgcgagataaaatcaaaga

SEQ ID NO: 259320 - DNA, 25 bp, Mus musculus
cgctgccgctccagaagctcgaagc

SEQ ID NO: 259321 - DNA, 25 bp, Mus musculus
cgctgcctactgggcaaggtggttt

SEQ ID NO: 259322 - DNA, 25 bp, Mus musculus
cgctgcctactggggaaggagaagc

SEQ ID NO: 259323 - DNA, 25 bp, Mus musculus
cgctgcctcagagcccaccgcaacg

SEQ ID NO: 259324 - DNA, 25 bp, Mus musculus
cgctgcctcagcaagccccgcccaa

SEQ ID NO: 259325 - DNA, 25 bp, Mus musculus
cgctgcctcttccaccttccagcag

SEQ ID NO: 259326 - DNA, 25 bp, Mus musculus
cgctgcctgcatctacctttgcaga

SEQ ID NO: 259327 - DNA, 25 bp, Mus musculus
cgctgcctgcatctgtctcttaacc

SEQ ID NO: 259328 - DNA, 25 bp, Mus musculus
cgctgcctggacagcattgccgcca

SEQ ID NO: 259329 - DNA, 25 bp, Mus musculus
cgctgcctggacaggggctctttag

SEQ ID NO: 259330 - DNA, 25 bp, Mus musculus
cgctgccttgactgtggaaagagcc

SEQ ID NO: 259331 - DNA, 25 bp, Mus musculus
cgctgccttgagagtcgcttcaaag

SEQ ID NO: 259332 - DNA, 25 bp, Mus musculus
cgctgcgagaggagcagcggcccct

SEQ ID NO: 259333 - DNA, 25 bp, Mus musculus
cgctgcgagaggagggtgctgacta

SEQ ID NO: 259334 - DNA, 25 bp, Mus musculus
cgctgcgagtggccgccccaccttc

SEQ ID NO: 259335 - DNA, 25 bp, Mus musculus
cgctgcgccaaattttcacctgacg

SEQ ID NO: 259336 - DNA, 25 bp, Mus musculus
cgctgcgcgagaggaatgcgctcat

SEQ ID NO: 259337 - DNA, 25 bp, Mus musculus
cgctgcgcgagagtatgtcttggct

SEQ ID NO: 259338 - DNA, 25 bp, Mus musculus
cgctgcgctaattgtaaattcacct

SEQ ID NO: 259339 - DNA, 25 bp, Mus musculus
cgctgcgctccgggagtaaagacat

SEQ ID NO: 259340 - DNA, 25 bp, Mus musculus
cgctgcgctcggtgagtgcaggatc

SEQ ID NO: 259341 - DNA, 25 bp, Mus musculus
cgctgcgctgcgctaattgtaaatt

SEQ ID NO: 259342 - DNA, 25 bp, Mus musculus
cgctgcgctgcgtgacagctggtgg

SEQ ID NO: 259343 - DNA, 25 bp, Mus musculus
cgctgcgctgcgtgcatccgtgcag

SEQ ID NO: 259344 - DNA, 25 bp, Mus musculus
cgctgcggagacaggttgcagaatt

SEQ ID NO: 259345 - DNA, 25 bp, Mus musculus
cgctgcggcaccgcttgtcctgggc

SEQ ID NO: 259346 - DNA, 25 bp, Mus musculus
cgctgcggcaccggctggcccgcgg

SEQ ID NO: 259347 - DNA, 25 bp, Mus musculus
cgctgcggcaccgtttcctctacag

SEQ ID NO: 259348 - DNA, 25 bp, Mus musculus
cgctgcggccagagcttcggtgcaa

SEQ ID NO: 259349 - DNA, 25 bp, Mus musculus
cgctgcggcgtggagcaaaacaatt

SEQ ID NO: 259350 - DNA, 25 bp, Mus musculus
cgctgcgggcaccgggagctggtga

SEQ ID NO: 259351 - DNA, 25 bp, Mus musculus
cgctgcgggcgagatgtatacatct

SEQ ID NO: 259352 - DNA, 25 bp, Mus musculus
cgctgctacgtgagaacttgaagca

SEQ ID NO: 259353 - DNA, 25 bp, Mus musculus
cgctgctacgtgagtttttcagatt

SEQ ID NO: 259354 - DNA, 25 bp, Mus musculus
cgctgctataggcatgaaagaagtg

SEQ ID NO: 259355 - DNA, 25 bp, Mus musculus
cgctgctataggctactattggaaa

SEQ ID NO: 259356 - DNA, 25 bp, Mus musculus
cgctgctattctccactccagagga

SEQ ID NO: 259357 - DNA, 25 bp, Mus musculus
cgctgctcaaccagacgcacctcta

SEQ ID NO: 259358 - DNA, 25 bp, Mus musculus
cgctgctcaaccagtggacatatca

SEQ ID NO: 259359 - DNA, 25 bp, Mus musculus
cgctgctcagaacgaaccaagaatt

SEQ ID NO: 259360 - DNA, 25 bp, Mus musculus
cgctgctcagaacggatcaataagc

SEQ ID NO: 259361 - DNA, 25 bp, Mus musculus
cgctgctcgccgagggcataacctg

SEQ ID NO: 259362 - DNA, 25 bp, Mus musculus
cgctgctgagataggacgggagaaa

SEQ ID NO: 259363 - DNA, 25 bp, Mus musculus
cgctgctgagcttcacctggttcac

SEQ ID NO: 259364 - DNA, 25 bp, Mus musculus
cgctgctgaggagaatgcggaggcc

SEQ ID NO: 259365 - DNA, 25 bp, Mus musculus
cgctgctgaggtcgtacaccctgga

SEQ ID NO: 259366 - DNA, 25 bp, Mus musculus
cgctgctgcctctgattggccttgg

SEQ ID NO: 259367 - DNA, 25 bp, Mus musculus
cgctgctgcctgtattgaccaagaa

SEQ ID NO: 259368 - DNA, 25 bp, Mus musculus
cgctgctgcgagaggccaaggtgac

SEQ ID NO: 259369 - DNA, 25 bp, Mus musculus
cgctgctgcgcacagagtcccaaaa

SEQ ID NO: 259370 - DNA, 25 bp, Mus musculus
cgctgctgcgcacagattccccaaa

SEQ ID NO: 259371 - DNA, 25 bp, Mus musculus
cgctgctgctcggcaatgatggcag

SEQ ID NO: 259372 - DNA, 25 bp, Mus musculus
cgctgctgggaataacagacaaaag

SEQ ID NO: 259373 - DNA, 25 bp, Mus musculus
cgctgctgtccacaggtccacggtg

SEQ ID NO: 259374 - DNA, 25 bp, Mus musculus
cgctgctgtgcagctttttagaact

SEQ ID NO: 259375 - DNA, 25 bp, Mus musculus
cgctgcttcagagatgagtgaaaat

SEQ ID NO: 259376 - DNA, 25 bp, Mus musculus
cgctgcttcagcacctctgggagcc

SEQ ID NO: 259377 - DNA, 25 bp, Mus musculus
cgctgcttcggtggtgtagtggagc

SEQ ID NO: 259378 - DNA, 25 bp, Mus musculus
cgctgcttgaaaagacactgagtcc

SEQ ID NO: 259379 - DNA, 25 bp, Mus musculus
cgctgctttagagtctccagagcca

SEQ ID NO: 259380 - DNA, 25 bp, Mus musculus
cgctgctttaggcccaggagggtga

SEQ ID NO: 259381 - DNA, 25 bp, Mus musculus
cgctggaaccctctagcacctaaag

SEQ ID NO: 259382 - DNA, 25 bp, Mus musculus
cgctggaaccctctgtgcagagagg

SEQ ID NO: 259383 - DNA, 25 bp, Mus musculus
cgctggaagatttatacaaaaggtt

SEQ ID NO: 259384 - DNA, 25 bp, Mus musculus
cgctggaatctggccctggttctga

SEQ ID NO: 259385 - DNA, 25 bp, Mus musculus
cgctggaatctgtgggcgggcagct

SEQ ID NO: 259386 - DNA, 25 bp, Mus musculus
cgctggacctccgggtcctgtgggt

SEQ ID NO: 259387 - DNA, 25 bp, Mus musculus
cgctggacgcaagggcattgaaaac

SEQ ID NO: 259388 - DNA, 25 bp, Mus musculus
cgctggacgcaagggtttgtgttta

SEQ ID NO: 259389 - DNA, 25 bp, Mus musculus
cgctggacgcgcggaaaggaaacct

SEQ ID NO: 259390 - DNA, 25 bp, Mus musculus
cgctggacgggtggagtgtcatctt

SEQ ID NO: 259391 - DNA, 25 bp, Mus musculus
cgctggagaattccttctctgaagc

SEQ ID NO: 259392 - DNA, 25 bp, Mus musculus
cgctggagcagaagaataaagagat

SEQ ID NO: 259393 - DNA, 25 bp, Mus musculus
cgctggagcagaaggataaacaaag

SEQ ID NO: 259394 - DNA, 25 bp, Mus musculus
cgctggagcagggccacgtggcacc

SEQ ID NO: 259395 - DNA, 25 bp, Mus musculus
cgctggagcccgagtggcaccagct

SEQ ID NO: 259396 - DNA, 25 bp, Mus musculus
cgctggagcccgatggttttcggaa

SEQ ID NO: 259397 - DNA, 25 bp, Mus musculus
cgctggagcgaccgccaggctccca

SEQ ID NO: 259398 - DNA, 25 bp, Mus musculus
cgctggagggcaagatattagcatt

SEQ ID NO: 259399 - DNA, 25 bp, Mus musculus
cgctggatcaggtattccttttttg

SEQ ID NO: 259400 - DNA, 25 bp, Mus musculus
cgctggatcaggttaactttgtggc

SEQ ID NO: 259401 - DNA, 25 bp, Mus musculus
cgctggatcagtttaggatttaaga

SEQ ID NO: 259402 - DNA, 25 bp, Mus musculus
cgctggatgtctctgcaccatcggt

SEQ ID NO: 259403 - DNA, 25 bp, Mus musculus
cgctggcaaactgttctgtggtggt

SEQ ID NO: 259404 - DNA, 25 bp, Mus musculus
cgctggcactgaggtttgggaacca

SEQ ID NO: 259405 - DNA, 25 bp, Mus musculus
cgctggcagaatgagaatgtgattc

SEQ ID NO: 259406 - DNA, 25 bp, Mus musculus
cgctggcaggtcccagggattttgg

SEQ ID NO: 259407 - DNA, 25 bp, Mus musculus
cgctggcatggacagttctgcccca

SEQ ID NO: 259408 - DNA, 25 bp, Mus musculus
cgctggccactggtttatatccaga

SEQ ID NO: 259409 - DNA, 25 bp, Mus musculus
cgctggccagacagctgcagcacga

SEQ ID NO: 259410 - DNA, 25 bp, Mus musculus
cgctggccagataaggctagcccta

SEQ ID NO: 259411 - DNA, 25 bp, Mus musculus
cgctggccagctgcctcaccctgcc

SEQ ID NO: 259412 - DNA, 25 bp, Mus musculus
cgctggccaggtattgttagaactc

SEQ ID NO: 259413 - DNA, 25 bp, Mus musculus
cgctggccagtatgtggcctttgcc

SEQ ID NO: 259414 - DNA, 25 bp, Mus musculus
cgctggccagtttcttcagcgaacc

SEQ ID NO: 259415 - DNA, 25 bp, Mus musculus
cgctggcccaagaggcattatcgac

SEQ ID NO: 259416 - DNA, 25 bp, Mus musculus
cgctggccccgagatgaagtgactg

SEQ ID NO: 259417 - DNA, 25 bp, Mus musculus
cgctggccctcctggtgctgatggc

SEQ ID NO: 259418 - DNA, 25 bp, Mus musculus
cgctggcctcaacagttcctgggtg

SEQ ID NO: 259419 - DNA, 25 bp, Mus musculus
cgctggcgcaagatgacgttgcacc

SEQ ID NO: 259420 - DNA, 25 bp, Mus musculus
cgctggctctctcttggcctgttgc

SEQ ID NO: 259421 - DNA, 25 bp, Mus musculus
cgctggctgaacagacttggctttc

SEQ ID NO: 259422 - DNA, 25 bp, Mus musculus
cgctggctgaacagagaacagagtt

SEQ ID NO: 259423 - DNA, 25 bp, Mus musculus
cgctggctgaacagtgagcttcact

SEQ ID NO: 259424 - DNA, 25 bp, Mus musculus
cgctggctgaacagtttccgctgcc

SEQ ID NO: 259425 - DNA, 25 bp, Mus musculus
cgctggctgtggatctcaggtgact

SEQ ID NO: 259426 - DNA, 25 bp, Mus musculus
cgctggcttccaaatggaactctga

SEQ ID NO: 259427 - DNA, 25 bp, Mus musculus
cgctgggaacaagtaccattaatta

SEQ ID NO: 259428 - DNA, 25 bp, Mus musculus
cgctgggagagcagcgggaacttca

SEQ ID NO: 259429 - DNA, 25 bp, Mus musculus
cgctgggagagcaggaggtgtaaag

SEQ ID NO: 259430 - DNA, 25 bp, Mus musculus
cgctgggatcgctttagaatgtgat

SEQ ID NO: 259431 - DNA, 25 bp, Mus musculus
cgctgggatcggtttttgtgaattc

SEQ ID NO: 259432 - DNA, 25 bp, Mus musculus
cgctgggatcgtttgtttatatggt

SEQ ID NO: 259433 - DNA, 25 bp, Mus musculus
cgctgggcagacgaaagagcctgtg

SEQ ID NO: 259434 - DNA, 25 bp, Mus musculus
cgctgggcagagggatctttggcca

SEQ ID NO: 259435 - DNA, 25 bp, Mus musculus
cgctgggcagatcttccttgggggc

SEQ ID NO: 259436 - DNA, 25 bp, Mus musculus
cgctgggcagggagatctgacgggc

SEQ ID NO: 259437 - DNA, 25 bp, Mus musculus
cgctgggcagtccattctctttggt

SEQ ID NO: 259438 - DNA, 25 bp, Mus musculus
cgctgggccgaggctcttctgcgat

SEQ ID NO: 259439 - DNA, 25 bp, Mus musculus
cgctgggctcctggtctctgggcca

SEQ ID NO: 259440 - DNA, 25 bp, Mus musculus
cgctgggctcggagttttcaggaag

SEQ ID NO: 259441 - DNA, 25 bp, Mus musculus
cgctggggaaggacgcatctcttcg

SEQ ID NO: 259442 - DNA, 25 bp, Mus musculus
cgctgggtgaaagtgttgacagccc

SEQ ID NO: 259443 - DNA, 25 bp, Mus musculus
cgctgggtggagaaaaatgttttac

SEQ ID NO: 259444 - DNA, 25 bp, Mus musculus
cgctggtcgggctgtggcagtttcc

SEQ ID NO: 259445 - DNA, 25 bp, Mus musculus
cgctggtgctgccccacacctctgg

SEQ ID NO: 259446 - DNA, 25 bp, Mus musculus
cgctggtgctgcccccggccagccc

SEQ ID NO: 259447 - DNA, 25 bp, Mus musculus
cgctggtgctggggtcctttatgga

SEQ ID NO: 259448 - DNA, 25 bp, Mus musculus
cgctggtggagggtgtcaccgaagg

SEQ ID NO: 259449 - DNA, 25 bp, Mus musculus
cgctggtggccgccgacaacactgg

SEQ ID NO: 259450 - DNA, 25 bp, Mus musculus
cgctggtggccgccgatacatatac

SEQ ID NO: 259451 - DNA, 25 bp, Mus musculus
cgctggtgtctggtggcactgacac

SEQ ID NO: 259452 - DNA, 25 bp, Mus musculus
cgctggtgtgccaacgaggaatatc

SEQ ID NO: 259453 - DNA, 25 bp, Mus musculus
cgctggtgtgccaacgccagctttt

SEQ ID NO: 259454 - DNA, 25 bp, Mus musculus
cgctggtgtgccaggagagtactaa

SEQ ID NO: 259455 - DNA, 25 bp, Mus musculus
cgctggtgttcgagttcctcaggtc

SEQ ID NO: 259456 - DNA, 25 bp, Mus musculus
cgctggttctgagaatctgcctgtg

SEQ ID NO: 259457 - DNA, 25 bp, Mus musculus
cgctggttctgagttctcatctccc

SEQ ID NO: 259458 - DNA, 25 bp, Mus musculus
cgctggtttgcgctccctccaacat

SEQ ID NO: 259459 - DNA, 25 bp, Mus musculus
cgctgtaaacagagactcacttctg

SEQ ID NO: 259460 - DNA, 25 bp, Mus musculus
cgctgtacaagattgggcagcccag

SEQ ID NO: 259461 - DNA, 25 bp, Mus musculus
cgctgtacaagattggtcaactcag

SEQ ID NO: 259462 - DNA, 25 bp, Mus musculus
cgctgtacaagcttggcttcttcaa

SEQ ID NO: 259463 - DNA, 25 bp, Mus musculus
cgctgtacaaggttcactctaattg

SEQ ID NO: 259464 - DNA, 25 bp, Mus musculus
cgctgtacgaggctccagcatacca

SEQ ID NO: 259465 - DNA, 25 bp, Mus musculus
cgctgtacgcagttttacagagagc

SEQ ID NO: 259466 - DNA, 25 bp, Mus musculus
cgctgtatagaatgcggggttcgct

SEQ ID NO: 259467 - DNA, 25 bp, Mus musculus
cgctgtcaaaagtcttgcgctcagg

SEQ ID NO: 259468 - DNA, 25 bp, Mus musculus
cgctgtcaagtcgatgagcagtttg

SEQ ID NO: 259469 - DNA, 25 bp, Mus musculus
cgctgtccagctcgtagtgcatgtt

SEQ ID NO: 259470 - DNA, 25 bp, Mus musculus
cgctgtccaggagctggagaagctg

SEQ ID NO: 259471 - DNA, 25 bp, Mus musculus
cgctgtccagggtcttcaaagcttc

SEQ ID NO: 259472 - DNA, 25 bp, Mus musculus
cgctgtccccaggaggccccactca

SEQ ID NO: 259473 - DNA, 25 bp, Mus musculus
cgctgtcccccacgcgagtttgtct

SEQ ID NO: 259474 - DNA, 25 bp, Mus musculus
cgctgtcccccaggcgagtttgtct

SEQ ID NO: 259475 - DNA, 25 bp, Mus musculus
cgctgtcctccccgttctgataccc

SEQ ID NO: 259476 - DNA, 25 bp, Mus musculus
cgctgtcctgtggaggtgtaaagaa

SEQ ID NO: 259477 - DNA, 25 bp, Mus musculus
cgctgtccttaatgaacctcccact

SEQ ID NO: 259478 - DNA, 25 bp, Mus musculus
cgctgtccttctcctccgcctctga

SEQ ID NO: 259479 - DNA, 25 bp, Mus musculus
cgctgtcgtgagaagcatggtgaag

SEQ ID NO: 259480 - DNA, 25 bp, Mus musculus
cgctgtcgtgagaaggtatagcagt

SEQ ID NO: 259481 - DNA, 25 bp, Mus musculus
cgctgtctccaagccaagaggacct

SEQ ID NO: 259482 - DNA, 25 bp, Mus musculus
cgctgtctccgcaggggaacagtac

SEQ ID NO: 259483 - DNA, 25 bp, Mus musculus
cgctgtcttcgagagaaaagttgga

SEQ ID NO: 259484 - DNA, 25 bp, Mus musculus
cgctgtcttcggctcttcatagcct

SEQ ID NO: 259485 - DNA, 25 bp, Mus musculus
cgctgtgacaactgccccctggaac

SEQ ID NO: 259486 - DNA, 25 bp, Mus musculus
cgctgtgacagatctgagcactgag

SEQ ID NO: 259487 - DNA, 25 bp, Mus musculus
cgctgtgacagcacctccgtccgag

SEQ ID NO: 259488 - DNA, 25 bp, Mus musculus
cgctgtgcaggggagcaccgcggcc

SEQ ID NO: 259489 - DNA, 25 bp, Mus musculus
cgctgtgcgggtgtctccacgacca

SEQ ID NO: 259490 - DNA, 25 bp, Mus musculus
cgctgtgcgggtgtgggcacatctg

SEQ ID NO: 259491 - DNA, 25 bp, Mus musculus
cgctgtggaactgtttgaaggcttg

SEQ ID NO: 259492 - DNA, 25 bp, Mus musculus
cgctgtggagataaagaagctgagg

SEQ ID NO: 259493 - DNA, 25 bp, Mus musculus
cgctgtggccacgtgttctgccgat

SEQ ID NO: 259494 - DNA, 25 bp, Mus musculus
cgctgtggtctatgaaaccaatgtt

SEQ ID NO: 259495 - DNA, 25 bp, Mus musculus
cgctgtggtgatgagatggaccaaa

SEQ ID NO: 259496 - DNA, 25 bp, Mus musculus
cgctgtggtgcggctgtgtggcacc

SEQ ID NO: 259497 - DNA, 25 bp, Mus musculus
cgctgtgtaactcagaaagaagatt

SEQ ID NO: 259498 - DNA, 25 bp, Mus musculus
cgctgtgtcctgaggatctttccaa

SEQ ID NO: 259499 - DNA, 25 bp, Mus musculus
cgctgtgtcctgagtatcccaggcg

SEQ ID NO: 259500 - DNA, 25 bp, Mus musculus
cgctgtgtctatcgtgcgggccctg

SEQ ID NO: 259501 - DNA, 25 bp, Mus musculus
cgctgtgtctatgtgaagccatcca

SEQ ID NO: 259502 - DNA, 25 bp, Mus musculus
cgctgtgttggacttccttgtggac

SEQ ID NO: 259503 - DNA, 25 bp, Mus musculus
cgctgttaagagttcacatgagact

SEQ ID NO: 259504 - DNA, 25 bp, Mus musculus
cgctgttacggaggcgaagaggatc

SEQ ID NO: 259505 - DNA, 25 bp, Mus musculus
cgctgttacgggctgtgacaatctc

SEQ ID NO: 259506 - DNA, 25 bp, Mus musculus
cgctgttgacagggtctgcagcata

SEQ ID NO: 259507 - DNA, 25 bp, Mus musculus
cgctgttgccgtgacctttgcagat

SEQ ID NO: 259508 - DNA, 25 bp, Mus musculus
cgctgttggttggagcatttgacat

SEQ ID NO: 259509 - DNA, 25 bp, Mus musculus
cgctgttggttggagtgctcaagga

SEQ ID NO: 259510 - DNA, 25 bp, Mus musculus
cgctgttttgaaacatgtccacctc

SEQ ID NO: 259511 - DNA, 25 bp, Mus musculus
cgcttaaactgggagtgtgtgccga

SEQ ID NO: 259512 - DNA, 25 bp, Mus musculus
cgcttaacatgaaggaccttctgtc

SEQ ID NO: 259513 - DNA, 25 bp, Mus musculus
cgcttaacatggagatgagtgtgaa

SEQ ID NO: 259514 - DNA, 25 bp, Mus musculus
cgcttaacatggaggaccctctgtc

SEQ ID NO: 259515 - DNA, 25 bp, Mus musculus
cgcttaagtttatgaattcctcaga

SEQ ID NO: 259516 - DNA, 25 bp, Mus musculus
cgcttaagtttatggctgcagttcc

SEQ ID NO: 259517 - DNA, 25 bp, Mus musculus
cgcttaagtttatgtgctctatgcc

SEQ ID NO: 259518 - DNA, 25 bp, Mus musculus
cgcttaattgagaaggcatacaaat

SEQ ID NO: 259519 - DNA, 25 bp, Mus musculus
cgcttacggactaggccagcaggtg

SEQ ID NO: 259520 - DNA, 25 bp, Mus musculus
cgcttacggactagggccctgcaca

SEQ ID NO: 259521 - DNA, 25 bp, Mus musculus
cgcttacggactaggtggccatcaa

SEQ ID NO: 259522 - DNA, 25 bp, Mus musculus
cgcttacttaaaggaagtggaacaa

SEQ ID NO: 259523 - DNA, 25 bp, Mus musculus
cgcttagcagacgcttaaaggatgg

SEQ ID NO: 259524 - DNA, 25 bp, Mus musculus
cgcttagcatacagaatatgaacat

SEQ ID NO: 259525 - DNA, 25 bp, Mus musculus
cgcttagcatacaggtccaacccag

SEQ ID NO: 259526 - DNA, 25 bp, Mus musculus
cgcttatcattaccagttcaagatc

SEQ ID NO: 259527 - DNA, 25 bp, Mus musculus
cgcttatttgaggagaatgagatca

SEQ ID NO: 259528 - DNA, 25 bp, Mus musculus
cgcttatttgaggagtttgggcttt

SEQ ID NO: 259529 - DNA, 25 bp, Mus musculus
cgcttcaaatggatagtcacatgct

SEQ ID NO: 259530 - DNA, 25 bp, Mus musculus
cgcttcaacaggaaggtgactgtgg

SEQ ID NO: 259531 - DNA, 25 bp, Mus musculus
cgcttcaacagggccatggaggaag

SEQ ID NO: 259532 - DNA, 25 bp, Mus musculus
cgcttcaatgcaccgggtgctcaac

SEQ ID NO: 259533 - DNA, 25 bp, Mus musculus
cgcttcacatacaggagcgacagtt

SEQ ID NO: 259534 - DNA, 25 bp, Mus musculus
cgcttcagacgcaagaccattcttt

SEQ ID NO: 259535 - DNA, 25 bp, Mus musculus
cgcttcaggtgaggcctttaccctc

SEQ ID NO: 259536 - DNA, 25 bp, Mus musculus
cgcttcattcaagtgcgcaaacttc

SEQ ID NO: 259537 - DNA, 25 bp, Mus musculus
cgcttcattcaatttgatcaagagg

SEQ ID NO: 259538 - DNA, 25 bp, Mus musculus
cgcttccacactgaggtgcactggc

SEQ ID NO: 259539 - DNA, 25 bp, Mus musculus
cgcttccaccgcagtgtgaagaaaa

SEQ ID NO: 259540 - DNA, 25 bp, Mus musculus
cgcttccagcagacatccttctacg

SEQ ID NO: 259541 - DNA, 25 bp, Mus musculus
cgcttccatcagacctgaggtccaa

SEQ ID NO: 259542 - DNA, 25 bp, Mus musculus
cgcttcccggagagccttacgagag

SEQ ID NO: 259543 - DNA, 25 bp, Mus musculus
cgcttcccggagcacttggaatctc

SEQ ID NO: 259544 - DNA, 25 bp, Mus musculus
cgcttccctcaggcgaaaatatttc

SEQ ID NO: 259545 - DNA, 25 bp, Mus musculus
cgcttccgatccttacctcgtgagg

SEQ ID NO: 259546 - DNA, 25 bp, Mus musculus
cgcttccggtcagatgttcacacgg

SEQ ID NO: 259547 - DNA, 25 bp, Mus musculus
cgcttcctagcagaggaaaagaagc

SEQ ID NO: 259548 - DNA, 25 bp, Mus musculus
cgcttcctagcaggagtgatgatgt

SEQ ID NO: 259549 - DNA, 25 bp, Mus musculus
cgcttcctcaagctgagtcctgaga

SEQ ID NO: 259550 - DNA, 25 bp, Mus musculus
cgcttcctcacactcagagccttcc

SEQ ID NO: 259551 - DNA, 25 bp, Mus musculus
cgcttcctcagcatggctggaccgc

SEQ ID NO: 259552 - DNA, 25 bp, Mus musculus
cgcttcctcataaggtcacgttcat

SEQ ID NO: 259553 - DNA, 25 bp, Mus musculus
cgcttcctgaagggatgggctcttc

SEQ ID NO: 259554 - DNA, 25 bp, Mus musculus
cgcttcctgtccgtacagagactca

SEQ ID NO: 259555 - DNA, 25 bp, Mus musculus
cgcttcgagaagaatttccgtgtgg

SEQ ID NO: 259556 - DNA, 25 bp, Mus musculus
cgcttcgagaaggtgccgacaatgg

SEQ ID NO: 259557 - DNA, 25 bp, Mus musculus
cgcttcggaatgagaaaaaggagaa

SEQ ID NO: 259558 - DNA, 25 bp, Mus musculus
cgcttcggagaagatgtggacccct

SEQ ID NO: 259559 - DNA, 25 bp, Mus musculus
cgcttcggagaaggcctcctgccag

SEQ ID NO: 259560 - DNA, 25 bp, Mus musculus
cgcttcggcaagcaaggcttatacc

SEQ ID NO: 259561 - DNA, 25 bp, Mus musculus
cgcttcgggcagctgctgattcacg

SEQ ID NO: 259562 - DNA, 25 bp, Mus musculus
cgcttcgtatcctagagaggtgctc

SEQ ID NO: 259563 - DNA, 25 bp, Mus musculus
cgcttctaaggtggtggcctaccat

SEQ ID NO: 259564 - DNA, 25 bp, Mus musculus
cgcttctagtgccgcttctcgaatg

SEQ ID NO: 259565 - DNA, 25 bp, Mus musculus
cgcttctccaggagagggaagaatt

SEQ ID NO: 259566 - DNA, 25 bp, Mus musculus
cgcttctcccacagtgcgtgctatt

SEQ ID NO: 259567 - DNA, 25 bp, Mus musculus
cgcttctctctgcaggtcaggaatc

SEQ ID NO: 259568 - DNA, 25 bp, Mus musculus
cgcttctctctgcaggttaatatcc

SEQ ID NO: 259569 - DNA, 25 bp, Mus musculus
cgcttctgaaggagacccagcatgt

SEQ ID NO: 259570 - DNA, 25 bp, Mus musculus
cgcttctgaaggagccggcatgacc

SEQ ID NO: 259571 - DNA, 25 bp, Mus musculus
cgcttctgcagctggcactggggct

SEQ ID NO: 259572 - DNA, 25 bp, Mus musculus
cgcttcttgccagtttattaacagc

SEQ ID NO: 259573 - DNA, 25 bp, Mus musculus
cgcttctttgaggactccagattcc

SEQ ID NO: 259574 - DNA, 25 bp, Mus musculus
cgcttgcaaggttcctgtcccacca

SEQ ID NO: 259575 - DNA, 25 bp, Mus musculus
cgcttgcaagtgtgacttggaaggg

SEQ ID NO: 259576 - DNA, 25 bp, Mus musculus
cgcttgccacactgtgaccctaaaa

SEQ ID NO: 259577 - DNA, 25 bp, Mus musculus
cgcttgccacttcaggatacatcag

SEQ ID NO: 259578 - DNA, 25 bp, Mus musculus
cgcttgccacttcaggtaaaatata

SEQ ID NO: 259579 - DNA, 25 bp, Mus musculus
cgcttgcggaggtttggattcagga

SEQ ID NO: 259580 - DNA, 25 bp, Mus musculus
cgcttgcgttcgggaagatgctggt

SEQ ID NO: 259581 - DNA, 25 bp, Mus musculus
cgcttggaaaagcacttggagctgc

SEQ ID NO: 259582 - DNA, 25 bp, Mus musculus
cgcttggaaaagtgctcatgacctg

SEQ ID NO: 259583 - DNA, 25 bp, Mus musculus
cgcttggaaagcaaatgcaataggc

SEQ ID NO: 259584 - DNA, 25 bp, Mus musculus
cgcttggaaagttgtccagtctggc

SEQ ID NO: 259585 - DNA, 25 bp, Mus musculus
cgcttggagaatggcagcagcagca

SEQ ID NO: 259586 - DNA, 25 bp, Mus musculus
cgcttggatggggtattgacaaatc

SEQ ID NO: 259587 - DNA, 25 bp, Mus musculus
cgcttggcagagccagacatcagaa

SEQ ID NO: 259588 - DNA, 25 bp, Mus musculus
cgcttggcaggccggcagaggactg

SEQ ID NO: 259589 - DNA, 25 bp, Mus musculus
cgcttggccagggttaactttgagg

SEQ ID NO: 259590 - DNA, 25 bp, Mus musculus
cgcttgtagaaatgccaaagccctt

SEQ ID NO: 259591 - DNA, 25 bp, Mus musculus
cgcttgtccggcctctgtagagctc

SEQ ID NO: 259592 - DNA, 25 bp, Mus musculus
cgcttgtccgggcgggttgaggcgc

SEQ ID NO: 259593 - DNA, 25 bp, Mus musculus
cgcttgtggggaatgtttttgagct

SEQ ID NO: 259594 - DNA, 25 bp, Mus musculus
cgctttaacttggggtgagtcagaa

SEQ ID NO: 259595 - DNA, 25 bp, Mus musculus
cgctttactcgccaggcaagcgctt

SEQ ID NO: 259596 - DNA, 25 bp, Mus musculus
cgctttcaactgtatggtcttgggc

SEQ ID NO: 259597 - DNA, 25 bp, Mus musculus
cgctttcaagctcctgctgaaccac

SEQ ID NO: 259598 - DNA, 25 bp, Mus musculus
cgctttcaggcccgcacaggcgcac

SEQ ID NO: 259599 - DNA, 25 bp, Mus musculus
cgctttcatttactgatgggagtca

SEQ ID NO: 259600 - DNA, 25 bp, Mus musculus
cgctttcatttactttgtggccttt

SEQ ID NO: 259601 - DNA, 25 bp, Mus musculus
cgctttcccgagacttcccaagaaa

SEQ ID NO: 259602 - DNA, 25 bp, Mus musculus
cgctttccctcagcagacacgcacc

SEQ ID NO: 259603 - DNA, 25 bp, Mus musculus
cgctttccggaaatggcactgtttt

SEQ ID NO: 259604 - DNA, 25 bp, Mus musculus
cgctttccggaaatgtgagcgggag

SEQ ID NO: 259605 - DNA, 25 bp, Mus musculus
cgctttccggcgagggctgtaaaaa

SEQ ID NO: 259606 - DNA, 25 bp, Mus musculus
cgctttcttagatgttgccttcatc

SEQ ID NO: 259607 - DNA, 25 bp, Mus musculus
cgctttgaagaagatgaagaggtgg

SEQ ID NO: 259608 - DNA, 25 bp, Mus musculus
cgctttgatggaaagaaaattgccc

SEQ ID NO: 259609 - DNA, 25 bp, Mus musculus
cgctttgatggaaaggagttctggc

SEQ ID NO: 259610 - DNA, 25 bp, Mus musculus
cgctttggacagaaaatcaccgtgc

SEQ ID NO: 259611 - DNA, 25 bp, Mus musculus
cgctttggacaggatattgactaga

SEQ ID NO: 259612 - DNA, 25 bp, Mus musculus
cgctttggagagcgtcaagatcaag

SEQ ID NO: 259613 - DNA, 25 bp, Mus musculus
cgctttggaggtgacaaacttgaag

SEQ ID NO: 259614 - DNA, 25 bp, Mus musculus
cgctttggatgagtgtgaactggac

SEQ ID NO: 259615 - DNA, 25 bp, Mus musculus
cgctttggatggctcccggacctct

SEQ ID NO: 259616 - DNA, 25 bp, Mus musculus
cgctttggatggtgatgatgaagat

SEQ ID NO: 259617 - DNA, 25 bp, Mus musculus
cgctttggatgtgccttcggaggcc

SEQ ID NO: 259618 - DNA, 25 bp, Mus musculus
cgctttggcagcggatctccatctt

SEQ ID NO: 259619 - DNA, 25 bp, Mus musculus
cgctttggccccaaacccatgcgta

SEQ ID NO: 259620 - DNA, 25 bp, Mus musculus
cgctttgggatgaagattgtggatg

SEQ ID NO: 259621 - DNA, 25 bp, Mus musculus
cgctttgtgcaggaagaagactacg

SEQ ID NO: 259622 - DNA, 25 bp, Mus musculus
cgctttgtgcaggcccagaggaact

SEQ ID NO: 259623 - DNA, 25 bp, Mus musculus
cgctttgtggcggacgtgacttgta

SEQ ID NO: 259624 - DNA, 25 bp, Mus musculus
cgctttgttaccttgctgtatcgac

SEQ ID NO: 259625 - DNA, 25 bp, Mus musculus
cgcttttcagatcctggatggtatc

SEQ ID NO: 259626 - DNA, 25 bp, Mus musculus
cgcttttctcagctgtgacttcttt

SEQ ID NO: 259627 - DNA, 25 bp, Mus musculus
cgcttttgaacttgatcgtactcga

SEQ ID NO: 259628 - DNA, 25 bp, Mus musculus
cgcttttgaacttggatgtccagag

SEQ ID NO: 259629 - DNA, 25 bp, Mus musculus
cgcttttgagcttggcaaatggtcc

SEQ ID NO: 259630 - DNA, 25 bp, Mus musculus
cgcttttgagtgacagccctgctga

SEQ ID NO: 259631 - DNA, 25 bp, Mus musculus
cgcttttgatttcctgtcccctgaa

SEQ ID NO: 259632 - DNA, 25 bp, Mus musculus
cgcttttgccagacaagcagtgaaa

SEQ ID NO: 259633 - DNA, 25 bp, Mus musculus
cgcttttgccaggtgatggaaaacg

SEQ ID NO: 259634 - DNA, 25 bp, Mus musculus
cgctttttgagcagacctgggccca

SEQ ID NO: 259635 - DNA, 25 bp, Mus musculus
cgctttttgagcaggtcacaaacct

SEQ ID NO: 259636 - DNA, 25 bp, Mus musculus
cgcttttttatcaggtcgcatcaaa

SEQ ID NO: 259637 - DNA, 25 bp, Mus musculus
cggaaaaaatgggtggacttggcct

SEQ ID NO: 259638 - DNA, 25 bp, Mus musculus
cggaaaaacaagagttactcacaaa

SEQ ID NO: 259639 - DNA, 25 bp, Mus musculus
cggaaaaaggaaggtcatcgtggag

SEQ ID NO: 259640 - DNA, 25 bp, Mus musculus
cggaaaaaggttttgacgcatctgg

SEQ ID NO: 259641 - DNA, 25 bp, Mus musculus
cggaaaaatccatggtgcctgagtt

SEQ ID NO: 259642 - DNA, 25 bp, Mus musculus
cggaaaaatccattaccagtgcttg

SEQ ID NO: 259643 - DNA, 25 bp, Mus musculus
cggaaaaatggaagtatagtctttg

SEQ ID NO: 259644 - DNA, 25 bp, Mus musculus
cggaaaaatgtgctccagctgaggc

SEQ ID NO: 259645 - DNA, 25 bp, Mus musculus
cggaaaacaaaggcatccttacttc

SEQ ID NO: 259646 - DNA, 25 bp, Mus musculus
cggaaaacactggaagcaagagaaa

SEQ ID NO: 259647 - DNA, 25 bp, Mus musculus
cggaaaacactggcggaaccagtat

SEQ ID NO: 259648 - DNA, 25 bp, Mus musculus
cggaaaaccagagtccagcctctga

SEQ ID NO: 259649 - DNA, 25 bp, Mus musculus
cggaaaacccaatctctgcgatttt

SEQ ID NO: 259650 - DNA, 25 bp, Mus musculus
cggaaaaggattttgatcactggag

SEQ ID NO: 259651 - DNA, 25 bp, Mus musculus
cggaaaaggattttggcaggaagag

SEQ ID NO: 259652 - DNA, 25 bp, Mus musculus
cggaaaaggattttgttgaccagat

SEQ ID NO: 259653 - DNA, 25 bp, Mus musculus
cggaaaagtttgtcaaagacataga

SEQ ID NO: 259654 - DNA, 25 bp, Mus musculus
cggaaaatgccgagctgccacaggc

SEQ ID NO: 259655 - DNA, 25 bp, Mus musculus
cggaaaatttaaaaggttgcagtgt

SEQ ID NO: 259656 - DNA, 25 bp, Mus musculus
cggaaacaggcggaggaaacctatg

SEQ ID NO: 259657 - DNA, 25 bp, Mus musculus
cggaaacaggcggaggctagacaaa

SEQ ID NO: 259658 - DNA, 25 bp, Mus musculus
cggaaacatgaagagggtaaatagc

SEQ ID NO: 259659 - DNA, 25 bp, Mus musculus
cggaaacatgaagaggtattgactg

SEQ ID NO: 259660 - DNA, 25 bp, Mus musculus
cggaaactcaagatgtcggttggac

SEQ ID NO: 259661 - DNA, 25 bp, Mus musculus
cggaaactcagatgaatgaagaaag

SEQ ID NO: 259662 - DNA, 25 bp, Mus musculus
cggaaacttagggaatgacaaggtc

SEQ ID NO: 259663 - DNA, 25 bp, Mus musculus
cggaaacttagtgagtgtgtccctt

SEQ ID NO: 259664 - DNA, 25 bp, Mus musculus
cggaaagaaaacgagctgtttgaca

SEQ ID NO: 259665 - DNA, 25 bp, Mus musculus
cggaaagatggcgtaccttctcatt

SEQ ID NO: 259666 - DNA, 25 bp, Mus musculus
cggaaagcaactttttctgctaatg

SEQ ID NO: 259667 - DNA, 25 bp, Mus musculus
cggaaagcaccaaagcttcgcataa

SEQ ID NO: 259668 - DNA, 25 bp, Mus musculus
cggaaagcaccaaagtaccatttag

SEQ ID NO: 259669 - DNA, 25 bp, Mus musculus
cggaaagcctgccaagttctggaaa

SEQ ID NO: 259670 - DNA, 25 bp, Mus musculus
cggaaagtgcgagacggtcgcagag

SEQ ID NO: 259671 - DNA, 25 bp, Mus musculus
cggaaagtgcgaggagatgctcacg

SEQ ID NO: 259672 - DNA, 25 bp, Mus musculus
cggaaagttggggccctggagtcca

SEQ ID NO: 259673 - DNA, 25 bp, Mus musculus
cggaaataagactgcagctttagac

SEQ ID NO: 259674 - DNA, 25 bp, Mus musculus
cggaaatatcagttactactcaact

SEQ ID NO: 259675 - DNA, 25 bp, Mus musculus
cggaaatatccagagcgacgagatt

SEQ ID NO: 259676 - DNA, 25 bp, Mus musculus
cggaaatatccagatttagagcgac

SEQ ID NO: 259677 - DNA, 25 bp, Mus musculus
cggaaatcaaggattcttaatcact

SEQ ID NO: 259678 - DNA, 25 bp, Mus musculus
cggaaatctagtgttctccagtttt

SEQ ID NO: 259679 - DNA, 25 bp, Mus musculus
cggaaatgatcagcctcagtccgat

SEQ ID NO: 259680 - DNA, 25 bp, Mus musculus
cggaaatgtactcaattagcatgac

SEQ ID NO: 259681 - DNA, 25 bp, Mus musculus
cggaaattagggcaagagccagagg

SEQ ID NO: 259682 - DNA, 25 bp, Mus musculus
cggaaattccaaggaacctggtggc

SEQ ID NO: 259683 - DNA, 25 bp, Mus musculus
cggaaatttgttagaaagcctgcaa

SEQ ID NO: 259684 - DNA, 25 bp, Mus musculus
cggaacaaagtaagaagctgtcttc

SEQ ID NO: 259685 - DNA, 25 bp, Mus musculus
cggaacaacaataggtgtttcacca

SEQ ID NO: 259686 - DNA, 25 bp, Mus musculus
cggaacaccacaagagcatcgcaac

SEQ ID NO: 259687 - DNA, 25 bp, Mus musculus
cggaacactggccggagaagctgga

SEQ ID NO: 259688 - DNA, 25 bp, Mus musculus
cggaacactggccggcacaatatga

SEQ ID NO: 259689 - DNA, 25 bp, Mus musculus
cggaacagccgtgaagcacctaaag

SEQ ID NO: 259690 - DNA, 25 bp, Mus musculus
cggaacagcgcaggacccagaagct

SEQ ID NO: 259691 - DNA, 25 bp, Mus musculus
cggaacagttcatgaaatcttttga

SEQ ID NO: 259692 - DNA, 25 bp, Mus musculus
cggaacagttcatgaggttacgtcc

SEQ ID NO: 259693 - DNA, 25 bp, Mus musculus
cggaacattgaagagcatgcctctg

SEQ ID NO: 259694 - DNA, 25 bp, Mus musculus
cggaacattttaaagacatttgaga

SEQ ID NO: 259695 - DNA, 25 bp, Mus musculus
cggaaccaaggtggctatggcggtt

SEQ ID NO: 259696 - DNA, 25 bp, Mus musculus
cggaaccagagtcagaaaaatataa

SEQ ID NO: 259697 - DNA, 25 bp, Mus musculus
cggaaccaggtgtcaccctgaggag

SEQ ID NO: 259698 - DNA, 25 bp, Mus musculus
cggaaccatggctagcctctgccga

SEQ ID NO: 259699 - DNA, 25 bp, Mus musculus
cggaaccatggcttccctttccctc

SEQ ID NO: 259700 - DNA, 25 bp, Mus musculus
cggaaccatgtgaaaccttccaccg

SEQ ID NO: 259701 - DNA, 25 bp, Mus musculus
cggaacccaagtcatcttggctgaa

SEQ ID NO: 259702 - DNA, 25 bp, Mus musculus
cggaacccatctcagatcttctgcc

SEQ ID NO: 259703 - DNA, 25 bp, Mus musculus
cggaaccctccactagctggcattc

SEQ ID NO: 259704 - DNA, 25 bp, Mus musculus
cggaaccctgaaggatcctcgctct

SEQ ID NO: 259705 - DNA, 25 bp, Mus musculus
cggaacctcaaagtcagtggctatc

SEQ ID NO: 259706 - DNA, 25 bp, Mus musculus
cggaacgctgcttcggtggtgtagt

SEQ ID NO: 259707 - DNA, 25 bp, Mus musculus
cggaacgggaatgctgatcactgga

SEQ ID NO: 259708 - DNA, 25 bp, Mus musculus
cggaactaaagcaaatggttatgag

SEQ ID NO: 259709 - DNA, 25 bp, Mus musculus
cggaactacagggtccaactgagcc

SEQ ID NO: 259710 - DNA, 25 bp, Mus musculus
cggaactatcctgtggtctccattg

SEQ ID NO: 259711 - DNA, 25 bp, Mus musculus
cggaactcagatttcaactattgca

SEQ ID NO: 259712 - DNA, 25 bp, Mus musculus
cggaactccatggtccccagtgctg

SEQ ID NO: 259713 - DNA, 25 bp, Mus musculus
cggaactcgatgagcctgtttgagc

SEQ ID NO: 259714 - DNA, 25 bp, Mus musculus
cggaactctgaacctctatgaagtc

SEQ ID NO: 259715 - DNA, 25 bp, Mus musculus
cggaactgaaagctgtcctctattg

SEQ ID NO: 259716 - DNA, 25 bp, Mus musculus
cggaactgaaagctgttttaaagga

SEQ ID NO: 259717 - DNA, 25 bp, Mus musculus
cggaactgagccatctcttggcgtc

SEQ ID NO: 259718 - DNA, 25 bp, Mus musculus
cggaactggacaagaaggagaagat

SEQ ID NO: 259719 - DNA, 25 bp, Mus musculus
cggaactggacaagtgtcttcttgg

SEQ ID NO: 259720 - DNA, 25 bp, Mus musculus
cggaacttcaaggatgaagaaacac

SEQ ID NO: 259721 - DNA, 25 bp, Mus musculus
cggaacttcaagtcctcctgcatat

SEQ ID NO: 259722 - DNA, 25 bp, Mus musculus
cggaacttggaccgcagccctctgc

SEQ ID NO: 259723 - DNA, 25 bp, Mus musculus
cggaacttggaccggaactgtccga

SEQ ID NO: 259724 - DNA, 25 bp, Mus musculus
cggaagaaaataaagaataaactag

SEQ ID NO: 259725 - DNA, 25 bp, Mus musculus
cggaagaacaccaaagagtgagtaa

SEQ ID NO: 259726 - DNA, 25 bp, Mus musculus
cggaagaacaccaaattttaagagt

SEQ ID NO: 259727 - DNA, 25 bp, Mus musculus
cggaagaagaatatgccccagagaa

SEQ ID NO: 259728 - DNA, 25 bp, Mus musculus
cggaagaagacacagagggctgaca

SEQ ID NO: 259729 - DNA, 25 bp, Mus musculus
cggaagaagagaagaaagatgaggc

SEQ ID NO: 259730 - DNA, 25 bp, Mus musculus
cggaagaatacgtatcaccaaactc

SEQ ID NO: 259731 - DNA, 25 bp, Mus musculus
cggaagacacggagtatatatcctg

SEQ ID NO: 259732 - DNA, 25 bp, Mus musculus
cggaagagatcctcgagtgaggacg

SEQ ID NO: 259733 - DNA, 25 bp, Mus musculus
cggaagagccgtctgggcaagcagg

SEQ ID NO: 259734 - DNA, 25 bp, Mus musculus
cggaagagccgtctggtgtggaggg

SEQ ID NO: 259735 - DNA, 25 bp, Mus musculus
cggaagagctcagagcagaaaactt

SEQ ID NO: 259736 - DNA, 25 bp, Mus musculus
cggaagaggagggagaatcccgtat

SEQ ID NO: 259737 - DNA, 25 bp, Mus musculus
cggaagaggtggagatcagcagagt

SEQ ID NO: 259738 - DNA, 25 bp, Mus musculus
cggaagaggtggaggccccagtcaa

SEQ ID NO: 259739 - DNA, 25 bp, Mus musculus
cggaagatgcaagatgcagagagaa

SEQ ID NO: 259740 - DNA, 25 bp, Mus musculus
cggaagatgtcagttcatatggaga

SEQ ID NO: 259741 - DNA, 25 bp, Mus musculus
cggaagattgtccagacggctgctc

SEQ ID NO: 259742 - DNA, 25 bp, Mus musculus
cggaagcaaggtctggtccatcgaa

SEQ ID NO: 259743 - DNA, 25 bp, Mus musculus
cggaagcactaacgtttgatcccca

SEQ ID NO: 259744 - DNA, 25 bp, Mus musculus
cggaagcactaactccagaactttc

SEQ ID NO: 259745 - DNA, 25 bp, Mus musculus
cggaagcagagatggctatgaacgg

SEQ ID NO: 259746 - DNA, 25 bp, Mus musculus
cggaagcagaggatctctcagcatg

SEQ ID NO: 259747 - DNA, 25 bp, Mus musculus
cggaagcagagggacctgtaccgcc

SEQ ID NO: 259748 - DNA, 25 bp, Mus musculus
cggaagcagggaggtaaagcgttcg

SEQ ID NO: 259749 - DNA, 25 bp, Mus musculus
cggaagcagtagctaagatgcgagt

SEQ ID NO: 259750 - DNA, 25 bp, Mus musculus
cggaagcatggaaactagagagatg

SEQ ID NO: 259751 - DNA, 25 bp, Mus musculus
cggaagccaggactccccgcggccg

SEQ ID NO: 259752 - DNA, 25 bp, Mus musculus
cggaagccaggctgggtcctagagt

SEQ ID NO: 259753 - DNA, 25 bp, Mus musculus
cggaagccatggcaggacaaagaga

SEQ ID NO: 259754 - DNA, 25 bp, Mus musculus
cggaagccctacactattaggaaac

SEQ ID NO: 259755 - DNA, 25 bp, Mus musculus
cggaagccctacagaaacctgtggg

SEQ ID NO: 259756 - DNA, 25 bp, Mus musculus
cggaagccgcagtggtggaggtgga

SEQ ID NO: 259757 - DNA, 25 bp, Mus musculus
cggaagcctctgagtcgcttcaaag

SEQ ID NO: 259758 - DNA, 25 bp, Mus musculus
cggaagcctctggaattggaaatgg

SEQ ID NO: 259759 - DNA, 25 bp, Mus musculus
cggaagcgagtgggcgtgtggaatg

SEQ ID NO: 259760 - DNA, 25 bp, Mus musculus
cggaagctccaaggcgtctgaattt

SEQ ID NO: 259761 - DNA, 25 bp, Mus musculus
cggaagctcctggagcaagaaaagc

SEQ ID NO: 259762 - DNA, 25 bp, Mus musculus
cggaagcttggtaatgcaggtggtg

SEQ ID NO: 259763 - DNA, 25 bp, Mus musculus
cggaaggaaaagaatgtggagaaga

SEQ ID NO: 259764 - DNA, 25 bp, Mus musculus
cggaaggaaggtcggcagctctgct

SEQ ID NO: 259765 - DNA, 25 bp, Mus musculus
cggaaggacttccggattaagcaat

SEQ ID NO: 259766 - DNA, 25 bp, Mus musculus
cggaaggagctgactggccaatcac

SEQ ID NO: 259767 - DNA, 25 bp, Mus musculus
cggaaggaggagagatactgttatc

SEQ ID NO: 259768 - DNA, 25 bp, Mus musculus
cggaaggaggagagcaataaactgg

SEQ ID NO: 259769 - DNA, 25 bp, Mus musculus
cggaaggaggagagcaccaatggaa

SEQ ID NO: 259770 - DNA, 25 bp, Mus musculus
cggaaggaggagaggctgtgacctc

SEQ ID NO: 259771 - DNA, 25 bp, Mus musculus
cggaaggaggagagttgctcttctg

SEQ ID NO: 259772 - DNA, 25 bp, Mus musculus
cggaaggagggcagaatctagatct

SEQ ID NO: 259773 - DNA, 25 bp, Mus musculus
cggaaggagtacgaggagattatgc

SEQ ID NO: 259774 - DNA, 25 bp, Mus musculus
cggaagggaagggatgcatgggcat

SEQ ID NO: 259775 - DNA, 25 bp, Mus musculus
cggaagggaagggctcgggtccgca

SEQ ID NO: 259776 - DNA, 25 bp, Mus musculus
cggaaggtcaagtcactggtgacgc

SEQ ID NO: 259777 - DNA, 25 bp, Mus musculus
cggaaggtgctgctggaggcccgga

SEQ ID NO: 259778 - DNA, 25 bp, Mus musculus
cggaagtaaggacaagaccagtgct

SEQ ID NO: 259779 - DNA, 25 bp, Mus musculus
cggaagtacccggacagagagagat

SEQ ID NO: 259780 - DNA, 25 bp, Mus musculus
cggaagtatgaagaggtggcccgta

SEQ ID NO: 259781 - DNA, 25 bp, Mus musculus
cggaagtcgggtgacagaagacaca

SEQ ID NO: 259782 - DNA, 25 bp, Mus musculus
cggaagtgaactcaaagacagatct

SEQ ID NO: 259783 - DNA, 25 bp, Mus musculus
cggaagtgaagcccctgcccggatg

SEQ ID NO: 259784 - DNA, 25 bp, Mus musculus
cggaagtgacagaatgaatcgcacc

SEQ ID NO: 259785 - DNA, 25 bp, Mus musculus
cggaagtgacagtatgaatcgcacc

SEQ ID NO: 259786 - DNA, 25 bp, Mus musculus
cggaagtgacgagagctgtcggcca

SEQ ID NO: 259787 - DNA, 25 bp, Mus musculus
cggaagtgattccaggttcagtacc

SEQ ID NO: 259788 - DNA, 25 bp, Mus musculus
cggaagtggcagcatgctaattcca

SEQ ID NO: 259789 - DNA, 25 bp, Mus musculus
cggaagttaaagcacggtttgctcc

SEQ ID NO: 259790 - DNA, 25 bp, Mus musculus
cggaagttccagggatccttgtggg

SEQ ID NO: 259791 - DNA, 25 bp, Mus musculus
cggaagttccaggtctggaggctca

SEQ ID NO: 259792 - DNA, 25 bp, Mus musculus
cggaataatgatacctcgttcgtgt

SEQ ID NO: 259793 - DNA, 25 bp, Mus musculus
cggaatacacagcctgcataccatg

SEQ ID NO: 259794 - DNA, 25 bp, Mus musculus
cggaatacacaggtgaactgtgtga

SEQ ID NO: 259795 - DNA, 25 bp, Mus musculus
cggaatacctaagctttctccagac

SEQ ID NO: 259796 - DNA, 25 bp, Mus musculus
cggaatacctaagtagtgttggagt

SEQ ID NO: 259797 - DNA, 25 bp, Mus musculus
cggaatagagggaaacaggccacca

SEQ ID NO: 259798 - DNA, 25 bp, Mus musculus
cggaataggggtcgaggatgtcaga

SEQ ID NO: 259799 - DNA, 25 bp, Mus musculus
cggaatccagatggtgaactgaagc

SEQ ID NO: 259800 - DNA, 25 bp, Mus musculus
cggaatccaggagtacaagaactga

SEQ ID NO: 259801 - DNA, 25 bp, Mus musculus
cggaatccaggcacatggatacaca

SEQ ID NO: 259802 - DNA, 25 bp, Mus musculus
cggaatccccagttcttagaccctg

SEQ ID NO: 259803 - DNA, 25 bp, Mus musculus
cggaatcgcaacaaactgacaagag

SEQ ID NO: 259804 - DNA, 25 bp, Mus musculus
cggaatcgcaaggacagatccagaa

SEQ ID NO: 259805 - DNA, 25 bp, Mus musculus
cggaatcgccgagaggaaccaagat

SEQ ID NO: 259806 - DNA, 25 bp, Mus musculus
cggaatctaggagcccaccttggga

SEQ ID NO: 259807 - DNA, 25 bp, Mus musculus
cggaatgacaaagaattactgactt

SEQ ID NO: 259808 - DNA, 25 bp, Mus musculus
cggaatgaccaacagcaacatggcc

SEQ ID NO: 259809 - DNA, 25 bp, Mus musculus
cggaatgaccaacagtttgaaggaa

SEQ ID NO: 259810 - DNA, 25 bp, Mus musculus
cggaatgagcaagcggcccttgatt

SEQ ID NO: 259811 - DNA, 25 bp, Mus musculus
cggaatgagcaagcggcttgttatg

SEQ ID NO: 259812 - DNA, 25 bp, Mus musculus
cggaatgatgagagccagctctccc

SEQ ID NO: 259813 - DNA, 25 bp, Mus musculus
cggaatgatgagctctcccctgcca

SEQ ID NO: 259814 - DNA, 25 bp, Mus musculus
cggaatggcggaagatataacagac

SEQ ID NO: 259815 - DNA, 25 bp, Mus musculus
cggaattaaactaggcctgaggagc

SEQ ID NO: 259816 - DNA, 25 bp, Mus musculus
cggaattggaatcaggtggacagca

SEQ ID NO: 259817 - DNA, 25 bp, Mus musculus
cggaatttccaccggtttgctgagg

SEQ ID NO: 259818 - DNA, 25 bp, Mus musculus
cggaatttggaactcagggcggtgt

SEQ ID NO: 259819 - DNA, 25 bp, Mus musculus
cggaatttgggctctggacctgatc

SEQ ID NO: 259820 - DNA, 25 bp, Mus musculus
cggacaaagcagatctgcaggtgtc

SEQ ID NO: 259821 - DNA, 25 bp, Mus musculus
cggacaaagcagcttccaggagctg

SEQ ID NO: 259822 - DNA, 25 bp, Mus musculus
cggacaaagcaggggtcgggtcaga

SEQ ID NO: 259823 - DNA, 25 bp, Mus musculus
cggacaacagcaagcccaccaattc

SEQ ID NO: 259824 - DNA, 25 bp, Mus musculus
cggacaagcggcagattgtagacct

SEQ ID NO: 259825 - DNA, 25 bp, Mus musculus
cggacaatacaggctaggggtgttc

SEQ ID NO: 259826 - DNA, 25 bp, Mus musculus
cggacacagacatggactgtctaac

SEQ ID NO: 259827 - DNA, 25 bp, Mus musculus
cggacacagcatgcccatttccaga

SEQ ID NO: 259828 - DNA, 25 bp, Mus musculus
cggacacataactggctctgtccac

SEQ ID NO: 259829 - DNA, 25 bp, Mus musculus
cggacacattttaactgtgacaaac

SEQ ID NO: 259830 - DNA, 25 bp, Mus musculus
cggacacccccaagttcaatctcat

SEQ ID NO: 259831 - DNA, 25 bp, Mus musculus
cggacacccggaaaccctgatggac

SEQ ID NO: 259832 - DNA, 25 bp, Mus musculus
cggacaccgccagctctgctgtggc

SEQ ID NO: 259833 - DNA, 25 bp, Mus musculus
cggacaccgggattatgtccctgtg

SEQ ID NO: 259834 - DNA, 25 bp, Mus musculus
cggacactcagacaggaccccgtca

SEQ ID NO: 259835 - DNA, 25 bp, Mus musculus
cggacactcagagactgtctctgga

SEQ ID NO: 259836 - DNA, 25 bp, Mus musculus
cggacactcagaggatttccctaga

SEQ ID NO: 259837 - DNA, 25 bp, Mus musculus
cggacactcagcctgcagcctgatg

SEQ ID NO: 259838 - DNA, 25 bp, Mus musculus
cggacacttgtgaagcagcaggaag

SEQ ID NO: 259839 - DNA, 25 bp, Mus musculus
cggacacttgtggagcattctggaa

SEQ ID NO: 259840 - DNA, 25 bp, Mus musculus
cggacagccagatgccaaagctggc

SEQ ID NO: 259841 - DNA, 25 bp, Mus musculus
cggacagccagcaggcgtctgtatc

SEQ ID NO: 259842 - DNA, 25 bp, Mus musculus
cggacagccagcccaggctatcctg

SEQ ID NO: 259843 - DNA, 25 bp, Mus musculus
cggacagccaggcctctggggacct

SEQ ID NO: 259844 - DNA, 25 bp, Mus musculus
cggacaggagagtgaagtgtgtcag

SEQ ID NO: 259845 - DNA, 25 bp, Mus musculus
cggacaggagatgaccggttcgaac

SEQ ID NO: 259846 - DNA, 25 bp, Mus musculus
cggacaggaggcgttgtctgtcttc

SEQ ID NO: 259847 - DNA, 25 bp, Mus musculus
cggacaggaggggagaagagacgtg

SEQ ID NO: 259848 - DNA, 25 bp, Mus musculus
cggacaggcctccgaatcacatggg

SEQ ID NO: 259849 - DNA, 25 bp, Mus musculus
cggacagtgagagcgagcaaccttc

SEQ ID NO: 259850 - DNA, 25 bp, Mus musculus
cggacataaatattcttgtagacac

SEQ ID NO: 259851 - DNA, 25 bp, Mus musculus
cggacatcacttggctgtcggcgag

SEQ ID NO: 259852 - DNA, 25 bp, Mus musculus
cggacatcatggagtatgctgtgaa

SEQ ID NO: 259853 - DNA, 25 bp, Mus musculus
cggacatcctgaagaattacctggc

SEQ ID NO: 259854 - DNA, 25 bp, Mus musculus
cggacatcctgaagtgtcttatctg

SEQ ID NO: 259855 - DNA, 25 bp, Mus musculus
cggacatcgccccagctccaaggaa

SEQ ID NO: 259856 - DNA, 25 bp, Mus musculus
cggacatctgtggttcggcagactc

SEQ ID NO: 259857 - DNA, 25 bp, Mus musculus
cggacatcttcctgaggaatgtcac

SEQ ID NO: 259858 - DNA, 25 bp, Mus musculus
cggacatcttcctggacacatctta

SEQ ID NO: 259859 - DNA, 25 bp, Mus musculus
cggacatgcagtggaaagttcgaag

SEQ ID NO: 259860 - DNA, 25 bp, Mus musculus
cggacatgtcagtggaaacctctgt

SEQ ID NO: 259861 - DNA, 25 bp, Mus musculus
cggacatgtgtgagggctgccggtc

SEQ ID NO: 259862 - DNA, 25 bp, Mus musculus
cggacattcagggcttcctgaagaa

SEQ ID NO: 259863 - DNA, 25 bp, Mus musculus
cggacattgtttactccctgaagga

SEQ ID NO: 259864 - DNA, 25 bp, Mus musculus
cggaccaaatggaatgaataaaatg

SEQ ID NO: 259865 - DNA, 25 bp, Mus musculus
cggaccaagcacagcctcctcttag

SEQ ID NO: 259866 - DNA, 25 bp, Mus musculus
cggaccaagctcagcctcctcttag

SEQ ID NO: 259867 - DNA, 25 bp, Mus musculus
cggaccacaggccacaaaaagaaga

SEQ ID NO: 259868 - DNA, 25 bp, Mus musculus
cggaccaccagagcctgtactcctg

SEQ ID NO: 259869 - DNA, 25 bp, Mus musculus
cggaccactcggagatgtggtcagc

SEQ ID NO: 259870 - DNA, 25 bp, Mus musculus
cggaccactcggcctctgcagagat

SEQ ID NO: 259871 - DNA, 25 bp, Mus musculus
cggaccagcaaagaaaaaatggcgt

SEQ ID NO: 259872 - DNA, 25 bp, Mus musculus
cggaccatcacccttcagagtcagc

SEQ ID NO: 259873 - DNA, 25 bp, Mus musculus
cggaccatcagccttggggagttct

SEQ ID NO: 259874 - DNA, 25 bp, Mus musculus
cggaccatgcgaatgttcggagcga

SEQ ID NO: 259875 - DNA, 25 bp, Mus musculus
cggacccaaagaggtctctcacctt

SEQ ID NO: 259876 - DNA, 25 bp, Mus musculus
cggacccaaagaggtgtgaggttaa

SEQ ID NO: 259877 - DNA, 25 bp, Mus musculus
cggaccccagcccgccggagtcctg

SEQ ID NO: 259878 - DNA, 25 bp, Mus musculus
cggaccccatgaaggtacgggtggt

SEQ ID NO: 259879 - DNA, 25 bp, Mus musculus
cggaccccatgaagtgtttggtgta

SEQ ID NO: 259880 - DNA, 25 bp, Mus musculus
cggaccccgaggagccaacatgttg

SEQ ID NO: 259881 - DNA, 25 bp, Mus musculus
cggacccctggttctccacatacga

SEQ ID NO: 259882 - DNA, 25 bp, Mus musculus
cggacccgagatgagcaataacagc

SEQ ID NO: 259883 - DNA, 25 bp, Mus musculus
cggacccgatgtgcgcattaaagag

SEQ ID NO: 259884 - DNA, 25 bp, Mus musculus
cggacccgatgtggctcttaaggac

SEQ ID NO: 259885 - DNA, 25 bp, Mus musculus
cggaccctgctcctgggcttgtgga

SEQ ID NO: 259886 - DNA, 25 bp, Mus musculus
cggaccctgctcctggtggcatctt

SEQ ID NO: 259887 - DNA, 25 bp, Mus musculus
cggaccctgctcctggtttctgaac

SEQ ID NO: 259888 - DNA, 25 bp, Mus musculus
cggaccctggacaaatgtcccttca

SEQ ID NO: 259889 - DNA, 25 bp, Mus musculus
cggaccctggacaagttaatcgatg

SEQ ID NO: 259890 - DNA, 25 bp, Mus musculus
cggaccctggcctgcctgagggatc

SEQ ID NO: 259891 - DNA, 25 bp, Mus musculus
cggaccctgggagcctacttccagc

SEQ ID NO: 259892 - DNA, 25 bp, Mus musculus
cggaccgccagattgtgccttctga

SEQ ID NO: 259893 - DNA, 25 bp, Mus musculus
cggaccgcgcggccacaaaaagaag

SEQ ID NO: 259894 - DNA, 25 bp, Mus musculus
cggaccggaacggatgtatacatct

SEQ ID NO: 259895 - DNA, 25 bp, Mus musculus
cggaccgggtgccggtcatcgtgga

SEQ ID NO: 259896 - DNA, 25 bp, Mus musculus
cggacctacaacttctgaaaagcaa

SEQ ID NO: 259897 - DNA, 25 bp, Mus musculus
cggacctacactgatgaagagtttg

SEQ ID NO: 259898 - DNA, 25 bp, Mus musculus
cggacctatgagtgtgatccagaag

SEQ ID NO: 259899 - DNA, 25 bp, Mus musculus
cggacctcaatcaccatgcccaccg

SEQ ID NO: 259900 - DNA, 25 bp, Mus musculus
cggacctcagcagaaatctcccgga

SEQ ID NO: 259901 - DNA, 25 bp, Mus musculus
cggacctcagcctttatcctcatgt

SEQ ID NO: 259902 - DNA, 25 bp, Mus musculus
cggacctcaggaaccctgatgacat

SEQ ID NO: 259903 - DNA, 25 bp, Mus musculus
cggacctcaggtctctgcctccgcg

SEQ ID NO: 259904 - DNA, 25 bp, Mus musculus
cggacctcttgtctacccagctggg

SEQ ID NO: 259905 - DNA, 25 bp, Mus musculus
cggacctggagcagaagtattggga

SEQ ID NO: 259906 - DNA, 25 bp, Mus musculus
cggacctggagtgggaccctgaaga

SEQ ID NO: 259907 - DNA, 25 bp, Mus musculus
cggaccttccggcaggcagttcctc

SEQ ID NO: 259908 - DNA, 25 bp, Mus musculus
cggacgagaatggaaacttgagttc

SEQ ID NO: 259909 - DNA, 25 bp, Mus musculus
cggacgagaatgggcaattgcttcc

SEQ ID NO: 259910 - DNA, 25 bp, Mus musculus
cggacgagctgtcggcattatgcca

SEQ ID NO: 259911 - DNA, 25 bp, Mus musculus
cggacgagctgtcgggagaaaattt

SEQ ID NO: 259912 - DNA, 25 bp, Mus musculus
cggacgaggccgagcccctcggagc

SEQ ID NO: 259913 - DNA, 25 bp, Mus musculus
cggacgcaggctcagcttctttgtg

SEQ ID NO: 259914 - DNA, 25 bp, Mus musculus
cggacgcagggaaggtagtgtgtgc

SEQ ID NO: 259915 - DNA, 25 bp, Mus musculus
cggacgccgagatgctccagacctt

SEQ ID NO: 259916 - DNA, 25 bp, Mus musculus
cggacgcgatttacgaaatctacca

SEQ ID NO: 259917 - DNA, 25 bp, Mus musculus
cggacgcggaagatctcagcggttc

SEQ ID NO: 259918 - DNA, 25 bp, Mus musculus
cggacgcggaagggaccagattttt

SEQ ID NO: 259919 - DNA, 25 bp, Mus musculus
cggacgcggagacgtttgaattagc

SEQ ID NO: 259920 - DNA, 25 bp, Mus musculus
cggacgcggagtctggtccatcgaa

SEQ ID NO: 259921 - DNA, 25 bp, Mus musculus
cggacgcggcgacaggtcttctact

SEQ ID NO: 259922 - DNA, 25 bp, Mus musculus
cggacggctcagaaaagggggattt

SEQ ID NO: 259923 - DNA, 25 bp, Mus musculus
cggacggctgccgggttgtgagccc

SEQ ID NO: 259924 - DNA, 25 bp, Mus musculus
cggacgggagggacggtattcaggc

SEQ ID NO: 259925 - DNA, 25 bp, Mus musculus
cggacggtggtcagtgtcctcaaga

SEQ ID NO: 259926 - DNA, 25 bp, Mus musculus
cggacggttcagaccatgacacccg

SEQ ID NO: 259927 - DNA, 25 bp, Mus musculus
cggacgtagaaggcctctttgacag

SEQ ID NO: 259928 - DNA, 25 bp, Mus musculus
cggacgtcctcgctttgtactggtt

SEQ ID NO: 259929 - DNA, 25 bp, Mus musculus
cggacgtccttgcggggcctgtgct

SEQ ID NO: 259930 - DNA, 25 bp, Mus musculus
cggactaataggactgaggatctcg

SEQ ID NO: 259931 - DNA, 25 bp, Mus musculus
cggactaataggcagatacatgcag

SEQ ID NO: 259932 - DNA, 25 bp, Mus musculus
cggactaatttagagatgaaatcct

SEQ ID NO: 259933 - DNA, 25 bp, Mus musculus
cggactaatttagaggggctccata

SEQ ID NO: 259934 - DNA, 25 bp, Mus musculus
cggactatacaaggtggggatgcgt

SEQ ID NO: 259935 - DNA, 25 bp, Mus musculus
cggactcaggaggatatttccaccc

SEQ ID NO: 259936 - DNA, 25 bp, Mus musculus
cggactcccggagaagcctccccag

SEQ ID NO: 259937 - DNA, 25 bp, Mus musculus
cggactcgagaggtcactggatgtt

SEQ ID NO: 259938 - DNA, 25 bp, Mus musculus
cggactcgagagttacaggtcactg

SEQ ID NO: 259939 - DNA, 25 bp, Mus musculus
cggactcgctgagctccagttataa

SEQ ID NO: 259940 - DNA, 25 bp, Mus musculus
cggactctgagacgccacagggcct

SEQ ID NO: 259941 - DNA, 25 bp, Mus musculus
cggactctgggagtctgtcccaggg

SEQ ID NO: 259942 - DNA, 25 bp, Mus musculus
cggactctgggctatgtgggtgagc

SEQ ID NO: 259943 - DNA, 25 bp, Mus musculus
cggactgaaggcagatcatgcctgg

SEQ ID NO: 259944 - DNA, 25 bp, Mus musculus
cggactgacgctgcacctggtggaa

SEQ ID NO: 259945 - DNA, 25 bp, Mus musculus
cggactgcagagaaagagggggccc

SEQ ID NO: 259946 - DNA, 25 bp, Mus musculus
cggactgcagagaaatgtgatttgt

SEQ ID NO: 259947 - DNA, 25 bp, Mus musculus
cggactgctgtaggtctgaccaccc

SEQ ID NO: 259948 - DNA, 25 bp, Mus musculus
cggactggaggcgccagcccctccc

SEQ ID NO: 259949 - DNA, 25 bp, Mus musculus
cggactgtgacaggcatcatagctg

SEQ ID NO: 259950 - DNA, 25 bp, Mus musculus
cggacttagcacactcctgggcatc

SEQ ID NO: 259951 - DNA, 25 bp, Mus musculus
cggacttcaggtgactcggactctg

SEQ ID NO: 259952 - DNA, 25 bp, Mus musculus
cggacttcaggtgattcacaagatg

SEQ ID NO: 259953 - DNA, 25 bp, Mus musculus
cggacttccaggctcagtgtttaga

SEQ ID NO: 259954 - DNA, 25 bp, Mus musculus
cggacttggacaaacacagccagct

SEQ ID NO: 259955 - DNA, 25 bp, Mus musculus
cggacttggactgacctgaaaagat

SEQ ID NO: 259956 - DNA, 25 bp, Mus musculus
cggactttgagaaccctgactgaaa

SEQ ID NO: 259957 - DNA, 25 bp, Mus musculus
cggacttttgatcctcacttcctga

SEQ ID NO: 259958 - DNA, 25 bp, Mus musculus
cggacttttggacagtttcttgaag

SEQ ID NO: 259959 - DNA, 25 bp, Mus musculus
cggagaaaagggagaacctggtgaa

SEQ ID NO: 259960 - DNA, 25 bp, Mus musculus
cggagaaacaatggagtccaacaca

SEQ ID NO: 259961 - DNA, 25 bp, Mus musculus
cggagaaacacgtcggcttctgacg

SEQ ID NO: 259962 - DNA, 25 bp, Mus musculus
cggagaaagcaggccaccccttcca

SEQ ID NO: 259963 - DNA, 25 bp, Mus musculus
cggagaaagcgcctgctggagttca

SEQ ID NO: 259964 - DNA, 25 bp, Mus musculus
cggagaacaagatcggttctctttg

SEQ ID NO: 259965 - DNA, 25 bp, Mus musculus
cggagaacaagatcgttggaatgcc

SEQ ID NO: 259966 - DNA, 25 bp, Mus musculus
cggagaaccctcgatggtttcaagg

SEQ ID NO: 259967 - DNA, 25 bp, Mus musculus
cggagaactggtgcctcgtctccag

SEQ ID NO: 259968 - DNA, 25 bp, Mus musculus
cggagaagacaaggttctttaacga

SEQ ID NO: 259969 - DNA, 25 bp, Mus musculus
cggagaagagaatacagacagattc

SEQ ID NO: 259970 - DNA, 25 bp, Mus musculus
cggagaagaggaattcatgaagtat

SEQ ID NO: 259971 - DNA, 25 bp, Mus musculus
cggagaagaggcaatcaagccctgc

SEQ ID NO: 259972 - DNA, 25 bp, Mus musculus
cggagaagatggtgaacctggaaga

SEQ ID NO: 259973 - DNA, 25 bp, Mus musculus
cggagaagcccacagaaacgcatcc

SEQ ID NO: 259974 - DNA, 25 bp, Mus musculus
cggagaagcccacagtccatggaga

SEQ ID NO: 259975 - DNA, 25 bp, Mus musculus
cggagaagctgaggacaagatctaa

SEQ ID NO: 259976 - DNA, 25 bp, Mus musculus
cggagaaggagctaggatgaacagc

SEQ ID NO: 259977 - DNA, 25 bp, Mus musculus
cggagaaggagctagtgacattcat

SEQ ID NO: 259978 - DNA, 25 bp, Mus musculus
cggagaagggtgagcaattgtgttc

SEQ ID NO: 259979 - DNA, 25 bp, Mus musculus
cggagaagtcaggttccaaggagca

SEQ ID NO: 259980 - DNA, 25 bp, Mus musculus
cggagaagtcccgttgtatcagagt

SEQ ID NO: 259981 - DNA, 25 bp, Mus musculus
cggagaagtggatgtcgcgtggagg

SEQ ID NO: 259982 - DNA, 25 bp, Mus musculus
cggagaagtggtgaaggccttggag

SEQ ID NO: 259983 - DNA, 25 bp, Mus musculus
cggagaatcagagtggtgtctcctt

SEQ ID NO: 259984 - DNA, 25 bp, Mus musculus
cggagaatgggcaggtggcactgat

SEQ ID NO: 259985 - DNA, 25 bp, Mus musculus
cggagaatgggcagttgttacaggt

SEQ ID NO: 259986 - DNA, 25 bp, Mus musculus
cggagacacagcttggtgacaatgc

SEQ ID NO: 259987 - DNA, 25 bp, Mus musculus
cggagacacaggccccatggggatg

SEQ ID NO: 259988 - DNA, 25 bp, Mus musculus
cggagacagcccaaggatgtcacag

SEQ ID NO: 259989 - DNA, 25 bp, Mus musculus
cggagacaggtaacagtttcggccg

SEQ ID NO: 259990 - DNA, 25 bp, Mus musculus
cggagacatgaggatgcagagagaa

SEQ ID NO: 259991 - DNA, 25 bp, Mus musculus
cggagaccagaaccccagctgaaag

SEQ ID NO: 259992 - DNA, 25 bp, Mus musculus
cggagacccggatttcccagcctgg

SEQ ID NO: 259993 - DNA, 25 bp, Mus musculus
cggagaccgaggaggcccagccagc

SEQ ID NO: 259994 - DNA, 25 bp, Mus musculus
cggagacgcggctcctgtgcggcac

SEQ ID NO: 259995 - DNA, 25 bp, Mus musculus
cggagacgtaagatcaacgagagat

SEQ ID NO: 259996 - DNA, 25 bp, Mus musculus
cggagactccagatgaggacgatgt

SEQ ID NO: 259997 - DNA, 25 bp, Mus musculus
cggagactccaggccacaatggaga

SEQ ID NO: 259998 - DNA, 25 bp, Mus musculus
cggagactgaggatgaggctgtaga

SEQ ID NO: 259999 - DNA, 25 bp, Mus musculus
cggagactgaggtgctgggtgtgtg

SEQ ID NO: 260000 - DNA, 25 bp, Mus musculus
cggagacttcagaatcaagatgtgt

SEQ ID NO: 260001 - DNA, 25 bp, Mus musculus
cggagacttttaggccatctcttgg

SEQ ID NO: 260002 - DNA, 25 bp, Mus musculus
cggagacttttagggccaaagatct

SEQ ID NO: 260003 - DNA, 25 bp, Mus musculus
cggagagaactcagaacatacaaca

SEQ ID NO: 260004 - DNA, 25 bp, Mus musculus
cggagagaactcagcagagcacccg

SEQ ID NO: 260005 - DNA, 25 bp, Mus musculus
cggagagaactcagctcatggcagc

SEQ ID NO: 260006 - DNA, 25 bp, Mus musculus
cggagagaactcaggccaggaacaa

SEQ ID NO: 260007 - DNA, 25 bp, Mus musculus
cggagagaaggtctaatgcgctctc

SEQ ID NO: 260008 - DNA, 25 bp, Mus musculus
cggagagaatgggttcaatgtatct

SEQ ID NO: 260009 - DNA, 25 bp, Mus musculus
cggagagaccaggtaggcgacgctg

SEQ ID NO: 260010 - DNA, 25 bp, Mus musculus
cggagagactgggatgagcacagct

SEQ ID NO: 260011 - DNA, 25 bp, Mus musculus
cggagagagaaggaaccaacacaag

SEQ ID NO: 260012 - DNA, 25 bp, Mus musculus
cggagagagcgtcgtatacaacgtg

SEQ ID NO: 260013 - DNA, 25 bp, Mus musculus
cggagagaggaaaagggctcggatg

SEQ ID NO: 260014 - DNA, 25 bp, Mus musculus
cggagagaggaggacagttactacc

SEQ ID NO: 260015 - DNA, 25 bp, Mus musculus
cggagagaggagggagatggtgttt

SEQ ID NO: 260016 - DNA, 25 bp, Mus musculus
cggagagatagatctagctagtgaa

SEQ ID NO: 260017 - DNA, 25 bp, Mus musculus
cggagagattttatacaagctgtac

SEQ ID NO: 260018 - DNA, 25 bp, Mus musculus
cggagagattttatgagaggctgta

SEQ ID NO: 260019 - DNA, 25 bp, Mus musculus
cggagagcaagactggtagtggctg

SEQ ID NO: 260020 - DNA, 25 bp, Mus musculus
cggagagcagaggtgtggagaagac

SEQ ID NO: 260021 - DNA, 25 bp, Mus musculus
cggagagcatggatacgtattatca

SEQ ID NO: 260022 - DNA, 25 bp, Mus musculus
cggagagccagcctggcgacccagt

SEQ ID NO: 260023 - DNA, 25 bp, Mus musculus
cggagagcctgaaggctagatatgg

SEQ ID NO: 260024 - DNA, 25 bp, Mus musculus
cggagagcggcgcgggtccaaccca

SEQ ID NO: 260025 - DNA, 25 bp, Mus musculus
cggagagcggcgcggtccccagagc

SEQ ID NO: 260026 - DNA, 25 bp, Mus musculus
cggagagcggtcccgtaggcctcac

SEQ ID NO: 260027 - DNA, 25 bp, Mus musculus
cggagaggaagagatcaagcacttc

SEQ ID NO: 260028 - DNA, 25 bp, Mus musculus
cggagaggagggagggagccatcac

SEQ ID NO: 260029 - DNA, 25 bp, Mus musculus
cggagaggcaggtctctggagctgg

SEQ ID NO: 260030 - DNA, 25 bp, Mus musculus
cggagagtagattggatccagtgtg

SEQ ID NO: 260031 - DNA, 25 bp, Mus musculus
cggagagtggaacagatcgctgtag

SEQ ID NO: 260032 - DNA, 25 bp, Mus musculus
cggagatccccaaggcgagttctgg

SEQ ID NO: 260033 - DNA, 25 bp, Mus musculus
cggagatccccagagacagaacttc

SEQ ID NO: 260034 - DNA, 25 bp, Mus musculus
cggagatgaagattcaatgagaggc

SEQ ID NO: 260035 - DNA, 25 bp, Mus musculus
cggagatgcccagatcatgagccac

SEQ ID NO: 260036 - DNA, 25 bp, Mus musculus
cggagatgcgggtttgcctgcaatg

SEQ ID NO: 260037 - DNA, 25 bp, Mus musculus
cggagatgctcagcaagccccgccc

SEQ ID NO: 260038 - DNA, 25 bp, Mus musculus
cggagatgctgagagctctggtgta

SEQ ID NO: 260039 - DNA, 25 bp, Mus musculus
cggagatgctgagctgtcgatgcca

SEQ ID NO: 260040 - DNA, 25 bp, Mus musculus
cggagatggaggctcagctgtctca

SEQ ID NO: 260041 - DNA, 25 bp, Mus musculus
cggagatgggccacgctctgtgcac

SEQ ID NO: 260042 - DNA, 25 bp, Mus musculus
cggagatgggccacggaactcatct

SEQ ID NO: 260043 - DNA, 25 bp, Mus musculus
cggagatgtacggttcctcatttga

SEQ ID NO: 260044 - DNA, 25 bp, Mus musculus
cggagattagcggagccaggtatgc

SEQ ID NO: 260045 - DNA, 25 bp, Mus musculus
cggagattcggcgacctgacaaagc

SEQ ID NO: 260046 - DNA, 25 bp, Mus musculus
cggagattcggcggtttatcaagag

SEQ ID NO: 260047 - DNA, 25 bp, Mus musculus
cggagatttgcagtccaacgtcgtg

SEQ ID NO: 260048 - DNA, 25 bp, Mus musculus
cggagcaaaccggtggccagaaccc

SEQ ID NO: 260049 - DNA, 25 bp, Mus musculus
cggagcaactgaagactcaggactc

SEQ ID NO: 260050 - DNA, 25 bp, Mus musculus
cggagcaagcagctcgaggaggaca

SEQ ID NO: 260051 - DNA, 25 bp, Mus musculus
cggagcaagcagctggaagatgagc

SEQ ID NO: 260052 - DNA, 25 bp, Mus musculus
cggagcaccccagtgcccgaggcgc

SEQ ID NO: 260053 - DNA, 25 bp, Mus musculus
cggagcagaatgatttccagagcag

SEQ ID NO: 260054 - DNA, 25 bp, Mus musculus
cggagcagatcaatgaaattggaga

SEQ ID NO: 260055 - DNA, 25 bp, Mus musculus
cggagcagcagcgagaatgcttcgt

SEQ ID NO: 260056 - DNA, 25 bp, Mus musculus
cggagcagcaggcgttgcagaaact

SEQ ID NO: 260057 - DNA, 25 bp, Mus musculus
cggagcaggacaaagcatgtggggc

SEQ ID NO: 260058 - DNA, 25 bp, Mus musculus
cggagcaggacaaaggagtctcacc

SEQ ID NO: 260059 - DNA, 25 bp, Mus musculus
cggagcaggagagattgttgacgct

SEQ ID NO: 260060 - DNA, 25 bp, Mus musculus
cggagcagtctggcatgctcccaaa

SEQ ID NO: 260061 - DNA, 25 bp, Mus musculus
cggagcatatgctgatcctgggcat

SEQ ID NO: 260062 - DNA, 25 bp, Mus musculus
cggagcatcagacatttccactggg

SEQ ID NO: 260063 - DNA, 25 bp, Mus musculus
cggagcatgaaagatcagacctgtc

SEQ ID NO: 260064 - DNA, 25 bp, Mus musculus
cggagcatgaaaggacgtccacgtc

SEQ ID NO: 260065 - DNA, 25 bp, Mus musculus
cggagcatgagccagatatactgca

SEQ ID NO: 260066 - DNA, 25 bp, Mus musculus
cggagccaacatcaacagaatcaaa

SEQ ID NO: 260067 - DNA, 25 bp, Mus musculus
cggagccaagatcccattctcagta

SEQ ID NO: 260068 - DNA, 25 bp, Mus musculus
cggagccaagtggttgatcggttgc

SEQ ID NO: 260069 - DNA, 25 bp, Mus musculus
cggagccaccccagacccaagaatc

SEQ ID NO: 260070 - DNA, 25 bp, Mus musculus
cggagccactgacggaccagagtga

SEQ ID NO: 260071 - DNA, 25 bp, Mus musculus
cggagccagcatgaatcagctgccc

SEQ ID NO: 260072 - DNA, 25 bp, Mus musculus
cggagccagcatgccttcctgggcg

SEQ ID NO: 260073 - DNA, 25 bp, Mus musculus
cggagccagcatgctcgtcaaggtg

SEQ ID NO: 260074 - DNA, 25 bp, Mus musculus
cggagccagcggatgaagctaccca

SEQ ID NO: 260075 - DNA, 25 bp, Mus musculus
cggagccaggacaaagccaactttg

SEQ ID NO: 260076 - DNA, 25 bp, Mus musculus
cggagccagggctcagattctttaa

SEQ ID NO: 260077 - DNA, 25 bp, Mus musculus
cggagccatcccagtgatgaatctg

SEQ ID NO: 260078 - DNA, 25 bp, Mus musculus
cggagccatcccagtgatggctacc

SEQ ID NO: 260079 - DNA, 25 bp, Mus musculus
cggagccatgcctcttcgacttgac

SEQ ID NO: 260080 - DNA, 25 bp, Mus musculus
cggagccatggagcatttcactgtc

SEQ ID NO: 260081 - DNA, 25 bp, Mus musculus
cggagccccctctagtgagcactcc

SEQ ID NO: 260082 - DNA, 25 bp, Mus musculus
cggagccccggatggcatggaggag

SEQ ID NO: 260083 - DNA, 25 bp, Mus musculus
cggagccccggatggccgggctcgt

SEQ ID NO: 260084 - DNA, 25 bp, Mus musculus
cggagcccctagtggcaagggaaaa

SEQ ID NO: 260085 - DNA, 25 bp, Mus musculus
cggagcccgaccagaaccgggtggt

SEQ ID NO: 260086 - DNA, 25 bp, Mus musculus
cggagcccgagggctactcttccgt

SEQ ID NO: 260087 - DNA, 25 bp, Mus musculus
cggagcccgcgattctcattgaaat

SEQ ID NO: 260088 - DNA, 25 bp, Mus musculus
cggagcccgcgggtcttactgttta

SEQ ID NO: 260089 - DNA, 25 bp, Mus musculus
cggagcccggctcaggacaatggat

SEQ ID NO: 260090 - DNA, 25 bp, Mus musculus
cggagccgaataagggaagaaagga

SEQ ID NO: 260091 - DNA, 25 bp, Mus musculus
cggagccgcaaaggatgaaacgagg

SEQ ID NO: 260092 - DNA, 25 bp, Mus musculus
cggagccgcagcagttgccccagaa

SEQ ID NO: 260093 - DNA, 25 bp, Mus musculus
cggagccgccaagtgcctgaagacc

SEQ ID NO: 260094 - DNA, 25 bp, Mus musculus
cggagccgcgactgatttcctgaag

SEQ ID NO: 260095 - DNA, 25 bp, Mus musculus
cggagccgcgcgtgtctccacagag

SEQ ID NO: 260096 - DNA, 25 bp, Mus musculus
cggagccgcgttggaggcctccctt

SEQ ID NO: 260097 - DNA, 25 bp, Mus musculus
cggagccgctgcacgatttaccttc

SEQ ID NO: 260098 - DNA, 25 bp, Mus musculus
cggagccggggctcgatgtctacac

SEQ ID NO: 260099 - DNA, 25 bp, Mus musculus
cggagccggttcgaggagcagaatg

SEQ ID NO: 260100 - DNA, 25 bp, Mus musculus
cggagccgtctgaagaactgagtgt

SEQ ID NO: 260101 - DNA, 25 bp, Mus musculus
cggagccgtctgaagactgctcttt

SEQ ID NO: 260102 - DNA, 25 bp, Mus musculus
cggagccgtgacggagatgctcacg

SEQ ID NO: 260103 - DNA, 25 bp, Mus musculus
cggagcctaagtctgtaccaaaacc

SEQ ID NO: 260104 - DNA, 25 bp, Mus musculus
cggagcctccggttaagcctgatca

SEQ ID NO: 260105 - DNA, 25 bp, Mus musculus
cggagcctccttcaggcctcaggct

SEQ ID NO: 260106 - DNA, 25 bp, Mus musculus
cggagcctggcaatggtctgccagg

SEQ ID NO: 260107 - DNA, 25 bp, Mus musculus
cggagcctttcccggtgggacgctc

SEQ ID NO: 260108 - DNA, 25 bp, Mus musculus
cggagcgaccgggtcatgtaggaaa

SEQ ID NO: 260109 - DNA, 25 bp, Mus musculus
cggagcgactcgatcccctgaactt

SEQ ID NO: 260110 - DNA, 25 bp, Mus musculus
cggagcgactcgttctgcctcccct

SEQ ID NO: 260111 - DNA, 25 bp, Mus musculus
cggagcgcggaggtgatgctagcga

SEQ ID NO: 260112 - DNA, 25 bp, Mus musculus
cggagcggagcaatgcctaaatcaa

SEQ ID NO: 260113 - DNA, 25 bp, Mus musculus
cggagcggagccccatcttgatatg

SEQ ID NO: 260114 - DNA, 25 bp, Mus musculus
cggagcggctcagagctaccaggag

SEQ ID NO: 260115 - DNA, 25 bp, Mus musculus
cggagcggctcaggttccagctacg

SEQ ID NO: 260116 - DNA, 25 bp, Mus musculus
cggagcggctgacagaaggacattt

SEQ ID NO: 260117 - DNA, 25 bp, Mus musculus
cggagcggtagaggcaagagcttca

SEQ ID NO: 260118 - DNA, 25 bp, Mus musculus
cggagcggtagagggagttgcatgg

SEQ ID NO: 260119 - DNA, 25 bp, Mus musculus
cggagcgtcaagcagactcgccagt

SEQ ID NO: 260120 - DNA, 25 bp, Mus musculus
cggagctaccagcggctctgctctg

SEQ ID NO: 260121 - DNA, 25 bp, Mus musculus
cggagctactggagaagccagatgc

SEQ ID NO: 260122 - DNA, 25 bp, Mus musculus
cggagctatgtttcgaaaccagtat

SEQ ID NO: 260123 - DNA, 25 bp, Mus musculus
cggagctcagagaaagcagaagata

SEQ ID NO: 260124 - DNA, 25 bp, Mus musculus
cggagctcagagggcgggatgtctc

SEQ ID NO: 260125 - DNA, 25 bp, Mus musculus
cggagctcagaggtgttttctatta

SEQ ID NO: 260126 - DNA, 25 bp, Mus musculus
cggagctcagaggttgactcttcac

SEQ ID NO: 260127 - DNA, 25 bp, Mus musculus
cggagctcagctatggagtcagtga

SEQ ID NO: 260128 - DNA, 25 bp, Mus musculus
cggagctcagctatggagtctgtat

SEQ ID NO: 260129 - DNA, 25 bp, Mus musculus
cggagctccgactggaaataccaga

SEQ ID NO: 260130 - DNA, 25 bp, Mus musculus
cggagctccgactggagtctccaaa

SEQ ID NO: 260131 - DNA, 25 bp, Mus musculus
cggagctcgcgactcactgtgtgct

SEQ ID NO: 260132 - DNA, 25 bp, Mus musculus
cggagctcggagcaggctcaggcca

SEQ ID NO: 260133 - DNA, 25 bp, Mus musculus
cggagctcgggcggggaccggagct

SEQ ID NO: 260134 - DNA, 25 bp, Mus musculus
cggagctgaccaaaccgggctccat

SEQ ID NO: 260135 - DNA, 25 bp, Mus musculus
cggagctgaccggtctccctatgta

SEQ ID NO: 260136 - DNA, 25 bp, Mus musculus
cggagctgagcatttcagatctgct

SEQ ID NO: 260137 - DNA, 25 bp, Mus musculus
cggagctgagggttccagaccacca

SEQ ID NO: 260138 - DNA, 25 bp, Mus musculus
cggagctgatcgatttgatctactg

SEQ ID NO: 260139 - DNA, 25 bp, Mus musculus
cggagctgatgaggatcctcagctc

SEQ ID NO: 260140 - DNA, 25 bp, Mus musculus
cggagctgccgccttcagggccgac

SEQ ID NO: 260141 - DNA, 25 bp, Mus musculus
cggagctgcgagaatgtctgaaggg

SEQ ID NO: 260142 - DNA, 25 bp, Mus musculus
cggagctgcgagcagagggacctgg

SEQ ID NO: 260143 - DNA, 25 bp, Mus musculus
cggagctgcgaggactgatgacaga

SEQ ID NO: 260144 - DNA, 25 bp, Mus musculus
cggagctgcgagttacagaatgtct

SEQ ID NO: 260145 - DNA, 25 bp, Mus musculus
cggagctgcgagttacagatttatc

SEQ ID NO: 260146 - DNA, 25 bp, Mus musculus
cggagctgctctggttgaaggtttg

SEQ ID NO: 260147 - DNA, 25 bp, Mus musculus
cggagctgctgctcggagagcggga

SEQ ID NO: 260148 - DNA, 25 bp, Mus musculus
cggagctgctgctggctttgaacat

SEQ ID NO: 260149 - DNA, 25 bp, Mus musculus
cggagctgctggacatgctgctggt

SEQ ID NO: 260150 - DNA, 25 bp, Mus musculus
cggagctgggaggcccagccagcag

SEQ ID NO: 260151 - DNA, 25 bp, Mus musculus
cggagctgggctgcctgcctgcctg

SEQ ID NO: 260152 - DNA, 25 bp, Mus musculus
cggagctggttaagagaaaatccct

SEQ ID NO: 260153 - DNA, 25 bp, Mus musculus
cggagctgtagatatggcataagat

SEQ ID NO: 260154 - DNA, 25 bp, Mus musculus
cggagctgtagctggcccatgagct

SEQ ID NO: 260155 - DNA, 25 bp, Mus musculus
cggagctgtaggcaagagataacac

SEQ ID NO: 260156 - DNA, 25 bp, Mus musculus
cggagctgtatgaggaagtaaagct

SEQ ID NO: 260157 - DNA, 25 bp, Mus musculus
cggagctgtccaatgacgaagctgc

SEQ ID NO: 260158 - DNA, 25 bp, Mus musculus
cggagctgtccaatttttggccttt

SEQ ID NO: 260159 - DNA, 25 bp, Mus musculus
cggagctgtgaggaatgagttcctg

SEQ ID NO: 260160 - DNA, 25 bp, Mus musculus
cggagctgtgaggacagaaaataat

SEQ ID NO: 260161 - DNA, 25 bp, Mus musculus
cggagctttgagttgctggttgttg

SEQ ID NO: 260162 - DNA, 25 bp, Mus musculus
cggagcttttgcaggtggctttgca

SEQ ID NO: 260163 - DNA, 25 bp, Mus musculus
cggaggaaagccatcatgttaagga

SEQ ID NO: 260164 - DNA, 25 bp, Mus musculus
cggaggaaaggatttctccatatag

SEQ ID NO: 260165 - DNA, 25 bp, Mus musculus
cggaggaagagggctgcctctgaag

SEQ ID NO: 260166 - DNA, 25 bp, Mus musculus
cggaggaagcacagaccagaagccc

SEQ ID NO: 260167 - DNA, 25 bp, Mus musculus
cggaggaagcacagctctggatggg

SEQ ID NO: 260168 - DNA, 25 bp, Mus musculus
cggaggacaaaggctatgtgcttca

SEQ ID NO: 260169 - DNA, 25 bp, Mus musculus
cggaggacaagggaccgtcacgacg

SEQ ID NO: 260170 - DNA, 25 bp, Mus musculus
cggaggacacagattccttctggaa

SEQ ID NO: 260171 - DNA, 25 bp, Mus musculus
cggaggacagcataagcagtacgct

SEQ ID NO: 260172 - DNA, 25 bp, Mus musculus
cggaggacagctcaatcgagctggg

SEQ ID NO: 260173 - DNA, 25 bp, Mus musculus
cggaggacagctcagctgttgaatc

SEQ ID NO: 260174 - DNA, 25 bp, Mus musculus
cggaggacatgaccccctgcccggc

SEQ ID NO: 260175 - DNA, 25 bp, Mus musculus
cggaggacatgacccggtctcaagg

SEQ ID NO: 260176 - DNA, 25 bp, Mus musculus
cggaggactgaatagttgcagtaag

SEQ ID NO: 260177 - DNA, 25 bp, Mus musculus
cggaggactgaggggggtccgccta

SEQ ID NO: 260178 - DNA, 25 bp, Mus musculus
cggaggagaaggaactatcccctca

SEQ ID NO: 260179 - DNA, 25 bp, Mus musculus
cggaggagaagtctggacagaggat

SEQ ID NO: 260180 - DNA, 25 bp, Mus musculus
cggaggagaggtacagacatgaaat

SEQ ID NO: 260181 - DNA, 25 bp, Mus musculus
cggaggagataggcgtttctaatgt

SEQ ID NO: 260182 - DNA, 25 bp, Mus musculus
cggaggagatggacgtggatgagtg

SEQ ID NO: 260183 - DNA, 25 bp, Mus musculus
cggaggagatggagcacgccccaga

SEQ ID NO: 260184 - DNA, 25 bp, Mus musculus
cggaggagctgggtccatattgtgg

SEQ ID NO: 260185 - DNA, 25 bp, Mus musculus
cggaggagctgggtgatggctgtgg

SEQ ID NO: 260186 - DNA, 25 bp, Mus musculus
cggaggaggagttctccaacacaac

SEQ ID NO: 260187 - DNA, 25 bp, Mus musculus
cggaggaggcagaagcctcacaggc

SEQ ID NO: 260188 - DNA, 25 bp, Mus musculus
cggaggaggcggacgagcaaaaatc

SEQ ID NO: 260189 - DNA, 25 bp, Mus musculus
cggaggagggaagatcctccctcat

SEQ ID NO: 260190 - DNA, 25 bp, Mus musculus
cggaggagggaaggggctggaaagt

SEQ ID NO: 260191 - DNA, 25 bp, Mus musculus
cggaggagggcagcagaaccagaca

SEQ ID NO: 260192 - DNA, 25 bp, Mus musculus
cggaggagggcaggaatcccagcca

SEQ ID NO: 260193 - DNA, 25 bp, Mus musculus
cggaggagggggaggccgctcacga

SEQ ID NO: 260194 - DNA, 25 bp, Mus musculus
cggaggagtaagacgtcgcctcatc

SEQ ID NO: 260195 - DNA, 25 bp, Mus musculus
cggaggagtggagacgtcggatgcg

SEQ ID NO: 260196 - DNA, 25 bp, Mus musculus
cggaggagtggtgtggaaggcagtg

SEQ ID NO: 260197 - DNA, 25 bp, Mus musculus
cggaggagttcaacatagactacac

SEQ ID NO: 260198 - DNA, 25 bp, Mus musculus
cggaggataggtcggccagtgagga

SEQ ID NO: 260199 - DNA, 25 bp, Mus musculus
cggaggatcaagacgaaactgcagc

SEQ ID NO: 260200 - DNA, 25 bp, Mus musculus
cggaggatcaagagttgaaagcgct

SEQ ID NO: 260201 - DNA, 25 bp, Mus musculus
cggaggatcagacatggtctcacca

SEQ ID NO: 260202 - DNA, 25 bp, Mus musculus
cggaggatctcttggccagagaaca

SEQ ID NO: 260203 - DNA, 25 bp, Mus musculus
cggaggatctcttggtaggccagga

SEQ ID NO: 260204 - DNA, 25 bp, Mus musculus
cggaggattcacgtatgggacccag

SEQ ID NO: 260205 - DNA, 25 bp, Mus musculus
cggaggcaaggagaggtacaaaatg

SEQ ID NO: 260206 - DNA, 25 bp, Mus musculus
cggaggccagcggggctggcgctgt

SEQ ID NO: 260207 - DNA, 25 bp, Mus musculus
cggaggccagcgggggctggcttac

SEQ ID NO: 260208 - DNA, 25 bp, Mus musculus
cggaggccagttctggtccgcatac

SEQ ID NO: 260209 - DNA, 25 bp, Mus musculus
cggaggccctgaccgattcacaatg

SEQ ID NO: 260210 - DNA, 25 bp, Mus musculus
cggaggccgcaggttggtgttcgag

SEQ ID NO: 260211 - DNA, 25 bp, Mus musculus
cggaggccgcgtgtaatgttcaagc

SEQ ID NO: 260212 - DNA, 25 bp, Mus musculus
cggaggcctgctgatgctcctgcca

SEQ ID NO: 260213 - DNA, 25 bp, Mus musculus
cggaggccttgaaggatttagttgt

SEQ ID NO: 260214 - DNA, 25 bp, Mus musculus
cggaggccttgaagtgctttaggat

SEQ ID NO: 260215 - DNA, 25 bp, Mus musculus
cggaggcgagaggccccacgcatgg

SEQ ID NO: 260216 - DNA, 25 bp, Mus musculus
cggaggcgagcgggcttggctgagt

SEQ ID NO: 260217 - DNA, 25 bp, Mus musculus
cggaggctccgtggaacactcgggc

SEQ ID NO: 260218 - DNA, 25 bp, Mus musculus
cggaggctcgcagaggcaggggtag

SEQ ID NO: 260219 - DNA, 25 bp, Mus musculus
cggaggctgagatcactggagattg

SEQ ID NO: 260220 - DNA, 25 bp, Mus musculus
cggagggaagtgttgacgctgctga

SEQ ID NO: 260221 - DNA, 25 bp, Mus musculus
cggagggacctcaaggaccttggtg

SEQ ID NO: 260222 - DNA, 25 bp, Mus musculus
cggagggactgggaagatggatgac

SEQ ID NO: 260223 - DNA, 25 bp, Mus musculus
cggagggactgggaagccagctaga

SEQ ID NO: 260224 - DNA, 25 bp, Mus musculus
cggagggcatcaccatcgtggaaga

SEQ ID NO: 260225 - DNA, 25 bp, Mus musculus
cggagggcatgagcctcaagatggt

SEQ ID NO: 260226 - DNA, 25 bp, Mus musculus
cggagggcatgagcgggactcgcca

SEQ ID NO: 260227 - DNA, 25 bp, Mus musculus
cggagggccaaaaaagtgtgcgctc

SEQ ID NO: 260228 - DNA, 25 bp, Mus musculus
cggagggccgcaacaccaagaagga

SEQ ID NO: 260229 - DNA, 25 bp, Mus musculus
cggagggcctcgagctgaagggaac

SEQ ID NO: 260230 - DNA, 25 bp, Mus musculus
cggagggcctcggtcacccagctgg

SEQ ID NO: 260231 - DNA, 25 bp, Mus musculus
cggagggcgagcgggaacagaactc

SEQ ID NO: 260232 - DNA, 25 bp, Mus musculus
cggaggggaggaaatgagaaagatg

SEQ ID NO: 260233 - DNA, 25 bp, Mus musculus
cggaggggaggaagatggcactgga

SEQ ID NO: 260234 - DNA, 25 bp, Mus musculus
cggaggggaggaagcctagccgccc

SEQ ID NO: 260235 - DNA, 25 bp, Mus musculus
cggaggggaggaaggcatcccccgc

SEQ ID NO: 260236 - DNA, 25 bp, Mus musculus
cggaggggcactgggtcgtcatgtc

SEQ ID NO: 260237 - DNA, 25 bp, Mus musculus
cggaggggcagaggtagccattgcg

SEQ ID NO: 260238 - DNA, 25 bp, Mus musculus
cggaggggcaggttctggtattgga

SEQ ID NO: 260239 - DNA, 25 bp, Mus musculus
cggaggggccccgcggcagactccg

SEQ ID NO: 260240 - DNA, 25 bp, Mus musculus
cggaggggtggaaaatgacattccc

SEQ ID NO: 260241 - DNA, 25 bp, Mus musculus
cggaggggtgggaggctgccggcgt

SEQ ID NO: 260242 - DNA, 25 bp, Mus musculus
cggaggggttggtgatggattcatg

SEQ ID NO: 260243 - DNA, 25 bp, Mus musculus
cggagggtagagacggggccctagc

SEQ ID NO: 260244 - DNA, 25 bp, Mus musculus
cggagggtcgagctgtcagagaagc

SEQ ID NO: 260245 - DNA, 25 bp, Mus musculus
cggagggtctgcaggtcttgtagaa

SEQ ID NO: 260246 - DNA, 25 bp, Mus musculus
cggaggtagtcttgtcctgggtggg

SEQ ID NO: 260247 - DNA, 25 bp, Mus musculus
cggaggtcctactggaacaaatgct

SEQ ID NO: 260248 - DNA, 25 bp, Mus musculus
cggaggtgacaacgaaaatatctgc

SEQ ID NO: 260249 - DNA, 25 bp, Mus musculus
cggagtaagtgaggtccagggaggg

SEQ ID NO: 260250 - DNA, 25 bp, Mus musculus
cggagtaagtgagtcctttcaggtc

SEQ ID NO: 260251 - DNA, 25 bp, Mus musculus
cggagtaatgacagacattgagata

SEQ ID NO: 260252 - DNA, 25 bp, Mus musculus
cggagtaatgacagctcagttccta

SEQ ID NO: 260253 - DNA, 25 bp, Mus musculus
cggagtaatgacagctccttcctct

SEQ ID NO: 260254 - DNA, 25 bp, Mus musculus
cggagtagaggcctttgtgaaaatg

SEQ ID NO: 260255 - DNA, 25 bp, Mus musculus
cggagtagcaaaggaatgggacaga

SEQ ID NO: 260256 - DNA, 25 bp, Mus musculus
cggagtagcaaaggttcagcctatg

SEQ ID NO: 260257 - DNA, 25 bp, Mus musculus
cggagtcaagagccttcgtgagccc

SEQ ID NO: 260258 - DNA, 25 bp, Mus musculus
cggagtcaagaggttctccccaatc

SEQ ID NO: 260259 - DNA, 25 bp, Mus musculus
cggagtcaagagtcccctgtcgctc

SEQ ID NO: 260260 - DNA, 25 bp, Mus musculus
cggagtcatgggggtctgctgcaca

SEQ ID NO: 260261 - DNA, 25 bp, Mus musculus
cggagtccagggtctccatagaggt

SEQ ID NO: 260262 - DNA, 25 bp, Mus musculus
cggagtcccaagtctccaggtggtc

SEQ ID NO: 260263 - DNA, 25 bp, Mus musculus
cggagtccccagtgaaagcagaaga

SEQ ID NO: 260264 - DNA, 25 bp, Mus musculus
cggagtccgtgctgagacgtcatca

SEQ ID NO: 260265 - DNA, 25 bp, Mus musculus
cggagtcctcacagtgagtgatagc

SEQ ID NO: 260266 - DNA, 25 bp, Mus musculus
cggagtcgactatgtgtacaagacc

SEQ ID NO: 260267 - DNA, 25 bp, Mus musculus
cggagtcgcaggtgactccatacca

SEQ ID NO: 260268 - DNA, 25 bp, Mus musculus
cggagtcgcaggtgttttgcaaact

SEQ ID NO: 260269 - DNA, 25 bp, Mus musculus
cggagtcgccatgcctacaacacag

SEQ ID NO: 260270 - DNA, 25 bp, Mus musculus
cggagtcgccatgtcaccccaggat

SEQ ID NO: 260271 - DNA, 25 bp, Mus musculus
cggagtcggaggccctaatgctggc

SEQ ID NO: 260272 - DNA, 25 bp, Mus musculus
cggagtctccgggaacgtgccaata

SEQ ID NO: 260273 - DNA, 25 bp, Mus musculus
cggagtctccgggctttggcgttgt

SEQ ID NO: 260274 - DNA, 25 bp, Mus musculus
cggagtctccggggatgaattgtct

SEQ ID NO: 260275 - DNA, 25 bp, Mus musculus
cggagtctggagccgccatggatac

SEQ ID NO: 260276 - DNA, 25 bp, Mus musculus
cggagtctggcaggagtgctcacca

SEQ ID NO: 260277 - DNA, 25 bp, Mus musculus
cggagtgaacgatcatgaaggaagt

SEQ ID NO: 260278 - DNA, 25 bp, Mus musculus
cggagtgaactgaagttgaaaagag

SEQ ID NO: 260279 - DNA, 25 bp, Mus musculus
cggagtgcaagcagagagagaagac

SEQ ID NO: 260280 - DNA, 25 bp, Mus musculus
cggagtgcaagcagttgcacgtttg

SEQ ID NO: 260281 - DNA, 25 bp, Mus musculus
cggagtgccaagacacaagcatcta

SEQ ID NO: 260282 - DNA, 25 bp, Mus musculus
cggagtgccaattattctgtttttt

SEQ ID NO: 260283 - DNA, 25 bp, Mus musculus
cggagtgcggagggcgggggcagag

SEQ ID NO: 260284 - DNA, 25 bp, Mus musculus
cggagtgcggagggggccccccaga

SEQ ID NO: 260285 - DNA, 25 bp, Mus musculus
cggagtggagaagtatattggattt

SEQ ID NO: 260286 - DNA, 25 bp, Mus musculus
cggagtggcagtccggctctccaag

SEQ ID NO: 260287 - DNA, 25 bp, Mus musculus
cggagtgtctcgctgtcactgagcc

SEQ ID NO: 260288 - DNA, 25 bp, Mus musculus
cggagtgtcttttctatagatgccc

SEQ ID NO: 260289 - DNA, 25 bp, Mus musculus
cggagtgtgatcgtttggaaaacga

SEQ ID NO: 260290 - DNA, 25 bp, Mus musculus
cggagtgttgaacagagaaattagc

SEQ ID NO: 260291 - DNA, 25 bp, Mus musculus
cggagtgttggtaactaaatgacca

SEQ ID NO: 260292 - DNA, 25 bp, Mus musculus
cggagttcagaagaggatgactgag

SEQ ID NO: 260293 - DNA, 25 bp, Mus musculus
cggagttcgagactaccaggtatgg

SEQ ID NO: 260294 - DNA, 25 bp, Mus musculus
cggagttgagattcccaccctgctg

SEQ ID NO: 260295 - DNA, 25 bp, Mus musculus
cggagttgcaagaccatagtctgtg

SEQ ID NO: 260296 - DNA, 25 bp, Mus musculus
cggagttgctgggagacattggggg

SEQ ID NO: 260297 - DNA, 25 bp, Mus musculus
cggataacaggctgaccacagtggc

SEQ ID NO: 260298 - DNA, 25 bp, Mus musculus
cggataaccagtggcatcctttgac

SEQ ID NO: 260299 - DNA, 25 bp, Mus musculus
cggataagacagatatgaaccgaca

SEQ ID NO: 260300 - DNA, 25 bp, Mus musculus
cggataagctctgacttcagaacat

SEQ ID NO: 260301 - DNA, 25 bp, Mus musculus
cggataagctctggggatgaagaga

SEQ ID NO: 260302 - DNA, 25 bp, Mus musculus
cggataccaaactgttttctggact

SEQ ID NO: 260303 - DNA, 25 bp, Mus musculus
cggatacgcggcgagccggtgtgag

SEQ ID NO: 260304 - DNA, 25 bp, Mus musculus
cggatacgcggcggcgcctgtgtct

SEQ ID NO: 260305 - DNA, 25 bp, Mus musculus
cggatacgggattggcctagaagga

SEQ ID NO: 260306 - DNA, 25 bp, Mus musculus
cggatactggacatgctggtgtcta

SEQ ID NO: 260307 - DNA, 25 bp, Mus musculus
cggatactggatgaagacagctgga

SEQ ID NO: 260308 - DNA, 25 bp, Mus musculus
cggatactgtaaggtatgtcactgg

SEQ ID NO: 260309 - DNA, 25 bp, Mus musculus
cggatactgtaagtgagggagctgg

SEQ ID NO: 260310 - DNA, 25 bp, Mus musculus
cggatagacgtcaggtggccatcaa

SEQ ID NO: 260311 - DNA, 25 bp, Mus musculus
cggatagcagacactacaagaagcg

SEQ ID NO: 260312 - DNA, 25 bp, Mus musculus
cggataggagatgtttgagacagag

SEQ ID NO: 260313 - DNA, 25 bp, Mus musculus
cggatagggagttcttccccagagg

SEQ ID NO: 260314 - DNA, 25 bp, Mus musculus
cggatatcatgagctttcccgaaag

SEQ ID NO: 260315 - DNA, 25 bp, Mus musculus
cggatatctgaggttcccaatcaag

SEQ ID NO: 260316 - DNA, 25 bp, Mus musculus
cggatatgagaagtcaaactacaac

SEQ ID NO: 260317 - DNA, 25 bp, Mus musculus
cggatatggcaggatgttcaactaa

SEQ ID NO: 260318 - DNA, 25 bp, Mus musculus
cggatatgtggccgatctgtccccg

SEQ ID NO: 260319 - DNA, 25 bp, Mus musculus
cggatcaatggctctgcctggtacc

SEQ ID NO: 260320 - DNA, 25 bp, Mus musculus
cggatcactgcaaaatgaacccaca

SEQ ID NO: 260321 - DNA, 25 bp, Mus musculus
cggatcagcagctgtggctaacttc

SEQ ID NO: 260322 - DNA, 25 bp, Mus musculus
cggatcatgtgcagagcctggccca

SEQ ID NO: 260323 - DNA, 25 bp, Mus musculus
cggatccaacctttgccatgggcct

SEQ ID NO: 260324 - DNA, 25 bp, Mus musculus
cggatccagaaggaactgactgatt

SEQ ID NO: 260325 - DNA, 25 bp, Mus musculus
cggatccagaaggttgctttcacta

SEQ ID NO: 260326 - DNA, 25 bp, Mus musculus
cggatccagacacagatggaggtag

SEQ ID NO: 260327 - DNA, 25 bp, Mus musculus
cggatccagacacaggcaactggcc

SEQ ID NO: 260328 - DNA, 25 bp, Mus musculus
cggatcccagggcctagtaactatc

SEQ ID NO: 260329 - DNA, 25 bp, Mus musculus
cggatcccgaggccacgtggcaccg

SEQ ID NO: 260330 - DNA, 25 bp, Mus musculus
cggatccctccagcggaactggctc

SEQ ID NO: 260331 - DNA, 25 bp, Mus musculus
cggatccctccaggaggagcaggac

SEQ ID NO: 260332 - DNA, 25 bp, Mus musculus
cggatccctgaattgacccagcccg

SEQ ID NO: 260333 - DNA, 25 bp, Mus musculus
cggatccgcaagctgccccccaagt

SEQ ID NO: 260334 - DNA, 25 bp, Mus musculus
cggatccgcaagctgtctgatcagt

SEQ ID NO: 260335 - DNA, 25 bp, Mus musculus
cggatccggcagcttaggttgtcct

SEQ ID NO: 260336 - DNA, 25 bp, Mus musculus
cggatccggcaggaattgaagttaa

SEQ ID NO: 260337 - DNA, 25 bp, Mus musculus
cggatccgggagcctgagcctttgc

SEQ ID NO: 260338 - DNA, 25 bp, Mus musculus
cggatcgcccctaagccttcaagat

SEQ ID NO: 260339 - DNA, 25 bp, Mus musculus
cggatcgcccctaaggtaagttctc

SEQ ID NO: 260340 - DNA, 25 bp, Mus musculus
cggatcgcctgcagagaggaagacg

SEQ ID NO: 260341 - DNA, 25 bp, Mus musculus
cggatcgcctgcagggtgagttggt

SEQ ID NO: 260342 - DNA, 25 bp, Mus musculus
cggatcggagaaacgcttcgttaag

SEQ ID NO: 260343 - DNA, 25 bp, Mus musculus
cggatctaacccaggtgatgaagtc

SEQ ID NO: 260344 - DNA, 25 bp, Mus musculus
cggatctcaccagggcccagtcatt

SEQ ID NO: 260345 - DNA, 25 bp, Mus musculus
cggatctcagataataaccaaagag

SEQ ID NO: 260346 - DNA, 25 bp, Mus musculus
cggatctgatcagaacaggacgcgg

SEQ ID NO: 260347 - DNA, 25 bp, Mus musculus
cggatctgatcaggtccagcctgat

SEQ ID NO: 260348 - DNA, 25 bp, Mus musculus
cggatctgatcagtctcggcatctc

SEQ ID NO: 260349 - DNA, 25 bp, Mus musculus
cggatctgctaaaagatttctgcat

SEQ ID NO: 260350 - DNA, 25 bp, Mus musculus
cggatctgtacaagggtgaaaaagg

SEQ ID NO: 260351 - DNA, 25 bp, Mus musculus
cggatctgtgattataaaagctttg

SEQ ID NO: 260352 - DNA, 25 bp, Mus musculus
cggatcttccggccccggaagctga

SEQ ID NO: 260353 - DNA, 25 bp, Mus musculus
cggatcttcttccagtgcaggtcct

SEQ ID NO: 260354 - DNA, 25 bp, Mus musculus
cggatgaaaacccagtgagatgagt

SEQ ID NO: 260355 - DNA, 25 bp, Mus musculus
cggatgaaaagcctgacagaagtcg

SEQ ID NO: 260356 - DNA, 25 bp, Mus musculus
cggatgaaaagcctgctccaggtct

SEQ ID NO: 260357 - DNA, 25 bp, Mus musculus
cggatgaagagaggcatgttggaga

SEQ ID NO: 260358 - DNA, 25 bp, Mus musculus
cggatgaagttagcaggagatgcgg

SEQ ID NO: 260359 - DNA, 25 bp, Mus musculus
cggatgacattcacctgctgtcttc

SEQ ID NO: 260360 - DNA, 25 bp, Mus musculus
cggatgactgaaatctacttaaaat

SEQ ID NO: 260361 - DNA, 25 bp, Mus musculus
cggatgagaccacagatgccaattc

SEQ ID NO: 260362 - DNA, 25 bp, Mus musculus
cggatgagcagagaccactgctatt

SEQ ID NO: 260363 - DNA, 25 bp, Mus musculus
cggatgagcatcaccctggaatgac

SEQ ID NO: 260364 - DNA, 25 bp, Mus musculus
cggatgagcccaaagcacccatgct

SEQ ID NO: 260365 - DNA, 25 bp, Mus musculus
cggatgagcgagctggagcagaact

SEQ ID NO: 260366 - DNA, 25 bp, Mus musculus
cggatgatctagtttgtttggtgta

SEQ ID NO: 260367 - DNA, 25 bp, Mus musculus
cggatgattcagagccccagggctt

SEQ ID NO: 260368 - DNA, 25 bp, Mus musculus
cggatgccagatgttgcatgtggct

SEQ ID NO: 260369 - DNA, 25 bp, Mus musculus
cggatgctcacggaacgaatgttca

SEQ ID NO: 260370 - DNA, 25 bp, Mus musculus
cggatgctcagcgaggacccgtgga

SEQ ID NO: 260371 - DNA, 25 bp, Mus musculus
cggatgctgagatggtttttgatca

SEQ ID NO: 260372 - DNA, 25 bp, Mus musculus
cggatgctgagcgaggagtgactgc

SEQ ID NO: 260373 - DNA, 25 bp, Mus musculus
cggatgctgcaggttactcggcggc

SEQ ID NO: 260374 - DNA, 25 bp, Mus musculus
cggatgctggagctctcttgagtca

SEQ ID NO: 260375 - DNA, 25 bp, Mus musculus
cggatgctgtcggtggctacagatg

SEQ ID NO: 260376 - DNA, 25 bp, Mus musculus
cggatgctgtgctgggtcacttttc

SEQ ID NO: 260377 - DNA, 25 bp, Mus musculus
cggatggaaaagcacctggatgctt

SEQ ID NO: 260378 - DNA, 25 bp, Mus musculus
cggatggaagtgtcatctgccaggt

SEQ ID NO: 260379 - DNA, 25 bp, Mus musculus
cggatggaatgtgagatatgatgaa

SEQ ID NO: 260380 - DNA, 25 bp, Mus musculus
cggatggacaatcagcgcctgttgg

SEQ ID NO: 260381 - DNA, 25 bp, Mus musculus
cggatggagaatatattcctccttt

SEQ ID NO: 260382 - DNA, 25 bp, Mus musculus
cggatggaggagagggctctgctct

SEQ ID NO: 260383 - DNA, 25 bp, Mus musculus
cggatggcacaggagctgatacaag

SEQ ID NO: 260384 - DNA, 25 bp, Mus musculus
cggatggccagccttggcctcacgc

SEQ ID NO: 260385 - DNA, 25 bp, Mus musculus
cggatgtacaaaacgcccattttcc

SEQ ID NO: 260386 - DNA, 25 bp, Mus musculus
cggatgtaccagaagactctaacag

SEQ ID NO: 260387 - DNA, 25 bp, Mus musculus
cggatgtaccaggtgatttcagact

SEQ ID NO: 260388 - DNA, 25 bp, Mus musculus
cggatgtatccaggctcacccagac

SEQ ID NO: 260389 - DNA, 25 bp, Mus musculus
cggatgtatccaggtcacccagatc

SEQ ID NO: 260390 - DNA, 25 bp, Mus musculus
cggatgtcagggaggtataagtgct

SEQ ID NO: 260391 - DNA, 25 bp, Mus musculus
cggatgtgaaagcacaggtggacgt

SEQ ID NO: 260392 - DNA, 25 bp, Mus musculus
cggatgtggacgcctctgcccattt

SEQ ID NO: 260393 - DNA, 25 bp, Mus musculus
cggatgtggacgcttctgccagact

SEQ ID NO: 260394 - DNA, 25 bp, Mus musculus
cggatgtggacggccgagctctgct

SEQ ID NO: 260395 - DNA, 25 bp, Mus musculus
cggatgtggataaaaatatccagca

SEQ ID NO: 260396 - DNA, 25 bp, Mus musculus
cggatgtggatgcaaatgaaaagaa

SEQ ID NO: 260397 - DNA, 25 bp, Mus musculus
cggatgtgggttatgttcagggcat

SEQ ID NO: 260398 - DNA, 25 bp, Mus musculus
cggatgttaaggagagggcgcgagt

SEQ ID NO: 260399 - DNA, 25 bp, Mus musculus
cggatgttaaggtgccaagtcgggg

SEQ ID NO: 260400 - DNA, 25 bp, Mus musculus
cggatgttcaagacgcaagtgggac

SEQ ID NO: 260401 - DNA, 25 bp, Mus musculus
cggatgtttccaggaaatgcccatg

SEQ ID NO: 260402 - DNA, 25 bp, Mus musculus
cggatgtttccagggctgcacagag

SEQ ID NO: 260403 - DNA, 25 bp, Mus musculus
cggattacatagccaacaaggagag

SEQ ID NO: 260404 - DNA, 25 bp, Mus musculus
cggattacataggttttactatata

SEQ ID NO: 260405 - DNA, 25 bp, Mus musculus
cggattacatagtgtatcccctact

SEQ ID NO: 260406 - DNA, 25 bp, Mus musculus
cggattcacaaataaagtggtgaca

SEQ ID NO: 260407 - DNA, 25 bp, Mus musculus
cggattcagaaggacattaacgagc

SEQ ID NO: 260408 - DNA, 25 bp, Mus musculus
cggattcagtgcaggtttggatgca

SEQ ID NO: 260409 - DNA, 25 bp, Mus musculus
cggattcagtggcattgaatccagc

SEQ ID NO: 260410 - DNA, 25 bp, Mus musculus
cggattccagcccaacatgcaaatc

SEQ ID NO: 260411 - DNA, 25 bp, Mus musculus
cggattccttatggatcgcagctcc

SEQ ID NO: 260412 - DNA, 25 bp, Mus musculus
cggattctcgggaggatccgagcgt

SEQ ID NO: 260413 - DNA, 25 bp, Mus musculus
cggattctcgggaggtggctgtctg

SEQ ID NO: 260414 - DNA, 25 bp, Mus musculus
cggattcttctcaatgtaaatttaa

SEQ ID NO: 260415 - DNA, 25 bp, Mus musculus
cggattgagcggtcctcgtctttca

SEQ ID NO: 260416 - DNA, 25 bp, Mus musculus
cggattgcctggagagtgtgaagga

SEQ ID NO: 260417 - DNA, 25 bp, Mus musculus
cggatttctggagccctgctttaag

SEQ ID NO: 260418 - DNA, 25 bp, Mus musculus
cggatttggagatataaccaagaac

SEQ ID NO: 260419 - DNA, 25 bp, Mus musculus
cggattttaaagagttgattccaga

SEQ ID NO: 260420 - DNA, 25 bp, Mus musculus
cggattttgcccaggaccagccatg

SEQ ID NO: 260421 - DNA, 25 bp, Mus musculus
cggatttttgttgaagtactcacca

SEQ ID NO: 260422 - DNA, 25 bp, Mus musculus
cggcaaaaaatgtaacatttcactt

SEQ ID NO: 260423 - DNA, 25 bp, Mus musculus
cggcaaaaaatgttggtttgccatc

SEQ ID NO: 260424 - DNA, 25 bp, Mus musculus
cggcaaaacccaggcaagtgctctc

SEQ ID NO: 260425 - DNA, 25 bp, Mus musculus
cggcaaaatgagccgcacggaagga

SEQ ID NO: 260426 - DNA, 25 bp, Mus musculus
cggcaaacatgacctggctcaccta

SEQ ID NO: 260427 - DNA, 25 bp, Mus musculus
cggcaaagaggcattctggaattta

SEQ ID NO: 260428 - DNA, 25 bp, Mus musculus
cggcaaattaggtctgactttgtga

SEQ ID NO: 260429 - DNA, 25 bp, Mus musculus
cggcaacaagacgctgccgtccagg

SEQ ID NO: 260430 - DNA, 25 bp, Mus musculus
cggcaacactgggtaacctccgtgc

SEQ ID NO: 260431 - DNA, 25 bp, Mus musculus
cggcaacctggcctctagacgtcct

SEQ ID NO: 260432 - DNA, 25 bp, Mus musculus
cggcaacggacagctcggattctga

SEQ ID NO: 260433 - DNA, 25 bp, Mus musculus
cggcaagagacggaagaacgagcca

SEQ ID NO: 260434 - DNA, 25 bp, Mus musculus
cggcaagcaaggcttatacccctag

SEQ ID NO: 260435 - DNA, 25 bp, Mus musculus
cggcaagcagactaggaatctcgat

SEQ ID NO: 260436 - DNA, 25 bp, Mus musculus
cggcaagcccctgccgacacccatc

SEQ ID NO: 260437 - DNA, 25 bp, Mus musculus
cggcaagcccctgcgacacctgcgg

SEQ ID NO: 260438 - DNA, 25 bp, Mus musculus
cggcaaggggagactggccaatcac

SEQ ID NO: 260439 - DNA, 25 bp, Mus musculus
cggcaaggtgaggagtactgaacct

SEQ ID NO: 260440 - DNA, 25 bp, Mus musculus
cggcaagtacctggcttcctgtgtc

SEQ ID NO: 260441 - DNA, 25 bp, Mus musculus
cggcaagtacctggtctggtcactc

SEQ ID NO: 260442 - DNA, 25 bp, Mus musculus
cggcaagtgatggagactcagaaag

SEQ ID NO: 260443 - DNA, 25 bp, Mus musculus
cggcaagtgctggaacacctgctga

SEQ ID NO: 260444 - DNA, 25 bp, Mus musculus
cggcaatcagtttggagattctcag

SEQ ID NO: 260445 - DNA, 25 bp, Mus musculus
cggcacaaaatcagcgcctgggaga

SEQ ID NO: 260446 - DNA, 25 bp, Mus musculus
cggcacaacccgcggggcgccctgc

SEQ ID NO: 260447 - DNA, 25 bp, Mus musculus
cggcacaactcctggtcatctagta

SEQ ID NO: 260448 - DNA, 25 bp, Mus musculus
cggcacaatcagagccttggctgtt

SEQ ID NO: 260449 - DNA, 25 bp, Mus musculus
cggcacactcgatctgatttgtact

SEQ ID NO: 260450 - DNA, 25 bp, Mus musculus
cggcacactgaaaagatccgcttca

SEQ ID NO: 260451 - DNA, 25 bp, Mus musculus
cggcacactgatgagcgcccctaca

SEQ ID NO: 260452 - DNA, 25 bp, Mus musculus
cggcacagccccctgcgggtgttta

SEQ ID NO: 260453 - DNA, 25 bp, Mus musculus
cggcacagctggctggaccagatct

SEQ ID NO: 260454 - DNA, 25 bp, Mus musculus
cggcacagtgcttgctgaatttcag

SEQ ID NO: 260455 - DNA, 25 bp, Mus musculus
cggcacataaaaaggagacagagtc

SEQ ID NO: 260456 - DNA, 25 bp, Mus musculus
cggcacataaaaaggctgagaaggc

SEQ ID NO: 260457 - DNA, 25 bp, Mus musculus
cggcaccaaactactaaaggtgtta

SEQ ID NO: 260458 - DNA, 25 bp, Mus musculus
cggcaccaaactccatagattgtaa

SEQ ID NO: 260459 - DNA, 25 bp, Mus musculus
cggcaccaaactgcttgatttaaat

SEQ ID NO: 260460 - DNA, 25 bp, Mus musculus
cggcaccaacagcgccaggcagcac

SEQ ID NO: 260461 - DNA, 25 bp, Mus musculus
cggcaccagccctttgcttatggga

SEQ ID NO: 260462 - DNA, 25 bp, Mus musculus
cggcaccatggcaaccgaagaacct

SEQ ID NO: 260463 - DNA, 25 bp, Mus musculus
cggcaccatggcgtttatgtttgaa

SEQ ID NO: 260464 - DNA, 25 bp, Mus musculus
cggcacccagtaatctttggaaaca

SEQ ID NO: 260465 - DNA, 25 bp, Mus musculus
cggcacccatcagaagcaagacgac

SEQ ID NO: 260466 - DNA, 25 bp, Mus musculus
cggcacccctgagtacttggctcca

SEQ ID NO: 260467 - DNA, 25 bp, Mus musculus
cggcaccgccacacagacagatgat

SEQ ID NO: 260468 - DNA, 25 bp, Mus musculus
cggcacctcgacacgtgtgcaaaat

SEQ ID NO: 260469 - DNA, 25 bp, Mus musculus
cggcacctcggctggaaccctgatg

SEQ ID NO: 260470 - DNA, 25 bp, Mus musculus
cggcacctgacaaaggttctgggag

SEQ ID NO: 260471 - DNA, 25 bp, Mus musculus
cggcacctgcagactctgcagaggc

SEQ ID NO: 260472 - DNA, 25 bp, Mus musculus
cggcacctgcagcctgctccccagg

SEQ ID NO: 260473 - DNA, 25 bp, Mus musculus
cggcacctggtcagtgagcctggag

SEQ ID NO: 260474 - DNA, 25 bp, Mus musculus
cggcacgccacaggactacagtggg

SEQ ID NO: 260475 - DNA, 25 bp, Mus musculus
cggcacgccgttcggggtctaatgg

SEQ ID NO: 260476 - DNA, 25 bp, Mus musculus
cggcacggcggagggaggaaatatg

SEQ ID NO: 260477 - DNA, 25 bp, Mus musculus
cggcacggcgggagtcagcattggc

SEQ ID NO: 260478 - DNA, 25 bp, Mus musculus
cggcacggcggggatcccactgcca

SEQ ID NO: 260479 - DNA, 25 bp, Mus musculus
cggcacggcgggtttcaaatgatat

SEQ ID NO: 260480 - DNA, 25 bp, Mus musculus
cggcacgggaaggcagaagaaatac

SEQ ID NO: 260481 - DNA, 25 bp, Mus musculus
cggcactacggatgatctgagaatt

SEQ ID NO: 260482 - DNA, 25 bp, Mus musculus
cggcactacgggttccaatattgaa

SEQ ID NO: 260483 - DNA, 25 bp, Mus musculus
cggcactgcgctcttggaatttgac

SEQ ID NO: 260484 - DNA, 25 bp, Mus musculus
cggcacttaggagcagttctccgac

SEQ ID NO: 260485 - DNA, 25 bp, Mus musculus
cggcagaaagagtaaataacagatg

SEQ ID NO: 260486 - DNA, 25 bp, Mus musculus
cggcagaaagctaaaaagatctgaa

SEQ ID NO: 260487 - DNA, 25 bp, Mus musculus
cggcagaacctgggccgcatgtatc

SEQ ID NO: 260488 - DNA, 25 bp, Mus musculus
cggcagaagcaagaggaagaggagc

SEQ ID NO: 260489 - DNA, 25 bp, Mus musculus
cggcagaagcacagaactgctgagt

SEQ ID NO: 260490 - DNA, 25 bp, Mus musculus
cggcagaagcacagatccatgcatg

SEQ ID NO: 260491 - DNA, 25 bp, Mus musculus
cggcagaagcacagggcatctgtta

SEQ ID NO: 260492 - DNA, 25 bp, Mus musculus
cggcagaagcagtggctctagtctg

SEQ ID NO: 260493 - DNA, 25 bp, Mus musculus
cggcagaagcagtgggtacaaacaa

SEQ ID NO: 260494 - DNA, 25 bp, Mus musculus
cggcagaaggagacaggagtcatcc

SEQ ID NO: 260495 - DNA, 25 bp, Mus musculus
cggcagaatggacagttgctcagac

SEQ ID NO: 260496 - DNA, 25 bp, Mus musculus
cggcagaatgggtgcagacctctga

SEQ ID NO: 260497 - DNA, 25 bp, Mus musculus
cggcagacagacagctggtggcaca

SEQ ID NO: 260498 - DNA, 25 bp, Mus musculus
cggcagacagtgaagccagtctcca

SEQ ID NO: 260499 - DNA, 25 bp, Mus musculus
cggcagacctgctggggtgacagtc

SEQ ID NO: 260500 - DNA, 25 bp, Mus musculus
cggcagacgcagcttcggcttcatt

SEQ ID NO: 260501 - DNA, 25 bp, Mus musculus
cggcagactcagctgtgctggatgc

SEQ ID NO: 260502 - DNA, 25 bp, Mus musculus
cggcagactcaggcacctctgtcag

SEQ ID NO: 260503 - DNA, 25 bp, Mus musculus
cggcagactgcagcctaggatgtca

SEQ ID NO: 260504 - DNA, 25 bp, Mus musculus
cggcagactgcagtttcaggtcaga

SEQ ID NO: 260505 - DNA, 25 bp, Mus musculus
cggcagagcaagccactcaggctct

SEQ ID NO: 260506 - DNA, 25 bp, Mus musculus
cggcagagcaaggtggagctcacct

SEQ ID NO: 260507 - DNA, 25 bp, Mus musculus
cggcagagcaggatgcccggggcat

SEQ ID NO: 260508 - DNA, 25 bp, Mus musculus
cggcagagccaggctagtgaaccgg

SEQ ID NO: 260509 - DNA, 25 bp, Mus musculus
cggcagaggagaaccctcttggctc

SEQ ID NO: 260510 - DNA, 25 bp, Mus musculus
cggcagaggagcctggaggagggac

SEQ ID NO: 260511 - DNA, 25 bp, Mus musculus
cggcagagtctagccaccaagatcc

SEQ ID NO: 260512 - DNA, 25 bp, Mus musculus
cggcagatcagagattgttattgac

SEQ ID NO: 260513 - DNA, 25 bp, Mus musculus
cggcagatcagaggttgagcttgtt

SEQ ID NO: 260514 - DNA, 25 bp, Mus musculus
cggcagcaccggaaaactcaaggac

SEQ ID NO: 260515 - DNA, 25 bp, Mus musculus
cggcagcagaaagagactaacggtt

SEQ ID NO: 260516 - DNA, 25 bp, Mus musculus
cggcagcagaaagagatctatcaag

SEQ ID NO: 260517 - DNA, 25 bp, Mus musculus
cggcagcagaaagaggtagaagaaa

SEQ ID NO: 260518 - DNA, 25 bp, Mus musculus
cggcagcagaggtggtttgtgcacc

SEQ ID NO: 260519 - DNA, 25 bp, Mus musculus
cggcagcagcagcagactcaagaat

SEQ ID NO: 260520 - DNA, 25 bp, Mus musculus
cggcagcagcgcagcctcaggctgg

SEQ ID NO: 260521 - DNA, 25 bp, Mus musculus
cggcagcaggaacggagcacctccc

SEQ ID NO: 260522 - DNA, 25 bp, Mus musculus
cggcagcaggccgcgctagaaaatg

SEQ ID NO: 260523 - DNA, 25 bp, Mus musculus
cggcagcaggccgggggacagtaaa

SEQ ID NO: 260524 - DNA, 25 bp, Mus musculus
cggcagcagggccgggagcaggctg

SEQ ID NO: 260525 - DNA, 25 bp, Mus musculus
cggcagccaacaagatgtcatggca

SEQ ID NO: 260526 - DNA, 25 bp, Mus musculus
cggcagccaacaaggacaaagtcgg

SEQ ID NO: 260527 - DNA, 25 bp, Mus musculus
cggcagccaggacatagtcacatta

SEQ ID NO: 260528 - DNA, 25 bp, Mus musculus
cggcagccaggcgcaacctgcggga

SEQ ID NO: 260529 - DNA, 25 bp, Mus musculus
cggcagccagggaacatctcaagta

SEQ ID NO: 260530 - DNA, 25 bp, Mus musculus
cggcagccaggtgcagggcagtctg

SEQ ID NO: 260531 - DNA, 25 bp, Mus musculus
cggcagccaggtgggatgctatgga

SEQ ID NO: 260532 - DNA, 25 bp, Mus musculus
cggcagccgacgatacagacggcag

SEQ ID NO: 260533 - DNA, 25 bp, Mus musculus
cggcagccgacggaggacccgctct

SEQ ID NO: 260534 - DNA, 25 bp, Mus musculus
cggcagccgacggcaccagagtttt

SEQ ID NO: 260535 - DNA, 25 bp, Mus musculus
cggcagccgaggttcctgcctcaag

SEQ ID NO: 260536 - DNA, 25 bp, Mus musculus
cggcagcctaaggactaacggttat

SEQ ID NO: 260537 - DNA, 25 bp, Mus musculus
cggcagcctaagggcacagcccgag

SEQ ID NO: 260538 - DNA, 25 bp, Mus musculus
cggcagcctccccgactcggccatc

SEQ ID NO: 260539 - DNA, 25 bp, Mus musculus
cggcagcctctttgactatgaacaa

SEQ ID NO: 260540 - DNA, 25 bp, Mus musculus
cggcagcctctttgggttcgtttcc

SEQ ID NO: 260541 - DNA, 25 bp, Mus musculus
cggcagcgccgatgccgcctgcaga

SEQ ID NO: 260542 - DNA, 25 bp, Mus musculus
cggcagcggcggcagaaatgatgga

SEQ ID NO: 260543 - DNA, 25 bp, Mus musculus
cggcagcggggcctgcggctcgacg

SEQ ID NO: 260544 - DNA, 25 bp, Mus musculus
cggcagcgtcaggggacagaccacc

SEQ ID NO: 260545 - DNA, 25 bp, Mus musculus
cggcagcgtgaaggaaatggaattt

SEQ ID NO: 260546 - DNA, 25 bp, Mus musculus
cggcagctagagacagtccgagaac

SEQ ID NO: 260547 - DNA, 25 bp, Mus musculus
cggcagctctcgcagagacgtggag

SEQ ID NO: 260548 - DNA, 25 bp, Mus musculus
cggcagctgctgaccctgagcaatg

SEQ ID NO: 260549 - DNA, 25 bp, Mus musculus
cggcaggaactaaatcttccatccg

SEQ ID NO: 260550 - DNA, 25 bp, Mus musculus
cggcaggaactgtgtggacgacccc

SEQ ID NO: 260551 - DNA, 25 bp, Mus musculus
cggcaggagagcctgtgtcctgacc

SEQ ID NO: 260552 - DNA, 25 bp, Mus musculus
cggcaggagagggctgtagcagtgg

SEQ ID NO: 260553 - DNA, 25 bp, Mus musculus
cggcaggattcacgttggtgaccag

SEQ ID NO: 260554 - DNA, 25 bp, Mus musculus
cggcaggcaccgaggtggtttgtgc

SEQ ID NO: 260555 - DNA, 25 bp, Mus musculus
cggcaggcactggtgtaatggatag

SEQ ID NO: 260556 - DNA, 25 bp, Mus musculus
cggcaggcagaatgggaaacagcac

SEQ ID NO: 260557 - DNA, 25 bp, Mus musculus
cggcaggcagaggcagatatcaaga

SEQ ID NO: 260558 - DNA, 25 bp, Mus musculus
cggcaggcatccgggtgatcatggt

SEQ ID NO: 260559 - DNA, 25 bp, Mus musculus
cggcaggccgcggagcaaccgaaga

SEQ ID NO: 260560 - DNA, 25 bp, Mus musculus
cggcaggcgggtacaaaaatataca

SEQ ID NO: 260561 - DNA, 25 bp, Mus musculus
cggcaggctcagctgcaggctgtga

SEQ ID NO: 260562 - DNA, 25 bp, Mus musculus
cggcaggctcaggccaccccacatc

SEQ ID NO: 260563 - DNA, 25 bp, Mus musculus
cggcaggctcaggctaccgagtcta

SEQ ID NO: 260564 - DNA, 25 bp, Mus musculus
cggcaggctgacattgattctgggc

SEQ ID NO: 260565 - DNA, 25 bp, Mus musculus
cggcagggagcacagaacctttgac

SEQ ID NO: 260566 - DNA, 25 bp, Mus musculus
cggcagggagcacagctcatcctgt

SEQ ID NO: 260567 - DNA, 25 bp, Mus musculus
cggcagggatttgcttcaacctggc

SEQ ID NO: 260568 - DNA, 25 bp, Mus musculus
cggcagggatttgtttcgcctgcag

SEQ ID NO: 260569 - DNA, 25 bp, Mus musculus
cggcaggtcccaggtatgaatacca

SEQ ID NO: 260570 - DNA, 25 bp, Mus musculus
cggcaggtgaaggcctatgagaagc

SEQ ID NO: 260571 - DNA, 25 bp, Mus musculus
cggcagtactggcaccttctccacg

SEQ ID NO: 260572 - DNA, 25 bp, Mus musculus
cggcagtactggtcctaaccgtagg

SEQ ID NO: 260573 - DNA, 25 bp, Mus musculus
cggcagtagagtcagatacagagtt

SEQ ID NO: 260574 - DNA, 25 bp, Mus musculus
cggcagtcctggcagactgtaccat

SEQ ID NO: 260575 - DNA, 25 bp, Mus musculus
cggcagtcctggcagagacagagat

SEQ ID NO: 260576 - DNA, 25 bp, Mus musculus
cggcagtgattcatcagaaaagttc

SEQ ID NO: 260577 - DNA, 25 bp, Mus musculus
cggcagtggcgcaggatggcgcaga

SEQ ID NO: 260578 - DNA, 25 bp, Mus musculus
cggcagtggcgcagttttactttca

SEQ ID NO: 260579 - DNA, 25 bp, Mus musculus
cggcagtggcgccgtccagaggacc

SEQ ID NO: 260580 - DNA, 25 bp, Mus musculus
cggcagtgttttcagggccctcagc

SEQ ID NO: 260581 - DNA, 25 bp, Mus musculus
cggcatcacaaggccatcgccacgg

SEQ ID NO: 260582 - DNA, 25 bp, Mus musculus
cggcatcacactatggagtgttccc

SEQ ID NO: 260583 - DNA, 25 bp, Mus musculus
cggcatcacagatggcctgcaatgc

SEQ ID NO: 260584 - DNA, 25 bp, Mus musculus
cggcatccacggcggaaccttagag

SEQ ID NO: 260585 - DNA, 25 bp, Mus musculus
cggcatccacggggctccacctgaa

SEQ ID NO: 260586 - DNA, 25 bp, Mus musculus
cggcatcctgaaagatcttggtggg

SEQ ID NO: 260587 - DNA, 25 bp, Mus musculus
cggcatcctgaaagggctgtgcgga

SEQ ID NO: 260588 - DNA, 25 bp, Mus musculus
cggcatcgagaggagtggctcagga

SEQ ID NO: 260589 - DNA, 25 bp, Mus musculus
cggcatcgcggaggatcggtcatgg

SEQ ID NO: 260590 - DNA, 25 bp, Mus musculus
cggcatcggaagcctggacaaacta

SEQ ID NO: 260591 - DNA, 25 bp, Mus musculus
cggcatctataatgtcacccagagg

SEQ ID NO: 260592 - DNA, 25 bp, Mus musculus
cggcatctatgcggagctgacccgg

SEQ ID NO: 260593 - DNA, 25 bp, Mus musculus
cggcatctatgtacgtgccctggaa

SEQ ID NO: 260594 - DNA, 25 bp, Mus musculus
cggcatcttactacctgaaccagct

SEQ ID NO: 260595 - DNA, 25 bp, Mus musculus
cggcatgaaccacaagacctgctac

SEQ ID NO: 260596 - DNA, 25 bp, Mus musculus
cggcatgaccaaactccgatgatcg

SEQ ID NO: 260597 - DNA, 25 bp, Mus musculus
cggcatgaccagtgtcagcgcaagc

SEQ ID NO: 260598 - DNA, 25 bp, Mus musculus
cggcatgcagaggaatctggggtcc

SEQ ID NO: 260599 - DNA, 25 bp, Mus musculus
cggcatgcagggtgtgtctgcagca

SEQ ID NO: 260600 - DNA, 25 bp, Mus musculus
cggcatgctcggggggaaggcccaa

SEQ ID NO: 260601 - DNA, 25 bp, Mus musculus
cggcatggggcggcgtcgcggcttt

SEQ ID NO: 260602 - DNA, 25 bp, Mus musculus
cggcatgtacgctaacttgggtatt

SEQ ID NO: 260603 - DNA, 25 bp, Mus musculus
cggcatgtcatctacatagaccagc

SEQ ID NO: 260604 - DNA, 25 bp, Mus musculus
cggcatgtcatctacatagaccagg

SEQ ID NO: 260605 - DNA, 25 bp, Mus musculus
cggcatgttcgtgtggacaaatgtc

SEQ ID NO: 260606 - DNA, 25 bp, Mus musculus
cggcatgttctctgaattcctgtcc

SEQ ID NO: 260607 - DNA, 25 bp, Mus musculus
cggcattaccttggttctgaccaga

SEQ ID NO: 260608 - DNA, 25 bp, Mus musculus
cggcattgcccgcccatgtgcctcc

SEQ ID NO: 260609 - DNA, 25 bp, Mus musculus
cggcatttgtataagagagttctgg

SEQ ID NO: 260610 - DNA, 25 bp, Mus musculus
cggcatttgtataaggtactgggaa

SEQ ID NO: 260611 - DNA, 25 bp, Mus musculus
cggccaaaaggcggacgccgcgggc

SEQ ID NO: 260612 - DNA, 25 bp, Mus musculus
cggccaaagcacatgctccatttgc

SEQ ID NO: 260613 - DNA, 25 bp, Mus musculus
cggccaacacaaagatgggtgttac

SEQ ID NO: 260614 - DNA, 25 bp, Mus musculus
cggccaagaagaacaaagctgtatg

SEQ ID NO: 260615 - DNA, 25 bp, Mus musculus
cggccaagaagaactttcattttca

SEQ ID NO: 260616 - DNA, 25 bp, Mus musculus
cggccaagcatcaggtgtggagggt

SEQ ID NO: 260617 - DNA, 25 bp, Mus musculus
cggccaaggatccatctgcagttgc

SEQ ID NO: 260618 - DNA, 25 bp, Mus musculus
cggccaagtctacaggtggtgtcta

SEQ ID NO: 260619 - DNA, 25 bp, Mus musculus
cggccaatagctctcagggcctgtg

SEQ ID NO: 260620 - DNA, 25 bp, Mus musculus
cggccaatgcgaacgacttcttcgc

SEQ ID NO: 260621 - DNA, 25 bp, Mus musculus
cggccacaaccgcggaagaaaacgg

SEQ ID NO: 260622 - DNA, 25 bp, Mus musculus
cggccacacggctggatagccggtc

SEQ ID NO: 260623 - DNA, 25 bp, Mus musculus
cggccacagtcatggccttccctcc

SEQ ID NO: 260624 - DNA, 25 bp, Mus musculus
cggccacattgattttcctcgcatc

SEQ ID NO: 260625 - DNA, 25 bp, Mus musculus
cggccacattgccctgtcagcctca

SEQ ID NO: 260626 - DNA, 25 bp, Mus musculus
cggccaccagccccttcacagaatt

SEQ ID NO: 260627 - DNA, 25 bp, Mus musculus
cggccaccaggttatcctacacaac

SEQ ID NO: 260628 - DNA, 25 bp, Mus musculus
cggccaccatgccgatcaataagtc

SEQ ID NO: 260629 - DNA, 25 bp, Mus musculus
cggccaccgcgcaggcttgacatct

SEQ ID NO: 260630 - DNA, 25 bp, Mus musculus
cggccaccgcttgaatctccccgag

SEQ ID NO: 260631 - DNA, 25 bp, Mus musculus
cggccaccggcaggggactttgtgc

SEQ ID NO: 260632 - DNA, 25 bp, Mus musculus
cggccacctacttgctggggcttca

SEQ ID NO: 260633 - DNA, 25 bp, Mus musculus
cggccacctaggcctgcagctgagc

SEQ ID NO: 260634 - DNA, 25 bp, Mus musculus
cggccacctaggcttcagtggggat

SEQ ID NO: 260635 - DNA, 25 bp, Mus musculus
cggccacctccggggccaagatggg

SEQ ID NO: 260636 - DNA, 25 bp, Mus musculus
cggccacctttgaagactcggtgtg

SEQ ID NO: 260637 - DNA, 25 bp, Mus musculus
cggccacctttgaggaaaccaggaa

SEQ ID NO: 260638 - DNA, 25 bp, Mus musculus
cggccacggcagggttaacctctgc

SEQ ID NO: 260639 - DNA, 25 bp, Mus musculus
cggccacgggcgaggacctatatcc

SEQ ID NO: 260640 - DNA, 25 bp, Mus musculus
cggccacgtgagagggtcgttgctc

SEQ ID NO: 260641 - DNA, 25 bp, Mus musculus
cggccacgtgagaggttggtactaa

SEQ ID NO: 260642 - DNA, 25 bp, Mus musculus
cggccactgaccgagaagtgccccc

SEQ ID NO: 260643 - DNA, 25 bp, Mus musculus
cggccagaagccaccccagtgatgc

SEQ ID NO: 260644 - DNA, 25 bp, Mus musculus
cggccagaagctgaaccttattcac

SEQ ID NO: 260645 - DNA, 25 bp, Mus musculus
cggccagaagttgcaagttgttcag

SEQ ID NO: 260646 - DNA, 25 bp, Mus musculus
cggccagacacccagaggctggtcc

SEQ ID NO: 260647 - DNA, 25 bp, Mus musculus
cggccagacagacaggcttttgagg

SEQ ID NO: 260648 - DNA, 25 bp, Mus musculus
cggccagacccggcatcaggaagat

SEQ ID NO: 260649 - DNA, 25 bp, Mus musculus
cggccagagaggccggggcccgccg

SEQ ID NO: 260650 - DNA, 25 bp, Mus musculus
cggccagagggttggtcctgtggaa

SEQ ID NO: 260651 - DNA, 25 bp, Mus musculus
cggccagatgcctgggccgatgatg

SEQ ID NO: 260652 - DNA, 25 bp, Mus musculus
cggccagatgcctgggcctaaccat

SEQ ID NO: 260653 - DNA, 25 bp, Mus musculus
cggccagatgggcaagagttcaaac

SEQ ID NO: 260654 - DNA, 25 bp, Mus musculus
cggccagcagatcgtgtccagccct

SEQ ID NO: 260655 - DNA, 25 bp, Mus musculus
cggccagcaggtactcctgagcact

SEQ ID NO: 260656 - DNA, 25 bp, Mus musculus
cggccagcagtactattactggact

SEQ ID NO: 260657 - DNA, 25 bp, Mus musculus
cggccagccagataagtacggtttc

SEQ ID NO: 260658 - DNA, 25 bp, Mus musculus
cggccagcccagggcaaacgctaca

SEQ ID NO: 260659 - DNA, 25 bp, Mus musculus
cggccagcccaggggcacctacccg

SEQ ID NO: 260660 - DNA, 25 bp, Mus musculus
cggccagcggagagcaaagaccatg

SEQ ID NO: 260661 - DNA, 25 bp, Mus musculus
cggccagcggcaagatgtcattgat

SEQ ID NO: 260662 - DNA, 25 bp, Mus musculus
cggccagcggcaaggtgcgccgtca

SEQ ID NO: 260663 - DNA, 25 bp, Mus musculus
cggccagcgggagaccgggtcccag

SEQ ID NO: 260664 - DNA, 25 bp, Mus musculus
cggccagcggggacaatcccagaac

SEQ ID NO: 260665 - DNA, 25 bp, Mus musculus
cggccagcgggttcccgaggagatc

SEQ ID NO: 260666 - DNA, 25 bp, Mus musculus
cggccaggaatggacatttggtcag

SEQ ID NO: 260667 - DNA, 25 bp, Mus musculus
cggccaggacgacggcccttcaaat

SEQ ID NO: 260668 - DNA, 25 bp, Mus musculus
cggccaggcaaggcgggcatctcct

SEQ ID NO: 260669 - DNA, 25 bp, Mus musculus
cggccaggcaaggcgttcacagacg

SEQ ID NO: 260670 - DNA, 25 bp, Mus musculus
cggccaggccatgccatgggttctc

SEQ ID NO: 260671 - DNA, 25 bp, Mus musculus
cggccaggtgaggctccatcaaggt

SEQ ID NO: 260672 - DNA, 25 bp, Mus musculus
cggccagtcagaatacagtttggtc

SEQ ID NO: 260673 - DNA, 25 bp, Mus musculus
cggccagtcctagaggccgggataa

SEQ ID NO: 260674 - DNA, 25 bp, Mus musculus
cggccagtgaaccggttccacttga

SEQ ID NO: 260675 - DNA, 25 bp, Mus musculus
cggccagttggggtgctgtggacag

SEQ ID NO: 260676 - DNA, 25 bp, Mus musculus
cggccatcccagccaatggcagccc

SEQ ID NO: 260677 - DNA, 25 bp, Mus musculus
cggccatcccagccaccctgggcgg

SEQ ID NO: 260678 - DNA, 25 bp, Mus musculus
cggccatcctcaggtgagactttca

SEQ ID NO: 260679 - DNA, 25 bp, Mus musculus
cggccatcctcaggtgtgtggtaga

SEQ ID NO: 260680 - DNA, 25 bp, Mus musculus
cggccatctcagctgtggtcctcta

SEQ ID NO: 260681 - DNA, 25 bp, Mus musculus
cggccatctcaggtgttcctgtata

SEQ ID NO: 260682 - DNA, 25 bp, Mus musculus
cggccatctcaggttgtactttctc

SEQ ID NO: 260683 - DNA, 25 bp, Mus musculus
cggccatctgccggctctgggggac

SEQ ID NO: 260684 - DNA, 25 bp, Mus musculus
cggccatctgccgggaaggaagcac

SEQ ID NO: 260685 - DNA, 25 bp, Mus musculus
cggccatgaaaggcgttaagcatct

SEQ ID NO: 260686 - DNA, 25 bp, Mus musculus
cggccatgaagaacaattgccagcc

SEQ ID NO: 260687 - DNA, 25 bp, Mus musculus
cggccatgaagaacgtgaccgagct

SEQ ID NO: 260688 - DNA, 25 bp, Mus musculus
cggccatgaagaacttccacaggag

SEQ ID NO: 260689 - DNA, 25 bp, Mus musculus
cggccatgaagcatgtctgctgtga

SEQ ID NO: 260690 - DNA, 25 bp, Mus musculus
cggccatgaaggcgggtgctacttc

SEQ ID NO: 260691 - DNA, 25 bp, Mus musculus
cggccatgatggctgaccatgatgt

SEQ ID NO: 260692 - DNA, 25 bp, Mus musculus
cggccatggcggggcccctaacggc

SEQ ID NO: 260693 - DNA, 25 bp, Mus musculus
cggccatgggctgaactacgctgcc

SEQ ID NO: 260694 - DNA, 25 bp, Mus musculus
cggccatggggtctgtgacagcagc

SEQ ID NO: 260695 - DNA, 25 bp, Mus musculus
cggccatgtattccccgtgaatccc

SEQ ID NO: 260696 - DNA, 25 bp, Mus musculus
cggcccaaagagatgaagttggcgc

SEQ ID NO: 260697 - DNA, 25 bp, Mus musculus
cggcccacccggtgtgacttcttta

SEQ ID NO: 260698 - DNA, 25 bp, Mus musculus
cggcccacctttgagatgacagaga

SEQ ID NO: 260699 - DNA, 25 bp, Mus musculus
cggcccacctttgagtgactgccag

SEQ ID NO: 260700 - DNA, 25 bp, Mus musculus
cggcccacgaggatcgtctgaagga

SEQ ID NO: 260701 - DNA, 25 bp, Mus musculus
cggcccagagatgggcacctccgtc

SEQ ID NO: 260702 - DNA, 25 bp, Mus musculus
cggcccagcaatggcaattggcatc

SEQ ID NO: 260703 - DNA, 25 bp, Mus musculus
cggcccagcaggaccaaactcttac

SEQ ID NO: 260704 - DNA, 25 bp, Mus musculus
cggcccagcccggtcaagcaggtag

SEQ ID NO: 260705 - DNA, 25 bp, Mus musculus
cggcccagcctcaggtcacgcccgg

SEQ ID NO: 260706 - DNA, 25 bp, Mus musculus
cggcccaggcccaccctgcaactcc

SEQ ID NO: 260707 - DNA, 25 bp, Mus musculus
cggcccaggcccattattgtgatca

SEQ ID NO: 260708 - DNA, 25 bp, Mus musculus
cggcccaggccgcccaaacccaagc

SEQ ID NO: 260709 - DNA, 25 bp, Mus musculus
cggcccaggcctgcgggtggacaaa

SEQ ID NO: 260710 - DNA, 25 bp, Mus musculus
cggcccatcgggtgagcccggcaag

SEQ ID NO: 260711 - DNA, 25 bp, Mus musculus
cggcccatgtccatccctatcatcc

SEQ ID NO: 260712 - DNA, 25 bp, Mus musculus
cggccccagtggacctgctggtgaa

SEQ ID NO: 260713 - DNA, 25 bp, Mus musculus
cggccccatgggtcctccaggactc

SEQ ID NO: 260714 - DNA, 25 bp, Mus musculus
cggccccctagcctggtctgggacc

SEQ ID NO: 260715 - DNA, 25 bp, Mus musculus
cggccccctcacagctctcagggcc

SEQ ID NO: 260716 - DNA, 25 bp, Mus musculus
cggccccgaaacgccagcgatgggc

SEQ ID NO: 260717 - DNA, 25 bp, Mus musculus
cggccccgagcaggtttcaaatgat

SEQ ID NO: 260718 - DNA, 25 bp, Mus musculus
cggccccgaggagtcagcattggca

SEQ ID NO: 260719 - DNA, 25 bp, Mus musculus
cggccccgcggcacgagacaatgaa

SEQ ID NO: 260720 - DNA, 25 bp, Mus musculus
cggccccggaagcaggtgcggtgct

SEQ ID NO: 260721 - DNA, 25 bp, Mus musculus
cggcccctcccatggagggtgctcg

SEQ ID NO: 260722 - DNA, 25 bp, Mus musculus
cggcccctgcagaagactgctagct

SEQ ID NO: 260723 - DNA, 25 bp, Mus musculus
cggcccgaggacgtgccaagccgca

SEQ ID NO: 260724 - DNA, 25 bp, Mus musculus
cggcccgctcaccggctgtaaaaaa

SEQ ID NO: 260725 - DNA, 25 bp, Mus musculus
cggcccggagagagctctcagggcc

SEQ ID NO: 260726 - DNA, 25 bp, Mus musculus
cggcccgggacccagtgcaggtcct

SEQ ID NO: 260727 - DNA, 25 bp, Mus musculus
cggccctaagaagggttgtgagccc

SEQ ID NO: 260728 - DNA, 25 bp, Mus musculus
cggccctaagggtggaactactctg

SEQ ID NO: 260729 - DNA, 25 bp, Mus musculus
cggccctaaggtttgaggattgcgt

SEQ ID NO: 260730 - DNA, 25 bp, Mus musculus
cggccctaagtgggagccggtgaag

SEQ ID NO: 260731 - DNA, 25 bp, Mus musculus
cggccctacagtgcctgagcaatgt

SEQ ID NO: 260732 - DNA, 25 bp, Mus musculus
cggccctacctggactttgatcctc

SEQ ID NO: 260733 - DNA, 25 bp, Mus musculus
cggccctacgcagctcccacagata

SEQ ID NO: 260734 - DNA, 25 bp, Mus musculus
cggccctacgcaggtcctgtccaga

SEQ ID NO: 260735 - DNA, 25 bp, Mus musculus
cggccctcccagagccgtactggat

SEQ ID NO: 260736 - DNA, 25 bp, Mus musculus
cggccctcccagtgacgtactggat

SEQ ID NO: 260737 - DNA, 25 bp, Mus musculus
cggccctgcaacattggttctttgt

SEQ ID NO: 260738 - DNA, 25 bp, Mus musculus
cggccctgcagatcaccagcaaaag

SEQ ID NO: 260739 - DNA, 25 bp, Mus musculus
cggccctgcaggagtgactagcacg

SEQ ID NO: 260740 - DNA, 25 bp, Mus musculus
cggccctgcagtggaagacttcgtt

SEQ ID NO: 260741 - DNA, 25 bp, Mus musculus
cggcccttcccagggtctgaatttc

SEQ ID NO: 260742 - DNA, 25 bp, Mus musculus
cggcccttctggcgacccccaggat

SEQ ID NO: 260743 - DNA, 25 bp, Mus musculus
cggcccttggagcaggtcaaagctg

SEQ ID NO: 260744 - DNA, 25 bp, Mus musculus
cggccgaagctgagatactccatgt

SEQ ID NO: 260745 - DNA, 25 bp, Mus musculus
cggccgaccagatgtgaggtgagat

SEQ ID NO: 260746 - DNA, 25 bp, Mus musculus
cggccgagaagcggcgtagggccac

SEQ ID NO: 260747 - DNA, 25 bp, Mus musculus
cggccgagaagcggggcctacagcg

SEQ ID NO: 260748 - DNA, 25 bp, Mus musculus
cggccgagagtgactcatgaaatgg

SEQ ID NO: 260749 - DNA, 25 bp, Mus musculus
cggccgagcaccagagacagccatt

SEQ ID NO: 260750 - DNA, 25 bp, Mus musculus
cggccgaggcggcagtgagctccta

SEQ ID NO: 260751 - DNA, 25 bp, Mus musculus
cggccgaggcggcccagggccttgc

SEQ ID NO: 260752 - DNA, 25 bp, Mus musculus
cggccgagttcggactttctgcact

SEQ ID NO: 260753 - DNA, 25 bp, Mus musculus
cggccgcaggcagcaggtgcccggc

SEQ ID NO: 260754 - DNA, 25 bp, Mus musculus
cggccgcatgtttgtcattgccttt

SEQ ID NO: 260755 - DNA, 25 bp, Mus musculus
cggccgccaaggacagtcacgagga

SEQ ID NO: 260756 - DNA, 25 bp, Mus musculus
cggccgccaaggttcgcttatcttg

SEQ ID NO: 260757 - DNA, 25 bp, Mus musculus
cggccgccacgatgtgtgccgtgca

SEQ ID NO: 260758 - DNA, 25 bp, Mus musculus
cggccgccagtctccacagaggcgt

SEQ ID NO: 260759 - DNA, 25 bp, Mus musculus
cggccgcccaagagtcctttgctgt

SEQ ID NO: 260760 - DNA, 25 bp, Mus musculus
cggccgccgcagatataaagacttg

SEQ ID NO: 260761 - DNA, 25 bp, Mus musculus
cggccgccgcgcgcgttccagggct

SEQ ID NO: 260762 - DNA, 25 bp, Mus musculus
cggccgccgctgcagcatggtttat

SEQ ID NO: 260763 - DNA, 25 bp, Mus musculus
cggccgccggcggaggacccagccc

SEQ ID NO: 260764 - DNA, 25 bp, Mus musculus
cggccgcctccaggactgaccaagg

SEQ ID NO: 260765 - DNA, 25 bp, Mus musculus
cggccgcctgcagcagagatgctga

SEQ ID NO: 260766 - DNA, 25 bp, Mus musculus
cggccgcctgcagcatgtttgtaca

SEQ ID NO: 260767 - DNA, 25 bp, Mus musculus
cggccgcgaacaagaccccctctat

SEQ ID NO: 260768 - DNA, 25 bp, Mus musculus
cggccgcgcagaactgtcattattg

SEQ ID NO: 260769 - DNA, 25 bp, Mus musculus
cggccgcgccatcactcggaaccca

SEQ ID NO: 260770 - DNA, 25 bp, Mus musculus
cggccgcgcgcgcgttattggaaat

SEQ ID NO: 260771 - DNA, 25 bp, Mus musculus
cggccgcggacagagcagactgtat

SEQ ID NO: 260772 - DNA, 25 bp, Mus musculus
cggccgcggccgaacatgggtgcaa

SEQ ID NO: 260773 - DNA, 25 bp, Mus musculus
cggccgcggccgaacgacagagact

SEQ ID NO: 260774 - DNA, 25 bp, Mus musculus
cggccgcggcgcaaggaccggctcc

SEQ ID NO: 260775 - DNA, 25 bp, Mus musculus
cggccgcgtcatggccgtgcctgca

SEQ ID NO: 260776 - DNA, 25 bp, Mus musculus
cggccgctagcacaggcttctaaac

SEQ ID NO: 260777 - DNA, 25 bp, Mus musculus
cggccgctagcacaggggttgtgtg

SEQ ID NO: 260778 - DNA, 25 bp, Mus musculus
cggccgctatcagatccatttgggc

SEQ ID NO: 260779 - DNA, 25 bp, Mus musculus
cggccgctgtcaaaagtcttgcgct

SEQ ID NO: 260780 - DNA, 25 bp, Mus musculus
cggccggaagatggcagactttctg

SEQ ID NO: 260781 - DNA, 25 bp, Mus musculus
cggccggaaggagtggaatgtgacg

SEQ ID NO: 260782 - DNA, 25 bp, Mus musculus
cggccggaagtgttactgtgacaac

SEQ ID NO: 260783 - DNA, 25 bp, Mus musculus
cggccggaccacaggccacaaaaag

SEQ ID NO: 260784 - DNA, 25 bp, Mus musculus
cggccggacgcagatcgcccacgtc

SEQ ID NO: 260785 - DNA, 25 bp, Mus musculus
cggccggacgctagcagaatcttaa

SEQ ID NO: 260786 - DNA, 25 bp, Mus musculus
cggccggacgggaagcttagatatg

SEQ ID NO: 260787 - DNA, 25 bp, Mus musculus
cggccggactcagatttgataatgg

SEQ ID NO: 260788 - DNA, 25 bp, Mus musculus
cggccggagcggagcaatgcctaaa

SEQ ID NO: 260789 - DNA, 25 bp, Mus musculus
cggccggagggattcatcagtggga

SEQ ID NO: 260790 - DNA, 25 bp, Mus musculus
cggccggagggattcgaggacgcgt

SEQ ID NO: 260791 - DNA, 25 bp, Mus musculus
cggccggagtggcctctgcatccta

SEQ ID NO: 260792 - DNA, 25 bp, Mus musculus
cggccggagtgggctggtgttcccg

SEQ ID NO: 260793 - DNA, 25 bp, Mus musculus
cggccggcatccacggcggaacctt

SEQ ID NO: 260794 - DNA, 25 bp, Mus musculus
cggccggcatccacggggctccacc

SEQ ID NO: 260795 - DNA, 25 bp, Mus musculus
cggccggccgaaggatcatctgtcc

SEQ ID NO: 260796 - DNA, 25 bp, Mus musculus
cggccggccgaaggttcttgattgt

SEQ ID NO: 260797 - DNA, 25 bp, Mus musculus
cggccggccgtcgggactctaatga

SEQ ID NO: 260798 - DNA, 25 bp, Mus musculus
cggccggcgggtgcccagatcattg

SEQ ID NO: 260799 - DNA, 25 bp, Mus musculus
cggccggctccattcagaacaaccc

SEQ ID NO: 260800 - DNA, 25 bp, Mus musculus
cggccggctggcagccatggagaac

SEQ ID NO: 260801 - DNA, 25 bp, Mus musculus
cggccgggaagatgccagtgtacgg

SEQ ID NO: 260802 - DNA, 25 bp, Mus musculus
cggccgggagagaccctcaggactt

SEQ ID NO: 260803 - DNA, 25 bp, Mus musculus
cggccgggagagacgcagtgagaaa

SEQ ID NO: 260804 - DNA, 25 bp, Mus musculus
cggccggggagaggtgggaaaagct

SEQ ID NO: 260805 - DNA, 25 bp, Mus musculus
cggccgggggaacacacccgtgctc

SEQ ID NO: 260806 - DNA, 25 bp, Mus musculus
cggccgggtaggcggatctgggacg

SEQ ID NO: 260807 - DNA, 25 bp, Mus musculus
cggccgggttttcagatccttaagc

SEQ ID NO: 260808 - DNA, 25 bp, Mus musculus
cggccgggttttcagcacactgccc

SEQ ID NO: 260809 - DNA, 25 bp, Mus musculus
cggccgggttttcagcctgaatacc

SEQ ID NO: 260810 - DNA, 25 bp, Mus musculus
cggccggtcaagacagggtcttact

SEQ ID NO: 260811 - DNA, 25 bp, Mus musculus
cggccggtcaagagttataccctga

SEQ ID NO: 260812 - DNA, 25 bp, Mus musculus
cggccggtcaaggtgtaaactcttc

SEQ ID NO: 260813 - DNA, 25 bp, Mus musculus
cggccggtcaagtgcacaaccctgg

SEQ ID NO: 260814 - DNA, 25 bp, Mus musculus
cggccggttccgagggaggttcaga

SEQ ID NO: 260815 - DNA, 25 bp, Mus musculus
cggccggttccgaggtgtgtgagga

SEQ ID NO: 260816 - DNA, 25 bp, Mus musculus
cggccgtaaggattcacctgaggga

SEQ ID NO: 260817 - DNA, 25 bp, Mus musculus
cggccgtaagtttgctaactgtgga

SEQ ID NO: 260818 - DNA, 25 bp, Mus musculus
cggccgtaccaccggcatcgtgttg

SEQ ID NO: 260819 - DNA, 25 bp, Mus musculus
cggccgtcaggagcagccatgtctg

SEQ ID NO: 260820 - DNA, 25 bp, Mus musculus
cggccgtgcggccagtgtgtgtgta

SEQ ID NO: 260821 - DNA, 25 bp, Mus musculus
cggccgttgtgaacagaccctgctg

SEQ ID NO: 260822 - DNA, 25 bp, Mus musculus
cggccgttgtgctcccatgtgtgaa

SEQ ID NO: 260823 - DNA, 25 bp, Mus musculus
cggccgttgtgggcaataccctttc

SEQ ID NO: 260824 - DNA, 25 bp, Mus musculus
cggccgtttccacggaagatgctac

SEQ ID NO: 260825 - DNA, 25 bp, Mus musculus
cggcctaaaaggctgctctttggcg

SEQ ID NO: 260826 - DNA, 25 bp, Mus musculus
cggcctaaaagggctccttctccta

SEQ ID NO: 260827 - DNA, 25 bp, Mus musculus
cggcctaaacgccaggagcccttgc

SEQ ID NO: 260828 - DNA, 25 bp, Mus musculus
cggcctaaacgccagggaacctttg

SEQ ID NO: 260829 - DNA, 25 bp, Mus musculus
cggcctaagccacagtgacaacagc

SEQ ID NO: 260830 - DNA, 25 bp, Mus musculus
cggcctatggcggagtagtgtatca

SEQ ID NO: 260831 - DNA, 25 bp, Mus musculus
cggcctatggcggtgttgtttacca

SEQ ID NO: 260832 - DNA, 25 bp, Mus musculus
cggcctcaaggtctgaggcgtcaac

SEQ ID NO: 260833 - DNA, 25 bp, Mus musculus
cggcctcaaggttggagaccagatt

SEQ ID NO: 260834 - DNA, 25 bp, Mus musculus
cggcctcaagtgaccttgcaaggag

SEQ ID NO: 260835 - DNA, 25 bp, Mus musculus
cggcctcactagtgttcccaggagc

SEQ ID NO: 260836 - DNA, 25 bp, Mus musculus
cggcctcactatcagacatgcagcg

SEQ ID NO: 260837 - DNA, 25 bp, Mus musculus
cggcctcagggagagatgagcaata

SEQ ID NO: 260838 - DNA, 25 bp, Mus musculus
cggcctcatcctggtgacatctccc

SEQ ID NO: 260839 - DNA, 25 bp, Mus musculus
cggcctcatgaagacgtcttcatca

SEQ ID NO: 260840 - DNA, 25 bp, Mus musculus
cggcctcatgaaggttcctttggct

SEQ ID NO: 260841 - DNA, 25 bp, Mus musculus
cggcctccaacgtatcccaccaaat

SEQ ID NO: 260842 - DNA, 25 bp, Mus musculus
cggcctccaggtctgtgcacttgtt

SEQ ID NO: 260843 - DNA, 25 bp, Mus musculus
cggcctccagtgacctgacagtgaa

SEQ ID NO: 260844 - DNA, 25 bp, Mus musculus
cggcctccagtgactgccgggtaaa

SEQ ID NO: 260845 - DNA, 25 bp, Mus musculus
cggcctccctaccaggaggaagcag

SEQ ID NO: 260846 - DNA, 25 bp, Mus musculus
cggcctccgtcagctgcagccgact

SEQ ID NO: 260847 - DNA, 25 bp, Mus musculus
cggcctcgcaccggaagaaaagatg

SEQ ID NO: 260848 - DNA, 25 bp, Mus musculus
cggcctcgctggtggctggaggggt

SEQ ID NO: 260849 - DNA, 25 bp, Mus musculus
cggcctctaccggacacacctgctc

SEQ ID NO: 260850 - DNA, 25 bp, Mus musculus
cggcctctcagaagacaaaagagag

SEQ ID NO: 260851 - DNA, 25 bp, Mus musculus
cggcctctcagaagcatcactattt

SEQ ID NO: 260852 - DNA, 25 bp, Mus musculus
cggcctctgatgacccccggagcaa

SEQ ID NO: 260853 - DNA, 25 bp, Mus musculus
cggcctctgatgcttgattatacat

SEQ ID NO: 260854 - DNA, 25 bp, Mus musculus
cggcctctggactgccatcagtctg

SEQ ID NO: 260855 - DNA, 25 bp, Mus musculus
cggcctctggtgtttgcagagacat

SEQ ID NO: 260856 - DNA, 25 bp, Mus musculus
cggcctcttgcctgctagcagccac

SEQ ID NO: 260857 - DNA, 25 bp, Mus musculus
cggcctctttggaggctcatccaaa

SEQ ID NO: 260858 - DNA, 25 bp, Mus musculus
cggcctctttggctgctgggaacgc

SEQ ID NO: 260859 - DNA, 25 bp, Mus musculus
cggcctgacccggctccactctagc

SEQ ID NO: 260860 - DNA, 25 bp, Mus musculus
cggcctgaccttataaacttcagtg

SEQ ID NO: 260861 - DNA, 25 bp, Mus musculus
cggcctgacggaatgtatcctgtcg

SEQ ID NO: 260862 - DNA, 25 bp, Mus musculus
cggcctgacgttatacaaaaggttt

SEQ ID NO: 260863 - DNA, 25 bp, Mus musculus
cggcctgatctggaagtggctcagg

SEQ ID NO: 260864 - DNA, 25 bp, Mus musculus
cggcctgcagatcttgaaccagatg

SEQ ID NO: 260865 - DNA, 25 bp, Mus musculus
cggcctgcagcacatcttcattacc

SEQ ID NO: 260866 - DNA, 25 bp, Mus musculus
cggcctgcaggcctgtcgaggggca

SEQ ID NO: 260867 - DNA, 25 bp, Mus musculus
cggcctgcaggtgcggacctatggt

SEQ ID NO: 260868 - DNA, 25 bp, Mus musculus
cggcctgcagtttcaggcctgtcga

SEQ ID NO: 260869 - DNA, 25 bp, Mus musculus
cggcctgcgacggccagggtggaac

SEQ ID NO: 260870 - DNA, 25 bp, Mus musculus
cggcctgcgcaggaatcttgggaag

SEQ ID NO: 260871 - DNA, 25 bp, Mus musculus
cggcctgcggaggataagacctctg

SEQ ID NO: 260872 - DNA, 25 bp, Mus musculus
cggcctgctggctggcggggtgcca

SEQ ID NO: 260873 - DNA, 25 bp, Mus musculus
cggcctgctgggttcacggctcagc

SEQ ID NO: 260874 - DNA, 25 bp, Mus musculus
cggcctggaggaggacagtggtcac

SEQ ID NO: 260875 - DNA, 25 bp, Mus musculus
cggcctggaggttgcagaggacagt

SEQ ID NO: 260876 - DNA, 25 bp, Mus musculus
cggcctggcacatgccctggtggaa

SEQ ID NO: 260877 - DNA, 25 bp, Mus musculus
cggcctggcaggtagcagaggcagc

SEQ ID NO: 260878 - DNA, 25 bp, Mus musculus
cggcctggcaggtttaagtttctag

SEQ ID NO: 260879 - DNA, 25 bp, Mus musculus
cggcctggcagtttctagtcctggc

SEQ ID NO: 260880 - DNA, 25 bp, Mus musculus
cggcctggcccggacttagcattca

SEQ ID NO: 260881 - DNA, 25 bp, Mus musculus
cggcctggtgacaagggagaccagg

SEQ ID NO: 260882 - DNA, 25 bp, Mus musculus
cggcctggtggtgcacaatcctgga

SEQ ID NO: 260883 - DNA, 25 bp, Mus musculus
cggcctgtgagctggatctcatgga

SEQ ID NO: 260884 - DNA, 25 bp, Mus musculus
cggcctgtgccaaggtcgagtatgc

SEQ ID NO: 260885 - DNA, 25 bp, Mus musculus
cggccttaatgggcaacgtggttct

SEQ ID NO: 260886 - DNA, 25 bp, Mus musculus
cggccttcagcacacagcacacctg

SEQ ID NO: 260887 - DNA, 25 bp, Mus musculus
cggccttccagttttacctgctgcc

SEQ ID NO: 260888 - DNA, 25 bp, Mus musculus
cggccttcgggctaacaggcagtga

SEQ ID NO: 260889 - DNA, 25 bp, Mus musculus
cggccttgacgagatgctgttggct

SEQ ID NO: 260890 - DNA, 25 bp, Mus musculus
cggccttgacgaggggatgagagag

SEQ ID NO: 260891 - DNA, 25 bp, Mus musculus
cggccttgccaggaaaatactaaag

SEQ ID NO: 260892 - DNA, 25 bp, Mus musculus
cggccttgggaagatgctgctcttt

SEQ ID NO: 260893 - DNA, 25 bp, Mus musculus
cggccttgggaagatgctggagacc

SEQ ID NO: 260894 - DNA, 25 bp, Mus musculus
cggccttgggaagatggctccttct

SEQ ID NO: 260895 - DNA, 25 bp, Mus musculus
cggccttgtggtaccaatggggatc

SEQ ID NO: 260896 - DNA, 25 bp, Mus musculus
cggcctttagccccagtggatctaa

SEQ ID NO: 260897 - DNA, 25 bp, Mus musculus
cggcctttaggatgggaaagttgac

SEQ ID NO: 260898 - DNA, 25 bp, Mus musculus
cggcctttaggctccccatatatac

SEQ ID NO: 260899 - DNA, 25 bp, Mus musculus
cggcctttatcggatccggaagggg

SEQ ID NO: 260900 - DNA, 25 bp, Mus musculus
cggcctttattaagtacagtccacc

SEQ ID NO: 260901 - DNA, 25 bp, Mus musculus
cggcgaaatgtagctttggcaccga

SEQ ID NO: 260902 - DNA, 25 bp, Mus musculus
cggcgaacgagagagctgttctcta

SEQ ID NO: 260903 - DNA, 25 bp, Mus musculus
cggcgaacgagagatgctcccttcg

SEQ ID NO: 260904 - DNA, 25 bp, Mus musculus
cggcgacatggaagcaagtgtggag

SEQ ID NO: 260905 - DNA, 25 bp, Mus musculus
cggcgaccgcccgaaacaagaagca

SEQ ID NO: 260906 - DNA, 25 bp, Mus musculus
cggcgaccgcccggtagtgtctcta

SEQ ID NO: 260907 - DNA, 25 bp, Mus musculus
cggcgaccgcccggtgttgcttctg

SEQ ID NO: 260908 - DNA, 25 bp, Mus musculus
cggcgacgcaggttgatatcaaaat

SEQ ID NO: 260909 - DNA, 25 bp, Mus musculus
cggcgacgcgggaagaagtcccaga

SEQ ID NO: 260910 - DNA, 25 bp, Mus musculus
cggcgacggaggcagcatctgcatc

SEQ ID NO: 260911 - DNA, 25 bp, Mus musculus
cggcgactctaggttgcagtgtgtg

SEQ ID NO: 260912 - DNA, 25 bp, Mus musculus
cggcgactgagcacacctgaggaga

SEQ ID NO: 260913 - DNA, 25 bp, Mus musculus
cggcgagaaacagcaacattacttc

SEQ ID NO: 260914 - DNA, 25 bp, Mus musculus
cggcgagaaacagcgtcatagcagg

SEQ ID NO: 260915 - DNA, 25 bp, Mus musculus
cggcgagaaggacccggctcgcgct

SEQ ID NO: 260916 - DNA, 25 bp, Mus musculus
cggcgagaagggagaagtcggacct

SEQ ID NO: 260917 - DNA, 25 bp, Mus musculus
cggcgagacccaaatcttggtgggc

SEQ ID NO: 260918 - DNA, 25 bp, Mus musculus
cggcgagcaaggtctgctgaagaca

SEQ ID NO: 260919 - DNA, 25 bp, Mus musculus
cggcgagccaggatgtccacctcgt

SEQ ID NO: 260920 - DNA, 25 bp, Mus musculus
cggcgagccagggcaaaggagcatt

SEQ ID NO: 260921 - DNA, 25 bp, Mus musculus
cggcgagcccagggaatatttttag

SEQ ID NO: 260922 - DNA, 25 bp, Mus musculus
cggcgagcccagtacgctccagaag

SEQ ID NO: 260923 - DNA, 25 bp, Mus musculus
cggcgagccccaaatgaaaacgggc

SEQ ID NO: 260924 - DNA, 25 bp, Mus musculus
cggcgagccccaacggcagccacaa

SEQ ID NO: 260925 - DNA, 25 bp, Mus musculus
cggcgagcccgcgaggtcactatcg

SEQ ID NO: 260926 - DNA, 25 bp, Mus musculus
cggcgagcccgtggttgtgccccct

SEQ ID NO: 260927 - DNA, 25 bp, Mus musculus
cggcgaggacagcgactttgaagat

SEQ ID NO: 260928 - DNA, 25 bp, Mus musculus
cggcgaggacagcggctggaatggt

SEQ ID NO: 260929 - DNA, 25 bp, Mus musculus
cggcgaggacttcaggtggaccagc

SEQ ID NO: 260930 - DNA, 25 bp, Mus musculus
cggcgaggccccactcctgaaagga

SEQ ID NO: 260931 - DNA, 25 bp, Mus musculus
cggcgagtgggaaagacaagaaaat

SEQ ID NO: 260932 - DNA, 25 bp, Mus musculus
cggcgatctccgagaaaattttgcc

SEQ ID NO: 260933 - DNA, 25 bp, Mus musculus
cggcgcaataacgttacaaattata

SEQ ID NO: 260934 - DNA, 25 bp, Mus musculus
cggcgcagaccaggatggctgccca

SEQ ID NO: 260935 - DNA, 25 bp, Mus musculus
cggcgcagcccgcgggggagccgcc

SEQ ID NO: 260936 - DNA, 25 bp, Mus musculus
cggcgcattcgcaaaggaacgggag

SEQ ID NO: 260937 - DNA, 25 bp, Mus musculus
cggcgcattcgcaaaggacgcatgg

SEQ ID NO: 260938 - DNA, 25 bp, Mus musculus
cggcgccaaagctgatggtgaggcc

SEQ ID NO: 260939 - DNA, 25 bp, Mus musculus
cggcgccaagatccccagctcaagg

SEQ ID NO: 260940 - DNA, 25 bp, Mus musculus
cggcgccaatgagaaagataagggc

SEQ ID NO: 260941 - DNA, 25 bp, Mus musculus
cggcgccagcacatctgcagagaaa

SEQ ID NO: 260942 - DNA, 25 bp, Mus musculus
cggcgccagccaggagcatagaaga

SEQ ID NO: 260943 - DNA, 25 bp, Mus musculus
cggcgccagggagtccttgccatct

SEQ ID NO: 260944 - DNA, 25 bp, Mus musculus
cggcgccaggggcagcttgactcga

SEQ ID NO: 260945 - DNA, 25 bp, Mus musculus
cggcgccccaacagattccacgagg

SEQ ID NO: 260946 - DNA, 25 bp, Mus musculus
cggcgccccgcaccgatgatattat

SEQ ID NO: 260947 - DNA, 25 bp, Mus musculus
cggcgcccctccttcctgagcatga

SEQ ID NO: 260948 - DNA, 25 bp, Mus musculus
cggcgccctggaagaccagagccct

SEQ ID NO: 260949 - DNA, 25 bp, Mus musculus
cggcgccgatcaggttaaagatcga

SEQ ID NO: 260950 - DNA, 25 bp, Mus musculus
cggcgccgcaggacggtgactgtcc

SEQ ID NO: 260951 - DNA, 25 bp, Mus musculus
cggcgccggacgaccgaagccagga

SEQ ID NO: 260952 - DNA, 25 bp, Mus musculus
cggcgccgggagtcctgttgaagag

SEQ ID NO: 260953 - DNA, 25 bp, Mus musculus
cggcgcctactctatcgctgcaggt

SEQ ID NO: 260954 - DNA, 25 bp, Mus musculus
cggcgcctactctatgtgtgctcat

SEQ ID NO: 260955 - DNA, 25 bp, Mus musculus
cggcgcctcggctggacattgtgca

SEQ ID NO: 260956 - DNA, 25 bp, Mus musculus
cggcgcctcggtggagtcttaccat

SEQ ID NO: 260957 - DNA, 25 bp, Mus musculus
cggcgcctgagctaggattggtagc

SEQ ID NO: 260958 - DNA, 25 bp, Mus musculus
cggcgcctgcagcaggaattgggga

SEQ ID NO: 260959 - DNA, 25 bp, Mus musculus
cggcgcctgccccgaaatcacactg

SEQ ID NO: 260960 - DNA, 25 bp, Mus musculus
cggcgcctgccccgccaaatgcaga

SEQ ID NO: 260961 - DNA, 25 bp, Mus musculus
cggcgcgactggaggataccagttc

SEQ ID NO: 260962 - DNA, 25 bp, Mus musculus
cggcgcgactgggtggggctgcttc

SEQ ID NO: 260963 - DNA, 25 bp, Mus musculus
cggcgcgaggcagcatggtctgaga

SEQ ID NO: 260964 - DNA, 25 bp, Mus musculus
cggcgcgcacagagctgaagcgctg

SEQ ID NO: 260965 - DNA, 25 bp, Mus musculus
cggcgcgcacagccgttgactactt

SEQ ID NO: 260966 - DNA, 25 bp, Mus musculus
cggcgcgcacagctgggtggctgtg

SEQ ID NO: 260967 - DNA, 25 bp, Mus musculus
cggcgcgccgagggtgtgtgggatg

SEQ ID NO: 260968 - DNA, 25 bp, Mus musculus
cggcgcgccgagttgaactttctag

SEQ ID NO: 260969 - DNA, 25 bp, Mus musculus
cggcgcgcgcagaggtttcatagtc

SEQ ID NO: 260970 - DNA, 25 bp, Mus musculus
cggcgcgcggagcagactgtcgcta

SEQ ID NO: 260971 - DNA, 25 bp, Mus musculus
cggcgcgcggagcagccctctctat

SEQ ID NO: 260972 - DNA, 25 bp, Mus musculus
cggcgcggacacagcatgcccattt

SEQ ID NO: 260973 - DNA, 25 bp, Mus musculus
cggcgcggagagagaactgctctga

SEQ ID NO: 260974 - DNA, 25 bp, Mus musculus
cggcgcggagagaggcctgctgaaa

SEQ ID NO: 260975 - DNA, 25 bp, Mus musculus
cggcgcggagcttagcagatcatac

SEQ ID NO: 260976 - DNA, 25 bp, Mus musculus
cggcgcggagtcacattagcttttt

SEQ ID NO: 260977 - DNA, 25 bp, Mus musculus
cggcgcggcaggtaccagctggagg

SEQ ID NO: 260978 - DNA, 25 bp, Mus musculus
cggcgcggcagtctgcgagtaaact

SEQ ID NO: 260979 - DNA, 25 bp, Mus musculus
cggcgcggccaaaaggcggacgccg

SEQ ID NO: 260980 - DNA, 25 bp, Mus musculus
cggcgcggcgggagccgctcccgtt

SEQ ID NO: 260981 - DNA, 25 bp, Mus musculus
cggcgcgggaggtgctggagagtca

SEQ ID NO: 260982 - DNA, 25 bp, Mus musculus
cggcgcgggcagcggtaaaatgtcg

SEQ ID NO: 260983 - DNA, 25 bp, Mus musculus
cggcgcgggctccagaggcgtccgg

SEQ ID NO: 260984 - DNA, 25 bp, Mus musculus
cggcgcggggagagttaagaatcat

SEQ ID NO: 260985 - DNA, 25 bp, Mus musculus
cggcgctcagagatggagagagaac

SEQ ID NO: 260986 - DNA, 25 bp, Mus musculus
cggcgctcatcatgctccgtcggga

SEQ ID NO: 260987 - DNA, 25 bp, Mus musculus
cggcgctcatcatggctcgcctgcg

SEQ ID NO: 260988 - DNA, 25 bp, Mus musculus
cggcgctccagcagattgctttatt

SEQ ID NO: 260989 - DNA, 25 bp, Mus musculus
cggcgctccagcagcactctgtttt

SEQ ID NO: 260990 - DNA, 25 bp, Mus musculus
cggcgctccgccgattcctttgtga

SEQ ID NO: 260991 - DNA, 25 bp, Mus musculus
cggcgctccgccggtgagcacgagc

SEQ ID NO: 260992 - DNA, 25 bp, Mus musculus
cggcgctgagcctcaaaatgcagcc

SEQ ID NO: 260993 - DNA, 25 bp, Mus musculus
cggcgctgcggagagctcagagcta

SEQ ID NO: 260994 - DNA, 25 bp, Mus musculus
cggcgctgcggcaatgccaagtgag

SEQ ID NO: 260995 - DNA, 25 bp, Mus musculus
cggcgctgctcggagcctggtggag

SEQ ID NO: 260996 - DNA, 25 bp, Mus musculus
cggcgctggagcctggaatgcttcc

SEQ ID NO: 260997 - DNA, 25 bp, Mus musculus
cggcgctggcgggtgatgaagcctg

SEQ ID NO: 260998 - DNA, 25 bp, Mus musculus
cggcgctggcgggtgttccgaatgc

SEQ ID NO: 260999 - DNA, 25 bp, Mus musculus
cggcgctggctgtggatctcaggtg

SEQ ID NO: 261000 - DNA, 25 bp, Mus musculus
cggcgctgtcagatcaagatccact

SEQ ID NO: 261001 - DNA, 25 bp, Mus musculus
cggcgctttcccgagacttcccaag

SEQ ID NO: 261002 - DNA, 25 bp, Mus musculus
cggcggaacaggtaattgctggctt

SEQ ID NO: 261003 - DNA, 25 bp, Mus musculus
cggcggacagagttgatggtgtcaa

SEQ ID NO: 261004 - DNA, 25 bp, Mus musculus
cggcggacagggagaatcccgtatc

SEQ ID NO: 261005 - DNA, 25 bp, Mus musculus
cggcggacgcggaagatctcagcgg

SEQ ID NO: 261006 - DNA, 25 bp, Mus musculus
cggcggacgcggaagggaccagatt

SEQ ID NO: 261007 - DNA, 25 bp, Mus musculus
cggcggagagcatggatacgtatta

SEQ ID NO: 261008 - DNA, 25 bp, Mus musculus
cggcggagcagaaatagatgaagac

SEQ ID NO: 261009 - DNA, 25 bp, Mus musculus
cggcggagcagaccatgctcgcatt

SEQ ID NO: 261010 - DNA, 25 bp, Mus musculus
cggcggagcagattcggaggcgccg

SEQ ID NO: 261011 - DNA, 25 bp, Mus musculus
cggcggagctgggaggcccagccag

SEQ ID NO: 261012 - DNA, 25 bp, Mus musculus
cggcggaggagggggaggccgctca

SEQ ID NO: 261013 - DNA, 25 bp, Mus musculus
cggcggaggccgcaggttggtgttc

SEQ ID NO: 261014 - DNA, 25 bp, Mus musculus
cggcggagggaagtgttgacgctgc

SEQ ID NO: 261015 - DNA, 25 bp, Mus musculus
cggcggagtctggagccgccatgga

SEQ ID NO: 261016 - DNA, 25 bp, Mus musculus
cggcggatccggcagcttaggttgt

SEQ ID NO: 261017 - DNA, 25 bp, Mus musculus
cggcggatccggcaggaattgaagt

SEQ ID NO: 261018 - DNA, 25 bp, Mus musculus
cggcggcaagagcaaccttcaaaca

SEQ ID NO: 261019 - DNA, 25 bp, Mus musculus
cggcggcacgatgccggtgcagctg

SEQ ID NO: 261020 - DNA, 25 bp, Mus musculus
cggcggcagcaggcaaggagatgag

SEQ ID NO: 261021 - DNA, 25 bp, Mus musculus
cggcggcagcaggcattaaaaaaat

SEQ ID NO: 261022 - DNA, 25 bp, Mus musculus
cggcggcagccggtcactatcgtct

SEQ ID NO: 261023 - DNA, 25 bp, Mus musculus
cggcggcagcggggcctgcggctcg

SEQ ID NO: 261024 - DNA, 25 bp, Mus musculus
cggcggcaggcactggtgtaatgga

SEQ ID NO: 261025 - DNA, 25 bp, Mus musculus
cggcggcaggcgggtacaaaaatat

SEQ ID NO: 261026 - DNA, 25 bp, Mus musculus
cggcggcagtgattcatcagaaaag

SEQ ID NO: 261027 - DNA, 25 bp, Mus musculus
cggcggccacctaggcctgcagctg

SEQ ID NO: 261028 - DNA, 25 bp, Mus musculus
cggcggccacctaggcttcagtggg

SEQ ID NO: 261029 - DNA, 25 bp, Mus musculus
cggcggccagcagatcgtgtccagc

SEQ ID NO: 261030 - DNA, 25 bp, Mus musculus
cggcggccagcaggtactcctgagc

SEQ ID NO: 261031 - DNA, 25 bp, Mus musculus
cggcggccagcatcaggaagatgat

SEQ ID NO: 261032 - DNA, 25 bp, Mus musculus
cggcggcccagacaggtgatttggc

SEQ ID NO: 261033 - DNA, 25 bp, Mus musculus
cggcggccccggagaagatggaggg

SEQ ID NO: 261034 - DNA, 25 bp, Mus musculus
cggcggcccgacgctgcggccaggc

SEQ ID NO: 261035 - DNA, 25 bp, Mus musculus
cggcggccgaggcggcagtgagctc

SEQ ID NO: 261036 - DNA, 25 bp, Mus musculus
cggcggccgaggtctgtctgcaggt

SEQ ID NO: 261037 - DNA, 25 bp, Mus musculus
cggcggccggagtggcctctgcatc

SEQ ID NO: 261038 - DNA, 25 bp, Mus musculus
cggcggccggagtgggctggtgttc

SEQ ID NO: 261039 - DNA, 25 bp, Mus musculus
cggcggcgaaatgtagctttggcac

SEQ ID NO: 261040 - DNA, 25 bp, Mus musculus
cggcggcgacgcgggaagaagtccc

SEQ ID NO: 261041 - DNA, 25 bp, Mus musculus
cggcggcgccggtgccaagtgctgg

SEQ ID NO: 261042 - DNA, 25 bp, Mus musculus
cggcggcgcgcacagagctgaagcg

SEQ ID NO: 261043 - DNA, 25 bp, Mus musculus
cggcggcgcgcacagctgggtggct

SEQ ID NO: 261044 - DNA, 25 bp, Mus musculus
cggcggcggaccggcggcggcggca

SEQ ID NO: 261045 - DNA, 25 bp, Mus musculus
cggcggcggagatcctgagggaaga

SEQ ID NO: 261046 - DNA, 25 bp, Mus musculus
cggcggcggcagaacccagcagtga

SEQ ID NO: 261047 - DNA, 25 bp, Mus musculus
cggcggcggcagccggtcactatcg

SEQ ID NO: 261048 - DNA, 25 bp, Mus musculus
cggcggcggcccagacaggtgattt

SEQ ID NO: 261049 - DNA, 25 bp, Mus musculus
cggcggcggcggcagaacccagcag

SEQ ID NO: 261050 - DNA, 25 bp, Mus musculus
cggcggcggcggggagaactacgat

SEQ ID NO: 261051 - DNA, 25 bp, Mus musculus
cggcggcggctcgcgacctcaatgt

SEQ ID NO: 261052 - DNA, 25 bp, Mus musculus
cggcggcgggacaagctggggtctc

SEQ ID NO: 261053 - DNA, 25 bp, Mus musculus
cggcggcgggacaaggagcagggca

SEQ ID NO: 261054 - DNA, 25 bp, Mus musculus
cggcggcgggacaaggaggtctgaa

SEQ ID NO: 261055 - DNA, 25 bp, Mus musculus
cggcggcggggagaactacgatgac

SEQ ID NO: 261056 - DNA, 25 bp, Mus musculus
cggcggcgtccgcgcgccgctgtgc

SEQ ID NO: 261057 - DNA, 25 bp, Mus musculus
cggcggctaccggggcggtgatact

SEQ ID NO: 261058 - DNA, 25 bp, Mus musculus
cggcggctcacaaagaacaagggag

SEQ ID NO: 261059 - DNA, 25 bp, Mus musculus
cggcggctcgcgacctcaatgtacc

SEQ ID NO: 261060 - DNA, 25 bp, Mus musculus
cggcggctgatagcgatcattgctg

SEQ ID NO: 261061 - DNA, 25 bp, Mus musculus
cggcggctgatagcggggatcccag

SEQ ID NO: 261062 - DNA, 25 bp, Mus musculus
cggcggctgcagcaggccaccatgg

SEQ ID NO: 261063 - DNA, 25 bp, Mus musculus
cggcggctggagtcgaatttggaaa

SEQ ID NO: 261064 - DNA, 25 bp, Mus musculus
cggcggctggtcacctttgtatgca

SEQ ID NO: 261065 - DNA, 25 bp, Mus musculus
cggcgggacaagctggggtctcaga

SEQ ID NO: 261066 - DNA, 25 bp, Mus musculus
cggcgggacaaggagcagggcagga

SEQ ID NO: 261067 - DNA, 25 bp, Mus musculus
cggcgggacaaggaggtctgaagaa

SEQ ID NO: 261068 - DNA, 25 bp, Mus musculus
cggcgggacagttgggcaaggcggg

SEQ ID NO: 261069 - DNA, 25 bp, Mus musculus
cggcgggacccgggtcctgataagc

SEQ ID NO: 261070 - DNA, 25 bp, Mus musculus
cggcgggagcgagggagcggacatg

SEQ ID NO: 261071 - DNA, 25 bp, Mus musculus
cggcgggaggctgacaatttccggc

SEQ ID NO: 261072 - DNA, 25 bp, Mus musculus
cggcgggatcctataagttgcaagg

SEQ ID NO: 261073 - DNA, 25 bp, Mus musculus
cggcgggatcctatgcatatttttc

SEQ ID NO: 261074 - DNA, 25 bp, Mus musculus
cggcgggcgagcagagcagacccag

SEQ ID NO: 261075 - DNA, 25 bp, Mus musculus
cggcgggcgagcaggtggaagggac

SEQ ID NO: 261076 - DNA, 25 bp, Mus musculus
cggcgggcgggtaaataacagatgc

SEQ ID NO: 261077 - DNA, 25 bp, Mus musculus
cggcggggacagatctcaagaccag

SEQ ID NO: 261078 - DNA, 25 bp, Mus musculus
cggcggggaggacttgcactaagaa

SEQ ID NO: 261079 - DNA, 25 bp, Mus musculus
cggcggggcagactgaagtgttgga

SEQ ID NO: 261080 - DNA, 25 bp, Mus musculus
cggcggggcaggagcaaaacaattg

SEQ ID NO: 261081 - DNA, 25 bp, Mus musculus
cggcggggcaggtgtagtaacatgc

SEQ ID NO: 261082 - DNA, 25 bp, Mus musculus
cggcgggggcggcagttctggcagg

SEQ ID NO: 261083 - DNA, 25 bp, Mus musculus
cggcgggtcgcgaggtgcagacatg

SEQ ID NO: 261084 - DNA, 25 bp, Mus musculus
cggcgggtctcagaaagaagaaaca

SEQ ID NO: 261085 - DNA, 25 bp, Mus musculus
cggcgggtctcaggacaagccaatg

SEQ ID NO: 261086 - DNA, 25 bp, Mus musculus
cggcggtcaaggccctcagcctccc

SEQ ID NO: 261087 - DNA, 25 bp, Mus musculus
cggcggtcaaggtcacggtctcggt

SEQ ID NO: 261088 - DNA, 25 bp, Mus musculus
cggcggtcgcgcggaccatcggggc

SEQ ID NO: 261089 - DNA, 25 bp, Mus musculus
cggcggtgacaatgagttttcttgg

SEQ ID NO: 261090 - DNA, 25 bp, Mus musculus
cggcggtgacaatggtaaacctagc

SEQ ID NO: 261091 - DNA, 25 bp, Mus musculus
cggcggtgcagatttcttgacctac

SEQ ID NO: 261092 - DNA, 25 bp, Mus musculus
cggcggttcaggaattacacagtcg

SEQ ID NO: 261093 - DNA, 25 bp, Mus musculus
cggcggttcaggggtatggaaactg

SEQ ID NO: 261094 - DNA, 25 bp, Mus musculus
cggcggttgagacttctccattccc

SEQ ID NO: 261095 - DNA, 25 bp, Mus musculus
cggcgtacaggagaatgactcagga

SEQ ID NO: 261096 - DNA, 25 bp, Mus musculus
cggcgtacgctggcccttctgtatt

SEQ ID NO: 261097 - DNA, 25 bp, Mus musculus
cggcgtacgctggttatttgctggc

SEQ ID NO: 261098 - DNA, 25 bp, Mus musculus
cggcgtcaggagcctgatgggaagg

SEQ ID NO: 261099 - DNA, 25 bp, Mus musculus
cggcgtcatcaaccctggagaatgc

SEQ ID NO: 261100 - DNA, 25 bp, Mus musculus
cggcgtcatggggtgtgtgagtgtt

SEQ ID NO: 261101 - DNA, 25 bp, Mus musculus
cggcgtccaagagtaagctaaaaaa

SEQ ID NO: 261102 - DNA, 25 bp, Mus musculus
cggcgtccaagagtccatatgttgt

SEQ ID NO: 261103 - DNA, 25 bp, Mus musculus
cggcgtccgcgccaggttcatcatt

SEQ ID NO: 261104 - DNA, 25 bp, Mus musculus
cggcgtccgcgcgccgctgtgcccc

SEQ ID NO: 261105 - DNA, 25 bp, Mus musculus
cggcgtccgctcagaccagcagtgc

SEQ ID NO: 261106 - DNA, 25 bp, Mus musculus
cggcgtccggacactgcagaaggaa

SEQ ID NO: 261107 - DNA, 25 bp, Mus musculus
cggcgtcctcagatatagccatatt

SEQ ID NO: 261108 - DNA, 25 bp, Mus musculus
cggcgtctcagctccgcgtgagtcg

SEQ ID NO: 261109 - DNA, 25 bp, Mus musculus
cggcgtctggcacagctgctgaacc

SEQ ID NO: 261110 - DNA, 25 bp, Mus musculus
cggcgtctggcacaggcttctgccc

SEQ ID NO: 261111 - DNA, 25 bp, Mus musculus
cggcgtgacagcatttgacattgtg

SEQ ID NO: 261112 - DNA, 25 bp, Mus musculus
cggcgtgacctccaactacattgac

SEQ ID NO: 261113 - DNA, 25 bp, Mus musculus
cggcgtgcagtggagctccgcgtga

SEQ ID NO: 261114 - DNA, 25 bp, Mus musculus
cggcgtgctccgagggaagctctac

SEQ ID NO: 261115 - DNA, 25 bp, Mus musculus
cggcgtggaggtggggtgctgtgag

SEQ ID NO: 261116 - DNA, 25 bp, Mus musculus
cggcgtggctggtcgggatggtggc

SEQ ID NO: 261117 - DNA, 25 bp, Mus musculus
cggcgtgtgatggggccaaactgag

SEQ ID NO: 261118 - DNA, 25 bp, Mus musculus
cggcgttctgatgagtgacccacag

SEQ ID NO: 261119 - DNA, 25 bp, Mus musculus
cggcgttctggttttttgcattgac

SEQ ID NO: 261120 - DNA, 25 bp, Mus musculus
cggcgttgttaggaagatgatccat

SEQ ID NO: 261121 - DNA, 25 bp, Mus musculus
cggcgttgttaggattatgtactga

SEQ ID NO: 261122 - DNA, 25 bp, Mus musculus
cggctaaagcagaggtgcagtgagc

SEQ ID NO: 261123 - DNA, 25 bp, Mus musculus
cggctaagcaggtgaagtccacggg

SEQ ID NO: 261124 - DNA, 25 bp, Mus musculus
cggctaaggcgagggattttaggtg

SEQ ID NO: 261125 - DNA, 25 bp, Mus musculus
cggctaatgccttgctgtgcttcta

SEQ ID NO: 261126 - DNA, 25 bp, Mus musculus
cggctaatgccttgggcgctgggct

SEQ ID NO: 261127 - DNA, 25 bp, Mus musculus
cggctacacagaagttcagttccgg

SEQ ID NO: 261128 - DNA, 25 bp, Mus musculus
cggctacacagatgttcactgaagg

SEQ ID NO: 261129 - DNA, 25 bp, Mus musculus
cggctacacagatttgacataattg

SEQ ID NO: 261130 - DNA, 25 bp, Mus musculus
cggctacacagtctgggtgtttggg

SEQ ID NO: 261131 - DNA, 25 bp, Mus musculus
cggctacagaactttgtacctattg

SEQ ID NO: 261132 - DNA, 25 bp, Mus musculus
cggctacatggcatcagtggatggt

SEQ ID NO: 261133 - DNA, 25 bp, Mus musculus
cggctacatggtcctctctctggct

SEQ ID NO: 261134 - DNA, 25 bp, Mus musculus
cggctacattgagagtcaggtacag

SEQ ID NO: 261135 - DNA, 25 bp, Mus musculus
cggctacattgagagtcatcctttt

SEQ ID NO: 261136 - DNA, 25 bp, Mus musculus
cggctaccacagaagctgaaccgga

SEQ ID NO: 261137 - DNA, 25 bp, Mus musculus
cggctaccacagaggccttgcccct

SEQ ID NO: 261138 - DNA, 25 bp, Mus musculus
cggctacccagctcgatcgagagct

SEQ ID NO: 261139 - DNA, 25 bp, Mus musculus
cggctaccggggcggtgatacttct

SEQ ID NO: 261140 - DNA, 25 bp, Mus musculus
cggctacgactacagtcagggtagt

SEQ ID NO: 261141 - DNA, 25 bp, Mus musculus
cggctactacacgtgggctgtcttc

SEQ ID NO: 261142 - DNA, 25 bp, Mus musculus
cggctacttctgggaacatcatgac

SEQ ID NO: 261143 - DNA, 25 bp, Mus musculus
cggctagaaaggaagatcctggccc

SEQ ID NO: 261144 - DNA, 25 bp, Mus musculus
cggctagatcacagtcaagcaggta

SEQ ID NO: 261145 - DNA, 25 bp, Mus musculus
cggctagtaagcagtctgcaaacag

SEQ ID NO: 261146 - DNA, 25 bp, Mus musculus
cggctattctaggaaggctgccttg

SEQ ID NO: 261147 - DNA, 25 bp, Mus musculus
cggctattctagtgacgccaagaga

SEQ ID NO: 261148 - DNA, 25 bp, Mus musculus
cggctatttaccagaccaagaaggt

SEQ ID NO: 261149 - DNA, 25 bp, Mus musculus
cggctatttaccaggacattcgaca

SEQ ID NO: 261150 - DNA, 25 bp, Mus musculus
cggctatttaccaggtgaggacact

SEQ ID NO: 261151 - DNA, 25 bp, Mus musculus
cggctcacaaaaaacttcatcaaag

SEQ ID NO: 261152 - DNA, 25 bp, Mus musculus
cggctcacaaagaacaagggagaag

SEQ ID NO: 261153 - DNA, 25 bp, Mus musculus
cggctcacagatggctgccagcaac

SEQ ID NO: 261154 - DNA, 25 bp, Mus musculus
cggctcacaggcagaagactttaac

SEQ ID NO: 261155 - DNA, 25 bp, Mus musculus
cggctcacctggttccggaagcaga

SEQ ID NO: 261156 - DNA, 25 bp, Mus musculus
cggctcactgaggctggaccacgtt

SEQ ID NO: 261157 - DNA, 25 bp, Mus musculus
cggctcagagcaatcaggaccgaaa

SEQ ID NO: 261158 - DNA, 25 bp, Mus musculus
cggctcagagctaccaggagcccgc

SEQ ID NO: 261159 - DNA, 25 bp, Mus musculus
cggctcagaggaaagaatacccacc

SEQ ID NO: 261160 - DNA, 25 bp, Mus musculus
cggctcagagggaggaggacagcct

SEQ ID NO: 261161 - DNA, 25 bp, Mus musculus
cggctcagggtcttggaggaggaac

SEQ ID NO: 261162 - DNA, 25 bp, Mus musculus
cggctcattgaggtgaatgggcaga

SEQ ID NO: 261163 - DNA, 25 bp, Mus musculus
cggctccaaagagggctatgtgctc

SEQ ID NO: 261164 - DNA, 25 bp, Mus musculus
cggctccaaagtcggtttctgtatg

SEQ ID NO: 261165 - DNA, 25 bp, Mus musculus
cggctccaaggatgccaacaaggag

SEQ ID NO: 261166 - DNA, 25 bp, Mus musculus
cggctccacacgggacaagctctga

SEQ ID NO: 261167 - DNA, 25 bp, Mus musculus
cggctccacacggttacaggcccaa

SEQ ID NO: 261168 - DNA, 25 bp, Mus musculus
cggctccaggagagggaaaagatgc

SEQ ID NO: 261169 - DNA, 25 bp, Mus musculus
cggctcccacagagctgatttatcc

SEQ ID NO: 261170 - DNA, 25 bp, Mus musculus
cggctccccaacagggagttggcac

SEQ ID NO: 261171 - DNA, 25 bp, Mus musculus
cggctcccccaggtttccatcgtgt

SEQ ID NO: 261172 - DNA, 25 bp, Mus musculus
cggctcccgagagagggaaacaaca

SEQ ID NO: 261173 - DNA, 25 bp, Mus musculus
cggctcccgagagagggtcagcctc

SEQ ID NO: 261174 - DNA, 25 bp, Mus musculus
cggctcccgccagagctcaggccct

SEQ ID NO: 261175 - DNA, 25 bp, Mus musculus
cggctcccgccagctcaaggtgatg

SEQ ID NO: 261176 - DNA, 25 bp, Mus musculus
cggctcccgccaggagaatggtgcc

SEQ ID NO: 261177 - DNA, 25 bp, Mus musculus
cggctcccgtccgaggtacccagac

SEQ ID NO: 261178 - DNA, 25 bp, Mus musculus
cggctcccgtccgaggtgtgaatga

SEQ ID NO: 261179 - DNA, 25 bp, Mus musculus
cggctccctcaggtataagtattgt

SEQ ID NO: 261180 - DNA, 25 bp, Mus musculus
cggctccctcccgatgagaagaagc

SEQ ID NO: 261181 - DNA, 25 bp, Mus musculus
cggctccctcccgggatatttgctt

SEQ ID NO: 261182 - DNA, 25 bp, Mus musculus
cggctccgactcagatcagctcgaa

SEQ ID NO: 261183 - DNA, 25 bp, Mus musculus
cggctccgactcagattctttatac

SEQ ID NO: 261184 - DNA, 25 bp, Mus musculus
cggctccgagccaggattgaaattc

SEQ ID NO: 261185 - DNA, 25 bp, Mus musculus
cggctccgagggagcagaaggccaa

SEQ ID NO: 261186 - DNA, 25 bp, Mus musculus
cggctccgaggtgggaaactacctg

SEQ ID NO: 261187 - DNA, 25 bp, Mus musculus
cggctccgcgggctgaggaaatata

SEQ ID NO: 261188 - DNA, 25 bp, Mus musculus
cggctccggaaaatccactgtgggt

SEQ ID NO: 261189 - DNA, 25 bp, Mus musculus
cggctccggaaactgctccccaggg

SEQ ID NO: 261190 - DNA, 25 bp, Mus musculus
cggctcctaccactgacaaagtctc

SEQ ID NO: 261191 - DNA, 25 bp, Mus musculus
cggctcctcagatatagccatattt

SEQ ID NO: 261192 - DNA, 25 bp, Mus musculus
cggctcctcagtattgtggaatgtg

SEQ ID NO: 261193 - DNA, 25 bp, Mus musculus
cggctcctcagtgtcggcggcggag

SEQ ID NO: 261194 - DNA, 25 bp, Mus musculus
cggctcctctggggcttagtccttg

SEQ ID NO: 261195 - DNA, 25 bp, Mus musculus
cggctcctggaacaggaacgttggc

SEQ ID NO: 261196 - DNA, 25 bp, Mus musculus
cggctcctgtacaggttggcggacc

SEQ ID NO: 261197 - DNA, 25 bp, Mus musculus
cggctcgcggcgagggtggtcctgg

SEQ ID NO: 261198 - DNA, 25 bp, Mus musculus
cggctcgcggcgaggtaattgaaga

SEQ ID NO: 261199 - DNA, 25 bp, Mus musculus
cggctcgctaagccacactcattct

SEQ ID NO: 261200 - DNA, 25 bp, Mus musculus
cggctcgctaagccggctgcccttt

SEQ ID NO: 261201 - DNA, 25 bp, Mus musculus
cggctcggcccagggctcccagttt

SEQ ID NO: 261202 - DNA, 25 bp, Mus musculus
cggctcggcctggtgtctccaaaca

SEQ ID NO: 261203 - DNA, 25 bp, Mus musculus
cggctcgggacggagatgaaaccag

SEQ ID NO: 261204 - DNA, 25 bp, Mus musculus
cggctcgggacggttcagtgtatct

SEQ ID NO: 261205 - DNA, 25 bp, Mus musculus
cggctcgggcatggaaactatcaat

SEQ ID NO: 261206 - DNA, 25 bp, Mus musculus
cggctcgtgcaagcgtgccaagtat

SEQ ID NO: 261207 - DNA, 25 bp, Mus musculus
cggctctaaggccaaagatctcatc

SEQ ID NO: 261208 - DNA, 25 bp, Mus musculus
cggctctactgccagactactggac

SEQ ID NO: 261209 - DNA, 25 bp, Mus musculus
cggctctactgccagtgtctgttgt

SEQ ID NO: 261210 - DNA, 25 bp, Mus musculus
cggctctagggcgtcccggggcccg

SEQ ID NO: 261211 - DNA, 25 bp, Mus musculus
cggctctagggggccagagtttgtg

SEQ ID NO: 261212 - DNA, 25 bp, Mus musculus
cggctctcaagcagaaaaatggcta

SEQ ID NO: 261213 - DNA, 25 bp, Mus musculus
cggctctcaaggaggccaaagcaaa

SEQ ID NO: 261214 - DNA, 25 bp, Mus musculus
cggctctccgggtgtaaagatcttt

SEQ ID NO: 261215 - DNA, 25 bp, Mus musculus
cggctctccttcagtaaattcaaga

SEQ ID NO: 261216 - DNA, 25 bp, Mus musculus
cggctctgattggaggtcggtgagc

SEQ ID NO: 261217 - DNA, 25 bp, Mus musculus
cggctctgcggggcgcctctgaagc

SEQ ID NO: 261218 - DNA, 25 bp, Mus musculus
cggctctggatctggtgaagcagga

SEQ ID NO: 261219 - DNA, 25 bp, Mus musculus
cggctctggctgcagggaattgatg

SEQ ID NO: 261220 - DNA, 25 bp, Mus musculus
cggctctggttggtcatgctgccat

SEQ ID NO: 261221 - DNA, 25 bp, Mus musculus
cggctctgtgaagccgaggaagtgg

SEQ ID NO: 261222 - DNA, 25 bp, Mus musculus
cggctctgtgacctcctcctctact

SEQ ID NO: 261223 - DNA, 25 bp, Mus musculus
cggctctgtggggctgctgccggca

SEQ ID NO: 261224 - DNA, 25 bp, Mus musculus
cggctctgtggtgccttagctggat

SEQ ID NO: 261225 - DNA, 25 bp, Mus musculus
cggctcttcaagtacggggtacagc

SEQ ID NO: 261226 - DNA, 25 bp, Mus musculus
cggctcttcagacaggcccagtgct

SEQ ID NO: 261227 - DNA, 25 bp, Mus musculus
cggctcttggcgcgatgaggaaact

SEQ ID NO: 261228 - DNA, 25 bp, Mus musculus
cggctgaacaaaccttatatctacg

SEQ ID NO: 261229 - DNA, 25 bp, Mus musculus
cggctgaacaagttggtgacacatc

SEQ ID NO: 261230 - DNA, 25 bp, Mus musculus
cggctgaagcaggctattgaagagg

SEQ ID NO: 261231 - DNA, 25 bp, Mus musculus
cggctgaagcaggtaaaaaacaaga

SEQ ID NO: 261232 - DNA, 25 bp, Mus musculus
cggctgaagccagcatcgagatcaa

SEQ ID NO: 261233 - DNA, 25 bp, Mus musculus
cggctgaagccaggagccaaaccag

SEQ ID NO: 261234 - DNA, 25 bp, Mus musculus
cggctgaagctaagccccaagcatt

SEQ ID NO: 261235 - DNA, 25 bp, Mus musculus
cggctgaaggcagacacatctgaca

SEQ ID NO: 261236 - DNA, 25 bp, Mus musculus
cggctgaaggcttgtgaaaaagcag

SEQ ID NO: 261237 - DNA, 25 bp, Mus musculus
cggctgaagggcctctggaaatgtc

SEQ ID NO: 261238 - DNA, 25 bp, Mus musculus
cggctgaagtcatgaactccaatgt

SEQ ID NO: 261239 - DNA, 25 bp, Mus musculus
cggctgacacaggaggacctccacc

SEQ ID NO: 261240 - DNA, 25 bp, Mus musculus
cggctgacactagctgcagccgact

SEQ ID NO: 261241 - DNA, 25 bp, Mus musculus
cggctgacagaaggacatttggatc

SEQ ID NO: 261242 - DNA, 25 bp, Mus musculus
cggctgacagacccgtggattccca

SEQ ID NO: 261243 - DNA, 25 bp, Mus musculus
cggctgacagcgtcctgaggttagc

SEQ ID NO: 261244 - DNA, 25 bp, Mus musculus
cggctgacagggcaagagttcaaac

SEQ ID NO: 261245 - DNA, 25 bp, Mus musculus
cggctgacaggtagaaaaccagttg

SEQ ID NO: 261246 - DNA, 25 bp, Mus musculus
cggctgacaggttcttacagtcttg

SEQ ID NO: 261247 - DNA, 25 bp, Mus musculus
cggctgacattacaggaccaggtgg

SEQ ID NO: 261248 - DNA, 25 bp, Mus musculus
cggctgacctgcaaatctggttctt

SEQ ID NO: 261249 - DNA, 25 bp, Mus musculus
cggctgacctggccctctgtcctgg

SEQ ID NO: 261250 - DNA, 25 bp, Mus musculus
cggctgacctgttgaacactctgaa

SEQ ID NO: 261251 - DNA, 25 bp, Mus musculus
cggctgacggaggtgtcccctgaac

SEQ ID NO: 261252 - DNA, 25 bp, Mus musculus
cggctgacgggctcctccccgacgc

SEQ ID NO: 261253 - DNA, 25 bp, Mus musculus
cggctgactctcacaggggagaagc

SEQ ID NO: 261254 - DNA, 25 bp, Mus musculus
cggctgagaggcaggctgcaaggct

SEQ ID NO: 261255 - DNA, 25 bp, Mus musculus
cggctgagaggcaggctgtcaatgc

SEQ ID NO: 261256 - DNA, 25 bp, Mus musculus
cggctgagcttgcaggcatctagtc

SEQ ID NO: 261257 - DNA, 25 bp, Mus musculus
cggctgaggaggccaccatggcaga

SEQ ID NO: 261258 - DNA, 25 bp, Mus musculus
cggctgatagcgatcattgctgtct

SEQ ID NO: 261259 - DNA, 25 bp, Mus musculus
cggctgatagcggggatcccagcat

SEQ ID NO: 261260 - DNA, 25 bp, Mus musculus
cggctgatggagtatggtgatgaag

SEQ ID NO: 261261 - DNA, 25 bp, Mus musculus
cggctgatggagtgatgggagccag

SEQ ID NO: 261262 - DNA, 25 bp, Mus musculus
cggctgcaaatgacacaacacggaa

SEQ ID NO: 261263 - DNA, 25 bp, Mus musculus
cggctgcaaatggtaacgatcggaa

SEQ ID NO: 261264 - DNA, 25 bp, Mus musculus
cggctgcaagatgagcctggggccg

SEQ ID NO: 261265 - DNA, 25 bp, Mus musculus
cggctgcaagggttgttaaacatga

SEQ ID NO: 261266 - DNA, 25 bp, Mus musculus
cggctgcacagcccatctctgagcg

SEQ ID NO: 261267 - DNA, 25 bp, Mus musculus
cggctgcacaggagcaacacgtcgg

SEQ ID NO: 261268 - DNA, 25 bp, Mus musculus
cggctgcacagtgacatgaaattgt

SEQ ID NO: 261269 - DNA, 25 bp, Mus musculus
cggctgcacgagtcacaccggaact

SEQ ID NO: 261270 - DNA, 25 bp, Mus musculus
cggctgcagaagcgtctcctgtaac

SEQ ID NO: 261271 - DNA, 25 bp, Mus musculus
cggctgcagaaggactggcccagcc

SEQ ID NO: 261272 - DNA, 25 bp, Mus musculus
cggctgcagacttgacatcgtcttt

SEQ ID NO: 261273 - DNA, 25 bp, Mus musculus
cggctgcagcaggccaccatggcag

SEQ ID NO: 261274 - DNA, 25 bp, Mus musculus
cggctgcagcgggaagatgtcatga

SEQ ID NO: 261275 - DNA, 25 bp, Mus musculus
cggctgcagggtaagaccagctgtg

SEQ ID NO: 261276 - DNA, 25 bp, Mus musculus
cggctgcagtgtggtggcacaagac

SEQ ID NO: 261277 - DNA, 25 bp, Mus musculus
cggctgccaaaagcggaggccaaaa

SEQ ID NO: 261278 - DNA, 25 bp, Mus musculus
cggctgccagaaacttcagtgccct

SEQ ID NO: 261279 - DNA, 25 bp, Mus musculus
cggctgcccactccgccttgataca

SEQ ID NO: 261280 - DNA, 25 bp, Mus musculus
cggctgcccgggcagtgacggacag

SEQ ID NO: 261281 - DNA, 25 bp, Mus musculus
cggctgcccgggcctgactaccaga

SEQ ID NO: 261282 - DNA, 25 bp, Mus musculus
cggctgccctgagaaacctcgacct

SEQ ID NO: 261283 - DNA, 25 bp, Mus musculus
cggctgccgactgcgaatcgccagg

SEQ ID NO: 261284 - DNA, 25 bp, Mus musculus
cggctgcctaggttctggtattgga

SEQ ID NO: 261285 - DNA, 25 bp, Mus musculus
cggctgcctctcaaatgaacctcta

SEQ ID NO: 261286 - DNA, 25 bp, Mus musculus
cggctgcgactccgagcaccactcc

SEQ ID NO: 261287 - DNA, 25 bp, Mus musculus
cggctgcgagcgcagttacccagca

SEQ ID NO: 261288 - DNA, 25 bp, Mus musculus
cggctgcgagcgctgtagacctgga

SEQ ID NO: 261289 - DNA, 25 bp, Mus musculus
cggctgcgaggaagaagaaatgcca

SEQ ID NO: 261290 - DNA, 25 bp, Mus musculus
cggctgcgaggaattcatcagagag

SEQ ID NO: 261291 - DNA, 25 bp, Mus musculus
cggctgcgattacatcaccctgacc

SEQ ID NO: 261292 - DNA, 25 bp, Mus musculus
cggctgcgcagctgcccctgtcgaa

SEQ ID NO: 261293 - DNA, 25 bp, Mus musculus
cggctgcgcaggaaagtgcccatct

SEQ ID NO: 261294 - DNA, 25 bp, Mus musculus
cggctgcgctgcgagagaggaagac

SEQ ID NO: 261295 - DNA, 25 bp, Mus musculus
cggctgctcagagtatagaaatatc

SEQ ID NO: 261296 - DNA, 25 bp, Mus musculus
cggctgctcagcaaggctgagcgcc

SEQ ID NO: 261297 - DNA, 25 bp, Mus musculus
cggctgctcaggtccaatcagcata

SEQ ID NO: 261298 - DNA, 25 bp, Mus musculus
cggctgctcatggaaacgtgtgccg

SEQ ID NO: 261299 - DNA, 25 bp, Mus musculus
cggctgctcttcgggaatcatggcc

SEQ ID NO: 261300 - DNA, 25 bp, Mus musculus
cggctgctgaagaaagaattgatat

SEQ ID NO: 261301 - DNA, 25 bp, Mus musculus
cggctgctgaagaaattgaagcagc

SEQ ID NO: 261302 - DNA, 25 bp, Mus musculus
cggctgctgcacagccctcctaagg

SEQ ID NO: 261303 - DNA, 25 bp, Mus musculus
cggctgctgcacaggaataaaggac

SEQ ID NO: 261304 - DNA, 25 bp, Mus musculus
cggctgctggaagtgagagggtcca

SEQ ID NO: 261305 - DNA, 25 bp, Mus musculus
cggctgctgtttcctcctaggatgt

SEQ ID NO: 261306 - DNA, 25 bp, Mus musculus
cggctggaggaggcgggcgtccgaa

SEQ ID NO: 261307 - DNA, 25 bp, Mus musculus
cggctggagtcgaatttggaaatac

SEQ ID NO: 261308 - DNA, 25 bp, Mus musculus
cggctggcagaacacagatctgttt

SEQ ID NO: 261309 - DNA, 25 bp, Mus musculus
cggctggcagaacttgatcaccaga

SEQ ID NO: 261310 - DNA, 25 bp, Mus musculus
cggctggcagagactcctgaaagga

SEQ ID NO: 261311 - DNA, 25 bp, Mus musculus
cggctggcagccatggagaacgctc

SEQ ID NO: 261312 - DNA, 25 bp, Mus musculus
cggctggcagctgcagaagagacca

SEQ ID NO: 261313 - DNA, 25 bp, Mus musculus
cggctggccacgtgtggttgaatct

SEQ ID NO: 261314 - DNA, 25 bp, Mus musculus
cggctggcccaggaggtgtctgaga

SEQ ID NO: 261315 - DNA, 25 bp, Mus musculus
cggctggcgactattcttctatgag

SEQ ID NO: 261316 - DNA, 25 bp, Mus musculus
cggctgggaagaccctgtttgggaa

SEQ ID NO: 261317 - DNA, 25 bp, Mus musculus
cggctggggtcattctcagagcttc

SEQ ID NO: 261318 - DNA, 25 bp, Mus musculus
cggctggtaaagctgtcctgcctgt

SEQ ID NO: 261319 - DNA, 25 bp, Mus musculus
cggctggttggcgagaatctgcttc

SEQ ID NO: 261320 - DNA, 25 bp, Mus musculus
cggctggttgggaatgtgactattt

SEQ ID NO: 261321 - DNA, 25 bp, Mus musculus
cggctgtaactacagaggcctccag

SEQ ID NO: 261322 - DNA, 25 bp, Mus musculus
cggctgtaactacagttgtgcccct

SEQ ID NO: 261323 - DNA, 25 bp, Mus musculus
cggctgtacacttccggcctgctat

SEQ ID NO: 261324 - DNA, 25 bp, Mus musculus
cggctgtatgtggacggatgacgac

SEQ ID NO: 261325 - DNA, 25 bp, Mus musculus
cggctgtcaacctaatgtctgcgac

SEQ ID NO: 261326 - DNA, 25 bp, Mus musculus
cggctgtcactcctgctggttgcat

SEQ ID NO: 261327 - DNA, 25 bp, Mus musculus
cggctgtcagagactatgaaatccc

SEQ ID NO: 261328 - DNA, 25 bp, Mus musculus
cggctgtcccacctcagcaccagga

SEQ ID NO: 261329 - DNA, 25 bp, Mus musculus
cggctgtcccaccttgtgcgccccg

SEQ ID NO: 261330 - DNA, 25 bp, Mus musculus
cggctgtggagcaggctcctagaag

SEQ ID NO: 261331 - DNA, 25 bp, Mus musculus
cggctgtgggaggtgctgtggacag

SEQ ID NO: 261332 - DNA, 25 bp, Mus musculus
cggcttaatgctgattttgctcagc

SEQ ID NO: 261333 - DNA, 25 bp, Mus musculus
cggcttaatggtgattttgctcagc

SEQ ID NO: 261334 - DNA, 25 bp, Mus musculus
cggcttagagagaagaaagaatatc

SEQ ID NO: 261335 - DNA, 25 bp, Mus musculus
cggcttagagagaagaaatctccac

SEQ ID NO: 261336 - DNA, 25 bp, Mus musculus
cggcttagagagaagcaactggtct

SEQ ID NO: 261337 - DNA, 25 bp, Mus musculus
cggcttaggaccagctcgcaggatt

SEQ ID NO: 261338 - DNA, 25 bp, Mus musculus
cggcttcaggatgagctgcaaaggc

SEQ ID NO: 261339 - DNA, 25 bp, Mus musculus
cggcttccaaggttcctacttgaaa

SEQ ID NO: 261340 - DNA, 25 bp, Mus musculus
cggcttccaagtctgttcttcagga

SEQ ID NO: 261341 - DNA, 25 bp, Mus musculus
cggcttccaggtaccaatggggatc

SEQ ID NO: 261342 - DNA, 25 bp, Mus musculus
cggcttccccatctggcatgcccac

SEQ ID NO: 261343 - DNA, 25 bp, Mus musculus
cggcttccggagatatgacgtgttc

SEQ ID NO: 261344 - DNA, 25 bp, Mus musculus
cggcttccggagtttgtgatcctgt

SEQ ID NO: 261345 - DNA, 25 bp, Mus musculus
cggcttcctgagatgaagaaactga

SEQ ID NO: 261346 - DNA, 25 bp, Mus musculus
cggcttccttaagacagatgggagc

SEQ ID NO: 261347 - DNA, 25 bp, Mus musculus
cggcttcgccatggtagcgatggtg

SEQ ID NO: 261348 - DNA, 25 bp, Mus musculus
cggcttctgcacgcccctccaggcc

SEQ ID NO: 261349 - DNA, 25 bp, Mus musculus
cggcttctgctacagcggctgtaca

SEQ ID NO: 261350 - DNA, 25 bp, Mus musculus
cggcttctgctacaggagtcagcag

SEQ ID NO: 261351 - DNA, 25 bp, Mus musculus
cggcttcttgccggccccgcccccg

SEQ ID NO: 261352 - DNA, 25 bp, Mus musculus
cggcttcttgccgggatctgaccca

SEQ ID NO: 261353 - DNA, 25 bp, Mus musculus
cggcttctttagctctcctcacatg

SEQ ID NO: 261354 - DNA, 25 bp, Mus musculus
cggcttctttaggacgacagccatg

SEQ ID NO: 261355 - DNA, 25 bp, Mus musculus
cggcttctttaggtctcctcacatg

SEQ ID NO: 261356 - DNA, 25 bp, Mus musculus
cggcttgagagagagagccagctgc

SEQ ID NO: 261357 - DNA, 25 bp, Mus musculus
cggcttgatagtgagattggcagac

SEQ ID NO: 261358 - DNA, 25 bp, Mus musculus
cggcttgtcacattcccacgaggtt

SEQ ID NO: 261359 - DNA, 25 bp, Mus musculus
cggcttgtggctgctcccgcaggct

SEQ ID NO: 261360 - DNA, 25 bp, Mus musculus
cggctttctatagagctgggctcgt

SEQ ID NO: 261361 - DNA, 25 bp, Mus musculus
cggctttctataggtatggggactg

SEQ ID NO: 261362 - DNA, 25 bp, Mus musculus
cggctttctgatcaggtgttgtttg

SEQ ID NO: 261363 - DNA, 25 bp, Mus musculus
cggctttgacagctgcaggtcctgg

SEQ ID NO: 261364 - DNA, 25 bp, Mus musculus
cggctttgatcacagtattttcaca

SEQ ID NO: 261365 - DNA, 25 bp, Mus musculus
cggctttgcaaaagtacgatcagag

SEQ ID NO: 261366 - DNA, 25 bp, Mus musculus
cggctttgcaaagtgattcgtaagg

SEQ ID NO: 261367 - DNA, 25 bp, Mus musculus
cggctttgcaaatgctcagcagagg

SEQ ID NO: 261368 - DNA, 25 bp, Mus musculus
cggctttggaggggctgtgggtttg

SEQ ID NO: 261369 - DNA, 25 bp, Mus musculus
cggcttttgaaagctctgcggagtc

SEQ ID NO: 261370 - DNA, 25 bp, Mus musculus
cggcttttgaaaggaacagattata

SEQ ID NO: 261371 - DNA, 25 bp, Mus musculus
cgggaaaacaatatggctccttatt

SEQ ID NO: 261372 - DNA, 25 bp, Mus musculus
cgggaaacaggacccagccacctcc

SEQ ID NO: 261373 - DNA, 25 bp, Mus musculus
cgggaaacgcgaagatgtgacagca

SEQ ID NO: 261374 - DNA, 25 bp, Mus musculus
cgggaaagaagtgagaagataaaga

SEQ ID NO: 261375 - DNA, 25 bp, Mus musculus
cgggaaagccatgtggagattggca

SEQ ID NO: 261376 - DNA, 25 bp, Mus musculus
cgggaaaggccggatggaccaagag

SEQ ID NO: 261377 - DNA, 25 bp, Mus musculus
cgggaaagtcttagcacctccgcac

SEQ ID NO: 261378 - DNA, 25 bp, Mus musculus
cgggaaagtcttagtgtcgagcaca

SEQ ID NO: 261379 - DNA, 25 bp, Mus musculus
cgggaacaagagaataaaggccgcg

SEQ ID NO: 261380 - DNA, 25 bp, Mus musculus
cgggaacaagagataaaactattaa

SEQ ID NO: 261381 - DNA, 25 bp, Mus musculus
cgggaacaggagctcctcttgcggc

SEQ ID NO: 261382 - DNA, 25 bp, Mus musculus
cgggaacatggagcacatggctgca

SEQ ID NO: 261383 - DNA, 25 bp, Mus musculus
cgggaaccaagaaatcccaggcagg

SEQ ID NO: 261384 - DNA, 25 bp, Mus musculus
cgggaaccaagaaggcacagacaga

SEQ ID NO: 261385 - DNA, 25 bp, Mus musculus
cgggaaccagccgcaagggaaggtg

SEQ ID NO: 261386 - DNA, 25 bp, Mus musculus
cgggaacgcatcgtattgacgacag

SEQ ID NO: 261387 - DNA, 25 bp, Mus musculus
cgggaacggagtgtgcaattctcat

SEQ ID NO: 261388 - DNA, 25 bp, Mus musculus
cgggaactgctggtgtgatccttgc

SEQ ID NO: 261389 - DNA, 25 bp, Mus musculus
cgggaagaatggaaaatgtttatag

SEQ ID NO: 261390 - DNA, 25 bp, Mus musculus
cgggaagagctggcatttcagtcga

SEQ ID NO: 261391 - DNA, 25 bp, Mus musculus
cgggaagaggggaagcatccacaaa

SEQ ID NO: 261392 - DNA, 25 bp, Mus musculus
cgggaagataaaacagaaagagtag

SEQ ID NO: 261393 - DNA, 25 bp, Mus musculus
cgggaagatcaagaggtcagggcca

SEQ ID NO: 261394 - DNA, 25 bp, Mus musculus
cgggaagatgccagtgtacggtcag

SEQ ID NO: 261395 - DNA, 25 bp, Mus musculus
cgggaagcaaacattcgagatctat

SEQ ID NO: 261396 - DNA, 25 bp, Mus musculus
cgggaagcacgggacgcctcagaaa

SEQ ID NO: 261397 - DNA, 25 bp, Mus musculus
cgggaagcccagcagtattcggagg

SEQ ID NO: 261398 - DNA, 25 bp, Mus musculus
cgggaagcctcaggaactcacccca

SEQ ID NO: 261399 - DNA, 25 bp, Mus musculus
cgggaagcctcaggctgtgggcgct

SEQ ID NO: 261400 - DNA, 25 bp, Mus musculus
cgggaagcctcagtgccactaagcc

SEQ ID NO: 261401 - DNA, 25 bp, Mus musculus
cgggaagcgcaacaggtcacctgga

SEQ ID NO: 261402 - DNA, 25 bp, Mus musculus
cgggaagctaagaaactgaggctcc

SEQ ID NO: 261403 - DNA, 25 bp, Mus musculus
cgggaagctgaggaaaccaatgttt

SEQ ID NO: 261404 - DNA, 25 bp, Mus musculus
cgggaagctgaggtctaatctcttg

SEQ ID NO: 261405 - DNA, 25 bp, Mus musculus
cgggaaggacaggacagcaaggtac

SEQ ID NO: 261406 - DNA, 25 bp, Mus musculus
cgggaaggacaggttcaactggaga

SEQ ID NO: 261407 - DNA, 25 bp, Mus musculus
cgggaaggagtggaaaagagagaca

SEQ ID NO: 261408 - DNA, 25 bp, Mus musculus
cgggaaggagttatccagcttgtcc

SEQ ID NO: 261409 - DNA, 25 bp, Mus musculus
cgggaaggccagggtcatttctctg

SEQ ID NO: 261410 - DNA, 25 bp, Mus musculus
cgggaagtccgcgagtggggttgcg

SEQ ID NO: 261411 - DNA, 25 bp, Mus musculus
cgggaagttcaggcctggtgatgag

SEQ ID NO: 261412 - DNA, 25 bp, Mus musculus
cgggaatctgggtggtactggggtt

SEQ ID NO: 261413 - DNA, 25 bp, Mus musculus
cgggaatgggcagcacatttaaaat

SEQ ID NO: 261414 - DNA, 25 bp, Mus musculus
cgggaattccagctgatggagacct

SEQ ID NO: 261415 - DNA, 25 bp, Mus musculus
cgggaattccagctgggtgagtctg

SEQ ID NO: 261416 - DNA, 25 bp, Mus musculus
cgggaattccaggtctcaagggatt

SEQ ID NO: 261417 - DNA, 25 bp, Mus musculus
cgggaattctcgcccgaacctcttg

SEQ ID NO: 261418 - DNA, 25 bp, Mus musculus
cgggacaaagggtgaagcagggaag

SEQ ID NO: 261419 - DNA, 25 bp, Mus musculus
cgggacaactatgggaagaagaaga

SEQ ID NO: 261420 - DNA, 25 bp, Mus musculus
cgggacaagtggctggcacccgatg

SEQ ID NO: 261421 - DNA, 25 bp, Mus musculus
cgggacactggacatcatcaccacc

SEQ ID NO: 261422 - DNA, 25 bp, Mus musculus
cgggacactgggatcttccttgact

SEQ ID NO: 261423 - DNA, 25 bp, Mus musculus
cgggacagaatacatgcaagaccct

SEQ ID NO: 261424 - DNA, 25 bp, Mus musculus
cgggacagagagggtccgtcgtaac

SEQ ID NO: 261425 - DNA, 25 bp, Mus musculus
cgggacagagcgcctcctcaagcca

SEQ ID NO: 261426 - DNA, 25 bp, Mus musculus
cgggacagataagcagcgtgcttcc

SEQ ID NO: 261427 - DNA, 25 bp, Mus musculus
cgggacagatgcaaagccgccatgg

SEQ ID NO: 261428 - DNA, 25 bp, Mus musculus
cgggacagcaaaggccgggtaggac

SEQ ID NO: 261429 - DNA, 25 bp, Mus musculus
cgggacagcaaaggttctggccgag

SEQ ID NO: 261430 - DNA, 25 bp, Mus musculus
cgggacagccaggtggagttgttac

SEQ ID NO: 261431 - DNA, 25 bp, Mus musculus
cgggacagccagtgcgtccagttag

SEQ ID NO: 261432 - DNA, 25 bp, Mus musculus
cgggacaggcaagcacaagctgctg

SEQ ID NO: 261433 - DNA, 25 bp, Mus musculus
cgggacaggcaccttctgtatttcc

SEQ ID NO: 261434 - DNA, 25 bp, Mus musculus
cgggaccaaagagcagccccggact

SEQ ID NO: 261435 - DNA, 25 bp, Mus musculus
cgggaccaaagagctgcctctgttc

SEQ ID NO: 261436 - DNA, 25 bp, Mus musculus
cgggaccaagactccacttcagttc

SEQ ID NO: 261437 - DNA, 25 bp, Mus musculus
cgggaccaaggttatttcgtcatca

SEQ ID NO: 261438 - DNA, 25 bp, Mus musculus
cgggaccaatgctcaggtctagaga

SEQ ID NO: 261439 - DNA, 25 bp, Mus musculus
cgggaccacagcctccaggatcact

SEQ ID NO: 261440 - DNA, 25 bp, Mus musculus
cgggaccatagtggagggacggctt

SEQ ID NO: 261441 - DNA, 25 bp, Mus musculus
cgggacccagggtgaaatggtcaac

SEQ ID NO: 261442 - DNA, 25 bp, Mus musculus
cgggaccccgagatcgccggggctc

SEQ ID NO: 261443 - DNA, 25 bp, Mus musculus
cgggacccgagatccacgtgtcgga

SEQ ID NO: 261444 - DNA, 25 bp, Mus musculus
cgggacccgagctgtgtctcttcag

SEQ ID NO: 261445 - DNA, 25 bp, Mus musculus
cgggacccgcaggtcctaatctgaa

SEQ ID NO: 261446 - DNA, 25 bp, Mus musculus
cgggacccgggtcctgataagccct

SEQ ID NO: 261447 - DNA, 25 bp, Mus musculus
cgggacccttaagggccacaccaag

SEQ ID NO: 261448 - DNA, 25 bp, Mus musculus
cgggacccttatgacctgatgggga

SEQ ID NO: 261449 - DNA, 25 bp, Mus musculus
cgggacccttctgccactgctgctg

SEQ ID NO: 261450 - DNA, 25 bp, Mus musculus
cgggaccgagcagcgaacagttgaa

SEQ ID NO: 261451 - DNA, 25 bp, Mus musculus
cgggaccgcagattatttttaatga

SEQ ID NO: 261452 - DNA, 25 bp, Mus musculus
cgggaccgcagggattctcctgatg

SEQ ID NO: 261453 - DNA, 25 bp, Mus musculus
cgggaccgcaggtgtgggatatggg

SEQ ID NO: 261454 - DNA, 25 bp, Mus musculus
cgggaccgcagttgagtggtgattt

SEQ ID NO: 261455 - DNA, 25 bp, Mus musculus
cgggaccgcctgatccggacactgg

SEQ ID NO: 261456 - DNA, 25 bp, Mus musculus
cgggaccgcctggaggaggacatct

SEQ ID NO: 261457 - DNA, 25 bp, Mus musculus
cgggaccgtaggcgctgaggcatgt

SEQ ID NO: 261458 - DNA, 25 bp, Mus musculus
cgggaccgtcctgtttggagtgctt

SEQ ID NO: 261459 - DNA, 25 bp, Mus musculus
cgggaccgtgaagtggatgggagcg

SEQ ID NO: 261460 - DNA, 25 bp, Mus musculus
cgggacctaaagcctgagaatttgc

SEQ ID NO: 261461 - DNA, 25 bp, Mus musculus
cgggacctcgagactgccactctcc

SEQ ID NO: 261462 - DNA, 25 bp, Mus musculus
cgggacctgacgtgtgctgtgatca

SEQ ID NO: 261463 - DNA, 25 bp, Mus musculus
cgggacctgggtgtctcttccaagg

SEQ ID NO: 261464 - DNA, 25 bp, Mus musculus
cgggacgcaaaggaggaagccagca

SEQ ID NO: 261465 - DNA, 25 bp, Mus musculus
cgggacgctgacgggctgacaggcg

SEQ ID NO: 261466 - DNA, 25 bp, Mus musculus
cgggacgctgacggggtggaggagc

SEQ ID NO: 261467 - DNA, 25 bp, Mus musculus
cgggacgctgcgaggaagagccctg

SEQ ID NO: 261468 - DNA, 25 bp, Mus musculus
cgggacgtggcgaggggatcgtggg

SEQ ID NO: 261469 - DNA, 25 bp, Mus musculus
cgggactacaggcgagcggcgtgct

SEQ ID NO: 261470 - DNA, 25 bp, Mus musculus
cgggactacagggtcaacgtggtgt

SEQ ID NO: 261471 - DNA, 25 bp, Mus musculus
cgggactagggagtgttcagtcacc

SEQ ID NO: 261472 - DNA, 25 bp, Mus musculus
cgggactatggctagatccagacta

SEQ ID NO: 261473 - DNA, 25 bp, Mus musculus
cgggactatggctagcattcaacat

SEQ ID NO: 261474 - DNA, 25 bp, Mus musculus
cgggactcctgagccgctctgcaca

SEQ ID NO: 261475 - DNA, 25 bp, Mus musculus
cgggactcggggctgagcagcaagt

SEQ ID NO: 261476 - DNA, 25 bp, Mus musculus
cgggactcgggggacaggcacgagg

SEQ ID NO: 261477 - DNA, 25 bp, Mus musculus
cgggactgatgcagggtaatcagga

SEQ ID NO: 261478 - DNA, 25 bp, Mus musculus
cgggactggctagaaaatactaaag

SEQ ID NO: 261479 - DNA, 25 bp, Mus musculus
cgggacttcatgcgattgagaagat

SEQ ID NO: 261480 - DNA, 25 bp, Mus musculus
cgggacttcatgttgatcacagccg

SEQ ID NO: 261481 - DNA, 25 bp, Mus musculus
cgggacttcgtgcagtgactccact

SEQ ID NO: 261482 - DNA, 25 bp, Mus musculus
cgggacttgtgccggtcctgccccc

SEQ ID NO: 261483 - DNA, 25 bp, Mus musculus
cgggagaagcagcttatggcaaacc

SEQ ID NO: 261484 - DNA, 25 bp, Mus musculus
cgggagaagcagggatctgggcact

SEQ ID NO: 261485 - DNA, 25 bp, Mus musculus
cgggagacactgaggctttcaggtt

SEQ ID NO: 261486 - DNA, 25 bp, Mus musculus
cgggagacaggcctctctttctgat

SEQ ID NO: 261487 - DNA, 25 bp, Mus musculus
cgggagacaggtacttgtggaaggc

SEQ ID NO: 261488 - DNA, 25 bp, Mus musculus
cgggagacgaaggcctggagcccag

SEQ ID NO: 261489 - DNA, 25 bp, Mus musculus
cgggagacgaagggcagaggtgacc

SEQ ID NO: 261490 - DNA, 25 bp, Mus musculus
cgggagactagcgtggcgactccat

SEQ ID NO: 261491 - DNA, 25 bp, Mus musculus
cgggagactaggtcacgagcctggg

SEQ ID NO: 261492 - DNA, 25 bp, Mus musculus
cgggagactcaagggatcctctgaa

SEQ ID NO: 261493 - DNA, 25 bp, Mus musculus
cgggagagacagctttttcctgcaa

SEQ ID NO: 261494 - DNA, 25 bp, Mus musculus
cgggagagcaatgtcacacttggtc

SEQ ID NO: 261495 - DNA, 25 bp, Mus musculus
cgggagagccggcagccatcatgtt

SEQ ID NO: 261496 - DNA, 25 bp, Mus musculus
cgggagagccggcaggatttctcca

SEQ ID NO: 261497 - DNA, 25 bp, Mus musculus
cgggagaggaacagtatccagatct

SEQ ID NO: 261498 - DNA, 25 bp, Mus musculus
cgggagaggaggtttgggatgctct

SEQ ID NO: 261499 - DNA, 25 bp, Mus musculus
cgggagaggcattcagtggctctga

SEQ ID NO: 261500 - DNA, 25 bp, Mus musculus
cgggagaggtcagaggatgcaaaga

SEQ ID NO: 261501 - DNA, 25 bp, Mus musculus
cgggagaggtcagaggctgtcaaaa

SEQ ID NO: 261502 - DNA, 25 bp, Mus musculus
cgggagaggtcggcagacggcgatg

SEQ ID NO: 261503 - DNA, 25 bp, Mus musculus
cgggagatacttgatccttcttacc

SEQ ID NO: 261504 - DNA, 25 bp, Mus musculus
cgggagatattggcaaaatatccag

SEQ ID NO: 261505 - DNA, 25 bp, Mus musculus
cgggagatcgagcaggtgaatgagc

SEQ ID NO: 261506 - DNA, 25 bp, Mus musculus
cgggagatcgagcaggttcctcatg

SEQ ID NO: 261507 - DNA, 25 bp, Mus musculus
cgggagatgagacgtgacttgtagc

SEQ ID NO: 261508 - DNA, 25 bp, Mus musculus
cgggagattggaggggactcctttt

SEQ ID NO: 261509 - DNA, 25 bp, Mus musculus
cgggagcacatcgactccagcaccc

SEQ ID NO: 261510 - DNA, 25 bp, Mus musculus
cgggagcactaccaggaagacatgg

SEQ ID NO: 261511 - DNA, 25 bp, Mus musculus
cgggagcaggaggagccaagcaata

SEQ ID NO: 261512 - DNA, 25 bp, Mus musculus
cgggagcaggaggagccaggagcag

SEQ ID NO: 261513 - DNA, 25 bp, Mus musculus
cgggagcatcaaaaccctactgaaa

SEQ ID NO: 261514 - DNA, 25 bp, Mus musculus
cgggagcatcaagaagtcatgctct

SEQ ID NO: 261515 - DNA, 25 bp, Mus musculus
cgggagccaggagaacgggatgcta

SEQ ID NO: 261516 - DNA, 25 bp, Mus musculus
cgggagccagttccaggcgaatcta

SEQ ID NO: 261517 - DNA, 25 bp, Mus musculus
cgggagccgagcccggtccccagcc

SEQ ID NO: 261518 - DNA, 25 bp, Mus musculus
cgggagccgagcccgtaggtgagcc

SEQ ID NO: 261519 - DNA, 25 bp, Mus musculus
cgggagcctgaaaaatacattgccc

SEQ ID NO: 261520 - DNA, 25 bp, Mus musculus
cgggagcctgcccaagtcttcaact

SEQ ID NO: 261521 - DNA, 25 bp, Mus musculus
cgggagcctgtggcctaaatgtaga

SEQ ID NO: 261522 - DNA, 25 bp, Mus musculus
cgggagcgacgatgtcaacctacaa

SEQ ID NO: 261523 - DNA, 25 bp, Mus musculus
cgggagcgagagctttgtaaatgga

SEQ ID NO: 261524 - DNA, 25 bp, Mus musculus
cgggagcgagccgagctgtcacgac

SEQ ID NO: 261525 - DNA, 25 bp, Mus musculus
cgggagcgagggagcggacatggac

SEQ ID NO: 261526 - DNA, 25 bp, Mus musculus
cgggagcgcatcaagacccttcgca

SEQ ID NO: 261527 - DNA, 25 bp, Mus musculus
cgggagcgcatcaaggagctggagt

SEQ ID NO: 261528 - DNA, 25 bp, Mus musculus
cgggagcgcatcaaggggatatcta

SEQ ID NO: 261529 - DNA, 25 bp, Mus musculus
cgggagcggagccagcaagccccgc

SEQ ID NO: 261530 - DNA, 25 bp, Mus musculus
cgggagcgtcaggtcttgagagagc

SEQ ID NO: 261531 - DNA, 25 bp, Mus musculus
cgggagctgttgtgatctcagttca

SEQ ID NO: 261532 - DNA, 25 bp, Mus musculus
cgggagcttcagcaggcatccatcc

SEQ ID NO: 261533 - DNA, 25 bp, Mus musculus
cgggagctttcccatcagaaaccaa

SEQ ID NO: 261534 - DNA, 25 bp, Mus musculus
cgggagcttttcagcacctttgggg

SEQ ID NO: 261535 - DNA, 25 bp, Mus musculus
cgggaggaaatggaggcaagaagac

SEQ ID NO: 261536 - DNA, 25 bp, Mus musculus
cgggaggactgtcctttcccatggc

SEQ ID NO: 261537 - DNA, 25 bp, Mus musculus
cgggaggcatagctggtctgaagag

SEQ ID NO: 261538 - DNA, 25 bp, Mus musculus
cgggaggcgaagactcatgaaatgg

SEQ ID NO: 261539 - DNA, 25 bp, Mus musculus
cgggagggacggtattcaggctgtg

SEQ ID NO: 261540 - DNA, 25 bp, Mus musculus
cgggagggaggaagatttgctccca

SEQ ID NO: 261541 - DNA, 25 bp, Mus musculus
cgggagggctgggcctgcagccggg

SEQ ID NO: 261542 - DNA, 25 bp, Mus musculus
cgggaggtccggatgctgttgacgg

SEQ ID NO: 261543 - DNA, 25 bp, Mus musculus
cgggagtcagaaagagcccagtgaa

SEQ ID NO: 261544 - DNA, 25 bp, Mus musculus
cgggagtccctagaggtgttggtgg

SEQ ID NO: 261545 - DNA, 25 bp, Mus musculus
cgggagtctcagatgaaagaaacaa

SEQ ID NO: 261546 - DNA, 25 bp, Mus musculus
cgggagtgaagaaatcttccatcct

SEQ ID NO: 261547 - DNA, 25 bp, Mus musculus
cgggagttaagagaggtaatagaat

SEQ ID NO: 261548 - DNA, 25 bp, Mus musculus
cgggataactgggaggatgagcccc

SEQ ID NO: 261549 - DNA, 25 bp, Mus musculus
cgggatacacgggacctcactgcgc

SEQ ID NO: 261550 - DNA, 25 bp, Mus musculus
cgggatacaggtgtgaatgaggcag

SEQ ID NO: 261551 - DNA, 25 bp, Mus musculus
cgggatacgaacgtggatgaggctg

SEQ ID NO: 261552 - DNA, 25 bp, Mus musculus
cgggatagtggagggtgtcccctga

SEQ ID NO: 261553 - DNA, 25 bp, Mus musculus
cgggatatatttgttaatggagtgt

SEQ ID NO: 261554 - DNA, 25 bp, Mus musculus
cgggatcaaggcagagatgctttat

SEQ ID NO: 261555 - DNA, 25 bp, Mus musculus
cgggatcagcgtgggagctccgctt

SEQ ID NO: 261556 - DNA, 25 bp, Mus musculus
cgggatccgcacgaaataaatcata

SEQ ID NO: 261557 - DNA, 25 bp, Mus musculus
cgggatcctacagcttcacatggag

SEQ ID NO: 261558 - DNA, 25 bp, Mus musculus
cgggatgatgccatagcatggaaga

SEQ ID NO: 261559 - DNA, 25 bp, Mus musculus
cgggatgatgccatgtacgcgtcta

SEQ ID NO: 261560 - DNA, 25 bp, Mus musculus
cgggatgcctgatcgtaccgagaag

SEQ ID NO: 261561 - DNA, 25 bp, Mus musculus
cgggatggagatgaggtgccacttc

SEQ ID NO: 261562 - DNA, 25 bp, Mus musculus
cgggatggcagcataggtggcagga

SEQ ID NO: 261563 - DNA, 25 bp, Mus musculus
cgggatggcaggatccaagtgaacg

SEQ ID NO: 261564 - DNA, 25 bp, Mus musculus
cgggatgtgaccagatgcatattcc

SEQ ID NO: 261565 - DNA, 25 bp, Mus musculus
cgggatgtgaccaggagatggctgg

SEQ ID NO: 261566 - DNA, 25 bp, Mus musculus
cgggatgtgaccaggtggccttgaa

SEQ ID NO: 261567 - DNA, 25 bp, Mus musculus
cgggatgtgtaccagatgacagaag

SEQ ID NO: 261568 - DNA, 25 bp, Mus musculus
cgggattaaagagcaaaagagagga

SEQ ID NO: 261569 - DNA, 25 bp, Mus musculus
cgggattaaagagtctattttcatg

SEQ ID NO: 261570 - DNA, 25 bp, Mus musculus
cgggattaaggaatcttccgacagc

SEQ ID NO: 261571 - DNA, 25 bp, Mus musculus
cgggattataccggctgcagtacct

SEQ ID NO: 261572 - DNA, 25 bp, Mus musculus
cgggattataccggggcccagtcat

SEQ ID NO: 261573 - DNA, 25 bp, Mus musculus
cgggattcagaggaagccaagggat

SEQ ID NO: 261574 - DNA, 25 bp, Mus musculus
cgggattccggtcacagtttgcact

SEQ ID NO: 261575 - DNA, 25 bp, Mus musculus
cgggattcctgcctgctccaggaca

SEQ ID NO: 261576 - DNA, 25 bp, Mus musculus
cgggattgccctgagaattcatata

SEQ ID NO: 261577 - DNA, 25 bp, Mus musculus
cgggattgccctgagagagaattct

SEQ ID NO: 261578 - DNA, 25 bp, Mus musculus
cgggattgctcagaaaaagatcatt

SEQ ID NO: 261579 - DNA, 25 bp, Mus musculus
cgggattgctcagaacttctcggta

SEQ ID NO: 261580 - DNA, 25 bp, Mus musculus
cgggattgctcagctgccttggctg

SEQ ID NO: 261581 - DNA, 25 bp, Mus musculus
cgggattgctcagggcattgaaaac

SEQ ID NO: 261582 - DNA, 25 bp, Mus musculus
cgggattgtagcaaggtatggtgcg

SEQ ID NO: 261583 - DNA, 25 bp, Mus musculus
cgggattgtgctttgagcgctgccg

SEQ ID NO: 261584 - DNA, 25 bp, Mus musculus
cgggcaacaaaatggcagtgaaaat

SEQ ID NO: 261585 - DNA, 25 bp, Mus musculus
cgggcaacaaagatttctgaaaaga

SEQ ID NO: 261586 - DNA, 25 bp, Mus musculus
cgggcaacaaagtgcactaggcctt

SEQ ID NO: 261587 - DNA, 25 bp, Mus musculus
cgggcaacaaatatgtctggatttg

SEQ ID NO: 261588 - DNA, 25 bp, Mus musculus
cgggcaacagttcactgaggaattt

SEQ ID NO: 261589 - DNA, 25 bp, Mus musculus
cgggcaagacatccacatcttttcg

SEQ ID NO: 261590 - DNA, 25 bp, Mus musculus
cgggcaagtctgaccttcatcactt

SEQ ID NO: 261591 - DNA, 25 bp, Mus musculus
cgggcaagtctgccctgacggtgaa

SEQ ID NO: 261592 - DNA, 25 bp, Mus musculus
cgggcaataatctatagaccatgga

SEQ ID NO: 261593 - DNA, 25 bp, Mus musculus
cgggcacaaccttcgagtcctcaaa

SEQ ID NO: 261594 - DNA, 25 bp, Mus musculus
cgggcacaccgcagggagaaaactg

SEQ ID NO: 261595 - DNA, 25 bp, Mus musculus
cgggcacagaaatggaagcccagag

SEQ ID NO: 261596 - DNA, 25 bp, Mus musculus
cgggcaccagtgagatcccatttct

SEQ ID NO: 261597 - DNA, 25 bp, Mus musculus
cgggcaccccagctggagtccttga

SEQ ID NO: 261598 - DNA, 25 bp, Mus musculus
cgggcaccccaggaatgcaccatgc

SEQ ID NO: 261599 - DNA, 25 bp, Mus musculus
cgggcaccgaagaggctaaccattt

SEQ ID NO: 261600 - DNA, 25 bp, Mus musculus
cgggcaccgagagtgttgagggcga

SEQ ID NO: 261601 - DNA, 25 bp, Mus musculus
cgggcaccgggagctggtgattgca

SEQ ID NO: 261602 - DNA, 25 bp, Mus musculus
cgggcaccgtcaggctcaagtccac

SEQ ID NO: 261603 - DNA, 25 bp, Mus musculus
cgggcacctggtccgggccatcagg

SEQ ID NO: 261604 - DNA, 25 bp, Mus musculus
cgggcactcaggttcgagtgacggt

SEQ ID NO: 261605 - DNA, 25 bp, Mus musculus
cgggcactggcaggcctgtacggag

SEQ ID NO: 261606 - DNA, 25 bp, Mus musculus
cgggcactggcagggctggtctaca

SEQ ID NO: 261607 - DNA, 25 bp, Mus musculus
cgggcagaagctgcgagacgctttt

SEQ ID NO: 261608 - DNA, 25 bp, Mus musculus
cgggcagacaacggttggcatcgaa

SEQ ID NO: 261609 - DNA, 25 bp, Mus musculus
cgggcagacaacgttcactttaatt

SEQ ID NO: 261610 - DNA, 25 bp, Mus musculus
cgggcagaccatggtgagcccattg

SEQ ID NO: 261611 - DNA, 25 bp, Mus musculus
cgggcagagaggaactaggaagtaa

SEQ ID NO: 261612 - DNA, 25 bp, Mus musculus
cgggcagagcaggccaaggagatcc

SEQ ID NO: 261613 - DNA, 25 bp, Mus musculus
cgggcagagctcaggatttctggta

SEQ ID NO: 261614 - DNA, 25 bp, Mus musculus
cgggcagaggcggaacgtgatgtcc

SEQ ID NO: 261615 - DNA, 25 bp, Mus musculus
cgggcagaggcgtaacgtgatgtcc

SEQ ID NO: 261616 - DNA, 25 bp, Mus musculus
cgggcagagggaatccggagatcgt

SEQ ID NO: 261617 - DNA, 25 bp, Mus musculus
cgggcagatcagctgtcctggaaga

SEQ ID NO: 261618 - DNA, 25 bp, Mus musculus
cgggcagatcagtccgcactggaga

SEQ ID NO: 261619 - DNA, 25 bp, Mus musculus
cgggcagatcctgccccgtcccagc

SEQ ID NO: 261620 - DNA, 25 bp, Mus musculus
cgggcagcagagttcattccgacag

SEQ ID NO: 261621 - DNA, 25 bp, Mus musculus
cgggcagcagcttggcaaatggtcc

SEQ ID NO: 261622 - DNA, 25 bp, Mus musculus
cgggcagcaggtcactacgttcacg

SEQ ID NO: 261623 - DNA, 25 bp, Mus musculus
cgggcagcagtgacagccctgctga

SEQ ID NO: 261624 - DNA, 25 bp, Mus musculus
cgggcagccaaacagcccatcacgg

SEQ ID NO: 261625 - DNA, 25 bp, Mus musculus
cgggcagccaggcaccacctaccct

SEQ ID NO: 261626 - DNA, 25 bp, Mus musculus
cgggcagccatgaggcggcaggccc

SEQ ID NO: 261627 - DNA, 25 bp, Mus musculus
cgggcagcgatacgcttgcctggtt

SEQ ID NO: 261628 - DNA, 25 bp, Mus musculus
cgggcagcgatacggctttggacct

SEQ ID NO: 261629 - DNA, 25 bp, Mus musculus
cgggcagcgcaggtatcgccaggcc

SEQ ID NO: 261630 - DNA, 25 bp, Mus musculus
cgggcagcgcaggtgccccgtgctc

SEQ ID NO: 261631 - DNA, 25 bp, Mus musculus
cgggcagcgcgcgcagagacactgt

SEQ ID NO: 261632 - DNA, 25 bp, Mus musculus
cgggcagcggcctggaggagggacg

SEQ ID NO: 261633 - DNA, 25 bp, Mus musculus
cgggcagctccccctctacctggaa

SEQ ID NO: 261634 - DNA, 25 bp, Mus musculus
cgggcagctgcccacggagcagccc

SEQ ID NO: 261635 - DNA, 25 bp, Mus musculus
cgggcagctgtgtgcctgctttggt

SEQ ID NO: 261636 - DNA, 25 bp, Mus musculus
cgggcaggcagtatgggcttatttt

SEQ ID NO: 261637 - DNA, 25 bp, Mus musculus
cgggcaggcctgtgataagacgctg

SEQ ID NO: 261638 - DNA, 25 bp, Mus musculus
cgggcaggcctgtgctcatatgaaa

SEQ ID NO: 261639 - DNA, 25 bp, Mus musculus
cgggcaggctcgatggctcccgcaa

SEQ ID NO: 261640 - DNA, 25 bp, Mus musculus
cgggcagggatttcagccatggctg

SEQ ID NO: 261641 - DNA, 25 bp, Mus musculus
cgggcagtctgggcctgccacccct

SEQ ID NO: 261642 - DNA, 25 bp, Mus musculus
cgggcagtctgggctgctggctcta

SEQ ID NO: 261643 - DNA, 25 bp, Mus musculus
cgggcagtggctcagctctgccatt

SEQ ID NO: 261644 - DNA, 25 bp, Mus musculus
cgggcagtgtgagctagcccttctt

SEQ ID NO: 261645 - DNA, 25 bp, Mus musculus
cgggcagtgtgagtgatttccggtg

SEQ ID NO: 261646 - DNA, 25 bp, Mus musculus
cgggcagttcaagccaaccatctgc

SEQ ID NO: 261647 - DNA, 25 bp, Mus musculus
cgggcatatcaagaatgctgtgaac

SEQ ID NO: 261648 - DNA, 25 bp, Mus musculus
cgggcatccttgactccaagcgggg

SEQ ID NO: 261649 - DNA, 25 bp, Mus musculus
cgggcatctctgagctcatgaccca

SEQ ID NO: 261650 - DNA, 25 bp, Mus musculus
cgggcatctctgaggtccgatctga

SEQ ID NO: 261651 - DNA, 25 bp, Mus musculus
cgggcatctgtgggcatgtatttaa

SEQ ID NO: 261652 - DNA, 25 bp, Mus musculus
cgggcatcttcaactccgagctgga

SEQ ID NO: 261653 - DNA, 25 bp, Mus musculus
cgggcatgagccaaagcctgcgcga

SEQ ID NO: 261654 - DNA, 25 bp, Mus musculus
cgggcatggcagccaaagcttaatt

SEQ ID NO: 261655 - DNA, 25 bp, Mus musculus
cgggcattgcagatggaaggattac

SEQ ID NO: 261656 - DNA, 25 bp, Mus musculus
cgggcattgcagcgtgcaatgatgc

SEQ ID NO: 261657 - DNA, 25 bp, Mus musculus
cgggcattgcccaggtgaaaatcca

SEQ ID NO: 261658 - DNA, 25 bp, Mus musculus
cgggccaaagaagattgcagagttc

SEQ ID NO: 261659 - DNA, 25 bp, Mus musculus
cgggccaaattcactgctttctgtg

SEQ ID NO: 261660 - DNA, 25 bp, Mus musculus
cgggccaaattcactgtatataaaa

SEQ ID NO: 261661 - DNA, 25 bp, Mus musculus
cgggccaagtctcgggtggatgaaa

SEQ ID NO: 261662 - DNA, 25 bp, Mus musculus
cgggccacagctgctaactctcttc

SEQ ID NO: 261663 - DNA, 25 bp, Mus musculus
cgggccaccagcaggccgaggaaag

SEQ ID NO: 261664 - DNA, 25 bp, Mus musculus
cgggccaccaggctattacaagcca

SEQ ID NO: 261665 - DNA, 25 bp, Mus musculus
cgggccacgtgcaggaaacatccga

SEQ ID NO: 261666 - DNA, 25 bp, Mus musculus
cgggccactcaaggttttgaggact

SEQ ID NO: 261667 - DNA, 25 bp, Mus musculus
cgggccagacctcagctcgcatcca

SEQ ID NO: 261668 - DNA, 25 bp, Mus musculus
cgggccagactcaggtatctgctat

SEQ ID NO: 261669 - DNA, 25 bp, Mus musculus
cgggccagcaaatagatcagagcca

SEQ ID NO: 261670 - DNA, 25 bp, Mus musculus
cgggccagcaaatagttccagggtc

SEQ ID NO: 261671 - DNA, 25 bp, Mus musculus
cgggccagctggctctggaatcatg

SEQ ID NO: 261672 - DNA, 25 bp, Mus musculus
cgggcccagtgcagcaggccacgcg

SEQ ID NO: 261673 - DNA, 25 bp, Mus musculus
cgggcccagtgcagcgctgtagcat

SEQ ID NO: 261674 - DNA, 25 bp, Mus musculus
cgggcccatggaatccaaaactacc

SEQ ID NO: 261675 - DNA, 25 bp, Mus musculus
cgggccccggacagagacagggcag

SEQ ID NO: 261676 - DNA, 25 bp, Mus musculus
cgggcccgcagtgtgagtgcctgct

SEQ ID NO: 261677 - DNA, 25 bp, Mus musculus
cgggcccgcagtgtggaggcagttg

SEQ ID NO: 261678 - DNA, 25 bp, Mus musculus
cgggcccgggagcaggctgaagctg

SEQ ID NO: 261679 - DNA, 25 bp, Mus musculus
cgggcccgggccgcgccatgggctg

SEQ ID NO: 261680 - DNA, 25 bp, Mus musculus
cgggcccgtgaggtggtgatgcttt

SEQ ID NO: 261681 - DNA, 25 bp, Mus musculus
cgggcccgtgagttcatattctttg

SEQ ID NO: 261682 - DNA, 25 bp, Mus musculus
cgggccctagcgcggaaacatcatc

SEQ ID NO: 261683 - DNA, 25 bp, Mus musculus
cgggccctagcgcgggctgggaagg

SEQ ID NO: 261684 - DNA, 25 bp, Mus musculus
cgggccctcagccctaccagcagta

SEQ ID NO: 261685 - DNA, 25 bp, Mus musculus
cgggccctcagtgagttgcagacat

SEQ ID NO: 261686 - DNA, 25 bp, Mus musculus
cgggccctgacgatctgctggtatc

SEQ ID NO: 261687 - DNA, 25 bp, Mus musculus
cgggccctgcaggaggacctggcgc

SEQ ID NO: 261688 - DNA, 25 bp, Mus musculus
cgggcccttgaagccacccgcggtc

SEQ ID NO: 261689 - DNA, 25 bp, Mus musculus
cgggcccttgaagcgcggctgggtt

SEQ ID NO: 261690 - DNA, 25 bp, Mus musculus
cgggcccttttcagtgagaaagcgc

SEQ ID NO: 261691 - DNA, 25 bp, Mus musculus
cgggccgccaaggtatgccatcatg

SEQ ID NO: 261692 - DNA, 25 bp, Mus musculus
cgggccgccagatagaaggacaagg

SEQ ID NO: 261693 - DNA, 25 bp, Mus musculus
cgggccgccatatgagacggtttaa

SEQ ID NO: 261694 - DNA, 25 bp, Mus musculus
cgggccgccatattcattccttgga

SEQ ID NO: 261695 - DNA, 25 bp, Mus musculus
cgggccgcctgcgcggctggccagc

SEQ ID NO: 261696 - DNA, 25 bp, Mus musculus
cgggccgcgacatggactgtcctgt

SEQ ID NO: 261697 - DNA, 25 bp, Mus musculus
cgggccgctcgatgaacctctagtc

SEQ ID NO: 261698 - DNA, 25 bp, Mus musculus
cgggccggaaaagacaaggaccagc

SEQ ID NO: 261699 - DNA, 25 bp, Mus musculus
cgggccggaccgagaaagggctatg

SEQ ID NO: 261700 - DNA, 25 bp, Mus musculus
cgggccggaccgcacagagaatgaa

SEQ ID NO: 261701 - DNA, 25 bp, Mus musculus
cgggccggcgaaatggcaaaatgtc

SEQ ID NO: 261702 - DNA, 25 bp, Mus musculus
cgggccggcgccgggagtcctgttg

SEQ ID NO: 261703 - DNA, 25 bp, Mus musculus
cgggccgtagggctgttgacctatc

SEQ ID NO: 261704 - DNA, 25 bp, Mus musculus
cgggccgtgggaaatgcagttatca

SEQ ID NO: 261705 - DNA, 25 bp, Mus musculus
cgggccgtgggctgcccagctggtc

SEQ ID NO: 261706 - DNA, 25 bp, Mus musculus
cgggccgtgtgagagattggtgtcc

SEQ ID NO: 261707 - DNA, 25 bp, Mus musculus
cgggcctacacctcggagacctacc

SEQ ID NO: 261708 - DNA, 25 bp, Mus musculus
cgggcctaccaggataaggaagcct

SEQ ID NO: 261709 - DNA, 25 bp, Mus musculus
cgggcctcaggaaccaatgacaagc

SEQ ID NO: 261710 - DNA, 25 bp, Mus musculus
cgggcctcaggcctcagcatttatc

SEQ ID NO: 261711 - DNA, 25 bp, Mus musculus
cgggcctcagtcttatgacctgaag

SEQ ID NO: 261712 - DNA, 25 bp, Mus musculus
cgggcctccccagcagtcctttgag

SEQ ID NO: 261713 - DNA, 25 bp, Mus musculus
cgggcctctaggaaggtatggcctc

SEQ ID NO: 261714 - DNA, 25 bp, Mus musculus
cgggcctctgagaaggagcgcagac

SEQ ID NO: 261715 - DNA, 25 bp, Mus musculus
cgggcctctgtgtggatgccttcaa

SEQ ID NO: 261716 - DNA, 25 bp, Mus musculus
cgggcctctgtgtgggtactatctt

SEQ ID NO: 261717 - DNA, 25 bp, Mus musculus
cgggcctgaagccggtcgacaatgg

SEQ ID NO: 261718 - DNA, 25 bp, Mus musculus
cgggcctgagcattggaaacaagct

SEQ ID NO: 261719 - DNA, 25 bp, Mus musculus
cgggccttccgctctgtgcctcact

SEQ ID NO: 261720 - DNA, 25 bp, Mus musculus
cgggcgacaggaagaactaggaagg

SEQ ID NO: 261721 - DNA, 25 bp, Mus musculus
cgggcgacaggtggtttcactccag

SEQ ID NO: 261722 - DNA, 25 bp, Mus musculus
cgggcgaccagccaggtcccagtga

SEQ ID NO: 261723 - DNA, 25 bp, Mus musculus
cgggcgaccaggacctataagaaca

SEQ ID NO: 261724 - DNA, 25 bp, Mus musculus
cgggcgacggcgctatggtggattg

SEQ ID NO: 261725 - DNA, 25 bp, Mus musculus
cgggcgactcaggcaccatgagcca

SEQ ID NO: 261726 - DNA, 25 bp, Mus musculus
cgggcgagcagagcagacccaggag

SEQ ID NO: 261727 - DNA, 25 bp, Mus musculus
cgggcgagcaggtggaagggactca

SEQ ID NO: 261728 - DNA, 25 bp, Mus musculus
cgggcgagctgtaaaagctggcagg

SEQ ID NO: 261729 - DNA, 25 bp, Mus musculus
cgggcgcaaggcctctctttctgat

SEQ ID NO: 261730 - DNA, 25 bp, Mus musculus
cgggcgcagagaagagcaccctcca

SEQ ID NO: 261731 - DNA, 25 bp, Mus musculus
cgggcgcagagaaggtcctaaaggg

SEQ ID NO: 261732 - DNA, 25 bp, Mus musculus
cgggcgcggagcagggcggcgagtc

SEQ ID NO: 261733 - DNA, 25 bp, Mus musculus
cgggcgctacagggcttttctccag

SEQ ID NO: 261734 - DNA, 25 bp, Mus musculus
cgggcgctacaggtggacaacatca

SEQ ID NO: 261735 - DNA, 25 bp, Mus musculus
cgggcgctaggtccgtctcccaggg

SEQ ID NO: 261736 - DNA, 25 bp, Mus musculus
cgggcgctgcacgccttcagagacg

SEQ ID NO: 261737 - DNA, 25 bp, Mus musculus
cgggcgctgcaggggctgacatgga

SEQ ID NO: 261738 - DNA, 25 bp, Mus musculus
cgggcgctgggcagacgaaagagcc

SEQ ID NO: 261739 - DNA, 25 bp, Mus musculus
cgggcgctgggcagtccattctctt

SEQ ID NO: 261740 - DNA, 25 bp, Mus musculus
cgggcggagccagatttagatgaaa

SEQ ID NO: 261741 - DNA, 25 bp, Mus musculus
cgggcggaggccgcgtgtaatgttc

SEQ ID NO: 261742 - DNA, 25 bp, Mus musculus
cgggcggcaggacctgctagaagtg

SEQ ID NO: 261743 - DNA, 25 bp, Mus musculus
cgggcggcagtgccatggcagaaca

SEQ ID NO: 261744 - DNA, 25 bp, Mus musculus
cgggcggccagccttgcactatgtc

SEQ ID NO: 261745 - DNA, 25 bp, Mus musculus
cgggcggccgtcaggagcagccatg

SEQ ID NO: 261746 - DNA, 25 bp, Mus musculus
cgggcggcgccaggtctgaccaccc

SEQ ID NO: 261747 - DNA, 25 bp, Mus musculus
cgggcggcggagagttgtctgctgg

SEQ ID NO: 261748 - DNA, 25 bp, Mus musculus
cgggcggcggtgcagatttcttgac

SEQ ID NO: 261749 - DNA, 25 bp, Mus musculus
cgggcggctgacagcgtcctgaggt

SEQ ID NO: 261750 - DNA, 25 bp, Mus musculus
cgggcggctgacaggttcttacagt

SEQ ID NO: 261751 - DNA, 25 bp, Mus musculus
cgggcgggactggtctccaaaaatg

SEQ ID NO: 261752 - DNA, 25 bp, Mus musculus
cgggcgggcgcagagctgagatact

SEQ ID NO: 261753 - DNA, 25 bp, Mus musculus
cgggcgggcgcagtgttatccacac

SEQ ID NO: 261754 - DNA, 25 bp, Mus musculus
cgggcgtaacaagccgcattttctg

SEQ ID NO: 261755 - DNA, 25 bp, Mus musculus
cgggcgtgccgacagactaacctaa

SEQ ID NO: 261756 - DNA, 25 bp, Mus musculus
cgggcgtgccgacaggagatgattt

SEQ ID NO: 261757 - DNA, 25 bp, Mus musculus
cgggcgttaaagctctcgtggcgct

SEQ ID NO: 261758 - DNA, 25 bp, Mus musculus
cgggctaacatgaagctgttctttc

SEQ ID NO: 261759 - DNA, 25 bp, Mus musculus
cgggctaacatgaaggcagacaagt

SEQ ID NO: 261760 - DNA, 25 bp, Mus musculus
cgggctaactggactcatgcagtgg

SEQ ID NO: 261761 - DNA, 25 bp, Mus musculus
cgggctaatgggaagagtacatctc

SEQ ID NO: 261762 - DNA, 25 bp, Mus musculus
cgggctacaggttgcgttacagtaa

SEQ ID NO: 261763 - DNA, 25 bp, Mus musculus
cgggctagcgcatttcagatctgct

SEQ ID NO: 261764 - DNA, 25 bp, Mus musculus
cgggctatgagatattactacaaac

SEQ ID NO: 261765 - DNA, 25 bp, Mus musculus
cgggctatgagccaacttccatgag

SEQ ID NO: 261766 - DNA, 25 bp, Mus musculus
cgggctcaaaatgtgcctctcccag

SEQ ID NO: 261767 - DNA, 25 bp, Mus musculus
cgggctcacattaatatttgccaat

SEQ ID NO: 261768 - DNA, 25 bp, Mus musculus
cgggctcaccttgaaaatgaagtcc

SEQ ID NO: 261769 - DNA, 25 bp, Mus musculus
cgggctcaccttgtgttcgacttcc

SEQ ID NO: 261770 - DNA, 25 bp, Mus musculus
cgggctcacggagggaccaacatca

SEQ ID NO: 261771 - DNA, 25 bp, Mus musculus
cgggctcagtggatgagaccctttt

SEQ ID NO: 261772 - DNA, 25 bp, Mus musculus
cgggctcagtggttgttgacctcct

SEQ ID NO: 261773 - DNA, 25 bp, Mus musculus
cgggctccagaggcgtccggtcgca

SEQ ID NO: 261774 - DNA, 25 bp, Mus musculus
cgggctcccctcaggctggcctgcc

SEQ ID NO: 261775 - DNA, 25 bp, Mus musculus
cgggctcccctcagggtcatgtagg

SEQ ID NO: 261776 - DNA, 25 bp, Mus musculus
cgggctccctttgggttctcaggcc

SEQ ID NO: 261777 - DNA, 25 bp, Mus musculus
cgggctcctgaggcatggaggggtc

SEQ ID NO: 261778 - DNA, 25 bp, Mus musculus
cgggctcctgcggcaaggggacatg

SEQ ID NO: 261779 - DNA, 25 bp, Mus musculus
cgggctcggaggtccctgacccttg

SEQ ID NO: 261780 - DNA, 25 bp, Mus musculus
cgggctcgggaatgggaaacagcac

SEQ ID NO: 261781 - DNA, 25 bp, Mus musculus
cgggctctccaggggaaaataagtc

SEQ ID NO: 261782 - DNA, 25 bp, Mus musculus
cgggctctggaggtacccactgatg

SEQ ID NO: 261783 - DNA, 25 bp, Mus musculus
cgggctctgtaggttgtgaaccatg

SEQ ID NO: 261784 - DNA, 25 bp, Mus musculus
cgggctgaggagcatgaacggtgcc

SEQ ID NO: 261785 - DNA, 25 bp, Mus musculus
cgggctgatcgaaaaggactctaat

SEQ ID NO: 261786 - DNA, 25 bp, Mus musculus
cgggctgatcgtgaccatctttcca

SEQ ID NO: 261787 - DNA, 25 bp, Mus musculus
cgggctgattccagttacttcctgc

SEQ ID NO: 261788 - DNA, 25 bp, Mus musculus
cgggctgattgtagacaccggtacc

SEQ ID NO: 261789 - DNA, 25 bp, Mus musculus
cgggctgcaaccatgagaccagcac

SEQ ID NO: 261790 - DNA, 25 bp, Mus musculus
cgggctgcaaccatgatcaagcact

SEQ ID NO: 261791 - DNA, 25 bp, Mus musculus
cgggctgcaaccatggatgacaagg

SEQ ID NO: 261792 - DNA, 25 bp, Mus musculus
cgggctgcagatgggcaccaacaag

SEQ ID NO: 261793 - DNA, 25 bp, Mus musculus
cgggctgcagatttattgccaagcc

SEQ ID NO: 261794 - DNA, 25 bp, Mus musculus
cgggctgcagccgatacgacaaata

SEQ ID NO: 261795 - DNA, 25 bp, Mus musculus
cgggctgcagccggaaggatccctg

SEQ ID NO: 261796 - DNA, 25 bp, Mus musculus
cgggctgcctggcgtggccgagaag

SEQ ID NO: 261797 - DNA, 25 bp, Mus musculus
cgggctgcctgtctccctccagagg

SEQ ID NO: 261798 - DNA, 25 bp, Mus musculus
cgggctgcgcggttggacgagtgac

SEQ ID NO: 261799 - DNA, 25 bp, Mus musculus
cgggctgcgtggcattgtcgccagc

SEQ ID NO: 261800 - DNA, 25 bp, Mus musculus
cgggctgcgttgagatttggtgact

SEQ ID NO: 261801 - DNA, 25 bp, Mus musculus
cgggctgctccaagcagtgcctggc

SEQ ID NO: 261802 - DNA, 25 bp, Mus musculus
cgggctgctggaaagggataaacag

SEQ ID NO: 261803 - DNA, 25 bp, Mus musculus
cgggctgcttagttcaaaccggagg

SEQ ID NO: 261804 - DNA, 25 bp, Mus musculus
cgggctggcctacattctaaggtga

SEQ ID NO: 261805 - DNA, 25 bp, Mus musculus
cgggctgggacaggaaatgctgtca

SEQ ID NO: 261806 - DNA, 25 bp, Mus musculus
cgggctggtgagaagacgcttccca

SEQ ID NO: 261807 - DNA, 25 bp, Mus musculus
cgggctggtgctgcatgggctcccc

SEQ ID NO: 261808 - DNA, 25 bp, Mus musculus
cgggctgtgaccgagatcaagatcc

SEQ ID NO: 261809 - DNA, 25 bp, Mus musculus
cgggctgtgaccgaggttgaacatt

SEQ ID NO: 261810 - DNA, 25 bp, Mus musculus
cgggctgtgagccggtgatctctgg

SEQ ID NO: 261811 - DNA, 25 bp, Mus musculus
cgggctgttgaggatgtgctcgaga

SEQ ID NO: 261812 - DNA, 25 bp, Mus musculus
cgggcttagggtggagcgaccctgt

SEQ ID NO: 261813 - DNA, 25 bp, Mus musculus
cgggcttcagggggctgaggcgatg

SEQ ID NO: 261814 - DNA, 25 bp, Mus musculus
cgggcttcaggtagaagccactcat

SEQ ID NO: 261815 - DNA, 25 bp, Mus musculus
cgggcttcaggtgaggatcccattt

SEQ ID NO: 261816 - DNA, 25 bp, Mus musculus
cgggcttcagtgctggaggaggcca

SEQ ID NO: 261817 - DNA, 25 bp, Mus musculus
cgggcttccagacgatactgtatcc

SEQ ID NO: 261818 - DNA, 25 bp, Mus musculus
cgggcttcgccatgcagtggccccg

SEQ ID NO: 261819 - DNA, 25 bp, Mus musculus
cgggcttcgccatggtggccatggt

SEQ ID NO: 261820 - DNA, 25 bp, Mus musculus
cgggcttgggcccagagtatgttcc

SEQ ID NO: 261821 - DNA, 25 bp, Mus musculus
cgggctttatcaggtcctcatgggt

SEQ ID NO: 261822 - DNA, 25 bp, Mus musculus
cggggaaacaatggagaagtgtacc

SEQ ID NO: 261823 - DNA, 25 bp, Mus musculus
cggggaaagctgacggacgaatgct

SEQ ID NO: 261824 - DNA, 25 bp, Mus musculus
cggggaaaggaatggatggctgtca

SEQ ID NO: 261825 - DNA, 25 bp, Mus musculus
cggggaaagggatgattctgaggat

SEQ ID NO: 261826 - DNA, 25 bp, Mus musculus
cggggaaatggactcagtggctttt

SEQ ID NO: 261827 - DNA, 25 bp, Mus musculus
cggggaaccagtgggaggtgggact

SEQ ID NO: 261828 - DNA, 25 bp, Mus musculus
cggggaaccagtggtgactgccctg

SEQ ID NO: 261829 - DNA, 25 bp, Mus musculus
cggggaacggtaatcccgctcaaga

SEQ ID NO: 261830 - DNA, 25 bp, Mus musculus
cggggaagatgtgccagcctgcccc

SEQ ID NO: 261831 - DNA, 25 bp, Mus musculus
cggggaagctggagggaagaagaag

SEQ ID NO: 261832 - DNA, 25 bp, Mus musculus
cggggaatgacagccgccgccatga

SEQ ID NO: 261833 - DNA, 25 bp, Mus musculus
cggggaatgggagagatgcagaaag

SEQ ID NO: 261834 - DNA, 25 bp, Mus musculus
cggggaatgggagagcttttgccta

SEQ ID NO: 261835 - DNA, 25 bp, Mus musculus
cggggaattcactccagatctctat

SEQ ID NO: 261836 - DNA, 25 bp, Mus musculus
cggggaattcactggaattcctgag

SEQ ID NO: 261837 - DNA, 25 bp, Mus musculus
cggggacaacaccagcgactgctgt

SEQ ID NO: 261838 - DNA, 25 bp, Mus musculus
cggggacaagggtgacaagggagat

SEQ ID NO: 261839 - DNA, 25 bp, Mus musculus
cggggacattcaggttggctcctgt

SEQ ID NO: 261840 - DNA, 25 bp, Mus musculus
cggggaccagctgggcccccagcat

SEQ ID NO: 261841 - DNA, 25 bp, Mus musculus
cggggaccaggagcttttccagacc

SEQ ID NO: 261842 - DNA, 25 bp, Mus musculus
cggggacccagccagccccggaaag

SEQ ID NO: 261843 - DNA, 25 bp, Mus musculus
cggggacccaggcgatcaaccgaga

SEQ ID NO: 261844 - DNA, 25 bp, Mus musculus
cggggaccccggattgcacaggcat

SEQ ID NO: 261845 - DNA, 25 bp, Mus musculus
cggggacccgcgaggagttggcatc

SEQ ID NO: 261846 - DNA, 25 bp, Mus musculus
cggggacccgcgaggcaagcagtct

SEQ ID NO: 261847 - DNA, 25 bp, Mus musculus
cggggacctcctgggcattgtcgcc

SEQ ID NO: 261848 - DNA, 25 bp, Mus musculus
cggggacgagatgatttttgatcct

SEQ ID NO: 261849 - DNA, 25 bp, Mus musculus
cggggacgcaatgtgtctggaattc

SEQ ID NO: 261850 - DNA, 25 bp, Mus musculus
cggggacgcggcgatctgccaggat

SEQ ID NO: 261851 - DNA, 25 bp, Mus musculus
cggggacgcggcgcacacagggcca

SEQ ID NO: 261852 - DNA, 25 bp, Mus musculus
cggggactaacaggactccaagccc

SEQ ID NO: 261853 - DNA, 25 bp, Mus musculus
cggggactcgcggagatcgtaccga

SEQ ID NO: 261854 - DNA, 25 bp, Mus musculus
cggggactgagcggtcttgacgaag

SEQ ID NO: 261855 - DNA, 25 bp, Mus musculus
cggggactggaaagatggagccagc

SEQ ID NO: 261856 - DNA, 25 bp, Mus musculus
cggggactggacacctgggctgtcc

SEQ ID NO: 261857 - DNA, 25 bp, Mus musculus
cggggactggacagatggagccagc

SEQ ID NO: 261858 - DNA, 25 bp, Mus musculus
cggggactggagggcttcgtggcgg

SEQ ID NO: 261859 - DNA, 25 bp, Mus musculus
cggggactggagggcttctcattcc

SEQ ID NO: 261860 - DNA, 25 bp, Mus musculus
cggggactgtcggatagggacttac

SEQ ID NO: 261861 - DNA, 25 bp, Mus musculus
cggggactgtcggggtacagcatgt

SEQ ID NO: 261862 - DNA, 25 bp, Mus musculus
cggggagaaaagctggcactcgact

SEQ ID NO: 261863 - DNA, 25 bp, Mus musculus
cggggagaacccagatgagatggac

SEQ ID NO: 261864 - DNA, 25 bp, Mus musculus
cggggagaagaactggagaatttga

SEQ ID NO: 261865 - DNA, 25 bp, Mus musculus
cggggagaagacctgtgtagatctt

SEQ ID NO: 261866 - DNA, 25 bp, Mus musculus
cggggagagccttttccagggctcc

SEQ ID NO: 261867 - DNA, 25 bp, Mus musculus
cggggagagctaggtcacttgtcca

SEQ ID NO: 261868 - DNA, 25 bp, Mus musculus
cggggagagctagttgctgcttcaa

SEQ ID NO: 261869 - DNA, 25 bp, Mus musculus
cggggagaggccaacttatttgtcc

SEQ ID NO: 261870 - DNA, 25 bp, Mus musculus
cggggagaggggcgtagtggcaaca

SEQ ID NO: 261871 - DNA, 25 bp, Mus musculus
cggggagaggtgggaaaagcttgtt

SEQ ID NO: 261872 - DNA, 25 bp, Mus musculus
cggggagatggtggcctggagagct

SEQ ID NO: 261873 - DNA, 25 bp, Mus musculus
cggggagcagaccaggtgactggtt

SEQ ID NO: 261874 - DNA, 25 bp, Mus musculus
cggggagcagaccagtaggggcaag

SEQ ID NO: 261875 - DNA, 25 bp, Mus musculus
cggggagccgcacgtgtcctgggtc

SEQ ID NO: 261876 - DNA, 25 bp, Mus musculus
cggggagccgggggcactatgaacg

SEQ ID NO: 261877 - DNA, 25 bp, Mus musculus
cggggagcggccagagtatggcttc

SEQ ID NO: 261878 - DNA, 25 bp, Mus musculus
cggggagcggccaggtgtaagagtg

SEQ ID NO: 261879 - DNA, 25 bp, Mus musculus
cggggagctggaggggaacctgatt

SEQ ID NO: 261880 - DNA, 25 bp, Mus musculus
cggggaggctggggaaggaagccag

SEQ ID NO: 261881 - DNA, 25 bp, Mus musculus
cggggaggctggtgcaaacagctgc

SEQ ID NO: 261882 - DNA, 25 bp, Mus musculus
cggggagggcaccaggtcactactt

SEQ ID NO: 261883 - DNA, 25 bp, Mus musculus
cggggagtccctgtgcgatgactgt

SEQ ID NO: 261884 - DNA, 25 bp, Mus musculus
cggggagtccctgtgtgacctcttg

SEQ ID NO: 261885 - DNA, 25 bp, Mus musculus
cggggagtgaggggagctaccgtca

SEQ ID NO: 261886 - DNA, 25 bp, Mus musculus
cggggatacagaacatctcccggga

SEQ ID NO: 261887 - DNA, 25 bp, Mus musculus
cggggatacagctttggggcgatgg

SEQ ID NO: 261888 - DNA, 25 bp, Mus musculus
cggggatcaggaggttgagaacaaa

SEQ ID NO: 261889 - DNA, 25 bp, Mus musculus
cggggatcagggcagagatggcctt

SEQ ID NO: 261890 - DNA, 25 bp, Mus musculus
cggggatgacttcagggactcacca

SEQ ID NO: 261891 - DNA, 25 bp, Mus musculus
cggggatgacttccgggactcacca

SEQ ID NO: 261892 - DNA, 25 bp, Mus musculus
cggggatggtcgaggacttgcacta

SEQ ID NO: 261893 - DNA, 25 bp, Mus musculus
cggggattacaggttaaaatgagct

SEQ ID NO: 261894 - DNA, 25 bp, Mus musculus
cggggattatcgggctcagcgttgt

SEQ ID NO: 261895 - DNA, 25 bp, Mus musculus
cggggattatcggggaagcgtttct

SEQ ID NO: 261896 - DNA, 25 bp, Mus musculus
cggggcaaaatggagctcgacgcca

SEQ ID NO: 261897 - DNA, 25 bp, Mus musculus
cggggcaagtgcatttggcacaata

SEQ ID NO: 261898 - DNA, 25 bp, Mus musculus
cggggcaatacaatgaggagactga

SEQ ID NO: 261899 - DNA, 25 bp, Mus musculus
cggggcaatacattgctatagctca

SEQ ID NO: 261900 - DNA, 25 bp, Mus musculus
cggggcagaagagattgtggatggc

SEQ ID NO: 261901 - DNA, 25 bp, Mus musculus
cggggcagcggaagaccagactctg

SEQ ID NO: 261902 - DNA, 25 bp, Mus musculus
cggggcaggtgcccatgttggaaga

SEQ ID NO: 261903 - DNA, 25 bp, Mus musculus
cggggcatagccaccccgctggggt

SEQ ID NO: 261904 - DNA, 25 bp, Mus musculus
cggggcatccgggactaggctctgt

SEQ ID NO: 261905 - DNA, 25 bp, Mus musculus
cggggcatgtagagtgatcgatggc

SEQ ID NO: 261906 - DNA, 25 bp, Mus musculus
cggggccactaccgacatctagagc

SEQ ID NO: 261907 - DNA, 25 bp, Mus musculus
cggggccactaccgcacggactccc

SEQ ID NO: 261908 - DNA, 25 bp, Mus musculus
cggggccagctgagcaattgtgttc

SEQ ID NO: 261909 - DNA, 25 bp, Mus musculus
cggggccagtagagtatagaaatat

SEQ ID NO: 261910 - DNA, 25 bp, Mus musculus
cggggccagtaggtccaatcagcat

SEQ ID NO: 261911 - DNA, 25 bp, Mus musculus
cggggccatcgatgtgcagaagacc

SEQ ID NO: 261912 - DNA, 25 bp, Mus musculus
cggggccatcgtgattcgagtcatc

SEQ ID NO: 261913 - DNA, 25 bp, Mus musculus
cggggccccagctgtttcagccatg

SEQ ID NO: 261914 - DNA, 25 bp, Mus musculus
cggggcccttggaagattggctctt

SEQ ID NO: 261915 - DNA, 25 bp, Mus musculus
cggggccgcagcctggtaacgaagg

SEQ ID NO: 261916 - DNA, 25 bp, Mus musculus
cggggccgcagcctgttgggcaagg

SEQ ID NO: 261917 - DNA, 25 bp, Mus musculus
cggggccgcaggaggcccagcctcg

SEQ ID NO: 261918 - DNA, 25 bp, Mus musculus
cggggccgtgaggaggataaaagca

SEQ ID NO: 261919 - DNA, 25 bp, Mus musculus
cggggccgtgaggtatccagctcat

SEQ ID NO: 261920 - DNA, 25 bp, Mus musculus
cggggcctcggaaccgtctggatct

SEQ ID NO: 261921 - DNA, 25 bp, Mus musculus
cggggcgagagtgggctgtaaaaaa

SEQ ID NO: 261922 - DNA, 25 bp, Mus musculus
cggggcgagcgaagtaagcggaggc

SEQ ID NO: 261923 - DNA, 25 bp, Mus musculus
cggggcgaggccgatactccatgtt

SEQ ID NO: 261924 - DNA, 25 bp, Mus musculus
cggggcgcagctgggcaccacaaga

SEQ ID NO: 261925 - DNA, 25 bp, Mus musculus
cggggcgcgaggtgcagggaagggg

SEQ ID NO: 261926 - DNA, 25 bp, Mus musculus
cggggcgcgcggtgtgaagaaaaag

SEQ ID NO: 261927 - DNA, 25 bp, Mus musculus
cggggcgctgacaggtactgggttt

SEQ ID NO: 261928 - DNA, 25 bp, Mus musculus
cggggcggacagacctacgcaatga

SEQ ID NO: 261929 - DNA, 25 bp, Mus musculus
cggggcggacagatctgacacacat

SEQ ID NO: 261930 - DNA, 25 bp, Mus musculus
cggggcggagtttgatggtgacagt

SEQ ID NO: 261931 - DNA, 25 bp, Mus musculus
cggggcgggacccagctgaccttaa

SEQ ID NO: 261932 - DNA, 25 bp, Mus musculus
cggggcgtagctctggtgcaccctc

SEQ ID NO: 261933 - DNA, 25 bp, Mus musculus
cggggcgtagctctgttcccacttc

SEQ ID NO: 261934 - DNA, 25 bp, Mus musculus
cggggcgtgggattgaagtgagtga

SEQ ID NO: 261935 - DNA, 25 bp, Mus musculus
cggggctacaggctcaccatcatgg

SEQ ID NO: 261936 - DNA, 25 bp, Mus musculus
cggggctcacaccgacctgagaaat

SEQ ID NO: 261937 - DNA, 25 bp, Mus musculus
cggggctcacaccgactgcgtaatt

SEQ ID NO: 261938 - DNA, 25 bp, Mus musculus
cggggctcacaccgataaccctaac

SEQ ID NO: 261939 - DNA, 25 bp, Mus musculus
cggggctcacgagaatcatcattca

SEQ ID NO: 261940 - DNA, 25 bp, Mus musculus
cggggctcacgtttcagatgagtga

SEQ ID NO: 261941 - DNA, 25 bp, Mus musculus
cggggctccccgcctccgctgaaga

SEQ ID NO: 261942 - DNA, 25 bp, Mus musculus
cggggctcctgatgtcactggtctc

SEQ ID NO: 261943 - DNA, 25 bp, Mus musculus
cggggctctggcaaggactcacaca

SEQ ID NO: 261944 - DNA, 25 bp, Mus musculus
cggggctctggcaaggtaccctggc

SEQ ID NO: 261945 - DNA, 25 bp, Mus musculus
cggggctgacagatcaacttatgag

SEQ ID NO: 261946 - DNA, 25 bp, Mus musculus
cggggctgagctggctagagatctg

SEQ ID NO: 261947 - DNA, 25 bp, Mus musculus
cggggctgcaggtcacagcggagtg

SEQ ID NO: 261948 - DNA, 25 bp, Mus musculus
cggggctgcgaggggcatgaaggat

SEQ ID NO: 261949 - DNA, 25 bp, Mus musculus
cggggctgctcccagcatggcggac

SEQ ID NO: 261950 - DNA, 25 bp, Mus musculus
cggggctgtggatctttccagaaca

SEQ ID NO: 261951 - DNA, 25 bp, Mus musculus
cggggcttgcagaggcctacgtgaa

SEQ ID NO: 261952 - DNA, 25 bp, Mus musculus
cggggcttgggagcatttagctcct

SEQ ID NO: 261953 - DNA, 25 bp, Mus musculus
cggggctttcctgaggagcggcggc

SEQ ID NO: 261954 - DNA, 25 bp, Mus musculus
cggggcttttgcggctaagtaagaa

SEQ ID NO: 261955 - DNA, 25 bp, Mus musculus
cgggggaagacgatcactttttaat

SEQ ID NO: 261956 - DNA, 25 bp, Mus musculus
cgggggaagacgatgtgtggtgtcg

SEQ ID NO: 261957 - DNA, 25 bp, Mus musculus
cgggggacaaggacccagcatggta

SEQ ID NO: 261958 - DNA, 25 bp, Mus musculus
cgggggacaagggtgccagtgatcc

SEQ ID NO: 261959 - DNA, 25 bp, Mus musculus
cgggggactggcaatgtttgcccgc

SEQ ID NO: 261960 - DNA, 25 bp, Mus musculus
cgggggactggccatgtttgccagc

SEQ ID NO: 261961 - DNA, 25 bp, Mus musculus
cgggggagccgagcactccgccaga

SEQ ID NO: 261962 - DNA, 25 bp, Mus musculus
cgggggagctgtggccatgttcata

SEQ ID NO: 261963 - DNA, 25 bp, Mus musculus
cgggggaggtgaagcccctccaggc

SEQ ID NO: 261964 - DNA, 25 bp, Mus musculus
cgggggattccagagtgtgtgggtt

SEQ ID NO: 261965 - DNA, 25 bp, Mus musculus
cgggggcagattcagcacagagctg

SEQ ID NO: 261966 - DNA, 25 bp, Mus musculus
cgggggcagattcaggtgattctcg

SEQ ID NO: 261967 - DNA, 25 bp, Mus musculus
cgggggcagctccccaggcctcaca

SEQ ID NO: 261968 - DNA, 25 bp, Mus musculus
cgggggcagctccccagtgaggtgg

SEQ ID NO: 261969 - DNA, 25 bp, Mus musculus
cgggggccagccgccgccatgatcc

SEQ ID NO: 261970 - DNA, 25 bp, Mus musculus
cgggggcccagaaggctgagaccgc

SEQ ID NO: 261971 - DNA, 25 bp, Mus musculus
cgggggcctgaccttccaatctgaa

SEQ ID NO: 261972 - DNA, 25 bp, Mus musculus
cgggggcgaggtggccaggcagaca

SEQ ID NO: 261973 - DNA, 25 bp, Mus musculus
cgggggcgaggtgtccccatgactt

SEQ ID NO: 261974 - DNA, 25 bp, Mus musculus
cgggggcgcggtctggaagctgaca

SEQ ID NO: 261975 - DNA, 25 bp, Mus musculus
cgggggctgcggcagggcatcatga

SEQ ID NO: 261976 - DNA, 25 bp, Mus musculus
cgggggctgtcagattggtgaccca

SEQ ID NO: 261977 - DNA, 25 bp, Mus musculus
cgggggctgtcaggcacagaggatc

SEQ ID NO: 261978 - DNA, 25 bp, Mus musculus
cgggggcttcccagaaaagatcagg

SEQ ID NO: 261979 - DNA, 25 bp, Mus musculus
cgggggcttgcccagctggctcctc

SEQ ID NO: 261980 - DNA, 25 bp, Mus musculus
cgggggcttgtgcaggtctggtcac

SEQ ID NO: 261981 - DNA, 25 bp, Mus musculus
cggggggaaggattggatggtgaga

SEQ ID NO: 261982 - DNA, 25 bp, Mus musculus
cggggggaagtgggcacatacaatg

SEQ ID NO: 261983 - DNA, 25 bp, Mus musculus
cggggggccgttgggcgtcgcggct

SEQ ID NO: 261984 - DNA, 25 bp, Mus musculus
cgggggtctaaggaacgctggcagt

SEQ ID NO: 261985 - DNA, 25 bp, Mus musculus
cgggggtctaaggatcgagagctga

SEQ ID NO: 261986 - DNA, 25 bp, Mus musculus
cgggggtgaggatttctcccaggaa

SEQ ID NO: 261987 - DNA, 25 bp, Mus musculus
cgggggtgagttgtcagtggggctg

SEQ ID NO: 261988 - DNA, 25 bp, Mus musculus
cgggggtgccacggacttgagcatc

SEQ ID NO: 261989 - DNA, 25 bp, Mus musculus
cgggggtgccacggtgaccatcgtc

SEQ ID NO: 261990 - DNA, 25 bp, Mus musculus
cggggtaaacatgctcatgaactaa

SEQ ID NO: 261991 - DNA, 25 bp, Mus musculus
cggggtagccaagctgcttttagaa

SEQ ID NO: 261992 - DNA, 25 bp, Mus musculus
cggggtagtgcaaggtggagtgtca

SEQ ID NO: 261993 - DNA, 25 bp, Mus musculus
cggggtcaggaagattgtcttagca

SEQ ID NO: 261994 - DNA, 25 bp, Mus musculus
cggggtccgcggtactgtgaggaaa

SEQ ID NO: 261995 - DNA, 25 bp, Mus musculus
cggggtcgccctcggctatcccctc

SEQ ID NO: 261996 - DNA, 25 bp, Mus musculus
cggggtcgccctcgggttccagcag

SEQ ID NO: 261997 - DNA, 25 bp, Mus musculus
cggggtgaaggtgagcctcatgttg

SEQ ID NO: 261998 - DNA, 25 bp, Mus musculus
cggggtgacggtggtcaacatgaag

SEQ ID NO: 261999 - DNA, 25 bp, Mus musculus
cggggtgagaaagaggagacagagt

SEQ ID NO: 262000 - DNA, 25 bp, Mus musculus
cggggtgagaaaggggagacagagt

SEQ ID NO: 262001 - DNA, 25 bp, Mus musculus
cggggtgagaaggtcatcctttttc

SEQ ID NO: 262002 - DNA, 25 bp, Mus musculus
cggggtgagccaggcctcgagcact

SEQ ID NO: 262003 - DNA, 25 bp, Mus musculus
cggggtgagccagtgactccactgg

SEQ ID NO: 262004 - DNA, 25 bp, Mus musculus
cggggtgcagaggtctctgtgttgg

SEQ ID NO: 262005 - DNA, 25 bp, Mus musculus
cggggtgcagcaggatgctgggcag

SEQ ID NO: 262006 - DNA, 25 bp, Mus musculus
cggggtgcagcaggatgcttcatct

SEQ ID NO: 262007 - DNA, 25 bp, Mus musculus
cggggtgcggaggtcgctcatccga

SEQ ID NO: 262008 - DNA, 25 bp, Mus musculus
cggggtgctatggggaagagacaca

SEQ ID NO: 262009 - DNA, 25 bp, Mus musculus
cggggtggccagggctctggctgag

SEQ ID NO: 262010 - DNA, 25 bp, Mus musculus
cggggtgtgggccctcccaggccca

SEQ ID NO: 262011 - DNA, 25 bp, Mus musculus
cggggtgtggggatttcgctttatt

SEQ ID NO: 262012 - DNA, 25 bp, Mus musculus
cggggttacaaatagcacgctgaag

SEQ ID NO: 262013 - DNA, 25 bp, Mus musculus
cggggttacaaatatgagctccccg

SEQ ID NO: 262014 - DNA, 25 bp, Mus musculus
cggggttcatcctgactatgcggcg

SEQ ID NO: 262015 - DNA, 25 bp, Mus musculus
cggggttcatcctgccagagactat

SEQ ID NO: 262016 - DNA, 25 bp, Mus musculus
cggggttcatttgcatccctggcac

SEQ ID NO: 262017 - DNA, 25 bp, Mus musculus
cggggttgggaatggctttgctgtg

SEQ ID NO: 262018 - DNA, 25 bp, Mus musculus
cggggttggggggcttctgcttctt

SEQ ID NO: 262019 - DNA, 25 bp, Mus musculus
cggggttggggtcgatactgacacc

SEQ ID NO: 262020 - DNA, 25 bp, Mus musculus
cggggttgtcaggtatgagcatgcg

SEQ ID NO: 262021 - DNA, 25 bp, Mus musculus
cggggtttctcggccgcgcgcggtt

SEQ ID NO: 262022 - DNA, 25 bp, Mus musculus
cggggtttgcctgaagagaaggagg

SEQ ID NO: 262023 - DNA, 25 bp, Mus musculus
cgggtaacagaggaaccgatgatgt

SEQ ID NO: 262024 - DNA, 25 bp, Mus musculus
cgggtaactccaggccatccgaacc

SEQ ID NO: 262025 - DNA, 25 bp, Mus musculus
cgggtaagcagttatgcctccacct

SEQ ID NO: 262026 - DNA, 25 bp, Mus musculus
cgggtaatcagaaagggtccccaga

SEQ ID NO: 262027 - DNA, 25 bp, Mus musculus
cgggtaccacacaagattccgcagg

SEQ ID NO: 262028 - DNA, 25 bp, Mus musculus
cgggtaccacacaagggccatcaaa

SEQ ID NO: 262029 - DNA, 25 bp, Mus musculus
cgggtacggcctacgagttacaatt

SEQ ID NO: 262030 - DNA, 25 bp, Mus musculus
cgggtactggggcctggatattcct

SEQ ID NO: 262031 - DNA, 25 bp, Mus musculus
cgggtacttaggtgctggaaagaca

SEQ ID NO: 262032 - DNA, 25 bp, Mus musculus
cgggtagccggagtatgccgcctgt

SEQ ID NO: 262033 - DNA, 25 bp, Mus musculus
cgggtaggcggatctgggacgatgt

SEQ ID NO: 262034 - DNA, 25 bp, Mus musculus
cgggtagtttagtgaagctgtgggc

SEQ ID NO: 262035 - DNA, 25 bp, Mus musculus
cgggtatccaaagcggctggagaag

SEQ ID NO: 262036 - DNA, 25 bp, Mus musculus
cgggtatgagtggcccaggatgggt

SEQ ID NO: 262037 - DNA, 25 bp, Mus musculus
cgggtcagccggatgtggagaaaga

SEQ ID NO: 262038 - DNA, 25 bp, Mus musculus
cgggtcaggtaaaacatcagagaga

SEQ ID NO: 262039 - DNA, 25 bp, Mus musculus
cgggtcataccaggtaatatccttg

SEQ ID NO: 262040 - DNA, 25 bp, Mus musculus
cgggtcatcaagggtcacgtgatta

SEQ ID NO: 262041 - DNA, 25 bp, Mus musculus
cgggtcatctaagaatgaagccaaa

SEQ ID NO: 262042 - DNA, 25 bp, Mus musculus
cgggtcatgaccaatggctggaagc

SEQ ID NO: 262043 - DNA, 25 bp, Mus musculus
cgggtcatggaaatatgggcttagg

SEQ ID NO: 262044 - DNA, 25 bp, Mus musculus
cgggtcattcagtacctcagtagta

SEQ ID NO: 262045 - DNA, 25 bp, Mus musculus
cgggtcattcagtagtaacagatgt

SEQ ID NO: 262046 - DNA, 25 bp, Mus musculus
cgggtcccaagagacaggggtccga

SEQ ID NO: 262047 - DNA, 25 bp, Mus musculus
cgggtccccgcgaggtgtcgcggaa

SEQ ID NO: 262048 - DNA, 25 bp, Mus musculus
cgggtcctactgtattatggagatt

SEQ ID NO: 262049 - DNA, 25 bp, Mus musculus
cgggtcctgcgttcttggcccagct

SEQ ID NO: 262050 - DNA, 25 bp, Mus musculus
cgggtccttctcgagattttattcc

SEQ ID NO: 262051 - DNA, 25 bp, Mus musculus
cgggtcgcaagcgggctgcctctga

SEQ ID NO: 262052 - DNA, 25 bp, Mus musculus
cgggtcgcaggaactggtgctccta

SEQ ID NO: 262053 - DNA, 25 bp, Mus musculus
cgggtcgcgaggtgcagacatggcc

SEQ ID NO: 262054 - DNA, 25 bp, Mus musculus
cgggtcggagactgcaagtggcaat

SEQ ID NO: 262055 - DNA, 25 bp, Mus musculus
cgggtcgtaggtctcaaaagattca

SEQ ID NO: 262056 - DNA, 25 bp, Mus musculus
cgggtctcacgatctttggcatgat

SEQ ID NO: 262057 - DNA, 25 bp, Mus musculus
cgggtctcacggaactctgatttca

SEQ ID NO: 262058 - DNA, 25 bp, Mus musculus
cgggtctcagaaagaagaaacaatg

SEQ ID NO: 262059 - DNA, 25 bp, Mus musculus
cgggtctcaggacaagccaatgact

SEQ ID NO: 262060 - DNA, 25 bp, Mus musculus
cgggtctccagacacagtttctctg

SEQ ID NO: 262061 - DNA, 25 bp, Mus musculus
cgggtctccaggacacagcccagtc

SEQ ID NO: 262062 - DNA, 25 bp, Mus musculus
cgggtctccaggtgtcctatctgac

SEQ ID NO: 262063 - DNA, 25 bp, Mus musculus
cgggtctcccaggaccgtcagaagg

SEQ ID NO: 262064 - DNA, 25 bp, Mus musculus
cgggtctccgtgacaagattgtaag

SEQ ID NO: 262065 - DNA, 25 bp, Mus musculus
cgggtctctctcagcatacgaagga

SEQ ID NO: 262066 - DNA, 25 bp, Mus musculus
cgggtctctctcaggcgtggaggag

SEQ ID NO: 262067 - DNA, 25 bp, Mus musculus
cgggtctgaggaacagtctgagatc

SEQ ID NO: 262068 - DNA, 25 bp, Mus musculus
cgggtctgctgagtcctgcagcagg

SEQ ID NO: 262069 - DNA, 25 bp, Mus musculus
cgggtctgtggatgatgaccacaag

SEQ ID NO: 262070 - DNA, 25 bp, Mus musculus
cgggtcttaagaagattgaaaagca

SEQ ID NO: 262071 - DNA, 25 bp, Mus musculus
cgggtcttaagaaggtcttgctgtg

SEQ ID NO: 262072 - DNA, 25 bp, Mus musculus
cgggtcttagagagagtgcagttct

SEQ ID NO: 262073 - DNA, 25 bp, Mus musculus
cgggtctttgagaggtatatctttg

SEQ ID NO: 262074 - DNA, 25 bp, Mus musculus
cgggtgaaaaccaagaatccacctc

SEQ ID NO: 262075 - DNA, 25 bp, Mus musculus
cgggtgaatgatccccaatcagggt

SEQ ID NO: 262076 - DNA, 25 bp, Mus musculus
cgggtgaatgggccaccacccaagc

SEQ ID NO: 262077 - DNA, 25 bp, Mus musculus
cgggtgaattctcagatgccagcat

SEQ ID NO: 262078 - DNA, 25 bp, Mus musculus
cgggtgaattctcagttaaatttaa

SEQ ID NO: 262079 - DNA, 25 bp, Mus musculus
cgggtgacagggccctggatgtcac

SEQ ID NO: 262080 - DNA, 25 bp, Mus musculus
cgggtgactgctcccttccctggtc

SEQ ID NO: 262081 - DNA, 25 bp, Mus musculus
cgggtgaggaggaagaaatggtcct

SEQ ID NO: 262082 - DNA, 25 bp, Mus musculus
cgggtgagtttcacggagaaatcca

SEQ ID NO: 262083 - DNA, 25 bp, Mus musculus
cgggtgatgctggacaagtgggaga

SEQ ID NO: 262084 - DNA, 25 bp, Mus musculus
cgggtgcagagagacatcccaatgc

SEQ ID NO: 262085 - DNA, 25 bp, Mus musculus
cgggtgcccgcagatgtgcctcatc

SEQ ID NO: 262086 - DNA, 25 bp, Mus musculus
cgggtgcgagggaagctgtttactt

SEQ ID NO: 262087 - DNA, 25 bp, Mus musculus
cgggtgcgcgcacagatgggctgta

SEQ ID NO: 262088 - DNA, 25 bp, Mus musculus
cgggtgctgcccggcggtcccgcga

SEQ ID NO: 262089 - DNA, 25 bp, Mus musculus
cgggtgctgtgcgcttctattccaa

SEQ ID NO: 262090 - DNA, 25 bp, Mus musculus
cgggtgcttgtaggtggcgggacgg

SEQ ID NO: 262091 - DNA, 25 bp, Mus musculus
cgggtggacggacgggcgcctctga

SEQ ID NO: 262092 - DNA, 25 bp, Mus musculus
cgggtggaggcagtgtgcaaatagt

SEQ ID NO: 262093 - DNA, 25 bp, Mus musculus
cgggtggaggcagttgtctgctaca

SEQ ID NO: 262094 - DNA, 25 bp, Mus musculus
cgggtggcaaggctggagcagcaga

SEQ ID NO: 262095 - DNA, 25 bp, Mus musculus
cgggtggccgggaagaccaaataca

SEQ ID NO: 262096 - DNA, 25 bp, Mus musculus
cgggtggcgccagctagccggatca

SEQ ID NO: 262097 - DNA, 25 bp, Mus musculus
cgggtggcggccgggatctgggacg

SEQ ID NO: 262098 - DNA, 25 bp, Mus musculus
cgggtggctggacttgaattcagtc

SEQ ID NO: 262099 - DNA, 25 bp, Mus musculus
cgggtggctggagttgaattcagtc

SEQ ID NO: 262100 - DNA, 25 bp, Mus musculus
cgggtggtgtcctggctggtatctg

SEQ ID NO: 262101 - DNA, 25 bp, Mus musculus
cgggtggttgtgctgggcctgcttc

SEQ ID NO: 262102 - DNA, 25 bp, Mus musculus
cgggtgtatggcgagatagaccatg

SEQ ID NO: 262103 - DNA, 25 bp, Mus musculus
cgggtgtatggcgagattttcagtt

SEQ ID NO: 262104 - DNA, 25 bp, Mus musculus
cgggtgtcagcgggaacagcagtgg

SEQ ID NO: 262105 - DNA, 25 bp, Mus musculus
cgggtgtccctcagctgcttccggt

SEQ ID NO: 262106 - DNA, 25 bp, Mus musculus
cgggtgtccctcaggtggccccttc

SEQ ID NO: 262107 - DNA, 25 bp, Mus musculus
cgggtgtccctcagtcgagccccgt

SEQ ID NO: 262108 - DNA, 25 bp, Mus musculus
cgggtgtgaagggtgagagtggttc

SEQ ID NO: 262109 - DNA, 25 bp, Mus musculus
cgggtgtgccacggatgaataaaaa

SEQ ID NO: 262110 - DNA, 25 bp, Mus musculus
cgggtgtggagaagaacgctgtgga

SEQ ID NO: 262111 - DNA, 25 bp, Mus musculus
cgggtgtggcaggaatgattaatat

SEQ ID NO: 262112 - DNA, 25 bp, Mus musculus
cgggtgttatatggttatatatttg

SEQ ID NO: 262113 - DNA, 25 bp, Mus musculus
cgggtgtttggggcctacacgccca

SEQ ID NO: 262114 - DNA, 25 bp, Mus musculus
cgggttcacagcagcacatccctac

SEQ ID NO: 262115 - DNA, 25 bp, Mus musculus
cgggttcacagcaggtgcccaggga

SEQ ID NO: 262116 - DNA, 25 bp, Mus musculus
cgggttcgtgggaagatagacccag

SEQ ID NO: 262117 - DNA, 25 bp, Mus musculus
cgggttctgacaggcctcaagaaag

SEQ ID NO: 262118 - DNA, 25 bp, Mus musculus
cgggttctgctgcagagacagcact

SEQ ID NO: 262119 - DNA, 25 bp, Mus musculus
cgggttctgctgggccactgccggt

SEQ ID NO: 262120 - DNA, 25 bp, Mus musculus
cgggttctgctgtctcagtgccatt

SEQ ID NO: 262121 - DNA, 25 bp, Mus musculus
cgggttgctgaggacaggacccgag

SEQ ID NO: 262122 - DNA, 25 bp, Mus musculus
cgggttggaggctaggtcttggttt

SEQ ID NO: 262123 - DNA, 25 bp, Mus musculus
cgggttgttgccgtaatctagctgc

SEQ ID NO: 262124 - DNA, 25 bp, Mus musculus
cgggtttcgacttctcgccgaggga

SEQ ID NO: 262125 - DNA, 25 bp, Mus musculus
cgggtttcttccagggcttggctga

SEQ ID NO: 262126 - DNA, 25 bp, Mus musculus
cgggtttgggggaccagtagttgca

SEQ ID NO: 262127 - DNA, 25 bp, Mus musculus
cgggttttcagatccttaagctgtt

SEQ ID NO: 262128 - DNA, 25 bp, Mus musculus
cgggttttcagcacactgccccatt

SEQ ID NO: 262129 - DNA, 25 bp, Mus musculus
cgggttttcagcctgaataccaagg

SEQ ID NO: 262130 - DNA, 25 bp, Mus musculus
cggtaaacctggagatgggtatcgg

SEQ ID NO: 262131 - DNA, 25 bp, Mus musculus
cggtaaagtgccggcagagcagttc

SEQ ID NO: 262132 - DNA, 25 bp, Mus musculus
cggtaactcgatcccgtactcttcc

SEQ ID NO: 262133 - DNA, 25 bp, Mus musculus
cggtaagagggggcccgtaagctgg

SEQ ID NO: 262134 - DNA, 25 bp, Mus musculus
cggtaatcaagagaacttctcggac

SEQ ID NO: 262135 - DNA, 25 bp, Mus musculus
cggtaatcaagagatcttctcggac

SEQ ID NO: 262136 - DNA, 25 bp, Mus musculus
cggtacatgatgcaggtgaagactt

SEQ ID NO: 262137 - DNA, 25 bp, Mus musculus
cggtacatgcaggtgcatattttcc

SEQ ID NO: 262138 - DNA, 25 bp, Mus musculus
cggtacatggacgacctgcaacttt

SEQ ID NO: 262139 - DNA, 25 bp, Mus musculus
cggtactccaaagtctttggaagca

SEQ ID NO: 262140 - DNA, 25 bp, Mus musculus
cggtactgaaggattctccagtgac

SEQ ID NO: 262141 - DNA, 25 bp, Mus musculus
cggtagaacgagccatttattgaaa

SEQ ID NO: 262142 - DNA, 25 bp, Mus musculus
cggtagatctagccttttctgatta

SEQ ID NO: 262143 - DNA, 25 bp, Mus musculus
cggtagatctagttacaacctgcca

SEQ ID NO: 262144 - DNA, 25 bp, Mus musculus
cggtagcggtgaacgctgttgctca

SEQ ID NO: 262145 - DNA, 25 bp, Mus musculus
cggtagcggtgccttctctccgtgg

SEQ ID NO: 262146 - DNA, 25 bp, Mus musculus
cggtagcggtgggtgtcaccgaagg

SEQ ID NO: 262147 - DNA, 25 bp, Mus musculus
cggtagcggtgtatgtgggatcctt

SEQ ID NO: 262148 - DNA, 25 bp, Mus musculus
cggtagctcggtttcttctgggacc

SEQ ID NO: 262149 - DNA, 25 bp, Mus musculus
cggtaggaagaagccattgctcctg

SEQ ID NO: 262150 - DNA, 25 bp, Mus musculus
cggtaggagacacaggtgacaaact

SEQ ID NO: 262151 - DNA, 25 bp, Mus musculus
cggtaggagacacaggttttggcta

SEQ ID NO: 262152 - DNA, 25 bp, Mus musculus
cggtagggtggcggggccctccatg

SEQ ID NO: 262153 - DNA, 25 bp, Mus musculus
cggtagtagctcctggtttgcttac

SEQ ID NO: 262154 - DNA, 25 bp, Mus musculus
cggtatcggggggagtacaaggaca

SEQ ID NO: 262155 - DNA, 25 bp, Mus musculus
cggtatggaggagaaaccaaggtat

SEQ ID NO: 262156 - DNA, 25 bp, Mus musculus
cggtattcctcaccttatggctatt

SEQ ID NO: 262157 - DNA, 25 bp, Mus musculus
cggtattcctcagcttatggctatt

SEQ ID NO: 262158 - DNA, 25 bp, Mus musculus
cggtattgagttggtcacaatggca

SEQ ID NO: 262159 - DNA, 25 bp, Mus musculus
cggtcaagcaagtgcaaagaaacga

SEQ ID NO: 262160 - DNA, 25 bp, Mus musculus
cggtcaataaggctgtggctctgga

SEQ ID NO: 262161 - DNA, 25 bp, Mus musculus
cggtcaatgacaaatcaggaccttt

SEQ ID NO: 262162 - DNA, 25 bp, Mus musculus
cggtcaatgggtcctaaatgctcag

SEQ ID NO: 262163 - DNA, 25 bp, Mus musculus
cggtcaatgggtgggtgaggtggtg

SEQ ID NO: 262164 - DNA, 25 bp, Mus musculus
cggtcaatggtcagcaagatccaga

SEQ ID NO: 262165 - DNA, 25 bp, Mus musculus
cggtcacaaacttaatctagagaag

SEQ ID NO: 262166 - DNA, 25 bp, Mus musculus
cggtcaccaggccattccaaggact

SEQ ID NO: 262167 - DNA, 25 bp, Mus musculus
cggtcaccctcacagaacatctaac

SEQ ID NO: 262168 - DNA, 25 bp, Mus musculus
cggtcactatgagtgaaacatcttt

SEQ ID NO: 262169 - DNA, 25 bp, Mus musculus
cggtcactatggtgataaagttaca

SEQ ID NO: 262170 - DNA, 25 bp, Mus musculus
cggtcactcagctcacagtggtacc

SEQ ID NO: 262171 - DNA, 25 bp, Mus musculus
cggtcactgagcctctgcaggtgtc

SEQ ID NO: 262172 - DNA, 25 bp, Mus musculus
cggtcactgaggtactggcggagga

SEQ ID NO: 262173 - DNA, 25 bp, Mus musculus
cggtcagaagctccccgcaggccca

SEQ ID NO: 262174 - DNA, 25 bp, Mus musculus
cggtcagagaaagatatgctggcat

SEQ ID NO: 262175 - DNA, 25 bp, Mus musculus
cggtcagagaaagatatggcagtga

SEQ ID NO: 262176 - DNA, 25 bp, Mus musculus
cggtcagagaaagatgtgcactagg

SEQ ID NO: 262177 - DNA, 25 bp, Mus musculus
cggtcagatccatagggatttgaaa

SEQ ID NO: 262178 - DNA, 25 bp, Mus musculus
cggtcagatctggcactcgctccca

SEQ ID NO: 262179 - DNA, 25 bp, Mus musculus
cggtcagatctgtcagtggtgcagt

SEQ ID NO: 262180 - DNA, 25 bp, Mus musculus
cggtcagcggaggggtatctgctat

SEQ ID NO: 262181 - DNA, 25 bp, Mus musculus
cggtcaggccaagacatgcccggaa

SEQ ID NO: 262182 - DNA, 25 bp, Mus musculus
cggtcaggccaagacgcccacagat

SEQ ID NO: 262183 - DNA, 25 bp, Mus musculus
cggtcaggccaagactaaggggtcc

SEQ ID NO: 262184 - DNA, 25 bp, Mus musculus
cggtcagtcaacacagtgttcaaga

SEQ ID NO: 262185 - DNA, 25 bp, Mus musculus
cggtcatcaccggggcttgcgacaa

SEQ ID NO: 262186 - DNA, 25 bp, Mus musculus
cggtcatcaccggggttccattttg

SEQ ID NO: 262187 - DNA, 25 bp, Mus musculus
cggtcattaggttcaaccagatgtg

SEQ ID NO: 262188 - DNA, 25 bp, Mus musculus
cggtccaagaggtcctccaggacca

SEQ ID NO: 262189 - DNA, 25 bp, Mus musculus
cggtccacagcaggattccccctct

SEQ ID NO: 262190 - DNA, 25 bp, Mus musculus
cggtccactaacagctctatttcag

SEQ ID NO: 262191 - DNA, 25 bp, Mus musculus
cggtccactaacagtgcttctctcc

SEQ ID NO: 262192 - DNA, 25 bp, Mus musculus
cggtccagaaaaacctccagcgtct

SEQ ID NO: 262193 - DNA, 25 bp, Mus musculus
cggtccaggagattgtgccttctga

SEQ ID NO: 262194 - DNA, 25 bp, Mus musculus
cggtccagtgaggctgtcatctggg

SEQ ID NO: 262195 - DNA, 25 bp, Mus musculus
cggtccagtgaggggtgcactctca

SEQ ID NO: 262196 - DNA, 25 bp, Mus musculus
cggtccatgagcaatggcaacagta

SEQ ID NO: 262197 - DNA, 25 bp, Mus musculus
cggtccatgagtgaattagtagaag

SEQ ID NO: 262198 - DNA, 25 bp, Mus musculus
cggtccattcaggagatggagttct

SEQ ID NO: 262199 - DNA, 25 bp, Mus musculus
cggtcccacacgcctctgtacaacc

SEQ ID NO: 262200 - DNA, 25 bp, Mus musculus
cggtcccacacggacgtggggctgc

SEQ ID NO: 262201 - DNA, 25 bp, Mus musculus
cggtcccagagccagatgaagagct

SEQ ID NO: 262202 - DNA, 25 bp, Mus musculus
cggtcccagagccaggctccccagc

SEQ ID NO: 262203 - DNA, 25 bp, Mus musculus
cggtcccattgcaagataaatagga

SEQ ID NO: 262204 - DNA, 25 bp, Mus musculus
cggtccctcagattgctgaagctaa

SEQ ID NO: 262205 - DNA, 25 bp, Mus musculus
cggtccctcagggtctggagtatgg

SEQ ID NO: 262206 - DNA, 25 bp, Mus musculus
cggtcctacagttggggaatggcgg

SEQ ID NO: 262207 - DNA, 25 bp, Mus musculus
cggtcctcactgccaaggcagcagc

SEQ ID NO: 262208 - DNA, 25 bp, Mus musculus
cggtcctccatgggcatggacatat

SEQ ID NO: 262209 - DNA, 25 bp, Mus musculus
cggtcctcggggcagaaaatatctg

SEQ ID NO: 262210 - DNA, 25 bp, Mus musculus
cggtcctcggggcagatcgtaatgt

SEQ ID NO: 262211 - DNA, 25 bp, Mus musculus
cggtcctgaggtccacctccacctc

SEQ ID NO: 262212 - DNA, 25 bp, Mus musculus
cggtccttttcatggttaatttcta

SEQ ID NO: 262213 - DNA, 25 bp, Mus musculus
cggtcgactgagagatcctgagcaa

SEQ ID NO: 262214 - DNA, 25 bp, Mus musculus
cggtcgagcagctggagaatcctgg

SEQ ID NO: 262215 - DNA, 25 bp, Mus musculus
cggtcgcccaggctccgcccccacg

SEQ ID NO: 262216 - DNA, 25 bp, Mus musculus
cggtcgcccagggactttgaatatg

SEQ ID NO: 262217 - DNA, 25 bp, Mus musculus
cggtcgcgcggaccatcggggctgc

SEQ ID NO: 262218 - DNA, 25 bp, Mus musculus
cggtcgcggcggtgacctacagcac

SEQ ID NO: 262219 - DNA, 25 bp, Mus musculus
cggtcggggctggtcaggacaaaga

SEQ ID NO: 262220 - DNA, 25 bp, Mus musculus
cggtcgtgaagctaggtactgggtt

SEQ ID NO: 262221 - DNA, 25 bp, Mus musculus
cggtcgtggctcatacacactttgg

SEQ ID NO: 262222 - DNA, 25 bp, Mus musculus
cggtcgtggctcatagtatgatatt

SEQ ID NO: 262223 - DNA, 25 bp, Mus musculus
cggtcgtgtggagagattgctctct

SEQ ID NO: 262224 - DNA, 25 bp, Mus musculus
cggtctaagggaaggaaccaagtgg

SEQ ID NO: 262225 - DNA, 25 bp, Mus musculus
cggtctcatacaggtgagaaacctt

SEQ ID NO: 262226 - DNA, 25 bp, Mus musculus
cggtctccagattcgcctctaatct

SEQ ID NO: 262227 - DNA, 25 bp, Mus musculus
cggtctccagcttcctgcgcttcct

SEQ ID NO: 262228 - DNA, 25 bp, Mus musculus
cggtctccagtgttcacaccgcggg

SEQ ID NO: 262229 - DNA, 25 bp, Mus musculus
cggtctctcagaaaacatctcgggc

SEQ ID NO: 262230 - DNA, 25 bp, Mus musculus
cggtctgacacggaacaggaaggca

SEQ ID NO: 262231 - DNA, 25 bp, Mus musculus
cggtctgattaaacaaattggagaa

SEQ ID NO: 262232 - DNA, 25 bp, Mus musculus
cggtctggaggtcctgggccttgta

SEQ ID NO: 262233 - DNA, 25 bp, Mus musculus
cggtctggatcagaccttgtgaccg

SEQ ID NO: 262234 - DNA, 25 bp, Mus musculus
cggtctgggccagagcttcgagtgt

SEQ ID NO: 262235 - DNA, 25 bp, Mus musculus
cggtctgggccaggtgcgtgctatt

SEQ ID NO: 262236 - DNA, 25 bp, Mus musculus
cggtctggtcaaagctgttcctgag

SEQ ID NO: 262237 - DNA, 25 bp, Mus musculus
cggtctgtgagcagcgcggatgtcg

SEQ ID NO: 262238 - DNA, 25 bp, Mus musculus
cggtctgtgagcaggaatcccttcg

SEQ ID NO: 262239 - DNA, 25 bp, Mus musculus
cggtctgtgagcagtggcagtggca

SEQ ID NO: 262240 - DNA, 25 bp, Mus musculus
cggtctgtgcagagatattcacaac

SEQ ID NO: 262241 - DNA, 25 bp, Mus musculus
cggtcttcaccacttccctgatgat

SEQ ID NO: 262242 - DNA, 25 bp, Mus musculus
cggtcttccgacatagactgactct

SEQ ID NO: 262243 - DNA, 25 bp, Mus musculus
cggtcttcttgagctcggcttcatg

SEQ ID NO: 262244 - DNA, 25 bp, Mus musculus
cggtcttcttgaggtgagcgggatg

SEQ ID NO: 262245 - DNA, 25 bp, Mus musculus
cggtcttcttttgccaggctgagct

SEQ ID NO: 262246 - DNA, 25 bp, Mus musculus
cggtgaaagggattgaaattccaag

SEQ ID NO: 262247 - DNA, 25 bp, Mus musculus
cggtgaacatcgaagacgccataaa

SEQ ID NO: 262248 - DNA, 25 bp, Mus musculus
cggtgaacatcggaaggaagagaga

SEQ ID NO: 262249 - DNA, 25 bp, Mus musculus
cggtgaagaaggtgataaatgcaca

SEQ ID NO: 262250 - DNA, 25 bp, Mus musculus
cggtgaagcggagccctgcaggcca

SEQ ID NO: 262251 - DNA, 25 bp, Mus musculus
cggtgaagcgggtcgccctcccggc

SEQ ID NO: 262252 - DNA, 25 bp, Mus musculus
cggtgaatccaggtttgatctgtgg

SEQ ID NO: 262253 - DNA, 25 bp, Mus musculus
cggtgacaatgagttttcttggagg

SEQ ID NO: 262254 - DNA, 25 bp, Mus musculus
cggtgacaatggtaaacctagcctt

SEQ ID NO: 262255 - DNA, 25 bp, Mus musculus
cggtgacagataagaactgagtcaa

SEQ ID NO: 262256 - DNA, 25 bp, Mus musculus
cggtgacagataagtgtccagctgc

SEQ ID NO: 262257 - DNA, 25 bp, Mus musculus
cggtgacagataagttcggaataaa

SEQ ID NO: 262258 - DNA, 25 bp, Mus musculus
cggtgacatgaccaatgaggaattc

SEQ ID NO: 262259 - DNA, 25 bp, Mus musculus
cggtgacctcctcagtgggaacaca

SEQ ID NO: 262260 - DNA, 25 bp, Mus musculus
cggtgacgccgccgaagatggcggc

SEQ ID NO: 262261 - DNA, 25 bp, Mus musculus
cggtgagagccagaggcactgagag

SEQ ID NO: 262262 - DNA, 25 bp, Mus musculus
cggtgagagctcaaggcttctagct

SEQ ID NO: 262263 - DNA, 25 bp, Mus musculus
cggtgagattccaggtggcagacat

SEQ ID NO: 262264 - DNA, 25 bp, Mus musculus
cggtgagcacgatgaaacggacagg

SEQ ID NO: 262265 - DNA, 25 bp, Mus musculus
cggtgagcagggatatcgctcgagg

SEQ ID NO: 262266 - DNA, 25 bp, Mus musculus
cggtgaggagaggtttcatagtcct

SEQ ID NO: 262267 - DNA, 25 bp, Mus musculus
cggtgaggatcaggttggtacacga

SEQ ID NO: 262268 - DNA, 25 bp, Mus musculus
cggtgaggattcgaaagaatagact

SEQ ID NO: 262269 - DNA, 25 bp, Mus musculus
cggtgaggattcggacttctagatc

SEQ ID NO: 262270 - DNA, 25 bp, Mus musculus
cggtgagtacgcctgctaagcccca

SEQ ID NO: 262271 - DNA, 25 bp, Mus musculus
cggtgataacggatagacaggaaaa

SEQ ID NO: 262272 - DNA, 25 bp, Mus musculus
cggtgataagtcagatgaatgagaa

SEQ ID NO: 262273 - DNA, 25 bp, Mus musculus
cggtgatcaagaaatgcattgatat

SEQ ID NO: 262274 - DNA, 25 bp, Mus musculus
cggtgatctcagacgggtcaccctt

SEQ ID NO: 262275 - DNA, 25 bp, Mus musculus
cggtgatctcagccttgccggagct

SEQ ID NO: 262276 - DNA, 25 bp, Mus musculus
cggtgatgcgcaagggctacgaggg

SEQ ID NO: 262277 - DNA, 25 bp, Mus musculus
cggtgatgcgcaaggtatgaatgct

SEQ ID NO: 262278 - DNA, 25 bp, Mus musculus
cggtgcaagcaggttatgaggtgac

SEQ ID NO: 262279 - DNA, 25 bp, Mus musculus
cggtgcagactggcccttcaaattg

SEQ ID NO: 262280 - DNA, 25 bp, Mus musculus
cggtgcagagccaccatgccaatca

SEQ ID NO: 262281 - DNA, 25 bp, Mus musculus
cggtgcagccagatggagtggccgg

SEQ ID NO: 262282 - DNA, 25 bp, Mus musculus
cggtgcagcgcggcgaaagaaagat

SEQ ID NO: 262283 - DNA, 25 bp, Mus musculus
cggtgcaggactgggctacacagag

SEQ ID NO: 262284 - DNA, 25 bp, Mus musculus
cggtgcaggactgggctacgcagat

SEQ ID NO: 262285 - DNA, 25 bp, Mus musculus
cggtgcaggctgactttttggggtt

SEQ ID NO: 262286 - DNA, 25 bp, Mus musculus
cggtgcaggctggttaccatggcat

SEQ ID NO: 262287 - DNA, 25 bp, Mus musculus
cggtgcatagagaaatccaaggtcc

SEQ ID NO: 262288 - DNA, 25 bp, Mus musculus
cggtgcatcaggtttgcaagtgaga

SEQ ID NO: 262289 - DNA, 25 bp, Mus musculus
cggtgcatccgtaagggcaccagcg

SEQ ID NO: 262290 - DNA, 25 bp, Mus musculus
cggtgcattctgggtttctggttag

SEQ ID NO: 262291 - DNA, 25 bp, Mus musculus
cggtgccagctgcaggccacaggca

SEQ ID NO: 262292 - DNA, 25 bp, Mus musculus
cggtgccagtactgtggtggcttca

SEQ ID NO: 262293 - DNA, 25 bp, Mus musculus
cggtgcccaggtctgggaacgtaat

SEQ ID NO: 262294 - DNA, 25 bp, Mus musculus
cggtgcccatcagattatctgcaat

SEQ ID NO: 262295 - DNA, 25 bp, Mus musculus
cggtgccccaaaccagcgtgcctca

SEQ ID NO: 262296 - DNA, 25 bp, Mus musculus
cggtgcccccggccctcaaggattt

SEQ ID NO: 262297 - DNA, 25 bp, Mus musculus
cggtgcccctgaccccatgactcag

SEQ ID NO: 262298 - DNA, 25 bp, Mus musculus
cggtgccgcagtctcaaaccatgaa

SEQ ID NO: 262299 - DNA, 25 bp, Mus musculus
cggtgcctatggagggaggagtgat

SEQ ID NO: 262300 - DNA, 25 bp, Mus musculus
cggtgcctatggaggggtggacaaa

SEQ ID NO: 262301 - DNA, 25 bp, Mus musculus
cggtgcctgcagtgtgcaatggtgc

SEQ ID NO: 262302 - DNA, 25 bp, Mus musculus
cggtgcctggagactcctccaccct

SEQ ID NO: 262303 - DNA, 25 bp, Mus musculus
cggtgcctggagggtctcattatgc

SEQ ID NO: 262304 - DNA, 25 bp, Mus musculus
cggtgccttgaaggaggggtcatct

SEQ ID NO: 262305 - DNA, 25 bp, Mus musculus
cggtgcgaggagcagatatggcctc

SEQ ID NO: 262306 - DNA, 25 bp, Mus musculus
cggtgcgcggaaagatcaacggaaa

SEQ ID NO: 262307 - DNA, 25 bp, Mus musculus
cggtgcgcttccggtacggtggcac

SEQ ID NO: 262308 - DNA, 25 bp, Mus musculus
cggtgcgtaaaaaaatatttcttgg

SEQ ID NO: 262309 - DNA, 25 bp, Mus musculus
cggtgctatgagtgctctggggatg

SEQ ID NO: 262310 - DNA, 25 bp, Mus musculus
cggtgctatggcctgtgctgctttg

SEQ ID NO: 262311 - DNA, 25 bp, Mus musculus
cggtgctcacagcagagggtcccca

SEQ ID NO: 262312 - DNA, 25 bp, Mus musculus
cggtgctcagggaggttacagcctg

SEQ ID NO: 262313 - DNA, 25 bp, Mus musculus
cggtgctcagtgtctggagacatgg

SEQ ID NO: 262314 - DNA, 25 bp, Mus musculus
cggtgctccaggacagcatcgcaaa

SEQ ID NO: 262315 - DNA, 25 bp, Mus musculus
cggtgctccagtccgttgtggggac

SEQ ID NO: 262316 - DNA, 25 bp, Mus musculus
cggtgctgagttaatatttgccaat

SEQ ID NO: 262317 - DNA, 25 bp, Mus musculus
cggtgctgattttgccaagtcatct

SEQ ID NO: 262318 - DNA, 25 bp, Mus musculus
cggtgctggacaaggcccgagtccg

SEQ ID NO: 262319 - DNA, 25 bp, Mus musculus
cggtggaaacaaaagataaaatatt

SEQ ID NO: 262320 - DNA, 25 bp, Mus musculus
cggtggaagagggtcagggctgcat

SEQ ID NO: 262321 - DNA, 25 bp, Mus musculus
cggtggactgggcgctggagagcga

SEQ ID NO: 262322 - DNA, 25 bp, Mus musculus
cggtggagacaaggagtttttgggt

SEQ ID NO: 262323 - DNA, 25 bp, Mus musculus
cggtggagcccaagtttcagccatg

SEQ ID NO: 262324 - DNA, 25 bp, Mus musculus
cggtggaggcgggggccctagctgc

SEQ ID NO: 262325 - DNA, 25 bp, Mus musculus
cggtggatcgaagtctgcttccctg

SEQ ID NO: 262326 - DNA, 25 bp, Mus musculus
cggtggattgattcgttctccccgc

SEQ ID NO: 262327 - DNA, 25 bp, Mus musculus
cggtggatttggtggagctagagcg

SEQ ID NO: 262328 - DNA, 25 bp, Mus musculus
cggtggcaacggggaggcacacggt

SEQ ID NO: 262329 - DNA, 25 bp, Mus musculus
cggtggcaagagactgcttatgtgc

SEQ ID NO: 262330 - DNA, 25 bp, Mus musculus
cggtggcacaatcaggcgacaggtg

SEQ ID NO: 262331 - DNA, 25 bp, Mus musculus
cggtggcacaatcaggttcttgaga

SEQ ID NO: 262332 - DNA, 25 bp, Mus musculus
cggtggccagcacgcaatcagcgga

SEQ ID NO: 262333 - DNA, 25 bp, Mus musculus
cggtggccagccaggcctgcagcat

SEQ ID NO: 262334 - DNA, 25 bp, Mus musculus
cggtggccgacagagtgcttgggat

SEQ ID NO: 262335 - DNA, 25 bp, Mus musculus
cggtggcctgcaggtagctcgcggc

SEQ ID NO: 262336 - DNA, 25 bp, Mus musculus
cggtggccttggcaggggccagtcc

SEQ ID NO: 262337 - DNA, 25 bp, Mus musculus
cggtggctacgacccgggagcccat

SEQ ID NO: 262338 - DNA, 25 bp, Mus musculus
cggtggctcaatgatccttccttca

SEQ ID NO: 262339 - DNA, 25 bp, Mus musculus
cggtgggacagaaactcatcatgga

SEQ ID NO: 262340 - DNA, 25 bp, Mus musculus
cggtgggacagctgggaacactcca

SEQ ID NO: 262341 - DNA, 25 bp, Mus musculus
cggtgggatccaccaccacgggctc

SEQ ID NO: 262342 - DNA, 25 bp, Mus musculus
cggtgggttctcgggcaatgatggc

SEQ ID NO: 262343 - DNA, 25 bp, Mus musculus
cggtggtacctgaagatgaaatgtg

SEQ ID NO: 262344 - DNA, 25 bp, Mus musculus
cggtggtagtggaagcaattttgga

SEQ ID NO: 262345 - DNA, 25 bp, Mus musculus
cggtggtagtggtggctatggcggt

SEQ ID NO: 262346 - DNA, 25 bp, Mus musculus
cggtggtcagtgtcctcaagaggag

SEQ ID NO: 262347 - DNA, 25 bp, Mus musculus
cggtggtgaagtaggaaacacactg

SEQ ID NO: 262348 - DNA, 25 bp, Mus musculus
cggtggtgcaatctgccagcttggg

SEQ ID NO: 262349 - DNA, 25 bp, Mus musculus
cggtggtgcacctcgcctgcatgtg

SEQ ID NO: 262350 - DNA, 25 bp, Mus musculus
cggtggtgcaggctctccttcctgc

SEQ ID NO: 262351 - DNA, 25 bp, Mus musculus
cggtggtgcttacgaacacagatat

SEQ ID NO: 262352 - DNA, 25 bp, Mus musculus
cggtggtggagtgcacctgtcaagc

SEQ ID NO: 262353 - DNA, 25 bp, Mus musculus
cggtggttgcaggagcacccccacc

SEQ ID NO: 262354 - DNA, 25 bp, Mus musculus
cggtggttgcaggagggtgaagggc

SEQ ID NO: 262355 - DNA, 25 bp, Mus musculus
cggtggtttgaggtcctccagaggt

SEQ ID NO: 262356 - DNA, 25 bp, Mus musculus
cggtgtaaagctggaccgtgtatcc

SEQ ID NO: 262357 - DNA, 25 bp, Mus musculus
cggtgtacagtacaggcaaatttcc

SEQ ID NO: 262358 - DNA, 25 bp, Mus musculus
cggtgtacctgcagcctgcactgga

SEQ ID NO: 262359 - DNA, 25 bp, Mus musculus
cggtgtacggcgcaacctgcggcag

SEQ ID NO: 262360 - DNA, 25 bp, Mus musculus
cggtgtcaagaaaaggaagtcgagt

SEQ ID NO: 262361 - DNA, 25 bp, Mus musculus
cggtgtcaagccacagagcaacaac

SEQ ID NO: 262362 - DNA, 25 bp, Mus musculus
cggtgtcaaggaaccacaaaccacc

SEQ ID NO: 262363 - DNA, 25 bp, Mus musculus
cggtgtcagcaggggtggatctggc

SEQ ID NO: 262364 - DNA, 25 bp, Mus musculus
cggtgtcagctgcccagcctggtga

SEQ ID NO: 262365 - DNA, 25 bp, Mus musculus
cggtgtcaggggacactcttaagga

SEQ ID NO: 262366 - DNA, 25 bp, Mus musculus
cggtgtcatttacacaatgtacttt

SEQ ID NO: 262367 - DNA, 25 bp, Mus musculus
cggtgtcatttacacgggttatgca

SEQ ID NO: 262368 - DNA, 25 bp, Mus musculus
cggtgtccagcacagggacctgagg

SEQ ID NO: 262369 - DNA, 25 bp, Mus musculus
cggtgtcgatgggggccgttgacta

SEQ ID NO: 262370 - DNA, 25 bp, Mus musculus
cggtgtcggatcagctgcctgctgt

SEQ ID NO: 262371 - DNA, 25 bp, Mus musculus
cggtgtcgtggaagggttttatgga

SEQ ID NO: 262372 - DNA, 25 bp, Mus musculus
cggtgtctttacagttgctagacct

SEQ ID NO: 262373 - DNA, 25 bp, Mus musculus
cggtgtgaagtaagcaatggcttcg

SEQ ID NO: 262374 - DNA, 25 bp, Mus musculus
cggtgtgcagttcatggaccgtctc

SEQ ID NO: 262375 - DNA, 25 bp, Mus musculus
cggtgtgcatgttgaccccaacaag

SEQ ID NO: 262376 - DNA, 25 bp, Mus musculus
cggtgtgctcatgcccgacatcgtg

SEQ ID NO: 262377 - DNA, 25 bp, Mus musculus
cggtgtgctcatgttcgagatgctc

SEQ ID NO: 262378 - DNA, 25 bp, Mus musculus
cggtgtgctgaagagaactgcttca

SEQ ID NO: 262379 - DNA, 25 bp, Mus musculus
cggtgtgctggaggacttcatcaac

SEQ ID NO: 262380 - DNA, 25 bp, Mus musculus
cggtgtggaagagatgaaccggaca

SEQ ID NO: 262381 - DNA, 25 bp, Mus musculus
cggtgtgtacaggccccgactctgg

SEQ ID NO: 262382 - DNA, 25 bp, Mus musculus
cggtgtgtatgattccctgtcgtga

SEQ ID NO: 262383 - DNA, 25 bp, Mus musculus
cggtgttcagggactgctgaccttt

SEQ ID NO: 262384 - DNA, 25 bp, Mus musculus
cggtgttcaggtcactgcaagacat

SEQ ID NO: 262385 - DNA, 25 bp, Mus musculus
cggtgttcctcagcaacttgatttc

SEQ ID NO: 262386 - DNA, 25 bp, Mus musculus
cggtgttcgcggggctcgtgctcgt

SEQ ID NO: 262387 - DNA, 25 bp, Mus musculus
cggtgttcgtgcggtcttttgatgg

SEQ ID NO: 262388 - DNA, 25 bp, Mus musculus
cggtgttctttccggctgtgacttc

SEQ ID NO: 262389 - DNA, 25 bp, Mus musculus
cggttaaaatacctgagcatctgta

SEQ ID NO: 262390 - DNA, 25 bp, Mus musculus
cggttaagaggggcagactgaagtc

SEQ ID NO: 262391 - DNA, 25 bp, Mus musculus
cggttaagagggggtctcactgtgt

SEQ ID NO: 262392 - DNA, 25 bp, Mus musculus
cggttaccttcagaattggataacc

SEQ ID NO: 262393 - DNA, 25 bp, Mus musculus
cggttactatctgggtgacaatagc

SEQ ID NO: 262394 - DNA, 25 bp, Mus musculus
cggttagaactggtgcaggtcctgc

SEQ ID NO: 262395 - DNA, 25 bp, Mus musculus
cggttagagcagatggaagattcag

SEQ ID NO: 262396 - DNA, 25 bp, Mus musculus
cggttagcagcccttggcgatatgt

SEQ ID NO: 262397 - DNA, 25 bp, Mus musculus
cggttagcagctgccgcccttggcg

SEQ ID NO: 262398 - DNA, 25 bp, Mus musculus
cggttagccagggattacgcagcca

SEQ ID NO: 262399 - DNA, 25 bp, Mus musculus
cggttaggcctgaggctgcttccgc

SEQ ID NO: 262400 - DNA, 25 bp, Mus musculus
cggttagtcgagaactgatagaagt

SEQ ID NO: 262401 - DNA, 25 bp, Mus musculus
cggttagtgctggattcgagttctg

SEQ ID NO: 262402 - DNA, 25 bp, Mus musculus
cggttcactgctcttccgaatccag

SEQ ID NO: 262403 - DNA, 25 bp, Mus musculus
cggttccacgcctgattctggcagg

SEQ ID NO: 262404 - DNA, 25 bp, Mus musculus
cggttccccgcagaagacctccttc

SEQ ID NO: 262405 - DNA, 25 bp, Mus musculus
cggttcccgggctttgatgacagtt

SEQ ID NO: 262406 - DNA, 25 bp, Mus musculus
cggttccgagctgtagccctcatgc

SEQ ID NO: 262407 - DNA, 25 bp, Mus musculus
cggttccgagggaggttcagaagtt

SEQ ID NO: 262408 - DNA, 25 bp, Mus musculus
cggttccgaggtgtgtgaggacgag

SEQ ID NO: 262409 - DNA, 25 bp, Mus musculus
cggttccggttcggattctgtgtct

SEQ ID NO: 262410 - DNA, 25 bp, Mus musculus
cggttcgcgcgcagtggtaactcat

SEQ ID NO: 262411 - DNA, 25 bp, Mus musculus
cggttcggagaagaagtctcagcgc

SEQ ID NO: 262412 - DNA, 25 bp, Mus musculus
cggttctcatcaagatcaatgaagg

SEQ ID NO: 262413 - DNA, 25 bp, Mus musculus
cggttctcatgctcctgtggctgtc

SEQ ID NO: 262414 - DNA, 25 bp, Mus musculus
cggttctcccagagtggcttcatca

SEQ ID NO: 262415 - DNA, 25 bp, Mus musculus
cggttctcccgaggaggcatgataa

SEQ ID NO: 262416 - DNA, 25 bp, Mus musculus
cggttctcccgagggctgggataag

SEQ ID NO: 262417 - DNA, 25 bp, Mus musculus
cggttctgagtcacgtgctgtaatt

SEQ ID NO: 262418 - DNA, 25 bp, Mus musculus
cggttctggcgctccggcactcagc

SEQ ID NO: 262419 - DNA, 25 bp, Mus musculus
cggttctggcgggattcctctgcgt

SEQ ID NO: 262420 - DNA, 25 bp, Mus musculus
cggttctggtgccagcaactggcca

SEQ ID NO: 262421 - DNA, 25 bp, Mus musculus
cggttctggtgccagggtttctctg

SEQ ID NO: 262422 - DNA, 25 bp, Mus musculus
cggttgagagaattggaaaatgact

SEQ ID NO: 262423 - DNA, 25 bp, Mus musculus
cggttgagagggggcacaatatatt

SEQ ID NO: 262424 - DNA, 25 bp, Mus musculus
cggttgcaggaattggccaacggct

SEQ ID NO: 262425 - DNA, 25 bp, Mus musculus
cggttgcccaggtgacagattatgt

SEQ ID NO: 262426 - DNA, 25 bp, Mus musculus
cggttgccgggcgagctggaaacca

SEQ ID NO: 262427 - DNA, 25 bp, Mus musculus
cggttgccgggcgaggcctctgaga

SEQ ID NO: 262428 - DNA, 25 bp, Mus musculus
cggttgcctgtagtcagaagatggc

SEQ ID NO: 262429 - DNA, 25 bp, Mus musculus
cggttgcctttgcacctgagaaccc

SEQ ID NO: 262430 - DNA, 25 bp, Mus musculus
cggttgcgcgcacagatttgaagac

SEQ ID NO: 262431 - DNA, 25 bp, Mus musculus
cggttgcgcgcacaggcctcctctg

SEQ ID NO: 262432 - DNA, 25 bp, Mus musculus
cggttgcttaatagattgtgcccac

SEQ ID NO: 262433 - DNA, 25 bp, Mus musculus
cggttggacaagggctgcaaacaca

SEQ ID NO: 262434 - DNA, 25 bp, Mus musculus
cggttggagagagtgtgaacatggc

SEQ ID NO: 262435 - DNA, 25 bp, Mus musculus
cggttggctggcgtgccctacgttg

SEQ ID NO: 262436 - DNA, 25 bp, Mus musculus
cggttgggcagtgaatccaaaacta

SEQ ID NO: 262437 - DNA, 25 bp, Mus musculus
cggttggtggaagatgtgctcgtag

SEQ ID NO: 262438 - DNA, 25 bp, Mus musculus
cggttgtaaaacgagccctcaggga

SEQ ID NO: 262439 - DNA, 25 bp, Mus musculus
cggttgtcagaaacttatggaacga

SEQ ID NO: 262440 - DNA, 25 bp, Mus musculus
cggttgtcaggagatataacagact

SEQ ID NO: 262441 - DNA, 25 bp, Mus musculus
cggttgtcagtccgcagatgcactt

SEQ ID NO: 262442 - DNA, 25 bp, Mus musculus
cggttgtcatgtatcacggtgatcg

SEQ ID NO: 262443 - DNA, 25 bp, Mus musculus
cggttgtgaggtagatgttgtagac

SEQ ID NO: 262444 - DNA, 25 bp, Mus musculus
cggttgtggcggttcccgaggagac

SEQ ID NO: 262445 - DNA, 25 bp, Mus musculus
cggtttaaagcggggatctgatgag

SEQ ID NO: 262446 - DNA, 25 bp, Mus musculus
cggtttagcaactccagctatcacc

SEQ ID NO: 262447 - DNA, 25 bp, Mus musculus
cggtttatcatgacaccaagctgga

SEQ ID NO: 262448 - DNA, 25 bp, Mus musculus
cggtttatgcctgagcgcttcttag

SEQ ID NO: 262449 - DNA, 25 bp, Mus musculus
cggtttatgcctgatccaacaggaa

SEQ ID NO: 262450 - DNA, 25 bp, Mus musculus
cggtttatgctgcgtccctgaccct

SEQ ID NO: 262451 - DNA, 25 bp, Mus musculus
cggtttcaggacaatctctcctgtt

SEQ ID NO: 262452 - DNA, 25 bp, Mus musculus
cggtttccagatgaagctctcaatg

SEQ ID NO: 262453 - DNA, 25 bp, Mus musculus
cggtttcccctttggagtcccatgg

SEQ ID NO: 262454 - DNA, 25 bp, Mus musculus
cggtttcttcaaggacgtagagtca

SEQ ID NO: 262455 - DNA, 25 bp, Mus musculus
cggtttgcaagagtctttttggtgt

SEQ ID NO: 262456 - DNA, 25 bp, Mus musculus
cggtttgcaagggcaaatggaaaaa

SEQ ID NO: 262457 - DNA, 25 bp, Mus musculus
cggtttgcactggtccaacccagac

SEQ ID NO: 262458 - DNA, 25 bp, Mus musculus
cggtttgcaggagagagggagctca

SEQ ID NO: 262459 - DNA, 25 bp, Mus musculus
cggtttgccaagggtatgtcggaga

SEQ ID NO: 262460 - DNA, 25 bp, Mus musculus
cggtttgccagggaaaatcatagtg

SEQ ID NO: 262461 - DNA, 25 bp, Mus musculus
cggtttgccagggcgacggaacaag

SEQ ID NO: 262462 - DNA, 25 bp, Mus musculus
cggtttgccaggtcggatgatgagc

SEQ ID NO: 262463 - DNA, 25 bp, Mus musculus
cggtttgctggaaaggaagcagaca

SEQ ID NO: 262464 - DNA, 25 bp, Mus musculus
cggtttgctggtacacactggtgga

SEQ ID NO: 262465 - DNA, 25 bp, Mus musculus
cggtttggccccagaagtcggtgac

SEQ ID NO: 262466 - DNA, 25 bp, Mus musculus
cggtttggccccagggcctgagcca

SEQ ID NO: 262467 - DNA, 25 bp, Mus musculus
cggtttgtatgaactccagttctca

SEQ ID NO: 262468 - DNA, 25 bp, Mus musculus
cggtttgtgagcctgccgctcatgc

SEQ ID NO: 262469 - DNA, 25 bp, Mus musculus
cggtttgtgagcctgtttgtgggct

SEQ ID NO: 262470 - DNA, 25 bp, Mus musculus
cggtttgtgtttaaggaatcaaaag

SEQ ID NO: 262471 - DNA, 25 bp, Mus musculus
cggttttagttaaaggtctctgtgt

SEQ ID NO: 262472 - DNA, 25 bp, Mus musculus
cggttttccctcagaatgggtcagc

SEQ ID NO: 262473 - DNA, 25 bp, Mus musculus
cggttttgcgaaggatgcacctcag

SEQ ID NO: 262474 - DNA, 25 bp, Mus musculus
cggttttgcgccccctcctctctcc

SEQ ID NO: 262475 - DNA, 25 bp, Mus musculus
cgtaaaaatgagtgaaaaagatgaa

SEQ ID NO: 262476 - DNA, 25 bp, Mus musculus
cgtaaaaatggaaatgcttgatgaa

SEQ ID NO: 262477 - DNA, 25 bp, Mus musculus
cgtaaaatcgaggttaataatgcga

SEQ ID NO: 262478 - DNA, 25 bp, Mus musculus
cgtaaacccaaggcagtgggctcca

SEQ ID NO: 262479 - DNA, 25 bp, Mus musculus
cgtaaagaatgaaggaataacagcc

SEQ ID NO: 262480 - DNA, 25 bp, Mus musculus
cgtaaagttcgaggtcacgttcatg

SEQ ID NO: 262481 - DNA, 25 bp, Mus musculus
cgtaacaagccgcattttctggcgc

SEQ ID NO: 262482 - DNA, 25 bp, Mus musculus
cgtaaccatagctcaccgtgtctct

SEQ ID NO: 262483 - DNA, 25 bp, Mus musculus
cgtaaccatagctcatcgggttcac

SEQ ID NO: 262484 - DNA, 25 bp, Mus musculus
cgtaaccgacctgagacttcattga

SEQ ID NO: 262485 - DNA, 25 bp, Mus musculus
cgtaaccgacctgagcaagaaatta

SEQ ID NO: 262486 - DNA, 25 bp, Mus musculus
cgtaaccgagccccaatccatgttg

SEQ ID NO: 262487 - DNA, 25 bp, Mus musculus
cgtaactctgagataaagtgcagga

SEQ ID NO: 262488 - DNA, 25 bp, Mus musculus
cgtaactctgagtcacaggaatgtg

SEQ ID NO: 262489 - DNA, 25 bp, Mus musculus
cgtaagaacttgaaaactcctcctt

SEQ ID NO: 262490 - DNA, 25 bp, Mus musculus
cgtaagaactttcttttgcatggtt

SEQ ID NO: 262491 - DNA, 25 bp, Mus musculus
cgtaagaatattgagacggccagag

SEQ ID NO: 262492 - DNA, 25 bp, Mus musculus
cgtaagaccaatcgcagcctgcagc

SEQ ID NO: 262493 - DNA, 25 bp, Mus musculus
cgtaagaccagtgggagcaggtgct

SEQ ID NO: 262494 - DNA, 25 bp, Mus musculus
cgtaagagccagctggctcgcatac

SEQ ID NO: 262495 - DNA, 25 bp, Mus musculus
cgtaagagccagttgctatgtccac

SEQ ID NO: 262496 - DNA, 25 bp, Mus musculus
cgtaagattcccacctgttgcccat

SEQ ID NO: 262497 - DNA, 25 bp, Mus musculus
cgtaagcatcagggaaacctcaccg

SEQ ID NO: 262498 - DNA, 25 bp, Mus musculus
cgtaaggagccttagctgccagcgg

SEQ ID NO: 262499 - DNA, 25 bp, Mus musculus
cgtaaggagccttgccctgtgtgtc

SEQ ID NO: 262500 - DNA, 25 bp, Mus musculus
cgtaagtggccctcaaagcggaggg

SEQ ID NO: 262501 - DNA, 25 bp, Mus musculus
cgtacaaagagccagttccaagaat

SEQ ID NO: 262502 - DNA, 25 bp, Mus musculus
cgtacaagcagtgagcttatggggg

SEQ ID NO: 262503 - DNA, 25 bp, Mus musculus
cgtacaatggtggtccatgagaaac

SEQ ID NO: 262504 - DNA, 25 bp, Mus musculus
cgtacacaaatgaagagagacttct

SEQ ID NO: 262505 - DNA, 25 bp, Mus musculus
cgtacacccagagaacctgtctctg

SEQ ID NO: 262506 - DNA, 25 bp, Mus musculus
cgtacacccagcttccggaataaca

SEQ ID NO: 262507 - DNA, 25 bp, Mus musculus
cgtacagctcagccctgcccacctc

SEQ ID NO: 262508 - DNA, 25 bp, Mus musculus
cgtacatcaggtacttcgtgagctt

SEQ ID NO: 262509 - DNA, 25 bp, Mus musculus
cgtaccaatgaaaagggtgccttct

SEQ ID NO: 262510 - DNA, 25 bp, Mus musculus
cgtaccaccggcatcgtgttggatt

SEQ ID NO: 262511 - DNA, 25 bp, Mus musculus
cgtaccagatcagctcaaggcaagg

SEQ ID NO: 262512 - DNA, 25 bp, Mus musculus
cgtaccagcctctggggccctggcc

SEQ ID NO: 262513 - DNA, 25 bp, Mus musculus
cgtacccattcaggctgcaacaggt

SEQ ID NO: 262514 - DNA, 25 bp, Mus musculus
cgtaccccagaccgattttgcacct

SEQ ID NO: 262515 - DNA, 25 bp, Mus musculus
cgtaccctacagaaacactcaaggc

SEQ ID NO: 262516 - DNA, 25 bp, Mus musculus
cgtacctcaatcaaggacagtctta

SEQ ID NO: 262517 - DNA, 25 bp, Mus musculus
cgtacctcaggctcatgtacagtca

SEQ ID NO: 262518 - DNA, 25 bp, Mus musculus
cgtacctcagtacaagcccaccacc

SEQ ID NO: 262519 - DNA, 25 bp, Mus musculus
cgtacctcagttctggctcaaggta

SEQ ID NO: 262520 - DNA, 25 bp, Mus musculus
cgtacctccaggtgatcaagctcgg

SEQ ID NO: 262521 - DNA, 25 bp, Mus musculus
cgtacctgcataaagacagacccct

SEQ ID NO: 262522 - DNA, 25 bp, Mus musculus
cgtacctgcataagaattgaattag

SEQ ID NO: 262523 - DNA, 25 bp, Mus musculus
cgtacctgcatgattgccacaatct

SEQ ID NO: 262524 - DNA, 25 bp, Mus musculus
cgtacctgcatgggtgaaagaattg

SEQ ID NO: 262525 - DNA, 25 bp, Mus musculus
cgtacgaggcagaaatgctgagctt

SEQ ID NO: 262526 - DNA, 25 bp, Mus musculus
cgtacgctggcccttctgtattatt

SEQ ID NO: 262527 - DNA, 25 bp, Mus musculus
cgtacgctggttatttgctggcgta

SEQ ID NO: 262528 - DNA, 25 bp, Mus musculus
cgtacggacaggaggcgttgtctgt

SEQ ID NO: 262529 - DNA, 25 bp, Mus musculus
cgtacggacaggaggggagaagaga

SEQ ID NO: 262530 - DNA, 25 bp, Mus musculus
cgtacggaccaaatggaatgaataa

SEQ ID NO: 262531 - DNA, 25 bp, Mus musculus
cgtactaaaactgtgcagggctatc

SEQ ID NO: 262532 - DNA, 25 bp, Mus musculus
cgtactcaagctccgccctcagtca

SEQ ID NO: 262533 - DNA, 25 bp, Mus musculus
cgtactcaagctcctgtcttctaat

SEQ ID NO: 262534 - DNA, 25 bp, Mus musculus
cgtactccaagaggctcgggtcttt

SEQ ID NO: 262535 - DNA, 25 bp, Mus musculus
cgtactctcttaggaaaagaagacc

SEQ ID NO: 262536 - DNA, 25 bp, Mus musculus
cgtactcttcagaggaatgatattg

SEQ ID NO: 262537 - DNA, 25 bp, Mus musculus
cgtactggagaagttatttccgaga

SEQ ID NO: 262538 - DNA, 25 bp, Mus musculus
cgtactggagacaccaacaggtgga

SEQ ID NO: 262539 - DNA, 25 bp, Mus musculus
cgtactgtgcccccaagtctgtctt

SEQ ID NO: 262540 - DNA, 25 bp, Mus musculus
cgtactgttcgagaggcctccaaca

SEQ ID NO: 262541 - DNA, 25 bp, Mus musculus
cgtacttccgcacctcctctccagg

SEQ ID NO: 262542 - DNA, 25 bp, Mus musculus
cgtacttcctctggactctgtgaag

SEQ ID NO: 262543 - DNA, 25 bp, Mus musculus
cgtacttcctctgtggaaggactct

SEQ ID NO: 262544 - DNA, 25 bp, Mus musculus
cgtacttcgggaggaattatgcttc

SEQ ID NO: 262545 - DNA, 25 bp, Mus musculus
cgtacttcgggagggatgtactgag

SEQ ID NO: 262546 - DNA, 25 bp, Mus musculus
cgtacttctacagttacccagctgt

SEQ ID NO: 262547 - DNA, 25 bp, Mus musculus
cgtagaaatcggaagatcttagatg

SEQ ID NO: 262548 - DNA, 25 bp, Mus musculus
cgtagaagaagctggtcccgtccat

SEQ ID NO: 262549 - DNA, 25 bp, Mus musculus
cgtagaagtggtgattgaaggtgat

SEQ ID NO: 262550 - DNA, 25 bp, Mus musculus
cgtagacctgaaggtgtcccccttg

SEQ ID NO: 262551 - DNA, 25 bp, Mus musculus
cgtagactccgagggacatctctac

SEQ ID NO: 262552 - DNA, 25 bp, Mus musculus
cgtagagaaggctggcaagagatct

SEQ ID NO: 262553 - DNA, 25 bp, Mus musculus
cgtagagaatgcgggtttccgcttc

SEQ ID NO: 262554 - DNA, 25 bp, Mus musculus
cgtagagaccaagaaaatccagcct

SEQ ID NO: 262555 - DNA, 25 bp, Mus musculus
cgtagagaccaagatgaagaaccac

SEQ ID NO: 262556 - DNA, 25 bp, Mus musculus
cgtagagcctagccccgtgtctgaa

SEQ ID NO: 262557 - DNA, 25 bp, Mus musculus
cgtagaggaggagctggagcgctcg

SEQ ID NO: 262558 - DNA, 25 bp, Mus musculus
cgtagaggcggatcacattccagct

SEQ ID NO: 262559 - DNA, 25 bp, Mus musculus
cgtagaggcggggctctgccacgtc

SEQ ID NO: 262560 - DNA, 25 bp, Mus musculus
cgtagatgttgtgaggctggtggag

SEQ ID NO: 262561 - DNA, 25 bp, Mus musculus
cgtagcaagcccgtcctggacaata

SEQ ID NO: 262562 - DNA, 25 bp, Mus musculus
cgtagcagaagcagatataatttct

SEQ ID NO: 262563 - DNA, 25 bp, Mus musculus
cgtagcagaagggttcactgcagtc

SEQ ID NO: 262564 - DNA, 25 bp, Mus musculus
cgtagccaccttcggcactgcagta

SEQ ID NO: 262565 - DNA, 25 bp, Mus musculus
cgtagccagctgctgagaacccaat

SEQ ID NO: 262566 - DNA, 25 bp, Mus musculus
cgtagcccagaaaaatatgaagatc

SEQ ID NO: 262567 - DNA, 25 bp, Mus musculus
cgtagcccagagcaagtccctccac

SEQ ID NO: 262568 - DNA, 25 bp, Mus musculus
cgtagcctcagagatgctggagtgt

SEQ ID NO: 262569 - DNA, 25 bp, Mus musculus
cgtagcctggatgttgccaaggcac

SEQ ID NO: 262570 - DNA, 25 bp, Mus musculus
cgtagcctggggcaggtcacctagc

SEQ ID NO: 262571 - DNA, 25 bp, Mus musculus
cgtagctcccacctgcaccttatag

SEQ ID NO: 262572 - DNA, 25 bp, Mus musculus
cgtagctcccacctggttttctctg

SEQ ID NO: 262573 - DNA, 25 bp, Mus musculus
cgtagctctggtgcaccctctgctc

SEQ ID NO: 262574 - DNA, 25 bp, Mus musculus
cgtagctctgttcccacttcaccct

SEQ ID NO: 262575 - DNA, 25 bp, Mus musculus
cgtagcttcaggtgacctcactgac

SEQ ID NO: 262576 - DNA, 25 bp, Mus musculus
cgtaggaagaagtccctctcgtgac

SEQ ID NO: 262577 - DNA, 25 bp, Mus musculus
cgtaggaagggtggtgctgatcggc

SEQ ID NO: 262578 - DNA, 25 bp, Mus musculus
cgtaggacagaaaggaagcagaggc

SEQ ID NO: 262579 - DNA, 25 bp, Mus musculus
cgtaggacagattgcatctgggtat

SEQ ID NO: 262580 - DNA, 25 bp, Mus musculus
cgtaggagcaatacaccaagtatca

SEQ ID NO: 262581 - DNA, 25 bp, Mus musculus
cgtaggatcatggggtactcaatgc

SEQ ID NO: 262582 - DNA, 25 bp, Mus musculus
cgtaggatcatgggttcctcggcct

SEQ ID NO: 262583 - DNA, 25 bp, Mus musculus
cgtaggatgcagggcattttcccga

SEQ ID NO: 262584 - DNA, 25 bp, Mus musculus
cgtaggatgcaggggtctcactgtg

SEQ ID NO: 262585 - DNA, 25 bp, Mus musculus
cgtaggcacgtgtgggatctttctc

SEQ ID NO: 262586 - DNA, 25 bp, Mus musculus
cgtagggcagatctggtattctttt

SEQ ID NO: 262587 - DNA, 25 bp, Mus musculus
cgtaggggcgaggcacccaagcagt

SEQ ID NO: 262588 - DNA, 25 bp, Mus musculus
cgtagggggcaagcggttcagtacc

SEQ ID NO: 262589 - DNA, 25 bp, Mus musculus
cgtaggtgtggctatttcaatggaa

SEQ ID NO: 262590 - DNA, 25 bp, Mus musculus
cgtagtcaaggcacatcccagcccc

SEQ ID NO: 262591 - DNA, 25 bp, Mus musculus
cgtagtggtgctgacctggacagga

SEQ ID NO: 262592 - DNA, 25 bp, Mus musculus
cgtagtggtggtcttatgctgactg

SEQ ID NO: 262593 - DNA, 25 bp, Mus musculus
cgtataaagacagggaggtggacat

SEQ ID NO: 262594 - DNA, 25 bp, Mus musculus
cgtatacaaggaattttctcgattt

SEQ ID NO: 262595 - DNA, 25 bp, Mus musculus
cgtatacaagttccctctaggaatt

SEQ ID NO: 262596 - DNA, 25 bp, Mus musculus
cgtatacgacacgggccggactgga

SEQ ID NO: 262597 - DNA, 25 bp, Mus musculus
cgtatagccaggtggtgaccgttat

SEQ ID NO: 262598 - DNA, 25 bp, Mus musculus
cgtatataagaagaccctatctaac

SEQ ID NO: 262599 - DNA, 25 bp, Mus musculus
cgtatataagaaggcactaacccta

SEQ ID NO: 262600 - DNA, 25 bp, Mus musculus
cgtatatgatggagagggataaagt

SEQ ID NO: 262601 - DNA, 25 bp, Mus musculus
cgtatatgatgggcaggatagcatg

SEQ ID NO: 262602 - DNA, 25 bp, Mus musculus
cgtatatgatgggttttaaagatgc

SEQ ID NO: 262603 - DNA, 25 bp, Mus musculus
cgtatcagcagtgtagtgattttga

SEQ ID NO: 262604 - DNA, 25 bp, Mus musculus
cgtatcccagaacaacctgcggcac

SEQ ID NO: 262605 - DNA, 25 bp, Mus musculus
cgtatccctcaagtgaccacacact

SEQ ID NO: 262606 - DNA, 25 bp, Mus musculus
cgtatcctagagaggtgctcggtct

SEQ ID NO: 262607 - DNA, 25 bp, Mus musculus
cgtatcctggtgttgggtatgagat

SEQ ID NO: 262608 - DNA, 25 bp, Mus musculus
cgtatccttgaattacatccaaggg

SEQ ID NO: 262609 - DNA, 25 bp, Mus musculus
cgtatccttgtgttatccaagataa

SEQ ID NO: 262610 - DNA, 25 bp, Mus musculus
cgtatctcagccatgatggtaacaa

SEQ ID NO: 262611 - DNA, 25 bp, Mus musculus
cgtatcttctacatggtgccatcag

SEQ ID NO: 262612 - DNA, 25 bp, Mus musculus
cgtatgaccaggtcacaatcattac

SEQ ID NO: 262613 - DNA, 25 bp, Mus musculus
cgtatgatgacatcgactatggcaa

SEQ ID NO: 262614 - DNA, 25 bp, Mus musculus
cgtatgctgggtgaacttcgaggcc

SEQ ID NO: 262615 - DNA, 25 bp, Mus musculus
cgtatggcacacagaaaggggagtg

SEQ ID NO: 262616 - DNA, 25 bp, Mus musculus
cgtatgggcgggctgacgcttccca

SEQ ID NO: 262617 - DNA, 25 bp, Mus musculus
cgtatgggcgggctgctgagaagac

SEQ ID NO: 262618 - DNA, 25 bp, Mus musculus
cgtatgggcgggctggtatgcgtct

SEQ ID NO: 262619 - DNA, 25 bp, Mus musculus
cgtatgtcagcagatcaacttctga

SEQ ID NO: 262620 - DNA, 25 bp, Mus musculus
cgtatgtggagaacgttgacaaaca

SEQ ID NO: 262621 - DNA, 25 bp, Mus musculus
cgtattaacaagtaagtgtggacat

SEQ ID NO: 262622 - DNA, 25 bp, Mus musculus
cgtattactgaagcttaaaaagcaa

SEQ ID NO: 262623 - DNA, 25 bp, Mus musculus
cgtattataaccacagtggaagacc

SEQ ID NO: 262624 - DNA, 25 bp, Mus musculus
cgtattataacctcatcgtgttgta

SEQ ID NO: 262625 - DNA, 25 bp, Mus musculus
cgtattctgagccaggtatcataca

SEQ ID NO: 262626 - DNA, 25 bp, Mus musculus
cgtattgtgcaggcatccagggtat

SEQ ID NO: 262627 - DNA, 25 bp, Mus musculus
cgtatttaacagacaaatggtggcc

SEQ ID NO: 262628 - DNA, 25 bp, Mus musculus
cgtatttaacagacaatcatggccc

SEQ ID NO: 262629 - DNA, 25 bp, Mus musculus
cgtatttaagcagagatgacgtcag

SEQ ID NO: 262630 - DNA, 25 bp, Mus musculus
cgtatttaccgcagaaacagtattg

SEQ ID NO: 262631 - DNA, 25 bp, Mus musculus
cgtatttcagatgatgacactgcca

SEQ ID NO: 262632 - DNA, 25 bp, Mus musculus
cgtcaaactggagcaggcagactgt

SEQ ID NO: 262633 - DNA, 25 bp, Mus musculus
cgtcaaactggaggaaagcacagac

SEQ ID NO: 262634 - DNA, 25 bp, Mus musculus
cgtcaaagaaggggaggaagtttgt

SEQ ID NO: 262635 - DNA, 25 bp, Mus musculus
cgtcaaagacctgatctccaagctg

SEQ ID NO: 262636 - DNA, 25 bp, Mus musculus
cgtcaaagacctgtttctctagatc

SEQ ID NO: 262637 - DNA, 25 bp, Mus musculus
cgtcaaagtcatagttgatattcca

SEQ ID NO: 262638 - DNA, 25 bp, Mus musculus
cgtcaaagtcattgttgatattcca

SEQ ID NO: 262639 - DNA, 25 bp, Mus musculus
cgtcaaagtcgtgaccccaggctcc

SEQ ID NO: 262640 - DNA, 25 bp, Mus musculus
cgtcaacaagcttgctcaggacctc

SEQ ID NO: 262641 - DNA, 25 bp, Mus musculus
cgtcaacagccctggaaatgtggac

SEQ ID NO: 262642 - DNA, 25 bp, Mus musculus
cgtcaacagccctggcactgaagat

SEQ ID NO: 262643 - DNA, 25 bp, Mus musculus
cgtcaaccaggaaaccaaaaagaga

SEQ ID NO: 262644 - DNA, 25 bp, Mus musculus
cgtcaaccctccagaaagccatcga

SEQ ID NO: 262645 - DNA, 25 bp, Mus musculus
cgtcaaccctccggagatggcgtca

SEQ ID NO: 262646 - DNA, 25 bp, Mus musculus
cgtcaacccttcagaaagccatcga

SEQ ID NO: 262647 - DNA, 25 bp, Mus musculus
cgtcaacgggctgagatctcttgat

SEQ ID NO: 262648 - DNA, 25 bp, Mus musculus
cgtcaacgggctgaggtctgtgcag

SEQ ID NO: 262649 - DNA, 25 bp, Mus musculus
cgtcaactctccatcctacctcacg

SEQ ID NO: 262650 - DNA, 25 bp, Mus musculus
cgtcaagatgcagggttccaagcgt

SEQ ID NO: 262651 - DNA, 25 bp, Mus musculus
cgtcaagatgcagtacccccacttc

SEQ ID NO: 262652 - DNA, 25 bp, Mus musculus
cgtcaagcagactcgccagtgatgg

SEQ ID NO: 262653 - DNA, 25 bp, Mus musculus
cgtcaagcagatgaagatcatccat

SEQ ID NO: 262654 - DNA, 25 bp, Mus musculus
cgtcaagcagtggcatcagaaattt

SEQ ID NO: 262655 - DNA, 25 bp, Mus musculus
cgtcaagcagtgggtatatgcttgt

SEQ ID NO: 262656 - DNA, 25 bp, Mus musculus
cgtcaagcccatcagaaaatcaccg

SEQ ID NO: 262657 - DNA, 25 bp, Mus musculus
cgtcaagtactggttgggtggtccg

SEQ ID NO: 262658 - DNA, 25 bp, Mus musculus
cgtcaagtactggtttacaggaaca

SEQ ID NO: 262659 - DNA, 25 bp, Mus musculus
cgtcaatgcacaggatgcagaaggg

SEQ ID NO: 262660 - DNA, 25 bp, Mus musculus
cgtcaatgtctcagatgcactccca

SEQ ID NO: 262661 - DNA, 25 bp, Mus musculus
cgtcacaaaccacttccattgaaga

SEQ ID NO: 262662 - DNA, 25 bp, Mus musculus
cgtcacaaactcttacgacatgatg

SEQ ID NO: 262663 - DNA, 25 bp, Mus musculus
cgtcacaaggttgtcaggaacaata

SEQ ID NO: 262664 - DNA, 25 bp, Mus musculus
cgtcacaataaagatctgggacata

SEQ ID NO: 262665 - DNA, 25 bp, Mus musculus
cgtcacaataaaggtactagtactt

SEQ ID NO: 262666 - DNA, 25 bp, Mus musculus
cgtcacaatgatttctatgggaagc

SEQ ID NO: 262667 - DNA, 25 bp, Mus musculus
cgtcacattagcctttggagctgac

SEQ ID NO: 262668 - DNA, 25 bp, Mus musculus
cgtcacattagggtccgcaagcagg

SEQ ID NO: 262669 - DNA, 25 bp, Mus musculus
cgtcaccaccaccagagagtcggct

SEQ ID NO: 262670 - DNA, 25 bp, Mus musculus
cgtcaccatgcccctggctagagat

SEQ ID NO: 262671 - DNA, 25 bp, Mus musculus
cgtcaccatgggaaggatcatgcgt

SEQ ID NO: 262672 - DNA, 25 bp, Mus musculus
cgtcacccaataggcaactccgaag

SEQ ID NO: 262673 - DNA, 25 bp, Mus musculus
cgtcacccacagcaatgagaggtat

SEQ ID NO: 262674 - DNA, 25 bp, Mus musculus
cgtcaccctccgcaagtgtccattg

SEQ ID NO: 262675 - DNA, 25 bp, Mus musculus
cgtcaccgtggccagaggcggaggc

SEQ ID NO: 262676 - DNA, 25 bp, Mus musculus
cgtcacctctacagatttcctccct

SEQ ID NO: 262677 - DNA, 25 bp, Mus musculus
cgtcacctgtaaggtagaaatttac

SEQ ID NO: 262678 - DNA, 25 bp, Mus musculus
cgtcacctgtaaggtctctagcatc

SEQ ID NO: 262679 - DNA, 25 bp, Mus musculus
cgtcacggattccacactacgccgc

SEQ ID NO: 262680 - DNA, 25 bp, Mus musculus
cgtcactgaccggaggaacaaggat

SEQ ID NO: 262681 - DNA, 25 bp, Mus musculus
cgtcagaaatatgatatcaccaccc

SEQ ID NO: 262682 - DNA, 25 bp, Mus musculus
cgtcagaaatatgatatcatgactg

SEQ ID NO: 262683 - DNA, 25 bp, Mus musculus
cgtcagaaatatgatcagcaagaag

SEQ ID NO: 262684 - DNA, 25 bp, Mus musculus
cgtcagaacagaaatgctgccaaga

SEQ ID NO: 262685 - DNA, 25 bp, Mus musculus
cgtcagaacagatcattgtgacaga

SEQ ID NO: 262686 - DNA, 25 bp, Mus musculus
cgtcagaagagaagacgccagcaaa

SEQ ID NO: 262687 - DNA, 25 bp, Mus musculus
cgtcagaagaggagtccaaaatcga

SEQ ID NO: 262688 - DNA, 25 bp, Mus musculus
cgtcagacaaggaggaaggctcaac

SEQ ID NO: 262689 - DNA, 25 bp, Mus musculus
cgtcagacaaggtaaggaattacat

SEQ ID NO: 262690 - DNA, 25 bp, Mus musculus
cgtcagacagcacatcgtcagcgac

SEQ ID NO: 262691 - DNA, 25 bp, Mus musculus
cgtcagacagctacagcacatcgtc

SEQ ID NO: 262692 - DNA, 25 bp, Mus musculus
cgtcagactacatggaatatgctca

SEQ ID NO: 262693 - DNA, 25 bp, Mus musculus
cgtcagagaaaaacggctcttgctt

SEQ ID NO: 262694 - DNA, 25 bp, Mus musculus
cgtcagagaatgctgactttgcaga

SEQ ID NO: 262695 - DNA, 25 bp, Mus musculus
cgtcagagcccagtctcagatctcg

SEQ ID NO: 262696 - DNA, 25 bp, Mus musculus
cgtcagatgagccctaggaccatga

SEQ ID NO: 262697 - DNA, 25 bp, Mus musculus
cgtcagcaagctgtgggccacattc

SEQ ID NO: 262698 - DNA, 25 bp, Mus musculus
cgtcagcagcagcggcaggaaaagc

SEQ ID NO: 262699 - DNA, 25 bp, Mus musculus
cgtcagcaggaagcgcatccagtat

SEQ ID NO: 262700 - DNA, 25 bp, Mus musculus
cgtcagcaggaagtatggaagcttc

SEQ ID NO: 262701 - DNA, 25 bp, Mus musculus
cgtcagcccagagctgatttatcca

SEQ ID NO: 262702 - DNA, 25 bp, Mus musculus
cgtcagccccacaccaaggagatcc

SEQ ID NO: 262703 - DNA, 25 bp, Mus musculus
cgtcagcccggttagctttatacgt

SEQ ID NO: 262704 - DNA, 25 bp, Mus musculus
cgtcagcgaaaccaggtccacagga

SEQ ID NO: 262705 - DNA, 25 bp, Mus musculus
cgtcagctttgacgttaccaccagg

SEQ ID NO: 262706 - DNA, 25 bp, Mus musculus
cgtcagctttgagtcggtctatgtg

SEQ ID NO: 262707 - DNA, 25 bp, Mus musculus
cgtcaggaactggcggtcttctgtt

SEQ ID NO: 262708 - DNA, 25 bp, Mus musculus
cgtcaggcttctctgcaagagctgt

SEQ ID NO: 262709 - DNA, 25 bp, Mus musculus
cgtcagggcccagtgggaggagtga

SEQ ID NO: 262710 - DNA, 25 bp, Mus musculus
cgtcaggtaatcaaattaaatagac

SEQ ID NO: 262711 - DNA, 25 bp, Mus musculus
cgtcagtaagccagaccactgagca

SEQ ID NO: 262712 - DNA, 25 bp, Mus musculus
cgtcagtccaggaccacttggtcat

SEQ ID NO: 262713 - DNA, 25 bp, Mus musculus
cgtcagtcggatgaggaagggcccg

SEQ ID NO: 262714 - DNA, 25 bp, Mus musculus
cgtcagtctcggcgtggaaaggaga

SEQ ID NO: 262715 - DNA, 25 bp, Mus musculus
cgtcagtctgaaggtgcttcctgga

SEQ ID NO: 262716 - DNA, 25 bp, Mus musculus
cgtcagtctgcctttgcctgatcat

SEQ ID NO: 262717 - DNA, 25 bp, Mus musculus
cgtcagtgcacagaacctcgttgcc

SEQ ID NO: 262718 - DNA, 25 bp, Mus musculus
cgtcagtgtggaagagctcccgcca

SEQ ID NO: 262719 - DNA, 25 bp, Mus musculus
cgtcagtgtggtgatttacaaaaaa

SEQ ID NO: 262720 - DNA, 25 bp, Mus musculus
cgtcagttctgggaagtctccaggc

SEQ ID NO: 262721 - DNA, 25 bp, Mus musculus
cgtcatactctgagtgacagcttcc

SEQ ID NO: 262722 - DNA, 25 bp, Mus musculus
cgtcatagcatcaggcactgttgta

SEQ ID NO: 262723 - DNA, 25 bp, Mus musculus
cgtcatagtacaggattcatcccag

SEQ ID NO: 262724 - DNA, 25 bp, Mus musculus
cgtcatagtactagattcatcccag

SEQ ID NO: 262725 - DNA, 25 bp, Mus musculus
cgtcatatcaggtaacgggcaacca

SEQ ID NO: 262726 - DNA, 25 bp, Mus musculus
cgtcatcaaccctggagaatgcaaa

SEQ ID NO: 262727 - DNA, 25 bp, Mus musculus
cgtcatccacggtgtggcctcttcc

SEQ ID NO: 262728 - DNA, 25 bp, Mus musculus
cgtcatcgttagaagcaaaatctac

SEQ ID NO: 262729 - DNA, 25 bp, Mus musculus
cgtcatcgttagaagctgaaggaag

SEQ ID NO: 262730 - DNA, 25 bp, Mus musculus
cgtcatctgtaccagccgtgactgt

SEQ ID NO: 262731 - DNA, 25 bp, Mus musculus
cgtcatctgtaccaggtgcgcaagg

SEQ ID NO: 262732 - DNA, 25 bp, Mus musculus
cgtcatcttaccgatcaagaagcta

SEQ ID NO: 262733 - DNA, 25 bp, Mus musculus
cgtcatgagtgagattgataacaac

SEQ ID NO: 262734 - DNA, 25 bp, Mus musculus
cgtcatgagtgagggtacaagaagg

SEQ ID NO: 262735 - DNA, 25 bp, Mus musculus
cgtcatgccagatgtctctccgagc

SEQ ID NO: 262736 - DNA, 25 bp, Mus musculus
cgtcatggcaacagactccaagccc

SEQ ID NO: 262737 - DNA, 25 bp, Mus musculus
cgtcatggctattgagcatgcacca

SEQ ID NO: 262738 - DNA, 25 bp, Mus musculus
cgtcatgggcccgattgacgacagt

SEQ ID NO: 262739 - DNA, 25 bp, Mus musculus
cgtcatgggggttaattcctatatc

SEQ ID NO: 262740 - DNA, 25 bp, Mus musculus
cgtcatggggtgtgtgagtgttatg

SEQ ID NO: 262741 - DNA, 25 bp, Mus musculus
cgtcatgtgcagagacaggctttga

SEQ ID NO: 262742 - DNA, 25 bp, Mus musculus
cgtcatgtgcaggctttgatatgtc

SEQ ID NO: 262743 - DNA, 25 bp, Mus musculus
cgtcattcagagaggaatgcgattc

SEQ ID NO: 262744 - DNA, 25 bp, Mus musculus
cgtcattgtcagctggattgtcatt

SEQ ID NO: 262745 - DNA, 25 bp, Mus musculus
cgtcatttatagggttatacagggg

SEQ ID NO: 262746 - DNA, 25 bp, Mus musculus
cgtccaaaaaacagatcaaaaggtc

SEQ ID NO: 262747 - DNA, 25 bp, Mus musculus
cgtccaagaacatgtaccctagtcc

SEQ ID NO: 262748 - DNA, 25 bp, Mus musculus
cgtccaagaggccattgtgagcttt

SEQ ID NO: 262749 - DNA, 25 bp, Mus musculus
cgtccaagagtaagctaaaaaagct

SEQ ID NO: 262750 - DNA, 25 bp, Mus musculus
cgtccaagagtccatatgttgtgaa

SEQ ID NO: 262751 - DNA, 25 bp, Mus musculus
cgtccaagtcactggaatttcttga

SEQ ID NO: 262752 - DNA, 25 bp, Mus musculus
cgtccaagtcactgggaatctgtcc

SEQ ID NO: 262753 - DNA, 25 bp, Mus musculus
cgtccaatatcatggggggatatcc

SEQ ID NO: 262754 - DNA, 25 bp, Mus musculus
cgtccacatgcttgtttatgaattt

SEQ ID NO: 262755 - DNA, 25 bp, Mus musculus
cgtccaccagtgaaaatgtgctatt

SEQ ID NO: 262756 - DNA, 25 bp, Mus musculus
cgtccactccagggctctctaagta

SEQ ID NO: 262757 - DNA, 25 bp, Mus musculus
cgtccagaagaaaacacacgtgaca

SEQ ID NO: 262758 - DNA, 25 bp, Mus musculus
cgtccagaagcccacagtcaccagc

SEQ ID NO: 262759 - DNA, 25 bp, Mus musculus
cgtccagaagggtgaacctaaggaa

SEQ ID NO: 262760 - DNA, 25 bp, Mus musculus
cgtccagagaggcagagacagggca

SEQ ID NO: 262761 - DNA, 25 bp, Mus musculus
cgtccagagcctgtgcttgaggcga

SEQ ID NO: 262762 - DNA, 25 bp, Mus musculus
cgtccagcagcaaagccgacccggg

SEQ ID NO: 262763 - DNA, 25 bp, Mus musculus
cgtccagcaggcgggcttggaggac

SEQ ID NO: 262764 - DNA, 25 bp, Mus musculus
cgtccagccaaggctgtcttcatgc

SEQ ID NO: 262765 - DNA, 25 bp, Mus musculus
cgtccagcgtgcgcccctccagcag

SEQ ID NO: 262766 - DNA, 25 bp, Mus musculus
cgtccagctccaagaaaagcacctt

SEQ ID NO: 262767 - DNA, 25 bp, Mus musculus
cgtccagctcctgggatacgtatta

SEQ ID NO: 262768 - DNA, 25 bp, Mus musculus
cgtccaggacctgcagctcttatgc

SEQ ID NO: 262769 - DNA, 25 bp, Mus musculus
cgtccaggacctgcaggccccccag

SEQ ID NO: 262770 - DNA, 25 bp, Mus musculus
cgtccaggagataattgtgtggagg

SEQ ID NO: 262771 - DNA, 25 bp, Mus musculus
cgtccagggagtgaagccaagaaga

SEQ ID NO: 262772 - DNA, 25 bp, Mus musculus
cgtccagtaacgtgtgctgccatgc

SEQ ID NO: 262773 - DNA, 25 bp, Mus musculus
cgtccagtatagggagaagctgggc

SEQ ID NO: 262774 - DNA, 25 bp, Mus musculus
cgtccagtgcggctgctcctggcac

SEQ ID NO: 262775 - DNA, 25 bp, Mus musculus
cgtccagtgcgggctgatgcatggg

SEQ ID NO: 262776 - DNA, 25 bp, Mus musculus
cgtccagttggttctgaccagaaag

SEQ ID NO: 262777 - DNA, 25 bp, Mus musculus
cgtccatattcccagcttctccagt

SEQ ID NO: 262778 - DNA, 25 bp, Mus musculus
cgtccatctgaagaaaaagaaagaa

SEQ ID NO: 262779 - DNA, 25 bp, Mus musculus
cgtccatctgacaatggattctgaa

SEQ ID NO: 262780 - DNA, 25 bp, Mus musculus
cgtccatctgcaaggaccatggtgg

SEQ ID NO: 262781 - DNA, 25 bp, Mus musculus
cgtccatgaacatatcccgtactct

SEQ ID NO: 262782 - DNA, 25 bp, Mus musculus
cgtccatgaacatgggtccaggagt

SEQ ID NO: 262783 - DNA, 25 bp, Mus musculus
cgtccatgtcgggtgtgaagattgc

SEQ ID NO: 262784 - DNA, 25 bp, Mus musculus
cgtcccaaagaacagaaaatcaatc

SEQ ID NO: 262785 - DNA, 25 bp, Mus musculus
cgtcccaaagaacaggtcctcagaa

SEQ ID NO: 262786 - DNA, 25 bp, Mus musculus
cgtcccaacgaaaattgaacagatc

SEQ ID NO: 262787 - DNA, 25 bp, Mus musculus
cgtcccagcgagcagccctgcaact

SEQ ID NO: 262788 - DNA, 25 bp, Mus musculus
cgtcccagcgcagggacagtcacga

SEQ ID NO: 262789 - DNA, 25 bp, Mus musculus
cgtcccagcggctgaccaaggcctt

SEQ ID NO: 262790 - DNA, 25 bp, Mus musculus
cgtcccagcgtcagcccaggccaga

SEQ ID NO: 262791 - DNA, 25 bp, Mus musculus
cgtcccaggctgatagagacatcgg

SEQ ID NO: 262792 - DNA, 25 bp, Mus musculus
cgtcccaggctggacagagatttcc

SEQ ID NO: 262793 - DNA, 25 bp, Mus musculus
cgtcccaggctggagaaagctgtgg

SEQ ID NO: 262794 - DNA, 25 bp, Mus musculus
cgtcccatggtcaagacgtccgtcc

SEQ ID NO: 262795 - DNA, 25 bp, Mus musculus
cgtccccaactcttcctcccctctt

SEQ ID NO: 262796 - DNA, 25 bp, Mus musculus
cgtccccagacgcttgtcggagctc

SEQ ID NO: 262797 - DNA, 25 bp, Mus musculus
cgtcccccagaggttgagaacaaaa

SEQ ID NO: 262798 - DNA, 25 bp, Mus musculus
cgtccccgcggacggcactgagagt

SEQ ID NO: 262799 - DNA, 25 bp, Mus musculus
cgtccccggacggagctgaagaaga

SEQ ID NO: 262800 - DNA, 25 bp, Mus musculus
cgtccccggtgaggcatatgctatg

SEQ ID NO: 262801 - DNA, 25 bp, Mus musculus
cgtccccggtgaggtataaagagga

SEQ ID NO: 262802 - DNA, 25 bp, Mus musculus
cgtccccggtggaatgcaagacttc

SEQ ID NO: 262803 - DNA, 25 bp, Mus musculus
cgtcccctcaggatcgccacgactc

SEQ ID NO: 262804 - DNA, 25 bp, Mus musculus
cgtcccctccaagagcaaagctgca

SEQ ID NO: 262805 - DNA, 25 bp, Mus musculus
cgtccccttcacggcatatggatca

SEQ ID NO: 262806 - DNA, 25 bp, Mus musculus
cgtccccttcacggttgcagcttca

SEQ ID NO: 262807 - DNA, 25 bp, Mus musculus
cgtcccgcaggtcctgcatgtccag

SEQ ID NO: 262808 - DNA, 25 bp, Mus musculus
cgtcccgctagaccggtggaaccta

SEQ ID NO: 262809 - DNA, 25 bp, Mus musculus
cgtcccggggcggagtttgatggtg

SEQ ID NO: 262810 - DNA, 25 bp, Mus musculus
cgtcccgtggccaggaaggacagga

SEQ ID NO: 262811 - DNA, 25 bp, Mus musculus
cgtccctaaagcaagggagccgagt

SEQ ID NO: 262812 - DNA, 25 bp, Mus musculus
cgtccctcaagagtttacaaacctg

SEQ ID NO: 262813 - DNA, 25 bp, Mus musculus
cgtccctccgggctgtgagcacctc

SEQ ID NO: 262814 - DNA, 25 bp, Mus musculus
cgtccctctcaaccctggctgcact

SEQ ID NO: 262815 - DNA, 25 bp, Mus musculus
cgtccctgccagatgaggatcatgc

SEQ ID NO: 262816 - DNA, 25 bp, Mus musculus
cgtccctgtcatcagattgatcttt

SEQ ID NO: 262817 - DNA, 25 bp, Mus musculus
cgtcccttaggtttgatcagaccta

SEQ ID NO: 262818 - DNA, 25 bp, Mus musculus
cgtcccttcactggctcccactact

SEQ ID NO: 262819 - DNA, 25 bp, Mus musculus
cgtcccttgcagccactgcaagaaa

SEQ ID NO: 262820 - DNA, 25 bp, Mus musculus
cgtcccttgcagccagacgttaggg

SEQ ID NO: 262821 - DNA, 25 bp, Mus musculus
cgtccgagacatgatagaagcgatg

SEQ ID NO: 262822 - DNA, 25 bp, Mus musculus
cgtccgagacatggagatcgagggc

SEQ ID NO: 262823 - DNA, 25 bp, Mus musculus
cgtccgagtccccaagaacacagcc

SEQ ID NO: 262824 - DNA, 25 bp, Mus musculus
cgtccgagtccccaagcacggctgg

SEQ ID NO: 262825 - DNA, 25 bp, Mus musculus
cgtccgagtctccaggaacacagcc

SEQ ID NO: 262826 - DNA, 25 bp, Mus musculus
cgtccgccagactcagtccgctagt

SEQ ID NO: 262827 - DNA, 25 bp, Mus musculus
cgtccgccagagtacagttgaccaa

SEQ ID NO: 262828 - DNA, 25 bp, Mus musculus
cgtccgcgccaggttcatcatttgg

SEQ ID NO: 262829 - DNA, 25 bp, Mus musculus
cgtccgctcagaccagcagtgccgt

SEQ ID NO: 262830 - DNA, 25 bp, Mus musculus
cgtccgctgctgccatccctcaggc

SEQ ID NO: 262831 - DNA, 25 bp, Mus musculus
cgtccggaaggtgaatcggtttagt

SEQ ID NO: 262832 - DNA, 25 bp, Mus musculus
cgtccggcaggggttcatggcatgg

SEQ ID NO: 262833 - DNA, 25 bp, Mus musculus
cgtccggcagtgttctcccgcctgt

SEQ ID NO: 262834 - DNA, 25 bp, Mus musculus
cgtccggcgcgcacagccgttgact

SEQ ID NO: 262835 - DNA, 25 bp, Mus musculus
cgtccgggaaaacaatatggctcct

SEQ ID NO: 262836 - DNA, 25 bp, Mus musculus
cgtccgtcaggtatttgtcaagtgt

SEQ ID NO: 262837 - DNA, 25 bp, Mus musculus
cgtccgtgcccgttctgtacttcac

SEQ ID NO: 262838 - DNA, 25 bp, Mus musculus
cgtccgtggaggttgtcagagaatt

SEQ ID NO: 262839 - DNA, 25 bp, Mus musculus
cgtcctaacccagaacatgtttggg

SEQ ID NO: 262840 - DNA, 25 bp, Mus musculus
cgtcctaatggagccatctttaaat

SEQ ID NO: 262841 - DNA, 25 bp, Mus musculus
cgtcctaatggaggtaattttggga

SEQ ID NO: 262842 - DNA, 25 bp, Mus musculus
cgtcctacgaagattatacagacac

SEQ ID NO: 262843 - DNA, 25 bp, Mus musculus
cgtcctacgtgggctcgccatacga

SEQ ID NO: 262844 - DNA, 25 bp, Mus musculus
cgtcctcaacgtgtattttgttaaa

SEQ ID NO: 262845 - DNA, 25 bp, Mus musculus
cgtcctcatacacagcgtgcagggt

SEQ ID NO: 262846 - DNA, 25 bp, Mus musculus
cgtcctcatttatgatcccataaaa

SEQ ID NO: 262847 - DNA, 25 bp, Mus musculus
cgtcctcccgaccatgctcgcattc

SEQ ID NO: 262848 - DNA, 25 bp, Mus musculus
cgtcctccgcagcctctactcaata

SEQ ID NO: 262849 - DNA, 25 bp, Mus musculus
cgtcctccgcaggttcgtggtacga

SEQ ID NO: 262850 - DNA, 25 bp, Mus musculus
cgtcctcgaagctagggtcccaaag

SEQ ID NO: 262851 - DNA, 25 bp, Mus musculus
cgtcctcgctttgtactggttccgc

SEQ ID NO: 262852 - DNA, 25 bp, Mus musculus
cgtcctcgtcctcctcttcttctaa

SEQ ID NO: 262853 - DNA, 25 bp, Mus musculus
cgtcctcgttggagtgacatcgtct

SEQ ID NO: 262854 - DNA, 25 bp, Mus musculus
cgtcctctcgagacatgaaaaatgc

SEQ ID NO: 262855 - DNA, 25 bp, Mus musculus
cgtcctctcggaggtaacagctagc

SEQ ID NO: 262856 - DNA, 25 bp, Mus musculus
cgtcctctgacccactcttggaact

SEQ ID NO: 262857 - DNA, 25 bp, Mus musculus
cgtcctgaaactgtaccagttcaac

SEQ ID NO: 262858 - DNA, 25 bp, Mus musculus
cgtcctgaacacgacccgagcaacg

SEQ ID NO: 262859 - DNA, 25 bp, Mus musculus
cgtcctgaaccctggcggaggctgc

SEQ ID NO: 262860 - DNA, 25 bp, Mus musculus
cgtcctgaggagatcatctttctga

SEQ ID NO: 262861 - DNA, 25 bp, Mus musculus
cgtcctgcaccaacctgcgagcctg

SEQ ID NO: 262862 - DNA, 25 bp, Mus musculus
cgtcctgcagagcgacgtttttctg

SEQ ID NO: 262863 - DNA, 25 bp, Mus musculus
cgtcctgccccacgggcttcagcag

SEQ ID NO: 262864 - DNA, 25 bp, Mus musculus
cgtcctgccctcactcggccgccgc

SEQ ID NO: 262865 - DNA, 25 bp, Mus musculus
cgtcctgccgggagctcttaccaaa

SEQ ID NO: 262866 - DNA, 25 bp, Mus musculus
cgtcctgcgctctttgagcgctgcc

SEQ ID NO: 262867 - DNA, 25 bp, Mus musculus
cgtcctgctgcaggctgccaacagc

SEQ ID NO: 262868 - DNA, 25 bp, Mus musculus
cgtcctgctgtctcaggtgctcctg

SEQ ID NO: 262869 - DNA, 25 bp, Mus musculus
cgtcctggggagtgaggacagaact

SEQ ID NO: 262870 - DNA, 25 bp, Mus musculus
cgtcctgggtggctctcccagggtg

SEQ ID NO: 262871 - DNA, 25 bp, Mus musculus
cgtcctgtctttgggcagctcaaag

SEQ ID NO: 262872 - DNA, 25 bp, Mus musculus
cgtcctgtgaacaggttgatcgtgt

SEQ ID NO: 262873 - DNA, 25 bp, Mus musculus
cgtcctgtgagagagattccccctc

SEQ ID NO: 262874 - DNA, 25 bp, Mus musculus
cgtcctgtgagatctatgtaagagc

SEQ ID NO: 262875 - DNA, 25 bp, Mus musculus
cgtcctgtgccaggaaagcactgcc

SEQ ID NO: 262876 - DNA, 25 bp, Mus musculus
cgtcctgtgccaggcaaggtgaccc

SEQ ID NO: 262877 - DNA, 25 bp, Mus musculus
cgtcctgtgcctatgcttataccat

SEQ ID NO: 262878 - DNA, 25 bp, Mus musculus
cgtcctgttccaccatagccatcat

SEQ ID NO: 262879 - DNA, 25 bp, Mus musculus
cgtccttcctccaggagccggccac

SEQ ID NO: 262880 - DNA, 25 bp, Mus musculus
cgtccttctagccagctgcagacgg

SEQ ID NO: 262881 - DNA, 25 bp, Mus musculus
cgtccttgaaagccctctgggcgtg

SEQ ID NO: 262882 - DNA, 25 bp, Mus musculus
cgtccttgcggggcctgtgctctct

SEQ ID NO: 262883 - DNA, 25 bp, Mus musculus
cgtccttgggaggttctggctgccc

SEQ ID NO: 262884 - DNA, 25 bp, Mus musculus
cgtccttgtcctctgcgagtggcag

SEQ ID NO: 262885 - DNA, 25 bp, Mus musculus
cgtcctttaggaaaggtatgctgaa

SEQ ID NO: 262886 - DNA, 25 bp, Mus musculus
cgtcgaaaagacaattgggaagaag

SEQ ID NO: 262887 - DNA, 25 bp, Mus musculus
cgtcgaagtcgctgacatcaatgca

SEQ ID NO: 262888 - DNA, 25 bp, Mus musculus
cgtcgaatgaaaacaagatgagcga

SEQ ID NO: 262889 - DNA, 25 bp, Mus musculus
cgtcgaatgaaactatccagcaaga

SEQ ID NO: 262890 - DNA, 25 bp, Mus musculus
cgtcgacgacagggaacgaatggag

SEQ ID NO: 262891 - DNA, 25 bp, Mus musculus
cgtcgagaaatcgagaacactgtta

SEQ ID NO: 262892 - DNA, 25 bp, Mus musculus
cgtcgagaaatcgagaacttgattc

SEQ ID NO: 262893 - DNA, 25 bp, Mus musculus
cgtcgagcagagtgtctacattgtt

SEQ ID NO: 262894 - DNA, 25 bp, Mus musculus
cgtcgagcccaggaggaagaaggca

SEQ ID NO: 262895 - DNA, 25 bp, Mus musculus
cgtcgagtgaccagtggagtgaagc

SEQ ID NO: 262896 - DNA, 25 bp, Mus musculus
cgtcgatacctgaggacacgagagg

SEQ ID NO: 262897 - DNA, 25 bp, Mus musculus
cgtcgatcccagatgtagaactctc

SEQ ID NO: 262898 - DNA, 25 bp, Mus musculus
cgtcgatcccaggtgcacctccgct

SEQ ID NO: 262899 - DNA, 25 bp, Mus musculus
cgtcgatcccaggtgcttgtcctgg

SEQ ID NO: 262900 - DNA, 25 bp, Mus musculus
cgtcgatggtagccgctgccgtgac

SEQ ID NO: 262901 - DNA, 25 bp, Mus musculus
cgtcgatggtagccggaagctgtgc

SEQ ID NO: 262902 - DNA, 25 bp, Mus musculus
cgtcgcagtcaggcctcagctgcac

SEQ ID NO: 262903 - DNA, 25 bp, Mus musculus
cgtcgcagtcagtactgttacataa

SEQ ID NO: 262904 - DNA, 25 bp, Mus musculus
cgtcgccaagcaggtagggccttcc

SEQ ID NO: 262905 - DNA, 25 bp, Mus musculus
cgtcgccatccttgaaattttctga

SEQ ID NO: 262906 - DNA, 25 bp, Mus musculus
cgtcgccatccttgaatgtccagtt

SEQ ID NO: 262907 - DNA, 25 bp, Mus musculus
cgtcgccatggctccagcacccgag

SEQ ID NO: 262908 - DNA, 25 bp, Mus musculus
cgtcgccccgagagaagtcaatgaa

SEQ ID NO: 262909 - DNA, 25 bp, Mus musculus
cgtcgcccctgagaaaaatgtttta

SEQ ID NO: 262910 - DNA, 25 bp, Mus musculus
cgtcgccgagaagacctccttccct

SEQ ID NO: 262911 - DNA, 25 bp, Mus musculus
cgtcgccggggatagaagtggaatt

SEQ ID NO: 262912 - DNA, 25 bp, Mus musculus
cgtcgcctgaagctaagctcccttc

SEQ ID NO: 262913 - DNA, 25 bp, Mus musculus
cgtcgcctgcaggatactttggaac

SEQ ID NO: 262914 - DNA, 25 bp, Mus musculus
cgtcgcctgcaggtgattttcgata

SEQ ID NO: 262915 - DNA, 25 bp, Mus musculus
cgtcgcctgcaggtgtctaagcact

SEQ ID NO: 262916 - DNA, 25 bp, Mus musculus
cgtcgcgcacaggattacatcttct

SEQ ID NO: 262917 - DNA, 25 bp, Mus musculus
cgtcgcgcacaggccctaccgtgga

SEQ ID NO: 262918 - DNA, 25 bp, Mus musculus
cgtcgcggccgcatggcggacaagg

SEQ ID NO: 262919 - DNA, 25 bp, Mus musculus
cgtcgcgtggatcggaactccagcg

SEQ ID NO: 262920 - DNA, 25 bp, Mus musculus
cgtcgcgtggatcggttcgccttgc

SEQ ID NO: 262921 - DNA, 25 bp, Mus musculus
cgtcgctagagttttcaggaagagc

SEQ ID NO: 262922 - DNA, 25 bp, Mus musculus
cgtcgctccgaaatcatgtccacac

SEQ ID NO: 262923 - DNA, 25 bp, Mus musculus
cgtcgctgaagccagagagtcatgg

SEQ ID NO: 262924 - DNA, 25 bp, Mus musculus
cgtcgctgagttctggaatacagtg

SEQ ID NO: 262925 - DNA, 25 bp, Mus musculus
cgtcgcttaccggtggaagcttgga

SEQ ID NO: 262926 - DNA, 25 bp, Mus musculus
cgtcgcttaccgttaccgcaggtgg

SEQ ID NO: 262927 - DNA, 25 bp, Mus musculus
cgtcgcttcctcaagctgagtcctg

SEQ ID NO: 262928 - DNA, 25 bp, Mus musculus
cgtcggaaactcagatgaatgaaga

SEQ ID NO: 262929 - DNA, 25 bp, Mus musculus
cgtcggaacagccgtgaagcaccta

SEQ ID NO: 262930 - DNA, 25 bp, Mus musculus
cgtcggaaccatggcttccctttcc

SEQ ID NO: 262931 - DNA, 25 bp, Mus musculus
cgtcggacatgcagtggaaagttcg

SEQ ID NO: 262932 - DNA, 25 bp, Mus musculus
cgtcggagatgaagattcaatgaga

SEQ ID NO: 262933 - DNA, 25 bp, Mus musculus
cgtcggcaatggctatgacattgcc

SEQ ID NO: 262934 - DNA, 25 bp, Mus musculus
cgtcggcatcagaacggccggtttg

SEQ ID NO: 262935 - DNA, 25 bp, Mus musculus
cgtcggctcagctggacagagggga

SEQ ID NO: 262936 - DNA, 25 bp, Mus musculus
cgtcgggaccaggatgaggctgtag

SEQ ID NO: 262937 - DNA, 25 bp, Mus musculus
cgtcgggccctcagccctaccagca

SEQ ID NO: 262938 - DNA, 25 bp, Mus musculus
cgtcgggccctcagtgagttgcaga

SEQ ID NO: 262939 - DNA, 25 bp, Mus musculus
cgtcgggccgccagatagaaggaca

SEQ ID NO: 262940 - DNA, 25 bp, Mus musculus
cgtcggggctccccgcctccgctga

SEQ ID NO: 262941 - DNA, 25 bp, Mus musculus
cgtcggtattttcaggaaatcagcc

SEQ ID NO: 262942 - DNA, 25 bp, Mus musculus
cgtcggtgctgcgatccggaggaag

SEQ ID NO: 262943 - DNA, 25 bp, Mus musculus
cgtcggtgctggccttcccagaacg

SEQ ID NO: 262944 - DNA, 25 bp, Mus musculus
cgtcgtactcttcagaggaatgata

SEQ ID NO: 262945 - DNA, 25 bp, Mus musculus
cgtcgtagtcagcattttcttgaga

SEQ ID NO: 262946 - DNA, 25 bp, Mus musculus
cgtcgtcatgatggagaggagaaga

SEQ ID NO: 262947 - DNA, 25 bp, Mus musculus
cgtcgtccgagtctccaggaacaca

SEQ ID NO: 262948 - DNA, 25 bp, Mus musculus
cgtcgtcgtccgctccagaaatctt

SEQ ID NO: 262949 - DNA, 25 bp, Mus musculus
cgtcgtgaagttaagcaaaactggc

SEQ ID NO: 262950 - DNA, 25 bp, Mus musculus
cgtcgtgcgttgcaggtctccggga

SEQ ID NO: 262951 - DNA, 25 bp, Mus musculus
cgtcgtggtgccgatctctgagaag

SEQ ID NO: 262952 - DNA, 25 bp, Mus musculus
cgtcgtgtacagtgacaccatctgt

SEQ ID NO: 262953 - DNA, 25 bp, Mus musculus
cgtcgtgtcttgggtcttctccatc

SEQ ID NO: 262954 - DNA, 25 bp, Mus musculus
cgtcgtgtgcagccagtcaggggag

SEQ ID NO: 262955 - DNA, 25 bp, Mus musculus
cgtcgtgtgcaggcagtcaggggag

SEQ ID NO: 262956 - DNA, 25 bp, Mus musculus
cgtcgttgttacagtttgccaggca

SEQ ID NO: 262957 - DNA, 25 bp, Mus musculus
cgtctacaagacgctgaaggacttc

SEQ ID NO: 262958 - DNA, 25 bp, Mus musculus
cgtctacaaggccatgacgttgatg

SEQ ID NO: 262959 - DNA, 25 bp, Mus musculus
cgtctaccaagctgttccacgcacc

SEQ ID NO: 262960 - DNA, 25 bp, Mus musculus
cgtctaccaaggagaggaacgtccc

SEQ ID NO: 262961 - DNA, 25 bp, Mus musculus
cgtctacggcggagtggaacactcg

SEQ ID NO: 262962 - DNA, 25 bp, Mus musculus
cgtctactccagtaaatcctgtcat

SEQ ID NO: 262963 - DNA, 25 bp, Mus musculus
cgtctagccccaggctcaatttgag

SEQ ID NO: 262964 - DNA, 25 bp, Mus musculus
cgtctagggagtagaacagaggcgt

SEQ ID NO: 262965 - DNA, 25 bp, Mus musculus
cgtctatagccaaggacattaagga

SEQ ID NO: 262966 - DNA, 25 bp, Mus musculus
cgtctatcagtcttgtctgtattcc

SEQ ID NO: 262967 - DNA, 25 bp, Mus musculus
cgtctatctgagatgccttattgga

SEQ ID NO: 262968 - DNA, 25 bp, Mus musculus
cgtctatgcaaaacgtataaatcct

SEQ ID NO: 262969 - DNA, 25 bp, Mus musculus
cgtctatgcaaaactgcttcaccga

SEQ ID NO: 262970 - DNA, 25 bp, Mus musculus
cgtctattcgtaatgatttcattat

SEQ ID NO: 262971 - DNA, 25 bp, Mus musculus
cgtctcactcacatagctaacccaa

SEQ ID NO: 262972 - DNA, 25 bp, Mus musculus
cgtctcactcacatgtgctggagag

SEQ ID NO: 262973 - DNA, 25 bp, Mus musculus
cgtctcagaaggtggacactgcact

SEQ ID NO: 262974 - DNA, 25 bp, Mus musculus
cgtctcagattggctatgtagtcag

SEQ ID NO: 262975 - DNA, 25 bp, Mus musculus
cgtctccaagaatggtcctggcact

SEQ ID NO: 262976 - DNA, 25 bp, Mus musculus
cgtctccacagccagagaacctgaa

SEQ ID NO: 262977 - DNA, 25 bp, Mus musculus
cgtctcccaggtgttcttgaagttt

SEQ ID NO: 262978 - DNA, 25 bp, Mus musculus
cgtctccctcttcacctcgctgagg

SEQ ID NO: 262979 - DNA, 25 bp, Mus musculus
cgtctccgccagaggatccgtgaag

SEQ ID NO: 262980 - DNA, 25 bp, Mus musculus
cgtctccgccagagggtgcactatt

SEQ ID NO: 262981 - DNA, 25 bp, Mus musculus
cgtctccgccggcgctggagaatct

SEQ ID NO: 262982 - DNA, 25 bp, Mus musculus
cgtctccgctggcgagcctccctgt

SEQ ID NO: 262983 - DNA, 25 bp, Mus musculus
cgtctccggcaatctctgagtttgg

SEQ ID NO: 262984 - DNA, 25 bp, Mus musculus
cgtctccggcaggaatttaatgaag

SEQ ID NO: 262985 - DNA, 25 bp, Mus musculus
cgtctccgggctggtttgataacct

SEQ ID NO: 262986 - DNA, 25 bp, Mus musculus
cgtctcctatagcagggtctacctg

SEQ ID NO: 262987 - DNA, 25 bp, Mus musculus
cgtctcctcagagagtcagtccttc

SEQ ID NO: 262988 - DNA, 25 bp, Mus musculus
cgtctcctcagagtctgcgagaaat

SEQ ID NO: 262989 - DNA, 25 bp, Mus musculus
cgtctcctcagccaaaacaacaccc

SEQ ID NO: 262990 - DNA, 25 bp, Mus musculus
cgtctcctcagccaaaacaacagcc

SEQ ID NO: 262991 - DNA, 25 bp, Mus musculus
cgtctcctcagccaaaacgacaccc

SEQ ID NO: 262992 - DNA, 25 bp, Mus musculus
cgtctcctcagcctctatcaggaac

SEQ ID NO: 262993 - DNA, 25 bp, Mus musculus
cgtctcctgcacgtgaggagcatgt

SEQ ID NO: 262994 - DNA, 25 bp, Mus musculus
cgtctccttccacaagaagaacgag

SEQ ID NO: 262995 - DNA, 25 bp, Mus musculus
cgtctccttccacaagtttcctctt

SEQ ID NO: 262996 - DNA, 25 bp, Mus musculus
cgtctccttgtccaagatcgagcgg

SEQ ID NO: 262997 - DNA, 25 bp, Mus musculus
cgtctcgataataagatcagcacca

SEQ ID NO: 262998 - DNA, 25 bp, Mus musculus
cgtctctaagtaacatacaagagat

SEQ ID NO: 262999 - DNA, 25 bp, Mus musculus
cgtctctcaggtgccgcaccagttt

SEQ ID NO: 263000 - DNA, 25 bp, Mus musculus
cgtctctccaaagtacttgggagac

SEQ ID NO: 263001 - DNA, 25 bp, Mus musculus
cgtctctcgaatctacactgaccct

SEQ ID NO: 263002 - DNA, 25 bp, Mus musculus
cgtctctcgaggttgcctgatatag

SEQ ID NO: 263003 - DNA, 25 bp, Mus musculus
cgtctctgagccacctgcgcaacag

SEQ ID NO: 263004 - DNA, 25 bp, Mus musculus
cgtctctgcagaagtttgatggtga

SEQ ID NO: 263005 - DNA, 25 bp, Mus musculus
cgtctctgtggacacagaagccatg

SEQ ID NO: 263006 - DNA, 25 bp, Mus musculus
cgtctcttggctcagaaatcctacg

SEQ ID NO: 263007 - DNA, 25 bp, Mus musculus
cgtctctttcaaattaattgtggtg

SEQ ID NO: 263008 - DNA, 25 bp, Mus musculus
cgtctgaaaccacagaggaagcatt

SEQ ID NO: 263009 - DNA, 25 bp, Mus musculus
cgtctgaaaccacagcattctcatc

SEQ ID NO: 263010 - DNA, 25 bp, Mus musculus
cgtctgaaaccacagctctagccaa

SEQ ID NO: 263011 - DNA, 25 bp, Mus musculus
cgtctgagtggagaacttcacctcc

SEQ ID NO: 263012 - DNA, 25 bp, Mus musculus
cgtctgcaaagataaaagctttgat

SEQ ID NO: 263013 - DNA, 25 bp, Mus musculus
cgtctgcactacgcgggtgacttca

SEQ ID NO: 263014 - DNA, 25 bp, Mus musculus
cgtctgcagaagcaacctcttacct

SEQ ID NO: 263015 - DNA, 25 bp, Mus musculus
cgtctgcagaaggccaagatggaca

SEQ ID NO: 263016 - DNA, 25 bp, Mus musculus
cgtctgcagactcggtcaccactca

SEQ ID NO: 263017 - DNA, 25 bp, Mus musculus
cgtctgcagcaagatcttggccaac

SEQ ID NO: 263018 - DNA, 25 bp, Mus musculus
cgtctgcagcaagcacatgcatccc

SEQ ID NO: 263019 - DNA, 25 bp, Mus musculus
cgtctgcatcgaggtggacaacatc

SEQ ID NO: 263020 - DNA, 25 bp, Mus musculus
cgtctgccaggcagacggctctgtg

SEQ ID NO: 263021 - DNA, 25 bp, Mus musculus
cgtctgccagtgcgaccagtaccgg

SEQ ID NO: 263022 - DNA, 25 bp, Mus musculus
cgtctgcctctgtccagttgtccct

SEQ ID NO: 263023 - DNA, 25 bp, Mus musculus
cgtctgcggagcggggttgaaagac

SEQ ID NO: 263024 - DNA, 25 bp, Mus musculus
cgtctgcggagcgggtttatggtcg

SEQ ID NO: 263025 - DNA, 25 bp, Mus musculus
cgtctgctgcatctctgagctgctg

SEQ ID NO: 263026 - DNA, 25 bp, Mus musculus
cgtctgctgcggtttctttgctctg

SEQ ID NO: 263027 - DNA, 25 bp, Mus musculus
cgtctggagatgaagctataaaagc

SEQ ID NO: 263028 - DNA, 25 bp, Mus musculus
cgtctggagcaggtgtgccacagat

SEQ ID NO: 263029 - DNA, 25 bp, Mus musculus
cgtctggatgacagctctgaccagg

SEQ ID NO: 263030 - DNA, 25 bp, Mus musculus
cgtctggcacagctgctgaaccagg

SEQ ID NO: 263031 - DNA, 25 bp, Mus musculus
cgtctggcacaggcttctgccctca

SEQ ID NO: 263032 - DNA, 25 bp, Mus musculus
cgtctggcaggtccaagggtagcca

SEQ ID NO: 263033 - DNA, 25 bp, Mus musculus
cgtctggccgccacggatgggtgct

SEQ ID NO: 263034 - DNA, 25 bp, Mus musculus
cgtctgtaactgggatcatggcagg

SEQ ID NO: 263035 - DNA, 25 bp, Mus musculus
cgtctgtaactgtcatcagagatca

SEQ ID NO: 263036 - DNA, 25 bp, Mus musculus
cgtctgtaagaatgacatacggccg

SEQ ID NO: 263037 - DNA, 25 bp, Mus musculus
cgtctgtcagccatcgtctagagaa

SEQ ID NO: 263038 - DNA, 25 bp, Mus musculus
cgtctgtcccgtcatctcccccaga

SEQ ID NO: 263039 - DNA, 25 bp, Mus musculus
cgtctgtgaagatcactgttaagaa

SEQ ID NO: 263040 - DNA, 25 bp, Mus musculus
cgtctgtgacaggtgacacggctca

SEQ ID NO: 263041 - DNA, 25 bp, Mus musculus
cgtctgtgacagtggagatctcaga

SEQ ID NO: 263042 - DNA, 25 bp, Mus musculus
cgtctgtgaccacagaatcagacac

SEQ ID NO: 263043 - DNA, 25 bp, Mus musculus
cgtctgtgaccacagatcttacctt

SEQ ID NO: 263044 - DNA, 25 bp, Mus musculus
cgtctgtttgctttgagcgctgccg

SEQ ID NO: 263045 - DNA, 25 bp, Mus musculus
cgtcttaaacaagcaataccttctg

SEQ ID NO: 263046 - DNA, 25 bp, Mus musculus
cgtcttaaggagctaagggaacaat

SEQ ID NO: 263047 - DNA, 25 bp, Mus musculus
cgtcttatttattggcacagacaca

SEQ ID NO: 263048 - DNA, 25 bp, Mus musculus
cgtcttcagattggagattttattt

SEQ ID NO: 263049 - DNA, 25 bp, Mus musculus
cgtcttcagattggttctgtaagcg

SEQ ID NO: 263050 - DNA, 25 bp, Mus musculus
cgtcttcatcgcgcccttgctgacc

SEQ ID NO: 263051 - DNA, 25 bp, Mus musculus
cgtcttcatcgtggacctgctgcag

SEQ ID NO: 263052 - DNA, 25 bp, Mus musculus
cgtcttcccacgaacaagatgccat

SEQ ID NO: 263053 - DNA, 25 bp, Mus musculus
cgtcttcccacggatgtgatcttcg

SEQ ID NO: 263054 - DNA, 25 bp, Mus musculus
cgtcttccgtgcaggcgcctaaaag

SEQ ID NO: 263055 - DNA, 25 bp, Mus musculus
cgtcttcctctggaatcaacataaa

SEQ ID NO: 263056 - DNA, 25 bp, Mus musculus
cgtcttcctgaaggttgagaacaaa

SEQ ID NO: 263057 - DNA, 25 bp, Mus musculus
cgtcttcgtctgaagacaaacctga

SEQ ID NO: 263058 - DNA, 25 bp, Mus musculus
cgtcttcgtctgaagatgggtcaga

SEQ ID NO: 263059 - DNA, 25 bp, Mus musculus
cgtcttctactagagttatctggga

SEQ ID NO: 263060 - DNA, 25 bp, Mus musculus
cgtcttctatctttggtatagttgg

SEQ ID NO: 263061 - DNA, 25 bp, Mus musculus
cgtcttctcagtcaggtaccaagcg

SEQ ID NO: 263062 - DNA, 25 bp, Mus musculus
cgtcttctcagtcaggtcgcagaca

SEQ ID NO: 263063 - DNA, 25 bp, Mus musculus
cgtcttctctggggtctatgtttct

SEQ ID NO: 263064 - DNA, 25 bp, Mus musculus
cgtcttctgctgtggaacgacatcg

SEQ ID NO: 263065 - DNA, 25 bp, Mus musculus
cgtcttctggctggctggaggcgtg

SEQ ID NO: 263066 - DNA, 25 bp, Mus musculus
cgtcttggggggtgtgaagaagttg

SEQ ID NO: 263067 - DNA, 25 bp, Mus musculus
cgtcttggtggtgtgtcggagctcc

SEQ ID NO: 263068 - DNA, 25 bp, Mus musculus
cgtcttgttacaggaagaaccccca

SEQ ID NO: 263069 - DNA, 25 bp, Mus musculus
cgtcttgttcaaaggaaatgccacc

SEQ ID NO: 263070 - DNA, 25 bp, Mus musculus
cgtcttgttcaaagggaagtggctg

SEQ ID NO: 263071 - DNA, 25 bp, Mus musculus
cgtctttcagaagttctatgcaaga

SEQ ID NO: 263072 - DNA, 25 bp, Mus musculus
cgtctttcagacagacatgagtgtc

SEQ ID NO: 263073 - DNA, 25 bp, Mus musculus
cgtctttcagctacagcggaacatc

SEQ ID NO: 263074 - DNA, 25 bp, Mus musculus
cgtctttcaggctgatgccccaaac

SEQ ID NO: 263075 - DNA, 25 bp, Mus musculus
cgtctttccagcccctgctggctct

SEQ ID NO: 263076 - DNA, 25 bp, Mus musculus
cgtctttccaggtcatcctgttcag

SEQ ID NO: 263077 - DNA, 25 bp, Mus musculus
cgtctttgaccttgggtgccttcca

SEQ ID NO: 263078 - DNA, 25 bp, Mus musculus
cgtctttgacttgctgaacattgtt

SEQ ID NO: 263079 - DNA, 25 bp, Mus musculus
cgtctttgcagtatggtggaaccca

SEQ ID NO: 263080 - DNA, 25 bp, Mus musculus
cgtctttggagggtggaagagcaga

SEQ ID NO: 263081 - DNA, 25 bp, Mus musculus
cgtcttttatctcaggtgacataaa

SEQ ID NO: 263082 - DNA, 25 bp, Mus musculus
cgtcttttcaaggtatttcctggtg

SEQ ID NO: 263083 - DNA, 25 bp, Mus musculus
cgtgaaaactatggattccaaaatg

SEQ ID NO: 263084 - DNA, 25 bp, Mus musculus
cgtgaaaactatggtgacctgctgg

SEQ ID NO: 263085 - DNA, 25 bp, Mus musculus
cgtgaaaatcagatgggatcagtca

SEQ ID NO: 263086 - DNA, 25 bp, Mus musculus
cgtgaaacaccattgctggggttcg

SEQ ID NO: 263087 - DNA, 25 bp, Mus musculus
cgtgaaactagaaatgatggaagaa

SEQ ID NO: 263088 - DNA, 25 bp, Mus musculus
cgtgaaactgacaccccggaggcag

SEQ ID NO: 263089 - DNA, 25 bp, Mus musculus
cgtgaaagaaacagaggtcaacagt

SEQ ID NO: 263090 - DNA, 25 bp, Mus musculus
cgtgaaagaaacagcttttaaagac

SEQ ID NO: 263091 - DNA, 25 bp, Mus musculus
cgtgaaagagaggaggcgcaggcag

SEQ ID NO: 263092 - DNA, 25 bp, Mus musculus
cgtgaaaggcaaagccatgtcatat

SEQ ID NO: 263093 - DNA, 25 bp, Mus musculus
cgtgaaagtgtgtggtgcaacagaa

SEQ ID NO: 263094 - DNA, 25 bp, Mus musculus
cgtgaaatcttcagctgctgacctc

SEQ ID NO: 263095 - DNA, 25 bp, Mus musculus
cgtgaacacagaaatcccttcactc

SEQ ID NO: 263096 - DNA, 25 bp, Mus musculus
cgtgaacacagggggcttccgaagt

SEQ ID NO: 263097 - DNA, 25 bp, Mus musculus
cgtgaacacagtaacctcagtcacc

SEQ ID NO: 263098 - DNA, 25 bp, Mus musculus
cgtgaaccctaggttctgctgcctt

SEQ ID NO: 263099 - DNA, 25 bp, Mus musculus
cgtgaacctcaccagcatgtccaaa

SEQ ID NO: 263100 - DNA, 25 bp, Mus musculus
cgtgaacctgcagtggaccccgaag

SEQ ID NO: 263101 - DNA, 25 bp, Mus musculus
cgtgaacgccatagaaaagtttcac

SEQ ID NO: 263102 - DNA, 25 bp, Mus musculus
cgtgaacgccatagaagtttcactc

SEQ ID NO: 263103 - DNA, 25 bp, Mus musculus
cgtgaacgccatagcatcaaaagac

SEQ ID NO: 263104 - DNA, 25 bp, Mus musculus
cgtgaacgccatagtggcattgaac

SEQ ID NO: 263105 - DNA, 25 bp, Mus musculus
cgtgaactggttaccaggcctgaat

SEQ ID NO: 263106 - DNA, 25 bp, Mus musculus
cgtgaagaaaattattgatattttc

SEQ ID NO: 263107 - DNA, 25 bp, Mus musculus
cgtgaagaacctaatatcaggacaa

SEQ ID NO: 263108 - DNA, 25 bp, Mus musculus
cgtgaagaacctgcaactggacaat

SEQ ID NO: 263109 - DNA, 25 bp, Mus musculus
cgtgaagacctgctgccgacaacct

SEQ ID NO: 263110 - DNA, 25 bp, Mus musculus
cgtgaagactgacaagcactgcccc

SEQ ID NO: 263111 - DNA, 25 bp, Mus musculus
cgtgaagatgcgcatgggaggcttt

SEQ ID NO: 263112 - DNA, 25 bp, Mus musculus
cgtgaagcgactccggccctcgaca

SEQ ID NO: 263113 - DNA, 25 bp, Mus musculus
cgtgaagctaggtactgggtttgga

SEQ ID NO: 263114 - DNA, 25 bp, Mus musculus
cgtgaaggaagaggctgtggccctg

SEQ ID NO: 263115 - DNA, 25 bp, Mus musculus
cgtgaagggaggggatcaaactctt

SEQ ID NO: 263116 - DNA, 25 bp, Mus musculus
cgtgaatcctcttggttcagacaat

SEQ ID NO: 263117 - DNA, 25 bp, Mus musculus
cgtgaatgggggcaatggcatctcc

SEQ ID NO: 263118 - DNA, 25 bp, Mus musculus
cgtgacaaataccggggtgaacctg

SEQ ID NO: 263119 - DNA, 25 bp, Mus musculus
cgtgacacctaaggtgaaggcgata

SEQ ID NO: 263120 - DNA, 25 bp, Mus musculus
cgtgacagagatggtcaagagattt

SEQ ID NO: 263121 - DNA, 25 bp, Mus musculus
cgtgacagaggaacagaaattcttt

SEQ ID NO: 263122 - DNA, 25 bp, Mus musculus
cgtgacagaggcgttctctgcggct

SEQ ID NO: 263123 - DNA, 25 bp, Mus musculus
cgtgacagagtggaatctggtgtgt

SEQ ID NO: 263124 - DNA, 25 bp, Mus musculus
cgtgacagagtgggacctggtgtgt

SEQ ID NO: 263125 - DNA, 25 bp, Mus musculus
cgtgacagtcaaagaacactggtga

SEQ ID NO: 263126 - DNA, 25 bp, Mus musculus
cgtgacatcaagctggaaaacctta

SEQ ID NO: 263127 - DNA, 25 bp, Mus musculus
cgtgacattgccctccccttttttt

SEQ ID NO: 263128 - DNA, 25 bp, Mus musculus
cgtgacccagcccgtccgcctcacc

SEQ ID NO: 263129 - DNA, 25 bp, Mus musculus
cgtgaccgtgagcccattctgcact

SEQ ID NO: 263130 - DNA, 25 bp, Mus musculus
cgtgacggagatttcttgacctaca

SEQ ID NO: 263131 - DNA, 25 bp, Mus musculus
cgtgactacgagacggtggtgaaag

SEQ ID NO: 263132 - DNA, 25 bp, Mus musculus
cgtgactgagtggaaccttgtgtgc

SEQ ID NO: 263133 - DNA, 25 bp, Mus musculus
cgtgactggacaggttttatacgtt

SEQ ID NO: 263134 - DNA, 25 bp, Mus musculus
cgtgactggctggtgtgcaggattt

SEQ ID NO: 263135 - DNA, 25 bp, Mus musculus
cgtgactgtttggtgctgcagagct

SEQ ID NO: 263136 - DNA, 25 bp, Mus musculus
cgtgactttcttcagttgtttcctc

SEQ ID NO: 263137 - DNA, 25 bp, Mus musculus
cgtgagaaagataggttgcagctgt

SEQ ID NO: 263138 - DNA, 25 bp, Mus musculus
cgtgagagagtacatcggcatcatg

SEQ ID NO: 263139 - DNA, 25 bp, Mus musculus
cgtgagagatctgaagcagataaag

SEQ ID NO: 263140 - DNA, 25 bp, Mus musculus
cgtgagcaggaggagctgagcaagc

SEQ ID NO: 263141 - DNA, 25 bp, Mus musculus
cgtgagcaggtacctggagtctgtg

SEQ ID NO: 263142 - DNA, 25 bp, Mus musculus
cgtgagcgcctatgacttggtgctg

SEQ ID NO: 263143 - DNA, 25 bp, Mus musculus
cgtgagcggagagtgaagtgtgtca

SEQ ID NO: 263144 - DNA, 25 bp, Mus musculus
cgtgagcttcaggaaaaacataaac

SEQ ID NO: 263145 - DNA, 25 bp, Mus musculus
cgtgagcttcaggttcatggacact

SEQ ID NO: 263146 - DNA, 25 bp, Mus musculus
cgtgaggaacaaagacaaagccagt

SEQ ID NO: 263147 - DNA, 25 bp, Mus musculus
cgtgaggactatggcaggttcaccg

SEQ ID NO: 263148 - DNA, 25 bp, Mus musculus
cgtgaggagaatgtcccagaaatcc

SEQ ID NO: 263149 - DNA, 25 bp, Mus musculus
cgtgaggagagacgtggagaaatgg

SEQ ID NO: 263150 - DNA, 25 bp, Mus musculus
cgtgaggagccggtccagattatct

SEQ ID NO: 263151 - DNA, 25 bp, Mus musculus
cgtgaggagtaccaggagaccctga

SEQ ID NO: 263152 - DNA, 25 bp, Mus musculus
cgtgaggagtaccaggaggagctgg

SEQ ID NO: 263153 - DNA, 25 bp, Mus musculus
cgtgagtaaacaagaattcctcaga

SEQ ID NO: 263154 - DNA, 25 bp, Mus musculus
cgtgagtaaacaagatctcgccctc

SEQ ID NO: 263155 - DNA, 25 bp, Mus musculus
cgtgagtacgccaggagtgagagag

SEQ ID NO: 263156 - DNA, 25 bp, Mus musculus
cgtgagtcagatgttccagcccatc

SEQ ID NO: 263157 - DNA, 25 bp, Mus musculus
cgtgagtcgaaacattgtggatttc

SEQ ID NO: 263158 - DNA, 25 bp, Mus musculus
cgtgagtgagattccctgttctgca

SEQ ID NO: 263159 - DNA, 25 bp, Mus musculus
cgtgagtgccaggtgatacttaaat

SEQ ID NO: 263160 - DNA, 25 bp, Mus musculus
cgtgagtggaagaatcctcggctcc

SEQ ID NO: 263161 - DNA, 25 bp, Mus musculus
cgtgagtggaaggcgagaactccac

SEQ ID NO: 263162 - DNA, 25 bp, Mus musculus
cgtgagtggaaggggattttacagt

SEQ ID NO: 263163 - DNA, 25 bp, Mus musculus
cgtgagttcagcgacattaaggccc

SEQ ID NO: 263164 - DNA, 25 bp, Mus musculus
cgtgagtttcacaagtggatagaga

SEQ ID NO: 263165 - DNA, 25 bp, Mus musculus
cgtgagtttcttgtaatagggccca

SEQ ID NO: 263166 - DNA, 25 bp, Mus musculus
cgtgagtttttggagttagaacaaa

SEQ ID NO: 263167 - DNA, 25 bp, Mus musculus
cgtgatcaaaggtatgagggtgctg

SEQ ID NO: 263168 - DNA, 25 bp, Mus musculus
cgtgatccccaagggtgtgctggct

SEQ ID NO: 263169 - DNA, 25 bp, Mus musculus
cgtgatccccaagtgcctggctgag

SEQ ID NO: 263170 - DNA, 25 bp, Mus musculus
cgtgatctcaagttggagaatttga

SEQ ID NO: 263171 - DNA, 25 bp, Mus musculus
cgtgatctcggagtcctccgggcag

SEQ ID NO: 263172 - DNA, 25 bp, Mus musculus
cgtgatctcgggcaatggcagcaga

SEQ ID NO: 263173 - DNA, 25 bp, Mus musculus
cgtgatctgggtactgtggcaagat

SEQ ID NO: 263174 - DNA, 25 bp, Mus musculus
cgtgatgacagggtccaaggctgca

SEQ ID NO: 263175 - DNA, 25 bp, Mus musculus
cgtgatgactgataaacaagctgga

SEQ ID NO: 263176 - DNA, 25 bp, Mus musculus
cgtgatgccatgaagccattttcag

SEQ ID NO: 263177 - DNA, 25 bp, Mus musculus
cgtgatgggaaggtatggatgtatt

SEQ ID NO: 263178 - DNA, 25 bp, Mus musculus
cgtgatgggtagtgatgtaagcggt

SEQ ID NO: 263179 - DNA, 25 bp, Mus musculus
cgtgatttccagtccctgcagggct

SEQ ID NO: 263180 - DNA, 25 bp, Mus musculus
cgtgcaaaaggtaactttcggcctg

SEQ ID NO: 263181 - DNA, 25 bp, Mus musculus
cgtgcaaaattcagaatgggctgta

SEQ ID NO: 263182 - DNA, 25 bp, Mus musculus
cgtgcaacttaccagacttggtggt

SEQ ID NO: 263183 - DNA, 25 bp, Mus musculus
cgtgcaacttaccaggtggatccca

SEQ ID NO: 263184 - DNA, 25 bp, Mus musculus
cgtgcaatcacaggtggataccctt

SEQ ID NO: 263185 - DNA, 25 bp, Mus musculus
cgtgcaattagagaaagataagggc

SEQ ID NO: 263186 - DNA, 25 bp, Mus musculus
cgtgcaattaggcgtgcagccggca

SEQ ID NO: 263187 - DNA, 25 bp, Mus musculus
cgtgcacagcagaggcagacaggca

SEQ ID NO: 263188 - DNA, 25 bp, Mus musculus
cgtgcacatccgagatgatgggcgt

SEQ ID NO: 263189 - DNA, 25 bp, Mus musculus
cgtgcacccagaaaacgaagagatg

SEQ ID NO: 263190 - DNA, 25 bp, Mus musculus
cgtgcacccagaaatgtatgagctt

SEQ ID NO: 263191 - DNA, 25 bp, Mus musculus
cgtgcacccaggggggaagccctat

SEQ ID NO: 263192 - DNA, 25 bp, Mus musculus
cgtgcacctaatgccacagagcaac

SEQ ID NO: 263193 - DNA, 25 bp, Mus musculus
cgtgcacgcggtcagaactgtgccg

SEQ ID NO: 263194 - DNA, 25 bp, Mus musculus
cgtgcacggcaacagatttctttct

SEQ ID NO: 263195 - DNA, 25 bp, Mus musculus
cgtgcacggcaacaggcctgatggg

SEQ ID NO: 263196 - DNA, 25 bp, Mus musculus
cgtgcactagcgggacttggtgagt

SEQ ID NO: 263197 - DNA, 25 bp, Mus musculus
cgtgcactagcggtctcaaaagatt

SEQ ID NO: 263198 - DNA, 25 bp, Mus musculus
cgtgcactatgagtctacctgaagg

SEQ ID NO: 263199 - DNA, 25 bp, Mus musculus
cgtgcactgggttaaaaacgacaac

SEQ ID NO: 263200 - DNA, 25 bp, Mus musculus
cgtgcagaacagagcctacttccag

SEQ ID NO: 263201 - DNA, 25 bp, Mus musculus
cgtgcagaagaatgccaccagtacc

SEQ ID NO: 263202 - DNA, 25 bp, Mus musculus
cgtgcagaagcagaaagaagaagaa

SEQ ID NO: 263203 - DNA, 25 bp, Mus musculus
cgtgcagacacagatgacgctcctg

SEQ ID NO: 263204 - DNA, 25 bp, Mus musculus
cgtgcagaggggtaccccaagatgg

SEQ ID NO: 263205 - DNA, 25 bp, Mus musculus
cgtgcagagtctgtgcggtgaccac

SEQ ID NO: 263206 - DNA, 25 bp, Mus musculus
cgtgcagcaagacccagaagctggg

SEQ ID NO: 263207 - DNA, 25 bp, Mus musculus
cgtgcagcccgagggatgagtttgt

SEQ ID NO: 263208 - DNA, 25 bp, Mus musculus
cgtgcaggagcagcctgagagggac

SEQ ID NO: 263209 - DNA, 25 bp, Mus musculus
cgtgcagtgatcgtttcagctctgc

SEQ ID NO: 263210 - DNA, 25 bp, Mus musculus
cgtgcagtggagctccgcgtgagtc

SEQ ID NO: 263211 - DNA, 25 bp, Mus musculus
cgtgcatattcagggtgacggcctc

SEQ ID NO: 263212 - DNA, 25 bp, Mus musculus
cgtgcatgaagacataccgacgctt

SEQ ID NO: 263213 - DNA, 25 bp, Mus musculus
cgtgccaaaatatctactagaaatg

SEQ ID NO: 263214 - DNA, 25 bp, Mus musculus
cgtgccaagcaggcagctgtgttaa

SEQ ID NO: 263215 - DNA, 25 bp, Mus musculus
cgtgccaagcgaagagacagggcag

SEQ ID NO: 263216 - DNA, 25 bp, Mus musculus
cgtgccaatgcgcttaagaaaatca

SEQ ID NO: 263217 - DNA, 25 bp, Mus musculus
cgtgccaatgcgtgcatgtcctgca

SEQ ID NO: 263218 - DNA, 25 bp, Mus musculus
cgtgccacagttcttgctgctgatt

SEQ ID NO: 263219 - DNA, 25 bp, Mus musculus
cgtgccactattgagcatgacctcc

SEQ ID NO: 263220 - DNA, 25 bp, Mus musculus
cgtgccagatgctaggcatgaggtg

SEQ ID NO: 263221 - DNA, 25 bp, Mus musculus
cgtgccatcatggacatcgataagg

SEQ ID NO: 263222 - DNA, 25 bp, Mus musculus
cgtgcccaaggttgtccagagctag

SEQ ID NO: 263223 - DNA, 25 bp, Mus musculus
cgtgcccacagcccaggctatatca

SEQ ID NO: 263224 - DNA, 25 bp, Mus musculus
cgtgcccacgagacttttctttgag

SEQ ID NO: 263225 - DNA, 25 bp, Mus musculus
cgtgcccacgagttcccacttggac

SEQ ID NO: 263226 - DNA, 25 bp, Mus musculus
cgtgcccaggggcaggatggtgttg

SEQ ID NO: 263227 - DNA, 25 bp, Mus musculus
cgtgccccgccgcaggcccggacac

SEQ ID NO: 263228 - DNA, 25 bp, Mus musculus
cgtgcccgagtttcaggtgccatgc

SEQ ID NO: 263229 - DNA, 25 bp, Mus musculus
cgtgcccggaaagccccggcagccc

SEQ ID NO: 263230 - DNA, 25 bp, Mus musculus
cgtgcccgggaagagttcagccggc

SEQ ID NO: 263231 - DNA, 25 bp, Mus musculus
cgtgcccgtatagattacatctcgc

SEQ ID NO: 263232 - DNA, 25 bp, Mus musculus
cgtgcccgtataggcacgtcagctt

SEQ ID NO: 263233 - DNA, 25 bp, Mus musculus
cgtgcccgtgaagagtgtttcccga

SEQ ID NO: 263234 - DNA, 25 bp, Mus musculus
cgtgcccgtggtgtgccccctctct

SEQ ID NO: 263235 - DNA, 25 bp, Mus musculus
cgtgccctatgggaatattcagagc

SEQ ID NO: 263236 - DNA, 25 bp, Mus musculus
cgtgccgacagactaacctaacatg

SEQ ID NO: 263237 - DNA, 25 bp, Mus musculus
cgtgccgacaggagatgatttctcc

SEQ ID NO: 263238 - DNA, 25 bp, Mus musculus
cgtgccgcgggagaggaaaagcagc

SEQ ID NO: 263239 - DNA, 25 bp, Mus musculus
cgtgccgcgggtgtgccaggagagg

SEQ ID NO: 263240 - DNA, 25 bp, Mus musculus
cgtgccgctcttggtttccatcgtg

SEQ ID NO: 263241 - DNA, 25 bp, Mus musculus
cgtgccggcagaggtggtttgtgca

SEQ ID NO: 263242 - DNA, 25 bp, Mus musculus
cgtgccggcagcagagacttgctga

SEQ ID NO: 263243 - DNA, 25 bp, Mus musculus
cgtgccggcggcctcagcactcttt

SEQ ID NO: 263244 - DNA, 25 bp, Mus musculus
cgtgccggttgagagggggcacaat

SEQ ID NO: 263245 - DNA, 25 bp, Mus musculus
cgtgccgtagcggggatgatgagca

SEQ ID NO: 263246 - DNA, 25 bp, Mus musculus
cgtgcctatactagtgagcatcaga

SEQ ID NO: 263247 - DNA, 25 bp, Mus musculus
cgtgcctatcaatcccaggctccgg

SEQ ID NO: 263248 - DNA, 25 bp, Mus musculus
cgtgcctatcaggaaaggactcagc

SEQ ID NO: 263249 - DNA, 25 bp, Mus musculus
cgtgcctccactcaggtctgggaac

SEQ ID NO: 263250 - DNA, 25 bp, Mus musculus
cgtgcctccaggaataacaggcaat

SEQ ID NO: 263251 - DNA, 25 bp, Mus musculus
cgtgcctccaggagacacaaagcag

SEQ ID NO: 263252 - DNA, 25 bp, Mus musculus
cgtgcctctgagatcccgtttcatg

SEQ ID NO: 263253 - DNA, 25 bp, Mus musculus
cgtgcctgagaactccgtgcaagaa

SEQ ID NO: 263254 - DNA, 25 bp, Mus musculus
cgtgcctgtgtgtctcagcctcagc

SEQ ID NO: 263255 - DNA, 25 bp, Mus musculus
cgtgcgaaagaagactttaagaaac

SEQ ID NO: 263256 - DNA, 25 bp, Mus musculus
cgtgcgacaaggaaacttatggaac

SEQ ID NO: 263257 - DNA, 25 bp, Mus musculus
cgtgcgacaagggtgactattatat

SEQ ID NO: 263258 - DNA, 25 bp, Mus musculus
cgtgcgacaaggtccgcagatgcac

SEQ ID NO: 263259 - DNA, 25 bp, Mus musculus
cgtgcgcaaactgactgatgatgct

SEQ ID NO: 263260 - DNA, 25 bp, Mus musculus
cgtgcgcaaactggcgccccttgtc

SEQ ID NO: 263261 - DNA, 25 bp, Mus musculus
cgtgcgcaagggtgaaaaatttgga

SEQ ID NO: 263262 - DNA, 25 bp, Mus musculus
cgtgcgcaaggtacgtgggagcaag

SEQ ID NO: 263263 - DNA, 25 bp, Mus musculus
cgtgcgcagagcagattttctgcat

SEQ ID NO: 263264 - DNA, 25 bp, Mus musculus
cgtgcgcagcaggctgcctgctgtc

SEQ ID NO: 263265 - DNA, 25 bp, Mus musculus
cgtgcgcatcacccagaacacacca

SEQ ID NO: 263266 - DNA, 25 bp, Mus musculus
cgtgcgccaggtgtcttctgcagag

SEQ ID NO: 263267 - DNA, 25 bp, Mus musculus
cgtgcgcctgcaggtctctgcaaga

SEQ ID NO: 263268 - DNA, 25 bp, Mus musculus
cgtgcgcctgcaggtggtggtggaa

SEQ ID NO: 263269 - DNA, 25 bp, Mus musculus
cgtgcgcctgcaggttcacattgag

SEQ ID NO: 263270 - DNA, 25 bp, Mus musculus
cgtgcgcctggccaggatccatttt

SEQ ID NO: 263271 - DNA, 25 bp, Mus musculus
cgtgcgcctggccaggtctggcata

SEQ ID NO: 263272 - DNA, 25 bp, Mus musculus
cgtgcgcgacaagccgaactgcttt

SEQ ID NO: 263273 - DNA, 25 bp, Mus musculus
cgtgcgcgcagggtttcacttagca

SEQ ID NO: 263274 - DNA, 25 bp, Mus musculus
cgtgcgcgcaggtacagcgcagcag

SEQ ID NO: 263275 - DNA, 25 bp, Mus musculus
cgtgcgcgctctcaggaggaggcaa

SEQ ID NO: 263276 - DNA, 25 bp, Mus musculus
cgtgcgcgctctcaggctagagttc

SEQ ID NO: 263277 - DNA, 25 bp, Mus musculus
cgtgcgctccgctagccaacatgag

SEQ ID NO: 263278 - DNA, 25 bp, Mus musculus
cgtgcgctcggaactgtgtcgtgat

SEQ ID NO: 263279 - DNA, 25 bp, Mus musculus
cgtgcggccagtgtgtgtgtatgga

SEQ ID NO: 263280 - DNA, 25 bp, Mus musculus
cgtgcggccggagggattcatcagt

SEQ ID NO: 263281 - DNA, 25 bp, Mus musculus
cgtgcggccggagggattcgaggac

SEQ ID NO: 263282 - DNA, 25 bp, Mus musculus
cgtgcgggtgtgaacaacgtgggca

SEQ ID NO: 263283 - DNA, 25 bp, Mus musculus
cgtgcgtaatgacttccctgctggg

SEQ ID NO: 263284 - DNA, 25 bp, Mus musculus
cgtgcgttcaggaggcagactccgg

SEQ ID NO: 263285 - DNA, 25 bp, Mus musculus
cgtgcgttgcaggtctccgggactc

SEQ ID NO: 263286 - DNA, 25 bp, Mus musculus
cgtgctaataagattgagtctgttt

SEQ ID NO: 263287 - DNA, 25 bp, Mus musculus
cgtgctaataaggggttgatagtcc

SEQ ID NO: 263288 - DNA, 25 bp, Mus musculus
cgtgctaatgatcaaagcgctgcag

SEQ ID NO: 263289 - DNA, 25 bp, Mus musculus
cgtgctaatgatcaacggttccagt

SEQ ID NO: 263290 - DNA, 25 bp, Mus musculus
cgtgctagaggaaccagcagataga

SEQ ID NO: 263291 - DNA, 25 bp, Mus musculus
cgtgctcaacctgctggttggtggg

SEQ ID NO: 263292 - DNA, 25 bp, Mus musculus
cgtgctcaccagtttgacttcggag

SEQ ID NO: 263293 - DNA, 25 bp, Mus musculus
cgtgctcatggaaacttcgggtgga

SEQ ID NO: 263294 - DNA, 25 bp, Mus musculus
cgtgctcatggggtacgtgtgtgct

SEQ ID NO: 263295 - DNA, 25 bp, Mus musculus
cgtgctccaaggggagcctcctttc

SEQ ID NO: 263296 - DNA, 25 bp, Mus musculus
cgtgctccagtgtggcgctgactcc

SEQ ID NO: 263297 - DNA, 25 bp, Mus musculus
cgtgctccgagggaagctctacaaa

SEQ ID NO: 263298 - DNA, 25 bp, Mus musculus
cgtgctccttgcagatttctaacga

SEQ ID NO: 263299 - DNA, 25 bp, Mus musculus
cgtgctgaaaggaagcaggtcccag

SEQ ID NO: 263300 - DNA, 25 bp, Mus musculus
cgtgctgaaagtgtctgatgccatt

SEQ ID NO: 263301 - DNA, 25 bp, Mus musculus
cgtgctgaatgatgctgggatccag

SEQ ID NO: 263302 - DNA, 25 bp, Mus musculus
cgtgctgagagcgaaccccgactgc

SEQ ID NO: 263303 - DNA, 25 bp, Mus musculus
cgtgctgatggacagccctgggatc

SEQ ID NO: 263304 - DNA, 25 bp, Mus musculus
cgtgctgcaaggtgatgaagtctcg

SEQ ID NO: 263305 - DNA, 25 bp, Mus musculus
cgtgctgcagactggtcttctcagt

SEQ ID NO: 263306 - DNA, 25 bp, Mus musculus
cgtgctgccgtttagctcgatgaga

SEQ ID NO: 263307 - DNA, 25 bp, Mus musculus
cgtgctgctgagagcggcccctttg

SEQ ID NO: 263308 - DNA, 25 bp, Mus musculus
cgtgctgctgagaggttcatgtact

SEQ ID NO: 263309 - DNA, 25 bp, Mus musculus
cgtgctgctgcaggtactagaagac

SEQ ID NO: 263310 - DNA, 25 bp, Mus musculus
cgtgctggccacagagttcctggag

SEQ ID NO: 263311 - DNA, 25 bp, Mus musculus
cgtgctggccacaggcctgcccaag

SEQ ID NO: 263312 - DNA, 25 bp, Mus musculus
cgtgctgggcaggtacctggacaat

SEQ ID NO: 263313 - DNA, 25 bp, Mus musculus
cgtgctgggcctggccaggagtgaa

SEQ ID NO: 263314 - DNA, 25 bp, Mus musculus
cgtgctggtaggcccacagaacatg

SEQ ID NO: 263315 - DNA, 25 bp, Mus musculus
cgtgctgtactggatgcaagacgct

SEQ ID NO: 263316 - DNA, 25 bp, Mus musculus
cgtgctgtactgggtcaatgatgcc

SEQ ID NO: 263317 - DNA, 25 bp, Mus musculus
cgtgctgtgcccctggctgggtttg

SEQ ID NO: 263318 - DNA, 25 bp, Mus musculus
cgtgctgtgcccctgttcacctgct

SEQ ID NO: 263319 - DNA, 25 bp, Mus musculus
cgtgctgttcccgatccgtacttcg

SEQ ID NO: 263320 - DNA, 25 bp, Mus musculus
cgtgcttggcggcgcctgtgagaga

SEQ ID NO: 263321 - DNA, 25 bp, Mus musculus
cgtggaaaacatggggcttctcacc

SEQ ID NO: 263322 - DNA, 25 bp, Mus musculus
cgtggaaagccgaaggtcctggtta

SEQ ID NO: 263323 - DNA, 25 bp, Mus musculus
cgtggaacaagtgctagccattgag

SEQ ID NO: 263324 - DNA, 25 bp, Mus musculus
cgtggaagaagggagcagcatccac

SEQ ID NO: 263325 - DNA, 25 bp, Mus musculus
cgtggaagaaggtgctccttcagca

SEQ ID NO: 263326 - DNA, 25 bp, Mus musculus
cgtggaagaggtaaagagagatcca

SEQ ID NO: 263327 - DNA, 25 bp, Mus musculus
cgtggaagaggtcagcagagcactt

SEQ ID NO: 263328 - DNA, 25 bp, Mus musculus
cgtggaagaggtcagggccaaaact

SEQ ID NO: 263329 - DNA, 25 bp, Mus musculus
cgtggaagagtccccaagagctgct

SEQ ID NO: 263330 - DNA, 25 bp, Mus musculus
cgtggaagcagagcgttggtcagac

SEQ ID NO: 263331 - DNA, 25 bp, Mus musculus
cgtggaaggcagaaaccaggtggcc

SEQ ID NO: 263332 - DNA, 25 bp, Mus musculus
cgtggaagttcaaggactcccttac

SEQ ID NO: 263333 - DNA, 25 bp, Mus musculus
cgtggaatatcagaagtgacagaca

SEQ ID NO: 263334 - DNA, 25 bp, Mus musculus
cgtggacaagtccctgctccagtac

SEQ ID NO: 263335 - DNA, 25 bp, Mus musculus
cgtggacacccttcatggcggctga

SEQ ID NO: 263336 - DNA, 25 bp, Mus musculus
cgtggacacctatgaacttgcgatg

SEQ ID NO: 263337 - DNA, 25 bp, Mus musculus
cgtggacacctatgttttcaaagat

SEQ ID NO: 263338 - DNA, 25 bp, Mus musculus
cgtggacacttgagaggctacagac

SEQ ID NO: 263339 - DNA, 25 bp, Mus musculus
cgtggacagcagtcccagcgcttcc

SEQ ID NO: 263340 - DNA, 25 bp, Mus musculus
cgtggacatcgttaaccagaatgga

SEQ ID NO: 263341 - DNA, 25 bp, Mus musculus
cgtggaccacgaatgtgccgcttca

SEQ ID NO: 263342 - DNA, 25 bp, Mus musculus
cgtggacccagctgtcctggaagat

SEQ ID NO: 263343 - DNA, 25 bp, Mus musculus
cgtggaccccagacatcacgagcat

SEQ ID NO: 263344 - DNA, 25 bp, Mus musculus
cgtggaccccagcggcagctccggc

SEQ ID NO: 263345 - DNA, 25 bp, Mus musculus
cgtggaccccgtggatggtgtggtc

SEQ ID NO: 263346 - DNA, 25 bp, Mus musculus
cgtggaccccgtggtctacgtgaca

SEQ ID NO: 263347 - DNA, 25 bp, Mus musculus
cgtggacctccactccaggcagcag

SEQ ID NO: 263348 - DNA, 25 bp, Mus musculus
cgtggacgagagtttcggggccagg

SEQ ID NO: 263349 - DNA, 25 bp, Mus musculus
cgtggacgaggtgtccacagaactg

SEQ ID NO: 263350 - DNA, 25 bp, Mus musculus
cgtggactacaagatgtcccacttt

SEQ ID NO: 263351 - DNA, 25 bp, Mus musculus
cgtggactctacaggagagtattgt

SEQ ID NO: 263352 - DNA, 25 bp, Mus musculus
cgtggactgaggtgctgcactgtgc

SEQ ID NO: 263353 - DNA, 25 bp, Mus musculus
cgtggacttagagcatcactcttac

SEQ ID NO: 263354 - DNA, 25 bp, Mus musculus
cgtggagaagatggttccatatctg

SEQ ID NO: 263355 - DNA, 25 bp, Mus musculus
cgtggagaatccgaggccacaggcc

SEQ ID NO: 263356 - DNA, 25 bp, Mus musculus
cgtggagaatgtgggctcatggcag

SEQ ID NO: 263357 - DNA, 25 bp, Mus musculus
cgtggagacaggacctcacgcatcc

SEQ ID NO: 263358 - DNA, 25 bp, Mus musculus
cgtggagacagtttgaagaggacat

SEQ ID NO: 263359 - DNA, 25 bp, Mus musculus
cgtggagaccaacagacctgatagc

SEQ ID NO: 263360 - DNA, 25 bp, Mus musculus
cgtggagaccaacagcaagaactgg

SEQ ID NO: 263361 - DNA, 25 bp, Mus musculus
cgtggagatggagacattgatggac

SEQ ID NO: 263362 - DNA, 25 bp, Mus musculus
cgtggagcaagtgtttgccaagaat

SEQ ID NO: 263363 - DNA, 25 bp, Mus musculus
cgtggagcacatatcgacttggaga

SEQ ID NO: 263364 - DNA, 25 bp, Mus musculus
cgtggagcacctgggagatactgtc

SEQ ID NO: 263365 - DNA, 25 bp, Mus musculus
cgtggagcaggacctggcaatgggc

SEQ ID NO: 263366 - DNA, 25 bp, Mus musculus
cgtggagcagggccgactgatcttt

SEQ ID NO: 263367 - DNA, 25 bp, Mus musculus
cgtggagcccttgacgcctccttgg

SEQ ID NO: 263368 - DNA, 25 bp, Mus musculus
cgtggagccgcgtagactttaagaa

SEQ ID NO: 263369 - DNA, 25 bp, Mus musculus
cgtggagcgagcggatttgataatg

SEQ ID NO: 263370 - DNA, 25 bp, Mus musculus
cgtggagctgagaaccagtcttctg

SEQ ID NO: 263371 - DNA, 25 bp, Mus musculus
cgtggagctgagctcactccgtgtc

SEQ ID NO: 263372 - DNA, 25 bp, Mus musculus
cgtggagctgctgggaagatgctac

SEQ ID NO: 263373 - DNA, 25 bp, Mus musculus
cgtggaggaaatcaatcgcaagcag

SEQ ID NO: 263374 - DNA, 25 bp, Mus musculus
cgtggaggatgacttgattatcttt

SEQ ID NO: 263375 - DNA, 25 bp, Mus musculus
cgtggaggcctcatgatgcctggaa

SEQ ID NO: 263376 - DNA, 25 bp, Mus musculus
cgtggaggcctcatgatggggcatc

SEQ ID NO: 263377 - DNA, 25 bp, Mus musculus
cgtggaggtggggtgctgtgagtgg

SEQ ID NO: 263378 - DNA, 25 bp, Mus musculus
cgtggagtcaaagagtggcttcacc

SEQ ID NO: 263379 - DNA, 25 bp, Mus musculus
cgtggagttacagctgccttgcctt

SEQ ID NO: 263380 - DNA, 25 bp, Mus musculus
cgtggagttcagcagcacttggaac

SEQ ID NO: 263381 - DNA, 25 bp, Mus musculus
cgtggataacatgagcatcatcagc

SEQ ID NO: 263382 - DNA, 25 bp, Mus musculus
cgtggatcacgaaggtaacttcatg

SEQ ID NO: 263383 - DNA, 25 bp, Mus musculus
cgtggatcacgaattgggccggtgt

SEQ ID NO: 263384 - DNA, 25 bp, Mus musculus
cgtggatccagaccaaaaccaacaa

SEQ ID NO: 263385 - DNA, 25 bp, Mus musculus
cgtggatcggaactccagcgaccca

SEQ ID NO: 263386 - DNA, 25 bp, Mus musculus
cgtggatcggcggttcattacagca

SEQ ID NO: 263387 - DNA, 25 bp, Mus musculus
cgtggatcggttcgccttgcgccat

SEQ ID NO: 263388 - DNA, 25 bp, Mus musculus
cgtggatctgcagccatgtcatatc

SEQ ID NO: 263389 - DNA, 25 bp, Mus musculus
cgtggatgacaaggcatctgtgggc

SEQ ID NO: 263390 - DNA, 25 bp, Mus musculus
cgtggatgactgaagctggccccgt

SEQ ID NO: 263391 - DNA, 25 bp, Mus musculus
cgtggatgactgggcagccacgccc

SEQ ID NO: 263392 - DNA, 25 bp, Mus musculus
cgtggatgagtacgctccagaagga

SEQ ID NO: 263393 - DNA, 25 bp, Mus musculus
cgtggatgagttttgaagtgaggag

SEQ ID NO: 263394 - DNA, 25 bp, Mus musculus
cgtggatgcaggccctgcttctcta

SEQ ID NO: 263395 - DNA, 25 bp, Mus musculus
cgtggatgcagggagcccccgggcc

SEQ ID NO: 263396 - DNA, 25 bp, Mus musculus
cgtggatgctgtggtggaatgcaat

SEQ ID NO: 263397 - DNA, 25 bp, Mus musculus
cgtggattccctccatccatatctc

SEQ ID NO: 263398 - DNA, 25 bp, Mus musculus
cgtggattggccggctatggggcat

SEQ ID NO: 263399 - DNA, 25 bp, Mus musculus
cgtggatttccaggcagtagaggcc

SEQ ID NO: 263400 - DNA, 25 bp, Mus musculus
cgtggatttccaggccgtggtattc

SEQ ID NO: 263401 - DNA, 25 bp, Mus musculus
cgtggcaaaaagtcagtccgaccgc

SEQ ID NO: 263402 - DNA, 25 bp, Mus musculus
cgtggcaagagccagcagcagcagc

SEQ ID NO: 263403 - DNA, 25 bp, Mus musculus
cgtggcaatcctggttctcgtggtg

SEQ ID NO: 263404 - DNA, 25 bp, Mus musculus
cgtggcacggcaggattcacagatg

SEQ ID NO: 263405 - DNA, 25 bp, Mus musculus
cgtggcagaggtagttctggtaggc

SEQ ID NO: 263406 - DNA, 25 bp, Mus musculus
cgtggcagggccgaggcccgatttc

SEQ ID NO: 263407 - DNA, 25 bp, Mus musculus
cgtggcagggctgagagatgggaaa

SEQ ID NO: 263408 - DNA, 25 bp, Mus musculus
cgtggcaggggtactacaagaagtt

SEQ ID NO: 263409 - DNA, 25 bp, Mus musculus
cgtggccacagagacactggagctc

SEQ ID NO: 263410 - DNA, 25 bp, Mus musculus
cgtggccagcacccggctacctgag

SEQ ID NO: 263411 - DNA, 25 bp, Mus musculus
cgtggccagcacccgggctgtggct

SEQ ID NO: 263412 - DNA, 25 bp, Mus musculus
cgtggccatacaggtcctgtccaga

SEQ ID NO: 263413 - DNA, 25 bp, Mus musculus
cgtggccatcataggtacccaggat

SEQ ID NO: 263414 - DNA, 25 bp, Mus musculus
cgtggccattgaggtgaggcacaga

SEQ ID NO: 263415 - DNA, 25 bp, Mus musculus
cgtggcccagacagtgactcaggtg

SEQ ID NO: 263416 - DNA, 25 bp, Mus musculus
cgtggccccagggttgtgagccccg

SEQ ID NO: 263417 - DNA, 25 bp, Mus musculus
cgtggcccccgaggatgtcagtgct

SEQ ID NO: 263418 - DNA, 25 bp, Mus musculus
cgtggccgagctagcaacctttccc

SEQ ID NO: 263419 - DNA, 25 bp, Mus musculus
cgtggccgagctagctgctgcctgt

SEQ ID NO: 263420 - DNA, 25 bp, Mus musculus
cgtggccgggatcaggtggatcaac

SEQ ID NO: 263421 - DNA, 25 bp, Mus musculus
cgtggccgtcgtcaggtgggtccga

SEQ ID NO: 263422 - DNA, 25 bp, Mus musculus
cgtggcctccagaagccaccatggg

SEQ ID NO: 263423 - DNA, 25 bp, Mus musculus
cgtggcctggagcttaccagccctt

SEQ ID NO: 263424 - DNA, 25 bp, Mus musculus
cgtggcctggagtgttgaagatgaa

SEQ ID NO: 263425 - DNA, 25 bp, Mus musculus
cgtggcctgtggagggttgtctacc

SEQ ID NO: 263426 - DNA, 25 bp, Mus musculus
cgtggccttaaagtctttaagaaat

SEQ ID NO: 263427 - DNA, 25 bp, Mus musculus
cgtggccttaccatgtgccctgggg

SEQ ID NO: 263428 - DNA, 25 bp, Mus musculus
cgtggccttcaaggttgtagccctc

SEQ ID NO: 263429 - DNA, 25 bp, Mus musculus
cgtggcctttgatgccgtcctgctt

SEQ ID NO: 263430 - DNA, 25 bp, Mus musculus
cgtggcgactgcagcctattccaag

SEQ ID NO: 263431 - DNA, 25 bp, Mus musculus
cgtggcgactgcaggtaacgggcaa

SEQ ID NO: 263432 - DNA, 25 bp, Mus musculus
cgtggcgcgcgtccgaaatgctgag

SEQ ID NO: 263433 - DNA, 25 bp, Mus musculus
cgtggcgctgtatactccatgtttc

SEQ ID NO: 263434 - DNA, 25 bp, Mus musculus
cgtggcggagatggcgcggccgatc

SEQ ID NO: 263435 - DNA, 25 bp, Mus musculus
cgtggctaattagcatctgaagttg

SEQ ID NO: 263436 - DNA, 25 bp, Mus musculus
cgtggctcatacacactttggaggt

SEQ ID NO: 263437 - DNA, 25 bp, Mus musculus
cgtggctcatagtatgatatttgct

SEQ ID NO: 263438 - DNA, 25 bp, Mus musculus
cgtggctcccttgggaagccggagg

SEQ ID NO: 263439 - DNA, 25 bp, Mus musculus
cgtggctcccttgggaatttagaag

SEQ ID NO: 263440 - DNA, 25 bp, Mus musculus
cgtggctcccttggggttctcacgc

SEQ ID NO: 263441 - DNA, 25 bp, Mus musculus
cgtggctgaagaggtcccaggtaaa

SEQ ID NO: 263442 - DNA, 25 bp, Mus musculus
cgtggctgaggaggcagctgaccta

SEQ ID NO: 263443 - DNA, 25 bp, Mus musculus
cgtggctgcttccaggcttttattt

SEQ ID NO: 263444 - DNA, 25 bp, Mus musculus
cgtggctggatccggtggacacacc

SEQ ID NO: 263445 - DNA, 25 bp, Mus musculus
cgtggctggatccgtaccccaagta

SEQ ID NO: 263446 - DNA, 25 bp, Mus musculus
cgtggctggatccgtattcttgttc

SEQ ID NO: 263447 - DNA, 25 bp, Mus musculus
cgtggctgggaaccaccgtcacttc

SEQ ID NO: 263448 - DNA, 25 bp, Mus musculus
cgtggctgttttgcccattggacgt

SEQ ID NO: 263449 - DNA, 25 bp, Mus musculus
cgtggcttaagagaagagccatgga

SEQ ID NO: 263450 - DNA, 25 bp, Mus musculus
cgtggcttaggattgtctaaagcca

SEQ ID NO: 263451 - DNA, 25 bp, Mus musculus
cgtggcttccggagacagaaaagag

SEQ ID NO: 263452 - DNA, 25 bp, Mus musculus
cgtggcttccggatcctttgtgtat

SEQ ID NO: 263453 - DNA, 25 bp, Mus musculus
cgtgggaaaaagaccaaagattcaa

SEQ ID NO: 263454 - DNA, 25 bp, Mus musculus
cgtgggaaactgctctcctatgtgg

SEQ ID NO: 263455 - DNA, 25 bp, Mus musculus
cgtgggaacagagccctttgggaga

SEQ ID NO: 263456 - DNA, 25 bp, Mus musculus
cgtgggaaggcactttccggatgat

SEQ ID NO: 263457 - DNA, 25 bp, Mus musculus
cgtgggaatcatacatgacgccttt

SEQ ID NO: 263458 - DNA, 25 bp, Mus musculus
cgtgggaattttatgtaagaccagc

SEQ ID NO: 263459 - DNA, 25 bp, Mus musculus
cgtgggacacctgcctgcagtacaa

SEQ ID NO: 263460 - DNA, 25 bp, Mus musculus
cgtgggacagattggatctggccgc

SEQ ID NO: 263461 - DNA, 25 bp, Mus musculus
cgtgggacataagttctacggcccc

SEQ ID NO: 263462 - DNA, 25 bp, Mus musculus
cgtgggacccacatggttactggga

SEQ ID NO: 263463 - DNA, 25 bp, Mus musculus
cgtgggaccggcccttggtgctgac

SEQ ID NO: 263464 - DNA, 25 bp, Mus musculus
cgtgggaccggggtgttgtgctacg

SEQ ID NO: 263465 - DNA, 25 bp, Mus musculus
cgtgggactctctgcgccctttgtg

SEQ ID NO: 263466 - DNA, 25 bp, Mus musculus
cgtgggagcagaggtggagcgaccc

SEQ ID NO: 263467 - DNA, 25 bp, Mus musculus
cgtgggagctaagaataatagggcc

SEQ ID NO: 263468 - DNA, 25 bp, Mus musculus
cgtgggagtcgagagactgaccaac

SEQ ID NO: 263469 - DNA, 25 bp, Mus musculus
cgtgggagtcgagttctaaaacaac

SEQ ID NO: 263470 - DNA, 25 bp, Mus musculus
cgtgggatctagacgaggacctatt

SEQ ID NO: 263471 - DNA, 25 bp, Mus musculus
cgtgggatctaggacgctgcattgg

SEQ ID NO: 263472 - DNA, 25 bp, Mus musculus
cgtgggatgacgaggaagaggaaca

SEQ ID NO: 263473 - DNA, 25 bp, Mus musculus
cgtgggattgcaggccctcaaggcc

SEQ ID NO: 263474 - DNA, 25 bp, Mus musculus
cgtgggcaagtcagaatcaacctac

SEQ ID NO: 263475 - DNA, 25 bp, Mus musculus
cgtgggcaagtcagacagtatctca

SEQ ID NO: 263476 - DNA, 25 bp, Mus musculus
cgtgggcaagtcagcgattgtagtg

SEQ ID NO: 263477 - DNA, 25 bp, Mus musculus
cgtgggccacaagccctagcatccc

SEQ ID NO: 263478 - DNA, 25 bp, Mus musculus
cgtgggccagaggcttcatgtggaa

SEQ ID NO: 263479 - DNA, 25 bp, Mus musculus
cgtgggccagagggtccaggtggag

SEQ ID NO: 263480 - DNA, 25 bp, Mus musculus
cgtgggccagatgggccctcctggt

SEQ ID NO: 263481 - DNA, 25 bp, Mus musculus
cgtgggcgcccggcgcagcaagcac

SEQ ID NO: 263482 - DNA, 25 bp, Mus musculus
cgtgggcggccggaggtttgccaaa

SEQ ID NO: 263483 - DNA, 25 bp, Mus musculus
cgtgggctccaaatctgaggttatg

SEQ ID NO: 263484 - DNA, 25 bp, Mus musculus
cgtggggaatgggagaagagttaga

SEQ ID NO: 263485 - DNA, 25 bp, Mus musculus
cgtggggaatgggagaagatgctgt

SEQ ID NO: 263486 - DNA, 25 bp, Mus musculus
cgtggggagctctcgaagtgccctg

SEQ ID NO: 263487 - DNA, 25 bp, Mus musculus
cgtggggagctctcggtctcaactc

SEQ ID NO: 263488 - DNA, 25 bp, Mus musculus
cgtggggccaggcctcttaggtaag

SEQ ID NO: 263489 - DNA, 25 bp, Mus musculus
cgtgggggagattttctaccttgcc

SEQ ID NO: 263490 - DNA, 25 bp, Mus musculus
cgtgggggaggatcccatagcctct

SEQ ID NO: 263491 - DNA, 25 bp, Mus musculus
cgtgggggaggtgacagattatgtt

SEQ ID NO: 263492 - DNA, 25 bp, Mus musculus
cgtgggggcagtaaatgatgctgga

SEQ ID NO: 263493 - DNA, 25 bp, Mus musculus
cgtggggttgagactcacacatgtt

SEQ ID NO: 263494 - DNA, 25 bp, Mus musculus
cgtgggtcacaagaagccgtctcag

SEQ ID NO: 263495 - DNA, 25 bp, Mus musculus
cgtgggtcacaaggtcaaagcaagt

SEQ ID NO: 263496 - DNA, 25 bp, Mus musculus
cgtgggtgatgactgcccagtgttt

SEQ ID NO: 263497 - DNA, 25 bp, Mus musculus
cgtgggtgcaggtctcaggagctat

SEQ ID NO: 263498 - DNA, 25 bp, Mus musculus
cgtgggtggagctgaagaaagcaat

SEQ ID NO: 263499 - DNA, 25 bp, Mus musculus
cgtgggtggagctgaagaaagccat

SEQ ID NO: 263500 - DNA, 25 bp, Mus musculus
cgtgggtgtcccagaaatttcagcc

SEQ ID NO: 263501 - DNA, 25 bp, Mus musculus
cgtgggtgtgtgaaatgcacttagc

SEQ ID NO: 263502 - DNA, 25 bp, Mus musculus
cgtgggtgtgtggactgtgcagcat

SEQ ID NO: 263503 - DNA, 25 bp, Mus musculus
cgtggtaaaagactacgcgtttgtt

SEQ ID NO: 263504 - DNA, 25 bp, Mus musculus
cgtggtacaaccacttccagctgcc

SEQ ID NO: 263505 - DNA, 25 bp, Mus musculus
cgtggtacaacccaagtaatgaaaa

SEQ ID NO: 263506 - DNA, 25 bp, Mus musculus
cgtggtacagcgccccgggatgccg

SEQ ID NO: 263507 - DNA, 25 bp, Mus musculus
cgtggtacaggccctgttgcatcga

SEQ ID NO: 263508 - DNA, 25 bp, Mus musculus
cgtggtacgttcaggaggccccatc

SEQ ID NO: 263509 - DNA, 25 bp, Mus musculus
cgtggtacgttcaggggttgtgctg

SEQ ID NO: 263510 - DNA, 25 bp, Mus musculus
cgtggtcaagacccagagaacatgg

SEQ ID NO: 263511 - DNA, 25 bp, Mus musculus
cgtggtcaagattgactttgaagat

SEQ ID NO: 263512 - DNA, 25 bp, Mus musculus
cgtggtcaccaacagtcagcgtggg

SEQ ID NO: 263513 - DNA, 25 bp, Mus musculus
cgtggtcagcatgattcgattcttg

SEQ ID NO: 263514 - DNA, 25 bp, Mus musculus
cgtggtccagaaccctctgattgcc

SEQ ID NO: 263515 - DNA, 25 bp, Mus musculus
cgtggtcccctggagcaccaaggaa

SEQ ID NO: 263516 - DNA, 25 bp, Mus musculus
cgtggtccctacacgaatgaagtgt

SEQ ID NO: 263517 - DNA, 25 bp, Mus musculus
cgtggtccgcgtcggtgctggcctg

SEQ ID NO: 263518 - DNA, 25 bp, Mus musculus
cgtggtcgcagacgaagaaatggaa

SEQ ID NO: 263519 - DNA, 25 bp, Mus musculus
cgtggtctcactgggcatacttctc

SEQ ID NO: 263520 - DNA, 25 bp, Mus musculus
cgtggtctctgcgcggttgactctt

SEQ ID NO: 263521 - DNA, 25 bp, Mus musculus
cgtggtctgggtcaggccctgctgg

SEQ ID NO: 263522 - DNA, 25 bp, Mus musculus
cgtggtgaagaaggttcattatgat

SEQ ID NO: 263523 - DNA, 25 bp, Mus musculus
cgtggtgacaagggcaacagcaggt

SEQ ID NO: 263524 - DNA, 25 bp, Mus musculus
cgtggtgagttcaggtactcagttc

SEQ ID NO: 263525 - DNA, 25 bp, Mus musculus
cgtggtgagttcaggtggttgtgga

SEQ ID NO: 263526 - DNA, 25 bp, Mus musculus
cgtggtgccgatctctgagaagaga

SEQ ID NO: 263527 - DNA, 25 bp, Mus musculus
cgtggtgcgaaagaaaaagtcagca

SEQ ID NO: 263528 - DNA, 25 bp, Mus musculus
cgtggtgctggaggtgtcctgtcca

SEQ ID NO: 263529 - DNA, 25 bp, Mus musculus
cgtggtgctggagttaaaggcagat

SEQ ID NO: 263530 - DNA, 25 bp, Mus musculus
cgtggtgctggggcctgtgctctct

SEQ ID NO: 263531 - DNA, 25 bp, Mus musculus
cgtggtggaaagataaggaattgga

SEQ ID NO: 263532 - DNA, 25 bp, Mus musculus
cgtggtggaaatagacaacctgttg

SEQ ID NO: 263533 - DNA, 25 bp, Mus musculus
cgtggtggaaatagctgcagtacct

SEQ ID NO: 263534 - DNA, 25 bp, Mus musculus
cgtggtggagggaaaaatggtgaaa

SEQ ID NO: 263535 - DNA, 25 bp, Mus musculus
cgtggtggaggttgaagaaattgta

SEQ ID NO: 263536 - DNA, 25 bp, Mus musculus
cgtggtggattctgggaaggtgaag

SEQ ID NO: 263537 - DNA, 25 bp, Mus musculus
cgtggtggcccgagctgtgggaacc

SEQ ID NO: 263538 - DNA, 25 bp, Mus musculus
cgtggtggtgaccggaactttctaa

SEQ ID NO: 263539 - DNA, 25 bp, Mus musculus
cgtggtgtgccccctctagtcctcc

SEQ ID NO: 263540 - DNA, 25 bp, Mus musculus
cgtggtgtggacactcctggagcca

SEQ ID NO: 263541 - DNA, 25 bp, Mus musculus
cgtggttacagagccgagcagttgg

SEQ ID NO: 263542 - DNA, 25 bp, Mus musculus
cgtggttacaggaaataatgaagac

SEQ ID NO: 263543 - DNA, 25 bp, Mus musculus
cgtggttcagacagctgtcatcagc

SEQ ID NO: 263544 - DNA, 25 bp, Mus musculus
cgtggttcagggtctggagacatgg

SEQ ID NO: 263545 - DNA, 25 bp, Mus musculus
cgtggttcatccatacatccagaac

SEQ ID NO: 263546 - DNA, 25 bp, Mus musculus
cgtggttgtgattgaacgggctgcc

SEQ ID NO: 263547 - DNA, 25 bp, Mus musculus
cgtggttgtgcatgggcgcctgaag

SEQ ID NO: 263548 - DNA, 25 bp, Mus musculus
cgtggtttatatgcattcacatcat

SEQ ID NO: 263549 - DNA, 25 bp, Mus musculus
cgtggtttatatgcttgtgggcttt

SEQ ID NO: 263550 - DNA, 25 bp, Mus musculus
cgtggtttgaaagtatccctggaag

SEQ ID NO: 263551 - DNA, 25 bp, Mus musculus
cgtgtaacagatgctccatcctcag

SEQ ID NO: 263552 - DNA, 25 bp, Mus musculus
cgtgtaacaggggctccttattgga

SEQ ID NO: 263553 - DNA, 25 bp, Mus musculus
cgtgtaaggacaagggagttgtatt

SEQ ID NO: 263554 - DNA, 25 bp, Mus musculus
cgtgtaaggacaaggtagactgggt

SEQ ID NO: 263555 - DNA, 25 bp, Mus musculus
cgtgtacgaaggtatggcctcacat

SEQ ID NO: 263556 - DNA, 25 bp, Mus musculus
cgtgtacggcggagatgaagttggc

SEQ ID NO: 263557 - DNA, 25 bp, Mus musculus
cgtgtactcctggaccatgatgtgc

SEQ ID NO: 263558 - DNA, 25 bp, Mus musculus
cgtgtagctggaatgttacagaatt

SEQ ID NO: 263559 - DNA, 25 bp, Mus musculus
cgtgtaggatacaggtgccctagct

SEQ ID NO: 263560 - DNA, 25 bp, Mus musculus
cgtgtataaatgagtctgctattga

SEQ ID NO: 263561 - DNA, 25 bp, Mus musculus
cgtgtataactaagaatgtcttcca

SEQ ID NO: 263562 - DNA, 25 bp, Mus musculus
cgtgtatggtctcgagatgaagata

SEQ ID NO: 263563 - DNA, 25 bp, Mus musculus
cgtgtatggtctcgagcagcagtga

SEQ ID NO: 263564 - DNA, 25 bp, Mus musculus
cgtgtattcagggggagatgactgc

SEQ ID NO: 263565 - DNA, 25 bp, Mus musculus
cgtgtcacccgcggttcctgagact

SEQ ID NO: 263566 - DNA, 25 bp, Mus musculus
cgtgtcactttcggctggggaactg

SEQ ID NO: 263567 - DNA, 25 bp, Mus musculus
cgtgtcagaaaatgagcttggtgtt

SEQ ID NO: 263568 - DNA, 25 bp, Mus musculus
cgtgtcatgggtctcagcctgggat

SEQ ID NO: 263569 - DNA, 25 bp, Mus musculus
cgtgtccagactcggggccctgttc

SEQ ID NO: 263570 - DNA, 25 bp, Mus musculus
cgtgtccagcacagaatcgtccttg

SEQ ID NO: 263571 - DNA, 25 bp, Mus musculus
cgtgtccagcacagccagccatatg

SEQ ID NO: 263572 - DNA, 25 bp, Mus musculus
cgtgtccctcgtttagctttttctc

SEQ ID NO: 263573 - DNA, 25 bp, Mus musculus
cgtgtccggccctgaacgccatgag

SEQ ID NO: 263574 - DNA, 25 bp, Mus musculus
cgtgtcctaacgagaatgtcatacc

SEQ ID NO: 263575 - DNA, 25 bp, Mus musculus
cgtgtcctatgactggccactgact

SEQ ID NO: 263576 - DNA, 25 bp, Mus musculus
cgtgtcctatgactggctgatcctt

SEQ ID NO: 263577 - DNA, 25 bp, Mus musculus
cgtgtcctctgatgctgaggaatac

SEQ ID NO: 263578 - DNA, 25 bp, Mus musculus
cgtgtcctctgcctgttccagttga

SEQ ID NO: 263579 - DNA, 25 bp, Mus musculus
cgtgtcctgcttagtcttgctgttt

SEQ ID NO: 263580 - DNA, 25 bp, Mus musculus
cgtgtcctgcttttttcacttccct

SEQ ID NO: 263581 - DNA, 25 bp, Mus musculus
cgtgtcgaaggagacgaagagatga

SEQ ID NO: 263582 - DNA, 25 bp, Mus musculus
cgtgtcgccaggtcagccatgtcat

SEQ ID NO: 263583 - DNA, 25 bp, Mus musculus
cgtgtcgccagtgtggaaggggagt

SEQ ID NO: 263584 - DNA, 25 bp, Mus musculus
cgtgtcgctgctcggtgtcgcaaca

SEQ ID NO: 263585 - DNA, 25 bp, Mus musculus
cgtgtcggaagtgatgggaccagtg

SEQ ID NO: 263586 - DNA, 25 bp, Mus musculus
cgtgtctatcggccgctcaccccag

SEQ ID NO: 263587 - DNA, 25 bp, Mus musculus
cgtgtctgaagaggaggtgctgggc

SEQ ID NO: 263588 - DNA, 25 bp, Mus musculus
cgtgtctgagaaccttctcccggaa

SEQ ID NO: 263589 - DNA, 25 bp, Mus musculus
cgtgtctgcaggtatatccgaatag

SEQ ID NO: 263590 - DNA, 25 bp, Mus musculus
cgtgtctgtgtggaggtacattcgc

SEQ ID NO: 263591 - DNA, 25 bp, Mus musculus
cgtgtcttgggtcttctccatcgtg

SEQ ID NO: 263592 - DNA, 25 bp, Mus musculus
cgtgtctttatctgcatcccctgtg

SEQ ID NO: 263593 - DNA, 25 bp, Mus musculus
cgtgtctttgcgggcgtgctggtca

SEQ ID NO: 263594 - DNA, 25 bp, Mus musculus
cgtgtctttgcgggtgcctggctga

SEQ ID NO: 263595 - DNA, 25 bp, Mus musculus
cgtgtctttggctaattctggctta

SEQ ID NO: 263596 - DNA, 25 bp, Mus musculus
cgtgtctttgtaaagtcgggcaaat

SEQ ID NO: 263597 - DNA, 25 bp, Mus musculus
cgtgtgaaagatacttggtaacgtt

SEQ ID NO: 263598 - DNA, 25 bp, Mus musculus
cgtgtgacttctcagacttttcgaa

SEQ ID NO: 263599 - DNA, 25 bp, Mus musculus
cgtgtgagattccctgctccagtac

SEQ ID NO: 263600 - DNA, 25 bp, Mus musculus
cgtgtgaggtacaggtgtcggctct

SEQ ID NO: 263601 - DNA, 25 bp, Mus musculus
cgtgtgatggggccaaactgagcct

SEQ ID NO: 263602 - DNA, 25 bp, Mus musculus
cgtgtgcaccaggagcacctgagcc

SEQ ID NO: 263603 - DNA, 25 bp, Mus musculus
cgtgtgccggcttgatgcccccaag

SEQ ID NO: 263604 - DNA, 25 bp, Mus musculus
cgtgtgcctgagcggaggactggct

SEQ ID NO: 263605 - DNA, 25 bp, Mus musculus
cgtgtgcctgagcgggctagctgtg

SEQ ID NO: 263606 - DNA, 25 bp, Mus musculus
cgtgtgccttctgggcattgaagat

SEQ ID NO: 263607 - DNA, 25 bp, Mus musculus
cgtgtgcgccctgggtccaactgag

SEQ ID NO: 263608 - DNA, 25 bp, Mus musculus
cgtgtgcgggtgagatctgattttc

SEQ ID NO: 263609 - DNA, 25 bp, Mus musculus
cgtgtgctaggtctcctcctgcctg

SEQ ID NO: 263610 - DNA, 25 bp, Mus musculus
cgtgtgctaggtttctgccacctcc

SEQ ID NO: 263611 - DNA, 25 bp, Mus musculus
cgtgtgctccaacggcttcctgctt

SEQ ID NO: 263612 - DNA, 25 bp, Mus musculus
cgtgtgctcgtggcacggaggtgcc

SEQ ID NO: 263613 - DNA, 25 bp, Mus musculus
cgtgtgctggcgattcacttcagca

SEQ ID NO: 263614 - DNA, 25 bp, Mus musculus
cgtgtggaagagttcaagctgaaga

SEQ ID NO: 263615 - DNA, 25 bp, Mus musculus
cgtgtggaccctaaggagaaggagc

SEQ ID NO: 263616 - DNA, 25 bp, Mus musculus
cgtgtggaccctaagtgcagctttg

SEQ ID NO: 263617 - DNA, 25 bp, Mus musculus
cgtgtgggtctccaggctcagcccg

SEQ ID NO: 263618 - DNA, 25 bp, Mus musculus
cgtgtggtccgtcaagcccttgacc

SEQ ID NO: 263619 - DNA, 25 bp, Mus musculus
cgtgtggttgcaccctcaggatcac

SEQ ID NO: 263620 - DNA, 25 bp, Mus musculus
cgtgtgtctgacgcactgtatcact

SEQ ID NO: 263621 - DNA, 25 bp, Mus musculus
cgtgtgtgcccgtggtatcgatgtt

SEQ ID NO: 263622 - DNA, 25 bp, Mus musculus
cgtgtgtggcctggtggatgactac

SEQ ID NO: 263623 - DNA, 25 bp, Mus musculus
cgtgtgtgtctgctgctgacaagga

SEQ ID NO: 263624 - DNA, 25 bp, Mus musculus
cgtgtgttaagccatcaaacaatga

SEQ ID NO: 263625 - DNA, 25 bp, Mus musculus
cgtgtgttaaggtctcatttttttt

SEQ ID NO: 263626 - DNA, 25 bp, Mus musculus
cgtgtgttaaggttaccaacatatc

SEQ ID NO: 263627 - DNA, 25 bp, Mus musculus
cgtgtgttgaggagcccaccgcaac

SEQ ID NO: 263628 - DNA, 25 bp, Mus musculus
cgtgttaatgagaagggagccttct

SEQ ID NO: 263629 - DNA, 25 bp, Mus musculus
cgtgttagagaacagggaccgtgtg

SEQ ID NO: 263630 - DNA, 25 bp, Mus musculus
cgtgttagaggagatttaccttcaa

SEQ ID NO: 263631 - DNA, 25 bp, Mus musculus
cgtgttcaaggatgccgccgtgctg

SEQ ID NO: 263632 - DNA, 25 bp, Mus musculus
cgtgttcaatgggcatgttcatcac

SEQ ID NO: 263633 - DNA, 25 bp, Mus musculus
cgtgttcactttagaacacccggga

SEQ ID NO: 263634 - DNA, 25 bp, Mus musculus
cgtgttcatttgtgattcatggcag

SEQ ID NO: 263635 - DNA, 25 bp, Mus musculus
cgtgttccagcaccacctctgcagt

SEQ ID NO: 263636 - DNA, 25 bp, Mus musculus
cgtgttcggggcgggccaatgattc

SEQ ID NO: 263637 - DNA, 25 bp, Mus musculus
cgtgttctatgatgattcggctcct

SEQ ID NO: 263638 - DNA, 25 bp, Mus musculus
cgtgttctcccggacgagggatctg

SEQ ID NO: 263639 - DNA, 25 bp, Mus musculus
cgtgttctgagatgacagtcatgtc

SEQ ID NO: 263640 - DNA, 25 bp, Mus musculus
cgtgttctgaggatcctggaaagct

SEQ ID NO: 263641 - DNA, 25 bp, Mus musculus
cgtgttcttgacagctaccagggag

SEQ ID NO: 263642 - DNA, 25 bp, Mus musculus
cgtgttcttggtttctgccagctct

SEQ ID NO: 263643 - DNA, 25 bp, Mus musculus
cgtgttgaccgaaagcacagccatc

SEQ ID NO: 263644 - DNA, 25 bp, Mus musculus
cgtgttgctggatgagtattggaga

SEQ ID NO: 263645 - DNA, 25 bp, Mus musculus
cgtgttgctggctgccatgcctatg

SEQ ID NO: 263646 - DNA, 25 bp, Mus musculus
cgtgttgctggctggattgcctttt

SEQ ID NO: 263647 - DNA, 25 bp, Mus musculus
cgtgttggaaggtggcattgacccc

SEQ ID NO: 263648 - DNA, 25 bp, Mus musculus
cgtgttggtcgcctctctgcctttc

SEQ ID NO: 263649 - DNA, 25 bp, Mus musculus
cgtgttggtcgcgggggttctactg

SEQ ID NO: 263650 - DNA, 25 bp, Mus musculus
cgtgttgttcggagatgggtatcgg

SEQ ID NO: 263651 - DNA, 25 bp, Mus musculus
cgtgtttaagttccgatacttcgct

SEQ ID NO: 263652 - DNA, 25 bp, Mus musculus
cgtgtttacatcagtggttggagac

SEQ ID NO: 263653 - DNA, 25 bp, Mus musculus
cgtgtttcaaaagctctcttctccc

SEQ ID NO: 263654 - DNA, 25 bp, Mus musculus
cgtgtttcaaaaggcattgcgctcc

SEQ ID NO: 263655 - DNA, 25 bp, Mus musculus
cgtgtttcaggtattctgcgttggg

SEQ ID NO: 263656 - DNA, 25 bp, Mus musculus
cgtgtttcggaggccgatggcacca

SEQ ID NO: 263657 - DNA, 25 bp, Mus musculus
cgtgtttctcagctcagaggctgag

SEQ ID NO: 263658 - DNA, 25 bp, Mus musculus
cgtgtttcttaccatctatggagtt

SEQ ID NO: 263659 - DNA, 25 bp, Mus musculus
cgtgtttgaccttgttaccggaggg

SEQ ID NO: 263660 - DNA, 25 bp, Mus musculus
cgtgtttgaggccttattcaggatg

SEQ ID NO: 263661 - DNA, 25 bp, Mus musculus
cgtgtttgccgggtgtaatggatag

SEQ ID NO: 263662 - DNA, 25 bp, Mus musculus
cgtgtttggaaaggcgaccgtgctg

SEQ ID NO: 263663 - DNA, 25 bp, Mus musculus
cgtgtttggaaaggctggcaagttt

SEQ ID NO: 263664 - DNA, 25 bp, Mus musculus
cgtgtttgtcctcaaatcgtcctgc

SEQ ID NO: 263665 - DNA, 25 bp, Mus musculus
cgttaaagaccacaaagaaacatgg

SEQ ID NO: 263666 - DNA, 25 bp, Mus musculus
cgttaacagataggttctgcctcat

SEQ ID NO: 263667 - DNA, 25 bp, Mus musculus
cgttaagacagtgggttgtatcccc

SEQ ID NO: 263668 - DNA, 25 bp, Mus musculus
cgttaagcagattttgaagcatgaa

SEQ ID NO: 263669 - DNA, 25 bp, Mus musculus
cgttaagcagatttttcattactca

SEQ ID NO: 263670 - DNA, 25 bp, Mus musculus
cgttaatgagtgcaatgctcacccc

SEQ ID NO: 263671 - DNA, 25 bp, Mus musculus
cgttaatgtggttcgtctccaacaa

SEQ ID NO: 263672 - DNA, 25 bp, Mus musculus
cgttaattgaacactgttaatttat

SEQ ID NO: 263673 - DNA, 25 bp, Mus musculus
cgttacaagataaagctcacttcaa

SEQ ID NO: 263674 - DNA, 25 bp, Mus musculus
cgttacaagtgggatgcctggaaca

SEQ ID NO: 263675 - DNA, 25 bp, Mus musculus
cgttacacatgagagcagcatggcc

SEQ ID NO: 263676 - DNA, 25 bp, Mus musculus
cgttacacatgctatacctgctctg

SEQ ID NO: 263677 - DNA, 25 bp, Mus musculus
cgttacagccaggcatgctgagccg

SEQ ID NO: 263678 - DNA, 25 bp, Mus musculus
cgttacatcgacagacatctgcaac

SEQ ID NO: 263679 - DNA, 25 bp, Mus musculus
cgttacccaaaggtggctctgcggg

SEQ ID NO: 263680 - DNA, 25 bp, Mus musculus
cgttactgccgatgcaatgccaccc

SEQ ID NO: 263681 - DNA, 25 bp, Mus musculus
cgttacttgtgccagtctaatgcac

SEQ ID NO: 263682 - DNA, 25 bp, Mus musculus
cgttagaaggaggattgcttcctga

SEQ ID NO: 263683 - DNA, 25 bp, Mus musculus
cgttagaaggaggccattaggaaac

SEQ ID NO: 263684 - DNA, 25 bp, Mus musculus
cgttagaaggaggggctaaggagaa

SEQ ID NO: 263685 - DNA, 25 bp, Mus musculus
cgttagactcagaggagctgtgatt

SEQ ID NO: 263686 - DNA, 25 bp, Mus musculus
cgttagactcagagtcataaggtca

SEQ ID NO: 263687 - DNA, 25 bp, Mus musculus
cgttagatctggctctgttgctgta

SEQ ID NO: 263688 - DNA, 25 bp, Mus musculus
cgttagccccgtggacccagcagct

SEQ ID NO: 263689 - DNA, 25 bp, Mus musculus
cgttagccccgtgggtgctcgtgtg

SEQ ID NO: 263690 - DNA, 25 bp, Mus musculus
cgttagccttcaaaccatgaagtga

SEQ ID NO: 263691 - DNA, 25 bp, Mus musculus
cgttagccttcggttgtttgtctgt

SEQ ID NO: 263692 - DNA, 25 bp, Mus musculus
cgttaggagtaaagcagtcagtgga

SEQ ID NO: 263693 - DNA, 25 bp, Mus musculus
cgttaggagtaaagctgcttctaaa

SEQ ID NO: 263694 - DNA, 25 bp, Mus musculus
cgttaggatcgcaccagagtatatg

SEQ ID NO: 263695 - DNA, 25 bp, Mus musculus
cgttaggattgcagcacctaccctc

SEQ ID NO: 263696 - DNA, 25 bp, Mus musculus
cgttagtggcggcttgacatctagg

SEQ ID NO: 263697 - DNA, 25 bp, Mus musculus
cgttatatatatggacatacatgtt

SEQ ID NO: 263698 - DNA, 25 bp, Mus musculus
cgttatatatatggatttgttgctg

SEQ ID NO: 263699 - DNA, 25 bp, Mus musculus
cgttatcatgaacacggctctagat

SEQ ID NO: 263700 - DNA, 25 bp, Mus musculus
cgttatcatgtttgatttgacagtt

SEQ ID NO: 263701 - DNA, 25 bp, Mus musculus
cgttatccagcatttccaggagaaa

SEQ ID NO: 263702 - DNA, 25 bp, Mus musculus
cgttatcgagcctactagttcaatg

SEQ ID NO: 263703 - DNA, 25 bp, Mus musculus
cgttatcgaggaaagcatgtggatg

SEQ ID NO: 263704 - DNA, 25 bp, Mus musculus
cgttatcgaggtaatatatataata

SEQ ID NO: 263705 - DNA, 25 bp, Mus musculus
cgttatctcacggcgaactttctga

SEQ ID NO: 263706 - DNA, 25 bp, Mus musculus
cgttatgaaagacctgtgttgcgtg

SEQ ID NO: 263707 - DNA, 25 bp, Mus musculus
cgttatgaaatggcctcaaaccccc

SEQ ID NO: 263708 - DNA, 25 bp, Mus musculus
cgttatgtgaaataggtgagaagcc

SEQ ID NO: 263709 - DNA, 25 bp, Mus musculus
cgttatgtgaaatagttttgggatt

SEQ ID NO: 263710 - DNA, 25 bp, Mus musculus
cgttatgttgattcacaatgacatc

SEQ ID NO: 263711 - DNA, 25 bp, Mus musculus
cgttattctcgatgaaacggacagg

SEQ ID NO: 263712 - DNA, 25 bp, Mus musculus
cgttattgctcggggtgacaaagac

SEQ ID NO: 263713 - DNA, 25 bp, Mus musculus
cgttcaaacaaagtctggtttttgt

SEQ ID NO: 263714 - DNA, 25 bp, Mus musculus
cgttcaaacacaagttggaaatcta

SEQ ID NO: 263715 - DNA, 25 bp, Mus musculus
cgttcaacaggcaaagcgagtggat

SEQ ID NO: 263716 - DNA, 25 bp, Mus musculus
cgttcaaccgggagaggtctgctct

SEQ ID NO: 263717 - DNA, 25 bp, Mus musculus
cgttcaaccgggagcaggaggacag

SEQ ID NO: 263718 - DNA, 25 bp, Mus musculus
cgttcaaccgggagcattctcagag

SEQ ID NO: 263719 - DNA, 25 bp, Mus musculus
cgttcaagtgaaagaggtcaaccgg

SEQ ID NO: 263720 - DNA, 25 bp, Mus musculus
cgttcaagttaattatgacctggcc

SEQ ID NO: 263721 - DNA, 25 bp, Mus musculus
cgttcaagttaattctgtcagacct

SEQ ID NO: 263722 - DNA, 25 bp, Mus musculus
cgttcaagtttgagctgggaagatg

SEQ ID NO: 263723 - DNA, 25 bp, Mus musculus
cgttcacaagatcatttccatgtgt

SEQ ID NO: 263724 - DNA, 25 bp, Mus musculus
cgttcacaagtctgagttcacttgc

SEQ ID NO: 263725 - DNA, 25 bp, Mus musculus
cgttcactccaatgatggcactcag

SEQ ID NO: 263726 - DNA, 25 bp, Mus musculus
cgttcactgaggcagttgcacctga

SEQ ID NO: 263727 - DNA, 25 bp, Mus musculus
cgttcactttggaagagctcattgc

SEQ ID NO: 263728 - DNA, 25 bp, Mus musculus
cgttcacttttcagtatatatggtc

SEQ ID NO: 263729 - DNA, 25 bp, Mus musculus
cgttcagaaaagttggactacatct

SEQ ID NO: 263730 - DNA, 25 bp, Mus musculus
cgttcagaaccgcgtgttgatcgtg

SEQ ID NO: 263731 - DNA, 25 bp, Mus musculus
cgttcagccaggttgcattgaaggc

SEQ ID NO: 263732 - DNA, 25 bp, Mus musculus
cgttcaggatgaagaactacaaagc

SEQ ID NO: 263733 - DNA, 25 bp, Mus musculus
cgttcaggatgaagaggagaagaca

SEQ ID NO: 263734 - DNA, 25 bp, Mus musculus
cgttcagttaatggaatcttctgag

SEQ ID NO: 263735 - DNA, 25 bp, Mus musculus
cgttcatatcagatgttttccagca

SEQ ID NO: 263736 - DNA, 25 bp, Mus musculus
cgttcatatcagtggaacacatttc

SEQ ID NO: 263737 - DNA, 25 bp, Mus musculus
cgttcatccccacagataattctga

SEQ ID NO: 263738 - DNA, 25 bp, Mus musculus
cgttcatccccacagggtcagtttt

SEQ ID NO: 263739 - DNA, 25 bp, Mus musculus
cgttcatccccacagtacccatgat

SEQ ID NO: 263740 - DNA, 25 bp, Mus musculus
cgttcatgataagtgcacaaagaag

SEQ ID NO: 263741 - DNA, 25 bp, Mus musculus
cgttcattccggctagccctgctcc

SEQ ID NO: 263742 - DNA, 25 bp, Mus musculus
cgttcattttcaaaagaaacagcaa

SEQ ID NO: 263743 - DNA, 25 bp, Mus musculus
cgttccaaaagctgccgcagtggca

SEQ ID NO: 263744 - DNA, 25 bp, Mus musculus
cgttcccaagtcggatgtggaaatg

SEQ ID NO: 263745 - DNA, 25 bp, Mus musculus
cgttcccaagtcggttaacagtgat

SEQ ID NO: 263746 - DNA, 25 bp, Mus musculus
cgttcccagggcagcccagcaagac

SEQ ID NO: 263747 - DNA, 25 bp, Mus musculus
cgttcccggctgtcactgagcactg

SEQ ID NO: 263748 - DNA, 25 bp, Mus musculus
cgttccctgacctcctgtaccctgg

SEQ ID NO: 263749 - DNA, 25 bp, Mus musculus
cgttccctttgcatcactggctcac

SEQ ID NO: 263750 - DNA, 25 bp, Mus musculus
cgttccgaagcgcctccctcttgat

SEQ ID NO: 263751 - DNA, 25 bp, Mus musculus
cgttccgaagcgcggtcaacatggc

SEQ ID NO: 263752 - DNA, 25 bp, Mus musculus
cgttccggaagctgcagcttcaacc

SEQ ID NO: 263753 - DNA, 25 bp, Mus musculus
cgttcctatgagactatggcagggg

SEQ ID NO: 263754 - DNA, 25 bp, Mus musculus
cgttcctcaagatggccgactctgg

SEQ ID NO: 263755 - DNA, 25 bp, Mus musculus
cgttcctttaaaagatcagcatgga

SEQ ID NO: 263756 - DNA, 25 bp, Mus musculus
cgttcggccggctccattcagaaca

SEQ ID NO: 263757 - DNA, 25 bp, Mus musculus
cgttcgggactacaggcgagcggcg

SEQ ID NO: 263758 - DNA, 25 bp, Mus musculus
cgttcgggactacagggtcaacgtg

SEQ ID NO: 263759 - DNA, 25 bp, Mus musculus
cgttcgggtcagccggatgtggaga

SEQ ID NO: 263760 - DNA, 25 bp, Mus musculus
cgttcgttcaaggggcagaatcctt

SEQ ID NO: 263761 - DNA, 25 bp, Mus musculus
cgttctaaagaccaaggacaagtat

SEQ ID NO: 263762 - DNA, 25 bp, Mus musculus
cgttctacttttctggaggcattgg

SEQ ID NO: 263763 - DNA, 25 bp, Mus musculus
cgttctagatgagatatgtgaatcc

SEQ ID NO: 263764 - DNA, 25 bp, Mus musculus
cgttctatgtgagcaactgggacaa

SEQ ID NO: 263765 - DNA, 25 bp, Mus musculus
cgttctatgtgaggaaaaacgggat

SEQ ID NO: 263766 - DNA, 25 bp, Mus musculus
cgttctcgggcaaggacttagcatt

SEQ ID NO: 263767 - DNA, 25 bp, Mus musculus
cgttctctagcgaaatccctctcta

SEQ ID NO: 263768 - DNA, 25 bp, Mus musculus
cgttctctagcgtgatttttcttcc

SEQ ID NO: 263769 - DNA, 25 bp, Mus musculus
cgttctctgaaccaggttatgaaaa

SEQ ID NO: 263770 - DNA, 25 bp, Mus musculus
cgttctctgggttaccacagtggag

SEQ ID NO: 263771 - DNA, 25 bp, Mus musculus
cgttctgattgaagcctgctgcaaa

SEQ ID NO: 263772 - DNA, 25 bp, Mus musculus
cgttctgccagcctccgctccttca

SEQ ID NO: 263773 - DNA, 25 bp, Mus musculus
cgttctgccagttcggataggtcct

SEQ ID NO: 263774 - DNA, 25 bp, Mus musculus
cgttctggaagccctggaagagaga

SEQ ID NO: 263775 - DNA, 25 bp, Mus musculus
cgttctggaagcctttgcttcctta

SEQ ID NO: 263776 - DNA, 25 bp, Mus musculus
cgttctggagctgagaagggttact

SEQ ID NO: 263777 - DNA, 25 bp, Mus musculus
cgttcttaaaaagtgcttctctctg

SEQ ID NO: 263778 - DNA, 25 bp, Mus musculus
cgttcttagccgatctctgagaaga

SEQ ID NO: 263779 - DNA, 25 bp, Mus musculus
cgttcttagccggtaccagacgtta

SEQ ID NO: 263780 - DNA, 25 bp, Mus musculus
cgttcttagccggtccttcagtagc

SEQ ID NO: 263781 - DNA, 25 bp, Mus musculus
cgttcttaggtaaggtggtcagcgc

SEQ ID NO: 263782 - DNA, 25 bp, Mus musculus
cgttcttcacaggtggcttctgctt

SEQ ID NO: 263783 - DNA, 25 bp, Mus musculus
cgttcttcacgctggatgttgaatg

SEQ ID NO: 263784 - DNA, 25 bp, Mus musculus
cgttcttcacgctggggtttctctg

SEQ ID NO: 263785 - DNA, 25 bp, Mus musculus
cgttcttcataaaactctgaaggca

SEQ ID NO: 263786 - DNA, 25 bp, Mus musculus
cgttcttgctaactgtccagttaaa

SEQ ID NO: 263787 - DNA, 25 bp, Mus musculus
cgttcttgctggtgcactgcctgtt

SEQ ID NO: 263788 - DNA, 25 bp, Mus musculus
cgttcttgtcaataaggtaatgtta

SEQ ID NO: 263789 - DNA, 25 bp, Mus musculus
cgttctttctctcagccaaagcctt

SEQ ID NO: 263790 - DNA, 25 bp, Mus musculus
cgttgaacaacatgggacgaaactt

SEQ ID NO: 263791 - DNA, 25 bp, Mus musculus
cgttgaagaacagagcatttagctc

SEQ ID NO: 263792 - DNA, 25 bp, Mus musculus
cgttgaagaacagggagtgcttggt

SEQ ID NO: 263793 - DNA, 25 bp, Mus musculus
cgttgaaggaagataaagccatccc

SEQ ID NO: 263794 - DNA, 25 bp, Mus musculus
cgttgaaggaagatacatgttgtca

SEQ ID NO: 263795 - DNA, 25 bp, Mus musculus
cgttgacctgaaaaggaaacctgca

SEQ ID NO: 263796 - DNA, 25 bp, Mus musculus
cgttgactctggtagagcagatcct

SEQ ID NO: 263797 - DNA, 25 bp, Mus musculus
cgttgccaagagagtacacggtcat

SEQ ID NO: 263798 - DNA, 25 bp, Mus musculus
cgttgccaagaggaaaatagcttca

SEQ ID NO: 263799 - DNA, 25 bp, Mus musculus
cgttgcccagagatggactccagat

SEQ ID NO: 263800 - DNA, 25 bp, Mus musculus
cgttgcccagatcctgtgggccgaa

SEQ ID NO: 263801 - DNA, 25 bp, Mus musculus
cgttgccttgtggaggaactacttc

SEQ ID NO: 263802 - DNA, 25 bp, Mus musculus
cgttgcgccaggcaggacactgcta

SEQ ID NO: 263803 - DNA, 25 bp, Mus musculus
cgttgcgccaggtgtagctccactt

SEQ ID NO: 263804 - DNA, 25 bp, Mus musculus
cgttgctatcatgcgtgagtgcatc

SEQ ID NO: 263805 - DNA, 25 bp, Mus musculus
cgttgctatgctaagtatgagagcc

SEQ ID NO: 263806 - DNA, 25 bp, Mus musculus
cgttgctctggtcgaatggtatgtg

SEQ ID NO: 263807 - DNA, 25 bp, Mus musculus
cgttgctgacagaattaacggcaca

SEQ ID NO: 263808 - DNA, 25 bp, Mus musculus
cgttgctgaggtattatgatcagat

SEQ ID NO: 263809 - DNA, 25 bp, Mus musculus
cgttgctgggaggagagcgacatgt

SEQ ID NO: 263810 - DNA, 25 bp, Mus musculus
cgttgctggtacaattaccagaact

SEQ ID NO: 263811 - DNA, 25 bp, Mus musculus
cgttgctgtccagaaccccgtctgt

SEQ ID NO: 263812 - DNA, 25 bp, Mus musculus
cgttgctgtccagggtgaagcctgc

SEQ ID NO: 263813 - DNA, 25 bp, Mus musculus
cgttggagctcaggtgcccctggga

SEQ ID NO: 263814 - DNA, 25 bp, Mus musculus
cgttggaggcagacgatttacatgg

SEQ ID NO: 263815 - DNA, 25 bp, Mus musculus
cgttggagtgttcggggttaactgc

SEQ ID NO: 263816 - DNA, 25 bp, Mus musculus
cgttggatcctcctctgtagagctc

SEQ ID NO: 263817 - DNA, 25 bp, Mus musculus
cgttggatcctgcgggttgaggcgc

SEQ ID NO: 263818 - DNA, 25 bp, Mus musculus
cgttggatgtaaagacctctcggga

SEQ ID NO: 263819 - DNA, 25 bp, Mus musculus
cgttggccagacagctgagaaggta

SEQ ID NO: 263820 - DNA, 25 bp, Mus musculus
cgttggctggtccagctggtcttca

SEQ ID NO: 263821 - DNA, 25 bp, Mus musculus
cgttggctggtccaggtacatccct

SEQ ID NO: 263822 - DNA, 25 bp, Mus musculus
cgttggcttcattttaggtttagga

SEQ ID NO: 263823 - DNA, 25 bp, Mus musculus
cgttgggaaggaagaacgctgtgga

SEQ ID NO: 263824 - DNA, 25 bp, Mus musculus
cgttgggatcagattgataagtatc

SEQ ID NO: 263825 - DNA, 25 bp, Mus musculus
cgttggggagtatccgcctccgact

SEQ ID NO: 263826 - DNA, 25 bp, Mus musculus
cgttggggttcagttctgatacccg

SEQ ID NO: 263827 - DNA, 25 bp, Mus musculus
cgttggtgtctgtggggacctctga

SEQ ID NO: 263828 - DNA, 25 bp, Mus musculus
cgttggttggcttttgtttgtcatt

SEQ ID NO: 263829 - DNA, 25 bp, Mus musculus
cgttggttgtttttggtgccttcaa

SEQ ID NO: 263830 - DNA, 25 bp, Mus musculus
cgttggtttttcagaagatatggcc

SEQ ID NO: 263831 - DNA, 25 bp, Mus musculus
cgttggtttttctaggaaatcaagc

SEQ ID NO: 263832 - DNA, 25 bp, Mus musculus
cgttggtttttgtctccctgcaaca

SEQ ID NO: 263833 - DNA, 25 bp, Mus musculus
cgttgtagagtgtgtaatgctgtgt

SEQ ID NO: 263834 - DNA, 25 bp, Mus musculus
cgttgtagcccagaaagtcctaggt

SEQ ID NO: 263835 - DNA, 25 bp, Mus musculus
cgttgtatggaagagttactttgga

SEQ ID NO: 263836 - DNA, 25 bp, Mus musculus
cgttgtatggaagatctctgcgata

SEQ ID NO: 263837 - DNA, 25 bp, Mus musculus
cgttgtcacctgaggcccttctccc

SEQ ID NO: 263838 - DNA, 25 bp, Mus musculus
cgttgtcacctggagcattccagaa

SEQ ID NO: 263839 - DNA, 25 bp, Mus musculus
cgttgtcagtcttatggggcccaga

SEQ ID NO: 263840 - DNA, 25 bp, Mus musculus
cgttgtcatcacagcttagcgctct

SEQ ID NO: 263841 - DNA, 25 bp, Mus musculus
cgttgtcattgagcaagaagagagg

SEQ ID NO: 263842 - DNA, 25 bp, Mus musculus
cgttgtcccagaggtgccccagctc

SEQ ID NO: 263843 - DNA, 25 bp, Mus musculus
cgttgtcccagctgtccctcctccc

SEQ ID NO: 263844 - DNA, 25 bp, Mus musculus
cgttgtccgcataggcttcagttgt

SEQ ID NO: 263845 - DNA, 25 bp, Mus musculus
cgttgtggaaggctcaaagcagtgg

SEQ ID NO: 263846 - DNA, 25 bp, Mus musculus
cgttgttacagtttgccaggcagta

SEQ ID NO: 263847 - DNA, 25 bp, Mus musculus
cgttgttcaagtcagaaaccaaatt

SEQ ID NO: 263848 - DNA, 25 bp, Mus musculus
cgttgttcatggggcagtaaatggc

SEQ ID NO: 263849 - DNA, 25 bp, Mus musculus
cgttgttgctaagacattcgacatg

SEQ ID NO: 263850 - DNA, 25 bp, Mus musculus
cgtttaaaaaactggtatccagctc

SEQ ID NO: 263851 - DNA, 25 bp, Mus musculus
cgtttaaacaaagatcctgtgtacc

SEQ ID NO: 263852 - DNA, 25 bp, Mus musculus
cgtttaaacaaagatgagtacattg

SEQ ID NO: 263853 - DNA, 25 bp, Mus musculus
cgtttaactgactagatcttgatat

SEQ ID NO: 263854 - DNA, 25 bp, Mus musculus
cgtttaattttagctgaaccaataa

SEQ ID NO: 263855 - DNA, 25 bp, Mus musculus
cgtttacctcactcaggctgccatc

SEQ ID NO: 263856 - DNA, 25 bp, Mus musculus
cgtttagatcagctgaagcttgctt

SEQ ID NO: 263857 - DNA, 25 bp, Mus musculus
cgtttatttcaagtgtcaccagact

SEQ ID NO: 263858 - DNA, 25 bp, Mus musculus
cgtttcaacgattgtactgcatcta

SEQ ID NO: 263859 - DNA, 25 bp, Mus musculus
cgtttcagagggcccatagcctgtc

SEQ ID NO: 263860 - DNA, 25 bp, Mus musculus
cgtttcagccagattctggctggcg

SEQ ID NO: 263861 - DNA, 25 bp, Mus musculus
cgtttccacggaagatgctaccaag

SEQ ID NO: 263862 - DNA, 25 bp, Mus musculus
cgtttcccagatctgtctcgagagc

SEQ ID NO: 263863 - DNA, 25 bp, Mus musculus
cgtttccctggattatgccatctcc

SEQ ID NO: 263864 - DNA, 25 bp, Mus musculus
cgtttccctgggtatttctctgagt

SEQ ID NO: 263865 - DNA, 25 bp, Mus musculus
cgtttccgaggctcagtactatggc

SEQ ID NO: 263866 - DNA, 25 bp, Mus musculus
cgtttcctgggcagactcagccatg

SEQ ID NO: 263867 - DNA, 25 bp, Mus musculus
cgtttcctgttcaggtccgcgaata

SEQ ID NO: 263868 - DNA, 25 bp, Mus musculus
cgtttccttgtggaggtcttccaag

SEQ ID NO: 263869 - DNA, 25 bp, Mus musculus
cgtttcgggcatgagccaaagcctg

SEQ ID NO: 263870 - DNA, 25 bp, Mus musculus
cgtttcgggtccccggctacagcaa

SEQ ID NO: 263871 - DNA, 25 bp, Mus musculus
cgtttctaaactacatgagcgatgt

SEQ ID NO: 263872 - DNA, 25 bp, Mus musculus
cgtttctattgaaatctcacaggcc

SEQ ID NO: 263873 - DNA, 25 bp, Mus musculus
cgtttctattgaatacaggctagtc

SEQ ID NO: 263874 - DNA, 25 bp, Mus musculus
cgtttctcaggttattactctggga

SEQ ID NO: 263875 - DNA, 25 bp, Mus musculus
cgtttctcagtgctgatgcagatgc

SEQ ID NO: 263876 - DNA, 25 bp, Mus musculus
cgtttctcagtgctgatgcgcttcg

SEQ ID NO: 263877 - DNA, 25 bp, Mus musculus
cgtttctcccctgctcctctccagt

SEQ ID NO: 263878 - DNA, 25 bp, Mus musculus
cgtttctgagtgagatcccatttct

SEQ ID NO: 263879 - DNA, 25 bp, Mus musculus
cgtttctgcatctgaacaccgacct

SEQ ID NO: 263880 - DNA, 25 bp, Mus musculus
cgtttctgtcaagcctggaatgaag

SEQ ID NO: 263881 - DNA, 25 bp, Mus musculus
cgtttcttaactatatgagcgatgt

SEQ ID NO: 263882 - DNA, 25 bp, Mus musculus
cgtttcttcccaggtgaagtggaag

SEQ ID NO: 263883 - DNA, 25 bp, Mus musculus
cgtttgaaaaagtcctaatcctgga

SEQ ID NO: 263884 - DNA, 25 bp, Mus musculus
cgtttgaaggaactctcaaggggaa

SEQ ID NO: 263885 - DNA, 25 bp, Mus musculus
cgtttgattgctaagatcccaccaa

SEQ ID NO: 263886 - DNA, 25 bp, Mus musculus
cgtttgattgctaaggttgagggca

SEQ ID NO: 263887 - DNA, 25 bp, Mus musculus
cgtttgcacaaagttcgagaaggaa

SEQ ID NO: 263888 - DNA, 25 bp, Mus musculus
cgtttgcaggatgccggtgcagctg

SEQ ID NO: 263889 - DNA, 25 bp, Mus musculus
cgtttgcgcatcctgcagccacatt

SEQ ID NO: 263890 - DNA, 25 bp, Mus musculus
cgtttgctcagaatttcatgcctca

SEQ ID NO: 263891 - DNA, 25 bp, Mus musculus
cgtttgctcaggtcttggctagcct

SEQ ID NO: 263892 - DNA, 25 bp, Mus musculus
cgtttgcttcatgactttatatgga

SEQ ID NO: 263893 - DNA, 25 bp, Mus musculus
cgtttggaggtgccctccaagacca

SEQ ID NO: 263894 - DNA, 25 bp, Mus musculus
cgtttggatttgtggagtctggcca

SEQ ID NO: 263895 - DNA, 25 bp, Mus musculus
cgtttggatttgtgggggccagaac

SEQ ID NO: 263896 - DNA, 25 bp, Mus musculus
cgtttggccacggatccgggaggag

SEQ ID NO: 263897 - DNA, 25 bp, Mus musculus
cgtttggccacgggctccggccatt

SEQ ID NO: 263898 - DNA, 25 bp, Mus musculus
cgtttggcgcgatgtctcacaccat

SEQ ID NO: 263899 - DNA, 25 bp, Mus musculus
cgtttggcgcgatgtgcctgcgaca

SEQ ID NO: 263900 - DNA, 25 bp, Mus musculus
cgtttgtagtggtgacactcgaggc

SEQ ID NO: 263901 - DNA, 25 bp, Mus musculus
cgtttgtcagattttccactcacga

SEQ ID NO: 263902 - DNA, 25 bp, Mus musculus
cgtttgtcctgctgtgtttcaaatc

SEQ ID NO: 263903 - DNA, 25 bp, Mus musculus
cgtttgtgagtttgatgcagcctac

SEQ ID NO: 263904 - DNA, 25 bp, Mus musculus
cgtttgtgagtttgtctttggaggc

SEQ ID NO: 263905 - DNA, 25 bp, Mus musculus
cgtttgtgttacagctgccctatcc

SEQ ID NO: 263906 - DNA, 25 bp, Mus musculus
cgtttgttggacagatgcaccaaca

SEQ ID NO: 263907 - DNA, 25 bp, Mus musculus
cgttttaatacagatactgggagtc

SEQ ID NO: 263908 - DNA, 25 bp, Mus musculus
cgttttaatacagatacttgtggca

SEQ ID NO: 263909 - DNA, 25 bp, Mus musculus
cgttttaatcaagtacggcgagctc

SEQ ID NO: 263910 - DNA, 25 bp, Mus musculus
cgttttaatcaagtgctaccggact

SEQ ID NO: 263911 - DNA, 25 bp, Mus musculus
cgttttagataagagttgtagtgca

SEQ ID NO: 263912 - DNA, 25 bp, Mus musculus
cgttttagataagtatgaattactt

SEQ ID NO: 263913 - DNA, 25 bp, Mus musculus
cgttttcacactgacttgaatttta

SEQ ID NO: 263914 - DNA, 25 bp, Mus musculus
cgttttcacaggggccgatcaacag

SEQ ID NO: 263915 - DNA, 25 bp, Mus musculus
cgttttcattgtgatctctgggcta

SEQ ID NO: 263916 - DNA, 25 bp, Mus musculus
cgttttccctctagtggaaacaagt

SEQ ID NO: 263917 - DNA, 25 bp, Mus musculus
cgttttccctctagttgtgagcggc

SEQ ID NO: 263918 - DNA, 25 bp, Mus musculus
cgttttcctcaggcgcagacactca

SEQ ID NO: 263919 - DNA, 25 bp, Mus musculus
cgttttcctgggagactccagaacc

SEQ ID NO: 263920 - DNA, 25 bp, Mus musculus
cgttttctctagatccatttgggct

SEQ ID NO: 263921 - DNA, 25 bp, Mus musculus
cgttttgacttatatgatgttgatt

SEQ ID NO: 263922 - DNA, 25 bp, Mus musculus
cgttttgctggccttcagtggggct

SEQ ID NO: 263923 - DNA, 25 bp, Mus musculus
cgttttggcaaggagaggccagctg

SEQ ID NO: 263924 - DNA, 25 bp, Mus musculus
cgtttttcaaggatgtcactgattt

SEQ ID NO: 263925 - DNA, 25 bp, Mus musculus
cgtttttcaagtatgaagtcagagg

SEQ ID NO: 263926 - DNA, 25 bp, Mus musculus
cgtttttcagaatgccggacacaga

SEQ ID NO: 263927 - DNA, 25 bp, Mus musculus
cgtttttgtgatctgccagcttggg

SEQ ID NO: 263928 - DNA, 25 bp, Mus musculus
ctaaaaaaagaaatcacaattcaca

SEQ ID NO: 263929 - DNA, 25 bp, Mus musculus
ctaaaaaaagaaggtgacacagcat

SEQ ID NO: 263930 - DNA, 25 bp, Mus musculus
ctaaaaaaagactgggctatatgcc

SEQ ID NO: 263931 - DNA, 25 bp, Mus musculus
ctaaaaaaagtgccgtgatgccgtc

SEQ ID NO: 263932 - DNA, 25 bp, Mus musculus
ctaaaaaacaacaaggagtacctgg

SEQ ID NO: 263933 - DNA, 25 bp, Mus musculus
ctaaaaaaccagatcatcacctcca

SEQ ID NO: 263934 - DNA, 25 bp, Mus musculus
ctaaaaaccagtcggcagaccacag

SEQ ID NO: 263935 - DNA, 25 bp, Mus musculus
ctaaaaactcaagatgtggagtaca

SEQ ID NO: 263936 - DNA, 25 bp, Mus musculus
ctaaaaactgctttgcacgtgacac

SEQ ID NO: 263937 - DNA, 25 bp, Mus musculus
ctaaaaagaggttgtggatgtggct

SEQ ID NO: 263938 - DNA, 25 bp, Mus musculus
ctaaaaagtgggaaatgaaagcttg

SEQ ID NO: 263939 - DNA, 25 bp, Mus musculus
ctaaaacaagagatttgaagttcac

SEQ ID NO: 263940 - DNA, 25 bp, Mus musculus
ctaaaacaagaggagattaggttgt

SEQ ID NO: 263941 - DNA, 25 bp, Mus musculus
ctaaaaccagcaaaggaagtgggga

SEQ ID NO: 263942 - DNA, 25 bp, Mus musculus
ctaaaaccagcaaaggtcctttcca

SEQ ID NO: 263943 - DNA, 25 bp, Mus musculus
ctaaaacctgagaatctgcccgaga

SEQ ID NO: 263944 - DNA, 25 bp, Mus musculus
ctaaaactacaagagtggatcatga

SEQ ID NO: 263945 - DNA, 25 bp, Mus musculus
ctaaaactatagaggtgccttggag

SEQ ID NO: 263946 - DNA, 25 bp, Mus musculus
ctaaaactccaatgtcacagaaaag

SEQ ID NO: 263947 - DNA, 25 bp, Mus musculus
ctaaaactccagttccttctgatgt

SEQ ID NO: 263948 - DNA, 25 bp, Mus musculus
ctaaaagaagtcgttccccatcagg

SEQ ID NO: 263949 - DNA, 25 bp, Mus musculus
ctaaaagataaagagggctacacat

SEQ ID NO: 263950 - DNA, 25 bp, Mus musculus
ctaaaagatttgtccataagaactt

SEQ ID NO: 263951 - DNA, 25 bp, Mus musculus
ctaaaagccaagcacggaaataacc

SEQ ID NO: 263952 - DNA, 25 bp, Mus musculus
ctaaaagccatgaaagtatatctca

SEQ ID NO: 263953 - DNA, 25 bp, Mus musculus
ctaaaagccatgcagcaccagcgaa

SEQ ID NO: 263954 - DNA, 25 bp, Mus musculus
ctaaaagctctgggggtgaaatggg

SEQ ID NO: 263955 - DNA, 25 bp, Mus musculus
ctaaaagctctgggggtgaacatga

SEQ ID NO: 263956 - DNA, 25 bp, Mus musculus
ctaaaaggcagagatgctgattctc

SEQ ID NO: 263957 - DNA, 25 bp, Mus musculus
ctaaaaggcagagtatgtttgatgt

SEQ ID NO: 263958 - DNA, 25 bp, Mus musculus
ctaaaagggaaacaagttctgacag

SEQ ID NO: 263959 - DNA, 25 bp, Mus musculus
ctaaaataaatatccatgggaaact

SEQ ID NO: 263960 - DNA, 25 bp, Mus musculus
ctaaaataaatcatacctgcggtgg

SEQ ID NO: 263961 - DNA, 25 bp, Mus musculus
ctaaaataatttcagctgccagtga

SEQ ID NO: 263962 - DNA, 25 bp, Mus musculus
ctaaaatactctcctgggttgtgtt

SEQ ID NO: 263963 - DNA, 25 bp, Mus musculus
ctaaaatagagctggagtaactgag

SEQ ID NO: 263964 - DNA, 25 bp, Mus musculus
ctaaaatcagcaccgtgcgagtcca

SEQ ID NO: 263965 - DNA, 25 bp, Mus musculus
ctaaaatcccttgctaacagagaag

SEQ ID NO: 263966 - DNA, 25 bp, Mus musculus
ctaaaattacaagttgatcgtgtcc

SEQ ID NO: 263967 - DNA, 25 bp, Mus musculus
ctaaaatttccacctgctgatctta

SEQ ID NO: 263968 - DNA, 25 bp, Mus musculus
ctaaacaacaagatctgtgatattg

SEQ ID NO: 263969 - DNA, 25 bp, Mus musculus
ctaaacaagaaactcgggtgccctc

SEQ ID NO: 263970 - DNA, 25 bp, Mus musculus
ctaaacaagcccatgaagtgccccc

SEQ ID NO: 263971 - DNA, 25 bp, Mus musculus
ctaaacaatcagcccaggagttaaa

SEQ ID NO: 263972 - DNA, 25 bp, Mus musculus
ctaaacaatcttcaggtggctgtga

SEQ ID NO: 263973 - DNA, 25 bp, Mus musculus
ctaaacacaagagaattcatacagg

SEQ ID NO: 263974 - DNA, 25 bp, Mus musculus
ctaaacacaagatcttctgcccaat

SEQ ID NO: 263975 - DNA, 25 bp, Mus musculus
ctaaacactctactggatgactgga

SEQ ID NO: 263976 - DNA, 25 bp, Mus musculus
ctaaacagaaaggtgtcaactctgc

SEQ ID NO: 263977 - DNA, 25 bp, Mus musculus
ctaaacagcccagatgttctccgcc

SEQ ID NO: 263978 - DNA, 25 bp, Mus musculus
ctaaacaggtcttgtcaaacacgct

SEQ ID NO: 263979 - DNA, 25 bp, Mus musculus
ctaaacatcacgaagaaacttgtgg

SEQ ID NO: 263980 - DNA, 25 bp, Mus musculus
ctaaacatcacgaaggctttacaat

SEQ ID NO: 263981 - DNA, 25 bp, Mus musculus
ctaaacatcatcacgaaactgaggc

SEQ ID NO: 263982 - DNA, 25 bp, Mus musculus
ctaaacatctgggacgttaaaggat

SEQ ID NO: 263983 - DNA, 25 bp, Mus musculus
ctaaacatctgtggatggatggatg

SEQ ID NO: 263984 - DNA, 25 bp, Mus musculus
ctaaacatgcagaagtcgatgcaga

SEQ ID NO: 263985 - DNA, 25 bp, Mus musculus
ctaaaccagagcaaattcagaaatg

SEQ ID NO: 263986 - DNA, 25 bp, Mus musculus
ctaaaccagcagaaaaaattcaagc

SEQ ID NO: 263987 - DNA, 25 bp, Mus musculus
ctaaaccagcaggaatccatcagca

SEQ ID NO: 263988 - DNA, 25 bp, Mus musculus
ctaaaccattgctggcctcgaactg

SEQ ID NO: 263989 - DNA, 25 bp, Mus musculus
ctaaacccaagagtgatggaaagaa

SEQ ID NO: 263990 - DNA, 25 bp, Mus musculus
ctaaacccagctggtgccagctttc

SEQ ID NO: 263991 - DNA, 25 bp, Mus musculus
ctaaacctctgaactatgcctgtgt

SEQ ID NO: 263992 - DNA, 25 bp, Mus musculus
ctaaacctctgggaggatgttggat

SEQ ID NO: 263993 - DNA, 25 bp, Mus musculus
ctaaacctctgggtgaagggagcag

SEQ ID NO: 263994 - DNA, 25 bp, Mus musculus
ctaaacctgctgaagattcagatat

SEQ ID NO: 263995 - DNA, 25 bp, Mus musculus
ctaaacctgctgaagggagcatttc

SEQ ID NO: 263996 - DNA, 25 bp, Mus musculus
ctaaacctttccagtatactcctga

SEQ ID NO: 263997 - DNA, 25 bp, Mus musculus
ctaaacgccaggagcccttgcccag

SEQ ID NO: 263998 - DNA, 25 bp, Mus musculus
ctaaacgccagggaacctttgcaca

SEQ ID NO: 263999 - DNA, 25 bp, Mus musculus
ctaaacggcagaggattcgtaaact

SEQ ID NO: 264000 - DNA, 25 bp, Mus musculus
ctaaacgtttcactgcgcaaaccat

SEQ ID NO: 264001 - DNA, 25 bp, Mus musculus
ctaaactaatgaaagaggttaggaa

SEQ ID NO: 264002 - DNA, 25 bp, Mus musculus
ctaaactactcacaggatgagcaga

SEQ ID NO: 264003 - DNA, 25 bp, Mus musculus
ctaaactcagcccaaggcttgcagt

SEQ ID NO: 264004 - DNA, 25 bp, Mus musculus
ctaaactcggagcaggcagctggcc

SEQ ID NO: 264005 - DNA, 25 bp, Mus musculus
ctaaactcggagcagtgggaccctg

SEQ ID NO: 264006 - DNA, 25 bp, Mus musculus
ctaaactctcaccaaaatgtgagcg

SEQ ID NO: 264007 - DNA, 25 bp, Mus musculus
ctaaactgcaacacggctaaggaag

SEQ ID NO: 264008 - DNA, 25 bp, Mus musculus
ctaaacttcaaggctgtagagaggc

SEQ ID NO: 264009 - DNA, 25 bp, Mus musculus
ctaaactttgtgacttgcactaaga

SEQ ID NO: 264010 - DNA, 25 bp, Mus musculus
ctaaagaaagagtttgacctggtgt

SEQ ID NO: 264011 - DNA, 25 bp, Mus musculus
ctaaagaaaggtattgaggctctga

SEQ ID NO: 264012 - DNA, 25 bp, Mus musculus
ctaaagaagaaaaatgataccttag

SEQ ID NO: 264013 - DNA, 25 bp, Mus musculus
ctaaagaagtattagatggacagtt

SEQ ID NO: 264014 - DNA, 25 bp, Mus musculus
ctaaagaccggaaagcactgccacc

SEQ ID NO: 264015 - DNA, 25 bp, Mus musculus
ctaaagacgtaagttgaagatgtga

SEQ ID NO: 264016 - DNA, 25 bp, Mus musculus
ctaaagagcctgaaggaagagagat

SEQ ID NO: 264017 - DNA, 25 bp, Mus musculus
ctaaagagcctgaaggttaaaatga

SEQ ID NO: 264018 - DNA, 25 bp, Mus musculus
ctaaagagtgaaggcttcagatgct

SEQ ID NO: 264019 - DNA, 25 bp, Mus musculus
ctaaagatgcagctttgcagaaacc

SEQ ID NO: 264020 - DNA, 25 bp, Mus musculus
ctaaagatgcaggaacctccttctc

SEQ ID NO: 264021 - DNA, 25 bp, Mus musculus
ctaaagcaagggagccgagtaccct

SEQ ID NO: 264022 - DNA, 25 bp, Mus musculus
ctaaagcaattctggatatgctctc

SEQ ID NO: 264023 - DNA, 25 bp, Mus musculus
ctaaagcagaggtgaaagacaagga

SEQ ID NO: 264024 - DNA, 25 bp, Mus musculus
ctaaagcagaggtgcagtgagcctg

SEQ ID NO: 264025 - DNA, 25 bp, Mus musculus
ctaaagcaggtactaaaatggatcg

SEQ ID NO: 264026 - DNA, 25 bp, Mus musculus
ctaaagcatgaccccgtggcccttg

SEQ ID NO: 264027 - DNA, 25 bp, Mus musculus
ctaaagccaaaaccaacagcagctc

SEQ ID NO: 264028 - DNA, 25 bp, Mus musculus
ctaaagcccattatctccagcctgc

SEQ ID NO: 264029 - DNA, 25 bp, Mus musculus
ctaaagccgatgctcaggaaaaggt

SEQ ID NO: 264030 - DNA, 25 bp, Mus musculus
ctaaagccgatggcttcgggagcaa

SEQ ID NO: 264031 - DNA, 25 bp, Mus musculus
ctaaagccggagactcttcctgatc

SEQ ID NO: 264032 - DNA, 25 bp, Mus musculus
ctaaagccggagcgtgtttggtgct

SEQ ID NO: 264033 - DNA, 25 bp, Mus musculus
ctaaagctacaggtggtaaagcggg

SEQ ID NO: 264034 - DNA, 25 bp, Mus musculus
ctaaagctcagcagaaaatgaaaat

SEQ ID NO: 264035 - DNA, 25 bp, Mus musculus
ctaaagctcagcaggaaataacagt

SEQ ID NO: 264036 - DNA, 25 bp, Mus musculus
ctaaaggaagacttcgctgatgaac

SEQ ID NO: 264037 - DNA, 25 bp, Mus musculus
ctaaaggaataccaggaaaatagtg

SEQ ID NO: 264038 - DNA, 25 bp, Mus musculus
ctaaaggaataccaggaaatgataa

SEQ ID NO: 264039 - DNA, 25 bp, Mus musculus
ctaaaggagatcagggcatcacagg

SEQ ID NO: 264040 - DNA, 25 bp, Mus musculus
ctaaaggatatgttcgcacaactgg

SEQ ID NO: 264041 - DNA, 25 bp, Mus musculus
ctaaaggatcaaaagcaggaggagc

SEQ ID NO: 264042 - DNA, 25 bp, Mus musculus
ctaaaggcagaccattccacattgc

SEQ ID NO: 264043 - DNA, 25 bp, Mus musculus
ctaaaggccttaaagactattaaga

SEQ ID NO: 264044 - DNA, 25 bp, Mus musculus
ctaaaggccttaaaggaaatgaaag

SEQ ID NO: 264045 - DNA, 25 bp, Mus musculus
ctaaaggctgtccaacaggtgcgcc

SEQ ID NO: 264046 - DNA, 25 bp, Mus musculus
ctaaagggatctttgagagaaatac

SEQ ID NO: 264047 - DNA, 25 bp, Mus musculus
ctaaaggggaagaaaagacatgctc

SEQ ID NO: 264048 - DNA, 25 bp, Mus musculus
ctaaaggggaagtgaaatcttgtga

SEQ ID NO: 264049 - DNA, 25 bp, Mus musculus
ctaaagtaaataaaggaatgtgttt

SEQ ID NO: 264050 - DNA, 25 bp, Mus musculus
ctaaagtagagactcagggtgaccc

SEQ ID NO: 264051 - DNA, 25 bp, Mus musculus
ctaaagtcattaagggtgatgttta

SEQ ID NO: 264052 - DNA, 25 bp, Mus musculus
ctaaagtcggagaggtacagattcc

SEQ ID NO: 264053 - DNA, 25 bp, Mus musculus
ctaaagtcggagaggttgacgtcga

SEQ ID NO: 264054 - DNA, 25 bp, Mus musculus
ctaaagtgaacaggccatggcgcag

SEQ ID NO: 264055 - DNA, 25 bp, Mus musculus
ctaaagtgaacaggtgccttcttca

SEQ ID NO: 264056 - DNA, 25 bp, Mus musculus
ctaaagttcaagagctgtttgacaa

SEQ ID NO: 264057 - DNA, 25 bp, Mus musculus
ctaaagttgaagagatccacgtctc

SEQ ID NO: 264058 - DNA, 25 bp, Mus musculus
ctaaagttgaagaggcacagagaac

SEQ ID NO: 264059 - DNA, 25 bp, Mus musculus
ctaaagttgctgaggttgccaagaa

SEQ ID NO: 264060 - DNA, 25 bp, Mus musculus
ctaaagttttacagtggaaagccca

SEQ ID NO: 264061 - DNA, 25 bp, Mus musculus
ctaaataaagaaactactcactggc

SEQ ID NO: 264062 - DNA, 25 bp, Mus musculus
ctaaataaccagagtatgctggata

SEQ ID NO: 264063 - DNA, 25 bp, Mus musculus
ctaaataagggccacacctagtcag

SEQ ID NO: 264064 - DNA, 25 bp, Mus musculus
ctaaataatcagtatgaagctgctc

SEQ ID NO: 264065 - DNA, 25 bp, Mus musculus
ctaaatacaactcagatcccaagca

SEQ ID NO: 264066 - DNA, 25 bp, Mus musculus
ctaaatacaactcagatctccatca

SEQ ID NO: 264067 - DNA, 25 bp, Mus musculus
ctaaatacaatgcctttaacttgtt

SEQ ID NO: 264068 - DNA, 25 bp, Mus musculus
ctaaatagtccaacagaaagcaaag

SEQ ID NO: 264069 - DNA, 25 bp, Mus musculus
ctaaatagtccaacaggtgactgtt

SEQ ID NO: 264070 - DNA, 25 bp, Mus musculus
ctaaatagtccaacatcttcagcaa

SEQ ID NO: 264071 - DNA, 25 bp, Mus musculus
ctaaatcacatcaggtgacagagtt

SEQ ID NO: 264072 - DNA, 25 bp, Mus musculus
ctaaatccgagaggtcgaaggatct

SEQ ID NO: 264073 - DNA, 25 bp, Mus musculus
ctaaatctctcaaaggatcctgctg

SEQ ID NO: 264074 - DNA, 25 bp, Mus musculus
ctaaatctctcaaaggatgacattt

SEQ ID NO: 264075 - DNA, 25 bp, Mus musculus
ctaaatgagcaatctgtaaagaaaa

SEQ ID NO: 264076 - DNA, 25 bp, Mus musculus
ctaaatgataagaatggcacacgaa

SEQ ID NO: 264077 - DNA, 25 bp, Mus musculus
ctaaatgataaggaacatgacattg

SEQ ID NO: 264078 - DNA, 25 bp, Mus musculus
ctaaatgatggtgagctccagaaag

SEQ ID NO: 264079 - DNA, 25 bp, Mus musculus
ctaaatggtcgatgaagagtttgat

SEQ ID NO: 264080 - DNA, 25 bp, Mus musculus
ctaaatggtcgatggtggatgtaca

SEQ ID NO: 264081 - DNA, 25 bp, Mus musculus
ctaaatgtgttgcaacagaccaact

SEQ ID NO: 264082 - DNA, 25 bp, Mus musculus
ctaaatgtttccaaggatctgttaa

SEQ ID NO: 264083 - DNA, 25 bp, Mus musculus
ctaaatgtttccaagtgttcatgga

SEQ ID NO: 264084 - DNA, 25 bp, Mus musculus
ctaaattaaagactgagtgtggatg

SEQ ID NO: 264085 - DNA, 25 bp, Mus musculus
ctaaattcaagtgacaatgccttag

SEQ ID NO: 264086 - DNA, 25 bp, Mus musculus
ctaaattccaagccatcttctcttc

SEQ ID NO: 264087 - DNA, 25 bp, Mus musculus
ctaaattctaagatgggatgtgacc

SEQ ID NO: 264088 - DNA, 25 bp, Mus musculus
ctaaatttaagtatgcagtactgtt

SEQ ID NO: 264089 - DNA, 25 bp, Mus musculus
ctaacaatcttggcaaagcgcaagt

SEQ ID NO: 264090 - DNA, 25 bp, Mus musculus
ctaacaatgagccgtggaagaagcc

SEQ ID NO: 264091 - DNA, 25 bp, Mus musculus
ctaacaattttcagcagtacccctc

SEQ ID NO: 264092 - DNA, 25 bp, Mus musculus
ctaacacacaagaatcgcagaatgc

SEQ ID NO: 264093 - DNA, 25 bp, Mus musculus
ctaacacagttgctcctgaattcgg

SEQ ID NO: 264094 - DNA, 25 bp, Mus musculus
ctaacaccaaggtcacaaagcactt

SEQ ID NO: 264095 - DNA, 25 bp, Mus musculus
ctaacaccctgatgcttcctttgca

SEQ ID NO: 264096 - DNA, 25 bp, Mus musculus
ctaacacctagagagttgcttcaga

SEQ ID NO: 264097 - DNA, 25 bp, Mus musculus
ctaacacgaagaggtatatgtggtt

SEQ ID NO: 264098 - DNA, 25 bp, Mus musculus
ctaacactaaggatcatggatatac

SEQ ID NO: 264099 - DNA, 25 bp, Mus musculus
ctaacagaaaccagattcatccagt

SEQ ID NO: 264100 - DNA, 25 bp, Mus musculus
ctaacagagatgattctgacaatgg

SEQ ID NO: 264101 - DNA, 25 bp, Mus musculus
ctaacagatttcacgtgtcaccatg

SEQ ID NO: 264102 - DNA, 25 bp, Mus musculus
ctaacagcagcaggaaaatgggaag

SEQ ID NO: 264103 - DNA, 25 bp, Mus musculus
ctaacagctcaagatggtgaggaag

SEQ ID NO: 264104 - DNA, 25 bp, Mus musculus
ctaacagctctgggatgtcacagcc

SEQ ID NO: 264105 - DNA, 25 bp, Mus musculus
ctaacagtggggagccagctcccgt

SEQ ID NO: 264106 - DNA, 25 bp, Mus musculus
ctaacagttacctagatattgctgt

SEQ ID NO: 264107 - DNA, 25 bp, Mus musculus
ctaacagttacctaggcttttcact

SEQ ID NO: 264108 - DNA, 25 bp, Mus musculus
ctaacagttgtctacttacagctct

SEQ ID NO: 264109 - DNA, 25 bp, Mus musculus
ctaacataagctgcttcctgcttgc

SEQ ID NO: 264110 - DNA, 25 bp, Mus musculus
ctaacataagtcttcttttttgttt

SEQ ID NO: 264111 - DNA, 25 bp, Mus musculus
ctaacatattaaaggaggtcctggc

SEQ ID NO: 264112 - DNA, 25 bp, Mus musculus
ctaacatatttgaggcggaggcagc

SEQ ID NO: 264113 - DNA, 25 bp, Mus musculus
ctaacatattttaatttcaggaatt

SEQ ID NO: 264114 - DNA, 25 bp, Mus musculus
ctaacatattttatccaagtttggc

SEQ ID NO: 264115 - DNA, 25 bp, Mus musculus
ctaacatcacagattgctgaaagac

SEQ ID NO: 264116 - DNA, 25 bp, Mus musculus
ctaacatctaaggtgccaagtgctg

SEQ ID NO: 264117 - DNA, 25 bp, Mus musculus
ctaacatcttcacgctaatgaaccg

SEQ ID NO: 264118 - DNA, 25 bp, Mus musculus
ctaacatcttcacgtctcgaaaagg

SEQ ID NO: 264119 - DNA, 25 bp, Mus musculus
ctaacatcttcctggcttctgctgt

SEQ ID NO: 264120 - DNA, 25 bp, Mus musculus
ctaacatgaagctgttctttctaca

SEQ ID NO: 264121 - DNA, 25 bp, Mus musculus
ctaacatgaaggcagacaagttgtt

SEQ ID NO: 264122 - DNA, 25 bp, Mus musculus
ctaacatgcaatgatcttcccaaac

SEQ ID NO: 264123 - DNA, 25 bp, Mus musculus
ctaacatgcagtacactgccatgtc

SEQ ID NO: 264124 - DNA, 25 bp, Mus musculus
ctaacatggggttcggagcgaccgt

SEQ ID NO: 264125 - DNA, 25 bp, Mus musculus
ctaacattagaaatccacaggtagc

SEQ ID NO: 264126 - DNA, 25 bp, Mus musculus
ctaaccaacgtcaatcgctgcctcg

SEQ ID NO: 264127 - DNA, 25 bp, Mus musculus
ctaaccaatgtcaatcgctgcctcg

SEQ ID NO: 264128 - DNA, 25 bp, Mus musculus
ctaaccactcacaatcagcggagtg

SEQ ID NO: 264129 - DNA, 25 bp, Mus musculus
ctaaccagacagatggagaaagacg

SEQ ID NO: 264130 - DNA, 25 bp, Mus musculus
ctaaccagactgagatggaccacac

SEQ ID NO: 264131 - DNA, 25 bp, Mus musculus
ctaaccagaggcaccaggatcatct

SEQ ID NO: 264132 - DNA, 25 bp, Mus musculus
ctaaccagatggactatccatcgct

SEQ ID NO: 264133 - DNA, 25 bp, Mus musculus
ctaaccagctcgacttgagcagcgg

SEQ ID NO: 264134 - DNA, 25 bp, Mus musculus
ctaaccagctcgtcttgagcagcgg

SEQ ID NO: 264135 - DNA, 25 bp, Mus musculus
ctaaccatataccagaggaggagtc

SEQ ID NO: 264136 - DNA, 25 bp, Mus musculus
ctaaccatcatgagatatctgccaa

SEQ ID NO: 264137 - DNA, 25 bp, Mus musculus
ctaacccaaaacaagctaatgtctg

SEQ ID NO: 264138 - DNA, 25 bp, Mus musculus
ctaacccaaaacaagttgctcccaa

SEQ ID NO: 264139 - DNA, 25 bp, Mus musculus
ctaacccaggccaaggaggagtcag

SEQ ID NO: 264140 - DNA, 25 bp, Mus musculus
ctaacccccccacaggtcatcctgt

SEQ ID NO: 264141 - DNA, 25 bp, Mus musculus
ctaaccccgaaggcaaataagattg

SEQ ID NO: 264142 - DNA, 25 bp, Mus musculus
ctaacccctctcctccataagcagc

SEQ ID NO: 264143 - DNA, 25 bp, Mus musculus
ctaaccctacagggtgactacaacc

SEQ ID NO: 264144 - DNA, 25 bp, Mus musculus
ctaaccctgcctcagcccataccca

SEQ ID NO: 264145 - DNA, 25 bp, Mus musculus
ctaaccctttagatgctagtggagg

SEQ ID NO: 264146 - DNA, 25 bp, Mus musculus
ctaaccctttagatggtgtggatcc

SEQ ID NO: 264147 - DNA, 25 bp, Mus musculus
ctaaccgtacctggtctgacagaga

SEQ ID NO: 264148 - DNA, 25 bp, Mus musculus
ctaacctcaaagcctctccgaccag

SEQ ID NO: 264149 - DNA, 25 bp, Mus musculus
ctaacctcacacaggtggctgtggg

SEQ ID NO: 264150 - DNA, 25 bp, Mus musculus
ctaacctcacacagtacagatctca

SEQ ID NO: 264151 - DNA, 25 bp, Mus musculus
ctaacctcaccaaaggctattcgga

SEQ ID NO: 264152 - DNA, 25 bp, Mus musculus
ctaacctcaccaagtaccgggaagc

SEQ ID NO: 264153 - DNA, 25 bp, Mus musculus
ctaacctgagattacaagagcgaca

SEQ ID NO: 264154 - DNA, 25 bp, Mus musculus
ctaacctgaggcatgtctaggccat

SEQ ID NO: 264155 - DNA, 25 bp, Mus musculus
ctaacctgcatcccagcctatgacc

SEQ ID NO: 264156 - DNA, 25 bp, Mus musculus
ctaacctgcctgtgatggtatggat

SEQ ID NO: 264157 - DNA, 25 bp, Mus musculus
ctaacctggagaatgccctggactt

SEQ ID NO: 264158 - DNA, 25 bp, Mus musculus
ctaacctggttggtttgggatgctc

SEQ ID NO: 264159 - DNA, 25 bp, Mus musculus
ctaacgacaacagcccaaggagctc

SEQ ID NO: 264160 - DNA, 25 bp, Mus musculus
ctaacgacgtgaaagactggaggcc

SEQ ID NO: 264161 - DNA, 25 bp, Mus musculus
ctaacgaggacgtctgcctggcagt

SEQ ID NO: 264162 - DNA, 25 bp, Mus musculus
ctaacggatttgtcccactcactta

SEQ ID NO: 264163 - DNA, 25 bp, Mus musculus
ctaacggatttgttggatggattta

SEQ ID NO: 264164 - DNA, 25 bp, Mus musculus
ctaacggcctatggtgatgaagctc

SEQ ID NO: 264165 - DNA, 25 bp, Mus musculus
ctaacggcctgatgggagccaggag

SEQ ID NO: 264166 - DNA, 25 bp, Mus musculus
ctaactaaaggatgacagtccccgg

SEQ ID NO: 264167 - DNA, 25 bp, Mus musculus
ctaactacaatccagaggagtctct

SEQ ID NO: 264168 - DNA, 25 bp, Mus musculus
ctaactactacaggtattaagttcc

SEQ ID NO: 264169 - DNA, 25 bp, Mus musculus
ctaactcactcagaagagaagagca

SEQ ID NO: 264170 - DNA, 25 bp, Mus musculus
ctaactcactcagtgtcaacaggga

SEQ ID NO: 264171 - DNA, 25 bp, Mus musculus
ctaactcaggagaggagccatttat

SEQ ID NO: 264172 - DNA, 25 bp, Mus musculus
ctaactcaggagaggctgctcccag

SEQ ID NO: 264173 - DNA, 25 bp, Mus musculus
ctaactcaggagaggtacttggaag

SEQ ID NO: 264174 - DNA, 25 bp, Mus musculus
ctaactcaggccgggaaccgatgat

SEQ ID NO: 264175 - DNA, 25 bp, Mus musculus
ctaactctaggatgaagagggccag

SEQ ID NO: 264176 - DNA, 25 bp, Mus musculus
ctaactctgagaaggtctattacaa

SEQ ID NO: 264177 - DNA, 25 bp, Mus musculus
ctaactctgagggcacgtcagaggc

SEQ ID NO: 264178 - DNA, 25 bp, Mus musculus
ctaactctgagttcctgaaattcgt

SEQ ID NO: 264179 - DNA, 25 bp, Mus musculus
ctaactgagaccatgcagaggcctc

SEQ ID NO: 264180 - DNA, 25 bp, Mus musculus
ctaactgataaaattctaccagtgg

SEQ ID NO: 264181 - DNA, 25 bp, Mus musculus
ctaactgataaactccagggattcc

SEQ ID NO: 264182 - DNA, 25 bp, Mus musculus
ctaactgctcaatagtgaaattcca

SEQ ID NO: 264183 - DNA, 25 bp, Mus musculus
ctaacttacacctcgttttactgca

SEQ ID NO: 264184 - DNA, 25 bp, Mus musculus
ctaacttacagagttgagtggccta

SEQ ID NO: 264185 - DNA, 25 bp, Mus musculus
ctaacttacaggttctgacgggaac

SEQ ID NO: 264186 - DNA, 25 bp, Mus musculus
ctaacttcacaccaggagagcactg

SEQ ID NO: 264187 - DNA, 25 bp, Mus musculus
ctaacttcacaccagtcttcgctga

SEQ ID NO: 264188 - DNA, 25 bp, Mus musculus
ctaacttcagccagaggctccagcc

SEQ ID NO: 264189 - DNA, 25 bp, Mus musculus
ctaacttcagtgcttatccctctga

SEQ ID NO: 264190 - DNA, 25 bp, Mus musculus
ctaacttctccagaggcaagttcaa

SEQ ID NO: 264191 - DNA, 25 bp, Mus musculus
ctaacttctgggccaacaaattact

SEQ ID NO: 264192 - DNA, 25 bp, Mus musculus
ctaacttgtccatggaggtcttcac

SEQ ID NO: 264193 - DNA, 25 bp, Mus musculus
ctaacttgtccattttgttgcatat

SEQ ID NO: 264194 - DNA, 25 bp, Mus musculus
ctaactttcagttcaaaccggagga

SEQ ID NO: 264195 - DNA, 25 bp, Mus musculus
ctaactttccactatttgctgcctg

SEQ ID NO: 264196 - DNA, 25 bp, Mus musculus
ctaacttttacaagacagtccagca

SEQ ID NO: 264197 - DNA, 25 bp, Mus musculus
ctaacttttacaaggtggtacagca

SEQ ID NO: 264198 - DNA, 25 bp, Mus musculus
ctaacttttagtcacagaaaagaaa

SEQ ID NO: 264199 - DNA, 25 bp, Mus musculus
ctaagaaaaacaagggaagcttaga

SEQ ID NO: 264200 - DNA, 25 bp, Mus musculus
ctaagaaaacagagaaacctgatca

SEQ ID NO: 264201 - DNA, 25 bp, Mus musculus
ctaagaaacctcgagatcccaaacg

SEQ ID NO: 264202 - DNA, 25 bp, Mus musculus
ctaagaaacgagcaaaaaattccag

SEQ ID NO: 264203 - DNA, 25 bp, Mus musculus
ctaagaaactgccaggagtaggaac

SEQ ID NO: 264204 - DNA, 25 bp, Mus musculus
ctaagaaagagaccagtgctgttgc

SEQ ID NO: 264205 - DNA, 25 bp, Mus musculus
ctaagaaagccagagaaggtgtgat

SEQ ID NO: 264206 - DNA, 25 bp, Mus musculus
ctaagaaagccagcagcattagatt

SEQ ID NO: 264207 - DNA, 25 bp, Mus musculus
ctaagaaaggaccctcaacacctta

SEQ ID NO: 264208 - DNA, 25 bp, Mus musculus
ctaagaaataagcagatccttgtaa

SEQ ID NO: 264209 - DNA, 25 bp, Mus musculus
ctaagaaataaggatcgttcatcta

SEQ ID NO: 264210 - DNA, 25 bp, Mus musculus
ctaagaaatatgaagcacaagccca

SEQ ID NO: 264211 - DNA, 25 bp, Mus musculus
ctaagaaatttcctaatcaccctca

SEQ ID NO: 264212 - DNA, 25 bp, Mus musculus
ctaagaacaagaaaacagataaata

SEQ ID NO: 264213 - DNA, 25 bp, Mus musculus
ctaagaacaagccagggcctcctgc

SEQ ID NO: 264214 - DNA, 25 bp, Mus musculus
ctaagaagaaagaagatagtaaaaa

SEQ ID NO: 264215 - DNA, 25 bp, Mus musculus
ctaagaagacccagagtgatatcca

SEQ ID NO: 264216 - DNA, 25 bp, Mus musculus
ctaagaagagtgcagatgggatgct

SEQ ID NO: 264217 - DNA, 25 bp, Mus musculus
ctaagaagctatatccaggaccagc

SEQ ID NO: 264218 - DNA, 25 bp, Mus musculus
ctaagaagctggggacagcactggg

SEQ ID NO: 264219 - DNA, 25 bp, Mus musculus
ctaagaaggagaagaccaccagact

SEQ ID NO: 264220 - DNA, 25 bp, Mus musculus
ctaagaaggaggggtgaggctgctg

SEQ ID NO: 264221 - DNA, 25 bp, Mus musculus
ctaagaatgctgttttgaatcagcg

SEQ ID NO: 264222 - DNA, 25 bp, Mus musculus
ctaagacattgctagcatttgaaga

SEQ ID NO: 264223 - DNA, 25 bp, Mus musculus
ctaagactaaatgggtgaccgaggt

SEQ ID NO: 264224 - DNA, 25 bp, Mus musculus
ctaagactcaggtaacagttcagta

SEQ ID NO: 264225 - DNA, 25 bp, Mus musculus
ctaagactctagatattagctcaat

SEQ ID NO: 264226 - DNA, 25 bp, Mus musculus
ctaagactgcagatgcccccgaaaa

SEQ ID NO: 264227 - DNA, 25 bp, Mus musculus
ctaagagcaagatatgaaatcgtgg

SEQ ID NO: 264228 - DNA, 25 bp, Mus musculus
ctaagagccaggtaatttctaatgc

SEQ ID NO: 264229 - DNA, 25 bp, Mus musculus
ctaagagcccaggttgtctgttctt

SEQ ID NO: 264230 - DNA, 25 bp, Mus musculus
ctaagagcccagtgccatgtcggac

SEQ ID NO: 264231 - DNA, 25 bp, Mus musculus
ctaagagggcgaatattcgcctccc

SEQ ID NO: 264232 - DNA, 25 bp, Mus musculus
ctaagagggcgaattgtggagcccc

SEQ ID NO: 264233 - DNA, 25 bp, Mus musculus
ctaagataggctgagcatcccagcc

SEQ ID NO: 264234 - DNA, 25 bp, Mus musculus
ctaagataggctggagtcccctccc

SEQ ID NO: 264235 - DNA, 25 bp, Mus musculus
ctaagatctggaagtgccaaagtag

SEQ ID NO: 264236 - DNA, 25 bp, Mus musculus
ctaagatggtgcagtgaaccaccat

SEQ ID NO: 264237 - DNA, 25 bp, Mus musculus
ctaagattagacctggttggctcaa

SEQ ID NO: 264238 - DNA, 25 bp, Mus musculus
ctaagattctccttccacgacccat

SEQ ID NO: 264239 - DNA, 25 bp, Mus musculus
ctaagattgaagatcgagcgtttgg

SEQ ID NO: 264240 - DNA, 25 bp, Mus musculus
ctaagcaactccgcctccctgcctc

SEQ ID NO: 264241 - DNA, 25 bp, Mus musculus
ctaagcaactccggagcctggtgaa

SEQ ID NO: 264242 - DNA, 25 bp, Mus musculus
ctaagcaagaacaatactacaagat

SEQ ID NO: 264243 - DNA, 25 bp, Mus musculus
ctaagcaagaagactaagaacattg

SEQ ID NO: 264244 - DNA, 25 bp, Mus musculus
ctaagcaagaagtggtggtaatcag

SEQ ID NO: 264245 - DNA, 25 bp, Mus musculus
ctaagcaagaatgagctgaagaggc

SEQ ID NO: 264246 - DNA, 25 bp, Mus musculus
ctaagcaaggtaacccagcatgtag

SEQ ID NO: 264247 - DNA, 25 bp, Mus musculus
ctaagcacaagagtcacctgtacct

SEQ ID NO: 264248 - DNA, 25 bp, Mus musculus
ctaagcacctagagacaagtaagca

SEQ ID NO: 264249 - DNA, 25 bp, Mus musculus
ctaagcactgggtatctctctttct

SEQ ID NO: 264250 - DNA, 25 bp, Mus musculus
ctaagcactgggtattttcttgtta

SEQ ID NO: 264251 - DNA, 25 bp, Mus musculus
ctaagcagaagcaccgagtggattt

SEQ ID NO: 264252 - DNA, 25 bp, Mus musculus
ctaagcagaaggtattgtcatcact

SEQ ID NO: 264253 - DNA, 25 bp, Mus musculus
ctaagcagccagatttagatcatgc

SEQ ID NO: 264254 - DNA, 25 bp, Mus musculus
ctaagcagtaccagtttgctagtgg

SEQ ID NO: 264255 - DNA, 25 bp, Mus musculus
ctaagcatttagaatgcacaaaaca

SEQ ID NO: 264256 - DNA, 25 bp, Mus musculus
ctaagccacagtgacaacagctact

SEQ ID NO: 264257 - DNA, 25 bp, Mus musculus
ctaagccagcaggcctcagggctgg

SEQ ID NO: 264258 - DNA, 25 bp, Mus musculus
ctaagccagcagggcctgggctggt

SEQ ID NO: 264259 - DNA, 25 bp, Mus musculus
ctaagccagtgggagtgtgcagcca

SEQ ID NO: 264260 - DNA, 25 bp, Mus musculus
ctaagcccaaacttgcacgagccac

SEQ ID NO: 264261 - DNA, 25 bp, Mus musculus
ctaagcccagatggctctgactcca

SEQ ID NO: 264262 - DNA, 25 bp, Mus musculus
ctaagccggaaggagtcccagccaa

SEQ ID NO: 264263 - DNA, 25 bp, Mus musculus
ctaagcctaaggtgctgtgctccat

SEQ ID NO: 264264 - DNA, 25 bp, Mus musculus
ctaagcctgaacctggctgcttttg

SEQ ID NO: 264265 - DNA, 25 bp, Mus musculus
ctaagcgtagaagccgaactcccgt

SEQ ID NO: 264266 - DNA, 25 bp, Mus musculus
ctaagctgccgggcatgtctaggcc

SEQ ID NO: 264267 - DNA, 25 bp, Mus musculus
ctaagcttacaggagtgccaggagg

SEQ ID NO: 264268 - DNA, 25 bp, Mus musculus
ctaagcttccagagcagaacatcat

SEQ ID NO: 264269 - DNA, 25 bp, Mus musculus
ctaagcttcctggtgcaaatagtct

SEQ ID NO: 264270 - DNA, 25 bp, Mus musculus
ctaaggaaacaggtctggaaccaaa

SEQ ID NO: 264271 - DNA, 25 bp, Mus musculus
ctaaggaaaggtacaaaaatataca

SEQ ID NO: 264272 - DNA, 25 bp, Mus musculus
ctaaggaaatacagatgctggcccg

SEQ ID NO: 264273 - DNA, 25 bp, Mus musculus
ctaaggaacaagactgggatcagat

SEQ ID NO: 264274 - DNA, 25 bp, Mus musculus
ctaaggaacaggtgtggtatcagta

SEQ ID NO: 264275 - DNA, 25 bp, Mus musculus
ctaaggaacatggggcagcaggagc

SEQ ID NO: 264276 - DNA, 25 bp, Mus musculus
ctaaggaacatgggtgtagtgattt

SEQ ID NO: 264277 - DNA, 25 bp, Mus musculus
ctaaggaagggtcttctacttacaa

SEQ ID NO: 264278 - DNA, 25 bp, Mus musculus
ctaaggaatgattggatccagtgtg

SEQ ID NO: 264279 - DNA, 25 bp, Mus musculus
ctaaggaatgggtattggcttgctt

SEQ ID NO: 264280 - DNA, 25 bp, Mus musculus
ctaaggacattgagacagaaagaca

SEQ ID NO: 264281 - DNA, 25 bp, Mus musculus
ctaaggaccctcaggcattatgaga

SEQ ID NO: 264282 - DNA, 25 bp, Mus musculus
ctaaggagacaagaccccagcgcat

SEQ ID NO: 264283 - DNA, 25 bp, Mus musculus
ctaaggagagcaaggctctgtacaa

SEQ ID NO: 264284 - DNA, 25 bp, Mus musculus
ctaaggagggcctggtttctcactt

SEQ ID NO: 264285 - DNA, 25 bp, Mus musculus
ctaaggagtgaggagtcaccactac

SEQ ID NO: 264286 - DNA, 25 bp, Mus musculus
ctaaggatccagcgtctgttgacat

SEQ ID NO: 264287 - DNA, 25 bp, Mus musculus
ctaaggatccaggaccacaagccag

SEQ ID NO: 264288 - DNA, 25 bp, Mus musculus
ctaaggatccagggctcactgatca

SEQ ID NO: 264289 - DNA, 25 bp, Mus musculus
ctaaggatcctgaccccgaacttct

SEQ ID NO: 264290 - DNA, 25 bp, Mus musculus
ctaaggatgatgggccagatcatct

SEQ ID NO: 264291 - DNA, 25 bp, Mus musculus
ctaaggatggtcctgcccccgctct

SEQ ID NO: 264292 - DNA, 25 bp, Mus musculus
ctaaggattcaggctaaaaccgact

SEQ ID NO: 264293 - DNA, 25 bp, Mus musculus
ctaaggattgtcccgaaagggtctc

SEQ ID NO: 264294 - DNA, 25 bp, Mus musculus
ctaaggattgtcccgatgtgaaaca

SEQ ID NO: 264295 - DNA, 25 bp, Mus musculus
ctaaggcaaagattattggatttgg

SEQ ID NO: 264296 - DNA, 25 bp, Mus musculus
ctaaggcaaccagagtaccagtgat

SEQ ID NO: 264297 - DNA, 25 bp, Mus musculus
ctaaggcaatcgtgaagtcctacct

SEQ ID NO: 264298 - DNA, 25 bp, Mus musculus
ctaaggccaagcttctggggtttgg

SEQ ID NO: 264299 - DNA, 25 bp, Mus musculus
ctaaggcccagggctgtaccatggc

SEQ ID NO: 264300 - DNA, 25 bp, Mus musculus
ctaaggcccaggtccctatttgttc

SEQ ID NO: 264301 - DNA, 25 bp, Mus musculus
ctaaggccggaaggtagcgatggtg

SEQ ID NO: 264302 - DNA, 25 bp, Mus musculus
ctaaggcgagggattttaggtgatg

SEQ ID NO: 264303 - DNA, 25 bp, Mus musculus
ctaaggcgcagaaggatcgccacga

SEQ ID NO: 264304 - DNA, 25 bp, Mus musculus
ctaaggcggcaggaccctgagccgt

SEQ ID NO: 264305 - DNA, 25 bp, Mus musculus
ctaagggaacacgaggttccgagtc

SEQ ID NO: 264306 - DNA, 25 bp, Mus musculus
ctaagggaagatacacctatggctg

SEQ ID NO: 264307 - DNA, 25 bp, Mus musculus
ctaagggaaggaaccaagtggttgt

SEQ ID NO: 264308 - DNA, 25 bp, Mus musculus
ctaagggacagatggctatgaacgg

SEQ ID NO: 264309 - DNA, 25 bp, Mus musculus
ctaagggacagggggctgaaagagg

SEQ ID NO: 264310 - DNA, 25 bp, Mus musculus
ctaagggcgagaagggagatcctgg

SEQ ID NO: 264311 - DNA, 25 bp, Mus musculus
ctaagggggcagccttgcagcagaa

SEQ ID NO: 264312 - DNA, 25 bp, Mus musculus
ctaagggggcagctttgtcgaaaca

SEQ ID NO: 264313 - DNA, 25 bp, Mus musculus
ctaagggtgaccgaggtggcatagg

SEQ ID NO: 264314 - DNA, 25 bp, Mus musculus
ctaaggtcggacaagctctactcca

SEQ ID NO: 264315 - DNA, 25 bp, Mus musculus
ctaaggtcggacaaggaaacacaga

SEQ ID NO: 264316 - DNA, 25 bp, Mus musculus
ctaagtaacttgataacaaagttgt

SEQ ID NO: 264317 - DNA, 25 bp, Mus musculus
ctaagtacacaaatgatgacttctg

SEQ ID NO: 264318 - DNA, 25 bp, Mus musculus
ctaagtacaggtcaccatcatgatg

SEQ ID NO: 264319 - DNA, 25 bp, Mus musculus
ctaagtacctagaagatcttggtaa

SEQ ID NO: 264320 - DNA, 25 bp, Mus musculus
ctaagtactttggcagcccgggcca

SEQ ID NO: 264321 - DNA, 25 bp, Mus musculus
ctaagtagtgagtctattgagaacc

SEQ ID NO: 264322 - DNA, 25 bp, Mus musculus
ctaagtcctgacaagccgcccctcg

SEQ ID NO: 264323 - DNA, 25 bp, Mus musculus
ctaagtcctgacacaagcgaccggg

SEQ ID NO: 264324 - DNA, 25 bp, Mus musculus
ctaagtcctggtacgccataccacc

SEQ ID NO: 264325 - DNA, 25 bp, Mus musculus
ctaagtcgaaagagttataccctga

SEQ ID NO: 264326 - DNA, 25 bp, Mus musculus
ctaagtcgcaggtagaatggatgag

SEQ ID NO: 264327 - DNA, 25 bp, Mus musculus
ctaagtctacccggcagttgggttc

SEQ ID NO: 264328 - DNA, 25 bp, Mus musculus
ctaagtctacccggtttattatata

SEQ ID NO: 264329 - DNA, 25 bp, Mus musculus
ctaagtctccccatgccctacctga

SEQ ID NO: 264330 - DNA, 25 bp, Mus musculus
ctaagtctgacccccattgttccca

SEQ ID NO: 264331 - DNA, 25 bp, Mus musculus
ctaagtgaaggacagagggtacccg

SEQ ID NO: 264332 - DNA, 25 bp, Mus musculus
ctaagtgacaagaaaatgacaagat

SEQ ID NO: 264333 - DNA, 25 bp, Mus musculus
ctaagtgacaagaatatagaacgat

SEQ ID NO: 264334 - DNA, 25 bp, Mus musculus
ctaagtgcaaagaatggctacatct

SEQ ID NO: 264335 - DNA, 25 bp, Mus musculus
ctaagtgcaaagagagacaggaatc

SEQ ID NO: 264336 - DNA, 25 bp, Mus musculus
ctaagtgcaagatatgaaattgttg

SEQ ID NO: 264337 - DNA, 25 bp, Mus musculus
ctaagtggaggttccatgttggata

SEQ ID NO: 264338 - DNA, 25 bp, Mus musculus
ctaagtggctctgtatttctgtcat

SEQ ID NO: 264339 - DNA, 25 bp, Mus musculus
ctaagtggctgagccaaaccagcaa

SEQ ID NO: 264340 - DNA, 25 bp, Mus musculus
ctaagtgttgaccctgcagaaaact

SEQ ID NO: 264341 - DNA, 25 bp, Mus musculus
ctaagttcaaacaggcagctgagac

SEQ ID NO: 264342 - DNA, 25 bp, Mus musculus
ctaagttcaaacagtcgagagctat

SEQ ID NO: 264343 - DNA, 25 bp, Mus musculus
ctaagtttgcagcttggatgctcaa

SEQ ID NO: 264344 - DNA, 25 bp, Mus musculus
ctaataaaaacagaacagttgaata

SEQ ID NO: 264345 - DNA, 25 bp, Mus musculus
ctaataacatccatccttcatgatt

SEQ ID NO: 264346 - DNA, 25 bp, Mus musculus
ctaataacctcaagtgactgtggtc

SEQ ID NO: 264347 - DNA, 25 bp, Mus musculus
ctaataagatgcactccatgaatgg

SEQ ID NO: 264348 - DNA, 25 bp, Mus musculus
ctaatacgagggagaagacacccat

SEQ ID NO: 264349 - DNA, 25 bp, Mus musculus
ctaatactctttaaggaagattact

SEQ ID NO: 264350 - DNA, 25 bp, Mus musculus
ctaataggagacaggtggcgacaga

SEQ ID NO: 264351 - DNA, 25 bp, Mus musculus
ctaataggagacagtcagtggatac

SEQ ID NO: 264352 - DNA, 25 bp, Mus musculus
ctaatagtgtccatgtcaatataca

SEQ ID NO: 264353 - DNA, 25 bp, Mus musculus
ctaatatcacagaacagcacttctt

SEQ ID NO: 264354 - DNA, 25 bp, Mus musculus
ctaatatcagcgctcatgctccgga

SEQ ID NO: 264355 - DNA, 25 bp, Mus musculus
ctaatatcatccagttgctgcttca

SEQ ID NO: 264356 - DNA, 25 bp, Mus musculus
ctaatatcccaacggagtcctcctt

SEQ ID NO: 264357 - DNA, 25 bp, Mus musculus
ctaatatctttgggagacgctctgt

SEQ ID NO: 264358 - DNA, 25 bp, Mus musculus
ctaatatctttggtctgtccgaatc

SEQ ID NO: 264359 - DNA, 25 bp, Mus musculus
ctaatatgaaggaagtacttaagca

SEQ ID NO: 264360 - DNA, 25 bp, Mus musculus
ctaatatgaggaactgtactgagtg

SEQ ID NO: 264361 - DNA, 25 bp, Mus musculus
ctaatattcaaacaagttcaaagaa

SEQ ID NO: 264362 - DNA, 25 bp, Mus musculus
ctaatattcaagacgccttgggatg

SEQ ID NO: 264363 - DNA, 25 bp, Mus musculus
ctaatcaaagagagaatccatggag

SEQ ID NO: 264364 - DNA, 25 bp, Mus musculus
ctaatcacatccgctgcgagcctgc

SEQ ID NO: 264365 - DNA, 25 bp, Mus musculus
ctaatcagcaaggagctagctgagc

SEQ ID NO: 264366 - DNA, 25 bp, Mus musculus
ctaatcagcagaaggaagagcggtc

SEQ ID NO: 264367 - DNA, 25 bp, Mus musculus
ctaatcagtgagaccaagtaccgta

SEQ ID NO: 264368 - DNA, 25 bp, Mus musculus
ctaatcagtgagcaagtacaaatct

SEQ ID NO: 264369 - DNA, 25 bp, Mus musculus
ctaatcatcgtttaacaatggaaca

SEQ ID NO: 264370 - DNA, 25 bp, Mus musculus
ctaatcatgcaggaggatctgctgg

SEQ ID NO: 264371 - DNA, 25 bp, Mus musculus
ctaatcatgcagggtcccacctcct

SEQ ID NO: 264372 - DNA, 25 bp, Mus musculus
ctaatcattcttgtgaatctcttgg

SEQ ID NO: 264373 - DNA, 25 bp, Mus musculus
ctaatcattctttctgagcagaagt

SEQ ID NO: 264374 - DNA, 25 bp, Mus musculus
ctaatcccaagcacggtagatggac

SEQ ID NO: 264375 - DNA, 25 bp, Mus musculus
ctaatccgggagctttctccagacc

SEQ ID NO: 264376 - DNA, 25 bp, Mus musculus
ctaatcctaaatctccacagttgac

SEQ ID NO: 264377 - DNA, 25 bp, Mus musculus
ctaatcctggaggtcctagaagacc

SEQ ID NO: 264378 - DNA, 25 bp, Mus musculus
ctaatcctggagttagcagcccaag

SEQ ID NO: 264379 - DNA, 25 bp, Mus musculus
ctaatcgattgaggcccaaggggct

SEQ ID NO: 264380 - DNA, 25 bp, Mus musculus
ctaatcgattggattttcaccttgt

SEQ ID NO: 264381 - DNA, 25 bp, Mus musculus
ctaatcgcaattggaaggatgcagg

SEQ ID NO: 264382 - DNA, 25 bp, Mus musculus
ctaatcgtggcaaaaagtcagtccg

SEQ ID NO: 264383 - DNA, 25 bp, Mus musculus
ctaatctgaaggtgccctgggacaa

SEQ ID NO: 264384 - DNA, 25 bp, Mus musculus
ctaatctttgaggcctgcagcatgc

SEQ ID NO: 264385 - DNA, 25 bp, Mus musculus
ctaatctttgagggaaccaatgaga

SEQ ID NO: 264386 - DNA, 25 bp, Mus musculus
ctaatgaaaagatctccaagagggt

SEQ ID NO: 264387 - DNA, 25 bp, Mus musculus
ctaatgaaagacagaaacaaactgt

SEQ ID NO: 264388 - DNA, 25 bp, Mus musculus
ctaatgaaagacagggacatgaaac

SEQ ID NO: 264389 - DNA, 25 bp, Mus musculus
ctaatgaaagaggttaggaatttgg

SEQ ID NO: 264390 - DNA, 25 bp, Mus musculus
ctaatgaatggattggtatgtgtgc

SEQ ID NO: 264391 - DNA, 25 bp, Mus musculus
ctaatgacagtaattatgccaccct

SEQ ID NO: 264392 - DNA, 25 bp, Mus musculus
ctaatgacatcaggacccgggtcgg

SEQ ID NO: 264393 - DNA, 25 bp, Mus musculus
ctaatgaccaagccttagggtcagc

SEQ ID NO: 264394 - DNA, 25 bp, Mus musculus
ctaatgagatggatcccccggatgt

SEQ ID NO: 264395 - DNA, 25 bp, Mus musculus
ctaatgatactgtcggccagtgaag

SEQ ID NO: 264396 - DNA, 25 bp, Mus musculus
ctaatgatcaaagcgctgcaggggt

SEQ ID NO: 264397 - DNA, 25 bp, Mus musculus
ctaatgatcaacggttccagtttgt

SEQ ID NO: 264398 - DNA, 25 bp, Mus musculus
ctaatgatgatgcagggccctggcc

SEQ ID NO: 264399 - DNA, 25 bp, Mus musculus
ctaatgatgcctatcctggcccgcc

SEQ ID NO: 264400 - DNA, 25 bp, Mus musculus
ctaatgcaaacaagggcaccctgga

SEQ ID NO: 264401 - DNA, 25 bp, Mus musculus
ctaatgcagagatccactgccagaa

SEQ ID NO: 264402 - DNA, 25 bp, Mus musculus
ctaatgcagaggggagtttgcccaa

SEQ ID NO: 264403 - DNA, 25 bp, Mus musculus
ctaatgccactaaacctggaccctt

SEQ ID NO: 264404 - DNA, 25 bp, Mus musculus
ctaatgccttgctgtgcttctacag

SEQ ID NO: 264405 - DNA, 25 bp, Mus musculus
ctaatgccttgggcgctgggctgca

SEQ ID NO: 264406 - DNA, 25 bp, Mus musculus
ctaatgctgacacctcctcatggac

SEQ ID NO: 264407 - DNA, 25 bp, Mus musculus
ctaatgctgacagctcctcatggac

SEQ ID NO: 264408 - DNA, 25 bp, Mus musculus
ctaatggaatgggcattatatttag

SEQ ID NO: 264409 - DNA, 25 bp, Mus musculus
ctaatggaatgggccttgcatttag

SEQ ID NO: 264410 - DNA, 25 bp, Mus musculus
ctaatggaccagctagtggaaccct

SEQ ID NO: 264411 - DNA, 25 bp, Mus musculus
ctaatggcagttggatcctccagat

SEQ ID NO: 264412 - DNA, 25 bp, Mus musculus
ctaatggctcagctttcaacatttc

SEQ ID NO: 264413 - DNA, 25 bp, Mus musculus
ctaatgggaagagtacatctcggat

SEQ ID NO: 264414 - DNA, 25 bp, Mus musculus
ctaatgggttatattatgggcaaag

SEQ ID NO: 264415 - DNA, 25 bp, Mus musculus
ctaatggtccatctctacaacatct

SEQ ID NO: 264416 - DNA, 25 bp, Mus musculus
ctaatggtccattacccaggcaaga

SEQ ID NO: 264417 - DNA, 25 bp, Mus musculus
ctaatgtaaacctgaactatgacaa

SEQ ID NO: 264418 - DNA, 25 bp, Mus musculus
ctaatgtaaacctgttgccaagaac

SEQ ID NO: 264419 - DNA, 25 bp, Mus musculus
ctaatgtaaaggggctctttcctgc

SEQ ID NO: 264420 - DNA, 25 bp, Mus musculus
ctaatgtaagaatgtctacaagcag

SEQ ID NO: 264421 - DNA, 25 bp, Mus musculus
ctaatgtcaacagaccgctccggcc

SEQ ID NO: 264422 - DNA, 25 bp, Mus musculus
ctaatgtgtgagcaaagaagataga

SEQ ID NO: 264423 - DNA, 25 bp, Mus musculus
ctaatgtgtgagcaacttggcatca

SEQ ID NO: 264424 - DNA, 25 bp, Mus musculus
ctaattaaagtgaagacgctgactg

SEQ ID NO: 264425 - DNA, 25 bp, Mus musculus
ctaattaaagtgaagtccaccacag

SEQ ID NO: 264426 - DNA, 25 bp, Mus musculus
ctaattactgaaaaagaagttattt

SEQ ID NO: 264427 - DNA, 25 bp, Mus musculus
ctaattactggattctgctctaata

SEQ ID NO: 264428 - DNA, 25 bp, Mus musculus
ctaattcacacagaagtgctgtcga

SEQ ID NO: 264429 - DNA, 25 bp, Mus musculus
ctaattcagacacaatggcctgtga

SEQ ID NO: 264430 - DNA, 25 bp, Mus musculus
ctaattcatacagattcatctgaaa

SEQ ID NO: 264431 - DNA, 25 bp, Mus musculus
ctaattcatacaggtcccatggcct

SEQ ID NO: 264432 - DNA, 25 bp, Mus musculus
ctaattcgcgacatgaatggaatga

SEQ ID NO: 264433 - DNA, 25 bp, Mus musculus
ctaattcgcgacatgatctacttct

SEQ ID NO: 264434 - DNA, 25 bp, Mus musculus
ctaattcgtctgaggaagaatgttt

SEQ ID NO: 264435 - DNA, 25 bp, Mus musculus
ctaattctttaagttcaagtttgga

SEQ ID NO: 264436 - DNA, 25 bp, Mus musculus
ctaattgatgagatggttggtaaag

SEQ ID NO: 264437 - DNA, 25 bp, Mus musculus
ctaattgtgggagtctgcagtgatg

SEQ ID NO: 264438 - DNA, 25 bp, Mus musculus
ctaatttagagatgaaatccttcag

SEQ ID NO: 264439 - DNA, 25 bp, Mus musculus
ctaatttagaggggctccatagaca

SEQ ID NO: 264440 - DNA, 25 bp, Mus musculus
ctaatttatgatcgttgtccaactc

SEQ ID NO: 264441 - DNA, 25 bp, Mus musculus
ctaatttatgccggaaccctctgca

SEQ ID NO: 264442 - DNA, 25 bp, Mus musculus
ctaatttatggcggaaccctctgca

SEQ ID NO: 264443 - DNA, 25 bp, Mus musculus
ctaatttcttggggcgctttcatct

SEQ ID NO: 264444 - DNA, 25 bp, Mus musculus
ctaatttcttggtgaatgaactcat

SEQ ID NO: 264445 - DNA, 25 bp, Mus musculus
ctaatttgtggaacctctgaggggc

SEQ ID NO: 264446 - DNA, 25 bp, Mus musculus
ctaatttgtggccgtctgctgacct

SEQ ID NO: 264447 - DNA, 25 bp, Mus musculus
ctaatttgtgtttacagacctgcag

SEQ ID NO: 264448 - DNA, 25 bp, Mus musculus
ctaattttgtgctcgattacgctcg

SEQ ID NO: 264449 - DNA, 25 bp, Mus musculus
ctaatttttcaggtgccgacttatt

SEQ ID NO: 264450 - DNA, 25 bp, Mus musculus
ctacaaaaaagtctgttgcaagaat

SEQ ID NO: 264451 - DNA, 25 bp, Mus musculus
ctacaaaaagattgaagacctgatt

SEQ ID NO: 264452 - DNA, 25 bp, Mus musculus
ctacaaaaccagaagaagctcgagt

SEQ ID NO: 264453 - DNA, 25 bp, Mus musculus
ctacaaaagcagaatgattgaagat

SEQ ID NO: 264454 - DNA, 25 bp, Mus musculus
ctacaaaaggtgcaccaatgggcag

SEQ ID NO: 264455 - DNA, 25 bp, Mus musculus
ctacaaacagcatgatgcagctgcc

SEQ ID NO: 264456 - DNA, 25 bp, Mus musculus
ctacaaacagcatggaactgacccg

SEQ ID NO: 264457 - DNA, 25 bp, Mus musculus
ctacaaacctggtctgaagcagcag

SEQ ID NO: 264458 - DNA, 25 bp, Mus musculus
ctacaaacctgtcgacttaaaacac

SEQ ID NO: 264459 - DNA, 25 bp, Mus musculus
ctacaaactgactggttctgcagca

SEQ ID NO: 264460 - DNA, 25 bp, Mus musculus
ctacaaagacaggagcgaatccgta

SEQ ID NO: 264461 - DNA, 25 bp, Mus musculus
ctacaaagacaggtgtaacgtggag

SEQ ID NO: 264462 - DNA, 25 bp, Mus musculus
ctacaaagacagttcagggcgacag

SEQ ID NO: 264463 - DNA, 25 bp, Mus musculus
ctacaaagagaaaaaactggccacg

SEQ ID NO: 264464 - DNA, 25 bp, Mus musculus
ctacaaagaggcctttgccagtgag

SEQ ID NO: 264465 - DNA, 25 bp, Mus musculus
ctacaaagaggtcttctgggagaat

SEQ ID NO: 264466 - DNA, 25 bp, Mus musculus
ctacaaagtcagatactccatatca

SEQ ID NO: 264467 - DNA, 25 bp, Mus musculus
ctacaaagtgaagtgctcaggagct

SEQ ID NO: 264468 - DNA, 25 bp, Mus musculus
ctacaaattgagcaggccgcttgga

SEQ ID NO: 264469 - DNA, 25 bp, Mus musculus
ctacaacaaaactacagacagtcga

SEQ ID NO: 264470 - DNA, 25 bp, Mus musculus
ctacaacaacgagcatcgaggagtt

SEQ ID NO: 264471 - DNA, 25 bp, Mus musculus
ctacaacaagaacattctcaagatc

SEQ ID NO: 264472 - DNA, 25 bp, Mus musculus
ctacaacaagaaggtagaggcagtc

SEQ ID NO: 264473 - DNA, 25 bp, Mus musculus
ctacaacaccaaaaggccgaggggc

SEQ ID NO: 264474 - DNA, 25 bp, Mus musculus
ctacaacaccaagagaggtattgtg

SEQ ID NO: 264475 - DNA, 25 bp, Mus musculus
ctacaacaccaagagcttactggcg

SEQ ID NO: 264476 - DNA, 25 bp, Mus musculus
ctacaacagcgtttatggggcccag

SEQ ID NO: 264477 - DNA, 25 bp, Mus musculus
ctacaacaggccattctttgcccca

SEQ ID NO: 264478 - DNA, 25 bp, Mus musculus
ctacaacagggcatccgtccctgcc

SEQ ID NO: 264479 - DNA, 25 bp, Mus musculus
ctacaacaggggcagtcccaggacg

SEQ ID NO: 264480 - DNA, 25 bp, Mus musculus
ctacaacaggggcagtgtttgccaa

SEQ ID NO: 264481 - DNA, 25 bp, Mus musculus
ctacaacatggagcatatccgtgtg

SEQ ID NO: 264482 - DNA, 25 bp, Mus musculus
ctacaaccaagaaggtttgatgagc

SEQ ID NO: 264483 - DNA, 25 bp, Mus musculus
ctacaaccaaggagaatagcaaaaa

SEQ ID NO: 264484 - DNA, 25 bp, Mus musculus
ctacaaccaagggtacttcgagaat

SEQ ID NO: 264485 - DNA, 25 bp, Mus musculus
ctacaaccactcagggcttcacacc

SEQ ID NO: 264486 - DNA, 25 bp, Mus musculus
ctacaaccatggaaggctcacccac

SEQ ID NO: 264487 - DNA, 25 bp, Mus musculus
ctacaacccacccaggaacaattgt

SEQ ID NO: 264488 - DNA, 25 bp, Mus musculus
ctacaacttcaggaaaagctcctcc

SEQ ID NO: 264489 - DNA, 25 bp, Mus musculus
ctacaagaagagatacgaggaggaa

SEQ ID NO: 264490 - DNA, 25 bp, Mus musculus
ctacaagaatgaggaaggcacttgg

SEQ ID NO: 264491 - DNA, 25 bp, Mus musculus
ctacaagaatgcggaaggcacttgg

SEQ ID NO: 264492 - DNA, 25 bp, Mus musculus
ctacaagacgcagctcggtgaggac

SEQ ID NO: 264493 - DNA, 25 bp, Mus musculus
ctacaagatgaggatgataatgatg

SEQ ID NO: 264494 - DNA, 25 bp, Mus musculus
ctacaagatgcagtatggtggggct

SEQ ID NO: 264495 - DNA, 25 bp, Mus musculus
ctacaagatgtgaagtgggagctgg

SEQ ID NO: 264496 - DNA, 25 bp, Mus musculus
ctacaagcaagacccaagagttaca

SEQ ID NO: 264497 - DNA, 25 bp, Mus musculus
ctacaagcaaggagttacaccctgg

SEQ ID NO: 264498 - DNA, 25 bp, Mus musculus
ctacaagcacaactcctaatagtac

SEQ ID NO: 264499 - DNA, 25 bp, Mus musculus
ctacaagcagtgccggctacagtgg

SEQ ID NO: 264500 - DNA, 25 bp, Mus musculus
ctacaagccaggagccatgcgaggc

SEQ ID NO: 264501 - DNA, 25 bp, Mus musculus
ctacaagctccttaagaaggcagat

SEQ ID NO: 264502 - DNA, 25 bp, Mus musculus
ctacaaggacccccagagttgatgg

SEQ ID NO: 264503 - DNA, 25 bp, Mus musculus
ctacaaggagaacgtggacttatgg

SEQ ID NO: 264504 - DNA, 25 bp, Mus musculus
ctacaaggagaacgttgacatttgg

SEQ ID NO: 264505 - DNA, 25 bp, Mus musculus
ctacaaggaggatctcagtaagagc

SEQ ID NO: 264506 - DNA, 25 bp, Mus musculus
ctacaaggatctgatttaaattagc

SEQ ID NO: 264507 - DNA, 25 bp, Mus musculus
ctacaagggacaggtgctgaagcat

SEQ ID NO: 264508 - DNA, 25 bp, Mus musculus
ctacaagggaccaagcattcacagc

SEQ ID NO: 264509 - DNA, 25 bp, Mus musculus
ctacaagtggccatggatcggttct

SEQ ID NO: 264510 - DNA, 25 bp, Mus musculus
ctacaagtgggcccgtgatttgatg

SEQ ID NO: 264511 - DNA, 25 bp, Mus musculus
ctacaagtgttgatacccataatat

SEQ ID NO: 264512 - DNA, 25 bp, Mus musculus
ctacaagtgttgttcccatggtgca

SEQ ID NO: 264513 - DNA, 25 bp, Mus musculus
ctacaagttctacaggcctgagaat

SEQ ID NO: 264514 - DNA, 25 bp, Mus musculus
ctacaagttctacaggctgccacag

SEQ ID NO: 264515 - DNA, 25 bp, Mus musculus
ctacaagttggtcagtgaaatggtg

SEQ ID NO: 264516 - DNA, 25 bp, Mus musculus
ctacaagttgtcagggctccagtgg

SEQ ID NO: 264517 - DNA, 25 bp, Mus musculus
ctacaatatctcggacgtgagggtc

SEQ ID NO: 264518 - DNA, 25 bp, Mus musculus
ctacaatatctcggagcggtttcct

SEQ ID NO: 264519 - DNA, 25 bp, Mus musculus
ctacaatccagaggagtctctgttt

SEQ ID NO: 264520 - DNA, 25 bp, Mus musculus
ctacaatctgaatgaagaaagacac

SEQ ID NO: 264521 - DNA, 25 bp, Mus musculus
ctacaatgcaacgtggccctgaatt

SEQ ID NO: 264522 - DNA, 25 bp, Mus musculus
ctacaatgcctacagctcttaacct

SEQ ID NO: 264523 - DNA, 25 bp, Mus musculus
ctacaatgcctacaggttcttcttc

SEQ ID NO: 264524 - DNA, 25 bp, Mus musculus
ctacaatttccccgccgactggcca

SEQ ID NO: 264525 - DNA, 25 bp, Mus musculus
ctacacaaaaagctgttcagcagac

SEQ ID NO: 264526 - DNA, 25 bp, Mus musculus
ctacacaaaaggtggttgttggaga

SEQ ID NO: 264527 - DNA, 25 bp, Mus musculus
ctacacaaatggctacacggatgca

SEQ ID NO: 264528 - DNA, 25 bp, Mus musculus
ctacacaagcacagcacggccctgc

SEQ ID NO: 264529 - DNA, 25 bp, Mus musculus
ctacacaatggagcatatccgtgtg

SEQ ID NO: 264530 - DNA, 25 bp, Mus musculus
ctacacaatttgggagtgagctact

SEQ ID NO: 264531 - DNA, 25 bp, Mus musculus
ctacacaccccccggtcacccgctg

SEQ ID NO: 264532 - DNA, 25 bp, Mus musculus
ctacacaccccctacctatggagtt

SEQ ID NO: 264533 - DNA, 25 bp, Mus musculus
ctacacactgtgggcatcctctaca

SEQ ID NO: 264534 - DNA, 25 bp, Mus musculus
ctacacactgtgggccatccacgaa

SEQ ID NO: 264535 - DNA, 25 bp, Mus musculus
ctacacactgtggggtgcccaatta

SEQ ID NO: 264536 - DNA, 25 bp, Mus musculus
ctacacagaaccagagcatgaccat

SEQ ID NO: 264537 - DNA, 25 bp, Mus musculus
ctacacagccatggggaaccagcct

SEQ ID NO: 264538 - DNA, 25 bp, Mus musculus
ctacacatacacagggagcatgact

SEQ ID NO: 264539 - DNA, 25 bp, Mus musculus
ctacacatccttgctgaggatcaaa

SEQ ID NO: 264540 - DNA, 25 bp, Mus musculus
ctacacatcctttaaaaagtatgga

SEQ ID NO: 264541 - DNA, 25 bp, Mus musculus
ctacacatgcaactgtgttattggc

SEQ ID NO: 264542 - DNA, 25 bp, Mus musculus
ctacaccaaacagagttattggaag

SEQ ID NO: 264543 - DNA, 25 bp, Mus musculus
ctacaccaaacaggaaggtaccagg

SEQ ID NO: 264544 - DNA, 25 bp, Mus musculus
ctacaccaaacaggcaccatcacag

SEQ ID NO: 264545 - DNA, 25 bp, Mus musculus
ctacaccaatggctggaaattaaat

SEQ ID NO: 264546 - DNA, 25 bp, Mus musculus
ctacaccacaaggggaggcaaaatt

SEQ ID NO: 264547 - DNA, 25 bp, Mus musculus
ctacaccacagattatcagctgtat

SEQ ID NO: 264548 - DNA, 25 bp, Mus musculus
ctacaccacgactggtggaaaaatt

SEQ ID NO: 264549 - DNA, 25 bp, Mus musculus
ctacaccactacatggaaaaaagat

SEQ ID NO: 264550 - DNA, 25 bp, Mus musculus
ctacaccatccccccgcaggctggc

SEQ ID NO: 264551 - DNA, 25 bp, Mus musculus
ctacaccatgccagtcttcccacca

SEQ ID NO: 264552 - DNA, 25 bp, Mus musculus
ctacaccatgcttctgtggacgcag

SEQ ID NO: 264553 - DNA, 25 bp, Mus musculus
ctacacccaagaatgtggcaatctg

SEQ ID NO: 264554 - DNA, 25 bp, Mus musculus
ctacacccaagcgagcctgtcagcg

SEQ ID NO: 264555 - DNA, 25 bp, Mus musculus
ctacacccacagttccagggtccct

SEQ ID NO: 264556 - DNA, 25 bp, Mus musculus
ctacacccaggtgattcgagtcatc

SEQ ID NO: 264557 - DNA, 25 bp, Mus musculus
ctacacccatgagcacttgctggct

SEQ ID NO: 264558 - DNA, 25 bp, Mus musculus
ctacacccccatgtatggctgtaag

SEQ ID NO: 264559 - DNA, 25 bp, Mus musculus
ctacacccgggtcaatgcaggggga

SEQ ID NO: 264560 - DNA, 25 bp, Mus musculus
ctacaccctgacaactggagtggat

SEQ ID NO: 264561 - DNA, 25 bp, Mus musculus
ctacaccctggtggtgtctgtgagt

SEQ ID NO: 264562 - DNA, 25 bp, Mus musculus
ctacaccctgtccccagaattccaa

SEQ ID NO: 264563 - DNA, 25 bp, Mus musculus
ctacaccgttttcagatagcggcca

SEQ ID NO: 264564 - DNA, 25 bp, Mus musculus
ctacaccgttttcaggctttctggc

SEQ ID NO: 264565 - DNA, 25 bp, Mus musculus
ctacaccgttttcagttatttgcca

SEQ ID NO: 264566 - DNA, 25 bp, Mus musculus
ctacacctcggagacctacctgatg

SEQ ID NO: 264567 - DNA, 25 bp, Mus musculus
ctacacctgcaaggaatattgaaga

SEQ ID NO: 264568 - DNA, 25 bp, Mus musculus
ctacacctgccggtcagggatcccc

SEQ ID NO: 264569 - DNA, 25 bp, Mus musculus
ctacacctgccggtccaaccgtgac

SEQ ID NO: 264570 - DNA, 25 bp, Mus musculus
ctacaccttagccagtccaaactga

SEQ ID NO: 264571 - DNA, 25 bp, Mus musculus
ctacacgagatgatggattatctat

SEQ ID NO: 264572 - DNA, 25 bp, Mus musculus
ctacacgcagacagtggacatttgg

SEQ ID NO: 264573 - DNA, 25 bp, Mus musculus
ctacacgcatgctgtggatacccta

SEQ ID NO: 264574 - DNA, 25 bp, Mus musculus
ctacacgcatggagtcgccctagtt

SEQ ID NO: 264575 - DNA, 25 bp, Mus musculus
ctacacgtacgtgaaggaattccgc

SEQ ID NO: 264576 - DNA, 25 bp, Mus musculus
ctacacgtcaaagaagtcttctaaa

SEQ ID NO: 264577 - DNA, 25 bp, Mus musculus
ctacacgtcaaagacctaactaccg

SEQ ID NO: 264578 - DNA, 25 bp, Mus musculus
ctacactactgactccatgcctgca

SEQ ID NO: 264579 - DNA, 25 bp, Mus musculus
ctacactctagatggagtggatgga

SEQ ID NO: 264580 - DNA, 25 bp, Mus musculus
ctacactgcactgggtgggctgaag

SEQ ID NO: 264581 - DNA, 25 bp, Mus musculus
ctacactgccaaccagaactgcgta

SEQ ID NO: 264582 - DNA, 25 bp, Mus musculus
ctacactgttgttggccgccccatc

SEQ ID NO: 264583 - DNA, 25 bp, Mus musculus
ctacacttacaagagcctcaggaca

SEQ ID NO: 264584 - DNA, 25 bp, Mus musculus
ctacacttacaagagggggaaggac

SEQ ID NO: 264585 - DNA, 25 bp, Mus musculus
ctacacttcagatttccaaaaggcc

SEQ ID NO: 264586 - DNA, 25 bp, Mus musculus
ctacacttcccaaaaagaagattat

SEQ ID NO: 264587 - DNA, 25 bp, Mus musculus
ctacacttctcaggttcctgtccca

SEQ ID NO: 264588 - DNA, 25 bp, Mus musculus
ctacacttctggagaccacatgtgt

SEQ ID NO: 264589 - DNA, 25 bp, Mus musculus
ctacacttctggaggaaaatatgtc

SEQ ID NO: 264590 - DNA, 25 bp, Mus musculus
ctacacttgcaaggccataccttct

SEQ ID NO: 264591 - DNA, 25 bp, Mus musculus
ctacacttttcatgcagatcctgtg

SEQ ID NO: 264592 - DNA, 25 bp, Mus musculus
ctacagaaacccatgtgagcatgcc

SEQ ID NO: 264593 - DNA, 25 bp, Mus musculus
ctacagaaagccttgagggtgtttc

SEQ ID NO: 264594 - DNA, 25 bp, Mus musculus
ctacagaacaggtgggcactctggt

SEQ ID NO: 264595 - DNA, 25 bp, Mus musculus
ctacagaacagtctatacaaccata

SEQ ID NO: 264596 - DNA, 25 bp, Mus musculus
ctacagaacctgacaggtatgtcat

SEQ ID NO: 264597 - DNA, 25 bp, Mus musculus
ctacagaactcaggtttaacagaag

SEQ ID NO: 264598 - DNA, 25 bp, Mus musculus
ctacagaagagggtgattaaagttt

SEQ ID NO: 264599 - DNA, 25 bp, Mus musculus
ctacagaagtccctaaatcaaaaag

SEQ ID NO: 264600 - DNA, 25 bp, Mus musculus
ctacagaagtccctactccggacca

SEQ ID NO: 264601 - DNA, 25 bp, Mus musculus
ctacagaataagcttagatatgcca

SEQ ID NO: 264602 - DNA, 25 bp, Mus musculus
ctacagagaatccccggcagcccaa

SEQ ID NO: 264603 - DNA, 25 bp, Mus musculus
ctacagagagcagattctgcccttt

SEQ ID NO: 264604 - DNA, 25 bp, Mus musculus
ctacagagaggaagaaacttcaccc

SEQ ID NO: 264605 - DNA, 25 bp, Mus musculus
ctacagagaggaagatgtttgagac

SEQ ID NO: 264606 - DNA, 25 bp, Mus musculus
ctacagagaggaggcttctcagaca

SEQ ID NO: 264607 - DNA, 25 bp, Mus musculus
ctacagagcagaaaaggaaggccga

SEQ ID NO: 264608 - DNA, 25 bp, Mus musculus
ctacagagccctgggcccttcctgt

SEQ ID NO: 264609 - DNA, 25 bp, Mus musculus
ctacagaggacaggctcacaactca

SEQ ID NO: 264610 - DNA, 25 bp, Mus musculus
ctacagaggtgggcttactgtaagt

SEQ ID NO: 264611 - DNA, 25 bp, Mus musculus
ctacagaggtgtccaacaggccatc

SEQ ID NO: 264612 - DNA, 25 bp, Mus musculus
ctacagagtctcagcctactgaggc

SEQ ID NO: 264613 - DNA, 25 bp, Mus musculus
ctacagagtctcaggtggtccacaa

SEQ ID NO: 264614 - DNA, 25 bp, Mus musculus
ctacagagtggccaccctttgtggt

SEQ ID NO: 264615 - DNA, 25 bp, Mus musculus
ctacagataacccccggcagcccaa

SEQ ID NO: 264616 - DNA, 25 bp, Mus musculus
ctacagattgctaaaagtactatta

SEQ ID NO: 264617 - DNA, 25 bp, Mus musculus
ctacagattgctaaagaccagagta

SEQ ID NO: 264618 - DNA, 25 bp, Mus musculus
ctacagattgctaaagcagtgggaa

SEQ ID NO: 264619 - DNA, 25 bp, Mus musculus
ctacagcaaaccaggactagacaag

SEQ ID NO: 264620 - DNA, 25 bp, Mus musculus
ctacagcaaacctggactagacaag

SEQ ID NO: 264621 - DNA, 25 bp, Mus musculus
ctacagcaacgaccctgaggacggg

SEQ ID NO: 264622 - DNA, 25 bp, Mus musculus
ctacagcaagttcgatccttcatga

SEQ ID NO: 264623 - DNA, 25 bp, Mus musculus
ctacagcaatgggatacggacagaa

SEQ ID NO: 264624 - DNA, 25 bp, Mus musculus
ctacagcaccctttcacaccggaac

SEQ ID NO: 264625 - DNA, 25 bp, Mus musculus
ctacagcagaggaataaatgaagaa

SEQ ID NO: 264626 - DNA, 25 bp, Mus musculus
ctacagcagcggcgagagatgctca

SEQ ID NO: 264627 - DNA, 25 bp, Mus musculus
ctacagcaggaagggtgagtttttc

SEQ ID NO: 264628 - DNA, 25 bp, Mus musculus
ctacagcatagccctcagggattca

SEQ ID NO: 264629 - DNA, 25 bp, Mus musculus
ctacagcatagggaagcagctgccc

SEQ ID NO: 264630 - DNA, 25 bp, Mus musculus
ctacagccagggctgatgaacaggt

SEQ ID NO: 264631 - DNA, 25 bp, Mus musculus
ctacagccaggtctgtgctgccgcc

SEQ ID NO: 264632 - DNA, 25 bp, Mus musculus
ctacagccatcgggtgggaaaatgg

SEQ ID NO: 264633 - DNA, 25 bp, Mus musculus
ctacagccatgatgattgtgggttc

SEQ ID NO: 264634 - DNA, 25 bp, Mus musculus
ctacagccatgggcttctgcttctt

SEQ ID NO: 264635 - DNA, 25 bp, Mus musculus
ctacagcccagggtctggtgagaag

SEQ ID NO: 264636 - DNA, 25 bp, Mus musculus
ctacagcccaggtttggtcatctcc

SEQ ID NO: 264637 - DNA, 25 bp, Mus musculus
ctacagccctgatcacaagtgctct

SEQ ID NO: 264638 - DNA, 25 bp, Mus musculus
ctacagcctagaacaggcagcagaa

SEQ ID NO: 264639 - DNA, 25 bp, Mus musculus
ctacagcctcagatgaaatcatgca

SEQ ID NO: 264640 - DNA, 25 bp, Mus musculus
ctacagcctgggctgcgccttcccc

SEQ ID NO: 264641 - DNA, 25 bp, Mus musculus
ctacagcgaagccgaagtcttactc

SEQ ID NO: 264642 - DNA, 25 bp, Mus musculus
ctacagcgaagccggagactatctg

SEQ ID NO: 264643 - DNA, 25 bp, Mus musculus
ctacagcgacagagagcacctaaag

SEQ ID NO: 264644 - DNA, 25 bp, Mus musculus
ctacagcgagagtctatataaactg

SEQ ID NO: 264645 - DNA, 25 bp, Mus musculus
ctacagctacctagcatgtccaaaa

SEQ ID NO: 264646 - DNA, 25 bp, Mus musculus
ctacagctcagatgtttttacccca

SEQ ID NO: 264647 - DNA, 25 bp, Mus musculus
ctacagctgctggaaattagagcgc

SEQ ID NO: 264648 - DNA, 25 bp, Mus musculus
ctacagctgctggctgagggtggga

SEQ ID NO: 264649 - DNA, 25 bp, Mus musculus
ctacagcttggggaagggaacataa

SEQ ID NO: 264650 - DNA, 25 bp, Mus musculus
ctacaggaaaacaggtttcaagtgc

SEQ ID NO: 264651 - DNA, 25 bp, Mus musculus
ctacaggaacagcgctcatccactg

SEQ ID NO: 264652 - DNA, 25 bp, Mus musculus
ctacaggaacagcggaaaatacaga

SEQ ID NO: 264653 - DNA, 25 bp, Mus musculus
ctacaggaacccgtcattgcctttc

SEQ ID NO: 264654 - DNA, 25 bp, Mus musculus
ctacaggaatacagagaccgtctcg

SEQ ID NO: 264655 - DNA, 25 bp, Mus musculus
ctacaggaatacaggattttggttc

SEQ ID NO: 264656 - DNA, 25 bp, Mus musculus
ctacaggaatggagagtggcaagcg

SEQ ID NO: 264657 - DNA, 25 bp, Mus musculus
ctacaggacaagaatgccctggact

SEQ ID NO: 264658 - DNA, 25 bp, Mus musculus
ctacaggacaagctaagcattgagg

SEQ ID NO: 264659 - DNA, 25 bp, Mus musculus
ctacaggagaagtggtgcatggatg

SEQ ID NO: 264660 - DNA, 25 bp, Mus musculus
ctacaggagaagtggtggcctgctt

SEQ ID NO: 264661 - DNA, 25 bp, Mus musculus
ctacaggagacagagggcatggtgg

SEQ ID NO: 264662 - DNA, 25 bp, Mus musculus
ctacaggattgagacaccggtacca

SEQ ID NO: 264663 - DNA, 25 bp, Mus musculus
ctacaggcaacgggggtctctttag

SEQ ID NO: 264664 - DNA, 25 bp, Mus musculus
ctacaggcagcagctccggtctgat

SEQ ID NO: 264665 - DNA, 25 bp, Mus musculus
ctacaggccaactgccaatttgtgg

SEQ ID NO: 264666 - DNA, 25 bp, Mus musculus
ctacaggctccagtctttcacccct

SEQ ID NO: 264667 - DNA, 25 bp, Mus musculus
ctacaggctttttcttacttctcgc

SEQ ID NO: 264668 - DNA, 25 bp, Mus musculus
ctacagggaacccaagcaccccttg

SEQ ID NO: 264669 - DNA, 25 bp, Mus musculus
ctacagggatgagactttgaagaga

SEQ ID NO: 264670 - DNA, 25 bp, Mus musculus
ctacagggatgagctagttaaaggc

SEQ ID NO: 264671 - DNA, 25 bp, Mus musculus
ctacagggggccaggtgagttggag

SEQ ID NO: 264672 - DNA, 25 bp, Mus musculus
ctacaggtgatcacgctcaccatca

SEQ ID NO: 264673 - DNA, 25 bp, Mus musculus
ctacaggtgtctagtggtaaagcgg

SEQ ID NO: 264674 - DNA, 25 bp, Mus musculus
ctacagtaagaaggtggaggagcct

SEQ ID NO: 264675 - DNA, 25 bp, Mus musculus
ctacagtaagaaggtggagtacctc

SEQ ID NO: 264676 - DNA, 25 bp, Mus musculus
ctacagtacagctaggtagaagccc

SEQ ID NO: 264677 - DNA, 25 bp, Mus musculus
ctacagtatgagggagtggggccgg

SEQ ID NO: 264678 - DNA, 25 bp, Mus musculus
ctacagtattcagaggaaatataag

SEQ ID NO: 264679 - DNA, 25 bp, Mus musculus
ctacagtattcagttacggtctttg

SEQ ID NO: 264680 - DNA, 25 bp, Mus musculus
ctacagtattcatgagaacctgcag

SEQ ID NO: 264681 - DNA, 25 bp, Mus musculus
ctacagtcagcacaaactacagctg

SEQ ID NO: 264682 - DNA, 25 bp, Mus musculus
ctacagtcagcacaactcctccagt

SEQ ID NO: 264683 - DNA, 25 bp, Mus musculus
ctacagtcatacagtccagacaaga

SEQ ID NO: 264684 - DNA, 25 bp, Mus musculus
ctacagtcccagcagagtgatggtt

SEQ ID NO: 264685 - DNA, 25 bp, Mus musculus
ctacagtcccagcaggacatggatt

SEQ ID NO: 264686 - DNA, 25 bp, Mus musculus
ctacagtctgaatgaagaaagacac

SEQ ID NO: 264687 - DNA, 25 bp, Mus musculus
ctacagtgaagatcgttaccagaaa

SEQ ID NO: 264688 - DNA, 25 bp, Mus musculus
ctacagtgacagaaatcagttcgtc

SEQ ID NO: 264689 - DNA, 25 bp, Mus musculus
ctacagtgacagttacggacgagtt

SEQ ID NO: 264690 - DNA, 25 bp, Mus musculus
ctacagtgatcaggttcagcgtcct

SEQ ID NO: 264691 - DNA, 25 bp, Mus musculus
ctacagtgcgcgcgatgaggctgta

SEQ ID NO: 264692 - DNA, 25 bp, Mus musculus
ctacagttaccaggaccgctccttt

SEQ ID NO: 264693 - DNA, 25 bp, Mus musculus
ctacagttaccaggggcacgaccag

SEQ ID NO: 264694 - DNA, 25 bp, Mus musculus
ctacagttgcaggcatcccacaaag

SEQ ID NO: 264695 - DNA, 25 bp, Mus musculus
ctacataagcgaagctctggggtct

SEQ ID NO: 264696 - DNA, 25 bp, Mus musculus
ctacatagaagttgaccagatatat

SEQ ID NO: 264697 - DNA, 25 bp, Mus musculus
ctacatataattcatattacaggcc

SEQ ID NO: 264698 - DNA, 25 bp, Mus musculus
ctacatatcaactcaacaaggacat

SEQ ID NO: 264699 - DNA, 25 bp, Mus musculus
ctacatatttgcaggtgtcctccac

SEQ ID NO: 264700 - DNA, 25 bp, Mus musculus
ctacatcaaaagaggcttccagttt

SEQ ID NO: 264701 - DNA, 25 bp, Mus musculus
ctacatcaaaaggtacttcgagttt

SEQ ID NO: 264702 - DNA, 25 bp, Mus musculus
ctacatcatgtttggacctgatatt

SEQ ID NO: 264703 - DNA, 25 bp, Mus musculus
ctacatcctggtgtttgtggtagcc

SEQ ID NO: 264704 - DNA, 25 bp, Mus musculus
ctacatcgacatttggctgtacagg

SEQ ID NO: 264705 - DNA, 25 bp, Mus musculus
ctacatcgacggctaccagagacca

SEQ ID NO: 264706 - DNA, 25 bp, Mus musculus
ctacatcgactccctgggctgtgat

SEQ ID NO: 264707 - DNA, 25 bp, Mus musculus
ctacatcgctgggactaatggcaat

SEQ ID NO: 264708 - DNA, 25 bp, Mus musculus
ctacatcggaggaaatgaggccagg

SEQ ID NO: 264709 - DNA, 25 bp, Mus musculus
ctacatcgtggtggacagtgaactt

SEQ ID NO: 264710 - DNA, 25 bp, Mus musculus
ctacatcgtggtgtatgttgtatgg

SEQ ID NO: 264711 - DNA, 25 bp, Mus musculus
ctacatctcaggccagggctttgac

SEQ ID NO: 264712 - DNA, 25 bp, Mus musculus
ctacatctcaggcccctggtttgat

SEQ ID NO: 264713 - DNA, 25 bp, Mus musculus
ctacatctgataaggaaggaaagga

SEQ ID NO: 264714 - DNA, 25 bp, Mus musculus
ctacatctttggtattgttgggtgt

SEQ ID NO: 264715 - DNA, 25 bp, Mus musculus
ctacatgaagtattacaatgactat

SEQ ID NO: 264716 - DNA, 25 bp, Mus musculus
ctacatgctaccagaagccagatga

SEQ ID NO: 264717 - DNA, 25 bp, Mus musculus
ctacatgctaccagcatttgatgac

SEQ ID NO: 264718 - DNA, 25 bp, Mus musculus
ctacatgctcaggtgcgctggtacc

SEQ ID NO: 264719 - DNA, 25 bp, Mus musculus
ctacatgctgcagctgctgttgatg

SEQ ID NO: 264720 - DNA, 25 bp, Mus musculus
ctacatgctgcagttggtgcttccc

SEQ ID NO: 264721 - DNA, 25 bp, Mus musculus
ctacatggagcagttaacgcggggg

SEQ ID NO: 264722 - DNA, 25 bp, Mus musculus
ctacatggccatccacaaggaggcc

SEQ ID NO: 264723 - DNA, 25 bp, Mus musculus
ctacatggctcctgctgactgggtt

SEQ ID NO: 264724 - DNA, 25 bp, Mus musculus
ctacatgtaaaggtcaagtagcatc

SEQ ID NO: 264725 - DNA, 25 bp, Mus musculus
ctacattaaagtgacatatgacatc

SEQ ID NO: 264726 - DNA, 25 bp, Mus musculus
ctacattaaagtgcccagccacagc

SEQ ID NO: 264727 - DNA, 25 bp, Mus musculus
ctacattaaagttctttcagattac

SEQ ID NO: 264728 - DNA, 25 bp, Mus musculus
ctacattaacgtggttcattatgat

SEQ ID NO: 264729 - DNA, 25 bp, Mus musculus
ctacattaatgattccattggctta

SEQ ID NO: 264730 - DNA, 25 bp, Mus musculus
ctacattaatgccaccctgcaggca

SEQ ID NO: 264731 - DNA, 25 bp, Mus musculus
ctacattaatgctaccgtcttgatt

SEQ ID NO: 264732 - DNA, 25 bp, Mus musculus
ctacattaggcaaatcaacaatgtc

SEQ ID NO: 264733 - DNA, 25 bp, Mus musculus
ctacattatatatgcaagttctgct

SEQ ID NO: 264734 - DNA, 25 bp, Mus musculus
ctacattatatctacatcaaatggg

SEQ ID NO: 264735 - DNA, 25 bp, Mus musculus
ctacattccagaggtgatggtggcc

SEQ ID NO: 264736 - DNA, 25 bp, Mus musculus
ctacattccagcagaccgacttgtc

SEQ ID NO: 264737 - DNA, 25 bp, Mus musculus
ctacattcctcagggaactgaaacc

SEQ ID NO: 264738 - DNA, 25 bp, Mus musculus
ctacattgagagtcaggtacagtgc

SEQ ID NO: 264739 - DNA, 25 bp, Mus musculus
ctacattgagagtcatcctttttca

SEQ ID NO: 264740 - DNA, 25 bp, Mus musculus
ctacattgaggggtacgtgccatca

SEQ ID NO: 264741 - DNA, 25 bp, Mus musculus
ctacattgaggggtctgtgcacttg

SEQ ID NO: 264742 - DNA, 25 bp, Mus musculus
ctacattgcaaagattctgaaaggc

SEQ ID NO: 264743 - DNA, 25 bp, Mus musculus
ctacattggctggggctccaacggc

SEQ ID NO: 264744 - DNA, 25 bp, Mus musculus
ctacattggctggtgtcccttctgg

SEQ ID NO: 264745 - DNA, 25 bp, Mus musculus
ctacattgtcttgctgagtatcctg

SEQ ID NO: 264746 - DNA, 25 bp, Mus musculus
ctacatttcaaaggtaccaaagcag

SEQ ID NO: 264747 - DNA, 25 bp, Mus musculus
ctacatttcaaaggttagcgatgca

SEQ ID NO: 264748 - DNA, 25 bp, Mus musculus
ctacatttcagacatcccgcttacg

SEQ ID NO: 264749 - DNA, 25 bp, Mus musculus
ctacatttcagatcctcctaccacc

SEQ ID NO: 264750 - DNA, 25 bp, Mus musculus
ctaccaaaacaaccctggcctatgg

SEQ ID NO: 264751 - DNA, 25 bp, Mus musculus
ctaccaaaacgaaaatgcaaaatta

SEQ ID NO: 264752 - DNA, 25 bp, Mus musculus
ctaccaaaatctcagaactcaagtg

SEQ ID NO: 264753 - DNA, 25 bp, Mus musculus
ctaccaaaatctcaggctggcctgt

SEQ ID NO: 264754 - DNA, 25 bp, Mus musculus
ctaccaaagtcttgtgatttgaact

SEQ ID NO: 264755 - DNA, 25 bp, Mus musculus
ctaccaaatactatctgaatgactt

SEQ ID NO: 264756 - DNA, 25 bp, Mus musculus
ctaccaaatattgcatttagccatc

SEQ ID NO: 264757 - DNA, 25 bp, Mus musculus
ctaccaacaagtatgaggtagacga

SEQ ID NO: 264758 - DNA, 25 bp, Mus musculus
ctaccaacggtaagacaataaaatt

SEQ ID NO: 264759 - DNA, 25 bp, Mus musculus
ctaccaacttcttaactgacaggcc

SEQ ID NO: 264760 - DNA, 25 bp, Mus musculus
ctaccaagaaaaagacgctgggctg

SEQ ID NO: 264761 - DNA, 25 bp, Mus musculus
ctaccaagaaaaagacttcaaggag

SEQ ID NO: 264762 - DNA, 25 bp, Mus musculus
ctaccaagagaaccggcatggagag

SEQ ID NO: 264763 - DNA, 25 bp, Mus musculus
ctaccacaaccagctgctgaaccga

SEQ ID NO: 264764 - DNA, 25 bp, Mus musculus
ctaccacaagaaggttgtggatcat

SEQ ID NO: 264765 - DNA, 25 bp, Mus musculus
ctaccacaagatgctggtggttggt

SEQ ID NO: 264766 - DNA, 25 bp, Mus musculus
ctaccacaaggggacatgaagcagc

SEQ ID NO: 264767 - DNA, 25 bp, Mus musculus
ctaccacacaaggtttgacggatga

SEQ ID NO: 264768 - DNA, 25 bp, Mus musculus
ctaccacagggtctgtaccaaaacc

SEQ ID NO: 264769 - DNA, 25 bp, Mus musculus
ctaccacatccactggtggagctgc

SEQ ID NO: 264770 - DNA, 25 bp, Mus musculus
ctaccaccaaactggctgataggac

SEQ ID NO: 264771 - DNA, 25 bp, Mus musculus
ctaccaccaacgagagccatccttc

SEQ ID NO: 264772 - DNA, 25 bp, Mus musculus
ctaccaccaccaccacggcgacgac

SEQ ID NO: 264773 - DNA, 25 bp, Mus musculus
ctaccacccaggaactaaggcaaga

SEQ ID NO: 264774 - DNA, 25 bp, Mus musculus
ctaccacccaggctgacccttccag

SEQ ID NO: 264775 - DNA, 25 bp, Mus musculus
ctaccaccgcgtaggatctttctca

SEQ ID NO: 264776 - DNA, 25 bp, Mus musculus
ctaccacggagtttgtcacagtaac

SEQ ID NO: 264777 - DNA, 25 bp, Mus musculus
ctaccacggctcgccagaggcctcg

SEQ ID NO: 264778 - DNA, 25 bp, Mus musculus
ctaccacggctctacttccccacga

SEQ ID NO: 264779 - DNA, 25 bp, Mus musculus
ctaccacgtcagtcctcgttgccat

SEQ ID NO: 264780 - DNA, 25 bp, Mus musculus
ctaccactacacccagctgccctca

SEQ ID NO: 264781 - DNA, 25 bp, Mus musculus
ctaccactcaggctctcgccttgat

SEQ ID NO: 264782 - DNA, 25 bp, Mus musculus
ctaccactggtgcgaacaaagtctc

SEQ ID NO: 264783 - DNA, 25 bp, Mus musculus
ctaccagaaagccttgtgcctctgc

SEQ ID NO: 264784 - DNA, 25 bp, Mus musculus
ctaccagaaagtttgcttacctggg

SEQ ID NO: 264785 - DNA, 25 bp, Mus musculus
ctaccagaatgttgaccccaacaag

SEQ ID NO: 264786 - DNA, 25 bp, Mus musculus
ctaccagaattatatatgttgggta

SEQ ID NO: 264787 - DNA, 25 bp, Mus musculus
ctaccagaccccaggtatgcgagac

SEQ ID NO: 264788 - DNA, 25 bp, Mus musculus
ctaccagaccccaggttccagtgcc

SEQ ID NO: 264789 - DNA, 25 bp, Mus musculus
ctaccagagcaaccggtgaaaaaag

SEQ ID NO: 264790 - DNA, 25 bp, Mus musculus
ctaccagagcaaccgtcaagtaaac

SEQ ID NO: 264791 - DNA, 25 bp, Mus musculus
ctaccagagcaaccgtttctatggc

SEQ ID NO: 264792 - DNA, 25 bp, Mus musculus
ctaccagaggaagtgggtagaggaa

SEQ ID NO: 264793 - DNA, 25 bp, Mus musculus
ctaccagcaaggttggcccctaggt

SEQ ID NO: 264794 - DNA, 25 bp, Mus musculus
ctaccagcaatgtgtgtccgtcctg

SEQ ID NO: 264795 - DNA, 25 bp, Mus musculus
ctaccagcagaacagcacagccccc

SEQ ID NO: 264796 - DNA, 25 bp, Mus musculus
ctaccagcagacccaatggaactga

SEQ ID NO: 264797 - DNA, 25 bp, Mus musculus
ctaccagcagacttttgatttcaaa

SEQ ID NO: 264798 - DNA, 25 bp, Mus musculus
ctaccagcaggagtcgcctcccgtt

SEQ ID NO: 264799 - DNA, 25 bp, Mus musculus
ctaccagcaggcgttgctgctgctg

SEQ ID NO: 264800 - DNA, 25 bp, Mus musculus
ctaccagcaggcttccccaccagat

SEQ ID NO: 264801 - DNA, 25 bp, Mus musculus
ctaccagccacaggagctcttaggg

SEQ ID NO: 264802 - DNA, 25 bp, Mus musculus
ctaccagcccaggtcaaccattcga

SEQ ID NO: 264803 - DNA, 25 bp, Mus musculus
ctaccagcctgtggaatagtcactg

SEQ ID NO: 264804 - DNA, 25 bp, Mus musculus
ctaccagcctgtgggtccgaagcag

SEQ ID NO: 264805 - DNA, 25 bp, Mus musculus
ctaccagcggagcatgcacgcctac

SEQ ID NO: 264806 - DNA, 25 bp, Mus musculus
ctaccagcggagggtttctctgtgt

SEQ ID NO: 264807 - DNA, 25 bp, Mus musculus
ctaccagcggctctgctctgcttta

SEQ ID NO: 264808 - DNA, 25 bp, Mus musculus
ctaccagctgaagacttgattgcaa

SEQ ID NO: 264809 - DNA, 25 bp, Mus musculus
ctaccagctggcctataggttgcaa

SEQ ID NO: 264810 - DNA, 25 bp, Mus musculus
ctaccagctgggtaacgacattgcc

SEQ ID NO: 264811 - DNA, 25 bp, Mus musculus
ctaccaggaaataatccttgctaac

SEQ ID NO: 264812 - DNA, 25 bp, Mus musculus
ctaccaggaattcagcaccccatga

SEQ ID NO: 264813 - DNA, 25 bp, Mus musculus
ctaccaggaattcaggaaatatttt

SEQ ID NO: 264814 - DNA, 25 bp, Mus musculus
ctaccaggagcctgccaccaccacc

SEQ ID NO: 264815 - DNA, 25 bp, Mus musculus
ctaccaggagtttgttcaggaagtg

SEQ ID NO: 264816 - DNA, 25 bp, Mus musculus
ctaccaggcatgaggggccataaag

SEQ ID NO: 264817 - DNA, 25 bp, Mus musculus
ctaccaggtacagcaatgacatttc

SEQ ID NO: 264818 - DNA, 25 bp, Mus musculus
ctaccaggttcccagtcttctcacc

SEQ ID NO: 264819 - DNA, 25 bp, Mus musculus
ctaccagtattgtacccatgatgca

SEQ ID NO: 264820 - DNA, 25 bp, Mus musculus
ctaccagtgtagcctatgcccatcc

SEQ ID NO: 264821 - DNA, 25 bp, Mus musculus
ctaccagttccccgaattccgtgta

SEQ ID NO: 264822 - DNA, 25 bp, Mus musculus
ctaccagttccccggtatccctctc

SEQ ID NO: 264823 - DNA, 25 bp, Mus musculus
ctaccatacggacatatagattctt

SEQ ID NO: 264824 - DNA, 25 bp, Mus musculus
ctaccatcacagagtcaaatccacg

SEQ ID NO: 264825 - DNA, 25 bp, Mus musculus
ctaccatcaccaaagccccccatca

SEQ ID NO: 264826 - DNA, 25 bp, Mus musculus
ctaccatccccaaggaacctgatgg

SEQ ID NO: 264827 - DNA, 25 bp, Mus musculus
ctaccatcctcagtggtacacttag

SEQ ID NO: 264828 - DNA, 25 bp, Mus musculus
ctaccatctgaagagtctactcgga

SEQ ID NO: 264829 - DNA, 25 bp, Mus musculus
ctaccatggccagggctctgacagc

SEQ ID NO: 264830 - DNA, 25 bp, Mus musculus
ctaccatggccagtgaggtgttcgg

SEQ ID NO: 264831 - DNA, 25 bp, Mus musculus
ctaccatggtgaagggaatgtacgg

SEQ ID NO: 264832 - DNA, 25 bp, Mus musculus
ctaccatgtgaagttccgctcgctg

SEQ ID NO: 264833 - DNA, 25 bp, Mus musculus
ctaccatttatggaagccctgcaga

SEQ ID NO: 264834 - DNA, 25 bp, Mus musculus
ctacccaaagtgatcaacttttgta

SEQ ID NO: 264835 - DNA, 25 bp, Mus musculus
ctacccaatggaggttctgaagacc

SEQ ID NO: 264836 - DNA, 25 bp, Mus musculus
ctacccacaggccagccttcttgct

SEQ ID NO: 264837 - DNA, 25 bp, Mus musculus
ctacccacctatgtgctcccaagat

SEQ ID NO: 264838 - DNA, 25 bp, Mus musculus
ctacccacctttggaatgactattc

SEQ ID NO: 264839 - DNA, 25 bp, Mus musculus
ctacccagaaggacggcactagaaa

SEQ ID NO: 264840 - DNA, 25 bp, Mus musculus
ctacccagaaggacggcattagaaa

SEQ ID NO: 264841 - DNA, 25 bp, Mus musculus
ctacccagagaactggcagaagcca

SEQ ID NO: 264842 - DNA, 25 bp, Mus musculus
ctacccagagataagaagcatttgg

SEQ ID NO: 264843 - DNA, 25 bp, Mus musculus
ctacccagaggaagaatttgagcat

SEQ ID NO: 264844 - DNA, 25 bp, Mus musculus
ctacccagcatagccccttcacaga

SEQ ID NO: 264845 - DNA, 25 bp, Mus musculus
ctacccagctcgatcgagagctgag

SEQ ID NO: 264846 - DNA, 25 bp, Mus musculus
ctacccaggagagaaggatgtgcgg

SEQ ID NO: 264847 - DNA, 25 bp, Mus musculus
ctacccaggcgggtatggtggggct

SEQ ID NO: 264848 - DNA, 25 bp, Mus musculus
ctacccaggtggatggaacatgaag

SEQ ID NO: 264849 - DNA, 25 bp, Mus musculus
ctacccatctgacagatcacagtga

SEQ ID NO: 264850 - DNA, 25 bp, Mus musculus
ctacccatggctcagactccgtggt

SEQ ID NO: 264851 - DNA, 25 bp, Mus musculus
ctacccatttctcccaagtgctggg

SEQ ID NO: 264852 - DNA, 25 bp, Mus musculus
ctaccccaaaacaggccccagggct

SEQ ID NO: 264853 - DNA, 25 bp, Mus musculus
ctaccccaaaacagtgggaaatgcc

SEQ ID NO: 264854 - DNA, 25 bp, Mus musculus
ctaccccaacaatgcaccttccggt

SEQ ID NO: 264855 - DNA, 25 bp, Mus musculus
ctaccccaacaggccccgggtgctg

SEQ ID NO: 264856 - DNA, 25 bp, Mus musculus
ctaccccatatcaagtttcttactt

SEQ ID NO: 264857 - DNA, 25 bp, Mus musculus
ctaccccatgagcatgtaccagagc

SEQ ID NO: 264858 - DNA, 25 bp, Mus musculus
ctaccccatgcctccagtccctggc

SEQ ID NO: 264859 - DNA, 25 bp, Mus musculus
ctaccccatttggtgacttcatggt

SEQ ID NO: 264860 - DNA, 25 bp, Mus musculus
ctaccccatttggtgatctgaatga

SEQ ID NO: 264861 - DNA, 25 bp, Mus musculus
ctacccccagatccctgcagccccc

SEQ ID NO: 264862 - DNA, 25 bp, Mus musculus
ctacccccgagctgctcttgtgaag

SEQ ID NO: 264863 - DNA, 25 bp, Mus musculus
ctaccccggcgctggagccccaaac

SEQ ID NO: 264864 - DNA, 25 bp, Mus musculus
ctaccccgggaggcaccaggatcat

SEQ ID NO: 264865 - DNA, 25 bp, Mus musculus
ctacccctaggcaagactggacgag

SEQ ID NO: 264866 - DNA, 25 bp, Mus musculus
ctacccctcaagaaaagctactggc

SEQ ID NO: 264867 - DNA, 25 bp, Mus musculus
ctacccctcaagccttcctgcctga

SEQ ID NO: 264868 - DNA, 25 bp, Mus musculus
ctacccctccacatggcttcttctc

SEQ ID NO: 264869 - DNA, 25 bp, Mus musculus
ctacccctccacatgtctctggatt

SEQ ID NO: 264870 - DNA, 25 bp, Mus musculus
ctacccctttcagattgtaagctcc

SEQ ID NO: 264871 - DNA, 25 bp, Mus musculus
ctacccctttcaggactccttctaa

SEQ ID NO: 264872 - DNA, 25 bp, Mus musculus
ctacccgacagacatacttcctgcc

SEQ ID NO: 264873 - DNA, 25 bp, Mus musculus
ctacccgacagccccataaggcctc

SEQ ID NO: 264874 - DNA, 25 bp, Mus musculus
ctacccgacaggaaggtctatatgg

SEQ ID NO: 264875 - DNA, 25 bp, Mus musculus
ctacccgacagggtgtgaacaaaga

SEQ ID NO: 264876 - DNA, 25 bp, Mus musculus
ctacccgcagacagacgtgttctta

SEQ ID NO: 264877 - DNA, 25 bp, Mus musculus
ctacccgcagacagttggagacaca

SEQ ID NO: 264878 - DNA, 25 bp, Mus musculus
ctacccggagctgagggttccagac

SEQ ID NO: 264879 - DNA, 25 bp, Mus musculus
ctaccctaagaacacagatctgttt

SEQ ID NO: 264880 - DNA, 25 bp, Mus musculus
ctaccctagccagatcaatacagaa

SEQ ID NO: 264881 - DNA, 25 bp, Mus musculus
ctaccctagccagcccgcttcgatg

SEQ ID NO: 264882 - DNA, 25 bp, Mus musculus
ctaccctattaatgcctcctcctct

SEQ ID NO: 264883 - DNA, 25 bp, Mus musculus
ctaccctattaatggcttccaggct

SEQ ID NO: 264884 - DNA, 25 bp, Mus musculus
ctaccctcaaccagcaagcctgcct

SEQ ID NO: 264885 - DNA, 25 bp, Mus musculus
ctaccctcctatgtgctcccaagat

SEQ ID NO: 264886 - DNA, 25 bp, Mus musculus
ctaccctctgggtctggagacatgg

SEQ ID NO: 264887 - DNA, 25 bp, Mus musculus
ctaccctgaggaagctggaaggtgg

SEQ ID NO: 264888 - DNA, 25 bp, Mus musculus
ctaccctgctaaatgttaggccggg

SEQ ID NO: 264889 - DNA, 25 bp, Mus musculus
ctaccctgtccaagcccacaggact

SEQ ID NO: 264890 - DNA, 25 bp, Mus musculus
ctacccttaaccaaggacattcact

SEQ ID NO: 264891 - DNA, 25 bp, Mus musculus
ctacccttaaccaagggatgactgg

SEQ ID NO: 264892 - DNA, 25 bp, Mus musculus
ctacccttcgatgtcgctcaccagg

SEQ ID NO: 264893 - DNA, 25 bp, Mus musculus
ctacccttctggttctttgtgtgga

SEQ ID NO: 264894 - DNA, 25 bp, Mus musculus
ctacccttgcagggagactccggca

SEQ ID NO: 264895 - DNA, 25 bp, Mus musculus
ctaccctttactgaaattaccatgg

SEQ ID NO: 264896 - DNA, 25 bp, Mus musculus
ctaccctttcactggggatcacaag

SEQ ID NO: 264897 - DNA, 25 bp, Mus musculus
ctaccgaggcctaggatcagttctt

SEQ ID NO: 264898 - DNA, 25 bp, Mus musculus
ctaccgagtgaccctgagcaagaac

SEQ ID NO: 264899 - DNA, 25 bp, Mus musculus
ctaccgatcaccgcaacggccattc

SEQ ID NO: 264900 - DNA, 25 bp, Mus musculus
ctaccgatcaccggggctaccgtgt

SEQ ID NO: 264901 - DNA, 25 bp, Mus musculus
ctaccgcaacagaggcctttcagtc

SEQ ID NO: 264902 - DNA, 25 bp, Mus musculus
ctaccgcaacagagggccttaacaa

SEQ ID NO: 264903 - DNA, 25 bp, Mus musculus
ctaccgcaacgtggtctccattgag

SEQ ID NO: 264904 - DNA, 25 bp, Mus musculus
ctaccgcaagcagcagtctctggtc

SEQ ID NO: 264905 - DNA, 25 bp, Mus musculus
ctaccgcatcttcaggcttctcggc

SEQ ID NO: 264906 - DNA, 25 bp, Mus musculus
ctaccgcatgaggttctactttacc

SEQ ID NO: 264907 - DNA, 25 bp, Mus musculus
ctaccgcggcggcaggattgtcttg

SEQ ID NO: 264908 - DNA, 25 bp, Mus musculus
ctaccgcggcggcaggctcctccta

SEQ ID NO: 264909 - DNA, 25 bp, Mus musculus
ctaccgctccgcccgtgttggtgga

SEQ ID NO: 264910 - DNA, 25 bp, Mus musculus
ctaccggacagctttcttcggaaaa

SEQ ID NO: 264911 - DNA, 25 bp, Mus musculus
ctaccggagttggatcggtcatggg

SEQ ID NO: 264912 - DNA, 25 bp, Mus musculus
ctaccggcagatcaccatccggagg

SEQ ID NO: 264913 - DNA, 25 bp, Mus musculus
ctaccggctgagcatggtggctgta

SEQ ID NO: 264914 - DNA, 25 bp, Mus musculus
ctaccgggcatcggccctgggcagt

SEQ ID NO: 264915 - DNA, 25 bp, Mus musculus
ctaccgggccttccgctctgtgcct

SEQ ID NO: 264916 - DNA, 25 bp, Mus musculus
ctaccggggagcattcagcctgtgt

SEQ ID NO: 264917 - DNA, 25 bp, Mus musculus
ctaccggggagtaacaatgaagagg

SEQ ID NO: 264918 - DNA, 25 bp, Mus musculus
ctaccggtttcagacaccctatttt

SEQ ID NO: 264919 - DNA, 25 bp, Mus musculus
ctaccgtagcccagaaaaatatgaa

SEQ ID NO: 264920 - DNA, 25 bp, Mus musculus
ctaccgtagcccagagcaagtccct

SEQ ID NO: 264921 - DNA, 25 bp, Mus musculus
ctaccgtcgctttctccagctgagt

SEQ ID NO: 264922 - DNA, 25 bp, Mus musculus
ctaccgtcttgctggtgagcaccga

SEQ ID NO: 264923 - DNA, 25 bp, Mus musculus
ctaccgtggtggagggaaaaatggt

SEQ ID NO: 264924 - DNA, 25 bp, Mus musculus
ctaccgtggtggaggttgaagaaat

SEQ ID NO: 264925 - DNA, 25 bp, Mus musculus
ctaccgtgtggataaacgttttgct

SEQ ID NO: 264926 - DNA, 25 bp, Mus musculus
ctaccgtgtggccttcagtggggct

SEQ ID NO: 264927 - DNA, 25 bp, Mus musculus
ctacctaatcgattgaggcccaagg

SEQ ID NO: 264928 - DNA, 25 bp, Mus musculus
ctacctaatcgattggattttcacc

SEQ ID NO: 264929 - DNA, 25 bp, Mus musculus
ctacctacaagagaactctgaaggc

SEQ ID NO: 264930 - DNA, 25 bp, Mus musculus
ctacctacaagaggagagtcaaaca

SEQ ID NO: 264931 - DNA, 25 bp, Mus musculus
ctacctacaagaggtagaaagtccc

SEQ ID NO: 264932 - DNA, 25 bp, Mus musculus
ctacctacaagatgtgaagtgggag

SEQ ID NO: 264933 - DNA, 25 bp, Mus musculus
ctacctacaatacccttcgagcaca

SEQ ID NO: 264934 - DNA, 25 bp, Mus musculus
ctacctacagcggcagaacccgggg

SEQ ID NO: 264935 - DNA, 25 bp, Mus musculus
ctacctaccagccctgggtcctgag

SEQ ID NO: 264936 - DNA, 25 bp, Mus musculus
ctacctaccaggatggtccacctcc

SEQ ID NO: 264937 - DNA, 25 bp, Mus musculus
ctacctacgaccaggttcagaacag

SEQ ID NO: 264938 - DNA, 25 bp, Mus musculus
ctacctacggctctcttaagagcct

SEQ ID NO: 264939 - DNA, 25 bp, Mus musculus
ctacctacggggaacttgaaatact

SEQ ID NO: 264940 - DNA, 25 bp, Mus musculus
ctacctactagagccggagaacagt

SEQ ID NO: 264941 - DNA, 25 bp, Mus musculus
ctacctagaaaagatttcacacacc

SEQ ID NO: 264942 - DNA, 25 bp, Mus musculus
ctacctagagaagacggaatggttc

SEQ ID NO: 264943 - DNA, 25 bp, Mus musculus
ctacctagtcacagagggctttaag

SEQ ID NO: 264944 - DNA, 25 bp, Mus musculus
ctacctagtcacagcaacaacactt

SEQ ID NO: 264945 - DNA, 25 bp, Mus musculus
ctacctcaaacccagaaccaaggag

SEQ ID NO: 264946 - DNA, 25 bp, Mus musculus
ctacctcaacagacatttgctccaa

SEQ ID NO: 264947 - DNA, 25 bp, Mus musculus
ctacctcaacctcagggaaccagct

SEQ ID NO: 264948 - DNA, 25 bp, Mus musculus
ctacctcaactaatttgtgatcctg

SEQ ID NO: 264949 - DNA, 25 bp, Mus musculus
ctacctcaagctgagggcagagcag

SEQ ID NO: 264950 - DNA, 25 bp, Mus musculus
ctacctcaaggagctgagcaagcgt

SEQ ID NO: 264951 - DNA, 25 bp, Mus musculus
ctacctcaatcacagttgcagcccc

SEQ ID NO: 264952 - DNA, 25 bp, Mus musculus
ctacctcagtctcacggatgattga

SEQ ID NO: 264953 - DNA, 25 bp, Mus musculus
ctacctcatctgtggtcaaaatcca

SEQ ID NO: 264954 - DNA, 25 bp, Mus musculus
ctacctcattaaatgaatctcctgt

SEQ ID NO: 264955 - DNA, 25 bp, Mus musculus
ctacctccagactttggttctgaaa

SEQ ID NO: 264956 - DNA, 25 bp, Mus musculus
ctacctccagaggttggcgatttga

SEQ ID NO: 264957 - DNA, 25 bp, Mus musculus
ctacctccagatttaggtcgctccc

SEQ ID NO: 264958 - DNA, 25 bp, Mus musculus
ctacctccaggcacttagcgctatg

SEQ ID NO: 264959 - DNA, 25 bp, Mus musculus
ctacctccaggtcggagtgacctct

SEQ ID NO: 264960 - DNA, 25 bp, Mus musculus
ctacctccaggtggttgttggagat

SEQ ID NO: 264961 - DNA, 25 bp, Mus musculus
ctacctccagtacctcactgtggac

SEQ ID NO: 264962 - DNA, 25 bp, Mus musculus
ctacctcctaatggtttctgtagct

SEQ ID NO: 264963 - DNA, 25 bp, Mus musculus
ctacctcctcaggacttctagcagc

SEQ ID NO: 264964 - DNA, 25 bp, Mus musculus
ctacctcctcaggagccgtctctca

SEQ ID NO: 264965 - DNA, 25 bp, Mus musculus
ctacctcctttcgcttcaagcacaa

SEQ ID NO: 264966 - DNA, 25 bp, Mus musculus
ctacctctagacgccagccttctct

SEQ ID NO: 264967 - DNA, 25 bp, Mus musculus
ctacctctatttcgccatgagctac

SEQ ID NO: 264968 - DNA, 25 bp, Mus musculus
ctacctctggatcgctcctttgatg

SEQ ID NO: 264969 - DNA, 25 bp, Mus musculus
ctacctctggatgtcgtcacgctgg

SEQ ID NO: 264970 - DNA, 25 bp, Mus musculus
ctacctctggatgtgtcttcggagc

SEQ ID NO: 264971 - DNA, 25 bp, Mus musculus
ctacctctggatgttgaacagcgtc

SEQ ID NO: 264972 - DNA, 25 bp, Mus musculus
ctacctctggggtgaatgagagtga

SEQ ID NO: 264973 - DNA, 25 bp, Mus musculus
ctacctctgtgaggtttttcaagac

SEQ ID NO: 264974 - DNA, 25 bp, Mus musculus
ctacctctgtgcaatgaaggtaacc

SEQ ID NO: 264975 - DNA, 25 bp, Mus musculus
ctacctctgtggaagctcggattct

SEQ ID NO: 264976 - DNA, 25 bp, Mus musculus
ctacctcttaggtctctttgagccc

SEQ ID NO: 264977 - DNA, 25 bp, Mus musculus
ctacctctttaaagatactatcgtg

SEQ ID NO: 264978 - DNA, 25 bp, Mus musculus
ctacctctttgaggaactttgatgt

SEQ ID NO: 264979 - DNA, 25 bp, Mus musculus
ctacctctttgagggaagaagccag

SEQ ID NO: 264980 - DNA, 25 bp, Mus musculus
ctacctgaacagggacccagaaggg

SEQ ID NO: 264981 - DNA, 25 bp, Mus musculus
ctacctgaagagcaccaagctgtgg

SEQ ID NO: 264982 - DNA, 25 bp, Mus musculus
ctacctgaaggatctgaaaacatca

SEQ ID NO: 264983 - DNA, 25 bp, Mus musculus
ctacctgaggctggcccagcctgag

SEQ ID NO: 264984 - DNA, 25 bp, Mus musculus
ctacctgagggtgaacaacatgccc

SEQ ID NO: 264985 - DNA, 25 bp, Mus musculus
ctacctgatgccgaatgatcaccgc

SEQ ID NO: 264986 - DNA, 25 bp, Mus musculus
ctacctgatgcctggcctggtctgt

SEQ ID NO: 264987 - DNA, 25 bp, Mus musculus
ctacctgatgcgcctggagctgtgc

SEQ ID NO: 264988 - DNA, 25 bp, Mus musculus
ctacctgcaaaatgtaactgcggat

SEQ ID NO: 264989 - DNA, 25 bp, Mus musculus
ctacctgcaccagagacggaaaacc

SEQ ID NO: 264990 - DNA, 25 bp, Mus musculus
ctacctgcaccaggattctaatccc

SEQ ID NO: 264991 - DNA, 25 bp, Mus musculus
ctacctgcagagctttgtggcgtga

SEQ ID NO: 264992 - DNA, 25 bp, Mus musculus
ctacctgcagcatcgaatcctggac

SEQ ID NO: 264993 - DNA, 25 bp, Mus musculus
ctacctgcaggagaccccatgtttc

SEQ ID NO: 264994 - DNA, 25 bp, Mus musculus
ctacctgcaggcagcctgatctctc

SEQ ID NO: 264995 - DNA, 25 bp, Mus musculus
ctacctgcagggctgaccagctggc

SEQ ID NO: 264996 - DNA, 25 bp, Mus musculus
ctacctgcaggtcacccacgtgttc

SEQ ID NO: 264997 - DNA, 25 bp, Mus musculus
ctacctgccactggtgcggaagatt

SEQ ID NO: 264998 - DNA, 25 bp, Mus musculus
ctacctgccactggtgtagatacag

SEQ ID NO: 264999 - DNA, 25 bp, Mus musculus
ctacctgccgcaaatctcccagctg

SEQ ID NO: 265000 - DNA, 25 bp, Mus musculus
ctacctgcctaaccagcccctccga

SEQ ID NO: 265001 - DNA, 25 bp, Mus musculus
ctacctgcggacagacaactgagga

SEQ ID NO: 265002 - DNA, 25 bp, Mus musculus
ctacctgcggacagtctcctgccct

SEQ ID NO: 265003 - DNA, 25 bp, Mus musculus
ctacctggaaccaggcacggctgga

SEQ ID NO: 265004 - DNA, 25 bp, Mus musculus
ctacctggaagaagccctgcagagg

SEQ ID NO: 265005 - DNA, 25 bp, Mus musculus
ctacctggaagagtgcctgctcact

SEQ ID NO: 265006 - DNA, 25 bp, Mus musculus
ctacctggacttaactgtgccacca

SEQ ID NO: 265007 - DNA, 25 bp, Mus musculus
ctacctggagatgttccgagaacaa

SEQ ID NO: 265008 - DNA, 25 bp, Mus musculus
ctacctggatagcatgtacatcatg

SEQ ID NO: 265009 - DNA, 25 bp, Mus musculus
ctacctggatgacgagttgatagac

SEQ ID NO: 265010 - DNA, 25 bp, Mus musculus
ctacctggatgacgttaatgaaatc

SEQ ID NO: 265011 - DNA, 25 bp, Mus musculus
ctacctggatgcccagtactatggc

SEQ ID NO: 265012 - DNA, 25 bp, Mus musculus
ctacctggcagagatggacatgcta

SEQ ID NO: 265013 - DNA, 25 bp, Mus musculus
ctacctggcagagccgctgatggac

SEQ ID NO: 265014 - DNA, 25 bp, Mus musculus
ctacctggcagaggtgatatgtaaa

SEQ ID NO: 265015 - DNA, 25 bp, Mus musculus
ctacctggccccgtgggagcccttg

SEQ ID NO: 265016 - DNA, 25 bp, Mus musculus
ctacctggcggacaggctgggccgt

SEQ ID NO: 265017 - DNA, 25 bp, Mus musculus
ctacctgggagccatcgagggaatg

SEQ ID NO: 265018 - DNA, 25 bp, Mus musculus
ctacctgggcccccgtcacagtttg

SEQ ID NO: 265019 - DNA, 25 bp, Mus musculus
ctacctggtttcaggccttcccctg

SEQ ID NO: 265020 - DNA, 25 bp, Mus musculus
ctacctggtttcagggcagcccctg

SEQ ID NO: 265021 - DNA, 25 bp, Mus musculus
ctacctgtacagggctggtacttct

SEQ ID NO: 265022 - DNA, 25 bp, Mus musculus
ctacctgtacagttttgtggcggct

SEQ ID NO: 265023 - DNA, 25 bp, Mus musculus
ctacctgtgaaaagatcatctgttc

SEQ ID NO: 265024 - DNA, 25 bp, Mus musculus
ctacctgtgaaaatggctctggaga

SEQ ID NO: 265025 - DNA, 25 bp, Mus musculus
ctacctgtgggctctggggtgtggt

SEQ ID NO: 265026 - DNA, 25 bp, Mus musculus
ctacctgttcttcagaaacaacatg

SEQ ID NO: 265027 - DNA, 25 bp, Mus musculus
ctacctgttcttcagaaacagacat

SEQ ID NO: 265028 - DNA, 25 bp, Mus musculus
ctaccttattgaaaggatgaagaaa

SEQ ID NO: 265029 - DNA, 25 bp, Mus musculus
ctaccttcaaggcctgcacgctgct

SEQ ID NO: 265030 - DNA, 25 bp, Mus musculus
ctaccttcaccaggactgggaggta

SEQ ID NO: 265031 - DNA, 25 bp, Mus musculus
ctaccttcttctgtatatgcaccat

SEQ ID NO: 265032 - DNA, 25 bp, Mus musculus
ctaccttgaaggcccacaatgtcct

SEQ ID NO: 265033 - DNA, 25 bp, Mus musculus
ctaccttgacgtcccacacttgcat

SEQ ID NO: 265034 - DNA, 25 bp, Mus musculus
ctaccttgcttgtgggattcacagc

SEQ ID NO: 265035 - DNA, 25 bp, Mus musculus
ctacctttgaacgaatcccgctcaa

SEQ ID NO: 265036 - DNA, 25 bp, Mus musculus
ctacgaaacaagtgcctgctttttc

SEQ ID NO: 265037 - DNA, 25 bp, Mus musculus
ctacgaacacggccaaagtgaaaga

SEQ ID NO: 265038 - DNA, 25 bp, Mus musculus
ctacgaaccacactgtaccagcaag

SEQ ID NO: 265039 - DNA, 25 bp, Mus musculus
ctacgaagcaggctgcaccctggag

SEQ ID NO: 265040 - DNA, 25 bp, Mus musculus
ctacgaagccgatttttgggaataa

SEQ ID NO: 265041 - DNA, 25 bp, Mus musculus
ctacgaagccgtgacactgatgaga

SEQ ID NO: 265042 - DNA, 25 bp, Mus musculus
ctacgaaggaggaaactcccagtat

SEQ ID NO: 265043 - DNA, 25 bp, Mus musculus
ctacgaccaggttcagaacagccag

SEQ ID NO: 265044 - DNA, 25 bp, Mus musculus
ctacgacctccctaggattctcaaa

SEQ ID NO: 265045 - DNA, 25 bp, Mus musculus
ctacgacctccctaggtgaggatta

SEQ ID NO: 265046 - DNA, 25 bp, Mus musculus
ctacgacgtgctgtgtgcagcagca

SEQ ID NO: 265047 - DNA, 25 bp, Mus musculus
ctacgacgtggttgcgcagacagca

SEQ ID NO: 265048 - DNA, 25 bp, Mus musculus
ctacgactacagtcagggtagtaca

SEQ ID NO: 265049 - DNA, 25 bp, Mus musculus
ctacgagacggtggtgaaagtgaag

SEQ ID NO: 265050 - DNA, 25 bp, Mus musculus
ctacgagagctttaattttgccaaa

SEQ ID NO: 265051 - DNA, 25 bp, Mus musculus
ctacgagagctttggtctctttgct

SEQ ID NO: 265052 - DNA, 25 bp, Mus musculus
ctacgagcagcgggtgctgacggta

SEQ ID NO: 265053 - DNA, 25 bp, Mus musculus
ctacgagcagggctgtgcgatagcc

SEQ ID NO: 265054 - DNA, 25 bp, Mus musculus
ctacgagctcagaaacaaatacatt

SEQ ID NO: 265055 - DNA, 25 bp, Mus musculus
ctacgagctcagaatattattggcg

SEQ ID NO: 265056 - DNA, 25 bp, Mus musculus
ctacgagctcaggtcctgaactttg

SEQ ID NO: 265057 - DNA, 25 bp, Mus musculus
ctacgagctgcagaaccagctagct

SEQ ID NO: 265058 - DNA, 25 bp, Mus musculus
ctacgagctgccgtgggttgaaaaa

SEQ ID NO: 265059 - DNA, 25 bp, Mus musculus
ctacgaggaagtaccatttaggtcc

SEQ ID NO: 265060 - DNA, 25 bp, Mus musculus
ctacgaggcaaaggtgtacagtgcc

SEQ ID NO: 265061 - DNA, 25 bp, Mus musculus
ctacgagtaccggcatgtcatgtta

SEQ ID NO: 265062 - DNA, 25 bp, Mus musculus
ctacgagtatctggaagtacaaagg

SEQ ID NO: 265063 - DNA, 25 bp, Mus musculus
ctacgagtatctggacatgtcctca

SEQ ID NO: 265064 - DNA, 25 bp, Mus musculus
ctacgagtatctggctcagagacat

SEQ ID NO: 265065 - DNA, 25 bp, Mus musculus
ctacgagtatctggttttaacagcg

SEQ ID NO: 265066 - DNA, 25 bp, Mus musculus
ctacgagtccgaaaggcaagagctg

SEQ ID NO: 265067 - DNA, 25 bp, Mus musculus
ctacgagtctgaggctgcttatgat

SEQ ID NO: 265068 - DNA, 25 bp, Mus musculus
ctacgatagaggactcctacaggaa

SEQ ID NO: 265069 - DNA, 25 bp, Mus musculus
ctacgatagagttgttggagttttt

SEQ ID NO: 265070 - DNA, 25 bp, Mus musculus
ctacgatagccatgagggcagaagt

SEQ ID NO: 265071 - DNA, 25 bp, Mus musculus
ctacgatagccattcccttcaggcc

SEQ ID NO: 265072 - DNA, 25 bp, Mus musculus
ctacgatgagtgtaaacgaagattt

SEQ ID NO: 265073 - DNA, 25 bp, Mus musculus
ctacgattatccagataagtagcag

SEQ ID NO: 265074 - DNA, 25 bp, Mus musculus
ctacgcaaaaagcaggcctgttgct

SEQ ID NO: 265075 - DNA, 25 bp, Mus musculus
ctacgcacagagtatgataggctgg

SEQ ID NO: 265076 - DNA, 25 bp, Mus musculus
ctacgcaccaaaggtgtgactttga

SEQ ID NO: 265077 - DNA, 25 bp, Mus musculus
ctacgcatcatgccactgccttctg

SEQ ID NO: 265078 - DNA, 25 bp, Mus musculus
ctacgcatgcccagctcaagaaggg

SEQ ID NO: 265079 - DNA, 25 bp, Mus musculus
ctacgcatgcccaggctcctgctcc

SEQ ID NO: 265080 - DNA, 25 bp, Mus musculus
ctacgccaagcatcatcagctggtt

SEQ ID NO: 265081 - DNA, 25 bp, Mus musculus
ctacgccagaagaagcgagtactta

SEQ ID NO: 265082 - DNA, 25 bp, Mus musculus
ctacgccagggccaggtcctgtgcg

SEQ ID NO: 265083 - DNA, 25 bp, Mus musculus
ctacgccatggagatgctctacatc

SEQ ID NO: 265084 - DNA, 25 bp, Mus musculus
ctacgccatgggctggcgccaccct

SEQ ID NO: 265085 - DNA, 25 bp, Mus musculus
ctacgccgcctatgtattgtattct

SEQ ID NO: 265086 - DNA, 25 bp, Mus musculus
ctacgccgcctctgtttggggcaac

SEQ ID NO: 265087 - DNA, 25 bp, Mus musculus
ctacgcctcccccggcccacaatgt

SEQ ID NO: 265088 - DNA, 25 bp, Mus musculus
ctacgcctggactaacggttatgac

SEQ ID NO: 265089 - DNA, 25 bp, Mus musculus
ctacgcctgtgaggtctgtgcattt

SEQ ID NO: 265090 - DNA, 25 bp, Mus musculus
ctacgccttcccgaactacgctgcc

SEQ ID NO: 265091 - DNA, 25 bp, Mus musculus
ctacgccttcttctgggagaagttt

SEQ ID NO: 265092 - DNA, 25 bp, Mus musculus
ctacgcgaggaggaggccctgcggg

SEQ ID NO: 265093 - DNA, 25 bp, Mus musculus
ctacgcgcggtatgtggcctttgcc

SEQ ID NO: 265094 - DNA, 25 bp, Mus musculus
ctacgcggcaaagcagctcctggag

SEQ ID NO: 265095 - DNA, 25 bp, Mus musculus
ctacgcgggacgggcccagttctgc

SEQ ID NO: 265096 - DNA, 25 bp, Mus musculus
ctacgcgggacggggcttctgaccc

SEQ ID NO: 265097 - DNA, 25 bp, Mus musculus
ctacgctgatggcagtgaagacaaa

SEQ ID NO: 265098 - DNA, 25 bp, Mus musculus
ctacgctgatggcggtgaagacaaa

SEQ ID NO: 265099 - DNA, 25 bp, Mus musculus
ctacgctgtggaactgtttgaaggc

SEQ ID NO: 265100 - DNA, 25 bp, Mus musculus
ctacgctttggccccaaacccatgc

SEQ ID NO: 265101 - DNA, 25 bp, Mus musculus
ctacggaaagaatgatgaagtggaa

SEQ ID NO: 265102 - DNA, 25 bp, Mus musculus
ctacggaaagatcagaaacatcgag

SEQ ID NO: 265103 - DNA, 25 bp, Mus musculus
ctacggaaaggtgactcagaactgc

SEQ ID NO: 265104 - DNA, 25 bp, Mus musculus
ctacggaagccgcagtggtggaggt

SEQ ID NO: 265105 - DNA, 25 bp, Mus musculus
ctacggacaggatcgagagctgaga

SEQ ID NO: 265106 - DNA, 25 bp, Mus musculus
ctacggactgacgctgcacctggtg

SEQ ID NO: 265107 - DNA, 25 bp, Mus musculus
ctacggagccagcggatgaagctac

SEQ ID NO: 265108 - DNA, 25 bp, Mus musculus
ctacggagtcaagagccttcgtgag

SEQ ID NO: 265109 - DNA, 25 bp, Mus musculus
ctacggagtcaagaggttctcccca

SEQ ID NO: 265110 - DNA, 25 bp, Mus musculus
ctacggagtcaagagtcccctgtcg

SEQ ID NO: 265111 - DNA, 25 bp, Mus musculus
ctacggatcaggtcgtgtcttatgc

SEQ ID NO: 265112 - DNA, 25 bp, Mus musculus
ctacggatcagtgacctgagggtgg

SEQ ID NO: 265113 - DNA, 25 bp, Mus musculus
ctacggatggaggaatcacttggac

SEQ ID NO: 265114 - DNA, 25 bp, Mus musculus
ctacggcaacactgggtaacctccg

SEQ ID NO: 265115 - DNA, 25 bp, Mus musculus
ctacggcacagtgcttgctgaattt

SEQ ID NO: 265116 - DNA, 25 bp, Mus musculus
ctacggcccagcaggaccaaactct

SEQ ID NO: 265117 - DNA, 25 bp, Mus musculus
ctacggccctgcaacattggttctt

SEQ ID NO: 265118 - DNA, 25 bp, Mus musculus
ctacggccctgcagtggaagacttc

SEQ ID NO: 265119 - DNA, 25 bp, Mus musculus
ctacggccgcactcggaacccactt

SEQ ID NO: 265120 - DNA, 25 bp, Mus musculus
ctacggcggagtggaacactcgggc

SEQ ID NO: 265121 - DNA, 25 bp, Mus musculus
ctacggctgtcaacctaatgtctgc

SEQ ID NO: 265122 - DNA, 25 bp, Mus musculus
ctacgggaagcacgggacgcctcag

SEQ ID NO: 265123 - DNA, 25 bp, Mus musculus
ctacgggaaggacaggacagcaagg

SEQ ID NO: 265124 - DNA, 25 bp, Mus musculus
ctacgggaaggacaggttcaactgg

SEQ ID NO: 265125 - DNA, 25 bp, Mus musculus
ctacgggcacggctcggatggcgtc

SEQ ID NO: 265126 - DNA, 25 bp, Mus musculus
ctacgggcagcagagttcattccga

SEQ ID NO: 265127 - DNA, 25 bp, Mus musculus
ctacgggcaggctcccggacctctg

SEQ ID NO: 265128 - DNA, 25 bp, Mus musculus
ctacgggcagtgatgatgactgtgt

SEQ ID NO: 265129 - DNA, 25 bp, Mus musculus
ctacgggtactggggcctggatatt

SEQ ID NO: 265130 - DNA, 25 bp, Mus musculus
ctacggtagtagctcctggtttgct

SEQ ID NO: 265131 - DNA, 25 bp, Mus musculus
ctacggtctctgctgcgctacatgg

SEQ ID NO: 265132 - DNA, 25 bp, Mus musculus
ctacggtgccaggctgtactgcctg

SEQ ID NO: 265133 - DNA, 25 bp, Mus musculus
ctacggttgtcagaaacttatggaa

SEQ ID NO: 265134 - DNA, 25 bp, Mus musculus
ctacggttgtcagtccgcagatgca

SEQ ID NO: 265135 - DNA, 25 bp, Mus musculus
ctacgtacaagatgaacatctgcaa

SEQ ID NO: 265136 - DNA, 25 bp, Mus musculus
ctacgtacaaggaatcaaagaagag

SEQ ID NO: 265137 - DNA, 25 bp, Mus musculus
ctacgtcaaggtcccaaagcccaca

SEQ ID NO: 265138 - DNA, 25 bp, Mus musculus
ctacgtcatgcagtgcccttccagt

SEQ ID NO: 265139 - DNA, 25 bp, Mus musculus
ctacgtcatggtcatctgctatatc

SEQ ID NO: 265140 - DNA, 25 bp, Mus musculus
ctacgtccagcaggcgggcttggag

SEQ ID NO: 265141 - DNA, 25 bp, Mus musculus
ctacgtcctcccgaccatgctcgca

SEQ ID NO: 265142 - DNA, 25 bp, Mus musculus
ctacgtcctgcagagcgacgttttt

SEQ ID NO: 265143 - DNA, 25 bp, Mus musculus
ctacgtgaagcaacatcctttgtac

SEQ ID NO: 265144 - DNA, 25 bp, Mus musculus
ctacgtgagcaggaggagctgagca

SEQ ID NO: 265145 - DNA, 25 bp, Mus musculus
ctacgtgcaaaaggtaactttcggc

SEQ ID NO: 265146 - DNA, 25 bp, Mus musculus
ctacgtgctgaagtatgccgcctgt

SEQ ID NO: 265147 - DNA, 25 bp, Mus musculus
ctacgtggaccccagacatcacgag

SEQ ID NO: 265148 - DNA, 25 bp, Mus musculus
ctacgtggaccccagcggcagctcc

SEQ ID NO: 265149 - DNA, 25 bp, Mus musculus
ctacgtggcagatggcagcctgcac

SEQ ID NO: 265150 - DNA, 25 bp, Mus musculus
ctacgtgtcctatgctgtcttcctt

SEQ ID NO: 265151 - DNA, 25 bp, Mus musculus
ctacgttaaggtcacctccaaggtc

SEQ ID NO: 265152 - DNA, 25 bp, Mus musculus
ctacgttaagttccggcgggaggag

SEQ ID NO: 265153 - DNA, 25 bp, Mus musculus
ctacgttcaacaggcaaagcgagtg

SEQ ID NO: 265154 - DNA, 25 bp, Mus musculus
ctacgttttcattgtgatctctggg

SEQ ID NO: 265155 - DNA, 25 bp, Mus musculus
ctactaagaaatgtcataaaggaac

SEQ ID NO: 265156 - DNA, 25 bp, Mus musculus
ctactaaggagggcgcagatgtcca

SEQ ID NO: 265157 - DNA, 25 bp, Mus musculus
ctactaaggagggcgctctctgtga

SEQ ID NO: 265158 - DNA, 25 bp, Mus musculus
ctactaatggaatgggcattatatt

SEQ ID NO: 265159 - DNA, 25 bp, Mus musculus
ctactaatggaatgggccttgcatt

SEQ ID NO: 265160 - DNA, 25 bp, Mus musculus
ctactacaacctggactgcagtgag

SEQ ID NO: 265161 - DNA, 25 bp, Mus musculus
ctactacaacctggcgtgacgggac

SEQ ID NO: 265162 - DNA, 25 bp, Mus musculus
ctactacaaccttgcggagtgtgca

SEQ ID NO: 265163 - DNA, 25 bp, Mus musculus
ctactacaagaaacatggcatcagg

SEQ ID NO: 265164 - DNA, 25 bp, Mus musculus
ctactacaaggtttgaagagtggca

SEQ ID NO: 265165 - DNA, 25 bp, Mus musculus
ctactacacgtgggctgtcttctgg

SEQ ID NO: 265166 - DNA, 25 bp, Mus musculus
ctactacagagtgatgctgaggaag

SEQ ID NO: 265167 - DNA, 25 bp, Mus musculus
ctactacagagttggtgaatatgtg

SEQ ID NO: 265168 - DNA, 25 bp, Mus musculus
ctactacagccctgatcacaagtgc

SEQ ID NO: 265169 - DNA, 25 bp, Mus musculus
ctactacatgatcatctccagaggc

SEQ ID NO: 265170 - DNA, 25 bp, Mus musculus
ctactaccccatgagcatgtaccag

SEQ ID NO: 265171 - DNA, 25 bp, Mus musculus
ctactaccccatgcctccagtccct

SEQ ID NO: 265172 - DNA, 25 bp, Mus musculus
ctactacgccatggagatgctctac

SEQ ID NO: 265173 - DNA, 25 bp, Mus musculus
ctactacgtacaagatgaacatctg

SEQ ID NO: 265174 - DNA, 25 bp, Mus musculus
ctactacgtacaaggaatcaaagaa

SEQ ID NO: 265175 - DNA, 25 bp, Mus musculus
ctactactgaataccccaagtacca

SEQ ID NO: 265176 - DNA, 25 bp, Mus musculus
ctactactgtggggtatccgagtgg

SEQ ID NO: 265177 - DNA, 25 bp, Mus musculus
ctactagaaacagaaaattcatttg

SEQ ID NO: 265178 - DNA, 25 bp, Mus musculus
ctactagggagagactctacaggag

SEQ ID NO: 265179 - DNA, 25 bp, Mus musculus
ctactataagaagatggactaagtt

SEQ ID NO: 265180 - DNA, 25 bp, Mus musculus
ctactataagccagattcccctgag

SEQ ID NO: 265181 - DNA, 25 bp, Mus musculus
ctactatatcaaccacgagacccaa

SEQ ID NO: 265182 - DNA, 25 bp, Mus musculus
ctactatatctctgctcatgtctac

SEQ ID NO: 265183 - DNA, 25 bp, Mus musculus
ctactatcccagccccccaggttcg

SEQ ID NO: 265184 - DNA, 25 bp, Mus musculus
ctactatcccagtatgcaaccgagg

SEQ ID NO: 265185 - DNA, 25 bp, Mus musculus
ctactatcccagtgtttgaaagacg

SEQ ID NO: 265186 - DNA, 25 bp, Mus musculus
ctactatcctgacagctacgacacg

SEQ ID NO: 265187 - DNA, 25 bp, Mus musculus
ctactatcggcgacgcctgggctcc

SEQ ID NO: 265188 - DNA, 25 bp, Mus musculus
ctactatcggcgtcttcccaaagcc

SEQ ID NO: 265189 - DNA, 25 bp, Mus musculus
ctactatgaactctggtggttcacc

SEQ ID NO: 265190 - DNA, 25 bp, Mus musculus
ctactatgaagacatccgttctcat

SEQ ID NO: 265191 - DNA, 25 bp, Mus musculus
ctactatgagaagctccataagtat

SEQ ID NO: 265192 - DNA, 25 bp, Mus musculus
ctactatggagacatttcgactttg

SEQ ID NO: 265193 - DNA, 25 bp, Mus musculus
ctactatggagatgtcatctgggtg

SEQ ID NO: 265194 - DNA, 25 bp, Mus musculus
ctactatggaggacagtggttcttg

SEQ ID NO: 265195 - DNA, 25 bp, Mus musculus
ctactatggaggggctccacgggcc

SEQ ID NO: 265196 - DNA, 25 bp, Mus musculus
ctactcaataagctgagagtgctag

SEQ ID NO: 265197 - DNA, 25 bp, Mus musculus
ctactcacagagagaaaaaaccatt

SEQ ID NO: 265198 - DNA, 25 bp, Mus musculus
ctactcacagagccccgtggcttct

SEQ ID NO: 265199 - DNA, 25 bp, Mus musculus
ctactcacaggagaaaatgctggat

SEQ ID NO: 265200 - DNA, 25 bp, Mus musculus
ctactcacaggatgagcagaagcta

SEQ ID NO: 265201 - DNA, 25 bp, Mus musculus
ctactcacctggttcaaccagatgt

SEQ ID NO: 265202 - DNA, 25 bp, Mus musculus
ctactcacgactagggaatgtgtga

SEQ ID NO: 265203 - DNA, 25 bp, Mus musculus
ctactcacgactagggagaaagaga

SEQ ID NO: 265204 - DNA, 25 bp, Mus musculus
ctactcactcagggatgactatgag

SEQ ID NO: 265205 - DNA, 25 bp, Mus musculus
ctactcagaaagagatcccattcct

SEQ ID NO: 265206 - DNA, 25 bp, Mus musculus
ctactcaggcagatccgttttgtgc

SEQ ID NO: 265207 - DNA, 25 bp, Mus musculus
ctactcaggcagtatctccaggagg

SEQ ID NO: 265208 - DNA, 25 bp, Mus musculus
ctactccaaggagaggtcaatacta

SEQ ID NO: 265209 - DNA, 25 bp, Mus musculus
ctactccaaggagaggttttcctta

SEQ ID NO: 265210 - DNA, 25 bp, Mus musculus
ctactccaaggtgaagcagaaagaa

SEQ ID NO: 265211 - DNA, 25 bp, Mus musculus
ctactccacggattacctcacggat

SEQ ID NO: 265212 - DNA, 25 bp, Mus musculus
ctactccacgggaggatgctccagt

SEQ ID NO: 265213 - DNA, 25 bp, Mus musculus
ctactccagaaaaatcttcaaatga

SEQ ID NO: 265214 - DNA, 25 bp, Mus musculus
ctactccagcacagatggatacagt

SEQ ID NO: 265215 - DNA, 25 bp, Mus musculus
ctactcccaccccgggatcgctcaa

SEQ ID NO: 265216 - DNA, 25 bp, Mus musculus
ctactcccagtgaccttcagaatgc

SEQ ID NO: 265217 - DNA, 25 bp, Mus musculus
ctactccccagaagtctggagagct

SEQ ID NO: 265218 - DNA, 25 bp, Mus musculus
ctactcccctgtgagggctgaactg

SEQ ID NO: 265219 - DNA, 25 bp, Mus musculus
ctactccgagcaggacacttggcaa

SEQ ID NO: 265220 - DNA, 25 bp, Mus musculus
ctactccgagcaggatgacagcacc

SEQ ID NO: 265221 - DNA, 25 bp, Mus musculus
ctactccgagcagtcatcctttgca

SEQ ID NO: 265222 - DNA, 25 bp, Mus musculus
ctactccgccattttcctgctgtcg

SEQ ID NO: 265223 - DNA, 25 bp, Mus musculus
ctactcctaagtccccaggtgcatc

SEQ ID NO: 265224 - DNA, 25 bp, Mus musculus
ctactcctaatgtgaaaaactcaaa

SEQ ID NO: 265225 - DNA, 25 bp, Mus musculus
ctactcctcagctggaattttggag

SEQ ID NO: 265226 - DNA, 25 bp, Mus musculus
ctactcctcgctgagcacctcccca

SEQ ID NO: 265227 - DNA, 25 bp, Mus musculus
ctactcctgatgaacaaaacaggga

SEQ ID NO: 265228 - DNA, 25 bp, Mus musculus
ctactcgctccaaagaacctaagga

SEQ ID NO: 265229 - DNA, 25 bp, Mus musculus
ctactcgctccaaagagaaaacggc

SEQ ID NO: 265230 - DNA, 25 bp, Mus musculus
ctactcgctccaaagatcctgtctc

SEQ ID NO: 265231 - DNA, 25 bp, Mus musculus
ctactcgctccaaaggctgcctgct

SEQ ID NO: 265232 - DNA, 25 bp, Mus musculus
ctactcggggactggacagatggag

SEQ ID NO: 265233 - DNA, 25 bp, Mus musculus
ctactcgtccagctcaagtctctgc

SEQ ID NO: 265234 - DNA, 25 bp, Mus musculus
ctactctaacataagctgcttcctg

SEQ ID NO: 265235 - DNA, 25 bp, Mus musculus
ctactctaacataagtcttcttttt

SEQ ID NO: 265236 - DNA, 25 bp, Mus musculus
ctactctagaggaggcctctaggtc

SEQ ID NO: 265237 - DNA, 25 bp, Mus musculus
ctactctagctcaggatgatatcct

SEQ ID NO: 265238 - DNA, 25 bp, Mus musculus
ctactctagctcaggtagcaacaat

SEQ ID NO: 265239 - DNA, 25 bp, Mus musculus
ctactctagctcaggtttctgtagc

SEQ ID NO: 265240 - DNA, 25 bp, Mus musculus
ctactctcaattagttgacattaaa

SEQ ID NO: 265241 - DNA, 25 bp, Mus musculus
ctactctccaaacagacgatccaga

SEQ ID NO: 265242 - DNA, 25 bp, Mus musculus
ctactctccagggtcttcctggctt

SEQ ID NO: 265243 - DNA, 25 bp, Mus musculus
ctactctcctcaaaactcagattgc

SEQ ID NO: 265244 - DNA, 25 bp, Mus musculus
ctactctcctcgacccatgagcttc

SEQ ID NO: 265245 - DNA, 25 bp, Mus musculus
ctactctctctcaggcacttgtgga

SEQ ID NO: 265246 - DNA, 25 bp, Mus musculus
ctactctctctcaggtctgaacata

SEQ ID NO: 265247 - DNA, 25 bp, Mus musculus
ctactctgacaacctgcttggaaag

SEQ ID NO: 265248 - DNA, 25 bp, Mus musculus
ctactctgagataaagccactcttg

SEQ ID NO: 265249 - DNA, 25 bp, Mus musculus
ctactctgagtgttataggctccag

SEQ ID NO: 265250 - DNA, 25 bp, Mus musculus
ctactctgtccctggcgtggggaca

SEQ ID NO: 265251 - DNA, 25 bp, Mus musculus
ctactctgtctgaagaagagctgga

SEQ ID NO: 265252 - DNA, 25 bp, Mus musculus
ctactctgtgaaggcccgagaccag

SEQ ID NO: 265253 - DNA, 25 bp, Mus musculus
ctactgaaacatgactttctgggac

SEQ ID NO: 265254 - DNA, 25 bp, Mus musculus
ctactgaaccacaagaacccatgta

SEQ ID NO: 265255 - DNA, 25 bp, Mus musculus
ctactgaagctcctgcagactgcag

SEQ ID NO: 265256 - DNA, 25 bp, Mus musculus
ctactgaagctgtggggattgccct

SEQ ID NO: 265257 - DNA, 25 bp, Mus musculus
ctactgacagttgtccgtgtaattg

SEQ ID NO: 265258 - DNA, 25 bp, Mus musculus
ctactgacatgtaccataatgtcac

SEQ ID NO: 265259 - DNA, 25 bp, Mus musculus
ctactgacttgttggcccgtgggat

SEQ ID NO: 265260 - DNA, 25 bp, Mus musculus
ctactgagacaggatttacatggat

SEQ ID NO: 265261 - DNA, 25 bp, Mus musculus
ctactgagcccaggaaactacaacc

SEQ ID NO: 265262 - DNA, 25 bp, Mus musculus
ctactgagggtgtgacttctttaag

SEQ ID NO: 265263 - DNA, 25 bp, Mus musculus
ctactgagtggccaccctttgtggt

SEQ ID NO: 265264 - DNA, 25 bp, Mus musculus
ctactgatagcaaaactccaccaga

SEQ ID NO: 265265 - DNA, 25 bp, Mus musculus
ctactgatagttgccttatcttccg

SEQ ID NO: 265266 - DNA, 25 bp, Mus musculus
ctactgatagttgcggatgacggag

SEQ ID NO: 265267 - DNA, 25 bp, Mus musculus
ctactgatctgtgctctaccgtgtg

SEQ ID NO: 265268 - DNA, 25 bp, Mus musculus
ctactgatctgtggtgctgcacagt

SEQ ID NO: 265269 - DNA, 25 bp, Mus musculus
ctactgattttagctctgatctcac

SEQ ID NO: 265270 - DNA, 25 bp, Mus musculus
ctactgcagagccatcctgactcgg

SEQ ID NO: 265271 - DNA, 25 bp, Mus musculus
ctactgcaggggagccctatcatga

SEQ ID NO: 265272 - DNA, 25 bp, Mus musculus
ctactgcatagctctgtggagcgac

SEQ ID NO: 265273 - DNA, 25 bp, Mus musculus
ctactgccacagtggttccggaagc

SEQ ID NO: 265274 - DNA, 25 bp, Mus musculus
ctactgccagactactggacttgga

SEQ ID NO: 265275 - DNA, 25 bp, Mus musculus
ctactgccagcggactcagaggcac

SEQ ID NO: 265276 - DNA, 25 bp, Mus musculus
ctactgccaggcaatgaacatcgtg

SEQ ID NO: 265277 - DNA, 25 bp, Mus musculus
ctactgccaggctccggtcgaacaa

SEQ ID NO: 265278 - DNA, 25 bp, Mus musculus
ctactgccagtgtctgttgtagact

SEQ ID NO: 265279 - DNA, 25 bp, Mus musculus
ctactgcccactcaacatcagaact

SEQ ID NO: 265280 - DNA, 25 bp, Mus musculus
ctactgcccattgaaaaatctggat

SEQ ID NO: 265281 - DNA, 25 bp, Mus musculus
ctactgcgagcgagaagatgtttgg

SEQ ID NO: 265282 - DNA, 25 bp, Mus musculus
ctactgcgagcgagactatgagaag

SEQ ID NO: 265283 - DNA, 25 bp, Mus musculus
ctactgctaaagggagaaaagacat

SEQ ID NO: 265284 - DNA, 25 bp, Mus musculus
ctactgctatggagcggaattccta

SEQ ID NO: 265285 - DNA, 25 bp, Mus musculus
ctactgctatgggtttcagtcccca

SEQ ID NO: 265286 - DNA, 25 bp, Mus musculus
ctactgctgcctcaggtacaactga

SEQ ID NO: 265287 - DNA, 25 bp, Mus musculus
ctactgctgctttggctaccgctgc

SEQ ID NO: 265288 - DNA, 25 bp, Mus musculus
ctactgctttaaacctaaacagaat

SEQ ID NO: 265289 - DNA, 25 bp, Mus musculus
ctactgctttaaacgacctgatctc

SEQ ID NO: 265290 - DNA, 25 bp, Mus musculus
ctactgctttaaacgtcgattgagt

SEQ ID NO: 265291 - DNA, 25 bp, Mus musculus
ctactggaaccacagggagttaatg

SEQ ID NO: 265292 - DNA, 25 bp, Mus musculus
ctactggaaggtacccagggcatgt

SEQ ID NO: 265293 - DNA, 25 bp, Mus musculus
ctactggaatagctacctcaggctc

SEQ ID NO: 265294 - DNA, 25 bp, Mus musculus
ctactggacatctcccaaacccaag

SEQ ID NO: 265295 - DNA, 25 bp, Mus musculus
ctactggactcaagctctcttgagt

SEQ ID NO: 265296 - DNA, 25 bp, Mus musculus
ctactggagaaaagggtgaacctgg

SEQ ID NO: 265297 - DNA, 25 bp, Mus musculus
ctactggagaaacagggtcatgatg

SEQ ID NO: 265298 - DNA, 25 bp, Mus musculus
ctactggagaagaagtcttggacag

SEQ ID NO: 265299 - DNA, 25 bp, Mus musculus
ctactggagaaggtgcaaaacatgt

SEQ ID NO: 265300 - DNA, 25 bp, Mus musculus
ctactggagatggaagtgtaaatgg

SEQ ID NO: 265301 - DNA, 25 bp, Mus musculus
ctactggagatggacctcctctggt

SEQ ID NO: 265302 - DNA, 25 bp, Mus musculus
ctactggagccaagatgataaatca

SEQ ID NO: 265303 - DNA, 25 bp, Mus musculus
ctactggaggaatgctgggacccag

SEQ ID NO: 265304 - DNA, 25 bp, Mus musculus
ctactggatacaggggtctgtgatg

SEQ ID NO: 265305 - DNA, 25 bp, Mus musculus
ctactggcaaggtggtctacttcac

SEQ ID NO: 265306 - DNA, 25 bp, Mus musculus
ctactggcaaggtggtctatttcac

SEQ ID NO: 265307 - DNA, 25 bp, Mus musculus
ctactggcacgatcctcaccacgat

SEQ ID NO: 265308 - DNA, 25 bp, Mus musculus
ctactggccacaggaccagctgcca

SEQ ID NO: 265309 - DNA, 25 bp, Mus musculus
ctactggccagaaggccagcaacat

SEQ ID NO: 265310 - DNA, 25 bp, Mus musculus
ctactggccctgctctctgctctct

SEQ ID NO: 265311 - DNA, 25 bp, Mus musculus
ctactggcgattggggtggtcctgc

SEQ ID NO: 265312 - DNA, 25 bp, Mus musculus
ctactggctgccacgcagactgtat

SEQ ID NO: 265313 - DNA, 25 bp, Mus musculus
ctactggtcataaaggttccagatg

SEQ ID NO: 265314 - DNA, 25 bp, Mus musculus
ctactgtaggaacccagcccaacct

SEQ ID NO: 265315 - DNA, 25 bp, Mus musculus
ctactgtatgcccggagcacagata

SEQ ID NO: 265316 - DNA, 25 bp, Mus musculus
ctactgtatgccgggagcacagata

SEQ ID NO: 265317 - DNA, 25 bp, Mus musculus
ctactgtcatccttgtctcattggg

SEQ ID NO: 265318 - DNA, 25 bp, Mus musculus
ctactgtccagaaagcgaccataac

SEQ ID NO: 265319 - DNA, 25 bp, Mus musculus
ctactgtcccggtgtgccagccttc

SEQ ID NO: 265320 - DNA, 25 bp, Mus musculus
ctactgtctgccagccaggtgccca

SEQ ID NO: 265321 - DNA, 25 bp, Mus musculus
ctactgtgaaggtgtggtccggtgt

SEQ ID NO: 265322 - DNA, 25 bp, Mus musculus
ctactgtgatctactgctgagaaga

SEQ ID NO: 265323 - DNA, 25 bp, Mus musculus
ctactgtgatctactgtacagagct

SEQ ID NO: 265324 - DNA, 25 bp, Mus musculus
ctactgtgccatggaagggtctgtt

SEQ ID NO: 265325 - DNA, 25 bp, Mus musculus
ctactgtgcgcaatggatctgtccg

SEQ ID NO: 265326 - DNA, 25 bp, Mus musculus
ctactgtggggtatccgagtggtga

SEQ ID NO: 265327 - DNA, 25 bp, Mus musculus
ctactgttcaaaatcgaacaccaaa

SEQ ID NO: 265328 - DNA, 25 bp, Mus musculus
ctactgttcctacggtttcacaagg

SEQ ID NO: 265329 - DNA, 25 bp, Mus musculus
ctactgtttacagtacagcaataac

SEQ ID NO: 265330 - DNA, 25 bp, Mus musculus
ctactgtttcaacttctactactaa

SEQ ID NO: 265331 - DNA, 25 bp, Mus musculus
ctactgtttcctgaactcggaaggt

SEQ ID NO: 265332 - DNA, 25 bp, Mus musculus
ctactgtttcctgatgcttttgggt

SEQ ID NO: 265333 - DNA, 25 bp, Mus musculus
ctacttaaaccagaatgcatacaca

SEQ ID NO: 265334 - DNA, 25 bp, Mus musculus
ctacttaaaccaggtttgcatgcag

SEQ ID NO: 265335 - DNA, 25 bp, Mus musculus
ctacttaaagcctttatcttctgag

SEQ ID NO: 265336 - DNA, 25 bp, Mus musculus
ctacttaaaggctttatcttctgag

SEQ ID NO: 265337 - DNA, 25 bp, Mus musculus
ctacttaccatcataacagcactac

SEQ ID NO: 265338 - DNA, 25 bp, Mus musculus
ctacttaccatcataggccagttca

SEQ ID NO: 265339 - DNA, 25 bp, Mus musculus
ctacttaccatggcattgatatgaa

SEQ ID NO: 265340 - DNA, 25 bp, Mus musculus
ctacttaccatgggaaggtgtcttg

SEQ ID NO: 265341 - DNA, 25 bp, Mus musculus
ctacttaccatgggcttcactgtat

SEQ ID NO: 265342 - DNA, 25 bp, Mus musculus
ctacttacgaaggaagtggttccag

SEQ ID NO: 265343 - DNA, 25 bp, Mus musculus
ctacttactctggatccaagacact

SEQ ID NO: 265344 - DNA, 25 bp, Mus musculus
ctacttagaaccaccataacacaaa

SEQ ID NO: 265345 - DNA, 25 bp, Mus musculus
ctacttattcaaagactcctggaag

SEQ ID NO: 265346 - DNA, 25 bp, Mus musculus
ctacttattcaaagttgtccgtgta

SEQ ID NO: 265347 - DNA, 25 bp, Mus musculus
ctacttcaaagccaaggactacgag

SEQ ID NO: 265348 - DNA, 25 bp, Mus musculus
ctacttcaaaggtggtgaaagtgaa

SEQ ID NO: 265349 - DNA, 25 bp, Mus musculus
ctacttcaagggccaacggcagact

SEQ ID NO: 265350 - DNA, 25 bp, Mus musculus
ctacttcagaaacagacctcgatgc

SEQ ID NO: 265351 - DNA, 25 bp, Mus musculus
ctacttcagaaacatctcctttcag

SEQ ID NO: 265352 - DNA, 25 bp, Mus musculus
ctacttcagcaggtccctgcatccc

SEQ ID NO: 265353 - DNA, 25 bp, Mus musculus
ctacttcatgataagaaccaacttc

SEQ ID NO: 265354 - DNA, 25 bp, Mus musculus
ctacttcatgataagggaagaagac

SEQ ID NO: 265355 - DNA, 25 bp, Mus musculus
ctacttcattgaccataacacaaag

SEQ ID NO: 265356 - DNA, 25 bp, Mus musculus
ctacttcattgatcataatacgaag

SEQ ID NO: 265357 - DNA, 25 bp, Mus musculus
ctacttccagaacatttaaaagatg

SEQ ID NO: 265358 - DNA, 25 bp, Mus musculus
ctacttccataattgtgtggattct

SEQ ID NO: 265359 - DNA, 25 bp, Mus musculus
ctacttccctggatcaataagtcgg

SEQ ID NO: 265360 - DNA, 25 bp, Mus musculus
ctacttcctcgaggcctacaattca

SEQ ID NO: 265361 - DNA, 25 bp, Mus musculus
ctacttcctggatgcgttaagatct

SEQ ID NO: 265362 - DNA, 25 bp, Mus musculus
ctacttcgcgtgggctgtcttctgg

SEQ ID NO: 265363 - DNA, 25 bp, Mus musculus
ctacttctaccaggcggaagatgga

SEQ ID NO: 265364 - DNA, 25 bp, Mus musculus
ctacttctcaaggaaacttcattct

SEQ ID NO: 265365 - DNA, 25 bp, Mus musculus
ctacttctcaaggaggcgcttccat

SEQ ID NO: 265366 - DNA, 25 bp, Mus musculus
ctacttctccaaagccaagcccgat

SEQ ID NO: 265367 - DNA, 25 bp, Mus musculus
ctacttctccaaaggtctgtcaaat

SEQ ID NO: 265368 - DNA, 25 bp, Mus musculus
ctacttctccaaggaaaaggaatcc

SEQ ID NO: 265369 - DNA, 25 bp, Mus musculus
ctacttctcctggacgtgcgaccgc

SEQ ID NO: 265370 - DNA, 25 bp, Mus musculus
ctacttctcctggcaacgatatccc

SEQ ID NO: 265371 - DNA, 25 bp, Mus musculus
ctacttctctgtcagcacagggtat

SEQ ID NO: 265372 - DNA, 25 bp, Mus musculus
ctacttctgggaacatcatgacaac

SEQ ID NO: 265373 - DNA, 25 bp, Mus musculus
ctacttctgtagagatttggcccag

SEQ ID NO: 265374 - DNA, 25 bp, Mus musculus
ctacttctgtgccaggctgtttgat

SEQ ID NO: 265375 - DNA, 25 bp, Mus musculus
ctacttcttcagctgcagtgttgaa

SEQ ID NO: 265376 - DNA, 25 bp, Mus musculus
ctacttcttcaggttccggaagcag

SEQ ID NO: 265377 - DNA, 25 bp, Mus musculus
ctacttcttcagttaccctgcagtt

SEQ ID NO: 265378 - DNA, 25 bp, Mus musculus
ctacttgcagattctcttctggctc

SEQ ID NO: 265379 - DNA, 25 bp, Mus musculus
ctacttgcaggccacagacaagcgg

SEQ ID NO: 265380 - DNA, 25 bp, Mus musculus
ctacttgccagctggacatcaacga

SEQ ID NO: 265381 - DNA, 25 bp, Mus musculus
ctacttgccagctggacgccaatga

SEQ ID NO: 265382 - DNA, 25 bp, Mus musculus
ctacttgccgtccggtggagagtac

SEQ ID NO: 265383 - DNA, 25 bp, Mus musculus
ctacttggagccctataataaagaa

SEQ ID NO: 265384 - DNA, 25 bp, Mus musculus
ctacttggcaccggtgcagccttgc

SEQ ID NO: 265385 - DNA, 25 bp, Mus musculus
ctacttggccttgatgaggagtggg

SEQ ID NO: 265386 - DNA, 25 bp, Mus musculus
ctacttggttcggtacatgggctgt

SEQ ID NO: 265387 - DNA, 25 bp, Mus musculus
ctacttgtcagattgctgcccggga

SEQ ID NO: 265388 - DNA, 25 bp, Mus musculus
ctacttgtgctggaggtgtccaaag

SEQ ID NO: 265389 - DNA, 25 bp, Mus musculus
ctactttaaaggcaaatggaagata

SEQ ID NO: 265390 - DNA, 25 bp, Mus musculus
ctactttaagggactgatggacggc

SEQ ID NO: 265391 - DNA, 25 bp, Mus musculus
ctactttaatggtgagtacgcaggt

SEQ ID NO: 265392 - DNA, 25 bp, Mus musculus
ctactttacatgctcttcctcatgg

SEQ ID NO: 265393 - DNA, 25 bp, Mus musculus
ctactttacctctctgcagaaagcc

SEQ ID NO: 265394 - DNA, 25 bp, Mus musculus
ctactttatcaaagtgatctcagcg

SEQ ID NO: 265395 - DNA, 25 bp, Mus musculus
ctactttcattctctttacagggaa

SEQ ID NO: 265396 - DNA, 25 bp, Mus musculus
ctactttcattctttagtaacaaat

SEQ ID NO: 265397 - DNA, 25 bp, Mus musculus
ctactttctgctttcatctccgtac

SEQ ID NO: 265398 - DNA, 25 bp, Mus musculus
ctacttttaagatttttgaagacta

SEQ ID NO: 265399 - DNA, 25 bp, Mus musculus
ctacttttccagaagaccagtttcc

SEQ ID NO: 265400 - DNA, 25 bp, Mus musculus
ctagaaaaagaattcttgaagtcat

SEQ ID NO: 265401 - DNA, 25 bp, Mus musculus
ctagaaaacaactcccagacctaca

SEQ ID NO: 265402 - DNA, 25 bp, Mus musculus
ctagaaaacaatattgatgggcagt

SEQ ID NO: 265403 - DNA, 25 bp, Mus musculus
ctagaaaagcacagacgagctaaac

SEQ ID NO: 265404 - DNA, 25 bp, Mus musculus
ctagaaacaaaggctagtctaccca

SEQ ID NO: 265405 - DNA, 25 bp, Mus musculus
ctagaaacagaaaattcatttgcaa

SEQ ID NO: 265406 - DNA, 25 bp, Mus musculus
ctagaaagagaaatggattccctgc

SEQ ID NO: 265407 - DNA, 25 bp, Mus musculus
ctagaaagcagatggaaaggcagcg

SEQ ID NO: 265408 - DNA, 25 bp, Mus musculus
ctagaaagcggcctgacctgctgaa

SEQ ID NO: 265409 - DNA, 25 bp, Mus musculus
ctagaaagcgggactttgccagcga

SEQ ID NO: 265410 - DNA, 25 bp, Mus musculus
ctagaaaggaagatcctggccctga

SEQ ID NO: 265411 - DNA, 25 bp, Mus musculus
ctagaaatataatagatgtggtatc

SEQ ID NO: 265412 - DNA, 25 bp, Mus musculus
ctagaaatatagctcccgttacttc

SEQ ID NO: 265413 - DNA, 25 bp, Mus musculus
ctagaaatatgcggctatggatgtt

SEQ ID NO: 265414 - DNA, 25 bp, Mus musculus
ctagaaatggcccatgattttgttc

SEQ ID NO: 265415 - DNA, 25 bp, Mus musculus
ctagaaatggcccatgtgctctgta

SEQ ID NO: 265416 - DNA, 25 bp, Mus musculus
ctagaaatggcccattgaaaagagt

SEQ ID NO: 265417 - DNA, 25 bp, Mus musculus
ctagaacaaaaggaagccagatgcc

SEQ ID NO: 265418 - DNA, 25 bp, Mus musculus
ctagaacaacagcgacagctatttg

SEQ ID NO: 265419 - DNA, 25 bp, Mus musculus
ctagaacaacaggtgttgggagccc

SEQ ID NO: 265420 - DNA, 25 bp, Mus musculus
ctagaacagatggaaagtgggaagc

SEQ ID NO: 265421 - DNA, 25 bp, Mus musculus
ctagaacataagcgtattatttatg

SEQ ID NO: 265422 - DNA, 25 bp, Mus musculus
ctagaaccacaacccaccaagcagt

SEQ ID NO: 265423 - DNA, 25 bp, Mus musculus
ctagaacccacagagatataaacta

SEQ ID NO: 265424 - DNA, 25 bp, Mus musculus
ctagaacccgataatgctgaggctt

SEQ ID NO: 265425 - DNA, 25 bp, Mus musculus
ctagaaccctcaaccgtgttaggag

SEQ ID NO: 265426 - DNA, 25 bp, Mus musculus
ctagaactgtatttggaataaccac

SEQ ID NO: 265427 - DNA, 25 bp, Mus musculus
ctagaagaaaagaaaaatcaagaac

SEQ ID NO: 265428 - DNA, 25 bp, Mus musculus
ctagaagaaaagtttctgtttctat

SEQ ID NO: 265429 - DNA, 25 bp, Mus musculus
ctagaagaaagcagggctttctgtg

SEQ ID NO: 265430 - DNA, 25 bp, Mus musculus
ctagaagaagaagctgaagtcattt

SEQ ID NO: 265431 - DNA, 25 bp, Mus musculus
ctagaagaagaggaatgggtacggc

SEQ ID NO: 265432 - DNA, 25 bp, Mus musculus
ctagaagagcagtcgggtgctctta

SEQ ID NO: 265433 - DNA, 25 bp, Mus musculus
ctagaagaggcaatattgataatac

SEQ ID NO: 265434 - DNA, 25 bp, Mus musculus
ctagaagcctggcaaaatgaaggat

SEQ ID NO: 265435 - DNA, 25 bp, Mus musculus
ctagaagctgagcagaaaggcgctc

SEQ ID NO: 265436 - DNA, 25 bp, Mus musculus
ctagaagctgagcaggcggaggaag

SEQ ID NO: 265437 - DNA, 25 bp, Mus musculus
ctagaagctgagggttcaaggaagg

SEQ ID NO: 265438 - DNA, 25 bp, Mus musculus
ctagaaggaaggtatcatgccaaag

SEQ ID NO: 265439 - DNA, 25 bp, Mus musculus
ctagaaggaggattattaattggag

SEQ ID NO: 265440 - DNA, 25 bp, Mus musculus
ctagaaggaggattctgataatcag

SEQ ID NO: 265441 - DNA, 25 bp, Mus musculus
ctagaagtaagcggactggaaacag

SEQ ID NO: 265442 - DNA, 25 bp, Mus musculus
ctagaagtcggccaaaactgttatg

SEQ ID NO: 265443 - DNA, 25 bp, Mus musculus
ctagaagtggtacaaatggacctac

SEQ ID NO: 265444 - DNA, 25 bp, Mus musculus
ctagaagtggtagaaatggacctac

SEQ ID NO: 265445 - DNA, 25 bp, Mus musculus
ctagaagttggtagtttacaaatga

SEQ ID NO: 265446 - DNA, 25 bp, Mus musculus
ctagaataatagcagtggcagcaat

SEQ ID NO: 265447 - DNA, 25 bp, Mus musculus
ctagaatacgcgtctgatggctata

SEQ ID NO: 265448 - DNA, 25 bp, Mus musculus
ctagaatatgacttgggtcagcaag

SEQ ID NO: 265449 - DNA, 25 bp, Mus musculus
ctagaatatggtggcccatatttga

SEQ ID NO: 265450 - DNA, 25 bp, Mus musculus
ctagaatgggccaagcagaaaagaa

SEQ ID NO: 265451 - DNA, 25 bp, Mus musculus
ctagaattaaaggtttgggatcaaa

SEQ ID NO: 265452 - DNA, 25 bp, Mus musculus
ctagaattcgatttcagaaatatag

SEQ ID NO: 265453 - DNA, 25 bp, Mus musculus
ctagaattcggtgggctggtatgtc

SEQ ID NO: 265454 - DNA, 25 bp, Mus musculus
ctagacacacagcccatcctcagcc

SEQ ID NO: 265455 - DNA, 25 bp, Mus musculus
ctagacacagggcccatcatggctg

SEQ ID NO: 265456 - DNA, 25 bp, Mus musculus
ctagacactgagggccgatatctct

SEQ ID NO: 265457 - DNA, 25 bp, Mus musculus
ctagacaggcaggacaggtcctgga

SEQ ID NO: 265458 - DNA, 25 bp, Mus musculus
ctagacatacagtatgctcctgaag

SEQ ID NO: 265459 - DNA, 25 bp, Mus musculus
ctagacatgtacgatggctttctgt

SEQ ID NO: 265460 - DNA, 25 bp, Mus musculus
ctagaccaactttgcagagttcaga

SEQ ID NO: 265461 - DNA, 25 bp, Mus musculus
ctagaccacagtaaggtgtaacacg

SEQ ID NO: 265462 - DNA, 25 bp, Mus musculus
ctagacccaggagttttgctctgca

SEQ ID NO: 265463 - DNA, 25 bp, Mus musculus
ctagaccctgataatgcactgctcc

SEQ ID NO: 265464 - DNA, 25 bp, Mus musculus
ctagaccctggagggaagggtggtg

SEQ ID NO: 265465 - DNA, 25 bp, Mus musculus
ctagaccgtaggggttcacgaacca

SEQ ID NO: 265466 - DNA, 25 bp, Mus musculus
ctagacgaaggaaacagcaagacat

SEQ ID NO: 265467 - DNA, 25 bp, Mus musculus
ctagacgccaaggttgtggagctga

SEQ ID NO: 265468 - DNA, 25 bp, Mus musculus
ctagactacagggaaagccacccac

SEQ ID NO: 265469 - DNA, 25 bp, Mus musculus
ctagactcagatcagaagagcagca

SEQ ID NO: 265470 - DNA, 25 bp, Mus musculus
ctagactcagatcagccttgcagca

SEQ ID NO: 265471 - DNA, 25 bp, Mus musculus
ctagactcagatcagctgggaaggg

SEQ ID NO: 265472 - DNA, 25 bp, Mus musculus
ctagactgggtctatggctatcgag

SEQ ID NO: 265473 - DNA, 25 bp, Mus musculus
ctagacttcggatccagcaatgcct

SEQ ID NO: 265474 - DNA, 25 bp, Mus musculus
ctagacttgcctaagttggaaaagc

SEQ ID NO: 265475 - DNA, 25 bp, Mus musculus
ctagacttggtggttctccgttctg

SEQ ID NO: 265476 - DNA, 25 bp, Mus musculus
ctagacttgttaagtttctagtggg

SEQ ID NO: 265477 - DNA, 25 bp, Mus musculus
ctagactttcccaataaagactgag

SEQ ID NO: 265478 - DNA, 25 bp, Mus musculus
ctagactttctgagtaccatggaga

SEQ ID NO: 265479 - DNA, 25 bp, Mus musculus
ctagactttgaggaggaagaagtgc

SEQ ID NO: 265480 - DNA, 25 bp, Mus musculus
ctagagaaatatgtgcatgagctca

SEQ ID NO: 265481 - DNA, 25 bp, Mus musculus
ctagagaacagcagaggttcagaag

SEQ ID NO: 265482 - DNA, 25 bp, Mus musculus
ctagagaacagcagctccattttat

SEQ ID NO: 265483 - DNA, 25 bp, Mus musculus
ctagagaagaacaaggtattgacaa

SEQ ID NO: 265484 - DNA, 25 bp, Mus musculus
ctagagaagacggaatggttccatt

SEQ ID NO: 265485 - DNA, 25 bp, Mus musculus
ctagagaagagttggttgatcgtgt

SEQ ID NO: 265486 - DNA, 25 bp, Mus musculus
ctagagaaggagctggagcagagcc

SEQ ID NO: 265487 - DNA, 25 bp, Mus musculus
ctagagaataatcaggttttaaaat

SEQ ID NO: 265488 - DNA, 25 bp, Mus musculus
ctagagacacggaagcctgtgctgg

SEQ ID NO: 265489 - DNA, 25 bp, Mus musculus
ctagagaccattgacaaagccaact

SEQ ID NO: 265490 - DNA, 25 bp, Mus musculus
ctagagagaacttacctaaagacgt

SEQ ID NO: 265491 - DNA, 25 bp, Mus musculus
ctagagagcaagttcattacagcat

SEQ ID NO: 265492 - DNA, 25 bp, Mus musculus
ctagagatcagtcggtactccctgg

SEQ ID NO: 265493 - DNA, 25 bp, Mus musculus
ctagagcataaggtttatctcaagt

SEQ ID NO: 265494 - DNA, 25 bp, Mus musculus
ctagagcatggaaaaccgtggactt

SEQ ID NO: 265495 - DNA, 25 bp, Mus musculus
ctagagccccgaaggactgctgcag

SEQ ID NO: 265496 - DNA, 25 bp, Mus musculus
ctagagccccgaaggcacacatgat

SEQ ID NO: 265497 - DNA, 25 bp, Mus musculus
ctagagccctccatggacatagtct

SEQ ID NO: 265498 - DNA, 25 bp, Mus musculus
ctagagccgtcaagctgatttatcc

SEQ ID NO: 265499 - DNA, 25 bp, Mus musculus
ctagagcggcgagagtaatccatat

SEQ ID NO: 265500 - DNA, 25 bp, Mus musculus
ctagagcgtgtgggcatcgttctgc

SEQ ID NO: 265501 - DNA, 25 bp, Mus musculus
ctagagctagcgggttatgcctcca

SEQ ID NO: 265502 - DNA, 25 bp, Mus musculus
ctagagctgacgggggtggcaccga

SEQ ID NO: 265503 - DNA, 25 bp, Mus musculus
ctagaggaagcctccatttacagtc

SEQ ID NO: 265504 - DNA, 25 bp, Mus musculus
ctagaggaaggcagagcatgggcct

SEQ ID NO: 265505 - DNA, 25 bp, Mus musculus
ctagaggagacagaggtattgacct

SEQ ID NO: 265506 - DNA, 25 bp, Mus musculus
ctagaggaggatgccctctgaagcc

SEQ ID NO: 265507 - DNA, 25 bp, Mus musculus
ctagaggaggcctcattgcatacat

SEQ ID NO: 265508 - DNA, 25 bp, Mus musculus
ctagaggaggcctcctcctggactg

SEQ ID NO: 265509 - DNA, 25 bp, Mus musculus
ctagaggaggcctctaggtcgccat

SEQ ID NO: 265510 - DNA, 25 bp, Mus musculus
ctagagggatggatgtgattttttc

SEQ ID NO: 265511 - DNA, 25 bp, Mus musculus
ctagagggcagagacaatgaatatg

SEQ ID NO: 265512 - DNA, 25 bp, Mus musculus
ctagaggtaaaggtcgatcgcgatc

SEQ ID NO: 265513 - DNA, 25 bp, Mus musculus
ctagaggtgggccaaggattctccc

SEQ ID NO: 265514 - DNA, 25 bp, Mus musculus
ctagagtatgagaacttctatgcgg

SEQ ID NO: 265515 - DNA, 25 bp, Mus musculus
ctagagtcattgcaggcccggcaca

SEQ ID NO: 265516 - DNA, 25 bp, Mus musculus
ctagagtcccagacaggcctcatgg

SEQ ID NO: 265517 - DNA, 25 bp, Mus musculus
ctagagtcccagctgcctgctgaat

SEQ ID NO: 265518 - DNA, 25 bp, Mus musculus
ctagagttcaaaggcggcgagtcca

SEQ ID NO: 265519 - DNA, 25 bp, Mus musculus
ctagagtttatggatccgcctccga

SEQ ID NO: 265520 - DNA, 25 bp, Mus musculus
ctagataagaaggacttcctaggga

SEQ ID NO: 265521 - DNA, 25 bp, Mus musculus
ctagatagtccttgtgaggcccagc

SEQ ID NO: 265522 - DNA, 25 bp, Mus musculus
ctagatatcaaaatcgggtcatgca

SEQ ID NO: 265523 - DNA, 25 bp, Mus musculus
ctagatatcaatctgtggttctctg

SEQ ID NO: 265524 - DNA, 25 bp, Mus musculus
ctagatcacagtcaagcaggtagag

SEQ ID NO: 265525 - DNA, 25 bp, Mus musculus
ctagatcctgaagatgttgctgtgc

SEQ ID NO: 265526 - DNA, 25 bp, Mus musculus
ctagatcctgaatgttgctgtgcat

SEQ ID NO: 265527 - DNA, 25 bp, Mus musculus
ctagatctaaggaactaatgaaaca

SEQ ID NO: 265528 - DNA, 25 bp, Mus musculus
ctagatctttcctggctagaccaca

SEQ ID NO: 265529 - DNA, 25 bp, Mus musculus
ctagatctttcctggtccatcaacc

SEQ ID NO: 265530 - DNA, 25 bp, Mus musculus
ctagatgaagaaaagcccctttcct

SEQ ID NO: 265531 - DNA, 25 bp, Mus musculus
ctagatgaagaaaagcgcagaagag

SEQ ID NO: 265532 - DNA, 25 bp, Mus musculus
ctagatgaggatagggttgtcgatg

SEQ ID NO: 265533 - DNA, 25 bp, Mus musculus
ctagatgatatggagagcaccactt

SEQ ID NO: 265534 - DNA, 25 bp, Mus musculus
ctagatgatatggcccactatgact

SEQ ID NO: 265535 - DNA, 25 bp, Mus musculus
ctagatgcttacagctcaaaggtga

SEQ ID NO: 265536 - DNA, 25 bp, Mus musculus
ctagatggaacaagtaaggatagat

SEQ ID NO: 265537 - DNA, 25 bp, Mus musculus
ctagattcatcggagaaggaactca

SEQ ID NO: 265538 - DNA, 25 bp, Mus musculus
ctagattcatcgttttgcgaggtgg

SEQ ID NO: 265539 - DNA, 25 bp, Mus musculus
ctagattgagatgagcagctctcaa

SEQ ID NO: 265540 - DNA, 25 bp, Mus musculus
ctagatttaaagtgttcctaggatc

SEQ ID NO: 265541 - DNA, 25 bp, Mus musculus
ctagattttagcaggtcaatggcca

SEQ ID NO: 265542 - DNA, 25 bp, Mus musculus
ctagcaaagaggaaagcgattggcc

SEQ ID NO: 265543 - DNA, 25 bp, Mus musculus
ctagcaaagaggctcctgacagtgc

SEQ ID NO: 265544 - DNA, 25 bp, Mus musculus
ctagcaaagcactgctgttcttgag

SEQ ID NO: 265545 - DNA, 25 bp, Mus musculus
ctagcaaatcagaagttacgagact

SEQ ID NO: 265546 - DNA, 25 bp, Mus musculus
ctagcaaatcaggaggtgcttgtct

SEQ ID NO: 265547 - DNA, 25 bp, Mus musculus
ctagcaacaaggaatcaaaaatgaa

SEQ ID NO: 265548 - DNA, 25 bp, Mus musculus
ctagcaagcagctatggccggtgat

SEQ ID NO: 265549 - DNA, 25 bp, Mus musculus
ctagcaagcaggcatgacttgccaa

SEQ ID NO: 265550 - DNA, 25 bp, Mus musculus
ctagcaatcagaacccaagagatga

SEQ ID NO: 265551 - DNA, 25 bp, Mus musculus
ctagcaatctctgcacctttgggga

SEQ ID NO: 265552 - DNA, 25 bp, Mus musculus
ctagcacaaggtgactacgagaagg

SEQ ID NO: 265553 - DNA, 25 bp, Mus musculus
ctagcaccaagaaattcattcctga

SEQ ID NO: 265554 - DNA, 25 bp, Mus musculus
ctagcacccaggttactcggcggcc

SEQ ID NO: 265555 - DNA, 25 bp, Mus musculus
ctagcacctattatggtaactttcg

SEQ ID NO: 265556 - DNA, 25 bp, Mus musculus
ctagcacgaaagagaccagctatgg

SEQ ID NO: 265557 - DNA, 25 bp, Mus musculus
ctagcactaacgtgaccctggctga

SEQ ID NO: 265558 - DNA, 25 bp, Mus musculus
ctagcactaactgacctgggcctgg

SEQ ID NO: 265559 - DNA, 25 bp, Mus musculus
ctagcactcacagcagggaccctgg

SEQ ID NO: 265560 - DNA, 25 bp, Mus musculus
ctagcagagcaggatccaagtgaac

SEQ ID NO: 265561 - DNA, 25 bp, Mus musculus
ctagcagatgaagatctcaggccca

SEQ ID NO: 265562 - DNA, 25 bp, Mus musculus
ctagcagattttaaactgtttcaga

SEQ ID NO: 265563 - DNA, 25 bp, Mus musculus
ctagcagcagaaagagccgtctctc

SEQ ID NO: 265564 - DNA, 25 bp, Mus musculus
ctagcagcccaggatcaaagaatcc

SEQ ID NO: 265565 - DNA, 25 bp, Mus musculus
ctagcagcccaggggaacggggggt

SEQ ID NO: 265566 - DNA, 25 bp, Mus musculus
ctagcagcccaggggtggaggagaa

SEQ ID NO: 265567 - DNA, 25 bp, Mus musculus
ctagcaggtctcaaaagcgctcctg

SEQ ID NO: 265568 - DNA, 25 bp, Mus musculus
ctagcagtaatggtaagtatactgt

SEQ ID NO: 265569 - DNA, 25 bp, Mus musculus
ctagcagtaatggtccatcctgata

SEQ ID NO: 265570 - DNA, 25 bp, Mus musculus
ctagcagtgcaaggtgtccgcaaat

SEQ ID NO: 265571 - DNA, 25 bp, Mus musculus
ctagcataattcagaaaatcagaaa

SEQ ID NO: 265572 - DNA, 25 bp, Mus musculus
ctagcatcaaagatcttcaggattt

SEQ ID NO: 265573 - DNA, 25 bp, Mus musculus
ctagcatcaaaggccagaaacatca

SEQ ID NO: 265574 - DNA, 25 bp, Mus musculus
ctagcatcagggcccatttggaggc

SEQ ID NO: 265575 - DNA, 25 bp, Mus musculus
ctagcatctaggaggctttgatgag

SEQ ID NO: 265576 - DNA, 25 bp, Mus musculus
ctagcatctgggaagaagccaccat

SEQ ID NO: 265577 - DNA, 25 bp, Mus musculus
ctagcatgagaacaaatataaagcc

SEQ ID NO: 265578 - DNA, 25 bp, Mus musculus
ctagcatgagcatcagttggggaac

SEQ ID NO: 265579 - DNA, 25 bp, Mus musculus
ctagcatgttgtccggcattggaag

SEQ ID NO: 265580 - DNA, 25 bp, Mus musculus
ctagcattacaaggaggtgcccctg

SEQ ID NO: 265581 - DNA, 25 bp, Mus musculus
ctagccaaagatatgaggatcaatg

SEQ ID NO: 265582 - DNA, 25 bp, Mus musculus
ctagccagaaaggtccacaccagtc

SEQ ID NO: 265583 - DNA, 25 bp, Mus musculus
ctagccagaaagtttcaggccatcc

SEQ ID NO: 265584 - DNA, 25 bp, Mus musculus
ctagccagtgagcgcatgagctacc

SEQ ID NO: 265585 - DNA, 25 bp, Mus musculus
ctagccagtgcctaaggaagaaccc

SEQ ID NO: 265586 - DNA, 25 bp, Mus musculus
ctagcccaacgctagaacatacaac

SEQ ID NO: 265587 - DNA, 25 bp, Mus musculus
ctagccccactccaggatcttttcc

SEQ ID NO: 265588 - DNA, 25 bp, Mus musculus
ctagccccactccaggcacactggc

SEQ ID NO: 265589 - DNA, 25 bp, Mus musculus
ctagccccagactggtgaatgagag

SEQ ID NO: 265590 - DNA, 25 bp, Mus musculus
ctagccccaggctcaatttgagaac

SEQ ID NO: 265591 - DNA, 25 bp, Mus musculus
ctagccccagtcattgctgagacat

SEQ ID NO: 265592 - DNA, 25 bp, Mus musculus
ctagccccagtgtaagcttcaagct

SEQ ID NO: 265593 - DNA, 25 bp, Mus musculus
ctagccctctgattgaaattttctt

SEQ ID NO: 265594 - DNA, 25 bp, Mus musculus
ctagccctgagacagactcacaccg

SEQ ID NO: 265595 - DNA, 25 bp, Mus musculus
ctagccgagggagaggcactgatgg

SEQ ID NO: 265596 - DNA, 25 bp, Mus musculus
ctagccgctgtggtgactgggctgg

SEQ ID NO: 265597 - DNA, 25 bp, Mus musculus
ctagcctaagttctgagaagtcaga

SEQ ID NO: 265598 - DNA, 25 bp, Mus musculus
ctagcctaccagggatggctctgag

SEQ ID NO: 265599 - DNA, 25 bp, Mus musculus
ctagcctacccaggaagaagctcac

SEQ ID NO: 265600 - DNA, 25 bp, Mus musculus
ctagcctcccaggtggaatgaacct

SEQ ID NO: 265601 - DNA, 25 bp, Mus musculus
ctagcctcccgttgttctacacagc

SEQ ID NO: 265602 - DNA, 25 bp, Mus musculus
ctagcctgaatctcctggagaaaga

SEQ ID NO: 265603 - DNA, 25 bp, Mus musculus
ctagcctgtgccttggacggctgtt

SEQ ID NO: 265604 - DNA, 25 bp, Mus musculus
ctagcctttcaaaggtagtttacaa

SEQ ID NO: 265605 - DNA, 25 bp, Mus musculus
ctagcgaaccagtaatggtcagcaa

SEQ ID NO: 265606 - DNA, 25 bp, Mus musculus
ctagcgaggacagaaccatccgagt

SEQ ID NO: 265607 - DNA, 25 bp, Mus musculus
ctagcgaggacagccccttgctctg

SEQ ID NO: 265608 - DNA, 25 bp, Mus musculus
ctagcgccacaggcatggggaggat

SEQ ID NO: 265609 - DNA, 25 bp, Mus musculus
ctagcgccgagagatagtgctggag

SEQ ID NO: 265610 - DNA, 25 bp, Mus musculus
ctagcgccgagagattggagaatga

SEQ ID NO: 265611 - DNA, 25 bp, Mus musculus
ctagcggacccagttcagcttgctc

SEQ ID NO: 265612 - DNA, 25 bp, Mus musculus
ctagcggccgccagtctccacagag

SEQ ID NO: 265613 - DNA, 25 bp, Mus musculus
ctagcgggtaagcagttatgcctcc

SEQ ID NO: 265614 - DNA, 25 bp, Mus musculus
ctagcggtccttggacttcaggaac

SEQ ID NO: 265615 - DNA, 25 bp, Mus musculus
ctagcgtctcagagtgcctggtgaa

SEQ ID NO: 265616 - DNA, 25 bp, Mus musculus
ctagcgtctcagccaacaagatagc

SEQ ID NO: 265617 - DNA, 25 bp, Mus musculus
ctagctaatggggtagctgggagta

SEQ ID NO: 265618 - DNA, 25 bp, Mus musculus
ctagctacagaactgtgccggatca

SEQ ID NO: 265619 - DNA, 25 bp, Mus musculus
ctagctactccaggtacgtaggtgc

SEQ ID NO: 265620 - DNA, 25 bp, Mus musculus
ctagctagaggcaactcgccatgat

SEQ ID NO: 265621 - DNA, 25 bp, Mus musculus
ctagctagagggtacaaaggattta

SEQ ID NO: 265622 - DNA, 25 bp, Mus musculus
ctagctagtccgtgtactttgtggg

SEQ ID NO: 265623 - DNA, 25 bp, Mus musculus
ctagctagttcaggcactggctcca

SEQ ID NO: 265624 - DNA, 25 bp, Mus musculus
ctagctatctggaggtgacccctga

SEQ ID NO: 265625 - DNA, 25 bp, Mus musculus
ctagctcacgccgagcagctgcccc

SEQ ID NO: 265626 - DNA, 25 bp, Mus musculus
ctagctcgagaagggcagttatacg

SEQ ID NO: 265627 - DNA, 25 bp, Mus musculus
ctagctcgagaagtctgatcagcgg

SEQ ID NO: 265628 - DNA, 25 bp, Mus musculus
ctagctctcagagctcctcctccca

SEQ ID NO: 265629 - DNA, 25 bp, Mus musculus
ctagctcttcagctctggggacact

SEQ ID NO: 265630 - DNA, 25 bp, Mus musculus
ctagctcttcaggactgggcagctc

SEQ ID NO: 265631 - DNA, 25 bp, Mus musculus
ctagctgaagtgagcaaaccaacat

SEQ ID NO: 265632 - DNA, 25 bp, Mus musculus
ctagctgacctcgaggaagtggaca

SEQ ID NO: 265633 - DNA, 25 bp, Mus musculus
ctagctgactatgctcactctttgg

SEQ ID NO: 265634 - DNA, 25 bp, Mus musculus
ctagctgaggaacatctgattgcct

SEQ ID NO: 265635 - DNA, 25 bp, Mus musculus
ctagctgaggtgcggagctgacccg

SEQ ID NO: 265636 - DNA, 25 bp, Mus musculus
ctagctggaaggactgggcaaagcc

SEQ ID NO: 265637 - DNA, 25 bp, Mus musculus
ctagctgggcaagatggtgtcacat

SEQ ID NO: 265638 - DNA, 25 bp, Mus musculus
ctagctgtcatggacagttacttca

SEQ ID NO: 265639 - DNA, 25 bp, Mus musculus
ctagctgtcgggacacagattgggt

SEQ ID NO: 265640 - DNA, 25 bp, Mus musculus
ctagctgtctacgagaccctgaaga

SEQ ID NO: 265641 - DNA, 25 bp, Mus musculus
ctagctgtctatgagacattgaaaa

SEQ ID NO: 265642 - DNA, 25 bp, Mus musculus
ctagctgtcttactcatcagagttg

SEQ ID NO: 265643 - DNA, 25 bp, Mus musculus
ctagcttcctagagaccaagatcac

SEQ ID NO: 265644 - DNA, 25 bp, Mus musculus
ctagcttgggggctttcaggtagct

SEQ ID NO: 265645 - DNA, 25 bp, Mus musculus
ctaggaaaaaaagtggtcatgctgc

SEQ ID NO: 265646 - DNA, 25 bp, Mus musculus
ctaggaacaaagagaacctgcaccc

SEQ ID NO: 265647 - DNA, 25 bp, Mus musculus
ctaggaacaaagagaccccgaggca

SEQ ID NO: 265648 - DNA, 25 bp, Mus musculus
ctaggaacaaaggtcaggtgcccat

SEQ ID NO: 265649 - DNA, 25 bp, Mus musculus
ctaggaacatgatgaactttcaacc

SEQ ID NO: 265650 - DNA, 25 bp, Mus musculus
ctaggaacatggtgtccatcctgtc

SEQ ID NO: 265651 - DNA, 25 bp, Mus musculus
ctaggaacccgtgaggtcaatatcc

SEQ ID NO: 265652 - DNA, 25 bp, Mus musculus
ctaggaactgtcaggctggtctgct

SEQ ID NO: 265653 - DNA, 25 bp, Mus musculus
ctaggaagaagagaatggaccgggt

SEQ ID NO: 265654 - DNA, 25 bp, Mus musculus
ctaggaagaggaacacgcagcactg

SEQ ID NO: 265655 - DNA, 25 bp, Mus musculus
ctaggaagaggtcagccatgtcatc

SEQ ID NO: 265656 - DNA, 25 bp, Mus musculus
ctaggaagcagaagatgccatactc

SEQ ID NO: 265657 - DNA, 25 bp, Mus musculus
ctaggaagccagtgacgccaagaga

SEQ ID NO: 265658 - DNA, 25 bp, Mus musculus
ctaggaagtatattacaggattcac

SEQ ID NO: 265659 - DNA, 25 bp, Mus musculus
ctaggaatgaagaacggcccctccg

SEQ ID NO: 265660 - DNA, 25 bp, Mus musculus
ctaggaatgaagatggccagctgag

SEQ ID NO: 265661 - DNA, 25 bp, Mus musculus
ctaggacatacccggttacatagga

SEQ ID NO: 265662 - DNA, 25 bp, Mus musculus
ctaggaccggaaagcgtctgcacca

SEQ ID NO: 265663 - DNA, 25 bp, Mus musculus
ctaggacctcgagtataactgcaac

SEQ ID NO: 265664 - DNA, 25 bp, Mus musculus
ctaggactgctgatggaattgtcag

SEQ ID NO: 265665 - DNA, 25 bp, Mus musculus
ctaggagaacttaggcttctttggc

SEQ ID NO: 265666 - DNA, 25 bp, Mus musculus
ctaggagaagcagagcactggcaga

SEQ ID NO: 265667 - DNA, 25 bp, Mus musculus
ctaggagaagggaaatatgctggct

SEQ ID NO: 265668 - DNA, 25 bp, Mus musculus
ctaggagaagggagtaaaggtatca

SEQ ID NO: 265669 - DNA, 25 bp, Mus musculus
ctaggagaatctaggcggcttcagc

SEQ ID NO: 265670 - DNA, 25 bp, Mus musculus
ctaggagaatctagggctcaccatc

SEQ ID NO: 265671 - DNA, 25 bp, Mus musculus
ctaggagacaaggtgagccctagat

SEQ ID NO: 265672 - DNA, 25 bp, Mus musculus
ctaggagagattgatgctgcacctc

SEQ ID NO: 265673 - DNA, 25 bp, Mus musculus
ctaggagagggaaaggtctgaaaag

SEQ ID NO: 265674 - DNA, 25 bp, Mus musculus
ctaggagcagagatcaagttcttga

SEQ ID NO: 265675 - DNA, 25 bp, Mus musculus
ctaggagcggtgtcctgtgccatct

SEQ ID NO: 265676 - DNA, 25 bp, Mus musculus
ctaggagctgggcttgcaggcaagg

SEQ ID NO: 265677 - DNA, 25 bp, Mus musculus
ctaggaggcacggagcacttgtctc

SEQ ID NO: 265678 - DNA, 25 bp, Mus musculus
ctaggaggccctggaccttggtgtg

SEQ ID NO: 265679 - DNA, 25 bp, Mus musculus
ctaggaggccctgttcacctctggg

SEQ ID NO: 265680 - DNA, 25 bp, Mus musculus
ctaggagggattgatgctgcacctc

SEQ ID NO: 265681 - DNA, 25 bp, Mus musculus
ctaggagggattgatgctgcgcctc

SEQ ID NO: 265682 - DNA, 25 bp, Mus musculus
ctaggagggctgaggtacagtcatg

SEQ ID NO: 265683 - DNA, 25 bp, Mus musculus
ctaggaggttggaggctcggatggc

SEQ ID NO: 265684 - DNA, 25 bp, Mus musculus
ctaggataacaggtccagttgtccc

SEQ ID NO: 265685 - DNA, 25 bp, Mus musculus
ctaggataacagtgacgtatgactt

SEQ ID NO: 265686 - DNA, 25 bp, Mus musculus
ctaggatctacaggtgaaagagctg

SEQ ID NO: 265687 - DNA, 25 bp, Mus musculus
ctaggatcttctagtgaacagcgtc

SEQ ID NO: 265688 - DNA, 25 bp, Mus musculus
ctaggatgcgatacaaatctcaaac

SEQ ID NO: 265689 - DNA, 25 bp, Mus musculus
ctaggatgcgatgccctgtggaatc

SEQ ID NO: 265690 - DNA, 25 bp, Mus musculus
ctaggatgctggacgctggatcgcg

SEQ ID NO: 265691 - DNA, 25 bp, Mus musculus
ctaggattgcgattttctaccttgc

SEQ ID NO: 265692 - DNA, 25 bp, Mus musculus
ctaggatttcagtttacccatcatg

SEQ ID NO: 265693 - DNA, 25 bp, Mus musculus
ctaggatttgttgtggctttttaaa

SEQ ID NO: 265694 - DNA, 25 bp, Mus musculus
ctaggcaatgacaccctgtactttt

SEQ ID NO: 265695 - DNA, 25 bp, Mus musculus
ctaggcaatgcactactctccgcca

SEQ ID NO: 265696 - DNA, 25 bp, Mus musculus
ctaggcaccagtctgcgttaagcat

SEQ ID NO: 265697 - DNA, 25 bp, Mus musculus
ctaggcattaaacaggacattcacc

SEQ ID NO: 265698 - DNA, 25 bp, Mus musculus
ctaggccaaaaagagcttggacaga

SEQ ID NO: 265699 - DNA, 25 bp, Mus musculus
ctaggccaaaaagagtgtgcaaaga

SEQ ID NO: 265700 - DNA, 25 bp, Mus musculus
ctaggccagcctggtctccgttatg

SEQ ID NO: 265701 - DNA, 25 bp, Mus musculus
ctaggccctcagatcaatgatgatg

SEQ ID NO: 265702 - DNA, 25 bp, Mus musculus
ctaggcctccaggaggaccttgttg

SEQ ID NO: 265703 - DNA, 25 bp, Mus musculus
ctaggcctccaggaggagactccca

SEQ ID NO: 265704 - DNA, 25 bp, Mus musculus
ctaggcctcgtctaggtgccgcccc

SEQ ID NO: 265705 - DNA, 25 bp, Mus musculus
ctaggcgggaggtgtttctgtttga

SEQ ID NO: 265706 - DNA, 25 bp, Mus musculus
ctaggcgtgcagataaagggagaag

SEQ ID NO: 265707 - DNA, 25 bp, Mus musculus
ctaggcgtgcagtgggagatttttc

SEQ ID NO: 265708 - DNA, 25 bp, Mus musculus
ctaggctataaagagcaaaacaatt

SEQ ID NO: 265709 - DNA, 25 bp, Mus musculus
ctaggctcagaggctgatggtgacc

SEQ ID NO: 265710 - DNA, 25 bp, Mus musculus
ctaggctgagaacggaaacctccac

SEQ ID NO: 265711 - DNA, 25 bp, Mus musculus
ctaggctgaggccaggtctcttaac

SEQ ID NO: 265712 - DNA, 25 bp, Mus musculus
ctaggctgtaagctgtacttcttcc

SEQ ID NO: 265713 - DNA, 25 bp, Mus musculus
ctagggaaagagacagcacggcggc

SEQ ID NO: 265714 - DNA, 25 bp, Mus musculus
ctagggaaagagataacagcagaca

SEQ ID NO: 265715 - DNA, 25 bp, Mus musculus
ctagggaacgggagagtggccttgt

SEQ ID NO: 265716 - DNA, 25 bp, Mus musculus
ctagggaatgaaggtgaagagattg

SEQ ID NO: 265717 - DNA, 25 bp, Mus musculus
ctagggacaagtcactgttctggga

SEQ ID NO: 265718 - DNA, 25 bp, Mus musculus
ctagggacagctggttccgtggctt

SEQ ID NO: 265719 - DNA, 25 bp, Mus musculus
ctagggagccgtgtggagcaaaaat

SEQ ID NO: 265720 - DNA, 25 bp, Mus musculus
ctagggatttgctggttttaggcta

SEQ ID NO: 265721 - DNA, 25 bp, Mus musculus
ctagggcctgcaggtctacagtgct

SEQ ID NO: 265722 - DNA, 25 bp, Mus musculus
ctagggctctgcaggaagcctgctg

SEQ ID NO: 265723 - DNA, 25 bp, Mus musculus
ctagggctggagctgaggagattat

SEQ ID NO: 265724 - DNA, 25 bp, Mus musculus
ctaggggaatctccgaaatcccgca

SEQ ID NO: 265725 - DNA, 25 bp, Mus musculus
ctaggggaatctccggtcccgcaca

SEQ ID NO: 265726 - DNA, 25 bp, Mus musculus
ctaggggcccaggtggacaacatca

SEQ ID NO: 265727 - DNA, 25 bp, Mus musculus
ctaggggctacctcacttacatcac

SEQ ID NO: 265728 - DNA, 25 bp, Mus musculus
ctaggggctcggcaggttcgcttat

SEQ ID NO: 265729 - DNA, 25 bp, Mus musculus
ctaggggcttggcaaatggaatcta

SEQ ID NO: 265730 - DNA, 25 bp, Mus musculus
ctaggggtggtgacgtgctgtgtga

SEQ ID NO: 265731 - DNA, 25 bp, Mus musculus
ctagggttaaaggagacattccaaa

SEQ ID NO: 265732 - DNA, 25 bp, Mus musculus
ctaggtaccacaggtaatctagctg

SEQ ID NO: 265733 - DNA, 25 bp, Mus musculus
ctaggtcagcgaggtattgaagccc

SEQ ID NO: 265734 - DNA, 25 bp, Mus musculus
ctaggtgcaggcagtctaaagtcat

SEQ ID NO: 265735 - DNA, 25 bp, Mus musculus
ctaggtgccaagagggagctccgct

SEQ ID NO: 265736 - DNA, 25 bp, Mus musculus
ctaggtgccagattgacgtgttgta

SEQ ID NO: 265737 - DNA, 25 bp, Mus musculus
ctaggtgccaggttggctgatgtta

SEQ ID NO: 265738 - DNA, 25 bp, Mus musculus
ctaggtgttccctgctgctctcaag

SEQ ID NO: 265739 - DNA, 25 bp, Mus musculus
ctaggttgcagacagtaaccagttt

SEQ ID NO: 265740 - DNA, 25 bp, Mus musculus
ctagtaaaagtgtcctagatgatga

SEQ ID NO: 265741 - DNA, 25 bp, Mus musculus
ctagtaacctttaggtcttgctagg

SEQ ID NO: 265742 - DNA, 25 bp, Mus musculus
ctagtaagcagtctgcaaacagcat

SEQ ID NO: 265743 - DNA, 25 bp, Mus musculus
ctagtactggaaggaaggtgcacac

SEQ ID NO: 265744 - DNA, 25 bp, Mus musculus
ctagtacttttttggttatgggcaa

SEQ ID NO: 265745 - DNA, 25 bp, Mus musculus
ctagtagagaaccccaggcacggcc

SEQ ID NO: 265746 - DNA, 25 bp, Mus musculus
ctagtagcagaagctgggagggcag

SEQ ID NO: 265747 - DNA, 25 bp, Mus musculus
ctagtagtgacaggacactactgga

SEQ ID NO: 265748 - DNA, 25 bp, Mus musculus
ctagtattaagtgcgtaatagcttg

SEQ ID NO: 265749 - DNA, 25 bp, Mus musculus
ctagtcaacaacagggaaagaaggc

SEQ ID NO: 265750 - DNA, 25 bp, Mus musculus
ctagtcacagagggctttaaggaag

SEQ ID NO: 265751 - DNA, 25 bp, Mus musculus
ctagtcacagcaacaacacttgatt

SEQ ID NO: 265752 - DNA, 25 bp, Mus musculus
ctagtcaccatcctgtcctactgtg

SEQ ID NO: 265753 - DNA, 25 bp, Mus musculus
ctagtcactgggaggtgtccctgta

SEQ ID NO: 265754 - DNA, 25 bp, Mus musculus
ctagtcatctgcgaacacgactcct

SEQ ID NO: 265755 - DNA, 25 bp, Mus musculus
ctagtccccagcaagcaagaggagg

SEQ ID NO: 265756 - DNA, 25 bp, Mus musculus
ctagtcctcagaactgtggacctcc

SEQ ID NO: 265757 - DNA, 25 bp, Mus musculus
ctagtccttttcagacccgggtcgg

SEQ ID NO: 265758 - DNA, 25 bp, Mus musculus
ctagtcgaagcccagagaagaaggt

SEQ ID NO: 265759 - DNA, 25 bp, Mus musculus
ctagtcgaagtgcccccctccttgg

SEQ ID NO: 265760 - DNA, 25 bp, Mus musculus
ctagtcgataaggttgaaagacaca

SEQ ID NO: 265761 - DNA, 25 bp, Mus musculus
ctagtcggaggtgtatcgttactct

SEQ ID NO: 265762 - DNA, 25 bp, Mus musculus
ctagtcggagttacagccgctgtct

SEQ ID NO: 265763 - DNA, 25 bp, Mus musculus
ctagtcttttaatggagaatggagt

SEQ ID NO: 265764 - DNA, 25 bp, Mus musculus
ctagtcttttaggtaagaagtatgg

SEQ ID NO: 265765 - DNA, 25 bp, Mus musculus
ctagtgaagattcaggcttgttccc

SEQ ID NO: 265766 - DNA, 25 bp, Mus musculus
ctagtgaaggggcagtctgtccatc

SEQ ID NO: 265767 - DNA, 25 bp, Mus musculus
ctagtgaccagatactgttaaagca

SEQ ID NO: 265768 - DNA, 25 bp, Mus musculus
ctagtgaccaggatcgactgcgggc

SEQ ID NO: 265769 - DNA, 25 bp, Mus musculus
ctagtgactggaggattctgtaccc

SEQ ID NO: 265770 - DNA, 25 bp, Mus musculus
ctagtgactggggaattgatgtccg

SEQ ID NO: 265771 - DNA, 25 bp, Mus musculus
ctagtgagaccggaccagctcccca

SEQ ID NO: 265772 - DNA, 25 bp, Mus musculus
ctagtgcaacccgtggcagtcaagc

SEQ ID NO: 265773 - DNA, 25 bp, Mus musculus
ctagtgcagcttgagtagcttatct

SEQ ID NO: 265774 - DNA, 25 bp, Mus musculus
ctagtgcagcttggagtggatttgt

SEQ ID NO: 265775 - DNA, 25 bp, Mus musculus
ctagtgcattagcctgccaccacca

SEQ ID NO: 265776 - DNA, 25 bp, Mus musculus
ctagtgccagcttcggtggtgtact

SEQ ID NO: 265777 - DNA, 25 bp, Mus musculus
ctagtgccaggaaaatactaaagtt

SEQ ID NO: 265778 - DNA, 25 bp, Mus musculus
ctagtgcccctcaggcggtgctata

SEQ ID NO: 265779 - DNA, 25 bp, Mus musculus
ctagtgcctgataagccaaagagcc

SEQ ID NO: 265780 - DNA, 25 bp, Mus musculus
ctagtgctacaggcactcttcaacc

SEQ ID NO: 265781 - DNA, 25 bp, Mus musculus
ctagtgctacaggttctcacgcggt

SEQ ID NO: 265782 - DNA, 25 bp, Mus musculus
ctagtgctacaggttctgctgactt

SEQ ID NO: 265783 - DNA, 25 bp, Mus musculus
ctagtgctcagagtgcctgcagtcc

SEQ ID NO: 265784 - DNA, 25 bp, Mus musculus
ctagtgctcagctacagcaacgttt

SEQ ID NO: 265785 - DNA, 25 bp, Mus musculus
ctagtgctcttcagaatgtgaagag

SEQ ID NO: 265786 - DNA, 25 bp, Mus musculus
ctagtggacactagactacatcgtc

SEQ ID NO: 265787 - DNA, 25 bp, Mus musculus
ctagtggaccagaggatatctgggc

SEQ ID NO: 265788 - DNA, 25 bp, Mus musculus
ctagtggagtccacgtacaagtatg

SEQ ID NO: 265789 - DNA, 25 bp, Mus musculus
ctagtggcaccggtttacatctcgg

SEQ ID NO: 265790 - DNA, 25 bp, Mus musculus
ctagtggcagcgaagatcacaaggt

SEQ ID NO: 265791 - DNA, 25 bp, Mus musculus
ctagtggcagcgaaggcctccttga

SEQ ID NO: 265792 - DNA, 25 bp, Mus musculus
ctagtggcgagaatttgctgagaga

SEQ ID NO: 265793 - DNA, 25 bp, Mus musculus
ctagtggcgagactttatgatgcat

SEQ ID NO: 265794 - DNA, 25 bp, Mus musculus
ctagtggcgagcacatgccaacgag

SEQ ID NO: 265795 - DNA, 25 bp, Mus musculus
ctagtggctcctggcactttgaatt

SEQ ID NO: 265796 - DNA, 25 bp, Mus musculus
ctagtggggcttatggtgtctgatc

SEQ ID NO: 265797 - DNA, 25 bp, Mus musculus
ctagtgtaaaagaaagatgatgaca

SEQ ID NO: 265798 - DNA, 25 bp, Mus musculus
ctagtgtattcaaagaacttagtag

SEQ ID NO: 265799 - DNA, 25 bp, Mus musculus
ctagtgtcattaagcccacaaggcc

SEQ ID NO: 265800 - DNA, 25 bp, Mus musculus
ctagtgtctgccagatctgtggcca

SEQ ID NO: 265801 - DNA, 25 bp, Mus musculus
ctagtgtctgccattgcaggatctg

SEQ ID NO: 265802 - DNA, 25 bp, Mus musculus
ctagtgtcttctcgcatgcacgcct

SEQ ID NO: 265803 - DNA, 25 bp, Mus musculus
ctagtgtgcagaatgtctcacagat

SEQ ID NO: 265804 - DNA, 25 bp, Mus musculus
ctagttaagaggtttggacatttcc

SEQ ID NO: 265805 - DNA, 25 bp, Mus musculus
ctagttaagccagaggcaatgggct

SEQ ID NO: 265806 - DNA, 25 bp, Mus musculus
ctagttagtacagatgcagacagcc

SEQ ID NO: 265807 - DNA, 25 bp, Mus musculus
ctagttatgctccagagtgagagac

SEQ ID NO: 265808 - DNA, 25 bp, Mus musculus
ctagttatgctccagagtttcagtt

SEQ ID NO: 265809 - DNA, 25 bp, Mus musculus
ctagttatgctccagccactctgct

SEQ ID NO: 265810 - DNA, 25 bp, Mus musculus
ctagttcaagaggaagaaatgcccc

SEQ ID NO: 265811 - DNA, 25 bp, Mus musculus
ctagttcaagaggacacaatgtagg

SEQ ID NO: 265812 - DNA, 25 bp, Mus musculus
ctagttcagagcaagaacagaagca

SEQ ID NO: 265813 - DNA, 25 bp, Mus musculus
ctagttccagataactgcctttgta

SEQ ID NO: 265814 - DNA, 25 bp, Mus musculus
ctagttccgagtcccgctcacgctc

SEQ ID NO: 265815 - DNA, 25 bp, Mus musculus
ctagttgaaggaatttgacaagatt

SEQ ID NO: 265816 - DNA, 25 bp, Mus musculus
ctagttgctgccttgcgctggcgct

SEQ ID NO: 265817 - DNA, 25 bp, Mus musculus
ctagttggaaaggcatttacactct

SEQ ID NO: 265818 - DNA, 25 bp, Mus musculus
ctagttggaaggctccgcccactac

SEQ ID NO: 265819 - DNA, 25 bp, Mus musculus
ctagttgttggaggaactgctgaag

SEQ ID NO: 265820 - DNA, 25 bp, Mus musculus
ctagtttgccatcaggtattggctt

SEQ ID NO: 265821 - DNA, 25 bp, Mus musculus
ctagtttgtttgaggaagctcacaa

SEQ ID NO: 265822 - DNA, 25 bp, Mus musculus
ctagttttccaggtcgtggttcaat

SEQ ID NO: 265823 - DNA, 25 bp, Mus musculus
ctataaaaattacagtaccaaagca

SEQ ID NO: 265824 - DNA, 25 bp, Mus musculus
ctataaaacatatttccagggtagc

SEQ ID NO: 265825 - DNA, 25 bp, Mus musculus
ctataaaagagcatgggtacacaat

SEQ ID NO: 265826 - DNA, 25 bp, Mus musculus
ctataaaagaggtatatattatgag

SEQ ID NO: 265827 - DNA, 25 bp, Mus musculus
ctataaaattacagagaatgcatca

SEQ ID NO: 265828 - DNA, 25 bp, Mus musculus
ctataaaattacagctcagtctgga

SEQ ID NO: 265829 - DNA, 25 bp, Mus musculus
ctataaaattgatgcatctctgaca

SEQ ID NO: 265830 - DNA, 25 bp, Mus musculus
ctataaacaggcggcagcagctctg

SEQ ID NO: 265831 - DNA, 25 bp, Mus musculus
ctataaacaggtcttagagccttct

SEQ ID NO: 265832 - DNA, 25 bp, Mus musculus
ctataaagcagtatcgtcatctgaa

SEQ ID NO: 265833 - DNA, 25 bp, Mus musculus
ctataaagccagagccatcgtgact

SEQ ID NO: 265834 - DNA, 25 bp, Mus musculus
ctataaaggactgattgtgaattcc

SEQ ID NO: 265835 - DNA, 25 bp, Mus musculus
ctataaaggatggcggtgttagaac

SEQ ID NO: 265836 - DNA, 25 bp, Mus musculus
ctataaagtcgtaaaatatgaaaga

SEQ ID NO: 265837 - DNA, 25 bp, Mus musculus
ctataaatttgcaagagccagaggg

SEQ ID NO: 265838 - DNA, 25 bp, Mus musculus
ctataacaataaagctgcagtgttg

SEQ ID NO: 265839 - DNA, 25 bp, Mus musculus
ctataaccagacacgcagtgctgat

SEQ ID NO: 265840 - DNA, 25 bp, Mus musculus
ctataaccaggtgcagacacgcagt

SEQ ID NO: 265841 - DNA, 25 bp, Mus musculus
ctataacccgataatcccctatgtt

SEQ ID NO: 265842 - DNA, 25 bp, Mus musculus
ctataacccgattccaggttgactt

SEQ ID NO: 265843 - DNA, 25 bp, Mus musculus
ctataacggactgctgaccttgggg

SEQ ID NO: 265844 - DNA, 25 bp, Mus musculus
ctataacggctgggcacgtggagat

SEQ ID NO: 265845 - DNA, 25 bp, Mus musculus
ctataacgtctgcatactatcgtgg

SEQ ID NO: 265846 - DNA, 25 bp, Mus musculus
ctataacttcaaaaagcagccttca

SEQ ID NO: 265847 - DNA, 25 bp, Mus musculus
ctataacttcaatgtctttaacatc

SEQ ID NO: 265848 - DNA, 25 bp, Mus musculus
ctataagaactgctccgctcggctc

SEQ ID NO: 265849 - DNA, 25 bp, Mus musculus
ctataagaactggcacaagtctaag

SEQ ID NO: 265850 - DNA, 25 bp, Mus musculus
ctataagcagcctgctgtggaggtg

SEQ ID NO: 265851 - DNA, 25 bp, Mus musculus
ctataagcagtgtgctgtgagaaca

SEQ ID NO: 265852 - DNA, 25 bp, Mus musculus
ctataaggagggtcactccaaaggc

SEQ ID NO: 265853 - DNA, 25 bp, Mus musculus
ctataaggtcaagcctgtgggccga

SEQ ID NO: 265854 - DNA, 25 bp, Mus musculus
ctataagtaaggaatgaattcgaag

SEQ ID NO: 265855 - DNA, 25 bp, Mus musculus
ctataagtaaggctgtagaaaaccc

SEQ ID NO: 265856 - DNA, 25 bp, Mus musculus
ctataagtgtgagatcgagtgcttc

SEQ ID NO: 265857 - DNA, 25 bp, Mus musculus
ctataatcctgtggctgaccatatc

SEQ ID NO: 265858 - DNA, 25 bp, Mus musculus
ctataatctggtatgtgtatcacag

SEQ ID NO: 265859 - DNA, 25 bp, Mus musculus
ctataatgccgtggctgctccagtt

SEQ ID NO: 265860 - DNA, 25 bp, Mus musculus
ctataatgccgtggtgtggcttgac

SEQ ID NO: 265861 - DNA, 25 bp, Mus musculus
ctataattagcacagagaatgaacc

SEQ ID NO: 265862 - DNA, 25 bp, Mus musculus
ctatacaaactatatatttgtcctt

SEQ ID NO: 265863 - DNA, 25 bp, Mus musculus
ctatacacaaccagtttccgttcag

SEQ ID NO: 265864 - DNA, 25 bp, Mus musculus
ctatacacaggtgattttcgatata

SEQ ID NO: 265865 - DNA, 25 bp, Mus musculus
ctatacacatagttacttgggattt

SEQ ID NO: 265866 - DNA, 25 bp, Mus musculus
ctatacagaggctctccctacggac

SEQ ID NO: 265867 - DNA, 25 bp, Mus musculus
ctatacaggaggttcaagttctttc

SEQ ID NO: 265868 - DNA, 25 bp, Mus musculus
ctatacatcagagacttcagtactc

SEQ ID NO: 265869 - DNA, 25 bp, Mus musculus
ctataccaagaagtgtcgagagctg

SEQ ID NO: 265870 - DNA, 25 bp, Mus musculus
ctataccattgacactggccaaaag

SEQ ID NO: 265871 - DNA, 25 bp, Mus musculus
ctatacctcacaggtgatccactgc

SEQ ID NO: 265872 - DNA, 25 bp, Mus musculus
ctatacctctaggcctgctctgttc

SEQ ID NO: 265873 - DNA, 25 bp, Mus musculus
ctatacctctaggccttatattgtg

SEQ ID NO: 265874 - DNA, 25 bp, Mus musculus
ctataccttacggtccctttccttg

SEQ ID NO: 265875 - DNA, 25 bp, Mus musculus
ctataccttgaactgagctggtggg

SEQ ID NO: 265876 - DNA, 25 bp, Mus musculus
ctatacctttaacagcccttagggc

SEQ ID NO: 265877 - DNA, 25 bp, Mus musculus
ctatacctttaacagcctctttcca

SEQ ID NO: 265878 - DNA, 25 bp, Mus musculus
ctatacctttaacagggccatcatg

SEQ ID NO: 265879 - DNA, 25 bp, Mus musculus
ctatacgaaaaggaacttacacatt

SEQ ID NO: 265880 - DNA, 25 bp, Mus musculus
ctatacgaaaaggctctacctctga

SEQ ID NO: 265881 - DNA, 25 bp, Mus musculus
ctatacgctgccgtgtacccctcca

SEQ ID NO: 265882 - DNA, 25 bp, Mus musculus
ctatactcccgtttggtgaactgac

SEQ ID NO: 265883 - DNA, 25 bp, Mus musculus
ctatactgccaaaggtcttttccgg

SEQ ID NO: 265884 - DNA, 25 bp, Mus musculus
ctatagaaacgggttctgctgcctt

SEQ ID NO: 265885 - DNA, 25 bp, Mus musculus
ctatagaaaggctgaaggcactggg

SEQ ID NO: 265886 - DNA, 25 bp, Mus musculus
ctatagaaagggcgctttcgttgct

SEQ ID NO: 265887 - DNA, 25 bp, Mus musculus
ctatagacttcagtttgatttccag

SEQ ID NO: 265888 - DNA, 25 bp, Mus musculus
ctatagataagaatagcagagaaag

SEQ ID NO: 265889 - DNA, 25 bp, Mus musculus
ctatagcacatgggagggactgggg

SEQ ID NO: 265890 - DNA, 25 bp, Mus musculus
ctatagcacgaccccttatccctct

SEQ ID NO: 265891 - DNA, 25 bp, Mus musculus
ctatagcacggtaacacaagtagcg

SEQ ID NO: 265892 - DNA, 25 bp, Mus musculus
ctatagccaaggacattaaggacgc

SEQ ID NO: 265893 - DNA, 25 bp, Mus musculus
ctatagcctggacctgctctccttg

SEQ ID NO: 265894 - DNA, 25 bp, Mus musculus
ctatagcctggctcggttctctcca

SEQ ID NO: 265895 - DNA, 25 bp, Mus musculus
ctatagcctggtgcttgagaaggcc

SEQ ID NO: 265896 - DNA, 25 bp, Mus musculus
ctatagctcagctgcctcatataca

SEQ ID NO: 265897 - DNA, 25 bp, Mus musculus
ctatagctctccaggtcaatggcca

SEQ ID NO: 265898 - DNA, 25 bp, Mus musculus
ctatagctctctgctcagtacaagc

SEQ ID NO: 265899 - DNA, 25 bp, Mus musculus
ctataggcaaaggttctgcctcatg

SEQ ID NO: 265900 - DNA, 25 bp, Mus musculus
ctatagggagtcgcgaggaggaaag

SEQ ID NO: 265901 - DNA, 25 bp, Mus musculus
ctatagtcatttacaaaatggttct

SEQ ID NO: 265902 - DNA, 25 bp, Mus musculus
ctatagtccaggacagccagggctg

SEQ ID NO: 265903 - DNA, 25 bp, Mus musculus
ctatagtgaagcccctggtcataag

SEQ ID NO: 265904 - DNA, 25 bp, Mus musculus
ctatagtgaaggtgtttcctacttg

SEQ ID NO: 265905 - DNA, 25 bp, Mus musculus
ctatagttcaggcatctactatgaa

SEQ ID NO: 265906 - DNA, 25 bp, Mus musculus
ctatataaagacactccgtggtgct

SEQ ID NO: 265907 - DNA, 25 bp, Mus musculus
ctatataagtggtaagccaaaagta

SEQ ID NO: 265908 - DNA, 25 bp, Mus musculus
ctatatacacaggccatcctggaca

SEQ ID NO: 265909 - DNA, 25 bp, Mus musculus
ctatatacaggctacagacaagaga

SEQ ID NO: 265910 - DNA, 25 bp, Mus musculus
ctatataccatgaggcttacagtcc

SEQ ID NO: 265911 - DNA, 25 bp, Mus musculus
ctatataggcaaaggtgatttatct

SEQ ID NO: 265912 - DNA, 25 bp, Mus musculus
ctatataggcaattcaacttgattt

SEQ ID NO: 265913 - DNA, 25 bp, Mus musculus
ctatataggcaattgggtccccatc

SEQ ID NO: 265914 - DNA, 25 bp, Mus musculus
ctatatattgaaaatccctgactct

SEQ ID NO: 265915 - DNA, 25 bp, Mus musculus
ctatatattgaagtgcggtgtttaa

SEQ ID NO: 265916 - DNA, 25 bp, Mus musculus
ctatatcaagaaggctgctttgcgt

SEQ ID NO: 265917 - DNA, 25 bp, Mus musculus
ctatatcaagtttcatgcaggctct

SEQ ID NO: 265918 - DNA, 25 bp, Mus musculus
ctatatcaccaaagctgaaaggggt

SEQ ID NO: 265919 - DNA, 25 bp, Mus musculus
ctatatcaccaaagtcctgaagggg

SEQ ID NO: 265920 - DNA, 25 bp, Mus musculus
ctatatcccttgcattccatattgg

SEQ ID NO: 265921 - DNA, 25 bp, Mus musculus
ctatatcgagcttcttcctccagct

SEQ ID NO: 265922 - DNA, 25 bp, Mus musculus
ctatatcggagacacagcttcatga

SEQ ID NO: 265923 - DNA, 25 bp, Mus musculus
ctatatcgtccaggtatttgataac

SEQ ID NO: 265924 - DNA, 25 bp, Mus musculus
ctatatctacactgaattttagaaa

SEQ ID NO: 265925 - DNA, 25 bp, Mus musculus
ctatatctacactgagtccaaacat

SEQ ID NO: 265926 - DNA, 25 bp, Mus musculus
ctatatctacactgagtgccagtca

SEQ ID NO: 265927 - DNA, 25 bp, Mus musculus
ctatatctacactgagtggttcctc

SEQ ID NO: 265928 - DNA, 25 bp, Mus musculus
ctatatcttgtaagctaaacagaaa

SEQ ID NO: 265929 - DNA, 25 bp, Mus musculus
ctatatgacagactccattagcaga

SEQ ID NO: 265930 - DNA, 25 bp, Mus musculus
ctatatgacagggcttctggtgtaa

SEQ ID NO: 265931 - DNA, 25 bp, Mus musculus
ctatatgcaatttcggagcttcacc

SEQ ID NO: 265932 - DNA, 25 bp, Mus musculus
ctatattactcaacaacatccccga

SEQ ID NO: 265933 - DNA, 25 bp, Mus musculus
ctatattcacagaattggcagaggg

SEQ ID NO: 265934 - DNA, 25 bp, Mus musculus
ctatattcacaggagtcgatagcgg

SEQ ID NO: 265935 - DNA, 25 bp, Mus musculus
ctatattcagggctacaacaaggct

SEQ ID NO: 265936 - DNA, 25 bp, Mus musculus
ctatattcaggtgacagacttcggt

SEQ ID NO: 265937 - DNA, 25 bp, Mus musculus
ctatattgatgttgattgatgtggg

SEQ ID NO: 265938 - DNA, 25 bp, Mus musculus
ctatattgatgttggaaactgtggc

SEQ ID NO: 265939 - DNA, 25 bp, Mus musculus
ctatattggaaggtcctcagaatgg

SEQ ID NO: 265940 - DNA, 25 bp, Mus musculus
ctatattggtgctggccaacaagca

SEQ ID NO: 265941 - DNA, 25 bp, Mus musculus
ctatatttcgcacatcttcattacc

SEQ ID NO: 265942 - DNA, 25 bp, Mus musculus
ctatcaactgagacattgtctttcc

SEQ ID NO: 265943 - DNA, 25 bp, Mus musculus
ctatcaatcaatctatctacctatc

SEQ ID NO: 265944 - DNA, 25 bp, Mus musculus
ctatcacaaaagctgcatagactca

SEQ ID NO: 265945 - DNA, 25 bp, Mus musculus
ctatcacaaataaagaaaaggaaaa

SEQ ID NO: 265946 - DNA, 25 bp, Mus musculus
ctatcacaaatatttcctcttctga

SEQ ID NO: 265947 - DNA, 25 bp, Mus musculus
ctatcacagacacgtgcgaccgcat

SEQ ID NO: 265948 - DNA, 25 bp, Mus musculus
ctatcacagacgatctagaagcaag

SEQ ID NO: 265949 - DNA, 25 bp, Mus musculus
ctatcacatagatgagaattctcca

SEQ ID NO: 265950 - DNA, 25 bp, Mus musculus
ctatcacatatacgcagtactccgg

SEQ ID NO: 265951 - DNA, 25 bp, Mus musculus
ctatcacctccagaacaatgagctt

SEQ ID NO: 265952 - DNA, 25 bp, Mus musculus
ctatcacctccagctaattgccttg

SEQ ID NO: 265953 - DNA, 25 bp, Mus musculus
ctatcactgtccaagagttgtttgc

SEQ ID NO: 265954 - DNA, 25 bp, Mus musculus
ctatcactgtccaaggatggaaggt

SEQ ID NO: 265955 - DNA, 25 bp, Mus musculus
ctatcactgttgagggatgacctgc

SEQ ID NO: 265956 - DNA, 25 bp, Mus musculus
ctatcagaaactccaggaccaggag

SEQ ID NO: 265957 - DNA, 25 bp, Mus musculus
ctatcagaaaggagatgaatatgac

SEQ ID NO: 265958 - DNA, 25 bp, Mus musculus
ctatcagaaagggatgaatatgagg

SEQ ID NO: 265959 - DNA, 25 bp, Mus musculus
ctatcagaacaccatcggggctgct

SEQ ID NO: 265960 - DNA, 25 bp, Mus musculus
ctatcagaataaggttcagcctatg

SEQ ID NO: 265961 - DNA, 25 bp, Mus musculus
ctatcagcgggcttatccgctggag

SEQ ID NO: 265962 - DNA, 25 bp, Mus musculus
ctatcagcgggtcatagaagagctt

SEQ ID NO: 265963 - DNA, 25 bp, Mus musculus
ctatcagctgcaggtggccaagacg

SEQ ID NO: 265964 - DNA, 25 bp, Mus musculus
ctatcagtgagtaccgtggccttcc

SEQ ID NO: 265965 - DNA, 25 bp, Mus musculus
ctatcagttggtttacctgctgcct

SEQ ID NO: 265966 - DNA, 25 bp, Mus musculus
ctatcagtttaggattcagctggcg

SEQ ID NO: 265967 - DNA, 25 bp, Mus musculus
ctatcatccggaaggctgtggcagt

SEQ ID NO: 265968 - DNA, 25 bp, Mus musculus
ctatcatccggaagtgtgtccctcc

SEQ ID NO: 265969 - DNA, 25 bp, Mus musculus
ctatcatgacattcgcttcaaaatc

SEQ ID NO: 265970 - DNA, 25 bp, Mus musculus
ctatcatgagggtccatgccttcct

SEQ ID NO: 265971 - DNA, 25 bp, Mus musculus
ctatcatgggtattggtccagtccc

SEQ ID NO: 265972 - DNA, 25 bp, Mus musculus
ctatcatggtgagtcatctccatcc

SEQ ID NO: 265973 - DNA, 25 bp, Mus musculus
ctatcattaagcaaagcactattgt

SEQ ID NO: 265974 - DNA, 25 bp, Mus musculus
ctatccaaaagataggaagtgcaga

SEQ ID NO: 265975 - DNA, 25 bp, Mus musculus
ctatccaagcaggctgtcgcttacc

SEQ ID NO: 265976 - DNA, 25 bp, Mus musculus
ctatccaatgccaatcgctgcctcc

SEQ ID NO: 265977 - DNA, 25 bp, Mus musculus
ctatccacgcagcctctgcctcggt

SEQ ID NO: 265978 - DNA, 25 bp, Mus musculus
ctatccacgcagctgccccttaccg

SEQ ID NO: 265979 - DNA, 25 bp, Mus musculus
ctatccagaacagggcgtgcctagg

SEQ ID NO: 265980 - DNA, 25 bp, Mus musculus
ctatccagaacaggtgaccttggag

SEQ ID NO: 265981 - DNA, 25 bp, Mus musculus
ctatccagagaaccattctgatgat

SEQ ID NO: 265982 - DNA, 25 bp, Mus musculus
ctatccagatgtaagtgccctggaa

SEQ ID NO: 265983 - DNA, 25 bp, Mus musculus
ctatccagatgtacgtgccctggaa

SEQ ID NO: 265984 - DNA, 25 bp, Mus musculus
ctatccatggagggctgagccggat

SEQ ID NO: 265985 - DNA, 25 bp, Mus musculus
ctatcccacagatggtatggtgtat

SEQ ID NO: 265986 - DNA, 25 bp, Mus musculus
ctatcccagaaaggatgaggccatc

SEQ ID NO: 265987 - DNA, 25 bp, Mus musculus
ctatccccaaacaggagacttaatg

SEQ ID NO: 265988 - DNA, 25 bp, Mus musculus
ctatccccctcacagtaattcttca

SEQ ID NO: 265989 - DNA, 25 bp, Mus musculus
ctatcccgagaaagcctacatcttc

SEQ ID NO: 265990 - DNA, 25 bp, Mus musculus
ctatcccgaggcccgagtccggaag

SEQ ID NO: 265991 - DNA, 25 bp, Mus musculus
ctatccctcttggaggaaccacaat

SEQ ID NO: 265992 - DNA, 25 bp, Mus musculus
ctatccctgagagctgctcctttgg

SEQ ID NO: 265993 - DNA, 25 bp, Mus musculus
ctatccctgctatgacactggctgg

SEQ ID NO: 265994 - DNA, 25 bp, Mus musculus
ctatccctggctccctcatcagcga

SEQ ID NO: 265995 - DNA, 25 bp, Mus musculus
ctatccgccccagaccctgttagac

SEQ ID NO: 265996 - DNA, 25 bp, Mus musculus
ctatcctaaaggggtctttgtgaac

SEQ ID NO: 265997 - DNA, 25 bp, Mus musculus
ctatcctaaagggtgacaaagggga

SEQ ID NO: 265998 - DNA, 25 bp, Mus musculus
ctatcctaagtgatgtgccagcatg

SEQ ID NO: 265999 - DNA, 25 bp, Mus musculus
ctatcctacagggaaatgcatagat

SEQ ID NO: 266000 - DNA, 25 bp, Mus musculus
ctatcctacctacggtgactctggc

SEQ ID NO: 266001 - DNA, 25 bp, Mus musculus
ctatcctatgaaggtggtatgtccg

SEQ ID NO: 266002 - DNA, 25 bp, Mus musculus
ctatcctgaagtgattttcctcgca

SEQ ID NO: 266003 - DNA, 25 bp, Mus musculus
ctatcctgacagctacgacacgtgg

SEQ ID NO: 266004 - DNA, 25 bp, Mus musculus
ctatcctgaggttgcaggtcagcaa

SEQ ID NO: 266005 - DNA, 25 bp, Mus musculus
ctatcctttttcaacttggagaaga

SEQ ID NO: 266006 - DNA, 25 bp, Mus musculus
ctatcgaaaatgagcaactggtggt

SEQ ID NO: 266007 - DNA, 25 bp, Mus musculus
ctatcgacaacatgaatgaatctga

SEQ ID NO: 266008 - DNA, 25 bp, Mus musculus
ctatcgacagagtcccagatcctaa

SEQ ID NO: 266009 - DNA, 25 bp, Mus musculus
ctatcgacagtttttgtggttcttg

SEQ ID NO: 266010 - DNA, 25 bp, Mus musculus
ctatcgagtacgaagtgggctaaag

SEQ ID NO: 266011 - DNA, 25 bp, Mus musculus
ctatcgataattccggcgggaggag

SEQ ID NO: 266012 - DNA, 25 bp, Mus musculus
ctatcggcatggtttgctaggtatt

SEQ ID NO: 266013 - DNA, 25 bp, Mus musculus
ctatcggcatgttctctgaattcct

SEQ ID NO: 266014 - DNA, 25 bp, Mus musculus
ctatcgggtcatctaagaatgaagc

SEQ ID NO: 266015 - DNA, 25 bp, Mus musculus
ctatcgtcaaagaaggggaggaagt

SEQ ID NO: 266016 - DNA, 25 bp, Mus musculus
ctatcgtgtgagccagatcttctgg

SEQ ID NO: 266017 - DNA, 25 bp, Mus musculus
ctatctaatgatgctttcagacttg

SEQ ID NO: 266018 - DNA, 25 bp, Mus musculus
ctatctaatgatggaacatgtctca

SEQ ID NO: 266019 - DNA, 25 bp, Mus musculus
ctatctacagtgggcagcaaagatt

SEQ ID NO: 266020 - DNA, 25 bp, Mus musculus
ctatctacagtgggccggcggccaa

SEQ ID NO: 266021 - DNA, 25 bp, Mus musculus
ctatctaccacaaatattatcacta

SEQ ID NO: 266022 - DNA, 25 bp, Mus musculus
ctatctaccacaacctgaagaacat

SEQ ID NO: 266023 - DNA, 25 bp, Mus musculus
ctatctatatggcaccagaggtcat

SEQ ID NO: 266024 - DNA, 25 bp, Mus musculus
ctatctatctatcatctatctacct

SEQ ID NO: 266025 - DNA, 25 bp, Mus musculus
ctatctcaaagcaagccccgcccaa

SEQ ID NO: 266026 - DNA, 25 bp, Mus musculus
ctatctcaccagttgtgtgaattat

SEQ ID NO: 266027 - DNA, 25 bp, Mus musculus
ctatctccaagcatgctggactatg

SEQ ID NO: 266028 - DNA, 25 bp, Mus musculus
ctatctccaagtcggttgtggggtt

SEQ ID NO: 266029 - DNA, 25 bp, Mus musculus
ctatctccggtccaaatatcacacc

SEQ ID NO: 266030 - DNA, 25 bp, Mus musculus
ctatctcctccagcggcagtacatc

SEQ ID NO: 266031 - DNA, 25 bp, Mus musculus
ctatctcctccgcagaggccaagtg

SEQ ID NO: 266032 - DNA, 25 bp, Mus musculus
ctatctcgcagaggagttagcgacg

SEQ ID NO: 266033 - DNA, 25 bp, Mus musculus
ctatctcgtgggccttacgatgggc

SEQ ID NO: 266034 - DNA, 25 bp, Mus musculus
ctatctgaaagaccccgcttggctg

SEQ ID NO: 266035 - DNA, 25 bp, Mus musculus
ctatctgaaagattgctgaagctaa

SEQ ID NO: 266036 - DNA, 25 bp, Mus musculus
ctatctgaaggccctgtccacggac

SEQ ID NO: 266037 - DNA, 25 bp, Mus musculus
ctatctgacaagcacaaacgggaga

SEQ ID NO: 266038 - DNA, 25 bp, Mus musculus
ctatctgacaagcacctatagtctt

SEQ ID NO: 266039 - DNA, 25 bp, Mus musculus
ctatctgacagaagtggtccttctc

SEQ ID NO: 266040 - DNA, 25 bp, Mus musculus
ctatctgacaggatggcttgccttc

SEQ ID NO: 266041 - DNA, 25 bp, Mus musculus
ctatctgagaaaacaggtcttaatt

SEQ ID NO: 266042 - DNA, 25 bp, Mus musculus
ctatctgattcaggtacacaactgg

SEQ ID NO: 266043 - DNA, 25 bp, Mus musculus
ctatctgccagcagaatggcattgt

SEQ ID NO: 266044 - DNA, 25 bp, Mus musculus
ctatctggaacagggaacaagctta

SEQ ID NO: 266045 - DNA, 25 bp, Mus musculus
ctatctggaggtgacccctgattca

SEQ ID NO: 266046 - DNA, 25 bp, Mus musculus
ctatctggcaagagcggcctcggtg

SEQ ID NO: 266047 - DNA, 25 bp, Mus musculus
ctatctgtgcatgggccagcgtgac

SEQ ID NO: 266048 - DNA, 25 bp, Mus musculus
ctatctgttatgaaacaaatgtcct

SEQ ID NO: 266049 - DNA, 25 bp, Mus musculus
ctatctgtttgtctctagataaggt

SEQ ID NO: 266050 - DNA, 25 bp, Mus musculus
ctatcttcgagataagacagtgatg

SEQ ID NO: 266051 - DNA, 25 bp, Mus musculus
ctatcttctccaagttgctgcaata

SEQ ID NO: 266052 - DNA, 25 bp, Mus musculus
ctatcttgcagttcatggcatctca

SEQ ID NO: 266053 - DNA, 25 bp, Mus musculus
ctatcttgcttcgaagccagacaca

SEQ ID NO: 266054 - DNA, 25 bp, Mus musculus
ctatcttgtaagcgtggggatgtcc

SEQ ID NO: 266055 - DNA, 25 bp, Mus musculus
ctatcttgtaagggtggggatgtcc

SEQ ID NO: 266056 - DNA, 25 bp, Mus musculus
ctatctttttgagttgtgtaaaaat

SEQ ID NO: 266057 - DNA, 25 bp, Mus musculus
ctatgaaaagggatggatctttaca

SEQ ID NO: 266058 - DNA, 25 bp, Mus musculus
ctatgaaaaggtgacgtgcacagac

SEQ ID NO: 266059 - DNA, 25 bp, Mus musculus
ctatgaaacaaagagttcaactaga

SEQ ID NO: 266060 - DNA, 25 bp, Mus musculus
ctatgaaacagaaaaacaccgaggg

SEQ ID NO: 266061 - DNA, 25 bp, Mus musculus
ctatgaaatatgcaggaggggaagc

SEQ ID NO: 266062 - DNA, 25 bp, Mus musculus
ctatgaaatatgcagtgagcatgtt

SEQ ID NO: 266063 - DNA, 25 bp, Mus musculus
ctatgaaatgggtgggatgctatgg

SEQ ID NO: 266064 - DNA, 25 bp, Mus musculus
ctatgaaatggtccaccaggctggg

SEQ ID NO: 266065 - DNA, 25 bp, Mus musculus
ctatgaaatggttttactgggcagc

SEQ ID NO: 266066 - DNA, 25 bp, Mus musculus
ctatgaacaaataggagacagcttg

SEQ ID NO: 266067 - DNA, 25 bp, Mus musculus
ctatgaacaccagaagcctaagagt

SEQ ID NO: 266068 - DNA, 25 bp, Mus musculus
ctatgaacaccaggtttggacgtca

SEQ ID NO: 266069 - DNA, 25 bp, Mus musculus
ctatgaacaccctccttgacggccc

SEQ ID NO: 266070 - DNA, 25 bp, Mus musculus
ctatgaacagacagctgaaattacc

SEQ ID NO: 266071 - DNA, 25 bp, Mus musculus
ctatgaacgagcagttttggcaatc

SEQ ID NO: 266072 - DNA, 25 bp, Mus musculus
ctatgaactctggtggttcaccacc

SEQ ID NO: 266073 - DNA, 25 bp, Mus musculus
ctatgaagacaggagtcttttattc

SEQ ID NO: 266074 - DNA, 25 bp, Mus musculus
ctatgaagagaagagccttgttgat

SEQ ID NO: 266075 - DNA, 25 bp, Mus musculus
ctatgaagccaagattgtaagggcc

SEQ ID NO: 266076 - DNA, 25 bp, Mus musculus
ctatgaagcgaaggacggatcttgt

SEQ ID NO: 266077 - DNA, 25 bp, Mus musculus
ctatgaagctacctacagccagctg

SEQ ID NO: 266078 - DNA, 25 bp, Mus musculus
ctatgaagctctggccatgggcaag

SEQ ID NO: 266079 - DNA, 25 bp, Mus musculus
ctatgaaggaggttccgagttggga

SEQ ID NO: 266080 - DNA, 25 bp, Mus musculus
ctatgaaggcgtgaatatgacatct

SEQ ID NO: 266081 - DNA, 25 bp, Mus musculus
ctatgaaggcgtgggtatgcaatat

SEQ ID NO: 266082 - DNA, 25 bp, Mus musculus
ctatgaaggggtcagaatacaagag

SEQ ID NO: 266083 - DNA, 25 bp, Mus musculus
ctatgaagtattagaaaaagatgtt

SEQ ID NO: 266084 - DNA, 25 bp, Mus musculus
ctatgaagtattagaataaatgaag

SEQ ID NO: 266085 - DNA, 25 bp, Mus musculus
ctatgaatacaggagtggaggctgg

SEQ ID NO: 266086 - DNA, 25 bp, Mus musculus
ctatgaatctgttgatgacattaat

SEQ ID NO: 266087 - DNA, 25 bp, Mus musculus
ctatgaatgcactgacactgaagat

SEQ ID NO: 266088 - DNA, 25 bp, Mus musculus
ctatgacaagaaaaagcggatggtg

SEQ ID NO: 266089 - DNA, 25 bp, Mus musculus
ctatgacagaacagtttttggcctt

SEQ ID NO: 266090 - DNA, 25 bp, Mus musculus
ctatgacatcaccacccgagaaacc

SEQ ID NO: 266091 - DNA, 25 bp, Mus musculus
ctatgacatcaccagccgagaaacc

SEQ ID NO: 266092 - DNA, 25 bp, Mus musculus
ctatgacattgcctcccacccgctg

SEQ ID NO: 266093 - DNA, 25 bp, Mus musculus
ctatgacccccctctctcccttctg

SEQ ID NO: 266094 - DNA, 25 bp, Mus musculus
ctatgacccctgcgaggcggtgctg

SEQ ID NO: 266095 - DNA, 25 bp, Mus musculus
ctatgaccctcagaaaaaagtggtt

SEQ ID NO: 266096 - DNA, 25 bp, Mus musculus
ctatgaccgcctggtctacgtgatc

SEQ ID NO: 266097 - DNA, 25 bp, Mus musculus
ctatgaccttactgtcccttttgct

SEQ ID NO: 266098 - DNA, 25 bp, Mus musculus
ctatgaccttgaggacagacaagga

SEQ ID NO: 266099 - DNA, 25 bp, Mus musculus
ctatgacgtgaccctggaagacatc

SEQ ID NO: 266100 - DNA, 25 bp, Mus musculus
ctatgacgtggccagcttcatcttc

SEQ ID NO: 266101 - DNA, 25 bp, Mus musculus
ctatgacgtggccagtgcttttaca

SEQ ID NO: 266102 - DNA, 25 bp, Mus musculus
ctatgactagagacctgcaggggag

SEQ ID NO: 266103 - DNA, 25 bp, Mus musculus
ctatgacttagcaggttcttgtctg

SEQ ID NO: 266104 - DNA, 25 bp, Mus musculus
ctatgacttcaaggctgacatctgg

SEQ ID NO: 266105 - DNA, 25 bp, Mus musculus
ctatgagaaagtccctccaggaggc

SEQ ID NO: 266106 - DNA, 25 bp, Mus musculus
ctatgagaatagagcacagtcagat

SEQ ID NO: 266107 - DNA, 25 bp, Mus musculus
ctatgagactatggcaggggcaggg

SEQ ID NO: 266108 - DNA, 25 bp, Mus musculus
ctatgagaggatgctgagagtccat

SEQ ID NO: 266109 - DNA, 25 bp, Mus musculus
ctatgagatggtagacaaacacatt

SEQ ID NO: 266110 - DNA, 25 bp, Mus musculus
ctatgagctaccgggacaagagtga

SEQ ID NO: 266111 - DNA, 25 bp, Mus musculus
ctatgaggaatgagtggccttgtga

SEQ ID NO: 266112 - DNA, 25 bp, Mus musculus
ctatgaggactgtgagtgttcccag

SEQ ID NO: 266113 - DNA, 25 bp, Mus musculus
ctatgaggagggtattcctacatga

SEQ ID NO: 266114 - DNA, 25 bp, Mus musculus
ctatgaggcacaaggagcaagaccc

SEQ ID NO: 266115 - DNA, 25 bp, Mus musculus
ctatgagggaaattgacttctatac

SEQ ID NO: 266116 - DNA, 25 bp, Mus musculus
ctatgagtacctcacgaaatctgtc

SEQ ID NO: 266117 - DNA, 25 bp, Mus musculus
ctatgagtacctcacgttcaggaaa

SEQ ID NO: 266118 - DNA, 25 bp, Mus musculus
ctatgagtacctcaggaaatctgtc

SEQ ID NO: 266119 - DNA, 25 bp, Mus musculus
ctatgagtacctcaggttcaggaaa

SEQ ID NO: 266120 - DNA, 25 bp, Mus musculus
ctatgagtagtgggatgagagtcat

SEQ ID NO: 266121 - DNA, 25 bp, Mus musculus
ctatgagtcccaggtgtattccctg

SEQ ID NO: 266122 - DNA, 25 bp, Mus musculus
ctatgagtctcccaggaagatctgc

SEQ ID NO: 266123 - DNA, 25 bp, Mus musculus
ctatgagtgcagaaaatattaatgg

SEQ ID NO: 266124 - DNA, 25 bp, Mus musculus
ctatgagtgcagcgtgttacccatt

SEQ ID NO: 266125 - DNA, 25 bp, Mus musculus
ctatgagtgcagttttcagcagatc

SEQ ID NO: 266126 - DNA, 25 bp, Mus musculus
ctatgagttagaggtcttgttgcgg

SEQ ID NO: 266127 - DNA, 25 bp, Mus musculus
ctatgataaggtacaaaatgaagcc

SEQ ID NO: 266128 - DNA, 25 bp, Mus musculus
ctatgataatgaaggaattgctatc

SEQ ID NO: 266129 - DNA, 25 bp, Mus musculus
ctatgatacatatgagtcaaacgtt

SEQ ID NO: 266130 - DNA, 25 bp, Mus musculus
ctatgatatcctcttgtttgccaga

SEQ ID NO: 266131 - DNA, 25 bp, Mus musculus
ctatgatattgtcatatccaactgt

SEQ ID NO: 266132 - DNA, 25 bp, Mus musculus
ctatgatcaacgcctgtagggactt

SEQ ID NO: 266133 - DNA, 25 bp, Mus musculus
ctatgatcagacaggaaaggatgtg

SEQ ID NO: 266134 - DNA, 25 bp, Mus musculus
ctatgatcccagagctggtttggcc

SEQ ID NO: 266135 - DNA, 25 bp, Mus musculus
ctatgatgtacaggtcatagatgag

SEQ ID NO: 266136 - DNA, 25 bp, Mus musculus
ctatgatgtaccagggagtggctgg

SEQ ID NO: 266137 - DNA, 25 bp, Mus musculus
ctatgatgtcctatatgaactgaga

SEQ ID NO: 266138 - DNA, 25 bp, Mus musculus
ctatgatgtgagagaacaagagata

SEQ ID NO: 266139 - DNA, 25 bp, Mus musculus
ctatgcaaaacgtataaatcctcga

SEQ ID NO: 266140 - DNA, 25 bp, Mus musculus
ctatgcaaaactgcttcaccgatac

SEQ ID NO: 266141 - DNA, 25 bp, Mus musculus
ctatgcaaaagttatgatggttaat

SEQ ID NO: 266142 - DNA, 25 bp, Mus musculus
ctatgcaaccgaagctgacattatc

SEQ ID NO: 266143 - DNA, 25 bp, Mus musculus
ctatgcagaagaagtactacaagta

SEQ ID NO: 266144 - DNA, 25 bp, Mus musculus
ctatgcagcaaagagttccaacacc

SEQ ID NO: 266145 - DNA, 25 bp, Mus musculus
ctatgcagcaaaggaaggacagacg

SEQ ID NO: 266146 - DNA, 25 bp, Mus musculus
ctatgcatcactaggaacagcatct

SEQ ID NO: 266147 - DNA, 25 bp, Mus musculus
ctatgcatccaagaaggatcctgta

SEQ ID NO: 266148 - DNA, 25 bp, Mus musculus
ctatgcatccaaggctgtcggcgag

SEQ ID NO: 266149 - DNA, 25 bp, Mus musculus
ctatgccaaggcaggctgtcaggtt

SEQ ID NO: 266150 - DNA, 25 bp, Mus musculus
ctatgccagaacagatagtcgtaca

SEQ ID NO: 266151 - DNA, 25 bp, Mus musculus
ctatgccatgaagcagaagggactc

SEQ ID NO: 266152 - DNA, 25 bp, Mus musculus
ctatgcccagaacatcccaacccag

SEQ ID NO: 266153 - DNA, 25 bp, Mus musculus
ctatgccccaagattcagtcccaag

SEQ ID NO: 266154 - DNA, 25 bp, Mus musculus
ctatgccccaaggaaagagtgccac

SEQ ID NO: 266155 - DNA, 25 bp, Mus musculus
ctatgcccggaattgaaagaatttg

SEQ ID NO: 266156 - DNA, 25 bp, Mus musculus
ctatgccgtggacaacaattacgat

SEQ ID NO: 266157 - DNA, 25 bp, Mus musculus
ctatgccgtggatgaacggggtaag

SEQ ID NO: 266158 - DNA, 25 bp, Mus musculus
ctatgcctgactcagactggttggg

SEQ ID NO: 266159 - DNA, 25 bp, Mus musculus
ctatgcctgactcaggcaggccagc

SEQ ID NO: 266160 - DNA, 25 bp, Mus musculus
ctatgcgaagcagatttatggtctg

SEQ ID NO: 266161 - DNA, 25 bp, Mus musculus
ctatgcgaagcagggtgtgcagatt

SEQ ID NO: 266162 - DNA, 25 bp, Mus musculus
ctatgctaagtatgagagccagacg

SEQ ID NO: 266163 - DNA, 25 bp, Mus musculus
ctatgctaataacatgtacctgaac

SEQ ID NO: 266164 - DNA, 25 bp, Mus musculus
ctatgctaccctaggaaggagtatg

SEQ ID NO: 266165 - DNA, 25 bp, Mus musculus
ctatgctatcgagatggtgacttgc

SEQ ID NO: 266166 - DNA, 25 bp, Mus musculus
ctatgctatcgaggtttttaagcct

SEQ ID NO: 266167 - DNA, 25 bp, Mus musculus
ctatgctcatagggtacagcatgtt

SEQ ID NO: 266168 - DNA, 25 bp, Mus musculus
ctatgctccctggtgcagcatgtgc

SEQ ID NO: 266169 - DNA, 25 bp, Mus musculus
ctatgctccctttcccaggtggtac

SEQ ID NO: 266170 - DNA, 25 bp, Mus musculus
ctatgctccggggagaaaaatgtat

SEQ ID NO: 266171 - DNA, 25 bp, Mus musculus
ctatgctccttggctgaaccttcgg

SEQ ID NO: 266172 - DNA, 25 bp, Mus musculus
ctatgctctcagaggttcctgacac

SEQ ID NO: 266173 - DNA, 25 bp, Mus musculus
ctatgctctcaggctggcatcatgc

SEQ ID NO: 266174 - DNA, 25 bp, Mus musculus
ctatgctctcttcattctcatacaa

SEQ ID NO: 266175 - DNA, 25 bp, Mus musculus
ctatgctgactcgagcattgcagag

SEQ ID NO: 266176 - DNA, 25 bp, Mus musculus
ctatgctgagctggtgaagcacaag

SEQ ID NO: 266177 - DNA, 25 bp, Mus musculus
ctatgctgagggccaaggatgtctt

SEQ ID NO: 266178 - DNA, 25 bp, Mus musculus
ctatgctgataaggccttgctcaac

SEQ ID NO: 266179 - DNA, 25 bp, Mus musculus
ctatgctgcaggaaatgacctgcag

SEQ ID NO: 266180 - DNA, 25 bp, Mus musculus
ctatgctgctgtgtgctgctctggt

SEQ ID NO: 266181 - DNA, 25 bp, Mus musculus
ctatgctggcctggcgttccacgcc

SEQ ID NO: 266182 - DNA, 25 bp, Mus musculus
ctatgctgggacggccttctctgac

SEQ ID NO: 266183 - DNA, 25 bp, Mus musculus
ctatgctgtggtttgccactagctt

SEQ ID NO: 266184 - DNA, 25 bp, Mus musculus
ctatgcttcagatggagtggatgga

SEQ ID NO: 266185 - DNA, 25 bp, Mus musculus
ctatgcttcagcccctggtcataag

SEQ ID NO: 266186 - DNA, 25 bp, Mus musculus
ctatgcttccggcatcgtgttggat

SEQ ID NO: 266187 - DNA, 25 bp, Mus musculus
ctatggaaaggtttttcaagtacga

SEQ ID NO: 266188 - DNA, 25 bp, Mus musculus
ctatggaagaaggatattacaaatg

SEQ ID NO: 266189 - DNA, 25 bp, Mus musculus
ctatggaagaggaatcttcaaagtc

SEQ ID NO: 266190 - DNA, 25 bp, Mus musculus
ctatggacaagcctgactgcctctt

SEQ ID NO: 266191 - DNA, 25 bp, Mus musculus
ctatggaccaaggtgttggggccac

SEQ ID NO: 266192 - DNA, 25 bp, Mus musculus
ctatggaccagggatttaaaatcca

SEQ ID NO: 266193 - DNA, 25 bp, Mus musculus
ctatggaccgccaggcactgggaaa

SEQ ID NO: 266194 - DNA, 25 bp, Mus musculus
ctatggacttaagaacttttcctat

SEQ ID NO: 266195 - DNA, 25 bp, Mus musculus
ctatggacttaagaccatgctcgca

SEQ ID NO: 266196 - DNA, 25 bp, Mus musculus
ctatggagagaagcaaatttccatt

SEQ ID NO: 266197 - DNA, 25 bp, Mus musculus
ctatggagagaagcaggagcttgaa

SEQ ID NO: 266198 - DNA, 25 bp, Mus musculus
ctatggagagagtatgctggataaa

SEQ ID NO: 266199 - DNA, 25 bp, Mus musculus
ctatggagagagtgctgaggctgta

SEQ ID NO: 266200 - DNA, 25 bp, Mus musculus
ctatggagaggtgggaaaggggtgc

SEQ ID NO: 266201 - DNA, 25 bp, Mus musculus
ctatggagagttcctcaccatgttt

SEQ ID NO: 266202 - DNA, 25 bp, Mus musculus
ctatggagcagcccaggcctcctca

SEQ ID NO: 266203 - DNA, 25 bp, Mus musculus
ctatggagcggtgtgctcggccatc

SEQ ID NO: 266204 - DNA, 25 bp, Mus musculus
ctatggagcggtgtggtcattgggc

SEQ ID NO: 266205 - DNA, 25 bp, Mus musculus
ctatggaggaagaagacagcatgaa

SEQ ID NO: 266206 - DNA, 25 bp, Mus musculus
ctatggaggaggaaattatggaagt

SEQ ID NO: 266207 - DNA, 25 bp, Mus musculus
ctatggagtgcctttctttctgccc

SEQ ID NO: 266208 - DNA, 25 bp, Mus musculus
ctatggagtggcaaaaactactctg

SEQ ID NO: 266209 - DNA, 25 bp, Mus musculus
ctatggagtgttggcagatatcccg

SEQ ID NO: 266210 - DNA, 25 bp, Mus musculus
ctatggataaggttaaaaattttgc

SEQ ID NO: 266211 - DNA, 25 bp, Mus musculus
ctatggatgccctcttggcttctgg

SEQ ID NO: 266212 - DNA, 25 bp, Mus musculus
ctatggatgggagacaatcccagct

SEQ ID NO: 266213 - DNA, 25 bp, Mus musculus
ctatggatgggagacctggaaccct

SEQ ID NO: 266214 - DNA, 25 bp, Mus musculus
ctatggatgggagacgatctggacg

SEQ ID NO: 266215 - DNA, 25 bp, Mus musculus
ctatggattcagtggggtgatgctc

SEQ ID NO: 266216 - DNA, 25 bp, Mus musculus
ctatggcaaggtgttccaggtgaga

SEQ ID NO: 266217 - DNA, 25 bp, Mus musculus
ctatggcactggtatctcattcagt

SEQ ID NO: 266218 - DNA, 25 bp, Mus musculus
ctatggcatatcagccatggacgga

SEQ ID NO: 266219 - DNA, 25 bp, Mus musculus
ctatggcatggttacagtaccttta

SEQ ID NO: 266220 - DNA, 25 bp, Mus musculus
ctatggccctaaaggggttggtgct

SEQ ID NO: 266221 - DNA, 25 bp, Mus musculus
ctatggcgagacagctcagctcttt

SEQ ID NO: 266222 - DNA, 25 bp, Mus musculus
ctatggcggagtgacaaagaattac

SEQ ID NO: 266223 - DNA, 25 bp, Mus musculus
ctatggcggagtttcaacaccgtga

SEQ ID NO: 266224 - DNA, 25 bp, Mus musculus
ctatggcggtggacatcatcctggg

SEQ ID NO: 266225 - DNA, 25 bp, Mus musculus
ctatggcgtaaagagactgatgtct

SEQ ID NO: 266226 - DNA, 25 bp, Mus musculus
ctatggcgtaaagaggttctcccca

SEQ ID NO: 266227 - DNA, 25 bp, Mus musculus
ctatggctagatccagactacattg

SEQ ID NO: 266228 - DNA, 25 bp, Mus musculus
ctatggctagcattcaacatcctgg

SEQ ID NO: 266229 - DNA, 25 bp, Mus musculus
ctatggctcccttcttctcatgggc

SEQ ID NO: 266230 - DNA, 25 bp, Mus musculus
ctatggctcggtgtgtcccttagaa

SEQ ID NO: 266231 - DNA, 25 bp, Mus musculus
ctatggctcggtgtgtgctgctttt

SEQ ID NO: 266232 - DNA, 25 bp, Mus musculus
ctatggctctcattattttcacaaa

SEQ ID NO: 266233 - DNA, 25 bp, Mus musculus
ctatggctgacaagcctatcctcta

SEQ ID NO: 266234 - DNA, 25 bp, Mus musculus
ctatggctggaggaatctgcgaagt

SEQ ID NO: 266235 - DNA, 25 bp, Mus musculus
ctatggcttaagaccgaagggagga

SEQ ID NO: 266236 - DNA, 25 bp, Mus musculus
ctatggcttaagggaccgacgtctg

SEQ ID NO: 266237 - DNA, 25 bp, Mus musculus
ctatggcttctttctccttgtggac

SEQ ID NO: 266238 - DNA, 25 bp, Mus musculus
ctatgggaaagagattctgaaaagc

SEQ ID NO: 266239 - DNA, 25 bp, Mus musculus
ctatgggaaggacatgaatgtgtta

SEQ ID NO: 266240 - DNA, 25 bp, Mus musculus
ctatgggacaccactgtcccaatac

SEQ ID NO: 266241 - DNA, 25 bp, Mus musculus
ctatgggagatgataaaagctttga

SEQ ID NO: 266242 - DNA, 25 bp, Mus musculus
ctatgggcaggtattcacctacaag

SEQ ID NO: 266243 - DNA, 25 bp, Mus musculus
ctatgggcaggtgttcacctacaag

SEQ ID NO: 266244 - DNA, 25 bp, Mus musculus
ctatgggcatgatgcccccgcctcc

SEQ ID NO: 266245 - DNA, 25 bp, Mus musculus
ctatgggcatgctagcaaaaaagta

SEQ ID NO: 266246 - DNA, 25 bp, Mus musculus
ctatgggcatggcatcgtcttcagc

SEQ ID NO: 266247 - DNA, 25 bp, Mus musculus
ctatgggccctctgggaccaagagg

SEQ ID NO: 266248 - DNA, 25 bp, Mus musculus
ctatgggccctgcaggactgttccc

SEQ ID NO: 266249 - DNA, 25 bp, Mus musculus
ctatgggctagagcaagccccgccc

SEQ ID NO: 266250 - DNA, 25 bp, Mus musculus
ctatggggagacaccagaggcatgc

SEQ ID NO: 266251 - DNA, 25 bp, Mus musculus
ctatgggggaaggtgacgccatctg

SEQ ID NO: 266252 - DNA, 25 bp, Mus musculus
ctatgggggcctgggtccaagccgg

SEQ ID NO: 266253 - DNA, 25 bp, Mus musculus
ctatggggggacctgcactcagcag

SEQ ID NO: 266254 - DNA, 25 bp, Mus musculus
ctatgggtcaggtagtgggcagcag

SEQ ID NO: 266255 - DNA, 25 bp, Mus musculus
ctatgggtcgcgggtctactctgtg

SEQ ID NO: 266256 - DNA, 25 bp, Mus musculus
ctatgggtcggttccgggagcgcat

SEQ ID NO: 266257 - DNA, 25 bp, Mus musculus
ctatgggttcaggttctgccaccag

SEQ ID NO: 266258 - DNA, 25 bp, Mus musculus
ctatggtaaagatccctcaagaaca

SEQ ID NO: 266259 - DNA, 25 bp, Mus musculus
ctatggtgaaccgtgtgtgtctgct

SEQ ID NO: 266260 - DNA, 25 bp, Mus musculus
ctatggtgaactctgtctgcaatcc

SEQ ID NO: 266261 - DNA, 25 bp, Mus musculus
ctatggtgaactggctgacagttga

SEQ ID NO: 266262 - DNA, 25 bp, Mus musculus
ctatggtgaactggctgagacttgc

SEQ ID NO: 266263 - DNA, 25 bp, Mus musculus
ctatggtgaaggctcttgctgagct

SEQ ID NO: 266264 - DNA, 25 bp, Mus musculus
ctatggtgcagtgcatcattgagga

SEQ ID NO: 266265 - DNA, 25 bp, Mus musculus
ctatggtggaggtagaagattttgt

SEQ ID NO: 266266 - DNA, 25 bp, Mus musculus
ctatggtgtcagaaaaaatgtgggg

SEQ ID NO: 266267 - DNA, 25 bp, Mus musculus
ctatggtttaagacgcttaaaggat

SEQ ID NO: 266268 - DNA, 25 bp, Mus musculus
ctatgtactacaatggcattggagt

SEQ ID NO: 266269 - DNA, 25 bp, Mus musculus
ctatgtactcaggatatgctgtcat

SEQ ID NO: 266270 - DNA, 25 bp, Mus musculus
ctatgtactcagggggaaaatgcta

SEQ ID NO: 266271 - DNA, 25 bp, Mus musculus
ctatgtagctcagaatgtgaagctc

SEQ ID NO: 266272 - DNA, 25 bp, Mus musculus
ctatgtagctcaggttcccctccag

SEQ ID NO: 266273 - DNA, 25 bp, Mus musculus
ctatgtaggtggaagtcttctatga

SEQ ID NO: 266274 - DNA, 25 bp, Mus musculus
ctatgtcaaaacctgggcaagatcc

SEQ ID NO: 266275 - DNA, 25 bp, Mus musculus
ctatgtcagcacagctgtctgggat

SEQ ID NO: 266276 - DNA, 25 bp, Mus musculus
ctatgtcagggttcggagcgaccgt

SEQ ID NO: 266277 - DNA, 25 bp, Mus musculus
ctatgtcagtgaggttcctgctgct

SEQ ID NO: 266278 - DNA, 25 bp, Mus musculus
ctatgtcatgatggtgtttggcctt

SEQ ID NO: 266279 - DNA, 25 bp, Mus musculus
ctatgtcatggtggggttttttggt

SEQ ID NO: 266280 - DNA, 25 bp, Mus musculus
ctatgtctgccagtgtgccccaggc

SEQ ID NO: 266281 - DNA, 25 bp, Mus musculus
ctatgtgaaggtgctcctggtcacg

SEQ ID NO: 266282 - DNA, 25 bp, Mus musculus
ctatgtgaatttgggaggtcataag

SEQ ID NO: 266283 - DNA, 25 bp, Mus musculus
ctatgtgaatttgggcacctccgca

SEQ ID NO: 266284 - DNA, 25 bp, Mus musculus
ctatgtgcaagacggcccccttgag

SEQ ID NO: 266285 - DNA, 25 bp, Mus musculus
ctatgtgcacaggaaaggaagttcc

SEQ ID NO: 266286 - DNA, 25 bp, Mus musculus
ctatgtgcacagggtcgggagaaca

SEQ ID NO: 266287 - DNA, 25 bp, Mus musculus
ctatgtgccagctgcaacggaagat

SEQ ID NO: 266288 - DNA, 25 bp, Mus musculus
ctatgtgccaggctgcccgcccacg

SEQ ID NO: 266289 - DNA, 25 bp, Mus musculus
ctatgtgctgcagactgaagtggcc

SEQ ID NO: 266290 - DNA, 25 bp, Mus musculus
ctatgtgctgcaggctacatgtgag

SEQ ID NO: 266291 - DNA, 25 bp, Mus musculus
ctatgtggaaaggaaaatagaaatt

SEQ ID NO: 266292 - DNA, 25 bp, Mus musculus
ctatgtggcaggctgggtcctagag

SEQ ID NO: 266293 - DNA, 25 bp, Mus musculus
ctatgtggcttagcagatcatcagt

SEQ ID NO: 266294 - DNA, 25 bp, Mus musculus
ctatgtgtatggcttggcaaattgt

SEQ ID NO: 266295 - DNA, 25 bp, Mus musculus
ctatgtgtatggtgattccaccagt

SEQ ID NO: 266296 - DNA, 25 bp, Mus musculus
ctatgtgtcctcagagtctcccatt

SEQ ID NO: 266297 - DNA, 25 bp, Mus musculus
ctatgttacagaacccaagagtgtt

SEQ ID NO: 266298 - DNA, 25 bp, Mus musculus
ctatgttgagattcattttatgtgg

SEQ ID NO: 266299 - DNA, 25 bp, Mus musculus
ctatgttgagcttcgttacgacgat

SEQ ID NO: 266300 - DNA, 25 bp, Mus musculus
ctatgtttagcgcagtgcttgacaa

SEQ ID NO: 266301 - DNA, 25 bp, Mus musculus
ctatgtttagggcagtgcttgacaa

SEQ ID NO: 266302 - DNA, 25 bp, Mus musculus
ctattaaaagagggtgcctcagaag

SEQ ID NO: 266303 - DNA, 25 bp, Mus musculus
ctattaaaagatgacttacagggta

SEQ ID NO: 266304 - DNA, 25 bp, Mus musculus
ctattaaaagccccagaccctccct

SEQ ID NO: 266305 - DNA, 25 bp, Mus musculus
ctattaaaagctcttttggaagaag

SEQ ID NO: 266306 - DNA, 25 bp, Mus musculus
ctattaaaaggtcaccaccatagca

SEQ ID NO: 266307 - DNA, 25 bp, Mus musculus
ctattaacacagatgctgctcagac

SEQ ID NO: 266308 - DNA, 25 bp, Mus musculus
ctattaacacagcacggtgcaacag

SEQ ID NO: 266309 - DNA, 25 bp, Mus musculus
ctattaacacaggatcacactatgg

SEQ ID NO: 266310 - DNA, 25 bp, Mus musculus
ctattaacagataagccctccctga

SEQ ID NO: 266311 - DNA, 25 bp, Mus musculus
ctattaacagcttcgaccttgcctc

SEQ ID NO: 266312 - DNA, 25 bp, Mus musculus
ctattaaccaggtcttcaagatgat

SEQ ID NO: 266313 - DNA, 25 bp, Mus musculus
ctattaagaagaagacaaaaaagcg

SEQ ID NO: 266314 - DNA, 25 bp, Mus musculus
ctattaagaatgaggtggcgagtgg

SEQ ID NO: 266315 - DNA, 25 bp, Mus musculus
ctattacaacctcgaggaatcatgc

SEQ ID NO: 266316 - DNA, 25 bp, Mus musculus
ctattacaccgggtgaacctgaatt

SEQ ID NO: 266317 - DNA, 25 bp, Mus musculus
ctattacatcaaccatcaaacacag

SEQ ID NO: 266318 - DNA, 25 bp, Mus musculus
ctattacatgccaacaattctcttg

SEQ ID NO: 266319 - DNA, 25 bp, Mus musculus
ctattacatggatacatgggcggca

SEQ ID NO: 266320 - DNA, 25 bp, Mus musculus
ctattacccaggggaccccagctct

SEQ ID NO: 266321 - DNA, 25 bp, Mus musculus
ctattaccgctctagccgcagccag

SEQ ID NO: 266322 - DNA, 25 bp, Mus musculus
ctattacctcaatgagatccagagt

SEQ ID NO: 266323 - DNA, 25 bp, Mus musculus
ctattacgacaagaacatcatcaag

SEQ ID NO: 266324 - DNA, 25 bp, Mus musculus
ctattacgacaagacaccaagtgga

SEQ ID NO: 266325 - DNA, 25 bp, Mus musculus
ctattacgagtatggctacatcttt

SEQ ID NO: 266326 - DNA, 25 bp, Mus musculus
ctattacggcatcctgagtgatgtt

SEQ ID NO: 266327 - DNA, 25 bp, Mus musculus
ctattacggcatggaccttgacttc

SEQ ID NO: 266328 - DNA, 25 bp, Mus musculus
ctattatcatagaccttcaggcaaa

SEQ ID NO: 266329 - DNA, 25 bp, Mus musculus
ctattatcatgatactaccacaaga

SEQ ID NO: 266330 - DNA, 25 bp, Mus musculus
ctattatgtagatgtgcagaaattc

SEQ ID NO: 266331 - DNA, 25 bp, Mus musculus
ctattattcccggtgtggaatatta

SEQ ID NO: 266332 - DNA, 25 bp, Mus musculus
ctattcaagagcccccaattttatc

SEQ ID NO: 266333 - DNA, 25 bp, Mus musculus
ctattcaatgaagagcggctgattg

SEQ ID NO: 266334 - DNA, 25 bp, Mus musculus
ctattcaatgaagagggcatctcct

SEQ ID NO: 266335 - DNA, 25 bp, Mus musculus
ctattcacagaagggttgactacag

SEQ ID NO: 266336 - DNA, 25 bp, Mus musculus
ctattcaccgatcagaaacctgata

SEQ ID NO: 266337 - DNA, 25 bp, Mus musculus
ctattcaccgatcaggacaacatcc

SEQ ID NO: 266338 - DNA, 25 bp, Mus musculus
ctattcacttccaacgtgaaactca

SEQ ID NO: 266339 - DNA, 25 bp, Mus musculus
ctattcagcaggaagcgtcccaggt

SEQ ID NO: 266340 - DNA, 25 bp, Mus musculus
ctattcagcaggaagtaaaatctct

SEQ ID NO: 266341 - DNA, 25 bp, Mus musculus
ctattcagccagatgaactttcaag

SEQ ID NO: 266342 - DNA, 25 bp, Mus musculus
ctattcagtacaggaaggctgtgaa

SEQ ID NO: 266343 - DNA, 25 bp, Mus musculus
ctattcagtacagggcttcttcgtg

SEQ ID NO: 266344 - DNA, 25 bp, Mus musculus
ctattcatccatggaccggcacgat

SEQ ID NO: 266345 - DNA, 25 bp, Mus musculus
ctattccaaagatactggcattgcc

SEQ ID NO: 266346 - DNA, 25 bp, Mus musculus
ctattccagagatgagatcacatag

SEQ ID NO: 266347 - DNA, 25 bp, Mus musculus
ctattcccagctccaccagagaaga

SEQ ID NO: 266348 - DNA, 25 bp, Mus musculus
ctattcctgaataaacactgaattg

SEQ ID NO: 266349 - DNA, 25 bp, Mus musculus
ctattcgagcaggtggggcgagcta

SEQ ID NO: 266350 - DNA, 25 bp, Mus musculus
ctattcgtaatgatttcattatgaa

SEQ ID NO: 266351 - DNA, 25 bp, Mus musculus
ctattcgtttgtcagattttccact

SEQ ID NO: 266352 - DNA, 25 bp, Mus musculus
ctattctacaagcatggcctgattg

SEQ ID NO: 266353 - DNA, 25 bp, Mus musculus
ctattctacaggaaaaatccgctgc

SEQ ID NO: 266354 - DNA, 25 bp, Mus musculus
ctattctgaagtagcttgccacaag

SEQ ID NO: 266355 - DNA, 25 bp, Mus musculus
ctattctgactggagccctttcagt

SEQ ID NO: 266356 - DNA, 25 bp, Mus musculus
ctattctgagaaggggctcctgttt

SEQ ID NO: 266357 - DNA, 25 bp, Mus musculus
ctattctgagaaggttccctgtagc

SEQ ID NO: 266358 - DNA, 25 bp, Mus musculus
ctattctgaggttggtgtcattggt

SEQ ID NO: 266359 - DNA, 25 bp, Mus musculus
ctattctgcatctgagtgggaactg

SEQ ID NO: 266360 - DNA, 25 bp, Mus musculus
ctattctgctcgtcagcacatcatg

SEQ ID NO: 266361 - DNA, 25 bp, Mus musculus
ctattcttactacaggaatgagtgc

SEQ ID NO: 266362 - DNA, 25 bp, Mus musculus
ctattcttgacggacttaaaaggac

SEQ ID NO: 266363 - DNA, 25 bp, Mus musculus
ctattgaaagagaggtcttacttgt

SEQ ID NO: 266364 - DNA, 25 bp, Mus musculus
ctattgagactgtgggatagtgtgc

SEQ ID NO: 266365 - DNA, 25 bp, Mus musculus
ctattgagactgtggtgtgtctgca

SEQ ID NO: 266366 - DNA, 25 bp, Mus musculus
ctattgagataaaagccagagttac

SEQ ID NO: 266367 - DNA, 25 bp, Mus musculus
ctattgagcctcgaagtctttacct

SEQ ID NO: 266368 - DNA, 25 bp, Mus musculus
ctattgagcgcaaggtaatagaact

SEQ ID NO: 266369 - DNA, 25 bp, Mus musculus
ctattgataaggctgcctttgatat

SEQ ID NO: 266370 - DNA, 25 bp, Mus musculus
ctattgataaggtaacaagccgatg

SEQ ID NO: 266371 - DNA, 25 bp, Mus musculus
ctattgatggaaaagggttcctttg

SEQ ID NO: 266372 - DNA, 25 bp, Mus musculus
ctattgatggaaagggtccaattgg

SEQ ID NO: 266373 - DNA, 25 bp, Mus musculus
ctattgattagtacaaacaggccat

SEQ ID NO: 266374 - DNA, 25 bp, Mus musculus
ctattgcacggatggtgaactttga

SEQ ID NO: 266375 - DNA, 25 bp, Mus musculus
ctattgcagagatggagactcaaag

SEQ ID NO: 266376 - DNA, 25 bp, Mus musculus
ctattgcagagggcaagtttatcca

SEQ ID NO: 266377 - DNA, 25 bp, Mus musculus
ctattgctatgaagttgaatctgcg

SEQ ID NO: 266378 - DNA, 25 bp, Mus musculus
ctattgctcaggccctggcacatct

SEQ ID NO: 266379 - DNA, 25 bp, Mus musculus
ctattggctgggcaatgaatgcagc

SEQ ID NO: 266380 - DNA, 25 bp, Mus musculus
ctattggcttctcccatgatgaccc

SEQ ID NO: 266381 - DNA, 25 bp, Mus musculus
ctattggggagagagaaaaaaccat

SEQ ID NO: 266382 - DNA, 25 bp, Mus musculus
ctattgggtaatgggccaattcaat

SEQ ID NO: 266383 - DNA, 25 bp, Mus musculus
ctattgtgaggaactaatgaccatt

SEQ ID NO: 266384 - DNA, 25 bp, Mus musculus
ctattgtgagtaccctgggaaaaga

SEQ ID NO: 266385 - DNA, 25 bp, Mus musculus
ctattgtggaaggatacgccaatgt

SEQ ID NO: 266386 - DNA, 25 bp, Mus musculus
ctattgtgtaagcagaatattcaag

SEQ ID NO: 266387 - DNA, 25 bp, Mus musculus
ctattgttgcatcaggtactgtaat

SEQ ID NO: 266388 - DNA, 25 bp, Mus musculus
ctatttaagaagagaaggtggctgc

SEQ ID NO: 266389 - DNA, 25 bp, Mus musculus
ctatttaagaagatgaaaccagatt

SEQ ID NO: 266390 - DNA, 25 bp, Mus musculus
ctatttacagagcccatggatggga

SEQ ID NO: 266391 - DNA, 25 bp, Mus musculus
ctatttaccagaccaagaaggtcta

SEQ ID NO: 266392 - DNA, 25 bp, Mus musculus
ctatttaccaggacattcgacatga

SEQ ID NO: 266393 - DNA, 25 bp, Mus musculus
ctatttaccaggtgaggacacttgt

SEQ ID NO: 266394 - DNA, 25 bp, Mus musculus
ctatttatgaattcacagacacagt

SEQ ID NO: 266395 - DNA, 25 bp, Mus musculus
ctatttatgatactgcatttttcaa

SEQ ID NO: 266396 - DNA, 25 bp, Mus musculus
ctatttattccagctacctggagaa

SEQ ID NO: 266397 - DNA, 25 bp, Mus musculus
ctatttcaaaaatgggaacttgacg

SEQ ID NO: 266398 - DNA, 25 bp, Mus musculus
ctatttcaaaaatgggatagatgtg

SEQ ID NO: 266399 - DNA, 25 bp, Mus musculus
ctatttcaagataaacaagctggag

SEQ ID NO: 266400 - DNA, 25 bp, Mus musculus
ctatttcatgctggatgacctcaat

SEQ ID NO: 266401 - DNA, 25 bp, Mus musculus
ctatttccagattggtgccattcag

SEQ ID NO: 266402 - DNA, 25 bp, Mus musculus
ctatttccagcactggccagtgttc

SEQ ID NO: 266403 - DNA, 25 bp, Mus musculus
ctatttccagcagggtgacatggag

SEQ ID NO: 266404 - DNA, 25 bp, Mus musculus
ctatttccaggtatggtatgaaacc

SEQ ID NO: 266405 - DNA, 25 bp, Mus musculus
ctatttccagtgcaccagcagaaca

SEQ ID NO: 266406 - DNA, 25 bp, Mus musculus
ctatttcctagagctgtttgacaac

SEQ ID NO: 266407 - DNA, 25 bp, Mus musculus
ctatttcttgttgccaaaacaaaga

SEQ ID NO: 266408 - DNA, 25 bp, Mus musculus
ctatttctttacctgacaaagccaa

SEQ ID NO: 266409 - DNA, 25 bp, Mus musculus
ctatttgacatggcctctgaagaac

SEQ ID NO: 266410 - DNA, 25 bp, Mus musculus
ctatttgaccatctgttctgtgccc

SEQ ID NO: 266411 - DNA, 25 bp, Mus musculus
ctatttgatgcactagctgaaaaac

SEQ ID NO: 266412 - DNA, 25 bp, Mus musculus
ctatttgatgttcatgcagaagaag

SEQ ID NO: 266413 - DNA, 25 bp, Mus musculus
ctatttgcccttaaggccctggaat

SEQ ID NO: 266414 - DNA, 25 bp, Mus musculus
ctatttgcccttaaggtccctgccc

SEQ ID NO: 266415 - DNA, 25 bp, Mus musculus
ctatttgcgtagccgcctgtgtggt

SEQ ID NO: 266416 - DNA, 25 bp, Mus musculus
ctatttgggtggggagaagagacgt

SEQ ID NO: 266417 - DNA, 25 bp, Mus musculus
ctatttgtcccgtggcccctctggt

SEQ ID NO: 266418 - DNA, 25 bp, Mus musculus
ctatttgtcccgtgggcccaagaac

SEQ ID NO: 266419 - DNA, 25 bp, Mus musculus
ctatttgtgaggcgaacattgaggc

SEQ ID NO: 266420 - DNA, 25 bp, Mus musculus
ctatttgtgggattgttcatcacct

SEQ ID NO: 266421 - DNA, 25 bp, Mus musculus
ctattttcaggatgtcagtggggga

SEQ ID NO: 266422 - DNA, 25 bp, Mus musculus
ctattttcaggggtttcgtgttgac

SEQ ID NO: 266423 - DNA, 25 bp, Mus musculus
ctattttgagagactgcctttagcg

SEQ ID NO: 266424 - DNA, 25 bp, Mus musculus
ctattttgaggttgagcacatcacc

SEQ ID NO: 266425 - DNA, 25 bp, Mus musculus
ctattttgtcgttcggtgctcgtag

SEQ ID NO: 266426 - DNA, 25 bp, Mus musculus
ctattttgtttcggaagacaacatg

SEQ ID NO: 266427 - DNA, 25 bp, Mus musculus
ctattttgtttcggacaggccagga

SEQ ID NO: 266428 - DNA, 25 bp, Mus musculus
ctattttgtttcgggacaactgcca

SEQ ID NO: 266429 - DNA, 25 bp, Mus musculus
ctcaaaaaacacagctgcctgcctt

SEQ ID NO: 266430 - DNA, 25 bp, Mus musculus
ctcaaaaaagccaggcctctgatcc

SEQ ID NO: 266431 - DNA, 25 bp, Mus musculus
ctcaaaaagtgtgcaggtttcaact

SEQ ID NO: 266432 - DNA, 25 bp, Mus musculus
ctcaaaaagtgtgcagttcagaggt

SEQ ID NO: 266433 - DNA, 25 bp, Mus musculus
ctcaaaaattataattgcttctact

SEQ ID NO: 266434 - DNA, 25 bp, Mus musculus
ctcaaaacagatctgtctgatttaa

SEQ ID NO: 266435 - DNA, 25 bp, Mus musculus
ctcaaaaccaaaaatcctgactttt

SEQ ID NO: 266436 - DNA, 25 bp, Mus musculus
ctcaaaaccaagtcactccttgtgg

SEQ ID NO: 266437 - DNA, 25 bp, Mus musculus
ctcaaaaccagggatactgggaacc

SEQ ID NO: 266438 - DNA, 25 bp, Mus musculus
ctcaaaacccaaaggaagagcccag

SEQ ID NO: 266439 - DNA, 25 bp, Mus musculus
ctcaaaacccagagggccagtaaga

SEQ ID NO: 266440 - DNA, 25 bp, Mus musculus
ctcaaaacctgacaagacatttcaa

SEQ ID NO: 266441 - DNA, 25 bp, Mus musculus
ctcaaaactggcttggagtcaaaat

SEQ ID NO: 266442 - DNA, 25 bp, Mus musculus
ctcaaaactgggattattggcccag

SEQ ID NO: 266443 - DNA, 25 bp, Mus musculus
ctcaaaaggctcaagggctttgctg

SEQ ID NO: 266444 - DNA, 25 bp, Mus musculus
ctcaaaatgagccccggcagcccaa

SEQ ID NO: 266445 - DNA, 25 bp, Mus musculus
ctcaaaatgtgcctctcccagtgtc

SEQ ID NO: 266446 - DNA, 25 bp, Mus musculus
ctcaaaattcaattgctgatagccc

SEQ ID NO: 266447 - DNA, 25 bp, Mus musculus
ctcaaaattcaatttctgttgcccc

SEQ ID NO: 266448 - DNA, 25 bp, Mus musculus
ctcaaacaaagcatcgctgatagac

SEQ ID NO: 266449 - DNA, 25 bp, Mus musculus
ctcaaacaaagcatctatccagcca

SEQ ID NO: 266450 - DNA, 25 bp, Mus musculus
ctcaaacaagaaaaagagaaaagag

SEQ ID NO: 266451 - DNA, 25 bp, Mus musculus
ctcaaacaagaagaatcctgttgtg

SEQ ID NO: 266452 - DNA, 25 bp, Mus musculus
ctcaaacaaggcaccaaggagagga

SEQ ID NO: 266453 - DNA, 25 bp, Mus musculus
ctcaaacaagtgtgatgctctgctg

SEQ ID NO: 266454 - DNA, 25 bp, Mus musculus
ctcaaacaataggtgaccagtgtgt

SEQ ID NO: 266455 - DNA, 25 bp, Mus musculus
ctcaaacacaaagtgctgcagtcgc

SEQ ID NO: 266456 - DNA, 25 bp, Mus musculus
ctcaaacacagctcaaagattagaa

SEQ ID NO: 266457 - DNA, 25 bp, Mus musculus
ctcaaacacatccacttcagcacct

SEQ ID NO: 266458 - DNA, 25 bp, Mus musculus
ctcaaacacatgtgactctcctatt

SEQ ID NO: 266459 - DNA, 25 bp, Mus musculus
ctcaaacagaaatggtgaggacact

SEQ ID NO: 266460 - DNA, 25 bp, Mus musculus
ctcaaacaggaaagatcgcaaaaga

SEQ ID NO: 266461 - DNA, 25 bp, Mus musculus
ctcaaaccaaatcagatgtcatggc

SEQ ID NO: 266462 - DNA, 25 bp, Mus musculus
ctcaaaccaacagtatcacatctgc

SEQ ID NO: 266463 - DNA, 25 bp, Mus musculus
ctcaaaccaacagttccctgccgct

SEQ ID NO: 266464 - DNA, 25 bp, Mus musculus
ctcaaaccaacattcagcaggactt

SEQ ID NO: 266465 - DNA, 25 bp, Mus musculus
ctcaaaccacgcggagtgtcctttt

SEQ ID NO: 266466 - DNA, 25 bp, Mus musculus
ctcaaaccacgtgacctcttggttc

SEQ ID NO: 266467 - DNA, 25 bp, Mus musculus
ctcaaaccagagaggacctgagctg

SEQ ID NO: 266468 - DNA, 25 bp, Mus musculus
ctcaaaccaggtgatcatgctaacc

SEQ ID NO: 266469 - DNA, 25 bp, Mus musculus
ctcaaacccagaaccaaggagagca

SEQ ID NO: 266470 - DNA, 25 bp, Mus musculus
ctcaaacccctcatctccccggccg

SEQ ID NO: 266471 - DNA, 25 bp, Mus musculus
ctcaaacccgcaacttgaattggtg

SEQ ID NO: 266472 - DNA, 25 bp, Mus musculus
ctcaaacctgccatgggaaggagat

SEQ ID NO: 266473 - DNA, 25 bp, Mus musculus
ctcaaacctgccatgggagctggac

SEQ ID NO: 266474 - DNA, 25 bp, Mus musculus
ctcaaactaagtggcctgcttgatt

SEQ ID NO: 266475 - DNA, 25 bp, Mus musculus
ctcaaactcaactctcgatccacac

SEQ ID NO: 266476 - DNA, 25 bp, Mus musculus
ctcaaactcctgccctgcataaggt

SEQ ID NO: 266477 - DNA, 25 bp, Mus musculus
ctcaaactctcagagaaccgagccc

SEQ ID NO: 266478 - DNA, 25 bp, Mus musculus
ctcaaactcttgcaaggtctggttt

SEQ ID NO: 266479 - DNA, 25 bp, Mus musculus
ctcaaagaagaaaagctcaacagag

SEQ ID NO: 266480 - DNA, 25 bp, Mus musculus
ctcaaagaaggtcagctggccgctg

SEQ ID NO: 266481 - DNA, 25 bp, Mus musculus
ctcaaagacactcaggtccctccag

SEQ ID NO: 266482 - DNA, 25 bp, Mus musculus
ctcaaagacagaaataaaaataaga

SEQ ID NO: 266483 - DNA, 25 bp, Mus musculus
ctcaaagacaggccagttaaattta

SEQ ID NO: 266484 - DNA, 25 bp, Mus musculus
ctcaaagatgcagtgccagttttgc

SEQ ID NO: 266485 - DNA, 25 bp, Mus musculus
ctcaaagattcaggctggacaattt

SEQ ID NO: 266486 - DNA, 25 bp, Mus musculus
ctcaaagattcaggttctccccaat

SEQ ID NO: 266487 - DNA, 25 bp, Mus musculus
ctcaaagatttctgttttggtcgtg

SEQ ID NO: 266488 - DNA, 25 bp, Mus musculus
ctcaaagcagcaggagcagaccccc

SEQ ID NO: 266489 - DNA, 25 bp, Mus musculus
ctcaaagcatggggacattcaatcc

SEQ ID NO: 266490 - DNA, 25 bp, Mus musculus
ctcaaagccaaactgcagatgacag

SEQ ID NO: 266491 - DNA, 25 bp, Mus musculus
ctcaaagccatggtttgactctgct

SEQ ID NO: 266492 - DNA, 25 bp, Mus musculus
ctcaaagcccaggagaagcgccccg

SEQ ID NO: 266493 - DNA, 25 bp, Mus musculus
ctcaaagcccaggtcaaactctggt

SEQ ID NO: 266494 - DNA, 25 bp, Mus musculus
ctcaaaggactgaagggagtggaaa

SEQ ID NO: 266495 - DNA, 25 bp, Mus musculus
ctcaaaggagagaaatgtcaacgtg

SEQ ID NO: 266496 - DNA, 25 bp, Mus musculus
ctcaaagggaaggaaaacgcttgtg

SEQ ID NO: 266497 - DNA, 25 bp, Mus musculus
ctcaaagggcaagcttctactcaga

SEQ ID NO: 266498 - DNA, 25 bp, Mus musculus
ctcaaagtaaacaaacatggaagat

SEQ ID NO: 266499 - DNA, 25 bp, Mus musculus
ctcaaagtaaacattttctatttaa

SEQ ID NO: 266500 - DNA, 25 bp, Mus musculus
ctcaaagtcaagaaaaaacaagaag

SEQ ID NO: 266501 - DNA, 25 bp, Mus musculus
ctcaaagtcaagatctcaaaatgtt

SEQ ID NO: 266502 - DNA, 25 bp, Mus musculus
ctcaaagtcaagctgaacagggcca

SEQ ID NO: 266503 - DNA, 25 bp, Mus musculus
ctcaaagtgctgaggctgcctgctg

SEQ ID NO: 266504 - DNA, 25 bp, Mus musculus
ctcaaagtggcaggccgcatccacg

SEQ ID NO: 266505 - DNA, 25 bp, Mus musculus
ctcaaataaagaagatacattattt

SEQ ID NO: 266506 - DNA, 25 bp, Mus musculus
ctcaaatacacgccttccttcaggc

SEQ ID NO: 266507 - DNA, 25 bp, Mus musculus
ctcaaatacacgctgatgttcctct

SEQ ID NO: 266508 - DNA, 25 bp, Mus musculus
ctcaaatcggggaaaaactctcaca

SEQ ID NO: 266509 - DNA, 25 bp, Mus musculus
ctcaaatctgatagggaaaacatca

SEQ ID NO: 266510 - DNA, 25 bp, Mus musculus
ctcaaatgaagaatcaccgccgccc

SEQ ID NO: 266511 - DNA, 25 bp, Mus musculus
ctcaaatgtcaaagctggcaagatg

SEQ ID NO: 266512 - DNA, 25 bp, Mus musculus
ctcaaatgtcaaaggatgaccttga

SEQ ID NO: 266513 - DNA, 25 bp, Mus musculus
ctcaaatgtgatgcatgtggcatga

SEQ ID NO: 266514 - DNA, 25 bp, Mus musculus
ctcaaattaaatccaagttaatccg

SEQ ID NO: 266515 - DNA, 25 bp, Mus musculus
ctcaaattctcacgacagcagccct

SEQ ID NO: 266516 - DNA, 25 bp, Mus musculus
ctcaaattctcaggacagcagccct

SEQ ID NO: 266517 - DNA, 25 bp, Mus musculus
ctcaaatttctggagcctatcttcc

SEQ ID NO: 266518 - DNA, 25 bp, Mus musculus
ctcaacaaaagggctctactacatg

SEQ ID NO: 266519 - DNA, 25 bp, Mus musculus
ctcaacaatctggctcttctgtcag

SEQ ID NO: 266520 - DNA, 25 bp, Mus musculus
ctcaacacaatttcaataacttaca

SEQ ID NO: 266521 - DNA, 25 bp, Mus musculus
ctcaacacaatttcaatgtgttaca

SEQ ID NO: 266522 - DNA, 25 bp, Mus musculus
ctcaacacaatttcagactacaaaa

SEQ ID NO: 266523 - DNA, 25 bp, Mus musculus
ctcaacacccatgtgaagcctttga

SEQ ID NO: 266524 - DNA, 25 bp, Mus musculus
ctcaacagaacaggatttgtgcagg

SEQ ID NO: 266525 - DNA, 25 bp, Mus musculus
ctcaacagaacagtgctcttggctc

SEQ ID NO: 266526 - DNA, 25 bp, Mus musculus
ctcaacagaagcgagacggtgttct

SEQ ID NO: 266527 - DNA, 25 bp, Mus musculus
ctcaacagaagggatacttaccgca

SEQ ID NO: 266528 - DNA, 25 bp, Mus musculus
ctcaacagacatttgctccaagtac

SEQ ID NO: 266529 - DNA, 25 bp, Mus musculus
ctcaacagagttcatgttctgtggt

SEQ ID NO: 266530 - DNA, 25 bp, Mus musculus
ctcaacagccatctccagtggcttc

SEQ ID NO: 266531 - DNA, 25 bp, Mus musculus
ctcaacagccatctgcaatggctgc

SEQ ID NO: 266532 - DNA, 25 bp, Mus musculus
ctcaacagcccaatggtgcaggttt

SEQ ID NO: 266533 - DNA, 25 bp, Mus musculus
ctcaacagcccaatggtttcgccac

SEQ ID NO: 266534 - DNA, 25 bp, Mus musculus
ctcaacagccggagcagctgggcag

SEQ ID NO: 266535 - DNA, 25 bp, Mus musculus
ctcaacagcttgtgaccttgtttga

SEQ ID NO: 266536 - DNA, 25 bp, Mus musculus
ctcaacatcgacagcatcaatagga

SEQ ID NO: 266537 - DNA, 25 bp, Mus musculus
ctcaacatgaacaagcgattataca

SEQ ID NO: 266538 - DNA, 25 bp, Mus musculus
ctcaacatgaacaagcgcttgtaca

SEQ ID NO: 266539 - DNA, 25 bp, Mus musculus
ctcaacatggaaaagtataacttct

SEQ ID NO: 266540 - DNA, 25 bp, Mus musculus
ctcaacatgtatggcttccgaaaag

SEQ ID NO: 266541 - DNA, 25 bp, Mus musculus
ctcaacatgtatggttttcggaagg

SEQ ID NO: 266542 - DNA, 25 bp, Mus musculus
ctcaacatgtctcattcagttcctg

SEQ ID NO: 266543 - DNA, 25 bp, Mus musculus
ctcaaccacaagcaacgatgcctac

SEQ ID NO: 266544 - DNA, 25 bp, Mus musculus
ctcaaccacagtgtggacaagaagg

SEQ ID NO: 266545 - DNA, 25 bp, Mus musculus
ctcaaccctcgtctcttctgtcgga

SEQ ID NO: 266546 - DNA, 25 bp, Mus musculus
ctcaacctagcagaagcgctcctgg

SEQ ID NO: 266547 - DNA, 25 bp, Mus musculus
ctcaacctcaagggctgtgaggtgg

SEQ ID NO: 266548 - DNA, 25 bp, Mus musculus
ctcaacctcagggaaccagctcagt

SEQ ID NO: 266549 - DNA, 25 bp, Mus musculus
ctcaacctcccaagactcctacagg

SEQ ID NO: 266550 - DNA, 25 bp, Mus musculus
ctcaacctctcttcaggcccagagc

SEQ ID NO: 266551 - DNA, 25 bp, Mus musculus
ctcaacctgccagatgcagagaaga

SEQ ID NO: 266552 - DNA, 25 bp, Mus musculus
ctcaacctgccaggatatgctctcc

SEQ ID NO: 266553 - DNA, 25 bp, Mus musculus
ctcaacctggtcacccatccctgac

SEQ ID NO: 266554 - DNA, 25 bp, Mus musculus
ctcaacctggtctatgaaacaactg

SEQ ID NO: 266555 - DNA, 25 bp, Mus musculus
ctcaaccttgctggcaccatcggtt

SEQ ID NO: 266556 - DNA, 25 bp, Mus musculus
ctcaacgagcaggatgaggtgttga

SEQ ID NO: 266557 - DNA, 25 bp, Mus musculus
ctcaacggagagtatgagagttcct

SEQ ID NO: 266558 - DNA, 25 bp, Mus musculus
ctcaacgtgctccccttctgctgca

SEQ ID NO: 266559 - DNA, 25 bp, Mus musculus
ctcaacgttaatgtggttcgtctcc

SEQ ID NO: 266560 - DNA, 25 bp, Mus musculus
ctcaactactgcgaggaggcggtgg

SEQ ID NO: 266561 - DNA, 25 bp, Mus musculus
ctcaactaggagcttcgatatgatc

SEQ ID NO: 266562 - DNA, 25 bp, Mus musculus
ctcaactagggaacatattcaaaag

SEQ ID NO: 266563 - DNA, 25 bp, Mus musculus
ctcaactatgcagtaaagacgctcc

SEQ ID NO: 266564 - DNA, 25 bp, Mus musculus
ctcaactatgcttaactgcggatcc

SEQ ID NO: 266565 - DNA, 25 bp, Mus musculus
ctcaactcaaatattatgagaagaa

SEQ ID NO: 266566 - DNA, 25 bp, Mus musculus
ctcaactcaaatattttgaaaaaca

SEQ ID NO: 266567 - DNA, 25 bp, Mus musculus
ctcaactcaactctctgaaaactga

SEQ ID NO: 266568 - DNA, 25 bp, Mus musculus
ctcaactcagtttgacccattgata

SEQ ID NO: 266569 - DNA, 25 bp, Mus musculus
ctcaactccaccccagcctgctgtt

SEQ ID NO: 266570 - DNA, 25 bp, Mus musculus
ctcaactccaccctgaagagctttg

SEQ ID NO: 266571 - DNA, 25 bp, Mus musculus
ctcaactccatggtcagcaacatca

SEQ ID NO: 266572 - DNA, 25 bp, Mus musculus
ctcaactcgaagctcctcccaacct

SEQ ID NO: 266573 - DNA, 25 bp, Mus musculus
ctcaactctttcgatatgtcttgtc

SEQ ID NO: 266574 - DNA, 25 bp, Mus musculus
ctcaactctttcgtctccttttacc

SEQ ID NO: 266575 - DNA, 25 bp, Mus musculus
ctcaactgatgggaccctgccactt

SEQ ID NO: 266576 - DNA, 25 bp, Mus musculus
ctcaactgcaagatggccactgaga

SEQ ID NO: 266577 - DNA, 25 bp, Mus musculus
ctcaactgcaagattgcccagctgc

SEQ ID NO: 266578 - DNA, 25 bp, Mus musculus
ctcaactggaagcaggacaacaatc

SEQ ID NO: 266579 - DNA, 25 bp, Mus musculus
ctcaactggcaggcgtgaagtgcag

SEQ ID NO: 266580 - DNA, 25 bp, Mus musculus
ctcaactggctatggctcctgggcg

SEQ ID NO: 266581 - DNA, 25 bp, Mus musculus
ctcaactggctgatgcttgacttcc

SEQ ID NO: 266582 - DNA, 25 bp, Mus musculus
ctcaacttcaaccgaagtgagtcca

SEQ ID NO: 266583 - DNA, 25 bp, Mus musculus
ctcaacttcagccactggaactctg

SEQ ID NO: 266584 - DNA, 25 bp, Mus musculus
ctcaacttcaggagggcctggggga

SEQ ID NO: 266585 - DNA, 25 bp, Mus musculus
ctcaacttctccaggtttggaggag

SEQ ID NO: 266586 - DNA, 25 bp, Mus musculus
ctcaacttcttccagagaatttgtt

SEQ ID NO: 266587 - DNA, 25 bp, Mus musculus
ctcaacttcttccagcttcacccct

SEQ ID NO: 266588 - DNA, 25 bp, Mus musculus
ctcaacttcttccaggctgaaggaa

SEQ ID NO: 266589 - DNA, 25 bp, Mus musculus
ctcaacttgaggccatccgctgcac

SEQ ID NO: 266590 - DNA, 25 bp, Mus musculus
ctcaacttgagtcagaagaggcaga

SEQ ID NO: 266591 - DNA, 25 bp, Mus musculus
ctcaacttgtccaatttcgaggact

SEQ ID NO: 266592 - DNA, 25 bp, Mus musculus
ctcaagaaagaagctgtttgggtat

SEQ ID NO: 266593 - DNA, 25 bp, Mus musculus
ctcaagaaagatgcgccaggaggag

SEQ ID NO: 266594 - DNA, 25 bp, Mus musculus
ctcaagaaaggacagatcgttacga

SEQ ID NO: 266595 - DNA, 25 bp, Mus musculus
ctcaagaaaggatggatgatccata

SEQ ID NO: 266596 - DNA, 25 bp, Mus musculus
ctcaagaaaggtgtggtgaccctgc

SEQ ID NO: 266597 - DNA, 25 bp, Mus musculus
ctcaagaacaacggctcggaagtgg

SEQ ID NO: 266598 - DNA, 25 bp, Mus musculus
ctcaagaacaagctcggaagtggcc

SEQ ID NO: 266599 - DNA, 25 bp, Mus musculus
ctcaagaacaatggctcggaagtgg

SEQ ID NO: 266600 - DNA, 25 bp, Mus musculus
ctcaagaagcaggttgcctagcaga

SEQ ID NO: 266601 - DNA, 25 bp, Mus musculus
ctcaagaagcagtgtgacgtgctgg

SEQ ID NO: 266602 - DNA, 25 bp, Mus musculus
ctcaagaaggcaagattactgtgta

SEQ ID NO: 266603 - DNA, 25 bp, Mus musculus
ctcaagaatatgttgttgatcacat

SEQ ID NO: 266604 - DNA, 25 bp, Mus musculus
ctcaagaattaggtaagtggagaaa

SEQ ID NO: 266605 - DNA, 25 bp, Mus musculus
ctcaagacaatcattttctctgttg

SEQ ID NO: 266606 - DNA, 25 bp, Mus musculus
ctcaagacagcagcaaaggccgttt

SEQ ID NO: 266607 - DNA, 25 bp, Mus musculus
ctcaagaggaaggcagtagagtcca

SEQ ID NO: 266608 - DNA, 25 bp, Mus musculus
ctcaagaggaaggccgaggatgaga

SEQ ID NO: 266609 - DNA, 25 bp, Mus musculus
ctcaagaggaaggctacgtgttctg

SEQ ID NO: 266610 - DNA, 25 bp, Mus musculus
ctcaagaggcagggtgctgaggggt

SEQ ID NO: 266611 - DNA, 25 bp, Mus musculus
ctcaagatatgtggtgacatccacg

SEQ ID NO: 266612 - DNA, 25 bp, Mus musculus
ctcaagatcagaggatcccactgac

SEQ ID NO: 266613 - DNA, 25 bp, Mus musculus
ctcaagatcatccggaagaagattc

SEQ ID NO: 266614 - DNA, 25 bp, Mus musculus
ctcaagatgaaggtctcagatctga

SEQ ID NO: 266615 - DNA, 25 bp, Mus musculus
ctcaagatggagagacgttagcaca

SEQ ID NO: 266616 - DNA, 25 bp, Mus musculus
ctcaagcaacagcaaatgaagctgg

SEQ ID NO: 266617 - DNA, 25 bp, Mus musculus
ctcaagcaagttgataatgaagaga

SEQ ID NO: 266618 - DNA, 25 bp, Mus musculus
ctcaagcacgcacctggaagggtct

SEQ ID NO: 266619 - DNA, 25 bp, Mus musculus
ctcaagcagccgagcctcgggatgg

SEQ ID NO: 266620 - DNA, 25 bp, Mus musculus
ctcaagcaggcaaggagacggaaga

SEQ ID NO: 266621 - DNA, 25 bp, Mus musculus
ctcaagcaggcaaggtgaccacatt

SEQ ID NO: 266622 - DNA, 25 bp, Mus musculus
ctcaagcagggaccaggccctctgc

SEQ ID NO: 266623 - DNA, 25 bp, Mus musculus
ctcaagcagggaccatggttggggt

SEQ ID NO: 266624 - DNA, 25 bp, Mus musculus
ctcaagcatgacttaacctgtgtga

SEQ ID NO: 266625 - DNA, 25 bp, Mus musculus
ctcaagccgcgacttttgccatgag

SEQ ID NO: 266626 - DNA, 25 bp, Mus musculus
ctcaagccgcggcttctacaaacca

SEQ ID NO: 266627 - DNA, 25 bp, Mus musculus
ctcaagcctgcggacttgactgcgt

SEQ ID NO: 266628 - DNA, 25 bp, Mus musculus
ctcaagcctgcggggacttgactgc

SEQ ID NO: 266629 - DNA, 25 bp, Mus musculus
ctcaagccttctaagctacctgaac

SEQ ID NO: 266630 - DNA, 25 bp, Mus musculus
ctcaagcgcggtttccgtgagagtg

SEQ ID NO: 266631 - DNA, 25 bp, Mus musculus
ctcaagctccaggagctgattcaga

SEQ ID NO: 266632 - DNA, 25 bp, Mus musculus
ctcaagctccgccctcagtcatctt

SEQ ID NO: 266633 - DNA, 25 bp, Mus musculus
ctcaagctcctgtcttctaattgtt

SEQ ID NO: 266634 - DNA, 25 bp, Mus musculus
ctcaagctgcaggaggaggcaaaaa

SEQ ID NO: 266635 - DNA, 25 bp, Mus musculus
ctcaaggaagcctctgtgcctctgg

SEQ ID NO: 266636 - DNA, 25 bp, Mus musculus
ctcaaggaccgagagggttacacat

SEQ ID NO: 266637 - DNA, 25 bp, Mus musculus
ctcaaggaccgagaggtgagacgtg

SEQ ID NO: 266638 - DNA, 25 bp, Mus musculus
ctcaaggaccgagaggtgatctgta

SEQ ID NO: 266639 - DNA, 25 bp, Mus musculus
ctcaaggacgacagggccccaaagg

SEQ ID NO: 266640 - DNA, 25 bp, Mus musculus
ctcaaggagaacaaggctgaatcag

SEQ ID NO: 266641 - DNA, 25 bp, Mus musculus
ctcaaggagaacaagtgccagaacc

SEQ ID NO: 266642 - DNA, 25 bp, Mus musculus
ctcaaggagctgtaggtggcgatgt

SEQ ID NO: 266643 - DNA, 25 bp, Mus musculus
ctcaaggagcttcaggcacgcatcg

SEQ ID NO: 266644 - DNA, 25 bp, Mus musculus
ctcaaggatggacacattcattact

SEQ ID NO: 266645 - DNA, 25 bp, Mus musculus
ctcaaggattaattagaaaaggagg

SEQ ID NO: 266646 - DNA, 25 bp, Mus musculus
ctcaaggcagcccctgttacagtgc

SEQ ID NO: 266647 - DNA, 25 bp, Mus musculus
ctcaaggcaggttgtaaaagttaac

SEQ ID NO: 266648 - DNA, 25 bp, Mus musculus
ctcaaggctacctagaaagtcccaa

SEQ ID NO: 266649 - DNA, 25 bp, Mus musculus
ctcaaggctacctagaacatcagaa

SEQ ID NO: 266650 - DNA, 25 bp, Mus musculus
ctcaagggtggttttgactggaact

SEQ ID NO: 266651 - DNA, 25 bp, Mus musculus
ctcaagggtttgaatgtatcgcaaa

SEQ ID NO: 266652 - DNA, 25 bp, Mus musculus
ctcaaggtactcaagcgagctgcag

SEQ ID NO: 266653 - DNA, 25 bp, Mus musculus
ctcaaggtactcaaggtaggctgct

SEQ ID NO: 266654 - DNA, 25 bp, Mus musculus
ctcaaggtcaaaagggagaacctgg

SEQ ID NO: 266655 - DNA, 25 bp, Mus musculus
ctcaaggtcctgaagcactcgggga

SEQ ID NO: 266656 - DNA, 25 bp, Mus musculus
ctcaaggtcctgaagcgcctgtgag

SEQ ID NO: 266657 - DNA, 25 bp, Mus musculus
ctcaaggtcctgaaggccgccggtg

SEQ ID NO: 266658 - DNA, 25 bp, Mus musculus
ctcaaggtctttgcaaagcccaaaa

SEQ ID NO: 266659 - DNA, 25 bp, Mus musculus
ctcaaggttaaggctagatatggat

SEQ ID NO: 266660 - DNA, 25 bp, Mus musculus
ctcaagtaccggcagtcctttacta

SEQ ID NO: 266661 - DNA, 25 bp, Mus musculus
ctcaagtagcaaagactctgttacg

SEQ ID NO: 266662 - DNA, 25 bp, Mus musculus
ctcaagtagcaaaggtgattggatg

SEQ ID NO: 266663 - DNA, 25 bp, Mus musculus
ctcaagtcaaagaaatggcctccac

SEQ ID NO: 266664 - DNA, 25 bp, Mus musculus
ctcaagtcctttcagtcttttgatg

SEQ ID NO: 266665 - DNA, 25 bp, Mus musculus
ctcaagtctgagtttgtgatcctga

SEQ ID NO: 266666 - DNA, 25 bp, Mus musculus
ctcaagtcttcacagagctgtgaaa

SEQ ID NO: 266667 - DNA, 25 bp, Mus musculus
ctcaagtgatgaagaagccttcctg

SEQ ID NO: 266668 - DNA, 25 bp, Mus musculus
ctcaagtgatgaaggagaggatgat

SEQ ID NO: 266669 - DNA, 25 bp, Mus musculus
ctcaagtggtcccagaatggaagcc

SEQ ID NO: 266670 - DNA, 25 bp, Mus musculus
ctcaagtggtcccagggccagaaaa

SEQ ID NO: 266671 - DNA, 25 bp, Mus musculus
ctcaagtgtaagagtgtgtttgaca

SEQ ID NO: 266672 - DNA, 25 bp, Mus musculus
ctcaagttaaagagaatgaaaatgt

SEQ ID NO: 266673 - DNA, 25 bp, Mus musculus
ctcaagttcaggacctctcctatta

SEQ ID NO: 266674 - DNA, 25 bp, Mus musculus
ctcaagttttctacagagatcccct

SEQ ID NO: 266675 - DNA, 25 bp, Mus musculus
ctcaatacaattgctgatactttgt

SEQ ID NO: 266676 - DNA, 25 bp, Mus musculus
ctcaatacccaaagatctttataag

SEQ ID NO: 266677 - DNA, 25 bp, Mus musculus
ctcaatacttctaccagaatcgagc

SEQ ID NO: 266678 - DNA, 25 bp, Mus musculus
ctcaatacttctatttttttattca

SEQ ID NO: 266679 - DNA, 25 bp, Mus musculus
ctcaatagcagaaagttccctggct

SEQ ID NO: 266680 - DNA, 25 bp, Mus musculus
ctcaatagcatagacatggactagg

SEQ ID NO: 266681 - DNA, 25 bp, Mus musculus
ctcaatagcatagacatggactttg

SEQ ID NO: 266682 - DNA, 25 bp, Mus musculus
ctcaatagcccctatggctgtagca

SEQ ID NO: 266683 - DNA, 25 bp, Mus musculus
ctcaatcaaggacagtcttatgaaa

SEQ ID NO: 266684 - DNA, 25 bp, Mus musculus
ctcaatcaaggtcagtcgtatgaaa

SEQ ID NO: 266685 - DNA, 25 bp, Mus musculus
ctcaatcaaggtgtggtcccaagct

SEQ ID NO: 266686 - DNA, 25 bp, Mus musculus
ctcaatcacttggggaaaggcgaag

SEQ ID NO: 266687 - DNA, 25 bp, Mus musculus
ctcaatcagaggtgcttcttaaaag

SEQ ID NO: 266688 - DNA, 25 bp, Mus musculus
ctcaatccactttgtcaagtggatt

SEQ ID NO: 266689 - DNA, 25 bp, Mus musculus
ctcaatgaaaatgtcatggttttta

SEQ ID NO: 266690 - DNA, 25 bp, Mus musculus
ctcaatgaacaggttgataaagaaa

SEQ ID NO: 266691 - DNA, 25 bp, Mus musculus
ctcaatgacgcctgggtcctaaagg

SEQ ID NO: 266692 - DNA, 25 bp, Mus musculus
ctcaatgagacagccaagcagcacg

SEQ ID NO: 266693 - DNA, 25 bp, Mus musculus
ctcaatgagacaggacatgggtcag

SEQ ID NO: 266694 - DNA, 25 bp, Mus musculus
ctcaatgagagcaggtcaaggaggc

SEQ ID NO: 266695 - DNA, 25 bp, Mus musculus
ctcaatgagagcagtgggagccggt

SEQ ID NO: 266696 - DNA, 25 bp, Mus musculus
ctcaatgaggccctgctggaggcct

SEQ ID NO: 266697 - DNA, 25 bp, Mus musculus
ctcaatgatgttgatgccctgctgg

SEQ ID NO: 266698 - DNA, 25 bp, Mus musculus
ctcaatgcacatcttcaagaaaaat

SEQ ID NO: 266699 - DNA, 25 bp, Mus musculus
ctcaatgcagatgggtggcaagaca

SEQ ID NO: 266700 - DNA, 25 bp, Mus musculus
ctcaatgcagtgactggatttgatt

SEQ ID NO: 266701 - DNA, 25 bp, Mus musculus
ctcaatgcctcagcttcggtagccc

SEQ ID NO: 266702 - DNA, 25 bp, Mus musculus
ctcaatgctaaggttcactacaaca

SEQ ID NO: 266703 - DNA, 25 bp, Mus musculus
ctcaatggataaaggagccgggtgt

SEQ ID NO: 266704 - DNA, 25 bp, Mus musculus
ctcaatgtcacctataattcacaga

SEQ ID NO: 266705 - DNA, 25 bp, Mus musculus
ctcaatgtgttgcaacagaccaact

SEQ ID NO: 266706 - DNA, 25 bp, Mus musculus
ctcaattcctctacgctgagcggca

SEQ ID NO: 266707 - DNA, 25 bp, Mus musculus
ctcaattggaaaagaggtccttctg

SEQ ID NO: 266708 - DNA, 25 bp, Mus musculus
ctcaattggaaaaggaatcttctat

SEQ ID NO: 266709 - DNA, 25 bp, Mus musculus
ctcaatttagacaagtatgatgatg

SEQ ID NO: 266710 - DNA, 25 bp, Mus musculus
ctcaatttagacaattggtggccat

SEQ ID NO: 266711 - DNA, 25 bp, Mus musculus
ctcaatttagtgagccacagtacac

SEQ ID NO: 266712 - DNA, 25 bp, Mus musculus
ctcaatttcaagtcagaagacatgt

SEQ ID NO: 266713 - DNA, 25 bp, Mus musculus
ctcaattttaaggcagtgtgtgaag

SEQ ID NO: 266714 - DNA, 25 bp, Mus musculus
ctcacaaaaaacttcatcaaagaaa

SEQ ID NO: 266715 - DNA, 25 bp, Mus musculus
ctcacaaaacaggagacatttgatg

SEQ ID NO: 266716 - DNA, 25 bp, Mus musculus
ctcacaaagaagcacagaccctgga

SEQ ID NO: 266717 - DNA, 25 bp, Mus musculus
ctcacaaagaaggatggaaggtttg

SEQ ID NO: 266718 - DNA, 25 bp, Mus musculus
ctcacaaagcaaagacaaatgagct

SEQ ID NO: 266719 - DNA, 25 bp, Mus musculus
ctcacaaagcaaagccagggcatag

SEQ ID NO: 266720 - DNA, 25 bp, Mus musculus
ctcacaaagcaaagccagtgaaact

SEQ ID NO: 266721 - DNA, 25 bp, Mus musculus
ctcacaaccaatgaggaatacttgg

SEQ ID NO: 266722 - DNA, 25 bp, Mus musculus
ctcacaaccttgccagaaaaccttg

SEQ ID NO: 266723 - DNA, 25 bp, Mus musculus
ctcacaaccttggtaccttcactca

SEQ ID NO: 266724 - DNA, 25 bp, Mus musculus
ctcacaacggacgcctccttggcat

SEQ ID NO: 266725 - DNA, 25 bp, Mus musculus
ctcacaacgggattgtcttggggat

SEQ ID NO: 266726 - DNA, 25 bp, Mus musculus
ctcacaactcacatccttgtctgta

SEQ ID NO: 266727 - DNA, 25 bp, Mus musculus
ctcacaactttgctcggaaaacgtt

SEQ ID NO: 266728 - DNA, 25 bp, Mus musculus
ctcacaagaagaaacatgtcattca

SEQ ID NO: 266729 - DNA, 25 bp, Mus musculus
ctcacaagaagacttccaactgaat

SEQ ID NO: 266730 - DNA, 25 bp, Mus musculus
ctcacaagaagtcgcaatgtgtctt

SEQ ID NO: 266731 - DNA, 25 bp, Mus musculus
ctcacaagcagaaacacctggtgtg

SEQ ID NO: 266732 - DNA, 25 bp, Mus musculus
ctcacaagcagtctttcacagaaac

SEQ ID NO: 266733 - DNA, 25 bp, Mus musculus
ctcacaaggaagtaatgtgatttat

SEQ ID NO: 266734 - DNA, 25 bp, Mus musculus
ctcacaaggaagtggatgatctttt

SEQ ID NO: 266735 - DNA, 25 bp, Mus musculus
ctcacaatcctttagcagctactcc

SEQ ID NO: 266736 - DNA, 25 bp, Mus musculus
ctcacaatggaggaagaacgagcca

SEQ ID NO: 266737 - DNA, 25 bp, Mus musculus
ctcacaattttacgcagatagagct

SEQ ID NO: 266738 - DNA, 25 bp, Mus musculus
ctcacaattttctggactgaagggt

SEQ ID NO: 266739 - DNA, 25 bp, Mus musculus
ctcacacaaagtttgctaggtattg

SEQ ID NO: 266740 - DNA, 25 bp, Mus musculus
ctcacacaagtttaaaaggatgctg

SEQ ID NO: 266741 - DNA, 25 bp, Mus musculus
ctcacacacagctttcttctgcagg

SEQ ID NO: 266742 - DNA, 25 bp, Mus musculus
ctcacacacaggacacagaagacct

SEQ ID NO: 266743 - DNA, 25 bp, Mus musculus
ctcacacacagggcgtgcgcaggga

SEQ ID NO: 266744 - DNA, 25 bp, Mus musculus
ctcacacagagcactggcctgaggc

SEQ ID NO: 266745 - DNA, 25 bp, Mus musculus
ctcacacagatgccccactgaaact

SEQ ID NO: 266746 - DNA, 25 bp, Mus musculus
ctcacacagctgaaaaagtctggtt

SEQ ID NO: 266747 - DNA, 25 bp, Mus musculus
ctcacacagggcgaaacaaaggtcc

SEQ ID NO: 266748 - DNA, 25 bp, Mus musculus
ctcacacatcagcaggcccgggaga

SEQ ID NO: 266749 - DNA, 25 bp, Mus musculus
ctcacaccaaaggagcagttcaggg

SEQ ID NO: 266750 - DNA, 25 bp, Mus musculus
ctcacaccaaaggagtgccaggagg

SEQ ID NO: 266751 - DNA, 25 bp, Mus musculus
ctcacacccatcaaggcgacctggc

SEQ ID NO: 266752 - DNA, 25 bp, Mus musculus
ctcacaccgacctgagaaatgccag

SEQ ID NO: 266753 - DNA, 25 bp, Mus musculus
ctcacaccgactgcgtaattcgaat

SEQ ID NO: 266754 - DNA, 25 bp, Mus musculus
ctcacaccgataaccctaacaagcg

SEQ ID NO: 266755 - DNA, 25 bp, Mus musculus
ctcacacctgcagcccggacaagtg

SEQ ID NO: 266756 - DNA, 25 bp, Mus musculus
ctcacacgaggtagctcgcggcgtc

SEQ ID NO: 266757 - DNA, 25 bp, Mus musculus
ctcacacgctgtgctgaatgagcaa

SEQ ID NO: 266758 - DNA, 25 bp, Mus musculus
ctcacacgtgtgcagataccccggt

SEQ ID NO: 266759 - DNA, 25 bp, Mus musculus
ctcacacgtgtgcagcctttgcttt

SEQ ID NO: 266760 - DNA, 25 bp, Mus musculus
ctcacacgtgtgcagttggcagata

SEQ ID NO: 266761 - DNA, 25 bp, Mus musculus
ctcacactcaagaataaatttgtgg

SEQ ID NO: 266762 - DNA, 25 bp, Mus musculus
ctcacactcaaggataagtttgttg

SEQ ID NO: 266763 - DNA, 25 bp, Mus musculus
ctcacactcactgtatgcttccact

SEQ ID NO: 266764 - DNA, 25 bp, Mus musculus
ctcacactcactgtttcttctagta

SEQ ID NO: 266765 - DNA, 25 bp, Mus musculus
ctcacactcaggggacaattcaagc

SEQ ID NO: 266766 - DNA, 25 bp, Mus musculus
ctcacactgaacaatggtttgctat

SEQ ID NO: 266767 - DNA, 25 bp, Mus musculus
ctcacactgtgatgtggtggaggtg

SEQ ID NO: 266768 - DNA, 25 bp, Mus musculus
ctcacagaaaagcctcatatagatc

SEQ ID NO: 266769 - DNA, 25 bp, Mus musculus
ctcacagaaaggtgtccacccagct

SEQ ID NO: 266770 - DNA, 25 bp, Mus musculus
ctcacagaagagagctgtgaattcc

SEQ ID NO: 266771 - DNA, 25 bp, Mus musculus
ctcacagaagcctgcagagcctatc

SEQ ID NO: 266772 - DNA, 25 bp, Mus musculus
ctcacagaaggctgttcatttagaa

SEQ ID NO: 266773 - DNA, 25 bp, Mus musculus
ctcacagaaggtggcttaaaaacca

SEQ ID NO: 266774 - DNA, 25 bp, Mus musculus
ctcacagaaggtgtaacacggctag

SEQ ID NO: 266775 - DNA, 25 bp, Mus musculus
ctcacagaatgcaagtcacacaagg

SEQ ID NO: 266776 - DNA, 25 bp, Mus musculus
ctcacagacagactgtcagtgttcc

SEQ ID NO: 266777 - DNA, 25 bp, Mus musculus
ctcacagagcacagctgtcccagaa

SEQ ID NO: 266778 - DNA, 25 bp, Mus musculus
ctcacagaggaaaagattgataagt

SEQ ID NO: 266779 - DNA, 25 bp, Mus musculus
ctcacagcagagtgccatcttgcca

SEQ ID NO: 266780 - DNA, 25 bp, Mus musculus
ctcacagcatgactgtgtgtccatt

SEQ ID NO: 266781 - DNA, 25 bp, Mus musculus
ctcacagccatgagcctcagggcta

SEQ ID NO: 266782 - DNA, 25 bp, Mus musculus
ctcacagcctagcctgtgtttgtga

SEQ ID NO: 266783 - DNA, 25 bp, Mus musculus
ctcacagctactgcgggggactccc

SEQ ID NO: 266784 - DNA, 25 bp, Mus musculus
ctcacagctgttctgcccgaggacg

SEQ ID NO: 266785 - DNA, 25 bp, Mus musculus
ctcacagctttccagaattcctcag

SEQ ID NO: 266786 - DNA, 25 bp, Mus musculus
ctcacagctttccagacttacaaca

SEQ ID NO: 266787 - DNA, 25 bp, Mus musculus
ctcacaggaatagatttcttatctg

SEQ ID NO: 266788 - DNA, 25 bp, Mus musculus
ctcacaggattgtggcgacaaataa

SEQ ID NO: 266789 - DNA, 25 bp, Mus musculus
ctcacaggtccagttgtactgcagc

SEQ ID NO: 266790 - DNA, 25 bp, Mus musculus
ctcacagtctcagaaaccattgaat

SEQ ID NO: 266791 - DNA, 25 bp, Mus musculus
ctcacagtctcagccacagagaacc

SEQ ID NO: 266792 - DNA, 25 bp, Mus musculus
ctcacagtgatagaatgcctgaatc

SEQ ID NO: 266793 - DNA, 25 bp, Mus musculus
ctcacagtgatgagaattttaaatg

SEQ ID NO: 266794 - DNA, 25 bp, Mus musculus
ctcacagtggaagggttccaatcct

SEQ ID NO: 266795 - DNA, 25 bp, Mus musculus
ctcacagtggagatgaatctggcta

SEQ ID NO: 266796 - DNA, 25 bp, Mus musculus
ctcacagttgtagaggatctgagaa

SEQ ID NO: 266797 - DNA, 25 bp, Mus musculus
ctcacataaaggctgaaggtgaaga

SEQ ID NO: 266798 - DNA, 25 bp, Mus musculus
ctcacatactggctacccaggcggc

SEQ ID NO: 266799 - DNA, 25 bp, Mus musculus
ctcacatccagggtaaagccccaaa

SEQ ID NO: 266800 - DNA, 25 bp, Mus musculus
ctcacatccaggtaaccgagaaggg

SEQ ID NO: 266801 - DNA, 25 bp, Mus musculus
ctcacatccgtcctgcctctgcctc

SEQ ID NO: 266802 - DNA, 25 bp, Mus musculus
ctcacatgaaggggcctctgctgtg

SEQ ID NO: 266803 - DNA, 25 bp, Mus musculus
ctcacatgaccagtgatcggcgcca

SEQ ID NO: 266804 - DNA, 25 bp, Mus musculus
ctcacatgaccagtggaaatgatgt

SEQ ID NO: 266805 - DNA, 25 bp, Mus musculus
ctcacatgaccagtgtcgttaggag

SEQ ID NO: 266806 - DNA, 25 bp, Mus musculus
ctcacatgaggcgtgggcttcggga

SEQ ID NO: 266807 - DNA, 25 bp, Mus musculus
ctcacatgcaggatccaaaccaagc

SEQ ID NO: 266808 - DNA, 25 bp, Mus musculus
ctcacatgctaggtggagagagcca

SEQ ID NO: 266809 - DNA, 25 bp, Mus musculus
ctcacatggagaaactgctgtcatt

SEQ ID NO: 266810 - DNA, 25 bp, Mus musculus
ctcacattcatttagaaactcccca

SEQ ID NO: 266811 - DNA, 25 bp, Mus musculus
ctcacattcatttagtatccgctcc

SEQ ID NO: 266812 - DNA, 25 bp, Mus musculus
ctcacattctacagggtcacagaca

SEQ ID NO: 266813 - DNA, 25 bp, Mus musculus
ctcacattgatgagaaaaagaaatc

SEQ ID NO: 266814 - DNA, 25 bp, Mus musculus
ctcacattgatgagtatgcacctga

SEQ ID NO: 266815 - DNA, 25 bp, Mus musculus
ctcaccaacctgcagatggcagcag

SEQ ID NO: 266816 - DNA, 25 bp, Mus musculus
ctcaccaacctgcagatggcagctc

SEQ ID NO: 266817 - DNA, 25 bp, Mus musculus
ctcaccaagcgggtcaaaaatgctg

SEQ ID NO: 266818 - DNA, 25 bp, Mus musculus
ctcaccaagctgctgtccagagtca

SEQ ID NO: 266819 - DNA, 25 bp, Mus musculus
ctcaccaataaagcccacagaagct

SEQ ID NO: 266820 - DNA, 25 bp, Mus musculus
ctcaccaataaaggcaaatcctcct

SEQ ID NO: 266821 - DNA, 25 bp, Mus musculus
ctcaccaatgagctgagcaatgttg

SEQ ID NO: 266822 - DNA, 25 bp, Mus musculus
ctcaccaatgcctctgcagggcccc

SEQ ID NO: 266823 - DNA, 25 bp, Mus musculus
ctcaccacagcttccactcagaatt

SEQ ID NO: 266824 - DNA, 25 bp, Mus musculus
ctcaccaccaaggaaaagttgtatg

SEQ ID NO: 266825 - DNA, 25 bp, Mus musculus
ctcaccaccaagggaacttaataca

SEQ ID NO: 266826 - DNA, 25 bp, Mus musculus
ctcaccaccctgaggcaaagaaatg

SEQ ID NO: 266827 - DNA, 25 bp, Mus musculus
ctcaccaccctgagtccagacagaa

SEQ ID NO: 266828 - DNA, 25 bp, Mus musculus
ctcaccactgtccgccgggagcagc

SEQ ID NO: 266829 - DNA, 25 bp, Mus musculus
ctcaccacttgagctcctggccagt

SEQ ID NO: 266830 - DNA, 25 bp, Mus musculus
ctcaccacttggtgaacagtgagtc

SEQ ID NO: 266831 - DNA, 25 bp, Mus musculus
ctcaccagaaactatggtggccctg

SEQ ID NO: 266832 - DNA, 25 bp, Mus musculus
ctcaccagagcaagaaaattgtgca

SEQ ID NO: 266833 - DNA, 25 bp, Mus musculus
ctcaccagagcaagatatggcgtga

SEQ ID NO: 266834 - DNA, 25 bp, Mus musculus
ctcaccagcccgtaagtttggtgag

SEQ ID NO: 266835 - DNA, 25 bp, Mus musculus
ctcaccagctgacagaaccagcaga

SEQ ID NO: 266836 - DNA, 25 bp, Mus musculus
ctcaccatcacacagcctcggccca

SEQ ID NO: 266837 - DNA, 25 bp, Mus musculus
ctcaccatcatccgggccatccgaa

SEQ ID NO: 266838 - DNA, 25 bp, Mus musculus
ctcaccatccatagtgaccatgagg

SEQ ID NO: 266839 - DNA, 25 bp, Mus musculus
ctcaccatcctggtatccgtggtca

SEQ ID NO: 266840 - DNA, 25 bp, Mus musculus
ctcaccatggcagaacctgcaactg

SEQ ID NO: 266841 - DNA, 25 bp, Mus musculus
ctcaccattgctggggtggagacca

SEQ ID NO: 266842 - DNA, 25 bp, Mus musculus
ctcaccattgctggtcaacgtcctg

SEQ ID NO: 266843 - DNA, 25 bp, Mus musculus
ctcaccattgttataataaagacct

SEQ ID NO: 266844 - DNA, 25 bp, Mus musculus
ctcacccaagattgatgaccagcga

SEQ ID NO: 266845 - DNA, 25 bp, Mus musculus
ctcacccaagctatgagcttggata

SEQ ID NO: 266846 - DNA, 25 bp, Mus musculus
ctcacccaaggagctgctagcactg

SEQ ID NO: 266847 - DNA, 25 bp, Mus musculus
ctcacccacagagtgctgacctagc

SEQ ID NO: 266848 - DNA, 25 bp, Mus musculus
ctcacccaccgacctttgcacagaa

SEQ ID NO: 266849 - DNA, 25 bp, Mus musculus
ctcacccacttactggtgcccggcg

SEQ ID NO: 266850 - DNA, 25 bp, Mus musculus
ctcacccagagcttgtcaatgtccc

SEQ ID NO: 266851 - DNA, 25 bp, Mus musculus
ctcacccagcagcaccctcagcgcc

SEQ ID NO: 266852 - DNA, 25 bp, Mus musculus
ctcacccagccatgcctatggaggc

SEQ ID NO: 266853 - DNA, 25 bp, Mus musculus
ctcacccagccatgctatcccaata

SEQ ID NO: 266854 - DNA, 25 bp, Mus musculus
ctcacccaggagatcttcagaacaa

SEQ ID NO: 266855 - DNA, 25 bp, Mus musculus
ctcacccaggagatggagttccaga

SEQ ID NO: 266856 - DNA, 25 bp, Mus musculus
ctcaccccaagatgctttgtgacga

SEQ ID NO: 266857 - DNA, 25 bp, Mus musculus
ctcacccccagcccagccaagcggc

SEQ ID NO: 266858 - DNA, 25 bp, Mus musculus
ctcacccccagctccaaccctcttg

SEQ ID NO: 266859 - DNA, 25 bp, Mus musculus
ctcacccccaggagttcaactagat

SEQ ID NO: 266860 - DNA, 25 bp, Mus musculus
ctcaccccccatggcttttcaagat

SEQ ID NO: 266861 - DNA, 25 bp, Mus musculus
ctcaccccgcttccgagcctcgatt

SEQ ID NO: 266862 - DNA, 25 bp, Mus musculus
ctcacccgagacgtgatcgtccgcg

SEQ ID NO: 266863 - DNA, 25 bp, Mus musculus
ctcacccggaacaaggatgtattta

SEQ ID NO: 266864 - DNA, 25 bp, Mus musculus
ctcacccggaacaaggtcctacatc

SEQ ID NO: 266865 - DNA, 25 bp, Mus musculus
ctcaccctcaggctctgagtcagat

SEQ ID NO: 266866 - DNA, 25 bp, Mus musculus
ctcaccgaaaagaggactaggaaaa

SEQ ID NO: 266867 - DNA, 25 bp, Mus musculus
ctcaccgaggtaagaaatggcgctc

SEQ ID NO: 266868 - DNA, 25 bp, Mus musculus
ctcaccgccagaaagacagggtttc

SEQ ID NO: 266869 - DNA, 25 bp, Mus musculus
ctcaccgccagaaaggaacacccct

SEQ ID NO: 266870 - DNA, 25 bp, Mus musculus
ctcaccgccataaaaagatgcagga

SEQ ID NO: 266871 - DNA, 25 bp, Mus musculus
ctcaccgctcgaggtggccaggcag

SEQ ID NO: 266872 - DNA, 25 bp, Mus musculus
ctcaccgctcggctctgggtgctct

SEQ ID NO: 266873 - DNA, 25 bp, Mus musculus
ctcaccgctcgggcctgtgctctct

SEQ ID NO: 266874 - DNA, 25 bp, Mus musculus
ctcaccggcaaggtgatgcttcttg

SEQ ID NO: 266875 - DNA, 25 bp, Mus musculus
ctcaccggcagaggctgaaggcggc

SEQ ID NO: 266876 - DNA, 25 bp, Mus musculus
ctcacctacacccaaaaacacagat

SEQ ID NO: 266877 - DNA, 25 bp, Mus musculus
ctcacctacacccaatacaagcagc

SEQ ID NO: 266878 - DNA, 25 bp, Mus musculus
ctcacctcaatgaggacaataatac

SEQ ID NO: 266879 - DNA, 25 bp, Mus musculus
ctcacctcaggattctgggtaggca

SEQ ID NO: 266880 - DNA, 25 bp, Mus musculus
ctcacctcagggaagagggatttca

SEQ ID NO: 266881 - DNA, 25 bp, Mus musculus
ctcacctcccagtggcaccaccgag

SEQ ID NO: 266882 - DNA, 25 bp, Mus musculus
ctcacctccctgccttcagccatct

SEQ ID NO: 266883 - DNA, 25 bp, Mus musculus
ctcacctccgctgcctgccttgtcc

SEQ ID NO: 266884 - DNA, 25 bp, Mus musculus
ctcacctcgccaggtggaggtggga

SEQ ID NO: 266885 - DNA, 25 bp, Mus musculus
ctcacctctcaattgtgggttgaat

SEQ ID NO: 266886 - DNA, 25 bp, Mus musculus
ctcacctctgagatacttggagatg

SEQ ID NO: 266887 - DNA, 25 bp, Mus musculus
ctcacctgaacagtgagacggttta

SEQ ID NO: 266888 - DNA, 25 bp, Mus musculus
ctcacctgaagaaaaaagcagtcat

SEQ ID NO: 266889 - DNA, 25 bp, Mus musculus
ctcacctgaagggatgtctgaattt

SEQ ID NO: 266890 - DNA, 25 bp, Mus musculus
ctcacctgaatgcagattgaggatg

SEQ ID NO: 266891 - DNA, 25 bp, Mus musculus
ctcacctgaatgcagtgacaagcat

SEQ ID NO: 266892 - DNA, 25 bp, Mus musculus
ctcacctgatgagagtgttcgagga

SEQ ID NO: 266893 - DNA, 25 bp, Mus musculus
ctcacctgcaccccggagtatgatc

SEQ ID NO: 266894 - DNA, 25 bp, Mus musculus
ctcacctgccacgctccagtggctt

SEQ ID NO: 266895 - DNA, 25 bp, Mus musculus
ctcacctgttaggaaagaatcttca

SEQ ID NO: 266896 - DNA, 25 bp, Mus musculus
ctcaccttcatggagaaggtgcacc

SEQ ID NO: 266897 - DNA, 25 bp, Mus musculus
ctcaccttccttggcggcagaaccc

SEQ ID NO: 266898 - DNA, 25 bp, Mus musculus
ctcaccttctacagaaaaccgtcaa

SEQ ID NO: 266899 - DNA, 25 bp, Mus musculus
ctcaccttctacgacggggtggagt

SEQ ID NO: 266900 - DNA, 25 bp, Mus musculus
ctcaccttctacgctgtggaggtga

SEQ ID NO: 266901 - DNA, 25 bp, Mus musculus
ctcaccttctcagagagacctgctt

SEQ ID NO: 266902 - DNA, 25 bp, Mus musculus
ctcaccttgctgtgccctcacgctc

SEQ ID NO: 266903 - DNA, 25 bp, Mus musculus
ctcaccttggcagccatcatggtgt

SEQ ID NO: 266904 - DNA, 25 bp, Mus musculus
ctcaccttgggaatcccaatgctga

SEQ ID NO: 266905 - DNA, 25 bp, Mus musculus
ctcacgaaaagatcctgagcaagca

SEQ ID NO: 266906 - DNA, 25 bp, Mus musculus
ctcacgaaagaaaggccagagggag

SEQ ID NO: 266907 - DNA, 25 bp, Mus musculus
ctcacgacaggtgatttccgatttt

SEQ ID NO: 266908 - DNA, 25 bp, Mus musculus
ctcacgacggctccagggaactgtc

SEQ ID NO: 266909 - DNA, 25 bp, Mus musculus
ctcacgactagggaatgtgtgacca

SEQ ID NO: 266910 - DNA, 25 bp, Mus musculus
ctcacgactagggagaaagagagag

SEQ ID NO: 266911 - DNA, 25 bp, Mus musculus
ctcacgagaagatgtgtatgtcgac

SEQ ID NO: 266912 - DNA, 25 bp, Mus musculus
ctcacgagcacacagatggagtgat

SEQ ID NO: 266913 - DNA, 25 bp, Mus musculus
ctcacgagcacacaggagagacctt

SEQ ID NO: 266914 - DNA, 25 bp, Mus musculus
ctcacgagggcgaggctcggctatt

SEQ ID NO: 266915 - DNA, 25 bp, Mus musculus
ctcacgatccaggtcagagcagcag

SEQ ID NO: 266916 - DNA, 25 bp, Mus musculus
ctcacgatccaggtgttcactgggg

SEQ ID NO: 266917 - DNA, 25 bp, Mus musculus
ctcacgcaagaccctgactgcacca

SEQ ID NO: 266918 - DNA, 25 bp, Mus musculus
ctcacgccgagcagctgccccagga

SEQ ID NO: 266919 - DNA, 25 bp, Mus musculus
ctcacgcctctcttctgtattatgg

SEQ ID NO: 266920 - DNA, 25 bp, Mus musculus
ctcacgcctcttgaccagcagttat

SEQ ID NO: 266921 - DNA, 25 bp, Mus musculus
ctcacgcgcgtagtgattgaggatg

SEQ ID NO: 266922 - DNA, 25 bp, Mus musculus
ctcacgctattgtgaggatgaagtt

SEQ ID NO: 266923 - DNA, 25 bp, Mus musculus
ctcacggattccttatggatcgcag

SEQ ID NO: 266924 - DNA, 25 bp, Mus musculus
ctcacggcacaggtcagacgggaac

SEQ ID NO: 266925 - DNA, 25 bp, Mus musculus
ctcacggcggaaggcaagattgaga

SEQ ID NO: 266926 - DNA, 25 bp, Mus musculus
ctcacgggcacagaaatggaagccc

SEQ ID NO: 266927 - DNA, 25 bp, Mus musculus
ctcacgtatttaccgcagaaacagt

SEQ ID NO: 266928 - DNA, 25 bp, Mus musculus
ctcacgtgcagatggtggacccagt

SEQ ID NO: 266929 - DNA, 25 bp, Mus musculus
ctcacgtgggaccggcccttggtgc

SEQ ID NO: 266930 - DNA, 25 bp, Mus musculus
ctcacgtgggaccggggtgttgtgc

SEQ ID NO: 266931 - DNA, 25 bp, Mus musculus
ctcactaacagcatcaaggtgtaat

SEQ ID NO: 266932 - DNA, 25 bp, Mus musculus
ctcactacaggcttccagccagctg

SEQ ID NO: 266933 - DNA, 25 bp, Mus musculus
ctcactacggaggtgcatcctgagc

SEQ ID NO: 266934 - DNA, 25 bp, Mus musculus
ctcactaggaacatgatgaactttc

SEQ ID NO: 266935 - DNA, 25 bp, Mus musculus
ctcactaggaacatggtgtccatcc

SEQ ID NO: 266936 - DNA, 25 bp, Mus musculus
ctcactaggttgcagacagtaacca

SEQ ID NO: 266937 - DNA, 25 bp, Mus musculus
ctcactatcgacagagtcccagatc

SEQ ID NO: 266938 - DNA, 25 bp, Mus musculus
ctcactatcgacagtttttgtggtt

SEQ ID NO: 266939 - DNA, 25 bp, Mus musculus
ctcactatgtgcaagacggccccct

SEQ ID NO: 266940 - DNA, 25 bp, Mus musculus
ctcactcaacttcagccactggaac

SEQ ID NO: 266941 - DNA, 25 bp, Mus musculus
ctcactcaacttcaggagggcctgg

SEQ ID NO: 266942 - DNA, 25 bp, Mus musculus
ctcactcaaggtaatagcgctcatc

SEQ ID NO: 266943 - DNA, 25 bp, Mus musculus
ctcactcaaggtggcgtgattgaag

SEQ ID NO: 266944 - DNA, 25 bp, Mus musculus
ctcactcacatagctaacccaagga

SEQ ID NO: 266945 - DNA, 25 bp, Mus musculus
ctcactcacatgtgctggagagtct

SEQ ID NO: 266946 - DNA, 25 bp, Mus musculus
ctcactcacgctgcccaacatgttt

SEQ ID NO: 266947 - DNA, 25 bp, Mus musculus
ctcactcaggagccgttgcccacgg

SEQ ID NO: 266948 - DNA, 25 bp, Mus musculus
ctcactcaggctcccatgtgtgaag

SEQ ID NO: 266949 - DNA, 25 bp, Mus musculus
ctcactcatgcaggttgctgatgcc

SEQ ID NO: 266950 - DNA, 25 bp, Mus musculus
ctcactccaaagacaaatatgaaac

SEQ ID NO: 266951 - DNA, 25 bp, Mus musculus
ctcactccaaagtccccagtcttca

SEQ ID NO: 266952 - DNA, 25 bp, Mus musculus
ctcactccactggttcgtcgcctgc

SEQ ID NO: 266953 - DNA, 25 bp, Mus musculus
ctcactccagatgtgtttgggctgg

SEQ ID NO: 266954 - DNA, 25 bp, Mus musculus
ctcactccagccggatgtatggaat

SEQ ID NO: 266955 - DNA, 25 bp, Mus musculus
ctcactccagtaaagactccttgtt

SEQ ID NO: 266956 - DNA, 25 bp, Mus musculus
ctcactctaagaaacattccctgtg

SEQ ID NO: 266957 - DNA, 25 bp, Mus musculus
ctcactctagggtgaagcctgctgg

SEQ ID NO: 266958 - DNA, 25 bp, Mus musculus
ctcactctgtcgcagattggaagaa

SEQ ID NO: 266959 - DNA, 25 bp, Mus musculus
ctcactcttctaaaacgttaccacc

SEQ ID NO: 266960 - DNA, 25 bp, Mus musculus
ctcactcttctaaagatccactatg

SEQ ID NO: 266961 - DNA, 25 bp, Mus musculus
ctcactgaaagatttgtatacatca

SEQ ID NO: 266962 - DNA, 25 bp, Mus musculus
ctcactgaaagctgggaagtcatca

SEQ ID NO: 266963 - DNA, 25 bp, Mus musculus
ctcactgaacccaaccagaatcgag

SEQ ID NO: 266964 - DNA, 25 bp, Mus musculus
ctcactgaccctctccccttaaaaa

SEQ ID NO: 266965 - DNA, 25 bp, Mus musculus
ctcactgcagacactccactctcca

SEQ ID NO: 266966 - DNA, 25 bp, Mus musculus
ctcactgcattgaaaaaatcccatg

SEQ ID NO: 266967 - DNA, 25 bp, Mus musculus
ctcactgcattggacttccttgtgg

SEQ ID NO: 266968 - DNA, 25 bp, Mus musculus
ctcactgccaaggggacaatgacgg

SEQ ID NO: 266969 - DNA, 25 bp, Mus musculus
ctcactgccaaggtgaaagcagcca

SEQ ID NO: 266970 - DNA, 25 bp, Mus musculus
ctcactgcccaggtggaagaactaa

SEQ ID NO: 266971 - DNA, 25 bp, Mus musculus
ctcactgcccaggtggagcaactag

SEQ ID NO: 266972 - DNA, 25 bp, Mus musculus
ctcactgcctccaggtctggagagc

SEQ ID NO: 266973 - DNA, 25 bp, Mus musculus
ctcactgcctgataaatacaacacc

SEQ ID NO: 266974 - DNA, 25 bp, Mus musculus
ctcactgcctgatgttgtccaggaa

SEQ ID NO: 266975 - DNA, 25 bp, Mus musculus
ctcactgctaatgagactcagtccg

SEQ ID NO: 266976 - DNA, 25 bp, Mus musculus
ctcactgctataggatacaaattgg

SEQ ID NO: 266977 - DNA, 25 bp, Mus musculus
ctcactgctataggttgatcagatc

SEQ ID NO: 266978 - DNA, 25 bp, Mus musculus
ctcactgcttaagagggttcagtaa

SEQ ID NO: 266979 - DNA, 25 bp, Mus musculus
ctcactggaagagccgcccgcaccc

SEQ ID NO: 266980 - DNA, 25 bp, Mus musculus
ctcactggaagagcctcagaaacac

SEQ ID NO: 266981 - DNA, 25 bp, Mus musculus
ctcactggagggaggttgtgtagcc

SEQ ID NO: 266982 - DNA, 25 bp, Mus musculus
ctcactggatcgccgcccttcactg

SEQ ID NO: 266983 - DNA, 25 bp, Mus musculus
ctcactggcatcatgggagcaggct

SEQ ID NO: 266984 - DNA, 25 bp, Mus musculus
ctcactggcatcatggtcaaaaatg

SEQ ID NO: 266985 - DNA, 25 bp, Mus musculus
ctcactggggttttaaggtgtctgg

SEQ ID NO: 266986 - DNA, 25 bp, Mus musculus
ctcactggttatgctttccatgaag

SEQ ID NO: 266987 - DNA, 25 bp, Mus musculus
ctcactggttatggatccatctgtt

SEQ ID NO: 266988 - DNA, 25 bp, Mus musculus
ctcactgtaaggcccatcctttgtg

SEQ ID NO: 266989 - DNA, 25 bp, Mus musculus
ctcactgtcaggaagttggtgtcct

SEQ ID NO: 266990 - DNA, 25 bp, Mus musculus
ctcactgtccagtgcttctacttct

SEQ ID NO: 266991 - DNA, 25 bp, Mus musculus
ctcactgtccagttaatgtgttaag

SEQ ID NO: 266992 - DNA, 25 bp, Mus musculus
ctcactgtgacgagggtggctcaca

SEQ ID NO: 266993 - DNA, 25 bp, Mus musculus
ctcactgtgagcacagcggctacaa

SEQ ID NO: 266994 - DNA, 25 bp, Mus musculus
ctcactgtgctaaaggcccacgttg

SEQ ID NO: 266995 - DNA, 25 bp, Mus musculus
ctcactgtgctataggcccacgttg

SEQ ID NO: 266996 - DNA, 25 bp, Mus musculus
ctcactgtggaggagctgaagttca

SEQ ID NO: 266997 - DNA, 25 bp, Mus musculus
ctcactgtgtaaaaggccttaacca

SEQ ID NO: 266998 - DNA, 25 bp, Mus musculus
ctcacttccccaaattcctgtccat

SEQ ID NO: 266999 - DNA, 25 bp, Mus musculus
ctcacttcggtgggctcggatggcg

SEQ ID NO: 267000 - DNA, 25 bp, Mus musculus
ctcacttctaggtcgtttcagctct

SEQ ID NO: 267001 - DNA, 25 bp, Mus musculus
ctcacttgaagcccatctctgagcg

SEQ ID NO: 267002 - DNA, 25 bp, Mus musculus
ctcacttgaaggacacccagctcca

SEQ ID NO: 267003 - DNA, 25 bp, Mus musculus
ctcacttgcttcagccagagtaaca

SEQ ID NO: 267004 - DNA, 25 bp, Mus musculus
ctcactttcagacatccggctccgg

SEQ ID NO: 267005 - DNA, 25 bp, Mus musculus
ctcagaaaacattccgtgcagtaaa

SEQ ID NO: 267006 - DNA, 25 bp, Mus musculus
ctcagaaaagagctctgtcttcccc

SEQ ID NO: 267007 - DNA, 25 bp, Mus musculus
ctcagaaaagccaggcctgtgatcc

SEQ ID NO: 267008 - DNA, 25 bp, Mus musculus
ctcagaaaatggctcctcggtggca

SEQ ID NO: 267009 - DNA, 25 bp, Mus musculus
ctcagaaacagaacttacacatttg

SEQ ID NO: 267010 - DNA, 25 bp, Mus musculus
ctcagaaacaggcggaaaaactgat

SEQ ID NO: 267011 - DNA, 25 bp, Mus musculus
ctcagaaacatcattcaagactgtc

SEQ ID NO: 267012 - DNA, 25 bp, Mus musculus
ctcagaaactgtggcccgaggcagc

SEQ ID NO: 267013 - DNA, 25 bp, Mus musculus
ctcagaaagaagctagacgaaaggg

SEQ ID NO: 267014 - DNA, 25 bp, Mus musculus
ctcagaaagagatcccattcctgga

SEQ ID NO: 267015 - DNA, 25 bp, Mus musculus
ctcagaaaggagattaacaagtggt

SEQ ID NO: 267016 - DNA, 25 bp, Mus musculus
ctcagaaaggaggcatcatagctgc

SEQ ID NO: 267017 - DNA, 25 bp, Mus musculus
ctcagaaatgacacacttttgtgta

SEQ ID NO: 267018 - DNA, 25 bp, Mus musculus
ctcagaaatgattcccgttgcgcag

SEQ ID NO: 267019 - DNA, 25 bp, Mus musculus
ctcagaacagaagcccacaaggaga

SEQ ID NO: 267020 - DNA, 25 bp, Mus musculus
ctcagaacagaaggagtgtgtaagc

SEQ ID NO: 267021 - DNA, 25 bp, Mus musculus
ctcagaacagcatcccctaccccag

SEQ ID NO: 267022 - DNA, 25 bp, Mus musculus
ctcagaacaggtcttcacatgctcc

SEQ ID NO: 267023 - DNA, 25 bp, Mus musculus
ctcagaacatctctgatgtggatgc

SEQ ID NO: 267024 - DNA, 25 bp, Mus musculus
ctcagaacccgagggtttctctgcc

SEQ ID NO: 267025 - DNA, 25 bp, Mus musculus
ctcagaacccggaggctgtttactt

SEQ ID NO: 267026 - DNA, 25 bp, Mus musculus
ctcagaacgcgagcactttcatcaa

SEQ ID NO: 267027 - DNA, 25 bp, Mus musculus
ctcagaactggatgaaggacattga

SEQ ID NO: 267028 - DNA, 25 bp, Mus musculus
ctcagaactggccagacaccttgtt

SEQ ID NO: 267029 - DNA, 25 bp, Mus musculus
ctcagaactggccagatccgtctac

SEQ ID NO: 267030 - DNA, 25 bp, Mus musculus
ctcagaactggccagccccctgcct

SEQ ID NO: 267031 - DNA, 25 bp, Mus musculus
ctcagaacttgggagacgactgcac

SEQ ID NO: 267032 - DNA, 25 bp, Mus musculus
ctcagaagagaaatatattgagcgg

SEQ ID NO: 267033 - DNA, 25 bp, Mus musculus
ctcagaagagaaattttgaaatgcc

SEQ ID NO: 267034 - DNA, 25 bp, Mus musculus
ctcagaagatctagatcccgctcaa

SEQ ID NO: 267035 - DNA, 25 bp, Mus musculus
ctcagaagcaacaggagtgcaggag

SEQ ID NO: 267036 - DNA, 25 bp, Mus musculus
ctcagaagcatctccatcgcctggt

SEQ ID NO: 267037 - DNA, 25 bp, Mus musculus
ctcagaagccaagctgctgcatttt

SEQ ID NO: 267038 - DNA, 25 bp, Mus musculus
ctcagaagcccagatggtgcagtca

SEQ ID NO: 267039 - DNA, 25 bp, Mus musculus
ctcagaaggtggccttcccaggaca

SEQ ID NO: 267040 - DNA, 25 bp, Mus musculus
ctcagaatgaagaaagagctgtgca

SEQ ID NO: 267041 - DNA, 25 bp, Mus musculus
ctcagaatgctggtggacaagaagc

SEQ ID NO: 267042 - DNA, 25 bp, Mus musculus
ctcagaattcagggaagctaccttg

SEQ ID NO: 267043 - DNA, 25 bp, Mus musculus
ctcagaattcaggtgttccatgagc

SEQ ID NO: 267044 - DNA, 25 bp, Mus musculus
ctcagaattccaggtctatggaaat

SEQ ID NO: 267045 - DNA, 25 bp, Mus musculus
ctcagaattccccctcctcaggtac

SEQ ID NO: 267046 - DNA, 25 bp, Mus musculus
ctcagaattccgggagtgatcgagt

SEQ ID NO: 267047 - DNA, 25 bp, Mus musculus
ctcagaattgctagattagtggagt

SEQ ID NO: 267048 - DNA, 25 bp, Mus musculus
ctcagacaaagatgggctacacccc

SEQ ID NO: 267049 - DNA, 25 bp, Mus musculus
ctcagacaaagctaaaaatatcttt

SEQ ID NO: 267050 - DNA, 25 bp, Mus musculus
ctcagacaaatgtcagtgagatcga

SEQ ID NO: 267051 - DNA, 25 bp, Mus musculus
ctcagacaagaggtaaagaagaaga

SEQ ID NO: 267052 - DNA, 25 bp, Mus musculus
ctcagacacaaaccaaatgaacaca

SEQ ID NO: 267053 - DNA, 25 bp, Mus musculus
ctcagacacaagcaggtcagatgta

SEQ ID NO: 267054 - DNA, 25 bp, Mus musculus
ctcagacacctgctcaacatggcgc

SEQ ID NO: 267055 - DNA, 25 bp, Mus musculus
ctcagacacctggcagtgcttaatt

SEQ ID NO: 267056 - DNA, 25 bp, Mus musculus
ctcagacacgcggagcctctgacct

SEQ ID NO: 267057 - DNA, 25 bp, Mus musculus
ctcagacagcaagacaaacgagggc

SEQ ID NO: 267058 - DNA, 25 bp, Mus musculus
ctcagacagccgtgcttatggagac

SEQ ID NO: 267059 - DNA, 25 bp, Mus musculus
ctcagacagtgggtgtccacccagc

SEQ ID NO: 267060 - DNA, 25 bp, Mus musculus
ctcagacatgctggatagtctcact

SEQ ID NO: 267061 - DNA, 25 bp, Mus musculus
ctcagacattccagatgtctggcca

SEQ ID NO: 267062 - DNA, 25 bp, Mus musculus
ctcagacattccaggtttcgtcttg

SEQ ID NO: 267063 - DNA, 25 bp, Mus musculus
ctcagaccagatggccaagctgcgc

SEQ ID NO: 267064 - DNA, 25 bp, Mus musculus
ctcagaccagcagaacgagatggtg

SEQ ID NO: 267065 - DNA, 25 bp, Mus musculus
ctcagacccgcgcggcccgcgcagc

SEQ ID NO: 267066 - DNA, 25 bp, Mus musculus
ctcagacccgcgcgggcccacactc

SEQ ID NO: 267067 - DNA, 25 bp, Mus musculus
ctcagacctcgcaggaaattctaca

SEQ ID NO: 267068 - DNA, 25 bp, Mus musculus
ctcagacctcgcaggaagacagatc

SEQ ID NO: 267069 - DNA, 25 bp, Mus musculus
ctcagaccttaagggatagagaagg

SEQ ID NO: 267070 - DNA, 25 bp, Mus musculus
ctcagacgataatgaagaaaacggg

SEQ ID NO: 267071 - DNA, 25 bp, Mus musculus
ctcagacgctgactcatcccaggaa

SEQ ID NO: 267072 - DNA, 25 bp, Mus musculus
ctcagacgggagctgcaggagatgc

SEQ ID NO: 267073 - DNA, 25 bp, Mus musculus
ctcagactcagggttgagctccata

SEQ ID NO: 267074 - DNA, 25 bp, Mus musculus
ctcagactccggaagaacctcagct

SEQ ID NO: 267075 - DNA, 25 bp, Mus musculus
ctcagactcggggtcgcatccctgg

SEQ ID NO: 267076 - DNA, 25 bp, Mus musculus
ctcagactcggtacctcggaatcgg

SEQ ID NO: 267077 - DNA, 25 bp, Mus musculus
ctcagactcggtcccccagaggtgc

SEQ ID NO: 267078 - DNA, 25 bp, Mus musculus
ctcagactgctctacgaagcgctgc

SEQ ID NO: 267079 - DNA, 25 bp, Mus musculus
ctcagactggagaggctcccccacc

SEQ ID NO: 267080 - DNA, 25 bp, Mus musculus
ctcagactgggcccagtcttctggg

SEQ ID NO: 267081 - DNA, 25 bp, Mus musculus
ctcagacttctaaggcctctcctgc

SEQ ID NO: 267082 - DNA, 25 bp, Mus musculus
ctcagacttggatacccttctgcaa

SEQ ID NO: 267083 - DNA, 25 bp, Mus musculus
ctcagagaagaagtgtttgaaagac

SEQ ID NO: 267084 - DNA, 25 bp, Mus musculus
ctcagagacaaggttctccccaccc

SEQ ID NO: 267085 - DNA, 25 bp, Mus musculus
ctcagagacaggcctcaggatatca

SEQ ID NO: 267086 - DNA, 25 bp, Mus musculus
ctcagagacatggagttcttttcaa

SEQ ID NO: 267087 - DNA, 25 bp, Mus musculus
ctcagagacatgtatgcactgaaga

SEQ ID NO: 267088 - DNA, 25 bp, Mus musculus
ctcagagacccaagtgcataagtaa

SEQ ID NO: 267089 - DNA, 25 bp, Mus musculus
ctcagagaccgcaatctcactggtc

SEQ ID NO: 267090 - DNA, 25 bp, Mus musculus
ctcagagaccgcaatgtgtatgtcg

SEQ ID NO: 267091 - DNA, 25 bp, Mus musculus
ctcagagagctgcatgcctcatggc

SEQ ID NO: 267092 - DNA, 25 bp, Mus musculus
ctcagagagtcggcgtccctacagc

SEQ ID NO: 267093 - DNA, 25 bp, Mus musculus
ctcagagagtcgggtctgagtgccc

SEQ ID NO: 267094 - DNA, 25 bp, Mus musculus
ctcagagagtgatgcatggagcagt

SEQ ID NO: 267095 - DNA, 25 bp, Mus musculus
ctcagagcagctttgacctcgaaaa

SEQ ID NO: 267096 - DNA, 25 bp, Mus musculus
ctcagagcaggtcactttgaatggc

SEQ ID NO: 267097 - DNA, 25 bp, Mus musculus
ctcagagccaaaagattcttcagtt

SEQ ID NO: 267098 - DNA, 25 bp, Mus musculus
ctcagagccaggttggttcctgtac

SEQ ID NO: 267099 - DNA, 25 bp, Mus musculus
ctcagagccatagaggtggagtaca

SEQ ID NO: 267100 - DNA, 25 bp, Mus musculus
ctcagagctgagatactagtgactg

SEQ ID NO: 267101 - DNA, 25 bp, Mus musculus
ctcagaggaggagtattccaccaaa

SEQ ID NO: 267102 - DNA, 25 bp, Mus musculus
ctcagaggatcacaagctgaagatt

SEQ ID NO: 267103 - DNA, 25 bp, Mus musculus
ctcagaggcagaagaacctgtgctg

SEQ ID NO: 267104 - DNA, 25 bp, Mus musculus
ctcagaggcagatgacctggatgga

SEQ ID NO: 267105 - DNA, 25 bp, Mus musculus
ctcagaggccagaagacaccagtgc

SEQ ID NO: 267106 - DNA, 25 bp, Mus musculus
ctcagaggccaggaccatccttgct

SEQ ID NO: 267107 - DNA, 25 bp, Mus musculus
ctcagaggctatggaattggaagcc

SEQ ID NO: 267108 - DNA, 25 bp, Mus musculus
ctcagaggctgagaaaataatgttg

SEQ ID NO: 267109 - DNA, 25 bp, Mus musculus
ctcagaggctgaggacaaatgagaa

SEQ ID NO: 267110 - DNA, 25 bp, Mus musculus
ctcagaggggcaggagctccgggtc

SEQ ID NO: 267111 - DNA, 25 bp, Mus musculus
ctcagagggtccgagattgtctaaa

SEQ ID NO: 267112 - DNA, 25 bp, Mus musculus
ctcagaggtggaagaagagaagtcc

SEQ ID NO: 267113 - DNA, 25 bp, Mus musculus
ctcagaggtggtaaaagagaagtcc

SEQ ID NO: 267114 - DNA, 25 bp, Mus musculus
ctcagagtattaaaaatgatacatc

SEQ ID NO: 267115 - DNA, 25 bp, Mus musculus
ctcagagtctgatgccaagccatga

SEQ ID NO: 267116 - DNA, 25 bp, Mus musculus
ctcagagtctgcaagaaactacatt

SEQ ID NO: 267117 - DNA, 25 bp, Mus musculus
ctcagagtgaagaagaactcctacc

SEQ ID NO: 267118 - DNA, 25 bp, Mus musculus
ctcagagtgaagaagcgagatcatc

SEQ ID NO: 267119 - DNA, 25 bp, Mus musculus
ctcagagtggcctctcaaaggcagg

SEQ ID NO: 267120 - DNA, 25 bp, Mus musculus
ctcagagttacaggggcccagactg

SEQ ID NO: 267121 - DNA, 25 bp, Mus musculus
ctcagagttacagggtatttttctt

SEQ ID NO: 267122 - DNA, 25 bp, Mus musculus
ctcagagtttgtcatccgtccttgg

SEQ ID NO: 267123 - DNA, 25 bp, Mus musculus
ctcagatatgctcggactcaaccgt

SEQ ID NO: 267124 - DNA, 25 bp, Mus musculus
ctcagatcagaaccagtcttcagta

SEQ ID NO: 267125 - DNA, 25 bp, Mus musculus
ctcagatcagaagagcagcagaagc

SEQ ID NO: 267126 - DNA, 25 bp, Mus musculus
ctcagatcagccttgcagcagaata

SEQ ID NO: 267127 - DNA, 25 bp, Mus musculus
ctcagatcagctgggaagggctacc

SEQ ID NO: 267128 - DNA, 25 bp, Mus musculus
ctcagatcaggtaagggagcacaca

SEQ ID NO: 267129 - DNA, 25 bp, Mus musculus
ctcagatctcctgagccacagcctg

SEQ ID NO: 267130 - DNA, 25 bp, Mus musculus
ctcagatcttggaggactccctgca

SEQ ID NO: 267131 - DNA, 25 bp, Mus musculus
ctcagatgcaggaacccagagtggg

SEQ ID NO: 267132 - DNA, 25 bp, Mus musculus
ctcagatggatgaggaagacatggg

SEQ ID NO: 267133 - DNA, 25 bp, Mus musculus
ctcagatggcaggaccccacaggcc

SEQ ID NO: 267134 - DNA, 25 bp, Mus musculus
ctcagatggcaggcccaagtatctg

SEQ ID NO: 267135 - DNA, 25 bp, Mus musculus
ctcagatgtcacaggttaaagaaac

SEQ ID NO: 267136 - DNA, 25 bp, Mus musculus
ctcagatgttagaagatgtagctaa

SEQ ID NO: 267137 - DNA, 25 bp, Mus musculus
ctcagatgttagcactagcaacaag

SEQ ID NO: 267138 - DNA, 25 bp, Mus musculus
ctcagattaagggtttcaaaaacaa

SEQ ID NO: 267139 - DNA, 25 bp, Mus musculus
ctcagattacagatttctgctccta

SEQ ID NO: 267140 - DNA, 25 bp, Mus musculus
ctcagattccagagacactgtacta

SEQ ID NO: 267141 - DNA, 25 bp, Mus musculus
ctcagattggctatgtagtcagtga

SEQ ID NO: 267142 - DNA, 25 bp, Mus musculus
ctcagatttggacagcttccttgtg

SEQ ID NO: 267143 - DNA, 25 bp, Mus musculus
ctcagatttggacagtttccagcag

SEQ ID NO: 267144 - DNA, 25 bp, Mus musculus
ctcagatttggggccaggaccctgc

SEQ ID NO: 267145 - DNA, 25 bp, Mus musculus
ctcagcaaaaagcctaagaaagttg

SEQ ID NO: 267146 - DNA, 25 bp, Mus musculus
ctcagcaaagaagttgggatatcta

SEQ ID NO: 267147 - DNA, 25 bp, Mus musculus
ctcagcaaagacaagattgaggatg

SEQ ID NO: 267148 - DNA, 25 bp, Mus musculus
ctcagcaaaggcagctgagatgctt

SEQ ID NO: 267149 - DNA, 25 bp, Mus musculus
ctcagcaaatgtggtaaacagctgg

SEQ ID NO: 267150 - DNA, 25 bp, Mus musculus
ctcagcaacctcatacattaaagtg

SEQ ID NO: 267151 - DNA, 25 bp, Mus musculus
ctcagcaacctcatccctggcagcc

SEQ ID NO: 267152 - DNA, 25 bp, Mus musculus
ctcagcaacctcatttccctgactg

SEQ ID NO: 267153 - DNA, 25 bp, Mus musculus
ctcagcaactgcaggacagtctccg

SEQ ID NO: 267154 - DNA, 25 bp, Mus musculus
ctcagcaactgcaggtggaagagct

SEQ ID NO: 267155 - DNA, 25 bp, Mus musculus
ctcagcaagccagagggcacccaca

SEQ ID NO: 267156 - DNA, 25 bp, Mus musculus
ctcagcaagccagaggtgtttggga

SEQ ID NO: 267157 - DNA, 25 bp, Mus musculus
ctcagcaagggccgcgtgttggagg

SEQ ID NO: 267158 - DNA, 25 bp, Mus musculus
ctcagcaatagtctggaagaaagga

SEQ ID NO: 267159 - DNA, 25 bp, Mus musculus
ctcagcaatggtgacctgctccagt

SEQ ID NO: 267160 - DNA, 25 bp, Mus musculus
ctcagcaatggtgtgaacaacccag

SEQ ID NO: 267161 - DNA, 25 bp, Mus musculus
ctcagcacaaagcagatttcaggta

SEQ ID NO: 267162 - DNA, 25 bp, Mus musculus
ctcagcacaaagcagtgtggtcatc

SEQ ID NO: 267163 - DNA, 25 bp, Mus musculus
ctcagcacacatggaaccatgaatt

SEQ ID NO: 267164 - DNA, 25 bp, Mus musculus
ctcagcacaccagaactatgccgag

SEQ ID NO: 267165 - DNA, 25 bp, Mus musculus
ctcagcacacctggagcctgttatt

SEQ ID NO: 267166 - DNA, 25 bp, Mus musculus
ctcagcacagcaagagtgctgtcga

SEQ ID NO: 267167 - DNA, 25 bp, Mus musculus
ctcagcacctcatgctgatacattg

SEQ ID NO: 267168 - DNA, 25 bp, Mus musculus
ctcagcacctcatggtgatacattg

SEQ ID NO: 267169 - DNA, 25 bp, Mus musculus
ctcagcactggagagaccagccacg

SEQ ID NO: 267170 - DNA, 25 bp, Mus musculus
ctcagcactgtcaagcggaagatgg

SEQ ID NO: 267171 - DNA, 25 bp, Mus musculus
ctcagcactgtcaagcttctcatgc

SEQ ID NO: 267172 - DNA, 25 bp, Mus musculus
ctcagcactgtcaaggatgtgtttg

SEQ ID NO: 267173 - DNA, 25 bp, Mus musculus
ctcagcactgtcagacatagatatt

SEQ ID NO: 267174 - DNA, 25 bp, Mus musculus
ctcagcactgtgtgtcaccgtgccg

SEQ ID NO: 267175 - DNA, 25 bp, Mus musculus
ctcagcagaacaaaccaaagaaaaa

SEQ ID NO: 267176 - DNA, 25 bp, Mus musculus
ctcagcagaagcaacagcagaagca

SEQ ID NO: 267177 - DNA, 25 bp, Mus musculus
ctcagcagaagctgggtgccattgt

SEQ ID NO: 267178 - DNA, 25 bp, Mus musculus
ctcagcagaatggcactacaagatg

SEQ ID NO: 267179 - DNA, 25 bp, Mus musculus
ctcagcagaccaaaatcacccagga

SEQ ID NO: 267180 - DNA, 25 bp, Mus musculus
ctcagcagaggtggaaagtacgcag

SEQ ID NO: 267181 - DNA, 25 bp, Mus musculus
ctcagcagatgatcctctaggcacc

SEQ ID NO: 267182 - DNA, 25 bp, Mus musculus
ctcagcagatggtacctggaccctg

SEQ ID NO: 267183 - DNA, 25 bp, Mus musculus
ctcagcagcatccagttcgtgaaga

SEQ ID NO: 267184 - DNA, 25 bp, Mus musculus
ctcagcagcggggttctctggaaac

SEQ ID NO: 267185 - DNA, 25 bp, Mus musculus
ctcagcagcttccagaaccacgtca

SEQ ID NO: 267186 - DNA, 25 bp, Mus musculus
ctcagcagcttccaggcgtccgcga

SEQ ID NO: 267187 - DNA, 25 bp, Mus musculus
ctcagcagggacgcccgaggagctc

SEQ ID NO: 267188 - DNA, 25 bp, Mus musculus
ctcagcagggtcagaccacacccgt

SEQ ID NO: 267189 - DNA, 25 bp, Mus musculus
ctcagcagtgctaattcaggtcttg

SEQ ID NO: 267190 - DNA, 25 bp, Mus musculus
ctcagcatagaaagtcctcgcgtgt

SEQ ID NO: 267191 - DNA, 25 bp, Mus musculus
ctcagcatagaagtttaccgacaag

SEQ ID NO: 267192 - DNA, 25 bp, Mus musculus
ctcagcatcagggagccataattcc

SEQ ID NO: 267193 - DNA, 25 bp, Mus musculus
ctcagcatcagggattgttacagag

SEQ ID NO: 267194 - DNA, 25 bp, Mus musculus
ctcagcatccctggctgagagctta

SEQ ID NO: 267195 - DNA, 25 bp, Mus musculus
ctcagcatccgcctgatctctcaac

SEQ ID NO: 267196 - DNA, 25 bp, Mus musculus
ctcagcatgcaaaattctaaagata

SEQ ID NO: 267197 - DNA, 25 bp, Mus musculus
ctcagcatgcaagagactctgcaga

SEQ ID NO: 267198 - DNA, 25 bp, Mus musculus
ctcagccacaggggcattaggagac

SEQ ID NO: 267199 - DNA, 25 bp, Mus musculus
ctcagccagacagagtccggccaca

SEQ ID NO: 267200 - DNA, 25 bp, Mus musculus
ctcagccagagcaaagtaaagacat

SEQ ID NO: 267201 - DNA, 25 bp, Mus musculus
ctcagccagcctattcttttacttt

SEQ ID NO: 267202 - DNA, 25 bp, Mus musculus
ctcagccagctgagggagtatgatt

SEQ ID NO: 267203 - DNA, 25 bp, Mus musculus
ctcagccatcaactggaccctcatt

SEQ ID NO: 267204 - DNA, 25 bp, Mus musculus
ctcagccatgatggtaacaaaagat

SEQ ID NO: 267205 - DNA, 25 bp, Mus musculus
ctcagcccacagaaaccactcactc

SEQ ID NO: 267206 - DNA, 25 bp, Mus musculus
ctcagcccacagctccccataggtg

SEQ ID NO: 267207 - DNA, 25 bp, Mus musculus
ctcagcccactggatcaaacaacat

SEQ ID NO: 267208 - DNA, 25 bp, Mus musculus
ctcagcccactggcctcttcaggtg

SEQ ID NO: 267209 - DNA, 25 bp, Mus musculus
ctcagcccaggatctagagtcatgt

SEQ ID NO: 267210 - DNA, 25 bp, Mus musculus
ctcagcccagggtctccctacagag

SEQ ID NO: 267211 - DNA, 25 bp, Mus musculus
ctcagcccaggtggtgctctgggtc

SEQ ID NO: 267212 - DNA, 25 bp, Mus musculus
ctcagcccatgaagcaagcttgggc

SEQ ID NO: 267213 - DNA, 25 bp, Mus musculus
ctcagccccagagcacagaggacat

SEQ ID NO: 267214 - DNA, 25 bp, Mus musculus
ctcagccccagagcagctcttatga

SEQ ID NO: 267215 - DNA, 25 bp, Mus musculus
ctcagccccagagcttcggtgcaac

SEQ ID NO: 267216 - DNA, 25 bp, Mus musculus
ctcagccccagaggtctcagcaatc

SEQ ID NO: 267217 - DNA, 25 bp, Mus musculus
ctcagccccagggaagaggaacagc

SEQ ID NO: 267218 - DNA, 25 bp, Mus musculus
ctcagccccagtttgacggatgaaa

SEQ ID NO: 267219 - DNA, 25 bp, Mus musculus
ctcagcccctcctcctccctccctc

SEQ ID NO: 267220 - DNA, 25 bp, Mus musculus
ctcagccctcatcaatgaggaactc

SEQ ID NO: 267221 - DNA, 25 bp, Mus musculus
ctcagccctgaggttatttcgtcat

SEQ ID NO: 267222 - DNA, 25 bp, Mus musculus
ctcagccggcaggctcatagtggca

SEQ ID NO: 267223 - DNA, 25 bp, Mus musculus
ctcagcctcgaatgggtgaagaccg

SEQ ID NO: 267224 - DNA, 25 bp, Mus musculus
ctcagcctgcataaggctgcggaga

SEQ ID NO: 267225 - DNA, 25 bp, Mus musculus
ctcagcctggaagacctgccaggcc

SEQ ID NO: 267226 - DNA, 25 bp, Mus musculus
ctcagcctggaggacacagagctgc

SEQ ID NO: 267227 - DNA, 25 bp, Mus musculus
ctcagcctgtctgccccatgtccat

SEQ ID NO: 267228 - DNA, 25 bp, Mus musculus
ctcagccttatgccctggttccacg

SEQ ID NO: 267229 - DNA, 25 bp, Mus musculus
ctcagccttcaaaagaatggcagtc

SEQ ID NO: 267230 - DNA, 25 bp, Mus musculus
ctcagccttcaaaagtgtgctgggg

SEQ ID NO: 267231 - DNA, 25 bp, Mus musculus
ctcagccttgaggtcccactggaag

SEQ ID NO: 267232 - DNA, 25 bp, Mus musculus
ctcagcgatcaggatatgacattac

SEQ ID NO: 267233 - DNA, 25 bp, Mus musculus
ctcagcgcaactcagatggctccag

SEQ ID NO: 267234 - DNA, 25 bp, Mus musculus
ctcagcgcaactcaggctgactccc

SEQ ID NO: 267235 - DNA, 25 bp, Mus musculus
ctcagcgcggattaccttatgctga

SEQ ID NO: 267236 - DNA, 25 bp, Mus musculus
ctcagcgctgacaggtacagagcta

SEQ ID NO: 267237 - DNA, 25 bp, Mus musculus
ctcagcgcttagcccggaagaccag

SEQ ID NO: 267238 - DNA, 25 bp, Mus musculus
ctcagcggcccagcgtccgatgcaa

SEQ ID NO: 267239 - DNA, 25 bp, Mus musculus
ctcagcgtcagggccgcgttggcct

SEQ ID NO: 267240 - DNA, 25 bp, Mus musculus
ctcagcgtcccatggcctagccgcc

SEQ ID NO: 267241 - DNA, 25 bp, Mus musculus
ctcagcgtgaagatgtactggttcc

SEQ ID NO: 267242 - DNA, 25 bp, Mus musculus
ctcagcgtgatcgcaatgagaggta

SEQ ID NO: 267243 - DNA, 25 bp, Mus musculus
ctcagcgtggagcccttggatgaag

SEQ ID NO: 267244 - DNA, 25 bp, Mus musculus
ctcagcgtggagctgcagcccttgg

SEQ ID NO: 267245 - DNA, 25 bp, Mus musculus
ctcagctaacagtggtaccagtggg

SEQ ID NO: 267246 - DNA, 25 bp, Mus musculus
ctcagctacaaaggcaacatctggg

SEQ ID NO: 267247 - DNA, 25 bp, Mus musculus
ctcagctacaggctcagaaagaaga

SEQ ID NO: 267248 - DNA, 25 bp, Mus musculus
ctcagctacccaggttgaggctgag

SEQ ID NO: 267249 - DNA, 25 bp, Mus musculus
ctcagctacctcggtaccagtactt

SEQ ID NO: 267250 - DNA, 25 bp, Mus musculus
ctcagctatggactgtctaactttc

SEQ ID NO: 267251 - DNA, 25 bp, Mus musculus
ctcagctatggagtcagtgactttt

SEQ ID NO: 267252 - DNA, 25 bp, Mus musculus
ctcagctatggagtctgtatctttt

SEQ ID NO: 267253 - DNA, 25 bp, Mus musculus
ctcagctcagagcagctttgacctc

SEQ ID NO: 267254 - DNA, 25 bp, Mus musculus
ctcagctcagcacaatcctggagga

SEQ ID NO: 267255 - DNA, 25 bp, Mus musculus
ctcagctcagcggaacctgcctctt

SEQ ID NO: 267256 - DNA, 25 bp, Mus musculus
ctcagctcagcggtcacacagcaaa

SEQ ID NO: 267257 - DNA, 25 bp, Mus musculus
ctcagctcaggtactagaagacaca

SEQ ID NO: 267258 - DNA, 25 bp, Mus musculus
ctcagctcggaggacaggtcaatgg

SEQ ID NO: 267259 - DNA, 25 bp, Mus musculus
ctcagctctaaagcgagacctagat

SEQ ID NO: 267260 - DNA, 25 bp, Mus musculus
ctcagctctaattggtttcaaatgt

SEQ ID NO: 267261 - DNA, 25 bp, Mus musculus
ctcagctctacctaggcacaaaagg

SEQ ID NO: 267262 - DNA, 25 bp, Mus musculus
ctcagctctgctctaaagcaaatcc

SEQ ID NO: 267263 - DNA, 25 bp, Mus musculus
ctcagctgagcccagtccctgcagg

SEQ ID NO: 267264 - DNA, 25 bp, Mus musculus
ctcagctgctgcgcagaagaagagc

SEQ ID NO: 267265 - DNA, 25 bp, Mus musculus
ctcagctggaaggaggaagatgggc

SEQ ID NO: 267266 - DNA, 25 bp, Mus musculus
ctcagctggacagagagttaattga

SEQ ID NO: 267267 - DNA, 25 bp, Mus musculus
ctcagctggttgtgcagacaaaatg

SEQ ID NO: 267268 - DNA, 25 bp, Mus musculus
ctcagctggttgtgcagtcaaaatg

SEQ ID NO: 267269 - DNA, 25 bp, Mus musculus
ctcagcttctcatgctcatctttcc

SEQ ID NO: 267270 - DNA, 25 bp, Mus musculus
ctcagcttctcatgtgcaggctgag

SEQ ID NO: 267271 - DNA, 25 bp, Mus musculus
ctcagcttggcagaacacatgtcgg

SEQ ID NO: 267272 - DNA, 25 bp, Mus musculus
ctcagctttatcaggtccacagagt

SEQ ID NO: 267273 - DNA, 25 bp, Mus musculus
ctcaggaaacaacagatcccccacc

SEQ ID NO: 267274 - DNA, 25 bp, Mus musculus
ctcaggaaaggactttcctggaacg

SEQ ID NO: 267275 - DNA, 25 bp, Mus musculus
ctcaggaaaggtaaacctagccttt

SEQ ID NO: 267276 - DNA, 25 bp, Mus musculus
ctcaggaacagccccacagcagcaa

SEQ ID NO: 267277 - DNA, 25 bp, Mus musculus
ctcaggaacagtatcatcaacattt

SEQ ID NO: 267278 - DNA, 25 bp, Mus musculus
ctcaggaagagggttcactgatcac

SEQ ID NO: 267279 - DNA, 25 bp, Mus musculus
ctcaggaagctaagctgtggtcctc

SEQ ID NO: 267280 - DNA, 25 bp, Mus musculus
ctcaggaagtgcttctgtttcctgc

SEQ ID NO: 267281 - DNA, 25 bp, Mus musculus
ctcaggaatgcaacttctcggtatc

SEQ ID NO: 267282 - DNA, 25 bp, Mus musculus
ctcaggaatgtctcctgaacttcga

SEQ ID NO: 267283 - DNA, 25 bp, Mus musculus
ctcaggaatgtctcctgtctgtggt

SEQ ID NO: 267284 - DNA, 25 bp, Mus musculus
ctcaggacaatgcagcttcacttgg

SEQ ID NO: 267285 - DNA, 25 bp, Mus musculus
ctcaggacaatgcagtgctgaaagg

SEQ ID NO: 267286 - DNA, 25 bp, Mus musculus
ctcaggacagagggactgctgcaga

SEQ ID NO: 267287 - DNA, 25 bp, Mus musculus
ctcaggacagcatcccagcctttac

SEQ ID NO: 267288 - DNA, 25 bp, Mus musculus
ctcaggaccaggtagattccataat

SEQ ID NO: 267289 - DNA, 25 bp, Mus musculus
ctcaggaccatgcgcaatcaggatt

SEQ ID NO: 267290 - DNA, 25 bp, Mus musculus
ctcaggaccatgcgcctgcggagtt

SEQ ID NO: 267291 - DNA, 25 bp, Mus musculus
ctcaggacccacagggccctgtgtg

SEQ ID NO: 267292 - DNA, 25 bp, Mus musculus
ctcaggaccccagctctgtcagcat

SEQ ID NO: 267293 - DNA, 25 bp, Mus musculus
ctcaggaccccaggaccttgccaca

SEQ ID NO: 267294 - DNA, 25 bp, Mus musculus
ctcaggacggagatgaacatctgca

SEQ ID NO: 267295 - DNA, 25 bp, Mus musculus
ctcaggactgcacagtgtacaaggc

SEQ ID NO: 267296 - DNA, 25 bp, Mus musculus
ctcaggagacagggaagaagccagc

SEQ ID NO: 267297 - DNA, 25 bp, Mus musculus
ctcaggagagaggtacaaagaagac

SEQ ID NO: 267298 - DNA, 25 bp, Mus musculus
ctcaggagagatgacttgtaccaga

SEQ ID NO: 267299 - DNA, 25 bp, Mus musculus
ctcaggagagatgagagcaatcacc

SEQ ID NO: 267300 - DNA, 25 bp, Mus musculus
ctcaggagagccaggcttagaatca

SEQ ID NO: 267301 - DNA, 25 bp, Mus musculus
ctcaggagaggagccatttattgaa

SEQ ID NO: 267302 - DNA, 25 bp, Mus musculus
ctcaggagaggctgctcccaggtac

SEQ ID NO: 267303 - DNA, 25 bp, Mus musculus
ctcaggagaggtacttggaaggctg

SEQ ID NO: 267304 - DNA, 25 bp, Mus musculus
ctcaggagatcatgcctcccgcagc

SEQ ID NO: 267305 - DNA, 25 bp, Mus musculus
ctcaggagcaagattgccaagggat

SEQ ID NO: 267306 - DNA, 25 bp, Mus musculus
ctcaggagcaagtttcaggttagtc

SEQ ID NO: 267307 - DNA, 25 bp, Mus musculus
ctcaggagcagagagtgacaacagt

SEQ ID NO: 267308 - DNA, 25 bp, Mus musculus
ctcaggagcagagatcatagcagtc

SEQ ID NO: 267309 - DNA, 25 bp, Mus musculus
ctcaggagcagcgggtttattgcct

SEQ ID NO: 267310 - DNA, 25 bp, Mus musculus
ctcaggagccgttgcccacggaccc

SEQ ID NO: 267311 - DNA, 25 bp, Mus musculus
ctcaggagcgaaagtgacaccagca

SEQ ID NO: 267312 - DNA, 25 bp, Mus musculus
ctcaggagctcaacgagctggacta

SEQ ID NO: 267313 - DNA, 25 bp, Mus musculus
ctcaggagctgacaggcagtatctg

SEQ ID NO: 267314 - DNA, 25 bp, Mus musculus
ctcaggaggatcaaggaactgcatt

SEQ ID NO: 267315 - DNA, 25 bp, Mus musculus
ctcaggagtacgcagtggaagccca

SEQ ID NO: 267316 - DNA, 25 bp, Mus musculus
ctcaggatatcaaggcctctgtgtc

SEQ ID NO: 267317 - DNA, 25 bp, Mus musculus
ctcaggatatcagctcttgcactgc

SEQ ID NO: 267318 - DNA, 25 bp, Mus musculus
ctcaggatcaccaggtgctcgaggc

SEQ ID NO: 267319 - DNA, 25 bp, Mus musculus
ctcaggatcctaccctctagacgtc

SEQ ID NO: 267320 - DNA, 25 bp, Mus musculus
ctcaggatcttgagactaccaaagg

SEQ ID NO: 267321 - DNA, 25 bp, Mus musculus
ctcaggatcttgagtttaccaaatt

SEQ ID NO: 267322 - DNA, 25 bp, Mus musculus
ctcaggattggaagatcgaagcctg

SEQ ID NO: 267323 - DNA, 25 bp, Mus musculus
ctcaggcaccaggttcctccaacac

SEQ ID NO: 267324 - DNA, 25 bp, Mus musculus
ctcaggcagcttgatcagtggacca

SEQ ID NO: 267325 - DNA, 25 bp, Mus musculus
ctcaggcagcttggaggaagagtca

SEQ ID NO: 267326 - DNA, 25 bp, Mus musculus
ctcaggccagatattcagaaaccct

SEQ ID NO: 267327 - DNA, 25 bp, Mus musculus
ctcaggccagatcaaaaaagggaaa

SEQ ID NO: 267328 - DNA, 25 bp, Mus musculus
ctcaggcccagcagtgcatcctgcc

SEQ ID NO: 267329 - DNA, 25 bp, Mus musculus
ctcaggccgcaggcctctctgtccc

SEQ ID NO: 267330 - DNA, 25 bp, Mus musculus
ctcaggccgggaaccgatgatgtgg

SEQ ID NO: 267331 - DNA, 25 bp, Mus musculus
ctcaggcgacccaactctactgcca

SEQ ID NO: 267332 - DNA, 25 bp, Mus musculus
ctcaggcggagaagtactctcaaaa

SEQ ID NO: 267333 - DNA, 25 bp, Mus musculus
ctcaggctaagaatggttttagctc

SEQ ID NO: 267334 - DNA, 25 bp, Mus musculus
ctcaggctcacaagaaataccattc

SEQ ID NO: 267335 - DNA, 25 bp, Mus musculus
ctcaggctcacaaggcagaaaaaaa

SEQ ID NO: 267336 - DNA, 25 bp, Mus musculus
ctcaggctcagcaccaaggagatcc

SEQ ID NO: 267337 - DNA, 25 bp, Mus musculus
ctcaggctcggaaacgaatacctcc

SEQ ID NO: 267338 - DNA, 25 bp, Mus musculus
ctcaggctctgggagttggaaccct

SEQ ID NO: 267339 - DNA, 25 bp, Mus musculus
ctcaggctgagaagtactctcagaa

SEQ ID NO: 267340 - DNA, 25 bp, Mus musculus
ctcaggctgtcagaaaaagatgcaa

SEQ ID NO: 267341 - DNA, 25 bp, Mus musculus
ctcaggctgtcagtctagtctcctg

SEQ ID NO: 267342 - DNA, 25 bp, Mus musculus
ctcaggctgtgagatatctgtttca

SEQ ID NO: 267343 - DNA, 25 bp, Mus musculus
ctcaggcttactcagactctaagga

SEQ ID NO: 267344 - DNA, 25 bp, Mus musculus
ctcaggcttcaggaagtgtgccatg

SEQ ID NO: 267345 - DNA, 25 bp, Mus musculus
ctcagggaaaagcacagagctgatg

SEQ ID NO: 267346 - DNA, 25 bp, Mus musculus
ctcagggaaaaggaacaccatggac

SEQ ID NO: 267347 - DNA, 25 bp, Mus musculus
ctcagggaaaaggtcattaaagggg

SEQ ID NO: 267348 - DNA, 25 bp, Mus musculus
ctcagggaacaagcccaggactgtg

SEQ ID NO: 267349 - DNA, 25 bp, Mus musculus
ctcagggaatggactatttgcatgc

SEQ ID NO: 267350 - DNA, 25 bp, Mus musculus
ctcagggagaaagagcctggcccaa

SEQ ID NO: 267351 - DNA, 25 bp, Mus musculus
ctcagggagagatgagcaataacag

SEQ ID NO: 267352 - DNA, 25 bp, Mus musculus
ctcagggatggaggcaaattccacc

SEQ ID NO: 267353 - DNA, 25 bp, Mus musculus
ctcagggcacaggaataacagaagc

SEQ ID NO: 267354 - DNA, 25 bp, Mus musculus
ctcagggcagccaagcctgagcaag

SEQ ID NO: 267355 - DNA, 25 bp, Mus musculus
ctcagggcagtggtcctcatagtcc

SEQ ID NO: 267356 - DNA, 25 bp, Mus musculus
ctcagggcgtggccatagtgaacag

SEQ ID NO: 267357 - DNA, 25 bp, Mus musculus
ctcaggggttcagatgccccatata

SEQ ID NO: 267358 - DNA, 25 bp, Mus musculus
ctcaggggttcagccaacaattctc

SEQ ID NO: 267359 - DNA, 25 bp, Mus musculus
ctcagggtaggagggtgggatggag

SEQ ID NO: 267360 - DNA, 25 bp, Mus musculus
ctcagggtcttcctggtgcagtggg

SEQ ID NO: 267361 - DNA, 25 bp, Mus musculus
ctcagggtgaggcgacccctctgag

SEQ ID NO: 267362 - DNA, 25 bp, Mus musculus
ctcagggtggcaaaggtgatgttcg

SEQ ID NO: 267363 - DNA, 25 bp, Mus musculus
ctcaggtaagagagatctggagctg

SEQ ID NO: 267364 - DNA, 25 bp, Mus musculus
ctcaggtactgtcggaccagcagtg

SEQ ID NO: 267365 - DNA, 25 bp, Mus musculus
ctcaggtatccaacgcttgtatcag

SEQ ID NO: 267366 - DNA, 25 bp, Mus musculus
ctcaggtcagcctccatgtactcag

SEQ ID NO: 267367 - DNA, 25 bp, Mus musculus
ctcaggtcccacgccctggcacatc

SEQ ID NO: 267368 - DNA, 25 bp, Mus musculus
ctcaggtcccagagaccagagggtt

SEQ ID NO: 267369 - DNA, 25 bp, Mus musculus
ctcaggtcccaggctgtgtcccact

SEQ ID NO: 267370 - DNA, 25 bp, Mus musculus
ctcaggtcctgacagaaatccatgc

SEQ ID NO: 267371 - DNA, 25 bp, Mus musculus
ctcaggtctccagggcctggaatgt

SEQ ID NO: 267372 - DNA, 25 bp, Mus musculus
ctcaggtgagcaggatcggaacgtc

SEQ ID NO: 267373 - DNA, 25 bp, Mus musculus
ctcaggtgctcaggtgtgtgtgacg

SEQ ID NO: 267374 - DNA, 25 bp, Mus musculus
ctcaggtgggttagccaaccccacc

SEQ ID NO: 267375 - DNA, 25 bp, Mus musculus
ctcaggttcatgatggatgacattc

SEQ ID NO: 267376 - DNA, 25 bp, Mus musculus
ctcaggttctgccgcctcctgatga

SEQ ID NO: 267377 - DNA, 25 bp, Mus musculus
ctcaggttctgccggggacccctgt

SEQ ID NO: 267378 - DNA, 25 bp, Mus musculus
ctcaggttgttcctcaatgtctgct

SEQ ID NO: 267379 - DNA, 25 bp, Mus musculus
ctcaggttttggctaccggctctct

SEQ ID NO: 267380 - DNA, 25 bp, Mus musculus
ctcagtaacaagcttcttaacccca

SEQ ID NO: 267381 - DNA, 25 bp, Mus musculus
ctcagtaagcggtgggtacagtcct

SEQ ID NO: 267382 - DNA, 25 bp, Mus musculus
ctcagtacagaagagacaggtgaga

SEQ ID NO: 267383 - DNA, 25 bp, Mus musculus
ctcagtacctggtactggtctcttt

SEQ ID NO: 267384 - DNA, 25 bp, Mus musculus
ctcagtagcccagggcagcgagatg

SEQ ID NO: 267385 - DNA, 25 bp, Mus musculus
ctcagtcaatggagagaacaagccc

SEQ ID NO: 267386 - DNA, 25 bp, Mus musculus
ctcagtcacgctcaatgagaagccc

SEQ ID NO: 267387 - DNA, 25 bp, Mus musculus
ctcagtcagttgggagaccgtacca

SEQ ID NO: 267388 - DNA, 25 bp, Mus musculus
ctcagtcagttgggagcttgcacta

SEQ ID NO: 267389 - DNA, 25 bp, Mus musculus
ctcagtcatgagaacacaaattgaa

SEQ ID NO: 267390 - DNA, 25 bp, Mus musculus
ctcagtccaaagctgctcagccatc

SEQ ID NO: 267391 - DNA, 25 bp, Mus musculus
ctcagtccattaggctcttctgcga

SEQ ID NO: 267392 - DNA, 25 bp, Mus musculus
ctcagtccattgtaatctcagatgg

SEQ ID NO: 267393 - DNA, 25 bp, Mus musculus
ctcagtcccagcagactgagcaaga

SEQ ID NO: 267394 - DNA, 25 bp, Mus musculus
ctcagtcctagtactgatgtcaaca

SEQ ID NO: 267395 - DNA, 25 bp, Mus musculus
ctcagtcctagtaggagagatccag

SEQ ID NO: 267396 - DNA, 25 bp, Mus musculus
ctcagtcgaaaggcaagaagcgaaa

SEQ ID NO: 267397 - DNA, 25 bp, Mus musculus
ctcagtcgtttggacttcaaatctc

SEQ ID NO: 267398 - DNA, 25 bp, Mus musculus
ctcagtctcacctggcaagatgaat

SEQ ID NO: 267399 - DNA, 25 bp, Mus musculus
ctcagtctcccagtggtactgccac

SEQ ID NO: 267400 - DNA, 25 bp, Mus musculus
ctcagtctgaaaggctccagatacc

SEQ ID NO: 267401 - DNA, 25 bp, Mus musculus
ctcagtctgcaacagttgtttaatg

SEQ ID NO: 267402 - DNA, 25 bp, Mus musculus
ctcagtctgtacaggttcctgcaga

SEQ ID NO: 267403 - DNA, 25 bp, Mus musculus
ctcagtctgtcaagggggtggcacc

SEQ ID NO: 267404 - DNA, 25 bp, Mus musculus
ctcagtgaaaggtaaaccagatgtg

SEQ ID NO: 267405 - DNA, 25 bp, Mus musculus
ctcagtgaagagtcacatactcacc

SEQ ID NO: 267406 - DNA, 25 bp, Mus musculus
ctcagtgactgcagaaccaagggcc

SEQ ID NO: 267407 - DNA, 25 bp, Mus musculus
ctcagtgactgcaggctcatgagca

SEQ ID NO: 267408 - DNA, 25 bp, Mus musculus
ctcagtgagaatgagacgtccagcg

SEQ ID NO: 267409 - DNA, 25 bp, Mus musculus
ctcagtgagaatgaggaaggcaagc

SEQ ID NO: 267410 - DNA, 25 bp, Mus musculus
ctcagtgagactaatagtgcagagg

SEQ ID NO: 267411 - DNA, 25 bp, Mus musculus
ctcagtgagactaatccagctgaac

SEQ ID NO: 267412 - DNA, 25 bp, Mus musculus
ctcagtgatggctgtcacgaccgga

SEQ ID NO: 267413 - DNA, 25 bp, Mus musculus
ctcagtgcaagacagtattggagag

SEQ ID NO: 267414 - DNA, 25 bp, Mus musculus
ctcagtgcaagtacagagactcagc

SEQ ID NO: 267415 - DNA, 25 bp, Mus musculus
ctcagtgcaagtcatggggaccctg

SEQ ID NO: 267416 - DNA, 25 bp, Mus musculus
ctcagtgcaatggatcagttggaga

SEQ ID NO: 267417 - DNA, 25 bp, Mus musculus
ctcagtgcaatggcttccatacgac

SEQ ID NO: 267418 - DNA, 25 bp, Mus musculus
ctcagtgccaacctttttgcccaga

SEQ ID NO: 267419 - DNA, 25 bp, Mus musculus
ctcagtgcctcatcttttgctggaa

SEQ ID NO: 267420 - DNA, 25 bp, Mus musculus
ctcagtgctcagggtttaagtcttg

SEQ ID NO: 267421 - DNA, 25 bp, Mus musculus
ctcagtgctcccaggggtgatctgc

SEQ ID NO: 267422 - DNA, 25 bp, Mus musculus
ctcagtgctgaatggggctttcccg

SEQ ID NO: 267423 - DNA, 25 bp, Mus musculus
ctcagtgctgatgcagatgcgcttc

SEQ ID NO: 267424 - DNA, 25 bp, Mus musculus
ctcagtgctgatgcgcttcgacggg

SEQ ID NO: 267425 - DNA, 25 bp, Mus musculus
ctcagtgctgggttttcagagcaca

SEQ ID NO: 267426 - DNA, 25 bp, Mus musculus
ctcagtggaagttctggatgattta

SEQ ID NO: 267427 - DNA, 25 bp, Mus musculus
ctcagtggagagatgaataagttgc

SEQ ID NO: 267428 - DNA, 25 bp, Mus musculus
ctcagtggcagcactccgccagagt

SEQ ID NO: 267429 - DNA, 25 bp, Mus musculus
ctcagtggcaggcggtgtggctaca

SEQ ID NO: 267430 - DNA, 25 bp, Mus musculus
ctcagtggcagttgctgcgattgtg

SEQ ID NO: 267431 - DNA, 25 bp, Mus musculus
ctcagtggccccgaggtctcagatc

SEQ ID NO: 267432 - DNA, 25 bp, Mus musculus
ctcagtggccccgagtgccagttgc

SEQ ID NO: 267433 - DNA, 25 bp, Mus musculus
ctcagtggtgggttttttcagggat

SEQ ID NO: 267434 - DNA, 25 bp, Mus musculus
ctcagtggtgtcggcattgctagct

SEQ ID NO: 267435 - DNA, 25 bp, Mus musculus
ctcagtggtgtcggtgttgccagtg

SEQ ID NO: 267436 - DNA, 25 bp, Mus musculus
ctcagtgtaacccagtgtggtgaac

SEQ ID NO: 267437 - DNA, 25 bp, Mus musculus
ctcagtgtatgccgcttacaagcac

SEQ ID NO: 267438 - DNA, 25 bp, Mus musculus
ctcagtgtcagggagtgttcctgta

SEQ ID NO: 267439 - DNA, 25 bp, Mus musculus
ctcagtgtcagtgattcgggtacct

SEQ ID NO: 267440 - DNA, 25 bp, Mus musculus
ctcagtgtctgaaaccaaggaagaa

SEQ ID NO: 267441 - DNA, 25 bp, Mus musculus
ctcagtgtctggacatttattcaga

SEQ ID NO: 267442 - DNA, 25 bp, Mus musculus
ctcagtgtctggatgccagccactg

SEQ ID NO: 267443 - DNA, 25 bp, Mus musculus
ctcagtgtctggtgcagagtggtgg

SEQ ID NO: 267444 - DNA, 25 bp, Mus musculus
ctcagtgtggcctcccctggttttc

SEQ ID NO: 267445 - DNA, 25 bp, Mus musculus
ctcagttaaaaaacaaggtgagaca

SEQ ID NO: 267446 - DNA, 25 bp, Mus musculus
ctcagttcagcgtcgccaacaggag

SEQ ID NO: 267447 - DNA, 25 bp, Mus musculus
ctcagttctcccaggttgttcctca

SEQ ID NO: 267448 - DNA, 25 bp, Mus musculus
ctcagttctgtgactgatgaagtat

SEQ ID NO: 267449 - DNA, 25 bp, Mus musculus
ctcagttcttaccagaacttgatca

SEQ ID NO: 267450 - DNA, 25 bp, Mus musculus
ctcagttcttaccagagttctggcc

SEQ ID NO: 267451 - DNA, 25 bp, Mus musculus
ctcagttcttaccagatgacaaatc

SEQ ID NO: 267452 - DNA, 25 bp, Mus musculus
ctcagttgcagcgacaagttctacc

SEQ ID NO: 267453 - DNA, 25 bp, Mus musculus
ctcagttgccgattgctgttcttct

SEQ ID NO: 267454 - DNA, 25 bp, Mus musculus
ctcagtttctcagaatcccctggtt

SEQ ID NO: 267455 - DNA, 25 bp, Mus musculus
ctcagtttctcctcttggataacca

SEQ ID NO: 267456 - DNA, 25 bp, Mus musculus
ctcagtttctgcagacttgtactgg

SEQ ID NO: 267457 - DNA, 25 bp, Mus musculus
ctcagtttctgctcttggataacca

SEQ ID NO: 267458 - DNA, 25 bp, Mus musculus
ctcagttttagcctgcggagcccaa

SEQ ID NO: 267459 - DNA, 25 bp, Mus musculus
ctcagttttagtgcattgcagaagt

SEQ ID NO: 267460 - DNA, 25 bp, Mus musculus
ctcagttttagtggcatcccctgtg

SEQ ID NO: 267461 - DNA, 25 bp, Mus musculus
ctcagttttcccaagcaaccctaca

SEQ ID NO: 267462 - DNA, 25 bp, Mus musculus
ctcagttttcgcatcaaggtgtaat

SEQ ID NO: 267463 - DNA, 25 bp, Mus musculus
ctcagtttttgttggaaatacagtt

SEQ ID NO: 267464 - DNA, 25 bp, Mus musculus
ctcataaataaggtgcgagaagatg

SEQ ID NO: 267465 - DNA, 25 bp, Mus musculus
ctcataaataaggttgtgcattttt

SEQ ID NO: 267466 - DNA, 25 bp, Mus musculus
ctcataaatcagccttacgatgggc

SEQ ID NO: 267467 - DNA, 25 bp, Mus musculus
ctcataaattatatgcaggacaggt

SEQ ID NO: 267468 - DNA, 25 bp, Mus musculus
ctcataaattccacatgagatatga

SEQ ID NO: 267469 - DNA, 25 bp, Mus musculus
ctcataaattgttggggtttcttgg

SEQ ID NO: 267470 - DNA, 25 bp, Mus musculus
ctcataagtaaaggagaggagccaa

SEQ ID NO: 267471 - DNA, 25 bp, Mus musculus
ctcataagtaccaggctggtaagaa

SEQ ID NO: 267472 - DNA, 25 bp, Mus musculus
ctcataatcgcaaaaacatcaaact

SEQ ID NO: 267473 - DNA, 25 bp, Mus musculus
ctcataattgcccaggactcgttaa

SEQ ID NO: 267474 - DNA, 25 bp, Mus musculus
ctcataattgcccagtatttaacag

SEQ ID NO: 267475 - DNA, 25 bp, Mus musculus
ctcatacaccagcaactctgatgat

SEQ ID NO: 267476 - DNA, 25 bp, Mus musculus
ctcatacatcaaaagctgcagaatc

SEQ ID NO: 267477 - DNA, 25 bp, Mus musculus
ctcataccctctgtggtgagcatca

SEQ ID NO: 267478 - DNA, 25 bp, Mus musculus
ctcataccctctgtgtgacagctca

SEQ ID NO: 267479 - DNA, 25 bp, Mus musculus
ctcatactacaggtgagcgtcctca

SEQ ID NO: 267480 - DNA, 25 bp, Mus musculus
ctcatactgcaggcagagaggtggc

SEQ ID NO: 267481 - DNA, 25 bp, Mus musculus
ctcatactgcagtctggacagagga

SEQ ID NO: 267482 - DNA, 25 bp, Mus musculus
ctcatagaagttaatggaacccctg

SEQ ID NO: 267483 - DNA, 25 bp, Mus musculus
ctcatagatgtaggtgaaaaatctc

SEQ ID NO: 267484 - DNA, 25 bp, Mus musculus
ctcatagcagaatctggtcaacctg

SEQ ID NO: 267485 - DNA, 25 bp, Mus musculus
ctcatagccagggttcagccgactc

SEQ ID NO: 267486 - DNA, 25 bp, Mus musculus
ctcatagctgtctggtttgtggaca

SEQ ID NO: 267487 - DNA, 25 bp, Mus musculus
ctcataggacagtctcccatggcta

SEQ ID NO: 267488 - DNA, 25 bp, Mus musculus
ctcataggcttttggccactcttgg

SEQ ID NO: 267489 - DNA, 25 bp, Mus musculus
ctcatagtctctaggatgctccaga

SEQ ID NO: 267490 - DNA, 25 bp, Mus musculus
ctcatatccaggagagagtctccgc

SEQ ID NO: 267491 - DNA, 25 bp, Mus musculus
ctcatatccaggaggtgacccacaa

SEQ ID NO: 267492 - DNA, 25 bp, Mus musculus
ctcatatccaggagttgatctttat

SEQ ID NO: 267493 - DNA, 25 bp, Mus musculus
ctcatatggaccacagccacctggg

SEQ ID NO: 267494 - DNA, 25 bp, Mus musculus
ctcatattaaatcctgaagtccaca

SEQ ID NO: 267495 - DNA, 25 bp, Mus musculus
ctcatattaaggaggccttgtcagt

SEQ ID NO: 267496 - DNA, 25 bp, Mus musculus
ctcatattactgaagatgagctaag

SEQ ID NO: 267497 - DNA, 25 bp, Mus musculus
ctcatattactggtgatgaatcttt

SEQ ID NO: 267498 - DNA, 25 bp, Mus musculus
ctcatattactgtatcatccagata

SEQ ID NO: 267499 - DNA, 25 bp, Mus musculus
ctcatcaaagaaacccatcttcatg

SEQ ID NO: 267500 - DNA, 25 bp, Mus musculus
ctcatcaacagtgagggggactcag

SEQ ID NO: 267501 - DNA, 25 bp, Mus musculus
ctcatcaacagtttgcaggacatgg

SEQ ID NO: 267502 - DNA, 25 bp, Mus musculus
ctcatcaagaaagggtacacccagc

SEQ ID NO: 267503 - DNA, 25 bp, Mus musculus
ctcatcaagagggctgggtcaagga

SEQ ID NO: 267504 - DNA, 25 bp, Mus musculus
ctcatcaagtgaggaatctgaggaa

SEQ ID NO: 267505 - DNA, 25 bp, Mus musculus
ctcatcaataaggactgcatcgacg

SEQ ID NO: 267506 - DNA, 25 bp, Mus musculus
ctcatcaatcccagggctccgggat

SEQ ID NO: 267507 - DNA, 25 bp, Mus musculus
ctcatcaatgcaggaaaggaaacag

SEQ ID NO: 267508 - DNA, 25 bp, Mus musculus
ctcatcaatgccaaccgtcctgggc

SEQ ID NO: 267509 - DNA, 25 bp, Mus musculus
ctcatcaatgccagtcccatcccat

SEQ ID NO: 267510 - DNA, 25 bp, Mus musculus
ctcatcaatgggtcccttttgcagt

SEQ ID NO: 267511 - DNA, 25 bp, Mus musculus
ctcatcaatggtgaacaacccagac

SEQ ID NO: 267512 - DNA, 25 bp, Mus musculus
ctcatcacactgttgaagagaagga

SEQ ID NO: 267513 - DNA, 25 bp, Mus musculus
ctcatcacagccaggaagtcacctg

SEQ ID NO: 267514 - DNA, 25 bp, Mus musculus
ctcatcacaggagcatctcaatggg

SEQ ID NO: 267515 - DNA, 25 bp, Mus musculus
ctcatcacaggcaagaaggagagga

SEQ ID NO: 267516 - DNA, 25 bp, Mus musculus
ctcatcaccaaggaggatataaatg

SEQ ID NO: 267517 - DNA, 25 bp, Mus musculus
ctcatcacctctggaacttagccca

SEQ ID NO: 267518 - DNA, 25 bp, Mus musculus
ctcatcagactgtgtcagaagtttg

SEQ ID NO: 267519 - DNA, 25 bp, Mus musculus
ctcatcagcaaatgacatctggatt

SEQ ID NO: 267520 - DNA, 25 bp, Mus musculus
ctcatcagcatccagtcctggctta

SEQ ID NO: 267521 - DNA, 25 bp, Mus musculus
ctcatcagcttctcagtgaatttga

SEQ ID NO: 267522 - DNA, 25 bp, Mus musculus
ctcatcagtcaaagaatgtccccta

SEQ ID NO: 267523 - DNA, 25 bp, Mus musculus
ctcatcagtcaaagagaaacaaagc

SEQ ID NO: 267524 - DNA, 25 bp, Mus musculus
ctcatcagtgccaactgtaaagctc

SEQ ID NO: 267525 - DNA, 25 bp, Mus musculus
ctcatcagtggccaccaatgaagtt

SEQ ID NO: 267526 - DNA, 25 bp, Mus musculus
ctcatcatacagaacagtacctttt

SEQ ID NO: 267527 - DNA, 25 bp, Mus musculus
ctcatcatagatatcacaaccacct

SEQ ID NO: 267528 - DNA, 25 bp, Mus musculus
ctcatcatagatgacttccatagtt

SEQ ID NO: 267529 - DNA, 25 bp, Mus musculus
ctcatcatccagctggatagcagtg

SEQ ID NO: 267530 - DNA, 25 bp, Mus musculus
ctcatccaaggaggcgagtacttta

SEQ ID NO: 267531 - DNA, 25 bp, Mus musculus
ctcatccaagtcctaccaggaacgg

SEQ ID NO: 267532 - DNA, 25 bp, Mus musculus
ctcatccacgaaggttttgcaggcc

SEQ ID NO: 267533 - DNA, 25 bp, Mus musculus
ctcatccacggtttgtggaatcttg

SEQ ID NO: 267534 - DNA, 25 bp, Mus musculus
ctcatccagaagtttggggacctgg

SEQ ID NO: 267535 - DNA, 25 bp, Mus musculus
ctcatccagaatggtggccacttgg

SEQ ID NO: 267536 - DNA, 25 bp, Mus musculus
ctcatccagactcggggttctctgg

SEQ ID NO: 267537 - DNA, 25 bp, Mus musculus
ctcatccagcagaaaaaagatggat

SEQ ID NO: 267538 - DNA, 25 bp, Mus musculus
ctcatcccatgcttccaaactataa

SEQ ID NO: 267539 - DNA, 25 bp, Mus musculus
ctcatccccaaggccgcagatcatg

SEQ ID NO: 267540 - DNA, 25 bp, Mus musculus
ctcatccccaaggggtcaatcctca

SEQ ID NO: 267541 - DNA, 25 bp, Mus musculus
ctcatccctcctgaggggatcccag

SEQ ID NO: 267542 - DNA, 25 bp, Mus musculus
ctcatccctcctgaggggatgcttg

SEQ ID NO: 267543 - DNA, 25 bp, Mus musculus
ctcatccctgctcctgtctccaatg

SEQ ID NO: 267544 - DNA, 25 bp, Mus musculus
ctcatccctgctctgttgtgtatcc

SEQ ID NO: 267545 - DNA, 25 bp, Mus musculus
ctcatccgaagtatcctggagaaca

SEQ ID NO: 267546 - DNA, 25 bp, Mus musculus
ctcatccgctgagacccatgcggac

SEQ ID NO: 267547 - DNA, 25 bp, Mus musculus
ctcatccgctgagatgctggtggac

SEQ ID NO: 267548 - DNA, 25 bp, Mus musculus
ctcatccgggccgtggaagcatcag

SEQ ID NO: 267549 - DNA, 25 bp, Mus musculus
ctcatcctagcaggtatgccacagg

SEQ ID NO: 267550 - DNA, 25 bp, Mus musculus
ctcatcctcaatagttgaactttct

SEQ ID NO: 267551 - DNA, 25 bp, Mus musculus
ctcatcctccccctcaagttcaaaa

SEQ ID NO: 267552 - DNA, 25 bp, Mus musculus
ctcatcctgagccttgagccagatg

SEQ ID NO: 267553 - DNA, 25 bp, Mus musculus
ctcatcctgagttctccacaccctg

SEQ ID NO: 267554 - DNA, 25 bp, Mus musculus
ctcatcctggaccctgcatgctgat

SEQ ID NO: 267555 - DNA, 25 bp, Mus musculus
ctcatccttatacgagaaaccatca

SEQ ID NO: 267556 - DNA, 25 bp, Mus musculus
ctcatccttataggagaaaccatca

SEQ ID NO: 267557 - DNA, 25 bp, Mus musculus
ctcatccttgcatgatatggcataa

SEQ ID NO: 267558 - DNA, 25 bp, Mus musculus
ctcatcgagaagcccatgggcatca

SEQ ID NO: 267559 - DNA, 25 bp, Mus musculus
ctcatcgatataaagactcggtacc

SEQ ID NO: 267560 - DNA, 25 bp, Mus musculus
ctcatcgatataaagattgccctga

SEQ ID NO: 267561 - DNA, 25 bp, Mus musculus
ctcatcgccatcgacctggaactgg

SEQ ID NO: 267562 - DNA, 25 bp, Mus musculus
ctcatcgcctcagagaacttctgca

SEQ ID NO: 267563 - DNA, 25 bp, Mus musculus
ctcatcgcctcagagatactacgga

SEQ ID NO: 267564 - DNA, 25 bp, Mus musculus
ctcatcgcctcttggattctgtgtc

SEQ ID NO: 267565 - DNA, 25 bp, Mus musculus
ctcatcggcagccagctggaggagc

SEQ ID NO: 267566 - DNA, 25 bp, Mus musculus
ctcatcgtccgccagactcagtccg

SEQ ID NO: 267567 - DNA, 25 bp, Mus musculus
ctcatcgtccgccagagtacagttg

SEQ ID NO: 267568 - DNA, 25 bp, Mus musculus
ctcatcgtctctgagccacctgcgc

SEQ ID NO: 267569 - DNA, 25 bp, Mus musculus
ctcatcgtggattactcctgcgccc

SEQ ID NO: 267570 - DNA, 25 bp, Mus musculus
ctcatctaaggaattagctgaacat

SEQ ID NO: 267571 - DNA, 25 bp, Mus musculus
ctcatctaagggagatgaaggagac

SEQ ID NO: 267572 - DNA, 25 bp, Mus musculus
ctcatctaatccaggatgctgggca

SEQ ID NO: 267573 - DNA, 25 bp, Mus musculus
ctcatctacaggtgccaagtcgggg

SEQ ID NO: 267574 - DNA, 25 bp, Mus musculus
ctcatctacttccccctttcccacc

SEQ ID NO: 267575 - DNA, 25 bp, Mus musculus
ctcatctataagcagcctgctgtgg

SEQ ID NO: 267576 - DNA, 25 bp, Mus musculus
ctcatctataagcagtgtgctgtga

SEQ ID NO: 267577 - DNA, 25 bp, Mus musculus
ctcatctatgagggctacgagggcc

SEQ ID NO: 267578 - DNA, 25 bp, Mus musculus
ctcatctcaccaaggattacacagt

SEQ ID NO: 267579 - DNA, 25 bp, Mus musculus
ctcatctcactgcagacactccact

SEQ ID NO: 267580 - DNA, 25 bp, Mus musculus
ctcatctcaggacagctccctctca

SEQ ID NO: 267581 - DNA, 25 bp, Mus musculus
ctcatctcagggctgtccaagaagc

SEQ ID NO: 267582 - DNA, 25 bp, Mus musculus
ctcatctccaagagtgaatgtgggc

SEQ ID NO: 267583 - DNA, 25 bp, Mus musculus
ctcatctccaagtccttccagggca

SEQ ID NO: 267584 - DNA, 25 bp, Mus musculus
ctcatctccgacttcttcgccaagc

SEQ ID NO: 267585 - DNA, 25 bp, Mus musculus
ctcatctcctgccaggaatgaagaa

SEQ ID NO: 267586 - DNA, 25 bp, Mus musculus
ctcatctctgatcgctggggtgcat

SEQ ID NO: 267587 - DNA, 25 bp, Mus musculus
ctcatctctgtgatgggtcactgcc

SEQ ID NO: 267588 - DNA, 25 bp, Mus musculus
ctcatctgcagggtccacgccattc

SEQ ID NO: 267589 - DNA, 25 bp, Mus musculus
ctcatctgcatggactcttactcga

SEQ ID NO: 267590 - DNA, 25 bp, Mus musculus
ctcatctgccgagaggggtcccaca

SEQ ID NO: 267591 - DNA, 25 bp, Mus musculus
ctcatctgctagagaagggcaagtc

SEQ ID NO: 267592 - DNA, 25 bp, Mus musculus
ctcatctgctagagactggctctcc

SEQ ID NO: 267593 - DNA, 25 bp, Mus musculus
ctcatctgctagagctctggtgttc

SEQ ID NO: 267594 - DNA, 25 bp, Mus musculus
ctcatctgctagaggttcacaacaa

SEQ ID NO: 267595 - DNA, 25 bp, Mus musculus
ctcatctgctagagtaggtgcttcc

SEQ ID NO: 267596 - DNA, 25 bp, Mus musculus
ctcatctgtgcctcgatggcactgc

SEQ ID NO: 267597 - DNA, 25 bp, Mus musculus
ctcatctgtgctggctgcaaccaag

SEQ ID NO: 267598 - DNA, 25 bp, Mus musculus
ctcatctgtggtcaaaatccagttt

SEQ ID NO: 267599 - DNA, 25 bp, Mus musculus
ctcatcttcaaagggattaacatcc

SEQ ID NO: 267600 - DNA, 25 bp, Mus musculus
ctcatcttcaaggccacaggaccct

SEQ ID NO: 267601 - DNA, 25 bp, Mus musculus
ctcatcttctcccagatgaccaaga

SEQ ID NO: 267602 - DNA, 25 bp, Mus musculus
ctcatcttctggggggcagctggca

SEQ ID NO: 267603 - DNA, 25 bp, Mus musculus
ctcatcttcttcctgacagctatcc

SEQ ID NO: 267604 - DNA, 25 bp, Mus musculus
ctcatcttgagaacccagcagtgat

SEQ ID NO: 267605 - DNA, 25 bp, Mus musculus
ctcatcttggtccaggatctttctc

SEQ ID NO: 267606 - DNA, 25 bp, Mus musculus
ctcatcttggtccaggtcatcccag

SEQ ID NO: 267607 - DNA, 25 bp, Mus musculus
ctcatctttgtgggcggggcctgcc

SEQ ID NO: 267608 - DNA, 25 bp, Mus musculus
ctcatcttttctgcggttgatccaa

SEQ ID NO: 267609 - DNA, 25 bp, Mus musculus
ctcatgaaaaaataggttttcctgc

SEQ ID NO: 267610 - DNA, 25 bp, Mus musculus
ctcatgaaaacttgctagaaatgat

SEQ ID NO: 267611 - DNA, 25 bp, Mus musculus
ctcatgaacgcaaggactttgaatc

SEQ ID NO: 267612 - DNA, 25 bp, Mus musculus
ctcatgaacgcaatgtggaccatct

SEQ ID NO: 267613 - DNA, 25 bp, Mus musculus
ctcatgaagacacgggtgatgtccc

SEQ ID NO: 267614 - DNA, 25 bp, Mus musculus
ctcatgaaggtcaacaccatcacca

SEQ ID NO: 267615 - DNA, 25 bp, Mus musculus
ctcatgagccttgagatggcgttga

SEQ ID NO: 267616 - DNA, 25 bp, Mus musculus
ctcatgaggaaacggctgctcttcc

SEQ ID NO: 267617 - DNA, 25 bp, Mus musculus
ctcatgaggcaagtcagaggccaaa

SEQ ID NO: 267618 - DNA, 25 bp, Mus musculus
ctcatgagtctggcgaacactctgc

SEQ ID NO: 267619 - DNA, 25 bp, Mus musculus
ctcatgatcaacaacaccaaggagt

SEQ ID NO: 267620 - DNA, 25 bp, Mus musculus
ctcatgatgacaggtttctactgca

SEQ ID NO: 267621 - DNA, 25 bp, Mus musculus
ctcatgatgcaagttactgtaacaa

SEQ ID NO: 267622 - DNA, 25 bp, Mus musculus
ctcatgatgtggaagattttaattc

SEQ ID NO: 267623 - DNA, 25 bp, Mus musculus
ctcatgcaatagaaatgatcaaaac

SEQ ID NO: 267624 - DNA, 25 bp, Mus musculus
ctcatgcaatagttccagttcagac

SEQ ID NO: 267625 - DNA, 25 bp, Mus musculus
ctcatgcaggttgctgatgccccct

SEQ ID NO: 267626 - DNA, 25 bp, Mus musculus
ctcatgcatgccaggttcccactat

SEQ ID NO: 267627 - DNA, 25 bp, Mus musculus
ctcatgcattaagtcttgtgaaaga

SEQ ID NO: 267628 - DNA, 25 bp, Mus musculus
ctcatgcattaagtcttgtgatatg

SEQ ID NO: 267629 - DNA, 25 bp, Mus musculus
ctcatgcattatgaagaagtctttg

SEQ ID NO: 267630 - DNA, 25 bp, Mus musculus
ctcatgccagggttgtcgccctgga

SEQ ID NO: 267631 - DNA, 25 bp, Mus musculus
ctcatgcctggataagagtaaagaa

SEQ ID NO: 267632 - DNA, 25 bp, Mus musculus
ctcatgcctggtggggcagtggccc

SEQ ID NO: 267633 - DNA, 25 bp, Mus musculus
ctcatgcctgtggggctgcgaggcc

SEQ ID NO: 267634 - DNA, 25 bp, Mus musculus
ctcatgcctttgggcttggaagtgt

SEQ ID NO: 267635 - DNA, 25 bp, Mus musculus
ctcatgcgagccaagatggacaacg

SEQ ID NO: 267636 - DNA, 25 bp, Mus musculus
ctcatgctaacaggaaaaattctcc

SEQ ID NO: 267637 - DNA, 25 bp, Mus musculus
ctcatgctagttcagcaatcagcaa

SEQ ID NO: 267638 - DNA, 25 bp, Mus musculus
ctcatgctataggaggatctcccag

SEQ ID NO: 267639 - DNA, 25 bp, Mus musculus
ctcatgcttaagctgaagtggtgtg

SEQ ID NO: 267640 - DNA, 25 bp, Mus musculus
ctcatgcttaaggctctctatctcc

SEQ ID NO: 267641 - DNA, 25 bp, Mus musculus
ctcatgctttcgaaatgaataacag

SEQ ID NO: 267642 - DNA, 25 bp, Mus musculus
ctcatggaagaggttcaaaccttgt

SEQ ID NO: 267643 - DNA, 25 bp, Mus musculus
ctcatggaagaggtttattaacaaa

SEQ ID NO: 267644 - DNA, 25 bp, Mus musculus
ctcatggaatcagctgctctgccct

SEQ ID NO: 267645 - DNA, 25 bp, Mus musculus
ctcatggaatcaggtgccaacaggc

SEQ ID NO: 267646 - DNA, 25 bp, Mus musculus
ctcatggacaagattaatgccgctg

SEQ ID NO: 267647 - DNA, 25 bp, Mus musculus
ctcatggactagcggcctggtctca

SEQ ID NO: 267648 - DNA, 25 bp, Mus musculus
ctcatggactagcgtttcaggcctg

SEQ ID NO: 267649 - DNA, 25 bp, Mus musculus
ctcatggagagtaaaagttggcatg

SEQ ID NO: 267650 - DNA, 25 bp, Mus musculus
ctcatggatacaatgagcagcacct

SEQ ID NO: 267651 - DNA, 25 bp, Mus musculus
ctcatggcacagagaagccatcctg

SEQ ID NO: 267652 - DNA, 25 bp, Mus musculus
ctcatggcacaggagcttgaaggat

SEQ ID NO: 267653 - DNA, 25 bp, Mus musculus
ctcatggccctggggctgggtcctt

SEQ ID NO: 267654 - DNA, 25 bp, Mus musculus
ctcatggcctttcaggtgatctgtc

SEQ ID NO: 267655 - DNA, 25 bp, Mus musculus
ctcatggctatactgatcatttcaa

SEQ ID NO: 267656 - DNA, 25 bp, Mus musculus
ctcatggctggaggggatgccaaca

SEQ ID NO: 267657 - DNA, 25 bp, Mus musculus
ctcatggctggaggggtgatggtaa

SEQ ID NO: 267658 - DNA, 25 bp, Mus musculus
ctcatgggacaggtgaacaccttta

SEQ ID NO: 267659 - DNA, 25 bp, Mus musculus
ctcatgggatagacaagaacggaga

SEQ ID NO: 267660 - DNA, 25 bp, Mus musculus
ctcatggtagcgaccacctgcagca

SEQ ID NO: 267661 - DNA, 25 bp, Mus musculus
ctcatggtttaacttattagtactt

SEQ ID NO: 267662 - DNA, 25 bp, Mus musculus
ctcatgtacactaggaagtcagagg

SEQ ID NO: 267663 - DNA, 25 bp, Mus musculus
ctcatgtagaaacgaaacgttgaca

SEQ ID NO: 267664 - DNA, 25 bp, Mus musculus
ctcatgtcagcagataggatctgta

SEQ ID NO: 267665 - DNA, 25 bp, Mus musculus
ctcatgtcagcaggaaatgatggat

SEQ ID NO: 267666 - DNA, 25 bp, Mus musculus
ctcatgtcagcaggctggcgcattg

SEQ ID NO: 267667 - DNA, 25 bp, Mus musculus
ctcatgtgcagaaggtctcgaggag

SEQ ID NO: 267668 - DNA, 25 bp, Mus musculus
ctcatgtgcatgtccatgctgtgga

SEQ ID NO: 267669 - DNA, 25 bp, Mus musculus
ctcatgtgcatgttcatgacttgca

SEQ ID NO: 267670 - DNA, 25 bp, Mus musculus
ctcatgtggaggctgggctgtacgg

SEQ ID NO: 267671 - DNA, 25 bp, Mus musculus
ctcatgttatgaaagagaatgcagt

SEQ ID NO: 267672 - DNA, 25 bp, Mus musculus
ctcatgttatgaaatagaatgcagc

SEQ ID NO: 267673 - DNA, 25 bp, Mus musculus
ctcatgttatgactcaacaaggaca

SEQ ID NO: 267674 - DNA, 25 bp, Mus musculus
ctcatgttatggttcctccatccct

SEQ ID NO: 267675 - DNA, 25 bp, Mus musculus
ctcatgttcacagggtacggattgc

SEQ ID NO: 267676 - DNA, 25 bp, Mus musculus
ctcatgttgagtgacaaaagaacta

SEQ ID NO: 267677 - DNA, 25 bp, Mus musculus
ctcatgttgatccgtggcttcagtg

SEQ ID NO: 267678 - DNA, 25 bp, Mus musculus
ctcatgttgccagagaggcagatga

SEQ ID NO: 267679 - DNA, 25 bp, Mus musculus
ctcatgtttaattgttcctgctgct

SEQ ID NO: 267680 - DNA, 25 bp, Mus musculus
ctcatgtttctgggctttcaggagg

SEQ ID NO: 267681 - DNA, 25 bp, Mus musculus
ctcattaaaggaaaaggatataact

SEQ ID NO: 267682 - DNA, 25 bp, Mus musculus
ctcattaaatgaatctcctgtaaaa

SEQ ID NO: 267683 - DNA, 25 bp, Mus musculus
ctcattaagaagaacaatcaccatg

SEQ ID NO: 267684 - DNA, 25 bp, Mus musculus
ctcattacagagggagtttattcaa

SEQ ID NO: 267685 - DNA, 25 bp, Mus musculus
ctcattacatcagattacgagctcc

SEQ ID NO: 267686 - DNA, 25 bp, Mus musculus
ctcattactacactgctctgctcag

SEQ ID NO: 267687 - DNA, 25 bp, Mus musculus
ctcattataggggtgatcctgtata

SEQ ID NO: 267688 - DNA, 25 bp, Mus musculus
ctcattatccagatacacagacagt

SEQ ID NO: 267689 - DNA, 25 bp, Mus musculus
ctcattcaagaggtaatcagccagt

SEQ ID NO: 267690 - DNA, 25 bp, Mus musculus
ctcattcaagatgttcacacggaag

SEQ ID NO: 267691 - DNA, 25 bp, Mus musculus
ctcattcaaggagtagacccatgtc

SEQ ID NO: 267692 - DNA, 25 bp, Mus musculus
ctcattcagaacccattccaagctt

SEQ ID NO: 267693 - DNA, 25 bp, Mus musculus
ctcattcaggataggggaatggtct

SEQ ID NO: 267694 - DNA, 25 bp, Mus musculus
ctcattcattcgatattacacaagg

SEQ ID NO: 267695 - DNA, 25 bp, Mus musculus
ctcattcccccccagctacccgtac

SEQ ID NO: 267696 - DNA, 25 bp, Mus musculus
ctcattcctccagctacactcctct

SEQ ID NO: 267697 - DNA, 25 bp, Mus musculus
ctcattcgaagatgttttcggtgca

SEQ ID NO: 267698 - DNA, 25 bp, Mus musculus
ctcattctaaagcagatactaaaat

SEQ ID NO: 267699 - DNA, 25 bp, Mus musculus
ctcattctctgcatcgggttcacac

SEQ ID NO: 267700 - DNA, 25 bp, Mus musculus
ctcattctgctggctgctgctgctg

SEQ ID NO: 267701 - DNA, 25 bp, Mus musculus
ctcattgaaggacagccaaatagaa

SEQ ID NO: 267702 - DNA, 25 bp, Mus musculus
ctcattgaaggttcaaccattttgc

SEQ ID NO: 267703 - DNA, 25 bp, Mus musculus
ctcattgaccatcagacaagctgca

SEQ ID NO: 267704 - DNA, 25 bp, Mus musculus
ctcattgacccaggtgctctcacca

SEQ ID NO: 267705 - DNA, 25 bp, Mus musculus
ctcattgactgcaggtccctggaaa

SEQ ID NO: 267706 - DNA, 25 bp, Mus musculus
ctcattgcacaaacaggagagcaac

SEQ ID NO: 267707 - DNA, 25 bp, Mus musculus
ctcattgcacacagaggaaagaaaa

SEQ ID NO: 267708 - DNA, 25 bp, Mus musculus
ctcattgcacacagttttggtttct

SEQ ID NO: 267709 - DNA, 25 bp, Mus musculus
ctcattgcctacagattgtctgtga

SEQ ID NO: 267710 - DNA, 25 bp, Mus musculus
ctcattgctcgagtttgtgacaagg

SEQ ID NO: 267711 - DNA, 25 bp, Mus musculus
ctcattggctttatctcggacctaa

SEQ ID NO: 267712 - DNA, 25 bp, Mus musculus
ctcattggtctaatctctgaccgcc

SEQ ID NO: 267713 - DNA, 25 bp, Mus musculus
ctcattgtccttgattggctctttg

SEQ ID NO: 267714 - DNA, 25 bp, Mus musculus
ctcattgtccttggcaggacctcag

SEQ ID NO: 267715 - DNA, 25 bp, Mus musculus
ctcattgtccttgtttatgctgctg

SEQ ID NO: 267716 - DNA, 25 bp, Mus musculus
ctcattgtgcaggcggctctcctag

SEQ ID NO: 267717 - DNA, 25 bp, Mus musculus
ctcattgtgcagttctgtgccaatg

SEQ ID NO: 267718 - DNA, 25 bp, Mus musculus
ctcattgtgggaaactccaaacagg

SEQ ID NO: 267719 - DNA, 25 bp, Mus musculus
ctcattgtggggaccagcgggaagg

SEQ ID NO: 267720 - DNA, 25 bp, Mus musculus
ctcattgtgtcagggacaggagttc

SEQ ID NO: 267721 - DNA, 25 bp, Mus musculus
ctcattgtgtcagggctggacagtg

SEQ ID NO: 267722 - DNA, 25 bp, Mus musculus
ctcattgtgtggaatcacaggcctc

SEQ ID NO: 267723 - DNA, 25 bp, Mus musculus
ctcattgttgtagaggatctgagaa

SEQ ID NO: 267724 - DNA, 25 bp, Mus musculus
ctcatttaacaatagacatgaagcg

SEQ ID NO: 267725 - DNA, 25 bp, Mus musculus
ctcatttaacctgagaaatgccaac

SEQ ID NO: 267726 - DNA, 25 bp, Mus musculus
ctcatttagcaaaggtgtggtggct

SEQ ID NO: 267727 - DNA, 25 bp, Mus musculus
ctcatttagtcaattggatccagtg

SEQ ID NO: 267728 - DNA, 25 bp, Mus musculus
ctcatttatgataattagcaccatg

SEQ ID NO: 267729 - DNA, 25 bp, Mus musculus
ctcatttatgatcccataaaaactg

SEQ ID NO: 267730 - DNA, 25 bp, Mus musculus
ctcatttcaaaggtattttaaccac

SEQ ID NO: 267731 - DNA, 25 bp, Mus musculus
ctcatttcaggttgctcaccacaat

SEQ ID NO: 267732 - DNA, 25 bp, Mus musculus
ctcatttccaaggctggtcttgaac

SEQ ID NO: 267733 - DNA, 25 bp, Mus musculus
ctcatttccaagtccttccagggaa

SEQ ID NO: 267734 - DNA, 25 bp, Mus musculus
ctcatttcccacagacctggatttg

SEQ ID NO: 267735 - DNA, 25 bp, Mus musculus
ctcatttccccaagtgcgccgcaga

SEQ ID NO: 267736 - DNA, 25 bp, Mus musculus
ctcatttccccttggtgcaccatgg

SEQ ID NO: 267737 - DNA, 25 bp, Mus musculus
ctcatttccgctgcccgtatggtgg

SEQ ID NO: 267738 - DNA, 25 bp, Mus musculus
ctcatttggatggcaccacccctgt

SEQ ID NO: 267739 - DNA, 25 bp, Mus musculus
ctcattttaaggccctgtggttctc

SEQ ID NO: 267740 - DNA, 25 bp, Mus musculus
ctcattttcagtcagatatacttta

SEQ ID NO: 267741 - DNA, 25 bp, Mus musculus
ctcatttttcgctcccagacctaca

SEQ ID NO: 267742 - DNA, 25 bp, Mus musculus
ctccaaaaaaggcaaattgaagaat

SEQ ID NO: 267743 - DNA, 25 bp, Mus musculus
ctccaaaaagagagggagccccgcg

SEQ ID NO: 267744 - DNA, 25 bp, Mus musculus
ctccaaaaccaaaggcagaccgaag

SEQ ID NO: 267745 - DNA, 25 bp, Mus musculus
ctccaaaaccagcaccgtcttctaa

SEQ ID NO: 267746 - DNA, 25 bp, Mus musculus
ctccaaaaccagtgtcgtcaccagc

SEQ ID NO: 267747 - DNA, 25 bp, Mus musculus
ctccaaaagccggaaggagaagggg

SEQ ID NO: 267748 - DNA, 25 bp, Mus musculus
ctccaaaagccggtgaagatcgtat

SEQ ID NO: 267749 - DNA, 25 bp, Mus musculus
ctccaaaataaaggtgagttcctca

SEQ ID NO: 267750 - DNA, 25 bp, Mus musculus
ctccaaaatgtattgaggaaaagga

SEQ ID NO: 267751 - DNA, 25 bp, Mus musculus
ctccaaaatgtcaggaattagctct

SEQ ID NO: 267752 - DNA, 25 bp, Mus musculus
ctccaaaattcaggtgattgacatt

SEQ ID NO: 267753 - DNA, 25 bp, Mus musculus
ctccaaacagaagctccctgagtga

SEQ ID NO: 267754 - DNA, 25 bp, Mus musculus
ctccaaacagacgatccagaaccac

SEQ ID NO: 267755 - DNA, 25 bp, Mus musculus
ctccaaacagtgaaggtgagcaggg

SEQ ID NO: 267756 - DNA, 25 bp, Mus musculus
ctccaaaccaagcagtcctatgcac

SEQ ID NO: 267757 - DNA, 25 bp, Mus musculus
ctccaaaccccattcaacctctaca

SEQ ID NO: 267758 - DNA, 25 bp, Mus musculus
ctccaaacccctgagggagagcagt

SEQ ID NO: 267759 - DNA, 25 bp, Mus musculus
ctccaaaccggagtcctgttgaaga

SEQ ID NO: 267760 - DNA, 25 bp, Mus musculus
ctccaaagaagaggaatgagttcct

SEQ ID NO: 267761 - DNA, 25 bp, Mus musculus
ctccaaagaagaggtgagtcctgag

SEQ ID NO: 267762 - DNA, 25 bp, Mus musculus
ctccaaagacacgagcaccgggggt

SEQ ID NO: 267763 - DNA, 25 bp, Mus musculus
ctccaaagagaaggaaaagtgatag

SEQ ID NO: 267764 - DNA, 25 bp, Mus musculus
ctccaaagagaaggcaggtacaccg

SEQ ID NO: 267765 - DNA, 25 bp, Mus musculus
ctccaaagagatggtcagccgcctg

SEQ ID NO: 267766 - DNA, 25 bp, Mus musculus
ctccaaagagctttggcaatccacg

SEQ ID NO: 267767 - DNA, 25 bp, Mus musculus
ctccaaagagggctatgtgctcaaa

SEQ ID NO: 267768 - DNA, 25 bp, Mus musculus
ctccaaagattgccatggtggtgca

SEQ ID NO: 267769 - DNA, 25 bp, Mus musculus
ctccaaagcaagagtgaagtgtgtc

SEQ ID NO: 267770 - DNA, 25 bp, Mus musculus
ctccaaagcatggaaataaatgcct

SEQ ID NO: 267771 - DNA, 25 bp, Mus musculus
ctccaaagcatggcaatgcttggca

SEQ ID NO: 267772 - DNA, 25 bp, Mus musculus
ctccaaaggacagaacaactgagat

SEQ ID NO: 267773 - DNA, 25 bp, Mus musculus
ctccaaaggacagaagaagaagaaa

SEQ ID NO: 267774 - DNA, 25 bp, Mus musculus
ctccaaagtcggtttctgtatgcaa

SEQ ID NO: 267775 - DNA, 25 bp, Mus musculus
ctccaaagtgaggaacttctgcagg

SEQ ID NO: 267776 - DNA, 25 bp, Mus musculus
ctccaaataaaacaggtggcttcgg

SEQ ID NO: 267777 - DNA, 25 bp, Mus musculus
ctccaaataaaacaggttcgggagc

SEQ ID NO: 267778 - DNA, 25 bp, Mus musculus
ctccaaatccggccaaagataactt

SEQ ID NO: 267779 - DNA, 25 bp, Mus musculus
ctccaaattatgtgccaccaaaagc

SEQ ID NO: 267780 - DNA, 25 bp, Mus musculus
ctccaacaaagcaaagtaacaatcc

SEQ ID NO: 267781 - DNA, 25 bp, Mus musculus
ctccaacaaaggagctgacaaacca

SEQ ID NO: 267782 - DNA, 25 bp, Mus musculus
ctccaacaaaggtcgtcctccttga

SEQ ID NO: 267783 - DNA, 25 bp, Mus musculus
ctccaacaccaaaagtgcccatgga

SEQ ID NO: 267784 - DNA, 25 bp, Mus musculus
ctccaacaccaaaatctgtagattg

SEQ ID NO: 267785 - DNA, 25 bp, Mus musculus
ctccaacaccaaagtggacatgact

SEQ ID NO: 267786 - DNA, 25 bp, Mus musculus
ctccaacacccgctgcctcaacggt

SEQ ID NO: 267787 - DNA, 25 bp, Mus musculus
ctccaacatcacagatgtctcccaa

SEQ ID NO: 267788 - DNA, 25 bp, Mus musculus
ctccaacatctgcagctctcccttt

SEQ ID NO: 267789 - DNA, 25 bp, Mus musculus
ctccaacatctgcagtgggccggat

SEQ ID NO: 267790 - DNA, 25 bp, Mus musculus
ctccaacatggcaggtaagaaagtg

SEQ ID NO: 267791 - DNA, 25 bp, Mus musculus
ctccaaccaaggcatcctcggagat

SEQ ID NO: 267792 - DNA, 25 bp, Mus musculus
ctccaaccaaggtatcatgtttgta

SEQ ID NO: 267793 - DNA, 25 bp, Mus musculus
ctccaaccacaggggccagctagag

SEQ ID NO: 267794 - DNA, 25 bp, Mus musculus
ctccaaccaccagttttggttcatc

SEQ ID NO: 267795 - DNA, 25 bp, Mus musculus
ctccaaccagccaatagttacagtt

SEQ ID NO: 267796 - DNA, 25 bp, Mus musculus
ctccaaccagttacagttagtgcag

SEQ ID NO: 267797 - DNA, 25 bp, Mus musculus
ctccaaccccccggccctgcctgcc

SEQ ID NO: 267798 - DNA, 25 bp, Mus musculus
ctccaacctccagtctcaccagcgc

SEQ ID NO: 267799 - DNA, 25 bp, Mus musculus
ctccaacctgaactctctctcttct

SEQ ID NO: 267800 - DNA, 25 bp, Mus musculus
ctccaacctggaacgagtggagtat

SEQ ID NO: 267801 - DNA, 25 bp, Mus musculus
ctccaacgacccgtgcccagggatg

SEQ ID NO: 267802 - DNA, 25 bp, Mus musculus
ctccaacgatgtgaaagagttccta

SEQ ID NO: 267803 - DNA, 25 bp, Mus musculus
ctccaacgtggaagcagcctgtgat

SEQ ID NO: 267804 - DNA, 25 bp, Mus musculus
ctccaacgtggaagccctctgctca

SEQ ID NO: 267805 - DNA, 25 bp, Mus musculus
ctccaactcagatctctcgtctgct

SEQ ID NO: 267806 - DNA, 25 bp, Mus musculus
ctccaactcagccctccaggacctc

SEQ ID NO: 267807 - DNA, 25 bp, Mus musculus
ctccaactccagcccccggcctcca

SEQ ID NO: 267808 - DNA, 25 bp, Mus musculus
ctccaactcttggcattgaccttgg

SEQ ID NO: 267809 - DNA, 25 bp, Mus musculus
ctccaactgctgaagacgtgactgc

SEQ ID NO: 267810 - DNA, 25 bp, Mus musculus
ctccaagaagaggttctcccagatg

SEQ ID NO: 267811 - DNA, 25 bp, Mus musculus
ctccaagaatggcgggcatatcgag

SEQ ID NO: 267812 - DNA, 25 bp, Mus musculus
ctccaagaatggtcctggcactgta

SEQ ID NO: 267813 - DNA, 25 bp, Mus musculus
ctccaagacagcgcatagaagctcc

SEQ ID NO: 267814 - DNA, 25 bp, Mus musculus
ctccaagacagcgcccatgcaggtg

SEQ ID NO: 267815 - DNA, 25 bp, Mus musculus
ctccaagactctcagaccaaataca

SEQ ID NO: 267816 - DNA, 25 bp, Mus musculus
ctccaagagaaggtggacctggcag

SEQ ID NO: 267817 - DNA, 25 bp, Mus musculus
ctccaagagacaggaggctgtcctt

SEQ ID NO: 267818 - DNA, 25 bp, Mus musculus
ctccaagagcgatatgagatcgtgg

SEQ ID NO: 267819 - DNA, 25 bp, Mus musculus
ctccaagagctggggtctgatcttg

SEQ ID NO: 267820 - DNA, 25 bp, Mus musculus
ctccaagcacaatggcatctgtaag

SEQ ID NO: 267821 - DNA, 25 bp, Mus musculus
ctccaagcagaggacaaaatcacaa

SEQ ID NO: 267822 - DNA, 25 bp, Mus musculus
ctccaagcagaggtatgtgcaggca

SEQ ID NO: 267823 - DNA, 25 bp, Mus musculus
ctccaagcaggggtattttgcctat

SEQ ID NO: 267824 - DNA, 25 bp, Mus musculus
ctccaagcagtatgtctggatttgg

SEQ ID NO: 267825 - DNA, 25 bp, Mus musculus
ctccaagcatgagttatttgctggc

SEQ ID NO: 267826 - DNA, 25 bp, Mus musculus
ctccaagcccagcatgtgagggagc

SEQ ID NO: 267827 - DNA, 25 bp, Mus musculus
ctccaagcccaggtaactgttcagt

SEQ ID NO: 267828 - DNA, 25 bp, Mus musculus
ctccaagcccatccaaggttacttt

SEQ ID NO: 267829 - DNA, 25 bp, Mus musculus
ctccaagcctcagctgctgttgcac

SEQ ID NO: 267830 - DNA, 25 bp, Mus musculus
ctccaagcctcaggattcctctatt

SEQ ID NO: 267831 - DNA, 25 bp, Mus musculus
ctccaagctgtacaggttgggctta

SEQ ID NO: 267832 - DNA, 25 bp, Mus musculus
ctccaaggagaggtcaatactatca

SEQ ID NO: 267833 - DNA, 25 bp, Mus musculus
ctccaaggagaggttttccttactg

SEQ ID NO: 267834 - DNA, 25 bp, Mus musculus
ctccaaggcaaaggtgttgaacgag

SEQ ID NO: 267835 - DNA, 25 bp, Mus musculus
ctccaaggctgggcgcgggctggga

SEQ ID NO: 267836 - DNA, 25 bp, Mus musculus
ctccaagggcaagggactccgaggg

SEQ ID NO: 267837 - DNA, 25 bp, Mus musculus
ctccaagggcaagggggagaagatt

SEQ ID NO: 267838 - DNA, 25 bp, Mus musculus
ctccaaggtggctggacccgactat

SEQ ID NO: 267839 - DNA, 25 bp, Mus musculus
ctccaaggtgtcatagacatgaaaa

SEQ ID NO: 267840 - DNA, 25 bp, Mus musculus
ctccaagtaagagtcaaagcagtcc

SEQ ID NO: 267841 - DNA, 25 bp, Mus musculus
ctccaagtacgtgctccaggcacta

SEQ ID NO: 267842 - DNA, 25 bp, Mus musculus
ctccaagtacgtgctctacaccctc

SEQ ID NO: 267843 - DNA, 25 bp, Mus musculus
ctccaagtatgaaggaggagtagaa

SEQ ID NO: 267844 - DNA, 25 bp, Mus musculus
ctccaagtatgagaaagagctaaag

SEQ ID NO: 267845 - DNA, 25 bp, Mus musculus
ctccaagtatgtaggaggagtaaaa

SEQ ID NO: 267846 - DNA, 25 bp, Mus musculus
ctccaagtccagagtcccggccacc

SEQ ID NO: 267847 - DNA, 25 bp, Mus musculus
ctccaagtccccaggagaggagaca

SEQ ID NO: 267848 - DNA, 25 bp, Mus musculus
ctccaagtccccaggccggggagcg

SEQ ID NO: 267849 - DNA, 25 bp, Mus musculus
ctccaagtccgagctctgaactcac

SEQ ID NO: 267850 - DNA, 25 bp, Mus musculus
ctccaagtgcaggcggaacaagaca

SEQ ID NO: 267851 - DNA, 25 bp, Mus musculus
ctccaagttcggggaatgcagcaat

SEQ ID NO: 267852 - DNA, 25 bp, Mus musculus
ctccaagttcggtcccctgtgtagg

SEQ ID NO: 267853 - DNA, 25 bp, Mus musculus
ctccaataattctatactttctggc

SEQ ID NO: 267854 - DNA, 25 bp, Mus musculus
ctccaataattcttatttgtagagt

SEQ ID NO: 267855 - DNA, 25 bp, Mus musculus
ctccaatcagcaggcccgtcaagtc

SEQ ID NO: 267856 - DNA, 25 bp, Mus musculus
ctccaatcagcaggggctgctgggg

SEQ ID NO: 267857 - DNA, 25 bp, Mus musculus
ctccaatcagcaggggtccttggac

SEQ ID NO: 267858 - DNA, 25 bp, Mus musculus
ctccaatgaaagtgctaatgctgac

SEQ ID NO: 267859 - DNA, 25 bp, Mus musculus
ctccaatgaaggagatgacaaatct

SEQ ID NO: 267860 - DNA, 25 bp, Mus musculus
ctccaatgaaggagctgaaaggcct

SEQ ID NO: 267861 - DNA, 25 bp, Mus musculus
ctccaatgaaggaggaatgtcaagt

SEQ ID NO: 267862 - DNA, 25 bp, Mus musculus
ctccaatgaaggaggtgactccaat

SEQ ID NO: 267863 - DNA, 25 bp, Mus musculus
ctccaatgcaggaggcccacctgct

SEQ ID NO: 267864 - DNA, 25 bp, Mus musculus
ctccaatgcgatgcaaatcctctgg

SEQ ID NO: 267865 - DNA, 25 bp, Mus musculus
ctccaatgcgatgctttggctcagc

SEQ ID NO: 267866 - DNA, 25 bp, Mus musculus
ctccaatggaggaggtgactccaat

SEQ ID NO: 267867 - DNA, 25 bp, Mus musculus
ctccaatgggacaaatgcctggaat

SEQ ID NO: 267868 - DNA, 25 bp, Mus musculus
ctccaatgtcaaatgtgactatgac

SEQ ID NO: 267869 - DNA, 25 bp, Mus musculus
ctccaattaatccccccttctagaa

SEQ ID NO: 267870 - DNA, 25 bp, Mus musculus
ctccaattctaggatgtggttagaa

SEQ ID NO: 267871 - DNA, 25 bp, Mus musculus
ctccacaaacgtgcagttcagtccc

SEQ ID NO: 267872 - DNA, 25 bp, Mus musculus
ctccacaaacgtggtgaatacatca

SEQ ID NO: 267873 - DNA, 25 bp, Mus musculus
ctccacaaaggtgtattccctggac

SEQ ID NO: 267874 - DNA, 25 bp, Mus musculus
ctccacaatcaataggtttccaggc

SEQ ID NO: 267875 - DNA, 25 bp, Mus musculus
ctccacacagtcaagggatgaactg

SEQ ID NO: 267876 - DNA, 25 bp, Mus musculus
ctccacacatgatcggaacaccatg

SEQ ID NO: 267877 - DNA, 25 bp, Mus musculus
ctccacacgagaggctcacaatatt

SEQ ID NO: 267878 - DNA, 25 bp, Mus musculus
ctccacacgaggagccagatgttaa

SEQ ID NO: 267879 - DNA, 25 bp, Mus musculus
ctccacacgggacaagctctgactc

SEQ ID NO: 267880 - DNA, 25 bp, Mus musculus
ctccacacggttacaggcccaaaaa

SEQ ID NO: 267881 - DNA, 25 bp, Mus musculus
ctccacactctggtacatccaaacg

SEQ ID NO: 267882 - DNA, 25 bp, Mus musculus
ctccacacttgtttgatttatgagg

SEQ ID NO: 267883 - DNA, 25 bp, Mus musculus
ctccacacttgtttgcgtttcccaa

SEQ ID NO: 267884 - DNA, 25 bp, Mus musculus
ctccacagagcaggagcttgaacca

SEQ ID NO: 267885 - DNA, 25 bp, Mus musculus
ctccacagcaacagccttctacttc

SEQ ID NO: 267886 - DNA, 25 bp, Mus musculus
ctccacagcacatttggtcagaaaa

SEQ ID NO: 267887 - DNA, 25 bp, Mus musculus
ctccacagcaggtggctggattcat

SEQ ID NO: 267888 - DNA, 25 bp, Mus musculus
ctccacagctgcggtgctcttagca

SEQ ID NO: 267889 - DNA, 25 bp, Mus musculus
ctccacaggagatggctttcacggt

SEQ ID NO: 267890 - DNA, 25 bp, Mus musculus
ctccacaggatgggtcccagcctgc

SEQ ID NO: 267891 - DNA, 25 bp, Mus musculus
ctccacagtaaaagctgaaaataat

SEQ ID NO: 267892 - DNA, 25 bp, Mus musculus
ctccacagtaaaggacagtctcatc

SEQ ID NO: 267893 - DNA, 25 bp, Mus musculus
ctccacagtaaaggttacagatata

SEQ ID NO: 267894 - DNA, 25 bp, Mus musculus
ctccacagtcactggagagtcaggc

SEQ ID NO: 267895 - DNA, 25 bp, Mus musculus
ctccacagtcaggtgacactgctga

SEQ ID NO: 267896 - DNA, 25 bp, Mus musculus
ctccacagtcgctggagagtcaggc

SEQ ID NO: 267897 - DNA, 25 bp, Mus musculus
ctccacagtgtaaagctctatgtca

SEQ ID NO: 267898 - DNA, 25 bp, Mus musculus
ctccacatacaagggacagtggcac

SEQ ID NO: 267899 - DNA, 25 bp, Mus musculus
ctccacatcctctgatcggttaagc

SEQ ID NO: 267900 - DNA, 25 bp, Mus musculus
ctccacatgcaggcttcccgaggag

SEQ ID NO: 267901 - DNA, 25 bp, Mus musculus
ctccacatgcaggtgtggtacatcc

SEQ ID NO: 267902 - DNA, 25 bp, Mus musculus
ctccacattcgagatggtggagtat

SEQ ID NO: 267903 - DNA, 25 bp, Mus musculus
ctccacattcgagatgttcctcctg

SEQ ID NO: 267904 - DNA, 25 bp, Mus musculus
ctccaccaactcaagaggcccagga

SEQ ID NO: 267905 - DNA, 25 bp, Mus musculus
ctccaccacagatgaagaagaagat

SEQ ID NO: 267906 - DNA, 25 bp, Mus musculus
ctccaccactcaggtgttttctctg

SEQ ID NO: 267907 - DNA, 25 bp, Mus musculus
ctccaccactgagtttgaagagccc

SEQ ID NO: 267908 - DNA, 25 bp, Mus musculus
ctccaccagctcagttaatggaacc

SEQ ID NO: 267909 - DNA, 25 bp, Mus musculus
ctccaccagtcggtgttgactttaa

SEQ ID NO: 267910 - DNA, 25 bp, Mus musculus
ctccaccatcaagaaccatgagttt

SEQ ID NO: 267911 - DNA, 25 bp, Mus musculus
ctccaccatcatctggctatgtata

SEQ ID NO: 267912 - DNA, 25 bp, Mus musculus
ctccaccatctggtgagtgaacccc

SEQ ID NO: 267913 - DNA, 25 bp, Mus musculus
ctccaccattggctggattgctgct

SEQ ID NO: 267914 - DNA, 25 bp, Mus musculus
ctccaccatttcagagtcagcttgc

SEQ ID NO: 267915 - DNA, 25 bp, Mus musculus
ctccacccacctctcactccccatg

SEQ ID NO: 267916 - DNA, 25 bp, Mus musculus
ctccacccaggctaccttcatggta

SEQ ID NO: 267917 - DNA, 25 bp, Mus musculus
ctccacccaggtgtcaacacatgtg

SEQ ID NO: 267918 - DNA, 25 bp, Mus musculus
ctccacccccagaaacgtgtgccgt

SEQ ID NO: 267919 - DNA, 25 bp, Mus musculus
ctccacccccgcctcccagacagac

SEQ ID NO: 267920 - DNA, 25 bp, Mus musculus
ctccacccgcgagggtggcccgagg

SEQ ID NO: 267921 - DNA, 25 bp, Mus musculus
ctccacccgcgggggccctagctgc

SEQ ID NO: 267922 - DNA, 25 bp, Mus musculus
ctccacccttgagtcaagtccatca

SEQ ID NO: 267923 - DNA, 25 bp, Mus musculus
ctccaccgaccagtggccacagtta

SEQ ID NO: 267924 - DNA, 25 bp, Mus musculus
ctccaccgcggtctgacagcggatg

SEQ ID NO: 267925 - DNA, 25 bp, Mus musculus
ctccaccgcggttggaattcgagga

SEQ ID NO: 267926 - DNA, 25 bp, Mus musculus
ctccaccgcggttggtgttcgagga

SEQ ID NO: 267927 - DNA, 25 bp, Mus musculus
ctccaccgtgaaccacccattcctc

SEQ ID NO: 267928 - DNA, 25 bp, Mus musculus
ctccacctaaaagtgctggacgagc

SEQ ID NO: 267929 - DNA, 25 bp, Mus musculus
ctccacctaaagagccactggacat

SEQ ID NO: 267930 - DNA, 25 bp, Mus musculus
ctccacctaaagtactgaccaagtg

SEQ ID NO: 267931 - DNA, 25 bp, Mus musculus
ctccacctaccaggagaactatgag

SEQ ID NO: 267932 - DNA, 25 bp, Mus musculus
ctccacctaccagtgaaatcaactc

SEQ ID NO: 267933 - DNA, 25 bp, Mus musculus
ctccacctcaaagagttgaaaagag

SEQ ID NO: 267934 - DNA, 25 bp, Mus musculus
ctccacctcaaaggtctgtgttgga

SEQ ID NO: 267935 - DNA, 25 bp, Mus musculus
ctccacctcctgagaaattagaagg

SEQ ID NO: 267936 - DNA, 25 bp, Mus musculus
ctccacctcctgagaccatggtatc

SEQ ID NO: 267937 - DNA, 25 bp, Mus musculus
ctccacctcctgagtctagccgccg

SEQ ID NO: 267938 - DNA, 25 bp, Mus musculus
ctccacctctgcacagaagaatgag

SEQ ID NO: 267939 - DNA, 25 bp, Mus musculus
ctccaccttcaagcttcagaacatg

SEQ ID NO: 267940 - DNA, 25 bp, Mus musculus
ctccaccttcaatttggaaggcctc

SEQ ID NO: 267941 - DNA, 25 bp, Mus musculus
ctccaccttcagacccaggcctgct

SEQ ID NO: 267942 - DNA, 25 bp, Mus musculus
ctccaccttctctctcttcctcctg

SEQ ID NO: 267943 - DNA, 25 bp, Mus musculus
ctccacgagagtgagttccaggaca

SEQ ID NO: 267944 - DNA, 25 bp, Mus musculus
ctccacgccatggatgcagtgacct

SEQ ID NO: 267945 - DNA, 25 bp, Mus musculus
ctccacgcctctcgtcagaagaaag

SEQ ID NO: 267946 - DNA, 25 bp, Mus musculus
ctccacgcgggccatcctggccctc

SEQ ID NO: 267947 - DNA, 25 bp, Mus musculus
ctccacgcggtagcactcagcatgg

SEQ ID NO: 267948 - DNA, 25 bp, Mus musculus
ctccacgctcaagcagcccacacac

SEQ ID NO: 267949 - DNA, 25 bp, Mus musculus
ctccacgctcaaggtgaccctgccc

SEQ ID NO: 267950 - DNA, 25 bp, Mus musculus
ctccacgctgaatgaaaagtcccca

SEQ ID NO: 267951 - DNA, 25 bp, Mus musculus
ctccacggcaatagacccagtgaca

SEQ ID NO: 267952 - DNA, 25 bp, Mus musculus
ctccacggcggtgcaagttgctccc

SEQ ID NO: 267953 - DNA, 25 bp, Mus musculus
ctccacggcggtgcctggagagcat

SEQ ID NO: 267954 - DNA, 25 bp, Mus musculus
ctccacgggaggatgctccagtgct

SEQ ID NO: 267955 - DNA, 25 bp, Mus musculus
ctccacggtccaggaagaatgtttc

SEQ ID NO: 267956 - DNA, 25 bp, Mus musculus
ctccacggtgagagtctgggatgtg

SEQ ID NO: 267957 - DNA, 25 bp, Mus musculus
ctccacgttccctgacctcctgtac

SEQ ID NO: 267958 - DNA, 25 bp, Mus musculus
ctccactaaagactgacacgtttag

SEQ ID NO: 267959 - DNA, 25 bp, Mus musculus
ctccactacaagatgaggtctcaat

SEQ ID NO: 267960 - DNA, 25 bp, Mus musculus
ctccactacgggcagtgatgatgac

SEQ ID NO: 267961 - DNA, 25 bp, Mus musculus
ctccactattaaaagagggtgcctc

SEQ ID NO: 267962 - DNA, 25 bp, Mus musculus
ctccactcagcttcccatgctccat

SEQ ID NO: 267963 - DNA, 25 bp, Mus musculus
ctccactcaggtctgggaacgtaat

SEQ ID NO: 267964 - DNA, 25 bp, Mus musculus
ctccactccagatcatgtcatcagg

SEQ ID NO: 267965 - DNA, 25 bp, Mus musculus
ctccactccagctggtggctggcat

SEQ ID NO: 267966 - DNA, 25 bp, Mus musculus
ctccactccagggtctagagattgt

SEQ ID NO: 267967 - DNA, 25 bp, Mus musculus
ctccactcttaccgatcagcaccag

SEQ ID NO: 267968 - DNA, 25 bp, Mus musculus
ctccactcttccctcctatcccctg

SEQ ID NO: 267969 - DNA, 25 bp, Mus musculus
ctccactcttgaaagaaaaatgact

SEQ ID NO: 267970 - DNA, 25 bp, Mus musculus
ctccactcttggatatcacgtatga

SEQ ID NO: 267971 - DNA, 25 bp, Mus musculus
ctccactcttggcaagtcggctcca

SEQ ID NO: 267972 - DNA, 25 bp, Mus musculus
ctccactctttcctcccttggagtt

SEQ ID NO: 267973 - DNA, 25 bp, Mus musculus
ctccactgagagcaggagatctgga

SEQ ID NO: 267974 - DNA, 25 bp, Mus musculus
ctccactgagagcattccagtgtca

SEQ ID NO: 267975 - DNA, 25 bp, Mus musculus
ctccactgctcaggttgaaggtttg

SEQ ID NO: 267976 - DNA, 25 bp, Mus musculus
ctccactggcctctcggacctcagg

SEQ ID NO: 267977 - DNA, 25 bp, Mus musculus
ctccactggtgaagaagcaggccag

SEQ ID NO: 267978 - DNA, 25 bp, Mus musculus
ctccactgtaaatggagatcgctct

SEQ ID NO: 267979 - DNA, 25 bp, Mus musculus
ctccacttcaaatggacccataact

SEQ ID NO: 267980 - DNA, 25 bp, Mus musculus
ctccacttcaaatgggaagaagatg

SEQ ID NO: 267981 - DNA, 25 bp, Mus musculus
ctccacttcaaatggggagggtaga

SEQ ID NO: 267982 - DNA, 25 bp, Mus musculus
ctccacttcaggtactaaacagacc

SEQ ID NO: 267983 - DNA, 25 bp, Mus musculus
ctccacttcctccagaagaagactc

SEQ ID NO: 267984 - DNA, 25 bp, Mus musculus
ctccacttcctgttgtcggtgcctg

SEQ ID NO: 267985 - DNA, 25 bp, Mus musculus
ctccacttctaaggcggcgacagca

SEQ ID NO: 267986 - DNA, 25 bp, Mus musculus
ctccacttgcaaaagaggccatgac

SEQ ID NO: 267987 - DNA, 25 bp, Mus musculus
ctccacttggggaagcctgagatgg

SEQ ID NO: 267988 - DNA, 25 bp, Mus musculus
ctccacttgggtgaaagacaaggag

SEQ ID NO: 267989 - DNA, 25 bp, Mus musculus
ctccagaaaacggtttcaggcacca

SEQ ID NO: 267990 - DNA, 25 bp, Mus musculus
ctccagaaaatccttgccagagatc

SEQ ID NO: 267991 - DNA, 25 bp, Mus musculus
ctccagaaaatccttgctagagaaa

SEQ ID NO: 267992 - DNA, 25 bp, Mus musculus
ctccagaaaatctcagcctccttcc

SEQ ID NO: 267993 - DNA, 25 bp, Mus musculus
ctccagaaagaggcgccctgtgctt

SEQ ID NO: 267994 - DNA, 25 bp, Mus musculus
ctccagaaagaggtgggtcttctca

SEQ ID NO: 267995 - DNA, 25 bp, Mus musculus
ctccagaaagtgctttgcatgggtt

SEQ ID NO: 267996 - DNA, 25 bp, Mus musculus
ctccagaaagtggtatcccataaat

SEQ ID NO: 267997 - DNA, 25 bp, Mus musculus
ctccagaacaaagtctgttcaagat

SEQ ID NO: 267998 - DNA, 25 bp, Mus musculus
ctccagaacacaggctgggaagatg

SEQ ID NO: 267999 - DNA, 25 bp, Mus musculus
ctccagaacagctatggatttgcca

SEQ ID NO: 268000 - DNA, 25 bp, Mus musculus
ctccagaacagctgttcctaaggct

SEQ ID NO: 268001 - DNA, 25 bp, Mus musculus
ctccagaaccagaaccggagtgttt

SEQ ID NO: 268002 - DNA, 25 bp, Mus musculus
ctccagaaccagataattagcacca

SEQ ID NO: 268003 - DNA, 25 bp, Mus musculus
ctccagaaccagtgtctgacagttc

SEQ ID NO: 268004 - DNA, 25 bp, Mus musculus
ctccagaaccgcaaagatgctggag

SEQ ID NO: 268005 - DNA, 25 bp, Mus musculus
ctccagaagacaggactcagctgag

SEQ ID NO: 268006 - DNA, 25 bp, Mus musculus
ctccagaagaccgaatttatctctg

SEQ ID NO: 268007 - DNA, 25 bp, Mus musculus
ctccagaagagcaagaacctgggag

SEQ ID NO: 268008 - DNA, 25 bp, Mus musculus
ctccagaagagcaagttaagtttga

SEQ ID NO: 268009 - DNA, 25 bp, Mus musculus
ctccagaataagctgaactcccacc

SEQ ID NO: 268010 - DNA, 25 bp, Mus musculus
ctccagacagataccagaagctcta

SEQ ID NO: 268011 - DNA, 25 bp, Mus musculus
ctccagacagtccaatgccacttta

SEQ ID NO: 268012 - DNA, 25 bp, Mus musculus
ctccagacagtcctaacaggggctt

SEQ ID NO: 268013 - DNA, 25 bp, Mus musculus
ctccagacatggagacaacagcttc

SEQ ID NO: 268014 - DNA, 25 bp, Mus musculus
ctccagacccacagacttccaaatt

SEQ ID NO: 268015 - DNA, 25 bp, Mus musculus
ctccagacccacagaggctcccaaa

SEQ ID NO: 268016 - DNA, 25 bp, Mus musculus
ctccagacctggctgcccagacccc

SEQ ID NO: 268017 - DNA, 25 bp, Mus musculus
ctccagaccttcacgcatcatgact

SEQ ID NO: 268018 - DNA, 25 bp, Mus musculus
ctccagactacctgacctcatcttt

SEQ ID NO: 268019 - DNA, 25 bp, Mus musculus
ctccagactcagctggcggtgcaga

SEQ ID NO: 268020 - DNA, 25 bp, Mus musculus
ctccagagaaagaggatggaggcct

SEQ ID NO: 268021 - DNA, 25 bp, Mus musculus
ctccagagaacaaggtccttccata

SEQ ID NO: 268022 - DNA, 25 bp, Mus musculus
ctccagagaagatacggactctgac

SEQ ID NO: 268023 - DNA, 25 bp, Mus musculus
ctccagagaggtgcccttctccaac

SEQ ID NO: 268024 - DNA, 25 bp, Mus musculus
ctccagagatctacctggcgtatcg

SEQ ID NO: 268025 - DNA, 25 bp, Mus musculus
ctccagagcacagatacctgactgt

SEQ ID NO: 268026 - DNA, 25 bp, Mus musculus
ctccagagcaccgcctcctggctgc

SEQ ID NO: 268027 - DNA, 25 bp, Mus musculus
ctccagagcagagtgccagctggac

SEQ ID NO: 268028 - DNA, 25 bp, Mus musculus
ctccagagccggggaatggtctagc

SEQ ID NO: 268029 - DNA, 25 bp, Mus musculus
ctccagagccggtttagtctccact

SEQ ID NO: 268030 - DNA, 25 bp, Mus musculus
ctccagagctacttctccttcaggc

SEQ ID NO: 268031 - DNA, 25 bp, Mus musculus
ctccagagctgctctgcgtacaagc

SEQ ID NO: 268032 - DNA, 25 bp, Mus musculus
ctccagagctggcaggacctacagc

SEQ ID NO: 268033 - DNA, 25 bp, Mus musculus
ctccagagggctagatgtggaagat

SEQ ID NO: 268034 - DNA, 25 bp, Mus musculus
ctccagaggtaaaagcgccattcca

SEQ ID NO: 268035 - DNA, 25 bp, Mus musculus
ctccagaggttaaagataacagtgg

SEQ ID NO: 268036 - DNA, 25 bp, Mus musculus
ctccagagtgataatgtgtacaagt

SEQ ID NO: 268037 - DNA, 25 bp, Mus musculus
ctccagatagagctcgccgcctgca

SEQ ID NO: 268038 - DNA, 25 bp, Mus musculus
ctccagatagagtcccaggtaaaga

SEQ ID NO: 268039 - DNA, 25 bp, Mus musculus
ctccagatatcctgagcagaggggc

SEQ ID NO: 268040 - DNA, 25 bp, Mus musculus
ctccagatatgcaaaccatgtttcc

SEQ ID NO: 268041 - DNA, 25 bp, Mus musculus
ctccagatcctgccggcgagtgagg

SEQ ID NO: 268042 - DNA, 25 bp, Mus musculus
ctccagatcctgccggcgctctgaa

SEQ ID NO: 268043 - DNA, 25 bp, Mus musculus
ctccagatctggggttggtgtcatt

SEQ ID NO: 268044 - DNA, 25 bp, Mus musculus
ctccagatgaagatccaggaggatc

SEQ ID NO: 268045 - DNA, 25 bp, Mus musculus
ctccagatgaagtcaggaggcaaga

SEQ ID NO: 268046 - DNA, 25 bp, Mus musculus
ctccagatgagagggaagagtggat

SEQ ID NO: 268047 - DNA, 25 bp, Mus musculus
ctccagatgagagggaagagtgtat

SEQ ID NO: 268048 - DNA, 25 bp, Mus musculus
ctccagatgccttacaagaggagtg

SEQ ID NO: 268049 - DNA, 25 bp, Mus musculus
ctccagatgccttacagcacatgta

SEQ ID NO: 268050 - DNA, 25 bp, Mus musculus
ctccagatggcagcacacgccaaag

SEQ ID NO: 268051 - DNA, 25 bp, Mus musculus
ctccagattcaggcgacaactggcc

SEQ ID NO: 268052 - DNA, 25 bp, Mus musculus
ctccagattgctttggcctggagag

SEQ ID NO: 268053 - DNA, 25 bp, Mus musculus
ctccagcaagcttcggaggggaaaa

SEQ ID NO: 268054 - DNA, 25 bp, Mus musculus
ctccagcaaggcatgatcaccatcc

SEQ ID NO: 268055 - DNA, 25 bp, Mus musculus
ctccagcaagttacagtccctgttt

SEQ ID NO: 268056 - DNA, 25 bp, Mus musculus
ctccagcacacccagcagcccgagc

SEQ ID NO: 268057 - DNA, 25 bp, Mus musculus
ctccagcacacttgtatggggatcc

SEQ ID NO: 268058 - DNA, 25 bp, Mus musculus
ctccagcacacttgtccaacaaagt

SEQ ID NO: 268059 - DNA, 25 bp, Mus musculus
ctccagcacagatggatacagtgag

SEQ ID NO: 268060 - DNA, 25 bp, Mus musculus
ctccagcacaggatgcgggctcctg

SEQ ID NO: 268061 - DNA, 25 bp, Mus musculus
ctccagcaccagctcttttgatata

SEQ ID NO: 268062 - DNA, 25 bp, Mus musculus
ctccagcaccagcttgctttctctt

SEQ ID NO: 268063 - DNA, 25 bp, Mus musculus
ctccagcacctcagggatttgcaaa

SEQ ID NO: 268064 - DNA, 25 bp, Mus musculus
ctccagcacctcagggccaataata

SEQ ID NO: 268065 - DNA, 25 bp, Mus musculus
ctccagcacctcagtgccttcccag

SEQ ID NO: 268066 - DNA, 25 bp, Mus musculus
ctccagcacctgtgaataaaagctg

SEQ ID NO: 268067 - DNA, 25 bp, Mus musculus
ctccagcacgatggagaatagggct

SEQ ID NO: 268068 - DNA, 25 bp, Mus musculus
ctccagcacgcagctttacatggtg

SEQ ID NO: 268069 - DNA, 25 bp, Mus musculus
ctccagcagaactaaagaacgcttc

SEQ ID NO: 268070 - DNA, 25 bp, Mus musculus
ctccagcagccacagagggagggag

SEQ ID NO: 268071 - DNA, 25 bp, Mus musculus
ctccagcagccacagcgggcagctc

SEQ ID NO: 268072 - DNA, 25 bp, Mus musculus
ctccagcagggagagcagagacggt

SEQ ID NO: 268073 - DNA, 25 bp, Mus musculus
ctccagcatagccccacggcctgct

SEQ ID NO: 268074 - DNA, 25 bp, Mus musculus
ctccagcatcgtggccaagatggac

SEQ ID NO: 268075 - DNA, 25 bp, Mus musculus
ctccagcattgctgaagtgcagagt

SEQ ID NO: 268076 - DNA, 25 bp, Mus musculus
ctccagccaaaggactgcaggctac

SEQ ID NO: 268077 - DNA, 25 bp, Mus musculus
ctccagccaatgagaaagagaaaac

SEQ ID NO: 268078 - DNA, 25 bp, Mus musculus
ctccagccaatgctgactaccagga

SEQ ID NO: 268079 - DNA, 25 bp, Mus musculus
ctccagccaccagcccctgcccgga

SEQ ID NO: 268080 - DNA, 25 bp, Mus musculus
ctccagccaggaatggcaagatgtg

SEQ ID NO: 268081 - DNA, 25 bp, Mus musculus
ctccagccaggatgtgatggtggtg

SEQ ID NO: 268082 - DNA, 25 bp, Mus musculus
ctccagccagggatagagaaggctg

SEQ ID NO: 268083 - DNA, 25 bp, Mus musculus
ctccagccaggtgatgttctgatta

SEQ ID NO: 268084 - DNA, 25 bp, Mus musculus
ctccagcccagaattaaccctgaat

SEQ ID NO: 268085 - DNA, 25 bp, Mus musculus
ctccagcccagatggaggatgagga

SEQ ID NO: 268086 - DNA, 25 bp, Mus musculus
ctccagcccagcagacaggaggatc

SEQ ID NO: 268087 - DNA, 25 bp, Mus musculus
ctccagcccagctggagatggagga

SEQ ID NO: 268088 - DNA, 25 bp, Mus musculus
ctccagcccaggccctccttgtcaa

SEQ ID NO: 268089 - DNA, 25 bp, Mus musculus
ctccagcccaggtgaacaccatgtc

SEQ ID NO: 268090 - DNA, 25 bp, Mus musculus
ctccagcccagtccaaggcgacctc

SEQ ID NO: 268091 - DNA, 25 bp, Mus musculus
ctccagccccagaacaaggaattga

SEQ ID NO: 268092 - DNA, 25 bp, Mus musculus
ctccagcccccagatctccttgtca

SEQ ID NO: 268093 - DNA, 25 bp, Mus musculus
ctccagccccctgaagacgatgacg

SEQ ID NO: 268094 - DNA, 25 bp, Mus musculus
ctccagcccctaaaggtctcagagg

SEQ ID NO: 268095 - DNA, 25 bp, Mus musculus
ctccagcccggttttgaggaaaagg

SEQ ID NO: 268096 - DNA, 25 bp, Mus musculus
ctccagccgggatgctgtccaggcc

SEQ ID NO: 268097 - DNA, 25 bp, Mus musculus
ctccagcctcagaggccagaaagga

SEQ ID NO: 268098 - DNA, 25 bp, Mus musculus
ctccagcctcagaggccagaagaag

SEQ ID NO: 268099 - DNA, 25 bp, Mus musculus
ctccagcctgagagcttcggtgcaa

SEQ ID NO: 268100 - DNA, 25 bp, Mus musculus
ctccagcctgggagggcctaggaac

SEQ ID NO: 268101 - DNA, 25 bp, Mus musculus
ctccagcgacatcgctgacttcagg

SEQ ID NO: 268102 - DNA, 25 bp, Mus musculus
ctccagcgccggggactctgatggg

SEQ ID NO: 268103 - DNA, 25 bp, Mus musculus
ctccagcgggacaggtggtgtccct

SEQ ID NO: 268104 - DNA, 25 bp, Mus musculus
ctccagcgggacagtgacgttgccc

SEQ ID NO: 268105 - DNA, 25 bp, Mus musculus
ctccagcgggcagaggcggatctta

SEQ ID NO: 268106 - DNA, 25 bp, Mus musculus
ctccagcgggcaggtcatgttagcg

SEQ ID NO: 268107 - DNA, 25 bp, Mus musculus
ctccagcgtcgccaccatgaccacc

SEQ ID NO: 268108 - DNA, 25 bp, Mus musculus
ctccagcgtctaaggttcctgtgtc

SEQ ID NO: 268109 - DNA, 25 bp, Mus musculus
ctccagctaccagtgtccaaatgat

SEQ ID NO: 268110 - DNA, 25 bp, Mus musculus
ctccagctatgagaagcaacaggcc

SEQ ID NO: 268111 - DNA, 25 bp, Mus musculus
ctccagctatgagcctggagtactc

SEQ ID NO: 268112 - DNA, 25 bp, Mus musculus
ctccagctcaaagctgctgagagcc

SEQ ID NO: 268113 - DNA, 25 bp, Mus musculus
ctccagctccaccccctactccccg

SEQ ID NO: 268114 - DNA, 25 bp, Mus musculus
ctccagctccaggtacttcgagttt

SEQ ID NO: 268115 - DNA, 25 bp, Mus musculus
ctccagctctccagatcatggctcc

SEQ ID NO: 268116 - DNA, 25 bp, Mus musculus
ctccagctcttggcagaagacttta

SEQ ID NO: 268117 - DNA, 25 bp, Mus musculus
ctccagctgactcagcaaatggaac

SEQ ID NO: 268118 - DNA, 25 bp, Mus musculus
ctccagctgcaatggggactctggc

SEQ ID NO: 268119 - DNA, 25 bp, Mus musculus
ctccagctgcagcagttctatgctg

SEQ ID NO: 268120 - DNA, 25 bp, Mus musculus
ctccagctgcaggatgaagtggccc

SEQ ID NO: 268121 - DNA, 25 bp, Mus musculus
ctccagctgccaaacgtcaaactcc

SEQ ID NO: 268122 - DNA, 25 bp, Mus musculus
ctccagctgcctttttcaacatgga

SEQ ID NO: 268123 - DNA, 25 bp, Mus musculus
ctccagctgctgacccaggtcctga

SEQ ID NO: 268124 - DNA, 25 bp, Mus musculus
ctccagcttcagcagcatctacagg

SEQ ID NO: 268125 - DNA, 25 bp, Mus musculus
ctccagcttcagcagctctagccaa

SEQ ID NO: 268126 - DNA, 25 bp, Mus musculus
ctccagcttccagatacctcagtcc

SEQ ID NO: 268127 - DNA, 25 bp, Mus musculus
ctccagcttccagccctacgttctt

SEQ ID NO: 268128 - DNA, 25 bp, Mus musculus
ctccagcttcctgaatgttttggct

SEQ ID NO: 268129 - DNA, 25 bp, Mus musculus
ctccaggaacagctcaaggccgtgc

SEQ ID NO: 268130 - DNA, 25 bp, Mus musculus
ctccaggaagaaaggtcaggatcgc

SEQ ID NO: 268131 - DNA, 25 bp, Mus musculus
ctccaggaagccaggtctttggcca

SEQ ID NO: 268132 - DNA, 25 bp, Mus musculus
ctccaggacaagatgcgagctacac

SEQ ID NO: 268133 - DNA, 25 bp, Mus musculus
ctccaggacaaggaagaaaccgttg

SEQ ID NO: 268134 - DNA, 25 bp, Mus musculus
ctccaggacaggaaggtacttctcc

SEQ ID NO: 268135 - DNA, 25 bp, Mus musculus
ctccaggaccatgcaaaagcaaaag

SEQ ID NO: 268136 - DNA, 25 bp, Mus musculus
ctccaggacccagtggaacaattgg

SEQ ID NO: 268137 - DNA, 25 bp, Mus musculus
ctccaggacgtgtctcccactccct

SEQ ID NO: 268138 - DNA, 25 bp, Mus musculus
ctccaggacgtttctaagctgacta

SEQ ID NO: 268139 - DNA, 25 bp, Mus musculus
ctccaggagaccagggagagaaata

SEQ ID NO: 268140 - DNA, 25 bp, Mus musculus
ctccaggagagggaaaagatgccgt

SEQ ID NO: 268141 - DNA, 25 bp, Mus musculus
ctccaggagccggaaagaagagacg

SEQ ID NO: 268142 - DNA, 25 bp, Mus musculus
ctccaggagccgggcattcaactcg

SEQ ID NO: 268143 - DNA, 25 bp, Mus musculus
ctccaggaggcagagagtgctacaa

SEQ ID NO: 268144 - DNA, 25 bp, Mus musculus
ctccaggaggcagaggtaagaaagt

SEQ ID NO: 268145 - DNA, 25 bp, Mus musculus
ctccaggaggcagaggtccctggct

SEQ ID NO: 268146 - DNA, 25 bp, Mus musculus
ctccaggagggaagatatgaatctg

SEQ ID NO: 268147 - DNA, 25 bp, Mus musculus
ctccaggataccaaggctcctgtga

SEQ ID NO: 268148 - DNA, 25 bp, Mus musculus
ctccaggatccaggcgccaggcagc

SEQ ID NO: 268149 - DNA, 25 bp, Mus musculus
ctccaggatccaggttttatccaga

SEQ ID NO: 268150 - DNA, 25 bp, Mus musculus
ctccaggatcctcatccgagagtcc

SEQ ID NO: 268151 - DNA, 25 bp, Mus musculus
ctccaggatgcaggagcctccagac

SEQ ID NO: 268152 - DNA, 25 bp, Mus musculus
ctccaggatgttctgaggaggactg

SEQ ID NO: 268153 - DNA, 25 bp, Mus musculus
ctccaggatttgggagccaaagact

SEQ ID NO: 268154 - DNA, 25 bp, Mus musculus
ctccaggatttggggtggtatcacg

SEQ ID NO: 268155 - DNA, 25 bp, Mus musculus
ctccaggcaaagatacagagtcagg

SEQ ID NO: 268156 - DNA, 25 bp, Mus musculus
ctccaggccacaatcggctatccat

SEQ ID NO: 268157 - DNA, 25 bp, Mus musculus
ctccaggccagcagacacacaacct

SEQ ID NO: 268158 - DNA, 25 bp, Mus musculus
ctccaggccagcagccctgtctcca

SEQ ID NO: 268159 - DNA, 25 bp, Mus musculus
ctccaggccatcactgacaaaagaa

SEQ ID NO: 268160 - DNA, 25 bp, Mus musculus
ctccaggccccagctttggtggccc

SEQ ID NO: 268161 - DNA, 25 bp, Mus musculus
ctccaggccctccggaggacctggc

SEQ ID NO: 268162 - DNA, 25 bp, Mus musculus
ctccaggccctgctggagctccagg

SEQ ID NO: 268163 - DNA, 25 bp, Mus musculus
ctccaggctctacttctgttcatat

SEQ ID NO: 268164 - DNA, 25 bp, Mus musculus
ctccaggctctgggaccctgaaagc

SEQ ID NO: 268165 - DNA, 25 bp, Mus musculus
ctccagggagacgaaggaggcgttc

SEQ ID NO: 268166 - DNA, 25 bp, Mus musculus
ctccagggatcagtgggcgagcttc

SEQ ID NO: 268167 - DNA, 25 bp, Mus musculus
ctccagggatcagtggtaccgggct

SEQ ID NO: 268168 - DNA, 25 bp, Mus musculus
ctccagggcaagccccaggactgga

SEQ ID NO: 268169 - DNA, 25 bp, Mus musculus
ctccagggccagtttcttctgggac

SEQ ID NO: 268170 - DNA, 25 bp, Mus musculus
ctccagggcccctgggcccacctgg

SEQ ID NO: 268171 - DNA, 25 bp, Mus musculus
ctccagggtcagcttccaagcaacc

SEQ ID NO: 268172 - DNA, 25 bp, Mus musculus
ctccagggtcaggtgaaccaccaaa

SEQ ID NO: 268173 - DNA, 25 bp, Mus musculus
ctccagggtttgctgagagtggaca

SEQ ID NO: 268174 - DNA, 25 bp, Mus musculus
ctccaggtaagtgctggccattcag

SEQ ID NO: 268175 - DNA, 25 bp, Mus musculus
ctccaggtacaagacgaactggaga

SEQ ID NO: 268176 - DNA, 25 bp, Mus musculus
ctccaggtcaaagtgattgtgtgtc

SEQ ID NO: 268177 - DNA, 25 bp, Mus musculus
ctccaggtgacaaagcaggtaaaca

SEQ ID NO: 268178 - DNA, 25 bp, Mus musculus
ctccaggtggccgagaagctgtttg

SEQ ID NO: 268179 - DNA, 25 bp, Mus musculus
ctccagtaaacccagtgatcaggtg

SEQ ID NO: 268180 - DNA, 25 bp, Mus musculus
ctccagtaaagactccttgttgcaa

SEQ ID NO: 268181 - DNA, 25 bp, Mus musculus
ctccagtaacagttacagaaacccc

SEQ ID NO: 268182 - DNA, 25 bp, Mus musculus
ctccagtaagtatgataggctgggc

SEQ ID NO: 268183 - DNA, 25 bp, Mus musculus
ctccagtaccattgcaagtactcca

SEQ ID NO: 268184 - DNA, 25 bp, Mus musculus
ctccagtagagaaataccggtatca

SEQ ID NO: 268185 - DNA, 25 bp, Mus musculus
ctccagtagagaagctgaagggaac

SEQ ID NO: 268186 - DNA, 25 bp, Mus musculus
ctccagtccagcaatcccaggatcc

SEQ ID NO: 268187 - DNA, 25 bp, Mus musculus
ctccagtccgttgtggggactgaac

SEQ ID NO: 268188 - DNA, 25 bp, Mus musculus
ctccagtctccaggtgattggatgt

SEQ ID NO: 268189 - DNA, 25 bp, Mus musculus
ctccagtctgagccgaatccacctt

SEQ ID NO: 268190 - DNA, 25 bp, Mus musculus
ctccagtctgcagcaagccccgccc

SEQ ID NO: 268191 - DNA, 25 bp, Mus musculus
ctccagtgactccatcaaagagagg

SEQ ID NO: 268192 - DNA, 25 bp, Mus musculus
ctccagtgagagttgctggaactgt

SEQ ID NO: 268193 - DNA, 25 bp, Mus musculus
ctccagtgcaagcagcccagccatg

SEQ ID NO: 268194 - DNA, 25 bp, Mus musculus
ctccagtgcagaagctgtagctatc

SEQ ID NO: 268195 - DNA, 25 bp, Mus musculus
ctccagtgcgactttactggaaaga

SEQ ID NO: 268196 - DNA, 25 bp, Mus musculus
ctccagtgctgcgccattttggctg

SEQ ID NO: 268197 - DNA, 25 bp, Mus musculus
ctccagtgctgtaaccctccactga

SEQ ID NO: 268198 - DNA, 25 bp, Mus musculus
ctccagtggatcggaaaaggcctac

SEQ ID NO: 268199 - DNA, 25 bp, Mus musculus
ctccagtgtagagggccaagtccac

SEQ ID NO: 268200 - DNA, 25 bp, Mus musculus
ctccagtgtagatttatttttataa

SEQ ID NO: 268201 - DNA, 25 bp, Mus musculus
ctccagtgtaggctctcagacactg

SEQ ID NO: 268202 - DNA, 25 bp, Mus musculus
ctccagtgtaggtgttggaactgta

SEQ ID NO: 268203 - DNA, 25 bp, Mus musculus
ctccagtgtgactggtttcatatgt

SEQ ID NO: 268204 - DNA, 25 bp, Mus musculus
ctccagttccaggaagtcgttcttc

SEQ ID NO: 268205 - DNA, 25 bp, Mus musculus
ctccagttccagtaagtgcaataaa

SEQ ID NO: 268206 - DNA, 25 bp, Mus musculus
ctccagttctaattgtaatcgtgtt

SEQ ID NO: 268207 - DNA, 25 bp, Mus musculus
ctccagttgtgagatgtggtgatct

SEQ ID NO: 268208 - DNA, 25 bp, Mus musculus
ctccagttttacaggaatctgggca

SEQ ID NO: 268209 - DNA, 25 bp, Mus musculus
ctccagttttccagagccccttcca

SEQ ID NO: 268210 - DNA, 25 bp, Mus musculus
ctccataaagcccatgcaggtgctc

SEQ ID NO: 268211 - DNA, 25 bp, Mus musculus
ctccatacacatatggaggggcttt

SEQ ID NO: 268212 - DNA, 25 bp, Mus musculus
ctccatacagaaagagtatgaaaag

SEQ ID NO: 268213 - DNA, 25 bp, Mus musculus
ctccatacagtgctctgtgaagaac

SEQ ID NO: 268214 - DNA, 25 bp, Mus musculus
ctccatacatcagccctcgtggtag

SEQ ID NO: 268215 - DNA, 25 bp, Mus musculus
ctccatacatcagttttgcaggtga

SEQ ID NO: 268216 - DNA, 25 bp, Mus musculus
ctccatacccaaaggtatcacagcc

SEQ ID NO: 268217 - DNA, 25 bp, Mus musculus
ctccatatatcaaatctggaggtga

SEQ ID NO: 268218 - DNA, 25 bp, Mus musculus
ctccatcaaaccccggcagcccaac

SEQ ID NO: 268219 - DNA, 25 bp, Mus musculus
ctccatcaaagaaattagccaggaa

SEQ ID NO: 268220 - DNA, 25 bp, Mus musculus
ctccatcaaaggacctgatagatga

SEQ ID NO: 268221 - DNA, 25 bp, Mus musculus
ctccatcaacaggatcattcggaca

SEQ ID NO: 268222 - DNA, 25 bp, Mus musculus
ctccatcaaggagctgaatgagcgt

SEQ ID NO: 268223 - DNA, 25 bp, Mus musculus
ctccatcaaggtgctctcgtcagtt

SEQ ID NO: 268224 - DNA, 25 bp, Mus musculus
ctccatcaccttcattcacaacgac

SEQ ID NO: 268225 - DNA, 25 bp, Mus musculus
ctccatcacgcaaggcatcccgagg

SEQ ID NO: 268226 - DNA, 25 bp, Mus musculus
ctccatcagacggctggaagaggcc

SEQ ID NO: 268227 - DNA, 25 bp, Mus musculus
ctccatcaggattccatggacaaaa

SEQ ID NO: 268228 - DNA, 25 bp, Mus musculus
ctccatcagttctgtgctcaaagat

SEQ ID NO: 268229 - DNA, 25 bp, Mus musculus
ctccatcatccacaagactgcggga

SEQ ID NO: 268230 - DNA, 25 bp, Mus musculus
ctccatcatgtccttcagtgctgac

SEQ ID NO: 268231 - DNA, 25 bp, Mus musculus
ctccatcccaagcgcctgtgtctgg

SEQ ID NO: 268232 - DNA, 25 bp, Mus musculus
ctccatccccaggtgctgctttcct

SEQ ID NO: 268233 - DNA, 25 bp, Mus musculus
ctccatccccatcaggccaaccaga

SEQ ID NO: 268234 - DNA, 25 bp, Mus musculus
ctccatcctaccagttcgcagacca

SEQ ID NO: 268235 - DNA, 25 bp, Mus musculus
ctccatcctaccatatctgtctcgg

SEQ ID NO: 268236 - DNA, 25 bp, Mus musculus
ctccatcctgaagtccctgctatgt

SEQ ID NO: 268237 - DNA, 25 bp, Mus musculus
ctccatcctgcagaccttatgtgag

SEQ ID NO: 268238 - DNA, 25 bp, Mus musculus
ctccatcctgcaggggctggcgaga

SEQ ID NO: 268239 - DNA, 25 bp, Mus musculus
ctccatcctggcctccctttttttt

SEQ ID NO: 268240 - DNA, 25 bp, Mus musculus
ctccatcctgggttggctgatgtta

SEQ ID NO: 268241 - DNA, 25 bp, Mus musculus
ctccatcctgtctatggagaaaata

SEQ ID NO: 268242 - DNA, 25 bp, Mus musculus
ctccatcctgttactgagctgcgtt

SEQ ID NO: 268243 - DNA, 25 bp, Mus musculus
ctccatcgctacagatactttatgc

SEQ ID NO: 268244 - DNA, 25 bp, Mus musculus
ctccatcggcgggctcctggccttg

SEQ ID NO: 268245 - DNA, 25 bp, Mus musculus
ctccatcggcggggaagtttggtga

SEQ ID NO: 268246 - DNA, 25 bp, Mus musculus
ctccatcggcttcagatatttatca

SEQ ID NO: 268247 - DNA, 25 bp, Mus musculus
ctccatcgtgagacataggaggcgg

SEQ ID NO: 268248 - DNA, 25 bp, Mus musculus
ctccatcgtgaggaactatgaatgg

SEQ ID NO: 268249 - DNA, 25 bp, Mus musculus
ctccatcgtgaggtagttgaaatgt

SEQ ID NO: 268250 - DNA, 25 bp, Mus musculus
ctccatctacactggaattacacta

SEQ ID NO: 268251 - DNA, 25 bp, Mus musculus
ctccatctatagatcttaccaatat

SEQ ID NO: 268252 - DNA, 25 bp, Mus musculus
ctccatctataggattcatgaataa

SEQ ID NO: 268253 - DNA, 25 bp, Mus musculus
ctccatctccgagctgatccacacc

SEQ ID NO: 268254 - DNA, 25 bp, Mus musculus
ctccatctgcagggttatcaagatg

SEQ ID NO: 268255 - DNA, 25 bp, Mus musculus
ctccatcttagaacatcctttactg

SEQ ID NO: 268256 - DNA, 25 bp, Mus musculus
ctccatcttccaggagaaccacaat

SEQ ID NO: 268257 - DNA, 25 bp, Mus musculus
ctccatcttggcatgtgctccactg

SEQ ID NO: 268258 - DNA, 25 bp, Mus musculus
ctccatctttggtctggctcccatg

SEQ ID NO: 268259 - DNA, 25 bp, Mus musculus
ctccatgacgcctgacctgctgaat

SEQ ID NO: 268260 - DNA, 25 bp, Mus musculus
ctccatgactacctcatgagcacac

SEQ ID NO: 268261 - DNA, 25 bp, Mus musculus
ctccatgagaccctggacatgaaca

SEQ ID NO: 268262 - DNA, 25 bp, Mus musculus
ctccatgagaccctgtacatgggct

SEQ ID NO: 268263 - DNA, 25 bp, Mus musculus
ctccatgcaagtgccaaatttacgg

SEQ ID NO: 268264 - DNA, 25 bp, Mus musculus
ctccatgcagcacatttaaaatcca

SEQ ID NO: 268265 - DNA, 25 bp, Mus musculus
ctccatgcagctgaggtctacattg

SEQ ID NO: 268266 - DNA, 25 bp, Mus musculus
ctccatgcaggtattgaggctctga

SEQ ID NO: 268267 - DNA, 25 bp, Mus musculus
ctccatgcaggtctatgaagggcta

SEQ ID NO: 268268 - DNA, 25 bp, Mus musculus
ctccatgccctctttagcagatata

SEQ ID NO: 268269 - DNA, 25 bp, Mus musculus
ctccatgctgtcagccgttgactac

SEQ ID NO: 268270 - DNA, 25 bp, Mus musculus
ctccatggacagactacagatgctg

SEQ ID NO: 268271 - DNA, 25 bp, Mus musculus
ctccatggacagtctacagatgctg

SEQ ID NO: 268272 - DNA, 25 bp, Mus musculus
ctccatggaccctggacttcgggtg

SEQ ID NO: 268273 - DNA, 25 bp, Mus musculus
ctccatggagaacaggtgcttttac

SEQ ID NO: 268274 - DNA, 25 bp, Mus musculus
ctccatggagacgatctatgacatg

SEQ ID NO: 268275 - DNA, 25 bp, Mus musculus
ctccatggagcttggagctgcctgg

SEQ ID NO: 268276 - DNA, 25 bp, Mus musculus
ctccatggaggcaagatgaatatga

SEQ ID NO: 268277 - DNA, 25 bp, Mus musculus
ctccatggcgacctggtgactccat

SEQ ID NO: 268278 - DNA, 25 bp, Mus musculus
ctccatggctggcaatgtccacaga

SEQ ID NO: 268279 - DNA, 25 bp, Mus musculus
ctccatgtggatataccgctgtggg

SEQ ID NO: 268280 - DNA, 25 bp, Mus musculus
ctccatgtggcatttggcacatcct

SEQ ID NO: 268281 - DNA, 25 bp, Mus musculus
ctccattaaaaagagcaacagtgtg

SEQ ID NO: 268282 - DNA, 25 bp, Mus musculus
ctccattcacaaggattcagggaat

SEQ ID NO: 268283 - DNA, 25 bp, Mus musculus
ctccattcagagcataccagaaatt

SEQ ID NO: 268284 - DNA, 25 bp, Mus musculus
ctccattcaggagacattccaaatg

SEQ ID NO: 268285 - DNA, 25 bp, Mus musculus
ctccattcaggcacagatgcttcta

SEQ ID NO: 268286 - DNA, 25 bp, Mus musculus
ctccattcagggttcccgggcccca

SEQ ID NO: 268287 - DNA, 25 bp, Mus musculus
ctccattcaggtagtgactgcagcc

SEQ ID NO: 268288 - DNA, 25 bp, Mus musculus
ctccattcagttttcctttttcaga

SEQ ID NO: 268289 - DNA, 25 bp, Mus musculus
ctccattcatgaaagctccttgtga

SEQ ID NO: 268290 - DNA, 25 bp, Mus musculus
ctccattcatgaaaggaagaacaat

SEQ ID NO: 268291 - DNA, 25 bp, Mus musculus
ctccattctcgaggtggctgttatc

SEQ ID NO: 268292 - DNA, 25 bp, Mus musculus
ctccattctgttgcaccaagtatag

SEQ ID NO: 268293 - DNA, 25 bp, Mus musculus
ctccattcttgactgggctgctgga

SEQ ID NO: 268294 - DNA, 25 bp, Mus musculus
ctccattgacacaattgttccagtg

SEQ ID NO: 268295 - DNA, 25 bp, Mus musculus
ctccattgacgatggcacgaacatg

SEQ ID NO: 268296 - DNA, 25 bp, Mus musculus
ctccattgcgaggctcctgacagtg

SEQ ID NO: 268297 - DNA, 25 bp, Mus musculus
ctccattgtagggatgtttcttgcg

SEQ ID NO: 268298 - DNA, 25 bp, Mus musculus
ctccatttatctgtaacagcgtgga

SEQ ID NO: 268299 - DNA, 25 bp, Mus musculus
ctccatttgtgaagatatcgatgag

SEQ ID NO: 268300 - DNA, 25 bp, Mus musculus
ctccatttgtgaagatgaagatgaa

SEQ ID NO: 268301 - DNA, 25 bp, Mus musculus
ctccattttggattcgtaaacttca

SEQ ID NO: 268302 - DNA, 25 bp, Mus musculus
ctccatttttcagagctgcgttcag

SEQ ID NO: 268303 - DNA, 25 bp, Mus musculus
ctcccaaactgagatttgcaacagc

SEQ ID NO: 268304 - DNA, 25 bp, Mus musculus
ctcccaaagatactggcattgcccg

SEQ ID NO: 268305 - DNA, 25 bp, Mus musculus
ctcccaaatgctggaccctcccagg

SEQ ID NO: 268306 - DNA, 25 bp, Mus musculus
ctcccaacagatgcagcgaagccct

SEQ ID NO: 268307 - DNA, 25 bp, Mus musculus
ctcccaacaggttctgggcctctgt

SEQ ID NO: 268308 - DNA, 25 bp, Mus musculus
ctcccaacccaaatcttccaccacc

SEQ ID NO: 268309 - DNA, 25 bp, Mus musculus
ctcccaacccaagtgacgttttgaa

SEQ ID NO: 268310 - DNA, 25 bp, Mus musculus
ctcccaacccctccaaggcccgaga

SEQ ID NO: 268311 - DNA, 25 bp, Mus musculus
ctcccaactacagaaaagcagtcag

SEQ ID NO: 268312 - DNA, 25 bp, Mus musculus
ctcccaactcagcgggtggataccc

SEQ ID NO: 268313 - DNA, 25 bp, Mus musculus
ctcccaactcagcgggttcttccag

SEQ ID NO: 268314 - DNA, 25 bp, Mus musculus
ctcccaactgtagtgctggacccaa

SEQ ID NO: 268315 - DNA, 25 bp, Mus musculus
ctcccaagacaagtgtcagcggaaa

SEQ ID NO: 268316 - DNA, 25 bp, Mus musculus
ctcccaagagccagatggtccagcg

SEQ ID NO: 268317 - DNA, 25 bp, Mus musculus
ctcccaagcaaggttgaaaggaaat

SEQ ID NO: 268318 - DNA, 25 bp, Mus musculus
ctcccaagcagacagaccgtgcgag

SEQ ID NO: 268319 - DNA, 25 bp, Mus musculus
ctcccaaggaaggagtctatgaact

SEQ ID NO: 268320 - DNA, 25 bp, Mus musculus
ctcccaaggaagttcatgttctgtg

SEQ ID NO: 268321 - DNA, 25 bp, Mus musculus
ctcccaaggtgcagcaacctcactt

SEQ ID NO: 268322 - DNA, 25 bp, Mus musculus
ctcccaaggtgcaggctttggttag

SEQ ID NO: 268323 - DNA, 25 bp, Mus musculus
ctcccaagtatgagcccaattttgc

SEQ ID NO: 268324 - DNA, 25 bp, Mus musculus
ctcccaatgacggtcaagatgctga

SEQ ID NO: 268325 - DNA, 25 bp, Mus musculus
ctcccaatttcaggctcacccatga

SEQ ID NO: 268326 - DNA, 25 bp, Mus musculus
ctcccacaacgttcacccggccaca

SEQ ID NO: 268327 - DNA, 25 bp, Mus musculus
ctcccacacagccttggacaaatta

SEQ ID NO: 268328 - DNA, 25 bp, Mus musculus
ctcccacacaggcgctctgaaatca

SEQ ID NO: 268329 - DNA, 25 bp, Mus musculus
ctcccacacaggtgagaagccctac

SEQ ID NO: 268330 - DNA, 25 bp, Mus musculus
ctcccacagaaatgctgcacaatgt

SEQ ID NO: 268331 - DNA, 25 bp, Mus musculus
ctcccacagaaggacccagaaatct

SEQ ID NO: 268332 - DNA, 25 bp, Mus musculus
ctcccacagcacccaccatcccctg

SEQ ID NO: 268333 - DNA, 25 bp, Mus musculus
ctcccacatcaaggtggtggtcggc

SEQ ID NO: 268334 - DNA, 25 bp, Mus musculus
ctcccacattcaggtccaacaaagt

SEQ ID NO: 268335 - DNA, 25 bp, Mus musculus
ctcccaccagaggctgatccccggc

SEQ ID NO: 268336 - DNA, 25 bp, Mus musculus
ctcccaccagatacccataatatct

SEQ ID NO: 268337 - DNA, 25 bp, Mus musculus
ctcccaccaggctcaatattgtgca

SEQ ID NO: 268338 - DNA, 25 bp, Mus musculus
ctcccaccatcccaaatttattcct

SEQ ID NO: 268339 - DNA, 25 bp, Mus musculus
ctcccaccatgaaacaaaaggaggg

SEQ ID NO: 268340 - DNA, 25 bp, Mus musculus
ctcccaccatgatgggaagaaagga

SEQ ID NO: 268341 - DNA, 25 bp, Mus musculus
ctcccaccccagggttcctgctgga

SEQ ID NO: 268342 - DNA, 25 bp, Mus musculus
ctcccaccccagtacggcctctact

SEQ ID NO: 268343 - DNA, 25 bp, Mus musculus
ctcccaccccgggatcgctcaatgt

SEQ ID NO: 268344 - DNA, 25 bp, Mus musculus
ctcccaccgagcaggtgacattccc

SEQ ID NO: 268345 - DNA, 25 bp, Mus musculus
ctcccaccgcagcccagggagaaag

SEQ ID NO: 268346 - DNA, 25 bp, Mus musculus
ctcccaccgcaggtatcatccggat

SEQ ID NO: 268347 - DNA, 25 bp, Mus musculus
ctcccaccggtgcctgctgtctccc

SEQ ID NO: 268348 - DNA, 25 bp, Mus musculus
ctcccacctacgggtggcggctgac

SEQ ID NO: 268349 - DNA, 25 bp, Mus musculus
ctcccacctgagctggatgtaccct

SEQ ID NO: 268350 - DNA, 25 bp, Mus musculus
ctcccacctgcaccttatagccatc

SEQ ID NO: 268351 - DNA, 25 bp, Mus musculus
ctcccacctggttttctctgtataa

SEQ ID NO: 268352 - DNA, 25 bp, Mus musculus
ctcccaccttgaggcctttcttcca

SEQ ID NO: 268353 - DNA, 25 bp, Mus musculus
ctcccaccttgagggaagtaaccag

SEQ ID NO: 268354 - DNA, 25 bp, Mus musculus
ctcccaccttgagggtcctgagtcc

SEQ ID NO: 268355 - DNA, 25 bp, Mus musculus
ctcccaccttgccaggttctgcctt

SEQ ID NO: 268356 - DNA, 25 bp, Mus musculus
ctcccacgcagagggtctggagaca

SEQ ID NO: 268357 - DNA, 25 bp, Mus musculus
ctcccacgctaagatgcccctagac

SEQ ID NO: 268358 - DNA, 25 bp, Mus musculus
ctcccactccccagagcctcaagtc

SEQ ID NO: 268359 - DNA, 25 bp, Mus musculus
ctcccactctcctgggctgcaactg

SEQ ID NO: 268360 - DNA, 25 bp, Mus musculus
ctcccactgcaatttgaagagcttg

SEQ ID NO: 268361 - DNA, 25 bp, Mus musculus
ctcccactggagcagctaaatgaga

SEQ ID NO: 268362 - DNA, 25 bp, Mus musculus
ctcccacttgctcagccttcctgat

SEQ ID NO: 268363 - DNA, 25 bp, Mus musculus
ctcccagaacacgagcccaagatga

SEQ ID NO: 268364 - DNA, 25 bp, Mus musculus
ctcccagaagatagtcacatgctgg

SEQ ID NO: 268365 - DNA, 25 bp, Mus musculus
ctcccagaatactgaacttcgtgta

SEQ ID NO: 268366 - DNA, 25 bp, Mus musculus
ctcccagaatactgacaaaaaaagc

SEQ ID NO: 268367 - DNA, 25 bp, Mus musculus
ctcccagaatggatgtaaccattac

SEQ ID NO: 268368 - DNA, 25 bp, Mus musculus
ctcccagaatgttatggctgcagct

SEQ ID NO: 268369 - DNA, 25 bp, Mus musculus
ctcccagagcctccagagcttcgtc

SEQ ID NO: 268370 - DNA, 25 bp, Mus musculus
ctcccagagctcaaggagcgaatct

SEQ ID NO: 268371 - DNA, 25 bp, Mus musculus
ctcccagagctcaaggctaaccctt

SEQ ID NO: 268372 - DNA, 25 bp, Mus musculus
ctcccagaggaactctgtgcctgtt

SEQ ID NO: 268373 - DNA, 25 bp, Mus musculus
ctcccagaggaggacgatgtcatga

SEQ ID NO: 268374 - DNA, 25 bp, Mus musculus
ctcccagaggagttggatattctaa

SEQ ID NO: 268375 - DNA, 25 bp, Mus musculus
ctcccagagtggcttcatcactgta

SEQ ID NO: 268376 - DNA, 25 bp, Mus musculus
ctcccagatacccagaaatggaact

SEQ ID NO: 268377 - DNA, 25 bp, Mus musculus
ctcccagatggtgtcataagccgaa

SEQ ID NO: 268378 - DNA, 25 bp, Mus musculus
ctcccagattataagtttccagaac

SEQ ID NO: 268379 - DNA, 25 bp, Mus musculus
ctcccagattatgcacaggacctca

SEQ ID NO: 268380 - DNA, 25 bp, Mus musculus
ctcccagcacctgtccctcactctc

SEQ ID NO: 268381 - DNA, 25 bp, Mus musculus
ctcccagcagaaggagtgtcctctc

SEQ ID NO: 268382 - DNA, 25 bp, Mus musculus
ctcccagcagaaggcagcaagcgcc

SEQ ID NO: 268383 - DNA, 25 bp, Mus musculus
ctcccagccaccaaaggggaggcgc

SEQ ID NO: 268384 - DNA, 25 bp, Mus musculus
ctcccagcgaggagagagtgtatat

SEQ ID NO: 268385 - DNA, 25 bp, Mus musculus
ctcccagcgcagggttaatttctaa

SEQ ID NO: 268386 - DNA, 25 bp, Mus musculus
ctcccagcgctttggagctgtgtgg

SEQ ID NO: 268387 - DNA, 25 bp, Mus musculus
ctcccagcgctttggagctgtgtgt

SEQ ID NO: 268388 - DNA, 25 bp, Mus musculus
ctcccagcggcagagatagctgttg

SEQ ID NO: 268389 - DNA, 25 bp, Mus musculus
ctcccagcggcagctgagcagaata

SEQ ID NO: 268390 - DNA, 25 bp, Mus musculus
ctcccagctccttcactcactcgtc

SEQ ID NO: 268391 - DNA, 25 bp, Mus musculus
ctcccagcttcgcaggacccaacct

SEQ ID NO: 268392 - DNA, 25 bp, Mus musculus
ctcccaggaagagagggagaaggcg

SEQ ID NO: 268393 - DNA, 25 bp, Mus musculus
ctcccaggaagcctcaaggagaagc

SEQ ID NO: 268394 - DNA, 25 bp, Mus musculus
ctcccaggaagcgtgcccaactaat

SEQ ID NO: 268395 - DNA, 25 bp, Mus musculus
ctcccaggaagtgcaaagaggagat

SEQ ID NO: 268396 - DNA, 25 bp, Mus musculus
ctcccaggactggtcaatgtggcta

SEQ ID NO: 268397 - DNA, 25 bp, Mus musculus
ctcccaggagaatttcacccacctg

SEQ ID NO: 268398 - DNA, 25 bp, Mus musculus
ctcccaggagaggaatgctgtggcc

SEQ ID NO: 268399 - DNA, 25 bp, Mus musculus
ctcccaggagagtcccggagagtgg

SEQ ID NO: 268400 - DNA, 25 bp, Mus musculus
ctcccaggagattaccaaggaaatg

SEQ ID NO: 268401 - DNA, 25 bp, Mus musculus
ctcccaggagattggagaccgaaac

SEQ ID NO: 268402 - DNA, 25 bp, Mus musculus
ctcccaggagttgaccctggaggtt

SEQ ID NO: 268403 - DNA, 25 bp, Mus musculus
ctcccaggccctgaatgaagaagag

SEQ ID NO: 268404 - DNA, 25 bp, Mus musculus
ctcccaggccttgggaaaagctgtg

SEQ ID NO: 268405 - DNA, 25 bp, Mus musculus
ctcccaggtcgggaccctggtgact

SEQ ID NO: 268406 - DNA, 25 bp, Mus musculus
ctcccaggtcggtgttttatctgct

SEQ ID NO: 268407 - DNA, 25 bp, Mus musculus
ctcccaggtgcaaccagagctgcct

SEQ ID NO: 268408 - DNA, 25 bp, Mus musculus
ctcccagtgacgtactggattgtgc

SEQ ID NO: 268409 - DNA, 25 bp, Mus musculus
ctcccagtggcacagatgccctagg

SEQ ID NO: 268410 - DNA, 25 bp, Mus musculus
ctcccagtggcacaggtctccaccg

SEQ ID NO: 268411 - DNA, 25 bp, Mus musculus
ctcccagtgtgctccaactgctgga

SEQ ID NO: 268412 - DNA, 25 bp, Mus musculus
ctcccatactcggtccctgaatggc

SEQ ID NO: 268413 - DNA, 25 bp, Mus musculus
ctcccatatgtgaaggaagaagaaa

SEQ ID NO: 268414 - DNA, 25 bp, Mus musculus
ctcccatcactcagggaaaccttag

SEQ ID NO: 268415 - DNA, 25 bp, Mus musculus
ctcccatcactcaggtcgctgttat

SEQ ID NO: 268416 - DNA, 25 bp, Mus musculus
ctcccatcagcaagccaccaccacg

SEQ ID NO: 268417 - DNA, 25 bp, Mus musculus
ctcccatcagcaagccccgcccaac

SEQ ID NO: 268418 - DNA, 25 bp, Mus musculus
ctcccatcaggaggaggagatagaa

SEQ ID NO: 268419 - DNA, 25 bp, Mus musculus
ctcccatcatttgaggctctttcac

SEQ ID NO: 268420 - DNA, 25 bp, Mus musculus
ctcccatcctgaagtttatcccgat

SEQ ID NO: 268421 - DNA, 25 bp, Mus musculus
ctcccatgaagaaaaaagatgttgg

SEQ ID NO: 268422 - DNA, 25 bp, Mus musculus
ctcccatgatgaccctatcaaggag

SEQ ID NO: 268423 - DNA, 25 bp, Mus musculus
ctcccatgattaatgaattagtaga

SEQ ID NO: 268424 - DNA, 25 bp, Mus musculus
ctcccatgcccgtggctgttcgacg

SEQ ID NO: 268425 - DNA, 25 bp, Mus musculus
ctcccattcttctgggtcggatgct

SEQ ID NO: 268426 - DNA, 25 bp, Mus musculus
ctcccattgagtagatttgaaagaa

SEQ ID NO: 268427 - DNA, 25 bp, Mus musculus
ctccccaaaacgcagctgcagcact

SEQ ID NO: 268428 - DNA, 25 bp, Mus musculus
ctccccaaaacgcaggaccatcaga

SEQ ID NO: 268429 - DNA, 25 bp, Mus musculus
ctccccaaagaccctctatgggatc

SEQ ID NO: 268430 - DNA, 25 bp, Mus musculus
ctccccaaaggatggctccatctcc

SEQ ID NO: 268431 - DNA, 25 bp, Mus musculus
ctccccaacagggagttggcacggg

SEQ ID NO: 268432 - DNA, 25 bp, Mus musculus
ctccccaacaggtaattggcacggg

SEQ ID NO: 268433 - DNA, 25 bp, Mus musculus
ctccccaacctcagctttctgacct

SEQ ID NO: 268434 - DNA, 25 bp, Mus musculus
ctccccaagtacccgcctacagttt

SEQ ID NO: 268435 - DNA, 25 bp, Mus musculus
ctccccaatcagagtgcggagatcc

SEQ ID NO: 268436 - DNA, 25 bp, Mus musculus
ctccccacagaggtggaagcacttc

SEQ ID NO: 268437 - DNA, 25 bp, Mus musculus
ctccccaccagcacctcctaccggc

SEQ ID NO: 268438 - DNA, 25 bp, Mus musculus
ctccccagaagacccagccagcagc

SEQ ID NO: 268439 - DNA, 25 bp, Mus musculus
ctccccagaagtctggagagctgtg

SEQ ID NO: 268440 - DNA, 25 bp, Mus musculus
ctccccagaccagatcatccagccc

SEQ ID NO: 268441 - DNA, 25 bp, Mus musculus
ctccccagaccaggatgaggaggag

SEQ ID NO: 268442 - DNA, 25 bp, Mus musculus
ctccccagagcaggagactctgagt

SEQ ID NO: 268443 - DNA, 25 bp, Mus musculus
ctccccagagcagtgctaccatctc

SEQ ID NO: 268444 - DNA, 25 bp, Mus musculus
ctccccagatgtctgatacatatct

SEQ ID NO: 268445 - DNA, 25 bp, Mus musculus
ctccccagatgtctggagtggatga

SEQ ID NO: 268446 - DNA, 25 bp, Mus musculus
ctccccagcaacaattgaaatggcg

SEQ ID NO: 268447 - DNA, 25 bp, Mus musculus
ctccccagcaacactgcaatggctg

SEQ ID NO: 268448 - DNA, 25 bp, Mus musculus
ctccccagcagtcagggcatctgtt

SEQ ID NO: 268449 - DNA, 25 bp, Mus musculus
ctccccagcctgacgggaggaaaac

SEQ ID NO: 268450 - DNA, 25 bp, Mus musculus
ctccccagcctgacgtttctcttca

SEQ ID NO: 268451 - DNA, 25 bp, Mus musculus
ctccccagcgaggggacaaaggcgt

SEQ ID NO: 268452 - DNA, 25 bp, Mus musculus
ctccccagtacaaagcccagcacct

SEQ ID NO: 268453 - DNA, 25 bp, Mus musculus
ctccccagtacaaagctgtcttgat

SEQ ID NO: 268454 - DNA, 25 bp, Mus musculus
ctccccagtacaaaggacaaagcca

SEQ ID NO: 268455 - DNA, 25 bp, Mus musculus
ctccccagtacaaagggaagtgtgg

SEQ ID NO: 268456 - DNA, 25 bp, Mus musculus
ctccccagtacaaaggggaccatgg

SEQ ID NO: 268457 - DNA, 25 bp, Mus musculus
ctccccagtacaaaggtgtctcttg

SEQ ID NO: 268458 - DNA, 25 bp, Mus musculus
ctccccagtacaaaggtgtggtatc

SEQ ID NO: 268459 - DNA, 25 bp, Mus musculus
ctccccagtcctcaggttctaagcg

SEQ ID NO: 268460 - DNA, 25 bp, Mus musculus
ctccccatcagctgtttctccaaac

SEQ ID NO: 268461 - DNA, 25 bp, Mus musculus
ctccccatcaggtttggacatatgc

SEQ ID NO: 268462 - DNA, 25 bp, Mus musculus
ctccccatgagaaattgccagtagt

SEQ ID NO: 268463 - DNA, 25 bp, Mus musculus
ctccccatggaagtctgctcgactg

SEQ ID NO: 268464 - DNA, 25 bp, Mus musculus
ctcccccaaggaggcggacgctcag

SEQ ID NO: 268465 - DNA, 25 bp, Mus musculus
ctcccccaaggaggtctctgagtgt

SEQ ID NO: 268466 - DNA, 25 bp, Mus musculus
ctcccccaggaggcatcacagcaga

SEQ ID NO: 268467 - DNA, 25 bp, Mus musculus
ctcccccaggctggagagaatgaag

SEQ ID NO: 268468 - DNA, 25 bp, Mus musculus
ctcccccagtagaaatcgcagcctg

SEQ ID NO: 268469 - DNA, 25 bp, Mus musculus
ctcccccagtgccctgggcaaggcc

SEQ ID NO: 268470 - DNA, 25 bp, Mus musculus
ctcccccgcacttctagacagctgt

SEQ ID NO: 268471 - DNA, 25 bp, Mus musculus
ctccccctcagatccaacactcctt

SEQ ID NO: 268472 - DNA, 25 bp, Mus musculus
ctccccctcagggatccgtgaacca

SEQ ID NO: 268473 - DNA, 25 bp, Mus musculus
ctccccctggaccgggagcagaatg

SEQ ID NO: 268474 - DNA, 25 bp, Mus musculus
ctccccctggggtctggagggagag

SEQ ID NO: 268475 - DNA, 25 bp, Mus musculus
ctcccccttagacactactttgctc

SEQ ID NO: 268476 - DNA, 25 bp, Mus musculus
ctcccccttctacttcagagccacc

SEQ ID NO: 268477 - DNA, 25 bp, Mus musculus
ctccccgaaactcagttccagagcc

SEQ ID NO: 268478 - DNA, 25 bp, Mus musculus
ctccccgacgcaggtcctacggcct

SEQ ID NO: 268479 - DNA, 25 bp, Mus musculus
ctccccgacgcaggtgttctttgac

SEQ ID NO: 268480 - DNA, 25 bp, Mus musculus
ctccccgcgccacggacaagtgacg

SEQ ID NO: 268481 - DNA, 25 bp, Mus musculus
ctccccgctctgctgccctgaatct

SEQ ID NO: 268482 - DNA, 25 bp, Mus musculus
ctccccgctgcagatttgcaacagc

SEQ ID NO: 268483 - DNA, 25 bp, Mus musculus
ctccccgcttccgctctcgggaccg

SEQ ID NO: 268484 - DNA, 25 bp, Mus musculus
ctccccggccagacagcaattcctc

SEQ ID NO: 268485 - DNA, 25 bp, Mus musculus
ctccccggccagatgaggacaagcc

SEQ ID NO: 268486 - DNA, 25 bp, Mus musculus
ctccccggccagtggctcttgaccg

SEQ ID NO: 268487 - DNA, 25 bp, Mus musculus
ctccccggcccacgaagcatgtaat

SEQ ID NO: 268488 - DNA, 25 bp, Mus musculus
ctccccggcggagatgaggaaactg

SEQ ID NO: 268489 - DNA, 25 bp, Mus musculus
ctccccggcggaggtgtgaccccac

SEQ ID NO: 268490 - DNA, 25 bp, Mus musculus
ctccccggctgagagtctccagagc

SEQ ID NO: 268491 - DNA, 25 bp, Mus musculus
ctccccgtaatgctggtgagattgg

SEQ ID NO: 268492 - DNA, 25 bp, Mus musculus
ctccccgtaattacgctggggagga

SEQ ID NO: 268493 - DNA, 25 bp, Mus musculus
ctccccgtcagcccggttagcttta

SEQ ID NO: 268494 - DNA, 25 bp, Mus musculus
ctccccgtggacaagtccctgctcc

SEQ ID NO: 268495 - DNA, 25 bp, Mus musculus
ctccccgttaggccagcaggtggcc

SEQ ID NO: 268496 - DNA, 25 bp, Mus musculus
ctcccctacacccgggtcaatgcag

SEQ ID NO: 268497 - DNA, 25 bp, Mus musculus
ctcccctacagttggagtaaaaatg

SEQ ID NO: 268498 - DNA, 25 bp, Mus musculus
ctcccctacagttggcgtaggagtg

SEQ ID NO: 268499 - DNA, 25 bp, Mus musculus
ctcccctacatctggacattggcac

SEQ ID NO: 268500 - DNA, 25 bp, Mus musculus
ctcccctacatctggcattcaggac

SEQ ID NO: 268501 - DNA, 25 bp, Mus musculus
ctcccctacatctgggctggttacc

SEQ ID NO: 268502 - DNA, 25 bp, Mus musculus
ctcccctatatcagtgacacaggaa

SEQ ID NO: 268503 - DNA, 25 bp, Mus musculus
ctcccctcaggctggcctgccttcc

SEQ ID NO: 268504 - DNA, 25 bp, Mus musculus
ctcccctcagggtcatgtagggata

SEQ ID NO: 268505 - DNA, 25 bp, Mus musculus
ctcccctccactcagcttcccatgc

SEQ ID NO: 268506 - DNA, 25 bp, Mus musculus
ctcccctcccaccggtgcctgctgt

SEQ ID NO: 268507 - DNA, 25 bp, Mus musculus
ctcccctccgaaaatgccatcccgc

SEQ ID NO: 268508 - DNA, 25 bp, Mus musculus
ctcccctccgaaactgtctgcccag

SEQ ID NO: 268509 - DNA, 25 bp, Mus musculus
ctcccctcgaagcagcaccgggact

SEQ ID NO: 268510 - DNA, 25 bp, Mus musculus
ctcccctctggccagacagtctgct

SEQ ID NO: 268511 - DNA, 25 bp, Mus musculus
ctcccctctggccaggcagttattc

SEQ ID NO: 268512 - DNA, 25 bp, Mus musculus
ctcccctgcccaagctgtgctggat

SEQ ID NO: 268513 - DNA, 25 bp, Mus musculus
ctcccctgcgagggtggctgctgct

SEQ ID NO: 268514 - DNA, 25 bp, Mus musculus
ctcccctgctttagtttcctgacag

SEQ ID NO: 268515 - DNA, 25 bp, Mus musculus
ctcccctggcgacggttaccacagt

SEQ ID NO: 268516 - DNA, 25 bp, Mus musculus
ctcccctgtgagggctgaactgaaa

SEQ ID NO: 268517 - DNA, 25 bp, Mus musculus
ctccccttagcagctcaagcccacc

SEQ ID NO: 268518 - DNA, 25 bp, Mus musculus
ctccccttcaggccagaaggtttgg

SEQ ID NO: 268519 - DNA, 25 bp, Mus musculus
ctccccttccccaggatgacagagg

SEQ ID NO: 268520 - DNA, 25 bp, Mus musculus
ctccccttggggccttctagccctc

SEQ ID NO: 268521 - DNA, 25 bp, Mus musculus
ctcccctttcgagagggagaatccc

SEQ ID NO: 268522 - DNA, 25 bp, Mus musculus
ctccccttttctgggtaacacaagg

SEQ ID NO: 268523 - DNA, 25 bp, Mus musculus
ctcccgaaaccaagtggagctgatt

SEQ ID NO: 268524 - DNA, 25 bp, Mus musculus
ctcccgaaactgaccactgcggcac

SEQ ID NO: 268525 - DNA, 25 bp, Mus musculus
ctcccgaaattcctgggcagagctg

SEQ ID NO: 268526 - DNA, 25 bp, Mus musculus
ctcccgagagagggaaacaacagta

SEQ ID NO: 268527 - DNA, 25 bp, Mus musculus
ctcccgagagagggtcagcctctca

SEQ ID NO: 268528 - DNA, 25 bp, Mus musculus
ctcccgagaggcacgcccccattgg

SEQ ID NO: 268529 - DNA, 25 bp, Mus musculus
ctcccgagaggcacgggcaatgagg

SEQ ID NO: 268530 - DNA, 25 bp, Mus musculus
ctcccgagcaggcagcaaacagaaa

SEQ ID NO: 268531 - DNA, 25 bp, Mus musculus
ctcccgagctcctcgagcctaaccc

SEQ ID NO: 268532 - DNA, 25 bp, Mus musculus
ctcccgagctcctcgctgtgatcac

SEQ ID NO: 268533 - DNA, 25 bp, Mus musculus
ctcccgagtgcctgtgctggtggag

SEQ ID NO: 268534 - DNA, 25 bp, Mus musculus
ctcccgagtgccttagtcctgggct

SEQ ID NO: 268535 - DNA, 25 bp, Mus musculus
ctcccgcaaagacaggtggtgtccg

SEQ ID NO: 268536 - DNA, 25 bp, Mus musculus
ctcccgcaagacgcttaaaggatgg

SEQ ID NO: 268537 - DNA, 25 bp, Mus musculus
ctcccgcagcgtgagccagtgggtg

SEQ ID NO: 268538 - DNA, 25 bp, Mus musculus
ctcccgcagcgtgaggtcctggtat

SEQ ID NO: 268539 - DNA, 25 bp, Mus musculus
ctcccgccaaacgccatgagaattt

SEQ ID NO: 268540 - DNA, 25 bp, Mus musculus
ctcccgccagagctcaggccctgga

SEQ ID NO: 268541 - DNA, 25 bp, Mus musculus
ctcccgccagctcaaggtgatgctg

SEQ ID NO: 268542 - DNA, 25 bp, Mus musculus
ctcccgccaggagaatggtgccagc

SEQ ID NO: 268543 - DNA, 25 bp, Mus musculus
ctcccgcccccagcgcctgctctgg

SEQ ID NO: 268544 - DNA, 25 bp, Mus musculus
ctcccgcccctggtgtgctaccacc

SEQ ID NO: 268545 - DNA, 25 bp, Mus musculus
ctcccgcccgctgaaaaaattgtgc

SEQ ID NO: 268546 - DNA, 25 bp, Mus musculus
ctcccgcctcgggttgctgttctgg

SEQ ID NO: 268547 - DNA, 25 bp, Mus musculus
ctcccgctgctcctgggtgctggcc

SEQ ID NO: 268548 - DNA, 25 bp, Mus musculus
ctcccgctttgggaaattcatcagg

SEQ ID NO: 268549 - DNA, 25 bp, Mus musculus
ctcccggaaagtgaattatacttca

SEQ ID NO: 268550 - DNA, 25 bp, Mus musculus
ctcccggaaggaaggtcggcagctc

SEQ ID NO: 268551 - DNA, 25 bp, Mus musculus
ctcccggagaggtgtcgcggaagat

SEQ ID NO: 268552 - DNA, 25 bp, Mus musculus
ctcccggagccaagatcccattctc

SEQ ID NO: 268553 - DNA, 25 bp, Mus musculus
ctcccggagccaagtggttgatcgg

SEQ ID NO: 268554 - DNA, 25 bp, Mus musculus
ctcccggaggaagcctcaagcacag

SEQ ID NO: 268555 - DNA, 25 bp, Mus musculus
ctcccggaggaaggtgttcctggtg

SEQ ID NO: 268556 - DNA, 25 bp, Mus musculus
ctcccggatttctgcaccccctgga

SEQ ID NO: 268557 - DNA, 25 bp, Mus musculus
ctcccggcagaggagcctggaggag

SEQ ID NO: 268558 - DNA, 25 bp, Mus musculus
ctcccggctagagaacatgaatggc

SEQ ID NO: 268559 - DNA, 25 bp, Mus musculus
ctcccggctagagatcggaatgtgc

SEQ ID NO: 268560 - DNA, 25 bp, Mus musculus
ctcccggctctgtggtgccttagct

SEQ ID NO: 268561 - DNA, 25 bp, Mus musculus
ctcccgggagatgcagcttcagaag

SEQ ID NO: 268562 - DNA, 25 bp, Mus musculus
ctcccgggagcagagaagaaagcga

SEQ ID NO: 268563 - DNA, 25 bp, Mus musculus
ctcccgggagcagtgatgaaaagac

SEQ ID NO: 268564 - DNA, 25 bp, Mus musculus
ctcccgggagcggggcagccacaga

SEQ ID NO: 268565 - DNA, 25 bp, Mus musculus
ctcccgggagcggtcgagctagagg

SEQ ID NO: 268566 - DNA, 25 bp, Mus musculus
ctcccgggaggctcaccatcatgga

SEQ ID NO: 268567 - DNA, 25 bp, Mus musculus
ctcccgggccaaggctagccaacga

SEQ ID NO: 268568 - DNA, 25 bp, Mus musculus
ctcccggggcatagccaccccgctg

SEQ ID NO: 268569 - DNA, 25 bp, Mus musculus
ctcccgtattaggagacacagaagg

SEQ ID NO: 268570 - DNA, 25 bp, Mus musculus
ctcccgtccgaggtacccagactca

SEQ ID NO: 268571 - DNA, 25 bp, Mus musculus
ctcccgtccgaggtgtgaatgacag

SEQ ID NO: 268572 - DNA, 25 bp, Mus musculus
ctcccgtgagcacttcattcaaggc

SEQ ID NO: 268573 - DNA, 25 bp, Mus musculus
ctcccgtgaggttcttgtagtgcta

SEQ ID NO: 268574 - DNA, 25 bp, Mus musculus
ctcccgtgcacccagaaaacgaaga

SEQ ID NO: 268575 - DNA, 25 bp, Mus musculus
ctcccgtgggggcagtaaatgatgc

SEQ ID NO: 268576 - DNA, 25 bp, Mus musculus
ctcccgtggtgcgaaagaaaaagtc

SEQ ID NO: 268577 - DNA, 25 bp, Mus musculus
ctcccgtttgagcccggttcctgga

SEQ ID NO: 268578 - DNA, 25 bp, Mus musculus
ctcccgtttggtgaactgactctac

SEQ ID NO: 268579 - DNA, 25 bp, Mus musculus
ctccctaaagttgcagaattaagaa

SEQ ID NO: 268580 - DNA, 25 bp, Mus musculus
ctccctacaagtccctgagttggaa

SEQ ID NO: 268581 - DNA, 25 bp, Mus musculus
ctccctacagagatgggagaccgtt

SEQ ID NO: 268582 - DNA, 25 bp, Mus musculus
ctccctacagaggagaatttagagc

SEQ ID NO: 268583 - DNA, 25 bp, Mus musculus
ctccctacagaggtgtgtcagagct

SEQ ID NO: 268584 - DNA, 25 bp, Mus musculus
ctccctaccaggaggaagcagtggc

SEQ ID NO: 268585 - DNA, 25 bp, Mus musculus
ctccctacggcatagtgccgtccag

SEQ ID NO: 268586 - DNA, 25 bp, Mus musculus
ctccctacggcatgaaacagaagag

SEQ ID NO: 268587 - DNA, 25 bp, Mus musculus
ctccctactgagtggccaccctttg

SEQ ID NO: 268588 - DNA, 25 bp, Mus musculus
ctccctagaagatggattcatgggt

SEQ ID NO: 268589 - DNA, 25 bp, Mus musculus
ctccctagaagggcaacaacccgga

SEQ ID NO: 268590 - DNA, 25 bp, Mus musculus
ctccctagcaaaactcttccaagtg

SEQ ID NO: 268591 - DNA, 25 bp, Mus musculus
ctccctagtagatccactgtgggtg

SEQ ID NO: 268592 - DNA, 25 bp, Mus musculus
ctccctatggcactggtatctcatt

SEQ ID NO: 268593 - DNA, 25 bp, Mus musculus
ctccctatgtcccatcttgtcaagt

SEQ ID NO: 268594 - DNA, 25 bp, Mus musculus
ctccctcaaaccccggcttcttcac

SEQ ID NO: 268595 - DNA, 25 bp, Mus musculus
ctccctcaaagatgaacgagaccgt

SEQ ID NO: 268596 - DNA, 25 bp, Mus musculus
ctccctcaagaacaaagtcacaatc

SEQ ID NO: 268597 - DNA, 25 bp, Mus musculus
ctccctcaagacatctccgacccca

SEQ ID NO: 268598 - DNA, 25 bp, Mus musculus
ctccctcaagattcaaacagacaag

SEQ ID NO: 268599 - DNA, 25 bp, Mus musculus
ctccctcaagtgctgcattgacctg

SEQ ID NO: 268600 - DNA, 25 bp, Mus musculus
ctccctcacagaccaagtctgaaac

SEQ ID NO: 268601 - DNA, 25 bp, Mus musculus
ctccctcaccaagcttagcaaggag

SEQ ID NO: 268602 - DNA, 25 bp, Mus musculus
ctccctcaccttgttttctgctcat

SEQ ID NO: 268603 - DNA, 25 bp, Mus musculus
ctccctcactgcactaacctttgag

SEQ ID NO: 268604 - DNA, 25 bp, Mus musculus
ctccctcactggtgagaatgtccgg

SEQ ID NO: 268605 - DNA, 25 bp, Mus musculus
ctccctcagcagcaggtcctgggag

SEQ ID NO: 268606 - DNA, 25 bp, Mus musculus
ctccctcagctgctcctggacttct

SEQ ID NO: 268607 - DNA, 25 bp, Mus musculus
ctccctcatccacgaaggttttgca

SEQ ID NO: 268608 - DNA, 25 bp, Mus musculus
ctccctcatccacggtttgtggaat

SEQ ID NO: 268609 - DNA, 25 bp, Mus musculus
ctccctccaaatttgggcagacatt

SEQ ID NO: 268610 - DNA, 25 bp, Mus musculus
ctccctccaactctacaccctcgcc

SEQ ID NO: 268611 - DNA, 25 bp, Mus musculus
ctccctccagacatggaccctacca

SEQ ID NO: 268612 - DNA, 25 bp, Mus musculus
ctccctccagactccatctgcgcag

SEQ ID NO: 268613 - DNA, 25 bp, Mus musculus
ctccctccagcgccaacgtcaccat

SEQ ID NO: 268614 - DNA, 25 bp, Mus musculus
ctccctcccagctgatggttcctgg

SEQ ID NO: 268615 - DNA, 25 bp, Mus musculus
ctccctcccatgcagccacctggac

SEQ ID NO: 268616 - DNA, 25 bp, Mus musculus
ctccctcccgatgagaagaagcaaa

SEQ ID NO: 268617 - DNA, 25 bp, Mus musculus
ctccctcccgggatatttgcttgaa

SEQ ID NO: 268618 - DNA, 25 bp, Mus musculus
ctccctccctggcagggggaggagg

SEQ ID NO: 268619 - DNA, 25 bp, Mus musculus
ctccctccgcggaaatctaccagag

SEQ ID NO: 268620 - DNA, 25 bp, Mus musculus
ctccctcctggtaccagactctcat

SEQ ID NO: 268621 - DNA, 25 bp, Mus musculus
ctccctcgcagttcttgaacacttc

SEQ ID NO: 268622 - DNA, 25 bp, Mus musculus
ctccctcggagaaaggccagccatg

SEQ ID NO: 268623 - DNA, 25 bp, Mus musculus
ctccctcgggagcaggtttcaacac

SEQ ID NO: 268624 - DNA, 25 bp, Mus musculus
ctccctctggctctctcaaaagaaa

SEQ ID NO: 268625 - DNA, 25 bp, Mus musculus
ctccctctgtcaagggggtgtcgtt

SEQ ID NO: 268626 - DNA, 25 bp, Mus musculus
ctccctctgtcaagttaacactcac

SEQ ID NO: 268627 - DNA, 25 bp, Mus musculus
ctccctcttcacctcgctgaggtga

SEQ ID NO: 268628 - DNA, 25 bp, Mus musculus
ctccctcttcatgacacccctggat

SEQ ID NO: 268629 - DNA, 25 bp, Mus musculus
ctccctgaactcggctgcacggctc

SEQ ID NO: 268630 - DNA, 25 bp, Mus musculus
ctccctgacaaacgtgactctcggg

SEQ ID NO: 268631 - DNA, 25 bp, Mus musculus
ctccctgacaaaggtgactctcggg

SEQ ID NO: 268632 - DNA, 25 bp, Mus musculus
ctccctgacagaggatggtttgttt

SEQ ID NO: 268633 - DNA, 25 bp, Mus musculus
ctccctgacagctatattgtcttca

SEQ ID NO: 268634 - DNA, 25 bp, Mus musculus
ctccctgacaggcccgagcctacgt

SEQ ID NO: 268635 - DNA, 25 bp, Mus musculus
ctccctgacaggggagagcacccct

SEQ ID NO: 268636 - DNA, 25 bp, Mus musculus
ctccctgactcgatggcaccgcatg

SEQ ID NO: 268637 - DNA, 25 bp, Mus musculus
ctccctgagcagattgaacgggctg

SEQ ID NO: 268638 - DNA, 25 bp, Mus musculus
ctccctgagccggaggttccaggat

SEQ ID NO: 268639 - DNA, 25 bp, Mus musculus
ctccctgaggaacagaaaatgttaa

SEQ ID NO: 268640 - DNA, 25 bp, Mus musculus
ctccctgaggaacagatcctggaga

SEQ ID NO: 268641 - DNA, 25 bp, Mus musculus
ctccctgaggggtacctcggaatcg

SEQ ID NO: 268642 - DNA, 25 bp, Mus musculus
ctccctgagtggctatggagttact

SEQ ID NO: 268643 - DNA, 25 bp, Mus musculus
ctccctgagtttgacgactctgact

SEQ ID NO: 268644 - DNA, 25 bp, Mus musculus
ctccctgatcaagatggactgtaac

SEQ ID NO: 268645 - DNA, 25 bp, Mus musculus
ctccctgcacaggggtgacagtcca

SEQ ID NO: 268646 - DNA, 25 bp, Mus musculus
ctccctgcactccccaggaccccaa

SEQ ID NO: 268647 - DNA, 25 bp, Mus musculus
ctccctgcagcttgacgtggccggt

SEQ ID NO: 268648 - DNA, 25 bp, Mus musculus
ctccctgcagggtcccacaaaacag

SEQ ID NO: 268649 - DNA, 25 bp, Mus musculus
ctccctgcatgtacccctcaatgga

SEQ ID NO: 268650 - DNA, 25 bp, Mus musculus
ctccctgccgggctgtgcctctcct

SEQ ID NO: 268651 - DNA, 25 bp, Mus musculus
ctccctgccttcagccatctgcaag

SEQ ID NO: 268652 - DNA, 25 bp, Mus musculus
ctccctgctccggcaagacattgct

SEQ ID NO: 268653 - DNA, 25 bp, Mus musculus
ctccctggaacgggtgaagttgatt

SEQ ID NO: 268654 - DNA, 25 bp, Mus musculus
ctccctggaaggggagccccgcaag

SEQ ID NO: 268655 - DNA, 25 bp, Mus musculus
ctccctggaaggtggaacctagggt

SEQ ID NO: 268656 - DNA, 25 bp, Mus musculus
ctccctggaccaaggtgcttcacct

SEQ ID NO: 268657 - DNA, 25 bp, Mus musculus
ctccctggaccacctctgccctccc

SEQ ID NO: 268658 - DNA, 25 bp, Mus musculus
ctccctggacccaggctgccctgcc

SEQ ID NO: 268659 - DNA, 25 bp, Mus musculus
ctccctggaggtggagccttttgcc

SEQ ID NO: 268660 - DNA, 25 bp, Mus musculus
ctccctggaggtttgcctcaaatac

SEQ ID NO: 268661 - DNA, 25 bp, Mus musculus
ctccctggatccaggcttacaatta

SEQ ID NO: 268662 - DNA, 25 bp, Mus musculus
ctccctggattcagtcatttgaaga

SEQ ID NO: 268663 - DNA, 25 bp, Mus musculus
ctccctggcattagggcaggctgga

SEQ ID NO: 268664 - DNA, 25 bp, Mus musculus
ctccctggcattagtacactgtagc

SEQ ID NO: 268665 - DNA, 25 bp, Mus musculus
ctccctggcgagtgactcagacccg

SEQ ID NO: 268666 - DNA, 25 bp, Mus musculus
ctccctgggctgtggtggtgagaag

SEQ ID NO: 268667 - DNA, 25 bp, Mus musculus
ctccctggggaaagctactgggatg

SEQ ID NO: 268668 - DNA, 25 bp, Mus musculus
ctccctgggtgtcactggtgcagac

SEQ ID NO: 268669 - DNA, 25 bp, Mus musculus
ctccctggtcgtaatggagataggg

SEQ ID NO: 268670 - DNA, 25 bp, Mus musculus
ctccctgtcacagattgaaatggat

SEQ ID NO: 268671 - DNA, 25 bp, Mus musculus
ctccctgtccgtcaagtttggaaat

SEQ ID NO: 268672 - DNA, 25 bp, Mus musculus
ctccctgtcggtgagatgggtgcaa

SEQ ID NO: 268673 - DNA, 25 bp, Mus musculus
ctccctgttaagcatcaacatttct

SEQ ID NO: 268674 - DNA, 25 bp, Mus musculus
ctcccttcagagggaggggcgacat

SEQ ID NO: 268675 - DNA, 25 bp, Mus musculus
ctcccttcccctcagagttgtctgc

SEQ ID NO: 268676 - DNA, 25 bp, Mus musculus
ctcccttcccctcaggagtggagtc

SEQ ID NO: 268677 - DNA, 25 bp, Mus musculus
ctcccttcccctcaggggtgatcca

SEQ ID NO: 268678 - DNA, 25 bp, Mus musculus
ctcccttccggctggccacccccat

SEQ ID NO: 268679 - DNA, 25 bp, Mus musculus
ctcccttctggtcagtgttcacacc

SEQ ID NO: 268680 - DNA, 25 bp, Mus musculus
ctcccttgggaagccggaggaagct

SEQ ID NO: 268681 - DNA, 25 bp, Mus musculus
ctcccttgggaatttagaagccgga

SEQ ID NO: 268682 - DNA, 25 bp, Mus musculus
ctcccttggggttctcacgcggttt

SEQ ID NO: 268683 - DNA, 25 bp, Mus musculus
ctcccttgtggtgtgaacattggcg

SEQ ID NO: 268684 - DNA, 25 bp, Mus musculus
ctccctttcggcttcgtgagcttcg

SEQ ID NO: 268685 - DNA, 25 bp, Mus musculus
ctccctttgcgcacaggttacatcg

SEQ ID NO: 268686 - DNA, 25 bp, Mus musculus
ctccctttgggttctcaggccgcct

SEQ ID NO: 268687 - DNA, 25 bp, Mus musculus
ctccgaaaggcccgacgactctttg

SEQ ID NO: 268688 - DNA, 25 bp, Mus musculus
ctccgaaatcaggcagaagaggagc

SEQ ID NO: 268689 - DNA, 25 bp, Mus musculus
ctccgaacaacaaagaatctgaagc

SEQ ID NO: 268690 - DNA, 25 bp, Mus musculus
ctccgaacctgattcacagatggag

SEQ ID NO: 268691 - DNA, 25 bp, Mus musculus
ctccgaagactgaaactgttatggt

SEQ ID NO: 268692 - DNA, 25 bp, Mus musculus
ctccgaagggtccagggtctcaggt

SEQ ID NO: 268693 - DNA, 25 bp, Mus musculus
ctccgaagtgaggggcttgcagatg

SEQ ID NO: 268694 - DNA, 25 bp, Mus musculus
ctccgaatagcagcttcttcggctg

SEQ ID NO: 268695 - DNA, 25 bp, Mus musculus
ctccgaatttatgttgaaaaacatt

SEQ ID NO: 268696 - DNA, 25 bp, Mus musculus
ctccgacaaatgcaggaatgtgcta

SEQ ID NO: 268697 - DNA, 25 bp, Mus musculus
ctccgacaactggaggaagagcagt

SEQ ID NO: 268698 - DNA, 25 bp, Mus musculus
ctccgacaagatgaaagaaacaatc

SEQ ID NO: 268699 - DNA, 25 bp, Mus musculus
ctccgacatcgatcctgcagtagta

SEQ ID NO: 268700 - DNA, 25 bp, Mus musculus
ctccgacatcggcagacagacacaa

SEQ ID NO: 268701 - DNA, 25 bp, Mus musculus
ctccgacatcgtgatccgggccaaa

SEQ ID NO: 268702 - DNA, 25 bp, Mus musculus
ctccgaccaggagtcaaactgaccc

SEQ ID NO: 268703 - DNA, 25 bp, Mus musculus
ctccgacccacagatccctctagct

SEQ ID NO: 268704 - DNA, 25 bp, Mus musculus
ctccgacccaccacgggagccaggt

SEQ ID NO: 268705 - DNA, 25 bp, Mus musculus
ctccgacccgggcaggagctgggag

SEQ ID NO: 268706 - DNA, 25 bp, Mus musculus
ctccgacccgttgatgtgacccggt

SEQ ID NO: 268707 - DNA, 25 bp, Mus musculus
ctccgactaaatagctggaccacgt

SEQ ID NO: 268708 - DNA, 25 bp, Mus musculus
ctccgactcagatcagctcgaacgg

SEQ ID NO: 268709 - DNA, 25 bp, Mus musculus
ctccgactcagattctttatacaat

SEQ ID NO: 268710 - DNA, 25 bp, Mus musculus
ctccgactcttgaagaacatatccc

SEQ ID NO: 268711 - DNA, 25 bp, Mus musculus
ctccgactcttgaaggacatagatg

SEQ ID NO: 268712 - DNA, 25 bp, Mus musculus
ctccgagaaccagagggcacatctg

SEQ ID NO: 268713 - DNA, 25 bp, Mus musculus
ctccgagaaccagttgataaaatta

SEQ ID NO: 268714 - DNA, 25 bp, Mus musculus
ctccgagaagccccggcagcccaac

SEQ ID NO: 268715 - DNA, 25 bp, Mus musculus
ctccgagacagagacaaaatcacaa

SEQ ID NO: 268716 - DNA, 25 bp, Mus musculus
ctccgagagagcaagaaggagcaga

SEQ ID NO: 268717 - DNA, 25 bp, Mus musculus
ctccgagagaggtgccgttctctga

SEQ ID NO: 268718 - DNA, 25 bp, Mus musculus
ctccgagagtgctcccagaggttcc

SEQ ID NO: 268719 - DNA, 25 bp, Mus musculus
ctccgagattctggacctgtgtttg

SEQ ID NO: 268720 - DNA, 25 bp, Mus musculus
ctccgagcaggacacttggcaagca

SEQ ID NO: 268721 - DNA, 25 bp, Mus musculus
ctccgagcaggatgacagcaccagc

SEQ ID NO: 268722 - DNA, 25 bp, Mus musculus
ctccgagcagtcatcctttgcagga

SEQ ID NO: 268723 - DNA, 25 bp, Mus musculus
ctccgagccaggattgaaattccaa

SEQ ID NO: 268724 - DNA, 25 bp, Mus musculus
ctccgagcctcatggttcggagcga

SEQ ID NO: 268725 - DNA, 25 bp, Mus musculus
ctccgaggacagagccaccagccat

SEQ ID NO: 268726 - DNA, 25 bp, Mus musculus
ctccgaggacgactccttctatgaa

SEQ ID NO: 268727 - DNA, 25 bp, Mus musculus
ctccgaggacttcaccatccacgaa

SEQ ID NO: 268728 - DNA, 25 bp, Mus musculus
ctccgaggagctaatcagtgagatg

SEQ ID NO: 268729 - DNA, 25 bp, Mus musculus
ctccgaggagctaattctgaagtcc

SEQ ID NO: 268730 - DNA, 25 bp, Mus musculus
ctccgaggctgacaggtgagatctc

SEQ ID NO: 268731 - DNA, 25 bp, Mus musculus
ctccgagggcagctactgcaagaca

SEQ ID NO: 268732 - DNA, 25 bp, Mus musculus
ctccgagggcgggcggcgacagcag

SEQ ID NO: 268733 - DNA, 25 bp, Mus musculus
ctccgagtacatcaccaagcttttc

SEQ ID NO: 268734 - DNA, 25 bp, Mus musculus
ctccgagtctggatcatctctggac

SEQ ID NO: 268735 - DNA, 25 bp, Mus musculus
ctccgataggcagagcagctccatc

SEQ ID NO: 268736 - DNA, 25 bp, Mus musculus
ctccgataggcagaggtcagtacca

SEQ ID NO: 268737 - DNA, 25 bp, Mus musculus
ctccgatccaacagaccctcaggac

SEQ ID NO: 268738 - DNA, 25 bp, Mus musculus
ctccgatgatgcgggagggaccttg

SEQ ID NO: 268739 - DNA, 25 bp, Mus musculus
ctccgatgatgcggggggcctggat

SEQ ID NO: 268740 - DNA, 25 bp, Mus musculus
ctccgatgatgcgggtttctccggc

SEQ ID NO: 268741 - DNA, 25 bp, Mus musculus
ctccgatgtgtctgagctgtccagc

SEQ ID NO: 268742 - DNA, 25 bp, Mus musculus
ctccgcaaaaggttcgaaccttctt

SEQ ID NO: 268743 - DNA, 25 bp, Mus musculus
ctccgcaaaaggttggaagcaatcg

SEQ ID NO: 268744 - DNA, 25 bp, Mus musculus
ctccgcaaagagaggcagatgaagg

SEQ ID NO: 268745 - DNA, 25 bp, Mus musculus
ctccgcaaagccaaatcaaatagaa

SEQ ID NO: 268746 - DNA, 25 bp, Mus musculus
ctccgcaaaggcaccaccttccatg

SEQ ID NO: 268747 - DNA, 25 bp, Mus musculus
ctccgcaaagggtacacgcagctct

SEQ ID NO: 268748 - DNA, 25 bp, Mus musculus
ctccgcaaccgatcacttgtggaag

SEQ ID NO: 268749 - DNA, 25 bp, Mus musculus
ctccgcaaggaaaggctcctagaag

SEQ ID NO: 268750 - DNA, 25 bp, Mus musculus
ctccgcaccaacgttttgaggactt

SEQ ID NO: 268751 - DNA, 25 bp, Mus musculus
ctccgcaccacaggcaaatcctcct

SEQ ID NO: 268752 - DNA, 25 bp, Mus musculus
ctccgcaccagaggaacttctgcag

SEQ ID NO: 268753 - DNA, 25 bp, Mus musculus
ctccgcacctacctggcaggccatg

SEQ ID NO: 268754 - DNA, 25 bp, Mus musculus
ctccgcagacaagatgccttggatg

SEQ ID NO: 268755 - DNA, 25 bp, Mus musculus
ctccgcagacacccgctgtgagcgc

SEQ ID NO: 268756 - DNA, 25 bp, Mus musculus
ctccgcagacaccttccgccaagag

SEQ ID NO: 268757 - DNA, 25 bp, Mus musculus
ctccgcagaggtcgcagcgtgagca

SEQ ID NO: 268758 - DNA, 25 bp, Mus musculus
ctccgcagcaagatcgaggagctgg

SEQ ID NO: 268759 - DNA, 25 bp, Mus musculus
ctccgcagcaggatgagccggcagg

SEQ ID NO: 268760 - DNA, 25 bp, Mus musculus
ctccgcagcagtttacaatctgtat

SEQ ID NO: 268761 - DNA, 25 bp, Mus musculus
ctccgcagccagaggagtatctgat

SEQ ID NO: 268762 - DNA, 25 bp, Mus musculus
ctccgcagccagaggggctcggtct

SEQ ID NO: 268763 - DNA, 25 bp, Mus musculus
ctccgcagcccgaatcctattctat

SEQ ID NO: 268764 - DNA, 25 bp, Mus musculus
ctccgcagccgaggctcgcgctgta

SEQ ID NO: 268765 - DNA, 25 bp, Mus musculus
ctccgcagtgcccagacctgtgtta

SEQ ID NO: 268766 - DNA, 25 bp, Mus musculus
ctccgccaagtggtttgctggtgct

SEQ ID NO: 268767 - DNA, 25 bp, Mus musculus
ctccgccaccagggccagagcttga

SEQ ID NO: 268768 - DNA, 25 bp, Mus musculus
ctccgccagaagcctgcatccttag

SEQ ID NO: 268769 - DNA, 25 bp, Mus musculus
ctccgccagaggatccgtgaagagg

SEQ ID NO: 268770 - DNA, 25 bp, Mus musculus
ctccgccagagggacagtcggccca

SEQ ID NO: 268771 - DNA, 25 bp, Mus musculus
ctccgccagagggtgcactattcca

SEQ ID NO: 268772 - DNA, 25 bp, Mus musculus
ctccgccagctcccggttgcttcct

SEQ ID NO: 268773 - DNA, 25 bp, Mus musculus
ctccgccagtcaacaggagaagttt

SEQ ID NO: 268774 - DNA, 25 bp, Mus musculus
ctccgccatcgtaggtgccgatccc

SEQ ID NO: 268775 - DNA, 25 bp, Mus musculus
ctccgccatgacagatcagacctac

SEQ ID NO: 268776 - DNA, 25 bp, Mus musculus
ctccgcccacagagatgagccgcca

SEQ ID NO: 268777 - DNA, 25 bp, Mus musculus
ctccgcccagacggctcagaggtgg

SEQ ID NO: 268778 - DNA, 25 bp, Mus musculus
ctccgcccaggcaactgcgcagttc

SEQ ID NO: 268779 - DNA, 25 bp, Mus musculus
ctccgccccagaaaaaggagaagaa

SEQ ID NO: 268780 - DNA, 25 bp, Mus musculus
ctccgccgagcacagtgtatgaaga

SEQ ID NO: 268781 - DNA, 25 bp, Mus musculus
ctccgccgagccggaccgggctggt

SEQ ID NO: 268782 - DNA, 25 bp, Mus musculus
ctccgccgagcgcctcggtcctgaa

SEQ ID NO: 268783 - DNA, 25 bp, Mus musculus
ctccgccgaggaagaaaatactcgg

SEQ ID NO: 268784 - DNA, 25 bp, Mus musculus
ctccgccgggagggttgatttcttc

SEQ ID NO: 268785 - DNA, 25 bp, Mus musculus
ctccgccgggaggtcatggctgcag

SEQ ID NO: 268786 - DNA, 25 bp, Mus musculus
ctccgccggggcaaggtctgttcac

SEQ ID NO: 268787 - DNA, 25 bp, Mus musculus
ctccgcctacgtggcctataacatt

SEQ ID NO: 268788 - DNA, 25 bp, Mus musculus
ctccgcctcagatggcagtcaaaac

SEQ ID NO: 268789 - DNA, 25 bp, Mus musculus
ctccgcctcagtaccaaacgtctat

SEQ ID NO: 268790 - DNA, 25 bp, Mus musculus
ctccgcctttggcaactgcgagtgc

SEQ ID NO: 268791 - DNA, 25 bp, Mus musculus
ctccgcctttggcactgtagctatc

SEQ ID NO: 268792 - DNA, 25 bp, Mus musculus
ctccgcctttggcagtcagaccaag

SEQ ID NO: 268793 - DNA, 25 bp, Mus musculus
ctccgcgagccgcgaagccaaaaac

SEQ ID NO: 268794 - DNA, 25 bp, Mus musculus
ctccgcgagccgctggtgcacggca

SEQ ID NO: 268795 - DNA, 25 bp, Mus musculus
ctccgcgcacagcattagcagagac

SEQ ID NO: 268796 - DNA, 25 bp, Mus musculus
ctccgcgccgagaatcaagaactta

SEQ ID NO: 268797 - DNA, 25 bp, Mus musculus
ctccgcgccgagattaaaagaaagt

SEQ ID NO: 268798 - DNA, 25 bp, Mus musculus
ctccgcgctcgtgcaagttccctgg

SEQ ID NO: 268799 - DNA, 25 bp, Mus musculus
ctccgcggagcaggctgccgactac

SEQ ID NO: 268800 - DNA, 25 bp, Mus musculus
ctccgcggagcagggtaaaggccgg

SEQ ID NO: 268801 - DNA, 25 bp, Mus musculus
ctccgcggagcaggtctacaggctt

SEQ ID NO: 268802 - DNA, 25 bp, Mus musculus
ctccgcggaggaccctaggaaaatt

SEQ ID NO: 268803 - DNA, 25 bp, Mus musculus
ctccgcggaggtattacttggactt

SEQ ID NO: 268804 - DNA, 25 bp, Mus musculus
ctccgcggccgcaggcagcaggtgc

SEQ ID NO: 268805 - DNA, 25 bp, Mus musculus
ctccgcgggctgaggaaatataaga

SEQ ID NO: 268806 - DNA, 25 bp, Mus musculus
ctccgcgggctggccctccaagacc

SEQ ID NO: 268807 - DNA, 25 bp, Mus musculus
ctccgcgtgcggtttctagagcatc

SEQ ID NO: 268808 - DNA, 25 bp, Mus musculus
ctccgctacacccaagaatgtggca

SEQ ID NO: 268809 - DNA, 25 bp, Mus musculus
ctccgctacacccaagcgagcctgt

SEQ ID NO: 268810 - DNA, 25 bp, Mus musculus
ctccgctcacgaaaggcaagctgag

SEQ ID NO: 268811 - DNA, 25 bp, Mus musculus
ctccgctcacgtgctacctgtcctc

SEQ ID NO: 268812 - DNA, 25 bp, Mus musculus
ctccgctcaggaacgagttcaagta

SEQ ID NO: 268813 - DNA, 25 bp, Mus musculus
ctccgctcaggtaaacagaatctgg

SEQ ID NO: 268814 - DNA, 25 bp, Mus musculus
ctccgctcccactgcttcacacagg

SEQ ID NO: 268815 - DNA, 25 bp, Mus musculus
ctccgctcccactggcatgctagtc

SEQ ID NO: 268816 - DNA, 25 bp, Mus musculus
ctccgctctccgaatcaagctatag

SEQ ID NO: 268817 - DNA, 25 bp, Mus musculus
ctccgctgagaatatgtacttttct

SEQ ID NO: 268818 - DNA, 25 bp, Mus musculus
ctccgctggcgagcctccctgtgaa

SEQ ID NO: 268819 - DNA, 25 bp, Mus musculus
ctccgcttccgtgatgtgctaacga

SEQ ID NO: 268820 - DNA, 25 bp, Mus musculus
ctccggaaaagtttgtcaaagacat

SEQ ID NO: 268821 - DNA, 25 bp, Mus musculus
ctccggaaagggctctatcacggac

SEQ ID NO: 268822 - DNA, 25 bp, Mus musculus
ctccggaactcagatttcaactatt

SEQ ID NO: 268823 - DNA, 25 bp, Mus musculus
ctccggaagtaaggacaagaccagt

SEQ ID NO: 268824 - DNA, 25 bp, Mus musculus
ctccggacacagaatatccagttat

SEQ ID NO: 268825 - DNA, 25 bp, Mus musculus
ctccggacagaccatggcaacgtat

SEQ ID NO: 268826 - DNA, 25 bp, Mus musculus
ctccggacaggatgcatttgcttaa

SEQ ID NO: 268827 - DNA, 25 bp, Mus musculus
ctccggacagtttccttttagacca

SEQ ID NO: 268828 - DNA, 25 bp, Mus musculus
ctccggacttggacaaacacagcca

SEQ ID NO: 268829 - DNA, 25 bp, Mus musculus
ctccggacttggactgacctgaaaa

SEQ ID NO: 268830 - DNA, 25 bp, Mus musculus
ctccggagatcacagctgcacgagt

SEQ ID NO: 268831 - DNA, 25 bp, Mus musculus
ctccggagatcattataggtaaaag

SEQ ID NO: 268832 - DNA, 25 bp, Mus musculus
ctccggaggaaagccatcatgttaa

SEQ ID NO: 268833 - DNA, 25 bp, Mus musculus
ctccggaggaaaggatttctccata

SEQ ID NO: 268834 - DNA, 25 bp, Mus musculus
ctccggatctgatcgtctgccgtag

SEQ ID NO: 268835 - DNA, 25 bp, Mus musculus
ctccggatcttccggccccggaagc

SEQ ID NO: 268836 - DNA, 25 bp, Mus musculus
ctccggcaaatcagccacacagaga

SEQ ID NO: 268837 - DNA, 25 bp, Mus musculus
ctccggcaaattaggtctgactttg

SEQ ID NO: 268838 - DNA, 25 bp, Mus musculus
ctccggcaccggactttttcctagg

SEQ ID NO: 268839 - DNA, 25 bp, Mus musculus
ctccggcaccgggccatggcggact

SEQ ID NO: 268840 - DNA, 25 bp, Mus musculus
ctccggcagacagacagctggtggc

SEQ ID NO: 268841 - DNA, 25 bp, Mus musculus
ctccggcagacagtgaagccagtct

SEQ ID NO: 268842 - DNA, 25 bp, Mus musculus
ctccggcagggaagcccagccctgg

SEQ ID NO: 268843 - DNA, 25 bp, Mus musculus
ctccggcatccagtcctctctctgg

SEQ ID NO: 268844 - DNA, 25 bp, Mus musculus
ctccggccaggcgagcagactacgt

SEQ ID NO: 268845 - DNA, 25 bp, Mus musculus
ctccggccaggcgattaaatcccct

SEQ ID NO: 268846 - DNA, 25 bp, Mus musculus
ctccggccatctcagctgtggtcct

SEQ ID NO: 268847 - DNA, 25 bp, Mus musculus
ctccggccatctcaggtgttcctgt

SEQ ID NO: 268848 - DNA, 25 bp, Mus musculus
ctccggccatctcaggttgtacttt

SEQ ID NO: 268849 - DNA, 25 bp, Mus musculus
ctccggccggtcaagacagggtctt

SEQ ID NO: 268850 - DNA, 25 bp, Mus musculus
ctccggccggtcaagagttataccc

SEQ ID NO: 268851 - DNA, 25 bp, Mus musculus
ctccggccggtcaaggtgtaaactc

SEQ ID NO: 268852 - DNA, 25 bp, Mus musculus
ctccggccggtcaagtgcacaaccc

SEQ ID NO: 268853 - DNA, 25 bp, Mus musculus
ctccggcctcagggggctactccgt

SEQ ID NO: 268854 - DNA, 25 bp, Mus musculus
ctccggcctctttggaggctcatcc

SEQ ID NO: 268855 - DNA, 25 bp, Mus musculus
ctccggcctctttggctgctgggaa

SEQ ID NO: 268856 - DNA, 25 bp, Mus musculus
ctccggccttaatgggcaacgtggt

SEQ ID NO: 268857 - DNA, 25 bp, Mus musculus
ctccggcggaagcagtatccagcat

SEQ ID NO: 268858 - DNA, 25 bp, Mus musculus
ctccggcggaaggtcatgttagcgg

SEQ ID NO: 268859 - DNA, 25 bp, Mus musculus
ctccggcggcagatgtgatggcacc

SEQ ID NO: 268860 - DNA, 25 bp, Mus musculus
ctccggcggccgctacaaggtgggg

SEQ ID NO: 268861 - DNA, 25 bp, Mus musculus
ctccggcgggcggcctcattgctcc

SEQ ID NO: 268862 - DNA, 25 bp, Mus musculus
ctccggcgggcggtggtacaggatc

SEQ ID NO: 268863 - DNA, 25 bp, Mus musculus
ctccggctctaaggccaaagatctc

SEQ ID NO: 268864 - DNA, 25 bp, Mus musculus
ctccggctggcccaccttgggacac

SEQ ID NO: 268865 - DNA, 25 bp, Mus musculus
ctccggctgtgggaggtgctgtgga

SEQ ID NO: 268866 - DNA, 25 bp, Mus musculus
ctccgggacactggacatcatcacc

SEQ ID NO: 268867 - DNA, 25 bp, Mus musculus
ctccgggacactgggatcttccttg

SEQ ID NO: 268868 - DNA, 25 bp, Mus musculus
ctccgggagaaggatcagtggtgaa

SEQ ID NO: 268869 - DNA, 25 bp, Mus musculus
ctccgggattgtgctttgagcgctg

SEQ ID NO: 268870 - DNA, 25 bp, Mus musculus
ctccgggccagagcctgagcctttg

SEQ ID NO: 268871 - DNA, 25 bp, Mus musculus
ctccgggccctgcaggaggacctgg

SEQ ID NO: 268872 - DNA, 25 bp, Mus musculus
ctccgggccggaccgagaaagggct

SEQ ID NO: 268873 - DNA, 25 bp, Mus musculus
ctccgggccggaccgcacagagaat

SEQ ID NO: 268874 - DNA, 25 bp, Mus musculus
ctccgggctcctgaggcatggaggg

SEQ ID NO: 268875 - DNA, 25 bp, Mus musculus
ctccgggctgaggagccaacatgtt

SEQ ID NO: 268876 - DNA, 25 bp, Mus musculus
ctccgggctgagtcaagtccatcat

SEQ ID NO: 268877 - DNA, 25 bp, Mus musculus
ctccggggccagtagagtatagaaa

SEQ ID NO: 268878 - DNA, 25 bp, Mus musculus
ctccggggccagtaggtccaatcag

SEQ ID NO: 268879 - DNA, 25 bp, Mus musculus
ctccgggtaaagaggtgtatgcagt

SEQ ID NO: 268880 - DNA, 25 bp, Mus musculus
ctccgggtcatcaagggtcacgtga

SEQ ID NO: 268881 - DNA, 25 bp, Mus musculus
ctccgggtgagtttgccaggcagta

SEQ ID NO: 268882 - DNA, 25 bp, Mus musculus
ctccgggtgtgaagggtgagagtgg

SEQ ID NO: 268883 - DNA, 25 bp, Mus musculus
ctccggtaaagtgacaaaacataaa

SEQ ID NO: 268884 - DNA, 25 bp, Mus musculus
ctccggtcactatgagtgaaacatc

SEQ ID NO: 268885 - DNA, 25 bp, Mus musculus
ctccggtcactatggtgataaagtt

SEQ ID NO: 268886 - DNA, 25 bp, Mus musculus
ctccggtctgaaccggctgattatg

SEQ ID NO: 268887 - DNA, 25 bp, Mus musculus
ctccggtgaagaatgctatcagaag

SEQ ID NO: 268888 - DNA, 25 bp, Mus musculus
ctccggtgcccaggtctgggaacgt

SEQ ID NO: 268889 - DNA, 25 bp, Mus musculus
ctccggttatggtacaaattctgag

SEQ ID NO: 268890 - DNA, 25 bp, Mus musculus
ctccgtacagatcttcgtccctccc

SEQ ID NO: 268891 - DNA, 25 bp, Mus musculus
ctccgtacagcgccatggctactta

SEQ ID NO: 268892 - DNA, 25 bp, Mus musculus
ctccgtagtggtgctgacctggaca

SEQ ID NO: 268893 - DNA, 25 bp, Mus musculus
ctccgtagtggtggtcttatgctga

SEQ ID NO: 268894 - DNA, 25 bp, Mus musculus
ctccgtatagaggaagcccagccct

SEQ ID NO: 268895 - DNA, 25 bp, Mus musculus
ctccgtattataaccacagtggaag

SEQ ID NO: 268896 - DNA, 25 bp, Mus musculus
ctccgtattataacctcatcgtgtt

SEQ ID NO: 268897 - DNA, 25 bp, Mus musculus
ctccgtcaacactgaggccttcaca

SEQ ID NO: 268898 - DNA, 25 bp, Mus musculus
ctccgtcaagaatccggagatcgtc

SEQ ID NO: 268899 - DNA, 25 bp, Mus musculus
ctccgtcaagcccccggaagcctct

SEQ ID NO: 268900 - DNA, 25 bp, Mus musculus
ctccgtcaaggtgtcggacgacact

SEQ ID NO: 268901 - DNA, 25 bp, Mus musculus
ctccgtcatgacgcaacttcggcac

SEQ ID NO: 268902 - DNA, 25 bp, Mus musculus
ctccgtccccagaacccgagccaga

SEQ ID NO: 268903 - DNA, 25 bp, Mus musculus
ctccgtcccccacacacctgctctc

SEQ ID NO: 268904 - DNA, 25 bp, Mus musculus
ctccgtcctggatactccatgtttc

SEQ ID NO: 268905 - DNA, 25 bp, Mus musculus
ctccgtcctttaggaaaggtatgct

SEQ ID NO: 268906 - DNA, 25 bp, Mus musculus
ctccgtcgccatggctccagcaccc

SEQ ID NO: 268907 - DNA, 25 bp, Mus musculus
ctccgtcgcttaccggtggaagctt

SEQ ID NO: 268908 - DNA, 25 bp, Mus musculus
ctccgtcgcttaccgttaccgcagg

SEQ ID NO: 268909 - DNA, 25 bp, Mus musculus
ctccgtcgtgtacagtgacaccatc

SEQ ID NO: 268910 - DNA, 25 bp, Mus musculus
ctccgtctgtaagaatgacatacgg

SEQ ID NO: 268911 - DNA, 25 bp, Mus musculus
ctccgtctttgcagtatggtggaac

SEQ ID NO: 268912 - DNA, 25 bp, Mus musculus
ctccgtgaaaaccaggcgactatct

SEQ ID NO: 268913 - DNA, 25 bp, Mus musculus
ctccgtgcccgagtttcaggtgcca

SEQ ID NO: 268914 - DNA, 25 bp, Mus musculus
ctccgtgccggcggcctcagcactc

SEQ ID NO: 268915 - DNA, 25 bp, Mus musculus
ctccgtgctgggggcagaatccttt

SEQ ID NO: 268916 - DNA, 25 bp, Mus musculus
ctccgtggagatggagacattgatg

SEQ ID NO: 268917 - DNA, 25 bp, Mus musculus
ctccgtggagcgactatcctgggtg

SEQ ID NO: 268918 - DNA, 25 bp, Mus musculus
ctccgtggagggtacactagctcag

SEQ ID NO: 268919 - DNA, 25 bp, Mus musculus
ctccgtgggtgtgtgaaatgcactt

SEQ ID NO: 268920 - DNA, 25 bp, Mus musculus
ctccgtgggtgtgtggactgtgcag

SEQ ID NO: 268921 - DNA, 25 bp, Mus musculus
ctccgtgtcctctgatgctgaggaa

SEQ ID NO: 268922 - DNA, 25 bp, Mus musculus
ctccgtgtcctctgcctgttccagt

SEQ ID NO: 268923 - DNA, 25 bp, Mus musculus
ctccgtgtgaaagatacttggtaac

SEQ ID NO: 268924 - DNA, 25 bp, Mus musculus
ctccgtgtttctcagctcagaggct

SEQ ID NO: 268925 - DNA, 25 bp, Mus musculus
ctccgtgtttgccgggtgtaatgga

SEQ ID NO: 268926 - DNA, 25 bp, Mus musculus
ctccgttatcatgaacacggctcta

SEQ ID NO: 268927 - DNA, 25 bp, Mus musculus
ctccgttatcatgtttgatttgaca

SEQ ID NO: 268928 - DNA, 25 bp, Mus musculus
ctccgttctctgggttaccacagtg

SEQ ID NO: 268929 - DNA, 25 bp, Mus musculus
ctccgttgttcaagtcagaaaccaa

SEQ ID NO: 268930 - DNA, 25 bp, Mus musculus
ctccgtttagatcagctgaagcttg

SEQ ID NO: 268931 - DNA, 25 bp, Mus musculus
ctccgtttggggcggcaacctttgg

SEQ ID NO: 268932 - DNA, 25 bp, Mus musculus
ctccgtttggggctacgccttctac

SEQ ID NO: 268933 - DNA, 25 bp, Mus musculus
ctcctaaaagaagtcgttccccatc

SEQ ID NO: 268934 - DNA, 25 bp, Mus musculus
ctcctaaaaggattgcaaaagtttc

SEQ ID NO: 268935 - DNA, 25 bp, Mus musculus
ctcctaaaattatttcagctgccag

SEQ ID NO: 268936 - DNA, 25 bp, Mus musculus
ctcctaaactttccacatctacatc

SEQ ID NO: 268937 - DNA, 25 bp, Mus musculus
ctcctaaaggatatgttcgcacaac

SEQ ID NO: 268938 - DNA, 25 bp, Mus musculus
ctcctaacagatgaacagtgttttc

SEQ ID NO: 268939 - DNA, 25 bp, Mus musculus
ctcctaacagctatgaaaggacagt

SEQ ID NO: 268940 - DNA, 25 bp, Mus musculus
ctcctaacccagttccgcagaggac

SEQ ID NO: 268941 - DNA, 25 bp, Mus musculus
ctcctaaccgcgttggctctcccag

SEQ ID NO: 268942 - DNA, 25 bp, Mus musculus
ctcctaactcaggtgaggcacagag

SEQ ID NO: 268943 - DNA, 25 bp, Mus musculus
ctcctaactggtcagtaccatgaat

SEQ ID NO: 268944 - DNA, 25 bp, Mus musculus
ctcctaacttatctacactgaccct

SEQ ID NO: 268945 - DNA, 25 bp, Mus musculus
ctcctaaggaagcacctcccttaca

SEQ ID NO: 268946 - DNA, 25 bp, Mus musculus
ctcctaaggaaggctcagagaaata

SEQ ID NO: 268947 - DNA, 25 bp, Mus musculus
ctcctaaggaagggtacctggaatg

SEQ ID NO: 268948 - DNA, 25 bp, Mus musculus
ctcctaatctttgaggcctgcagca

SEQ ID NO: 268949 - DNA, 25 bp, Mus musculus
ctcctaatctttgagggaaccaatg

SEQ ID NO: 268950 - DNA, 25 bp, Mus musculus
ctcctacactgggctcctccaccac

SEQ ID NO: 268951 - DNA, 25 bp, Mus musculus
ctcctacactggtgacaagacgagc

SEQ ID NO: 268952 - DNA, 25 bp, Mus musculus
ctcctacagagtctcagcctactga

SEQ ID NO: 268953 - DNA, 25 bp, Mus musculus
ctcctacagagtctcaggtggtcca

SEQ ID NO: 268954 - DNA, 25 bp, Mus musculus
ctcctaccactgacaaagtctcccc

SEQ ID NO: 268955 - DNA, 25 bp, Mus musculus
ctcctaccagcggagcatgcacgcc

SEQ ID NO: 268956 - DNA, 25 bp, Mus musculus
ctcctaccagcggagggtttctctg

SEQ ID NO: 268957 - DNA, 25 bp, Mus musculus
ctcctaccctcctatgtgctcccaa

SEQ ID NO: 268958 - DNA, 25 bp, Mus musculus
ctcctacctgaagagcaccaagctg

SEQ ID NO: 268959 - DNA, 25 bp, Mus musculus
ctcctacctgtgaaaagatcatctg

SEQ ID NO: 268960 - DNA, 25 bp, Mus musculus
ctcctacctgtgaaaatggctctgg

SEQ ID NO: 268961 - DNA, 25 bp, Mus musculus
ctcctacgagcagcgggtgctgacg

SEQ ID NO: 268962 - DNA, 25 bp, Mus musculus
ctcctacgagcagggctgtgcgata

SEQ ID NO: 268963 - DNA, 25 bp, Mus musculus
ctcctacgagtccgaaaggcaagag

SEQ ID NO: 268964 - DNA, 25 bp, Mus musculus
ctcctactcttgtatgtcttcgtgg

SEQ ID NO: 268965 - DNA, 25 bp, Mus musculus
ctcctactggaaggtacccagggca

SEQ ID NO: 268966 - DNA, 25 bp, Mus musculus
ctcctacttcaagggccaacggcag

SEQ ID NO: 268967 - DNA, 25 bp, Mus musculus
ctcctacttcttcagctgcagtgtt

SEQ ID NO: 268968 - DNA, 25 bp, Mus musculus
ctcctacttcttcagttaccctgca

SEQ ID NO: 268969 - DNA, 25 bp, Mus musculus
ctcctaggagggagcctccctgtga

SEQ ID NO: 268970 - DNA, 25 bp, Mus musculus
ctcctaggggtggcgaccgtgctgt

SEQ ID NO: 268971 - DNA, 25 bp, Mus musculus
ctcctaggtgcaggcagtctaaagt

SEQ ID NO: 268972 - DNA, 25 bp, Mus musculus
ctcctagtgagcttgtccaggtgac

SEQ ID NO: 268973 - DNA, 25 bp, Mus musculus
ctcctatagcagggtctacctgctg

SEQ ID NO: 268974 - DNA, 25 bp, Mus musculus
ctcctatagtggactcgggagggca

SEQ ID NO: 268975 - DNA, 25 bp, Mus musculus
ctcctatataagtaactttgaaaca

SEQ ID NO: 268976 - DNA, 25 bp, Mus musculus
ctcctatataagtggtaagccaaaa

SEQ ID NO: 268977 - DNA, 25 bp, Mus musculus
ctcctatatcatagcaagaggaggc

SEQ ID NO: 268978 - DNA, 25 bp, Mus musculus
ctcctatcattaagcaaagcactat

SEQ ID NO: 268979 - DNA, 25 bp, Mus musculus
ctcctatctatatggcaccagaggt

SEQ ID NO: 268980 - DNA, 25 bp, Mus musculus
ctcctatgaagagaagagccttgtt

SEQ ID NO: 268981 - DNA, 25 bp, Mus musculus
ctcctatgctccttggctgaacctt

SEQ ID NO: 268982 - DNA, 25 bp, Mus musculus
ctcctatgctctcttcattctcata

SEQ ID NO: 268983 - DNA, 25 bp, Mus musculus
ctcctatggaccaaggtgttggggc

SEQ ID NO: 268984 - DNA, 25 bp, Mus musculus
ctcctatggctggaggaatctgcga

SEQ ID NO: 268985 - DNA, 25 bp, Mus musculus
ctcctattacaccgggtgaacctga

SEQ ID NO: 268986 - DNA, 25 bp, Mus musculus
ctcctattacttgaagctggctaag

SEQ ID NO: 268987 - DNA, 25 bp, Mus musculus
ctcctattacttgtcccaaaggaag

SEQ ID NO: 268988 - DNA, 25 bp, Mus musculus
ctcctattcagaccctcagtgctca

SEQ ID NO: 268989 - DNA, 25 bp, Mus musculus
ctcctattcaggccatgtggctggg

SEQ ID NO: 268990 - DNA, 25 bp, Mus musculus
ctcctattccagtatcattttgcct

SEQ ID NO: 268991 - DNA, 25 bp, Mus musculus
ctcctatttgtgggattgttcatca

SEQ ID NO: 268992 - DNA, 25 bp, Mus musculus
ctcctcaacctggtcacccatccct

SEQ ID NO: 268993 - DNA, 25 bp, Mus musculus
ctcctcaacctggtctatgaaacaa

SEQ ID NO: 268994 - DNA, 25 bp, Mus musculus
ctcctcaagatggagagacgttagc

SEQ ID NO: 268995 - DNA, 25 bp, Mus musculus
ctcctcaatatgccctacacagtcc

SEQ ID NO: 268996 - DNA, 25 bp, Mus musculus
ctcctcaatatggaaagtacctaac

SEQ ID NO: 268997 - DNA, 25 bp, Mus musculus
ctcctcacaagcagaaacacctggt

SEQ ID NO: 268998 - DNA, 25 bp, Mus musculus
ctcctcacaagcagtctttcacaga

SEQ ID NO: 268999 - DNA, 25 bp, Mus musculus
ctcctcacacagatgccccactgaa

SEQ ID NO: 269000 - DNA, 25 bp, Mus musculus
ctcctcacatactggctacccaggc

SEQ ID NO: 269001 - DNA, 25 bp, Mus musculus
ctcctcaccacagcttccactcaga

SEQ ID NO: 269002 - DNA, 25 bp, Mus musculus
ctcctcaccgcagcacccccactgc

SEQ ID NO: 269003 - DNA, 25 bp, Mus musculus
ctcctcaccggaacaaggagcccag

SEQ ID NO: 269004 - DNA, 25 bp, Mus musculus
ctcctcacctagcaccatcggtttg

SEQ ID NO: 269005 - DNA, 25 bp, Mus musculus
ctcctcacctgcctgcagcaacaag

SEQ ID NO: 269006 - DNA, 25 bp, Mus musculus
ctcctcacctttacagattggagct

SEQ ID NO: 269007 - DNA, 25 bp, Mus musculus
ctcctcactccagccggatgtatgg

SEQ ID NO: 269008 - DNA, 25 bp, Mus musculus
ctcctcagacagcactcaaagaaga

SEQ ID NO: 269009 - DNA, 25 bp, Mus musculus
ctcctcagaggcagcatcctgttca

SEQ ID NO: 269010 - DNA, 25 bp, Mus musculus
ctcctcagagtctgatgccaagcca

SEQ ID NO: 269011 - DNA, 25 bp, Mus musculus
ctcctcagagtctgcaagaaactac

SEQ ID NO: 269012 - DNA, 25 bp, Mus musculus
ctcctcagagtttgtcatccgtcct

SEQ ID NO: 269013 - DNA, 25 bp, Mus musculus
ctcctcagcagagttacgtcaatat

SEQ ID NO: 269014 - DNA, 25 bp, Mus musculus
ctcctcagcaggtatttgtcaagtg

SEQ ID NO: 269015 - DNA, 25 bp, Mus musculus
ctcctcagccatgagaaaacaagaa

SEQ ID NO: 269016 - DNA, 25 bp, Mus musculus
ctcctcagccccctcccgccttcct

SEQ ID NO: 269017 - DNA, 25 bp, Mus musculus
ctcctcagcccctcctcctccctcc

SEQ ID NO: 269018 - DNA, 25 bp, Mus musculus
ctcctcagccctgaggttatttcgt

SEQ ID NO: 269019 - DNA, 25 bp, Mus musculus
ctcctcagcccttcagggtggtaag

SEQ ID NO: 269020 - DNA, 25 bp, Mus musculus
ctcctcaggaagagggttcactgat

SEQ ID NO: 269021 - DNA, 25 bp, Mus musculus
ctcctcagtggcaggcggtgtggct

SEQ ID NO: 269022 - DNA, 25 bp, Mus musculus
ctcctcagtggcagttgctgcgatt

SEQ ID NO: 269023 - DNA, 25 bp, Mus musculus
ctcctccaaaacctcaggctggcta

SEQ ID NO: 269024 - DNA, 25 bp, Mus musculus
ctcctccaacccgggaagcacaggc

SEQ ID NO: 269025 - DNA, 25 bp, Mus musculus
ctcctccacaggctctggtcagggt

SEQ ID NO: 269026 - DNA, 25 bp, Mus musculus
ctcctccacccaggtgtcaacacat

SEQ ID NO: 269027 - DNA, 25 bp, Mus musculus
ctcctccacggagcaggagcgagag

SEQ ID NO: 269028 - DNA, 25 bp, Mus musculus
ctcctccacggagcgagagggggga

SEQ ID NO: 269029 - DNA, 25 bp, Mus musculus
ctcctccagagctcccagacctctg

SEQ ID NO: 269030 - DNA, 25 bp, Mus musculus
ctcctccagcaggcttgtgacatca

SEQ ID NO: 269031 - DNA, 25 bp, Mus musculus
ctcctccagcagtgggtttttcttc

SEQ ID NO: 269032 - DNA, 25 bp, Mus musculus
ctcctccagggccagtttcttctgg

SEQ ID NO: 269033 - DNA, 25 bp, Mus musculus
ctcctccagggtcagcttccaagca

SEQ ID NO: 269034 - DNA, 25 bp, Mus musculus
ctcctccagggtcaggtgaaccacc

SEQ ID NO: 269035 - DNA, 25 bp, Mus musculus
ctcctccatcaccttcattcacaac

SEQ ID NO: 269036 - DNA, 25 bp, Mus musculus
ctcctccatcttggcatgtgctcca

SEQ ID NO: 269037 - DNA, 25 bp, Mus musculus
ctcctccatgctggacagtgctaca

SEQ ID NO: 269038 - DNA, 25 bp, Mus musculus
ctcctcccaaagatactggcattgc

SEQ ID NO: 269039 - DNA, 25 bp, Mus musculus
ctcctcccaagcaaggttgaaagga

SEQ ID NO: 269040 - DNA, 25 bp, Mus musculus
ctcctcccagcgcagggttaatttc

SEQ ID NO: 269041 - DNA, 25 bp, Mus musculus
ctcctcccagtgccctggggggcag

SEQ ID NO: 269042 - DNA, 25 bp, Mus musculus
ctcctccccagaagacccagccagc

SEQ ID NO: 269043 - DNA, 25 bp, Mus musculus
ctcctccccagatcagcaccgacac

SEQ ID NO: 269044 - DNA, 25 bp, Mus musculus
ctcctcccccaggcttcagcaccgt

SEQ ID NO: 269045 - DNA, 25 bp, Mus musculus
ctcctccccttggggccttctagcc

SEQ ID NO: 269046 - DNA, 25 bp, Mus musculus
ctcctcccgctttgggaaattcatc

SEQ ID NO: 269047 - DNA, 25 bp, Mus musculus
ctcctccctgagcagattgaacggg

SEQ ID NO: 269048 - DNA, 25 bp, Mus musculus
ctcctccgacgtggtgacgtatgcc

SEQ ID NO: 269049 - DNA, 25 bp, Mus musculus
ctcctccgagaagccccggcagccc

SEQ ID NO: 269050 - DNA, 25 bp, Mus musculus
ctcctccgagaattatatcagaatt

SEQ ID NO: 269051 - DNA, 25 bp, Mus musculus
ctcctccgagagaggtgccgttctc

SEQ ID NO: 269052 - DNA, 25 bp, Mus musculus
ctcctccgaggtccagtttggccat

SEQ ID NO: 269053 - DNA, 25 bp, Mus musculus
ctcctccgcagaggccaagtgagac

SEQ ID NO: 269054 - DNA, 25 bp, Mus musculus
ctcctccggcggaagcagtatccag

SEQ ID NO: 269055 - DNA, 25 bp, Mus musculus
ctcctccggcggaaggtcatgttag

SEQ ID NO: 269056 - DNA, 25 bp, Mus musculus
ctcctccggcttgttggaggtgagc

SEQ ID NO: 269057 - DNA, 25 bp, Mus musculus
ctcctccgggaaggtagactgcctg

SEQ ID NO: 269058 - DNA, 25 bp, Mus musculus
ctcctcctcacctagcaccatcggt

SEQ ID NO: 269059 - DNA, 25 bp, Mus musculus
ctcctcctctcggtacttctccata

SEQ ID NO: 269060 - DNA, 25 bp, Mus musculus
ctcctcctgacccagaaacaacttg

SEQ ID NO: 269061 - DNA, 25 bp, Mus musculus
ctcctcctgacccagccaaggcagg

SEQ ID NO: 269062 - DNA, 25 bp, Mus musculus
ctcctcctggcaatcccctggttga

SEQ ID NO: 269063 - DNA, 25 bp, Mus musculus
ctcctcctggcagtaagatcctaca

SEQ ID NO: 269064 - DNA, 25 bp, Mus musculus
ctcctcctggtttaggagatcccag

SEQ ID NO: 269065 - DNA, 25 bp, Mus musculus
ctcctcctgtccagcaaatctccca

SEQ ID NO: 269066 - DNA, 25 bp, Mus musculus
ctcctccttaaagcctgcggagccc

SEQ ID NO: 269067 - DNA, 25 bp, Mus musculus
ctcctccttggctggcagcacagac

SEQ ID NO: 269068 - DNA, 25 bp, Mus musculus
ctcctccttggctgggaaaatgacc

SEQ ID NO: 269069 - DNA, 25 bp, Mus musculus
ctcctccttggctgggggaagaaca

SEQ ID NO: 269070 - DNA, 25 bp, Mus musculus
ctcctccttgggcccattgactcgg

SEQ ID NO: 269071 - DNA, 25 bp, Mus musculus
ctcctcgaaagatgttccggcacac

SEQ ID NO: 269072 - DNA, 25 bp, Mus musculus
ctcctcgaatgataatctggaggct

SEQ ID NO: 269073 - DNA, 25 bp, Mus musculus
ctcctcgacgggtcctgcatggtgg

SEQ ID NO: 269074 - DNA, 25 bp, Mus musculus
ctcctcgaggctgtgtgactctggg

SEQ ID NO: 269075 - DNA, 25 bp, Mus musculus
ctcctcgagggcataacctgggtcc

SEQ ID NO: 269076 - DNA, 25 bp, Mus musculus
ctcctcgcagcaggaagaagtagct

SEQ ID NO: 269077 - DNA, 25 bp, Mus musculus
ctcctcgcattccggatgattgtaa

SEQ ID NO: 269078 - DNA, 25 bp, Mus musculus
ctcctcggaagaggagaaggggacc

SEQ ID NO: 269079 - DNA, 25 bp, Mus musculus
ctcctcggaagcactgctacaggag

SEQ ID NO: 269080 - DNA, 25 bp, Mus musculus
ctcctcggaagcatctcctctggcc

SEQ ID NO: 269081 - DNA, 25 bp, Mus musculus
ctcctcggagagacctccattgctg

SEQ ID NO: 269082 - DNA, 25 bp, Mus musculus
ctcctcggcatcatgatgacccgga

SEQ ID NO: 269083 - DNA, 25 bp, Mus musculus
ctcctcgtccagcagcaaagccgac

SEQ ID NO: 269084 - DNA, 25 bp, Mus musculus
ctcctcgtcctagccatctgcatca

SEQ ID NO: 269085 - DNA, 25 bp, Mus musculus
ctcctcgtcctaggtattctcatgg

SEQ ID NO: 269086 - DNA, 25 bp, Mus musculus
ctcctcgtgtgcggattcctttgtt

SEQ ID NO: 269087 - DNA, 25 bp, Mus musculus
ctcctcgtgtgcggtgcacgatctg

SEQ ID NO: 269088 - DNA, 25 bp, Mus musculus
ctcctctaaaaggcaacaactctac

SEQ ID NO: 269089 - DNA, 25 bp, Mus musculus
ctcctctaaaagggccgcgcctgcg

SEQ ID NO: 269090 - DNA, 25 bp, Mus musculus
ctcctctaattaagctgtctcctaa

SEQ ID NO: 269091 - DNA, 25 bp, Mus musculus
ctcctctacaatgggcacctgggtt

SEQ ID NO: 269092 - DNA, 25 bp, Mus musculus
ctcctctagaggctgtggggtgggc

SEQ ID NO: 269093 - DNA, 25 bp, Mus musculus
ctcctctatgctcctttcctggctg

SEQ ID NO: 269094 - DNA, 25 bp, Mus musculus
ctcctctatggctcagcactgcatt

SEQ ID NO: 269095 - DNA, 25 bp, Mus musculus
ctcctctcaaagggacagccagccc

SEQ ID NO: 269096 - DNA, 25 bp, Mus musculus
ctcctctcaaaggtttattttattt

SEQ ID NO: 269097 - DNA, 25 bp, Mus musculus
ctcctctcaacctctcttcaggccc

SEQ ID NO: 269098 - DNA, 25 bp, Mus musculus
ctcctctcaactccacgtcagcact

SEQ ID NO: 269099 - DNA, 25 bp, Mus musculus
ctcctctcaagcaagctatagtcag

SEQ ID NO: 269100 - DNA, 25 bp, Mus musculus
ctcctctcagcaaagctgttgctga

SEQ ID NO: 269101 - DNA, 25 bp, Mus musculus
ctcctctcaggccgcctctagacgt

SEQ ID NO: 269102 - DNA, 25 bp, Mus musculus
ctcctctcaggccgggttcgagtga

SEQ ID NO: 269103 - DNA, 25 bp, Mus musculus
ctcctctcaggccggtgacgctgac

SEQ ID NO: 269104 - DNA, 25 bp, Mus musculus
ctcctctccaggatgttctgaggag

SEQ ID NO: 269105 - DNA, 25 bp, Mus musculus
ctcctctccgacatcacccatgctg

SEQ ID NO: 269106 - DNA, 25 bp, Mus musculus
ctcctctcctgaaaatgactccctc

SEQ ID NO: 269107 - DNA, 25 bp, Mus musculus
ctcctctcctgtcctgagctttccc

SEQ ID NO: 269108 - DNA, 25 bp, Mus musculus
ctcctctcttagactatcccccgaa

SEQ ID NO: 269109 - DNA, 25 bp, Mus musculus
ctcctctcttggtcaaactacaact

SEQ ID NO: 269110 - DNA, 25 bp, Mus musculus
ctcctctgaactggatgccagtaaa

SEQ ID NO: 269111 - DNA, 25 bp, Mus musculus
ctcctctgaactgtataaaatggtt

SEQ ID NO: 269112 - DNA, 25 bp, Mus musculus
ctcctctgaaggctagccctgctcc

SEQ ID NO: 269113 - DNA, 25 bp, Mus musculus
ctcctctgacagtgaagaaaatgct

SEQ ID NO: 269114 - DNA, 25 bp, Mus musculus
ctcctctgacagtggtgggtgtgtg

SEQ ID NO: 269115 - DNA, 25 bp, Mus musculus
ctcctctgatgaccacggctccttc

SEQ ID NO: 269116 - DNA, 25 bp, Mus musculus
ctcctctgcagttgttgacctcctg

SEQ ID NO: 269117 - DNA, 25 bp, Mus musculus
ctcctctggaaagacccccctttgt

SEQ ID NO: 269118 - DNA, 25 bp, Mus musculus
ctcctctggatcaggctgctccact

SEQ ID NO: 269119 - DNA, 25 bp, Mus musculus
ctcctctggatcagggtttgaggag

SEQ ID NO: 269120 - DNA, 25 bp, Mus musculus
ctcctctggcatgaacctctcagga

SEQ ID NO: 269121 - DNA, 25 bp, Mus musculus
ctcctctggcccagaccgaagccag

SEQ ID NO: 269122 - DNA, 25 bp, Mus musculus
ctcctctggctctgaatttctcttc

SEQ ID NO: 269123 - DNA, 25 bp, Mus musculus
ctcctctggctctgacagcgacgaa

SEQ ID NO: 269124 - DNA, 25 bp, Mus musculus
ctcctctggggcttagtccttggct

SEQ ID NO: 269125 - DNA, 25 bp, Mus musculus
ctcctcttctctggggcctggaatg

SEQ ID NO: 269126 - DNA, 25 bp, Mus musculus
ctcctcttctgcagaactgggagtc

SEQ ID NO: 269127 - DNA, 25 bp, Mus musculus
ctcctcttctgcagtctacctgtgc

SEQ ID NO: 269128 - DNA, 25 bp, Mus musculus
ctcctcttgagaatattctccttct

SEQ ID NO: 269129 - DNA, 25 bp, Mus musculus
ctcctcttgagcattgcgccagccc

SEQ ID NO: 269130 - DNA, 25 bp, Mus musculus
ctcctcttgcagatactggagtgtg

SEQ ID NO: 269131 - DNA, 25 bp, Mus musculus
ctcctcttgcctcagtgacatcagg

SEQ ID NO: 269132 - DNA, 25 bp, Mus musculus
ctcctcttgtgatgaagctcaacaa

SEQ ID NO: 269133 - DNA, 25 bp, Mus musculus
ctcctcttgtggaagtgcggcttct

SEQ ID NO: 269134 - DNA, 25 bp, Mus musculus
ctcctcttgtggaagtgtgacttct

SEQ ID NO: 269135 - DNA, 25 bp, Mus musculus
ctcctctttaccagtaaccaggtga

SEQ ID NO: 269136 - DNA, 25 bp, Mus musculus
ctcctctttgaagacctttgcacag

SEQ ID NO: 269137 - DNA, 25 bp, Mus musculus
ctcctctttggacagagccagtata

SEQ ID NO: 269138 - DNA, 25 bp, Mus musculus
ctcctcttttctggacaagatggca

SEQ ID NO: 269139 - DNA, 25 bp, Mus musculus
ctcctgaaatgcctaacatacatgg

SEQ ID NO: 269140 - DNA, 25 bp, Mus musculus
ctcctgaacaaggtccaggacatct

SEQ ID NO: 269141 - DNA, 25 bp, Mus musculus
ctcctgaaccagctggtccctgaga

SEQ ID NO: 269142 - DNA, 25 bp, Mus musculus
ctcctgaagatctagtgcgccgtca

SEQ ID NO: 269143 - DNA, 25 bp, Mus musculus
ctcctgaagtaggtgtaattattga

SEQ ID NO: 269144 - DNA, 25 bp, Mus musculus
ctcctgaatgcagttggaatgccaa

SEQ ID NO: 269145 - DNA, 25 bp, Mus musculus
ctcctgaatgtacccctctagacgc

SEQ ID NO: 269146 - DNA, 25 bp, Mus musculus
ctcctgacccagaaacaacttgagc

SEQ ID NO: 269147 - DNA, 25 bp, Mus musculus
ctcctgacccagccaaggcaggagc

SEQ ID NO: 269148 - DNA, 25 bp, Mus musculus
ctcctgacctctagttgggatgaat

SEQ ID NO: 269149 - DNA, 25 bp, Mus musculus
ctcctgactacagaggatgcgtccg

SEQ ID NO: 269150 - DNA, 25 bp, Mus musculus
ctcctgactacaggtacaatagagg

SEQ ID NO: 269151 - DNA, 25 bp, Mus musculus
ctcctgactccgttcaacacacaga

SEQ ID NO: 269152 - DNA, 25 bp, Mus musculus
ctcctgacttgagggagtgcccagc

SEQ ID NO: 269153 - DNA, 25 bp, Mus musculus
ctcctgacttgagggtcctgaggga

SEQ ID NO: 269154 - DNA, 25 bp, Mus musculus
ctcctgactttgggtaatgttctcc

SEQ ID NO: 269155 - DNA, 25 bp, Mus musculus
ctcctgagaaaagggcagtcatgga

SEQ ID NO: 269156 - DNA, 25 bp, Mus musculus
ctcctgagaaacagtcatggaagtg

SEQ ID NO: 269157 - DNA, 25 bp, Mus musculus
ctcctgagacagggttgtgagcccc

SEQ ID NO: 269158 - DNA, 25 bp, Mus musculus
ctcctgagagagaacttgccgacgt

SEQ ID NO: 269159 - DNA, 25 bp, Mus musculus
ctcctgagagagaggtgcaggcagt

SEQ ID NO: 269160 - DNA, 25 bp, Mus musculus
ctcctgagaggttgatcgtgtcctg

SEQ ID NO: 269161 - DNA, 25 bp, Mus musculus
ctcctgagattaaaggacaaccctc

SEQ ID NO: 269162 - DNA, 25 bp, Mus musculus
ctcctgagcagggacctgaggtgca

SEQ ID NO: 269163 - DNA, 25 bp, Mus musculus
ctcctgagcaggtcttgggacccat

SEQ ID NO: 269164 - DNA, 25 bp, Mus musculus
ctcctgagccaggttgatgtaggag

SEQ ID NO: 269165 - DNA, 25 bp, Mus musculus
ctcctgagcccggctgtgctggatg

SEQ ID NO: 269166 - DNA, 25 bp, Mus musculus
ctcctgagctggaagatttcatcct

SEQ ID NO: 269167 - DNA, 25 bp, Mus musculus
ctcctgatacaggagttccactcca

SEQ ID NO: 269168 - DNA, 25 bp, Mus musculus
ctcctgataggcaacatgtcggcag

SEQ ID NO: 269169 - DNA, 25 bp, Mus musculus
ctcctgatatctaatagcattcctt

SEQ ID NO: 269170 - DNA, 25 bp, Mus musculus
ctcctgatgaacaaaacagggattt

SEQ ID NO: 269171 - DNA, 25 bp, Mus musculus
ctcctgatgaagaccctcttgtgag

SEQ ID NO: 269172 - DNA, 25 bp, Mus musculus
ctcctgatgaaggactatgtgctgg

SEQ ID NO: 269173 - DNA, 25 bp, Mus musculus
ctcctgatgcgggagcacagtcgga

SEQ ID NO: 269174 - DNA, 25 bp, Mus musculus
ctcctgatggaggtgcttgtcctgg

SEQ ID NO: 269175 - DNA, 25 bp, Mus musculus
ctcctgcaagcgttctgtcaacagg

SEQ ID NO: 269176 - DNA, 25 bp, Mus musculus
ctcctgcaagtttctccaggagtga

SEQ ID NO: 269177 - DNA, 25 bp, Mus musculus
ctcctgcacagattgcgctggctcc

SEQ ID NO: 269178 - DNA, 25 bp, Mus musculus
ctcctgcagaaagaggtacataatg

SEQ ID NO: 269179 - DNA, 25 bp, Mus musculus
ctcctgcagaaagaggtgaaaaaac

SEQ ID NO: 269180 - DNA, 25 bp, Mus musculus
ctcctgcagcaaagccaccatgcca

SEQ ID NO: 269181 - DNA, 25 bp, Mus musculus
ctcctgcagcaaaggccgatacaaa

SEQ ID NO: 269182 - DNA, 25 bp, Mus musculus
ctcctgcagcgagcttcaagcgtgt

SEQ ID NO: 269183 - DNA, 25 bp, Mus musculus
ctcctgcagcgatatcgatgagtgc

SEQ ID NO: 269184 - DNA, 25 bp, Mus musculus
ctcctgcatttggggttcctgctgg

SEQ ID NO: 269185 - DNA, 25 bp, Mus musculus
ctcctgccagacttggcagcctggg

SEQ ID NO: 269186 - DNA, 25 bp, Mus musculus
ctcctgccagaggccctgcccgcct

SEQ ID NO: 269187 - DNA, 25 bp, Mus musculus
ctcctgccagccattctgtattgga

SEQ ID NO: 269188 - DNA, 25 bp, Mus musculus
ctcctgccaggaatgaagaaagaag

SEQ ID NO: 269189 - DNA, 25 bp, Mus musculus
ctcctgccaggccaaaagcacctat

SEQ ID NO: 269190 - DNA, 25 bp, Mus musculus
ctcctgccagggcgattcagggggg

SEQ ID NO: 269191 - DNA, 25 bp, Mus musculus
ctcctgccaggttttttccttgact

SEQ ID NO: 269192 - DNA, 25 bp, Mus musculus
ctcctgccatccttgctcggcgtcc

SEQ ID NO: 269193 - DNA, 25 bp, Mus musculus
ctcctgccatccttggtgaggcttt

SEQ ID NO: 269194 - DNA, 25 bp, Mus musculus
ctcctgcccaggtttgcacaccctt

SEQ ID NO: 269195 - DNA, 25 bp, Mus musculus
ctcctgccccgtgaactgtgacaaa

SEQ ID NO: 269196 - DNA, 25 bp, Mus musculus
ctcctgccctgtgcaagtgccctct

SEQ ID NO: 269197 - DNA, 25 bp, Mus musculus
ctcctgcctacaggttaggccgggg

SEQ ID NO: 269198 - DNA, 25 bp, Mus musculus
ctcctgcctcagtaaaggccaaaaa

SEQ ID NO: 269199 - DNA, 25 bp, Mus musculus
ctcctgccttcctttctttgatgtt

SEQ ID NO: 269200 - DNA, 25 bp, Mus musculus
ctcctgccttgatgacagggtccct

SEQ ID NO: 269201 - DNA, 25 bp, Mus musculus
ctcctgcctttgaggatgacatgca

SEQ ID NO: 269202 - DNA, 25 bp, Mus musculus
ctcctgcgcgcgcccggcctggcca

SEQ ID NO: 269203 - DNA, 25 bp, Mus musculus
ctcctgcggcaaggggacatgcttc

SEQ ID NO: 269204 - DNA, 25 bp, Mus musculus
ctcctgcggcgctagctaggcggcc

SEQ ID NO: 269205 - DNA, 25 bp, Mus musculus
ctcctgctactccaggtttcttgaa

SEQ ID NO: 269206 - DNA, 25 bp, Mus musculus
ctcctgctactcgcggttcccagag

SEQ ID NO: 269207 - DNA, 25 bp, Mus musculus
ctcctgctattcaaaacagcgtgga

SEQ ID NO: 269208 - DNA, 25 bp, Mus musculus
ctcctgctccaaggctacagctccc

SEQ ID NO: 269209 - DNA, 25 bp, Mus musculus
ctcctgctccaaggctacagctctc

SEQ ID NO: 269210 - DNA, 25 bp, Mus musculus
ctcctgctctgctctgcctcggcaa

SEQ ID NO: 269211 - DNA, 25 bp, Mus musculus
ctcctgctctggtggctccttgtga

SEQ ID NO: 269212 - DNA, 25 bp, Mus musculus
ctcctgctgccctggaatcttccga

SEQ ID NO: 269213 - DNA, 25 bp, Mus musculus
ctcctgctgccctggagcctcaaac

SEQ ID NO: 269214 - DNA, 25 bp, Mus musculus
ctcctgctggggtagacagcaagag

SEQ ID NO: 269215 - DNA, 25 bp, Mus musculus
ctcctgctgtgaaatcttctattcc

SEQ ID NO: 269216 - DNA, 25 bp, Mus musculus
ctcctgcttccggtgttccgaatgc

SEQ ID NO: 269217 - DNA, 25 bp, Mus musculus
ctcctgcttggctcctgtagtttca

SEQ ID NO: 269218 - DNA, 25 bp, Mus musculus
ctcctggaaaactgggcccattgac

SEQ ID NO: 269219 - DNA, 25 bp, Mus musculus
ctcctggaacaacagaaaatcaatc

SEQ ID NO: 269220 - DNA, 25 bp, Mus musculus
ctcctggaacaacaggtcctcagaa

SEQ ID NO: 269221 - DNA, 25 bp, Mus musculus
ctcctggaacaggaacgttggcggg

SEQ ID NO: 269222 - DNA, 25 bp, Mus musculus
ctcctggaacggcagatcacagagc

SEQ ID NO: 269223 - DNA, 25 bp, Mus musculus
ctcctggaacggcagcgtgttgagg

SEQ ID NO: 269224 - DNA, 25 bp, Mus musculus
ctcctggaacggcaggtagagatga

SEQ ID NO: 269225 - DNA, 25 bp, Mus musculus
ctcctggaactatgtcttcagtacc

SEQ ID NO: 269226 - DNA, 25 bp, Mus musculus
ctcctggaactcaagttggtgggaa

SEQ ID NO: 269227 - DNA, 25 bp, Mus musculus
ctcctggaactcaagtttggacgtc

SEQ ID NO: 269228 - DNA, 25 bp, Mus musculus
ctcctggaactgaataaaagctgtg

SEQ ID NO: 269229 - DNA, 25 bp, Mus musculus
ctcctggaactgtgttacatcctga

SEQ ID NO: 269230 - DNA, 25 bp, Mus musculus
ctcctggaatcagcagccagtgagg

SEQ ID NO: 269231 - DNA, 25 bp, Mus musculus
ctcctggaatgccgccatgactacc

SEQ ID NO: 269232 - DNA, 25 bp, Mus musculus
ctcctggagcagcctgactctgact

SEQ ID NO: 269233 - DNA, 25 bp, Mus musculus
ctcctggagctcagcttttccagac

SEQ ID NO: 269234 - DNA, 25 bp, Mus musculus
ctcctggaggagttctcagagtaca

SEQ ID NO: 269235 - DNA, 25 bp, Mus musculus
ctcctggagggcatatcctttttac

SEQ ID NO: 269236 - DNA, 25 bp, Mus musculus
ctcctggatatatctattcttccaa

SEQ ID NO: 269237 - DNA, 25 bp, Mus musculus
ctcctggatgaaaggtcgagatttc

SEQ ID NO: 269238 - DNA, 25 bp, Mus musculus
ctcctggatgctcagacatggtgcc

SEQ ID NO: 269239 - DNA, 25 bp, Mus musculus
ctcctggatgctcagagacaatgtc

SEQ ID NO: 269240 - DNA, 25 bp, Mus musculus
ctcctggcagccaaccaatggaatc

SEQ ID NO: 269241 - DNA, 25 bp, Mus musculus
ctcctggcagcctggtgatcctgcc

SEQ ID NO: 269242 - DNA, 25 bp, Mus musculus
ctcctggcaggaaggcctgcgcttt

SEQ ID NO: 269243 - DNA, 25 bp, Mus musculus
ctcctggcataaggatgctttcatt

SEQ ID NO: 269244 - DNA, 25 bp, Mus musculus
ctcctggcataagggagctggtaag

SEQ ID NO: 269245 - DNA, 25 bp, Mus musculus
ctcctggcatgcggcctcctcctcc

SEQ ID NO: 269246 - DNA, 25 bp, Mus musculus
ctcctggcatggtacttttctcact

SEQ ID NO: 269247 - DNA, 25 bp, Mus musculus
ctcctggccacgaaacactctctgg

SEQ ID NO: 269248 - DNA, 25 bp, Mus musculus
ctcctggcccagcaaccttccctgg

SEQ ID NO: 269249 - DNA, 25 bp, Mus musculus
ctcctggcccagcaatcttccctgg

SEQ ID NO: 269250 - DNA, 25 bp, Mus musculus
ctcctggccccaaggtggccattga

SEQ ID NO: 269251 - DNA, 25 bp, Mus musculus
ctcctggccctcagggacctgcagg

SEQ ID NO: 269252 - DNA, 25 bp, Mus musculus
ctcctggccgatgaggtaatcactg

SEQ ID NO: 269253 - DNA, 25 bp, Mus musculus
ctcctggccgatgagtaatatgcag

SEQ ID NO: 269254 - DNA, 25 bp, Mus musculus
ctcctggctccagatgacctcatcc

SEQ ID NO: 269255 - DNA, 25 bp, Mus musculus
ctcctggctccagcggacgcccgtg

SEQ ID NO: 269256 - DNA, 25 bp, Mus musculus
ctcctggctgttggagacaggagca

SEQ ID NO: 269257 - DNA, 25 bp, Mus musculus
ctcctggcttgccgggccctccagg

SEQ ID NO: 269258 - DNA, 25 bp, Mus musculus
ctcctgggaccaactcagtacctgt

SEQ ID NO: 269259 - DNA, 25 bp, Mus musculus
ctcctgggagtccttttgtcctctg

SEQ ID NO: 269260 - DNA, 25 bp, Mus musculus
ctcctgggatcctataaatttgaaa

SEQ ID NO: 269261 - DNA, 25 bp, Mus musculus
ctcctgggattctgtctcaaaccat

SEQ ID NO: 269262 - DNA, 25 bp, Mus musculus
ctcctgggccctcaccagagcagca

SEQ ID NO: 269263 - DNA, 25 bp, Mus musculus
ctcctgggcttggggaagtcccaga

SEQ ID NO: 269264 - DNA, 25 bp, Mus musculus
ctcctggggctgcgccggagcgcag

SEQ ID NO: 269265 - DNA, 25 bp, Mus musculus
ctcctggggtacagattcccgtggg

SEQ ID NO: 269266 - DNA, 25 bp, Mus musculus
ctcctgggtgcccgggatgaaagtg

SEQ ID NO: 269267 - DNA, 25 bp, Mus musculus
ctcctggtacagaggtatctacaca

SEQ ID NO: 269268 - DNA, 25 bp, Mus musculus
ctcctggtacagtgacagctcttac

SEQ ID NO: 269269 - DNA, 25 bp, Mus musculus
ctcctggtaccagactctcatggac

SEQ ID NO: 269270 - DNA, 25 bp, Mus musculus
ctcctggtcccagcgcaggagcctg

SEQ ID NO: 269271 - DNA, 25 bp, Mus musculus
ctcctggtctcaggaatctatgaat

SEQ ID NO: 269272 - DNA, 25 bp, Mus musculus
ctcctggtctcaggtaatctccaaa

SEQ ID NO: 269273 - DNA, 25 bp, Mus musculus
ctcctggtctgagaggtcttcctgg

SEQ ID NO: 269274 - DNA, 25 bp, Mus musculus
ctcctggtgccaagggcgaagctgg

SEQ ID NO: 269275 - DNA, 25 bp, Mus musculus
ctcctggtgctaatacaacctgtgg

SEQ ID NO: 269276 - DNA, 25 bp, Mus musculus
ctcctggtgctaatcacagaactgt

SEQ ID NO: 269277 - DNA, 25 bp, Mus musculus
ctcctggtgctaatgtctgtgcgtc

SEQ ID NO: 269278 - DNA, 25 bp, Mus musculus
ctcctggtggctcagtttctacagt

SEQ ID NO: 269279 - DNA, 25 bp, Mus musculus
ctcctggtggtgaccgcagggaggc

SEQ ID NO: 269280 - DNA, 25 bp, Mus musculus
ctcctggtggtgcgtcttctgggac

SEQ ID NO: 269281 - DNA, 25 bp, Mus musculus
ctcctggtgttggagcccctgggaa

SEQ ID NO: 269282 - DNA, 25 bp, Mus musculus
ctcctggtgttggagctctgtgata

SEQ ID NO: 269283 - DNA, 25 bp, Mus musculus
ctcctggtgttggaggaagtaaagc

SEQ ID NO: 269284 - DNA, 25 bp, Mus musculus
ctcctggttacggtcatttggtgtc

SEQ ID NO: 269285 - DNA, 25 bp, Mus musculus
ctcctggttcgcctgggtggcggct

SEQ ID NO: 269286 - DNA, 25 bp, Mus musculus
ctcctggttcggggccgtcgtgacc

SEQ ID NO: 269287 - DNA, 25 bp, Mus musculus
ctcctggtttaggagatcccagcca

SEQ ID NO: 269288 - DNA, 25 bp, Mus musculus
ctcctgtacaggttggcggacctca

SEQ ID NO: 269289 - DNA, 25 bp, Mus musculus
ctcctgtacttgcgaaagcagttga

SEQ ID NO: 269290 - DNA, 25 bp, Mus musculus
ctcctgtacttggttcgtcaatgca

SEQ ID NO: 269291 - DNA, 25 bp, Mus musculus
ctcctgtagagagccatatacagaa

SEQ ID NO: 269292 - DNA, 25 bp, Mus musculus
ctcctgtagaggtgaggcatgaaat

SEQ ID NO: 269293 - DNA, 25 bp, Mus musculus
ctcctgtagcgatgaagaaagagga

SEQ ID NO: 269294 - DNA, 25 bp, Mus musculus
ctcctgtcagatgggattgatgagg

SEQ ID NO: 269295 - DNA, 25 bp, Mus musculus
ctcctgtcaggccagatttggacca

SEQ ID NO: 269296 - DNA, 25 bp, Mus musculus
ctcctgtccacgcggttctatggta

SEQ ID NO: 269297 - DNA, 25 bp, Mus musculus
ctcctgtccacgcgtgcagtctgca

SEQ ID NO: 269298 - DNA, 25 bp, Mus musculus
ctcctgtccagcaaatctcccagct

SEQ ID NO: 269299 - DNA, 25 bp, Mus musculus
ctcctgtcctcagaggtgtgctcct

SEQ ID NO: 269300 - DNA, 25 bp, Mus musculus
ctcctgtcctgagctttcccgagac

SEQ ID NO: 269301 - DNA, 25 bp, Mus musculus
ctcctgtcgcagcctcggcctggca

SEQ ID NO: 269302 - DNA, 25 bp, Mus musculus
ctcctgtcgcctgtagttgcagccc

SEQ ID NO: 269303 - DNA, 25 bp, Mus musculus
ctcctgtcggcatggcagcccaccc

SEQ ID NO: 269304 - DNA, 25 bp, Mus musculus
ctcctgtctgagcgggaggaagcac

SEQ ID NO: 269305 - DNA, 25 bp, Mus musculus
ctcctgtctgagctctttcctgtaa

SEQ ID NO: 269306 - DNA, 25 bp, Mus musculus
ctcctgtctgagtggacgagcgaag

SEQ ID NO: 269307 - DNA, 25 bp, Mus musculus
ctcctgtgaagacagggccagtgcg

SEQ ID NO: 269308 - DNA, 25 bp, Mus musculus
ctcctgtgcccacaagcctcccctc

SEQ ID NO: 269309 - DNA, 25 bp, Mus musculus
ctcctgtgctagtttcgcatttggc

SEQ ID NO: 269310 - DNA, 25 bp, Mus musculus
ctcctgtggcaagggagtcatccag

SEQ ID NO: 269311 - DNA, 25 bp, Mus musculus
ctcctgtgtagtgtgaaacagaaga

SEQ ID NO: 269312 - DNA, 25 bp, Mus musculus
ctcctgtgtatgctacaggagggga

SEQ ID NO: 269313 - DNA, 25 bp, Mus musculus
ctcctgtgttacaagctaatggcac

SEQ ID NO: 269314 - DNA, 25 bp, Mus musculus
ctcctgtgttacaagggactgagtg

SEQ ID NO: 269315 - DNA, 25 bp, Mus musculus
ctcctgttaggcgtctcttttctcc

SEQ ID NO: 269316 - DNA, 25 bp, Mus musculus
ctcctgttccaggatggaggtaaag

SEQ ID NO: 269317 - DNA, 25 bp, Mus musculus
ctcctgttgaggatattttctttcc

SEQ ID NO: 269318 - DNA, 25 bp, Mus musculus
ctcctgttgaggcctggaatgtcct

SEQ ID NO: 269319 - DNA, 25 bp, Mus musculus
ctcctgttggagcgggcggcaggaa

SEQ ID NO: 269320 - DNA, 25 bp, Mus musculus
ctcctgttggtggtcatcaactcca

SEQ ID NO: 269321 - DNA, 25 bp, Mus musculus
ctcctgttttagaaccaaccgatgt

SEQ ID NO: 269322 - DNA, 25 bp, Mus musculus
ctccttaaagcctgcggagcccaag

SEQ ID NO: 269323 - DNA, 25 bp, Mus musculus
ctccttaaattgggaagatgctggt

SEQ ID NO: 269324 - DNA, 25 bp, Mus musculus
ctccttaacactgtcataggcctcc

SEQ ID NO: 269325 - DNA, 25 bp, Mus musculus
ctccttaagggtcttgagaccatcc

SEQ ID NO: 269326 - DNA, 25 bp, Mus musculus
ctccttaccaggagatcgagactca

SEQ ID NO: 269327 - DNA, 25 bp, Mus musculus
ctccttacggcaaagtctcatacat

SEQ ID NO: 269328 - DNA, 25 bp, Mus musculus
ctccttacttcagaggagctggctc

SEQ ID NO: 269329 - DNA, 25 bp, Mus musculus
ctccttacttcagtacaggtcaagt

SEQ ID NO: 269330 - DNA, 25 bp, Mus musculus
ctccttagcaaggtcaacaacagtc

SEQ ID NO: 269331 - DNA, 25 bp, Mus musculus
ctccttaggtttgcagatgatacgt

SEQ ID NO: 269332 - DNA, 25 bp, Mus musculus
ctccttaggtttgcatgggacacag

SEQ ID NO: 269333 - DNA, 25 bp, Mus musculus
ctccttagtaaaacttacctcactg

SEQ ID NO: 269334 - DNA, 25 bp, Mus musculus
ctccttatcaggacgcacatgcaaa

SEQ ID NO: 269335 - DNA, 25 bp, Mus musculus
ctccttatcccactctgcccgacct

SEQ ID NO: 269336 - DNA, 25 bp, Mus musculus
ctccttatgacaggttctgtccatt

SEQ ID NO: 269337 - DNA, 25 bp, Mus musculus
ctccttatggcaggtgctgacctga

SEQ ID NO: 269338 - DNA, 25 bp, Mus musculus
ctccttattaccacagcgtttatgt

SEQ ID NO: 269339 - DNA, 25 bp, Mus musculus
ctccttattaccacaggaactgcat

SEQ ID NO: 269340 - DNA, 25 bp, Mus musculus
ctccttcacccgggaggaagctgat

SEQ ID NO: 269341 - DNA, 25 bp, Mus musculus
ctccttccaaagaggatttgttggt

SEQ ID NO: 269342 - DNA, 25 bp, Mus musculus
ctccttccaaagggtgatgtcttcc

SEQ ID NO: 269343 - DNA, 25 bp, Mus musculus
ctccttccacaagaagaacgagacg

SEQ ID NO: 269344 - DNA, 25 bp, Mus musculus
ctccttccacaagtttcctcttact

SEQ ID NO: 269345 - DNA, 25 bp, Mus musculus
ctccttccacaatcggtattaccag

SEQ ID NO: 269346 - DNA, 25 bp, Mus musculus
ctccttccacagacttcccaagaaa

SEQ ID NO: 269347 - DNA, 25 bp, Mus musculus
ctccttccacagctgctccgaaaga

SEQ ID NO: 269348 - DNA, 25 bp, Mus musculus
ctccttccaggatcccctgccgtgg

SEQ ID NO: 269349 - DNA, 25 bp, Mus musculus
ctccttccagtgggatgatctggcc

SEQ ID NO: 269350 - DNA, 25 bp, Mus musculus
ctccttccatggctgtgacccaatt

SEQ ID NO: 269351 - DNA, 25 bp, Mus musculus
ctccttccattatgtatagcagtgt

SEQ ID NO: 269352 - DNA, 25 bp, Mus musculus
ctccttcccgggcttttcgcagtgg

SEQ ID NO: 269353 - DNA, 25 bp, Mus musculus
ctccttccctgagcatagtaacatt

SEQ ID NO: 269354 - DNA, 25 bp, Mus musculus
ctccttccctgcacctccgcacctg

SEQ ID NO: 269355 - DNA, 25 bp, Mus musculus
ctccttccgttcagcggacgccgcg

SEQ ID NO: 269356 - DNA, 25 bp, Mus musculus
ctccttcctcagctactgtgactac

SEQ ID NO: 269357 - DNA, 25 bp, Mus musculus
ctccttcctggcattggaggcggag

SEQ ID NO: 269358 - DNA, 25 bp, Mus musculus
ctccttcctgtgccccacagattac

SEQ ID NO: 269359 - DNA, 25 bp, Mus musculus
ctccttcctgttggcaaccgtgtct

SEQ ID NO: 269360 - DNA, 25 bp, Mus musculus
ctccttcctgttgggcatctcctat

SEQ ID NO: 269361 - DNA, 25 bp, Mus musculus
ctccttccttcagaagagttcgctc

SEQ ID NO: 269362 - DNA, 25 bp, Mus musculus
ctccttccttttgggcagcaaggcg

SEQ ID NO: 269363 - DNA, 25 bp, Mus musculus
ctccttccttttgtgagattttttt

SEQ ID NO: 269364 - DNA, 25 bp, Mus musculus
ctccttccttttgttttcagctttg

SEQ ID NO: 269365 - DNA, 25 bp, Mus musculus
ctccttcggaggagccagttcttgc

SEQ ID NO: 269366 - DNA, 25 bp, Mus musculus
ctccttctacagagccttggggatt

SEQ ID NO: 269367 - DNA, 25 bp, Mus musculus
ctccttctacagtgctcctttgtcc

SEQ ID NO: 269368 - DNA, 25 bp, Mus musculus
ctccttctagtggcagacctgttgt

SEQ ID NO: 269369 - DNA, 25 bp, Mus musculus
ctccttctcccaggaagtgatccca

SEQ ID NO: 269370 - DNA, 25 bp, Mus musculus
ctccttctgggataaaaagaagcaa

SEQ ID NO: 269371 - DNA, 25 bp, Mus musculus
ctccttctgtaggtgtgctgatgat

SEQ ID NO: 269372 - DNA, 25 bp, Mus musculus
ctccttctttgaaagacactacgca

SEQ ID NO: 269373 - DNA, 25 bp, Mus musculus
ctccttgaaagacctgcctggagtt

SEQ ID NO: 269374 - DNA, 25 bp, Mus musculus
ctccttgaatacctctgcaggtgtc

SEQ ID NO: 269375 - DNA, 25 bp, Mus musculus
ctccttgactctcggtgtcctccac

SEQ ID NO: 269376 - DNA, 25 bp, Mus musculus
ctccttgaggcagctggaagctggc

SEQ ID NO: 269377 - DNA, 25 bp, Mus musculus
ctccttgataagctcgttggcgagt

SEQ ID NO: 269378 - DNA, 25 bp, Mus musculus
ctccttgatctcagatctgcagact

SEQ ID NO: 269379 - DNA, 25 bp, Mus musculus
ctccttgatctcaggtgattactga

SEQ ID NO: 269380 - DNA, 25 bp, Mus musculus
ctccttgcaacactctgggttatga

SEQ ID NO: 269381 - DNA, 25 bp, Mus musculus
ctccttgcagagcaggcaaggagaa

SEQ ID NO: 269382 - DNA, 25 bp, Mus musculus
ctccttgcagatttctaacgagcgt

SEQ ID NO: 269383 - DNA, 25 bp, Mus musculus
ctccttgcatgagacacacaacctt

SEQ ID NO: 269384 - DNA, 25 bp, Mus musculus
ctccttgccgaatgcctaaatcaaa

SEQ ID NO: 269385 - DNA, 25 bp, Mus musculus
ctccttgcgccacagactcttccaa

SEQ ID NO: 269386 - DNA, 25 bp, Mus musculus
ctccttgcttaatagacttggtccc

SEQ ID NO: 269387 - DNA, 25 bp, Mus musculus
ctccttgcttaataggtgtgtcctc

SEQ ID NO: 269388 - DNA, 25 bp, Mus musculus
ctccttggacagatgaaaaagagaa

SEQ ID NO: 269389 - DNA, 25 bp, Mus musculus
ctccttggacagtaattttatgaat

SEQ ID NO: 269390 - DNA, 25 bp, Mus musculus
ctccttggcgcttagtgctgctctg

SEQ ID NO: 269391 - DNA, 25 bp, Mus musculus
ctccttggctggcagcacagactct

SEQ ID NO: 269392 - DNA, 25 bp, Mus musculus
ctccttggctgggaaaatgacccag

SEQ ID NO: 269393 - DNA, 25 bp, Mus musculus
ctccttggctgggggaagaacagtt

SEQ ID NO: 269394 - DNA, 25 bp, Mus musculus
ctccttggcttgcagataaaaatat

SEQ ID NO: 269395 - DNA, 25 bp, Mus musculus
ctccttgggccaacacctgaatctc

SEQ ID NO: 269396 - DNA, 25 bp, Mus musculus
ctccttggtcccagctgtgcagtgc

SEQ ID NO: 269397 - DNA, 25 bp, Mus musculus
ctccttgtacagcaggcaggcaacc

SEQ ID NO: 269398 - DNA, 25 bp, Mus musculus
ctccttgtcaagtggtgtgggcata

SEQ ID NO: 269399 - DNA, 25 bp, Mus musculus
ctccttgtccaagatcgagcggtcc

SEQ ID NO: 269400 - DNA, 25 bp, Mus musculus
ctccttgtctgtcttcatctcggag

SEQ ID NO: 269401 - DNA, 25 bp, Mus musculus
ctccttgtctgttgcggggccacag

SEQ ID NO: 269402 - DNA, 25 bp, Mus musculus
ctcctttacgcagaagatgttggac

SEQ ID NO: 269403 - DNA, 25 bp, Mus musculus
ctcctttacgcaggcccagatgaca

SEQ ID NO: 269404 - DNA, 25 bp, Mus musculus
ctcctttacgcagttcacacagaag

SEQ ID NO: 269405 - DNA, 25 bp, Mus musculus
ctcctttactgacagcttttgccta

SEQ ID NO: 269406 - DNA, 25 bp, Mus musculus
ctcctttcaagaattacaggcccgg

SEQ ID NO: 269407 - DNA, 25 bp, Mus musculus
ctcctttcaggatgctgtgcgcacg

SEQ ID NO: 269408 - DNA, 25 bp, Mus musculus
ctcctttctgccagggacatgaaat

SEQ ID NO: 269409 - DNA, 25 bp, Mus musculus
ctcctttgcagactttgatcctcac

SEQ ID NO: 269410 - DNA, 25 bp, Mus musculus
ctcctttgcagagcctgaccagaca

SEQ ID NO: 269411 - DNA, 25 bp, Mus musculus
ctcctttgcagccacagacagtaag

SEQ ID NO: 269412 - DNA, 25 bp, Mus musculus
ctcctttggtgccacaagccccgcc

SEQ ID NO: 269413 - DNA, 25 bp, Mus musculus
ctcctttggttcctcaagccccgcc

SEQ ID NO: 269414 - DNA, 25 bp, Mus musculus
ctccttttaaagatcagccagatgc

SEQ ID NO: 269415 - DNA, 25 bp, Mus musculus
ctccttttacctattcatcgctcca

SEQ ID NO: 269416 - DNA, 25 bp, Mus musculus
ctccttttagaagcaattctacaga

SEQ ID NO: 269417 - DNA, 25 bp, Mus musculus
ctcctttttgctgttcactttggaa

SEQ ID NO: 269418 - DNA, 25 bp, Mus musculus
ctcgaaaaaacatgcagagatctct

SEQ ID NO: 269419 - DNA, 25 bp, Mus musculus
ctcgaaaactccaggatgtgtttga

SEQ ID NO: 269420 - DNA, 25 bp, Mus musculus
ctcgaaaatggggtccaagggtagc

SEQ ID NO: 269421 - DNA, 25 bp, Mus musculus
ctcgaaacagatcagccagcattac

SEQ ID NO: 269422 - DNA, 25 bp, Mus musculus
ctcgaaacagggtcacgtctctggg

SEQ ID NO: 269423 - DNA, 25 bp, Mus musculus
ctcgaaacagtagtttagtatgatg

SEQ ID NO: 269424 - DNA, 25 bp, Mus musculus
ctcgaaacattctattcactggcaa

SEQ ID NO: 269425 - DNA, 25 bp, Mus musculus
ctcgaaactgcatgttgcgggatga

SEQ ID NO: 269426 - DNA, 25 bp, Mus musculus
ctcgaaagtccaaggtgccccgagc

SEQ ID NO: 269427 - DNA, 25 bp, Mus musculus
ctcgaaatctgacagatttcatcat

SEQ ID NO: 269428 - DNA, 25 bp, Mus musculus
ctcgaaatctgactcagagcaaccc

SEQ ID NO: 269429 - DNA, 25 bp, Mus musculus
ctcgaaatgggaaccctaatgggga

SEQ ID NO: 269430 - DNA, 25 bp, Mus musculus
ctcgaacacctatgtgcccttccca

SEQ ID NO: 269431 - DNA, 25 bp, Mus musculus
ctcgaacacctgagccagcccgcat

SEQ ID NO: 269432 - DNA, 25 bp, Mus musculus
ctcgaacagacaagcctttgaggac

SEQ ID NO: 269433 - DNA, 25 bp, Mus musculus
ctcgaacagacaagggtgtgtctgc

SEQ ID NO: 269434 - DNA, 25 bp, Mus musculus
ctcgaaccagtggcaacactggcag

SEQ ID NO: 269435 - DNA, 25 bp, Mus musculus
ctcgaacctggaacaaggcctgagt

SEQ ID NO: 269436 - DNA, 25 bp, Mus musculus
ctcgaacggccaggtgtcgtgatta

SEQ ID NO: 269437 - DNA, 25 bp, Mus musculus
ctcgaacgtgccacggtcagggaaa

SEQ ID NO: 269438 - DNA, 25 bp, Mus musculus
ctcgaagagcaccagaattcatcct

SEQ ID NO: 269439 - DNA, 25 bp, Mus musculus
ctcgaagattccccccagctggtgc

SEQ ID NO: 269440 - DNA, 25 bp, Mus musculus
ctcgaagcagaatcagagaagctgg

SEQ ID NO: 269441 - DNA, 25 bp, Mus musculus
ctcgaagctagggtcccaaaggccg

SEQ ID NO: 269442 - DNA, 25 bp, Mus musculus
ctcgaagtcgctaggacttctctca

SEQ ID NO: 269443 - DNA, 25 bp, Mus musculus
ctcgaagtgagattgaccttgttca

SEQ ID NO: 269444 - DNA, 25 bp, Mus musculus
ctcgaagttcaatatgctcccaagc

SEQ ID NO: 269445 - DNA, 25 bp, Mus musculus
ctcgaatacgaaaatggatcgaaca

SEQ ID NO: 269446 - DNA, 25 bp, Mus musculus
ctcgaatgacacccatgaaccgcac

SEQ ID NO: 269447 - DNA, 25 bp, Mus musculus
ctcgaatttaagcgtctagccagct

SEQ ID NO: 269448 - DNA, 25 bp, Mus musculus
ctcgacaaagcatagtaacattcca

SEQ ID NO: 269449 - DNA, 25 bp, Mus musculus
ctcgacaagtaaagaatctgctgga

SEQ ID NO: 269450 - DNA, 25 bp, Mus musculus
ctcgacacaatacaaaagaaagaaa

SEQ ID NO: 269451 - DNA, 25 bp, Mus musculus
ctcgacagcctgatgggggatgagt

SEQ ID NO: 269452 - DNA, 25 bp, Mus musculus
ctcgacagcctgattggagatagca

SEQ ID NO: 269453 - DNA, 25 bp, Mus musculus
ctcgacagcgcggagacgcgtggcg

SEQ ID NO: 269454 - DNA, 25 bp, Mus musculus
ctcgacaggcctaagtgtccaccat

SEQ ID NO: 269455 - DNA, 25 bp, Mus musculus
ctcgacagtgttagcaacaagacgg

SEQ ID NO: 269456 - DNA, 25 bp, Mus musculus
ctcgacatagatatcccaatgtctg

SEQ ID NO: 269457 - DNA, 25 bp, Mus musculus
ctcgacataggtgcactgcatcagc

SEQ ID NO: 269458 - DNA, 25 bp, Mus musculus
ctcgacatgagcaaggtctttgaag

SEQ ID NO: 269459 - DNA, 25 bp, Mus musculus
ctcgacatggagatgagtgtgaatg

SEQ ID NO: 269460 - DNA, 25 bp, Mus musculus
ctcgacatggaggaccctctgtcat

SEQ ID NO: 269461 - DNA, 25 bp, Mus musculus
ctcgaccacaggaagaagagctgga

SEQ ID NO: 269462 - DNA, 25 bp, Mus musculus
ctcgaccagagagaagcaaccattg

SEQ ID NO: 269463 - DNA, 25 bp, Mus musculus
ctcgaccagctgcttaaaggatagc

SEQ ID NO: 269464 - DNA, 25 bp, Mus musculus
ctcgacctggaggatgtttcttgcg

SEQ ID NO: 269465 - DNA, 25 bp, Mus musculus
ctcgaccttactatgaggtctacac

SEQ ID NO: 269466 - DNA, 25 bp, Mus musculus
ctcgaccttactatggagaaggaag

SEQ ID NO: 269467 - DNA, 25 bp, Mus musculus
ctcgacctttgaatgatagagacag

SEQ ID NO: 269468 - DNA, 25 bp, Mus musculus
ctcgacgagtccagattgctgaagc

SEQ ID NO: 269469 - DNA, 25 bp, Mus musculus
ctcgacgcagcaggtcttctatcag

SEQ ID NO: 269470 - DNA, 25 bp, Mus musculus
ctcgacggcccaagcctactcgccc

SEQ ID NO: 269471 - DNA, 25 bp, Mus musculus
ctcgactcattaaagagtggccgag

SEQ ID NO: 269472 - DNA, 25 bp, Mus musculus
ctcgactccgcatatttcagacttc

SEQ ID NO: 269473 - DNA, 25 bp, Mus musculus
ctcgactccgcattggaactggaac

SEQ ID NO: 269474 - DNA, 25 bp, Mus musculus
ctcgactctataaattggagctggc

SEQ ID NO: 269475 - DNA, 25 bp, Mus musculus
ctcgactgaccttggcatgcttgct

SEQ ID NO: 269476 - DNA, 25 bp, Mus musculus
ctcgactgagggtccaaaccttgtc

SEQ ID NO: 269477 - DNA, 25 bp, Mus musculus
ctcgactgtgcccggaatcccagtc

SEQ ID NO: 269478 - DNA, 25 bp, Mus musculus
ctcgacttagaatattagaagtggc

SEQ ID NO: 269479 - DNA, 25 bp, Mus musculus
ctcgacttaggagcaggctgccctc

SEQ ID NO: 269480 - DNA, 25 bp, Mus musculus
ctcgacttagtgcggctgtgtggag

SEQ ID NO: 269481 - DNA, 25 bp, Mus musculus
ctcgacttctgcagctaatgggaat

SEQ ID NO: 269482 - DNA, 25 bp, Mus musculus
ctcgagaaattcgggccaatggtgg

SEQ ID NO: 269483 - DNA, 25 bp, Mus musculus
ctcgagaagcagagattttattccc

SEQ ID NO: 269484 - DNA, 25 bp, Mus musculus
ctcgagacactacaggagagcacac

SEQ ID NO: 269485 - DNA, 25 bp, Mus musculus
ctcgagacgggccattgctcctgtg

SEQ ID NO: 269486 - DNA, 25 bp, Mus musculus
ctcgagactcaaggtcaacatggcc

SEQ ID NO: 269487 - DNA, 25 bp, Mus musculus
ctcgagactcaagtttagctgttaa

SEQ ID NO: 269488 - DNA, 25 bp, Mus musculus
ctcgagcagagtccgtctcccaggg

SEQ ID NO: 269489 - DNA, 25 bp, Mus musculus
ctcgagccagacagattccctcctt

SEQ ID NO: 269490 - DNA, 25 bp, Mus musculus
ctcgagccaggttctctccactatg

SEQ ID NO: 269491 - DNA, 25 bp, Mus musculus
ctcgagcccgctgcctgtgcctatc

SEQ ID NO: 269492 - DNA, 25 bp, Mus musculus
ctcgagcccggggactttgtgcagc

SEQ ID NO: 269493 - DNA, 25 bp, Mus musculus
ctcgagcccggtacctgggccagct

SEQ ID NO: 269494 - DNA, 25 bp, Mus musculus
ctcgaggacaagatgctcatgagca

SEQ ID NO: 269495 - DNA, 25 bp, Mus musculus
ctcgaggagaaattggtccttaccc

SEQ ID NO: 269496 - DNA, 25 bp, Mus musculus
ctcgaggaggtggaggacctcatgg

SEQ ID NO: 269497 - DNA, 25 bp, Mus musculus
ctcgaggatgaagaaagaagcatcg

SEQ ID NO: 269498 - DNA, 25 bp, Mus musculus
ctcgagggaaagtgtccacagacaa

SEQ ID NO: 269499 - DNA, 25 bp, Mus musculus
ctcgagggccttcaggaagatgcta

SEQ ID NO: 269500 - DNA, 25 bp, Mus musculus
ctcgagggttccctgatctatgagg

SEQ ID NO: 269501 - DNA, 25 bp, Mus musculus
ctcgaggtgccccgggtgaacgcgg

SEQ ID NO: 269502 - DNA, 25 bp, Mus musculus
ctcgagtcaccgtttgccatctctg

SEQ ID NO: 269503 - DNA, 25 bp, Mus musculus
ctcgagtgatcatgtgcctctcctt

SEQ ID NO: 269504 - DNA, 25 bp, Mus musculus
ctcgagtgcggacgggaatctggtc

SEQ ID NO: 269505 - DNA, 25 bp, Mus musculus
ctcgagtggcaggagaaacccaagc

SEQ ID NO: 269506 - DNA, 25 bp, Mus musculus
ctcgagtggcaggaggtccggagtt

SEQ ID NO: 269507 - DNA, 25 bp, Mus musculus
ctcgagttgctccttcctctccact

SEQ ID NO: 269508 - DNA, 25 bp, Mus musculus
ctcgataataagatcagcaccagtg

SEQ ID NO: 269509 - DNA, 25 bp, Mus musculus
ctcgatcaactcaataaagccgttg

SEQ ID NO: 269510 - DNA, 25 bp, Mus musculus
ctcgatcaactcagccggctcaaca

SEQ ID NO: 269511 - DNA, 25 bp, Mus musculus
ctcgatgccctggtcgtgtgcccct

SEQ ID NO: 269512 - DNA, 25 bp, Mus musculus
ctcgatggcatcaagttcatgggcg

SEQ ID NO: 269513 - DNA, 25 bp, Mus musculus
ctcgatggcggagaggtgtctgtga

SEQ ID NO: 269514 - DNA, 25 bp, Mus musculus
ctcgatggcggagagtgaggggtca

SEQ ID NO: 269515 - DNA, 25 bp, Mus musculus
ctcgatgtcgttgaacggtcaccac

SEQ ID NO: 269516 - DNA, 25 bp, Mus musculus
ctcgatgtgtttacagtggataatg

SEQ ID NO: 269517 - DNA, 25 bp, Mus musculus
ctcgatgttccactcgctctttgcc

SEQ ID NO: 269518 - DNA, 25 bp, Mus musculus
ctcgatgttccactcggatcaagtt

SEQ ID NO: 269519 - DNA, 25 bp, Mus musculus
ctcgcaaaccagctccttaattgat

SEQ ID NO: 269520 - DNA, 25 bp, Mus musculus
ctcgcaaattacgtccacagcaaag

SEQ ID NO: 269521 - DNA, 25 bp, Mus musculus
ctcgcaacgaggagactccagaacc

SEQ ID NO: 269522 - DNA, 25 bp, Mus musculus
ctcgcaagctgcaggctgcactgag

SEQ ID NO: 269523 - DNA, 25 bp, Mus musculus
ctcgcaagctgcgggtgcagcaggc

SEQ ID NO: 269524 - DNA, 25 bp, Mus musculus
ctcgcaaggccaagagcacggacga

SEQ ID NO: 269525 - DNA, 25 bp, Mus musculus
ctcgcaaggccaagctattacaagc

SEQ ID NO: 269526 - DNA, 25 bp, Mus musculus
ctcgcacaaggccccgaaatgggac

SEQ ID NO: 269527 - DNA, 25 bp, Mus musculus
ctcgcacaccgagatatgaggatca

SEQ ID NO: 269528 - DNA, 25 bp, Mus musculus
ctcgcacacggcctctgtgctcgaa

SEQ ID NO: 269529 - DNA, 25 bp, Mus musculus
ctcgcacacggcctggaggtgtgac

SEQ ID NO: 269530 - DNA, 25 bp, Mus musculus
ctcgcacacgggggacgcccccttc

SEQ ID NO: 269531 - DNA, 25 bp, Mus musculus
ctcgcacagcatgatcaacaggccc

SEQ ID NO: 269532 - DNA, 25 bp, Mus musculus
ctcgcacaggacctaaagattgtct

SEQ ID NO: 269533 - DNA, 25 bp, Mus musculus
ctcgcacaggctaggtatgacggag

SEQ ID NO: 269534 - DNA, 25 bp, Mus musculus
ctcgcacagtgatgatgtgctgact

SEQ ID NO: 269535 - DNA, 25 bp, Mus musculus
ctcgcacagtgggctgttggtgctg

SEQ ID NO: 269536 - DNA, 25 bp, Mus musculus
ctcgcacagtggtttcaagtgcccc

SEQ ID NO: 269537 - DNA, 25 bp, Mus musculus
ctcgcacattacaaggacatgggca

SEQ ID NO: 269538 - DNA, 25 bp, Mus musculus
ctcgcacccaaatagcgctggcgtg

SEQ ID NO: 269539 - DNA, 25 bp, Mus musculus
ctcgcaccggaagaaaagatgtgga

SEQ ID NO: 269540 - DNA, 25 bp, Mus musculus
ctcgcactatggtccacgcttcatg

SEQ ID NO: 269541 - DNA, 25 bp, Mus musculus
ctcgcagaaagaagctctacaaaga

SEQ ID NO: 269542 - DNA, 25 bp, Mus musculus
ctcgcagaaagtgggtttcccgtct

SEQ ID NO: 269543 - DNA, 25 bp, Mus musculus
ctcgcagcaggaagaagtagctaaa

SEQ ID NO: 269544 - DNA, 25 bp, Mus musculus
ctcgcagctagcaggtgccttccaa

SEQ ID NO: 269545 - DNA, 25 bp, Mus musculus
ctcgcagtgcttagagaacgatgtg

SEQ ID NO: 269546 - DNA, 25 bp, Mus musculus
ctcgcagtgcttagctcttctgtcg

SEQ ID NO: 269547 - DNA, 25 bp, Mus musculus
ctcgcagttcaaggagatgccagac

SEQ ID NO: 269548 - DNA, 25 bp, Mus musculus
ctcgcataggcagttctcccagatg

SEQ ID NO: 269549 - DNA, 25 bp, Mus musculus
ctcgcatatactaggtcctgtggga

SEQ ID NO: 269550 - DNA, 25 bp, Mus musculus
ctcgcatcaactgcagccaggctat

SEQ ID NO: 269551 - DNA, 25 bp, Mus musculus
ctcgcatgaaggagatcttggacaa

SEQ ID NO: 269552 - DNA, 25 bp, Mus musculus
ctcgcattccggatgattgtaaagt

SEQ ID NO: 269553 - DNA, 25 bp, Mus musculus
ctcgcatttgctgtccgctacagag

SEQ ID NO: 269554 - DNA, 25 bp, Mus musculus
ctcgccaaggctggctggctactcg

SEQ ID NO: 269555 - DNA, 25 bp, Mus musculus
ctcgccacagagctcagcagtcagc

SEQ ID NO: 269556 - DNA, 25 bp, Mus musculus
ctcgccaccagtcaactcctagtac

SEQ ID NO: 269557 - DNA, 25 bp, Mus musculus
ctcgccaccagtgctgaggatcaaa

SEQ ID NO: 269558 - DNA, 25 bp, Mus musculus
ctcgccaccagttaaaaagtatgga

SEQ ID NO: 269559 - DNA, 25 bp, Mus musculus
ctcgccactgcacagattgcatctg

SEQ ID NO: 269560 - DNA, 25 bp, Mus musculus
ctcgccatagtgggacaatatccca

SEQ ID NO: 269561 - DNA, 25 bp, Mus musculus
ctcgccatcgagcaggtattcccaa

SEQ ID NO: 269562 - DNA, 25 bp, Mus musculus
ctcgccatcgagcaggtgtcaccgg

SEQ ID NO: 269563 - DNA, 25 bp, Mus musculus
ctcgccatgaagaagcccattggaa

SEQ ID NO: 269564 - DNA, 25 bp, Mus musculus
ctcgcccatcaagggaaaactcgat

SEQ ID NO: 269565 - DNA, 25 bp, Mus musculus
ctcgcccatgtcagtatttcctaaa

SEQ ID NO: 269566 - DNA, 25 bp, Mus musculus
ctcgccccagaggtcacccggcctg

SEQ ID NO: 269567 - DNA, 25 bp, Mus musculus
ctcgccccagaggtgacccttaccc

SEQ ID NO: 269568 - DNA, 25 bp, Mus musculus
ctcgccccaggcactgggctccctc

SEQ ID NO: 269569 - DNA, 25 bp, Mus musculus
ctcgcccccagagattaatgtggct

SEQ ID NO: 269570 - DNA, 25 bp, Mus musculus
ctcgcccccagaggtgtcgtggagg

SEQ ID NO: 269571 - DNA, 25 bp, Mus musculus
ctcgcccccgaccagagcagagggc

SEQ ID NO: 269572 - DNA, 25 bp, Mus musculus
ctcgccccgagagactgaattccct

SEQ ID NO: 269573 - DNA, 25 bp, Mus musculus
ctcgcccgactatctctcacctatc

SEQ ID NO: 269574 - DNA, 25 bp, Mus musculus
ctcgccctctcaagctcagcctttt

SEQ ID NO: 269575 - DNA, 25 bp, Mus musculus
ctcgccctgccgggagccctgcagg

SEQ ID NO: 269576 - DNA, 25 bp, Mus musculus
ctcgccctttgaacttatattggat

SEQ ID NO: 269577 - DNA, 25 bp, Mus musculus
ctcgccgagcagaacatgccggggt

SEQ ID NO: 269578 - DNA, 25 bp, Mus musculus
ctcgccgagcagcctgtagtgaaag

SEQ ID NO: 269579 - DNA, 25 bp, Mus musculus
ctcgccgagggcataacctgggtcc

SEQ ID NO: 269580 - DNA, 25 bp, Mus musculus
ctcgccgccctccccactgcgtctc

SEQ ID NO: 269581 - DNA, 25 bp, Mus musculus
ctcgccgccgagctggagaactacg

SEQ ID NO: 269582 - DNA, 25 bp, Mus musculus
ctcgccgccgagctggaggtggggc

SEQ ID NO: 269583 - DNA, 25 bp, Mus musculus
ctcgccgcctcgatgagcagctctc

SEQ ID NO: 269584 - DNA, 25 bp, Mus musculus
ctcgccgcgcagactgggaagagtg

SEQ ID NO: 269585 - DNA, 25 bp, Mus musculus
ctcgccgcgcaggatctaccaaggc

SEQ ID NO: 269586 - DNA, 25 bp, Mus musculus
ctcgccgcgcttcagggcaactatt

SEQ ID NO: 269587 - DNA, 25 bp, Mus musculus
ctcgccggcagctcttcctcccctc

SEQ ID NO: 269588 - DNA, 25 bp, Mus musculus
ctcgccggcagggttgggatcacac

SEQ ID NO: 269589 - DNA, 25 bp, Mus musculus
ctcgccgggggaagagtacacacga

SEQ ID NO: 269590 - DNA, 25 bp, Mus musculus
ctcgccgtctggggcctcatttcag

SEQ ID NO: 269591 - DNA, 25 bp, Mus musculus
ctcgccgtggggctgcagcagcctc

SEQ ID NO: 269592 - DNA, 25 bp, Mus musculus
ctcgcctaccctgggagtttttcgt

SEQ ID NO: 269593 - DNA, 25 bp, Mus musculus
ctcgcctcagagtgtgttcagttcc

SEQ ID NO: 269594 - DNA, 25 bp, Mus musculus
ctcgcctcagagttccctggcagct

SEQ ID NO: 269595 - DNA, 25 bp, Mus musculus
ctcgcctgagactcgtcctcccacg

SEQ ID NO: 269596 - DNA, 25 bp, Mus musculus
ctcgcctgcaaggttcctgctgctg

SEQ ID NO: 269597 - DNA, 25 bp, Mus musculus
ctcgcctgcaagtgtctcactttac

SEQ ID NO: 269598 - DNA, 25 bp, Mus musculus
ctcgcctgcgtgacgtgtcacgatg

SEQ ID NO: 269599 - DNA, 25 bp, Mus musculus
ctcgcctgtgaactcatcagcacct

SEQ ID NO: 269600 - DNA, 25 bp, Mus musculus
ctcgcctgtggttggtgacaaacag

SEQ ID NO: 269601 - DNA, 25 bp, Mus musculus
ctcgccttccaagagttttcttgga

SEQ ID NO: 269602 - DNA, 25 bp, Mus musculus
ctcgccttgccttctctcaaactcc

SEQ ID NO: 269603 - DNA, 25 bp, Mus musculus
ctcgcctttggtaccacgtacacag

SEQ ID NO: 269604 - DNA, 25 bp, Mus musculus
ctcgcgaaccttgcccatggcgaat

SEQ ID NO: 269605 - DNA, 25 bp, Mus musculus
ctcgcgaaccttgggaattcgacac

SEQ ID NO: 269606 - DNA, 25 bp, Mus musculus
ctcgcgaggacgatccactgcaaca

SEQ ID NO: 269607 - DNA, 25 bp, Mus musculus
ctcgcgagtcccaagccccacccac

SEQ ID NO: 269608 - DNA, 25 bp, Mus musculus
ctcgcgcagcatgaaagatgtattc

SEQ ID NO: 269609 - DNA, 25 bp, Mus musculus
ctcgcgcagcatgtcaaagaaaaga

SEQ ID NO: 269610 - DNA, 25 bp, Mus musculus
ctcgcgcatccaggtcatccttcgg

SEQ ID NO: 269611 - DNA, 25 bp, Mus musculus
ctcgcgccagaggaaggtgggagtc

SEQ ID NO: 269612 - DNA, 25 bp, Mus musculus
ctcgcgccagagtttgtgatcctgt

SEQ ID NO: 269613 - DNA, 25 bp, Mus musculus
ctcgcgcctccagtgaccaaagact

SEQ ID NO: 269614 - DNA, 25 bp, Mus musculus
ctcgcgcctccagtttttggctttc

SEQ ID NO: 269615 - DNA, 25 bp, Mus musculus
ctcgcggagagcggtcccgtaggcc

SEQ ID NO: 269616 - DNA, 25 bp, Mus musculus
ctcgcggagccgagtaaagacattt

SEQ ID NO: 269617 - DNA, 25 bp, Mus musculus
ctcgcggagtcagaaggtagcaggt

SEQ ID NO: 269618 - DNA, 25 bp, Mus musculus
ctcgcggagtcaggctcttgtctgg

SEQ ID NO: 269619 - DNA, 25 bp, Mus musculus
ctcgcggccgagggtacttgtggaa

SEQ ID NO: 269620 - DNA, 25 bp, Mus musculus
ctcgcggcctaaactccagtctttc

SEQ ID NO: 269621 - DNA, 25 bp, Mus musculus
ctcgcggcctgcagatcttgaacca

SEQ ID NO: 269622 - DNA, 25 bp, Mus musculus
ctcgcggcctgcagcacatcttcat

SEQ ID NO: 269623 - DNA, 25 bp, Mus musculus
ctcgcggcgagggtggtcctggact

SEQ ID NO: 269624 - DNA, 25 bp, Mus musculus
ctcgcggcgaggtaattgaagatag

SEQ ID NO: 269625 - DNA, 25 bp, Mus musculus
ctcgcggcggaagactgctagctac

SEQ ID NO: 269626 - DNA, 25 bp, Mus musculus
ctcgcggcggatagaaggacaagga

SEQ ID NO: 269627 - DNA, 25 bp, Mus musculus
ctcgcggcgggtaccttaacatggg

SEQ ID NO: 269628 - DNA, 25 bp, Mus musculus
ctcgcggcttgactaaaatgtcaaa

SEQ ID NO: 269629 - DNA, 25 bp, Mus musculus
ctcgcggggcaggtgtccatgttgg

SEQ ID NO: 269630 - DNA, 25 bp, Mus musculus
ctcgcggtgctcagggaggttacag

SEQ ID NO: 269631 - DNA, 25 bp, Mus musculus
ctcgcggtgctcagtgtctggagac

SEQ ID NO: 269632 - DNA, 25 bp, Mus musculus
ctcgcggtttgctggaaaggaagca

SEQ ID NO: 269633 - DNA, 25 bp, Mus musculus
ctcgcggtttgctggtacacactgg

SEQ ID NO: 269634 - DNA, 25 bp, Mus musculus
ctcgcgtcgctccgaaatcatgtcc

SEQ ID NO: 269635 - DNA, 25 bp, Mus musculus
ctcgcgtctagggagtagaacagag

SEQ ID NO: 269636 - DNA, 25 bp, Mus musculus
ctcgctacgaggtgtgggctcaccg

SEQ ID NO: 269637 - DNA, 25 bp, Mus musculus
ctcgctacgataggaaacagatggg

SEQ ID NO: 269638 - DNA, 25 bp, Mus musculus
ctcgctacgataggaacacatcaag

SEQ ID NO: 269639 - DNA, 25 bp, Mus musculus
ctcgctacgatagtggttccatgtc

SEQ ID NO: 269640 - DNA, 25 bp, Mus musculus
ctcgctactacaagaaacatggcat

SEQ ID NO: 269641 - DNA, 25 bp, Mus musculus
ctcgctattcagattcttctggaat

SEQ ID NO: 269642 - DNA, 25 bp, Mus musculus
ctcgctcaaaggagaaaggatcctg

SEQ ID NO: 269643 - DNA, 25 bp, Mus musculus
ctcgctcaaaggtcgatccttcggg

SEQ ID NO: 269644 - DNA, 25 bp, Mus musculus
ctcgctccaaagaacctaaggaagg

SEQ ID NO: 269645 - DNA, 25 bp, Mus musculus
ctcgctccaaagagaaaacggcccc

SEQ ID NO: 269646 - DNA, 25 bp, Mus musculus
ctcgctccaaagatcctgtctctac

SEQ ID NO: 269647 - DNA, 25 bp, Mus musculus
ctcgctccaaaggctgcctgcttct

SEQ ID NO: 269648 - DNA, 25 bp, Mus musculus
ctcgctcctccctcgagaggagctg

SEQ ID NO: 269649 - DNA, 25 bp, Mus musculus
ctcgctcgtgccaagtctcacacag

SEQ ID NO: 269650 - DNA, 25 bp, Mus musculus
ctcgctgacccagcggcgaggacga

SEQ ID NO: 269651 - DNA, 25 bp, Mus musculus
ctcgctgctataggcatgaaagaag

SEQ ID NO: 269652 - DNA, 25 bp, Mus musculus
ctcgctgctataggctactattgga

SEQ ID NO: 269653 - DNA, 25 bp, Mus musculus
ctcgctggccagtatgtggcctttg

SEQ ID NO: 269654 - DNA, 25 bp, Mus musculus
ctcgctgggaaatctacaaaatggc

SEQ ID NO: 269655 - DNA, 25 bp, Mus musculus
ctcgctgggatcgctttagaatgtg

SEQ ID NO: 269656 - DNA, 25 bp, Mus musculus
ctcgctgggatcggtttttgtgaat

SEQ ID NO: 269657 - DNA, 25 bp, Mus musculus
ctcgctgggatcgtttgtttatatg

SEQ ID NO: 269658 - DNA, 25 bp, Mus musculus
ctcgctgggcagatcttccttgggg

SEQ ID NO: 269659 - DNA, 25 bp, Mus musculus
ctcgctggtggctggaggggtagca

SEQ ID NO: 269660 - DNA, 25 bp, Mus musculus
ctcgctggtgtctggtggcactgac

SEQ ID NO: 269661 - DNA, 25 bp, Mus musculus
ctcgctggttctgagaatctgcctg

SEQ ID NO: 269662 - DNA, 25 bp, Mus musculus
ctcgctggttctgagttctcatctc

SEQ ID NO: 269663 - DNA, 25 bp, Mus musculus
ctcgctggtttgcgctccctccaac

SEQ ID NO: 269664 - DNA, 25 bp, Mus musculus
ctcgctgtgttggacttccttgtgg

SEQ ID NO: 269665 - DNA, 25 bp, Mus musculus
ctcgcttctaaggtggtggcctacc

SEQ ID NO: 269666 - DNA, 25 bp, Mus musculus
ctcgcttttgagcttggcaaatggt

SEQ ID NO: 269667 - DNA, 25 bp, Mus musculus
ctcgcttttgagtgacagccctgct

SEQ ID NO: 269668 - DNA, 25 bp, Mus musculus
ctcggaaaccatcgagcgtttggaa

SEQ ID NO: 269669 - DNA, 25 bp, Mus musculus
ctcggaagcactaacgtttgatccc

SEQ ID NO: 269670 - DNA, 25 bp, Mus musculus
ctcggaagcactaactccagaactt

SEQ ID NO: 269671 - DNA, 25 bp, Mus musculus
ctcggaagcagagatggctatgaac

SEQ ID NO: 269672 - DNA, 25 bp, Mus musculus
ctcggaagtgaactcaaagacagat

SEQ ID NO: 269673 - DNA, 25 bp, Mus musculus
ctcggaatgatgagagccagctctc

SEQ ID NO: 269674 - DNA, 25 bp, Mus musculus
ctcggaatgatgagctctcccctgc

SEQ ID NO: 269675 - DNA, 25 bp, Mus musculus
ctcggaatgggaaccctaatggcaa

SEQ ID NO: 269676 - DNA, 25 bp, Mus musculus
ctcggaatgggaaccctaatgggga

SEQ ID NO: 269677 - DNA, 25 bp, Mus musculus
ctcggacacagagaagcagggtccc

SEQ ID NO: 269678 - DNA, 25 bp, Mus musculus
ctcggacacagatgcctccagctca

SEQ ID NO: 269679 - DNA, 25 bp, Mus musculus
ctcggacactcagagactgtctctg

SEQ ID NO: 269680 - DNA, 25 bp, Mus musculus
ctcggacactcagaggatttcccta

SEQ ID NO: 269681 - DNA, 25 bp, Mus musculus
ctcggacaggagagtgaagtgtgtc

SEQ ID NO: 269682 - DNA, 25 bp, Mus musculus
ctcggaccatcagccttggggagtt

SEQ ID NO: 269683 - DNA, 25 bp, Mus musculus
ctcggacctggagcagaagtattgg

SEQ ID NO: 269684 - DNA, 25 bp, Mus musculus
ctcggacctggagtgggaccctgaa

SEQ ID NO: 269685 - DNA, 25 bp, Mus musculus
ctcggacctggatgctaaaaggatt

SEQ ID NO: 269686 - DNA, 25 bp, Mus musculus
ctcggacctggtcataagggctaaa

SEQ ID NO: 269687 - DNA, 25 bp, Mus musculus
ctcggacgcaggctcagcttctttg

SEQ ID NO: 269688 - DNA, 25 bp, Mus musculus
ctcggacgcagggaaggtagtgtgt

SEQ ID NO: 269689 - DNA, 25 bp, Mus musculus
ctcggacgtagaaggcctctttgac

SEQ ID NO: 269690 - DNA, 25 bp, Mus musculus
ctcggactcgagaggtcactggatg

SEQ ID NO: 269691 - DNA, 25 bp, Mus musculus
ctcggactcgagagttacaggtcac

SEQ ID NO: 269692 - DNA, 25 bp, Mus musculus
ctcggagaaaggccagccatgtgag

SEQ ID NO: 269693 - DNA, 25 bp, Mus musculus
ctcggagaaccctcgatggtttcaa

SEQ ID NO: 269694 - DNA, 25 bp, Mus musculus
ctcggagacgcggctcctgtgcggc

SEQ ID NO: 269695 - DNA, 25 bp, Mus musculus
ctcggagagcagaggtgtggagaag

SEQ ID NO: 269696 - DNA, 25 bp, Mus musculus
ctcggagaggaagagatcaagcact

SEQ ID NO: 269697 - DNA, 25 bp, Mus musculus
ctcggagatcgcttttgtggctaca

SEQ ID NO: 269698 - DNA, 25 bp, Mus musculus
ctcggagatcgtatacttgaaggct

SEQ ID NO: 269699 - DNA, 25 bp, Mus musculus
ctcggagatgcccagatcatgagcc

SEQ ID NO: 269700 - DNA, 25 bp, Mus musculus
ctcggagatggaggctcagctgtct

SEQ ID NO: 269701 - DNA, 25 bp, Mus musculus
ctcggagcagaaatgcatcgccatg

SEQ ID NO: 269702 - DNA, 25 bp, Mus musculus
ctcggagcagagcgatcagcagctg

SEQ ID NO: 269703 - DNA, 25 bp, Mus musculus
ctcggagcagatcggtgcagccttc

SEQ ID NO: 269704 - DNA, 25 bp, Mus musculus
ctcggagcaggcagctggccgtgtc

SEQ ID NO: 269705 - DNA, 25 bp, Mus musculus
ctcggagcaggctcaggccatccag

SEQ ID NO: 269706 - DNA, 25 bp, Mus musculus
ctcggagcagtgggaccctgaagat

SEQ ID NO: 269707 - DNA, 25 bp, Mus musculus
ctcggagccgccaagtgcctgaaga

SEQ ID NO: 269708 - DNA, 25 bp, Mus musculus
ctcggagcgaccgggtcatgtagga

SEQ ID NO: 269709 - DNA, 25 bp, Mus musculus
ctcggagctgctgctggctttgaac

SEQ ID NO: 269710 - DNA, 25 bp, Mus musculus
ctcggaggaagcaccactgccgaaa

SEQ ID NO: 269711 - DNA, 25 bp, Mus musculus
ctcggaggacagcataagcagtacg

SEQ ID NO: 269712 - DNA, 25 bp, Mus musculus
ctcggaggatcagacatggtctcac

SEQ ID NO: 269713 - DNA, 25 bp, Mus musculus
ctcggaggcgggttcagccgactcc

SEQ ID NO: 269714 - DNA, 25 bp, Mus musculus
ctcggaggggcagaggtagccattg

SEQ ID NO: 269715 - DNA, 25 bp, Mus musculus
ctcggagtccgtgctgagacgtcat

SEQ ID NO: 269716 - DNA, 25 bp, Mus musculus
ctcggagtttgatccattttttagt

SEQ ID NO: 269717 - DNA, 25 bp, Mus musculus
ctcggataagctctgacttcagaac

SEQ ID NO: 269718 - DNA, 25 bp, Mus musculus
ctcggataagctctggggatgaaga

SEQ ID NO: 269719 - DNA, 25 bp, Mus musculus
ctcggataggagatgtttgagacag

SEQ ID NO: 269720 - DNA, 25 bp, Mus musculus
ctcggatcaaacagggttcctctgt

SEQ ID NO: 269721 - DNA, 25 bp, Mus musculus
ctcggatcaatgcacaaagaagacg

SEQ ID NO: 269722 - DNA, 25 bp, Mus musculus
ctcggatcggagaaacgcttcgtta

SEQ ID NO: 269723 - DNA, 25 bp, Mus musculus
ctcggatgccagatgttgcatgtgg

SEQ ID NO: 269724 - DNA, 25 bp, Mus musculus
ctcggatgtggataaaaatatccag

SEQ ID NO: 269725 - DNA, 25 bp, Mus musculus
ctcggatgtggatgcaaatgaaaag

SEQ ID NO: 269726 - DNA, 25 bp, Mus musculus
ctcggatgtttccaggaaatgccca

SEQ ID NO: 269727 - DNA, 25 bp, Mus musculus
ctcggatgtttccagggctgcacag

SEQ ID NO: 269728 - DNA, 25 bp, Mus musculus
ctcggcaacaagacgctgccgtcca

SEQ ID NO: 269729 - DNA, 25 bp, Mus musculus
ctcggcaaggggagactggccaatc

SEQ ID NO: 269730 - DNA, 25 bp, Mus musculus
ctcggcaatcagtttggagattctc

SEQ ID NO: 269731 - DNA, 25 bp, Mus musculus
ctcggcacccatcagaagcaagacg

SEQ ID NO: 269732 - DNA, 25 bp, Mus musculus
ctcggcacctgcagactctgcagag

SEQ ID NO: 269733 - DNA, 25 bp, Mus musculus
ctcggcacctgcagcctgctcccca

SEQ ID NO: 269734 - DNA, 25 bp, Mus musculus
ctcggcaggcagaatgggaaacagc

SEQ ID NO: 269735 - DNA, 25 bp, Mus musculus
ctcggcaggccgtttagggacgcgg

SEQ ID NO: 269736 - DNA, 25 bp, Mus musculus
ctcggcatcatgatgacccggagaa

SEQ ID NO: 269737 - DNA, 25 bp, Mus musculus
ctcggcatcttactacctgaaccag

SEQ ID NO: 269738 - DNA, 25 bp, Mus musculus
ctcggcatgttcgtgtggacaaatg

SEQ ID NO: 269739 - DNA, 25 bp, Mus musculus
ctcggccacctccggggccaagatg

SEQ ID NO: 269740 - DNA, 25 bp, Mus musculus
ctcggccagaagccaccccagtgat

SEQ ID NO: 269741 - DNA, 25 bp, Mus musculus
ctcggccagaagctgaaccttattc

SEQ ID NO: 269742 - DNA, 25 bp, Mus musculus
ctcggccagaagttgcaagttgttc

SEQ ID NO: 269743 - DNA, 25 bp, Mus musculus
ctcggccagagaggccggggcccgc

SEQ ID NO: 269744 - DNA, 25 bp, Mus musculus
ctcggcccacgaggatcgtctgaag

SEQ ID NO: 269745 - DNA, 25 bp, Mus musculus
ctcggcccagagatgggcacctccg

SEQ ID NO: 269746 - DNA, 25 bp, Mus musculus
ctcggcccagcacagccccccagcg

SEQ ID NO: 269747 - DNA, 25 bp, Mus musculus
ctcggcccaggataagtacggtttc

SEQ ID NO: 269748 - DNA, 25 bp, Mus musculus
ctcggcccagggctcccagtttgtg

SEQ ID NO: 269749 - DNA, 25 bp, Mus musculus
ctcggccctacagtgcctgagcaat

SEQ ID NO: 269750 - DNA, 25 bp, Mus musculus
ctcggccgtggtaagggaacaatta

SEQ ID NO: 269751 - DNA, 25 bp, Mus musculus
ctcggcctcaggaaattccttcaca

SEQ ID NO: 269752 - DNA, 25 bp, Mus musculus
ctcggcctcagtagagtgatgcctg

SEQ ID NO: 269753 - DNA, 25 bp, Mus musculus
ctcggcctcatcctggtgacatctc

SEQ ID NO: 269754 - DNA, 25 bp, Mus musculus
ctcggcctggcacatgccctggtgg

SEQ ID NO: 269755 - DNA, 25 bp, Mus musculus
ctcggccttccagttttacctgctg

SEQ ID NO: 269756 - DNA, 25 bp, Mus musculus
ctcggccttgccaggaaaatactaa

SEQ ID NO: 269757 - DNA, 25 bp, Mus musculus
ctcggcgccaaagctgatggtgagg

SEQ ID NO: 269758 - DNA, 25 bp, Mus musculus
ctcggcgccagggagtccttgccat

SEQ ID NO: 269759 - DNA, 25 bp, Mus musculus
ctcggcgccaggggcagcttgactc

SEQ ID NO: 269760 - DNA, 25 bp, Mus musculus
ctcggcgccctggaagaccagagcc

SEQ ID NO: 269761 - DNA, 25 bp, Mus musculus
ctcggcgcgggaactggcatcaaag

SEQ ID NO: 269762 - DNA, 25 bp, Mus musculus
ctcggcgcgggtgaacaccatgtcc

SEQ ID NO: 269763 - DNA, 25 bp, Mus musculus
ctcggcgcgggtgagccctatttct

SEQ ID NO: 269764 - DNA, 25 bp, Mus musculus
ctcggcggagggaagtgttgacgct

SEQ ID NO: 269765 - DNA, 25 bp, Mus musculus
ctcggcggcagcaggcaaggagatg

SEQ ID NO: 269766 - DNA, 25 bp, Mus musculus
ctcggcggcagcaggcattaaaaaa

SEQ ID NO: 269767 - DNA, 25 bp, Mus musculus
ctcggcgtacaggagaatgactcag

SEQ ID NO: 269768 - DNA, 25 bp, Mus musculus
ctcggcgtcgccggcagctgcagca

SEQ ID NO: 269769 - DNA, 25 bp, Mus musculus
ctcggctagtaagcagtctgcaaac

SEQ ID NO: 269770 - DNA, 25 bp, Mus musculus
ctcggctcacagatggctgccagca

SEQ ID NO: 269771 - DNA, 25 bp, Mus musculus
ctcggctcacaggcagaagacttta

SEQ ID NO: 269772 - DNA, 25 bp, Mus musculus
ctcggctcacgcgccctcccgccgg

SEQ ID NO: 269773 - DNA, 25 bp, Mus musculus
ctcggctcacggatgatgactcttc

SEQ ID NO: 269774 - DNA, 25 bp, Mus musculus
ctcggctcactgaggctggaccacg

SEQ ID NO: 269775 - DNA, 25 bp, Mus musculus
ctcggctccctcccgatgagaagaa

SEQ ID NO: 269776 - DNA, 25 bp, Mus musculus
ctcggctccctcccgggatatttgc

SEQ ID NO: 269777 - DNA, 25 bp, Mus musculus
ctcggctccgctagttctgacggtt

SEQ ID NO: 269778 - DNA, 25 bp, Mus musculus
ctcggctccgctgccctgggccctg

SEQ ID NO: 269779 - DNA, 25 bp, Mus musculus
ctcggctgaggaggccaccatggca

SEQ ID NO: 269780 - DNA, 25 bp, Mus musculus
ctcggctgcagggtaagaccagctg

SEQ ID NO: 269781 - DNA, 25 bp, Mus musculus
ctcggctgcccgggcctgactacca

SEQ ID NO: 269782 - DNA, 25 bp, Mus musculus
ctcggctgcgcagctgcccctgtcg

SEQ ID NO: 269783 - DNA, 25 bp, Mus musculus
ctcggctgcgcaggaaagtgcccat

SEQ ID NO: 269784 - DNA, 25 bp, Mus musculus
ctcggctggggtcattctcagagct

SEQ ID NO: 269785 - DNA, 25 bp, Mus musculus
ctcggctgtagagagtcagtcgttg

SEQ ID NO: 269786 - DNA, 25 bp, Mus musculus
ctcggcttcagagcactaaagcgaa

SEQ ID NO: 269787 - DNA, 25 bp, Mus musculus
ctcggcttcagctggaaaggcatct

SEQ ID NO: 269788 - DNA, 25 bp, Mus musculus
ctcggcttcaggtgaagctgaggac

SEQ ID NO: 269789 - DNA, 25 bp, Mus musculus
ctcggcttccaaggttcctacttga

SEQ ID NO: 269790 - DNA, 25 bp, Mus musculus
ctcggcttccaagtctgttcttcag

SEQ ID NO: 269791 - DNA, 25 bp, Mus musculus
ctcggcttcctgagatgaagaaact

SEQ ID NO: 269792 - DNA, 25 bp, Mus musculus
ctcggctttgacagctgcaggtcct

SEQ ID NO: 269793 - DNA, 25 bp, Mus musculus
ctcgggaaaagttagctttatacgt

SEQ ID NO: 269794 - DNA, 25 bp, Mus musculus
ctcgggaaacaggacccagccacct

SEQ ID NO: 269795 - DNA, 25 bp, Mus musculus
ctcgggaaacatacccagagaaatt

SEQ ID NO: 269796 - DNA, 25 bp, Mus musculus
ctcgggaaacatcacagaagtaccc

SEQ ID NO: 269797 - DNA, 25 bp, Mus musculus
ctcgggaaagccatgtggagattgg

SEQ ID NO: 269798 - DNA, 25 bp, Mus musculus
ctcgggagagaaattttaagcggcg

SEQ ID NO: 269799 - DNA, 25 bp, Mus musculus
ctcgggagcaggtttcaacactaaa

SEQ ID NO: 269800 - DNA, 25 bp, Mus musculus
ctcgggagcctgtggcctaaatgta

SEQ ID NO: 269801 - DNA, 25 bp, Mus musculus
ctcgggatcagcgtgggagctccgc

SEQ ID NO: 269802 - DNA, 25 bp, Mus musculus
ctcgggatcctacagcttcacatgg

SEQ ID NO: 269803 - DNA, 25 bp, Mus musculus
ctcgggcaaggacttagcattcagg

SEQ ID NO: 269804 - DNA, 25 bp, Mus musculus
ctcgggcaccgtcaggctcaagtcc

SEQ ID NO: 269805 - DNA, 25 bp, Mus musculus
ctcgggcagagatgggtggcctaac

SEQ ID NO: 269806 - DNA, 25 bp, Mus musculus
ctcgggcagctgtgtgcctgctttg

SEQ ID NO: 269807 - DNA, 25 bp, Mus musculus
ctcgggcatggaaactatcaataca

SEQ ID NO: 269808 - DNA, 25 bp, Mus musculus
ctcgggcctgaagccggtcgacaat

SEQ ID NO: 269809 - DNA, 25 bp, Mus musculus
ctcgggcggcggagagttgtctgct

SEQ ID NO: 269810 - DNA, 25 bp, Mus musculus
ctcgggctcagtggatgagaccctt

SEQ ID NO: 269811 - DNA, 25 bp, Mus musculus
ctcgggctcagtggttgttgacctc

SEQ ID NO: 269812 - DNA, 25 bp, Mus musculus
ctcgggctgcagatttattgccaag

SEQ ID NO: 269813 - DNA, 25 bp, Mus musculus
ctcgggctgctccaagcagtgcctg

SEQ ID NO: 269814 - DNA, 25 bp, Mus musculus
ctcgggctgttgacagctagaatat

SEQ ID NO: 269815 - DNA, 25 bp, Mus musculus
ctcggggacaacaccagcgactgct

SEQ ID NO: 269816 - DNA, 25 bp, Mus musculus
ctcggggacattcaggttggctcct

SEQ ID NO: 269817 - DNA, 25 bp, Mus musculus
ctcggggacgcggcgatctgccagg

SEQ ID NO: 269818 - DNA, 25 bp, Mus musculus
ctcggggacgcggcgcacacagggc

SEQ ID NO: 269819 - DNA, 25 bp, Mus musculus
ctcggggactggacagatggagcca

SEQ ID NO: 269820 - DNA, 25 bp, Mus musculus
ctcggggcagaaaatatctgcagaa

SEQ ID NO: 269821 - DNA, 25 bp, Mus musculus
ctcggggcagatcgtaatgtaaata

SEQ ID NO: 269822 - DNA, 25 bp, Mus musculus
ctcggggcagggatgccctggacct

SEQ ID NO: 269823 - DNA, 25 bp, Mus musculus
ctcggggcggtaggaaatcagtctc

SEQ ID NO: 269824 - DNA, 25 bp, Mus musculus
ctcgggggactggcaatgtttgccc

SEQ ID NO: 269825 - DNA, 25 bp, Mus musculus
ctcgggggactggccatgtttgcca

SEQ ID NO: 269826 - DNA, 25 bp, Mus musculus
ctcgggggctgtcagattggtgacc

SEQ ID NO: 269827 - DNA, 25 bp, Mus musculus
ctcgggggctgtcaggcacagagga

SEQ ID NO: 269828 - DNA, 25 bp, Mus musculus
ctcggggtagccaagctgcttttag

SEQ ID NO: 269829 - DNA, 25 bp, Mus musculus
ctcggggtgcagcaggatgctgggc

SEQ ID NO: 269830 - DNA, 25 bp, Mus musculus
ctcggggtgcagcaggatgcttcat

SEQ ID NO: 269831 - DNA, 25 bp, Mus musculus
ctcggggtttgcctgaagagaagga

SEQ ID NO: 269832 - DNA, 25 bp, Mus musculus
ctcgggtcgcaggaactggtgctcc

SEQ ID NO: 269833 - DNA, 25 bp, Mus musculus
ctcgggtctccagacacagtttctc

SEQ ID NO: 269834 - DNA, 25 bp, Mus musculus
ctcgggtctccaggacacagcccag

SEQ ID NO: 269835 - DNA, 25 bp, Mus musculus
ctcgggtctccaggtgtcctatctg

SEQ ID NO: 269836 - DNA, 25 bp, Mus musculus
ctcgggtctgaggaacagtctgaga

SEQ ID NO: 269837 - DNA, 25 bp, Mus musculus
ctcgggtggctggacttgaattcag

SEQ ID NO: 269838 - DNA, 25 bp, Mus musculus
ctcgggtggctggagttgaattcag

SEQ ID NO: 269839 - DNA, 25 bp, Mus musculus
ctcgggtggtggaggacaaccataa

SEQ ID NO: 269840 - DNA, 25 bp, Mus musculus
ctcgggtggtggctctgtctctgtc

SEQ ID NO: 269841 - DNA, 25 bp, Mus musculus
ctcggtaagagggggcccgtaagct

SEQ ID NO: 269842 - DNA, 25 bp, Mus musculus
ctcggtacaggttgtaagttctaca

SEQ ID NO: 269843 - DNA, 25 bp, Mus musculus
ctcggtacatgcaggtgcatatttt

SEQ ID NO: 269844 - DNA, 25 bp, Mus musculus
ctcggtcaagggggagtgcagaagg

SEQ ID NO: 269845 - DNA, 25 bp, Mus musculus
ctcggtcagtcaacacagtgttcaa

SEQ ID NO: 269846 - DNA, 25 bp, Mus musculus
ctcggtcctccatgggcatggacat

SEQ ID NO: 269847 - DNA, 25 bp, Mus musculus
ctcggtctctcagaaaacatctcgg

SEQ ID NO: 269848 - DNA, 25 bp, Mus musculus
ctcggtctggtttatctccggcatc

SEQ ID NO: 269849 - DNA, 25 bp, Mus musculus
ctcggtcttcaccacttccctgatg

SEQ ID NO: 269850 - DNA, 25 bp, Mus musculus
ctcggtgaaagggattgaaattcca

SEQ ID NO: 269851 - DNA, 25 bp, Mus musculus
ctcggtgaacatcgaagacgccata

SEQ ID NO: 269852 - DNA, 25 bp, Mus musculus
ctcggtgaacatcggaaggaagaga

SEQ ID NO: 269853 - DNA, 25 bp, Mus musculus
ctcggtgacagaacaaatcagttga

SEQ ID NO: 269854 - DNA, 25 bp, Mus musculus
ctcggtgacaggtttggggccttag

SEQ ID NO: 269855 - DNA, 25 bp, Mus musculus
ctcggtgactctgtgaacctacaca

SEQ ID NO: 269856 - DNA, 25 bp, Mus musculus
ctcggtgagcacgatgaaacggaca

SEQ ID NO: 269857 - DNA, 25 bp, Mus musculus
ctcggtgaggattcgaaagaataga

SEQ ID NO: 269858 - DNA, 25 bp, Mus musculus
ctcggtgaggattcggacttctaga

SEQ ID NO: 269859 - DNA, 25 bp, Mus musculus
ctcggtgagttgcaggatccagcat

SEQ ID NO: 269860 - DNA, 25 bp, Mus musculus
ctcggtgcaggctatctatgtgcct

SEQ ID NO: 269861 - DNA, 25 bp, Mus musculus
ctcggtgcctggagactcctccacc

SEQ ID NO: 269862 - DNA, 25 bp, Mus musculus
ctcggtgcctggagggtctcattat

SEQ ID NO: 269863 - DNA, 25 bp, Mus musculus
ctcggtgctggcgccggagtactgg

SEQ ID NO: 269864 - DNA, 25 bp, Mus musculus
ctcggtggaagagggtcagggctgc

SEQ ID NO: 269865 - DNA, 25 bp, Mus musculus
ctcggtggatcgaagtctgcttccc

SEQ ID NO: 269866 - DNA, 25 bp, Mus musculus
ctcggtggccgacagagtgcttggg

SEQ ID NO: 269867 - DNA, 25 bp, Mus musculus
ctcggtgggacagaaactcatcatg

SEQ ID NO: 269868 - DNA, 25 bp, Mus musculus
ctcggtgggacagctgggaacactc

SEQ ID NO: 269869 - DNA, 25 bp, Mus musculus
ctcggtgtggaagagatgaaccgga

SEQ ID NO: 269870 - DNA, 25 bp, Mus musculus
ctcggttcccttctctgggtcctta

SEQ ID NO: 269871 - DNA, 25 bp, Mus musculus
ctcgtaagattcccacctgttgccc

SEQ ID NO: 269872 - DNA, 25 bp, Mus musculus
ctcgtaagcatcagggaaacctcac

SEQ ID NO: 269873 - DNA, 25 bp, Mus musculus
ctcgtaccaggcacagaagaatgag

SEQ ID NO: 269874 - DNA, 25 bp, Mus musculus
ctcgtacctgcatgattgccacaat

SEQ ID NO: 269875 - DNA, 25 bp, Mus musculus
ctcgtacctgcatgggtgaaagaat

SEQ ID NO: 269876 - DNA, 25 bp, Mus musculus
ctcgtactcagaaacgaaagctgca

SEQ ID NO: 269877 - DNA, 25 bp, Mus musculus
ctcgtagaggaggagctggagcgct

SEQ ID NO: 269878 - DNA, 25 bp, Mus musculus
ctcgtcaactctccatcctacctca

SEQ ID NO: 269879 - DNA, 25 bp, Mus musculus
ctcgtcacagataacatctggttgg

SEQ ID NO: 269880 - DNA, 25 bp, Mus musculus
ctcgtcacaggaatggcggccctag

SEQ ID NO: 269881 - DNA, 25 bp, Mus musculus
ctcgtcagaagagaagacgccagca

SEQ ID NO: 269882 - DNA, 25 bp, Mus musculus
ctcgtcagaagaggagtccaaaatc

SEQ ID NO: 269883 - DNA, 25 bp, Mus musculus
ctcgtcagctttgacgttaccacca

SEQ ID NO: 269884 - DNA, 25 bp, Mus musculus
ctcgtcagctttgagtcggtctatg

SEQ ID NO: 269885 - DNA, 25 bp, Mus musculus
ctcgtccagcagcaaagccgacccg

SEQ ID NO: 269886 - DNA, 25 bp, Mus musculus
ctcgtccgtggaggttgtcagagaa

SEQ ID NO: 269887 - DNA, 25 bp, Mus musculus
ctcgtcctacgaagattatacagac

SEQ ID NO: 269888 - DNA, 25 bp, Mus musculus
ctcgtcctagccatctgcatcatcc

SEQ ID NO: 269889 - DNA, 25 bp, Mus musculus
ctcgtcctaggctaggcggccgtca

SEQ ID NO: 269890 - DNA, 25 bp, Mus musculus
ctcgtcctagggggagcttctggag

SEQ ID NO: 269891 - DNA, 25 bp, Mus musculus
ctcgtcctaggtattctcatgggag

SEQ ID NO: 269892 - DNA, 25 bp, Mus musculus
ctcgtcctcgtcctcctcttcttct

SEQ ID NO: 269893 - DNA, 25 bp, Mus musculus
ctcgtcctgtgcctatgcttatacc

SEQ ID NO: 269894 - DNA, 25 bp, Mus musculus
ctcgtccttgagagatgccaaaggc

SEQ ID NO: 269895 - DNA, 25 bp, Mus musculus
ctcgtcggcatcagaacggccggtt

SEQ ID NO: 269896 - DNA, 25 bp, Mus musculus
ctcgtctatcagtcttgtctgtatt

SEQ ID NO: 269897 - DNA, 25 bp, Mus musculus
ctcgtctccggcaatctctgagttt

SEQ ID NO: 269898 - DNA, 25 bp, Mus musculus
ctcgtctccggcaggaatttaatga

SEQ ID NO: 269899 - DNA, 25 bp, Mus musculus
ctcgtctgatgtcatggctccgaac

SEQ ID NO: 269900 - DNA, 25 bp, Mus musculus
ctcgtctgatgttcacctcacctcg

SEQ ID NO: 269901 - DNA, 25 bp, Mus musculus
ctcgtctggagatgaagctataaaa

SEQ ID NO: 269902 - DNA, 25 bp, Mus musculus
ctcgtcttaaacaagcaataccttc

SEQ ID NO: 269903 - DNA, 25 bp, Mus musculus
ctcgtcttcctgaaggttgagaaca

SEQ ID NO: 269904 - DNA, 25 bp, Mus musculus
ctcgtcttttcaaggtatttcctgg

SEQ ID NO: 269905 - DNA, 25 bp, Mus musculus
ctcgtgaaactagaaatgatggaag

SEQ ID NO: 269906 - DNA, 25 bp, Mus musculus
ctcgtgaaagattcaactggcatgt

SEQ ID NO: 269907 - DNA, 25 bp, Mus musculus
ctcgtgaaagtgcattgttggtgtg

SEQ ID NO: 269908 - DNA, 25 bp, Mus musculus
ctcgtgaactggttaccaggcctga

SEQ ID NO: 269909 - DNA, 25 bp, Mus musculus
ctcgtgagagctgcttcagctgaca

SEQ ID NO: 269910 - DNA, 25 bp, Mus musculus
ctcgtgagagggtttctctgtgtat

SEQ ID NO: 269911 - DNA, 25 bp, Mus musculus
ctcgtgagttcagcgacattaaggc

SEQ ID NO: 269912 - DNA, 25 bp, Mus musculus
ctcgtgatcaggaagaaaagcaact

SEQ ID NO: 269913 - DNA, 25 bp, Mus musculus
ctcgtgatcaggaggaatctgagag

SEQ ID NO: 269914 - DNA, 25 bp, Mus musculus
ctcgtgatcagtagcaagattgaca

SEQ ID NO: 269915 - DNA, 25 bp, Mus musculus
ctcgtgcaagcgtgccaagtatccc

SEQ ID NO: 269916 - DNA, 25 bp, Mus musculus
ctcgtgccaagtctcacacaggtcc

SEQ ID NO: 269917 - DNA, 25 bp, Mus musculus
ctcgtggaggctgctctgacagttg

SEQ ID NO: 269918 - DNA, 25 bp, Mus musculus
ctcgtggatttccaggcagtagagg

SEQ ID NO: 269919 - DNA, 25 bp, Mus musculus
ctcgtggatttccaggccgtggtat

SEQ ID NO: 269920 - DNA, 25 bp, Mus musculus
ctcgtggcaggggtactacaagaag

SEQ ID NO: 269921 - DNA, 25 bp, Mus musculus
ctcgtgggctgtgccggcattggca

SEQ ID NO: 269922 - DNA, 25 bp, Mus musculus
ctcgtggtccagaaccctctgattg

SEQ ID NO: 269923 - DNA, 25 bp, Mus musculus
ctcgtggtggcccgagctgtgggaa

SEQ ID NO: 269924 - DNA, 25 bp, Mus musculus
ctcgtgtaaggatcttctgcctatt

SEQ ID NO: 269925 - DNA, 25 bp, Mus musculus
ctcgtgtataactaagaatgtcttc

SEQ ID NO: 269926 - DNA, 25 bp, Mus musculus
ctcgtgtattcagggggagatgact

SEQ ID NO: 269927 - DNA, 25 bp, Mus musculus
ctcgtgtccctcgtttagctttttc

SEQ ID NO: 269928 - DNA, 25 bp, Mus musculus
ctcgtgtccgacttcagaggatgaa

SEQ ID NO: 269929 - DNA, 25 bp, Mus musculus
ctcgtgtccgatttattaaccttgc

SEQ ID NO: 269930 - DNA, 25 bp, Mus musculus
ctcgtgtctttggctaattctggct

SEQ ID NO: 269931 - DNA, 25 bp, Mus musculus
ctcgtgtctttgtaaagtcgggcaa

SEQ ID NO: 269932 - DNA, 25 bp, Mus musculus
ctcgtgtgcggattcctttgtttct

SEQ ID NO: 269933 - DNA, 25 bp, Mus musculus
ctcgtgtgcggtgcacgatctgatt

SEQ ID NO: 269934 - DNA, 25 bp, Mus musculus
ctcgtgtttgaccttgttaccggag

SEQ ID NO: 269935 - DNA, 25 bp, Mus musculus
ctcgttaacagataggttctgcctc

SEQ ID NO: 269936 - DNA, 25 bp, Mus musculus
ctcgttaggatcgcaccagagtata

SEQ ID NO: 269937 - DNA, 25 bp, Mus musculus
ctcgttcaaacaaagtctggttttt

SEQ ID NO: 269938 - DNA, 25 bp, Mus musculus
ctcgttcaagagggagcccgcctgc

SEQ ID NO: 269939 - DNA, 25 bp, Mus musculus
ctcgttcaagggggcgactttctca

SEQ ID NO: 269940 - DNA, 25 bp, Mus musculus
ctcgttcactccaatgatggcactc

SEQ ID NO: 269941 - DNA, 25 bp, Mus musculus
ctcgttcatgataagtgcacaaaga

SEQ ID NO: 269942 - DNA, 25 bp, Mus musculus
ctcgttcctcaagatggccgactct

SEQ ID NO: 269943 - DNA, 25 bp, Mus musculus
ctcgttctctgaaccttcagctgcc

SEQ ID NO: 269944 - DNA, 25 bp, Mus musculus
ctcgttgcccagatcctgtgggccg

SEQ ID NO: 269945 - DNA, 25 bp, Mus musculus
ctcgttgctgtccagaaccccgtct

SEQ ID NO: 269946 - DNA, 25 bp, Mus musculus
ctcgttgctgtccagggtgaagcct

SEQ ID NO: 269947 - DNA, 25 bp, Mus musculus
ctcgttggagtgacatcgtctttaa

SEQ ID NO: 269948 - DNA, 25 bp, Mus musculus
ctcgttggatcctcctctgtagagc

SEQ ID NO: 269949 - DNA, 25 bp, Mus musculus
ctcgttggatcctgcgggttgaggc

SEQ ID NO: 269950 - DNA, 25 bp, Mus musculus
ctcgtttcaagagaacggcaggctg

SEQ ID NO: 269951 - DNA, 25 bp, Mus musculus
ctcgtttccctggattatgccatct

SEQ ID NO: 269952 - DNA, 25 bp, Mus musculus
ctcgtttccctgggtatttctctga

SEQ ID NO: 269953 - DNA, 25 bp, Mus musculus
ctcgtttctggtccatacattgtgt

SEQ ID NO: 269954 - DNA, 25 bp, Mus musculus
ctcgtttgtagggacagtgatgctg

SEQ ID NO: 269955 - DNA, 25 bp, Mus musculus
ctctaaaaacccacaactccttgag

SEQ ID NO: 269956 - DNA, 25 bp, Mus musculus
ctctaaaaactcaagatgtggagta

SEQ ID NO: 269957 - DNA, 25 bp, Mus musculus
ctctaaaaagaggttgtggatgtgg

SEQ ID NO: 269958 - DNA, 25 bp, Mus musculus
ctctaaaacaagagatttgaagttc

SEQ ID NO: 269959 - DNA, 25 bp, Mus musculus
ctctaaaactgaagcaccttcagga

SEQ ID NO: 269960 - DNA, 25 bp, Mus musculus
ctctaaaacttctatcatcctgaag

SEQ ID NO: 269961 - DNA, 25 bp, Mus musculus
ctctaaaagatttgtccataagaac

SEQ ID NO: 269962 - DNA, 25 bp, Mus musculus
ctctaaaaggcaacaactctacata

SEQ ID NO: 269963 - DNA, 25 bp, Mus musculus
ctctaaaagggccgcgcctgcgcag

SEQ ID NO: 269964 - DNA, 25 bp, Mus musculus
ctctaaaatagagctggagtaactg

SEQ ID NO: 269965 - DNA, 25 bp, Mus musculus
ctctaaaatggtgcacctccgctct

SEQ ID NO: 269966 - DNA, 25 bp, Mus musculus
ctctaaacaagacgggccgcattga

SEQ ID NO: 269967 - DNA, 25 bp, Mus musculus
ctctaaagaaggatgtggactgtgc

SEQ ID NO: 269968 - DNA, 25 bp, Mus musculus
ctctaaagaccggaaagcactgcca

SEQ ID NO: 269969 - DNA, 25 bp, Mus musculus
ctctaaagagtgaaggcttcagatg

SEQ ID NO: 269970 - DNA, 25 bp, Mus musculus
ctctaaagcgagacctagatgcccg

SEQ ID NO: 269971 - DNA, 25 bp, Mus musculus
ctctaaatgggatatccttctcgtc

SEQ ID NO: 269972 - DNA, 25 bp, Mus musculus
ctctaaattcaagtgacaatgcctt

SEQ ID NO: 269973 - DNA, 25 bp, Mus musculus
ctctaaattccaagccatcttctct

SEQ ID NO: 269974 - DNA, 25 bp, Mus musculus
ctctaacacccttatttagaagtct

SEQ ID NO: 269975 - DNA, 25 bp, Mus musculus
ctctaacaccgcaagccccgcccaa

SEQ ID NO: 269976 - DNA, 25 bp, Mus musculus
ctctaacataagctgcttcctgctt

SEQ ID NO: 269977 - DNA, 25 bp, Mus musculus
ctctaacataagtcttcttttttgt

SEQ ID NO: 269978 - DNA, 25 bp, Mus musculus
ctctaacatcacagattgctgaaag

SEQ ID NO: 269979 - DNA, 25 bp, Mus musculus
ctctaaccagatggactatccatcg

SEQ ID NO: 269980 - DNA, 25 bp, Mus musculus
ctctaacctgcatcccagcctatga

SEQ ID NO: 269981 - DNA, 25 bp, Mus musculus
ctctaacctgcctgtgatggtatgg

SEQ ID NO: 269982 - DNA, 25 bp, Mus musculus
ctctaacctggccctctgctgtttt

SEQ ID NO: 269983 - DNA, 25 bp, Mus musculus
ctctaactcactcagaagagaagag

SEQ ID NO: 269984 - DNA, 25 bp, Mus musculus
ctctaactcactcagtgtcaacagg

SEQ ID NO: 269985 - DNA, 25 bp, Mus musculus
ctctaagaaacattccctgtgtggt

SEQ ID NO: 269986 - DNA, 25 bp, Mus musculus
ctctaagatggtgcagtgaaccacc

SEQ ID NO: 269987 - DNA, 25 bp, Mus musculus
ctctaagattgaagatcgagcgttt

SEQ ID NO: 269988 - DNA, 25 bp, Mus musculus
ctctaagcaggtaaacgagttgtac

SEQ ID NO: 269989 - DNA, 25 bp, Mus musculus
ctctaagcaggtttctaccccaggc

SEQ ID NO: 269990 - DNA, 25 bp, Mus musculus
ctctaagcttacaggagtgccagga

SEQ ID NO: 269991 - DNA, 25 bp, Mus musculus
ctctaaggatggtcctgcccccgct

SEQ ID NO: 269992 - DNA, 25 bp, Mus musculus
ctctaagtagtgagtctattgagaa

SEQ ID NO: 269993 - DNA, 25 bp, Mus musculus
ctctaagtgacaagaaaatgacaag

SEQ ID NO: 269994 - DNA, 25 bp, Mus musculus
ctctaagtgacaagaatatagaacg

SEQ ID NO: 269995 - DNA, 25 bp, Mus musculus
ctctaagttaggcaagagttcaaac

SEQ ID NO: 269996 - DNA, 25 bp, Mus musculus
ctctaataaagcaaggagtaaataa

SEQ ID NO: 269997 - DNA, 25 bp, Mus musculus
ctctaataaaggatatggtggtgat

SEQ ID NO: 269998 - DNA, 25 bp, Mus musculus
ctctaatacagactcagccatggtc

SEQ ID NO: 269999 - DNA, 25 bp, Mus musculus
ctctaatacagtggcttctttctcc

SEQ ID NO: 270000 - DNA, 25 bp, Mus musculus
ctctaattaagctgtctcctaagaa

SEQ ID NO: 270001 - DNA, 25 bp, Mus musculus
ctctaattctttaagttcaagtttg

SEQ ID NO: 270002 - DNA, 25 bp, Mus musculus
ctctaatttttcaggtgccgactta

SEQ ID NO: 270003 - DNA, 25 bp, Mus musculus
ctctacaaaaagattgaagacctga

SEQ ID NO: 270004 - DNA, 25 bp, Mus musculus
ctctacaaatgataaaactattaaa

SEQ ID NO: 270005 - DNA, 25 bp, Mus musculus
ctctacaatgggcacctgggttagg

SEQ ID NO: 270006 - DNA, 25 bp, Mus musculus
ctctacacaggaaatccaccttcca

SEQ ID NO: 270007 - DNA, 25 bp, Mus musculus
ctctacacaggctgacaagaaaact

SEQ ID NO: 270008 - DNA, 25 bp, Mus musculus
ctctacacatccttgctgaggatca

SEQ ID NO: 270009 - DNA, 25 bp, Mus musculus
ctctacacatcctttaaaaagtatg

SEQ ID NO: 270010 - DNA, 25 bp, Mus musculus
ctctacaccctggtggtgtctgtga

SEQ ID NO: 270011 - DNA, 25 bp, Mus musculus
ctctacagaacaggtgggcactctg

SEQ ID NO: 270012 - DNA, 25 bp, Mus musculus
ctctacagaacagtctatacaacca

SEQ ID NO: 270013 - DNA, 25 bp, Mus musculus
ctctacagagaatccccggcagccc

SEQ ID NO: 270014 - DNA, 25 bp, Mus musculus
ctctacagataacccccggcagccc

SEQ ID NO: 270015 - DNA, 25 bp, Mus musculus
ctctacagattcctgcggaacatct

SEQ ID NO: 270016 - DNA, 25 bp, Mus musculus
ctctacagcaatgggatacggacag

SEQ ID NO: 270017 - DNA, 25 bp, Mus musculus
ctctacagccctcagccaaacaggg

SEQ ID NO: 270018 - DNA, 25 bp, Mus musculus
ctctacagcctgggctgcgccttcc

SEQ ID NO: 270019 - DNA, 25 bp, Mus musculus
ctctacagctcagatgtttttaccc

SEQ ID NO: 270020 - DNA, 25 bp, Mus musculus
ctctacaggaacccgtcattgcctt

SEQ ID NO: 270021 - DNA, 25 bp, Mus musculus
ctctacagggatgagactttgaaga

SEQ ID NO: 270022 - DNA, 25 bp, Mus musculus
ctctacagggatgagctagttaaag

SEQ ID NO: 270023 - DNA, 25 bp, Mus musculus
ctctacaggtagggacccgaaagtg

SEQ ID NO: 270024 - DNA, 25 bp, Mus musculus
ctctacatagaagttgaccagatat

SEQ ID NO: 270025 - DNA, 25 bp, Mus musculus
ctctacatgggtaaaaagcaagata

SEQ ID NO: 270026 - DNA, 25 bp, Mus musculus
ctctacattccagaggtgatggtgg

SEQ ID NO: 270027 - DNA, 25 bp, Mus musculus
ctctaccaaatactatctgaatgac

SEQ ID NO: 270028 - DNA, 25 bp, Mus musculus
ctctaccaaatattgcatttagcca

SEQ ID NO: 270029 - DNA, 25 bp, Mus musculus
ctctaccacaagaaggttgtggatc

SEQ ID NO: 270030 - DNA, 25 bp, Mus musculus
ctctaccacaagatgctggtggttg

SEQ ID NO: 270031 - DNA, 25 bp, Mus musculus
ctctaccacagtgactcatgttcat

SEQ ID NO: 270032 - DNA, 25 bp, Mus musculus
ctctaccagcagaacagcacagccc

SEQ ID NO: 270033 - DNA, 25 bp, Mus musculus
ctctaccagcagacccaatggaact

SEQ ID NO: 270034 - DNA, 25 bp, Mus musculus
ctctaccagcaggcttccccaccag

SEQ ID NO: 270035 - DNA, 25 bp, Mus musculus
ctctaccatcctcagtggtacactt

SEQ ID NO: 270036 - DNA, 25 bp, Mus musculus
ctctaccatggccagggctctgaca

SEQ ID NO: 270037 - DNA, 25 bp, Mus musculus
ctctaccatggccagtgaggtgttc

SEQ ID NO: 270038 - DNA, 25 bp, Mus musculus
ctctaccatttatggaagccctgca

SEQ ID NO: 270039 - DNA, 25 bp, Mus musculus
ctctaccccatttggtgacttcatg

SEQ ID NO: 270040 - DNA, 25 bp, Mus musculus
ctctaccccatttggtgatctgaat

SEQ ID NO: 270041 - DNA, 25 bp, Mus musculus
ctctaccccctgctgaatgaggccg

SEQ ID NO: 270042 - DNA, 25 bp, Mus musculus
ctctaccctcaaccagcaagcctgc

SEQ ID NO: 270043 - DNA, 25 bp, Mus musculus
ctctaccggcttgatctcagtgaaa

SEQ ID NO: 270044 - DNA, 25 bp, Mus musculus
ctctacctaggcacaaaaggcaacc

SEQ ID NO: 270045 - DNA, 25 bp, Mus musculus
ctctacctcagggccccgccgtcac

SEQ ID NO: 270046 - DNA, 25 bp, Mus musculus
ctctacctgcaggcagcctgatctc

SEQ ID NO: 270047 - DNA, 25 bp, Mus musculus
ctctacctggcagagatggacatgc

SEQ ID NO: 270048 - DNA, 25 bp, Mus musculus
ctctacctggcagagccgctgatgg

SEQ ID NO: 270049 - DNA, 25 bp, Mus musculus
ctctacctggcagaggtgatatgta

SEQ ID NO: 270050 - DNA, 25 bp, Mus musculus
ctctaccttgaaggcccacaatgtc

SEQ ID NO: 270051 - DNA, 25 bp, Mus musculus
ctctacgacacgaacctgccagatg

SEQ ID NO: 270052 - DNA, 25 bp, Mus musculus
ctctacggatggaggaatcacttgg

SEQ ID NO: 270053 - DNA, 25 bp, Mus musculus
ctctacggccctgcaacattggttc

SEQ ID NO: 270054 - DNA, 25 bp, Mus musculus
ctctacggccctgcagtggaagact

SEQ ID NO: 270055 - DNA, 25 bp, Mus musculus
ctctacgggtactggggcctggata

SEQ ID NO: 270056 - DNA, 25 bp, Mus musculus
ctctactaagtgccctgcattgaag

SEQ ID NO: 270057 - DNA, 25 bp, Mus musculus
ctctactactgaataccccaagtac

SEQ ID NO: 270058 - DNA, 25 bp, Mus musculus
ctctactatggagatgtcatctggg

SEQ ID NO: 270059 - DNA, 25 bp, Mus musculus
ctctactatggaggggctccacggg

SEQ ID NO: 270060 - DNA, 25 bp, Mus musculus
ctctactcaatagtcaaggaggttc

SEQ ID NO: 270061 - DNA, 25 bp, Mus musculus
ctctactcagttcctcatttgactt

SEQ ID NO: 270062 - DNA, 25 bp, Mus musculus
ctctactccaggatggaggcctcct

SEQ ID NO: 270063 - DNA, 25 bp, Mus musculus
ctctactccgccattttcctgctgt

SEQ ID NO: 270064 - DNA, 25 bp, Mus musculus
ctctactcctaagtccccaggtgca

SEQ ID NO: 270065 - DNA, 25 bp, Mus musculus
ctctactcctaatgtgaaaaactca

SEQ ID NO: 270066 - DNA, 25 bp, Mus musculus
ctctactcgtcctcttccacttcct

SEQ ID NO: 270067 - DNA, 25 bp, Mus musculus
ctctactgagcccaggaaactacaa

SEQ ID NO: 270068 - DNA, 25 bp, Mus musculus
ctctactgccacagtggttccggaa

SEQ ID NO: 270069 - DNA, 25 bp, Mus musculus
ctctactgccagactactggacttg

SEQ ID NO: 270070 - DNA, 25 bp, Mus musculus
ctctactgccagtgtctgttgtaga

SEQ ID NO: 270071 - DNA, 25 bp, Mus musculus
ctctactggaatagctacctcaggc

SEQ ID NO: 270072 - DNA, 25 bp, Mus musculus
ctctactggccagaaggccagcaac

SEQ ID NO: 270073 - DNA, 25 bp, Mus musculus
ctctactgtcccggtgtgccagcct

SEQ ID NO: 270074 - DNA, 25 bp, Mus musculus
ctctactgtgaaggtgtggtccggt

SEQ ID NO: 270075 - DNA, 25 bp, Mus musculus
ctctactgtgaggtctacatcaccg

SEQ ID NO: 270076 - DNA, 25 bp, Mus musculus
ctctactttcattctctttacaggg

SEQ ID NO: 270077 - DNA, 25 bp, Mus musculus
ctctactttcattctttagtaacaa

SEQ ID NO: 270078 - DNA, 25 bp, Mus musculus
ctctagaaaagttgaaatactggac

SEQ ID NO: 270079 - DNA, 25 bp, Mus musculus
ctctagaacagatgcaaaatcgtat

SEQ ID NO: 270080 - DNA, 25 bp, Mus musculus
ctctagaacaggagagcctgacaag

SEQ ID NO: 270081 - DNA, 25 bp, Mus musculus
ctctagaactgaactcattatacaa

SEQ ID NO: 270082 - DNA, 25 bp, Mus musculus
ctctagaagagcagtcgggtgctct

SEQ ID NO: 270083 - DNA, 25 bp, Mus musculus
ctctagaagcgaaggaatacacaga

SEQ ID NO: 270084 - DNA, 25 bp, Mus musculus
ctctagacacctttctctcccttca

SEQ ID NO: 270085 - DNA, 25 bp, Mus musculus
ctctagagaaggagctagaagcgat

SEQ ID NO: 270086 - DNA, 25 bp, Mus musculus
ctctagagccgtcaagctgatttat

SEQ ID NO: 270087 - DNA, 25 bp, Mus musculus
ctctagaggaggcctctaggtcgcc

SEQ ID NO: 270088 - DNA, 25 bp, Mus musculus
ctctagatagggtgagcgtggacag

SEQ ID NO: 270089 - DNA, 25 bp, Mus musculus
ctctagcaacaaggaatcaaaaatg

SEQ ID NO: 270090 - DNA, 25 bp, Mus musculus
ctctagcacaggttggtctggggtg

SEQ ID NO: 270091 - DNA, 25 bp, Mus musculus
ctctagcattgaggcctttgctgtg

SEQ ID NO: 270092 - DNA, 25 bp, Mus musculus
ctctagccgagatgtggtgaccaag

SEQ ID NO: 270093 - DNA, 25 bp, Mus musculus
ctctagccgaggccatgtggagcag

SEQ ID NO: 270094 - DNA, 25 bp, Mus musculus
ctctagcctaagttctgagaagtca

SEQ ID NO: 270095 - DNA, 25 bp, Mus musculus
ctctagcctcccaggtggaatgaac

SEQ ID NO: 270096 - DNA, 25 bp, Mus musculus
ctctagctcaggatgatatcctcca

SEQ ID NO: 270097 - DNA, 25 bp, Mus musculus
ctctagctcaggtagcaacaattgc

SEQ ID NO: 270098 - DNA, 25 bp, Mus musculus
ctctagctcaggtttctgtagctgg

SEQ ID NO: 270099 - DNA, 25 bp, Mus musculus
ctctagctgaagtgagcaaaccaac

SEQ ID NO: 270100 - DNA, 25 bp, Mus musculus
ctctagctgactggtgagcaccgag

SEQ ID NO: 270101 - DNA, 25 bp, Mus musculus
ctctagctgggcgaggacccgtgga

SEQ ID NO: 270102 - DNA, 25 bp, Mus musculus
ctctaggaaggtatggcctcacaag

SEQ ID NO: 270103 - DNA, 25 bp, Mus musculus
ctctaggagaacttaggcttctttg

SEQ ID NO: 270104 - DNA, 25 bp, Mus musculus
ctctagggacagctggttccgtggc

SEQ ID NO: 270105 - DNA, 25 bp, Mus musculus
ctctaggtcagcgaggtattgaagc

SEQ ID NO: 270106 - DNA, 25 bp, Mus musculus
ctctagtcctcagaactgtggacct

SEQ ID NO: 270107 - DNA, 25 bp, Mus musculus
ctctagtgctacaggcactcttcaa

SEQ ID NO: 270108 - DNA, 25 bp, Mus musculus
ctctagtgctacaggttctcacgcg

SEQ ID NO: 270109 - DNA, 25 bp, Mus musculus
ctctagtgctacaggttctgctgac

SEQ ID NO: 270110 - DNA, 25 bp, Mus musculus
ctctagtggaccagaggatatctgg

SEQ ID NO: 270111 - DNA, 25 bp, Mus musculus
ctctataaaaagaaaaatattacaa

SEQ ID NO: 270112 - DNA, 25 bp, Mus musculus
ctctataaacaggcggcagcagctc

SEQ ID NO: 270113 - DNA, 25 bp, Mus musculus
ctctataaacaggtcttagagcctt

SEQ ID NO: 270114 - DNA, 25 bp, Mus musculus
ctctataaagcattgaggccaagct

SEQ ID NO: 270115 - DNA, 25 bp, Mus musculus
ctctataaaggactgattgtgaatt

SEQ ID NO: 270116 - DNA, 25 bp, Mus musculus
ctctataaagtctttcctgtactct

SEQ ID NO: 270117 - DNA, 25 bp, Mus musculus
ctctataaattggagctggcctgaa

SEQ ID NO: 270118 - DNA, 25 bp, Mus musculus
ctctataaggagggtcactccaaag

SEQ ID NO: 270119 - DNA, 25 bp, Mus musculus
ctctataattagcacagagaatgaa

SEQ ID NO: 270120 - DNA, 25 bp, Mus musculus
ctctatacacatagttacttgggat

SEQ ID NO: 270121 - DNA, 25 bp, Mus musculus
ctctataccagactttgtacctatt

SEQ ID NO: 270122 - DNA, 25 bp, Mus musculus
ctctataccttacggtccctttcct

SEQ ID NO: 270123 - DNA, 25 bp, Mus musculus
ctctatagtccaggacagccagggc

SEQ ID NO: 270124 - DNA, 25 bp, Mus musculus
ctctatataaagacactccgtggtg

SEQ ID NO: 270125 - DNA, 25 bp, Mus musculus
ctctatatcgtccaggtatttgata

SEQ ID NO: 270126 - DNA, 25 bp, Mus musculus
ctctatcaaaggttgccgaggctgg

SEQ ID NO: 270127 - DNA, 25 bp, Mus musculus
ctctatcaagatctgggataaaagc

SEQ ID NO: 270128 - DNA, 25 bp, Mus musculus
ctctatcacaggccaaaacaacttc

SEQ ID NO: 270129 - DNA, 25 bp, Mus musculus
ctctatcacatagatgagaattctc

SEQ ID NO: 270130 - DNA, 25 bp, Mus musculus
ctctatccaagggaaggaaaataca

SEQ ID NO: 270131 - DNA, 25 bp, Mus musculus
ctctatcccacagatggtatggtgt

SEQ ID NO: 270132 - DNA, 25 bp, Mus musculus
ctctatccctcttggaggaaccaca

SEQ ID NO: 270133 - DNA, 25 bp, Mus musculus
ctctatcctgaagtgattttcctcg

SEQ ID NO: 270134 - DNA, 25 bp, Mus musculus
ctctatcgaggctacatgaaggact

SEQ ID NO: 270135 - DNA, 25 bp, Mus musculus
ctctatctcaccagttgtgtgaatt

SEQ ID NO: 270136 - DNA, 25 bp, Mus musculus
ctctatctcctccagcggcagtaca

SEQ ID NO: 270137 - DNA, 25 bp, Mus musculus
ctctatctgagaaaacaggtcttaa

SEQ ID NO: 270138 - DNA, 25 bp, Mus musculus
ctctatctggggactgcctccagaa

SEQ ID NO: 270139 - DNA, 25 bp, Mus musculus
ctctatctgggttggacctcgagga

SEQ ID NO: 270140 - DNA, 25 bp, Mus musculus
ctctatgaaaaactgatgagccctg

SEQ ID NO: 270141 - DNA, 25 bp, Mus musculus
ctctatgaaaagtctgtcagtttgt

SEQ ID NO: 270142 - DNA, 25 bp, Mus musculus
ctctatgaccctcagaaaaaagtgg

SEQ ID NO: 270143 - DNA, 25 bp, Mus musculus
ctctatgagaatagagcacagtcag

SEQ ID NO: 270144 - DNA, 25 bp, Mus musculus
ctctatgaggaatgagtggccttgt

SEQ ID NO: 270145 - DNA, 25 bp, Mus musculus
ctctatgagggaaattgacttctat

SEQ ID NO: 270146 - DNA, 25 bp, Mus musculus
ctctatgagtagtgggatgagagtc

SEQ ID NO: 270147 - DNA, 25 bp, Mus musculus
ctctatgctccggggagaaaaatgt

SEQ ID NO: 270148 - DNA, 25 bp, Mus musculus
ctctatgctgtggtttgccactagc

SEQ ID NO: 270149 - DNA, 25 bp, Mus musculus
ctctatgcttccggcatcgtgttgg

SEQ ID NO: 270150 - DNA, 25 bp, Mus musculus
ctctatggaagaggaatcttcaaag

SEQ ID NO: 270151 - DNA, 25 bp, Mus musculus
ctctatggcggaacctaaggaaggt

SEQ ID NO: 270152 - DNA, 25 bp, Mus musculus
ctctatggcggatcctgtctctaca

SEQ ID NO: 270153 - DNA, 25 bp, Mus musculus
ctctatggctcccttcttctcatgg

SEQ ID NO: 270154 - DNA, 25 bp, Mus musculus
ctctatgggctagagcaagccccgc

SEQ ID NO: 270155 - DNA, 25 bp, Mus musculus
ctctatgggtcgcgggtctactctg

SEQ ID NO: 270156 - DNA, 25 bp, Mus musculus
ctctatgggtcggttccgggagcgc

SEQ ID NO: 270157 - DNA, 25 bp, Mus musculus
ctctatgtaactgtcaccgtttctg

SEQ ID NO: 270158 - DNA, 25 bp, Mus musculus
ctctatgtactacaatggcattgga

SEQ ID NO: 270159 - DNA, 25 bp, Mus musculus
ctctatgtactcaggatatgctgtc

SEQ ID NO: 270160 - DNA, 25 bp, Mus musculus
ctctatgtactcagggggaaaatgc

SEQ ID NO: 270161 - DNA, 25 bp, Mus musculus
ctctattaaaagatgacttacaggg

SEQ ID NO: 270162 - DNA, 25 bp, Mus musculus
ctctattaaaagctcttttggaaga

SEQ ID NO: 270163 - DNA, 25 bp, Mus musculus
ctctattacccaggggaccccagct

SEQ ID NO: 270164 - DNA, 25 bp, Mus musculus
ctctattcagctcccattttcgcca

SEQ ID NO: 270165 - DNA, 25 bp, Mus musculus
ctctattgggtaatgggccaattca

SEQ ID NO: 270166 - DNA, 25 bp, Mus musculus
ctctatttaagaagagaaggtggct

SEQ ID NO: 270167 - DNA, 25 bp, Mus musculus
ctctatttaagaagatgaaaccaga

SEQ ID NO: 270168 - DNA, 25 bp, Mus musculus
ctctatttcaggactcagtggcttt

SEQ ID NO: 270169 - DNA, 25 bp, Mus musculus
ctctatttgatgcactagctgaaaa

SEQ ID NO: 270170 - DNA, 25 bp, Mus musculus
ctctatttgatgttcatgcagaaga

SEQ ID NO: 270171 - DNA, 25 bp, Mus musculus
ctctcaaaacagatctgtctgattt

SEQ ID NO: 270172 - DNA, 25 bp, Mus musculus
ctctcaaaatgagccccggcagccc

SEQ ID NO: 270173 - DNA, 25 bp, Mus musculus
ctctcaaaccacgcggagtgtcctt

SEQ ID NO: 270174 - DNA, 25 bp, Mus musculus
ctctcaaaccacgtgacctcttggt

SEQ ID NO: 270175 - DNA, 25 bp, Mus musculus
ctctcaaactagatttcctctgaga

SEQ ID NO: 270176 - DNA, 25 bp, Mus musculus
ctctcaaactcctgccctgcataag

SEQ ID NO: 270177 - DNA, 25 bp, Mus musculus
ctctcaaagccaaactgcagatgac

SEQ ID NO: 270178 - DNA, 25 bp, Mus musculus
ctctcaaagtcaagctgaacagggc

SEQ ID NO: 270179 - DNA, 25 bp, Mus musculus
ctctcaacatggaaaagtataactt

SEQ ID NO: 270180 - DNA, 25 bp, Mus musculus
ctctcaaccctggctgcactgctgc

SEQ ID NO: 270181 - DNA, 25 bp, Mus musculus
ctctcaacctctcttcaggcccaga

SEQ ID NO: 270182 - DNA, 25 bp, Mus musculus
ctctcaacctgtctgcaaacagcat

SEQ ID NO: 270183 - DNA, 25 bp, Mus musculus
ctctcaactggctgatgcttgactt

SEQ ID NO: 270184 - DNA, 25 bp, Mus musculus
ctctcaactggtgtggtgtggatga

SEQ ID NO: 270185 - DNA, 25 bp, Mus musculus
ctctcaagaaagatgcgccaggagg

SEQ ID NO: 270186 - DNA, 25 bp, Mus musculus
ctctcaagaaaggacagatcgttac

SEQ ID NO: 270187 - DNA, 25 bp, Mus musculus
ctctcaagcctgcggacttgactgc

SEQ ID NO: 270188 - DNA, 25 bp, Mus musculus
ctctcaagcctgcggggacttgact

SEQ ID NO: 270189 - DNA, 25 bp, Mus musculus
ctctcaatgggtgttcaggataaac

SEQ ID NO: 270190 - DNA, 25 bp, Mus musculus
ctctcaattagttgacattaaaaag

SEQ ID NO: 270191 - DNA, 25 bp, Mus musculus
ctctcacaatgctctgtcagaaacg

SEQ ID NO: 270192 - DNA, 25 bp, Mus musculus
ctctcacaatgtgtcctactgaaac

SEQ ID NO: 270193 - DNA, 25 bp, Mus musculus
ctctcacacacagctttcttctgca

SEQ ID NO: 270194 - DNA, 25 bp, Mus musculus
ctctcacacacaggacacagaagac

SEQ ID NO: 270195 - DNA, 25 bp, Mus musculus
ctctcacactcaggggacaattcaa

SEQ ID NO: 270196 - DNA, 25 bp, Mus musculus
ctctcacagtgatagaatgcctgaa

SEQ ID NO: 270197 - DNA, 25 bp, Mus musculus
ctctcacagtgatgagaattttaaa

SEQ ID NO: 270198 - DNA, 25 bp, Mus musculus
ctctcacatggagaaactgctgtca

SEQ ID NO: 270199 - DNA, 25 bp, Mus musculus
ctctcaccaagcggacagagaagtt

SEQ ID NO: 270200 - DNA, 25 bp, Mus musculus
ctctcaccaaggctctggcctatgt

SEQ ID NO: 270201 - DNA, 25 bp, Mus musculus
ctctcacccaccgacctttgcacag

SEQ ID NO: 270202 - DNA, 25 bp, Mus musculus
ctctcacccgcccgagttcgtcaac

SEQ ID NO: 270203 - DNA, 25 bp, Mus musculus
ctctcacccggtacttggtggagga

SEQ ID NO: 270204 - DNA, 25 bp, Mus musculus
ctctcaccgctcggctctgggtgct

SEQ ID NO: 270205 - DNA, 25 bp, Mus musculus
ctctcaccgctcgggcctgtgctct

SEQ ID NO: 270206 - DNA, 25 bp, Mus musculus
ctctcaccggcagaggctgaaggcg

SEQ ID NO: 270207 - DNA, 25 bp, Mus musculus
ctctcacctcaatgaggacaataat

SEQ ID NO: 270208 - DNA, 25 bp, Mus musculus
ctctcactgaccctctccccttaaa

SEQ ID NO: 270209 - DNA, 25 bp, Mus musculus
ctctcactgggtcttctgggtagga

SEQ ID NO: 270210 - DNA, 25 bp, Mus musculus
ctctcactgtcaggaagttggtgtc

SEQ ID NO: 270211 - DNA, 25 bp, Mus musculus
ctctcacttccagaggaactcaagc

SEQ ID NO: 270212 - DNA, 25 bp, Mus musculus
ctctcagaagacaaaagagagcatt

SEQ ID NO: 270213 - DNA, 25 bp, Mus musculus
ctctcagaagcatcactatttcatg

SEQ ID NO: 270214 - DNA, 25 bp, Mus musculus
ctctcagaaggcaaatgtgccgagc

SEQ ID NO: 270215 - DNA, 25 bp, Mus musculus
ctctcagaaggccaagttcgacagc

SEQ ID NO: 270216 - DNA, 25 bp, Mus musculus
ctctcagacaggaacagaaattctt

SEQ ID NO: 270217 - DNA, 25 bp, Mus musculus
ctctcagacaggtttggtcgcaaga

SEQ ID NO: 270218 - DNA, 25 bp, Mus musculus
ctctcagagctgtggcagctcagca

SEQ ID NO: 270219 - DNA, 25 bp, Mus musculus
ctctcagaggcagatgacctggatg

SEQ ID NO: 270220 - DNA, 25 bp, Mus musculus
ctctcagaggctgagaaaataatgt

SEQ ID NO: 270221 - DNA, 25 bp, Mus musculus
ctctcagaggctgaggacaaatgag

SEQ ID NO: 270222 - DNA, 25 bp, Mus musculus
ctctcagcacacctggagcctgtta

SEQ ID NO: 270223 - DNA, 25 bp, Mus musculus
ctctcagcagatgatcctctaggca

SEQ ID NO: 270224 - DNA, 25 bp, Mus musculus
ctctcagcagatggtacctggaccc

SEQ ID NO: 270225 - DNA, 25 bp, Mus musculus
ctctcagcagattccaaaggctggc

SEQ ID NO: 270226 - DNA, 25 bp, Mus musculus
ctctcagcaggccttgagcctccct

SEQ ID NO: 270227 - DNA, 25 bp, Mus musculus
ctctcagcatgcaaaattctaaaga

SEQ ID NO: 270228 - DNA, 25 bp, Mus musculus
ctctcagcatgcaagagactctgca

SEQ ID NO: 270229 - DNA, 25 bp, Mus musculus
ctctcagctcagcggaacctgcctc

SEQ ID NO: 270230 - DNA, 25 bp, Mus musculus
ctctcagctcagcggtcacacagca

SEQ ID NO: 270231 - DNA, 25 bp, Mus musculus
ctctcagcttctcatgctcatcttt

SEQ ID NO: 270232 - DNA, 25 bp, Mus musculus
ctctcagcttctcatgtgcaggctg

SEQ ID NO: 270233 - DNA, 25 bp, Mus musculus
ctctcaggaccaggtagattccata

SEQ ID NO: 270234 - DNA, 25 bp, Mus musculus
ctctcaggagagaggtacaaagaag

SEQ ID NO: 270235 - DNA, 25 bp, Mus musculus
ctctcaggcaccaggttcctccaac

SEQ ID NO: 270236 - DNA, 25 bp, Mus musculus
ctctcaggccgcctctagacgtcct

SEQ ID NO: 270237 - DNA, 25 bp, Mus musculus
ctctcaggccgggttcgagtgagcc

SEQ ID NO: 270238 - DNA, 25 bp, Mus musculus
ctctcaggccggtgacgctgactgc

SEQ ID NO: 270239 - DNA, 25 bp, Mus musculus
ctctcaggctctgggagttggaacc

SEQ ID NO: 270240 - DNA, 25 bp, Mus musculus
ctctcaggctgtcagaaaaagatgc

SEQ ID NO: 270241 - DNA, 25 bp, Mus musculus
ctctcaggctgtcagtctagtctcc

SEQ ID NO: 270242 - DNA, 25 bp, Mus musculus
ctctcaggctgtgagatatctgttt

SEQ ID NO: 270243 - DNA, 25 bp, Mus musculus
ctctcaggtcccagagaccagaggg

SEQ ID NO: 270244 - DNA, 25 bp, Mus musculus
ctctcaggtcccaggctgtgtccca

SEQ ID NO: 270245 - DNA, 25 bp, Mus musculus
ctctcaggttttggctaccggctct

SEQ ID NO: 270246 - DNA, 25 bp, Mus musculus
ctctcagtcaggtttggacgtcatg

SEQ ID NO: 270247 - DNA, 25 bp, Mus musculus
ctctcagtccattaggctcttctgc

SEQ ID NO: 270248 - DNA, 25 bp, Mus musculus
ctctcagtctgaaaggctccagata

SEQ ID NO: 270249 - DNA, 25 bp, Mus musculus
ctctcagtgcaagacagtattggag

SEQ ID NO: 270250 - DNA, 25 bp, Mus musculus
ctctcagtgcaagtcatggggaccc

SEQ ID NO: 270251 - DNA, 25 bp, Mus musculus
ctctcagtgctgggttttcagagca

SEQ ID NO: 270252 - DNA, 25 bp, Mus musculus
ctctcagtggccccagggcccggag

SEQ ID NO: 270253 - DNA, 25 bp, Mus musculus
ctctcataaagccctttctgacatg

SEQ ID NO: 270254 - DNA, 25 bp, Mus musculus
ctctcatagccagggttcagccgac

SEQ ID NO: 270255 - DNA, 25 bp, Mus musculus
ctctcatagggaactttcaagttgt

SEQ ID NO: 270256 - DNA, 25 bp, Mus musculus
ctctcatcaataaggactgcatcga

SEQ ID NO: 270257 - DNA, 25 bp, Mus musculus
ctctcatcacctctggaacttagcc

SEQ ID NO: 270258 - DNA, 25 bp, Mus musculus
ctctcatcagcatccgccaccacgc

SEQ ID NO: 270259 - DNA, 25 bp, Mus musculus
ctctcatcaggtgaaaacatgattc

SEQ ID NO: 270260 - DNA, 25 bp, Mus musculus
ctctcatcagttcttacccaagaca

SEQ ID NO: 270261 - DNA, 25 bp, Mus musculus
ctctcatccctagcagaacatcatg

SEQ ID NO: 270262 - DNA, 25 bp, Mus musculus
ctctcatctacttccccctttccca

SEQ ID NO: 270263 - DNA, 25 bp, Mus musculus
ctctcatctccgacttcttcgccaa

SEQ ID NO: 270264 - DNA, 25 bp, Mus musculus
ctctcatgagtctggcgaacactct

SEQ ID NO: 270265 - DNA, 25 bp, Mus musculus
ctctcatgcctgtggggctgcgagg

SEQ ID NO: 270266 - DNA, 25 bp, Mus musculus
ctctcatgctagttcagcaatcagc

SEQ ID NO: 270267 - DNA, 25 bp, Mus musculus
ctctcattgaggcttatgtaaacat

SEQ ID NO: 270268 - DNA, 25 bp, Mus musculus
ctctcattgctcgagtttgtgacaa

SEQ ID NO: 270269 - DNA, 25 bp, Mus musculus
ctctcattgtgcaggcggctctcct

SEQ ID NO: 270270 - DNA, 25 bp, Mus musculus
ctctcattgtgcagttctgtgccaa

SEQ ID NO: 270271 - DNA, 25 bp, Mus musculus
ctctcatttagtcaattggatccag

SEQ ID NO: 270272 - DNA, 25 bp, Mus musculus
ctctcatttttcgctcccagaccta

SEQ ID NO: 270273 - DNA, 25 bp, Mus musculus
ctctccaaaagtaaagcaccgtgga

SEQ ID NO: 270274 - DNA, 25 bp, Mus musculus
ctctccaaacagacgatccagaacc

SEQ ID NO: 270275 - DNA, 25 bp, Mus musculus
ctctccaaagtacttgggagacagg

SEQ ID NO: 270276 - DNA, 25 bp, Mus musculus
ctctccaaccaaggcatcctcggag

SEQ ID NO: 270277 - DNA, 25 bp, Mus musculus
ctctccaaccaaggtatcatgtttg

SEQ ID NO: 270278 - DNA, 25 bp, Mus musculus
ctctccaaccagccaatagttacag

SEQ ID NO: 270279 - DNA, 25 bp, Mus musculus
ctctccaaccagttacagttagtgc

SEQ ID NO: 270280 - DNA, 25 bp, Mus musculus
ctctccaacctccagtctcaccagc

SEQ ID NO: 270281 - DNA, 25 bp, Mus musculus
ctctccaactggctttaagggaatt

SEQ ID NO: 270282 - DNA, 25 bp, Mus musculus
ctctccaagtaagagtcaaagcagt

SEQ ID NO: 270283 - DNA, 25 bp, Mus musculus
ctctccaagtatgtaggaggagtaa

SEQ ID NO: 270284 - DNA, 25 bp, Mus musculus
ctctccaccgggaaaatctgaacaa

SEQ ID NO: 270285 - DNA, 25 bp, Mus musculus
ctctccactacaagatgaggtctca

SEQ ID NO: 270286 - DNA, 25 bp, Mus musculus
ctctccagaacaaagtctgttcaag

SEQ ID NO: 270287 - DNA, 25 bp, Mus musculus
ctctccagatagagctcgccgcctg

SEQ ID NO: 270288 - DNA, 25 bp, Mus musculus
ctctccagatagagtcccaggtaaa

SEQ ID NO: 270289 - DNA, 25 bp, Mus musculus
ctctccagatgagagggaagagtgg

SEQ ID NO: 270290 - DNA, 25 bp, Mus musculus
ctctccagcacctgtgaataaaagc

SEQ ID NO: 270291 - DNA, 25 bp, Mus musculus
ctctccagcagaactaaagaacgct

SEQ ID NO: 270292 - DNA, 25 bp, Mus musculus
ctctccagcaggttacagtaccttt

SEQ ID NO: 270293 - DNA, 25 bp, Mus musculus
ctctccagccaggatgtgatggtgg

SEQ ID NO: 270294 - DNA, 25 bp, Mus musculus
ctctccagccaggctgcttctgatg

SEQ ID NO: 270295 - DNA, 25 bp, Mus musculus
ctctccagccagtgaggatcccatt

SEQ ID NO: 270296 - DNA, 25 bp, Mus musculus
ctctccagccatatctggcaccaat

SEQ ID NO: 270297 - DNA, 25 bp, Mus musculus
ctctccagccccagaacaaggaatt

SEQ ID NO: 270298 - DNA, 25 bp, Mus musculus
ctctccagcccccagatctccttgt

SEQ ID NO: 270299 - DNA, 25 bp, Mus musculus
ctctccagcccggttttgaggaaaa

SEQ ID NO: 270300 - DNA, 25 bp, Mus musculus
ctctccagctatgagaagcaacagg

SEQ ID NO: 270301 - DNA, 25 bp, Mus musculus
ctctccagctatgagcctggagtac

SEQ ID NO: 270302 - DNA, 25 bp, Mus musculus
ctctccaggatgttctgaggaggac

SEQ ID NO: 270303 - DNA, 25 bp, Mus musculus
ctctccaggctctacttctgttcat

SEQ ID NO: 270304 - DNA, 25 bp, Mus musculus
ctctccaggctctgggaccctgaaa

SEQ ID NO: 270305 - DNA, 25 bp, Mus musculus
ctctccagggccctgacgtcaagac

SEQ ID NO: 270306 - DNA, 25 bp, Mus musculus
ctctccagtggtggatgtgaagaaa

SEQ ID NO: 270307 - DNA, 25 bp, Mus musculus
ctctccataaggtggcccacgcgct

SEQ ID NO: 270308 - DNA, 25 bp, Mus musculus
ctctccatcaggtttctttcttgtt

SEQ ID NO: 270309 - DNA, 25 bp, Mus musculus
ctctccatcctgaagtccctgctat

SEQ ID NO: 270310 - DNA, 25 bp, Mus musculus
ctctccattcaggcacagatgcttc

SEQ ID NO: 270311 - DNA, 25 bp, Mus musculus
ctctccattcaggtagtgactgcag

SEQ ID NO: 270312 - DNA, 25 bp, Mus musculus
ctctccattgcgaggctcctgacag

SEQ ID NO: 270313 - DNA, 25 bp, Mus musculus
ctctccattgtagggatgtttcttg

SEQ ID NO: 270314 - DNA, 25 bp, Mus musculus
ctctcccaatcctgtgatagtcctc

SEQ ID NO: 270315 - DNA, 25 bp, Mus musculus
ctctcccaccatcccaaatttattc

SEQ ID NO: 270316 - DNA, 25 bp, Mus musculus
ctctcccaccatgaaacaaaaggag

SEQ ID NO: 270317 - DNA, 25 bp, Mus musculus
ctctcccacgctaagatgcccctag

SEQ ID NO: 270318 - DNA, 25 bp, Mus musculus
ctctcccagattataagtttccaga

SEQ ID NO: 270319 - DNA, 25 bp, Mus musculus
ctctcccagattatgcacaggacct

SEQ ID NO: 270320 - DNA, 25 bp, Mus musculus
ctctcccagcttcgcaggacccaac

SEQ ID NO: 270321 - DNA, 25 bp, Mus musculus
ctctcccagggatgaacaggccgat

SEQ ID NO: 270322 - DNA, 25 bp, Mus musculus
ctctcccggagaggtgtcgcggaag

SEQ ID NO: 270323 - DNA, 25 bp, Mus musculus
ctctccctacggcatagtgccgtcc

SEQ ID NO: 270324 - DNA, 25 bp, Mus musculus
ctctccctacggcatgaaacagaag

SEQ ID NO: 270325 - DNA, 25 bp, Mus musculus
ctctccctagcaaaactcttccaag

SEQ ID NO: 270326 - DNA, 25 bp, Mus musculus
ctctccctcaagacatctccgaccc

SEQ ID NO: 270327 - DNA, 25 bp, Mus musculus
ctctccctcaagtgctgcattgacc

SEQ ID NO: 270328 - DNA, 25 bp, Mus musculus
ctctccctcgcagttcttgaacact

SEQ ID NO: 270329 - DNA, 25 bp, Mus musculus
ctctccctgggctgtggtggtgaga

SEQ ID NO: 270330 - DNA, 25 bp, Mus musculus
ctctccgacatcacccatgctggac

SEQ ID NO: 270331 - DNA, 25 bp, Mus musculus
ctctccgacccgggcaggagctggg

SEQ ID NO: 270332 - DNA, 25 bp, Mus musculus
ctctccgagacagagacaaaatcac

SEQ ID NO: 270333 - DNA, 25 bp, Mus musculus
ctctccgagggcgggcggcgacagc

SEQ ID NO: 270334 - DNA, 25 bp, Mus musculus
ctctccgcagcaggatgagccggca

SEQ ID NO: 270335 - DNA, 25 bp, Mus musculus
ctctccgcagcagtttacaatctgt

SEQ ID NO: 270336 - DNA, 25 bp, Mus musculus
ctctccgcccacagagatgagccgc

SEQ ID NO: 270337 - DNA, 25 bp, Mus musculus
ctctccgcgcacagcattagcagag

SEQ ID NO: 270338 - DNA, 25 bp, Mus musculus
ctctccggcaccggactttttccta

SEQ ID NO: 270339 - DNA, 25 bp, Mus musculus
ctctccggcaccgggccatggcgga

SEQ ID NO: 270340 - DNA, 25 bp, Mus musculus
ctctccggctctaaggccaaagatc

SEQ ID NO: 270341 - DNA, 25 bp, Mus musculus
ctctccggctggatgagcctgcccg

SEQ ID NO: 270342 - DNA, 25 bp, Mus musculus
ctctccgggattgtgctttgagcgc

SEQ ID NO: 270343 - DNA, 25 bp, Mus musculus
ctctccggtctgaaccggctgatta

SEQ ID NO: 270344 - DNA, 25 bp, Mus musculus
ctctccgtacagatcttcgtccctc

SEQ ID NO: 270345 - DNA, 25 bp, Mus musculus
ctctccgtacagcgccatggctact

SEQ ID NO: 270346 - DNA, 25 bp, Mus musculus
ctctccgtcctttaggaaaggtatg

SEQ ID NO: 270347 - DNA, 25 bp, Mus musculus
ctctccgtgccggcggcctcagcac

SEQ ID NO: 270348 - DNA, 25 bp, Mus musculus
ctctccgtgtgaaagatacttggta

SEQ ID NO: 270349 - DNA, 25 bp, Mus musculus
ctctcctaaaaggattgcaaaagtt

SEQ ID NO: 270350 - DNA, 25 bp, Mus musculus
ctctcctaactcaggtgaggcacag

SEQ ID NO: 270351 - DNA, 25 bp, Mus musculus
ctctcctaactggtcagtaccatga

SEQ ID NO: 270352 - DNA, 25 bp, Mus musculus
ctctcctacactgggctcctccacc

SEQ ID NO: 270353 - DNA, 25 bp, Mus musculus
ctctcctacactggtgacaagacga

SEQ ID NO: 270354 - DNA, 25 bp, Mus musculus
ctctcctcaatatgccctacacagt

SEQ ID NO: 270355 - DNA, 25 bp, Mus musculus
ctctcctcaatatggaaagtaccta

SEQ ID NO: 270356 - DNA, 25 bp, Mus musculus
ctctcctcagaagactggtccccgg

SEQ ID NO: 270357 - DNA, 25 bp, Mus musculus
ctctcctcagcccttcagggtggta

SEQ ID NO: 270358 - DNA, 25 bp, Mus musculus
ctctcctcaggtcatgtttactggt

SEQ ID NO: 270359 - DNA, 25 bp, Mus musculus
ctctcctccaggcacaactgtgcgg

SEQ ID NO: 270360 - DNA, 25 bp, Mus musculus
ctctcctctatgctcctttcctggc

SEQ ID NO: 270361 - DNA, 25 bp, Mus musculus
ctctcctctatggctcagcactgca

SEQ ID NO: 270362 - DNA, 25 bp, Mus musculus
ctctcctctcaactccacgtcagca

SEQ ID NO: 270363 - DNA, 25 bp, Mus musculus
ctctcctctcaagcaagctatagtc

SEQ ID NO: 270364 - DNA, 25 bp, Mus musculus
ctctcctctcagaggctctggagac

SEQ ID NO: 270365 - DNA, 25 bp, Mus musculus
ctctcctctgaaggctagccctgct

SEQ ID NO: 270366 - DNA, 25 bp, Mus musculus
ctctcctgaaagcgctgagaagcag

SEQ ID NO: 270367 - DNA, 25 bp, Mus musculus
ctctcctgaagtaggtgtaattatt

SEQ ID NO: 270368 - DNA, 25 bp, Mus musculus
ctctcctgactttgggtaatgttct

SEQ ID NO: 270369 - DNA, 25 bp, Mus musculus
ctctcctgagagagaacttgccgac

SEQ ID NO: 270370 - DNA, 25 bp, Mus musculus
ctctcctgagagagaggtgcaggca

SEQ ID NO: 270371 - DNA, 25 bp, Mus musculus
ctctcctgcaaaggctgaggagctg

SEQ ID NO: 270372 - DNA, 25 bp, Mus musculus
ctctcctgcaaatgtccaaacggat

SEQ ID NO: 270373 - DNA, 25 bp, Mus musculus
ctctcctgcaagtgtcctgtgggat

SEQ ID NO: 270374 - DNA, 25 bp, Mus musculus
ctctcctgcaggaagtggacattgt

SEQ ID NO: 270375 - DNA, 25 bp, Mus musculus
ctctcctgccccgtgaactgtgaca

SEQ ID NO: 270376 - DNA, 25 bp, Mus musculus
ctctcctgccttcctttctttgatg

SEQ ID NO: 270377 - DNA, 25 bp, Mus musculus
ctctcctgctgggacacccctcaca

SEQ ID NO: 270378 - DNA, 25 bp, Mus musculus
ctctcctgctgggtctgtgatggtg

SEQ ID NO: 270379 - DNA, 25 bp, Mus musculus
ctctcctggccacgaaacactctct

SEQ ID NO: 270380 - DNA, 25 bp, Mus musculus
ctctcctggttacggtcatttggtg

SEQ ID NO: 270381 - DNA, 25 bp, Mus musculus
ctctcctgtcctgagctttcccgag

SEQ ID NO: 270382 - DNA, 25 bp, Mus musculus
ctctcctgtcgcagcctcggcctgg

SEQ ID NO: 270383 - DNA, 25 bp, Mus musculus
ctctcctgttaggcgtctcttttct

SEQ ID NO: 270384 - DNA, 25 bp, Mus musculus
ctctccttcagtaaattcaagatgg

SEQ ID NO: 270385 - DNA, 25 bp, Mus musculus
ctctccttccattatgtatagcagt

SEQ ID NO: 270386 - DNA, 25 bp, Mus musculus
ctctccttccttttgggcagcaagg

SEQ ID NO: 270387 - DNA, 25 bp, Mus musculus
ctctccttccttttgtgagattttt

SEQ ID NO: 270388 - DNA, 25 bp, Mus musculus
ctctccttccttttgttttcagctt

SEQ ID NO: 270389 - DNA, 25 bp, Mus musculus
ctctccttctttgaaagacactacg

SEQ ID NO: 270390 - DNA, 25 bp, Mus musculus
ctctccttgccgaatgcctaaatca

SEQ ID NO: 270391 - DNA, 25 bp, Mus musculus
ctctcctttcaagaattacaggccc

SEQ ID NO: 270392 - DNA, 25 bp, Mus musculus
ctctccttttaaagatcagccagat

SEQ ID NO: 270393 - DNA, 25 bp, Mus musculus
ctctcctttttgctgttcactttgg

SEQ ID NO: 270394 - DNA, 25 bp, Mus musculus
ctctcgaaaggttctgtacctcact

SEQ ID NO: 270395 - DNA, 25 bp, Mus musculus
ctctcgaacctggaacaaggcctga

SEQ ID NO: 270396 - DNA, 25 bp, Mus musculus
ctctcgaagattccccccagctggt

SEQ ID NO: 270397 - DNA, 25 bp, Mus musculus
ctctcgagagaagcgagagaagcgg

SEQ ID NO: 270398 - DNA, 25 bp, Mus musculus
ctctcgcagaaagtgggtttcccgt

SEQ ID NO: 270399 - DNA, 25 bp, Mus musculus
ctctcgccggcagctcttcctcccc

SEQ ID NO: 270400 - DNA, 25 bp, Mus musculus
ctctcgccggcagggttgggatcac

SEQ ID NO: 270401 - DNA, 25 bp, Mus musculus
ctctcggaagtgaactcaaagacag

SEQ ID NO: 270402 - DNA, 25 bp, Mus musculus
ctctcggacaggagagtgaagtgtg

SEQ ID NO: 270403 - DNA, 25 bp, Mus musculus
ctctcggacgcaggctcagcttctt

SEQ ID NO: 270404 - DNA, 25 bp, Mus musculus
ctctcggacgcagggaaggtagtgt

SEQ ID NO: 270405 - DNA, 25 bp, Mus musculus
ctctcggcagagtcattcccgagcc

SEQ ID NO: 270406 - DNA, 25 bp, Mus musculus
ctctcggcaggccgtttagggacgc

SEQ ID NO: 270407 - DNA, 25 bp, Mus musculus
ctctcggcaggcctggctgagaggc

SEQ ID NO: 270408 - DNA, 25 bp, Mus musculus
ctctcggcgccagggagtccttgcc

SEQ ID NO: 270409 - DNA, 25 bp, Mus musculus
ctctcggcgccaggggcagcttgac

SEQ ID NO: 270410 - DNA, 25 bp, Mus musculus
ctctcggctccgctagttctgacgg

SEQ ID NO: 270411 - DNA, 25 bp, Mus musculus
ctctcggctccgctgccctgggccc

SEQ ID NO: 270412 - DNA, 25 bp, Mus musculus
ctctcgggacggagatactactcgt

SEQ ID NO: 270413 - DNA, 25 bp, Mus musculus
ctctcgggacgggccctggtggtgg

SEQ ID NO: 270414 - DNA, 25 bp, Mus musculus
ctctcgggacggttcaatgtatcta

SEQ ID NO: 270415 - DNA, 25 bp, Mus musculus
ctctcggggctgctcttctcggggc

SEQ ID NO: 270416 - DNA, 25 bp, Mus musculus
ctctcgtcaagtgagccccaggcca

SEQ ID NO: 270417 - DNA, 25 bp, Mus musculus
ctctcgtcagatgtcgtcaccgtca

SEQ ID NO: 270418 - DNA, 25 bp, Mus musculus
ctctcgtcaggactgcaagaggctt

SEQ ID NO: 270419 - DNA, 25 bp, Mus musculus
ctctcgtcctaggctaggcggccgt

SEQ ID NO: 270420 - DNA, 25 bp, Mus musculus
ctctcgtcctagggggagcttctgg

SEQ ID NO: 270421 - DNA, 25 bp, Mus musculus
ctctcgtggaggctgctctgacagt

SEQ ID NO: 270422 - DNA, 25 bp, Mus musculus
ctctctaacacccttatttagaagt

SEQ ID NO: 270423 - DNA, 25 bp, Mus musculus
ctctctaaggatggtcctgcccccg

SEQ ID NO: 270424 - DNA, 25 bp, Mus musculus
ctctctacaaatgataaaactatta

SEQ ID NO: 270425 - DNA, 25 bp, Mus musculus
ctctctacagccctcagccaaacag

SEQ ID NO: 270426 - DNA, 25 bp, Mus musculus
ctctctacctgcaggcagcctgatc

SEQ ID NO: 270427 - DNA, 25 bp, Mus musculus
ctctctagaaaagttgaaatactgg

SEQ ID NO: 270428 - DNA, 25 bp, Mus musculus
ctctctagaactgaactcattatac

SEQ ID NO: 270429 - DNA, 25 bp, Mus musculus
ctctctagcagccctacgttcttcc

SEQ ID NO: 270430 - DNA, 25 bp, Mus musculus
ctctctagcctaagttctgagaagt

SEQ ID NO: 270431 - DNA, 25 bp, Mus musculus
ctctctatagtccaggacagccagg

SEQ ID NO: 270432 - DNA, 25 bp, Mus musculus
ctctctatataaagacactccgtgg

SEQ ID NO: 270433 - DNA, 25 bp, Mus musculus
ctctctatgagaatagagcacagtc

SEQ ID NO: 270434 - DNA, 25 bp, Mus musculus
ctctctatgagggaaattgacttct

SEQ ID NO: 270435 - DNA, 25 bp, Mus musculus
ctctctatgctgtggtttgccacta

SEQ ID NO: 270436 - DNA, 25 bp, Mus musculus
ctctctatttcacgctgcccccgac

SEQ ID NO: 270437 - DNA, 25 bp, Mus musculus
ctctctatttggagagaaatacatc

SEQ ID NO: 270438 - DNA, 25 bp, Mus musculus
ctctctcagcgcatctcctccctca

SEQ ID NO: 270439 - DNA, 25 bp, Mus musculus
ctctctcatgaggagccccaggatg

SEQ ID NO: 270440 - DNA, 25 bp, Mus musculus
ctctctcatgctagttcagcaatca

SEQ ID NO: 270441 - DNA, 25 bp, Mus musculus
ctctctcatttttcgctcccagacc

SEQ ID NO: 270442 - DNA, 25 bp, Mus musculus
ctctctccagataatctggaggctg

SEQ ID NO: 270443 - DNA, 25 bp, Mus musculus
ctctctccagccaggatgtgatggt

SEQ ID NO: 270444 - DNA, 25 bp, Mus musculus
ctctctccagcgcctgtattatgtg

SEQ ID NO: 270445 - DNA, 25 bp, Mus musculus
ctctctccagggagtgttcctgtat

SEQ ID NO: 270446 - DNA, 25 bp, Mus musculus
ctctctccagtacccccacttcctg

SEQ ID NO: 270447 - DNA, 25 bp, Mus musculus
ctctctccataaggtggcccacgcg

SEQ ID NO: 270448 - DNA, 25 bp, Mus musculus
ctctctcccagatgacagtcatgct

SEQ ID NO: 270449 - DNA, 25 bp, Mus musculus
ctctctccccatgactgacttggac

SEQ ID NO: 270450 - DNA, 25 bp, Mus musculus
ctctctccgacccgggcaggagctg

SEQ ID NO: 270451 - DNA, 25 bp, Mus musculus
ctctctcctaactggtcagtaccat

SEQ ID NO: 270452 - DNA, 25 bp, Mus musculus
ctctctcctgagagagaacttgccg

SEQ ID NO: 270453 - DNA, 25 bp, Mus musculus
ctctctcctgagagagaggtgcagg

SEQ ID NO: 270454 - DNA, 25 bp, Mus musculus
ctctctcgaaaggttctgtacctca

SEQ ID NO: 270455 - DNA, 25 bp, Mus musculus
ctctctcggcagagtcattcccgag

SEQ ID NO: 270456 - DNA, 25 bp, Mus musculus
ctctctcggcaggcctggctgagag

SEQ ID NO: 270457 - DNA, 25 bp, Mus musculus
ctctctctaccctcctgctgactgg

SEQ ID NO: 270458 - DNA, 25 bp, Mus musculus
ctctctctcaggcacttgtggaatg

SEQ ID NO: 270459 - DNA, 25 bp, Mus musculus
ctctctctcaggtctgaacataagg

SEQ ID NO: 270460 - DNA, 25 bp, Mus musculus
ctctctctccagataatctggaggc

SEQ ID NO: 270461 - DNA, 25 bp, Mus musculus
ctctctctccataaggtggcccacg

SEQ ID NO: 270462 - DNA, 25 bp, Mus musculus
ctctctctctccagataatctggag

SEQ ID NO: 270463 - DNA, 25 bp, Mus musculus
ctctctctctgtgagagccaaagac

SEQ ID NO: 270464 - DNA, 25 bp, Mus musculus
ctctctctctttgatgggggaacca

SEQ ID NO: 270465 - DNA, 25 bp, Mus musculus
ctctctctggaccctactttcaggc

SEQ ID NO: 270466 - DNA, 25 bp, Mus musculus
ctctctctggctgagtgactgggtg

SEQ ID NO: 270467 - DNA, 25 bp, Mus musculus
ctctctctgtgagagccaaagactc

SEQ ID NO: 270468 - DNA, 25 bp, Mus musculus
ctctctcttacagatcaagatctta

SEQ ID NO: 270469 - DNA, 25 bp, Mus musculus
ctctctcttacaggcactacagact

SEQ ID NO: 270470 - DNA, 25 bp, Mus musculus
ctctctcttgacccaagccacgaac

SEQ ID NO: 270471 - DNA, 25 bp, Mus musculus
ctctctctttgatgggggaaccagg

SEQ ID NO: 270472 - DNA, 25 bp, Mus musculus
ctctctgaaaccaggttccacagca

SEQ ID NO: 270473 - DNA, 25 bp, Mus musculus
ctctctgaagaagtcttagggaaag

SEQ ID NO: 270474 - DNA, 25 bp, Mus musculus
ctctctgaagagcactctggccacg

SEQ ID NO: 270475 - DNA, 25 bp, Mus musculus
ctctctgaagcaggacctggagttg

SEQ ID NO: 270476 - DNA, 25 bp, Mus musculus
ctctctgacaccagtggcagtgaac

SEQ ID NO: 270477 - DNA, 25 bp, Mus musculus
ctctctgacaggtgtccccagaact

SEQ ID NO: 270478 - DNA, 25 bp, Mus musculus
ctctctgaccgggactttgaatatg

SEQ ID NO: 270479 - DNA, 25 bp, Mus musculus
ctctctgactcagattccaccatag

SEQ ID NO: 270480 - DNA, 25 bp, Mus musculus
ctctctgagcagtggtagtgtgaag

SEQ ID NO: 270481 - DNA, 25 bp, Mus musculus
ctctctgatattagggaggtgcccc

SEQ ID NO: 270482 - DNA, 25 bp, Mus musculus
ctctctgcaagatcatgctgggaga

SEQ ID NO: 270483 - DNA, 25 bp, Mus musculus
ctctctgcaggtcaggaatctaccc

SEQ ID NO: 270484 - DNA, 25 bp, Mus musculus
ctctctgcaggttaatatccgacaa

SEQ ID NO: 270485 - DNA, 25 bp, Mus musculus
ctctctgcattctgggagcctaggg

SEQ ID NO: 270486 - DNA, 25 bp, Mus musculus
ctctctgcccactcagccagttgtc

SEQ ID NO: 270487 - DNA, 25 bp, Mus musculus
ctctctgcccatgtgatcatgattc

SEQ ID NO: 270488 - DNA, 25 bp, Mus musculus
ctctctgcctggcccgatttcccgc

SEQ ID NO: 270489 - DNA, 25 bp, Mus musculus
ctctctgcctgtcagtgaagctggc

SEQ ID NO: 270490 - DNA, 25 bp, Mus musculus
ctctctgcctgtttttgagccacgt

SEQ ID NO: 270491 - DNA, 25 bp, Mus musculus
ctctctgctacacagcctcttgcca

SEQ ID NO: 270492 - DNA, 25 bp, Mus musculus
ctctctgctcaggaagaacgttggt

SEQ ID NO: 270493 - DNA, 25 bp, Mus musculus
ctctctgctgacctatgaggagatc

SEQ ID NO: 270494 - DNA, 25 bp, Mus musculus
ctctctgctgagtctgaagatgcaa

SEQ ID NO: 270495 - DNA, 25 bp, Mus musculus
ctctctgctgcaggatgctgccaag

SEQ ID NO: 270496 - DNA, 25 bp, Mus musculus
ctctctgctgcggtcatgtaggaaa

SEQ ID NO: 270497 - DNA, 25 bp, Mus musculus
ctctctgcttgaggaagaagctcac

SEQ ID NO: 270498 - DNA, 25 bp, Mus musculus
ctctctggaaaccaggaagtgagtg

SEQ ID NO: 270499 - DNA, 25 bp, Mus musculus
ctctctggaaaccaggagaacagta

SEQ ID NO: 270500 - DNA, 25 bp, Mus musculus
ctctctggaccctactttcaggctg

SEQ ID NO: 270501 - DNA, 25 bp, Mus musculus
ctctctggcagaatccatgcgacga

SEQ ID NO: 270502 - DNA, 25 bp, Mus musculus
ctctctggcagcgaaattggaacag

SEQ ID NO: 270503 - DNA, 25 bp, Mus musculus
ctctctggcagggatggaagactgt

SEQ ID NO: 270504 - DNA, 25 bp, Mus musculus
ctctctggctgagtgactgggtgac

SEQ ID NO: 270505 - DNA, 25 bp, Mus musculus
ctctctggtggttcatccctgagtc

SEQ ID NO: 270506 - DNA, 25 bp, Mus musculus
ctctctgtctggtatctatcctgtt

SEQ ID NO: 270507 - DNA, 25 bp, Mus musculus
ctctctgtgagagccaaagactctg

SEQ ID NO: 270508 - DNA, 25 bp, Mus musculus
ctctctgtgcagcacgatggcctgg

SEQ ID NO: 270509 - DNA, 25 bp, Mus musculus
ctctctgtgcgcggcaatacagagt

SEQ ID NO: 270510 - DNA, 25 bp, Mus musculus
ctctctgtgctccaggctctcacag

SEQ ID NO: 270511 - DNA, 25 bp, Mus musculus
ctctctgtggttgagtacgtgaagg

SEQ ID NO: 270512 - DNA, 25 bp, Mus musculus
ctctctgttattcagctaccactac

SEQ ID NO: 270513 - DNA, 25 bp, Mus musculus
ctctctgttattcaggctttcacca

SEQ ID NO: 270514 - DNA, 25 bp, Mus musculus
ctctcttacagatcaagatcttaga

SEQ ID NO: 270515 - DNA, 25 bp, Mus musculus
ctctcttacaggcactacagactcg

SEQ ID NO: 270516 - DNA, 25 bp, Mus musculus
ctctcttaccagtctccactcagcc

SEQ ID NO: 270517 - DNA, 25 bp, Mus musculus
ctctcttcagctacctcagctttat

SEQ ID NO: 270518 - DNA, 25 bp, Mus musculus
ctctcttccaccgcgccctgtctca

SEQ ID NO: 270519 - DNA, 25 bp, Mus musculus
ctctcttccatgtctcccatcagca

SEQ ID NO: 270520 - DNA, 25 bp, Mus musculus
ctctcttgatcagcaagccccgccc

SEQ ID NO: 270521 - DNA, 25 bp, Mus musculus
ctctctttcaagcctggagacgtaa

SEQ ID NO: 270522 - DNA, 25 bp, Mus musculus
ctctctttcaaggctggagacgtaa

SEQ ID NO: 270523 - DNA, 25 bp, Mus musculus
ctctctttcagggagacatagcctc

SEQ ID NO: 270524 - DNA, 25 bp, Mus musculus
ctctctttcctcgttgtttttgttt

SEQ ID NO: 270525 - DNA, 25 bp, Mus musculus
ctctctttgccaaggtgaacgtgag

SEQ ID NO: 270526 - DNA, 25 bp, Mus musculus
ctctctttgtagggactacaagaaa

SEQ ID NO: 270527 - DNA, 25 bp, Mus musculus
ctctctttttagtctctggaagact

SEQ ID NO: 270528 - DNA, 25 bp, Mus musculus
ctctcttttttgagattgagctcct

SEQ ID NO: 270529 - DNA, 25 bp, Mus musculus
ctctgaaaaagtcaccttaattttc

SEQ ID NO: 270530 - DNA, 25 bp, Mus musculus
ctctgaaaaagtcctaatcaaagtc

SEQ ID NO: 270531 - DNA, 25 bp, Mus musculus
ctctgaaaaatagtcacaaagcact

SEQ ID NO: 270532 - DNA, 25 bp, Mus musculus
ctctgaaacagagatggctcccaag

SEQ ID NO: 270533 - DNA, 25 bp, Mus musculus
ctctgaaacaggtcctgcctaatca

SEQ ID NO: 270534 - DNA, 25 bp, Mus musculus
ctctgaaaccaggttccacagcact

SEQ ID NO: 270535 - DNA, 25 bp, Mus musculus
ctctgaaacccgctgtacgctggat

SEQ ID NO: 270536 - DNA, 25 bp, Mus musculus
ctctgaaacccggtagtgcaacttc

SEQ ID NO: 270537 - DNA, 25 bp, Mus musculus
ctctgaaactagactctacaggagc

SEQ ID NO: 270538 - DNA, 25 bp, Mus musculus
ctctgaaactataattttattccca

SEQ ID NO: 270539 - DNA, 25 bp, Mus musculus
ctctgaaactctgccgagtgtttca

SEQ ID NO: 270540 - DNA, 25 bp, Mus musculus
ctctgaaactgaactttctaagctg

SEQ ID NO: 270541 - DNA, 25 bp, Mus musculus
ctctgaaactgatgcagtgacctat

SEQ ID NO: 270542 - DNA, 25 bp, Mus musculus
ctctgaaactgtagcttctttgtta

SEQ ID NO: 270543 - DNA, 25 bp, Mus musculus
ctctgaaactgtgccgatccccttg

SEQ ID NO: 270544 - DNA, 25 bp, Mus musculus
ctctgaaagatattaccaggagact

SEQ ID NO: 270545 - DNA, 25 bp, Mus musculus
ctctgaacactgaggggttcctgga

SEQ ID NO: 270546 - DNA, 25 bp, Mus musculus
ctctgaaccagcctccagtccctgg

SEQ ID NO: 270547 - DNA, 25 bp, Mus musculus
ctctgaaccaggttatgaaaatgac

SEQ ID NO: 270548 - DNA, 25 bp, Mus musculus
ctctgaacctaacacagaagaatcc

SEQ ID NO: 270549 - DNA, 25 bp, Mus musculus
ctctgaacctacactttcctgagcc

SEQ ID NO: 270550 - DNA, 25 bp, Mus musculus
ctctgaacctagtgctacaataacc

SEQ ID NO: 270551 - DNA, 25 bp, Mus musculus
ctctgaacctataattttattccca

SEQ ID NO: 270552 - DNA, 25 bp, Mus musculus
ctctgaacctatactttggcaaaag

SEQ ID NO: 270553 - DNA, 25 bp, Mus musculus
ctctgaacctcatagttttgggaag

SEQ ID NO: 270554 - DNA, 25 bp, Mus musculus
ctctgaacctccaccactggtccag

SEQ ID NO: 270555 - DNA, 25 bp, Mus musculus
ctctgaacctctatgaagtcttaca

SEQ ID NO: 270556 - DNA, 25 bp, Mus musculus
ctctgaacctctccttcttctacgc

SEQ ID NO: 270557 - DNA, 25 bp, Mus musculus
ctctgaacctgacagagatttcctc

SEQ ID NO: 270558 - DNA, 25 bp, Mus musculus
ctctgaacctgacccagaagctggg

SEQ ID NO: 270559 - DNA, 25 bp, Mus musculus
ctctgaacctgccgaattcgaggac

SEQ ID NO: 270560 - DNA, 25 bp, Mus musculus
ctctgaacctgctccgcccccacgc

SEQ ID NO: 270561 - DNA, 25 bp, Mus musculus
ctctgaacctggctctggtagccga

SEQ ID NO: 270562 - DNA, 25 bp, Mus musculus
ctctgaacctgtggatattgtcctg

SEQ ID NO: 270563 - DNA, 25 bp, Mus musculus
ctctgaacctgttccagctacggtc

SEQ ID NO: 270564 - DNA, 25 bp, Mus musculus
ctctgaactcagactactcgctgct

SEQ ID NO: 270565 - DNA, 25 bp, Mus musculus
ctctgaactgtttgatcacattcca

SEQ ID NO: 270566 - DNA, 25 bp, Mus musculus
ctctgaacttaacatctctgaaagt

SEQ ID NO: 270567 - DNA, 25 bp, Mus musculus
ctctgaacttgtggcagggctgaga

SEQ ID NO: 270568 - DNA, 25 bp, Mus musculus
ctctgaagaaggatgtggactgtgc

SEQ ID NO: 270569 - DNA, 25 bp, Mus musculus
ctctgaagaaggctccttcccctga

SEQ ID NO: 270570 - DNA, 25 bp, Mus musculus
ctctgaagaagtcttagggaaagtt

SEQ ID NO: 270571 - DNA, 25 bp, Mus musculus
ctctgaagaatgcaccaccaaaaaa

SEQ ID NO: 270572 - DNA, 25 bp, Mus musculus
ctctgaagcagattcgctgcctgat

SEQ ID NO: 270573 - DNA, 25 bp, Mus musculus
ctctgaagcaggacctggagttgct

SEQ ID NO: 270574 - DNA, 25 bp, Mus musculus
ctctgaagccagaggtacttgatgt

SEQ ID NO: 270575 - DNA, 25 bp, Mus musculus
ctctgaagcgagaccaccgtgggaa

SEQ ID NO: 270576 - DNA, 25 bp, Mus musculus
ctctgaagggtataggcatcgcctc

SEQ ID NO: 270577 - DNA, 25 bp, Mus musculus
ctctgaagtcaccctgccagcaaga

SEQ ID NO: 270578 - DNA, 25 bp, Mus musculus
ctctgaatcactaagagggaccagt

SEQ ID NO: 270579 - DNA, 25 bp, Mus musculus
ctctgaatgtcaagccccgcccaac

SEQ ID NO: 270580 - DNA, 25 bp, Mus musculus
ctctgacaacctgcttggaaagttc

SEQ ID NO: 270581 - DNA, 25 bp, Mus musculus
ctctgacaagaaggaaatgttgtcc

SEQ ID NO: 270582 - DNA, 25 bp, Mus musculus
ctctgacacacagggagaaaatccc

SEQ ID NO: 270583 - DNA, 25 bp, Mus musculus
ctctgacaccagtggcagtgaacct

SEQ ID NO: 270584 - DNA, 25 bp, Mus musculus
ctctgacagtgaagaaaatgctgag

SEQ ID NO: 270585 - DNA, 25 bp, Mus musculus
ctctgacagtggtgggtgtgtgcac

SEQ ID NO: 270586 - DNA, 25 bp, Mus musculus
ctctgacatagcctaggaagtagag

SEQ ID NO: 270587 - DNA, 25 bp, Mus musculus
ctctgacatatggggcatcatggag

SEQ ID NO: 270588 - DNA, 25 bp, Mus musculus
ctctgacatggaggatatgctgtca

SEQ ID NO: 270589 - DNA, 25 bp, Mus musculus
ctctgaccacagttttcctgacttc

SEQ ID NO: 270590 - DNA, 25 bp, Mus musculus
ctctgacccactcttggaactgaag

SEQ ID NO: 270591 - DNA, 25 bp, Mus musculus
ctctgaccctgaatcgtccttggaa

SEQ ID NO: 270592 - DNA, 25 bp, Mus musculus
ctctgacctaccagggtacgagccg

SEQ ID NO: 270593 - DNA, 25 bp, Mus musculus
ctctgacctccagaaaggtgctgga

SEQ ID NO: 270594 - DNA, 25 bp, Mus musculus
ctctgacctgggacccctcatggtg

SEQ ID NO: 270595 - DNA, 25 bp, Mus musculus
ctctgacgctggcagacaccactaa

SEQ ID NO: 270596 - DNA, 25 bp, Mus musculus
ctctgacggggcatatctgctgttc

SEQ ID NO: 270597 - DNA, 25 bp, Mus musculus
ctctgacgtccattacagaagactg

SEQ ID NO: 270598 - DNA, 25 bp, Mus musculus
ctctgactacccgtgatacttaaat

SEQ ID NO: 270599 - DNA, 25 bp, Mus musculus
ctctgactatgcatcatctatactc

SEQ ID NO: 270600 - DNA, 25 bp, Mus musculus
ctctgactcagattccaccatagac

SEQ ID NO: 270601 - DNA, 25 bp, Mus musculus
ctctgactgaaccttatcaagcact

SEQ ID NO: 270602 - DNA, 25 bp, Mus musculus
ctctgactgtccctggccacatcta

SEQ ID NO: 270603 - DNA, 25 bp, Mus musculus
ctctgacttaccagctgggaagggc

SEQ ID NO: 270604 - DNA, 25 bp, Mus musculus
ctctgacttagagaagagtgggaat

SEQ ID NO: 270605 - DNA, 25 bp, Mus musculus
ctctgacttagaggaaatgctgtca

SEQ ID NO: 270606 - DNA, 25 bp, Mus musculus
ctctgacttctgtttctcttcagca

SEQ ID NO: 270607 - DNA, 25 bp, Mus musculus
ctctgacttggggaagaaagtgaat

SEQ ID NO: 270608 - DNA, 25 bp, Mus musculus
ctctgagaaactgatctctcaccta

SEQ ID NO: 270609 - DNA, 25 bp, Mus musculus
ctctgagaacaggaagcccagccct

SEQ ID NO: 270610 - DNA, 25 bp, Mus musculus
ctctgagaagagatggcgtcagaca

SEQ ID NO: 270611 - DNA, 25 bp, Mus musculus
ctctgagaaggagcgcagaccctga

SEQ ID NO: 270612 - DNA, 25 bp, Mus musculus
ctctgagaaggtctattacaatggc

SEQ ID NO: 270613 - DNA, 25 bp, Mus musculus
ctctgagaaggtctgcgaatggaag

SEQ ID NO: 270614 - DNA, 25 bp, Mus musculus
ctctgagacagactgcatgtatggg

SEQ ID NO: 270615 - DNA, 25 bp, Mus musculus
ctctgagaccagacgtctccaccag

SEQ ID NO: 270616 - DNA, 25 bp, Mus musculus
ctctgagagaagacccatgcttgta

SEQ ID NO: 270617 - DNA, 25 bp, Mus musculus
ctctgagagaaggtggagcagccct

SEQ ID NO: 270618 - DNA, 25 bp, Mus musculus
ctctgagaggacagccctgactccc

SEQ ID NO: 270619 - DNA, 25 bp, Mus musculus
ctctgagaggacaggcattgttatc

SEQ ID NO: 270620 - DNA, 25 bp, Mus musculus
ctctgagaggcccctgcccggatgg

SEQ ID NO: 270621 - DNA, 25 bp, Mus musculus
ctctgagataggtgtcttccacctg

SEQ ID NO: 270622 - DNA, 25 bp, Mus musculus
ctctgagatcacaggggacctcagc

SEQ ID NO: 270623 - DNA, 25 bp, Mus musculus
ctctgagatctcagtccaagaaagc

SEQ ID NO: 270624 - DNA, 25 bp, Mus musculus
ctctgagatctcagtgctgatctgg

SEQ ID NO: 270625 - DNA, 25 bp, Mus musculus
ctctgagcaactagggttacaggga

SEQ ID NO: 270626 - DNA, 25 bp, Mus musculus
ctctgagcaactagtctaaatgttc

SEQ ID NO: 270627 - DNA, 25 bp, Mus musculus
ctctgagcaggaggatgagtctgag

SEQ ID NO: 270628 - DNA, 25 bp, Mus musculus
ctctgagcagggcgaaggagcaggg

SEQ ID NO: 270629 - DNA, 25 bp, Mus musculus
ctctgagcagtggtagtgtgaagcc

SEQ ID NO: 270630 - DNA, 25 bp, Mus musculus
ctctgagcccctccccccgccatga

SEQ ID NO: 270631 - DNA, 25 bp, Mus musculus
ctctgagcgtgccttcatcaagtag

SEQ ID NO: 270632 - DNA, 25 bp, Mus musculus
ctctgagctgcaagataagcagaca

SEQ ID NO: 270633 - DNA, 25 bp, Mus musculus
ctctgagctgcaaggaactcattat

SEQ ID NO: 270634 - DNA, 25 bp, Mus musculus
ctctgaggaagagacactccagcaa

SEQ ID NO: 270635 - DNA, 25 bp, Mus musculus
ctctgaggaagaggacttttgggga

SEQ ID NO: 270636 - DNA, 25 bp, Mus musculus
ctctgaggacagaacttatttgtcc

SEQ ID NO: 270637 - DNA, 25 bp, Mus musculus
ctctgaggaggcccactgagtgttt

SEQ ID NO: 270638 - DNA, 25 bp, Mus musculus
ctctgaggcaggtacccacccggaa

SEQ ID NO: 270639 - DNA, 25 bp, Mus musculus
ctctgaggctgcaggtgccctacgt

SEQ ID NO: 270640 - DNA, 25 bp, Mus musculus
ctctgaggggagcttttcccagtca

SEQ ID NO: 270641 - DNA, 25 bp, Mus musculus
ctctgaggggcaccatgtactggtc

SEQ ID NO: 270642 - DNA, 25 bp, Mus musculus
ctctgagggttccaattggttccaa

SEQ ID NO: 270643 - DNA, 25 bp, Mus musculus
ctctgaggtgcacggctgtgtttgg

SEQ ID NO: 270644 - DNA, 25 bp, Mus musculus
ctctgaggtgcacgggtgacccaga

SEQ ID NO: 270645 - DNA, 25 bp, Mus musculus
ctctgagtacaaagtgaaggaggag

SEQ ID NO: 270646 - DNA, 25 bp, Mus musculus
ctctgagtaccaaggcaaagaccca

SEQ ID NO: 270647 - DNA, 25 bp, Mus musculus
ctctgagtccaaccaagtttattgt

SEQ ID NO: 270648 - DNA, 25 bp, Mus musculus
ctctgagttccactgggctcccatc

SEQ ID NO: 270649 - DNA, 25 bp, Mus musculus
ctctgagttttatgagaggaacctg

SEQ ID NO: 270650 - DNA, 25 bp, Mus musculus
ctctgataaaaccaggtttgcttat

SEQ ID NO: 270651 - DNA, 25 bp, Mus musculus
ctctgataaaggcaactgttggatt

SEQ ID NO: 270652 - DNA, 25 bp, Mus musculus
ctctgataagtatggaacaactcct

SEQ ID NO: 270653 - DNA, 25 bp, Mus musculus
ctctgatagcatcaggcgcgagctt

SEQ ID NO: 270654 - DNA, 25 bp, Mus musculus
ctctgatattagggaggtgcccctg

SEQ ID NO: 270655 - DNA, 25 bp, Mus musculus
ctctgatcagagtgccagaaggctc

SEQ ID NO: 270656 - DNA, 25 bp, Mus musculus
ctctgatccttcatggcagtgaaga

SEQ ID NO: 270657 - DNA, 25 bp, Mus musculus
ctctgatcttggggagtgggaggtg

SEQ ID NO: 270658 - DNA, 25 bp, Mus musculus
ctctgatgaactgaatccaaatcca

SEQ ID NO: 270659 - DNA, 25 bp, Mus musculus
ctctgatgaccacggctccttcacc

SEQ ID NO: 270660 - DNA, 25 bp, Mus musculus
ctctgatgctggctggggacatctt

SEQ ID NO: 270661 - DNA, 25 bp, Mus musculus
ctctgatgggagagcaagccctcat

SEQ ID NO: 270662 - DNA, 25 bp, Mus musculus
ctctgatgggagaggctttgaagac

SEQ ID NO: 270663 - DNA, 25 bp, Mus musculus
ctctgatgtatggatcggaacgtca

SEQ ID NO: 270664 - DNA, 25 bp, Mus musculus
ctctgatgtgtaagcttatcacagt

SEQ ID NO: 270665 - DNA, 25 bp, Mus musculus
ctctgattaaaggtggagcagccct

SEQ ID NO: 270666 - DNA, 25 bp, Mus musculus
ctctgattaaagtaacgacattctg

SEQ ID NO: 270667 - DNA, 25 bp, Mus musculus
ctctgattcatcagacacctgctgt

SEQ ID NO: 270668 - DNA, 25 bp, Mus musculus
ctctgattcatgagccatcaaagag

SEQ ID NO: 270669 - DNA, 25 bp, Mus musculus
ctctgattccaagcctggaagggcg

SEQ ID NO: 270670 - DNA, 25 bp, Mus musculus
ctctgattgcagttccaactacctc

SEQ ID NO: 270671 - DNA, 25 bp, Mus musculus
ctctgattgctgtggacagacgcct

SEQ ID NO: 270672 - DNA, 25 bp, Mus musculus
ctctgattggaggtcggtgagctgg

SEQ ID NO: 270673 - DNA, 25 bp, Mus musculus
ctctgatttagatcttgaaccagat

SEQ ID NO: 270674 - DNA, 25 bp, Mus musculus
ctctgatttcttggaatagaaaccc

SEQ ID NO: 270675 - DNA, 25 bp, Mus musculus
ctctgatttcttgggtgaagaaaat

SEQ ID NO: 270676 - DNA, 25 bp, Mus musculus
ctctgattttgagaattcagagcca

SEQ ID NO: 270677 - DNA, 25 bp, Mus musculus
ctctgattttgagtttgaaaatgaa

SEQ ID NO: 270678 - DNA, 25 bp, Mus musculus
ctctgcaaaagattcacagtctccg

SEQ ID NO: 270679 - DNA, 25 bp, Mus musculus
ctctgcaaaagcaatgtcttcaatg

SEQ ID NO: 270680 - DNA, 25 bp, Mus musculus
ctctgcaaacagtgccaccaaaagc

SEQ ID NO: 270681 - DNA, 25 bp, Mus musculus
ctctgcaaagcgccatcaaaggatt

SEQ ID NO: 270682 - DNA, 25 bp, Mus musculus
ctctgcaaagcgctactgttgaggc

SEQ ID NO: 270683 - DNA, 25 bp, Mus musculus
ctctgcaaagtgacccagactacag

SEQ ID NO: 270684 - DNA, 25 bp, Mus musculus
ctctgcaaagtggcctatgaggagc

SEQ ID NO: 270685 - DNA, 25 bp, Mus musculus
ctctgcaaatggcgaaagtcctagg

SEQ ID NO: 270686 - DNA, 25 bp, Mus musculus
ctctgcaaattagatgttctttgtt

SEQ ID NO: 270687 - DNA, 25 bp, Mus musculus
ctctgcaacaaaggcttcaccacag

SEQ ID NO: 270688 - DNA, 25 bp, Mus musculus
ctctgcaacaaaggtactggtgagg

SEQ ID NO: 270689 - DNA, 25 bp, Mus musculus
ctctgcaaccaaggcctttgtagat

SEQ ID NO: 270690 - DNA, 25 bp, Mus musculus
ctctgcaagaaaaggcaagagctgg

SEQ ID NO: 270691 - DNA, 25 bp, Mus musculus
ctctgcaagaacacatacagtgtct

SEQ ID NO: 270692 - DNA, 25 bp, Mus musculus
ctctgcaagaacactgtcttcaaga

SEQ ID NO: 270693 - DNA, 25 bp, Mus musculus
ctctgcaagaggtgttgtcggaatt

SEQ ID NO: 270694 - DNA, 25 bp, Mus musculus
ctctgcaagatcaagacagctgcat

SEQ ID NO: 270695 - DNA, 25 bp, Mus musculus
ctctgcaaggctgtgtatacagttt

SEQ ID NO: 270696 - DNA, 25 bp, Mus musculus
ctctgcaatacctggcgccagagct

SEQ ID NO: 270697 - DNA, 25 bp, Mus musculus
ctctgcaatataaggcacaatggaa

SEQ ID NO: 270698 - DNA, 25 bp, Mus musculus
ctctgcaatcgaggtcatgcttctg

SEQ ID NO: 270699 - DNA, 25 bp, Mus musculus
ctctgcaatggcaggcctagccagc

SEQ ID NO: 270700 - DNA, 25 bp, Mus musculus
ctctgcaatggcagtctgttccggt

SEQ ID NO: 270701 - DNA, 25 bp, Mus musculus
ctctgcacagacaggagcatgcaaa

SEQ ID NO: 270702 - DNA, 25 bp, Mus musculus
ctctgcacagacaggagcatgcatt

SEQ ID NO: 270703 - DNA, 25 bp, Mus musculus
ctctgcacagatatctttccatctg

SEQ ID NO: 270704 - DNA, 25 bp, Mus musculus
ctctgcaccagagattgtgcacgag

SEQ ID NO: 270705 - DNA, 25 bp, Mus musculus
ctctgcaccaggtctacctgggttt

SEQ ID NO: 270706 - DNA, 25 bp, Mus musculus
ctctgcacccagccaaggtagccac

SEQ ID NO: 270707 - DNA, 25 bp, Mus musculus
ctctgcacgaagatctgttagcaag

SEQ ID NO: 270708 - DNA, 25 bp, Mus musculus
ctctgcactgctctcaggagaagta

SEQ ID NO: 270709 - DNA, 25 bp, Mus musculus
ctctgcagaagtttgatggtgacag

SEQ ID NO: 270710 - DNA, 25 bp, Mus musculus
ctctgcagacacagggctctgctct

SEQ ID NO: 270711 - DNA, 25 bp, Mus musculus
ctctgcagagacaggagctgctgct

SEQ ID NO: 270712 - DNA, 25 bp, Mus musculus
ctctgcagagacaggtactgagttc

SEQ ID NO: 270713 - DNA, 25 bp, Mus musculus
ctctgcagcctcagcaaagaagagt

SEQ ID NO: 270714 - DNA, 25 bp, Mus musculus
ctctgcagctggtcacagctctgga

SEQ ID NO: 270715 - DNA, 25 bp, Mus musculus
ctctgcagctgtatgttgtatgggc

SEQ ID NO: 270716 - DNA, 25 bp, Mus musculus
ctctgcagcttgcactgaggccaaa

SEQ ID NO: 270717 - DNA, 25 bp, Mus musculus
ctctgcaggacatgaagctacagtc

SEQ ID NO: 270718 - DNA, 25 bp, Mus musculus
ctctgcaggagaaaagaataaatga

SEQ ID NO: 270719 - DNA, 25 bp, Mus musculus
ctctgcaggggaggacatagtcgac

SEQ ID NO: 270720 - DNA, 25 bp, Mus musculus
ctctgcaggggaggctttgctacag

SEQ ID NO: 270721 - DNA, 25 bp, Mus musculus
ctctgcagtggaaggcaaagagaaa

SEQ ID NO: 270722 - DNA, 25 bp, Mus musculus
ctctgcatacggtagtcttttacag

SEQ ID NO: 270723 - DNA, 25 bp, Mus musculus
ctctgcatagcagagctacccagct

SEQ ID NO: 270724 - DNA, 25 bp, Mus musculus
ctctgcatccggggacagagtcctt

SEQ ID NO: 270725 - DNA, 25 bp, Mus musculus
ctctgcatcgcggggtggcgggacg

SEQ ID NO: 270726 - DNA, 25 bp, Mus musculus
ctctgcatgccgcagagtggccatg

SEQ ID NO: 270727 - DNA, 25 bp, Mus musculus
ctctgcatgccggagagtggccatg

SEQ ID NO: 270728 - DNA, 25 bp, Mus musculus
ctctgcattctgggagcctagggct

SEQ ID NO: 270729 - DNA, 25 bp, Mus musculus
ctctgccaaggagttaatcagtcaa

SEQ ID NO: 270730 - DNA, 25 bp, Mus musculus
ctctgccacacttaggcatcctaca

SEQ ID NO: 270731 - DNA, 25 bp, Mus musculus
ctctgccactgcgcgccggagcctg

SEQ ID NO: 270732 - DNA, 25 bp, Mus musculus
ctctgccactgcgcgcgcccggcat

SEQ ID NO: 270733 - DNA, 25 bp, Mus musculus
ctctgccagatgaagatgactgtca

SEQ ID NO: 270734 - DNA, 25 bp, Mus musculus
ctctgccagcaaggtgtagctactt

SEQ ID NO: 270735 - DNA, 25 bp, Mus musculus
ctctgccagtgcaagaatggccatt

SEQ ID NO: 270736 - DNA, 25 bp, Mus musculus
ctctgccagtgcaagatgaagcact

SEQ ID NO: 270737 - DNA, 25 bp, Mus musculus
ctctgccagtggaccctcatgacct

SEQ ID NO: 270738 - DNA, 25 bp, Mus musculus
ctctgccagtggacgactctcaggc

SEQ ID NO: 270739 - DNA, 25 bp, Mus musculus
ctctgcccaacaaggcacctcccac

SEQ ID NO: 270740 - DNA, 25 bp, Mus musculus
ctctgcccaataaggcacctcccac

SEQ ID NO: 270741 - DNA, 25 bp, Mus musculus
ctctgcccacacagggtgtgtcccc

SEQ ID NO: 270742 - DNA, 25 bp, Mus musculus
ctctgcccacacaggttctgcagta

SEQ ID NO: 270743 - DNA, 25 bp, Mus musculus
ctctgcccacagagagcccagacgc

SEQ ID NO: 270744 - DNA, 25 bp, Mus musculus
ctctgcccaccaggcttggaaggga

SEQ ID NO: 270745 - DNA, 25 bp, Mus musculus
ctctgcccatgtgatcatgattctg

SEQ ID NO: 270746 - DNA, 25 bp, Mus musculus
ctctgccccaaaggcattcgatggg

SEQ ID NO: 270747 - DNA, 25 bp, Mus musculus
ctctgccccaaagttccccagctcg

SEQ ID NO: 270748 - DNA, 25 bp, Mus musculus
ctctgccccccaattattaagaaat

SEQ ID NO: 270749 - DNA, 25 bp, Mus musculus
ctctgccctgaaggctggataatca

SEQ ID NO: 270750 - DNA, 25 bp, Mus musculus
ctctgccctgattccttctggaacc

SEQ ID NO: 270751 - DNA, 25 bp, Mus musculus
ctctgccctgctataacggaggcat

SEQ ID NO: 270752 - DNA, 25 bp, Mus musculus
ctctgccctggattggtagcttatg

SEQ ID NO: 270753 - DNA, 25 bp, Mus musculus
ctctgccctgtgagtttcaggtgcc

SEQ ID NO: 270754 - DNA, 25 bp, Mus musculus
ctctgccctttttggctgcagagat

SEQ ID NO: 270755 - DNA, 25 bp, Mus musculus
ctctgccctttttgtgccgtggtga

SEQ ID NO: 270756 - DNA, 25 bp, Mus musculus
ctctgccgaagcaaggtgagatctc

SEQ ID NO: 270757 - DNA, 25 bp, Mus musculus
ctctgccgcccgagcagttgcccca

SEQ ID NO: 270758 - DNA, 25 bp, Mus musculus
ctctgcctcagcagccaatggaaac

SEQ ID NO: 270759 - DNA, 25 bp, Mus musculus
ctctgcctcagcagggctgcccttt

SEQ ID NO: 270760 - DNA, 25 bp, Mus musculus
ctctgcctgaaggtttgacttcatg

SEQ ID NO: 270761 - DNA, 25 bp, Mus musculus
ctctgcctgctccggctcctgctcc

SEQ ID NO: 270762 - DNA, 25 bp, Mus musculus
ctctgcctgtaacggagactctggt

SEQ ID NO: 270763 - DNA, 25 bp, Mus musculus
ctctgcctgtcaggaccgaataaac

SEQ ID NO: 270764 - DNA, 25 bp, Mus musculus
ctctgcctgtcagtgaagctggcta

SEQ ID NO: 270765 - DNA, 25 bp, Mus musculus
ctctgcctgtttttgagccacgtgg

SEQ ID NO: 270766 - DNA, 25 bp, Mus musculus
ctctgccttcctggattcaccggcg

SEQ ID NO: 270767 - DNA, 25 bp, Mus musculus
ctctgccttctctgggttccctgga

SEQ ID NO: 270768 - DNA, 25 bp, Mus musculus
ctctgcctttggggatgtcgtcacc

SEQ ID NO: 270769 - DNA, 25 bp, Mus musculus
ctctgccttttacaatgctcatgac

SEQ ID NO: 270770 - DNA, 25 bp, Mus musculus
ctctgcgaaaaagggatgactgagt

SEQ ID NO: 270771 - DNA, 25 bp, Mus musculus
ctctgcgaaccaaacacactgggtt

SEQ ID NO: 270772 - DNA, 25 bp, Mus musculus
ctctgcgaaccaactgccaggggac

SEQ ID NO: 270773 - DNA, 25 bp, Mus musculus
ctctgcgaagatggaatgaaacctt

SEQ ID NO: 270774 - DNA, 25 bp, Mus musculus
ctctgcgaagggaaatgctcataaa

SEQ ID NO: 270775 - DNA, 25 bp, Mus musculus
ctctgcgagcagccaccactggtcc

SEQ ID NO: 270776 - DNA, 25 bp, Mus musculus
ctctgcgagccgcagtggttttatg

SEQ ID NO: 270777 - DNA, 25 bp, Mus musculus
ctctgcgcagacaggtgtcagctga

SEQ ID NO: 270778 - DNA, 25 bp, Mus musculus
ctctgcgcagatgttgatgagtgtc

SEQ ID NO: 270779 - DNA, 25 bp, Mus musculus
ctctgcgcagtgctagctcttctgt

SEQ ID NO: 270780 - DNA, 25 bp, Mus musculus
ctctgcgccacgtatcagagcatcg

SEQ ID NO: 270781 - DNA, 25 bp, Mus musculus
ctctgcgccaggtatcagagcatcg

SEQ ID NO: 270782 - DNA, 25 bp, Mus musculus
ctctgcgcccccagccactggcccc

SEQ ID NO: 270783 - DNA, 25 bp, Mus musculus
ctctgcgcgtccagggtttcctctc

SEQ ID NO: 270784 - DNA, 25 bp, Mus musculus
ctctgcgcgtccaggttaaatgaat

SEQ ID NO: 270785 - DNA, 25 bp, Mus musculus
ctctgcggaggtgctgctggggaaa

SEQ ID NO: 270786 - DNA, 25 bp, Mus musculus
ctctgcggcccggctagttcattga

SEQ ID NO: 270787 - DNA, 25 bp, Mus musculus
ctctgcgggccagaatcaccgccgc

SEQ ID NO: 270788 - DNA, 25 bp, Mus musculus
ctctgcggtttccagatgaagctct

SEQ ID NO: 270789 - DNA, 25 bp, Mus musculus
ctctgcgtacagatgtggagattgg

SEQ ID NO: 270790 - DNA, 25 bp, Mus musculus
ctctgcgtgcccagggtcctgtggg

SEQ ID NO: 270791 - DNA, 25 bp, Mus musculus
ctctgctaaaggactggaaaggaga

SEQ ID NO: 270792 - DNA, 25 bp, Mus musculus
ctctgctaatagttcctgcacgacc

SEQ ID NO: 270793 - DNA, 25 bp, Mus musculus
ctctgctaatatggatgcaaagacc

SEQ ID NO: 270794 - DNA, 25 bp, Mus musculus
ctctgctacaaggaggatctcagta

SEQ ID NO: 270795 - DNA, 25 bp, Mus musculus
ctctgctacaaggctttcttctgtg

SEQ ID NO: 270796 - DNA, 25 bp, Mus musculus
ctctgctacaagtgactacttccgg

SEQ ID NO: 270797 - DNA, 25 bp, Mus musculus
ctctgctacacagcctcttgccagc

SEQ ID NO: 270798 - DNA, 25 bp, Mus musculus
ctctgctacctgaattttgtgccat

SEQ ID NO: 270799 - DNA, 25 bp, Mus musculus
ctctgctaccttcaagatgctgtcc

SEQ ID NO: 270800 - DNA, 25 bp, Mus musculus
ctctgctagccaagatatcaacctg

SEQ ID NO: 270801 - DNA, 25 bp, Mus musculus
ctctgctagccaaggtgctggatta

SEQ ID NO: 270802 - DNA, 25 bp, Mus musculus
ctctgctatcaaggtgcagagcccc

SEQ ID NO: 270803 - DNA, 25 bp, Mus musculus
ctctgctattgcagaggtggctttt

SEQ ID NO: 270804 - DNA, 25 bp, Mus musculus
ctctgctattgcaggtttcctggca

SEQ ID NO: 270805 - DNA, 25 bp, Mus musculus
ctctgctcagcagccactctctaca

SEQ ID NO: 270806 - DNA, 25 bp, Mus musculus
ctctgctcagcagggataactctct

SEQ ID NO: 270807 - DNA, 25 bp, Mus musculus
ctctgctcagcctgaaggacttcta

SEQ ID NO: 270808 - DNA, 25 bp, Mus musculus
ctctgctcaggaagaacgttggtga

SEQ ID NO: 270809 - DNA, 25 bp, Mus musculus
ctctgctcaggatcccagccagccc

SEQ ID NO: 270810 - DNA, 25 bp, Mus musculus
ctctgctcccccaggccggtagtgg

SEQ ID NO: 270811 - DNA, 25 bp, Mus musculus
ctctgctccgaggtctccaaaaatg

SEQ ID NO: 270812 - DNA, 25 bp, Mus musculus
ctctgctcctgccaatgggaagctc

SEQ ID NO: 270813 - DNA, 25 bp, Mus musculus
ctctgctcggctcacggatgatgac

SEQ ID NO: 270814 - DNA, 25 bp, Mus musculus
ctctgctcggtctggtttatctccg

SEQ ID NO: 270815 - DNA, 25 bp, Mus musculus
ctctgctctgcagtgcctgagcaac

SEQ ID NO: 270816 - DNA, 25 bp, Mus musculus
ctctgctctgggatgctgcaggacc

SEQ ID NO: 270817 - DNA, 25 bp, Mus musculus
ctctgctcttccaggtgacagtcac

SEQ ID NO: 270818 - DNA, 25 bp, Mus musculus
ctctgctcttccagtgggaaacatt

SEQ ID NO: 270819 - DNA, 25 bp, Mus musculus
ctctgctgaaggtgtccatcatacc

SEQ ID NO: 270820 - DNA, 25 bp, Mus musculus
ctctgctgacagacactgtcctgtt

SEQ ID NO: 270821 - DNA, 25 bp, Mus musculus
ctctgctgaccaagcccactcccca

SEQ ID NO: 270822 - DNA, 25 bp, Mus musculus
ctctgctgacctgggcacacatgag

SEQ ID NO: 270823 - DNA, 25 bp, Mus musculus
ctctgctgcacagtgatcatcaagg

SEQ ID NO: 270824 - DNA, 25 bp, Mus musculus
ctctgctgcaggatgctgccaaggt

SEQ ID NO: 270825 - DNA, 25 bp, Mus musculus
ctctgctgcatcagaacctcttaca

SEQ ID NO: 270826 - DNA, 25 bp, Mus musculus
ctctgctgcatcagcccagcactat

SEQ ID NO: 270827 - DNA, 25 bp, Mus musculus
ctctgctgcatcaggtaccaccagc

SEQ ID NO: 270828 - DNA, 25 bp, Mus musculus
ctctgctgccggcttttctcctgaa

SEQ ID NO: 270829 - DNA, 25 bp, Mus musculus
ctctgctgccgggtcagcacctcgg

SEQ ID NO: 270830 - DNA, 25 bp, Mus musculus
ctctgctgcggtcatgtaggaaatt

SEQ ID NO: 270831 - DNA, 25 bp, Mus musculus
ctctgctgctgctggaacgggttcc

SEQ ID NO: 270832 - DNA, 25 bp, Mus musculus
ctctgctggagaaagagtacttctt

SEQ ID NO: 270833 - DNA, 25 bp, Mus musculus
ctctgctggatggctctgccttatt

SEQ ID NO: 270834 - DNA, 25 bp, Mus musculus
ctctgctggcaagaacttgacctca

SEQ ID NO: 270835 - DNA, 25 bp, Mus musculus
ctctgctgtcaggtacaggtcaagt

SEQ ID NO: 270836 - DNA, 25 bp, Mus musculus
ctctgctgtctgtgaacaaatctac

SEQ ID NO: 270837 - DNA, 25 bp, Mus musculus
ctctgctgtctgtgcagtactccag

SEQ ID NO: 270838 - DNA, 25 bp, Mus musculus
ctctgctgtgctgaaatggaggcgt

SEQ ID NO: 270839 - DNA, 25 bp, Mus musculus
ctctgctgtgggaacttatttagaa

SEQ ID NO: 270840 - DNA, 25 bp, Mus musculus
ctctgctgttcagccagggacagtg

SEQ ID NO: 270841 - DNA, 25 bp, Mus musculus
ctctgcttctatgaggttgactgtg

SEQ ID NO: 270842 - DNA, 25 bp, Mus musculus
ctctgcttgaggaagaagctcacta

SEQ ID NO: 270843 - DNA, 25 bp, Mus musculus
ctctgcttggataagattaatgtcc

SEQ ID NO: 270844 - DNA, 25 bp, Mus musculus
ctctgcttgtaaggcatctcagaag

SEQ ID NO: 270845 - DNA, 25 bp, Mus musculus
ctctgcttgtgggccaccccttcca

SEQ ID NO: 270846 - DNA, 25 bp, Mus musculus
ctctgctttccagcaagccccgccc

SEQ ID NO: 270847 - DNA, 25 bp, Mus musculus
ctctgctttcctgggaaggtgtgaa

SEQ ID NO: 270848 - DNA, 25 bp, Mus musculus
ctctgcttttggcaactcgttggta

SEQ ID NO: 270849 - DNA, 25 bp, Mus musculus
ctctggaaacagaaaggacttcatc

SEQ ID NO: 270850 - DNA, 25 bp, Mus musculus
ctctggaaaccaggaagtgagtgcc

SEQ ID NO: 270851 - DNA, 25 bp, Mus musculus
ctctggaaaccaggagaacagtacg

SEQ ID NO: 270852 - DNA, 25 bp, Mus musculus
ctctggaaagccccggcagcccaac

SEQ ID NO: 270853 - DNA, 25 bp, Mus musculus
ctctggaaataaggccgttgactac

SEQ ID NO: 270854 - DNA, 25 bp, Mus musculus
ctctggaagagaacctgtggacaaa

SEQ ID NO: 270855 - DNA, 25 bp, Mus musculus
ctctggaagcagcagccgcagccta

SEQ ID NO: 270856 - DNA, 25 bp, Mus musculus
ctctggaaggggcgtatgatcctgc

SEQ ID NO: 270857 - DNA, 25 bp, Mus musculus
ctctggaagtgccgaattcgaggac

SEQ ID NO: 270858 - DNA, 25 bp, Mus musculus
ctctggacaaactgtcctgtgtgga

SEQ ID NO: 270859 - DNA, 25 bp, Mus musculus
ctctggacaatgccaacagtataca

SEQ ID NO: 270860 - DNA, 25 bp, Mus musculus
ctctggacaccgatgactttgtgaa

SEQ ID NO: 270861 - DNA, 25 bp, Mus musculus
ctctggacaccgccacagtacatgt

SEQ ID NO: 270862 - DNA, 25 bp, Mus musculus
ctctggacagcggaggctgctgaac

SEQ ID NO: 270863 - DNA, 25 bp, Mus musculus
ctctggacccaaatcaatactacaa

SEQ ID NO: 270864 - DNA, 25 bp, Mus musculus
ctctggaccgggtagcaaatgccac

SEQ ID NO: 270865 - DNA, 25 bp, Mus musculus
ctctggacctgcagacccaagaatc

SEQ ID NO: 270866 - DNA, 25 bp, Mus musculus
ctctggacctgcagcacgtgggata

SEQ ID NO: 270867 - DNA, 25 bp, Mus musculus
ctctggactatggctggcagaggga

SEQ ID NO: 270868 - DNA, 25 bp, Mus musculus
ctctggagaaagagtttgagaggac

SEQ ID NO: 270869 - DNA, 25 bp, Mus musculus
ctctggagaaggccaacagcaggct

SEQ ID NO: 270870 - DNA, 25 bp, Mus musculus
ctctggagaccggtggaggatctgg

SEQ ID NO: 270871 - DNA, 25 bp, Mus musculus
ctctggagatccaggcttccgtggg

SEQ ID NO: 270872 - DNA, 25 bp, Mus musculus
ctctggagattaaagtaattggcaa

SEQ ID NO: 270873 - DNA, 25 bp, Mus musculus
ctctggagattgtcctgctttaagg

SEQ ID NO: 270874 - DNA, 25 bp, Mus musculus
ctctggagcagaagacaaaagaaat

SEQ ID NO: 270875 - DNA, 25 bp, Mus musculus
ctctggagcagaaggttatgttctt

SEQ ID NO: 270876 - DNA, 25 bp, Mus musculus
ctctggagccgattcaaaaggtgat

SEQ ID NO: 270877 - DNA, 25 bp, Mus musculus
ctctggagctgccatcaacaccccc

SEQ ID NO: 270878 - DNA, 25 bp, Mus musculus
ctctggaggcgagaaccatgtgtgc

SEQ ID NO: 270879 - DNA, 25 bp, Mus musculus
ctctggaggcgagtatttcctaaat

SEQ ID NO: 270880 - DNA, 25 bp, Mus musculus
ctctggagggagagacgtgaaaaat

SEQ ID NO: 270881 - DNA, 25 bp, Mus musculus
ctctggagtcgagctcctggggccc

SEQ ID NO: 270882 - DNA, 25 bp, Mus musculus
ctctggagtcgatgaggatccagac

SEQ ID NO: 270883 - DNA, 25 bp, Mus musculus
ctctggagttgctttttgcaatgtt

SEQ ID NO: 270884 - DNA, 25 bp, Mus musculus
ctctggagttggctgcaacaggtga

SEQ ID NO: 270885 - DNA, 25 bp, Mus musculus
ctctggatcagaattaaaatgctct

SEQ ID NO: 270886 - DNA, 25 bp, Mus musculus
ctctggatcagatctccatgatcag

SEQ ID NO: 270887 - DNA, 25 bp, Mus musculus
ctctggatcagattgattatgtgta

SEQ ID NO: 270888 - DNA, 25 bp, Mus musculus
ctctggatcaggctgctccactact

SEQ ID NO: 270889 - DNA, 25 bp, Mus musculus
ctctggatcagggtttgaggagtat

SEQ ID NO: 270890 - DNA, 25 bp, Mus musculus
ctctggatccaggtggtacccggga

SEQ ID NO: 270891 - DNA, 25 bp, Mus musculus
ctctggatctagtgacagcagctac

SEQ ID NO: 270892 - DNA, 25 bp, Mus musculus
ctctggatctggtgaagcaggaagg

SEQ ID NO: 270893 - DNA, 25 bp, Mus musculus
ctctggatgaacaacactttcatgg

SEQ ID NO: 270894 - DNA, 25 bp, Mus musculus
ctctggatgagagggagatgagaca

SEQ ID NO: 270895 - DNA, 25 bp, Mus musculus
ctctggatggaacctgttcgatttc

SEQ ID NO: 270896 - DNA, 25 bp, Mus musculus
ctctggatggagagggccctggatg

SEQ ID NO: 270897 - DNA, 25 bp, Mus musculus
ctctggatgtcgtcacgctggccgt

SEQ ID NO: 270898 - DNA, 25 bp, Mus musculus
ctctggatgtgtcttcggagcctca

SEQ ID NO: 270899 - DNA, 25 bp, Mus musculus
ctctggatgttgaacagcgtcacgc

SEQ ID NO: 270900 - DNA, 25 bp, Mus musculus
ctctggatttatcactttttaattc

SEQ ID NO: 270901 - DNA, 25 bp, Mus musculus
ctctggcaaaatgcgtgcccacact

SEQ ID NO: 270902 - DNA, 25 bp, Mus musculus
ctctggcaaggactcacacacgaga

SEQ ID NO: 270903 - DNA, 25 bp, Mus musculus
ctctggcaaggtaccctggctaaag

SEQ ID NO: 270904 - DNA, 25 bp, Mus musculus
ctctggcacagccggagagaagccc

SEQ ID NO: 270905 - DNA, 25 bp, Mus musculus
ctctggcacaggtgctttgccagat

SEQ ID NO: 270906 - DNA, 25 bp, Mus musculus
ctctggcactactggcctgcccaag

SEQ ID NO: 270907 - DNA, 25 bp, Mus musculus
ctctggcagaaggttctctctcttg

SEQ ID NO: 270908 - DNA, 25 bp, Mus musculus
ctctggcaggctctgtcccaggtaa

SEQ ID NO: 270909 - DNA, 25 bp, Mus musculus
ctctggcatccaggtgcgctacctg

SEQ ID NO: 270910 - DNA, 25 bp, Mus musculus
ctctggccacaggaaatcgagagga

SEQ ID NO: 270911 - DNA, 25 bp, Mus musculus
ctctggccacgggaaatcgagagga

SEQ ID NO: 270912 - DNA, 25 bp, Mus musculus
ctctggccagacagtctgctaggga

SEQ ID NO: 270913 - DNA, 25 bp, Mus musculus
ctctggccaggcagttattcagaat

SEQ ID NO: 270914 - DNA, 25 bp, Mus musculus
ctctggccaggttccgggagaccct

SEQ ID NO: 270915 - DNA, 25 bp, Mus musculus
ctctggcccagaccgaagccaggac

SEQ ID NO: 270916 - DNA, 25 bp, Mus musculus
ctctggcccagcagctggagcaatt

SEQ ID NO: 270917 - DNA, 25 bp, Mus musculus
ctctggcccgaacaggtcttatttt

SEQ ID NO: 270918 - DNA, 25 bp, Mus musculus
ctctggccctggggatgtgacaagc

SEQ ID NO: 270919 - DNA, 25 bp, Mus musculus
ctctggccgtcgcggctggactgta

SEQ ID NO: 270920 - DNA, 25 bp, Mus musculus
ctctggcctcaggtaaccatggaga

SEQ ID NO: 270921 - DNA, 25 bp, Mus musculus
ctctggcgaccgcagcaacccttct

SEQ ID NO: 270922 - DNA, 25 bp, Mus musculus
ctctggcgggatggactcctgtcat

SEQ ID NO: 270923 - DNA, 25 bp, Mus musculus
ctctggcggggctgcagtatggcgg

SEQ ID NO: 270924 - DNA, 25 bp, Mus musculus
ctctggcgtcttatgggttggagga

SEQ ID NO: 270925 - DNA, 25 bp, Mus musculus
ctctggcgttattgctgtctcccca

SEQ ID NO: 270926 - DNA, 25 bp, Mus musculus
ctctggctcaaaaaaaaaaagcctc

SEQ ID NO: 270927 - DNA, 25 bp, Mus musculus
ctctggctccagagaaatcttctag

SEQ ID NO: 270928 - DNA, 25 bp, Mus musculus
ctctggctctgaatttctcttcttt

SEQ ID NO: 270929 - DNA, 25 bp, Mus musculus
ctctggctctgacagcgacgaaccg

SEQ ID NO: 270930 - DNA, 25 bp, Mus musculus
ctctggctgcagggaattgatgtcc

SEQ ID NO: 270931 - DNA, 25 bp, Mus musculus
ctctggcttccacaggattttcacc

SEQ ID NO: 270932 - DNA, 25 bp, Mus musculus
ctctggcttcctcccgaggccgagc

SEQ ID NO: 270933 - DNA, 25 bp, Mus musculus
ctctggcttctcagatgggagctca

SEQ ID NO: 270934 - DNA, 25 bp, Mus musculus
ctctggcttctcagttccagagcct

SEQ ID NO: 270935 - DNA, 25 bp, Mus musculus
ctctgggaaaagggtcaatgctagg

SEQ ID NO: 270936 - DNA, 25 bp, Mus musculus
ctctgggaaaggtattctctaagaa

SEQ ID NO: 270937 - DNA, 25 bp, Mus musculus
ctctgggaagctgtgctcagtagtc

SEQ ID NO: 270938 - DNA, 25 bp, Mus musculus
ctctgggaatagattccaagagcag

SEQ ID NO: 270939 - DNA, 25 bp, Mus musculus
ctctgggacccgaacaatttcgaag

SEQ ID NO: 270940 - DNA, 25 bp, Mus musculus
ctctgggaccggattcccgaagccc

SEQ ID NO: 270941 - DNA, 25 bp, Mus musculus
ctctgggacgcttggtaaagcgttc

SEQ ID NO: 270942 - DNA, 25 bp, Mus musculus
ctctgggagaatcaggcatcgcctc

SEQ ID NO: 270943 - DNA, 25 bp, Mus musculus
ctctgggagtttgaggaattagaaa

SEQ ID NO: 270944 - DNA, 25 bp, Mus musculus
ctctgggattaacctggatcctgac

SEQ ID NO: 270945 - DNA, 25 bp, Mus musculus
ctctgggcacgctaataattttcaa

SEQ ID NO: 270946 - DNA, 25 bp, Mus musculus
ctctgggctatgtgggtgagcctgt

SEQ ID NO: 270947 - DNA, 25 bp, Mus musculus
ctctggggaagccttggccacgagg

SEQ ID NO: 270948 - DNA, 25 bp, Mus musculus
ctctggggaagctgctgcccagacc

SEQ ID NO: 270949 - DNA, 25 bp, Mus musculus
ctctggggaatattcctacctccac

SEQ ID NO: 270950 - DNA, 25 bp, Mus musculus
ctctggggagaaaacaccagctaca

SEQ ID NO: 270951 - DNA, 25 bp, Mus musculus
ctctggggatcatgtcggtcacaca

SEQ ID NO: 270952 - DNA, 25 bp, Mus musculus
ctctggggctacaggtggccttgca

SEQ ID NO: 270953 - DNA, 25 bp, Mus musculus
ctctggggtctggccaaagatctca

SEQ ID NO: 270954 - DNA, 25 bp, Mus musculus
ctctggggtctggtcagaaagacag

SEQ ID NO: 270955 - DNA, 25 bp, Mus musculus
ctctgggtacccgctttcttgatca

SEQ ID NO: 270956 - DNA, 25 bp, Mus musculus
ctctgggtctggaggtttgaggctc

SEQ ID NO: 270957 - DNA, 25 bp, Mus musculus
ctctgggtgagaggctgcccctgga

SEQ ID NO: 270958 - DNA, 25 bp, Mus musculus
ctctgggtgtccagacgctgcggcc

SEQ ID NO: 270959 - DNA, 25 bp, Mus musculus
ctctggtaacagaagaaaagatgtg

SEQ ID NO: 270960 - DNA, 25 bp, Mus musculus
ctctggtatatcgaactcgcacttg

SEQ ID NO: 270961 - DNA, 25 bp, Mus musculus
ctctggtatatcgttgtgcagacta

SEQ ID NO: 270962 - DNA, 25 bp, Mus musculus
ctctggtcagtcaatcccatgggac

SEQ ID NO: 270963 - DNA, 25 bp, Mus musculus
ctctggtccagcagatgcgtcgagc

SEQ ID NO: 270964 - DNA, 25 bp, Mus musculus
ctctggtcgaggaagatgggctcct

SEQ ID NO: 270965 - DNA, 25 bp, Mus musculus
ctctggtcttaggttcttgattgtc

SEQ ID NO: 270966 - DNA, 25 bp, Mus musculus
ctctggtgatgatgtggccctcact

SEQ ID NO: 270967 - DNA, 25 bp, Mus musculus
ctctggtgatgtactccaacctgga

SEQ ID NO: 270968 - DNA, 25 bp, Mus musculus
ctctggtggagcaaggtggccctgt

SEQ ID NO: 270969 - DNA, 25 bp, Mus musculus
ctctggttagaggtgaagaatattg

SEQ ID NO: 270970 - DNA, 25 bp, Mus musculus
ctctggttcaggctggcctgccttc

SEQ ID NO: 270971 - DNA, 25 bp, Mus musculus
ctctggttggacttggtgtgagtca

SEQ ID NO: 270972 - DNA, 25 bp, Mus musculus
ctctggtttgcctcctgaataaaaa

SEQ ID NO: 270973 - DNA, 25 bp, Mus musculus
ctctggtttgggaagggctgtcatg

SEQ ID NO: 270974 - DNA, 25 bp, Mus musculus
ctctggtttgtgtggggttcactga

SEQ ID NO: 270975 - DNA, 25 bp, Mus musculus
ctctgtaaaagggtgtctttaagaa

SEQ ID NO: 270976 - DNA, 25 bp, Mus musculus
ctctgtaaagtgatggctgcagcaa

SEQ ID NO: 270977 - DNA, 25 bp, Mus musculus
ctctgtaagcagcctaggatgtcag

SEQ ID NO: 270978 - DNA, 25 bp, Mus musculus
ctctgtaatggcagtttgagatggt

SEQ ID NO: 270979 - DNA, 25 bp, Mus musculus
ctctgtacacgtccggatagcttct

SEQ ID NO: 270980 - DNA, 25 bp, Mus musculus
ctctgtacagaattggacaaaatcc

SEQ ID NO: 270981 - DNA, 25 bp, Mus musculus
ctctgtaccagttgctgtgattggc

SEQ ID NO: 270982 - DNA, 25 bp, Mus musculus
ctctgtaccttggacaaagtggggc

SEQ ID NO: 270983 - DNA, 25 bp, Mus musculus
ctctgtacggcttgtgaaatggaga

SEQ ID NO: 270984 - DNA, 25 bp, Mus musculus
ctctgtagcaggtctagtgacagga

SEQ ID NO: 270985 - DNA, 25 bp, Mus musculus
ctctgtataccagcacctgaggaga

SEQ ID NO: 270986 - DNA, 25 bp, Mus musculus
ctctgtatatcatgcatccattttt

SEQ ID NO: 270987 - DNA, 25 bp, Mus musculus
ctctgtatccctgttgctgagctgg

SEQ ID NO: 270988 - DNA, 25 bp, Mus musculus
ctctgtatcctcagttcatgttcca

SEQ ID NO: 270989 - DNA, 25 bp, Mus musculus
ctctgtcaaggcccgagaccagaag

SEQ ID NO: 270990 - DNA, 25 bp, Mus musculus
ctctgtcaaggcggcccagaccagt

SEQ ID NO: 270991 - DNA, 25 bp, Mus musculus
ctctgtcaagggggtgtcgtttgac

SEQ ID NO: 270992 - DNA, 25 bp, Mus musculus
ctctgtcaagttaacactcacgatc

SEQ ID NO: 270993 - DNA, 25 bp, Mus musculus
ctctgtcacatgggaccatctgggc

SEQ ID NO: 270994 - DNA, 25 bp, Mus musculus
ctctgtcactgtcacgttcatgaat

SEQ ID NO: 270995 - DNA, 25 bp, Mus musculus
ctctgtcatcacagacaccctctct

SEQ ID NO: 270996 - DNA, 25 bp, Mus musculus
ctctgtcatcacagattctttaaga

SEQ ID NO: 270997 - DNA, 25 bp, Mus musculus
ctctgtcatccgaaaactccaggga

SEQ ID NO: 270998 - DNA, 25 bp, Mus musculus
ctctgtcatccgccctagcacaaaa

SEQ ID NO: 270999 - DNA, 25 bp, Mus musculus
ctctgtcatgggtcctctacagcct

SEQ ID NO: 271000 - DNA, 25 bp, Mus musculus
ctctgtccaccattccaaggaacag

SEQ ID NO: 271001 - DNA, 25 bp, Mus musculus
ctctgtccagaaggacaaggtggaa

SEQ ID NO: 271002 - DNA, 25 bp, Mus musculus
ctctgtccccaggcgtatgggcaag

SEQ ID NO: 271003 - DNA, 25 bp, Mus musculus
ctctgtccccagggaacagactgct

SEQ ID NO: 271004 - DNA, 25 bp, Mus musculus
ctctgtccccagggactgaaaggag

SEQ ID NO: 271005 - DNA, 25 bp, Mus musculus
ctctgtccccagtgcatgggtacag

SEQ ID NO: 271006 - DNA, 25 bp, Mus musculus
ctctgtcccccaggtttcacggggc

SEQ ID NO: 271007 - DNA, 25 bp, Mus musculus
ctctgtccctggcgtggggacagtg

SEQ ID NO: 271008 - DNA, 25 bp, Mus musculus
ctctgtcctcataccagaatctggt

SEQ ID NO: 271009 - DNA, 25 bp, Mus musculus
ctctgtcctcgtaggaatcagagaa

SEQ ID NO: 271010 - DNA, 25 bp, Mus musculus
ctctgtccttgtcttatctcctctg

SEQ ID NO: 271011 - DNA, 25 bp, Mus musculus
ctctgtccttttgcctttatcatgg

SEQ ID NO: 271012 - DNA, 25 bp, Mus musculus
ctctgtcgcagattggaagaattgt

SEQ ID NO: 271013 - DNA, 25 bp, Mus musculus
ctctgtctacccttatgagctaccg

SEQ ID NO: 271014 - DNA, 25 bp, Mus musculus
ctctgtctagagctgaggacctgga

SEQ ID NO: 271015 - DNA, 25 bp, Mus musculus
ctctgtctagggctgacggttgctg

SEQ ID NO: 271016 - DNA, 25 bp, Mus musculus
ctctgtctaggtatcttttggataa

SEQ ID NO: 271017 - DNA, 25 bp, Mus musculus
ctctgtctcacccaggatgagtttc

SEQ ID NO: 271018 - DNA, 25 bp, Mus musculus
ctctgtctccacgaccctgcttttt

SEQ ID NO: 271019 - DNA, 25 bp, Mus musculus
ctctgtctccaggacacccaacaca

SEQ ID NO: 271020 - DNA, 25 bp, Mus musculus
ctctgtctcggggaaaggttggaag

SEQ ID NO: 271021 - DNA, 25 bp, Mus musculus
ctctgtctcggggtgacaatagctt

SEQ ID NO: 271022 - DNA, 25 bp, Mus musculus
ctctgtcttaaaggccgttgatgct

SEQ ID NO: 271023 - DNA, 25 bp, Mus musculus
ctctgtcttaaaggtatctcattca

SEQ ID NO: 271024 - DNA, 25 bp, Mus musculus
ctctgtgaaaggtaaccccaggtga

SEQ ID NO: 271025 - DNA, 25 bp, Mus musculus
ctctgtgaagccgaggaagtggaga

SEQ ID NO: 271026 - DNA, 25 bp, Mus musculus
ctctgtgaagctgtttgttcaggat

SEQ ID NO: 271027 - DNA, 25 bp, Mus musculus
ctctgtgaaggcaatggtgctccac

SEQ ID NO: 271028 - DNA, 25 bp, Mus musculus
ctctgtgaaggcccgagaccagaag

SEQ ID NO: 271029 - DNA, 25 bp, Mus musculus
ctctgtgaaggtcacagtaatgaaa

SEQ ID NO: 271030 - DNA, 25 bp, Mus musculus
ctctgtgacctcctcctctactgct

SEQ ID NO: 271031 - DNA, 25 bp, Mus musculus
ctctgtgacctgtataatggttaca

SEQ ID NO: 271032 - DNA, 25 bp, Mus musculus
ctctgtgaccttggtctgccttgac

SEQ ID NO: 271033 - DNA, 25 bp, Mus musculus
ctctgtgacttgctgctgcgatact

SEQ ID NO: 271034 - DNA, 25 bp, Mus musculus
ctctgtgagagggtatgtctcctgt

SEQ ID NO: 271035 - DNA, 25 bp, Mus musculus
ctctgtgagctagagaagatccaga

SEQ ID NO: 271036 - DNA, 25 bp, Mus musculus
ctctgtgagctaggaaccggagtgg

SEQ ID NO: 271037 - DNA, 25 bp, Mus musculus
ctctgtgataccagaccctgaagaa

SEQ ID NO: 271038 - DNA, 25 bp, Mus musculus
ctctgtgatttacaggtggaaagct

SEQ ID NO: 271039 - DNA, 25 bp, Mus musculus
ctctgtgcaagccagccccaggtat

SEQ ID NO: 271040 - DNA, 25 bp, Mus musculus
ctctgtgcagcacgatggcctggtg

SEQ ID NO: 271041 - DNA, 25 bp, Mus musculus
ctctgtgccagacatcctgcagttc

SEQ ID NO: 271042 - DNA, 25 bp, Mus musculus
ctctgtgccagccatgaatgtcctg

SEQ ID NO: 271043 - DNA, 25 bp, Mus musculus
ctctgtgcccaagattgggtgtgat

SEQ ID NO: 271044 - DNA, 25 bp, Mus musculus
ctctgtgcccataggttacaaccat

SEQ ID NO: 271045 - DNA, 25 bp, Mus musculus
ctctgtgccgaacatctcatcattg

SEQ ID NO: 271046 - DNA, 25 bp, Mus musculus
ctctgtgccgcccccagaggaactc

SEQ ID NO: 271047 - DNA, 25 bp, Mus musculus
ctctgtgcctctctgtgagcaaaga

SEQ ID NO: 271048 - DNA, 25 bp, Mus musculus
ctctgtgcgcggcaatacagagtgc

SEQ ID NO: 271049 - DNA, 25 bp, Mus musculus
ctctgtgctacagatgtcacagcca

SEQ ID NO: 271050 - DNA, 25 bp, Mus musculus
ctctgtgctacagattacacctttg

SEQ ID NO: 271051 - DNA, 25 bp, Mus musculus
ctctgtgctccaggctctcacagca

SEQ ID NO: 271052 - DNA, 25 bp, Mus musculus
ctctgtgctcctggcacacacttgt

SEQ ID NO: 271053 - DNA, 25 bp, Mus musculus
ctctgtgctctcaggggactcctct

SEQ ID NO: 271054 - DNA, 25 bp, Mus musculus
ctctgtgctgagctgggtgaagatg

SEQ ID NO: 271055 - DNA, 25 bp, Mus musculus
ctctgtggaaaactgatgagaaatg

SEQ ID NO: 271056 - DNA, 25 bp, Mus musculus
ctctgtggaaagcagatgagaaatg

SEQ ID NO: 271057 - DNA, 25 bp, Mus musculus
ctctgtggaagagacctctgctaag

SEQ ID NO: 271058 - DNA, 25 bp, Mus musculus
ctctgtggaatcaccctgccccacg

SEQ ID NO: 271059 - DNA, 25 bp, Mus musculus
ctctgtggacggaatcttggagaga

SEQ ID NO: 271060 - DNA, 25 bp, Mus musculus
ctctgtggaggaaatcctgaagaag

SEQ ID NO: 271061 - DNA, 25 bp, Mus musculus
ctctgtggatgaggtcactacttca

SEQ ID NO: 271062 - DNA, 25 bp, Mus musculus
ctctgtggcccaggttgctacaggc

SEQ ID NO: 271063 - DNA, 25 bp, Mus musculus
ctctgtggcccagtcactggccggg

SEQ ID NO: 271064 - DNA, 25 bp, Mus musculus
ctctgtggcgaggagaaagcggtgg

SEQ ID NO: 271065 - DNA, 25 bp, Mus musculus
ctctgtgggaagacaaagccattgg

SEQ ID NO: 271066 - DNA, 25 bp, Mus musculus
ctctgtggggctccacagaattgtg

SEQ ID NO: 271067 - DNA, 25 bp, Mus musculus
ctctgtggggctccctccatgtgct

SEQ ID NO: 271068 - DNA, 25 bp, Mus musculus
ctctgtggtaacatggccaacctat

SEQ ID NO: 271069 - DNA, 25 bp, Mus musculus
ctctgtggtcctagggttctccaca

SEQ ID NO: 271070 - DNA, 25 bp, Mus musculus
ctctgtggttgagctagaaaattat

SEQ ID NO: 271071 - DNA, 25 bp, Mus musculus
ctctgtggttgagtacgtgaagggc

SEQ ID NO: 271072 - DNA, 25 bp, Mus musculus
ctctgtgtcaacgaggaaatgttgt

SEQ ID NO: 271073 - DNA, 25 bp, Mus musculus
ctctgtgtcaacgaggtccccggac

SEQ ID NO: 271074 - DNA, 25 bp, Mus musculus
ctctgtgtctcactaatgctcatac

SEQ ID NO: 271075 - DNA, 25 bp, Mus musculus
ctctgtgtctcgtttaaaaagcttg

SEQ ID NO: 271076 - DNA, 25 bp, Mus musculus
ctctgtgtgatcaggagttcctctg

SEQ ID NO: 271077 - DNA, 25 bp, Mus musculus
ctctgtgtgcgggagaaaccactgg

SEQ ID NO: 271078 - DNA, 25 bp, Mus musculus
ctctgtgtgcggggatctgaagttg

SEQ ID NO: 271079 - DNA, 25 bp, Mus musculus
ctctgtgtgcgtgtattctagtcaa

SEQ ID NO: 271080 - DNA, 25 bp, Mus musculus
ctctgtgtgcgtgttaaaagagcca

SEQ ID NO: 271081 - DNA, 25 bp, Mus musculus
ctctgtgtggagaaatctgacgttt

SEQ ID NO: 271082 - DNA, 25 bp, Mus musculus
ctctgtgtggatgccttcaaaggac

SEQ ID NO: 271083 - DNA, 25 bp, Mus musculus
ctctgtgtgggtactatcttggccg

SEQ ID NO: 271084 - DNA, 25 bp, Mus musculus
ctctgtgttagcggggtgccacggc

SEQ ID NO: 271085 - DNA, 25 bp, Mus musculus
ctctgttaagaaagaaacgctgcat

SEQ ID NO: 271086 - DNA, 25 bp, Mus musculus
ctctgttaagaaagattaaagatga

SEQ ID NO: 271087 - DNA, 25 bp, Mus musculus
ctctgttaagaaaggacaaagatgt

SEQ ID NO: 271088 - DNA, 25 bp, Mus musculus
ctctgttaccgtaaagccttgggga

SEQ ID NO: 271089 - DNA, 25 bp, Mus musculus
ctctgttactgccaggcatctggag

SEQ ID NO: 271090 - DNA, 25 bp, Mus musculus
ctctgttactgcccatgaaacccct

SEQ ID NO: 271091 - DNA, 25 bp, Mus musculus
ctctgttattcagctaccactaccc

SEQ ID NO: 271092 - DNA, 25 bp, Mus musculus
ctctgttattcaggctttcaccact

SEQ ID NO: 271093 - DNA, 25 bp, Mus musculus
ctctgttcagcccttcccacaaatc

SEQ ID NO: 271094 - DNA, 25 bp, Mus musculus
ctctgttcaggatatgcagtacctt

SEQ ID NO: 271095 - DNA, 25 bp, Mus musculus
ctctgttcagtgaacctaacactga

SEQ ID NO: 271096 - DNA, 25 bp, Mus musculus
ctctgttccgaggagaagcctacaa

SEQ ID NO: 271097 - DNA, 25 bp, Mus musculus
ctctgttccgtcacagtcacgccac

SEQ ID NO: 271098 - DNA, 25 bp, Mus musculus
ctctgttcttggaggagggcaatgc

SEQ ID NO: 271099 - DNA, 25 bp, Mus musculus
ctctgttgctaacggacatggcggt

SEQ ID NO: 271100 - DNA, 25 bp, Mus musculus
ctctgttgtgtagatgaacgagacc

SEQ ID NO: 271101 - DNA, 25 bp, Mus musculus
ctctgtttaatgaagactttgtatc

SEQ ID NO: 271102 - DNA, 25 bp, Mus musculus
ctctgtttaatgaagtgtcacgagc

SEQ ID NO: 271103 - DNA, 25 bp, Mus musculus
ctctgtttcagtggaaacaagttga

SEQ ID NO: 271104 - DNA, 25 bp, Mus musculus
ctctgtttcccagaccaggtcgacc

SEQ ID NO: 271105 - DNA, 25 bp, Mus musculus
ctctgtttcccagggtcccaaaggc

SEQ ID NO: 271106 - DNA, 25 bp, Mus musculus
ctctgtttctgtgaggaccttgaga

SEQ ID NO: 271107 - DNA, 25 bp, Mus musculus
ctctgtttcttggaggatctggaga

SEQ ID NO: 271108 - DNA, 25 bp, Mus musculus
ctctgtttgagtgatgagccggcag

SEQ ID NO: 271109 - DNA, 25 bp, Mus musculus
ctctgttttatcctggtctctaata

SEQ ID NO: 271110 - DNA, 25 bp, Mus musculus
ctctgttttctgttgagcggctgca

SEQ ID NO: 271111 - DNA, 25 bp, Mus musculus
ctcttaaaacaagtgcctccaaaac

SEQ ID NO: 271112 - DNA, 25 bp, Mus musculus
ctcttaaaacaagtgttttgtcaag

SEQ ID NO: 271113 - DNA, 25 bp, Mus musculus
ctcttaaactcggtgtgtatgaagc

SEQ ID NO: 271114 - DNA, 25 bp, Mus musculus
ctcttaaagctggcgagcttctgca

SEQ ID NO: 271115 - DNA, 25 bp, Mus musculus
ctcttaaagctggcggtccccaacc

SEQ ID NO: 271116 - DNA, 25 bp, Mus musculus
ctcttaaaggagagcttgaacttgg

SEQ ID NO: 271117 - DNA, 25 bp, Mus musculus
ctcttaacaagcacaatgggtgtgt

SEQ ID NO: 271118 - DNA, 25 bp, Mus musculus
ctcttaagaaggactgcagtgaggt

SEQ ID NO: 271119 - DNA, 25 bp, Mus musculus
ctcttaagggagatcgccacgactc

SEQ ID NO: 271120 - DNA, 25 bp, Mus musculus
ctcttaagtacatggcgcagcagca

SEQ ID NO: 271121 - DNA, 25 bp, Mus musculus
ctcttacaagaagagtaccagcctc

SEQ ID NO: 271122 - DNA, 25 bp, Mus musculus
ctcttaccaatcttgaactttccac

SEQ ID NO: 271123 - DNA, 25 bp, Mus musculus
ctcttaccacctgtggtggactggt

SEQ ID NO: 271124 - DNA, 25 bp, Mus musculus
ctcttaccagtctccactcagcctc

SEQ ID NO: 271125 - DNA, 25 bp, Mus musculus
ctcttacccagaccaacagcaacca

SEQ ID NO: 271126 - DNA, 25 bp, Mus musculus
ctcttacccagcatatatttggttt

SEQ ID NO: 271127 - DNA, 25 bp, Mus musculus
ctcttacccaggtttttgtgcgtct

SEQ ID NO: 271128 - DNA, 25 bp, Mus musculus
ctcttacctgcctgtgccgtgtgac

SEQ ID NO: 271129 - DNA, 25 bp, Mus musculus
ctcttactccgtggcgaatctcatt

SEQ ID NO: 271130 - DNA, 25 bp, Mus musculus
ctcttactctcccagcatgctggac

SEQ ID NO: 271131 - DNA, 25 bp, Mus musculus
ctcttactgacagttgaacaccagt

SEQ ID NO: 271132 - DNA, 25 bp, Mus musculus
ctcttactgccaagatatagatgag

SEQ ID NO: 271133 - DNA, 25 bp, Mus musculus
ctcttacttaaggaactcagagaaa

SEQ ID NO: 271134 - DNA, 25 bp, Mus musculus
ctcttagagaacatgctggatagta

SEQ ID NO: 271135 - DNA, 25 bp, Mus musculus
ctcttagagaagatccatctgacac

SEQ ID NO: 271136 - DNA, 25 bp, Mus musculus
ctcttagagtaccagcgcgggatgc

SEQ ID NO: 271137 - DNA, 25 bp, Mus musculus
ctcttagcagaaatctagatcttga

SEQ ID NO: 271138 - DNA, 25 bp, Mus musculus
ctcttagccatgaaacactctctgg

SEQ ID NO: 271139 - DNA, 25 bp, Mus musculus
ctcttagccccaggtgctgcagtcg

SEQ ID NO: 271140 - DNA, 25 bp, Mus musculus
ctcttagcccgcgaggaacagtctg

SEQ ID NO: 271141 - DNA, 25 bp, Mus musculus
ctcttagtcccagtggaagcaccag

SEQ ID NO: 271142 - DNA, 25 bp, Mus musculus
ctcttatcaggtatggggcagatgt

SEQ ID NO: 271143 - DNA, 25 bp, Mus musculus
ctcttatgaaggtctacggcttgaa

SEQ ID NO: 271144 - DNA, 25 bp, Mus musculus
ctcttatgacagctggaacgcttta

SEQ ID NO: 271145 - DNA, 25 bp, Mus musculus
ctcttatgacaggtggctgtctgcc

SEQ ID NO: 271146 - DNA, 25 bp, Mus musculus
ctcttatgtcctcagagagtattgg

SEQ ID NO: 271147 - DNA, 25 bp, Mus musculus
ctcttcaaagacaagctcaaacatg

SEQ ID NO: 271148 - DNA, 25 bp, Mus musculus
ctcttcaaagacaaggtgagggtgg

SEQ ID NO: 271149 - DNA, 25 bp, Mus musculus
ctcttcaaaggctttggagacaggt

SEQ ID NO: 271150 - DNA, 25 bp, Mus musculus
ctcttcaacaggttctactcagttc

SEQ ID NO: 271151 - DNA, 25 bp, Mus musculus
ctcttcaaccaacaggagctctttg

SEQ ID NO: 271152 - DNA, 25 bp, Mus musculus
ctcttcaaccatcaggggctggtgt

SEQ ID NO: 271153 - DNA, 25 bp, Mus musculus
ctcttcaaccatcaggtctaggtgg

SEQ ID NO: 271154 - DNA, 25 bp, Mus musculus
ctcttcaactctgtagtgaatgtgg

SEQ ID NO: 271155 - DNA, 25 bp, Mus musculus
ctcttcaagaaggagaacagagaaa

SEQ ID NO: 271156 - DNA, 25 bp, Mus musculus
ctcttcaagaaggagtatggctgta

SEQ ID NO: 271157 - DNA, 25 bp, Mus musculus
ctcttcaagtgatagttctcagtat

SEQ ID NO: 271158 - DNA, 25 bp, Mus musculus
ctcttcaatgaggggaagcgcttgg

SEQ ID NO: 271159 - DNA, 25 bp, Mus musculus
ctcttcacaaccattcctggtctga

SEQ ID NO: 271160 - DNA, 25 bp, Mus musculus
ctcttcacccggaggtttcagaaag

SEQ ID NO: 271161 - DNA, 25 bp, Mus musculus
ctcttcacctgcttcctggcagtgg

SEQ ID NO: 271162 - DNA, 25 bp, Mus musculus
ctcttcacgataggcaaggggaagt

SEQ ID NO: 271163 - DNA, 25 bp, Mus musculus
ctcttcacggaactcgatggagcaa

SEQ ID NO: 271164 - DNA, 25 bp, Mus musculus
ctcttcacggcactggttctaaggc

SEQ ID NO: 271165 - DNA, 25 bp, Mus musculus
ctcttcagaaacaggtctggatgct

SEQ ID NO: 271166 - DNA, 25 bp, Mus musculus
ctcttcagaaacaggtctggcagga

SEQ ID NO: 271167 - DNA, 25 bp, Mus musculus
ctcttcagaaaggccggagcctcaa

SEQ ID NO: 271168 - DNA, 25 bp, Mus musculus
ctcttcagacagacccttagagggc

SEQ ID NO: 271169 - DNA, 25 bp, Mus musculus
ctcttcagacagagggccacagcta

SEQ ID NO: 271170 - DNA, 25 bp, Mus musculus
ctcttcagacaggcccagtgctcgc

SEQ ID NO: 271171 - DNA, 25 bp, Mus musculus
ctcttcagcctgggctcagccatcg

SEQ ID NO: 271172 - DNA, 25 bp, Mus musculus
ctcttcagctacctcagctttatga

SEQ ID NO: 271173 - DNA, 25 bp, Mus musculus
ctcttcagctgctctgtccgggcct

SEQ ID NO: 271174 - DNA, 25 bp, Mus musculus
ctcttcagcttcaaatcagtaccac

SEQ ID NO: 271175 - DNA, 25 bp, Mus musculus
ctcttcagcttcaaggtttggattc

SEQ ID NO: 271176 - DNA, 25 bp, Mus musculus
ctcttcaggagcggaggtacactgt

SEQ ID NO: 271177 - DNA, 25 bp, Mus musculus
ctcttcaggagggggaacagacatc

SEQ ID NO: 271178 - DNA, 25 bp, Mus musculus
ctcttcaggcaacatgaaattgatg

SEQ ID NO: 271179 - DNA, 25 bp, Mus musculus
ctcttcagtattcctgtcttgactt

SEQ ID NO: 271180 - DNA, 25 bp, Mus musculus
ctcttcagtggaaggtaaacagaat

SEQ ID NO: 271181 - DNA, 25 bp, Mus musculus
ctcttcatcaggatgctgcacaaca

SEQ ID NO: 271182 - DNA, 25 bp, Mus musculus
ctcttcatccagcagatccgaatcc

SEQ ID NO: 271183 - DNA, 25 bp, Mus musculus
ctcttcatccagcattccatgatct

SEQ ID NO: 271184 - DNA, 25 bp, Mus musculus
ctcttcatggcgaagaagaagacac

SEQ ID NO: 271185 - DNA, 25 bp, Mus musculus
ctcttcattaaacccaacaaacctg

SEQ ID NO: 271186 - DNA, 25 bp, Mus musculus
ctcttcattgatgggcagacacgca

SEQ ID NO: 271187 - DNA, 25 bp, Mus musculus
ctcttcattgctggctttgcggtgg

SEQ ID NO: 271188 - DNA, 25 bp, Mus musculus
ctcttccaagaggcaacaactgtat

SEQ ID NO: 271189 - DNA, 25 bp, Mus musculus
ctcttccaaggaatttgaaatcagt

SEQ ID NO: 271190 - DNA, 25 bp, Mus musculus
ctcttccaaggagtgccggtgcgta

SEQ ID NO: 271191 - DNA, 25 bp, Mus musculus
ctcttccacacacgccaccccacct

SEQ ID NO: 271192 - DNA, 25 bp, Mus musculus
ctcttccacacacggaggaggttgg

SEQ ID NO: 271193 - DNA, 25 bp, Mus musculus
ctcttccacaggtctgttggtgccc

SEQ ID NO: 271194 - DNA, 25 bp, Mus musculus
ctcttccaccgcgccctgtctcact

SEQ ID NO: 271195 - DNA, 25 bp, Mus musculus
ctcttccactggggtgtgtctgcag

SEQ ID NO: 271196 - DNA, 25 bp, Mus musculus
ctcttccagctaccactatgccgct

SEQ ID NO: 271197 - DNA, 25 bp, Mus musculus
ctcttccatacagatgatattgaaa

SEQ ID NO: 271198 - DNA, 25 bp, Mus musculus
ctcttccatcctgagcggctctctg

SEQ ID NO: 271199 - DNA, 25 bp, Mus musculus
ctcttccatgtgctccccacactcc

SEQ ID NO: 271200 - DNA, 25 bp, Mus musculus
ctcttcccaaaacagaataaatgga

SEQ ID NO: 271201 - DNA, 25 bp, Mus musculus
ctcttcccaaaacagtatctttcag

SEQ ID NO: 271202 - DNA, 25 bp, Mus musculus
ctcttcccaacaagacgatgatgat

SEQ ID NO: 271203 - DNA, 25 bp, Mus musculus
ctcttcccaagctaaagcccattat

SEQ ID NO: 271204 - DNA, 25 bp, Mus musculus
ctcttcccacccaggaatccaaacg

SEQ ID NO: 271205 - DNA, 25 bp, Mus musculus
ctcttcccacccagtgatgactacg

SEQ ID NO: 271206 - DNA, 25 bp, Mus musculus
ctcttcccagagaccgtgaagaaca

SEQ ID NO: 271207 - DNA, 25 bp, Mus musculus
ctcttcccaggctttgacctagaga

SEQ ID NO: 271208 - DNA, 25 bp, Mus musculus
ctcttcccccacagtcccagacgag

SEQ ID NO: 271209 - DNA, 25 bp, Mus musculus
ctcttcccccagatgcctgtcggtg

SEQ ID NO: 271210 - DNA, 25 bp, Mus musculus
ctcttcccgatttgcccatgaagct

SEQ ID NO: 271211 - DNA, 25 bp, Mus musculus
ctcttccctcccgcccaagcctaat

SEQ ID NO: 271212 - DNA, 25 bp, Mus musculus
ctcttccctcctatcccctgctttt

SEQ ID NO: 271213 - DNA, 25 bp, Mus musculus
ctcttccctgtcctgaggccatgct

SEQ ID NO: 271214 - DNA, 25 bp, Mus musculus
ctcttccctttctcaggtccaggtg

SEQ ID NO: 271215 - DNA, 25 bp, Mus musculus
ctcttccgaggacccacactcaggc

SEQ ID NO: 271216 - DNA, 25 bp, Mus musculus
ctcttccgtcataacgggcctgtgt

SEQ ID NO: 271217 - DNA, 25 bp, Mus musculus
ctcttcctacaaaaggtgtggcgtg

SEQ ID NO: 271218 - DNA, 25 bp, Mus musculus
ctcttcctacagttggtcccgcaga

SEQ ID NO: 271219 - DNA, 25 bp, Mus musculus
ctcttcctccaccaggtagctgaga

SEQ ID NO: 271220 - DNA, 25 bp, Mus musculus
ctcttcctcgcgtttcatgcaggct

SEQ ID NO: 271221 - DNA, 25 bp, Mus musculus
ctcttcctcgggctccactctcgct

SEQ ID NO: 271222 - DNA, 25 bp, Mus musculus
ctcttcctctgacagtctcatcttt

SEQ ID NO: 271223 - DNA, 25 bp, Mus musculus
ctcttcctgccctcgctagttctga

SEQ ID NO: 271224 - DNA, 25 bp, Mus musculus
ctcttcctgctcaggagactgcttc

SEQ ID NO: 271225 - DNA, 25 bp, Mus musculus
ctcttcctggagttccctgaggatc

SEQ ID NO: 271226 - DNA, 25 bp, Mus musculus
ctcttcctgggcggcggccagcgcg

SEQ ID NO: 271227 - DNA, 25 bp, Mus musculus
ctcttccttacacatgatgaagata

SEQ ID NO: 271228 - DNA, 25 bp, Mus musculus
ctcttccttggtactctcaagttca

SEQ ID NO: 271229 - DNA, 25 bp, Mus musculus
ctcttcgaacggcacccaccaggtg

SEQ ID NO: 271230 - DNA, 25 bp, Mus musculus
ctcttcgccgccattgctcctgtgc

SEQ ID NO: 271231 - DNA, 25 bp, Mus musculus
ctcttcgcttggggtgcacacagtg

SEQ ID NO: 271232 - DNA, 25 bp, Mus musculus
ctcttcggctacatggtcctctctc

SEQ ID NO: 271233 - DNA, 25 bp, Mus musculus
ctcttcgtcaaggaaacctgcagat

SEQ ID NO: 271234 - DNA, 25 bp, Mus musculus
ctcttcgtcaaggccggaagtgatg

SEQ ID NO: 271235 - DNA, 25 bp, Mus musculus
ctcttcgtcaaggctggttatgacg

SEQ ID NO: 271236 - DNA, 25 bp, Mus musculus
ctcttctaaaacgttaccacctgca

SEQ ID NO: 271237 - DNA, 25 bp, Mus musculus
ctcttctaaagacctcaaaggaaga

SEQ ID NO: 271238 - DNA, 25 bp, Mus musculus
ctcttctaaagatccactatgggcc

SEQ ID NO: 271239 - DNA, 25 bp, Mus musculus
ctcttctaaccagaggcaccaggat

SEQ ID NO: 271240 - DNA, 25 bp, Mus musculus
ctcttctaccactgaggggtttcac

SEQ ID NO: 271241 - DNA, 25 bp, Mus musculus
ctcttctagatcagccaccatgcgg

SEQ ID NO: 271242 - DNA, 25 bp, Mus musculus
ctcttctagtagcttgtcttctcac

SEQ ID NO: 271243 - DNA, 25 bp, Mus musculus
ctcttctattttgagagactgcctt

SEQ ID NO: 271244 - DNA, 25 bp, Mus musculus
ctcttctattttgaggttgagcaca

SEQ ID NO: 271245 - DNA, 25 bp, Mus musculus
ctcttctcagagaagaaaagcgagt

SEQ ID NO: 271246 - DNA, 25 bp, Mus musculus
ctcttctcagcatccctggctgaga

SEQ ID NO: 271247 - DNA, 25 bp, Mus musculus
ctcttctcagcatttgccctggttc

SEQ ID NO: 271248 - DNA, 25 bp, Mus musculus
ctcttctcagggtctcagaatggcc

SEQ ID NO: 271249 - DNA, 25 bp, Mus musculus
ctcttctccaccaagtcaaagtaaa

SEQ ID NO: 271250 - DNA, 25 bp, Mus musculus
ctcttctccatagcagactagagag

SEQ ID NO: 271251 - DNA, 25 bp, Mus musculus
ctcttctccatatacctggtgatgg

SEQ ID NO: 271252 - DNA, 25 bp, Mus musculus
ctcttctcccctgacagacccggag

SEQ ID NO: 271253 - DNA, 25 bp, Mus musculus
ctcttctcccctggtttctgtatgc

SEQ ID NO: 271254 - DNA, 25 bp, Mus musculus
ctcttctctaaaaaagattgatagc

SEQ ID NO: 271255 - DNA, 25 bp, Mus musculus
ctcttctctgagtttctcagtgtaa

SEQ ID NO: 271256 - DNA, 25 bp, Mus musculus
ctcttctctggggcctggaatgaga

SEQ ID NO: 271257 - DNA, 25 bp, Mus musculus
ctcttctctgtgcctttcttcctga

SEQ ID NO: 271258 - DNA, 25 bp, Mus musculus
ctcttctgcagaactgggagtcctc

SEQ ID NO: 271259 - DNA, 25 bp, Mus musculus
ctcttctgcagtctacctgtgcccc

SEQ ID NO: 271260 - DNA, 25 bp, Mus musculus
ctcttctgcatgaacttctgcacag

SEQ ID NO: 271261 - DNA, 25 bp, Mus musculus
ctcttctgcatgaatttcagttcgt

SEQ ID NO: 271262 - DNA, 25 bp, Mus musculus
ctcttctgcccagccaccccgctgg

SEQ ID NO: 271263 - DNA, 25 bp, Mus musculus
ctcttctggaaagagatggctgtct

SEQ ID NO: 271264 - DNA, 25 bp, Mus musculus
ctcttctggaaagctaggtagaagc

SEQ ID NO: 271265 - DNA, 25 bp, Mus musculus
ctcttctggaaaggcctagactggt

SEQ ID NO: 271266 - DNA, 25 bp, Mus musculus
ctcttctggaagccgctctctctcc

SEQ ID NO: 271267 - DNA, 25 bp, Mus musculus
ctcttctggaaggactaccaccttg

SEQ ID NO: 271268 - DNA, 25 bp, Mus musculus
ctcttctggaaggactcgggacacc

SEQ ID NO: 271269 - DNA, 25 bp, Mus musculus
ctcttctggaaggatccgccgcgat

SEQ ID NO: 271270 - DNA, 25 bp, Mus musculus
ctcttctggaatgtggaacagcccc

SEQ ID NO: 271271 - DNA, 25 bp, Mus musculus
ctcttctggaatgtggtagcgagat

SEQ ID NO: 271272 - DNA, 25 bp, Mus musculus
ctcttctggcctccgatggtgacat

SEQ ID NO: 271273 - DNA, 25 bp, Mus musculus
ctcttctgtggccatttctggcagc

SEQ ID NO: 271274 - DNA, 25 bp, Mus musculus
ctcttcttaattctggcagttaaac

SEQ ID NO: 271275 - DNA, 25 bp, Mus musculus
ctcttcttcacggtgccttggagca

SEQ ID NO: 271276 - DNA, 25 bp, Mus musculus
ctcttcttcagatacatgtctcaga

SEQ ID NO: 271277 - DNA, 25 bp, Mus musculus
ctcttcttctttgtactaggcggcc

SEQ ID NO: 271278 - DNA, 25 bp, Mus musculus
ctcttctttgatgagaagtcccgtg

SEQ ID NO: 271279 - DNA, 25 bp, Mus musculus
ctcttgaaaatgtggagtgtgacaa

SEQ ID NO: 271280 - DNA, 25 bp, Mus musculus
ctcttgaaagtgcaggaaaggaagt

SEQ ID NO: 271281 - DNA, 25 bp, Mus musculus
ctcttgaagaagtaaccctcctccc

SEQ ID NO: 271282 - DNA, 25 bp, Mus musculus
ctcttgaagaagtttcctgtggcca

SEQ ID NO: 271283 - DNA, 25 bp, Mus musculus
ctcttgacaggaaggagggggagag

SEQ ID NO: 271284 - DNA, 25 bp, Mus musculus
ctcttgaccaagttccaggaagaca

SEQ ID NO: 271285 - DNA, 25 bp, Mus musculus
ctcttgacctggaagggaacatgcc

SEQ ID NO: 271286 - DNA, 25 bp, Mus musculus
ctcttgactcgagaagtcgtcacat

SEQ ID NO: 271287 - DNA, 25 bp, Mus musculus
ctcttgactttcacacaatcagggc

SEQ ID NO: 271288 - DNA, 25 bp, Mus musculus
ctcttgagaccagcaggtttctgga

SEQ ID NO: 271289 - DNA, 25 bp, Mus musculus
ctcttgagccagcccatacccagcc

SEQ ID NO: 271290 - DNA, 25 bp, Mus musculus
ctcttgagggaggccttaaccatgg

SEQ ID NO: 271291 - DNA, 25 bp, Mus musculus
ctcttgagtcaagagaatcggctat

SEQ ID NO: 271292 - DNA, 25 bp, Mus musculus
ctcttgagtcaagagatcaggactt

SEQ ID NO: 271293 - DNA, 25 bp, Mus musculus
ctcttgagtcaagagatgaagccac

SEQ ID NO: 271294 - DNA, 25 bp, Mus musculus
ctcttgatagtgatctttccagaac

SEQ ID NO: 271295 - DNA, 25 bp, Mus musculus
ctcttgatcagcaagccccgcccaa

SEQ ID NO: 271296 - DNA, 25 bp, Mus musculus
ctcttgatgagggtccaccaaaata

SEQ ID NO: 271297 - DNA, 25 bp, Mus musculus
ctcttgcaaaggtgacccttaccct

SEQ ID NO: 271298 - DNA, 25 bp, Mus musculus
ctcttgcaaggagtcagcattggca

SEQ ID NO: 271299 - DNA, 25 bp, Mus musculus
ctcttgcagctcaaatgtccccagc

SEQ ID NO: 271300 - DNA, 25 bp, Mus musculus
ctcttgcagctgtctagcccatgcc

SEQ ID NO: 271301 - DNA, 25 bp, Mus musculus
ctcttgccatgctggccgaggcggc

SEQ ID NO: 271302 - DNA, 25 bp, Mus musculus
ctcttgccatgcttccaccactgcc

SEQ ID NO: 271303 - DNA, 25 bp, Mus musculus
ctcttgcccgctggacagttgctgt

SEQ ID NO: 271304 - DNA, 25 bp, Mus musculus
ctcttgcctcagtgacatcaggctg

SEQ ID NO: 271305 - DNA, 25 bp, Mus musculus
ctcttgcctgctagcagccacatag

SEQ ID NO: 271306 - DNA, 25 bp, Mus musculus
ctcttgcctggacctcctcccatct

SEQ ID NO: 271307 - DNA, 25 bp, Mus musculus
ctcttgctaatgaagcaagtgtgga

SEQ ID NO: 271308 - DNA, 25 bp, Mus musculus
ctcttgctcagccacagaacatcca

SEQ ID NO: 271309 - DNA, 25 bp, Mus musculus
ctcttgctcagggtcctcttaaaag

SEQ ID NO: 271310 - DNA, 25 bp, Mus musculus
ctcttggaagaggccctgggcttct

SEQ ID NO: 271311 - DNA, 25 bp, Mus musculus
ctcttggacagcaagggccatgtga

SEQ ID NO: 271312 - DNA, 25 bp, Mus musculus
ctcttggactgccagggtcacgtgg

SEQ ID NO: 271313 - DNA, 25 bp, Mus musculus
ctcttggactgccagtacttggctc

SEQ ID NO: 271314 - DNA, 25 bp, Mus musculus
ctcttggaggctgcaaaagacattt

SEQ ID NO: 271315 - DNA, 25 bp, Mus musculus
ctcttggccaacaagagtcctcgtt

SEQ ID NO: 271316 - DNA, 25 bp, Mus musculus
ctcttggccaacaagagtgatctgt

SEQ ID NO: 271317 - DNA, 25 bp, Mus musculus
ctcttggccactgatagtgcctttg

SEQ ID NO: 271318 - DNA, 25 bp, Mus musculus
ctcttggcgcgatgaggaaactgag

SEQ ID NO: 271319 - DNA, 25 bp, Mus musculus
ctcttggctcagaaatcctacgaac

SEQ ID NO: 271320 - DNA, 25 bp, Mus musculus
ctcttgggaataggccctttggaga

SEQ ID NO: 271321 - DNA, 25 bp, Mus musculus
ctcttgggagagcgcattaaagagg

SEQ ID NO: 271322 - DNA, 25 bp, Mus musculus
ctcttgggccagagagctgggtttg

SEQ ID NO: 271323 - DNA, 25 bp, Mus musculus
ctcttgggtgacaattggtgcgacc

SEQ ID NO: 271324 - DNA, 25 bp, Mus musculus
ctcttgggttcaagatcttggcaac

SEQ ID NO: 271325 - DNA, 25 bp, Mus musculus
ctcttggtccttgaggatttcaaac

SEQ ID NO: 271326 - DNA, 25 bp, Mus musculus
ctcttggtccttgttccaccctcca

SEQ ID NO: 271327 - DNA, 25 bp, Mus musculus
ctcttggtgacaaggtgaattccct

SEQ ID NO: 271328 - DNA, 25 bp, Mus musculus
ctcttggtgcagggtttgtggtagt

SEQ ID NO: 271329 - DNA, 25 bp, Mus musculus
ctcttggtgtggacacttcccgagt

SEQ ID NO: 271330 - DNA, 25 bp, Mus musculus
ctcttggtgtgggacgcccctaaag

SEQ ID NO: 271331 - DNA, 25 bp, Mus musculus
ctcttgtaaagtaccagtgctgtgg

SEQ ID NO: 271332 - DNA, 25 bp, Mus musculus
ctcttgtaaagttacaagcccaaac

SEQ ID NO: 271333 - DNA, 25 bp, Mus musculus
ctcttgtaccagagaactgaaaagc

SEQ ID NO: 271334 - DNA, 25 bp, Mus musculus
ctcttgtcacaggtggtgagattgc

SEQ ID NO: 271335 - DNA, 25 bp, Mus musculus
ctcttgtcccccacgtgccccgagc

SEQ ID NO: 271336 - DNA, 25 bp, Mus musculus
ctcttgtcgtgacctctaaatgtgg

SEQ ID NO: 271337 - DNA, 25 bp, Mus musculus
ctcttgtctggggcttcaatggggg

SEQ ID NO: 271338 - DNA, 25 bp, Mus musculus
ctcttgtggaagtgcggcttcttca

SEQ ID NO: 271339 - DNA, 25 bp, Mus musculus
ctcttgtggaagtgtgacttcttta

SEQ ID NO: 271340 - DNA, 25 bp, Mus musculus
ctcttgtggatggcttcaagccagg

SEQ ID NO: 271341 - DNA, 25 bp, Mus musculus
ctcttgtgtatatgctgtagaaaac

SEQ ID NO: 271342 - DNA, 25 bp, Mus musculus
ctcttgttacacaggttacaaccct

SEQ ID NO: 271343 - DNA, 25 bp, Mus musculus
ctcttgttaggttcacctggagaaa

SEQ ID NO: 271344 - DNA, 25 bp, Mus musculus
ctcttgttgcccagctggcattttt

SEQ ID NO: 271345 - DNA, 25 bp, Mus musculus
ctcttgtttgccagaatggaggata

SEQ ID NO: 271346 - DNA, 25 bp, Mus musculus
ctcttgttttacagatggctcattg

SEQ ID NO: 271347 - DNA, 25 bp, Mus musculus
ctcttgttttacaggtgtgtgtggt

SEQ ID NO: 271348 - DNA, 25 bp, Mus musculus
ctctttaaagatactatcgtggagc

SEQ ID NO: 271349 - DNA, 25 bp, Mus musculus
ctctttaaaggattggtgaccaggc

SEQ ID NO: 271350 - DNA, 25 bp, Mus musculus
ctctttaagaagtttgatgaaggcc

SEQ ID NO: 271351 - DNA, 25 bp, Mus musculus
ctctttaatgatccggaccttcgag

SEQ ID NO: 271352 - DNA, 25 bp, Mus musculus
ctctttacagcaaatgcaacaaatg

SEQ ID NO: 271353 - DNA, 25 bp, Mus musculus
ctctttacagcaagccttttctgat

SEQ ID NO: 271354 - DNA, 25 bp, Mus musculus
ctctttaccaaggagctggagaagg

SEQ ID NO: 271355 - DNA, 25 bp, Mus musculus
ctctttaccagtaaccaggtgactg

SEQ ID NO: 271356 - DNA, 25 bp, Mus musculus
ctctttacctacaactgctgcttgt

SEQ ID NO: 271357 - DNA, 25 bp, Mus musculus
ctctttactctcagatagcctttca

SEQ ID NO: 271358 - DNA, 25 bp, Mus musculus
ctctttagcaactggagcactaaag

SEQ ID NO: 271359 - DNA, 25 bp, Mus musculus
ctctttaggcacaaggatactgaga

SEQ ID NO: 271360 - DNA, 25 bp, Mus musculus
ctctttagtcccgatcatccaggtt

SEQ ID NO: 271361 - DNA, 25 bp, Mus musculus
ctctttataaaaatctgctgtatct

SEQ ID NO: 271362 - DNA, 25 bp, Mus musculus
ctctttattaccaagatgaaccccc

SEQ ID NO: 271363 - DNA, 25 bp, Mus musculus
ctctttattaccaagcataccacaa

SEQ ID NO: 271364 - DNA, 25 bp, Mus musculus
ctctttattaccaaggtgctatatc

SEQ ID NO: 271365 - DNA, 25 bp, Mus musculus
ctctttattcagaagtaccgggctt

SEQ ID NO: 271366 - DNA, 25 bp, Mus musculus
ctctttattctgtcaaccacagaag

SEQ ID NO: 271367 - DNA, 25 bp, Mus musculus
ctctttcaagccgtaattgctggct

SEQ ID NO: 271368 - DNA, 25 bp, Mus musculus
ctctttcaagcctggagacgtaata

SEQ ID NO: 271369 - DNA, 25 bp, Mus musculus
ctctttcaaggctggagacgtaata

SEQ ID NO: 271370 - DNA, 25 bp, Mus musculus
ctctttcagatgagggaaagcactg

SEQ ID NO: 271371 - DNA, 25 bp, Mus musculus
ctctttcagggagacatagcctctc

SEQ ID NO: 271372 - DNA, 25 bp, Mus musculus
ctctttcatctcagatgtggtgaac

SEQ ID NO: 271373 - DNA, 25 bp, Mus musculus
ctctttccgggtgaacagagagatc

SEQ ID NO: 271374 - DNA, 25 bp, Mus musculus
ctctttcctatggatttggccatgg

SEQ ID NO: 271375 - DNA, 25 bp, Mus musculus
ctctttcctcgttgtttttgttttg

SEQ ID NO: 271376 - DNA, 25 bp, Mus musculus
ctctttcctctctgacttcctcttt

SEQ ID NO: 271377 - DNA, 25 bp, Mus musculus
ctctttctgagacaccccctgtttg

SEQ ID NO: 271378 - DNA, 25 bp, Mus musculus
ctctttcttctggaaccagctattg

SEQ ID NO: 271379 - DNA, 25 bp, Mus musculus
ctctttcttgaccggatccgctccc

SEQ ID NO: 271380 - DNA, 25 bp, Mus musculus
ctctttcttgaccgggcttctcaga

SEQ ID NO: 271381 - DNA, 25 bp, Mus musculus
ctctttgaaagaagcagttccgagg

SEQ ID NO: 271382 - DNA, 25 bp, Mus musculus
ctctttgacactctcgtgggcgcct

SEQ ID NO: 271383 - DNA, 25 bp, Mus musculus
ctctttgacacttttctcaacagac

SEQ ID NO: 271384 - DNA, 25 bp, Mus musculus
ctctttgactccagctattcacgga

SEQ ID NO: 271385 - DNA, 25 bp, Mus musculus
ctctttgagcataggtcctgatcac

SEQ ID NO: 271386 - DNA, 25 bp, Mus musculus
ctctttgaggacctttactctttga

SEQ ID NO: 271387 - DNA, 25 bp, Mus musculus
ctctttgattccagctactcccgaa

SEQ ID NO: 271388 - DNA, 25 bp, Mus musculus
ctctttgcaaataccggtcaactat

SEQ ID NO: 271389 - DNA, 25 bp, Mus musculus
ctctttgcagatcttgatatggaag

SEQ ID NO: 271390 - DNA, 25 bp, Mus musculus
ctctttgcaggcttcctccccagga

SEQ ID NO: 271391 - DNA, 25 bp, Mus musculus
ctctttgccctcaggcaccgaataa

SEQ ID NO: 271392 - DNA, 25 bp, Mus musculus
ctctttgctgcgattatttgattct

SEQ ID NO: 271393 - DNA, 25 bp, Mus musculus
ctctttgctgcggcttcatagagcc

SEQ ID NO: 271394 - DNA, 25 bp, Mus musculus
ctctttgcttgaatgggcctgtgtt

SEQ ID NO: 271395 - DNA, 25 bp, Mus musculus
ctctttggacagagccagtatacag

SEQ ID NO: 271396 - DNA, 25 bp, Mus musculus
ctctttggcagatcagtaatggaac

SEQ ID NO: 271397 - DNA, 25 bp, Mus musculus
ctctttgggcacaggaaagccatca

SEQ ID NO: 271398 - DNA, 25 bp, Mus musculus
ctctttgtagggactacaagaaata

SEQ ID NO: 271399 - DNA, 25 bp, Mus musculus
ctctttgtcactgagaaacgtctca

SEQ ID NO: 271400 - DNA, 25 bp, Mus musculus
ctctttgtcactgagctcctgcttc

SEQ ID NO: 271401 - DNA, 25 bp, Mus musculus
ctctttgtcaggtaagaatgattga

SEQ ID NO: 271402 - DNA, 25 bp, Mus musculus
ctctttgtcctaagattagcctcac

SEQ ID NO: 271403 - DNA, 25 bp, Mus musculus
ctctttgtctgctccctggtggttc

SEQ ID NO: 271404 - DNA, 25 bp, Mus musculus
ctctttgtcttcttgtctggggagg

SEQ ID NO: 271405 - DNA, 25 bp, Mus musculus
ctctttgttcgaataaatgctgctc

SEQ ID NO: 271406 - DNA, 25 bp, Mus musculus
ctcttttagaaagggggagctggtg

SEQ ID NO: 271407 - DNA, 25 bp, Mus musculus
ctcttttatgagtttgaaggaagga

SEQ ID NO: 271408 - DNA, 25 bp, Mus musculus
ctcttttcagaccaatacccacagg

SEQ ID NO: 271409 - DNA, 25 bp, Mus musculus
ctcttttccaggcatggtttattga

SEQ ID NO: 271410 - DNA, 25 bp, Mus musculus
ctcttttccaggtggttttcctggg

SEQ ID NO: 271411 - DNA, 25 bp, Mus musculus
ctcttttcctgaaagctttggatag

SEQ ID NO: 271412 - DNA, 25 bp, Mus musculus
ctcttttcctgaaagttaaatcgga

SEQ ID NO: 271413 - DNA, 25 bp, Mus musculus
ctcttttctcagagcaacacgtttt

SEQ ID NO: 271414 - DNA, 25 bp, Mus musculus
ctcttttctggacaagatggcaacc

SEQ ID NO: 271415 - DNA, 25 bp, Mus musculus
ctcttttgagcaaaggagaagcgct

SEQ ID NO: 271416 - DNA, 25 bp, Mus musculus
ctcttttgctatgctcagcacattg

SEQ ID NO: 271417 - DNA, 25 bp, Mus musculus
ctcttttggactgggttttgccagg

SEQ ID NO: 271418 - DNA, 25 bp, Mus musculus
ctctttttagtctctggaagactga

SEQ ID NO: 271419 - DNA, 25 bp, Mus musculus
ctctttttccagcagttggaattga

SEQ ID NO: 271420 - DNA, 25 bp, Mus musculus
ctctttttctcgaaagaaggatttc

SEQ ID NO: 271421 - DNA, 25 bp, Mus musculus
ctcttttttgagattgagctccttg

SEQ ID NO: 271422 - DNA, 25 bp, Mus musculus
ctcttttttgctggatagagagagt

SEQ ID NO: 271423 - DNA, 25 bp, Mus musculus
ctgaaaaaaggctgtgacctctctt

SEQ ID NO: 271424 - DNA, 25 bp, Mus musculus
ctgaaaaactacaaaatccacaggt

SEQ ID NO: 271425 - DNA, 25 bp, Mus musculus
ctgaaaaactacagaagttaaatga

SEQ ID NO: 271426 - DNA, 25 bp, Mus musculus
ctgaaaaagacaagatctccctagg

SEQ ID NO: 271427 - DNA, 25 bp, Mus musculus
ctgaaaaagagctgcatgagaaatt

SEQ ID NO: 271428 - DNA, 25 bp, Mus musculus
ctgaaaaaggacggctcctctaacc

SEQ ID NO: 271429 - DNA, 25 bp, Mus musculus
ctgaaaaatagtcacaaagcactta

SEQ ID NO: 271430 - DNA, 25 bp, Mus musculus
ctgaaaaatcaagaaatgtgcctgt

SEQ ID NO: 271431 - DNA, 25 bp, Mus musculus
ctgaaaaatcaagttgtcactcagc

SEQ ID NO: 271432 - DNA, 25 bp, Mus musculus
ctgaaaaatcgggttctgcctgtgc

SEQ ID NO: 271433 - DNA, 25 bp, Mus musculus
ctgaaaaatgagttcattgagaagc

SEQ ID NO: 271434 - DNA, 25 bp, Mus musculus
ctgaaaaatgggagattatgtttaa

SEQ ID NO: 271435 - DNA, 25 bp, Mus musculus
ctgaaaaatgggatgggttggagca

SEQ ID NO: 271436 - DNA, 25 bp, Mus musculus
ctgaaaacaaacgatacaaggaggc

SEQ ID NO: 271437 - DNA, 25 bp, Mus musculus
ctgaaaacaaacggtcctgctgtct

SEQ ID NO: 271438 - DNA, 25 bp, Mus musculus
ctgaaaacaaccaggtattgaccaa

SEQ ID NO: 271439 - DNA, 25 bp, Mus musculus
ctgaaaacatacatgttgccaggat

SEQ ID NO: 271440 - DNA, 25 bp, Mus musculus
ctgaaaacatgggtacaggaccctg

SEQ ID NO: 271441 - DNA, 25 bp, Mus musculus
ctgaaaacattcaaggtgtcaactc

SEQ ID NO: 271442 - DNA, 25 bp, Mus musculus
ctgaaaacctcggctctctgctccc

SEQ ID NO: 271443 - DNA, 25 bp, Mus musculus
ctgaaaagaagatccagccgcagcc

SEQ ID NO: 271444 - DNA, 25 bp, Mus musculus
ctgaaaagagattcatctgtttgta

SEQ ID NO: 271445 - DNA, 25 bp, Mus musculus
ctgaaaagagatttcgatagtgact

SEQ ID NO: 271446 - DNA, 25 bp, Mus musculus
ctgaaaaggggacacattttagttt

SEQ ID NO: 271447 - DNA, 25 bp, Mus musculus
ctgaaaataaaggtgcctcgtctcc

SEQ ID NO: 271448 - DNA, 25 bp, Mus musculus
ctgaaaatgaagagataggcgctca

SEQ ID NO: 271449 - DNA, 25 bp, Mus musculus
ctgaaaatttggaggcagcaccggc

SEQ ID NO: 271450 - DNA, 25 bp, Mus musculus
ctgaaacaccaggaacgggagcgaa

SEQ ID NO: 271451 - DNA, 25 bp, Mus musculus
ctgaaacaccaggagttggagaggc

SEQ ID NO: 271452 - DNA, 25 bp, Mus musculus
ctgaaacagatgctgaccttaagag

SEQ ID NO: 271453 - DNA, 25 bp, Mus musculus
ctgaaacataatcacagaactgtgt

SEQ ID NO: 271454 - DNA, 25 bp, Mus musculus
ctgaaacatgaccaggccatgtgaa

SEQ ID NO: 271455 - DNA, 25 bp, Mus musculus
ctgaaacatgactttctgggacaag

SEQ ID NO: 271456 - DNA, 25 bp, Mus musculus
ctgaaacatggtggtaagagaagct

SEQ ID NO: 271457 - DNA, 25 bp, Mus musculus
ctgaaacattttaacagtgatgtca

SEQ ID NO: 271458 - DNA, 25 bp, Mus musculus
ctgaaaccaaggctggtctgctcag

SEQ ID NO: 271459 - DNA, 25 bp, Mus musculus
ctgaaaccacagaggaagcattctc

SEQ ID NO: 271460 - DNA, 25 bp, Mus musculus
ctgaaaccacagcattctcatcttc

SEQ ID NO: 271461 - DNA, 25 bp, Mus musculus
ctgaaaccacagctctagccaagag

SEQ ID NO: 271462 - DNA, 25 bp, Mus musculus
ctgaaaccagagtccagcttggtac

SEQ ID NO: 271463 - DNA, 25 bp, Mus musculus
ctgaaaccaggagattggccggtac

SEQ ID NO: 271464 - DNA, 25 bp, Mus musculus
ctgaaaccaggttccacagcactgg

SEQ ID NO: 271465 - DNA, 25 bp, Mus musculus
ctgaaaccatcgatagtgtccggat

SEQ ID NO: 271466 - DNA, 25 bp, Mus musculus
ctgaaaccattaagttcgagaagct

SEQ ID NO: 271467 - DNA, 25 bp, Mus musculus
ctgaaacccacagcatggtgagaca

SEQ ID NO: 271468 - DNA, 25 bp, Mus musculus
ctgaaacccagatccttactgactg

SEQ ID NO: 271469 - DNA, 25 bp, Mus musculus
ctgaaacccgctgtacgctggattt

SEQ ID NO: 271470 - DNA, 25 bp, Mus musculus
ctgaaacccggtagtgcaacttcag

SEQ ID NO: 271471 - DNA, 25 bp, Mus musculus
ctgaaaccgatcccagctctaccgc

SEQ ID NO: 271472 - DNA, 25 bp, Mus musculus
ctgaaactaagccgcccagccacca

SEQ ID NO: 271473 - DNA, 25 bp, Mus musculus
ctgaaactagctgggatactaacaa

SEQ ID NO: 271474 - DNA, 25 bp, Mus musculus
ctgaaactcaagcacgtgttctttg

SEQ ID NO: 271475 - DNA, 25 bp, Mus musculus
ctgaaactcaagcaggtgttctttg

SEQ ID NO: 271476 - DNA, 25 bp, Mus musculus
ctgaaactcaggtggtgctgatcaa

SEQ ID NO: 271477 - DNA, 25 bp, Mus musculus
ctgaaactcaggttatgaggtgacg

SEQ ID NO: 271478 - DNA, 25 bp, Mus musculus
ctgaaactctacaagcacttgcaga

SEQ ID NO: 271479 - DNA, 25 bp, Mus musculus
ctgaaactgaaggctggcaacatgg

SEQ ID NO: 271480 - DNA, 25 bp, Mus musculus
ctgaaactgcaggtcacggaagcgt

SEQ ID NO: 271481 - DNA, 25 bp, Mus musculus
ctgaaactgcagtggactgagttta

SEQ ID NO: 271482 - DNA, 25 bp, Mus musculus
ctgaaactgtagcttctttgttaca

SEQ ID NO: 271483 - DNA, 25 bp, Mus musculus
ctgaaagagaggaagcatcaacacc

SEQ ID NO: 271484 - DNA, 25 bp, Mus musculus
ctgaaagagaggaagtaaaactcaa

SEQ ID NO: 271485 - DNA, 25 bp, Mus musculus
ctgaaagagatgaaggactcgctgg

SEQ ID NO: 271486 - DNA, 25 bp, Mus musculus
ctgaaagaggatatcaagttcattg

SEQ ID NO: 271487 - DNA, 25 bp, Mus musculus
ctgaaagatagtaacaggagactga

SEQ ID NO: 271488 - DNA, 25 bp, Mus musculus
ctgaaagatattaccaggagactga

SEQ ID NO: 271489 - DNA, 25 bp, Mus musculus
ctgaaagatcaatgggcagcagcaa

SEQ ID NO: 271490 - DNA, 25 bp, Mus musculus
ctgaaagcagaacctggtccacgtg

SEQ ID NO: 271491 - DNA, 25 bp, Mus musculus
ctgaaagcagggtgtggacaggcca

SEQ ID NO: 271492 - DNA, 25 bp, Mus musculus
ctgaaagcaggtctgggtattggat

SEQ ID NO: 271493 - DNA, 25 bp, Mus musculus
ctgaaagcatccagtttgtgctcga

SEQ ID NO: 271494 - DNA, 25 bp, Mus musculus
ctgaaagcccaagtggccgcacgag

SEQ ID NO: 271495 - DNA, 25 bp, Mus musculus
ctgaaagcctcctaggcacccgagg

SEQ ID NO: 271496 - DNA, 25 bp, Mus musculus
ctgaaagctgtcctctattgtatgg

SEQ ID NO: 271497 - DNA, 25 bp, Mus musculus
ctgaaagctgttttaaaggacacct

SEQ ID NO: 271498 - DNA, 25 bp, Mus musculus
ctgaaagcttatttggtatgctaac

SEQ ID NO: 271499 - DNA, 25 bp, Mus musculus
ctgaaaggaagtcagagaagcttca

SEQ ID NO: 271500 - DNA, 25 bp, Mus musculus
ctgaaaggagagaaaacggtgtatt

SEQ ID NO: 271501 - DNA, 25 bp, Mus musculus
ctgaaaggagagaaaagcatctgtc

SEQ ID NO: 271502 - DNA, 25 bp, Mus musculus
ctgaaaggagagaaagatcagccac

SEQ ID NO: 271503 - DNA, 25 bp, Mus musculus
ctgaaaggagatgagtccccggcat

SEQ ID NO: 271504 - DNA, 25 bp, Mus musculus
ctgaaaggcaaaggtcagtgtcctg

SEQ ID NO: 271505 - DNA, 25 bp, Mus musculus
ctgaaagtacttgaaaactggtggt

SEQ ID NO: 271506 - DNA, 25 bp, Mus musculus
ctgaaagtcaaaaggtctccagatg

SEQ ID NO: 271507 - DNA, 25 bp, Mus musculus
ctgaaagtgaaacactagaccagct

SEQ ID NO: 271508 - DNA, 25 bp, Mus musculus
ctgaaagtgaaaccagaggaggagt

SEQ ID NO: 271509 - DNA, 25 bp, Mus musculus
ctgaaagtgacagagaaagtgatct

SEQ ID NO: 271510 - DNA, 25 bp, Mus musculus
ctgaaagtgacagagagtcagtggg

SEQ ID NO: 271511 - DNA, 25 bp, Mus musculus
ctgaaatacgattcagatggttacg

SEQ ID NO: 271512 - DNA, 25 bp, Mus musculus
ctgaaatactaggttgcaggaatcc

SEQ ID NO: 271513 - DNA, 25 bp, Mus musculus
ctgaaatcaaccaagctgctcttct

SEQ ID NO: 271514 - DNA, 25 bp, Mus musculus
ctgaaatctaccagaacaatctgga

SEQ ID NO: 271515 - DNA, 25 bp, Mus musculus
ctgaaatctaccagttgagaaatgt

SEQ ID NO: 271516 - DNA, 25 bp, Mus musculus
ctgaaatctgtaacggaaggtgcat

SEQ ID NO: 271517 - DNA, 25 bp, Mus musculus
ctgaaatggacgtatgttccatcaa

SEQ ID NO: 271518 - DNA, 25 bp, Mus musculus
ctgaaatgtgagctcactctgcaga

SEQ ID NO: 271519 - DNA, 25 bp, Mus musculus
ctgaaattacggccgagatccagtc

SEQ ID NO: 271520 - DNA, 25 bp, Mus musculus
ctgaaattagatggcttccctttcc

SEQ ID NO: 271521 - DNA, 25 bp, Mus musculus
ctgaaattatatcattggatacttt

SEQ ID NO: 271522 - DNA, 25 bp, Mus musculus
ctgaaattccacaagctgatcaacg

SEQ ID NO: 271523 - DNA, 25 bp, Mus musculus
ctgaaattcctcaaggagtcacctg

SEQ ID NO: 271524 - DNA, 25 bp, Mus musculus
ctgaaattcctcaaggcacttaggc

SEQ ID NO: 271525 - DNA, 25 bp, Mus musculus
ctgaaattcctcaagggggaggata

SEQ ID NO: 271526 - DNA, 25 bp, Mus musculus
ctgaacaaccaactgggcagcaact

SEQ ID NO: 271527 - DNA, 25 bp, Mus musculus
ctgaacaaccaggagccctacacag

SEQ ID NO: 271528 - DNA, 25 bp, Mus musculus
ctgaacaagaagatctaccgcattg

SEQ ID NO: 271529 - DNA, 25 bp, Mus musculus
ctgaacaatgcaagaaaacgaagtc

SEQ ID NO: 271530 - DNA, 25 bp, Mus musculus
ctgaacacaatcaagcccccactgt

SEQ ID NO: 271531 - DNA, 25 bp, Mus musculus
ctgaacacaatcaaggcacttcgga

SEQ ID NO: 271532 - DNA, 25 bp, Mus musculus
ctgaacacaatcaaggtccacagga

SEQ ID NO: 271533 - DNA, 25 bp, Mus musculus
ctgaacaccttgcagaacattccag

SEQ ID NO: 271534 - DNA, 25 bp, Mus musculus
ctgaacaccttgcatcccacgagtc

SEQ ID NO: 271535 - DNA, 25 bp, Mus musculus
ctgaacactgaggggttcctggact

SEQ ID NO: 271536 - DNA, 25 bp, Mus musculus
ctgaacagaaaggtcaaatcattaa

SEQ ID NO: 271537 - DNA, 25 bp, Mus musculus
ctgaacagagacactcctgaggaaa

SEQ ID NO: 271538 - DNA, 25 bp, Mus musculus
ctgaacagagagcagatcttgagtg

SEQ ID NO: 271539 - DNA, 25 bp, Mus musculus
ctgaacagagatgatgattctgatg

SEQ ID NO: 271540 - DNA, 25 bp, Mus musculus
ctgaacagcagctcccgttacttcc

SEQ ID NO: 271541 - DNA, 25 bp, Mus musculus
ctgaacagcaggtcccaggatttat

SEQ ID NO: 271542 - DNA, 25 bp, Mus musculus
ctgaacaggaacatagcggcggagc

SEQ ID NO: 271543 - DNA, 25 bp, Mus musculus
ctgaacagtgccatatgagaacatg

SEQ ID NO: 271544 - DNA, 25 bp, Mus musculus
ctgaacagtgccgcaacataacatg

SEQ ID NO: 271545 - DNA, 25 bp, Mus musculus
ctgaacatcaacggttctcccatgg

SEQ ID NO: 271546 - DNA, 25 bp, Mus musculus
ctgaacatgatgaagaatagaattg

SEQ ID NO: 271547 - DNA, 25 bp, Mus musculus
ctgaacatgatgatgaacttgttcc

SEQ ID NO: 271548 - DNA, 25 bp, Mus musculus
ctgaacatggaaaagaaaatagata

SEQ ID NO: 271549 - DNA, 25 bp, Mus musculus
ctgaacatggaaaagatatcaccag

SEQ ID NO: 271550 - DNA, 25 bp, Mus musculus
ctgaacattacaagaagacgctgca

SEQ ID NO: 271551 - DNA, 25 bp, Mus musculus
ctgaacattacaaggtgggagaggg

SEQ ID NO: 271552 - DNA, 25 bp, Mus musculus
ctgaacattataagattccccccct

SEQ ID NO: 271553 - DNA, 25 bp, Mus musculus
ctgaacattccaccatgccagcagc

SEQ ID NO: 271554 - DNA, 25 bp, Mus musculus
ctgaaccacaggaattcaaacccat

SEQ ID NO: 271555 - DNA, 25 bp, Mus musculus
ctgaaccacaggatgtgaactactt

SEQ ID NO: 271556 - DNA, 25 bp, Mus musculus
ctgaaccactgcaggatttctggca

SEQ ID NO: 271557 - DNA, 25 bp, Mus musculus
ctgaaccagctcaaaggcaaatcaa

SEQ ID NO: 271558 - DNA, 25 bp, Mus musculus
ctgaaccagctcgaaaaaacaatgg

SEQ ID NO: 271559 - DNA, 25 bp, Mus musculus
ctgaaccaggccgcgttgtctgtct

SEQ ID NO: 271560 - DNA, 25 bp, Mus musculus
ctgaacccagcatgagtccgcagag

SEQ ID NO: 271561 - DNA, 25 bp, Mus musculus
ctgaaccctggcggaggctgctgaa

SEQ ID NO: 271562 - DNA, 25 bp, Mus musculus
ctgaaccgagcctgttcctgcgccc

SEQ ID NO: 271563 - DNA, 25 bp, Mus musculus
ctgaaccgcatccaggtcttggata

SEQ ID NO: 271564 - DNA, 25 bp, Mus musculus
ctgaaccgcatccaggttaaacgct

SEQ ID NO: 271565 - DNA, 25 bp, Mus musculus
ctgaaccgctggttgggtgaacagt

SEQ ID NO: 271566 - DNA, 25 bp, Mus musculus
ctgaacctaaggctgctgactttcc

SEQ ID NO: 271567 - DNA, 25 bp, Mus musculus
ctgaacctattttggaagagcagtc

SEQ ID NO: 271568 - DNA, 25 bp, Mus musculus
ctgaacctattttggttgataatcc

SEQ ID NO: 271569 - DNA, 25 bp, Mus musculus
ctgaaccttgagaggcttatacccc

SEQ ID NO: 271570 - DNA, 25 bp, Mus musculus
ctgaaccttggcatgaataggttga

SEQ ID NO: 271571 - DNA, 25 bp, Mus musculus
ctgaaccttgggtggcttgtccctt

SEQ ID NO: 271572 - DNA, 25 bp, Mus musculus
ctgaacgctgagatcatctttctga

SEQ ID NO: 271573 - DNA, 25 bp, Mus musculus
ctgaacgggagacaggtacttgtgg

SEQ ID NO: 271574 - DNA, 25 bp, Mus musculus
ctgaactaagacagaaagacatggc

SEQ ID NO: 271575 - DNA, 25 bp, Mus musculus
ctgaactatttccagcactggccag

SEQ ID NO: 271576 - DNA, 25 bp, Mus musculus
ctgaactcaacatggcaaggcactg

SEQ ID NO: 271577 - DNA, 25 bp, Mus musculus
ctgaactcaagttcacgcaaagaat

SEQ ID NO: 271578 - DNA, 25 bp, Mus musculus
ctgaactcagactactcgctgctgc

SEQ ID NO: 271579 - DNA, 25 bp, Mus musculus
ctgaactcgcaggcaccttttgtgt

SEQ ID NO: 271580 - DNA, 25 bp, Mus musculus
ctgaactcgcaggttctggctggac

SEQ ID NO: 271581 - DNA, 25 bp, Mus musculus
ctgaactctatcatattgcagcacc

SEQ ID NO: 271582 - DNA, 25 bp, Mus musculus
ctgaactctattcagctcccatttt

SEQ ID NO: 271583 - DNA, 25 bp, Mus musculus
ctgaactctcagacacatgcctgga

SEQ ID NO: 271584 - DNA, 25 bp, Mus musculus
ctgaactctcaggaaacccaaggaa

SEQ ID NO: 271585 - DNA, 25 bp, Mus musculus
ctgaactctcatcaggtgaaaacat

SEQ ID NO: 271586 - DNA, 25 bp, Mus musculus
ctgaactctcatcagttcttaccca

SEQ ID NO: 271587 - DNA, 25 bp, Mus musculus
ctgaactgcacagaggggctcttta

SEQ ID NO: 271588 - DNA, 25 bp, Mus musculus
ctgaactggacaggtacctctaagt

SEQ ID NO: 271589 - DNA, 25 bp, Mus musculus
ctgaactggcagaacagctgatttt

SEQ ID NO: 271590 - DNA, 25 bp, Mus musculus
ctgaactgtttgatcacattccagc

SEQ ID NO: 271591 - DNA, 25 bp, Mus musculus
ctgaacttggatcctttctctatct

SEQ ID NO: 271592 - DNA, 25 bp, Mus musculus
ctgaagaaaaggccttggcaattaa

SEQ ID NO: 271593 - DNA, 25 bp, Mus musculus
ctgaagaaaagtactctcaaaaaga

SEQ ID NO: 271594 - DNA, 25 bp, Mus musculus
ctgaagaaaggaactgtcgtccatc

SEQ ID NO: 271595 - DNA, 25 bp, Mus musculus
ctgaagaaagtggtatcccgccact

SEQ ID NO: 271596 - DNA, 25 bp, Mus musculus
ctgaagaaatgcaaacccagccata

SEQ ID NO: 271597 - DNA, 25 bp, Mus musculus
ctgaagaacaaggcagctgcaggaa

SEQ ID NO: 271598 - DNA, 25 bp, Mus musculus
ctgaagaacatgatgcaaggagacg

SEQ ID NO: 271599 - DNA, 25 bp, Mus musculus
ctgaagaacatggactggaaagtta

SEQ ID NO: 271600 - DNA, 25 bp, Mus musculus
ctgaagaaccaagcaatgtcttcaa

SEQ ID NO: 271601 - DNA, 25 bp, Mus musculus
ctgaagaacgggtatggctttgtgg

SEQ ID NO: 271602 - DNA, 25 bp, Mus musculus
ctgaagaacggtatcactgaggaga

SEQ ID NO: 271603 - DNA, 25 bp, Mus musculus
ctgaagaacggtctgttatgttctg

SEQ ID NO: 271604 - DNA, 25 bp, Mus musculus
ctgaagaagaaaaagggtgatcctg

SEQ ID NO: 271605 - DNA, 25 bp, Mus musculus
ctgaagaagaagcagcaacagttgg

SEQ ID NO: 271606 - DNA, 25 bp, Mus musculus
ctgaagaagagagggactcaaagct

SEQ ID NO: 271607 - DNA, 25 bp, Mus musculus
ctgaagaagagcagtttccggaggt

SEQ ID NO: 271608 - DNA, 25 bp, Mus musculus
ctgaagaagaggtcacgaaagaagg

SEQ ID NO: 271609 - DNA, 25 bp, Mus musculus
ctgaagaagatgactttgaaaaagc

SEQ ID NO: 271610 - DNA, 25 bp, Mus musculus
ctgaagaagatggatgcagattcct

SEQ ID NO: 271611 - DNA, 25 bp, Mus musculus
ctgaagaagatggattatgacaatg

SEQ ID NO: 271612 - DNA, 25 bp, Mus musculus
ctgaagaagatgggcctgacggagg

SEQ ID NO: 271613 - DNA, 25 bp, Mus musculus
ctgaagaagcaatatggtattcatg

SEQ ID NO: 271614 - DNA, 25 bp, Mus musculus
ctgaagaagcaatgaactcccaggc

SEQ ID NO: 271615 - DNA, 25 bp, Mus musculus
ctgaagaatgcaccaccaaaaaagg

SEQ ID NO: 271616 - DNA, 25 bp, Mus musculus
ctgaagaattccaaatagcatagct

SEQ ID NO: 271617 - DNA, 25 bp, Mus musculus
ctgaagaattccaaatgcttacttt

SEQ ID NO: 271618 - DNA, 25 bp, Mus musculus
ctgaagacacaggggctccttattg

SEQ ID NO: 271619 - DNA, 25 bp, Mus musculus
ctgaagacagcccaggacccaggca

SEQ ID NO: 271620 - DNA, 25 bp, Mus musculus
ctgaagacatagggaatctgtcctt

SEQ ID NO: 271621 - DNA, 25 bp, Mus musculus
ctgaagacccagaggacacaaagat

SEQ ID NO: 271622 - DNA, 25 bp, Mus musculus
ctgaagacccagaggaggaagagtt

SEQ ID NO: 271623 - DNA, 25 bp, Mus musculus
ctgaagaccccactcagagatgctg

SEQ ID NO: 271624 - DNA, 25 bp, Mus musculus
ctgaagaccccactgactcatccca

SEQ ID NO: 271625 - DNA, 25 bp, Mus musculus
ctgaagacccctatacaaccagtgc

SEQ ID NO: 271626 - DNA, 25 bp, Mus musculus
ctgaagaccctcacctccacgccct

SEQ ID NO: 271627 - DNA, 25 bp, Mus musculus
ctgaagacctcccataacacgacaa

SEQ ID NO: 271628 - DNA, 25 bp, Mus musculus
ctgaagacgagttggtgtcagaatt

SEQ ID NO: 271629 - DNA, 25 bp, Mus musculus
ctgaagacgagttttcgtttctctg

SEQ ID NO: 271630 - DNA, 25 bp, Mus musculus
ctgaagactatcaccttaaccaacc

SEQ ID NO: 271631 - DNA, 25 bp, Mus musculus
ctgaagacttggagcactttgagga

SEQ ID NO: 271632 - DNA, 25 bp, Mus musculus
ctgaagactttagtcctgcactaga

SEQ ID NO: 271633 - DNA, 25 bp, Mus musculus
ctgaagagaagccttccagcaccca

SEQ ID NO: 271634 - DNA, 25 bp, Mus musculus
ctgaagagacttggttgaaaggcca

SEQ ID NO: 271635 - DNA, 25 bp, Mus musculus
ctgaagagagagagaagacagttct

SEQ ID NO: 271636 - DNA, 25 bp, Mus musculus
ctgaagagcaagatcctggcagcca

SEQ ID NO: 271637 - DNA, 25 bp, Mus musculus
ctgaagagcacggatgttctttggc

SEQ ID NO: 271638 - DNA, 25 bp, Mus musculus
ctgaagagcagacttggaggtaaca

SEQ ID NO: 271639 - DNA, 25 bp, Mus musculus
ctgaagagcctagaggagaaagtct

SEQ ID NO: 271640 - DNA, 25 bp, Mus musculus
ctgaagagcgaggagacgagcaaaa

SEQ ID NO: 271641 - DNA, 25 bp, Mus musculus
ctgaagagcgaggaggtggaagata

SEQ ID NO: 271642 - DNA, 25 bp, Mus musculus
ctgaagagctagagatatgtgtcac

SEQ ID NO: 271643 - DNA, 25 bp, Mus musculus
ctgaagagctcaggtgtaccagctg

SEQ ID NO: 271644 - DNA, 25 bp, Mus musculus
ctgaagagcttgctacaatgggtga

SEQ ID NO: 271645 - DNA, 25 bp, Mus musculus
ctgaagaggacatcgatccctttga

SEQ ID NO: 271646 - DNA, 25 bp, Mus musculus
ctgaagagttgtgttagggttttac

SEQ ID NO: 271647 - DNA, 25 bp, Mus musculus
ctgaagatcgcctgtagcaaagtcc

SEQ ID NO: 271648 - DNA, 25 bp, Mus musculus
ctgaagatctagtgcgccgtcatga

SEQ ID NO: 271649 - DNA, 25 bp, Mus musculus
ctgaagatgaaaaaggtcatttact

SEQ ID NO: 271650 - DNA, 25 bp, Mus musculus
ctgaagatgaaccggaagtatgaag

SEQ ID NO: 271651 - DNA, 25 bp, Mus musculus
ctgaagatgagaaaggtcatttact

SEQ ID NO: 271652 - DNA, 25 bp, Mus musculus
ctgaagatgcagaagacggacaaga

SEQ ID NO: 271653 - DNA, 25 bp, Mus musculus
ctgaagatgcagaagtgtatgagag

SEQ ID NO: 271654 - DNA, 25 bp, Mus musculus
ctgaagcaaggtattggttttcgct

SEQ ID NO: 271655 - DNA, 25 bp, Mus musculus
ctgaagcaccagcatcggtgtgtgg

SEQ ID NO: 271656 - DNA, 25 bp, Mus musculus
ctgaagcaccaggtgaatgggattg

SEQ ID NO: 271657 - DNA, 25 bp, Mus musculus
ctgaagcagaagactctcttctgca

SEQ ID NO: 271658 - DNA, 25 bp, Mus musculus
ctgaagcagaaggagctaggtggcg

SEQ ID NO: 271659 - DNA, 25 bp, Mus musculus
ctgaagcaggaagcaggaagcctgt

SEQ ID NO: 271660 - DNA, 25 bp, Mus musculus
ctgaagcaggaatagcctgcacagg

SEQ ID NO: 271661 - DNA, 25 bp, Mus musculus
ctgaagcagggaacccagggggcaa

SEQ ID NO: 271662 - DNA, 25 bp, Mus musculus
ctgaagcagggagggcaagctcccc

SEQ ID NO: 271663 - DNA, 25 bp, Mus musculus
ctgaagcagggagtaatgcatgaaa

SEQ ID NO: 271664 - DNA, 25 bp, Mus musculus
ctgaagccagagagtcatggatgct

SEQ ID NO: 271665 - DNA, 25 bp, Mus musculus
ctgaagccagaggtacttgatgtgt

SEQ ID NO: 271666 - DNA, 25 bp, Mus musculus
ctgaagccagcatcgagatcaacaa

SEQ ID NO: 271667 - DNA, 25 bp, Mus musculus
ctgaagccaggagccaaaccagagg

SEQ ID NO: 271668 - DNA, 25 bp, Mus musculus
ctgaagccatgaaaggaacagagtg

SEQ ID NO: 271669 - DNA, 25 bp, Mus musculus
ctgaagcccagaagccctacccatg

SEQ ID NO: 271670 - DNA, 25 bp, Mus musculus
ctgaagcccagaagctgtgattgga

SEQ ID NO: 271671 - DNA, 25 bp, Mus musculus
ctgaagcccagcagatttggcctgg

SEQ ID NO: 271672 - DNA, 25 bp, Mus musculus
ctgaagcccagcaggccagtgtgct

SEQ ID NO: 271673 - DNA, 25 bp, Mus musculus
ctgaagcctaagaaggcaccgacag

SEQ ID NO: 271674 - DNA, 25 bp, Mus musculus
ctgaagcctgaaggtctccaccagc

SEQ ID NO: 271675 - DNA, 25 bp, Mus musculus
ctgaagcctggttccctcaaccccg

SEQ ID NO: 271676 - DNA, 25 bp, Mus musculus
ctgaagcgagaccaccgtgggaaat

SEQ ID NO: 271677 - DNA, 25 bp, Mus musculus
ctgaagcgggatctgttctctcaga

SEQ ID NO: 271678 - DNA, 25 bp, Mus musculus
ctgaagcggtgctcactcctggccc

SEQ ID NO: 271679 - DNA, 25 bp, Mus musculus
ctgaagctaagccccaagcattctg

SEQ ID NO: 271680 - DNA, 25 bp, Mus musculus
ctgaagctacagggttgaaaaatac

SEQ ID NO: 271681 - DNA, 25 bp, Mus musculus
ctgaagctcagaactttgccaattc

SEQ ID NO: 271682 - DNA, 25 bp, Mus musculus
ctgaagctcggaaacaagctcccat

SEQ ID NO: 271683 - DNA, 25 bp, Mus musculus
ctgaagctgatcaggctctaaggga

SEQ ID NO: 271684 - DNA, 25 bp, Mus musculus
ctgaagctgctgatgaaccacgcct

SEQ ID NO: 271685 - DNA, 25 bp, Mus musculus
ctgaagctgctgatggtcgacaccc

SEQ ID NO: 271686 - DNA, 25 bp, Mus musculus
ctgaagctgctgcagccctgccagt

SEQ ID NO: 271687 - DNA, 25 bp, Mus musculus
ctgaagctgggatcaagcacttcct

SEQ ID NO: 271688 - DNA, 25 bp, Mus musculus
ctgaagctggggggtcgtgtgaaga

SEQ ID NO: 271689 - DNA, 25 bp, Mus musculus
ctgaagctttcaaagccattggcac

SEQ ID NO: 271690 - DNA, 25 bp, Mus musculus
ctgaaggaaaaccaggcacgcatcg

SEQ ID NO: 271691 - DNA, 25 bp, Mus musculus
ctgaaggaagtggaggtggaggaat

SEQ ID NO: 271692 - DNA, 25 bp, Mus musculus
ctgaaggacttgaggaacttcctgt

SEQ ID NO: 271693 - DNA, 25 bp, Mus musculus
ctgaaggagaacagcaaacctctga

SEQ ID NO: 271694 - DNA, 25 bp, Mus musculus
ctgaaggagaccagaaggactccat

SEQ ID NO: 271695 - DNA, 25 bp, Mus musculus
ctgaaggagatggcaattccggtct

SEQ ID NO: 271696 - DNA, 25 bp, Mus musculus
ctgaaggagctgaggtgggctggta

SEQ ID NO: 271697 - DNA, 25 bp, Mus musculus
ctgaaggagctggtacagacttacg

SEQ ID NO: 271698 - DNA, 25 bp, Mus musculus
ctgaaggaggaggttggaagtcgga

SEQ ID NO: 271699 - DNA, 25 bp, Mus musculus
ctgaaggagtaggccctgtattgga

SEQ ID NO: 271700 - DNA, 25 bp, Mus musculus
ctgaaggagtgtggcatgttcatca

SEQ ID NO: 271701 - DNA, 25 bp, Mus musculus
ctgaaggcaagaagacagtaaccag

SEQ ID NO: 271702 - DNA, 25 bp, Mus musculus
ctgaaggcactggcactacaagatg

SEQ ID NO: 271703 - DNA, 25 bp, Mus musculus
ctgaaggcagatcatgcctggggga

SEQ ID NO: 271704 - DNA, 25 bp, Mus musculus
ctgaaggccctgaggtatcaccaca

SEQ ID NO: 271705 - DNA, 25 bp, Mus musculus
ctgaaggccgctacggatacaggtt

SEQ ID NO: 271706 - DNA, 25 bp, Mus musculus
ctgaaggcctggttctgcataagca

SEQ ID NO: 271707 - DNA, 25 bp, Mus musculus
ctgaaggctacaaggtgctggtggc

SEQ ID NO: 271708 - DNA, 25 bp, Mus musculus
ctgaaggctcgcaacaccaagaagg

SEQ ID NO: 271709 - DNA, 25 bp, Mus musculus
ctgaaggctgacaaggaatttcggc

SEQ ID NO: 271710 - DNA, 25 bp, Mus musculus
ctgaaggcttcaggaaatcaggacc

SEQ ID NO: 271711 - DNA, 25 bp, Mus musculus
ctgaagggaaaaaggtgatgtctat

SEQ ID NO: 271712 - DNA, 25 bp, Mus musculus
ctgaagggaatactaagatgcttag

SEQ ID NO: 271713 - DNA, 25 bp, Mus musculus
ctgaagggaatcctggcctcccagt

SEQ ID NO: 271714 - DNA, 25 bp, Mus musculus
ctgaagggaatcctggggacactta

SEQ ID NO: 271715 - DNA, 25 bp, Mus musculus
ctgaagggagagttcgtgtcgatgg

SEQ ID NO: 271716 - DNA, 25 bp, Mus musculus
ctgaagggcaaggaactaccgtggg

SEQ ID NO: 271717 - DNA, 25 bp, Mus musculus
ctgaagggcaaggtgctcatctgca

SEQ ID NO: 271718 - DNA, 25 bp, Mus musculus
ctgaagggcagacaagatgaacctc

SEQ ID NO: 271719 - DNA, 25 bp, Mus musculus
ctgaagggcagagggatacagtaca

SEQ ID NO: 271720 - DNA, 25 bp, Mus musculus
ctgaagggcagggacattagtcatg

SEQ ID NO: 271721 - DNA, 25 bp, Mus musculus
ctgaagggcaggtttggcatagaaa

SEQ ID NO: 271722 - DNA, 25 bp, Mus musculus
ctgaaggggaagaggaatattgaag

SEQ ID NO: 271723 - DNA, 25 bp, Mus musculus
ctgaagggtataggcatcgcctcca

SEQ ID NO: 271724 - DNA, 25 bp, Mus musculus
ctgaagggtttgagagaatcgcacg

SEQ ID NO: 271725 - DNA, 25 bp, Mus musculus
ctgaaggtcactgagggcggtgagc

SEQ ID NO: 271726 - DNA, 25 bp, Mus musculus
ctgaaggtcgtgccagaaggaatga

SEQ ID NO: 271727 - DNA, 25 bp, Mus musculus
ctgaaggtgaaagagactcggatga

SEQ ID NO: 271728 - DNA, 25 bp, Mus musculus
ctgaagtcaagggcaggcactgatg

SEQ ID NO: 271729 - DNA, 25 bp, Mus musculus
ctgaagtcaaggtcggttaggcccc

SEQ ID NO: 271730 - DNA, 25 bp, Mus musculus
ctgaagtcaccctgccagcaagaag

SEQ ID NO: 271731 - DNA, 25 bp, Mus musculus
ctgaagtcatgaactccaatgtgga

SEQ ID NO: 271732 - DNA, 25 bp, Mus musculus
ctgaagtcccgaggccaaccgcgta

SEQ ID NO: 271733 - DNA, 25 bp, Mus musculus
ctgaagtcccgaggttgagccccac

SEQ ID NO: 271734 - DNA, 25 bp, Mus musculus
ctgaagtcgcagagaaagataaggg

SEQ ID NO: 271735 - DNA, 25 bp, Mus musculus
ctgaagtgaaaaagtgccactgagg

SEQ ID NO: 271736 - DNA, 25 bp, Mus musculus
ctgaagtgaggggggtccagcgagt

SEQ ID NO: 271737 - DNA, 25 bp, Mus musculus
ctgaagtgagtgggcccagccacgg

SEQ ID NO: 271738 - DNA, 25 bp, Mus musculus
ctgaagtgcaggaactctgcaaaca

SEQ ID NO: 271739 - DNA, 25 bp, Mus musculus
ctgaagtgcaggtatcagggtggcc

SEQ ID NO: 271740 - DNA, 25 bp, Mus musculus
ctgaagtggtgtgctcggaggacac

SEQ ID NO: 271741 - DNA, 25 bp, Mus musculus
ctgaagtggttctgaacacggtaca

SEQ ID NO: 271742 - DNA, 25 bp, Mus musculus
ctgaagtgtcagcttgatactcatg

SEQ ID NO: 271743 - DNA, 25 bp, Mus musculus
ctgaagtgtcaggcgtttgcacatg

SEQ ID NO: 271744 - DNA, 25 bp, Mus musculus
ctgaagtgtggcttggtacctggaa

SEQ ID NO: 271745 - DNA, 25 bp, Mus musculus
ctgaagtgttccaggacatgctacc

SEQ ID NO: 271746 - DNA, 25 bp, Mus musculus
ctgaagttacagtcaccggaagaag

SEQ ID NO: 271747 - DNA, 25 bp, Mus musculus
ctgaagttagacacaccagaagagg

SEQ ID NO: 271748 - DNA, 25 bp, Mus musculus
ctgaagttatgagagagattcagaa

SEQ ID NO: 271749 - DNA, 25 bp, Mus musculus
ctgaagttatgcagggatggcaaga

SEQ ID NO: 271750 - DNA, 25 bp, Mus musculus
ctgaagttcggttcctgtgtgacga

SEQ ID NO: 271751 - DNA, 25 bp, Mus musculus
ctgaataataccaggtggtgccaca

SEQ ID NO: 271752 - DNA, 25 bp, Mus musculus
ctgaatacacaggccccagtgcctt

SEQ ID NO: 271753 - DNA, 25 bp, Mus musculus
ctgaatagcgtgcctcaggagccgt

SEQ ID NO: 271754 - DNA, 25 bp, Mus musculus
ctgaatatccccaggtactgtgcag

SEQ ID NO: 271755 - DNA, 25 bp, Mus musculus
ctgaatatccgtcgaaaagcggcat

SEQ ID NO: 271756 - DNA, 25 bp, Mus musculus
ctgaatatgaactctcatccttatt

SEQ ID NO: 271757 - DNA, 25 bp, Mus musculus
ctgaatcactaagagggaccagtct

SEQ ID NO: 271758 - DNA, 25 bp, Mus musculus
ctgaatcagatcaggtggatgtgtg

SEQ ID NO: 271759 - DNA, 25 bp, Mus musculus
ctgaatcctgagcaatggaagagtt

SEQ ID NO: 271760 - DNA, 25 bp, Mus musculus
ctgaatcctgaggtgcagcgtggcg

SEQ ID NO: 271761 - DNA, 25 bp, Mus musculus
ctgaatcgaaaggctcaggtcacag

SEQ ID NO: 271762 - DNA, 25 bp, Mus musculus
ctgaatcgccacagagcctacagag

SEQ ID NO: 271763 - DNA, 25 bp, Mus musculus
ctgaatctcacttcaggcccagagc

SEQ ID NO: 271764 - DNA, 25 bp, Mus musculus
ctgaatctcactttagatagtgacg

SEQ ID NO: 271765 - DNA, 25 bp, Mus musculus
ctgaatctcccaggaaacctcatcg

SEQ ID NO: 271766 - DNA, 25 bp, Mus musculus
ctgaatctcccaggtagtcaatacc

SEQ ID NO: 271767 - DNA, 25 bp, Mus musculus
ctgaatctgtcagacgtgttgatgc

SEQ ID NO: 271768 - DNA, 25 bp, Mus musculus
ctgaatcttaacaagggataactct

SEQ ID NO: 271769 - DNA, 25 bp, Mus musculus
ctgaatcttcattgagcatgttttt

SEQ ID NO: 271770 - DNA, 25 bp, Mus musculus
ctgaatgaaagggagaagaaggaac

SEQ ID NO: 271771 - DNA, 25 bp, Mus musculus
ctgaatgaacagcttctacctaagc

SEQ ID NO: 271772 - DNA, 25 bp, Mus musculus
ctgaatgacaagctccccgaggctc

SEQ ID NO: 271773 - DNA, 25 bp, Mus musculus
ctgaatgacaaggtggaggagcggc

SEQ ID NO: 271774 - DNA, 25 bp, Mus musculus
ctgaatgagaaagaccttgtcctgg

SEQ ID NO: 271775 - DNA, 25 bp, Mus musculus
ctgaatgatctggagtgccccgagc

SEQ ID NO: 271776 - DNA, 25 bp, Mus musculus
ctgaatgatgctgggatccagatgt

SEQ ID NO: 271777 - DNA, 25 bp, Mus musculus
ctgaatgcagattgaggatgggtac

SEQ ID NO: 271778 - DNA, 25 bp, Mus musculus
ctgaatgcagtgacaagcatcagtt

SEQ ID NO: 271779 - DNA, 25 bp, Mus musculus
ctgaatgcagttggaatgccaagat

SEQ ID NO: 271780 - DNA, 25 bp, Mus musculus
ctgaatgccatcaaactacaactcc

SEQ ID NO: 271781 - DNA, 25 bp, Mus musculus
ctgaatggcaggaaatctcaccaca

SEQ ID NO: 271782 - DNA, 25 bp, Mus musculus
ctgaatgggcacaaggcgacccaag

SEQ ID NO: 271783 - DNA, 25 bp, Mus musculus
ctgaatgggcacaagggtgtggact

SEQ ID NO: 271784 - DNA, 25 bp, Mus musculus
ctgaatgggctgaagagaatgcaaa

SEQ ID NO: 271785 - DNA, 25 bp, Mus musculus
ctgaatggtgggtgcaagtcccagg

SEQ ID NO: 271786 - DNA, 25 bp, Mus musculus
ctgaatggtgtggagtttgcagatt

SEQ ID NO: 271787 - DNA, 25 bp, Mus musculus
ctgaatgtcaaagattgtaacataa

SEQ ID NO: 271788 - DNA, 25 bp, Mus musculus
ctgaatgtcatgtatttcaacaatc

SEQ ID NO: 271789 - DNA, 25 bp, Mus musculus
ctgaatgtgagaagattacagtagc

SEQ ID NO: 271790 - DNA, 25 bp, Mus musculus
ctgaattcaaaggaggttcatgagt

SEQ ID NO: 271791 - DNA, 25 bp, Mus musculus
ctgaattcaagggaaacaactggaa

SEQ ID NO: 271792 - DNA, 25 bp, Mus musculus
ctgaattcagaggaggtggctgaag

SEQ ID NO: 271793 - DNA, 25 bp, Mus musculus
ctgaattcagaggtggcgagtgaaa

SEQ ID NO: 271794 - DNA, 25 bp, Mus musculus
ctgaattcctaaaagcagccaacaa

SEQ ID NO: 271795 - DNA, 25 bp, Mus musculus
ctgaattcgatccaggctccccggc

SEQ ID NO: 271796 - DNA, 25 bp, Mus musculus
ctgaattcgatccaggtgctaccaa

SEQ ID NO: 271797 - DNA, 25 bp, Mus musculus
ctgaattctgagggactaactacga

SEQ ID NO: 271798 - DNA, 25 bp, Mus musculus
ctgaattcttcaaggactggggatc

SEQ ID NO: 271799 - DNA, 25 bp, Mus musculus
ctgaattcttcaaggtggtacctca

SEQ ID NO: 271800 - DNA, 25 bp, Mus musculus
ctgaattcttgcagacacctttgtc

SEQ ID NO: 271801 - DNA, 25 bp, Mus musculus
ctgaattcttgcagatccgtctacc

SEQ ID NO: 271802 - DNA, 25 bp, Mus musculus
ctgaattgaggattaagcttgcaat

SEQ ID NO: 271803 - DNA, 25 bp, Mus musculus
ctgaattgtacagatccgctgtact

SEQ ID NO: 271804 - DNA, 25 bp, Mus musculus
ctgaatttacggtcaccattcttgt

SEQ ID NO: 271805 - DNA, 25 bp, Mus musculus
ctgaatttacggtggctctcccaaa

SEQ ID NO: 271806 - DNA, 25 bp, Mus musculus
ctgaatttatcaggaaacaaaagga

SEQ ID NO: 271807 - DNA, 25 bp, Mus musculus
ctgaatttatcgtcagatacagagt

SEQ ID NO: 271808 - DNA, 25 bp, Mus musculus
ctgaatttccaaaagagaacggaca

SEQ ID NO: 271809 - DNA, 25 bp, Mus musculus
ctgaatttccaaaagcctgaaacat

SEQ ID NO: 271810 - DNA, 25 bp, Mus musculus
ctgaattttagagaacgagttagta

SEQ ID NO: 271811 - DNA, 25 bp, Mus musculus
ctgaattttagagaatggctctgaa

SEQ ID NO: 271812 - DNA, 25 bp, Mus musculus
ctgaatttttcaaatttctgctgga

SEQ ID NO: 271813 - DNA, 25 bp, Mus musculus
ctgacaaaagaaagaatatgtactc

SEQ ID NO: 271814 - DNA, 25 bp, Mus musculus
ctgacaaagaaggctggattctcat

SEQ ID NO: 271815 - DNA, 25 bp, Mus musculus
ctgacaaatgacacccagtcttctg

SEQ ID NO: 271816 - DNA, 25 bp, Mus musculus
ctgacaacaaatggaccccttcttt

SEQ ID NO: 271817 - DNA, 25 bp, Mus musculus
ctgacaacaaatgtcactagtgcca

SEQ ID NO: 271818 - DNA, 25 bp, Mus musculus
ctgacaacaagagcctggccatccc

SEQ ID NO: 271819 - DNA, 25 bp, Mus musculus
ctgacaacagccaagagaaacatca

SEQ ID NO: 271820 - DNA, 25 bp, Mus musculus
ctgacaacaggtcaccttcgtctcc

SEQ ID NO: 271821 - DNA, 25 bp, Mus musculus
ctgacaactttgaactctgcacttt

SEQ ID NO: 271822 - DNA, 25 bp, Mus musculus
ctgacaagaaagctgttcttcctac

SEQ ID NO: 271823 - DNA, 25 bp, Mus musculus
ctgacaagaaagcttgatccggagc

SEQ ID NO: 271824 - DNA, 25 bp, Mus musculus
ctgacaagaaggaaatgttgtcctt

SEQ ID NO: 271825 - DNA, 25 bp, Mus musculus
ctgacaagcaaatgatcaaacttca

SEQ ID NO: 271826 - DNA, 25 bp, Mus musculus
ctgacaagccccagggcagtccttt

SEQ ID NO: 271827 - DNA, 25 bp, Mus musculus
ctgacaagccccagggtgccacctc

SEQ ID NO: 271828 - DNA, 25 bp, Mus musculus
ctgacaaggaaagctggtgaagcac

SEQ ID NO: 271829 - DNA, 25 bp, Mus musculus
ctgacaaggaaagctgtctgcaatc

SEQ ID NO: 271830 - DNA, 25 bp, Mus musculus
ctgacaaggaagcggcctttgacga

SEQ ID NO: 271831 - DNA, 25 bp, Mus musculus
ctgacaaggaaggcctgaagggaaa

SEQ ID NO: 271832 - DNA, 25 bp, Mus musculus
ctgacaaggacacctgctttgaatt

SEQ ID NO: 271833 - DNA, 25 bp, Mus musculus
ctgacaaggagaatacacctctcat

SEQ ID NO: 271834 - DNA, 25 bp, Mus musculus
ctgacaaggagaatgtcccttcaga

SEQ ID NO: 271835 - DNA, 25 bp, Mus musculus
ctgacaagtggagaaatgattagca

SEQ ID NO: 271836 - DNA, 25 bp, Mus musculus
ctgacaagtggagtcattttataag

SEQ ID NO: 271837 - DNA, 25 bp, Mus musculus
ctgacaatgagctgtgtgtccgagc

SEQ ID NO: 271838 - DNA, 25 bp, Mus musculus
ctgacaatgcaagtgcaccttccag

SEQ ID NO: 271839 - DNA, 25 bp, Mus musculus
ctgacaatgctcaagagtatagtca

SEQ ID NO: 271840 - DNA, 25 bp, Mus musculus
ctgacacacaccaggggtgacagtc

SEQ ID NO: 271841 - DNA, 25 bp, Mus musculus
ctgacacacagggagaaaatccccc

SEQ ID NO: 271842 - DNA, 25 bp, Mus musculus
ctgacacacccctgtctgcaggcat

SEQ ID NO: 271843 - DNA, 25 bp, Mus musculus
ctgacacagctaagttcacagccat

SEQ ID NO: 271844 - DNA, 25 bp, Mus musculus
ctgacacaggaggacctccaccatg

SEQ ID NO: 271845 - DNA, 25 bp, Mus musculus
ctgacaccaccaagatcccatggtt

SEQ ID NO: 271846 - DNA, 25 bp, Mus musculus
ctgacaccagtggcagtgaacctgg

SEQ ID NO: 271847 - DNA, 25 bp, Mus musculus
ctgacaccgtacgaggcagctgtgg

SEQ ID NO: 271848 - DNA, 25 bp, Mus musculus
ctgacacctcagggcacacttgccg

SEQ ID NO: 271849 - DNA, 25 bp, Mus musculus
ctgacacctccatgtatcccaaggg

SEQ ID NO: 271850 - DNA, 25 bp, Mus musculus
ctgacacctggaaggcagccagagt

SEQ ID NO: 271851 - DNA, 25 bp, Mus musculus
ctgacacgctgagaaatacgaagaa

SEQ ID NO: 271852 - DNA, 25 bp, Mus musculus
ctgacacgctgagaatatatcagag

SEQ ID NO: 271853 - DNA, 25 bp, Mus musculus
ctgacacggaacaggaaggcaaata

SEQ ID NO: 271854 - DNA, 25 bp, Mus musculus
ctgacacggagcaggaaggcaaata

SEQ ID NO: 271855 - DNA, 25 bp, Mus musculus
ctgacactagctgcagccgactccg

SEQ ID NO: 271856 - DNA, 25 bp, Mus musculus
ctgacactgactctcatggtaccaa

SEQ ID NO: 271857 - DNA, 25 bp, Mus musculus
ctgacacttccgtgttaggcacggg

SEQ ID NO: 271858 - DNA, 25 bp, Mus musculus
ctgacagaaacaaataaaacctcag

SEQ ID NO: 271859 - DNA, 25 bp, Mus musculus
ctgacagaaaccgtaatcctccacc

SEQ ID NO: 271860 - DNA, 25 bp, Mus musculus
ctgacagaaaggaaacatggagctc

SEQ ID NO: 271861 - DNA, 25 bp, Mus musculus
ctgacagaacaggtcctgctgcagg

SEQ ID NO: 271862 - DNA, 25 bp, Mus musculus
ctgacagaacccgaaaagggccctg

SEQ ID NO: 271863 - DNA, 25 bp, Mus musculus
ctgacagaacccgagctgcctgccg

SEQ ID NO: 271864 - DNA, 25 bp, Mus musculus
ctgacagaaggtctccgggcacaat

SEQ ID NO: 271865 - DNA, 25 bp, Mus musculus
ctgacagaagttaccaaatgggaac

SEQ ID NO: 271866 - DNA, 25 bp, Mus musculus
ctgacagaattaacggcacagccaa

SEQ ID NO: 271867 - DNA, 25 bp, Mus musculus
ctgacagacagaacagtctaagagt

SEQ ID NO: 271868 - DNA, 25 bp, Mus musculus
ctgacagacagtatctgaacacagt

SEQ ID NO: 271869 - DNA, 25 bp, Mus musculus
ctgacagaccaagtctgctgaagac

SEQ ID NO: 271870 - DNA, 25 bp, Mus musculus
ctgacagacgaggtaaacagcccag

SEQ ID NO: 271871 - DNA, 25 bp, Mus musculus
ctgacagactgagccccttaggtga

SEQ ID NO: 271872 - DNA, 25 bp, Mus musculus
ctgacagagaaacgtctgtctgcag

SEQ ID NO: 271873 - DNA, 25 bp, Mus musculus
ctgacagagaggaggagacacggtc

SEQ ID NO: 271874 - DNA, 25 bp, Mus musculus
ctgacagagggggaggaagaaattg

SEQ ID NO: 271875 - DNA, 25 bp, Mus musculus
ctgacagatatagactcttcaagaa

SEQ ID NO: 271876 - DNA, 25 bp, Mus musculus
ctgacagatgatatgctggacaaat

SEQ ID NO: 271877 - DNA, 25 bp, Mus musculus
ctgacagatgatcaggagttagtga

SEQ ID NO: 271878 - DNA, 25 bp, Mus musculus
ctgacagatgttctgcgccccactc

SEQ ID NO: 271879 - DNA, 25 bp, Mus musculus
ctgacagatgttctggccaacctct

SEQ ID NO: 271880 - DNA, 25 bp, Mus musculus
ctgacagcaaacgaggcctaagtca

SEQ ID NO: 271881 - DNA, 25 bp, Mus musculus
ctgacagcaggggcttcagtgtgac

SEQ ID NO: 271882 - DNA, 25 bp, Mus musculus
ctgacagcagttcccacagctgcac

SEQ ID NO: 271883 - DNA, 25 bp, Mus musculus
ctgacagccagaagaattggctgga

SEQ ID NO: 271884 - DNA, 25 bp, Mus musculus
ctgacagccagaaggtagcccctgg

SEQ ID NO: 271885 - DNA, 25 bp, Mus musculus
ctgacagccagatgaatagagaaga

SEQ ID NO: 271886 - DNA, 25 bp, Mus musculus
ctgacagccctgtgtggggctgcct

SEQ ID NO: 271887 - DNA, 25 bp, Mus musculus
ctgacagcctctctggtacatggct

SEQ ID NO: 271888 - DNA, 25 bp, Mus musculus
ctgacagctctgcctatttgatcaa

SEQ ID NO: 271889 - DNA, 25 bp, Mus musculus
ctgacagctgggatctccatctttc

SEQ ID NO: 271890 - DNA, 25 bp, Mus musculus
ctgacaggagttcgggactctgctg

SEQ ID NO: 271891 - DNA, 25 bp, Mus musculus
ctgacaggcaggccaggagtgtgcc

SEQ ID NO: 271892 - DNA, 25 bp, Mus musculus
ctgacaggggcacaaggcattgcca

SEQ ID NO: 271893 - DNA, 25 bp, Mus musculus
ctgacaggtagccaggcttggcacg

SEQ ID NO: 271894 - DNA, 25 bp, Mus musculus
ctgacagtccagagcgcctccccat

SEQ ID NO: 271895 - DNA, 25 bp, Mus musculus
ctgacagtgaggatccaaaggaggc

SEQ ID NO: 271896 - DNA, 25 bp, Mus musculus
ctgacagtgcagggtcaccatcatg

SEQ ID NO: 271897 - DNA, 25 bp, Mus musculus
ctgacagtgccggtcctgtaagagg

SEQ ID NO: 271898 - DNA, 25 bp, Mus musculus
ctgacagtgccggtgctgtaagagg

SEQ ID NO: 271899 - DNA, 25 bp, Mus musculus
ctgacatcacagatgagctccagtg

SEQ ID NO: 271900 - DNA, 25 bp, Mus musculus
ctgacatcatcgagaccctgaggaa

SEQ ID NO: 271901 - DNA, 25 bp, Mus musculus
ctgacatcatcgaggcgctgcacaa

SEQ ID NO: 271902 - DNA, 25 bp, Mus musculus
ctgacatcctgttgtacgtggtgat

SEQ ID NO: 271903 - DNA, 25 bp, Mus musculus
ctgacatggaggaaatgctgtcatt

SEQ ID NO: 271904 - DNA, 25 bp, Mus musculus
ctgacatggaggatatgctgtcatt

SEQ ID NO: 271905 - DNA, 25 bp, Mus musculus
ctgacatggcctcaggtggcccggc

SEQ ID NO: 271906 - DNA, 25 bp, Mus musculus
ctgacatggtaaagggaatgcagtg

SEQ ID NO: 271907 - DNA, 25 bp, Mus musculus
ctgacatggtctagagctttatgga

SEQ ID NO: 271908 - DNA, 25 bp, Mus musculus
ctgacatgtgcctgagcggagcgtc

SEQ ID NO: 271909 - DNA, 25 bp, Mus musculus
ctgacatgtggagcattggcgtcat

SEQ ID NO: 271910 - DNA, 25 bp, Mus musculus
ctgacattacaggaccaggtggaca

SEQ ID NO: 271911 - DNA, 25 bp, Mus musculus
ctgacattactggcatgcctgtggt

SEQ ID NO: 271912 - DNA, 25 bp, Mus musculus
ctgacattcagagttgaaactgtgg

SEQ ID NO: 271913 - DNA, 25 bp, Mus musculus
ctgacattcaggtgcagtctttgtc

SEQ ID NO: 271914 - DNA, 25 bp, Mus musculus
ctgacattccccaggattgggtttc

SEQ ID NO: 271915 - DNA, 25 bp, Mus musculus
ctgacattgaaagagcccattctgc

SEQ ID NO: 271916 - DNA, 25 bp, Mus musculus
ctgacattgagagggaatgaggtct

SEQ ID NO: 271917 - DNA, 25 bp, Mus musculus
ctgacattgagagggagagtgtgga

SEQ ID NO: 271918 - DNA, 25 bp, Mus musculus
ctgacattgggagaatcccgggcag

SEQ ID NO: 271919 - DNA, 25 bp, Mus musculus
ctgaccaaaaataaggtacaagttc

SEQ ID NO: 271920 - DNA, 25 bp, Mus musculus
ctgaccaaagaatacattccaccac

SEQ ID NO: 271921 - DNA, 25 bp, Mus musculus
ctgaccaaagatgagaaagtattcc

SEQ ID NO: 271922 - DNA, 25 bp, Mus musculus
ctgaccaacagaacatacaacatca

SEQ ID NO: 271923 - DNA, 25 bp, Mus musculus
ctgaccacaccctgttcttgcttca

SEQ ID NO: 271924 - DNA, 25 bp, Mus musculus
ctgaccacagacaaggccaacatca

SEQ ID NO: 271925 - DNA, 25 bp, Mus musculus
ctgaccacagactactggtgcctag

SEQ ID NO: 271926 - DNA, 25 bp, Mus musculus
ctgaccacagccaactttccagatg

SEQ ID NO: 271927 - DNA, 25 bp, Mus musculus
ctgaccacagttttcctgacttctc

SEQ ID NO: 271928 - DNA, 25 bp, Mus musculus
ctgaccacatctgtcaaattatcac

SEQ ID NO: 271929 - DNA, 25 bp, Mus musculus
ctgaccacatgcagaatcacagcga

SEQ ID NO: 271930 - DNA, 25 bp, Mus musculus
ctgaccacatgcaggagagattttg

SEQ ID NO: 271931 - DNA, 25 bp, Mus musculus
ctgaccaccacacccagtgttgggc

SEQ ID NO: 271932 - DNA, 25 bp, Mus musculus
ctgaccaccacggcatcacggctgc

SEQ ID NO: 271933 - DNA, 25 bp, Mus musculus
ctgaccagagagcttctgtgtggag

SEQ ID NO: 271934 - DNA, 25 bp, Mus musculus
ctgaccagattgccgacttcaagga

SEQ ID NO: 271935 - DNA, 25 bp, Mus musculus
ctgaccagattgccgatcgagttct

SEQ ID NO: 271936 - DNA, 25 bp, Mus musculus
ctgaccaggcagttctagatgagcg

SEQ ID NO: 271937 - DNA, 25 bp, Mus musculus
ctgaccagggcgacttcgagaagcc

SEQ ID NO: 271938 - DNA, 25 bp, Mus musculus
ctgaccaggtttgggttccccagga

SEQ ID NO: 271939 - DNA, 25 bp, Mus musculus
ctgaccagtctatatatattggggc

SEQ ID NO: 271940 - DNA, 25 bp, Mus musculus
ctgaccagtgactccaatatgcctg

SEQ ID NO: 271941 - DNA, 25 bp, Mus musculus
ctgaccatacaggctgggccggtaa

SEQ ID NO: 271942 - DNA, 25 bp, Mus musculus
ctgaccatactggacaccctttcag

SEQ ID NO: 271943 - DNA, 25 bp, Mus musculus
ctgaccatagacgagttggagtgga

SEQ ID NO: 271944 - DNA, 25 bp, Mus musculus
ctgaccatagacgtggaaactgtct

SEQ ID NO: 271945 - DNA, 25 bp, Mus musculus
ctgaccatcaagctgacccctgccc

SEQ ID NO: 271946 - DNA, 25 bp, Mus musculus
ctgaccatcacagtccgcaccaaga

SEQ ID NO: 271947 - DNA, 25 bp, Mus musculus
ctgaccatggacgatctgtttcccc

SEQ ID NO: 271948 - DNA, 25 bp, Mus musculus
ctgaccatggccaagatggagttcc

SEQ ID NO: 271949 - DNA, 25 bp, Mus musculus
ctgaccattactgggggatgcagag

SEQ ID NO: 271950 - DNA, 25 bp, Mus musculus
ctgacccaagagattgctatggagc

SEQ ID NO: 271951 - DNA, 25 bp, Mus musculus
ctgacccaagcttatgatggagcag

SEQ ID NO: 271952 - DNA, 25 bp, Mus musculus
ctgacccaccaggtgccagcctcac

SEQ ID NO: 271953 - DNA, 25 bp, Mus musculus
ctgacccaccaggtgtgccagggga

SEQ ID NO: 271954 - DNA, 25 bp, Mus musculus
ctgacccagaggtctttgacccact

SEQ ID NO: 271955 - DNA, 25 bp, Mus musculus
ctgacccattctgtgctgcctgcca

SEQ ID NO: 271956 - DNA, 25 bp, Mus musculus
ctgacccattctgtggctttcactt

SEQ ID NO: 271957 - DNA, 25 bp, Mus musculus
ctgaccccagaagtagaaatccaga

SEQ ID NO: 271958 - DNA, 25 bp, Mus musculus
ctgaccccagcaagacattcacccc

SEQ ID NO: 271959 - DNA, 25 bp, Mus musculus
ctgaccccagcccagccagtggttt

SEQ ID NO: 271960 - DNA, 25 bp, Mus musculus
ctgacccccaagaggccattaactg

SEQ ID NO: 271961 - DNA, 25 bp, Mus musculus
ctgacccccaaggccatcgcccact

SEQ ID NO: 271962 - DNA, 25 bp, Mus musculus
ctgaccccgaagcttgatggtgtga

SEQ ID NO: 271963 - DNA, 25 bp, Mus musculus
ctgaccccgaagttgatgaaacata

SEQ ID NO: 271964 - DNA, 25 bp, Mus musculus
ctgaccccgcgggtccttcacacac

SEQ ID NO: 271965 - DNA, 25 bp, Mus musculus
ctgaccccttcaaaggtgatccttt

SEQ ID NO: 271966 - DNA, 25 bp, Mus musculus
ctgacccgaagggtcacagacgaac

SEQ ID NO: 271967 - DNA, 25 bp, Mus musculus
ctgacccggccatcctacctgccta

SEQ ID NO: 271968 - DNA, 25 bp, Mus musculus
ctgacccggccatcgttgtggagct

SEQ ID NO: 271969 - DNA, 25 bp, Mus musculus
ctgaccctcagatagtgtttctaga

SEQ ID NO: 271970 - DNA, 25 bp, Mus musculus
ctgaccctcttcggctacagcaagt

SEQ ID NO: 271971 - DNA, 25 bp, Mus musculus
ctgaccctgtgtctcaggggcctac

SEQ ID NO: 271972 - DNA, 25 bp, Mus musculus
ctgaccgacaaaaagatcaggcaaa

SEQ ID NO: 271973 - DNA, 25 bp, Mus musculus
ctgaccgccctgctgctcatgatcc

SEQ ID NO: 271974 - DNA, 25 bp, Mus musculus
ctgaccggggcaggaagtggtcctt

SEQ ID NO: 271975 - DNA, 25 bp, Mus musculus
ctgaccgtgacccagcccgtccgcc

SEQ ID NO: 271976 - DNA, 25 bp, Mus musculus
ctgaccgtggtgagttgaggggtgt

SEQ ID NO: 271977 - DNA, 25 bp, Mus musculus
ctgaccgttgaatcttttgagcata

SEQ ID NO: 271978 - DNA, 25 bp, Mus musculus
ctgacctaccagggtacgagccgcc

SEQ ID NO: 271979 - DNA, 25 bp, Mus musculus
ctgacctactaggtcactgcccagc

SEQ ID NO: 271980 - DNA, 25 bp, Mus musculus
ctgacctatctcgacgtcggatgcg

SEQ ID NO: 271981 - DNA, 25 bp, Mus musculus
ctgacctcaagggtggttttgactg

SEQ ID NO: 271982 - DNA, 25 bp, Mus musculus
ctgacctcaaggtttccctggagaa

SEQ ID NO: 271983 - DNA, 25 bp, Mus musculus
ctgacctcaatgtctttacatccaa

SEQ ID NO: 271984 - DNA, 25 bp, Mus musculus
ctgacctcactcagagccatgatgc

SEQ ID NO: 271985 - DNA, 25 bp, Mus musculus
ctgacctcaggattggaaaactgag

SEQ ID NO: 271986 - DNA, 25 bp, Mus musculus
ctgacctccagaaaggtgctggatc

SEQ ID NO: 271987 - DNA, 25 bp, Mus musculus
ctgacctcgaggaagtggacattgt

SEQ ID NO: 271988 - DNA, 25 bp, Mus musculus
ctgacctctagttgggatgaatggg

SEQ ID NO: 271989 - DNA, 25 bp, Mus musculus
ctgacctgagataccatggccaaag

SEQ ID NO: 271990 - DNA, 25 bp, Mus musculus
ctgacctgcagcaggtgatagaggg

SEQ ID NO: 271991 - DNA, 25 bp, Mus musculus
ctgacctgccaatcccatctctccc

SEQ ID NO: 271992 - DNA, 25 bp, Mus musculus
ctgacctgcgccgagagatcccgat

SEQ ID NO: 271993 - DNA, 25 bp, Mus musculus
ctgacctgcgtgcatcagagtcttc

SEQ ID NO: 271994 - DNA, 25 bp, Mus musculus
ctgacctggagaagctgacctctct

SEQ ID NO: 271995 - DNA, 25 bp, Mus musculus
ctgacctgggagagtttgtgagaag

SEQ ID NO: 271996 - DNA, 25 bp, Mus musculus
ctgacctgtgctgctccgcagaagg

SEQ ID NO: 271997 - DNA, 25 bp, Mus musculus
ctgacctgtggttcctgcacgacca

SEQ ID NO: 271998 - DNA, 25 bp, Mus musculus
ctgaccttataaacttcagtgccct

SEQ ID NO: 271999 - DNA, 25 bp, Mus musculus
ctgaccttcacaccctcagaacagc

SEQ ID NO: 272000 - DNA, 25 bp, Mus musculus
ctgaccttcagctcacgaggcgcat

SEQ ID NO: 272001 - DNA, 25 bp, Mus musculus
ctgaccttcatgcaaggctgggccc

SEQ ID NO: 272002 - DNA, 25 bp, Mus musculus
ctgaccttctagctcaccctagcat

SEQ ID NO: 272003 - DNA, 25 bp, Mus musculus
ctgaccttgaaggggactcagaaga

SEQ ID NO: 272004 - DNA, 25 bp, Mus musculus
ctgaccttgcacgggctgcaggatg

SEQ ID NO: 272005 - DNA, 25 bp, Mus musculus
ctgaccttgctggactcgccagtga

SEQ ID NO: 272006 - DNA, 25 bp, Mus musculus
ctgaccttttgggaccagctggaag

SEQ ID NO: 272007 - DNA, 25 bp, Mus musculus
ctgacgaaaaaagatgattctttta

SEQ ID NO: 272008 - DNA, 25 bp, Mus musculus
ctgacgaaaaaaggaatgtcctcca

SEQ ID NO: 272009 - DNA, 25 bp, Mus musculus
ctgacgaatgcaaggcaccaacaga

SEQ ID NO: 272010 - DNA, 25 bp, Mus musculus
ctgacgaatgcaaggtgagagcaca

SEQ ID NO: 272011 - DNA, 25 bp, Mus musculus
ctgacgacaatgcagctataaaacc

SEQ ID NO: 272012 - DNA, 25 bp, Mus musculus
ctgacgagaccgaggcttacttctt

SEQ ID NO: 272013 - DNA, 25 bp, Mus musculus
ctgacgagaccgaggtctttgacag

SEQ ID NO: 272014 - DNA, 25 bp, Mus musculus
ctgacgagaccgagttacttgccgg

SEQ ID NO: 272015 - DNA, 25 bp, Mus musculus
ctgacgagaccggcggcaagtacat

SEQ ID NO: 272016 - DNA, 25 bp, Mus musculus
ctgacgagcatgagaggaggagctt

SEQ ID NO: 272017 - DNA, 25 bp, Mus musculus
ctgacgagcatgagcttagcagcct

SEQ ID NO: 272018 - DNA, 25 bp, Mus musculus
ctgacgagcatgagtggggtccggc

SEQ ID NO: 272019 - DNA, 25 bp, Mus musculus
ctgacgaggggtctccgggcacaat

SEQ ID NO: 272020 - DNA, 25 bp, Mus musculus
ctgacgattactttgaataccctgg

SEQ ID NO: 272021 - DNA, 25 bp, Mus musculus
ctgacgattactttggccgttgtgc

SEQ ID NO: 272022 - DNA, 25 bp, Mus musculus
ctgacgcaaacacaggtgaaaatct

SEQ ID NO: 272023 - DNA, 25 bp, Mus musculus
ctgacgcaagagcaggaatccagcc

SEQ ID NO: 272024 - DNA, 25 bp, Mus musculus
ctgacgcaggatgatgtctggcagg

SEQ ID NO: 272025 - DNA, 25 bp, Mus musculus
ctgacgcctcaagcacttgtctctg

SEQ ID NO: 272026 - DNA, 25 bp, Mus musculus
ctgacgcctcaagggttgagacatc

SEQ ID NO: 272027 - DNA, 25 bp, Mus musculus
ctgacgcgggtgggtcatcgtggag

SEQ ID NO: 272028 - DNA, 25 bp, Mus musculus
ctgacgctagtcagggacaagaaga

SEQ ID NO: 272029 - DNA, 25 bp, Mus musculus
ctgacgctcagagagggggaggcat

SEQ ID NO: 272030 - DNA, 25 bp, Mus musculus
ctgacgctcagaggttttctctttt

SEQ ID NO: 272031 - DNA, 25 bp, Mus musculus
ctgacgctctacacgatgcggccga

SEQ ID NO: 272032 - DNA, 25 bp, Mus musculus
ctgacgctctacacgtatgaagtac

SEQ ID NO: 272033 - DNA, 25 bp, Mus musculus
ctgacgctgagctccaacagtgtct

SEQ ID NO: 272034 - DNA, 25 bp, Mus musculus
ctgacgctggcagacaccactaact

SEQ ID NO: 272035 - DNA, 25 bp, Mus musculus
ctgacggacagatcttcttggaaac

SEQ ID NO: 272036 - DNA, 25 bp, Mus musculus
ctgacggaccccggcaggaggactg

SEQ ID NO: 272037 - DNA, 25 bp, Mus musculus
ctgacggacccctgtttgtaagcgg

SEQ ID NO: 272038 - DNA, 25 bp, Mus musculus
ctgacggagacagggagttctcaga

SEQ ID NO: 272039 - DNA, 25 bp, Mus musculus
ctgacggagcaggcctgtctcgtca

SEQ ID NO: 272040 - DNA, 25 bp, Mus musculus
ctgacggagggtgaggagttctacg

SEQ ID NO: 272041 - DNA, 25 bp, Mus musculus
ctgacggaggtgtcccctgaactga

SEQ ID NO: 272042 - DNA, 25 bp, Mus musculus
ctgacggatgcggatgccatgaagt

SEQ ID NO: 272043 - DNA, 25 bp, Mus musculus
ctgacggcaccatggcgtttatgtt

SEQ ID NO: 272044 - DNA, 25 bp, Mus musculus
ctgacgtagaggaaatgctgtcatt

SEQ ID NO: 272045 - DNA, 25 bp, Mus musculus
ctgacgtcatagtacaggattcatc

SEQ ID NO: 272046 - DNA, 25 bp, Mus musculus
ctgacgtccattacagaagactgtg

SEQ ID NO: 272047 - DNA, 25 bp, Mus musculus
ctgacgtctccacagccagagaacc

SEQ ID NO: 272048 - DNA, 25 bp, Mus musculus
ctgactacagaggatgcgtccgaag

SEQ ID NO: 272049 - DNA, 25 bp, Mus musculus
ctgactacaggcactggcagatccc

SEQ ID NO: 272050 - DNA, 25 bp, Mus musculus
ctgactacaggtacaatagaggaaa

SEQ ID NO: 272051 - DNA, 25 bp, Mus musculus
ctgactacccgtgatacttaaatac

SEQ ID NO: 272052 - DNA, 25 bp, Mus musculus
ctgactacgagctaaggaggctcgc

SEQ ID NO: 272053 - DNA, 25 bp, Mus musculus
ctgactacgagcttaagtacccacc

SEQ ID NO: 272054 - DNA, 25 bp, Mus musculus
ctgactactccagtcactgtggggc

SEQ ID NO: 272055 - DNA, 25 bp, Mus musculus
ctgactactccatgcggctctgcag

SEQ ID NO: 272056 - DNA, 25 bp, Mus musculus
ctgactagagttagaatcccttcgc

SEQ ID NO: 272057 - DNA, 25 bp, Mus musculus
ctgactatgaacaaataggagacag

SEQ ID NO: 272058 - DNA, 25 bp, Mus musculus
ctgactatgcatcatctatactctt

SEQ ID NO: 272059 - DNA, 25 bp, Mus musculus
ctgactatttggttcctgctgctct

SEQ ID NO: 272060 - DNA, 25 bp, Mus musculus
ctgactcaagggaagtaagcaatgg

SEQ ID NO: 272061 - DNA, 25 bp, Mus musculus
ctgactcacacaaagtttgctaggt

SEQ ID NO: 272062 - DNA, 25 bp, Mus musculus
ctgactcagaacaggtgagaactca

SEQ ID NO: 272063 - DNA, 25 bp, Mus musculus
ctgactcagaagaaccaatcactga

SEQ ID NO: 272064 - DNA, 25 bp, Mus musculus
ctgactcagaaggtgtacagactcc

SEQ ID NO: 272065 - DNA, 25 bp, Mus musculus
ctgactcagactgggcccagtcttc

SEQ ID NO: 272066 - DNA, 25 bp, Mus musculus
ctgactcaggctaagaatggtttta

SEQ ID NO: 272067 - DNA, 25 bp, Mus musculus
ctgactcaggtaggcctgtcaaccc

SEQ ID NO: 272068 - DNA, 25 bp, Mus musculus
ctgactcagtgtctgaaaccaagga

SEQ ID NO: 272069 - DNA, 25 bp, Mus musculus
ctgactcagtgtctggacatttatt

SEQ ID NO: 272070 - DNA, 25 bp, Mus musculus
ctgactcagtgtctggtgcagagtg

SEQ ID NO: 272071 - DNA, 25 bp, Mus musculus
ctgactcatatgagtccaacactgg

SEQ ID NO: 272072 - DNA, 25 bp, Mus musculus
ctgactcatatgccctggtgtgggg

SEQ ID NO: 272073 - DNA, 25 bp, Mus musculus
ctgactcatggtggcccgaggcagc

SEQ ID NO: 272074 - DNA, 25 bp, Mus musculus
ctgactccacgtcgtggtcctgcca

SEQ ID NO: 272075 - DNA, 25 bp, Mus musculus
ctgactccaggaggaatgctgtgga

SEQ ID NO: 272076 - DNA, 25 bp, Mus musculus
ctgactccaggtctgttctcagagc

SEQ ID NO: 272077 - DNA, 25 bp, Mus musculus
ctgactcccagacattgggcctgta

SEQ ID NO: 272078 - DNA, 25 bp, Mus musculus
ctgactcccagaccatctcctacat

SEQ ID NO: 272079 - DNA, 25 bp, Mus musculus
ctgactcccaggatgccctgatgga

SEQ ID NO: 272080 - DNA, 25 bp, Mus musculus
ctgactcctgagatcatgaaggaag

SEQ ID NO: 272081 - DNA, 25 bp, Mus musculus
ctgactcgatggcaccgcatgcgtg

SEQ ID NO: 272082 - DNA, 25 bp, Mus musculus
ctgactcgcaacgagtctgtagctc

SEQ ID NO: 272083 - DNA, 25 bp, Mus musculus
ctgactcggaaaagtcatgttgcaa

SEQ ID NO: 272084 - DNA, 25 bp, Mus musculus
ctgactcggaaagttccattttggg

SEQ ID NO: 272085 - DNA, 25 bp, Mus musculus
ctgactctacagccactacgaaggt

SEQ ID NO: 272086 - DNA, 25 bp, Mus musculus
ctgactctacaggcattgggcatgg

SEQ ID NO: 272087 - DNA, 25 bp, Mus musculus
ctgactctatttcaggactcagtgg

SEQ ID NO: 272088 - DNA, 25 bp, Mus musculus
ctgactctcacaggggagaagcgag

SEQ ID NO: 272089 - DNA, 25 bp, Mus musculus
ctgactctgcaaacagtgccaccaa

SEQ ID NO: 272090 - DNA, 25 bp, Mus musculus
ctgactctggacaaactgtcctgtg

SEQ ID NO: 272091 - DNA, 25 bp, Mus musculus
ctgactctggacaatgccaacagta

SEQ ID NO: 272092 - DNA, 25 bp, Mus musculus
ctgactgaaccttatcaagcactga

SEQ ID NO: 272093 - DNA, 25 bp, Mus musculus
ctgactgagcacactctgcagagga

SEQ ID NO: 272094 - DNA, 25 bp, Mus musculus
ctgactgagcacgcggtggagggag

SEQ ID NO: 272095 - DNA, 25 bp, Mus musculus
ctgactgagtcagaggaggggtgag

SEQ ID NO: 272096 - DNA, 25 bp, Mus musculus
ctgactgagtcagaggatccacact

SEQ ID NO: 272097 - DNA, 25 bp, Mus musculus
ctgactgatagacagcccctgttgc

SEQ ID NO: 272098 - DNA, 25 bp, Mus musculus
ctgactgatagacagctgctgctcc

SEQ ID NO: 272099 - DNA, 25 bp, Mus musculus
ctgactgatatccagtatggaaggg

SEQ ID NO: 272100 - DNA, 25 bp, Mus musculus
ctgactgcagagaggctggcctcca

SEQ ID NO: 272101 - DNA, 25 bp, Mus musculus
ctgactgcagatctgatttgtactc

SEQ ID NO: 272102 - DNA, 25 bp, Mus musculus
ctgactgcagcaggcaccagagttt

SEQ ID NO: 272103 - DNA, 25 bp, Mus musculus
ctgactgccgtatcaacattgatga

SEQ ID NO: 272104 - DNA, 25 bp, Mus musculus
ctgactgctccagcggctgtgacag

SEQ ID NO: 272105 - DNA, 25 bp, Mus musculus
ctgactgctccgaggcatgtccccc

SEQ ID NO: 272106 - DNA, 25 bp, Mus musculus
ctgactgctcttgtctgaaaacagt

SEQ ID NO: 272107 - DNA, 25 bp, Mus musculus
ctgactgctgcagcagagagccagc

SEQ ID NO: 272108 - DNA, 25 bp, Mus musculus
ctgactgctgcggacaagtttttac

SEQ ID NO: 272109 - DNA, 25 bp, Mus musculus
ctgactgcttctgtatcaagatatt

SEQ ID NO: 272110 - DNA, 25 bp, Mus musculus
ctgactggaaagcactctccagccc

SEQ ID NO: 272111 - DNA, 25 bp, Mus musculus
ctgactggaaggatctgcgatggcg

SEQ ID NO: 272112 - DNA, 25 bp, Mus musculus
ctgactggacatgattttgggcatc

SEQ ID NO: 272113 - DNA, 25 bp, Mus musculus
ctgactggacatggggatcctgtgg

SEQ ID NO: 272114 - DNA, 25 bp, Mus musculus
ctgactggctggtttttcaacgacg

SEQ ID NO: 272115 - DNA, 25 bp, Mus musculus
ctgactgggagacttgtggcaatat

SEQ ID NO: 272116 - DNA, 25 bp, Mus musculus
ctgactgtctacagtgtctagctgc

SEQ ID NO: 272117 - DNA, 25 bp, Mus musculus
ctgactgtcttgagtgtctagctgc

SEQ ID NO: 272118 - DNA, 25 bp, Mus musculus
ctgactgtggaagaaggtggtgatc

SEQ ID NO: 272119 - DNA, 25 bp, Mus musculus
ctgactgtgtgtcccatgggtgctt

SEQ ID NO: 272120 - DNA, 25 bp, Mus musculus
ctgactgttaatagcccacaggtcc

SEQ ID NO: 272121 - DNA, 25 bp, Mus musculus
ctgactgttaataggtcctgcctcc

SEQ ID NO: 272122 - DNA, 25 bp, Mus musculus
ctgacttaccagctgggaagggcta

SEQ ID NO: 272123 - DNA, 25 bp, Mus musculus
ctgacttagagaagagtgggaatgc

SEQ ID NO: 272124 - DNA, 25 bp, Mus musculus
ctgacttagaggaaatgctgtcatt

SEQ ID NO: 272125 - DNA, 25 bp, Mus musculus
ctgacttagccgagttcaatctcat

SEQ ID NO: 272126 - DNA, 25 bp, Mus musculus
ctgacttcaatggggttgcggccgt

SEQ ID NO: 272127 - DNA, 25 bp, Mus musculus
ctgacttcacagtggaaggacattc

SEQ ID NO: 272128 - DNA, 25 bp, Mus musculus
ctgacttcactaaagcaaaaatcgt

SEQ ID NO: 272129 - DNA, 25 bp, Mus musculus
ctgacttcactaaggcaaaaatcgt

SEQ ID NO: 272130 - DNA, 25 bp, Mus musculus
ctgacttccagatgatgttgatcct

SEQ ID NO: 272131 - DNA, 25 bp, Mus musculus
ctgacttcccagatggcgaatactg

SEQ ID NO: 272132 - DNA, 25 bp, Mus musculus
ctgacttcccaggagctgatgcact

SEQ ID NO: 272133 - DNA, 25 bp, Mus musculus
ctgacttcccttagaatgtgatttt

SEQ ID NO: 272134 - DNA, 25 bp, Mus musculus
ctgacttctggatggacagtctgag

SEQ ID NO: 272135 - DNA, 25 bp, Mus musculus
ctgacttctgtttctcttcagcaac

SEQ ID NO: 272136 - DNA, 25 bp, Mus musculus
ctgacttgacctcagatcttggtaa

SEQ ID NO: 272137 - DNA, 25 bp, Mus musculus
ctgacttgagaggcccaggatgggt

SEQ ID NO: 272138 - DNA, 25 bp, Mus musculus
ctgacttgagggagtgcccagctgc

SEQ ID NO: 272139 - DNA, 25 bp, Mus musculus
ctgacttgagggtcctgagggaggc

SEQ ID NO: 272140 - DNA, 25 bp, Mus musculus
ctgacttgatagcatagaaaattgg

SEQ ID NO: 272141 - DNA, 25 bp, Mus musculus
ctgacttgatgtgtcttaccactga

SEQ ID NO: 272142 - DNA, 25 bp, Mus musculus
ctgacttgcaggttgatatgtcaga

SEQ ID NO: 272143 - DNA, 25 bp, Mus musculus
ctgacttggggaagaaagtgaatcc

SEQ ID NO: 272144 - DNA, 25 bp, Mus musculus
ctgacttgttggcccgtgggattga

SEQ ID NO: 272145 - DNA, 25 bp, Mus musculus
ctgactttaaactagcagggggagg

SEQ ID NO: 272146 - DNA, 25 bp, Mus musculus
ctgactttaatcaaagcaatggaag

SEQ ID NO: 272147 - DNA, 25 bp, Mus musculus
ctgactttcatgatgcccccaccat

SEQ ID NO: 272148 - DNA, 25 bp, Mus musculus
ctgactttgagcggaggctgctgaa

SEQ ID NO: 272149 - DNA, 25 bp, Mus musculus
ctgactttgatgaggtacagtatca

SEQ ID NO: 272150 - DNA, 25 bp, Mus musculus
ctgactttgccttcaatctcacaga

SEQ ID NO: 272151 - DNA, 25 bp, Mus musculus
ctgactttgggtaatgttctccttt

SEQ ID NO: 272152 - DNA, 25 bp, Mus musculus
ctgacttttagaaccagctcagcta

SEQ ID NO: 272153 - DNA, 25 bp, Mus musculus
ctgactttttcgctgccttggggtg

SEQ ID NO: 272154 - DNA, 25 bp, Mus musculus
ctgactttttcggtgcctcctgaga

SEQ ID NO: 272155 - DNA, 25 bp, Mus musculus
ctgagaaaacagaagattctagtgt

SEQ ID NO: 272156 - DNA, 25 bp, Mus musculus
ctgagaaaacaggatctgactttgt

SEQ ID NO: 272157 - DNA, 25 bp, Mus musculus
ctgagaaaagggcagtcatggaagt

SEQ ID NO: 272158 - DNA, 25 bp, Mus musculus
ctgagaaacagcacacagggccaga

SEQ ID NO: 272159 - DNA, 25 bp, Mus musculus
ctgagaaacaggtggaagagctgtt

SEQ ID NO: 272160 - DNA, 25 bp, Mus musculus
ctgagaaacctgagatttctgtttt

SEQ ID NO: 272161 - DNA, 25 bp, Mus musculus
ctgagaaacctgaggagttaggatc

SEQ ID NO: 272162 - DNA, 25 bp, Mus musculus
ctgagaaactgatctctcacctatc

SEQ ID NO: 272163 - DNA, 25 bp, Mus musculus
ctgagaaactggagaccttcttcgg

SEQ ID NO: 272164 - DNA, 25 bp, Mus musculus
ctgagaaactgggtgctcttctctc

SEQ ID NO: 272165 - DNA, 25 bp, Mus musculus
ctgagaaacttgaggccagaagtca

SEQ ID NO: 272166 - DNA, 25 bp, Mus musculus
ctgagaaacttgagtatgaaagcaa

SEQ ID NO: 272167 - DNA, 25 bp, Mus musculus
ctgagaaagaagctgctccagctgc

SEQ ID NO: 272168 - DNA, 25 bp, Mus musculus
ctgagaaagcataagaatgttttga

SEQ ID NO: 272169 - DNA, 25 bp, Mus musculus
ctgagaaagcataaggtgactcata

SEQ ID NO: 272170 - DNA, 25 bp, Mus musculus
ctgagaaataccagtccctggccta

SEQ ID NO: 272171 - DNA, 25 bp, Mus musculus
ctgagaaatcaggtcttaatttgca

SEQ ID NO: 272172 - DNA, 25 bp, Mus musculus
ctgagaaatgcaggaatctccggtt

SEQ ID NO: 272173 - DNA, 25 bp, Mus musculus
ctgagaaatggcatttatctgggag

SEQ ID NO: 272174 - DNA, 25 bp, Mus musculus
ctgagaacaggaagcccagccctgg

SEQ ID NO: 272175 - DNA, 25 bp, Mus musculus
ctgagaacaggaatggccttgatga

SEQ ID NO: 272176 - DNA, 25 bp, Mus musculus
ctgagaacaggtccaaagagaaagc

SEQ ID NO: 272177 - DNA, 25 bp, Mus musculus
ctgagaacaggtctaggtccaaaga

SEQ ID NO: 272178 - DNA, 25 bp, Mus musculus
ctgagaaccgggaccgcgtggcgcg

SEQ ID NO: 272179 - DNA, 25 bp, Mus musculus
ctgagaacctgccctgcagttaaac

SEQ ID NO: 272180 - DNA, 25 bp, Mus musculus
ctgagaacggaaacctccacatgga

SEQ ID NO: 272181 - DNA, 25 bp, Mus musculus
ctgagaacttcaggctcctgggcaa

SEQ ID NO: 272182 - DNA, 25 bp, Mus musculus
ctgagaagaaggtgtttctcctggc

SEQ ID NO: 272183 - DNA, 25 bp, Mus musculus
ctgagaagacccagaaatttgtatg

SEQ ID NO: 272184 - DNA, 25 bp, Mus musculus
ctgagaagatgggtaatgccatcga

SEQ ID NO: 272185 - DNA, 25 bp, Mus musculus
ctgagaagcaggctgtgcagctatc

SEQ ID NO: 272186 - DNA, 25 bp, Mus musculus
ctgagaagcaggtctgttctcctgg

SEQ ID NO: 272187 - DNA, 25 bp, Mus musculus
ctgagaaggaacaaggtctgcaaac

SEQ ID NO: 272188 - DNA, 25 bp, Mus musculus
ctgagaaggaaggtctgtctgcagg

SEQ ID NO: 272189 - DNA, 25 bp, Mus musculus
ctgagaaggacaaattggagcctgc

SEQ ID NO: 272190 - DNA, 25 bp, Mus musculus
ctgagaaggacaaggttaactgctc

SEQ ID NO: 272191 - DNA, 25 bp, Mus musculus
ctgagaaggagacaatcccagacat

SEQ ID NO: 272192 - DNA, 25 bp, Mus musculus
ctgagaaggagcttcctgtcacgga

SEQ ID NO: 272193 - DNA, 25 bp, Mus musculus
ctgagaaggaggtcactcttatcca

SEQ ID NO: 272194 - DNA, 25 bp, Mus musculus
ctgagaaggatgcccactgagcagg

SEQ ID NO: 272195 - DNA, 25 bp, Mus musculus
ctgagaagggcaaagacgatgcggt

SEQ ID NO: 272196 - DNA, 25 bp, Mus musculus
ctgagaagggcaaaggctggagcaa

SEQ ID NO: 272197 - DNA, 25 bp, Mus musculus
ctgagaagtcgggtacaaagtaaga

SEQ ID NO: 272198 - DNA, 25 bp, Mus musculus
ctgagaagtctggagaaatctgggc

SEQ ID NO: 272199 - DNA, 25 bp, Mus musculus
ctgagaataaatccaagtttggggc

SEQ ID NO: 272200 - DNA, 25 bp, Mus musculus
ctgagaataaatccttggagctggt

SEQ ID NO: 272201 - DNA, 25 bp, Mus musculus
ctgagaataaatgcctttaatgtga

SEQ ID NO: 272202 - DNA, 25 bp, Mus musculus
ctgagaatatgtacttttctcactt

SEQ ID NO: 272203 - DNA, 25 bp, Mus musculus
ctgagaatccagaaatggcctccac

SEQ ID NO: 272204 - DNA, 25 bp, Mus musculus
ctgagaatccagatccagggttcct

SEQ ID NO: 272205 - DNA, 25 bp, Mus musculus
ctgagaatccaggtctcccggactt

SEQ ID NO: 272206 - DNA, 25 bp, Mus musculus
ctgagaatgaagacactcagccgga

SEQ ID NO: 272207 - DNA, 25 bp, Mus musculus
ctgagaatgaaggctctggaatggc

SEQ ID NO: 272208 - DNA, 25 bp, Mus musculus
ctgagaattcaagtctgtcacctaa

SEQ ID NO: 272209 - DNA, 25 bp, Mus musculus
ctgagaattgattcatctgtttgta

SEQ ID NO: 272210 - DNA, 25 bp, Mus musculus
ctgagacaagcaaggaggtgagtgc

SEQ ID NO: 272211 - DNA, 25 bp, Mus musculus
ctgagacaagcaagggctctgtaaa

SEQ ID NO: 272212 - DNA, 25 bp, Mus musculus
ctgagacatcctaagatcaaacaaa

SEQ ID NO: 272213 - DNA, 25 bp, Mus musculus
ctgagacatcctaaggtcctcggcc

SEQ ID NO: 272214 - DNA, 25 bp, Mus musculus
ctgagacatttcaagaagacagcat

SEQ ID NO: 272215 - DNA, 25 bp, Mus musculus
ctgagacatttcaagctcttagccc

SEQ ID NO: 272216 - DNA, 25 bp, Mus musculus
ctgagaccaccctcccttggaacgc

SEQ ID NO: 272217 - DNA, 25 bp, Mus musculus
ctgagaccagacgtctccaccagct

SEQ ID NO: 272218 - DNA, 25 bp, Mus musculus
ctgagaccattacagaagctgaacc

SEQ ID NO: 272219 - DNA, 25 bp, Mus musculus
ctgagacccaacagaaaaatggcta

SEQ ID NO: 272220 - DNA, 25 bp, Mus musculus
ctgagacccaagggcctgatttgtt

SEQ ID NO: 272221 - DNA, 25 bp, Mus musculus
ctgagacccaggtggtactgataaa

SEQ ID NO: 272222 - DNA, 25 bp, Mus musculus
ctgagaccccgagtggaaagctgag

SEQ ID NO: 272223 - DNA, 25 bp, Mus musculus
ctgagaccttcaccttccagagaag

SEQ ID NO: 272224 - DNA, 25 bp, Mus musculus
ctgagaccttccaggaacttccatt

SEQ ID NO: 272225 - DNA, 25 bp, Mus musculus
ctgagaccttccaggtggaggattt

SEQ ID NO: 272226 - DNA, 25 bp, Mus musculus
ctgagacggttctacatccctttca

SEQ ID NO: 272227 - DNA, 25 bp, Mus musculus
ctgagacggttctagatccctttca

SEQ ID NO: 272228 - DNA, 25 bp, Mus musculus
ctgagacgtgaaagataaagctttt

SEQ ID NO: 272229 - DNA, 25 bp, Mus musculus
ctgagactaaagtctttaagaaata

SEQ ID NO: 272230 - DNA, 25 bp, Mus musculus
ctgagactgaccaaggctccagaaa

SEQ ID NO: 272231 - DNA, 25 bp, Mus musculus
ctgagactgaccaaggggctgacgg

SEQ ID NO: 272232 - DNA, 25 bp, Mus musculus
ctgagactgagatagacaccatctt

SEQ ID NO: 272233 - DNA, 25 bp, Mus musculus
ctgagactgagatagatttcaaata

SEQ ID NO: 272234 - DNA, 25 bp, Mus musculus
ctgagacttacagattgccaaaatg

SEQ ID NO: 272235 - DNA, 25 bp, Mus musculus
ctgagacttgacaaggtggtgacag

SEQ ID NO: 272236 - DNA, 25 bp, Mus musculus
ctgagactttccaagaaagtcactg

SEQ ID NO: 272237 - DNA, 25 bp, Mus musculus
ctgagactttccaaggtggaacttg

SEQ ID NO: 272238 - DNA, 25 bp, Mus musculus
ctgagagaaactgcaagaaaaatga

SEQ ID NO: 272239 - DNA, 25 bp, Mus musculus
ctgagagaaagtgatgtatcgcctg

SEQ ID NO: 272240 - DNA, 25 bp, Mus musculus
ctgagagaacatgaacaaaaagttt

SEQ ID NO: 272241 - DNA, 25 bp, Mus musculus
ctgagagaagacccatgcttgtaca

SEQ ID NO: 272242 - DNA, 25 bp, Mus musculus
ctgagagaaggtggagcagccctgg

SEQ ID NO: 272243 - DNA, 25 bp, Mus musculus
ctgagagaatggctgataatgcctg

SEQ ID NO: 272244 - DNA, 25 bp, Mus musculus
ctgagagacaggacggggcgctgtt

SEQ ID NO: 272245 - DNA, 25 bp, Mus musculus
ctgagagacaggccttctgtatact

SEQ ID NO: 272246 - DNA, 25 bp, Mus musculus
ctgagagacttaaaatgaaatggaa

SEQ ID NO: 272247 - DNA, 25 bp, Mus musculus
ctgagagagaggatgagaccggggc

SEQ ID NO: 272248 - DNA, 25 bp, Mus musculus
ctgagagataaggcacctccaagtg

SEQ ID NO: 272249 - DNA, 25 bp, Mus musculus
ctgagagatcccagcatatcaatga

SEQ ID NO: 272250 - DNA, 25 bp, Mus musculus
ctgagagatcccaggatatcaatga

SEQ ID NO: 272251 - DNA, 25 bp, Mus musculus
ctgagagatgcaagctgataggagc

SEQ ID NO: 272252 - DNA, 25 bp, Mus musculus
ctgagagattagaagaaaaccacga

SEQ ID NO: 272253 - DNA, 25 bp, Mus musculus
ctgagagcaaaaagaacatgtttgg

SEQ ID NO: 272254 - DNA, 25 bp, Mus musculus
ctgagagcacggactagaagtgaga

SEQ ID NO: 272255 - DNA, 25 bp, Mus musculus
ctgagagccagagctgttctgccaa

SEQ ID NO: 272256 - DNA, 25 bp, Mus musculus
ctgagagccagatatccattgaata

SEQ ID NO: 272257 - DNA, 25 bp, Mus musculus
ctgagagcgaaccccgactgcaggg

SEQ ID NO: 272258 - DNA, 25 bp, Mus musculus
ctgagagctagcagacatctctgtg

SEQ ID NO: 272259 - DNA, 25 bp, Mus musculus
ctgagagctagcagttccagtgcag

SEQ ID NO: 272260 - DNA, 25 bp, Mus musculus
ctgagagctggctcccttccccagg

SEQ ID NO: 272261 - DNA, 25 bp, Mus musculus
ctgagaggaaccattctctgaggat

SEQ ID NO: 272262 - DNA, 25 bp, Mus musculus
ctgagaggaacccttctctgaggat

SEQ ID NO: 272263 - DNA, 25 bp, Mus musculus
ctgagaggaagttttatctgtgcaa

SEQ ID NO: 272264 - DNA, 25 bp, Mus musculus
ctgagaggaagttttatctgtgcag

SEQ ID NO: 272265 - DNA, 25 bp, Mus musculus
ctgagaggacagccctgactccccc

SEQ ID NO: 272266 - DNA, 25 bp, Mus musculus
ctgagaggacaggcattgttatcgg

SEQ ID NO: 272267 - DNA, 25 bp, Mus musculus
ctgagaggagcacaggaccatcaga

SEQ ID NO: 272268 - DNA, 25 bp, Mus musculus
ctgagaggcatcaagagtcattccc

SEQ ID NO: 272269 - DNA, 25 bp, Mus musculus
ctgagaggttccacaacttagaagg

SEQ ID NO: 272270 - DNA, 25 bp, Mus musculus
ctgagagtaagatttatgacattca

SEQ ID NO: 272271 - DNA, 25 bp, Mus musculus
ctgagagtcgggccctgtctccaac

SEQ ID NO: 272272 - DNA, 25 bp, Mus musculus
ctgagagtcgggggcctggtgtaca

SEQ ID NO: 272273 - DNA, 25 bp, Mus musculus
ctgagagtgagaagcatttcttcac

SEQ ID NO: 272274 - DNA, 25 bp, Mus musculus
ctgagagtggcaggaagaagtccca

SEQ ID NO: 272275 - DNA, 25 bp, Mus musculus
ctgagatacaaggaaagaaaggaga

SEQ ID NO: 272276 - DNA, 25 bp, Mus musculus
ctgagatagaaagaaaggcccaggc

SEQ ID NO: 272277 - DNA, 25 bp, Mus musculus
ctgagatcacaggggacctcagccc

SEQ ID NO: 272278 - DNA, 25 bp, Mus musculus
ctgagatcattaggaaacaggtctc

SEQ ID NO: 272279 - DNA, 25 bp, Mus musculus
ctgagatcattaggtctcagccact

SEQ ID NO: 272280 - DNA, 25 bp, Mus musculus
ctgagatcgacaggaagcccgcaat

SEQ ID NO: 272281 - DNA, 25 bp, Mus musculus
ctgagatctcagtccaagaaagctg

SEQ ID NO: 272282 - DNA, 25 bp, Mus musculus
ctgagatctcagtgctgatctggga

SEQ ID NO: 272283 - DNA, 25 bp, Mus musculus
ctgagatcttaaaggttgccaggat

SEQ ID NO: 272284 - DNA, 25 bp, Mus musculus
ctgagatcttggaaatagcagacac

SEQ ID NO: 272285 - DNA, 25 bp, Mus musculus
ctgagatgacagcagaagtccataa

SEQ ID NO: 272286 - DNA, 25 bp, Mus musculus
ctgagatgacagcagccttcaaggg

SEQ ID NO: 272287 - DNA, 25 bp, Mus musculus
ctgagatggaaaagcaaaaggtggc

SEQ ID NO: 272288 - DNA, 25 bp, Mus musculus
ctgagatggaaaaggtggcgcgtta

SEQ ID NO: 272289 - DNA, 25 bp, Mus musculus
ctgagatggtgcaggacatgggggc

SEQ ID NO: 272290 - DNA, 25 bp, Mus musculus
ctgagattaaagacagctgcagcac

SEQ ID NO: 272291 - DNA, 25 bp, Mus musculus
ctgagattaaagcattggataccct

SEQ ID NO: 272292 - DNA, 25 bp, Mus musculus
ctgagattaaaggacaaccctccat

SEQ ID NO: 272293 - DNA, 25 bp, Mus musculus
ctgagattaaaggcctctggggacc

SEQ ID NO: 272294 - DNA, 25 bp, Mus musculus
ctgagattacagaatcgtatggaag

SEQ ID NO: 272295 - DNA, 25 bp, Mus musculus
ctgagattacagagaaaacagaggc

SEQ ID NO: 272296 - DNA, 25 bp, Mus musculus
ctgagattacagaggcctcattcac

SEQ ID NO: 272297 - DNA, 25 bp, Mus musculus
ctgagattacaggaatggaagaaag

SEQ ID NO: 272298 - DNA, 25 bp, Mus musculus
ctgagattacagggacagtgatcat

SEQ ID NO: 272299 - DNA, 25 bp, Mus musculus
ctgagattacaggtgtggttgaatc

SEQ ID NO: 272300 - DNA, 25 bp, Mus musculus
ctgagattgaagaaaccgggctcca

SEQ ID NO: 272301 - DNA, 25 bp, Mus musculus
ctgagattgccaggcccgacgactc

SEQ ID NO: 272302 - DNA, 25 bp, Mus musculus
ctgagcaaacagctgcccgggagga

SEQ ID NO: 272303 - DNA, 25 bp, Mus musculus
ctgagcaaagatgaagcggcagctg

SEQ ID NO: 272304 - DNA, 25 bp, Mus musculus
ctgagcaaaggagtgattctcgatc

SEQ ID NO: 272305 - DNA, 25 bp, Mus musculus
ctgagcaaattcagatataaaaaga

SEQ ID NO: 272306 - DNA, 25 bp, Mus musculus
ctgagcaaattcagctaataatttt

SEQ ID NO: 272307 - DNA, 25 bp, Mus musculus
ctgagcaactagggttacagggaaa

SEQ ID NO: 272308 - DNA, 25 bp, Mus musculus
ctgagcaactagtctaaatgttcag

SEQ ID NO: 272309 - DNA, 25 bp, Mus musculus
ctgagcaaggaggacttcgtggaga

SEQ ID NO: 272310 - DNA, 25 bp, Mus musculus
ctgagcaaggagtggctccgcgggc

SEQ ID NO: 272311 - DNA, 25 bp, Mus musculus
ctgagcaataagagcggtctcaccc

SEQ ID NO: 272312 - DNA, 25 bp, Mus musculus
ctgagcacaatcagagctattctca

SEQ ID NO: 272313 - DNA, 25 bp, Mus musculus
ctgagcacaatcaggtggaaacttc

SEQ ID NO: 272314 - DNA, 25 bp, Mus musculus
ctgagcacaatcaggtggccaatag

SEQ ID NO: 272315 - DNA, 25 bp, Mus musculus
ctgagcacaatcaggtgggagaaaa

SEQ ID NO: 272316 - DNA, 25 bp, Mus musculus
ctgagcacagtgagcatgtttttga

SEQ ID NO: 272317 - DNA, 25 bp, Mus musculus
ctgagcaccagggcttccagctggc

SEQ ID NO: 272318 - DNA, 25 bp, Mus musculus
ctgagcacggtgcctgtggcctaag

SEQ ID NO: 272319 - DNA, 25 bp, Mus musculus
ctgagcacggtgttcctgtagttgc

SEQ ID NO: 272320 - DNA, 25 bp, Mus musculus
ctgagcactggaggagttgtaatgg

SEQ ID NO: 272321 - DNA, 25 bp, Mus musculus
ctgagcagaagggccttcttgaagt

SEQ ID NO: 272322 - DNA, 25 bp, Mus musculus
ctgagcagagtcactgagggccagg

SEQ ID NO: 272323 - DNA, 25 bp, Mus musculus
ctgagcagcacagattctaactcag

SEQ ID NO: 272324 - DNA, 25 bp, Mus musculus
ctgagcagcacgcctccggtctacc

SEQ ID NO: 272325 - DNA, 25 bp, Mus musculus
ctgagcagcaggctgacgaggtccc

SEQ ID NO: 272326 - DNA, 25 bp, Mus musculus
ctgagcagcaggtgaaccagctggt

SEQ ID NO: 272327 - DNA, 25 bp, Mus musculus
ctgagcaggagaatctggagaagca

SEQ ID NO: 272328 - DNA, 25 bp, Mus musculus
ctgagcaggaggatgagtctgagga

SEQ ID NO: 272329 - DNA, 25 bp, Mus musculus
ctgagcagggcgaaggagcagggcg

SEQ ID NO: 272330 - DNA, 25 bp, Mus musculus
ctgagcagtccgcaggtctttggcc

SEQ ID NO: 272331 - DNA, 25 bp, Mus musculus
ctgagcatccagggtgagtgtccat

SEQ ID NO: 272332 - DNA, 25 bp, Mus musculus
ctgagcatgagcttttatgggagcc

SEQ ID NO: 272333 - DNA, 25 bp, Mus musculus
ctgagcatgaggtctcagacagccc

SEQ ID NO: 272334 - DNA, 25 bp, Mus musculus
ctgagcatgcacaggaaaagttatt

SEQ ID NO: 272335 - DNA, 25 bp, Mus musculus
ctgagcatgctttcatgagcatgtt

SEQ ID NO: 272336 - DNA, 25 bp, Mus musculus
ctgagcatgtaagctctggcttctc

SEQ ID NO: 272337 - DNA, 25 bp, Mus musculus
ctgagcattggaaacaagctcccat

SEQ ID NO: 272338 - DNA, 25 bp, Mus musculus
ctgagcatttcacagctattgtcca

SEQ ID NO: 272339 - DNA, 25 bp, Mus musculus
ctgagccaacatggtcgtgaaaata

SEQ ID NO: 272340 - DNA, 25 bp, Mus musculus
ctgagccatctgggaaagatgtgga

SEQ ID NO: 272341 - DNA, 25 bp, Mus musculus
ctgagccatctgggaagatgtctgc

SEQ ID NO: 272342 - DNA, 25 bp, Mus musculus
ctgagcccagaggcagactcacctc

SEQ ID NO: 272343 - DNA, 25 bp, Mus musculus
ctgagcccagcagcgtaaacgaccc

SEQ ID NO: 272344 - DNA, 25 bp, Mus musculus
ctgagcccaggaaactacaaccttt

SEQ ID NO: 272345 - DNA, 25 bp, Mus musculus
ctgagcccatgagtggaaacaagtt

SEQ ID NO: 272346 - DNA, 25 bp, Mus musculus
ctgagcccatggttccaggatggct

SEQ ID NO: 272347 - DNA, 25 bp, Mus musculus
ctgagcccccgcaggataaggaagc

SEQ ID NO: 272348 - DNA, 25 bp, Mus musculus
ctgagcccccgcaggtgcgcttgag

SEQ ID NO: 272349 - DNA, 25 bp, Mus musculus
ctgagccccgagggtcctgcggtgg

SEQ ID NO: 272350 - DNA, 25 bp, Mus musculus
ctgagccccgtgtactggttccgcc

SEQ ID NO: 272351 - DNA, 25 bp, Mus musculus
ctgagcccggctgtgctggatgccc

SEQ ID NO: 272352 - DNA, 25 bp, Mus musculus
ctgagccctgaagattttctgcatt

SEQ ID NO: 272353 - DNA, 25 bp, Mus musculus
ctgagccctgcgccaaaacgacacc

SEQ ID NO: 272354 - DNA, 25 bp, Mus musculus
ctgagccgagagaagagccctgggg

SEQ ID NO: 272355 - DNA, 25 bp, Mus musculus
ctgagccgcattaaggacagccttc

SEQ ID NO: 272356 - DNA, 25 bp, Mus musculus
ctgagccggaggttccaggatggct

SEQ ID NO: 272357 - DNA, 25 bp, Mus musculus
ctgagcctcactggtgggtgtgcaa

SEQ ID NO: 272358 - DNA, 25 bp, Mus musculus
ctgagcctccagtgttgagtggaga

SEQ ID NO: 272359 - DNA, 25 bp, Mus musculus
ctgagcctcgttccagggtcacatc

SEQ ID NO: 272360 - DNA, 25 bp, Mus musculus
ctgagcctcttaaggtcattttctt

SEQ ID NO: 272361 - DNA, 25 bp, Mus musculus
ctgagcctgaagaaaaagttaaact

SEQ ID NO: 272362 - DNA, 25 bp, Mus musculus
ctgagcctgaagtggtgttcaacat

SEQ ID NO: 272363 - DNA, 25 bp, Mus musculus
ctgagcctggggaacaaaaactgca

SEQ ID NO: 272364 - DNA, 25 bp, Mus musculus
ctgagcctgggtcactgttctggga

SEQ ID NO: 272365 - DNA, 25 bp, Mus musculus
ctgagccttcgcgaggtggtggctg

SEQ ID NO: 272366 - DNA, 25 bp, Mus musculus
ctgagccttgcgtgccctcccagtc

SEQ ID NO: 272367 - DNA, 25 bp, Mus musculus
ctgagccttgctcaggagtatcccg

SEQ ID NO: 272368 - DNA, 25 bp, Mus musculus
ctgagccttgctcaggtttcccttc

SEQ ID NO: 272369 - DNA, 25 bp, Mus musculus
ctgagcgaccagagatgtggctttg

SEQ ID NO: 272370 - DNA, 25 bp, Mus musculus
ctgagcgaccaggacaggattccat

SEQ ID NO: 272371 - DNA, 25 bp, Mus musculus
ctgagcgactgaggcaattaaaaac

SEQ ID NO: 272372 - DNA, 25 bp, Mus musculus
ctgagcgactgaggtctgccgacgg

SEQ ID NO: 272373 - DNA, 25 bp, Mus musculus
ctgagcgagagagggaactggagga

SEQ ID NO: 272374 - DNA, 25 bp, Mus musculus
ctgagcgaggcgagcgtgcacagtg

SEQ ID NO: 272375 - DNA, 25 bp, Mus musculus
ctgagcgaggcgaggcaccatgaca

SEQ ID NO: 272376 - DNA, 25 bp, Mus musculus
ctgagcgaggtgtgactgcaaagtg

SEQ ID NO: 272377 - DNA, 25 bp, Mus musculus
ctgagcgagttcaagaacctggaca

SEQ ID NO: 272378 - DNA, 25 bp, Mus musculus
ctgagcgagttcaagctgatcatgg

SEQ ID NO: 272379 - DNA, 25 bp, Mus musculus
ctgagcgcagtgggagatttgaaaa

SEQ ID NO: 272380 - DNA, 25 bp, Mus musculus
ctgagcgcattgaggaaagcgggac

SEQ ID NO: 272381 - DNA, 25 bp, Mus musculus
ctgagcgccagagtacagtcgcttt

SEQ ID NO: 272382 - DNA, 25 bp, Mus musculus
ctgagcgctgagattggtgtccttt

SEQ ID NO: 272383 - DNA, 25 bp, Mus musculus
ctgagcgctgattcctgagtcaggc

SEQ ID NO: 272384 - DNA, 25 bp, Mus musculus
ctgagcggactggcttttatgaaac

SEQ ID NO: 272385 - DNA, 25 bp, Mus musculus
ctgagcggagttgagattcccaccc

SEQ ID NO: 272386 - DNA, 25 bp, Mus musculus
ctgagcggccggaagatggcagact

SEQ ID NO: 272387 - DNA, 25 bp, Mus musculus
ctgagcggccggaaggagtggaatg

SEQ ID NO: 272388 - DNA, 25 bp, Mus musculus
ctgagcggccggaagtgttactgtg

SEQ ID NO: 272389 - DNA, 25 bp, Mus musculus
ctgagcggcggaagggttaccctcg

SEQ ID NO: 272390 - DNA, 25 bp, Mus musculus
ctgagcggtaggagggaactgagcc

SEQ ID NO: 272391 - DNA, 25 bp, Mus musculus
ctgagcgtggagaaaaagcagcgat

SEQ ID NO: 272392 - DNA, 25 bp, Mus musculus
ctgagcgtgttggggacaaagagaa

SEQ ID NO: 272393 - DNA, 25 bp, Mus musculus
ctgagctcaagcccccggaagcctc

SEQ ID NO: 272394 - DNA, 25 bp, Mus musculus
ctgagctcaatatggatcaaaatta

SEQ ID NO: 272395 - DNA, 25 bp, Mus musculus
ctgagctcaccaagctactccattc

SEQ ID NO: 272396 - DNA, 25 bp, Mus musculus
ctgagctctgcaggggactcctttt

SEQ ID NO: 272397 - DNA, 25 bp, Mus musculus
ctgagctctgggatcagtttgacaa

SEQ ID NO: 272398 - DNA, 25 bp, Mus musculus
ctgagctcttccaacacttcgacaa

SEQ ID NO: 272399 - DNA, 25 bp, Mus musculus
ctgagctgaactgagctgagctggg

SEQ ID NO: 272400 - DNA, 25 bp, Mus musculus
ctgagctgagaggcaaacccgtggc

SEQ ID NO: 272401 - DNA, 25 bp, Mus musculus
ctgagctgagctggagagtcagtcc

SEQ ID NO: 272402 - DNA, 25 bp, Mus musculus
ctgagctgagctggcaactattgat

SEQ ID NO: 272403 - DNA, 25 bp, Mus musculus
ctgagctgagctgggagagtcagtc

SEQ ID NO: 272404 - DNA, 25 bp, Mus musculus
ctgagctgcaagataagcagacagc

SEQ ID NO: 272405 - DNA, 25 bp, Mus musculus
ctgagctgcaaggaactcattatac

SEQ ID NO: 272406 - DNA, 25 bp, Mus musculus
ctgagctgcgaggggtcctgagaag

SEQ ID NO: 272407 - DNA, 25 bp, Mus musculus
ctgagctggaagatttcatcctgat

SEQ ID NO: 272408 - DNA, 25 bp, Mus musculus
ctgagctggcaccagctgaggatgg

SEQ ID NO: 272409 - DNA, 25 bp, Mus musculus
ctgagctgggagagtcagtccttcc

SEQ ID NO: 272410 - DNA, 25 bp, Mus musculus
ctgagctgtgaggcgcagcaagcac

SEQ ID NO: 272411 - DNA, 25 bp, Mus musculus
ctgagcttgagcagcatcagaaaag

SEQ ID NO: 272412 - DNA, 25 bp, Mus musculus
ctgagcttgagcagctgagtccctt

SEQ ID NO: 272413 - DNA, 25 bp, Mus musculus
ctgagcttgcaggcatctagtcttg

SEQ ID NO: 272414 - DNA, 25 bp, Mus musculus
ctgagcttgctaagctacaagaaga

SEQ ID NO: 272415 - DNA, 25 bp, Mus musculus
ctgagcttgctaaggtggaagaaga

SEQ ID NO: 272416 - DNA, 25 bp, Mus musculus
ctgagcttggagcagctgggaacac

SEQ ID NO: 272417 - DNA, 25 bp, Mus musculus
ctgagctttcggagcattttctgca

SEQ ID NO: 272418 - DNA, 25 bp, Mus musculus
ctgaggaaacaggccgaggaagatg

SEQ ID NO: 272419 - DNA, 25 bp, Mus musculus
ctgaggaaacaggggaacacctcta

SEQ ID NO: 272420 - DNA, 25 bp, Mus musculus
ctgaggaaagaggaagaagtcgtca

SEQ ID NO: 272421 - DNA, 25 bp, Mus musculus
ctgaggaacagaaaatgttaacaag

SEQ ID NO: 272422 - DNA, 25 bp, Mus musculus
ctgaggaacagatcctggagagaaa

SEQ ID NO: 272423 - DNA, 25 bp, Mus musculus
ctgaggaacagcgcatcgccatggt

SEQ ID NO: 272424 - DNA, 25 bp, Mus musculus
ctgaggaacatgtaacaggtccact

SEQ ID NO: 272425 - DNA, 25 bp, Mus musculus
ctgaggaaccactgaactggcatta

SEQ ID NO: 272426 - DNA, 25 bp, Mus musculus
ctgaggaagagacactccagcaact

SEQ ID NO: 272427 - DNA, 25 bp, Mus musculus
ctgaggaagaggacttttggggaac

SEQ ID NO: 272428 - DNA, 25 bp, Mus musculus
ctgaggaagcagatataaagacttg

SEQ ID NO: 272429 - DNA, 25 bp, Mus musculus
ctgaggaagccgccactggagaatg

SEQ ID NO: 272430 - DNA, 25 bp, Mus musculus
ctgaggaagcctaaggatgatgctg

SEQ ID NO: 272431 - DNA, 25 bp, Mus musculus
ctgaggaatagacttttcactgagt

SEQ ID NO: 272432 - DNA, 25 bp, Mus musculus
ctgaggaatagccctggctttcctg

SEQ ID NO: 272433 - DNA, 25 bp, Mus musculus
ctgaggaatagcttctggaatttct

SEQ ID NO: 272434 - DNA, 25 bp, Mus musculus
ctgaggaatcagcttaccaacaaaa

SEQ ID NO: 272435 - DNA, 25 bp, Mus musculus
ctgaggaatcagtattcgcctggga

SEQ ID NO: 272436 - DNA, 25 bp, Mus musculus
ctgaggaatgtgatggttctccagg

SEQ ID NO: 272437 - DNA, 25 bp, Mus musculus
ctgaggaatgtgcccctgtcccttc

SEQ ID NO: 272438 - DNA, 25 bp, Mus musculus
ctgaggacagaacttatttgtccaa

SEQ ID NO: 272439 - DNA, 25 bp, Mus musculus
ctgaggacagagaaagagctaaagc

SEQ ID NO: 272440 - DNA, 25 bp, Mus musculus
ctgaggacattaagagtggaaagct

SEQ ID NO: 272441 - DNA, 25 bp, Mus musculus
ctgaggacattaaggccacccgaga

SEQ ID NO: 272442 - DNA, 25 bp, Mus musculus
ctgaggaccaaggtgagcctgtgac

SEQ ID NO: 272443 - DNA, 25 bp, Mus musculus
ctgaggaccacatgggtggcatccc

SEQ ID NO: 272444 - DNA, 25 bp, Mus musculus
ctgaggaccgtgttcgtaagcagac

SEQ ID NO: 272445 - DNA, 25 bp, Mus musculus
ctgaggactcaaggtaagaaatcca

SEQ ID NO: 272446 - DNA, 25 bp, Mus musculus
ctgaggactcaagtttcagagtgat

SEQ ID NO: 272447 - DNA, 25 bp, Mus musculus
ctgaggacttctcagagtctgtccc

SEQ ID NO: 272448 - DNA, 25 bp, Mus musculus
ctgaggactttgcaactgctgctga

SEQ ID NO: 272449 - DNA, 25 bp, Mus musculus
ctgaggagaagcaaaccaagagttt

SEQ ID NO: 272450 - DNA, 25 bp, Mus musculus
ctgaggagaagtgtgagaaacttta

SEQ ID NO: 272451 - DNA, 25 bp, Mus musculus
ctgaggagagagaacctggtccacg

SEQ ID NO: 272452 - DNA, 25 bp, Mus musculus
ctgaggagagagtgttccagaagga

SEQ ID NO: 272453 - DNA, 25 bp, Mus musculus
ctgaggagagatcaggaatctttct

SEQ ID NO: 272454 - DNA, 25 bp, Mus musculus
ctgaggagagggaactagttcccta

SEQ ID NO: 272455 - DNA, 25 bp, Mus musculus
ctgaggagctcttccaggaatctgg

SEQ ID NO: 272456 - DNA, 25 bp, Mus musculus
ctgaggagctgagtgataacattca

SEQ ID NO: 272457 - DNA, 25 bp, Mus musculus
ctgaggagctgagtgattttgagga

SEQ ID NO: 272458 - DNA, 25 bp, Mus musculus
ctgaggagctgccagaaaagccttt

SEQ ID NO: 272459 - DNA, 25 bp, Mus musculus
ctgaggaggcagtaggacttagaag

SEQ ID NO: 272460 - DNA, 25 bp, Mus musculus
ctgaggagtcccggcgtggagcgtt

SEQ ID NO: 272461 - DNA, 25 bp, Mus musculus
ctgaggagtcccggctcatcactct

SEQ ID NO: 272462 - DNA, 25 bp, Mus musculus
ctgaggagtcggagatggcagccac

SEQ ID NO: 272463 - DNA, 25 bp, Mus musculus
ctgaggatacagcaacttctaagga

SEQ ID NO: 272464 - DNA, 25 bp, Mus musculus
ctgaggatcccgagggcatcagatc

SEQ ID NO: 272465 - DNA, 25 bp, Mus musculus
ctgaggatcccgggcgtgattgagt

SEQ ID NO: 272466 - DNA, 25 bp, Mus musculus
ctgaggatcttcgggtatttggctc

SEQ ID NO: 272467 - DNA, 25 bp, Mus musculus
ctgaggatgacatccgtggacagct

SEQ ID NO: 272468 - DNA, 25 bp, Mus musculus
ctgaggatggcagggtatttatgag

SEQ ID NO: 272469 - DNA, 25 bp, Mus musculus
ctgaggattttccatctttaaatcc

SEQ ID NO: 272470 - DNA, 25 bp, Mus musculus
ctgaggcaaagctagacaagttgga

SEQ ID NO: 272471 - DNA, 25 bp, Mus musculus
ctgaggcagaagctccaagatgaaa

SEQ ID NO: 272472 - DNA, 25 bp, Mus musculus
ctgaggcagcgggagctggaacagc

SEQ ID NO: 272473 - DNA, 25 bp, Mus musculus
ctgaggcagcgggagggagctgaat

SEQ ID NO: 272474 - DNA, 25 bp, Mus musculus
ctgaggcaggaaggttcgttctccc

SEQ ID NO: 272475 - DNA, 25 bp, Mus musculus
ctgaggcaggacggattctgatgca

SEQ ID NO: 272476 - DNA, 25 bp, Mus musculus
ctgaggcaggacggctgctgtgaag

SEQ ID NO: 272477 - DNA, 25 bp, Mus musculus
ctgaggcatcaaaacaaatggcctc

SEQ ID NO: 272478 - DNA, 25 bp, Mus musculus
ctgaggcatcagatgcttataccat

SEQ ID NO: 272479 - DNA, 25 bp, Mus musculus
ctgaggccaaacagctcaggcctgc

SEQ ID NO: 272480 - DNA, 25 bp, Mus musculus
ctgaggccaggtctcttaaccttca

SEQ ID NO: 272481 - DNA, 25 bp, Mus musculus
ctgaggccatgagttccgactctga

SEQ ID NO: 272482 - DNA, 25 bp, Mus musculus
ctgaggcccgccaggaattgtggag

SEQ ID NO: 272483 - DNA, 25 bp, Mus musculus
ctgaggcccgccaggatatgaattg

SEQ ID NO: 272484 - DNA, 25 bp, Mus musculus
ctgaggccgcagggttgcagaaact

SEQ ID NO: 272485 - DNA, 25 bp, Mus musculus
ctgaggccttgcaagcaaggtgcag

SEQ ID NO: 272486 - DNA, 25 bp, Mus musculus
ctgaggccttgcaagctatgtctga

SEQ ID NO: 272487 - DNA, 25 bp, Mus musculus
ctgaggccttgcaaggggagagtta

SEQ ID NO: 272488 - DNA, 25 bp, Mus musculus
ctgaggcgaaagagagccgggtcaa

SEQ ID NO: 272489 - DNA, 25 bp, Mus musculus
ctgaggcgagcagctggtggccccc

SEQ ID NO: 272490 - DNA, 25 bp, Mus musculus
ctgaggcgagcagctgtggcccctc

SEQ ID NO: 272491 - DNA, 25 bp, Mus musculus
ctgaggcgcacagcggggactcgag

SEQ ID NO: 272492 - DNA, 25 bp, Mus musculus
ctgaggcgcacagcggtaaaatgtc

SEQ ID NO: 272493 - DNA, 25 bp, Mus musculus
ctgaggcgcggcccagcactatggt

SEQ ID NO: 272494 - DNA, 25 bp, Mus musculus
ctgaggcggacgcagaattcggccc

SEQ ID NO: 272495 - DNA, 25 bp, Mus musculus
ctgaggcggacgcaggtccgctaca

SEQ ID NO: 272496 - DNA, 25 bp, Mus musculus
ctgaggctcagaaaggatgtcaaag

SEQ ID NO: 272497 - DNA, 25 bp, Mus musculus
ctgaggctcaggagaccaccatcag

SEQ ID NO: 272498 - DNA, 25 bp, Mus musculus
ctgaggctcagtggagaccagagga

SEQ ID NO: 272499 - DNA, 25 bp, Mus musculus
ctgaggctgcaggtgccctacgttg

SEQ ID NO: 272500 - DNA, 25 bp, Mus musculus
ctgaggctgctgcaggttgctgaga

SEQ ID NO: 272501 - DNA, 25 bp, Mus musculus
ctgaggctgcttctttttaaagatg

SEQ ID NO: 272502 - DNA, 25 bp, Mus musculus
ctgaggctgcttgggaaccaacaga

SEQ ID NO: 272503 - DNA, 25 bp, Mus musculus
ctgaggctggtcttcttctacatct

SEQ ID NO: 272504 - DNA, 25 bp, Mus musculus
ctgagggaaagaaaaataccttgag

SEQ ID NO: 272505 - DNA, 25 bp, Mus musculus
ctgagggaaagagttcacatgagac

SEQ ID NO: 272506 - DNA, 25 bp, Mus musculus
ctgagggaaagattgacggcggggc

SEQ ID NO: 272507 - DNA, 25 bp, Mus musculus
ctgagggaccagacaaaaagtccca

SEQ ID NO: 272508 - DNA, 25 bp, Mus musculus
ctgagggactacagtggacaaggcg

SEQ ID NO: 272509 - DNA, 25 bp, Mus musculus
ctgagggagacagaggcattcaagg

SEQ ID NO: 272510 - DNA, 25 bp, Mus musculus
ctgagggcaccaagcactgaaaact

SEQ ID NO: 272511 - DNA, 25 bp, Mus musculus
ctgagggctctagcttggacagccc

SEQ ID NO: 272512 - DNA, 25 bp, Mus musculus
ctgagggctctagtgtcactgctca

SEQ ID NO: 272513 - DNA, 25 bp, Mus musculus
ctgagggctgtggagacaaatgaat

SEQ ID NO: 272514 - DNA, 25 bp, Mus musculus
ctgagggctgtggaggaacgggatt

SEQ ID NO: 272515 - DNA, 25 bp, Mus musculus
ctgagggctttccctgagaagcagc

SEQ ID NO: 272516 - DNA, 25 bp, Mus musculus
ctgaggggaagagatgcaattcgaa

SEQ ID NO: 272517 - DNA, 25 bp, Mus musculus
ctgaggggagacgtggtactcagtt

SEQ ID NO: 272518 - DNA, 25 bp, Mus musculus
ctgaggggagcttttcccagtcatt

SEQ ID NO: 272519 - DNA, 25 bp, Mus musculus
ctgagggtcgagaatacaagaaaat

SEQ ID NO: 272520 - DNA, 25 bp, Mus musculus
ctgagggtcggtgccagcacatcat

SEQ ID NO: 272521 - DNA, 25 bp, Mus musculus
ctgagggtctctgagtggaggtgaa

SEQ ID NO: 272522 - DNA, 25 bp, Mus musculus
ctgagggtggaagggccagggacca

SEQ ID NO: 272523 - DNA, 25 bp, Mus musculus
ctgagggttccaattggttccaaga

SEQ ID NO: 272524 - DNA, 25 bp, Mus musculus
ctgaggtacaaggtgaactgtggac

SEQ ID NO: 272525 - DNA, 25 bp, Mus musculus
ctgaggtccagatgggctcctcagc

SEQ ID NO: 272526 - DNA, 25 bp, Mus musculus
ctgaggtccaggaactgttaagaca

SEQ ID NO: 272527 - DNA, 25 bp, Mus musculus
ctgaggtcctgggctcttctctcac

SEQ ID NO: 272528 - DNA, 25 bp, Mus musculus
ctgaggtgagagcagccatggagcc

SEQ ID NO: 272529 - DNA, 25 bp, Mus musculus
ctgaggtgagctttgacgccgccac

SEQ ID NO: 272530 - DNA, 25 bp, Mus musculus
ctgaggtgagggaaccagaccttaa

SEQ ID NO: 272531 - DNA, 25 bp, Mus musculus
ctgaggtgcacggctgtgtttggat

SEQ ID NO: 272532 - DNA, 25 bp, Mus musculus
ctgaggtgcacgggtgacccagata

SEQ ID NO: 272533 - DNA, 25 bp, Mus musculus
ctgaggtgccagacgacctggagga

SEQ ID NO: 272534 - DNA, 25 bp, Mus musculus
ctgaggtgccaggatgaacagcagt

SEQ ID NO: 272535 - DNA, 25 bp, Mus musculus
ctgaggtgccaggctggacccatga

SEQ ID NO: 272536 - DNA, 25 bp, Mus musculus
ctgaggtggagaaggccaaggggaa

SEQ ID NO: 272537 - DNA, 25 bp, Mus musculus
ctgaggtggagaaggccgagtacaa

SEQ ID NO: 272538 - DNA, 25 bp, Mus musculus
ctgaggtggagcagccctgttccct

SEQ ID NO: 272539 - DNA, 25 bp, Mus musculus
ctgaggtggagcaggtgaggggtcg

SEQ ID NO: 272540 - DNA, 25 bp, Mus musculus
ctgaggtggaggagatcctggtgct

SEQ ID NO: 272541 - DNA, 25 bp, Mus musculus
ctgaggtggatgtgtgggtgcaggt

SEQ ID NO: 272542 - DNA, 25 bp, Mus musculus
ctgaggtgggccaggtccacctcca

SEQ ID NO: 272543 - DNA, 25 bp, Mus musculus
ctgaggtggtgcaggagatccccca

SEQ ID NO: 272544 - DNA, 25 bp, Mus musculus
ctgaggtgtggtctcggattgggaa

SEQ ID NO: 272545 - DNA, 25 bp, Mus musculus
ctgaggtttcttctgatgaaagaga

SEQ ID NO: 272546 - DNA, 25 bp, Mus musculus
ctgaggttttgacaggactggagga

SEQ ID NO: 272547 - DNA, 25 bp, Mus musculus
ctgagtaaaggtgaacatcagtgaa

SEQ ID NO: 272548 - DNA, 25 bp, Mus musculus
ctgagtaaaggtgaacgacgactgt

SEQ ID NO: 272549 - DNA, 25 bp, Mus musculus
ctgagtaaatatttgggcccagcaa

SEQ ID NO: 272550 - DNA, 25 bp, Mus musculus
ctgagtaaatatttggtgctggtaa

SEQ ID NO: 272551 - DNA, 25 bp, Mus musculus
ctgagtaaatgttagtgacagctag

SEQ ID NO: 272552 - DNA, 25 bp, Mus musculus
ctgagtaagccgagttctctagcct

SEQ ID NO: 272553 - DNA, 25 bp, Mus musculus
ctgagtacaaagtgaaggaggaggg

SEQ ID NO: 272554 - DNA, 25 bp, Mus musculus
ctgagtacaaggttggaagtcggat

SEQ ID NO: 272555 - DNA, 25 bp, Mus musculus
ctgagtacagacgtgacttgtagct

SEQ ID NO: 272556 - DNA, 25 bp, Mus musculus
ctgagtacaggatatgaatcagaga

SEQ ID NO: 272557 - DNA, 25 bp, Mus musculus
ctgagtacaggcgtgggtgactgat

SEQ ID NO: 272558 - DNA, 25 bp, Mus musculus
ctgagtaccacgcggacatctatga

SEQ ID NO: 272559 - DNA, 25 bp, Mus musculus
ctgagtaccacgcgggggaagggct

SEQ ID NO: 272560 - DNA, 25 bp, Mus musculus
ctgagtacgaggaggaaatctccaa

SEQ ID NO: 272561 - DNA, 25 bp, Mus musculus
ctgagtatagacaactgtcatcatg

SEQ ID NO: 272562 - DNA, 25 bp, Mus musculus
ctgagtatagaggtgctccagacca

SEQ ID NO: 272563 - DNA, 25 bp, Mus musculus
ctgagtataggaaggggccagattc

SEQ ID NO: 272564 - DNA, 25 bp, Mus musculus
ctgagtcaagagcttggattctgaa

SEQ ID NO: 272565 - DNA, 25 bp, Mus musculus
ctgagtcacgtgctgtaattacagg

SEQ ID NO: 272566 - DNA, 25 bp, Mus musculus
ctgagtcactcaagagcctcatccc

SEQ ID NO: 272567 - DNA, 25 bp, Mus musculus
ctgagtcactcaaggaggctgttgt

SEQ ID NO: 272568 - DNA, 25 bp, Mus musculus
ctgagtcagaggaggggtgagggga

SEQ ID NO: 272569 - DNA, 25 bp, Mus musculus
ctgagtcagaggatccacactggcc

SEQ ID NO: 272570 - DNA, 25 bp, Mus musculus
ctgagtcatggacggtttgaagatc

SEQ ID NO: 272571 - DNA, 25 bp, Mus musculus
ctgagtcatggacgttcggggatga

SEQ ID NO: 272572 - DNA, 25 bp, Mus musculus
ctgagtccaagaaatggcctccacc

SEQ ID NO: 272573 - DNA, 25 bp, Mus musculus
ctgagtccaagtcagtttctgatga

SEQ ID NO: 272574 - DNA, 25 bp, Mus musculus
ctgagtccaggtgcagctgctggac

SEQ ID NO: 272575 - DNA, 25 bp, Mus musculus
ctgagtccaggtgttttggttcatc

SEQ ID NO: 272576 - DNA, 25 bp, Mus musculus
ctgagtcccaaaagaccatgtgacc

SEQ ID NO: 272577 - DNA, 25 bp, Mus musculus
ctgagtcccaaaggatgcatgctgt

SEQ ID NO: 272578 - DNA, 25 bp, Mus musculus
ctgagtcccaaagggtcttcagatt

SEQ ID NO: 272579 - DNA, 25 bp, Mus musculus
ctgagtcccaaaggtgtcctgcagg

SEQ ID NO: 272580 - DNA, 25 bp, Mus musculus
ctgagtcccgaaatggggttggtgt

SEQ ID NO: 272581 - DNA, 25 bp, Mus musculus
ctgagtccctagaagcaagacgacc

SEQ ID NO: 272582 - DNA, 25 bp, Mus musculus
ctgagtcctgtgagacagtgtttct

SEQ ID NO: 272583 - DNA, 25 bp, Mus musculus
ctgagtcctgtgagagatggatgtc

SEQ ID NO: 272584 - DNA, 25 bp, Mus musculus
ctgagtccttaaaggtttatgggac

SEQ ID NO: 272585 - DNA, 25 bp, Mus musculus
ctgagtcgcctcgagaaccctgcac

SEQ ID NO: 272586 - DNA, 25 bp, Mus musculus
ctgagtcgcctcgaggaagaaggca

SEQ ID NO: 272587 - DNA, 25 bp, Mus musculus
ctgagtctaaagggaagcgattata

SEQ ID NO: 272588 - DNA, 25 bp, Mus musculus
ctgagtctcaagagccaaggacatg

SEQ ID NO: 272589 - DNA, 25 bp, Mus musculus
ctgagtctctgggcacggaggtgcc

SEQ ID NO: 272590 - DNA, 25 bp, Mus musculus
ctgagtctgaagcaggaaggaacag

SEQ ID NO: 272591 - DNA, 25 bp, Mus musculus
ctgagtctgaagcaggatctgaaga

SEQ ID NO: 272592 - DNA, 25 bp, Mus musculus
ctgagtctgttcagactgtactccc

SEQ ID NO: 272593 - DNA, 25 bp, Mus musculus
ctgagtctttaaggagaaagcatcc

SEQ ID NO: 272594 - DNA, 25 bp, Mus musculus
ctgagtctttaagtggttctgtgta

SEQ ID NO: 272595 - DNA, 25 bp, Mus musculus
ctgagtctttcctggttttctattt

SEQ ID NO: 272596 - DNA, 25 bp, Mus musculus
ctgagtgaactgcgggacatctatg

SEQ ID NO: 272597 - DNA, 25 bp, Mus musculus
ctgagtgaactgcgggagtctttgt

SEQ ID NO: 272598 - DNA, 25 bp, Mus musculus
ctgagtgaagaaactgatctccgag

SEQ ID NO: 272599 - DNA, 25 bp, Mus musculus
ctgagtgaagaggagatgcatgctg

SEQ ID NO: 272600 - DNA, 25 bp, Mus musculus
ctgagtgaagattatttgtctttat

SEQ ID NO: 272601 - DNA, 25 bp, Mus musculus
ctgagtgacaggggacccatgagct

SEQ ID NO: 272602 - DNA, 25 bp, Mus musculus
ctgagtgacatcgcatcggctctta

SEQ ID NO: 272603 - DNA, 25 bp, Mus musculus
ctgagtgacatcggcgccagagctt

SEQ ID NO: 272604 - DNA, 25 bp, Mus musculus
ctgagtgactctgccgaccccttcc

SEQ ID NO: 272605 - DNA, 25 bp, Mus musculus
ctgagtgactctgctcttctagatt

SEQ ID NO: 272606 - DNA, 25 bp, Mus musculus
ctgagtgagaaaaggatgattgaga

SEQ ID NO: 272607 - DNA, 25 bp, Mus musculus
ctgagtgagaaaaggccctcaactt

SEQ ID NO: 272608 - DNA, 25 bp, Mus musculus
ctgagtgagcacggatgaaaatttt

SEQ ID NO: 272609 - DNA, 25 bp, Mus musculus
ctgagtgagcaggctcctgcaaaaa

SEQ ID NO: 272610 - DNA, 25 bp, Mus musculus
ctgagtgatgatggaatcagcgtga

SEQ ID NO: 272611 - DNA, 25 bp, Mus musculus
ctgagtgcaagtgtcctgcaggaga

SEQ ID NO: 272612 - DNA, 25 bp, Mus musculus
ctgagtgccagtgcccgccccatat

SEQ ID NO: 272613 - DNA, 25 bp, Mus musculus
ctgagtgccatggattggcgtctct

SEQ ID NO: 272614 - DNA, 25 bp, Mus musculus
ctgagtgcgcaagcaaaagaaagtg

SEQ ID NO: 272615 - DNA, 25 bp, Mus musculus
ctgagtgcgcgtggaacctagggtc

SEQ ID NO: 272616 - DNA, 25 bp, Mus musculus
ctgagtgctgaagaggaagagcaga

SEQ ID NO: 272617 - DNA, 25 bp, Mus musculus
ctgagtggagagggcgaggccccca

SEQ ID NO: 272618 - DNA, 25 bp, Mus musculus
ctgagtggagtggggacggcagcgg

SEQ ID NO: 272619 - DNA, 25 bp, Mus musculus
ctgagtgggagttgtgacacaggat

SEQ ID NO: 272620 - DNA, 25 bp, Mus musculus
ctgagtgtagaattctcactggccg

SEQ ID NO: 272621 - DNA, 25 bp, Mus musculus
ctgagtgtcaggatggtggtgcgga

SEQ ID NO: 272622 - DNA, 25 bp, Mus musculus
ctgagtgtcaggctgtgagtcctga

SEQ ID NO: 272623 - DNA, 25 bp, Mus musculus
ctgagtgtcctaggtcttgagagag

SEQ ID NO: 272624 - DNA, 25 bp, Mus musculus
ctgagtgtctctgatcaagagcacc

SEQ ID NO: 272625 - DNA, 25 bp, Mus musculus
ctgagtgtgtctcaggtggtccaca

SEQ ID NO: 272626 - DNA, 25 bp, Mus musculus
ctgagtgttggcgggccatcccagc

SEQ ID NO: 272627 - DNA, 25 bp, Mus musculus
ctgagttcacagaaacttcgtggca

SEQ ID NO: 272628 - DNA, 25 bp, Mus musculus
ctgagttcacagagcatgcaaccca

SEQ ID NO: 272629 - DNA, 25 bp, Mus musculus
ctgagttcacagagttctcagtatg

SEQ ID NO: 272630 - DNA, 25 bp, Mus musculus
ctgagttccactgggctcccatcct

SEQ ID NO: 272631 - DNA, 25 bp, Mus musculus
ctgagttccagagcccccttcactc

SEQ ID NO: 272632 - DNA, 25 bp, Mus musculus
ctgagttgccctgactctaccgcac

SEQ ID NO: 272633 - DNA, 25 bp, Mus musculus
ctgagttggcaggaagaaaatgccg

SEQ ID NO: 272634 - DNA, 25 bp, Mus musculus
ctgagttggcagtcacaaactcgca

SEQ ID NO: 272635 - DNA, 25 bp, Mus musculus
ctgagtttacaatccaagagaaaag

SEQ ID NO: 272636 - DNA, 25 bp, Mus musculus
ctgagtttacaattttctaatgatg

SEQ ID NO: 272637 - DNA, 25 bp, Mus musculus
ctgagtttactatccaagagaaaag

SEQ ID NO: 272638 - DNA, 25 bp, Mus musculus
ctgagtttactattttctaatgatg

SEQ ID NO: 272639 - DNA, 25 bp, Mus musculus
ctgagtttcaggagcggctgcaaag

SEQ ID NO: 272640 - DNA, 25 bp, Mus musculus
ctgagtttgaggaggctcaacgcac

SEQ ID NO: 272641 - DNA, 25 bp, Mus musculus
ctgagttttatgagaggaacctgtc

SEQ ID NO: 272642 - DNA, 25 bp, Mus musculus
ctgagttttcgcgagaactttcaaa

SEQ ID NO: 272643 - DNA, 25 bp, Mus musculus
ctgagtttttagatattatgagaag

SEQ ID NO: 272644 - DNA, 25 bp, Mus musculus
ctgataaaaagtatgtctacgttgc

SEQ ID NO: 272645 - DNA, 25 bp, Mus musculus
ctgataaaaccaggtttgcttatga

SEQ ID NO: 272646 - DNA, 25 bp, Mus musculus
ctgataaaattctggagctggagga

SEQ ID NO: 272647 - DNA, 25 bp, Mus musculus
ctgataaataagagggcaatgcgag

SEQ ID NO: 272648 - DNA, 25 bp, Mus musculus
ctgataaataggagctccaccccag

SEQ ID NO: 272649 - DNA, 25 bp, Mus musculus
ctgataacacaggccatggcgcagg

SEQ ID NO: 272650 - DNA, 25 bp, Mus musculus
ctgataacacaggtgccttcttcac

SEQ ID NO: 272651 - DNA, 25 bp, Mus musculus
ctgataaccacggctctgaagcgtc

SEQ ID NO: 272652 - DNA, 25 bp, Mus musculus
ctgataaccacgtctctgggtcctt

SEQ ID NO: 272653 - DNA, 25 bp, Mus musculus
ctgataagaagattatttccaagtt

SEQ ID NO: 272654 - DNA, 25 bp, Mus musculus
ctgataagagtgcagctcagagaca

SEQ ID NO: 272655 - DNA, 25 bp, Mus musculus
ctgataagccatcaggtccatggag

SEQ ID NO: 272656 - DNA, 25 bp, Mus musculus
ctgataagtttgaggtattctgcta

SEQ ID NO: 272657 - DNA, 25 bp, Mus musculus
ctgataatagccagaacaaatataa

SEQ ID NO: 272658 - DNA, 25 bp, Mus musculus
ctgataatagtgttatccaagataa

SEQ ID NO: 272659 - DNA, 25 bp, Mus musculus
ctgatacagagcgcctagatgattt

SEQ ID NO: 272660 - DNA, 25 bp, Mus musculus
ctgataccaacaaggcaaagggtgg

SEQ ID NO: 272661 - DNA, 25 bp, Mus musculus
ctgataccaggggttccagtgtccc

SEQ ID NO: 272662 - DNA, 25 bp, Mus musculus
ctgataccatcctcatccctttttg

SEQ ID NO: 272663 - DNA, 25 bp, Mus musculus
ctgatactgccacatgctgctgggg

SEQ ID NO: 272664 - DNA, 25 bp, Mus musculus
ctgatagaaaggtttacgaaagata

SEQ ID NO: 272665 - DNA, 25 bp, Mus musculus
ctgatagaaagttgatcttcttagg

SEQ ID NO: 272666 - DNA, 25 bp, Mus musculus
ctgatagaagaagtgagctgaagag

SEQ ID NO: 272667 - DNA, 25 bp, Mus musculus
ctgatagaagagcttcggaaatgtg

SEQ ID NO: 272668 - DNA, 25 bp, Mus musculus
ctgatagaagagtggtagatgaccc

SEQ ID NO: 272669 - DNA, 25 bp, Mus musculus
ctgatagacagcccctgttgcatga

SEQ ID NO: 272670 - DNA, 25 bp, Mus musculus
ctgatagacagctgctgctccagct

SEQ ID NO: 272671 - DNA, 25 bp, Mus musculus
ctgatagactaggatattttaaaga

SEQ ID NO: 272672 - DNA, 25 bp, Mus musculus
ctgatagactaggttggtttgccat

SEQ ID NO: 272673 - DNA, 25 bp, Mus musculus
ctgatagagttgcaacatctcggat

SEQ ID NO: 272674 - DNA, 25 bp, Mus musculus
ctgatagcaaaactccaccagagaa

SEQ ID NO: 272675 - DNA, 25 bp, Mus musculus
ctgatagcagctgtgagtaccagag

SEQ ID NO: 272676 - DNA, 25 bp, Mus musculus
ctgatagcatcaggcgcgagcttca

SEQ ID NO: 272677 - DNA, 25 bp, Mus musculus
ctgatagccatattgccctctgttt

SEQ ID NO: 272678 - DNA, 25 bp, Mus musculus
ctgatagcctgggtttgtcactctt

SEQ ID NO: 272679 - DNA, 25 bp, Mus musculus
ctgatagctgaaaagaaagggccaa

SEQ ID NO: 272680 - DNA, 25 bp, Mus musculus
ctgatagctgaaaaggtgtctctgg

SEQ ID NO: 272681 - DNA, 25 bp, Mus musculus
ctgataggcaggagatgagccgctc

SEQ ID NO: 272682 - DNA, 25 bp, Mus musculus
ctgataggcttggtgaatcacagac

SEQ ID NO: 272683 - DNA, 25 bp, Mus musculus
ctgatagtccagcagactgatacct

SEQ ID NO: 272684 - DNA, 25 bp, Mus musculus
ctgatagtggtaaggccatcgaaga

SEQ ID NO: 272685 - DNA, 25 bp, Mus musculus
ctgatagtggtaagtgcggctggct

SEQ ID NO: 272686 - DNA, 25 bp, Mus musculus
ctgatagttgccttatcttccgtaa

SEQ ID NO: 272687 - DNA, 25 bp, Mus musculus
ctgatagttgcggatgacggaggct

SEQ ID NO: 272688 - DNA, 25 bp, Mus musculus
ctgatatactcatctgccatggtgt

SEQ ID NO: 272689 - DNA, 25 bp, Mus musculus
ctgatatcaagtcgcgcattgccaa

SEQ ID NO: 272690 - DNA, 25 bp, Mus musculus
ctgatatcaggaggagccatgggag

SEQ ID NO: 272691 - DNA, 25 bp, Mus musculus
ctgatatccagtatggaagggtgga

SEQ ID NO: 272692 - DNA, 25 bp, Mus musculus
ctgatatgaggacccatcctctgtc

SEQ ID NO: 272693 - DNA, 25 bp, Mus musculus
ctgatatggagaaccttcacacctg

SEQ ID NO: 272694 - DNA, 25 bp, Mus musculus
ctgatattagggaggtgcccctgaa

SEQ ID NO: 272695 - DNA, 25 bp, Mus musculus
ctgatatttgacattaacgagctga

SEQ ID NO: 272696 - DNA, 25 bp, Mus musculus
ctgatcaaaaagtttcagttcgttg

SEQ ID NO: 272697 - DNA, 25 bp, Mus musculus
ctgatcaaaggaaaggactcagctt

SEQ ID NO: 272698 - DNA, 25 bp, Mus musculus
ctgatcaacaggtctccattttgac

SEQ ID NO: 272699 - DNA, 25 bp, Mus musculus
ctgatcaacgacaaggtggcccagc

SEQ ID NO: 272700 - DNA, 25 bp, Mus musculus
ctgatcaaggaaccttctgtggatg

SEQ ID NO: 272701 - DNA, 25 bp, Mus musculus
ctgatcacaaagcagacccaggaga

SEQ ID NO: 272702 - DNA, 25 bp, Mus musculus
ctgatcacaccacagggctatgaga

SEQ ID NO: 272703 - DNA, 25 bp, Mus musculus
ctgatcacaccacaggtcccaggag

SEQ ID NO: 272704 - DNA, 25 bp, Mus musculus
ctgatcacaccacagttgctaaggg

SEQ ID NO: 272705 - DNA, 25 bp, Mus musculus
ctgatcacagaaggccagcaacatg

SEQ ID NO: 272706 - DNA, 25 bp, Mus musculus
ctgatcacaggacagctccctctca

SEQ ID NO: 272707 - DNA, 25 bp, Mus musculus
ctgatcacctacgggccctatgccg

SEQ ID NO: 272708 - DNA, 25 bp, Mus musculus
ctgatcagaaacctgaacctgtgga

SEQ ID NO: 272709 - DNA, 25 bp, Mus musculus
ctgatcagaaacctgatattcagac

SEQ ID NO: 272710 - DNA, 25 bp, Mus musculus
ctgatcagcagaggtgctgttacca

SEQ ID NO: 272711 - DNA, 25 bp, Mus musculus
ctgatcagcagagtgaaatggttaa

SEQ ID NO: 272712 - DNA, 25 bp, Mus musculus
ctgatcaggtccagggcaatggcag

SEQ ID NO: 272713 - DNA, 25 bp, Mus musculus
ctgatcatcacaggagttggtgaca

SEQ ID NO: 272714 - DNA, 25 bp, Mus musculus
ctgatcatcccggcgcctccccatc

SEQ ID NO: 272715 - DNA, 25 bp, Mus musculus
ctgatcatcccgggagttccgactc

SEQ ID NO: 272716 - DNA, 25 bp, Mus musculus
ctgatcatcccggtatccctggaac

SEQ ID NO: 272717 - DNA, 25 bp, Mus musculus
ctgatcatggacggggcatttggca

SEQ ID NO: 272718 - DNA, 25 bp, Mus musculus
ctgatccaaaaaggatacatgagga

SEQ ID NO: 272719 - DNA, 25 bp, Mus musculus
ctgatccagacggccacccgagacc

SEQ ID NO: 272720 - DNA, 25 bp, Mus musculus
ctgatccagggcaagaaagtatcca

SEQ ID NO: 272721 - DNA, 25 bp, Mus musculus
ctgatccagggcaaggtatgtcctc

SEQ ID NO: 272722 - DNA, 25 bp, Mus musculus
ctgatccagtcaaggaggaggatga

SEQ ID NO: 272723 - DNA, 25 bp, Mus musculus
ctgatccagtcaaggatgactatga

SEQ ID NO: 272724 - DNA, 25 bp, Mus musculus
ctgatcccaagggttggcccctagg

SEQ ID NO: 272725 - DNA, 25 bp, Mus musculus
ctgatccccacaggagaaatgctct

SEQ ID NO: 272726 - DNA, 25 bp, Mus musculus
ctgatccccacaggtgatggacaga

SEQ ID NO: 272727 - DNA, 25 bp, Mus musculus
ctgatccccagacagttacacgtct

SEQ ID NO: 272728 - DNA, 25 bp, Mus musculus
ctgatccccagctgtgctcaggatg

SEQ ID NO: 272729 - DNA, 25 bp, Mus musculus
ctgatcccccagagaggccaggctg

SEQ ID NO: 272730 - DNA, 25 bp, Mus musculus
ctgatcccccagagagtcatggacc

SEQ ID NO: 272731 - DNA, 25 bp, Mus musculus
ctgatccctagagatgtcttcctga

SEQ ID NO: 272732 - DNA, 25 bp, Mus musculus
ctgatccctaggtcagacgggaaca

SEQ ID NO: 272733 - DNA, 25 bp, Mus musculus
ctgatccggaacggtctgaaggtca

SEQ ID NO: 272734 - DNA, 25 bp, Mus musculus
ctgatccggaacggtggttgtggag

SEQ ID NO: 272735 - DNA, 25 bp, Mus musculus
ctgatcctagtgtcaaaggtcccca

SEQ ID NO: 272736 - DNA, 25 bp, Mus musculus
ctgatcctatggtgaatcccccgga

SEQ ID NO: 272737 - DNA, 25 bp, Mus musculus
ctgatcctgagaatgaatgaacaaa

SEQ ID NO: 272738 - DNA, 25 bp, Mus musculus
ctgatcctgagaatggtctctctgg

SEQ ID NO: 272739 - DNA, 25 bp, Mus musculus
ctgatcctgagacttgttcaagggg

SEQ ID NO: 272740 - DNA, 25 bp, Mus musculus
ctgatcctggaggctgttcatcagc

SEQ ID NO: 272741 - DNA, 25 bp, Mus musculus
ctgatccttcatggcagtgaagaag

SEQ ID NO: 272742 - DNA, 25 bp, Mus musculus
ctgatcgaaaggtggcctcctcaga

SEQ ID NO: 272743 - DNA, 25 bp, Mus musculus
ctgatcgaagagttagcaatagcga

SEQ ID NO: 272744 - DNA, 25 bp, Mus musculus
ctgatcgcctcaaggagtatgtctc

SEQ ID NO: 272745 - DNA, 25 bp, Mus musculus
ctgatcgtgtacagggtgaagttga

SEQ ID NO: 272746 - DNA, 25 bp, Mus musculus
ctgatctaaggagattacctggagc

SEQ ID NO: 272747 - DNA, 25 bp, Mus musculus
ctgatctagaagaagaagctgaagt

SEQ ID NO: 272748 - DNA, 25 bp, Mus musculus
ctgatctccaactaggcggccgtca

SEQ ID NO: 272749 - DNA, 25 bp, Mus musculus
ctgatctccatgatggtggccagta

SEQ ID NO: 272750 - DNA, 25 bp, Mus musculus
ctgatctccgcatctcttcgccgaa

SEQ ID NO: 272751 - DNA, 25 bp, Mus musculus
ctgatctcctaggagtgcgcgatga

SEQ ID NO: 272752 - DNA, 25 bp, Mus musculus
ctgatctcctaggtttcaggaatgg

SEQ ID NO: 272753 - DNA, 25 bp, Mus musculus
ctgatctctcagtgtaccccgaagg

SEQ ID NO: 272754 - DNA, 25 bp, Mus musculus
ctgatctgagaggcctctcctgcag

SEQ ID NO: 272755 - DNA, 25 bp, Mus musculus
ctgatctgcagactcagccttatgg

SEQ ID NO: 272756 - DNA, 25 bp, Mus musculus
ctgatctgcagtcagcaactcttag

SEQ ID NO: 272757 - DNA, 25 bp, Mus musculus
ctgatctgcggcggtcagggaaact

SEQ ID NO: 272758 - DNA, 25 bp, Mus musculus
ctgatctgtgctctaccgtgtgaac

SEQ ID NO: 272759 - DNA, 25 bp, Mus musculus
ctgatctgtggtgctgcacagtttt

SEQ ID NO: 272760 - DNA, 25 bp, Mus musculus
ctgatctgtgtgggcgggtgcatgt

SEQ ID NO: 272761 - DNA, 25 bp, Mus musculus
ctgatcttgaacggggtgccacggc

SEQ ID NO: 272762 - DNA, 25 bp, Mus musculus
ctgatcttggggagtgggaggtgct

SEQ ID NO: 272763 - DNA, 25 bp, Mus musculus
ctgatctttaaatatatttactggc

SEQ ID NO: 272764 - DNA, 25 bp, Mus musculus
ctgatctttaggaggagcaggctgc

SEQ ID NO: 272765 - DNA, 25 bp, Mus musculus
ctgatgaaaaacagggaagctgccc

SEQ ID NO: 272766 - DNA, 25 bp, Mus musculus
ctgatgaaaaacagggaagctgcta

SEQ ID NO: 272767 - DNA, 25 bp, Mus musculus
ctgatgaaaacgttgtatcagagta

SEQ ID NO: 272768 - DNA, 25 bp, Mus musculus
ctgatgaaagggaggctacagacac

SEQ ID NO: 272769 - DNA, 25 bp, Mus musculus
ctgatgaaaggggagggcactgaca

SEQ ID NO: 272770 - DNA, 25 bp, Mus musculus
ctgatgaaatgctttgaaccctgaa

SEQ ID NO: 272771 - DNA, 25 bp, Mus musculus
ctgatgaaatggaaaaactctgatg

SEQ ID NO: 272772 - DNA, 25 bp, Mus musculus
ctgatgaaatggtcttcttcccgtg

SEQ ID NO: 272773 - DNA, 25 bp, Mus musculus
ctgatgaactcagctctgatgtctc

SEQ ID NO: 272774 - DNA, 25 bp, Mus musculus
ctgatgaactgaatccaaatccaga

SEQ ID NO: 272775 - DNA, 25 bp, Mus musculus
ctgatgaactgcctgacttgtgaca

SEQ ID NO: 272776 - DNA, 25 bp, Mus musculus
ctgatgaatcccaaaggccctgcca

SEQ ID NO: 272777 - DNA, 25 bp, Mus musculus
ctgatgacaaacaagctgctaactc

SEQ ID NO: 272778 - DNA, 25 bp, Mus musculus
ctgatgacaaacaagctttgaaaag

SEQ ID NO: 272779 - DNA, 25 bp, Mus musculus
ctgatgacacagattctgagctggg

SEQ ID NO: 272780 - DNA, 25 bp, Mus musculus
ctgatgacactggctgcggctggaa

SEQ ID NO: 272781 - DNA, 25 bp, Mus musculus
ctgatgacagtatggaagggcctag

SEQ ID NO: 272782 - DNA, 25 bp, Mus musculus
ctgatgacccagtcttatctcctct

SEQ ID NO: 272783 - DNA, 25 bp, Mus musculus
ctgatgactccgaaccaactgtgag

SEQ ID NO: 272784 - DNA, 25 bp, Mus musculus
ctgatgagaaaaaggtcctggagtg

SEQ ID NO: 272785 - DNA, 25 bp, Mus musculus
ctgatgagacaaagggagctgaagg

SEQ ID NO: 272786 - DNA, 25 bp, Mus musculus
ctgatgagagtgttcgaggaatatg

SEQ ID NO: 272787 - DNA, 25 bp, Mus musculus
ctgatgagccagtcccgcatccttc

SEQ ID NO: 272788 - DNA, 25 bp, Mus musculus
ctgatgaggagatactggagtgtgg

SEQ ID NO: 272789 - DNA, 25 bp, Mus musculus
ctgatgaggcgaaggaaagctcaca

SEQ ID NO: 272790 - DNA, 25 bp, Mus musculus
ctgatgagttctcccataccctcca

SEQ ID NO: 272791 - DNA, 25 bp, Mus musculus
ctgatgatcaggaccagtgtccaga

SEQ ID NO: 272792 - DNA, 25 bp, Mus musculus
ctgatgatggagaggtggacatgga

SEQ ID NO: 272793 - DNA, 25 bp, Mus musculus
ctgatgattaacctggtgctggatt

SEQ ID NO: 272794 - DNA, 25 bp, Mus musculus
ctgatgattcacagtggtaagattg

SEQ ID NO: 272795 - DNA, 25 bp, Mus musculus
ctgatgcaaaaaggtctgctgaaga

SEQ ID NO: 272796 - DNA, 25 bp, Mus musculus
ctgatgcaaagttccaggtgttcct

SEQ ID NO: 272797 - DNA, 25 bp, Mus musculus
ctgatgcacgggaaggaagtgggca

SEQ ID NO: 272798 - DNA, 25 bp, Mus musculus
ctgatgcagacggagaagcagttct

SEQ ID NO: 272799 - DNA, 25 bp, Mus musculus
ctgatgcagctccccaccacttact

SEQ ID NO: 272800 - DNA, 25 bp, Mus musculus
ctgatgcattcacagggtgatcttg

SEQ ID NO: 272801 - DNA, 25 bp, Mus musculus
ctgatgccaagtttgagcatgccac

SEQ ID NO: 272802 - DNA, 25 bp, Mus musculus
ctgatgccaagtttgagtctggaga

SEQ ID NO: 272803 - DNA, 25 bp, Mus musculus
ctgatgccagtcattgcattcagca

SEQ ID NO: 272804 - DNA, 25 bp, Mus musculus
ctgatgccagtcattgtatacaaca

SEQ ID NO: 272805 - DNA, 25 bp, Mus musculus
ctgatgccattccaggtaaatgggc

SEQ ID NO: 272806 - DNA, 25 bp, Mus musculus
ctgatgccctgcaccactttgccag

SEQ ID NO: 272807 - DNA, 25 bp, Mus musculus
ctgatgcctcacctgctccaggttt

SEQ ID NO: 272808 - DNA, 25 bp, Mus musculus
ctgatgcctcacctgggtgctacag

SEQ ID NO: 272809 - DNA, 25 bp, Mus musculus
ctgatgcctcaggttcaaccaggcc

SEQ ID NO: 272810 - DNA, 25 bp, Mus musculus
ctgatgcctccgctggaaaccatgg

SEQ ID NO: 272811 - DNA, 25 bp, Mus musculus
ctgatgctcggtgaaggaggtcgta

SEQ ID NO: 272812 - DNA, 25 bp, Mus musculus
ctgatgctgacggtcacagagctgc

SEQ ID NO: 272813 - DNA, 25 bp, Mus musculus
ctgatgctgaggcctgacctggagc

SEQ ID NO: 272814 - DNA, 25 bp, Mus musculus
ctgatgctgccaggagacgctctgt

SEQ ID NO: 272815 - DNA, 25 bp, Mus musculus
ctgatgctggccagccggtttaagc

SEQ ID NO: 272816 - DNA, 25 bp, Mus musculus
ctgatgctggggagaatcccgtatc

SEQ ID NO: 272817 - DNA, 25 bp, Mus musculus
ctgatgctgtagagagacaatgtct

SEQ ID NO: 272818 - DNA, 25 bp, Mus musculus
ctgatggaattgaacttttgagcag

SEQ ID NO: 272819 - DNA, 25 bp, Mus musculus
ctgatggacagccctgggatcgatg

SEQ ID NO: 272820 - DNA, 25 bp, Mus musculus
ctgatggacggctctcagacactgc

SEQ ID NO: 272821 - DNA, 25 bp, Mus musculus
ctgatggagaacaggatgaagaaga

SEQ ID NO: 272822 - DNA, 25 bp, Mus musculus
ctgatggagagaggtgccagcgtgg

SEQ ID NO: 272823 - DNA, 25 bp, Mus musculus
ctgatggagagttatttgcttgggg

SEQ ID NO: 272824 - DNA, 25 bp, Mus musculus
ctgatggaggagtcttctatgagtg

SEQ ID NO: 272825 - DNA, 25 bp, Mus musculus
ctgatggagtatggtgatgaagctc

SEQ ID NO: 272826 - DNA, 25 bp, Mus musculus
ctgatggagtgatgggagccaggag

SEQ ID NO: 272827 - DNA, 25 bp, Mus musculus
ctgatggagttggacattggtgccc

SEQ ID NO: 272828 - DNA, 25 bp, Mus musculus
ctgatggattgtcgcgatagagtac

SEQ ID NO: 272829 - DNA, 25 bp, Mus musculus
ctgatggcaaaagtttcttctggga

SEQ ID NO: 272830 - DNA, 25 bp, Mus musculus
ctgatggcacagaagatgctgacaa

SEQ ID NO: 272831 - DNA, 25 bp, Mus musculus
ctgatggcagcctctccaggcagaa

SEQ ID NO: 272832 - DNA, 25 bp, Mus musculus
ctgatggcatgtgtccaaatgatga

SEQ ID NO: 272833 - DNA, 25 bp, Mus musculus
ctgatggccatggtcaagaaaaaaa

SEQ ID NO: 272834 - DNA, 25 bp, Mus musculus
ctgatggccggggacctgaagacga

SEQ ID NO: 272835 - DNA, 25 bp, Mus musculus
ctgatggcggtgaagacaaagtagt

SEQ ID NO: 272836 - DNA, 25 bp, Mus musculus
ctgatggctattcggagaataatgt

SEQ ID NO: 272837 - DNA, 25 bp, Mus musculus
ctgatggctgatgaggtataccaag

SEQ ID NO: 272838 - DNA, 25 bp, Mus musculus
ctgatgggaaggtggcagtgaacct

SEQ ID NO: 272839 - DNA, 25 bp, Mus musculus
ctgatgggagagcaagccctcatga

SEQ ID NO: 272840 - DNA, 25 bp, Mus musculus
ctgatgggagaggctttgaagactg

SEQ ID NO: 272841 - DNA, 25 bp, Mus musculus
ctgatgggcaaggctgggtgggtga

SEQ ID NO: 272842 - DNA, 25 bp, Mus musculus
ctgatgggcaggcaccaggagagct

SEQ ID NO: 272843 - DNA, 25 bp, Mus musculus
ctgatgggcggagatctgagtgccc

SEQ ID NO: 272844 - DNA, 25 bp, Mus musculus
ctgatgggctgcagggacctcccgg

SEQ ID NO: 272845 - DNA, 25 bp, Mus musculus
ctgatggtacctacccagcgtcccc

SEQ ID NO: 272846 - DNA, 25 bp, Mus musculus
ctgatggtcaggtgtgacagacatc

SEQ ID NO: 272847 - DNA, 25 bp, Mus musculus
ctgatggtccaaagggcaacccagg

SEQ ID NO: 272848 - DNA, 25 bp, Mus musculus
ctgatggtcccaaaggtgcagctgg

SEQ ID NO: 272849 - DNA, 25 bp, Mus musculus
ctgatggtgaagatcccatacatca

SEQ ID NO: 272850 - DNA, 25 bp, Mus musculus
ctgatgtaaagattttgctggaaga

SEQ ID NO: 272851 - DNA, 25 bp, Mus musculus
ctgatgtatgaggcttcctgcgggc

SEQ ID NO: 272852 - DNA, 25 bp, Mus musculus
ctgatgtatggatcggaacgtcaat

SEQ ID NO: 272853 - DNA, 25 bp, Mus musculus
ctgatgtcattctcccatgtgtgaa

SEQ ID NO: 272854 - DNA, 25 bp, Mus musculus
ctgatgtccgggcactagagcagcc

SEQ ID NO: 272855 - DNA, 25 bp, Mus musculus
ctgatgtcgcagggacactgggttc

SEQ ID NO: 272856 - DNA, 25 bp, Mus musculus
ctgatgtgaggctcctcatagtcct

SEQ ID NO: 272857 - DNA, 25 bp, Mus musculus
ctgatgtgatgacaggaaattgttt

SEQ ID NO: 272858 - DNA, 25 bp, Mus musculus
ctgatgtggaaaggaaaatagaaat

SEQ ID NO: 272859 - DNA, 25 bp, Mus musculus
ctgatgtgggaggtacgtgggagca

SEQ ID NO: 272860 - DNA, 25 bp, Mus musculus
ctgatgtgggtccaggctctggacc

SEQ ID NO: 272861 - DNA, 25 bp, Mus musculus
ctgatgtgtaagcttatcacagttc

SEQ ID NO: 272862 - DNA, 25 bp, Mus musculus
ctgatgttgaaatggaatacactat

SEQ ID NO: 272863 - DNA, 25 bp, Mus musculus
ctgatgtttcccagaatcatacgat

SEQ ID NO: 272864 - DNA, 25 bp, Mus musculus
ctgattaaaggtggagcagccctgg

SEQ ID NO: 272865 - DNA, 25 bp, Mus musculus
ctgattaaagtaacgacattctgcc

SEQ ID NO: 272866 - DNA, 25 bp, Mus musculus
ctgattatagggtcctgctgatgga

SEQ ID NO: 272867 - DNA, 25 bp, Mus musculus
ctgattatcagtaccccaccccagg

SEQ ID NO: 272868 - DNA, 25 bp, Mus musculus
ctgattcaaggaggcttggcaaatt

SEQ ID NO: 272869 - DNA, 25 bp, Mus musculus
ctgattcacatcgagaaagcctttg

SEQ ID NO: 272870 - DNA, 25 bp, Mus musculus
ctgattcacatcgagctggagtacc

SEQ ID NO: 272871 - DNA, 25 bp, Mus musculus
ctgattcagacattgcagatggtga

SEQ ID NO: 272872 - DNA, 25 bp, Mus musculus
ctgattcatcagacacctgctgtcc

SEQ ID NO: 272873 - DNA, 25 bp, Mus musculus
ctgattcatgagccatcaaagagag

SEQ ID NO: 272874 - DNA, 25 bp, Mus musculus
ctgattccaagcctggaagggcgtt

SEQ ID NO: 272875 - DNA, 25 bp, Mus musculus
ctgattccacgcttcttgccacctg

SEQ ID NO: 272876 - DNA, 25 bp, Mus musculus
ctgattccagctgaccagggtggag

SEQ ID NO: 272877 - DNA, 25 bp, Mus musculus
ctgattccagttacttcctgccttg

SEQ ID NO: 272878 - DNA, 25 bp, Mus musculus
ctgattccattctttgtggtcgcta

SEQ ID NO: 272879 - DNA, 25 bp, Mus musculus
ctgattccattcttttgttggggat

SEQ ID NO: 272880 - DNA, 25 bp, Mus musculus
ctgattcccagctgtttggggcaac

SEQ ID NO: 272881 - DNA, 25 bp, Mus musculus
ctgattcccctggatcattcggaca

SEQ ID NO: 272882 - DNA, 25 bp, Mus musculus
ctgattccgggactgcaggctacaa

SEQ ID NO: 272883 - DNA, 25 bp, Mus musculus
ctgattcctcagggcatcgtgaagc

SEQ ID NO: 272884 - DNA, 25 bp, Mus musculus
ctgattcgagaggttccgtgaggag

SEQ ID NO: 272885 - DNA, 25 bp, Mus musculus
ctgattcgagcgacttcggagcaca

SEQ ID NO: 272886 - DNA, 25 bp, Mus musculus
ctgattcgagcggggttccttgtgg

SEQ ID NO: 272887 - DNA, 25 bp, Mus musculus
ctgattctgaggtgtggcttgacgc

SEQ ID NO: 272888 - DNA, 25 bp, Mus musculus
ctgattctgtggaactagtcttgca

SEQ ID NO: 272889 - DNA, 25 bp, Mus musculus
ctgattcttgaatgcaccttatagc

SEQ ID NO: 272890 - DNA, 25 bp, Mus musculus
ctgattgaaagtaatcacccaattg

SEQ ID NO: 272891 - DNA, 25 bp, Mus musculus
ctgattgaaagtataattgcagaag

SEQ ID NO: 272892 - DNA, 25 bp, Mus musculus
ctgattgaagcctgctgcaaaaatg

SEQ ID NO: 272893 - DNA, 25 bp, Mus musculus
ctgattgagaagctgggaggctgga

SEQ ID NO: 272894 - DNA, 25 bp, Mus musculus
ctgattgataatcctgctaccagcc

SEQ ID NO: 272895 - DNA, 25 bp, Mus musculus
ctgattgcagttccaactacctcag

SEQ ID NO: 272896 - DNA, 25 bp, Mus musculus
ctgattgccttttcccagtgttgtg

SEQ ID NO: 272897 - DNA, 25 bp, Mus musculus
ctgattgctgtggacagacgcctgc

SEQ ID NO: 272898 - DNA, 25 bp, Mus musculus
ctgattggaggtcggtgagctggta

SEQ ID NO: 272899 - DNA, 25 bp, Mus musculus
ctgattggcaggtctcacatgagtt

SEQ ID NO: 272900 - DNA, 25 bp, Mus musculus
ctgattggccgagagatgaaaaatg

SEQ ID NO: 272901 - DNA, 25 bp, Mus musculus
ctgattggccgagaggcaagaagag

SEQ ID NO: 272902 - DNA, 25 bp, Mus musculus
ctgattgggaaggtttggcctggaa

SEQ ID NO: 272903 - DNA, 25 bp, Mus musculus
ctgattggggagggttttgaatcct

SEQ ID NO: 272904 - DNA, 25 bp, Mus musculus
ctgattggttatgtcacaaacataa

SEQ ID NO: 272905 - DNA, 25 bp, Mus musculus
ctgattggttatgtggcagcagaag

SEQ ID NO: 272906 - DNA, 25 bp, Mus musculus
ctgattgtagacaccggtaccaacg

SEQ ID NO: 272907 - DNA, 25 bp, Mus musculus
ctgattgtgaaaacattcgtatagc

SEQ ID NO: 272908 - DNA, 25 bp, Mus musculus
ctgattgtgagcggaaaagtgtacc

SEQ ID NO: 272909 - DNA, 25 bp, Mus musculus
ctgattgtggcaggacgaagaatga

SEQ ID NO: 272910 - DNA, 25 bp, Mus musculus
ctgattgtggcaggtatcacgagca

SEQ ID NO: 272911 - DNA, 25 bp, Mus musculus
ctgatttaaggcttttgcctaccaa

SEQ ID NO: 272912 - DNA, 25 bp, Mus musculus
ctgatttaagggcagcagggaacct

SEQ ID NO: 272913 - DNA, 25 bp, Mus musculus
ctgatttacagaagataacaaagtt

SEQ ID NO: 272914 - DNA, 25 bp, Mus musculus
ctgatttacagaagtgctaggcctg

SEQ ID NO: 272915 - DNA, 25 bp, Mus musculus
ctgatttacagaagtggacaagaag

SEQ ID NO: 272916 - DNA, 25 bp, Mus musculus
ctgatttcgaggggacccagccgta

SEQ ID NO: 272917 - DNA, 25 bp, Mus musculus
ctgatttcttggaatagaaacccta

SEQ ID NO: 272918 - DNA, 25 bp, Mus musculus
ctgatttcttgggtgaagaaaatct

SEQ ID NO: 272919 - DNA, 25 bp, Mus musculus
ctgattttagctctgatctcactct

SEQ ID NO: 272920 - DNA, 25 bp, Mus musculus
ctgattttcccgaatactcctcaag

SEQ ID NO: 272921 - DNA, 25 bp, Mus musculus
ctgattttgagaattcagagccaat

SEQ ID NO: 272922 - DNA, 25 bp, Mus musculus
ctgattttgagtttgaaaatgaaaa

SEQ ID NO: 272923 - DNA, 25 bp, Mus musculus
ctgattttgccaagtcatctcacat

SEQ ID NO: 272924 - DNA, 25 bp, Mus musculus
ctgatttttcaggcccaatgatgat

SEQ ID NO: 272925 - DNA, 25 bp, Mus musculus
ctgatttttcaggggatgtttcgga

SEQ ID NO: 272926 - DNA, 25 bp, Mus musculus
ctgattttttgcaggcatcacagac

SEQ ID NO: 272927 - DNA, 25 bp, Mus musculus
ctgcaaaaacaaagctcctgggctc

SEQ ID NO: 272928 - DNA, 25 bp, Mus musculus
ctgcaaaaacagatgtggaaagagc

SEQ ID NO: 272929 - DNA, 25 bp, Mus musculus
ctgcaaaaacagctcaatgacagtc

SEQ ID NO: 272930 - DNA, 25 bp, Mus musculus
ctgcaaaaacagctctgtccaaagc

SEQ ID NO: 272931 - DNA, 25 bp, Mus musculus
ctgcaaaaagaaatacgaagaaaaa

SEQ ID NO: 272932 - DNA, 25 bp, Mus musculus
ctgcaaaaaggggatggaattcgaa

SEQ ID NO: 272933 - DNA, 25 bp, Mus musculus
ctgcaaaacccaaagccctttgcca

SEQ ID NO: 272934 - DNA, 25 bp, Mus musculus
ctgcaaaagagcaccagcacagctg

SEQ ID NO: 272935 - DNA, 25 bp, Mus musculus
ctgcaaaagcgggcctcctgctgcc

SEQ ID NO: 272936 - DNA, 25 bp, Mus musculus
ctgcaaaagcgggtggaggagagca

SEQ ID NO: 272937 - DNA, 25 bp, Mus musculus
ctgcaaaatggcaggagctcgacgc

SEQ ID NO: 272938 - DNA, 25 bp, Mus musculus
ctgcaaaatgggagccaggagtcct

SEQ ID NO: 272939 - DNA, 25 bp, Mus musculus
ctgcaaaatgtaactgcggatcccc

SEQ ID NO: 272940 - DNA, 25 bp, Mus musculus
ctgcaaaccatgatctcaagaccag

SEQ ID NO: 272941 - DNA, 25 bp, Mus musculus
ctgcaaaccatgcctcaatctaggt

SEQ ID NO: 272942 - DNA, 25 bp, Mus musculus
ctgcaaacgggaggatatgatggtt

SEQ ID NO: 272943 - DNA, 25 bp, Mus musculus
ctgcaaacggtggttggcacttacc

SEQ ID NO: 272944 - DNA, 25 bp, Mus musculus
ctgcaaactatactgagatcgcctt

SEQ ID NO: 272945 - DNA, 25 bp, Mus musculus
ctgcaaactgccacgtcctccccga

SEQ ID NO: 272946 - DNA, 25 bp, Mus musculus
ctgcaaactggcacgtcctccccga

SEQ ID NO: 272947 - DNA, 25 bp, Mus musculus
ctgcaaactttatgatcctggggca

SEQ ID NO: 272948 - DNA, 25 bp, Mus musculus
ctgcaaagagccgtctagacaaggg

SEQ ID NO: 272949 - DNA, 25 bp, Mus musculus
ctgcaaagaggctgatttatcgctg

SEQ ID NO: 272950 - DNA, 25 bp, Mus musculus
ctgcaaagcgccatcaaaggatttt

SEQ ID NO: 272951 - DNA, 25 bp, Mus musculus
ctgcaaagcgctactgttgaggcta

SEQ ID NO: 272952 - DNA, 25 bp, Mus musculus
ctgcaaagctgaaggctccgagtac

SEQ ID NO: 272953 - DNA, 25 bp, Mus musculus
ctgcaaaggaaacgatggatctggg

SEQ ID NO: 272954 - DNA, 25 bp, Mus musculus
ctgcaaaggaaacggtgcctcctcc

SEQ ID NO: 272955 - DNA, 25 bp, Mus musculus
ctgcaaaggaagctcaatgacagtc

SEQ ID NO: 272956 - DNA, 25 bp, Mus musculus
ctgcaaagggagcttggcatggatc

SEQ ID NO: 272957 - DNA, 25 bp, Mus musculus
ctgcaaaggtaaccagagcgagcac

SEQ ID NO: 272958 - DNA, 25 bp, Mus musculus
ctgcaaagtaatatctccatctctg

SEQ ID NO: 272959 - DNA, 25 bp, Mus musculus
ctgcaaagtggacagtcccaccgtc

SEQ ID NO: 272960 - DNA, 25 bp, Mus musculus
ctgcaaataacgtgaactgtggact

SEQ ID NO: 272961 - DNA, 25 bp, Mus musculus
ctgcaaatacttaacgtctcattct

SEQ ID NO: 272962 - DNA, 25 bp, Mus musculus
ctgcaaatggcgaaagtcctaggtg

SEQ ID NO: 272963 - DNA, 25 bp, Mus musculus
ctgcaaattagatgttctttgttta

SEQ ID NO: 272964 - DNA, 25 bp, Mus musculus
ctgcaaatttacagagcagcatggc

SEQ ID NO: 272965 - DNA, 25 bp, Mus musculus
ctgcaacaaaggcttcaccacagca

SEQ ID NO: 272966 - DNA, 25 bp, Mus musculus
ctgcaacaaaggtactggtgaggtt

SEQ ID NO: 272967 - DNA, 25 bp, Mus musculus
ctgcaacaaccttgaccttattcaa

SEQ ID NO: 272968 - DNA, 25 bp, Mus musculus
ctgcaacaacgggatcccggagaac

SEQ ID NO: 272969 - DNA, 25 bp, Mus musculus
ctgcaacaaggtgtcagctgatggt

SEQ ID NO: 272970 - DNA, 25 bp, Mus musculus
ctgcaacaatgaatggcatgcattt

SEQ ID NO: 272971 - DNA, 25 bp, Mus musculus
ctgcaacaatggcgccccctgtaat

SEQ ID NO: 272972 - DNA, 25 bp, Mus musculus
ctgcaacagcaaggtggccacgaag

SEQ ID NO: 272973 - DNA, 25 bp, Mus musculus
ctgcaacaggctaggtgctggtgtt

SEQ ID NO: 272974 - DNA, 25 bp, Mus musculus
ctgcaacaggctaggttgcaggaag

SEQ ID NO: 272975 - DNA, 25 bp, Mus musculus
ctgcaacatacaggttaccaaagtg

SEQ ID NO: 272976 - DNA, 25 bp, Mus musculus
ctgcaaccaagatgagtccttccac

SEQ ID NO: 272977 - DNA, 25 bp, Mus musculus
ctgcaaccaagatttaaacgagtgt

SEQ ID NO: 272978 - DNA, 25 bp, Mus musculus
ctgcaaccaaggcctttgtagattt

SEQ ID NO: 272979 - DNA, 25 bp, Mus musculus
ctgcaaccatgagaccagcaccaac

SEQ ID NO: 272980 - DNA, 25 bp, Mus musculus
ctgcaaccatgatcaagcacttcct

SEQ ID NO: 272981 - DNA, 25 bp, Mus musculus
ctgcaaccatggatgacaaggagta

SEQ ID NO: 272982 - DNA, 25 bp, Mus musculus
ctgcaacccagagaccttccccttg

SEQ ID NO: 272983 - DNA, 25 bp, Mus musculus
ctgcaacccatgagcatccaggtga

SEQ ID NO: 272984 - DNA, 25 bp, Mus musculus
ctgcaaccccagcccgcacccggaa

SEQ ID NO: 272985 - DNA, 25 bp, Mus musculus
ctgcaaccctggagctgccgcagtg

SEQ ID NO: 272986 - DNA, 25 bp, Mus musculus
ctgcaaccgaggtcacatggtgggc

SEQ ID NO: 272987 - DNA, 25 bp, Mus musculus
ctgcaacctgccgaataaggccagc

SEQ ID NO: 272988 - DNA, 25 bp, Mus musculus
ctgcaacctgccgagaaaccctttt

SEQ ID NO: 272989 - DNA, 25 bp, Mus musculus
ctgcaacgcacgacgcagtggaaga

SEQ ID NO: 272990 - DNA, 25 bp, Mus musculus
ctgcaacgccacttgaccaaatgtg

SEQ ID NO: 272991 - DNA, 25 bp, Mus musculus
ctgcaactcaaggatggatgccctg

SEQ ID NO: 272992 - DNA, 25 bp, Mus musculus
ctgcaactcaaggtctaaggtacaa

SEQ ID NO: 272993 - DNA, 25 bp, Mus musculus
ctgcaactgacaagatttagccttc

SEQ ID NO: 272994 - DNA, 25 bp, Mus musculus
ctgcaactgacaaggtattcatgct

SEQ ID NO: 272995 - DNA, 25 bp, Mus musculus
ctgcaactttaagatggagccagat

SEQ ID NO: 272996 - DNA, 25 bp, Mus musculus
ctgcaagaaaaggaaggaactcaag

SEQ ID NO: 272997 - DNA, 25 bp, Mus musculus
ctgcaagaaaaggactggacagact

SEQ ID NO: 272998 - DNA, 25 bp, Mus musculus
ctgcaagaaaaggctcatgtgtttt

SEQ ID NO: 272999 - DNA, 25 bp, Mus musculus
ctgcaagaaaccttgtcactagatg

SEQ ID NO: 273000 - DNA, 25 bp, Mus musculus
ctgcaagaaatttgccgaggccttg

SEQ ID NO: 273001 - DNA, 25 bp, Mus musculus
ctgcaagaaatttggtgtccaggga

SEQ ID NO: 273002 - DNA, 25 bp, Mus musculus
ctgcaagaacacatacagtgtcttc

SEQ ID NO: 273003 - DNA, 25 bp, Mus musculus
ctgcaagaacactgtcttcaagatc

SEQ ID NO: 273004 - DNA, 25 bp, Mus musculus
ctgcaagaatcaaacatttttaaga

SEQ ID NO: 273005 - DNA, 25 bp, Mus musculus
ctgcaagaccaaggacgagtcttgc

SEQ ID NO: 273006 - DNA, 25 bp, Mus musculus
ctgcaagactaggtttgccagatct

SEQ ID NO: 273007 - DNA, 25 bp, Mus musculus
ctgcaagagcaataaaattgctact

SEQ ID NO: 273008 - DNA, 25 bp, Mus musculus
ctgcaagagcagtttgacaacttaa

SEQ ID NO: 273009 - DNA, 25 bp, Mus musculus
ctgcaagagctttctatccaaggag

SEQ ID NO: 273010 - DNA, 25 bp, Mus musculus
ctgcaagatcaagacagctgcatct

SEQ ID NO: 273011 - DNA, 25 bp, Mus musculus
ctgcaagatggaagaaaatctgggt

SEQ ID NO: 273012 - DNA, 25 bp, Mus musculus
ctgcaagatggaagggctctctaaa

SEQ ID NO: 273013 - DNA, 25 bp, Mus musculus
ctgcaagcagtcccggctgagtttg

SEQ ID NO: 273014 - DNA, 25 bp, Mus musculus
ctgcaagcatccagagcaagaagag

SEQ ID NO: 273015 - DNA, 25 bp, Mus musculus
ctgcaagcatccagggcttatcaga

SEQ ID NO: 273016 - DNA, 25 bp, Mus musculus
ctgcaagccaagcagtctctggtcc

SEQ ID NO: 273017 - DNA, 25 bp, Mus musculus
ctgcaagccaggccattccccagta

SEQ ID NO: 273018 - DNA, 25 bp, Mus musculus
ctgcaagccaggtggagcagccaat

SEQ ID NO: 273019 - DNA, 25 bp, Mus musculus
ctgcaagccaggttccttaaaagaa

SEQ ID NO: 273020 - DNA, 25 bp, Mus musculus
ctgcaagccctgagcttgtcccact

SEQ ID NO: 273021 - DNA, 25 bp, Mus musculus
ctgcaagccctggctgcttttagaa

SEQ ID NO: 273022 - DNA, 25 bp, Mus musculus
ctgcaagccggtggcccagcctgca

SEQ ID NO: 273023 - DNA, 25 bp, Mus musculus
ctgcaagcctgtatggatggattcc

SEQ ID NO: 273024 - DNA, 25 bp, Mus musculus
ctgcaagctaggtaggaacaacctt

SEQ ID NO: 273025 - DNA, 25 bp, Mus musculus
ctgcaagctcagatgtatagactca

SEQ ID NO: 273026 - DNA, 25 bp, Mus musculus
ctgcaagctgcaggttgcttctata

SEQ ID NO: 273027 - DNA, 25 bp, Mus musculus
ctgcaaggaaggttggcagcgtggt

SEQ ID NO: 273028 - DNA, 25 bp, Mus musculus
ctgcaaggatgctacggaagagtcc

SEQ ID NO: 273029 - DNA, 25 bp, Mus musculus
ctgcaaggatggagaatacattgat

SEQ ID NO: 273030 - DNA, 25 bp, Mus musculus
ctgcaaggattccagccccagtctc

SEQ ID NO: 273031 - DNA, 25 bp, Mus musculus
ctgcaaggcaaatctcatataaaac

SEQ ID NO: 273032 - DNA, 25 bp, Mus musculus
ctgcaaggcaggtcttccatgtttg

SEQ ID NO: 273033 - DNA, 25 bp, Mus musculus
ctgcaaggcaggttggcgtgggtgg

SEQ ID NO: 273034 - DNA, 25 bp, Mus musculus
ctgcaaggcatggcccagttcaatt

SEQ ID NO: 273035 - DNA, 25 bp, Mus musculus
ctgcaaggccagtggatgcgcctat

SEQ ID NO: 273036 - DNA, 25 bp, Mus musculus
ctgcaaggctgtgtatacagttttg

SEQ ID NO: 273037 - DNA, 25 bp, Mus musculus
ctgcaaggttcctgccgctaacgtc

SEQ ID NO: 273038 - DNA, 25 bp, Mus musculus
ctgcaagtataggacaacctcaagt

SEQ ID NO: 273039 - DNA, 25 bp, Mus musculus
ctgcaagtcaatcaggcgacggtgt

SEQ ID NO: 273040 - DNA, 25 bp, Mus musculus
ctgcaagtggaccagcagcagcagc

SEQ ID NO: 273041 - DNA, 25 bp, Mus musculus
ctgcaagtggaccaggactacctta

SEQ ID NO: 273042 - DNA, 25 bp, Mus musculus
ctgcaagtggcaggattctgaatca

SEQ ID NO: 273043 - DNA, 25 bp, Mus musculus
ctgcaagtgggtctccaacaagtgg

SEQ ID NO: 273044 - DNA, 25 bp, Mus musculus
ctgcaagttaaaaggaacttctgca

SEQ ID NO: 273045 - DNA, 25 bp, Mus musculus
ctgcaagttataccacatcacagct

SEQ ID NO: 273046 - DNA, 25 bp, Mus musculus
ctgcaatacctggcgccagagcttc

SEQ ID NO: 273047 - DNA, 25 bp, Mus musculus
ctgcaatataaggcacaatggaagg

SEQ ID NO: 273048 - DNA, 25 bp, Mus musculus
ctgcaatatgactgaaacggcatgg

SEQ ID NO: 273049 - DNA, 25 bp, Mus musculus
ctgcaatatgactgcccgaagcctt

SEQ ID NO: 273050 - DNA, 25 bp, Mus musculus
ctgcaatcatcaggagcaaagagcc

SEQ ID NO: 273051 - DNA, 25 bp, Mus musculus
ctgcaatcgaggtcatgcttctgga

SEQ ID NO: 273052 - DNA, 25 bp, Mus musculus
ctgcaatcttaacaattcaggccaa

SEQ ID NO: 273053 - DNA, 25 bp, Mus musculus
ctgcaatgaggtcaactccgtcaac

SEQ ID NO: 273054 - DNA, 25 bp, Mus musculus
ctgcaatgattattgggtgtgcatt

SEQ ID NO: 273055 - DNA, 25 bp, Mus musculus
ctgcaatggcagaacacaagaatta

SEQ ID NO: 273056 - DNA, 25 bp, Mus musculus
ctgcaatggcagcctggactgcatc

SEQ ID NO: 273057 - DNA, 25 bp, Mus musculus
ctgcaatggcaggcctagccagcat

SEQ ID NO: 273058 - DNA, 25 bp, Mus musculus
ctgcaatggcaggttttactgcaat

SEQ ID NO: 273059 - DNA, 25 bp, Mus musculus
ctgcaatggcagtctgttccggtac

SEQ ID NO: 273060 - DNA, 25 bp, Mus musculus
ctgcaattacaaaggtggctttgac

SEQ ID NO: 273061 - DNA, 25 bp, Mus musculus
ctgcaattcagaatgtctctcatgt

SEQ ID NO: 273062 - DNA, 25 bp, Mus musculus
ctgcaattcagaatgttgttcagat

SEQ ID NO: 273063 - DNA, 25 bp, Mus musculus
ctgcaattctccccaggaaaataca

SEQ ID NO: 273064 - DNA, 25 bp, Mus musculus
ctgcaattgccaaggcaggtgcagt

SEQ ID NO: 273065 - DNA, 25 bp, Mus musculus
ctgcacaaaacgagatctggcagac

SEQ ID NO: 273066 - DNA, 25 bp, Mus musculus
ctgcacaaaacgagtgacgagtatc

SEQ ID NO: 273067 - DNA, 25 bp, Mus musculus
ctgcacaaacagagcagctctggct

SEQ ID NO: 273068 - DNA, 25 bp, Mus musculus
ctgcacaaacgagctccttatgtct

SEQ ID NO: 273069 - DNA, 25 bp, Mus musculus
ctgcacaaacgaggggaatatatta

SEQ ID NO: 273070 - DNA, 25 bp, Mus musculus
ctgcacaacagaatgcacgtagaaa

SEQ ID NO: 273071 - DNA, 25 bp, Mus musculus
ctgcacaagcaagagtaaaaagaag

SEQ ID NO: 273072 - DNA, 25 bp, Mus musculus
ctgcacaaggttctgaaccagctgg

SEQ ID NO: 273073 - DNA, 25 bp, Mus musculus
ctgcacaattgagggttgccccggc

SEQ ID NO: 273074 - DNA, 25 bp, Mus musculus
ctgcacaattgctcactatttggat

SEQ ID NO: 273075 - DNA, 25 bp, Mus musculus
ctgcacaatttcaccgtattagaaa

SEQ ID NO: 273076 - DNA, 25 bp, Mus musculus
ctgcacaatttcacggtattagaaa

SEQ ID NO: 273077 - DNA, 25 bp, Mus musculus
ctgcacacataacaccaatgactgc

SEQ ID NO: 273078 - DNA, 25 bp, Mus musculus
ctgcacacatacacgcccgaatggc

SEQ ID NO: 273079 - DNA, 25 bp, Mus musculus
ctgcacacatggatgaaaattcagg

SEQ ID NO: 273080 - DNA, 25 bp, Mus musculus
ctgcacacttacgtccacgccacgc

SEQ ID NO: 273081 - DNA, 25 bp, Mus musculus
ctgcacagaaaacccagccagtggt

SEQ ID NO: 273082 - DNA, 25 bp, Mus musculus
ctgcacagaaagactaccaccatac

SEQ ID NO: 273083 - DNA, 25 bp, Mus musculus
ctgcacagaaagccaggggctgggt

SEQ ID NO: 273084 - DNA, 25 bp, Mus musculus
ctgcacagaaagggagagtcctgca

SEQ ID NO: 273085 - DNA, 25 bp, Mus musculus
ctgcacagacaggagcatgcaaaac

SEQ ID NO: 273086 - DNA, 25 bp, Mus musculus
ctgcacagacaggagcatgcattct

SEQ ID NO: 273087 - DNA, 25 bp, Mus musculus
ctgcacagacgagctgttcaaggag

SEQ ID NO: 273088 - DNA, 25 bp, Mus musculus
ctgcacagagagaattttgttcagg

SEQ ID NO: 273089 - DNA, 25 bp, Mus musculus
ctgcacagagatcccaagtgtcctt

SEQ ID NO: 273090 - DNA, 25 bp, Mus musculus
ctgcacagaggggctctttagagca

SEQ ID NO: 273091 - DNA, 25 bp, Mus musculus
ctgcacagatatctttccatctgtg

SEQ ID NO: 273092 - DNA, 25 bp, Mus musculus
ctgcacagcagaggtggaaaatggt

SEQ ID NO: 273093 - DNA, 25 bp, Mus musculus
ctgcacagcccaaagtctgacacta

SEQ ID NO: 273094 - DNA, 25 bp, Mus musculus
ctgcacagcgaccagcagccagttc

SEQ ID NO: 273095 - DNA, 25 bp, Mus musculus
ctgcacagcgggctgacggctgagg

SEQ ID NO: 273096 - DNA, 25 bp, Mus musculus
ctgcacagcgtacagatgaaaaggg

SEQ ID NO: 273097 - DNA, 25 bp, Mus musculus
ctgcacagcgtacaggctcaggaaa

SEQ ID NO: 273098 - DNA, 25 bp, Mus musculus
ctgcacaggagaagggagttggcag

SEQ ID NO: 273099 - DNA, 25 bp, Mus musculus
ctgcacaggagaaggtgaaggaggg

SEQ ID NO: 273100 - DNA, 25 bp, Mus musculus
ctgcacaggagggtcacttccctcc

SEQ ID NO: 273101 - DNA, 25 bp, Mus musculus
ctgcacagtgatcatcaaggaggtc

SEQ ID NO: 273102 - DNA, 25 bp, Mus musculus
ctgcacagtgatgactcttccacga

SEQ ID NO: 273103 - DNA, 25 bp, Mus musculus
ctgcacagtgtatgagaagcagcga

SEQ ID NO: 273104 - DNA, 25 bp, Mus musculus
ctgcacagttatggtgtgggagatc

SEQ ID NO: 273105 - DNA, 25 bp, Mus musculus
ctgcacatatgaggtgcttgagcag

SEQ ID NO: 273106 - DNA, 25 bp, Mus musculus
ctgcacatatgagtgttttaaaatg

SEQ ID NO: 273107 - DNA, 25 bp, Mus musculus
ctgcacatcaagacctgtgttcctg

SEQ ID NO: 273108 - DNA, 25 bp, Mus musculus
ctgcacatcaaggtccctttgtgtg

SEQ ID NO: 273109 - DNA, 25 bp, Mus musculus
ctgcacatctctgatgtggaagggg

SEQ ID NO: 273110 - DNA, 25 bp, Mus musculus
ctgcacattcaccaggtgcactgcc

SEQ ID NO: 273111 - DNA, 25 bp, Mus musculus
ctgcaccagaatggcatccaggtga

SEQ ID NO: 273112 - DNA, 25 bp, Mus musculus
ctgcaccagagcaatgttcttctgc

SEQ ID NO: 273113 - DNA, 25 bp, Mus musculus
ctgcaccatcgagggctgtcctggc

SEQ ID NO: 273114 - DNA, 25 bp, Mus musculus
ctgcaccatcgccaagaacagcagc

SEQ ID NO: 273115 - DNA, 25 bp, Mus musculus
ctgcaccatcgctcactatctggat

SEQ ID NO: 273116 - DNA, 25 bp, Mus musculus
ctgcacccaagcccctccagttctt

SEQ ID NO: 273117 - DNA, 25 bp, Mus musculus
ctgcacccaagggcacagaccggct

SEQ ID NO: 273118 - DNA, 25 bp, Mus musculus
ctgcacccagaggcatcagaaaagt

SEQ ID NO: 273119 - DNA, 25 bp, Mus musculus
ctgcacccagccaaggtagccacgg

SEQ ID NO: 273120 - DNA, 25 bp, Mus musculus
ctgcaccccggagtatgatcccaac

SEQ ID NO: 273121 - DNA, 25 bp, Mus musculus
ctgcacccctacagccccagctaac

SEQ ID NO: 273122 - DNA, 25 bp, Mus musculus
ctgcacccctacaggatggtcagaa

SEQ ID NO: 273123 - DNA, 25 bp, Mus musculus
ctgcacccctacaggtctgtctgac

SEQ ID NO: 273124 - DNA, 25 bp, Mus musculus
ctgcacccctacagtcagggtttct

SEQ ID NO: 273125 - DNA, 25 bp, Mus musculus
ctgcacccctacagtgttctcaaca

SEQ ID NO: 273126 - DNA, 25 bp, Mus musculus
ctgcacccgcaaagcctccaggtga

SEQ ID NO: 273127 - DNA, 25 bp, Mus musculus
ctgcaccctctgatactccagatcc

SEQ ID NO: 273128 - DNA, 25 bp, Mus musculus
ctgcaccctctgattgctaaagaag

SEQ ID NO: 273129 - DNA, 25 bp, Mus musculus
ctgcaccgcggaggctctgcagaag

SEQ ID NO: 273130 - DNA, 25 bp, Mus musculus
ctgcaccgtgacaagggtgaagatg

SEQ ID NO: 273131 - DNA, 25 bp, Mus musculus
ctgcacctaccaaactggcattatg

SEQ ID NO: 273132 - DNA, 25 bp, Mus musculus
ctgcacctatatcctgaataaaaag

SEQ ID NO: 273133 - DNA, 25 bp, Mus musculus
ctgcacctcccaggaccccaagaca

SEQ ID NO: 273134 - DNA, 25 bp, Mus musculus
ctgcacctcctgtgctttcgttggg

SEQ ID NO: 273135 - DNA, 25 bp, Mus musculus
ctgcacctggagatctgcctgtcaa

SEQ ID NO: 273136 - DNA, 25 bp, Mus musculus
ctgcacctggatgcaccctgctctt

SEQ ID NO: 273137 - DNA, 25 bp, Mus musculus
ctgcacctggatgcattttgttccc

SEQ ID NO: 273138 - DNA, 25 bp, Mus musculus
ctgcaccttcagcagagcacacaac

SEQ ID NO: 273139 - DNA, 25 bp, Mus musculus
ctgcaccttcaggacgccgaggcag

SEQ ID NO: 273140 - DNA, 25 bp, Mus musculus
ctgcacgaagatctgttagcaagaa

SEQ ID NO: 273141 - DNA, 25 bp, Mus musculus
ctgcacgatagtatgaccggttgct

SEQ ID NO: 273142 - DNA, 25 bp, Mus musculus
ctgcacgcaaggtggccgaaggcct

SEQ ID NO: 273143 - DNA, 25 bp, Mus musculus
ctgcacgcagaaagatgacaggaaa

SEQ ID NO: 273144 - DNA, 25 bp, Mus musculus
ctgcacgcaggatggacctctctac

SEQ ID NO: 273145 - DNA, 25 bp, Mus musculus
ctgcacgcaggatgtgtatccatcg

SEQ ID NO: 273146 - DNA, 25 bp, Mus musculus
ctgcacgccgccagagacggcaaag

SEQ ID NO: 273147 - DNA, 25 bp, Mus musculus
ctgcacgcctacagcttcctggtgg

SEQ ID NO: 273148 - DNA, 25 bp, Mus musculus
ctgcacgcgcttgccgacccttccc

SEQ ID NO: 273149 - DNA, 25 bp, Mus musculus
ctgcacgcggaaagagaactagatc

SEQ ID NO: 273150 - DNA, 25 bp, Mus musculus
ctgcacggcgggagggagcccagag

SEQ ID NO: 273151 - DNA, 25 bp, Mus musculus
ctgcacggcgggtaacttcatggaa

SEQ ID NO: 273152 - DNA, 25 bp, Mus musculus
ctgcacggctggccaggccaaggaa

SEQ ID NO: 273153 - DNA, 25 bp, Mus musculus
ctgcacggtgaagatctggaacaac

SEQ ID NO: 273154 - DNA, 25 bp, Mus musculus
ctgcacgtcaggacaaagtggggca

SEQ ID NO: 273155 - DNA, 25 bp, Mus musculus
ctgcacgtgacagtgggctccctgc

SEQ ID NO: 273156 - DNA, 25 bp, Mus musculus
ctgcacgtgcagcgcccacaggccc

SEQ ID NO: 273157 - DNA, 25 bp, Mus musculus
ctgcacgtgcagggtccccgacaac

SEQ ID NO: 273158 - DNA, 25 bp, Mus musculus
ctgcacgtggaccacagtgaactgc

SEQ ID NO: 273159 - DNA, 25 bp, Mus musculus
ctgcacgtgggtccctggaggctgt

SEQ ID NO: 273160 - DNA, 25 bp, Mus musculus
ctgcactacacagccattaggaacc

SEQ ID NO: 273161 - DNA, 25 bp, Mus musculus
ctgcactacacaggacaccaaggac

SEQ ID NO: 273162 - DNA, 25 bp, Mus musculus
ctgcactacgcgggtgacttcacct

SEQ ID NO: 273163 - DNA, 25 bp, Mus musculus
ctgcactagagtatcaagagagcct

SEQ ID NO: 273164 - DNA, 25 bp, Mus musculus
ctgcactatcggtctgtgcactgtg

SEQ ID NO: 273165 - DNA, 25 bp, Mus musculus
ctgcactatcggtttggaggtacca

SEQ ID NO: 273166 - DNA, 25 bp, Mus musculus
ctgcactcaaaagtcagcgtgggag

SEQ ID NO: 273167 - DNA, 25 bp, Mus musculus
ctgcactcagaaccattgttggagt

SEQ ID NO: 273168 - DNA, 25 bp, Mus musculus
ctgcactcagctgccaactccagct

SEQ ID NO: 273169 - DNA, 25 bp, Mus musculus
ctgcactcaggaagaggagacagat

SEQ ID NO: 273170 - DNA, 25 bp, Mus musculus
ctgcactcaggtagtgacatggtag

SEQ ID NO: 273171 - DNA, 25 bp, Mus musculus
ctgcactcgcagaacaccagcctca

SEQ ID NO: 273172 - DNA, 25 bp, Mus musculus
ctgcactctatgttttctcagtgcc

SEQ ID NO: 273173 - DNA, 25 bp, Mus musculus
ctgcactctcagctccagctagaag

SEQ ID NO: 273174 - DNA, 25 bp, Mus musculus
ctgcactgaaataaccagctttcac

SEQ ID NO: 273175 - DNA, 25 bp, Mus musculus
ctgcactgcagggttttggcgaccc

SEQ ID NO: 273176 - DNA, 25 bp, Mus musculus
ctgcactgccagcacggggtctgga

SEQ ID NO: 273177 - DNA, 25 bp, Mus musculus
ctgcactgccccaaggtgaagaact

SEQ ID NO: 273178 - DNA, 25 bp, Mus musculus
ctgcactgctccatgctggcagaag

SEQ ID NO: 273179 - DNA, 25 bp, Mus musculus
ctgcactggacttgctgaaacctgg

SEQ ID NO: 273180 - DNA, 25 bp, Mus musculus
ctgcactgggaaatatggctttgta

SEQ ID NO: 273181 - DNA, 25 bp, Mus musculus
ctgcactgggaaggcttgtcgctta

SEQ ID NO: 273182 - DNA, 25 bp, Mus musculus
ctgcactgtacagacagtggatttg

SEQ ID NO: 273183 - DNA, 25 bp, Mus musculus
ctgcactgtcagagagtggggacag

SEQ ID NO: 273184 - DNA, 25 bp, Mus musculus
ctgcactgtcagcagcattccttgc

SEQ ID NO: 273185 - DNA, 25 bp, Mus musculus
ctgcactgtgtgtggagtgctgaca

SEQ ID NO: 273186 - DNA, 25 bp, Mus musculus
ctgcactgtgtgtggcatattctca

SEQ ID NO: 273187 - DNA, 25 bp, Mus musculus
ctgcacttaacaggacaagctctga

SEQ ID NO: 273188 - DNA, 25 bp, Mus musculus
ctgcacttcaaccagtgtttgtcag

SEQ ID NO: 273189 - DNA, 25 bp, Mus musculus
ctgcacttcagacgaattatcaata

SEQ ID NO: 273190 - DNA, 25 bp, Mus musculus
ctgcacttcgtggggagcaggtcca

SEQ ID NO: 273191 - DNA, 25 bp, Mus musculus
ctgcactttacaggtggctttgcag

SEQ ID NO: 273192 - DNA, 25 bp, Mus musculus
ctgcactttgaggaggaagagatca

SEQ ID NO: 273193 - DNA, 25 bp, Mus musculus
ctgcagaaaaagacggcctgtcagg

SEQ ID NO: 273194 - DNA, 25 bp, Mus musculus
ctgcagaaaaaggagcaggtagggg

SEQ ID NO: 273195 - DNA, 25 bp, Mus musculus
ctgcagaaaatatggtggtcactga

SEQ ID NO: 273196 - DNA, 25 bp, Mus musculus
ctgcagaaaatcaaactgcagcttg

SEQ ID NO: 273197 - DNA, 25 bp, Mus musculus
ctgcagaaagaaaagcccttatgtt

SEQ ID NO: 273198 - DNA, 25 bp, Mus musculus
ctgcagaaagaggtacataatgctg

SEQ ID NO: 273199 - DNA, 25 bp, Mus musculus
ctgcagaaagaggtgaaaaaactgc

SEQ ID NO: 273200 - DNA, 25 bp, Mus musculus
ctgcagaaaggtcagacgggaacac

SEQ ID NO: 273201 - DNA, 25 bp, Mus musculus
ctgcagaacacaagggcaagatcat

SEQ ID NO: 273202 - DNA, 25 bp, Mus musculus
ctgcagaacacagcggagatccagc

SEQ ID NO: 273203 - DNA, 25 bp, Mus musculus
ctgcagaacacaggtgttgaatcat

SEQ ID NO: 273204 - DNA, 25 bp, Mus musculus
ctgcagaaccaggtggagaatctaa

SEQ ID NO: 273205 - DNA, 25 bp, Mus musculus
ctgcagaacctgaggcactgaaaga

SEQ ID NO: 273206 - DNA, 25 bp, Mus musculus
ctgcagaacggatcgagcgtttgga

SEQ ID NO: 273207 - DNA, 25 bp, Mus musculus
ctgcagaacttgcggtcttagagcc

SEQ ID NO: 273208 - DNA, 25 bp, Mus musculus
ctgcagaagccatggctcggatggc

SEQ ID NO: 273209 - DNA, 25 bp, Mus musculus
ctgcagaagctggaagatgaagaaa

SEQ ID NO: 273210 - DNA, 25 bp, Mus musculus
ctgcagaaggactggcccagcctga

SEQ ID NO: 273211 - DNA, 25 bp, Mus musculus
ctgcagaaggcccagctctgataag

SEQ ID NO: 273212 - DNA, 25 bp, Mus musculus
ctgcagaaggcccaggtcgtggact

SEQ ID NO: 273213 - DNA, 25 bp, Mus musculus
ctgcagaaggcccaggtggctttca

SEQ ID NO: 273214 - DNA, 25 bp, Mus musculus
ctgcagaatcggccagcgcccgagg

SEQ ID NO: 273215 - DNA, 25 bp, Mus musculus
ctgcagaatctggaggctggtgagg

SEQ ID NO: 273216 - DNA, 25 bp, Mus musculus
ctgcagaatgacagatttgaccagt

SEQ ID NO: 273217 - DNA, 25 bp, Mus musculus
ctgcagaatgcagcagtttgcaaag

SEQ ID NO: 273218 - DNA, 25 bp, Mus musculus
ctgcagaatgcaggtgtaatgtctt

SEQ ID NO: 273219 - DNA, 25 bp, Mus musculus
ctgcagaatgctggccttgcagatg

SEQ ID NO: 273220 - DNA, 25 bp, Mus musculus
ctgcagaatggtaatacacagctgg

SEQ ID NO: 273221 - DNA, 25 bp, Mus musculus
ctgcagaatgtttaccgagagaaag

SEQ ID NO: 273222 - DNA, 25 bp, Mus musculus
ctgcagacacagggctctgctctga

SEQ ID NO: 273223 - DNA, 25 bp, Mus musculus
ctgcagacagtcttcatcagctgcc

SEQ ID NO: 273224 - DNA, 25 bp, Mus musculus
ctgcagaccagaggctgcctggagc

SEQ ID NO: 273225 - DNA, 25 bp, Mus musculus
ctgcagaccccggaaagccagaacc

SEQ ID NO: 273226 - DNA, 25 bp, Mus musculus
ctgcagacctctgacaaggatgaga

SEQ ID NO: 273227 - DNA, 25 bp, Mus musculus
ctgcagacctctgagcgaacatccc

SEQ ID NO: 273228 - DNA, 25 bp, Mus musculus
ctgcagacctgccaggacgctgagc

SEQ ID NO: 273229 - DNA, 25 bp, Mus musculus
ctgcagacctgccaggtgtcaccat

SEQ ID NO: 273230 - DNA, 25 bp, Mus musculus
ctgcagactcggtcaccactcaaga

SEQ ID NO: 273231 - DNA, 25 bp, Mus musculus
ctgcagactctgatactaccacaag

SEQ ID NO: 273232 - DNA, 25 bp, Mus musculus
ctgcagactggtcttctcagtacag

SEQ ID NO: 273233 - DNA, 25 bp, Mus musculus
ctgcagagaaactcatcaagcaatc

SEQ ID NO: 273234 - DNA, 25 bp, Mus musculus
ctgcagagaaagaacatttcagaac

SEQ ID NO: 273235 - DNA, 25 bp, Mus musculus
ctgcagagaaagagggggcccgcct

SEQ ID NO: 273236 - DNA, 25 bp, Mus musculus
ctgcagagaaatgtgatttgttcat

SEQ ID NO: 273237 - DNA, 25 bp, Mus musculus
ctgcagagacaggagctgctgctgg

SEQ ID NO: 273238 - DNA, 25 bp, Mus musculus
ctgcagagacaggtactgagttcaa

SEQ ID NO: 273239 - DNA, 25 bp, Mus musculus
ctgcagagaccccgatcctcgtggg

SEQ ID NO: 273240 - DNA, 25 bp, Mus musculus
ctgcagagaccccggaccaatctcc

SEQ ID NO: 273241 - DNA, 25 bp, Mus musculus
ctgcagagaccccgggtccagcacc

SEQ ID NO: 273242 - DNA, 25 bp, Mus musculus
ctgcagagagatgactggtctggtt

SEQ ID NO: 273243 - DNA, 25 bp, Mus musculus
ctgcagagagatgagcatccagctc

SEQ ID NO: 273244 - DNA, 25 bp, Mus musculus
ctgcagagagctctggcgcaacagc

SEQ ID NO: 273245 - DNA, 25 bp, Mus musculus
ctgcagagaggaaaaccaaagaagt

SEQ ID NO: 273246 - DNA, 25 bp, Mus musculus
ctgcagagaggctggcctccacatt

SEQ ID NO: 273247 - DNA, 25 bp, Mus musculus
ctgcagagagtcaggaacgtggaag

SEQ ID NO: 273248 - DNA, 25 bp, Mus musculus
ctgcagagccacggtcaagatgctg

SEQ ID NO: 273249 - DNA, 25 bp, Mus musculus
ctgcagagccagagccagctgacct

SEQ ID NO: 273250 - DNA, 25 bp, Mus musculus
ctgcagagccagagtctgcagacaa

SEQ ID NO: 273251 - DNA, 25 bp, Mus musculus
ctgcagagccagtgagccctgccta

SEQ ID NO: 273252 - DNA, 25 bp, Mus musculus
ctgcagagcgggaggagactcggaa

SEQ ID NO: 273253 - DNA, 25 bp, Mus musculus
ctgcagagcttcgagcttccattaa

SEQ ID NO: 273254 - DNA, 25 bp, Mus musculus
ctgcagaggactgggccccacagga

SEQ ID NO: 273255 - DNA, 25 bp, Mus musculus
ctgcagaggactgtatgaacgaggc

SEQ ID NO: 273256 - DNA, 25 bp, Mus musculus
ctgcagaggagcctggccccttcat

SEQ ID NO: 273257 - DNA, 25 bp, Mus musculus
ctgcagaggaggagggtggacggac

SEQ ID NO: 273258 - DNA, 25 bp, Mus musculus
ctgcagaggaggtgttactagtaca

SEQ ID NO: 273259 - DNA, 25 bp, Mus musculus
ctgcagaggataagtactctcagaa

SEQ ID NO: 273260 - DNA, 25 bp, Mus musculus
ctgcagaggccagagctattaagaa

SEQ ID NO: 273261 - DNA, 25 bp, Mus musculus
ctgcagaggtccagacgtcgcctca

SEQ ID NO: 273262 - DNA, 25 bp, Mus musculus
ctgcagagtaatgctccaagtatgt

SEQ ID NO: 273263 - DNA, 25 bp, Mus musculus
ctgcagagtgaaatgacactgctgt

SEQ ID NO: 273264 - DNA, 25 bp, Mus musculus
ctgcagagtgagcaccaggttttgt

SEQ ID NO: 273265 - DNA, 25 bp, Mus musculus
ctgcagagtgagcagccccacagtg

SEQ ID NO: 273266 - DNA, 25 bp, Mus musculus
ctgcagagtgatgtcaagtacaaat

SEQ ID NO: 273267 - DNA, 25 bp, Mus musculus
ctgcagagtgcagtattgtggaatg

SEQ ID NO: 273268 - DNA, 25 bp, Mus musculus
ctgcagataagtgattgacatttcg

SEQ ID NO: 273269 - DNA, 25 bp, Mus musculus
ctgcagataagttactctcagctgg

SEQ ID NO: 273270 - DNA, 25 bp, Mus musculus
ctgcagatacaggatcacttctgta

SEQ ID NO: 273271 - DNA, 25 bp, Mus musculus
ctgcagatccgcccctccttctcct

SEQ ID NO: 273272 - DNA, 25 bp, Mus musculus
ctgcagatccggtcctctccgggct

SEQ ID NO: 273273 - DNA, 25 bp, Mus musculus
ctgcagatgacctcctcctggggag

SEQ ID NO: 273274 - DNA, 25 bp, Mus musculus
ctgcagatgcacagatttgacataa

SEQ ID NO: 273275 - DNA, 25 bp, Mus musculus
ctgcagatgcgggaggggaaaatgg

SEQ ID NO: 273276 - DNA, 25 bp, Mus musculus
ctgcagatggcaaagcaacagaaaa

SEQ ID NO: 273277 - DNA, 25 bp, Mus musculus
ctgcagatggcaaaggaagactccc

SEQ ID NO: 273278 - DNA, 25 bp, Mus musculus
ctgcagatggctaggagtaaaaatg

SEQ ID NO: 273279 - DNA, 25 bp, Mus musculus
ctgcagatggctagggaatgtggag

SEQ ID NO: 273280 - DNA, 25 bp, Mus musculus
ctgcagatgtccctgtccattgccc

SEQ ID NO: 273281 - DNA, 25 bp, Mus musculus
ctgcagatttgggacacagcaggcc

SEQ ID NO: 273282 - DNA, 25 bp, Mus musculus
ctgcagcaaagccaccatgccaatc

SEQ ID NO: 273283 - DNA, 25 bp, Mus musculus
ctgcagcaaaggccgatacaaagca

SEQ ID NO: 273284 - DNA, 25 bp, Mus musculus
ctgcagcaagagttccactgttgtg

SEQ ID NO: 273285 - DNA, 25 bp, Mus musculus
ctgcagcaagatcttggccaacttg

SEQ ID NO: 273286 - DNA, 25 bp, Mus musculus
ctgcagcaagcacatgcatcccctc

SEQ ID NO: 273287 - DNA, 25 bp, Mus musculus
ctgcagcaataccctgcagcaaggg

SEQ ID NO: 273288 - DNA, 25 bp, Mus musculus
ctgcagcacaggttctgattcggtt

SEQ ID NO: 273289 - DNA, 25 bp, Mus musculus
ctgcagcactgcaggagcctgtgac

SEQ ID NO: 273290 - DNA, 25 bp, Mus musculus
ctgcagcacttcagtgctgtcttcc

SEQ ID NO: 273291 - DNA, 25 bp, Mus musculus
ctgcagcagaaagatagaagctaga

SEQ ID NO: 273292 - DNA, 25 bp, Mus musculus
ctgcagcagaagattctctgtggca

SEQ ID NO: 273293 - DNA, 25 bp, Mus musculus
ctgcagcaggggccctccctgaccc

SEQ ID NO: 273294 - DNA, 25 bp, Mus musculus
ctgcagcatcacaggaggcacctca

SEQ ID NO: 273295 - DNA, 25 bp, Mus musculus
ctgcagcattcaggtcaaggaagct

SEQ ID NO: 273296 - DNA, 25 bp, Mus musculus
ctgcagccaaagggtggataccctg

SEQ ID NO: 273297 - DNA, 25 bp, Mus musculus
ctgcagccaacgggattggtcgcct

SEQ ID NO: 273298 - DNA, 25 bp, Mus musculus
ctgcagccacgatggacagtctgag

SEQ ID NO: 273299 - DNA, 25 bp, Mus musculus
ctgcagccagaagaatatccagtta

SEQ ID NO: 273300 - DNA, 25 bp, Mus musculus
ctgcagcccagaagggtgtgcagat

SEQ ID NO: 273301 - DNA, 25 bp, Mus musculus
ctgcagcccagggcgctgtgaggtt

SEQ ID NO: 273302 - DNA, 25 bp, Mus musculus
ctgcagccccagggcctgcttccga

SEQ ID NO: 273303 - DNA, 25 bp, Mus musculus
ctgcagcccctgtccaggtgattga

SEQ ID NO: 273304 - DNA, 25 bp, Mus musculus
ctgcagccgaggcagacgaggcata

SEQ ID NO: 273305 - DNA, 25 bp, Mus musculus
ctgcagccgagggaatgggcttgga

SEQ ID NO: 273306 - DNA, 25 bp, Mus musculus
ctgcagccgcccggccatctgcttc

SEQ ID NO: 273307 - DNA, 25 bp, Mus musculus
ctgcagccgcccgggacaggccatc

SEQ ID NO: 273308 - DNA, 25 bp, Mus musculus
ctgcagcctcagcaaagaagagtcg

SEQ ID NO: 273309 - DNA, 25 bp, Mus musculus
ctgcagcctcgggttcctccatctc

SEQ ID NO: 273310 - DNA, 25 bp, Mus musculus
ctgcagcctctgtccggatagcttc

SEQ ID NO: 273311 - DNA, 25 bp, Mus musculus
ctgcagcctgtggtatcctgtggct

SEQ ID NO: 273312 - DNA, 25 bp, Mus musculus
ctgcagcgagaggtggaggtagagg

SEQ ID NO: 273313 - DNA, 25 bp, Mus musculus
ctgcagcgagcctatagtttggcca

SEQ ID NO: 273314 - DNA, 25 bp, Mus musculus
ctgcagcgagctcgcgagtacaacg

SEQ ID NO: 273315 - DNA, 25 bp, Mus musculus
ctgcagcgagtgcccttcgcattgc

SEQ ID NO: 273316 - DNA, 25 bp, Mus musculus
ctgcagcgagtttggccaaggagca

SEQ ID NO: 273317 - DNA, 25 bp, Mus musculus
ctgcagcgctagatggaggtgaatt

SEQ ID NO: 273318 - DNA, 25 bp, Mus musculus
ctgcagcgctatgcttggcgcaaac

SEQ ID NO: 273319 - DNA, 25 bp, Mus musculus
ctgcagcgctatgtgatgtacaaag

SEQ ID NO: 273320 - DNA, 25 bp, Mus musculus
ctgcagcgctccggaccctggctgg

SEQ ID NO: 273321 - DNA, 25 bp, Mus musculus
ctgcagcggcatgaagatgagctaa

SEQ ID NO: 273322 - DNA, 25 bp, Mus musculus
ctgcagcggcatggtgatgaatctt

SEQ ID NO: 273323 - DNA, 25 bp, Mus musculus
ctgcagcggcttcctctggggggtc

SEQ ID NO: 273324 - DNA, 25 bp, Mus musculus
ctgcagcgggccagctacgaataca

SEQ ID NO: 273325 - DNA, 25 bp, Mus musculus
ctgcagcgggccaggaatgagatca

SEQ ID NO: 273326 - DNA, 25 bp, Mus musculus
ctgcagcgttcgaggagcgacacaa

SEQ ID NO: 273327 - DNA, 25 bp, Mus musculus
ctgcagcgttcgaggtcgtgagtca

SEQ ID NO: 273328 - DNA, 25 bp, Mus musculus
ctgcagctaacaggattggtatcat

SEQ ID NO: 273329 - DNA, 25 bp, Mus musculus
ctgcagctaaggcagaaaagatagc

SEQ ID NO: 273330 - DNA, 25 bp, Mus musculus
ctgcagctacaggagtcatggctgg

SEQ ID NO: 273331 - DNA, 25 bp, Mus musculus
ctgcagctccgagagcaggtctggg

SEQ ID NO: 273332 - DNA, 25 bp, Mus musculus
ctgcagctccgagaggtcctggccc

SEQ ID NO: 273333 - DNA, 25 bp, Mus musculus
ctgcagctctctcaggagttaaaaa

SEQ ID NO: 273334 - DNA, 25 bp, Mus musculus
ctgcagctcttagagattcccaccc

SEQ ID NO: 273335 - DNA, 25 bp, Mus musculus
ctgcagctgcacgggcaggtggtag

SEQ ID NO: 273336 - DNA, 25 bp, Mus musculus
ctgcagctgccatgactcagtcggc

SEQ ID NO: 273337 - DNA, 25 bp, Mus musculus
ctgcagctgccatgggaattcctca

SEQ ID NO: 273338 - DNA, 25 bp, Mus musculus
ctgcagctgcccaggccaagcaggg

SEQ ID NO: 273339 - DNA, 25 bp, Mus musculus
ctgcagctgctgaaggaagcaatgt

SEQ ID NO: 273340 - DNA, 25 bp, Mus musculus
ctgcagctggaggtgtggaacacca

SEQ ID NO: 273341 - DNA, 25 bp, Mus musculus
ctgcagctggccgagaaaaacgggt

SEQ ID NO: 273342 - DNA, 25 bp, Mus musculus
ctgcagctggccgaggaacacctgc

SEQ ID NO: 273343 - DNA, 25 bp, Mus musculus
ctgcagcttcaggatttctaccacg

SEQ ID NO: 273344 - DNA, 25 bp, Mus musculus
ctgcagcttcctgcctgttcacctc

SEQ ID NO: 273345 - DNA, 25 bp, Mus musculus
ctgcagcttcgagaagtacgatgaa

SEQ ID NO: 273346 - DNA, 25 bp, Mus musculus
ctgcagcttcgctcttgtggacaaa

SEQ ID NO: 273347 - DNA, 25 bp, Mus musculus
ctgcaggaaccaatgagacaccatg

SEQ ID NO: 273348 - DNA, 25 bp, Mus musculus
ctgcaggaaccaatggagccattcc

SEQ ID NO: 273349 - DNA, 25 bp, Mus musculus
ctgcaggaaccaggttggtctgggg

SEQ ID NO: 273350 - DNA, 25 bp, Mus musculus
ctgcaggaaccagttggaaggacct

SEQ ID NO: 273351 - DNA, 25 bp, Mus musculus
ctgcaggaagaaagtctgcaccaag

SEQ ID NO: 273352 - DNA, 25 bp, Mus musculus
ctgcaggaagcttgggatccgctgg

SEQ ID NO: 273353 - DNA, 25 bp, Mus musculus
ctgcaggaagggtccccctgtgggg

SEQ ID NO: 273354 - DNA, 25 bp, Mus musculus
ctgcaggaaggtgtggggcggagtc

SEQ ID NO: 273355 - DNA, 25 bp, Mus musculus
ctgcaggacaggaggattacaacca

SEQ ID NO: 273356 - DNA, 25 bp, Mus musculus
ctgcaggacaggtggcctctgatga

SEQ ID NO: 273357 - DNA, 25 bp, Mus musculus
ctgcaggacatgaagctacagtcgt

SEQ ID NO: 273358 - DNA, 25 bp, Mus musculus
ctgcaggaccaggtgtcatttggaa

SEQ ID NO: 273359 - DNA, 25 bp, Mus musculus
ctgcaggaccaggtgtctgatctgg

SEQ ID NO: 273360 - DNA, 25 bp, Mus musculus
ctgcaggactacatgctcacagtta

SEQ ID NO: 273361 - DNA, 25 bp, Mus musculus
ctgcaggagaaaagaataaatgaag

SEQ ID NO: 273362 - DNA, 25 bp, Mus musculus
ctgcaggagaagatcacaagaggga

SEQ ID NO: 273363 - DNA, 25 bp, Mus musculus
ctgcaggagaagatggtggatcgca

SEQ ID NO: 273364 - DNA, 25 bp, Mus musculus
ctgcaggagaaggaagaacaaaaaa

SEQ ID NO: 273365 - DNA, 25 bp, Mus musculus
ctgcaggagagcgcacacacgtaga

SEQ ID NO: 273366 - DNA, 25 bp, Mus musculus
ctgcaggagagctgggtcgcccaat

SEQ ID NO: 273367 - DNA, 25 bp, Mus musculus
ctgcaggagcagctgacaggtctga

SEQ ID NO: 273368 - DNA, 25 bp, Mus musculus
ctgcaggagcaggccaacgagggca

SEQ ID NO: 273369 - DNA, 25 bp, Mus musculus
ctgcaggagtcccagatccagtatg

SEQ ID NO: 273370 - DNA, 25 bp, Mus musculus
ctgcaggatataaagaaaccagacc

SEQ ID NO: 273371 - DNA, 25 bp, Mus musculus
ctgcaggatataaagaccgtgatga

SEQ ID NO: 273372 - DNA, 25 bp, Mus musculus
ctgcaggatgatgcgattcatgcta

SEQ ID NO: 273373 - DNA, 25 bp, Mus musculus
ctgcaggcagggaggtgtgagcatg

SEQ ID NO: 273374 - DNA, 25 bp, Mus musculus
ctgcaggcatccaagcatttgtggt

SEQ ID NO: 273375 - DNA, 25 bp, Mus musculus
ctgcaggcatccagggccttttgct

SEQ ID NO: 273376 - DNA, 25 bp, Mus musculus
ctgcaggcatgaggtgttctggctg

SEQ ID NO: 273377 - DNA, 25 bp, Mus musculus
ctgcaggcattgacccttcttggag

SEQ ID NO: 273378 - DNA, 25 bp, Mus musculus
ctgcaggcattgaccgctcatccta

SEQ ID NO: 273379 - DNA, 25 bp, Mus musculus
ctgcaggccgagatcaagatgctgt

SEQ ID NO: 273380 - DNA, 25 bp, Mus musculus
ctgcaggccgagcaggtccttgaag

SEQ ID NO: 273381 - DNA, 25 bp, Mus musculus
ctgcaggcctttgagttgtccaggg

SEQ ID NO: 273382 - DNA, 25 bp, Mus musculus
ctgcaggcctttgctggagcatgtt

SEQ ID NO: 273383 - DNA, 25 bp, Mus musculus
ctgcaggcctttgggaaggaatgtt

SEQ ID NO: 273384 - DNA, 25 bp, Mus musculus
ctgcaggcgcgaggttctgcagacc

SEQ ID NO: 273385 - DNA, 25 bp, Mus musculus
ctgcaggcggcccaagatgtccatc

SEQ ID NO: 273386 - DNA, 25 bp, Mus musculus
ctgcaggcggcttgaagatgagcag

SEQ ID NO: 273387 - DNA, 25 bp, Mus musculus
ctgcaggcgtgaggaaactgctgtc

SEQ ID NO: 273388 - DNA, 25 bp, Mus musculus
ctgcaggctacatggggttgacctg

SEQ ID NO: 273389 - DNA, 25 bp, Mus musculus
ctgcaggctcaagaaatagccagac

SEQ ID NO: 273390 - DNA, 25 bp, Mus musculus
ctgcaggctcagcaaatgacaagat

SEQ ID NO: 273391 - DNA, 25 bp, Mus musculus
ctgcagggatgaaggacacagggac

SEQ ID NO: 273392 - DNA, 25 bp, Mus musculus
ctgcagggatgaaggtctgtcagtt

SEQ ID NO: 273393 - DNA, 25 bp, Mus musculus
ctgcagggcaagatccggactcttc

SEQ ID NO: 273394 - DNA, 25 bp, Mus musculus
ctgcagggcacccgccaacatgagt

SEQ ID NO: 273395 - DNA, 25 bp, Mus musculus
ctgcagggcccaggaattgcattgg

SEQ ID NO: 273396 - DNA, 25 bp, Mus musculus
ctgcaggggaggacatagtcgacag

SEQ ID NO: 273397 - DNA, 25 bp, Mus musculus
ctgcaggggaggcaggtatggatgt

SEQ ID NO: 273398 - DNA, 25 bp, Mus musculus
ctgcaggggaggctttgctacagat

SEQ ID NO: 273399 - DNA, 25 bp, Mus musculus
ctgcaggtccattgggcatcatgaa

SEQ ID NO: 273400 - DNA, 25 bp, Mus musculus
ctgcaggtgagtacggctccacagc

SEQ ID NO: 273401 - DNA, 25 bp, Mus musculus
ctgcaggtgcttctggtaacccagg

SEQ ID NO: 273402 - DNA, 25 bp, Mus musculus
ctgcaggtggcagttttaggttctg

SEQ ID NO: 273403 - DNA, 25 bp, Mus musculus
ctgcaggtggtgagcgccgagcaga

SEQ ID NO: 273404 - DNA, 25 bp, Mus musculus
ctgcaggtgtgtatgctaatgggaa

SEQ ID NO: 273405 - DNA, 25 bp, Mus musculus
ctgcagtaattccgaaatcaacatg

SEQ ID NO: 273406 - DNA, 25 bp, Mus musculus
ctgcagtaattccgagtcctgaaga

SEQ ID NO: 273407 - DNA, 25 bp, Mus musculus
ctgcagtaggggctgctgaataatg

SEQ ID NO: 273408 - DNA, 25 bp, Mus musculus
ctgcagtatggaagttcccagaaat

SEQ ID NO: 273409 - DNA, 25 bp, Mus musculus
ctgcagtcaaaatcaagcactgcac

SEQ ID NO: 273410 - DNA, 25 bp, Mus musculus
ctgcagtcaaatggatctggcttct

SEQ ID NO: 273411 - DNA, 25 bp, Mus musculus
ctgcagtcaagaaagcctgtacccc

SEQ ID NO: 273412 - DNA, 25 bp, Mus musculus
ctgcagtcaagaaaggacatctgat

SEQ ID NO: 273413 - DNA, 25 bp, Mus musculus
ctgcagtcaagaaagtcatcagcag

SEQ ID NO: 273414 - DNA, 25 bp, Mus musculus
ctgcagtcagcaaaatatccagaga

SEQ ID NO: 273415 - DNA, 25 bp, Mus musculus
ctgcagtcaggcatcaaggagtcct

SEQ ID NO: 273416 - DNA, 25 bp, Mus musculus
ctgcagtccagagtggaccagattg

SEQ ID NO: 273417 - DNA, 25 bp, Mus musculus
ctgcagtccaggatagatatgattg

SEQ ID NO: 273418 - DNA, 25 bp, Mus musculus
ctgcagtccaggtcctgcgactgga

SEQ ID NO: 273419 - DNA, 25 bp, Mus musculus
ctgcagtcccacttgttcggccagt

SEQ ID NO: 273420 - DNA, 25 bp, Mus musculus
ctgcagtcccccctagccagcggaa

SEQ ID NO: 273421 - DNA, 25 bp, Mus musculus
ctgcagtcccccctcaggacattca

SEQ ID NO: 273422 - DNA, 25 bp, Mus musculus
ctgcagtcccccctgaatgggtccc

SEQ ID NO: 273423 - DNA, 25 bp, Mus musculus
ctgcagtcctcgaggagatcccagc

SEQ ID NO: 273424 - DNA, 25 bp, Mus musculus
ctgcagtcgtgaggtaccgaaagaa

SEQ ID NO: 273425 - DNA, 25 bp, Mus musculus
ctgcagtgaccaacattgatcgccc

SEQ ID NO: 273426 - DNA, 25 bp, Mus musculus
ctgcagtgaccaccattcctgcgcc

SEQ ID NO: 273427 - DNA, 25 bp, Mus musculus
ctgcagtgcggacctaaataacgag

SEQ ID NO: 273428 - DNA, 25 bp, Mus musculus
ctgcagtgcggaccttcactacttc

SEQ ID NO: 273429 - DNA, 25 bp, Mus musculus
ctgcagtggaaggcaaagagaaaca

SEQ ID NO: 273430 - DNA, 25 bp, Mus musculus
ctgcagtggagttgtttaagaatgt

SEQ ID NO: 273431 - DNA, 25 bp, Mus musculus
ctgcagtggatgagcaacatgttct

SEQ ID NO: 273432 - DNA, 25 bp, Mus musculus
ctgcagtggatgatgagtctgacta

SEQ ID NO: 273433 - DNA, 25 bp, Mus musculus
ctgcagtgtaaacaattagatttag

SEQ ID NO: 273434 - DNA, 25 bp, Mus musculus
ctgcagtgtagggtaaacacaagac

SEQ ID NO: 273435 - DNA, 25 bp, Mus musculus
ctgcagtgtcagtgctgccctagga

SEQ ID NO: 273436 - DNA, 25 bp, Mus musculus
ctgcagtgtcagttcctttctagat

SEQ ID NO: 273437 - DNA, 25 bp, Mus musculus
ctgcagtgtgattgggagaaaccac

SEQ ID NO: 273438 - DNA, 25 bp, Mus musculus
ctgcagtgtggggaaatcccacctg

SEQ ID NO: 273439 - DNA, 25 bp, Mus musculus
ctgcagtgtggtggcacaagacttg

SEQ ID NO: 273440 - DNA, 25 bp, Mus musculus
ctgcagttccacaggctcagggaag

SEQ ID NO: 273441 - DNA, 25 bp, Mus musculus
ctgcagttccaggaggaggacttca

SEQ ID NO: 273442 - DNA, 25 bp, Mus musculus
ctgcagttccaggtccctgagggtc

SEQ ID NO: 273443 - DNA, 25 bp, Mus musculus
ctgcagttctatatgctgtctccta

SEQ ID NO: 273444 - DNA, 25 bp, Mus musculus
ctgcagttctatatgttcgcatgga

SEQ ID NO: 273445 - DNA, 25 bp, Mus musculus
ctgcagttctgtttctctctgtagc

SEQ ID NO: 273446 - DNA, 25 bp, Mus musculus
ctgcagttcttccacttgatcccag

SEQ ID NO: 273447 - DNA, 25 bp, Mus musculus
ctgcagttgcagctctaagaacagg

SEQ ID NO: 273448 - DNA, 25 bp, Mus musculus
ctgcagttgcaggtttcttcgggta

SEQ ID NO: 273449 - DNA, 25 bp, Mus musculus
ctgcagtttaaaaacggcgtggagc

SEQ ID NO: 273450 - DNA, 25 bp, Mus musculus
ctgcagtttgccatgaagcggctgc

SEQ ID NO: 273451 - DNA, 25 bp, Mus musculus
ctgcagttttgaggcaagaaatctc

SEQ ID NO: 273452 - DNA, 25 bp, Mus musculus
ctgcataaggccacatgttttatgg

SEQ ID NO: 273453 - DNA, 25 bp, Mus musculus
ctgcatacacaggaaagggctgtga

SEQ ID NO: 273454 - DNA, 25 bp, Mus musculus
ctgcatacccctgcccagatcaagg

SEQ ID NO: 273455 - DNA, 25 bp, Mus musculus
ctgcataccgacaacatctggggaa

SEQ ID NO: 273456 - DNA, 25 bp, Mus musculus
ctgcatacggtagtcttttacagaa

SEQ ID NO: 273457 - DNA, 25 bp, Mus musculus
ctgcatactcacgtgaatgatggca

SEQ ID NO: 273458 - DNA, 25 bp, Mus musculus
ctgcatagaccaggtgagacggaag

SEQ ID NO: 273459 - DNA, 25 bp, Mus musculus
ctgcatagaggtagttcctaatatt

SEQ ID NO: 273460 - DNA, 25 bp, Mus musculus
ctgcatagaggtgtgaaattgaaac

SEQ ID NO: 273461 - DNA, 25 bp, Mus musculus
ctgcatagatgacgccacacgcggg

SEQ ID NO: 273462 - DNA, 25 bp, Mus musculus
ctgcatagcagagctacccagctgg

SEQ ID NO: 273463 - DNA, 25 bp, Mus musculus
ctgcatagctctgtggagcgaccct

SEQ ID NO: 273464 - DNA, 25 bp, Mus musculus
ctgcatataaactggcgagatgtcc

SEQ ID NO: 273465 - DNA, 25 bp, Mus musculus
ctgcatatctaggggagtatgtgct

SEQ ID NO: 273466 - DNA, 25 bp, Mus musculus
ctgcatcaaggagcttgtgtcagat

SEQ ID NO: 273467 - DNA, 25 bp, Mus musculus
ctgcatcaaggtacttgtgtcagat

SEQ ID NO: 273468 - DNA, 25 bp, Mus musculus
ctgcatcaccctgacaaaggagaca

SEQ ID NO: 273469 - DNA, 25 bp, Mus musculus
ctgcatcagcagtgatgatcttttc

SEQ ID NO: 273470 - DNA, 25 bp, Mus musculus
ctgcatcatggtatttgatgtccag

SEQ ID NO: 273471 - DNA, 25 bp, Mus musculus
ctgcatccagaacaatggagacacc

SEQ ID NO: 273472 - DNA, 25 bp, Mus musculus
ctgcatccagaggtctggtagcagc

SEQ ID NO: 273473 - DNA, 25 bp, Mus musculus
ctgcatcccagctggaagcaggaga

SEQ ID NO: 273474 - DNA, 25 bp, Mus musculus
ctgcatcccagctgtcgctgactcc

SEQ ID NO: 273475 - DNA, 25 bp, Mus musculus
ctgcatcccttgaggagttaccaaa

SEQ ID NO: 273476 - DNA, 25 bp, Mus musculus
ctgcatccgaccagacagatggata

SEQ ID NO: 273477 - DNA, 25 bp, Mus musculus
ctgcatccgaccagcttttttaaac

SEQ ID NO: 273478 - DNA, 25 bp, Mus musculus
ctgcatccgaccaggatggcttccc

SEQ ID NO: 273479 - DNA, 25 bp, Mus musculus
ctgcatccggggacagagtccttgg

SEQ ID NO: 273480 - DNA, 25 bp, Mus musculus
ctgcatcctcaagaggaagcccgtg

SEQ ID NO: 273481 - DNA, 25 bp, Mus musculus
ctgcatccttcaggtctccagatga

SEQ ID NO: 273482 - DNA, 25 bp, Mus musculus
ctgcatccttcgaatgctgactccc

SEQ ID NO: 273483 - DNA, 25 bp, Mus musculus
ctgcatcgaggtggacaacatcagt

SEQ ID NO: 273484 - DNA, 25 bp, Mus musculus
ctgcatcgcccttgactacaagtcc

SEQ ID NO: 273485 - DNA, 25 bp, Mus musculus
ctgcatcgcctgcagggcatggaac

SEQ ID NO: 273486 - DNA, 25 bp, Mus musculus
ctgcatcgcggggtggcgggacggg

SEQ ID NO: 273487 - DNA, 25 bp, Mus musculus
ctgcatctagtgcaggtgagtgcag

SEQ ID NO: 273488 - DNA, 25 bp, Mus musculus
ctgcatctatacaggtgacctcttg

SEQ ID NO: 273489 - DNA, 25 bp, Mus musculus
ctgcatctatgaggagaaccatggc

SEQ ID NO: 273490 - DNA, 25 bp, Mus musculus
ctgcatctgaagaggtggccatggc

SEQ ID NO: 273491 - DNA, 25 bp, Mus musculus
ctgcatctgagtgccgtactgttcg

SEQ ID NO: 273492 - DNA, 25 bp, Mus musculus
ctgcatctgcctcattgtacaagtc

SEQ ID NO: 273493 - DNA, 25 bp, Mus musculus
ctgcatctgcctgcaccgtactagc

SEQ ID NO: 273494 - DNA, 25 bp, Mus musculus
ctgcatctgcctgctgggctcagtg

SEQ ID NO: 273495 - DNA, 25 bp, Mus musculus
ctgcatcttccttcctaggcatcgt

SEQ ID NO: 273496 - DNA, 25 bp, Mus musculus
ctgcatctttggaatgcacaagccc

SEQ ID NO: 273497 - DNA, 25 bp, Mus musculus
ctgcatgaagcggtgttcgaggaat

SEQ ID NO: 273498 - DNA, 25 bp, Mus musculus
ctgcatgacactaaacatggagtgg

SEQ ID NO: 273499 - DNA, 25 bp, Mus musculus
ctgcatgaccagtgtagtccatgga

SEQ ID NO: 273500 - DNA, 25 bp, Mus musculus
ctgcatgacgtgttcgagaaccgtt

SEQ ID NO: 273501 - DNA, 25 bp, Mus musculus
ctgcatgagcagtaccccctggcct

SEQ ID NO: 273502 - DNA, 25 bp, Mus musculus
ctgcatgagcagtcgatggctgtgt

SEQ ID NO: 273503 - DNA, 25 bp, Mus musculus
ctgcatgaggcttggatctagcaat

SEQ ID NO: 273504 - DNA, 25 bp, Mus musculus
ctgcatgatatagataccaagtggt

SEQ ID NO: 273505 - DNA, 25 bp, Mus musculus
ctgcatgatataggacagaaattgg

SEQ ID NO: 273506 - DNA, 25 bp, Mus musculus
ctgcatgatgcggagaatataggca

SEQ ID NO: 273507 - DNA, 25 bp, Mus musculus
ctgcatgcagaacccttaccagttt

SEQ ID NO: 273508 - DNA, 25 bp, Mus musculus
ctgcatgcagatggagatgcagcct

SEQ ID NO: 273509 - DNA, 25 bp, Mus musculus
ctgcatgcagatgggggcagagatg

SEQ ID NO: 273510 - DNA, 25 bp, Mus musculus
ctgcatgcagctggtgcagaaccct

SEQ ID NO: 273511 - DNA, 25 bp, Mus musculus
ctgcatgcagtcagacttctccaag

SEQ ID NO: 273512 - DNA, 25 bp, Mus musculus
ctgcatgcagtcagtgcagcccttc

SEQ ID NO: 273513 - DNA, 25 bp, Mus musculus
ctgcatgcatgcatgtggtcaacct

SEQ ID NO: 273514 - DNA, 25 bp, Mus musculus
ctgcatgccgcagagtggccatgtt

SEQ ID NO: 273515 - DNA, 25 bp, Mus musculus
ctgcatgccggagagtggccatgtt

SEQ ID NO: 273516 - DNA, 25 bp, Mus musculus
ctgcatgcggacaggcctgagtact

SEQ ID NO: 273517 - DNA, 25 bp, Mus musculus
ctgcatgcggacaggccttgttttc

SEQ ID NO: 273518 - DNA, 25 bp, Mus musculus
ctgcatgcggaccaggccttgtttt

SEQ ID NO: 273519 - DNA, 25 bp, Mus musculus
ctgcatgctcatggtgggcagcaat

SEQ ID NO: 273520 - DNA, 25 bp, Mus musculus
ctgcatgctgaccctgttggccttc

SEQ ID NO: 273521 - DNA, 25 bp, Mus musculus
ctgcatgctgatgccttagacttgc

SEQ ID NO: 273522 - DNA, 25 bp, Mus musculus
ctgcatgctggaggtacgctggatc

SEQ ID NO: 273523 - DNA, 25 bp, Mus musculus
ctgcatgctggctcttcatagcctg

SEQ ID NO: 273524 - DNA, 25 bp, Mus musculus
ctgcatgctgggtccttcaggaccc

SEQ ID NO: 273525 - DNA, 25 bp, Mus musculus
ctgcatggatggagtgacggatgac

SEQ ID NO: 273526 - DNA, 25 bp, Mus musculus
ctgcatggctgatccttccttgttg

SEQ ID NO: 273527 - DNA, 25 bp, Mus musculus
ctgcatgggcacagtgaccccagtt

SEQ ID NO: 273528 - DNA, 25 bp, Mus musculus
ctgcatgtcaccctgatggtgcccc

SEQ ID NO: 273529 - DNA, 25 bp, Mus musculus
ctgcatgtcaccctgccgtggatgc

SEQ ID NO: 273530 - DNA, 25 bp, Mus musculus
ctgcatgtcaccctggactggtggc

SEQ ID NO: 273531 - DNA, 25 bp, Mus musculus
ctgcatgtcaccctgtgctgaaggc

SEQ ID NO: 273532 - DNA, 25 bp, Mus musculus
ctgcatgtctacaagcatttgtcaa

SEQ ID NO: 273533 - DNA, 25 bp, Mus musculus
ctgcatgtgacctctctatcacgga

SEQ ID NO: 273534 - DNA, 25 bp, Mus musculus
ctgcatgtgctccctctctatagcc

SEQ ID NO: 273535 - DNA, 25 bp, Mus musculus
ctgcatgtggagaagtctggtgcct

SEQ ID NO: 273536 - DNA, 25 bp, Mus musculus
ctgcatgttgagacacaaagatcga

SEQ ID NO: 273537 - DNA, 25 bp, Mus musculus
ctgcattacaagcccacagagcagt

SEQ ID NO: 273538 - DNA, 25 bp, Mus musculus
ctgcattacaagccttcccgctcca

SEQ ID NO: 273539 - DNA, 25 bp, Mus musculus
ctgcattatctggtgaccatctcgg

SEQ ID NO: 273540 - DNA, 25 bp, Mus musculus
ctgcattcacacaaatagcatgtgt

SEQ ID NO: 273541 - DNA, 25 bp, Mus musculus
ctgcattcacacaattaccagaact

SEQ ID NO: 273542 - DNA, 25 bp, Mus musculus
ctgcattcaggacaggggtccgaat

SEQ ID NO: 273543 - DNA, 25 bp, Mus musculus
ctgcattcgtgccgaggagttgtct

SEQ ID NO: 273544 - DNA, 25 bp, Mus musculus
ctgcattcgtggtgtttgtctttgg

SEQ ID NO: 273545 - DNA, 25 bp, Mus musculus
ctgcattctggcgcctagtgagaag

SEQ ID NO: 273546 - DNA, 25 bp, Mus musculus
ctgcattctgggagcctagggcttc

SEQ ID NO: 273547 - DNA, 25 bp, Mus musculus
ctgcattgcatgcagcgtgcagggt

SEQ ID NO: 273548 - DNA, 25 bp, Mus musculus
ctgcattggaccagttttcagagct

SEQ ID NO: 273549 - DNA, 25 bp, Mus musculus
ctgcattggaggttaaaattataca

SEQ ID NO: 273550 - DNA, 25 bp, Mus musculus
ctgcattggcggaggtgtggacctc

SEQ ID NO: 273551 - DNA, 25 bp, Mus musculus
ctgcatttactgagaaacatggtga

SEQ ID NO: 273552 - DNA, 25 bp, Mus musculus
ctgcatttggcataattccaagaaa

SEQ ID NO: 273553 - DNA, 25 bp, Mus musculus
ctgcatttggggttcctgctggact

SEQ ID NO: 273554 - DNA, 25 bp, Mus musculus
ctgcatttggtggagtgtgacaata

SEQ ID NO: 273555 - DNA, 25 bp, Mus musculus
ctgcattttaaggaagatccttgga

SEQ ID NO: 273556 - DNA, 25 bp, Mus musculus
ctgcattttaaggagcataaacatc

SEQ ID NO: 273557 - DNA, 25 bp, Mus musculus
ctgcattttaaggagtgcatgcggg

SEQ ID NO: 273558 - DNA, 25 bp, Mus musculus
ctgccaaaacagatgaagaaccacc

SEQ ID NO: 273559 - DNA, 25 bp, Mus musculus
ctgccaaaacgaaaacagatacaaa

SEQ ID NO: 273560 - DNA, 25 bp, Mus musculus
ctgccaaaagttgtggagctcctgg

SEQ ID NO: 273561 - DNA, 25 bp, Mus musculus
ctgccaaagtgaagccgaagaagct

SEQ ID NO: 273562 - DNA, 25 bp, Mus musculus
ctgccaaatcaacatcaacgattgc

SEQ ID NO: 273563 - DNA, 25 bp, Mus musculus
ctgccaacagacccagtgttgagta

SEQ ID NO: 273564 - DNA, 25 bp, Mus musculus
ctgccaacagatctacacacaatga

SEQ ID NO: 273565 - DNA, 25 bp, Mus musculus
ctgccaacagcctatcttcttcctc

SEQ ID NO: 273566 - DNA, 25 bp, Mus musculus
ctgccaacaggaatgggtaggagaa

SEQ ID NO: 273567 - DNA, 25 bp, Mus musculus
ctgccaacaggaggttctgcagtca

SEQ ID NO: 273568 - DNA, 25 bp, Mus musculus
ctgccaacagggtgcatcgctttcc

SEQ ID NO: 273569 - DNA, 25 bp, Mus musculus
ctgccaaccaggactgggcaaagcc

SEQ ID NO: 273570 - DNA, 25 bp, Mus musculus
ctgccaaccagttgtctaatgggtt

SEQ ID NO: 273571 - DNA, 25 bp, Mus musculus
ctgccaaccccataggaggccgcta

SEQ ID NO: 273572 - DNA, 25 bp, Mus musculus
ctgccaactctgaaaagaagaaaaa

SEQ ID NO: 273573 - DNA, 25 bp, Mus musculus
ctgccaactgagaggactggctgcc

SEQ ID NO: 273574 - DNA, 25 bp, Mus musculus
ctgccaactggcaggggacatgaag

SEQ ID NO: 273575 - DNA, 25 bp, Mus musculus
ctgccaactggcaggtatttgacat

SEQ ID NO: 273576 - DNA, 25 bp, Mus musculus
ctgccaagaccaggaacagcctcat

SEQ ID NO: 273577 - DNA, 25 bp, Mus musculus
ctgccaagaccagtgaggtctggta

SEQ ID NO: 273578 - DNA, 25 bp, Mus musculus
ctgccaagatcatgggtgtggctgg

SEQ ID NO: 273579 - DNA, 25 bp, Mus musculus
ctgccaagatggctccagctccagc

SEQ ID NO: 273580 - DNA, 25 bp, Mus musculus
ctgccaagatgggtgctcacagtac

SEQ ID NO: 273581 - DNA, 25 bp, Mus musculus
ctgccaagcaataaaattcatataa

SEQ ID NO: 273582 - DNA, 25 bp, Mus musculus
ctgccaagcatgatgtcaaagtctt

SEQ ID NO: 273583 - DNA, 25 bp, Mus musculus
ctgccaagcattgtggcagatgtga

SEQ ID NO: 273584 - DNA, 25 bp, Mus musculus
ctgccaagcatttccctccaggctt

SEQ ID NO: 273585 - DNA, 25 bp, Mus musculus
ctgccaaggaggagaagtataaaga

SEQ ID NO: 273586 - DNA, 25 bp, Mus musculus
ctgccaaggcaacggccacgtaccc

SEQ ID NO: 273587 - DNA, 25 bp, Mus musculus
ctgccaaggcctgtggcatcctgcc

SEQ ID NO: 273588 - DNA, 25 bp, Mus musculus
ctgccaagtttgatgaagcggagca

SEQ ID NO: 273589 - DNA, 25 bp, Mus musculus
ctgccaatcaacaatgtgcccagat

SEQ ID NO: 273590 - DNA, 25 bp, Mus musculus
ctgccaatgggattggtcgcctggt

SEQ ID NO: 273591 - DNA, 25 bp, Mus musculus
ctgccaattatacaactgctgacaa

SEQ ID NO: 273592 - DNA, 25 bp, Mus musculus
ctgccaattttgagcagttcctcca

SEQ ID NO: 273593 - DNA, 25 bp, Mus musculus
ctgccaatttttgacaacagaacaa

SEQ ID NO: 273594 - DNA, 25 bp, Mus musculus
ctgccacacaatcaggacttcccag

SEQ ID NO: 273595 - DNA, 25 bp, Mus musculus
ctgccacactggggtagcctttgtg

SEQ ID NO: 273596 - DNA, 25 bp, Mus musculus
ctgccacacttaggcatcctacatc

SEQ ID NO: 273597 - DNA, 25 bp, Mus musculus
ctgccacagacagggccactgccgg

SEQ ID NO: 273598 - DNA, 25 bp, Mus musculus
ctgccacagccccggccaccctcct

SEQ ID NO: 273599 - DNA, 25 bp, Mus musculus
ctgccacatagaaggctctcagcac

SEQ ID NO: 273600 - DNA, 25 bp, Mus musculus
ctgccacatcatgacaagaaaaaga

SEQ ID NO: 273601 - DNA, 25 bp, Mus musculus
ctgccacatcattcaaatattggag

SEQ ID NO: 273602 - DNA, 25 bp, Mus musculus
ctgccaccaaaggtcgggtcattcc

SEQ ID NO: 273603 - DNA, 25 bp, Mus musculus
ctgccaccaagcagaaacagcacct

SEQ ID NO: 273604 - DNA, 25 bp, Mus musculus
ctgccaccaagcaggagattacctg

SEQ ID NO: 273605 - DNA, 25 bp, Mus musculus
ctgccaccaccaggaacttcctgta

SEQ ID NO: 273606 - DNA, 25 bp, Mus musculus
ctgccaccactcaggagcccttgcc

SEQ ID NO: 273607 - DNA, 25 bp, Mus musculus
ctgccaccagcagccaggccaaaaa

SEQ ID NO: 273608 - DNA, 25 bp, Mus musculus
ctgccaccatatcagccattgaagc

SEQ ID NO: 273609 - DNA, 25 bp, Mus musculus
ctgccaccatgaaaggagaagcgga

SEQ ID NO: 273610 - DNA, 25 bp, Mus musculus
ctgccaccatttggcttcattaaaa

SEQ ID NO: 273611 - DNA, 25 bp, Mus musculus
ctgccacccaggttctgattggaac

SEQ ID NO: 273612 - DNA, 25 bp, Mus musculus
ctgccaccgcgttcacattctctaa

SEQ ID NO: 273613 - DNA, 25 bp, Mus musculus
ctgccaccgctcacgaagttgggag

SEQ ID NO: 273614 - DNA, 25 bp, Mus musculus
ctgccacctactggacccttttgtg

SEQ ID NO: 273615 - DNA, 25 bp, Mus musculus
ctgccacctccaagtcagcctccaa

SEQ ID NO: 273616 - DNA, 25 bp, Mus musculus
ctgccacctgccaagactgtggccg

SEQ ID NO: 273617 - DNA, 25 bp, Mus musculus
ctgccacctgcgagcccactcggct

SEQ ID NO: 273618 - DNA, 25 bp, Mus musculus
ctgccacctggagatggtgtttccc

SEQ ID NO: 273619 - DNA, 25 bp, Mus musculus
ctgccacgagagagctgcaagacct

SEQ ID NO: 273620 - DNA, 25 bp, Mus musculus
ctgccactcacgcgagttccagtgt

SEQ ID NO: 273621 - DNA, 25 bp, Mus musculus
ctgccactcagcttgatactcatgg

SEQ ID NO: 273622 - DNA, 25 bp, Mus musculus
ctgccactgcccacccccgcgatgg

SEQ ID NO: 273623 - DNA, 25 bp, Mus musculus
ctgccactgcgcgccggagcctggc

SEQ ID NO: 273624 - DNA, 25 bp, Mus musculus
ctgccactgcgcgcgcccggcatgc

SEQ ID NO: 273625 - DNA, 25 bp, Mus musculus
ctgccactgggacaggacctctgga

SEQ ID NO: 273626 - DNA, 25 bp, Mus musculus
ctgccactgggacagggatcataga

SEQ ID NO: 273627 - DNA, 25 bp, Mus musculus
ctgccactttcagacctagatactt

SEQ ID NO: 273628 - DNA, 25 bp, Mus musculus
ctgccactttccagccttccccgag

SEQ ID NO: 273629 - DNA, 25 bp, Mus musculus
ctgccactttccaggtgacatatca

SEQ ID NO: 273630 - DNA, 25 bp, Mus musculus
ctgccagaaacagcatgccagaatt

SEQ ID NO: 273631 - DNA, 25 bp, Mus musculus
ctgccagaaagtgacagcatcctct

SEQ ID NO: 273632 - DNA, 25 bp, Mus musculus
ctgccagaaccacctgtagctcttg

SEQ ID NO: 273633 - DNA, 25 bp, Mus musculus
ctgccagaagactagattgaggagg

SEQ ID NO: 273634 - DNA, 25 bp, Mus musculus
ctgccagaagactagccgccgtgcc

SEQ ID NO: 273635 - DNA, 25 bp, Mus musculus
ctgccagaggccctgcccgcctggt

SEQ ID NO: 273636 - DNA, 25 bp, Mus musculus
ctgccagagggtaacatctgccggc

SEQ ID NO: 273637 - DNA, 25 bp, Mus musculus
ctgccagagggttgcatctgatgcc

SEQ ID NO: 273638 - DNA, 25 bp, Mus musculus
ctgccagatacttcactcgctcgaa

SEQ ID NO: 273639 - DNA, 25 bp, Mus musculus
ctgccagatgaagatgactgtcaga

SEQ ID NO: 273640 - DNA, 25 bp, Mus musculus
ctgccagattgtggctctgaacttc

SEQ ID NO: 273641 - DNA, 25 bp, Mus musculus
ctgccagcaaggtgtagctacttca

SEQ ID NO: 273642 - DNA, 25 bp, Mus musculus
ctgccagcaatgaggtaccatggtt

SEQ ID NO: 273643 - DNA, 25 bp, Mus musculus
ctgccagcaatgaggtggctcacaa

SEQ ID NO: 273644 - DNA, 25 bp, Mus musculus
ctgccagcacaagaaccaggcagat

SEQ ID NO: 273645 - DNA, 25 bp, Mus musculus
ctgccagcaggtagatcatgatcca

SEQ ID NO: 273646 - DNA, 25 bp, Mus musculus
ctgccagcaggtctccccctcctct

SEQ ID NO: 273647 - DNA, 25 bp, Mus musculus
ctgccagcataagacagtgatgata

SEQ ID NO: 273648 - DNA, 25 bp, Mus musculus
ctgccagccaggcttcccggatttg

SEQ ID NO: 273649 - DNA, 25 bp, Mus musculus
ctgccagccagggactaggccctgg

SEQ ID NO: 273650 - DNA, 25 bp, Mus musculus
ctgccagccggaacagtgagcagaa

SEQ ID NO: 273651 - DNA, 25 bp, Mus musculus
ctgccagctgcaggtggtggctgag

SEQ ID NO: 273652 - DNA, 25 bp, Mus musculus
ctgccagctggagacctccacacag

SEQ ID NO: 273653 - DNA, 25 bp, Mus musculus
ctgccaggaatgtaataacatgctg

SEQ ID NO: 273654 - DNA, 25 bp, Mus musculus
ctgccaggagtgaagaccttgcact

SEQ ID NO: 273655 - DNA, 25 bp, Mus musculus
ctgccaggctctagttcattgaaag

SEQ ID NO: 273656 - DNA, 25 bp, Mus musculus
ctgccaggtgtggcgctaatgtgca

SEQ ID NO: 273657 - DNA, 25 bp, Mus musculus
ctgccagtagcaaggaggccaatgc

SEQ ID NO: 273658 - DNA, 25 bp, Mus musculus
ctgccagtagcaagttgcaggaggc

SEQ ID NO: 273659 - DNA, 25 bp, Mus musculus
ctgccagtagggggtacagtcctca

SEQ ID NO: 273660 - DNA, 25 bp, Mus musculus
ctgccagtctacaatcggtggagac

SEQ ID NO: 273661 - DNA, 25 bp, Mus musculus
ctgccagtgcaagaatggccatttg

SEQ ID NO: 273662 - DNA, 25 bp, Mus musculus
ctgccagtgcaagatgaagcactga

SEQ ID NO: 273663 - DNA, 25 bp, Mus musculus
ctgccagtgcccccaccggatgcag

SEQ ID NO: 273664 - DNA, 25 bp, Mus musculus
ctgccagtggaccctcatgacctac

SEQ ID NO: 273665 - DNA, 25 bp, Mus musculus
ctgccagtggacgactctcaggcac

SEQ ID NO: 273666 - DNA, 25 bp, Mus musculus
ctgccagtgggatcccactaaattt

SEQ ID NO: 273667 - DNA, 25 bp, Mus musculus
ctgccagtgggatcgctgttgtggc

SEQ ID NO: 273668 - DNA, 25 bp, Mus musculus
ctgccagtgtgattttgacattgct

SEQ ID NO: 273669 - DNA, 25 bp, Mus musculus
ctgccagttcttcagtgctgagcct

SEQ ID NO: 273670 - DNA, 25 bp, Mus musculus
ctgccagttgcctctcagtttcagc

SEQ ID NO: 273671 - DNA, 25 bp, Mus musculus
ctgccataatgacaagtaccaggtg

SEQ ID NO: 273672 - DNA, 25 bp, Mus musculus
ctgccatactgaagctgacattatc

SEQ ID NO: 273673 - DNA, 25 bp, Mus musculus
ctgccatatttagattataaaaaag

SEQ ID NO: 273674 - DNA, 25 bp, Mus musculus
ctgccatatttagcattcccgtcaa

SEQ ID NO: 273675 - DNA, 25 bp, Mus musculus
ctgccatcaaattatttttaatgaa

SEQ ID NO: 273676 - DNA, 25 bp, Mus musculus
ctgccatcaaggcccctaacagctc

SEQ ID NO: 273677 - DNA, 25 bp, Mus musculus
ctgccatcaccttggcatttagtaa

SEQ ID NO: 273678 - DNA, 25 bp, Mus musculus
ctgccatcagatacaagcggaaggg

SEQ ID NO: 273679 - DNA, 25 bp, Mus musculus
ctgccatccctggatgtcagtgctc

SEQ ID NO: 273680 - DNA, 25 bp, Mus musculus
ctgccatcctcaggttcaggcagct

SEQ ID NO: 273681 - DNA, 25 bp, Mus musculus
ctgccatccttgctcggcgtcctac

SEQ ID NO: 273682 - DNA, 25 bp, Mus musculus
ctgccatccttggtgaggctttccc

SEQ ID NO: 273683 - DNA, 25 bp, Mus musculus
ctgccatctacaggctgtttgatta

SEQ ID NO: 273684 - DNA, 25 bp, Mus musculus
ctgccatctacagtggctacagctt

SEQ ID NO: 273685 - DNA, 25 bp, Mus musculus
ctgccatctagcactaagagcggcg

SEQ ID NO: 273686 - DNA, 25 bp, Mus musculus
ctgccatctgtgcaggtcctacggc

SEQ ID NO: 273687 - DNA, 25 bp, Mus musculus
ctgccatgaaatggccctgcggatt

SEQ ID NO: 273688 - DNA, 25 bp, Mus musculus
ctgccatgagacgaaagtaggtggg

SEQ ID NO: 273689 - DNA, 25 bp, Mus musculus
ctgccatgagagctgtttgacaact

SEQ ID NO: 273690 - DNA, 25 bp, Mus musculus
ctgccatgaggaattcttctacttt

SEQ ID NO: 273691 - DNA, 25 bp, Mus musculus
ctgccatgcagtgagctgctggtga

SEQ ID NO: 273692 - DNA, 25 bp, Mus musculus
ctgccatgcgcagtacaacccggag

SEQ ID NO: 273693 - DNA, 25 bp, Mus musculus
ctgccatgcttcctctaacagcagc

SEQ ID NO: 273694 - DNA, 25 bp, Mus musculus
ctgccatggtagtgatggacagaat

SEQ ID NO: 273695 - DNA, 25 bp, Mus musculus
ctgccatgtacgagctggtggtgat

SEQ ID NO: 273696 - DNA, 25 bp, Mus musculus
ctgccatgtcagccagtataatgtt

SEQ ID NO: 273697 - DNA, 25 bp, Mus musculus
ctgccatgtccaagcggggtgccac

SEQ ID NO: 273698 - DNA, 25 bp, Mus musculus
ctgccatgtcccagtatgaggtttg

SEQ ID NO: 273699 - DNA, 25 bp, Mus musculus
ctgccatgttggatgccgccttgga

SEQ ID NO: 273700 - DNA, 25 bp, Mus musculus
ctgccattcaaacacacacaggaga

SEQ ID NO: 273701 - DNA, 25 bp, Mus musculus
ctgccattcaaattcatgagatatt

SEQ ID NO: 273702 - DNA, 25 bp, Mus musculus
ctgccattcaagaaggagaaaatat

SEQ ID NO: 273703 - DNA, 25 bp, Mus musculus
ctgccattcaagtggcagccacagc

SEQ ID NO: 273704 - DNA, 25 bp, Mus musculus
ctgccattctagatgtgaaggcacc

SEQ ID NO: 273705 - DNA, 25 bp, Mus musculus
ctgccattctcaggaaaactactca

SEQ ID NO: 273706 - DNA, 25 bp, Mus musculus
ctgccattctgatgaagttcctgat

SEQ ID NO: 273707 - DNA, 25 bp, Mus musculus
ctgccattcttattctgaggaagcc

SEQ ID NO: 273708 - DNA, 25 bp, Mus musculus
ctgccattgaagctgaagaagatgc

SEQ ID NO: 273709 - DNA, 25 bp, Mus musculus
ctgccattgagaaaatgaaacagct

SEQ ID NO: 273710 - DNA, 25 bp, Mus musculus
ctgccattgagacgtaccaccagac

SEQ ID NO: 273711 - DNA, 25 bp, Mus musculus
ctgccattgctgctgattactctgt

SEQ ID NO: 273712 - DNA, 25 bp, Mus musculus
ctgccattgtcgagggggtggcacc

SEQ ID NO: 273713 - DNA, 25 bp, Mus musculus
ctgccattgtcgaggtgtcaagctc

SEQ ID NO: 273714 - DNA, 25 bp, Mus musculus
ctgccattgttaagaccgagaattc

SEQ ID NO: 273715 - DNA, 25 bp, Mus musculus
ctgccattttctaggaaacctcgtg

SEQ ID NO: 273716 - DNA, 25 bp, Mus musculus
ctgcccaaacgtgtgcccaattacc

SEQ ID NO: 273717 - DNA, 25 bp, Mus musculus
ctgcccaaagagcatgccaccagcc

SEQ ID NO: 273718 - DNA, 25 bp, Mus musculus
ctgcccaaagagccccctcagagct

SEQ ID NO: 273719 - DNA, 25 bp, Mus musculus
ctgcccaaagcctgagacccacccc

SEQ ID NO: 273720 - DNA, 25 bp, Mus musculus
ctgcccaaaggacagaataatcctc

SEQ ID NO: 273721 - DNA, 25 bp, Mus musculus
ctgcccaaaggacagctggctgtat

SEQ ID NO: 273722 - DNA, 25 bp, Mus musculus
ctgcccaaagggacactacatgaag

SEQ ID NO: 273723 - DNA, 25 bp, Mus musculus
ctgcccaacaaggcacctcccacgt

SEQ ID NO: 273724 - DNA, 25 bp, Mus musculus
ctgcccaacaccagaactattgtcc

SEQ ID NO: 273725 - DNA, 25 bp, Mus musculus
ctgcccaacatcatgaaagccaaga

SEQ ID NO: 273726 - DNA, 25 bp, Mus musculus
ctgcccaagaagcgtgggaccttca

SEQ ID NO: 273727 - DNA, 25 bp, Mus musculus
ctgcccaagaccagctcacggatga

SEQ ID NO: 273728 - DNA, 25 bp, Mus musculus
ctgcccaagaggtcactgagcactg

SEQ ID NO: 273729 - DNA, 25 bp, Mus musculus
ctgcccaagataaggatggtagagg

SEQ ID NO: 273730 - DNA, 25 bp, Mus musculus
ctgcccaagataaggcactcctgca

SEQ ID NO: 273731 - DNA, 25 bp, Mus musculus
ctgcccaagctaaaggagctgaatc

SEQ ID NO: 273732 - DNA, 25 bp, Mus musculus
ctgcccaagctgcaccaggaggcgg

SEQ ID NO: 273733 - DNA, 25 bp, Mus musculus
ctgcccaataaggcacctcccacct

SEQ ID NO: 273734 - DNA, 25 bp, Mus musculus
ctgcccaattgttatggctttgagt

SEQ ID NO: 273735 - DNA, 25 bp, Mus musculus
ctgcccacacagggtgtgtccccag

SEQ ID NO: 273736 - DNA, 25 bp, Mus musculus
ctgcccacacaggttctgcagtaca

SEQ ID NO: 273737 - DNA, 25 bp, Mus musculus
ctgcccacacgctgattctctacct

SEQ ID NO: 273738 - DNA, 25 bp, Mus musculus
ctgcccacacgctgcaggtgctgtt

SEQ ID NO: 273739 - DNA, 25 bp, Mus musculus
ctgcccacagagagcccagacgctc

SEQ ID NO: 273740 - DNA, 25 bp, Mus musculus
ctgcccacagagaggtgacagaatc

SEQ ID NO: 273741 - DNA, 25 bp, Mus musculus
ctgcccacaggaaataacagtattc

SEQ ID NO: 273742 - DNA, 25 bp, Mus musculus
ctgcccaccaggattctcagtcctt

SEQ ID NO: 273743 - DNA, 25 bp, Mus musculus
ctgcccaccaggcttggaagggagg

SEQ ID NO: 273744 - DNA, 25 bp, Mus musculus
ctgcccacctacaggatgtcaatcg

SEQ ID NO: 273745 - DNA, 25 bp, Mus musculus
ctgcccacctggtacttcctgtggc

SEQ ID NO: 273746 - DNA, 25 bp, Mus musculus
ctgcccacctggttcccagagctag

SEQ ID NO: 273747 - DNA, 25 bp, Mus musculus
ctgcccactctacagcttggccagc

SEQ ID NO: 273748 - DNA, 25 bp, Mus musculus
ctgcccactctacaggttcacctgg

SEQ ID NO: 273749 - DNA, 25 bp, Mus musculus
ctgcccactgccggatcctaataac

SEQ ID NO: 273750 - DNA, 25 bp, Mus musculus
ctgcccacttgggaggcagaggcca

SEQ ID NO: 273751 - DNA, 25 bp, Mus musculus
ctgcccagaaagtgcttctctcctt

SEQ ID NO: 273752 - DNA, 25 bp, Mus musculus
ctgcccagaaagtggtcacgcccgg

SEQ ID NO: 273753 - DNA, 25 bp, Mus musculus
ctgcccagaaggagtcgaaagccaa

SEQ ID NO: 273754 - DNA, 25 bp, Mus musculus
ctgcccagagtgaacctgtgagaag

SEQ ID NO: 273755 - DNA, 25 bp, Mus musculus
ctgcccagcaaaaatcccaggatca

SEQ ID NO: 273756 - DNA, 25 bp, Mus musculus
ctgcccagcaaaaatgggggcagcc

SEQ ID NO: 273757 - DNA, 25 bp, Mus musculus
ctgcccagccaggagagaatctggg

SEQ ID NO: 273758 - DNA, 25 bp, Mus musculus
ctgcccagccaggagctatcctctg

SEQ ID NO: 273759 - DNA, 25 bp, Mus musculus
ctgcccagccggtaagaccagctgt

SEQ ID NO: 273760 - DNA, 25 bp, Mus musculus
ctgcccaggatgtggctggaccgct

SEQ ID NO: 273761 - DNA, 25 bp, Mus musculus
ctgcccaggctgaaggcatcccacg

SEQ ID NO: 273762 - DNA, 25 bp, Mus musculus
ctgcccagtttgccactgcgctgga

SEQ ID NO: 273763 - DNA, 25 bp, Mus musculus
ctgcccatatgcagaagttgctctg

SEQ ID NO: 273764 - DNA, 25 bp, Mus musculus
ctgcccatcatcagtttttccagag

SEQ ID NO: 273765 - DNA, 25 bp, Mus musculus
ctgcccatcgatcagatgttgcttt

SEQ ID NO: 273766 - DNA, 25 bp, Mus musculus
ctgcccatcgatcaggcccaatgat

SEQ ID NO: 273767 - DNA, 25 bp, Mus musculus
ctgcccatcgatcaggtcaactttg

SEQ ID NO: 273768 - DNA, 25 bp, Mus musculus
ctgcccatgtgatcatgattctgga

SEQ ID NO: 273769 - DNA, 25 bp, Mus musculus
ctgccccaaagacattctgcccaag

SEQ ID NO: 273770 - DNA, 25 bp, Mus musculus
ctgccccaaaggcattcgatgggtg

SEQ ID NO: 273771 - DNA, 25 bp, Mus musculus
ctgccccaaagttccccagctcggg

SEQ ID NO: 273772 - DNA, 25 bp, Mus musculus
ctgccccaaggctgacttccccacc

SEQ ID NO: 273773 - DNA, 25 bp, Mus musculus
ctgccccaaggtgaagaactgattg

SEQ ID NO: 273774 - DNA, 25 bp, Mus musculus
ctgccccacaccccgtgacccgcag

SEQ ID NO: 273775 - DNA, 25 bp, Mus musculus
ctgccccactaagattgaagattat

SEQ ID NO: 273776 - DNA, 25 bp, Mus musculus
ctgccccagccacagatgaacgaga

SEQ ID NO: 273777 - DNA, 25 bp, Mus musculus
ctgccccaggagacctaggcagact

SEQ ID NO: 273778 - DNA, 25 bp, Mus musculus
ctgccccaggagaggactcttcccc

SEQ ID NO: 273779 - DNA, 25 bp, Mus musculus
ctgccccaggagtttcctgaagtcg

SEQ ID NO: 273780 - DNA, 25 bp, Mus musculus
ctgccccaggccgtgaatgaccagt

SEQ ID NO: 273781 - DNA, 25 bp, Mus musculus
ctgccccaggccgtggactaaagac

SEQ ID NO: 273782 - DNA, 25 bp, Mus musculus
ctgccccaggcgggatccgggagac

SEQ ID NO: 273783 - DNA, 25 bp, Mus musculus
ctgccccatccagaggccatggacg

SEQ ID NO: 273784 - DNA, 25 bp, Mus musculus
ctgcccccaagaggacgagtcttgc

SEQ ID NO: 273785 - DNA, 25 bp, Mus musculus
ctgcccccaaggtggtgttcgtaga

SEQ ID NO: 273786 - DNA, 25 bp, Mus musculus
ctgcccccagaacctggaccctttc

SEQ ID NO: 273787 - DNA, 25 bp, Mus musculus
ctgcccccagaggctgaagatggaa

SEQ ID NO: 273788 - DNA, 25 bp, Mus musculus
ctgcccccagagggagaaggggagt

SEQ ID NO: 273789 - DNA, 25 bp, Mus musculus
ctgcccccagtgagcctccctctcc

SEQ ID NO: 273790 - DNA, 25 bp, Mus musculus
ctgccccccaattattaagaaattt

SEQ ID NO: 273791 - DNA, 25 bp, Mus musculus
ctgccccccagaatggtgggacgct

SEQ ID NO: 273792 - DNA, 25 bp, Mus musculus
ctgccccccaggtcaagtggctggg

SEQ ID NO: 273793 - DNA, 25 bp, Mus musculus
ctgccccccaggtcttgactcagga

SEQ ID NO: 273794 - DNA, 25 bp, Mus musculus
ctgccccctggcctgagaagcctgt

SEQ ID NO: 273795 - DNA, 25 bp, Mus musculus
ctgccccctggcctgattgcagccc

SEQ ID NO: 273796 - DNA, 25 bp, Mus musculus
ctgccccgaggcggttctcctgatt

SEQ ID NO: 273797 - DNA, 25 bp, Mus musculus
ctgccccgccggccaatgggcccag

SEQ ID NO: 273798 - DNA, 25 bp, Mus musculus
ctgccccgctatgagcttgaggagg

SEQ ID NO: 273799 - DNA, 25 bp, Mus musculus
ctgccccggccagctgactgctgtc

SEQ ID NO: 273800 - DNA, 25 bp, Mus musculus
ctgccccgggacgtggtcaacgtgg

SEQ ID NO: 273801 - DNA, 25 bp, Mus musculus
ctgccccgtgaactgtgacaaacgg

SEQ ID NO: 273802 - DNA, 25 bp, Mus musculus
ctgcccctcaccgaggaggagaatg

SEQ ID NO: 273803 - DNA, 25 bp, Mus musculus
ctgcccctcagcagcagcaacagca

SEQ ID NO: 273804 - DNA, 25 bp, Mus musculus
ctgcccctcgcgagagctggctcgg

SEQ ID NO: 273805 - DNA, 25 bp, Mus musculus
ctgcccctgccagggctgatggtga

SEQ ID NO: 273806 - DNA, 25 bp, Mus musculus
ctgcccctgcctaagcctgaaaatc

SEQ ID NO: 273807 - DNA, 25 bp, Mus musculus
ctgcccctgcctgagcaaggggacc

SEQ ID NO: 273808 - DNA, 25 bp, Mus musculus
ctgcccctggaggctgccacccgtc

SEQ ID NO: 273809 - DNA, 25 bp, Mus musculus
ctgcccgaaagagtctaaagcctga

SEQ ID NO: 273810 - DNA, 25 bp, Mus musculus
ctgcccgaaagagtctaaagcgcct

SEQ ID NO: 273811 - DNA, 25 bp, Mus musculus
ctgcccgaaaggctgagaccgctgc

SEQ ID NO: 273812 - DNA, 25 bp, Mus musculus
ctgcccgacttgggcaggtaaacca

SEQ ID NO: 273813 - DNA, 25 bp, Mus musculus
ctgcccgagcgtttctagagcatct

SEQ ID NO: 273814 - DNA, 25 bp, Mus musculus
ctgcccgcactggagcgtgctcttc

SEQ ID NO: 273815 - DNA, 25 bp, Mus musculus
ctgcccgcaggagcgcagcaatcta

SEQ ID NO: 273816 - DNA, 25 bp, Mus musculus
ctgcccgccgccaatatgcctgaag

SEQ ID NO: 273817 - DNA, 25 bp, Mus musculus
ctgcccgcctgtaagttccaggtgg

SEQ ID NO: 273818 - DNA, 25 bp, Mus musculus
ctgcccgcctgtcgccttgaagctg

SEQ ID NO: 273819 - DNA, 25 bp, Mus musculus
ctgcccgcggggactggtatccggt

SEQ ID NO: 273820 - DNA, 25 bp, Mus musculus
ctgcccggagccgcgactgatttcc

SEQ ID NO: 273821 - DNA, 25 bp, Mus musculus
ctgcccggagccgcgttggaggcct

SEQ ID NO: 273822 - DNA, 25 bp, Mus musculus
ctgcccggagcgagacactttcctg

SEQ ID NO: 273823 - DNA, 25 bp, Mus musculus
ctgcccggagcgaggtagcaaacaa

SEQ ID NO: 273824 - DNA, 25 bp, Mus musculus
ctgcccggctgcaggcgaatctggt

SEQ ID NO: 273825 - DNA, 25 bp, Mus musculus
ctgcccggtcttccgctgaagggga

SEQ ID NO: 273826 - DNA, 25 bp, Mus musculus
ctgcccggtgtgtgcgtgtgcaaga

SEQ ID NO: 273827 - DNA, 25 bp, Mus musculus
ctgcccgtcaaaagattccaagaaa

SEQ ID NO: 273828 - DNA, 25 bp, Mus musculus
ctgcccgtcgaaaagacaattggga

SEQ ID NO: 273829 - DNA, 25 bp, Mus musculus
ctgcccgtggaggaggtggacatct

SEQ ID NO: 273830 - DNA, 25 bp, Mus musculus
ctgcccgttttagcttggctgaaga

SEQ ID NO: 273831 - DNA, 25 bp, Mus musculus
ctgccctaagaggttatcaagaaat

SEQ ID NO: 273832 - DNA, 25 bp, Mus musculus
ctgccctagagatagtcaataacag

SEQ ID NO: 273833 - DNA, 25 bp, Mus musculus
ctgccctagagatcaagatattatc

SEQ ID NO: 273834 - DNA, 25 bp, Mus musculus
ctgccctagcttgggggctttcagg

SEQ ID NO: 273835 - DNA, 25 bp, Mus musculus
ctgccctattcctcagggtctctaa

SEQ ID NO: 273836 - DNA, 25 bp, Mus musculus
ctgccctcaagaaagaagctgtttg

SEQ ID NO: 273837 - DNA, 25 bp, Mus musculus
ctgccctcaagaaaggtgtggtgac

SEQ ID NO: 273838 - DNA, 25 bp, Mus musculus
ctgccctcaaggtaatggatgacta

SEQ ID NO: 273839 - DNA, 25 bp, Mus musculus
ctgccctcaaggtggtgaagaaagt

SEQ ID NO: 273840 - DNA, 25 bp, Mus musculus
ctgccctcacacagagaggtctgaa

SEQ ID NO: 273841 - DNA, 25 bp, Mus musculus
ctgccctcacacaggtttccctctg

SEQ ID NO: 273842 - DNA, 25 bp, Mus musculus
ctgccctcactcggccgccgcgtgt

SEQ ID NO: 273843 - DNA, 25 bp, Mus musculus
ctgccctccacagagttccccacac

SEQ ID NO: 273844 - DNA, 25 bp, Mus musculus
ctgccctccacagcccctacttcca

SEQ ID NO: 273845 - DNA, 25 bp, Mus musculus
ctgccctccacaggagcaggcgagc

SEQ ID NO: 273846 - DNA, 25 bp, Mus musculus
ctgccctccggccaggcgattaaat

SEQ ID NO: 273847 - DNA, 25 bp, Mus musculus
ctgccctccgttgaaagcaccatac

SEQ ID NO: 273848 - DNA, 25 bp, Mus musculus
ctgccctcgacttagaatattagaa

SEQ ID NO: 273849 - DNA, 25 bp, Mus musculus
ctgccctcgacttaggagcaggctg

SEQ ID NO: 273850 - DNA, 25 bp, Mus musculus
ctgccctctgtcactgtcacgttca

SEQ ID NO: 273851 - DNA, 25 bp, Mus musculus
ctgccctgaaagtcccgagtttatg

SEQ ID NO: 273852 - DNA, 25 bp, Mus musculus
ctgccctgaaggctggataatcagg

SEQ ID NO: 273853 - DNA, 25 bp, Mus musculus
ctgccctgaccccggtgtgtgatag

SEQ ID NO: 273854 - DNA, 25 bp, Mus musculus
ctgccctgagaaacctcgaccttga

SEQ ID NO: 273855 - DNA, 25 bp, Mus musculus
ctgccctgcagccagacagtgaccc

SEQ ID NO: 273856 - DNA, 25 bp, Mus musculus
ctgccctgcagtaccacatcaacaa

SEQ ID NO: 273857 - DNA, 25 bp, Mus musculus
ctgccctgcccattgtgtcctgggg

SEQ ID NO: 273858 - DNA, 25 bp, Mus musculus
ctgccctgcctgtgggaagtgcttt

SEQ ID NO: 273859 - DNA, 25 bp, Mus musculus
ctgccctgcctgtgggctcagtctc

SEQ ID NO: 273860 - DNA, 25 bp, Mus musculus
ctgccctgggagcctctgacctcca

SEQ ID NO: 273861 - DNA, 25 bp, Mus musculus
ctgccctgtccccagccccctcccc

SEQ ID NO: 273862 - DNA, 25 bp, Mus musculus
ctgccctgtgagtttcaggtgccat

SEQ ID NO: 273863 - DNA, 25 bp, Mus musculus
ctgccctgtgcaagtgccctctgtg

SEQ ID NO: 273864 - DNA, 25 bp, Mus musculus
ctgcccttaaacaggaaatctttga

SEQ ID NO: 273865 - DNA, 25 bp, Mus musculus
ctgcccttaaacagttgcaggaaat

SEQ ID NO: 273866 - DNA, 25 bp, Mus musculus
ctgcccttccgagctatccgggtga

SEQ ID NO: 273867 - DNA, 25 bp, Mus musculus
ctgcccttccgaggaagtctgccgg

SEQ ID NO: 273868 - DNA, 25 bp, Mus musculus
ctgcccttcttcgacatggctgggc

SEQ ID NO: 273869 - DNA, 25 bp, Mus musculus
ctgcccttcttcgtggatccaggtt

SEQ ID NO: 273870 - DNA, 25 bp, Mus musculus
ctgcccttgaagggtaagtggagaa

SEQ ID NO: 273871 - DNA, 25 bp, Mus musculus
ctgccctttctctggaacttcgagt

SEQ ID NO: 273872 - DNA, 25 bp, Mus musculus
ctgccctttctctgggagctgaaca

SEQ ID NO: 273873 - DNA, 25 bp, Mus musculus
ctgccctttttggctgcagagatac

SEQ ID NO: 273874 - DNA, 25 bp, Mus musculus
ctgccctttttgtgccgtggtgaga

SEQ ID NO: 273875 - DNA, 25 bp, Mus musculus
ctgccgaaacccagatgaggaataa

SEQ ID NO: 273876 - DNA, 25 bp, Mus musculus
ctgccgaagcaaggtgagatctcca

SEQ ID NO: 273877 - DNA, 25 bp, Mus musculus
ctgccgacacagccacagcatttca

SEQ ID NO: 273878 - DNA, 25 bp, Mus musculus
ctgccgagaaagaggcagagaaacc

SEQ ID NO: 273879 - DNA, 25 bp, Mus musculus
ctgccgagaggggtcccacagaggc

SEQ ID NO: 273880 - DNA, 25 bp, Mus musculus
ctgccgaggaggctagacaaatggc

SEQ ID NO: 273881 - DNA, 25 bp, Mus musculus
ctgccgataagtacgccctggagcg

SEQ ID NO: 273882 - DNA, 25 bp, Mus musculus
ctgccgatctcagtctctggtccca

SEQ ID NO: 273883 - DNA, 25 bp, Mus musculus
ctgccgcaacgatgggaagctcctg

SEQ ID NO: 273884 - DNA, 25 bp, Mus musculus
ctgccgcagacagagtgccctgggc

SEQ ID NO: 273885 - DNA, 25 bp, Mus musculus
ctgccgcaggacagcaccacgcccc

SEQ ID NO: 273886 - DNA, 25 bp, Mus musculus
ctgccgccacagcggccccgtgtct

SEQ ID NO: 273887 - DNA, 25 bp, Mus musculus
ctgccgccagcattgacctctttaa

SEQ ID NO: 273888 - DNA, 25 bp, Mus musculus
ctgccgcccagtgttcctttgaaga

SEQ ID NO: 273889 - DNA, 25 bp, Mus musculus
ctgccgcccagtgttgtcactggac

SEQ ID NO: 273890 - DNA, 25 bp, Mus musculus
ctgccgccccaacccgtgtcacaat

SEQ ID NO: 273891 - DNA, 25 bp, Mus musculus
ctgccgcccctgctattacaagcca

SEQ ID NO: 273892 - DNA, 25 bp, Mus musculus
ctgccgcccgagcagttgccccaga

SEQ ID NO: 273893 - DNA, 25 bp, Mus musculus
ctgccgccgtcatggccgactactg

SEQ ID NO: 273894 - DNA, 25 bp, Mus musculus
ctgccgccgtgcggggagcagcaat

SEQ ID NO: 273895 - DNA, 25 bp, Mus musculus
ctgccgccgtgcggggatagctgcc

SEQ ID NO: 273896 - DNA, 25 bp, Mus musculus
ctgccgcctcagaggtttaaacgca

SEQ ID NO: 273897 - DNA, 25 bp, Mus musculus
ctgccgcctccagtgccgggagccc

SEQ ID NO: 273898 - DNA, 25 bp, Mus musculus
ctgccgcctcctcagtatcaggcac

SEQ ID NO: 273899 - DNA, 25 bp, Mus musculus
ctgccgcgacctgaacacatgtcgg

SEQ ID NO: 273900 - DNA, 25 bp, Mus musculus
ctgccgcgacgagaaccccagacag

SEQ ID NO: 273901 - DNA, 25 bp, Mus musculus
ctgccgcgacgagccctgctggtgt

SEQ ID NO: 273902 - DNA, 25 bp, Mus musculus
ctgccgcgacgagctgaggagggca

SEQ ID NO: 273903 - DNA, 25 bp, Mus musculus
ctgccgcgagataaaatcaaagaca

SEQ ID NO: 273904 - DNA, 25 bp, Mus musculus
ctgccgcgcctggagagctccacgc

SEQ ID NO: 273905 - DNA, 25 bp, Mus musculus
ctgccgcgggcgcagataaagaagc

SEQ ID NO: 273906 - DNA, 25 bp, Mus musculus
ctgccgctccacagtggctccacgt

SEQ ID NO: 273907 - DNA, 25 bp, Mus musculus
ctgccgctccagaagctcgaagcgg

SEQ ID NO: 273908 - DNA, 25 bp, Mus musculus
ctgccgctccatcagggttccagtg

SEQ ID NO: 273909 - DNA, 25 bp, Mus musculus
ctgccgctccatcagtggctccacg

SEQ ID NO: 273910 - DNA, 25 bp, Mus musculus
ctgccgctgagtggatacattccac

SEQ ID NO: 273911 - DNA, 25 bp, Mus musculus
ctgccgctgctgggtggctgcgttg

SEQ ID NO: 273912 - DNA, 25 bp, Mus musculus
ctgccgctggccagtttcttcagcg

SEQ ID NO: 273913 - DNA, 25 bp, Mus musculus
ctgccgctgggcgtccgacctccca

SEQ ID NO: 273914 - DNA, 25 bp, Mus musculus
ctgccgctggtaagactttgaaccc

SEQ ID NO: 273915 - DNA, 25 bp, Mus musculus
ctgccggaggagaggtacagacatg

SEQ ID NO: 273916 - DNA, 25 bp, Mus musculus
ctgccggcctccaggtctgtgcact

SEQ ID NO: 273917 - DNA, 25 bp, Mus musculus
ctgccggcggggtctcctgtgagca

SEQ ID NO: 273918 - DNA, 25 bp, Mus musculus
ctgccggctcagagggaggaggaca

SEQ ID NO: 273919 - DNA, 25 bp, Mus musculus
ctgccggctgaggagaaacaacaaa

SEQ ID NO: 273920 - DNA, 25 bp, Mus musculus
ctgccggctgccgttccgagccctt

SEQ ID NO: 273921 - DNA, 25 bp, Mus musculus
ctgccggctgggctgctgattcacg

SEQ ID NO: 273922 - DNA, 25 bp, Mus musculus
ctgccgggcagccaggcaccaccta

SEQ ID NO: 273923 - DNA, 25 bp, Mus musculus
ctgccgggcagcgagtcatcctcca

SEQ ID NO: 273924 - DNA, 25 bp, Mus musculus
ctgccgggctgtgcctctcctttcc

SEQ ID NO: 273925 - DNA, 25 bp, Mus musculus
ctgccggtgcccccggccctcaagg

SEQ ID NO: 273926 - DNA, 25 bp, Mus musculus
ctgccgtaagaatttcatcctatct

SEQ ID NO: 273927 - DNA, 25 bp, Mus musculus
ctgccgtaccagagccattcatcag

SEQ ID NO: 273928 - DNA, 25 bp, Mus musculus
ctgccgtaccagggacattcttctc

SEQ ID NO: 273929 - DNA, 25 bp, Mus musculus
ctgccgtatcaacattgatgagtgc

SEQ ID NO: 273930 - DNA, 25 bp, Mus musculus
ctgccgtcaaagtcgtgaccccagg

SEQ ID NO: 273931 - DNA, 25 bp, Mus musculus
ctgccgtcgctagagttttcaggaa

SEQ ID NO: 273932 - DNA, 25 bp, Mus musculus
ctgccgtgacgcatgatctttcttc

SEQ ID NO: 273933 - DNA, 25 bp, Mus musculus
ctgccgtgacggttgcaggccgagt

SEQ ID NO: 273934 - DNA, 25 bp, Mus musculus
ctgccgtgcactgggttaaaaacga

SEQ ID NO: 273935 - DNA, 25 bp, Mus musculus
ctgccgtgtgagttctgtggggtgc

SEQ ID NO: 273936 - DNA, 25 bp, Mus musculus
ctgccgtgtgtctgcccatcgtgtc

SEQ ID NO: 273937 - DNA, 25 bp, Mus musculus
ctgccgtgttagatgagaaccacag

SEQ ID NO: 273938 - DNA, 25 bp, Mus musculus
ctgccgtgttagtccctataaccgg

SEQ ID NO: 273939 - DNA, 25 bp, Mus musculus
ctgccgttaggctactacatgggca

SEQ ID NO: 273940 - DNA, 25 bp, Mus musculus
ctgccgtttagctcgatgagagaaa

SEQ ID NO: 273941 - DNA, 25 bp, Mus musculus
ctgccgtttggtggtgaagcagtat

SEQ ID NO: 273942 - DNA, 25 bp, Mus musculus
ctgcctaacaagtggtggaccaagc

SEQ ID NO: 273943 - DNA, 25 bp, Mus musculus
ctgcctaacaggtcgctgttattcc

SEQ ID NO: 273944 - DNA, 25 bp, Mus musculus
ctgcctaagaatggctcttaccgcc

SEQ ID NO: 273945 - DNA, 25 bp, Mus musculus
ctgcctaagaatgggatgcctggaa

SEQ ID NO: 273946 - DNA, 25 bp, Mus musculus
ctgcctacactctagatggagtgga

SEQ ID NO: 273947 - DNA, 25 bp, Mus musculus
ctgcctacagataccatggcgttcc

SEQ ID NO: 273948 - DNA, 25 bp, Mus musculus
ctgcctacagctcagcagagaaaag

SEQ ID NO: 273949 - DNA, 25 bp, Mus musculus
ctgcctacaggaaaaaaaatccctg

SEQ ID NO: 273950 - DNA, 25 bp, Mus musculus
ctgcctacaggtgactggatggccg

SEQ ID NO: 273951 - DNA, 25 bp, Mus musculus
ctgcctacaggttaggccggggctt

SEQ ID NO: 273952 - DNA, 25 bp, Mus musculus
ctgcctacatctggtagtttacaag

SEQ ID NO: 273953 - DNA, 25 bp, Mus musculus
ctgcctaccagatatgaaagatcat

SEQ ID NO: 273954 - DNA, 25 bp, Mus musculus
ctgcctaccaggtgcagagcccctc

SEQ ID NO: 273955 - DNA, 25 bp, Mus musculus
ctgcctaccaggtggcaaaggaaac

SEQ ID NO: 273956 - DNA, 25 bp, Mus musculus
ctgcctaccctgaggaagctggaag

SEQ ID NO: 273957 - DNA, 25 bp, Mus musculus
ctgcctaccttcaaggcctgcacgc

SEQ ID NO: 273958 - DNA, 25 bp, Mus musculus
ctgcctacggacaggatcgagagct

SEQ ID NO: 273959 - DNA, 25 bp, Mus musculus
ctgcctactgggcaaggtggtttgg

SEQ ID NO: 273960 - DNA, 25 bp, Mus musculus
ctgcctactggggaaggagaagctg

SEQ ID NO: 273961 - DNA, 25 bp, Mus musculus
ctgcctagcgccgagagatagtgct

SEQ ID NO: 273962 - DNA, 25 bp, Mus musculus
ctgcctagcgccgagagattggaga

SEQ ID NO: 273963 - DNA, 25 bp, Mus musculus
ctgcctagctttgtatagtccagat

SEQ ID NO: 273964 - DNA, 25 bp, Mus musculus
ctgcctagtgagtttacaggctggt

SEQ ID NO: 273965 - DNA, 25 bp, Mus musculus
ctgcctatcctacagggaaatgcat

SEQ ID NO: 273966 - DNA, 25 bp, Mus musculus
ctgcctatgcaacccccagtcccca

SEQ ID NO: 273967 - DNA, 25 bp, Mus musculus
ctgcctatgcaagactcatttcacc

SEQ ID NO: 273968 - DNA, 25 bp, Mus musculus
ctgcctattcaagatctgcacgttt

SEQ ID NO: 273969 - DNA, 25 bp, Mus musculus
ctgcctcaaagctcattggctaagc

SEQ ID NO: 273970 - DNA, 25 bp, Mus musculus
ctgcctcaagaaatttgtcaagcct

SEQ ID NO: 273971 - DNA, 25 bp, Mus musculus
ctgcctcacaagggactcatgcagt

SEQ ID NO: 273972 - DNA, 25 bp, Mus musculus
ctgcctcacaggtggataccttggc

SEQ ID NO: 273973 - DNA, 25 bp, Mus musculus
ctgcctcagagaacatgagctgtgg

SEQ ID NO: 273974 - DNA, 25 bp, Mus musculus
ctgcctcagagcacctacgcttgga

SEQ ID NO: 273975 - DNA, 25 bp, Mus musculus
ctgcctcagaggtggaagaagagaa

SEQ ID NO: 273976 - DNA, 25 bp, Mus musculus
ctgcctcagcagccaatggaaacga

SEQ ID NO: 273977 - DNA, 25 bp, Mus musculus
ctgcctcagcagggctgccctttgg

SEQ ID NO: 273978 - DNA, 25 bp, Mus musculus
ctgcctcagcatccgcctgatctct

SEQ ID NO: 273979 - DNA, 25 bp, Mus musculus
ctgcctcagtgtcagggagtgttcc

SEQ ID NO: 273980 - DNA, 25 bp, Mus musculus
ctgcctcagtgtcagtgattcgggt

SEQ ID NO: 273981 - DNA, 25 bp, Mus musculus
ctgcctcatggcacaggagcttgaa

SEQ ID NO: 273982 - DNA, 25 bp, Mus musculus
ctgcctccactccagctggtggctg

SEQ ID NO: 273983 - DNA, 25 bp, Mus musculus
ctgcctccagcactgggaagcaaat

SEQ ID NO: 273984 - DNA, 25 bp, Mus musculus
ctgcctccaggagaaggtccttttc

SEQ ID NO: 273985 - DNA, 25 bp, Mus musculus
ctgcctccaggtctggagagctgtg

SEQ ID NO: 273986 - DNA, 25 bp, Mus musculus
ctgcctcccaaggttgttaaacatg

SEQ ID NO: 273987 - DNA, 25 bp, Mus musculus
ctgcctccccactaccctccaactc

SEQ ID NO: 273988 - DNA, 25 bp, Mus musculus
ctgcctccctccctggcagggggag

SEQ ID NO: 273989 - DNA, 25 bp, Mus musculus
ctgcctccctgagactctttgctga

SEQ ID NO: 273990 - DNA, 25 bp, Mus musculus
ctgcctccctgagcctccatgtact

SEQ ID NO: 273991 - DNA, 25 bp, Mus musculus
ctgcctccgcaaaaggttcgaacct

SEQ ID NO: 273992 - DNA, 25 bp, Mus musculus
ctgcctccgcaaaaggttggaagca

SEQ ID NO: 273993 - DNA, 25 bp, Mus musculus
ctgcctcctcaagagctttcatcat

SEQ ID NO: 273994 - DNA, 25 bp, Mus musculus
ctgcctcctcaaggttggctcaaaa

SEQ ID NO: 273995 - DNA, 25 bp, Mus musculus
ctgcctcctggcagcctggtgatcc

SEQ ID NO: 273996 - DNA, 25 bp, Mus musculus
ctgcctccttaagggtcttgagacc

SEQ ID NO: 273997 - DNA, 25 bp, Mus musculus
ctgcctccttcagatgacggattcc

SEQ ID NO: 273998 - DNA, 25 bp, Mus musculus
ctgcctcctttcaggatgctgtgcg

SEQ ID NO: 273999 - DNA, 25 bp, Mus musculus
ctgcctcgaatacgaaaatggatcg

SEQ ID NO: 274000 - DNA, 25 bp, Mus musculus
ctgcctcgaatcttaggtgcccgga

SEQ ID NO: 274001 - DNA, 25 bp, Mus musculus
ctgcctcgcaaagagttataccctg

SEQ ID NO: 274002 - DNA, 25 bp, Mus musculus
ctgcctcgccgtctggggcctcatt

SEQ ID NO: 274003 - DNA, 25 bp, Mus musculus
ctgcctcggtgctggcgccggagta

SEQ ID NO: 274004 - DNA, 25 bp, Mus musculus
ctgcctcggttcctgtaaagctggt

SEQ ID NO: 274005 - DNA, 25 bp, Mus musculus
ctgcctcgtcatctgggagggcatt

SEQ ID NO: 274006 - DNA, 25 bp, Mus musculus
ctgcctcgtcatgcacaccaagatg

SEQ ID NO: 274007 - DNA, 25 bp, Mus musculus
ctgcctctaagatctcaggatggac

SEQ ID NO: 274008 - DNA, 25 bp, Mus musculus
ctgcctctatggcggaacctaagga

SEQ ID NO: 274009 - DNA, 25 bp, Mus musculus
ctgcctctatggcggatcctgtctc

SEQ ID NO: 274010 - DNA, 25 bp, Mus musculus
ctgcctctcaaatgaacctctagtc

SEQ ID NO: 274011 - DNA, 25 bp, Mus musculus
ctgcctctcacagaatacatccagc

SEQ ID NO: 274012 - DNA, 25 bp, Mus musculus
ctgcctctggcgggatggactcctg

SEQ ID NO: 274013 - DNA, 25 bp, Mus musculus
ctgcctctggcggggctgcagtatg

SEQ ID NO: 274014 - DNA, 25 bp, Mus musculus
ctgcctctgggcggaaaaactgatg

SEQ ID NO: 274015 - DNA, 25 bp, Mus musculus
ctgcctctgggttaacaatcaagat

SEQ ID NO: 274016 - DNA, 25 bp, Mus musculus
ctgcctctgttaccgtaaagccttg

SEQ ID NO: 274017 - DNA, 25 bp, Mus musculus
ctgcctcttccaccttccagcagat

SEQ ID NO: 274018 - DNA, 25 bp, Mus musculus
ctgcctcttgaagaagtggatgacc

SEQ ID NO: 274019 - DNA, 25 bp, Mus musculus
ctgcctcttgaagtcagtttcagag

SEQ ID NO: 274020 - DNA, 25 bp, Mus musculus
ctgcctgaagagaagccttccagca

SEQ ID NO: 274021 - DNA, 25 bp, Mus musculus
ctgcctgaaggtttgacttcatgct

SEQ ID NO: 274022 - DNA, 25 bp, Mus musculus
ctgcctgacaaattgacatcagcaa

SEQ ID NO: 274023 - DNA, 25 bp, Mus musculus
ctgcctgacaattggcagcttcagt

SEQ ID NO: 274024 - DNA, 25 bp, Mus musculus
ctgcctgacagctggctgaagggag

SEQ ID NO: 274025 - DNA, 25 bp, Mus musculus
ctgcctgactcagaacaggtgagaa

SEQ ID NO: 274026 - DNA, 25 bp, Mus musculus
ctgcctgagaagctcaaacaggccg

SEQ ID NO: 274027 - DNA, 25 bp, Mus musculus
ctgcctgaggaggattcagaatttc

SEQ ID NO: 274028 - DNA, 25 bp, Mus musculus
ctgcctgagggttaaaattctgtgt

SEQ ID NO: 274029 - DNA, 25 bp, Mus musculus
ctgcctgagtgcgcaagcaaaagaa

SEQ ID NO: 274030 - DNA, 25 bp, Mus musculus
ctgcctgagtgcgcgtggaacctag

SEQ ID NO: 274031 - DNA, 25 bp, Mus musculus
ctgcctgatgagctgggagaccttc

SEQ ID NO: 274032 - DNA, 25 bp, Mus musculus
ctgcctgatgctgcctcacacaaga

SEQ ID NO: 274033 - DNA, 25 bp, Mus musculus
ctgcctgcacgcaaggtggccgaag

SEQ ID NO: 274034 - DNA, 25 bp, Mus musculus
ctgcctgcagaatcggccagcgccc

SEQ ID NO: 274035 - DNA, 25 bp, Mus musculus
ctgcctgcagccactacctcctcca

SEQ ID NO: 274036 - DNA, 25 bp, Mus musculus
ctgcctgcagtggatacattgttgc

SEQ ID NO: 274037 - DNA, 25 bp, Mus musculus
ctgcctgcatctacctttgcagatc

SEQ ID NO: 274038 - DNA, 25 bp, Mus musculus
ctgcctgcatctgtctcttaacctt

SEQ ID NO: 274039 - DNA, 25 bp, Mus musculus
ctgcctgccaggattttaccggaag

SEQ ID NO: 274040 - DNA, 25 bp, Mus musculus
ctgcctgccattgctgctctgacag

SEQ ID NO: 274041 - DNA, 25 bp, Mus musculus
ctgcctgccattgctgctgacaagg

SEQ ID NO: 274042 - DNA, 25 bp, Mus musculus
ctgcctgccgagcaatgccaagtga

SEQ ID NO: 274043 - DNA, 25 bp, Mus musculus
ctgcctgcctgcagccactacctcc

SEQ ID NO: 274044 - DNA, 25 bp, Mus musculus
ctgcctgcttctcggttcagcatgg

SEQ ID NO: 274045 - DNA, 25 bp, Mus musculus
ctgcctggaatctgcgacccatacg

SEQ ID NO: 274046 - DNA, 25 bp, Mus musculus
ctgcctggacagcattgccgccacc

SEQ ID NO: 274047 - DNA, 25 bp, Mus musculus
ctgcctggacaggggctctttagag

SEQ ID NO: 274048 - DNA, 25 bp, Mus musculus
ctgcctggaccactggcagcattag

SEQ ID NO: 274049 - DNA, 25 bp, Mus musculus
ctgcctggagaatagctcctgtatc

SEQ ID NO: 274050 - DNA, 25 bp, Mus musculus
ctgcctggcacaaggtgatagaggg

SEQ ID NO: 274051 - DNA, 25 bp, Mus musculus
ctgcctggcacacaagccttcaggg

SEQ ID NO: 274052 - DNA, 25 bp, Mus musculus
ctgcctggcacagaagccttcaggg

SEQ ID NO: 274053 - DNA, 25 bp, Mus musculus
ctgcctggccagatcagcatatagg

SEQ ID NO: 274054 - DNA, 25 bp, Mus musculus
ctgcctggccagttcagcatatagg

SEQ ID NO: 274055 - DNA, 25 bp, Mus musculus
ctgcctggccccccgggcgatggca

SEQ ID NO: 274056 - DNA, 25 bp, Mus musculus
ctgcctggcccggaagatgcaagcc

SEQ ID NO: 274057 - DNA, 25 bp, Mus musculus
ctgcctggcccggtcacagcaaact

SEQ ID NO: 274058 - DNA, 25 bp, Mus musculus
ctgcctggccctccgggtccttctg

SEQ ID NO: 274059 - DNA, 25 bp, Mus musculus
ctgcctggctaagagggaaggctcc

SEQ ID NO: 274060 - DNA, 25 bp, Mus musculus
ctgcctggctcacctctgctattgt

SEQ ID NO: 274061 - DNA, 25 bp, Mus musculus
ctgcctgggatgcgccgcagcacct

SEQ ID NO: 274062 - DNA, 25 bp, Mus musculus
ctgcctgggattttcctggtctgga

SEQ ID NO: 274063 - DNA, 25 bp, Mus musculus
ctgcctgggcgcaggaagatttgga

SEQ ID NO: 274064 - DNA, 25 bp, Mus musculus
ctgcctggtcagtgtcagctggtca

SEQ ID NO: 274065 - DNA, 25 bp, Mus musculus
ctgcctggtggaggcggacctatgt

SEQ ID NO: 274066 - DNA, 25 bp, Mus musculus
ctgcctgtaacggagactctggtgg

SEQ ID NO: 274067 - DNA, 25 bp, Mus musculus
ctgcctgtattggccttctgtatac

SEQ ID NO: 274068 - DNA, 25 bp, Mus musculus
ctgcctgtcagcaaagttatttcgc

SEQ ID NO: 274069 - DNA, 25 bp, Mus musculus
ctgcctgtcaggaccgaataaacct

SEQ ID NO: 274070 - DNA, 25 bp, Mus musculus
ctgcctgtcaggcttcctgcgggca

SEQ ID NO: 274071 - DNA, 25 bp, Mus musculus
ctgcctgtcagtgaagctggctatt

SEQ ID NO: 274072 - DNA, 25 bp, Mus musculus
ctgcctgtccagacatcttcttctc

SEQ ID NO: 274073 - DNA, 25 bp, Mus musculus
ctgcctgtccagggatttggacatt

SEQ ID NO: 274074 - DNA, 25 bp, Mus musculus
ctgcctgtctgagccgctacagaac

SEQ ID NO: 274075 - DNA, 25 bp, Mus musculus
ctgcctgtgaagacttggatgaatg

SEQ ID NO: 274076 - DNA, 25 bp, Mus musculus
ctgcctgtgaagtcttggatgaatg

SEQ ID NO: 274077 - DNA, 25 bp, Mus musculus
ctgcctgtgactcaggattctctac

SEQ ID NO: 274078 - DNA, 25 bp, Mus musculus
ctgcctgtgccggcctttaatgtga

SEQ ID NO: 274079 - DNA, 25 bp, Mus musculus
ctgcctgtggggaaaaccagttggg

SEQ ID NO: 274080 - DNA, 25 bp, Mus musculus
ctgcctgtggggaaagcatctgaac

SEQ ID NO: 274081 - DNA, 25 bp, Mus musculus
ctgcctgttacaggtctgcagcata

SEQ ID NO: 274082 - DNA, 25 bp, Mus musculus
ctgcctgtttttgagccacgtggtg

SEQ ID NO: 274083 - DNA, 25 bp, Mus musculus
ctgccttaaaaaagaatccatgccc

SEQ ID NO: 274084 - DNA, 25 bp, Mus musculus
ctgccttaaaaaaggatgctcatgt

SEQ ID NO: 274085 - DNA, 25 bp, Mus musculus
ctgccttaagaaagaatgggaaaca

SEQ ID NO: 274086 - DNA, 25 bp, Mus musculus
ctgccttacagacgtggctctttgg

SEQ ID NO: 274087 - DNA, 25 bp, Mus musculus
ctgccttacccatatctgtcaggat

SEQ ID NO: 274088 - DNA, 25 bp, Mus musculus
ctgccttacctccagaacccgctca

SEQ ID NO: 274089 - DNA, 25 bp, Mus musculus
ctgccttcaaacgtgtttggactta

SEQ ID NO: 274090 - DNA, 25 bp, Mus musculus
ctgccttcacggcggagtgttcctg

SEQ ID NO: 274091 - DNA, 25 bp, Mus musculus
ctgccttcagaaaaaatgctgtttc

SEQ ID NO: 274092 - DNA, 25 bp, Mus musculus
ctgccttcaggacgaatgctacaac

SEQ ID NO: 274093 - DNA, 25 bp, Mus musculus
ctgccttcaggctttgcagggaccc

SEQ ID NO: 274094 - DNA, 25 bp, Mus musculus
ctgccttccagtgtgtggacagccc

SEQ ID NO: 274095 - DNA, 25 bp, Mus musculus
ctgccttccagtgtgtggtgtcccc

SEQ ID NO: 274096 - DNA, 25 bp, Mus musculus
ctgccttcctatgtagcactcagca

SEQ ID NO: 274097 - DNA, 25 bp, Mus musculus
ctgccttcctcaagcagtataattc

SEQ ID NO: 274098 - DNA, 25 bp, Mus musculus
ctgccttcctggattcaccggcgcc

SEQ ID NO: 274099 - DNA, 25 bp, Mus musculus
ctgccttctctgggttccctggacg

SEQ ID NO: 274100 - DNA, 25 bp, Mus musculus
ctgccttctgagttaatatgacaga

SEQ ID NO: 274101 - DNA, 25 bp, Mus musculus
ctgccttctgagttattgcggaagc

SEQ ID NO: 274102 - DNA, 25 bp, Mus musculus
ctgccttctgagttgtagttagcgc

SEQ ID NO: 274103 - DNA, 25 bp, Mus musculus
ctgccttctgagttttcctcttgct

SEQ ID NO: 274104 - DNA, 25 bp, Mus musculus
ctgccttgaaagatttacaagggcc

SEQ ID NO: 274105 - DNA, 25 bp, Mus musculus
ctgccttgaaagcccccaaaataga

SEQ ID NO: 274106 - DNA, 25 bp, Mus musculus
ctgccttgagagcttacccctcatg

SEQ ID NO: 274107 - DNA, 25 bp, Mus musculus
ctgccttgagagtcgcttcaaagta

SEQ ID NO: 274108 - DNA, 25 bp, Mus musculus
ctgccttgaggacgggcagaaccca

SEQ ID NO: 274109 - DNA, 25 bp, Mus musculus
ctgccttgaggatgacaagatccag

SEQ ID NO: 274110 - DNA, 25 bp, Mus musculus
ctgccttgaggctggctactgtttg

SEQ ID NO: 274111 - DNA, 25 bp, Mus musculus
ctgccttgaggttcctagacaactt

SEQ ID NO: 274112 - DNA, 25 bp, Mus musculus
ctgccttgatgacagggtcccttgc

SEQ ID NO: 274113 - DNA, 25 bp, Mus musculus
ctgccttgattggccctcctttttc

SEQ ID NO: 274114 - DNA, 25 bp, Mus musculus
ctgccttgccttactcagacactga

SEQ ID NO: 274115 - DNA, 25 bp, Mus musculus
ctgccttgcttaccctagaagccgt

SEQ ID NO: 274116 - DNA, 25 bp, Mus musculus
ctgccttgtcaggggtgacacccct

SEQ ID NO: 274117 - DNA, 25 bp, Mus musculus
ctgcctttccgatacgttctggacc

SEQ ID NO: 274118 - DNA, 25 bp, Mus musculus
ctgcctttgaaacagacataatgag

SEQ ID NO: 274119 - DNA, 25 bp, Mus musculus
ctgcctttgaacatgattctgttac

SEQ ID NO: 274120 - DNA, 25 bp, Mus musculus
ctgcctttgagaagcatgtggatgg

SEQ ID NO: 274121 - DNA, 25 bp, Mus musculus
ctgcctttgaggatgacatgcacag

SEQ ID NO: 274122 - DNA, 25 bp, Mus musculus
ctgcctttgggctgtaccttggcca

SEQ ID NO: 274123 - DNA, 25 bp, Mus musculus
ctgcctttggggatgtcgtcaccgt

SEQ ID NO: 274124 - DNA, 25 bp, Mus musculus
ctgccttttacaatgctcatgacct

SEQ ID NO: 274125 - DNA, 25 bp, Mus musculus
ctgccttttcctgggatcagccttg

SEQ ID NO: 274126 - DNA, 25 bp, Mus musculus
ctgccttttgacagccacacctgcg

SEQ ID NO: 274127 - DNA, 25 bp, Mus musculus
ctgccttttgacatcccagaggagg

SEQ ID NO: 274128 - DNA, 25 bp, Mus musculus
ctgcgaaaaagggatgactgagtgg

SEQ ID NO: 274129 - DNA, 25 bp, Mus musculus
ctgcgaaccaaacacactgggttct

SEQ ID NO: 274130 - DNA, 25 bp, Mus musculus
ctgcgaaccaactgccaggggacag

SEQ ID NO: 274131 - DNA, 25 bp, Mus musculus
ctgcgaacctggtagcctataacat

SEQ ID NO: 274132 - DNA, 25 bp, Mus musculus
ctgcgaaggaagtactattactgga

SEQ ID NO: 274133 - DNA, 25 bp, Mus musculus
ctgcgaaggtcaagcacccctattg

SEQ ID NO: 274134 - DNA, 25 bp, Mus musculus
ctgcgaaggtcaaggccacaggcct

SEQ ID NO: 274135 - DNA, 25 bp, Mus musculus
ctgcgaatcggagccccagatcctg

SEQ ID NO: 274136 - DNA, 25 bp, Mus musculus
ctgcgaatggaaggagagtccagat

SEQ ID NO: 274137 - DNA, 25 bp, Mus musculus
ctgcgacaaggcccttggactggac

SEQ ID NO: 274138 - DNA, 25 bp, Mus musculus
ctgcgacagattggttctaggtctt

SEQ ID NO: 274139 - DNA, 25 bp, Mus musculus
ctgcgaccaggctttggcgttgttg

SEQ ID NO: 274140 - DNA, 25 bp, Mus musculus
ctgcgaccaggtgacccaatgacaa

SEQ ID NO: 274141 - DNA, 25 bp, Mus musculus
ctgcgacccagccattcattgagaa

SEQ ID NO: 274142 - DNA, 25 bp, Mus musculus
ctgcgacccaggtgcctggctgcag

SEQ ID NO: 274143 - DNA, 25 bp, Mus musculus
ctgcgacccccagcccagtaggcac

SEQ ID NO: 274144 - DNA, 25 bp, Mus musculus
ctgcgaccctgcaagagttcttttt

SEQ ID NO: 274145 - DNA, 25 bp, Mus musculus
ctgcgaccctgcaagatggaggggg

SEQ ID NO: 274146 - DNA, 25 bp, Mus musculus
ctgcgaccgtggctcctaatgtaca

SEQ ID NO: 274147 - DNA, 25 bp, Mus musculus
ctgcgacggccagggtggaactact

SEQ ID NO: 274148 - DNA, 25 bp, Mus musculus
ctgcgactccgagcaccactcccat

SEQ ID NO: 274149 - DNA, 25 bp, Mus musculus
ctgcgactctgagagcagaggggca

SEQ ID NO: 274150 - DNA, 25 bp, Mus musculus
ctgcgacttggataagaaaacttcc

SEQ ID NO: 274151 - DNA, 25 bp, Mus musculus
ctgcgacttgggcttcctgtatccc

SEQ ID NO: 274152 - DNA, 25 bp, Mus musculus
ctgcgagactaaagaaacgtgttcc

SEQ ID NO: 274153 - DNA, 25 bp, Mus musculus
ctgcgagaggagcagcggcccctga

SEQ ID NO: 274154 - DNA, 25 bp, Mus musculus
ctgcgagaggagggtgctgactact

SEQ ID NO: 274155 - DNA, 25 bp, Mus musculus
ctgcgagcaagggtctctgatatgg

SEQ ID NO: 274156 - DNA, 25 bp, Mus musculus
ctgcgagcaaggtccttccatagtg

SEQ ID NO: 274157 - DNA, 25 bp, Mus musculus
ctgcgagcagccaccactggtccag

SEQ ID NO: 274158 - DNA, 25 bp, Mus musculus
ctgcgagcccgcatggattccaggt

SEQ ID NO: 274159 - DNA, 25 bp, Mus musculus
ctgcgagccgcagtggttttatgaa

SEQ ID NO: 274160 - DNA, 25 bp, Mus musculus
ctgcgagcgagaagatgtttggcac

SEQ ID NO: 274161 - DNA, 25 bp, Mus musculus
ctgcgagcgagactatgagaagatg

SEQ ID NO: 274162 - DNA, 25 bp, Mus musculus
ctgcgagcgcagttacccagcatgc

SEQ ID NO: 274163 - DNA, 25 bp, Mus musculus
ctgcgagcgctgtagacctggacac

SEQ ID NO: 274164 - DNA, 25 bp, Mus musculus
ctgcgagctacaagtattctgagga

SEQ ID NO: 274165 - DNA, 25 bp, Mus musculus
ctgcgagctccagcaagaaaaattc

SEQ ID NO: 274166 - DNA, 25 bp, Mus musculus
ctgcgaggccgcaatctgtcgcttt

SEQ ID NO: 274167 - DNA, 25 bp, Mus musculus
ctgcgaggcgccacgacctgtgcta

SEQ ID NO: 274168 - DNA, 25 bp, Mus musculus
ctgcgaggcgccacggtagcgcctg

SEQ ID NO: 274169 - DNA, 25 bp, Mus musculus
ctgcgaggggaagattgcatctggg

SEQ ID NO: 274170 - DNA, 25 bp, Mus musculus
ctgcgaggggaaggtgaagtatttg

SEQ ID NO: 274171 - DNA, 25 bp, Mus musculus
ctgcgagtcccaggtttgaagagtg

SEQ ID NO: 274172 - DNA, 25 bp, Mus musculus
ctgcgagtcccagtgctgtaattac

SEQ ID NO: 274173 - DNA, 25 bp, Mus musculus
ctgcgagtcttcggggccctctgtc

SEQ ID NO: 274174 - DNA, 25 bp, Mus musculus
ctgcgataaaccattgttgaggacc

SEQ ID NO: 274175 - DNA, 25 bp, Mus musculus
ctgcgatatatacagatttgcaaca

SEQ ID NO: 274176 - DNA, 25 bp, Mus musculus
ctgcgatcggaagagaccaagcaaa

SEQ ID NO: 274177 - DNA, 25 bp, Mus musculus
ctgcgatctgggtggaaatggaatt

SEQ ID NO: 274178 - DNA, 25 bp, Mus musculus
ctgcgatgaatgcgtgtatgcccag

SEQ ID NO: 274179 - DNA, 25 bp, Mus musculus
ctgcgatgaatgggtgtatgcccag

SEQ ID NO: 274180 - DNA, 25 bp, Mus musculus
ctgcgatgagcttaaaagatgatga

SEQ ID NO: 274181 - DNA, 25 bp, Mus musculus
ctgcgattacatcaccctgacctgg

SEQ ID NO: 274182 - DNA, 25 bp, Mus musculus
ctgcgattcaaccctcctgggatca

SEQ ID NO: 274183 - DNA, 25 bp, Mus musculus
ctgcgattcccaaggccttcccccc

SEQ ID NO: 274184 - DNA, 25 bp, Mus musculus
ctgcgattgaagagtcttttcacag

SEQ ID NO: 274185 - DNA, 25 bp, Mus musculus
ctgcgattgtgtcgaacaaatagtg

SEQ ID NO: 274186 - DNA, 25 bp, Mus musculus
ctgcgattgtgtcggacggtgggag

SEQ ID NO: 274187 - DNA, 25 bp, Mus musculus
ctgcgatttagctgctgtgtggatg

SEQ ID NO: 274188 - DNA, 25 bp, Mus musculus
ctgcgcaaaatcacgcttaaaggat

SEQ ID NO: 274189 - DNA, 25 bp, Mus musculus
ctgcgcaagatgcgccagcgcactg

SEQ ID NO: 274190 - DNA, 25 bp, Mus musculus
ctgcgcaaggagatgctgtggggcc

SEQ ID NO: 274191 - DNA, 25 bp, Mus musculus
ctgcgcaaggagatggtggggctgc

SEQ ID NO: 274192 - DNA, 25 bp, Mus musculus
ctgcgcaaggagatgttgtctgtag

SEQ ID NO: 274193 - DNA, 25 bp, Mus musculus
ctgcgcacagagtcccaaaagaaaa

SEQ ID NO: 274194 - DNA, 25 bp, Mus musculus
ctgcgcacagattccccaaaggccc

SEQ ID NO: 274195 - DNA, 25 bp, Mus musculus
ctgcgcaccttggtggaacactctg

SEQ ID NO: 274196 - DNA, 25 bp, Mus musculus
ctgcgcagacaggtgtcagctgact

SEQ ID NO: 274197 - DNA, 25 bp, Mus musculus
ctgcgcagactactttactggaaag

SEQ ID NO: 274198 - DNA, 25 bp, Mus musculus
ctgcgcagagaggtccaggatgcct

SEQ ID NO: 274199 - DNA, 25 bp, Mus musculus
ctgcgcagagaggtccaggatgctg

SEQ ID NO: 274200 - DNA, 25 bp, Mus musculus
ctgcgcagagcgcgggtgatgtgaa

SEQ ID NO: 274201 - DNA, 25 bp, Mus musculus
ctgcgcagcgagcggagagtcatgg

SEQ ID NO: 274202 - DNA, 25 bp, Mus musculus
ctgcgcagctcggcatttcagtcga

SEQ ID NO: 274203 - DNA, 25 bp, Mus musculus
ctgcgcagctgcagcctgacagagc

SEQ ID NO: 274204 - DNA, 25 bp, Mus musculus
ctgcgcagctgcagctcctcctagg

SEQ ID NO: 274205 - DNA, 25 bp, Mus musculus
ctgcgcagctgcaggcaaaatgaag

SEQ ID NO: 274206 - DNA, 25 bp, Mus musculus
ctgcgcagctgcagggaggggaact

SEQ ID NO: 274207 - DNA, 25 bp, Mus musculus
ctgcgcagtgctagctcttctgtcg

SEQ ID NO: 274208 - DNA, 25 bp, Mus musculus
ctgcgcatgaagttcatgcaaagag

SEQ ID NO: 274209 - DNA, 25 bp, Mus musculus
ctgcgccacaggaaagcactgccac

SEQ ID NO: 274210 - DNA, 25 bp, Mus musculus
ctgcgccagccaagaagaagatgaa

SEQ ID NO: 274211 - DNA, 25 bp, Mus musculus
ctgcgccagccaaggtggggctgca

SEQ ID NO: 274212 - DNA, 25 bp, Mus musculus
ctgcgcccccagccactggccccta

SEQ ID NO: 274213 - DNA, 25 bp, Mus musculus
ctgcgccccgggctccagcatacca

SEQ ID NO: 274214 - DNA, 25 bp, Mus musculus
ctgcgccctcaggatgactgagtgg

SEQ ID NO: 274215 - DNA, 25 bp, Mus musculus
ctgcgccctgggattcatcactcac

SEQ ID NO: 274216 - DNA, 25 bp, Mus musculus
ctgcgccgagagatcccgatgtgtg

SEQ ID NO: 274217 - DNA, 25 bp, Mus musculus
ctgcgccgggaccgacgccacaggg

SEQ ID NO: 274218 - DNA, 25 bp, Mus musculus
ctgcgcctaggggaggatcatgcgg

SEQ ID NO: 274219 - DNA, 25 bp, Mus musculus
ctgcgcctggagcaggaagggccag

SEQ ID NO: 274220 - DNA, 25 bp, Mus musculus
ctgcgcgacaggttttggctcgtga

SEQ ID NO: 274221 - DNA, 25 bp, Mus musculus
ctgcgcgagaggaatgcgctcatgt

SEQ ID NO: 274222 - DNA, 25 bp, Mus musculus
ctgcgcgagagtatgtcttggctgt

SEQ ID NO: 274223 - DNA, 25 bp, Mus musculus
ctgcgcgcgcagacttacactttga

SEQ ID NO: 274224 - DNA, 25 bp, Mus musculus
ctgcgcgcgcagagccaacagagaa

SEQ ID NO: 274225 - DNA, 25 bp, Mus musculus
ctgcgcgcgcagccaaagtgtatgt

SEQ ID NO: 274226 - DNA, 25 bp, Mus musculus
ctgcgcggcggcgggcaccatccaa

SEQ ID NO: 274227 - DNA, 25 bp, Mus musculus
ctgcgcggcggctggtttcctcaag

SEQ ID NO: 274228 - DNA, 25 bp, Mus musculus
ctgcgcgggagagtcctttcaagtg

SEQ ID NO: 274229 - DNA, 25 bp, Mus musculus
ctgcgcggttggacgagtgaccaaa

SEQ ID NO: 274230 - DNA, 25 bp, Mus musculus
ctgcgcgtcacgccttggcccattg

SEQ ID NO: 274231 - DNA, 25 bp, Mus musculus
ctgcgcgtccagggtttcctctcct

SEQ ID NO: 274232 - DNA, 25 bp, Mus musculus
ctgcgcgtccaggttaaatgaatac

SEQ ID NO: 274233 - DNA, 25 bp, Mus musculus
ctgcgcgtcccagggacccagctga

SEQ ID NO: 274234 - DNA, 25 bp, Mus musculus
ctgcgctactgcccactcaacatca

SEQ ID NO: 274235 - DNA, 25 bp, Mus musculus
ctgcgctactgcccattgaaaaatc

SEQ ID NO: 274236 - DNA, 25 bp, Mus musculus
ctgcgctatcatgagggtccatgcc

SEQ ID NO: 274237 - DNA, 25 bp, Mus musculus
ctgcgctcaacaaggacccctcatg

SEQ ID NO: 274238 - DNA, 25 bp, Mus musculus
ctgcgctcagagcgtaaacgacccc

SEQ ID NO: 274239 - DNA, 25 bp, Mus musculus
ctgcgctccaggtgccacatcatct

SEQ ID NO: 274240 - DNA, 25 bp, Mus musculus
ctgcgctccgggagtaaagacattt

SEQ ID NO: 274241 - DNA, 25 bp, Mus musculus
ctgcgctcggtgagttgcaggatcc

SEQ ID NO: 274242 - DNA, 25 bp, Mus musculus
ctgcgctgactgacatctactgccg

SEQ ID NO: 274243 - DNA, 25 bp, Mus musculus
ctgcgctgaggctccagccttcccc

SEQ ID NO: 274244 - DNA, 25 bp, Mus musculus
ctgcgctgccctggggctgtgtctg

SEQ ID NO: 274245 - DNA, 25 bp, Mus musculus
ctgcgctgcgagagaggaagacgac

SEQ ID NO: 274246 - DNA, 25 bp, Mus musculus
ctgcgctgcgctaattgtaaattca

SEQ ID NO: 274247 - DNA, 25 bp, Mus musculus
ctgcgctgcgtgacagctggtggca

SEQ ID NO: 274248 - DNA, 25 bp, Mus musculus
ctgcgctgcgtgcatccgtgcagcc

SEQ ID NO: 274249 - DNA, 25 bp, Mus musculus
ctgcgctggcaggtcccagggattt

SEQ ID NO: 274250 - DNA, 25 bp, Mus musculus
ctgcgctggcaggttgtagataccc

SEQ ID NO: 274251 - DNA, 25 bp, Mus musculus
ctgcgcttatttgaggagaatgaga

SEQ ID NO: 274252 - DNA, 25 bp, Mus musculus
ctgcgcttatttgaggagtttgggc

SEQ ID NO: 274253 - DNA, 25 bp, Mus musculus
ctgcgcttcgcccgcagcctcgccc

SEQ ID NO: 274254 - DNA, 25 bp, Mus musculus
ctgcggaaagtacacaaacaagttc

SEQ ID NO: 274255 - DNA, 25 bp, Mus musculus
ctgcggaagcagaggatctctcagc

SEQ ID NO: 274256 - DNA, 25 bp, Mus musculus
ctgcggaagcagagggacctgtacc

SEQ ID NO: 274257 - DNA, 25 bp, Mus musculus
ctgcggaagggaaacaacctgatca

SEQ ID NO: 274258 - DNA, 25 bp, Mus musculus
ctgcggaatggggtgagtgaggaga

SEQ ID NO: 274259 - DNA, 25 bp, Mus musculus
ctgcggacaatacaggctaggggtg

SEQ ID NO: 274260 - DNA, 25 bp, Mus musculus
ctgcggacacgtcttttgctctgca

SEQ ID NO: 274261 - DNA, 25 bp, Mus musculus
ctgcggacacgtgaatgtctgaagc

SEQ ID NO: 274262 - DNA, 25 bp, Mus musculus
ctgcggacacgtttcatcctatcta

SEQ ID NO: 274263 - DNA, 25 bp, Mus musculus
ctgcggacacttgtgaagcagcagg

SEQ ID NO: 274264 - DNA, 25 bp, Mus musculus
ctgcggacacttgtggagcattctg

SEQ ID NO: 274265 - DNA, 25 bp, Mus musculus
ctgcggacagacaactgaggataag

SEQ ID NO: 274266 - DNA, 25 bp, Mus musculus
ctgcggacagtctcctgccctgaga

SEQ ID NO: 274267 - DNA, 25 bp, Mus musculus
ctgcggaccgagaacctctccataa

SEQ ID NO: 274268 - DNA, 25 bp, Mus musculus
ctgcggaccgagaagaaccgatcgc

SEQ ID NO: 274269 - DNA, 25 bp, Mus musculus
ctgcggacctcagcctttatcctca

SEQ ID NO: 274270 - DNA, 25 bp, Mus musculus
ctgcggacctcaggaaccctgatga

SEQ ID NO: 274271 - DNA, 25 bp, Mus musculus
ctgcggagacagggggctcacccta

SEQ ID NO: 274272 - DNA, 25 bp, Mus musculus
ctgcggagacaggttgcagaattca

SEQ ID NO: 274273 - DNA, 25 bp, Mus musculus
ctgcggagacaggtttcggccgagt

SEQ ID NO: 274274 - DNA, 25 bp, Mus musculus
ctgcggagacgtaagatcaacgaga

SEQ ID NO: 274275 - DNA, 25 bp, Mus musculus
ctgcggagagaggaccaaatggata

SEQ ID NO: 274276 - DNA, 25 bp, Mus musculus
ctgcggagagggttcttgaccacca

SEQ ID NO: 274277 - DNA, 25 bp, Mus musculus
ctgcggagagtaagcggaggcctgg

SEQ ID NO: 274278 - DNA, 25 bp, Mus musculus
ctgcggagcagaatgatttccagag

SEQ ID NO: 274279 - DNA, 25 bp, Mus musculus
ctgcggagcattctgtgcccccaag

SEQ ID NO: 274280 - DNA, 25 bp, Mus musculus
ctgcggagcattgtgaccactgact

SEQ ID NO: 274281 - DNA, 25 bp, Mus musculus
ctgcggagcctaagtctgtaccaaa

SEQ ID NO: 274282 - DNA, 25 bp, Mus musculus
ctgcggagcgcggaggtgatgctag

SEQ ID NO: 274283 - DNA, 25 bp, Mus musculus
ctgcggagcggggttgaaagacaca

SEQ ID NO: 274284 - DNA, 25 bp, Mus musculus
ctgcggagcgggtttatggtcggct

SEQ ID NO: 274285 - DNA, 25 bp, Mus musculus
ctgcggagctcgcgactcactgtgt

SEQ ID NO: 274286 - DNA, 25 bp, Mus musculus
ctgcggagctcggaattagctgaac

SEQ ID NO: 274287 - DNA, 25 bp, Mus musculus
ctgcggaggggtgggaggctgccgg

SEQ ID NO: 274288 - DNA, 25 bp, Mus musculus
ctgcggatggagaatatattcctcc

SEQ ID NO: 274289 - DNA, 25 bp, Mus musculus
ctgcggattcggagcattcttgaag

SEQ ID NO: 274290 - DNA, 25 bp, Mus musculus
ctgcggattcggatggattccaaag

SEQ ID NO: 274291 - DNA, 25 bp, Mus musculus
ctgcggcaaagaggcattctggaat

SEQ ID NO: 274292 - DNA, 25 bp, Mus musculus
ctgcggcaagtttgatggtgacagt

SEQ ID NO: 274293 - DNA, 25 bp, Mus musculus
ctgcggcaccatggcaaccgaagaa

SEQ ID NO: 274294 - DNA, 25 bp, Mus musculus
ctgcggcaccgcttgtcctgggctg

SEQ ID NO: 274295 - DNA, 25 bp, Mus musculus
ctgcggcaccggctggcccgcgggt

SEQ ID NO: 274296 - DNA, 25 bp, Mus musculus
ctgcggcaccgtttcctctacaggt

SEQ ID NO: 274297 - DNA, 25 bp, Mus musculus
ctgcggcagaatggacagttgctca

SEQ ID NO: 274298 - DNA, 25 bp, Mus musculus
ctgcggcagaatgggtgcagacctc

SEQ ID NO: 274299 - DNA, 25 bp, Mus musculus
ctgcggccaatagctctcagggcct

SEQ ID NO: 274300 - DNA, 25 bp, Mus musculus
ctgcggccacacgtgacactggcca

SEQ ID NO: 274301 - DNA, 25 bp, Mus musculus
ctgcggccacacgttctgcggggag

SEQ ID NO: 274302 - DNA, 25 bp, Mus musculus
ctgcggccacgaaacgatcagcaga

SEQ ID NO: 274303 - DNA, 25 bp, Mus musculus
ctgcggccagagcttcggtgcaacc

SEQ ID NO: 274304 - DNA, 25 bp, Mus musculus
ctgcggccaggaggtggcttacaag

SEQ ID NO: 274305 - DNA, 25 bp, Mus musculus
ctgcggcccggctagttcattgaaa

SEQ ID NO: 274306 - DNA, 25 bp, Mus musculus
ctgcggccgcaggcctgaagctcat

SEQ ID NO: 274307 - DNA, 25 bp, Mus musculus
ctgcggccgcgtcatggccgtgcct

SEQ ID NO: 274308 - DNA, 25 bp, Mus musculus
ctgcggcctgacccggctccactct

SEQ ID NO: 274309 - DNA, 25 bp, Mus musculus
ctgcggcgcgactggaggataccag

SEQ ID NO: 274310 - DNA, 25 bp, Mus musculus
ctgcggcgcgactgggtggggctgc

SEQ ID NO: 274311 - DNA, 25 bp, Mus musculus
ctgcggcgctagctaggcggccgtc

SEQ ID NO: 274312 - DNA, 25 bp, Mus musculus
ctgcggcgggacagttgggcaaggc

SEQ ID NO: 274313 - DNA, 25 bp, Mus musculus
ctgcggcggttgagacttctccatt

SEQ ID NO: 274314 - DNA, 25 bp, Mus musculus
ctgcggcgtggagcaaaacaattgg

SEQ ID NO: 274315 - DNA, 25 bp, Mus musculus
ctgcggctgcagaagcgtctcctgt

SEQ ID NO: 274316 - DNA, 25 bp, Mus musculus
ctgcggctgccagaaacttcagtgc

SEQ ID NO: 274317 - DNA, 25 bp, Mus musculus
ctgcggctgcccgggcagtgacgga

SEQ ID NO: 274318 - DNA, 25 bp, Mus musculus
ctgcggctggaggttttcccgctca

SEQ ID NO: 274319 - DNA, 25 bp, Mus musculus
ctgcggctggagtgcccacgatggc

SEQ ID NO: 274320 - DNA, 25 bp, Mus musculus
ctgcggctggccacgtgtggttgaa

SEQ ID NO: 274321 - DNA, 25 bp, Mus musculus
ctgcgggaaaccgctgaagctgacg

SEQ ID NO: 274322 - DNA, 25 bp, Mus musculus
ctgcgggaacaggagctcctcttgc

SEQ ID NO: 274323 - DNA, 25 bp, Mus musculus
ctgcgggaccaatgctcaggtctag

SEQ ID NO: 274324 - DNA, 25 bp, Mus musculus
ctgcgggaccaggatgggctcaggc

SEQ ID NO: 274325 - DNA, 25 bp, Mus musculus
ctgcgggacctgggtgtctcttcca

SEQ ID NO: 274326 - DNA, 25 bp, Mus musculus
ctgcgggactggctagaaaatacta

SEQ ID NO: 274327 - DNA, 25 bp, Mus musculus
ctgcgggagcgtcaggtcttgagag

SEQ ID NO: 274328 - DNA, 25 bp, Mus musculus
ctgcgggcacaggtggacgaccccc

SEQ ID NO: 274329 - DNA, 25 bp, Mus musculus
ctgcgggcaccgggagctggtgatt

SEQ ID NO: 274330 - DNA, 25 bp, Mus musculus
ctgcgggccagaatcaccgccgccc

SEQ ID NO: 274331 - DNA, 25 bp, Mus musculus
ctgcgggcccagttgctgatagccc

SEQ ID NO: 274332 - DNA, 25 bp, Mus musculus
ctgcgggcccggaaatgcacttagc

SEQ ID NO: 274333 - DNA, 25 bp, Mus musculus
ctgcgggcccgggactgtgcagcat

SEQ ID NO: 274334 - DNA, 25 bp, Mus musculus
ctgcgggccggcgaaatggcaaaat

SEQ ID NO: 274335 - DNA, 25 bp, Mus musculus
ctgcgggcgagatgtatacatctca

SEQ ID NO: 274336 - DNA, 25 bp, Mus musculus
ctgcgggcgcggattgtgccttctg

SEQ ID NO: 274337 - DNA, 25 bp, Mus musculus
ctgcgggcgctacagggcttttctc

SEQ ID NO: 274338 - DNA, 25 bp, Mus musculus
ctgcgggcgctacaggtggacaaca

SEQ ID NO: 274339 - DNA, 25 bp, Mus musculus
ctgcgggctcgggaatgggaaacag

SEQ ID NO: 274340 - DNA, 25 bp, Mus musculus
ctgcgggctctccaggggaaaataa

SEQ ID NO: 274341 - DNA, 25 bp, Mus musculus
ctgcgggctttgcttaaatccagtg

SEQ ID NO: 274342 - DNA, 25 bp, Mus musculus
ctgcggggagtgaggggagctaccg

SEQ ID NO: 274343 - DNA, 25 bp, Mus musculus
ctgcggggcggttgccgctggtggg

SEQ ID NO: 274344 - DNA, 25 bp, Mus musculus
ctgcgggggagttttacagagagca

SEQ ID NO: 274345 - DNA, 25 bp, Mus musculus
ctgcgggtcccaagagacaggggtc

SEQ ID NO: 274346 - DNA, 25 bp, Mus musculus
ctgcgggtgaatgatccccaatcag

SEQ ID NO: 274347 - DNA, 25 bp, Mus musculus
ctgcgggtgaatgggccaccaccca

SEQ ID NO: 274348 - DNA, 25 bp, Mus musculus
ctgcgggtgtttggggcctacacgc

SEQ ID NO: 274349 - DNA, 25 bp, Mus musculus
ctgcgggttttgctggaccgcagca

SEQ ID NO: 274350 - DNA, 25 bp, Mus musculus
ctgcggtagctcggtttcttctggg

SEQ ID NO: 274351 - DNA, 25 bp, Mus musculus
ctgcggtgcagactggcccttcaaa

SEQ ID NO: 274352 - DNA, 25 bp, Mus musculus
ctgcggtgctcacagcagagggtcc

SEQ ID NO: 274353 - DNA, 25 bp, Mus musculus
ctgcggttaagaggggcagactgaa

SEQ ID NO: 274354 - DNA, 25 bp, Mus musculus
ctgcggttaagagggggtctcactg

SEQ ID NO: 274355 - DNA, 25 bp, Mus musculus
ctgcggttaagtgagcaaaccaaca

SEQ ID NO: 274356 - DNA, 25 bp, Mus musculus
ctgcggttggacaagggctgcaaac

SEQ ID NO: 274357 - DNA, 25 bp, Mus musculus
ctgcggttggctggcgtgccctacg

SEQ ID NO: 274358 - DNA, 25 bp, Mus musculus
ctgcggtttccagatgaagctctca

SEQ ID NO: 274359 - DNA, 25 bp, Mus musculus
ctgcgtaagtggccctcaaagcgga

SEQ ID NO: 274360 - DNA, 25 bp, Mus musculus
ctgcgtacagatgtggagattggca

SEQ ID NO: 274361 - DNA, 25 bp, Mus musculus
ctgcgtaccagcatcgagaaggtgt

SEQ ID NO: 274362 - DNA, 25 bp, Mus musculus
ctgcgtaccaggtatggcatcagcc

SEQ ID NO: 274363 - DNA, 25 bp, Mus musculus
ctgcgtaccccagaccgattttgca

SEQ ID NO: 274364 - DNA, 25 bp, Mus musculus
ctgcgtagagaatgcgggtttccgc

SEQ ID NO: 274365 - DNA, 25 bp, Mus musculus
ctgcgtaggagcaatacaccaagta

SEQ ID NO: 274366 - DNA, 25 bp, Mus musculus
ctgcgtcaagacccggatgcagagc

SEQ ID NO: 274367 - DNA, 25 bp, Mus musculus
ctgcgtcaaggtgcagccggatgtg

SEQ ID NO: 274368 - DNA, 25 bp, Mus musculus
ctgcgtcattcagagaggaatgcga

SEQ ID NO: 274369 - DNA, 25 bp, Mus musculus
ctgcgtcccgagggaaatggagcag

SEQ ID NO: 274370 - DNA, 25 bp, Mus musculus
ctgcgtccctctggggctgtggtca

SEQ ID NO: 274371 - DNA, 25 bp, Mus musculus
ctgcgtccgtgcccgttctgtactt

SEQ ID NO: 274372 - DNA, 25 bp, Mus musculus
ctgcgtctaaaggcttcgagtacct

SEQ ID NO: 274373 - DNA, 25 bp, Mus musculus
ctgcgtctcgagacaagaccataaa

SEQ ID NO: 274374 - DNA, 25 bp, Mus musculus
ctgcgtctcgagacaagaccatcat

SEQ ID NO: 274375 - DNA, 25 bp, Mus musculus
ctgcgtctgctgcatctctgagctg

SEQ ID NO: 274376 - DNA, 25 bp, Mus musculus
ctgcgtctgctgcggtttctttgct

SEQ ID NO: 274377 - DNA, 25 bp, Mus musculus
ctgcgtctgtttgctttgagcgctg

SEQ ID NO: 274378 - DNA, 25 bp, Mus musculus
ctgcgtctttggagggtggaagagc

SEQ ID NO: 274379 - DNA, 25 bp, Mus musculus
ctgcgtgacgtgtcacgatgtctga

SEQ ID NO: 274380 - DNA, 25 bp, Mus musculus
ctgcgtgcaattagagaaagataag

SEQ ID NO: 274381 - DNA, 25 bp, Mus musculus
ctgcgtgcaattaggcgtgcagccg

SEQ ID NO: 274382 - DNA, 25 bp, Mus musculus
ctgcgtgcagattaccttatgctga

SEQ ID NO: 274383 - DNA, 25 bp, Mus musculus
ctgcgtgcagtgatcgtttcagctc

SEQ ID NO: 274384 - DNA, 25 bp, Mus musculus
ctgcgtgcccacgagacttttcttt

SEQ ID NO: 274385 - DNA, 25 bp, Mus musculus
ctgcgtgcccacgagttcccacttg

SEQ ID NO: 274386 - DNA, 25 bp, Mus musculus
ctgcgtgcccagggcctagtgcttg

SEQ ID NO: 274387 - DNA, 25 bp, Mus musculus
ctgcgtgcccagggtcctgtgggca

SEQ ID NO: 274388 - DNA, 25 bp, Mus musculus
ctgcgtgcccaggttgtgtagcctg

SEQ ID NO: 274389 - DNA, 25 bp, Mus musculus
ctgcgtgcctatcaatcccaggctc

SEQ ID NO: 274390 - DNA, 25 bp, Mus musculus
ctgcgtgcctatcaggaaaggactc

SEQ ID NO: 274391 - DNA, 25 bp, Mus musculus
ctgcgtgctcatggaaacttcgggt

SEQ ID NO: 274392 - DNA, 25 bp, Mus musculus
ctgcgtgctcatggggtacgtgtgt

SEQ ID NO: 274393 - DNA, 25 bp, Mus musculus
ctgcgtggagctcaggcctgcatgc

SEQ ID NO: 274394 - DNA, 25 bp, Mus musculus
ctgcgtggagctgagaaccagtctt

SEQ ID NO: 274395 - DNA, 25 bp, Mus musculus
ctgcgtggagctgagctcactccgt

SEQ ID NO: 274396 - DNA, 25 bp, Mus musculus
ctgcgtggagtgttcagccaagcac

SEQ ID NO: 274397 - DNA, 25 bp, Mus musculus
ctgcgtggcttccggagacagaaaa

SEQ ID NO: 274398 - DNA, 25 bp, Mus musculus
ctgcgtggcttccggatcctttgtg

SEQ ID NO: 274399 - DNA, 25 bp, Mus musculus
ctgcgtgtgagcgtggcacaagact

SEQ ID NO: 274400 - DNA, 25 bp, Mus musculus
ctgcgttaattgaacactgttaatt

SEQ ID NO: 274401 - DNA, 25 bp, Mus musculus
ctgcgttcactgaggcagttgcacc

SEQ ID NO: 274402 - DNA, 25 bp, Mus musculus
ctgcgttgagatttggtgactgagg

SEQ ID NO: 274403 - DNA, 25 bp, Mus musculus
ctgctaaaagatttctgcatgaacc

SEQ ID NO: 274404 - DNA, 25 bp, Mus musculus
ctgctaaaccattgctggcctcgaa

SEQ ID NO: 274405 - DNA, 25 bp, Mus musculus
ctgctaaactgcaacacggctaagg

SEQ ID NO: 274406 - DNA, 25 bp, Mus musculus
ctgctaaaggactggaaaggagaca

SEQ ID NO: 274407 - DNA, 25 bp, Mus musculus
ctgctaaagggagaaaagacatgct

SEQ ID NO: 274408 - DNA, 25 bp, Mus musculus
ctgctaaaggggaagaaaagacatg

SEQ ID NO: 274409 - DNA, 25 bp, Mus musculus
ctgctaaaggggaagtgaaatcttg

SEQ ID NO: 274410 - DNA, 25 bp, Mus musculus
ctgctaacaatgagccgtggaagaa

SEQ ID NO: 274411 - DNA, 25 bp, Mus musculus
ctgctaacaggtgatatttttgaat

SEQ ID NO: 274412 - DNA, 25 bp, Mus musculus
ctgctaaccgggtctttggggctgc

SEQ ID NO: 274413 - DNA, 25 bp, Mus musculus
ctgctaactctaaactgcgaggcca

SEQ ID NO: 274414 - DNA, 25 bp, Mus musculus
ctgctaactctagcatatgaaactt

SEQ ID NO: 274415 - DNA, 25 bp, Mus musculus
ctgctaactgagaccatgcagaggc

SEQ ID NO: 274416 - DNA, 25 bp, Mus musculus
ctgctaagaaggattcatggttggc

SEQ ID NO: 274417 - DNA, 25 bp, Mus musculus
ctgctaagaagggtgctcacttcgt

SEQ ID NO: 274418 - DNA, 25 bp, Mus musculus
ctgctaaggatcctgaccccgaact

SEQ ID NO: 274419 - DNA, 25 bp, Mus musculus
ctgctaagggaagatacacctatgg

SEQ ID NO: 274420 - DNA, 25 bp, Mus musculus
ctgctaatgagactcagtccgctag

SEQ ID NO: 274421 - DNA, 25 bp, Mus musculus
ctgctaatgtcagcagaccgctccg

SEQ ID NO: 274422 - DNA, 25 bp, Mus musculus
ctgctacaacaaaactacagacagt

SEQ ID NO: 274423 - DNA, 25 bp, Mus musculus
ctgctacaaggaggatctcagtaag

SEQ ID NO: 274424 - DNA, 25 bp, Mus musculus
ctgctacaaggctttcttctgtggc

SEQ ID NO: 274425 - DNA, 25 bp, Mus musculus
ctgctacaaggtgcagcagaaagat

SEQ ID NO: 274426 - DNA, 25 bp, Mus musculus
ctgctacaagtgactacttccgggc

SEQ ID NO: 274427 - DNA, 25 bp, Mus musculus
ctgctacacagcctcttgccagcca

SEQ ID NO: 274428 - DNA, 25 bp, Mus musculus
ctgctacacgaggtgcagtgggtgg

SEQ ID NO: 274429 - DNA, 25 bp, Mus musculus
ctgctacacgagtgggtggtgcaaa

SEQ ID NO: 274430 - DNA, 25 bp, Mus musculus
ctgctacagaggttgcaagtgttga

SEQ ID NO: 274431 - DNA, 25 bp, Mus musculus
ctgctacagcctcagatgaaatcat

SEQ ID NO: 274432 - DNA, 25 bp, Mus musculus
ctgctacattaataccctggagcag

SEQ ID NO: 274433 - DNA, 25 bp, Mus musculus
ctgctaccacacaaggtttgacgga

SEQ ID NO: 274434 - DNA, 25 bp, Mus musculus
ctgctaccacagccgctagtcagac

SEQ ID NO: 274435 - DNA, 25 bp, Mus musculus
ctgctaccacaggagccgaaagcgt

SEQ ID NO: 274436 - DNA, 25 bp, Mus musculus
ctgctaccactcaggctctcgcctt

SEQ ID NO: 274437 - DNA, 25 bp, Mus musculus
ctgctaccataggagactacacgga

SEQ ID NO: 274438 - DNA, 25 bp, Mus musculus
ctgctaccataggctccacttacct

SEQ ID NO: 274439 - DNA, 25 bp, Mus musculus
ctgctacccaagcagggtggccact

SEQ ID NO: 274440 - DNA, 25 bp, Mus musculus
ctgctaccccggcaaagctgttgct

SEQ ID NO: 274441 - DNA, 25 bp, Mus musculus
ctgctacctacggctctcttaagag

SEQ ID NO: 274442 - DNA, 25 bp, Mus musculus
ctgctacctacggggaacttgaaat

SEQ ID NO: 274443 - DNA, 25 bp, Mus musculus
ctgctacctgaattttgtgccatcg

SEQ ID NO: 274444 - DNA, 25 bp, Mus musculus
ctgctacctggaagaagccctgcag

SEQ ID NO: 274445 - DNA, 25 bp, Mus musculus
ctgctacctggaagagtgcctgctc

SEQ ID NO: 274446 - DNA, 25 bp, Mus musculus
ctgctaccttcaagatgctgtcccc

SEQ ID NO: 274447 - DNA, 25 bp, Mus musculus
ctgctacgataggtacctgtgtcgt

SEQ ID NO: 274448 - DNA, 25 bp, Mus musculus
ctgctacggccgcactcggaaccca

SEQ ID NO: 274449 - DNA, 25 bp, Mus musculus
ctgctacgtgagaacttgaagcaag

SEQ ID NO: 274450 - DNA, 25 bp, Mus musculus
ctgctacgtgagtttttcagattat

SEQ ID NO: 274451 - DNA, 25 bp, Mus musculus
ctgctactactgtgctgaggagacc

SEQ ID NO: 274452 - DNA, 25 bp, Mus musculus
ctgctactccaggtttcttgaactc

SEQ ID NO: 274453 - DNA, 25 bp, Mus musculus
ctgctactcgcggttcccagagcta

SEQ ID NO: 274454 - DNA, 25 bp, Mus musculus
ctgctactgctatggagcggaattc

SEQ ID NO: 274455 - DNA, 25 bp, Mus musculus
ctgctactgctatgggtttcagtcc

SEQ ID NO: 274456 - DNA, 25 bp, Mus musculus
ctgctacttctctgtcagcacaggg

SEQ ID NO: 274457 - DNA, 25 bp, Mus musculus
ctgctagaaggctgaagaacctgga

SEQ ID NO: 274458 - DNA, 25 bp, Mus musculus
ctgctagaattcgatttcagaaata

SEQ ID NO: 274459 - DNA, 25 bp, Mus musculus
ctgctagaattcggtgggctggtat

SEQ ID NO: 274460 - DNA, 25 bp, Mus musculus
ctgctagacaggcttgtgttgcgga

SEQ ID NO: 274461 - DNA, 25 bp, Mus musculus
ctgctagacgtggctgtgagtcctg

SEQ ID NO: 274462 - DNA, 25 bp, Mus musculus
ctgctagagaaggagctggagcaga

SEQ ID NO: 274463 - DNA, 25 bp, Mus musculus
ctgctagagacggtcgctcgcattc

SEQ ID NO: 274464 - DNA, 25 bp, Mus musculus
ctgctagagcgcatcccagccttta

SEQ ID NO: 274465 - DNA, 25 bp, Mus musculus
ctgctagagcgtgtgggcatcgttc

SEQ ID NO: 274466 - DNA, 25 bp, Mus musculus
ctgctagataaggtcctggagacct

SEQ ID NO: 274467 - DNA, 25 bp, Mus musculus
ctgctagataaggtcctggaggagg

SEQ ID NO: 274468 - DNA, 25 bp, Mus musculus
ctgctagcatagatattttgagacg

SEQ ID NO: 274469 - DNA, 25 bp, Mus musculus
ctgctagcatcagggcccatttgga

SEQ ID NO: 274470 - DNA, 25 bp, Mus musculus
ctgctagccaagatatcaacctgaa

SEQ ID NO: 274471 - DNA, 25 bp, Mus musculus
ctgctagccaaggtgctggattaaa

SEQ ID NO: 274472 - DNA, 25 bp, Mus musculus
ctgctagcgaaccagtaatggtcag

SEQ ID NO: 274473 - DNA, 25 bp, Mus musculus
ctgctaggagcagagatcaagttct

SEQ ID NO: 274474 - DNA, 25 bp, Mus musculus
ctgctaggcctccaggaggaccttg

SEQ ID NO: 274475 - DNA, 25 bp, Mus musculus
ctgctaggcctccaggaggagactc

SEQ ID NO: 274476 - DNA, 25 bp, Mus musculus
ctgctagtggagatgccgttcctat

SEQ ID NO: 274477 - DNA, 25 bp, Mus musculus
ctgctagtggagcaccaaggagttt

SEQ ID NO: 274478 - DNA, 25 bp, Mus musculus
ctgctagtggaggagtttcatttct

SEQ ID NO: 274479 - DNA, 25 bp, Mus musculus
ctgctagtggagggggttacaacta

SEQ ID NO: 274480 - DNA, 25 bp, Mus musculus
ctgctagtggagtgcactgaggcca

SEQ ID NO: 274481 - DNA, 25 bp, Mus musculus
ctgctagttggaaggctccgcccac

SEQ ID NO: 274482 - DNA, 25 bp, Mus musculus
ctgctataaagaaactacataaagc

SEQ ID NO: 274483 - DNA, 25 bp, Mus musculus
ctgctataaaggacttagaagtctg

SEQ ID NO: 274484 - DNA, 25 bp, Mus musculus
ctgctatacgaaggggctcctgggc

SEQ ID NO: 274485 - DNA, 25 bp, Mus musculus
ctgctatagaaggtaattacactct

SEQ ID NO: 274486 - DNA, 25 bp, Mus musculus
ctgctatcaaggtgcagagcccctc

SEQ ID NO: 274487 - DNA, 25 bp, Mus musculus
ctgctatcctaagtgatgtgccagc

SEQ ID NO: 274488 - DNA, 25 bp, Mus musculus
ctgctatcgtggatggagacaggat

SEQ ID NO: 274489 - DNA, 25 bp, Mus musculus
ctgctatctacagtgggcagcaaag

SEQ ID NO: 274490 - DNA, 25 bp, Mus musculus
ctgctatctacagtgggccggcggc

SEQ ID NO: 274491 - DNA, 25 bp, Mus musculus
ctgctatctgttatgaaacaaatgt

SEQ ID NO: 274492 - DNA, 25 bp, Mus musculus
ctgctatgaacaccctccttgacgg

SEQ ID NO: 274493 - DNA, 25 bp, Mus musculus
ctgctatgagaaactccccaacttt

SEQ ID NO: 274494 - DNA, 25 bp, Mus musculus
ctgctatgaggagggtattcctaca

SEQ ID NO: 274495 - DNA, 25 bp, Mus musculus
ctgctatgcaaaagttatgatggtt

SEQ ID NO: 274496 - DNA, 25 bp, Mus musculus
ctgctatggatggtgctttgcaagg

SEQ ID NO: 274497 - DNA, 25 bp, Mus musculus
ctgctatggcaaccagtataatgtt

SEQ ID NO: 274498 - DNA, 25 bp, Mus musculus
ctgctatggcaatgacaccagccag

SEQ ID NO: 274499 - DNA, 25 bp, Mus musculus
ctgctatgggcatattgtattagag

SEQ ID NO: 274500 - DNA, 25 bp, Mus musculus
ctgctatgggttcaggttctgccac

SEQ ID NO: 274501 - DNA, 25 bp, Mus musculus
ctgctatgtcgaccagtatgaggtt

SEQ ID NO: 274502 - DNA, 25 bp, Mus musculus
ctgctatgtgaaggtgctcctggtc

SEQ ID NO: 274503 - DNA, 25 bp, Mus musculus
ctgctatgtggccaccctggagaaa

SEQ ID NO: 274504 - DNA, 25 bp, Mus musculus
ctgctattaagatcgagttctctaa

SEQ ID NO: 274505 - DNA, 25 bp, Mus musculus
ctgctattatcatagaccttcaggc

SEQ ID NO: 274506 - DNA, 25 bp, Mus musculus
ctgctattatcatgatactaccaca

SEQ ID NO: 274507 - DNA, 25 bp, Mus musculus
ctgctattcaaaacagcgtggaaga

SEQ ID NO: 274508 - DNA, 25 bp, Mus musculus
ctgctattctacaggaaaaatccgc

SEQ ID NO: 274509 - DNA, 25 bp, Mus musculus
ctgctattgcagaggtggcttttgc

SEQ ID NO: 274510 - DNA, 25 bp, Mus musculus
ctgctattgcaggtttcctggcaga

SEQ ID NO: 274511 - DNA, 25 bp, Mus musculus
ctgctcaaacaagtgtgatgctctg

SEQ ID NO: 274512 - DNA, 25 bp, Mus musculus
ctgctcaacagccatctccagtggc

SEQ ID NO: 274513 - DNA, 25 bp, Mus musculus
ctgctcaacaggacttggatgttgt

SEQ ID NO: 274514 - DNA, 25 bp, Mus musculus
ctgctcaacaggctcacaccactcg

SEQ ID NO: 274515 - DNA, 25 bp, Mus musculus
ctgctcaaccagacgcacctctagt

SEQ ID NO: 274516 - DNA, 25 bp, Mus musculus
ctgctcaaccagtggacatatcagg

SEQ ID NO: 274517 - DNA, 25 bp, Mus musculus
ctgctcaagttcgattggatccgag

SEQ ID NO: 274518 - DNA, 25 bp, Mus musculus
ctgctcaagttcttctctgtgttcc

SEQ ID NO: 274519 - DNA, 25 bp, Mus musculus
ctgctcacaaaacaggagacatttg

SEQ ID NO: 274520 - DNA, 25 bp, Mus musculus
ctgctcacagagtcagtccgaccgc

SEQ ID NO: 274521 - DNA, 25 bp, Mus musculus
ctgctcacagcctccctcttaacct

SEQ ID NO: 274522 - DNA, 25 bp, Mus musculus
ctgctcaccatggcagaacctgcaa

SEQ ID NO: 274523 - DNA, 25 bp, Mus musculus
ctgctcaccattggagaccggtttg

SEQ ID NO: 274524 - DNA, 25 bp, Mus musculus
ctgctcacccacagagtgctgacct

SEQ ID NO: 274525 - DNA, 25 bp, Mus musculus
ctgctcacccagagcttgtcaatgt

SEQ ID NO: 274526 - DNA, 25 bp, Mus musculus
ctgctcactgacagggtttctctgt

SEQ ID NO: 274527 - DNA, 25 bp, Mus musculus
ctgctcactgcattggataccctgt

SEQ ID NO: 274528 - DNA, 25 bp, Mus musculus
ctgctcactgggggaatgcggggcc

SEQ ID NO: 274529 - DNA, 25 bp, Mus musculus
ctgctcagaacgaaccaagaattgt

SEQ ID NO: 274530 - DNA, 25 bp, Mus musculus
ctgctcagaacggatcaataagcca

SEQ ID NO: 274531 - DNA, 25 bp, Mus musculus
ctgctcagaaggctcaggaggcatg

SEQ ID NO: 274532 - DNA, 25 bp, Mus musculus
ctgctcagacagccgtgcttatgga

SEQ ID NO: 274533 - DNA, 25 bp, Mus musculus
ctgctcagagagtcggcgtccctac

SEQ ID NO: 274534 - DNA, 25 bp, Mus musculus
ctgctcagagagtcgggtctgagtg

SEQ ID NO: 274535 - DNA, 25 bp, Mus musculus
ctgctcagagtggcctctcaaaggc

SEQ ID NO: 274536 - DNA, 25 bp, Mus musculus
ctgctcagatggtttagacacgtgt

SEQ ID NO: 274537 - DNA, 25 bp, Mus musculus
ctgctcagcaaggctgagcgccgcg

SEQ ID NO: 274538 - DNA, 25 bp, Mus musculus
ctgctcagcaagggccgcgtgttgg

SEQ ID NO: 274539 - DNA, 25 bp, Mus musculus
ctgctcagcagaatcgggttgagat

SEQ ID NO: 274540 - DNA, 25 bp, Mus musculus
ctgctcagcagccactctctacaaa

SEQ ID NO: 274541 - DNA, 25 bp, Mus musculus
ctgctcagcagggataactctctgc

SEQ ID NO: 274542 - DNA, 25 bp, Mus musculus
ctgctcagccttgaggtcccactgg

SEQ ID NO: 274543 - DNA, 25 bp, Mus musculus
ctgctcagcgtggagcccttggatg

SEQ ID NO: 274544 - DNA, 25 bp, Mus musculus
ctgctcagcgtggagctgcagccct

SEQ ID NO: 274545 - DNA, 25 bp, Mus musculus
ctgctcagctcaggtactagaagac

SEQ ID NO: 274546 - DNA, 25 bp, Mus musculus
ctgctcagctctgctctaaagcaaa

SEQ ID NO: 274547 - DNA, 25 bp, Mus musculus
ctgctcagctgcgcatcctgcctct

SEQ ID NO: 274548 - DNA, 25 bp, Mus musculus
ctgctcagctgcgtcggcacccagg

SEQ ID NO: 274549 - DNA, 25 bp, Mus musculus
ctgctcaggaaaggactttcctgga

SEQ ID NO: 274550 - DNA, 25 bp, Mus musculus
ctgctcaggaacagccccacagcag

SEQ ID NO: 274551 - DNA, 25 bp, Mus musculus
ctgctcaggaacagtatcatcaaca

SEQ ID NO: 274552 - DNA, 25 bp, Mus musculus
ctgctcaggatcccagccagccctg

SEQ ID NO: 274553 - DNA, 25 bp, Mus musculus
ctgctcagggcagccaagcctgagc

SEQ ID NO: 274554 - DNA, 25 bp, Mus musculus
ctgctcagggcagtggtcctcatag

SEQ ID NO: 274555 - DNA, 25 bp, Mus musculus
ctgctcaggtcagcctccatgtact

SEQ ID NO: 274556 - DNA, 25 bp, Mus musculus
ctgctcatccgaagtatcctggaga

SEQ ID NO: 274557 - DNA, 25 bp, Mus musculus
ctgctcatccgctcccatctccagg

SEQ ID NO: 274558 - DNA, 25 bp, Mus musculus
ctgctcatggaaacgtgtgccgtca

SEQ ID NO: 274559 - DNA, 25 bp, Mus musculus
ctgctcatggatgaagttgctgccc

SEQ ID NO: 274560 - DNA, 25 bp, Mus musculus
ctgctcatgggggcacctatgaggt

SEQ ID NO: 274561 - DNA, 25 bp, Mus musculus
ctgctcattcgaagatgttttcggt

SEQ ID NO: 274562 - DNA, 25 bp, Mus musculus
ctgctcatttatgataattagcacc

SEQ ID NO: 274563 - DNA, 25 bp, Mus musculus
ctgctccaaggctacagctccccca

SEQ ID NO: 274564 - DNA, 25 bp, Mus musculus
ctgctccaaggctacagctctcaac

SEQ ID NO: 274565 - DNA, 25 bp, Mus musculus
ctgctccacaggtgttctacactca

SEQ ID NO: 274566 - DNA, 25 bp, Mus musculus
ctgctccaccttcaagcttcagaac

SEQ ID NO: 274567 - DNA, 25 bp, Mus musculus
ctgctccaccttcaatttggaaggc

SEQ ID NO: 274568 - DNA, 25 bp, Mus musculus
ctgctccacgcggtagcactcagca

SEQ ID NO: 274569 - DNA, 25 bp, Mus musculus
ctgctccacttctatcagcaatccc

SEQ ID NO: 274570 - DNA, 25 bp, Mus musculus
ctgctccagacgtcttgagagcaga

SEQ ID NO: 274571 - DNA, 25 bp, Mus musculus
ctgctccagagcatctaaagaaaaa

SEQ ID NO: 274572 - DNA, 25 bp, Mus musculus
ctgctccagagctacttctccttca

SEQ ID NO: 274573 - DNA, 25 bp, Mus musculus
ctgctccagagctgctctgcgtaca

SEQ ID NO: 274574 - DNA, 25 bp, Mus musculus
ctgctccagagctggagaagcgggg

SEQ ID NO: 274575 - DNA, 25 bp, Mus musculus
ctgctccagagctggcaggacctac

SEQ ID NO: 274576 - DNA, 25 bp, Mus musculus
ctgctccagatgaagatccaggagg

SEQ ID NO: 274577 - DNA, 25 bp, Mus musculus
ctgctccagatgaagtcaggaggca

SEQ ID NO: 274578 - DNA, 25 bp, Mus musculus
ctgctccagcctgggagggcctagg

SEQ ID NO: 274579 - DNA, 25 bp, Mus musculus
ctgctccagcggctgtgacagcgag

SEQ ID NO: 274580 - DNA, 25 bp, Mus musculus
ctgctccagcggggactctggcgga

SEQ ID NO: 274581 - DNA, 25 bp, Mus musculus
ctgctccagggatccagaaggagct

SEQ ID NO: 274582 - DNA, 25 bp, Mus musculus
ctgctccagtaacagttacagaaac

SEQ ID NO: 274583 - DNA, 25 bp, Mus musculus
ctgctccattgacacaattgttcca

SEQ ID NO: 274584 - DNA, 25 bp, Mus musculus
ctgctccattgacgatggcacgaac

SEQ ID NO: 274585 - DNA, 25 bp, Mus musculus
ctgctcccaagcccttggacatccg

SEQ ID NO: 274586 - DNA, 25 bp, Mus musculus
ctgctcccagcatggcggacaagga

SEQ ID NO: 274587 - DNA, 25 bp, Mus musculus
ctgctcccagcgtttcccaacagag

SEQ ID NO: 274588 - DNA, 25 bp, Mus musculus
ctgctcccatgatgttcctgtacaa

SEQ ID NO: 274589 - DNA, 25 bp, Mus musculus
ctgctcccatgcttatcattgcaag

SEQ ID NO: 274590 - DNA, 25 bp, Mus musculus
ctgctcccccaggccggtagtggtg

SEQ ID NO: 274591 - DNA, 25 bp, Mus musculus
ctgctcccgtccccaccgacaacgg

SEQ ID NO: 274592 - DNA, 25 bp, Mus musculus
ctgctcccgtttgagcccggttcct

SEQ ID NO: 274593 - DNA, 25 bp, Mus musculus
ctgctccctttgcgcacaggttaca

SEQ ID NO: 274594 - DNA, 25 bp, Mus musculus
ctgctccgaaatcaggcagaagagg

SEQ ID NO: 274595 - DNA, 25 bp, Mus musculus
ctgctccgacaatatgcacctattt

SEQ ID NO: 274596 - DNA, 25 bp, Mus musculus
ctgctccgacaatgtagatttagaa

SEQ ID NO: 274597 - DNA, 25 bp, Mus musculus
ctgctccgagctcacaggaaggaga

SEQ ID NO: 274598 - DNA, 25 bp, Mus musculus
ctgctccgaggcatgtcccccaggc

SEQ ID NO: 274599 - DNA, 25 bp, Mus musculus
ctgctccgaggtctccaaaaatgct

SEQ ID NO: 274600 - DNA, 25 bp, Mus musculus
ctgctccgccaccagggccagagct

SEQ ID NO: 274601 - DNA, 25 bp, Mus musculus
ctgctccgtatagaggaagcccagc

SEQ ID NO: 274602 - DNA, 25 bp, Mus musculus
ctgctccgtggagggtacactagct

SEQ ID NO: 274603 - DNA, 25 bp, Mus musculus
ctgctccgtttggggcggcaacctt

SEQ ID NO: 274604 - DNA, 25 bp, Mus musculus
ctgctccgtttggggctacgccttc

SEQ ID NO: 274605 - DNA, 25 bp, Mus musculus
ctgctcctaaactttccacatctac

SEQ ID NO: 274606 - DNA, 25 bp, Mus musculus
ctgctcctagaagcgtgcaatcacc

SEQ ID NO: 274607 - DNA, 25 bp, Mus musculus
ctgctcctcagccatgagaaaacaa

SEQ ID NO: 274608 - DNA, 25 bp, Mus musculus
ctgctcctcagccctaaagaaccac

SEQ ID NO: 274609 - DNA, 25 bp, Mus musculus
ctgctcctccacaggctctggtcag

SEQ ID NO: 274610 - DNA, 25 bp, Mus musculus
ctgctcctgatgaagaccctcttgt

SEQ ID NO: 274611 - DNA, 25 bp, Mus musculus
ctgctcctgatgaaggactatgtgc

SEQ ID NO: 274612 - DNA, 25 bp, Mus musculus
ctgctcctgcaggtggaagcacttc

SEQ ID NO: 274613 - DNA, 25 bp, Mus musculus
ctgctcctgccaatgggaagctcct

SEQ ID NO: 274614 - DNA, 25 bp, Mus musculus
ctgctcctggaggctttggaaatgt

SEQ ID NO: 274615 - DNA, 25 bp, Mus musculus
ctgctcctgtgctagtttcgcattt

SEQ ID NO: 274616 - DNA, 25 bp, Mus musculus
ctgctccttgaatacctctgcaggt

SEQ ID NO: 274617 - DNA, 25 bp, Mus musculus
ctgctcgaaacagatcagccagcat

SEQ ID NO: 274618 - DNA, 25 bp, Mus musculus
ctgctcgaaacagtagtttagtatg

SEQ ID NO: 274619 - DNA, 25 bp, Mus musculus
ctgctcgcaagctgcaggctgcact

SEQ ID NO: 274620 - DNA, 25 bp, Mus musculus
ctgctcgcaagctgcgggtgcagca

SEQ ID NO: 274621 - DNA, 25 bp, Mus musculus
ctgctcgccccagaggtcacccggc

SEQ ID NO: 274622 - DNA, 25 bp, Mus musculus
ctgctcgccccagaggtgaccctta

SEQ ID NO: 274623 - DNA, 25 bp, Mus musculus
ctgctcgccgagggcataacctggg

SEQ ID NO: 274624 - DNA, 25 bp, Mus musculus
ctgctcggcagcacatcatgcaacg

SEQ ID NO: 274625 - DNA, 25 bp, Mus musculus
ctgctcggctcacggatgatgactc

SEQ ID NO: 274626 - DNA, 25 bp, Mus musculus
ctgctcggtctggtttatctccggc

SEQ ID NO: 274627 - DNA, 25 bp, Mus musculus
ctgctcgtaccaggcacagaagaat

SEQ ID NO: 274628 - DNA, 25 bp, Mus musculus
ctgctctacagaaaataaatcataa

SEQ ID NO: 274629 - DNA, 25 bp, Mus musculus
ctgctctaccagtccttcgtgaagg

SEQ ID NO: 274630 - DNA, 25 bp, Mus musculus
ctgctctatcgaggctacatgaagg

SEQ ID NO: 274631 - DNA, 25 bp, Mus musculus
ctgctctatggctcccttcttctca

SEQ ID NO: 274632 - DNA, 25 bp, Mus musculus
ctgctctcaaaggtcttcctgcagc

SEQ ID NO: 274633 - DNA, 25 bp, Mus musculus
ctgctctcaatgcaggtcaatggcc

SEQ ID NO: 274634 - DNA, 25 bp, Mus musculus
ctgctctcacccaccgacctttgca

SEQ ID NO: 274635 - DNA, 25 bp, Mus musculus
ctgctctccaccgggaaaatctgaa

SEQ ID NO: 274636 - DNA, 25 bp, Mus musculus
ctgctctccctcaagacatctccga

SEQ ID NO: 274637 - DNA, 25 bp, Mus musculus
ctgctctccctcaagtgctgcattg

SEQ ID NO: 274638 - DNA, 25 bp, Mus musculus
ctgctctctaacacccttatttaga

SEQ ID NO: 274639 - DNA, 25 bp, Mus musculus
ctgctctctagcagccctacgttct

SEQ ID NO: 274640 - DNA, 25 bp, Mus musculus
ctgctctctatttcacgctgccccc

SEQ ID NO: 274641 - DNA, 25 bp, Mus musculus
ctgctctctatttggagagaaatac

SEQ ID NO: 274642 - DNA, 25 bp, Mus musculus
ctgctctctcagcgcatctcctccc

SEQ ID NO: 274643 - DNA, 25 bp, Mus musculus
ctgctctctcgaaaggttctgtacc

SEQ ID NO: 274644 - DNA, 25 bp, Mus musculus
ctgctctctcttgacccaagccacg

SEQ ID NO: 274645 - DNA, 25 bp, Mus musculus
ctgctctgaaagcttactgataagg

SEQ ID NO: 274646 - DNA, 25 bp, Mus musculus
ctgctctgaccacagttttcctgac

SEQ ID NO: 274647 - DNA, 25 bp, Mus musculus
ctgctctgagacctcgccatgccct

SEQ ID NO: 274648 - DNA, 25 bp, Mus musculus
ctgctctgcagtgcctgagcaacac

SEQ ID NO: 274649 - DNA, 25 bp, Mus musculus
ctgctctgcgccaaggacactgcca

SEQ ID NO: 274650 - DNA, 25 bp, Mus musculus
ctgctctgctctgcctcggcaacag

SEQ ID NO: 274651 - DNA, 25 bp, Mus musculus
ctgctctggatgagagggagatgag

SEQ ID NO: 274652 - DNA, 25 bp, Mus musculus
ctgctctgggatgctgcaggaccag

SEQ ID NO: 274653 - DNA, 25 bp, Mus musculus
ctgctctggtcttaggttcttgatt

SEQ ID NO: 274654 - DNA, 25 bp, Mus musculus
ctgctctgtaagcagcctaggatgt

SEQ ID NO: 274655 - DNA, 25 bp, Mus musculus
ctgctctgtcatgggtcctctacag

SEQ ID NO: 274656 - DNA, 25 bp, Mus musculus
ctgctcttaccaatcttgaactttc

SEQ ID NO: 274657 - DNA, 25 bp, Mus musculus
ctgctcttcacctgcttcctggcag

SEQ ID NO: 274658 - DNA, 25 bp, Mus musculus
ctgctcttccaggtgacagtcacag

SEQ ID NO: 274659 - DNA, 25 bp, Mus musculus
ctgctcttccagtgggaaacattct

SEQ ID NO: 274660 - DNA, 25 bp, Mus musculus
ctgctcttcgggaatcatggcccaa

SEQ ID NO: 274661 - DNA, 25 bp, Mus musculus
ctgctcttgccatgcttccaccact

SEQ ID NO: 274662 - DNA, 25 bp, Mus musculus
ctgctgaaaacatgggtacaggacc

SEQ ID NO: 274663 - DNA, 25 bp, Mus musculus
ctgctgaacgagggttcagccgact

SEQ ID NO: 274664 - DNA, 25 bp, Mus musculus
ctgctgaagaaaagtactctcaaaa

SEQ ID NO: 274665 - DNA, 25 bp, Mus musculus
ctgctgaagaaagaattgatatttt

SEQ ID NO: 274666 - DNA, 25 bp, Mus musculus
ctgctgaagaaattgaagcagctgg

SEQ ID NO: 274667 - DNA, 25 bp, Mus musculus
ctgctgaagaacatgatgcaaggag

SEQ ID NO: 274668 - DNA, 25 bp, Mus musculus
ctgctgaagaacatggactggaaag

SEQ ID NO: 274669 - DNA, 25 bp, Mus musculus
ctgctgaagaagagagggactcaaa

SEQ ID NO: 274670 - DNA, 25 bp, Mus musculus
ctgctgaagaagagcagtttccgga

SEQ ID NO: 274671 - DNA, 25 bp, Mus musculus
ctgctgaagagcacggatgttcttt

SEQ ID NO: 274672 - DNA, 25 bp, Mus musculus
ctgctgaagctggggggtcgtgtga

SEQ ID NO: 274673 - DNA, 25 bp, Mus musculus
ctgctgaagttagacacaccagaag

SEQ ID NO: 274674 - DNA, 25 bp, Mus musculus
ctgctgaattttagagaacgagtta

SEQ ID NO: 274675 - DNA, 25 bp, Mus musculus
ctgctgaattttagagaatggctct

SEQ ID NO: 274676 - DNA, 25 bp, Mus musculus
ctgctgacaagccgatacacctcct

SEQ ID NO: 274677 - DNA, 25 bp, Mus musculus
ctgctgacaattgcttctacttctc

SEQ ID NO: 274678 - DNA, 25 bp, Mus musculus
ctgctgacagaaatcttaaaaaggc

SEQ ID NO: 274679 - DNA, 25 bp, Mus musculus
ctgctgacagacactgtcctgttgg

SEQ ID NO: 274680 - DNA, 25 bp, Mus musculus
ctgctgacaggcaccacacagtcac

SEQ ID NO: 274681 - DNA, 25 bp, Mus musculus
ctgctgacaggccgggtgaccaaga

SEQ ID NO: 274682 - DNA, 25 bp, Mus musculus
ctgctgacagtatccctggaagaca

SEQ ID NO: 274683 - DNA, 25 bp, Mus musculus
ctgctgacatcacagatgagctcca

SEQ ID NO: 274684 - DNA, 25 bp, Mus musculus
ctgctgaccaagcccactccccacc

SEQ ID NO: 274685 - DNA, 25 bp, Mus musculus
ctgctgaccgacaggctctgcgcgc

SEQ ID NO: 274686 - DNA, 25 bp, Mus musculus
ctgctgaccgatttctgcatgaacc

SEQ ID NO: 274687 - DNA, 25 bp, Mus musculus
ctgctgacctgggcacacatgagag

SEQ ID NO: 274688 - DNA, 25 bp, Mus musculus
ctgctgacgcagatcattaagtgtc

SEQ ID NO: 274689 - DNA, 25 bp, Mus musculus
ctgctgacgcaggatcctacccaga

SEQ ID NO: 274690 - DNA, 25 bp, Mus musculus
ctgctgactccaggaggaatgctgt

SEQ ID NO: 274691 - DNA, 25 bp, Mus musculus
ctgctgactccaggtctgttctcag

SEQ ID NO: 274692 - DNA, 25 bp, Mus musculus
ctgctgactcccagacattgggcct

SEQ ID NO: 274693 - DNA, 25 bp, Mus musculus
ctgctgactcccagaccatctccta

SEQ ID NO: 274694 - DNA, 25 bp, Mus musculus
ctgctgactcccaggatgccctgat

SEQ ID NO: 274695 - DNA, 25 bp, Mus musculus
ctgctgactggttgcccattggacg

SEQ ID NO: 274696 - DNA, 25 bp, Mus musculus
ctgctgagagcggcccctttgttgc

SEQ ID NO: 274697 - DNA, 25 bp, Mus musculus
ctgctgagaggttcatgtactggac

SEQ ID NO: 274698 - DNA, 25 bp, Mus musculus
ctgctgagatcttggaaatagcaga

SEQ ID NO: 274699 - DNA, 25 bp, Mus musculus
ctgctgagcaaagatgaagcggcag

SEQ ID NO: 274700 - DNA, 25 bp, Mus musculus
ctgctgagcaaaggagtgattctcg

SEQ ID NO: 274701 - DNA, 25 bp, Mus musculus
ctgctgagcaaggatgaagatggaa

SEQ ID NO: 274702 - DNA, 25 bp, Mus musculus
ctgctgagcagctgcagcagcccct

SEQ ID NO: 274703 - DNA, 25 bp, Mus musculus
ctgctgagcaggtagataataaagg

SEQ ID NO: 274704 - DNA, 25 bp, Mus musculus
ctgctgagcaggttcaattttatat

SEQ ID NO: 274705 - DNA, 25 bp, Mus musculus
ctgctgagcctggggaacaaaaact

SEQ ID NO: 274706 - DNA, 25 bp, Mus musculus
ctgctgagcctgggtcactgttctg

SEQ ID NO: 274707 - DNA, 25 bp, Mus musculus
ctgctgagcgctgagattggtgtcc

SEQ ID NO: 274708 - DNA, 25 bp, Mus musculus
ctgctgagcgctgattcctgagtca

SEQ ID NO: 274709 - DNA, 25 bp, Mus musculus
ctgctgaggaaacaggccgaggaag

SEQ ID NO: 274710 - DNA, 25 bp, Mus musculus
ctgctgaggagaatgcggaggccac

SEQ ID NO: 274711 - DNA, 25 bp, Mus musculus
ctgctgaggcggacaaatcagcagc

SEQ ID NO: 274712 - DNA, 25 bp, Mus musculus
ctgctgagtacaggatatgaatcag

SEQ ID NO: 274713 - DNA, 25 bp, Mus musculus
ctgctgagtacaggcgtgggtgact

SEQ ID NO: 274714 - DNA, 25 bp, Mus musculus
ctgctgagtcctgcagcaggtgcag

SEQ ID NO: 274715 - DNA, 25 bp, Mus musculus
ctgctgataacacaggccatggcgc

SEQ ID NO: 274716 - DNA, 25 bp, Mus musculus
ctgctgataacacaggtgccttctt

SEQ ID NO: 274717 - DNA, 25 bp, Mus musculus
ctgctgataccggtgacagtggtaa

SEQ ID NO: 274718 - DNA, 25 bp, Mus musculus
ctgctgatccagacggccacccgag

SEQ ID NO: 274719 - DNA, 25 bp, Mus musculus
ctgctgatgaaggagagagaagtgc

SEQ ID NO: 274720 - DNA, 25 bp, Mus musculus
ctgctgatgaagggtccgcaggtcc

SEQ ID NO: 274721 - DNA, 25 bp, Mus musculus
ctgctgatggacggctctcagacac

SEQ ID NO: 274722 - DNA, 25 bp, Mus musculus
ctgctgatggagcatctgggtggtc

SEQ ID NO: 274723 - DNA, 25 bp, Mus musculus
ctgctgatggagctatatacgccat

SEQ ID NO: 274724 - DNA, 25 bp, Mus musculus
ctgctgattcgagaggttccgtgag

SEQ ID NO: 274725 - DNA, 25 bp, Mus musculus
ctgctgattgggaacaagtcagacc

SEQ ID NO: 274726 - DNA, 25 bp, Mus musculus
ctgctgcaaagcctgcctggggctt

SEQ ID NO: 274727 - DNA, 25 bp, Mus musculus
ctgctgcaacagcaaggtggccacg

SEQ ID NO: 274728 - DNA, 25 bp, Mus musculus
ctgctgcaacagcgaggcagaggct

SEQ ID NO: 274729 - DNA, 25 bp, Mus musculus
ctgctgcacagccctcctaagggtt

SEQ ID NO: 274730 - DNA, 25 bp, Mus musculus
ctgctgcacaggaataaaggacata

SEQ ID NO: 274731 - DNA, 25 bp, Mus musculus
ctgctgcacagtgatcatcaaggag

SEQ ID NO: 274732 - DNA, 25 bp, Mus musculus
ctgctgcaccagattataagtgcct

SEQ ID NO: 274733 - DNA, 25 bp, Mus musculus
ctgctgcaccagattgatgtcctcg

SEQ ID NO: 274734 - DNA, 25 bp, Mus musculus
ctgctgcactcgcagaacaccagcc

SEQ ID NO: 274735 - DNA, 25 bp, Mus musculus
ctgctgcactgaaataaccagcttt

SEQ ID NO: 274736 - DNA, 25 bp, Mus musculus
ctgctgcagaacgagtttgttgtat

SEQ ID NO: 274737 - DNA, 25 bp, Mus musculus
ctgctgcagccgaggcagacgaggc

SEQ ID NO: 274738 - DNA, 25 bp, Mus musculus
ctgctgcagccgagggaatgggctt

SEQ ID NO: 274739 - DNA, 25 bp, Mus musculus
ctgctgcagcttcgctcttgtggac

SEQ ID NO: 274740 - DNA, 25 bp, Mus musculus
ctgctgcagtcagcaaaatatccag

SEQ ID NO: 274741 - DNA, 25 bp, Mus musculus
ctgctgcagtgtggggaaatcccac

SEQ ID NO: 274742 - DNA, 25 bp, Mus musculus
ctgctgcatcagaacctcttacata

SEQ ID NO: 274743 - DNA, 25 bp, Mus musculus
ctgctgcatcagcccagcactatgg

SEQ ID NO: 274744 - DNA, 25 bp, Mus musculus
ctgctgcatcaggtaccaccagctt

SEQ ID NO: 274745 - DNA, 25 bp, Mus musculus
ctgctgcatgcagaacccttaccag

SEQ ID NO: 274746 - DNA, 25 bp, Mus musculus
ctgctgcatgcagctggtgcagaac

SEQ ID NO: 274747 - DNA, 25 bp, Mus musculus
ctgctgccactgcccacccccgcga

SEQ ID NO: 274748 - DNA, 25 bp, Mus musculus
ctgctgccagagggaaattgtggga

SEQ ID NO: 274749 - DNA, 25 bp, Mus musculus
ctgctgccagataaagatagagaaa

SEQ ID NO: 274750 - DNA, 25 bp, Mus musculus
ctgctgccagccaggcttcccggat

SEQ ID NO: 274751 - DNA, 25 bp, Mus musculus
ctgctgccagccagggactaggccc

SEQ ID NO: 274752 - DNA, 25 bp, Mus musculus
ctgctgccaggaagaattcagttgt

SEQ ID NO: 274753 - DNA, 25 bp, Mus musculus
ctgctgccaggtggagagagccagc

SEQ ID NO: 274754 - DNA, 25 bp, Mus musculus
ctgctgccatggtagtgatggacag

SEQ ID NO: 274755 - DNA, 25 bp, Mus musculus
ctgctgcccacagagaggtgacaga

SEQ ID NO: 274756 - DNA, 25 bp, Mus musculus
ctgctgcccacaggaaataacagta

SEQ ID NO: 274757 - DNA, 25 bp, Mus musculus
ctgctgccccaggagacctaggcag

SEQ ID NO: 274758 - DNA, 25 bp, Mus musculus
ctgctgccccaggagtttcctgaag

SEQ ID NO: 274759 - DNA, 25 bp, Mus musculus
ctgctgcccctcctgggccctggct

SEQ ID NO: 274760 - DNA, 25 bp, Mus musculus
ctgctgcccgcggggactggtatcc

SEQ ID NO: 274761 - DNA, 25 bp, Mus musculus
ctgctgccctggaatcttccgacag

SEQ ID NO: 274762 - DNA, 25 bp, Mus musculus
ctgctgccctggagcctcaaaccac

SEQ ID NO: 274763 - DNA, 25 bp, Mus musculus
ctgctgccgatctcagtctctggtc

SEQ ID NO: 274764 - DNA, 25 bp, Mus musculus
ctgctgccggcttttctcctgaact

SEQ ID NO: 274765 - DNA, 25 bp, Mus musculus
ctgctgccgggtcagcacctcggca

SEQ ID NO: 274766 - DNA, 25 bp, Mus musculus
ctgctgccgtgtgagttctgtgggg

SEQ ID NO: 274767 - DNA, 25 bp, Mus musculus
ctgctgccgttaggctactacatgg

SEQ ID NO: 274768 - DNA, 25 bp, Mus musculus
ctgctgcctcaggtacaactgatga

SEQ ID NO: 274769 - DNA, 25 bp, Mus musculus
ctgctgcgagaggccaaggtgacct

SEQ ID NO: 274770 - DNA, 25 bp, Mus musculus
ctgctgcgagtctgttgctgtggag

SEQ ID NO: 274771 - DNA, 25 bp, Mus musculus
ctgctgcgcacagagtcccaaaaga

SEQ ID NO: 274772 - DNA, 25 bp, Mus musculus
ctgctgcgcacagattccccaaagg

SEQ ID NO: 274773 - DNA, 25 bp, Mus musculus
ctgctgcgcatgaagttcatgcaaa

SEQ ID NO: 274774 - DNA, 25 bp, Mus musculus
ctgctgcgcttcgcccgcagcctcg

SEQ ID NO: 274775 - DNA, 25 bp, Mus musculus
ctgctgcggaagaacgcagaggtga

SEQ ID NO: 274776 - DNA, 25 bp, Mus musculus
ctgctgctaaagcttattgagcggt

SEQ ID NO: 274777 - DNA, 25 bp, Mus musculus
ctgctgctaaagggttatcacacat

SEQ ID NO: 274778 - DNA, 25 bp, Mus musculus
ctgctgctaactgtgtggtttaatc

SEQ ID NO: 274779 - DNA, 25 bp, Mus musculus
ctgctgctactactgtgctgaggag

SEQ ID NO: 274780 - DNA, 25 bp, Mus musculus
ctgctgctagcccgggccccatatc

SEQ ID NO: 274781 - DNA, 25 bp, Mus musculus
ctgctgctagccctgctcttggaca

SEQ ID NO: 274782 - DNA, 25 bp, Mus musculus
ctgctgctatcgtggatggagacag

SEQ ID NO: 274783 - DNA, 25 bp, Mus musculus
ctgctgctcacacacacacacacac

SEQ ID NO: 274784 - DNA, 25 bp, Mus musculus
ctgctgctcagaaggctcaggaggc

SEQ ID NO: 274785 - DNA, 25 bp, Mus musculus
ctgctgctccaggaaattgccaaac

SEQ ID NO: 274786 - DNA, 25 bp, Mus musculus
ctgctgctcctggaggctttggaaa

SEQ ID NO: 274787 - DNA, 25 bp, Mus musculus
ctgctgctcggagagcgggactacg

SEQ ID NO: 274788 - DNA, 25 bp, Mus musculus
ctgctgctcggcaatgatggcagtg

SEQ ID NO: 274789 - DNA, 25 bp, Mus musculus
ctgctgctcggcgctggagaatctg

SEQ ID NO: 274790 - DNA, 25 bp, Mus musculus
ctgctgctctggcaaggccagacct

SEQ ID NO: 274791 - DNA, 25 bp, Mus musculus
ctgctgctctgggtaaccaaggctc

SEQ ID NO: 274792 - DNA, 25 bp, Mus musculus
ctgctgctctgtaaagaagaagaat

SEQ ID NO: 274793 - DNA, 25 bp, Mus musculus
ctgctgctgaaagaaattagccgag

SEQ ID NO: 274794 - DNA, 25 bp, Mus musculus
ctgctgctgaagaacttttccagtc

SEQ ID NO: 274795 - DNA, 25 bp, Mus musculus
ctgctgctgaatttgaagtcctgaa

SEQ ID NO: 274796 - DNA, 25 bp, Mus musculus
ctgctgctgagcaaggatgaagatg

SEQ ID NO: 274797 - DNA, 25 bp, Mus musculus
ctgctgctgagtgagcgggtgagca

SEQ ID NO: 274798 - DNA, 25 bp, Mus musculus
ctgctgctgccagataaagatagag

SEQ ID NO: 274799 - DNA, 25 bp, Mus musculus
ctgctgctgcctccaggtggaggaa

SEQ ID NO: 274800 - DNA, 25 bp, Mus musculus
ctgctgctgctcggcgctggagaat

SEQ ID NO: 274801 - DNA, 25 bp, Mus musculus
ctgctgctgctgctggtcacgtgaa

SEQ ID NO: 274802 - DNA, 25 bp, Mus musculus
ctgctgctgctggaacgggttccag

SEQ ID NO: 274803 - DNA, 25 bp, Mus musculus
ctgctgctgctggcctctccggagt

SEQ ID NO: 274804 - DNA, 25 bp, Mus musculus
ctgctgctgctgggtgctggagagt

SEQ ID NO: 274805 - DNA, 25 bp, Mus musculus
ctgctgctgctggtcacgtgaagaa

SEQ ID NO: 274806 - DNA, 25 bp, Mus musculus
ctgctgctggccggtataactgcaa

SEQ ID NO: 274807 - DNA, 25 bp, Mus musculus
ctgctgctggcctctccggagtccc

SEQ ID NO: 274808 - DNA, 25 bp, Mus musculus
ctgctgctggctgggctggttcttc

SEQ ID NO: 274809 - DNA, 25 bp, Mus musculus
ctgctgctgggcgctgtctcagcct

SEQ ID NO: 274810 - DNA, 25 bp, Mus musculus
ctgctgctgggcttggttcctgcct

SEQ ID NO: 274811 - DNA, 25 bp, Mus musculus
ctgctgctgggtgctggagagtctg

SEQ ID NO: 274812 - DNA, 25 bp, Mus musculus
ctgctgctgtcactggtgctcctgg

SEQ ID NO: 274813 - DNA, 25 bp, Mus musculus
ctgctgctgtggaagctgggattct

SEQ ID NO: 274814 - DNA, 25 bp, Mus musculus
ctgctgctgtggaagtgtggcttct

SEQ ID NO: 274815 - DNA, 25 bp, Mus musculus
ctgctgcttctaggtgctggagagt

SEQ ID NO: 274816 - DNA, 25 bp, Mus musculus
ctgctgcttctcagtcaggatggct

SEQ ID NO: 274817 - DNA, 25 bp, Mus musculus
ctgctgcttctgccaagattacagt

SEQ ID NO: 274818 - DNA, 25 bp, Mus musculus
ctgctgcttctggatttatttatta

SEQ ID NO: 274819 - DNA, 25 bp, Mus musculus
ctgctgcttctggctggccggcctg

SEQ ID NO: 274820 - DNA, 25 bp, Mus musculus
ctgctgcttctgggtgccggtgaat

SEQ ID NO: 274821 - DNA, 25 bp, Mus musculus
ctgctgctttggctaccgctgcttc

SEQ ID NO: 274822 - DNA, 25 bp, Mus musculus
ctgctggaaaagccacacctgcgcc

SEQ ID NO: 274823 - DNA, 25 bp, Mus musculus
ctgctggaaaaggtacctgagattg

SEQ ID NO: 274824 - DNA, 25 bp, Mus musculus
ctgctggaaagagattgctctctca

SEQ ID NO: 274825 - DNA, 25 bp, Mus musculus
ctgctggaactaaaggaaggccctc

SEQ ID NO: 274826 - DNA, 25 bp, Mus musculus
ctgctggaaggagcagcggtcagca

SEQ ID NO: 274827 - DNA, 25 bp, Mus musculus
ctgctggaaggtgtgaccccacaac

SEQ ID NO: 274828 - DNA, 25 bp, Mus musculus
ctgctggaagtgagagggtccaagc

SEQ ID NO: 274829 - DNA, 25 bp, Mus musculus
ctgctggactccacgtggaacttag

SEQ ID NO: 274830 - DNA, 25 bp, Mus musculus
ctgctggactttcgttcagaaaatg

SEQ ID NO: 274831 - DNA, 25 bp, Mus musculus
ctgctggactttggttcagaaaatg

SEQ ID NO: 274832 - DNA, 25 bp, Mus musculus
ctgctggagaaagagtacttcttag

SEQ ID NO: 274833 - DNA, 25 bp, Mus musculus
ctgctggagagagggaaatctacaa

SEQ ID NO: 274834 - DNA, 25 bp, Mus musculus
ctgctggagaggttatcaatgctgc

SEQ ID NO: 274835 - DNA, 25 bp, Mus musculus
ctgctggagccagaagaacagacaa

SEQ ID NO: 274836 - DNA, 25 bp, Mus musculus
ctgctggagccagaaggtttggatt

SEQ ID NO: 274837 - DNA, 25 bp, Mus musculus
ctgctggagccagaggctgcattgt

SEQ ID NO: 274838 - DNA, 25 bp, Mus musculus
ctgctggagggctgcagtatggcgg

SEQ ID NO: 274839 - DNA, 25 bp, Mus musculus
ctgctggaggtacgaggatgtcgtc

SEQ ID NO: 274840 - DNA, 25 bp, Mus musculus
ctgctggagtccatcctgatggagt

SEQ ID NO: 274841 - DNA, 25 bp, Mus musculus
ctgctggagtccatgtttactgtct

SEQ ID NO: 274842 - DNA, 25 bp, Mus musculus
ctgctggagtgaggcctgccacccc

SEQ ID NO: 274843 - DNA, 25 bp, Mus musculus
ctgctggatcagaaaaggaagtgga

SEQ ID NO: 274844 - DNA, 25 bp, Mus musculus
ctgctggatcagaccctgaatctgt

SEQ ID NO: 274845 - DNA, 25 bp, Mus musculus
ctgctggatcagactaagagcagcg

SEQ ID NO: 274846 - DNA, 25 bp, Mus musculus
ctgctggatcagaggtatcctgtct

SEQ ID NO: 274847 - DNA, 25 bp, Mus musculus
ctgctggatcatgcacctccagaga

SEQ ID NO: 274848 - DNA, 25 bp, Mus musculus
ctgctggatgagattctggactttg

SEQ ID NO: 274849 - DNA, 25 bp, Mus musculus
ctgctggatgatcctagcaaacaga

SEQ ID NO: 274850 - DNA, 25 bp, Mus musculus
ctgctggatgatgaagttctcatca

SEQ ID NO: 274851 - DNA, 25 bp, Mus musculus
ctgctggatggctctgccttattct

SEQ ID NO: 274852 - DNA, 25 bp, Mus musculus
ctgctggattcgatgatatggaagg

SEQ ID NO: 274853 - DNA, 25 bp, Mus musculus
ctgctggcaagaacttgacctcatg

SEQ ID NO: 274854 - DNA, 25 bp, Mus musculus
ctgctggcagaagctggaatgcctt

SEQ ID NO: 274855 - DNA, 25 bp, Mus musculus
ctgctggcagagaagcaacatggct

SEQ ID NO: 274856 - DNA, 25 bp, Mus musculus
ctgctggcagagaagcaataccaca

SEQ ID NO: 274857 - DNA, 25 bp, Mus musculus
ctgctggcagcaatgctggctttca

SEQ ID NO: 274858 - DNA, 25 bp, Mus musculus
ctgctggcagcctccggacccctcc

SEQ ID NO: 274859 - DNA, 25 bp, Mus musculus
ctgctggcaggtcgcttctccgatt

SEQ ID NO: 274860 - DNA, 25 bp, Mus musculus
ctgctggccaaaataccgactggaa

SEQ ID NO: 274861 - DNA, 25 bp, Mus musculus
ctgctggccaatgacactctgaaca

SEQ ID NO: 274862 - DNA, 25 bp, Mus musculus
ctgctggccagatagacaggaaaat

SEQ ID NO: 274863 - DNA, 25 bp, Mus musculus
ctgctggccagggtttaacgtttac

SEQ ID NO: 274864 - DNA, 25 bp, Mus musculus
ctgctggccgcacttggttacaaga

SEQ ID NO: 274865 - DNA, 25 bp, Mus musculus
ctgctggccggcattgaatgtccca

SEQ ID NO: 274866 - DNA, 25 bp, Mus musculus
ctgctggccggtataactgcaaccc

SEQ ID NO: 274867 - DNA, 25 bp, Mus musculus
ctgctggctaagaggagaaaggcag

SEQ ID NO: 274868 - DNA, 25 bp, Mus musculus
ctgctggctcttaagatcttctgtg

SEQ ID NO: 274869 - DNA, 25 bp, Mus musculus
ctgctggctgagaaaatggctgttg

SEQ ID NO: 274870 - DNA, 25 bp, Mus musculus
ctgctggctggcggggtgccacggc

SEQ ID NO: 274871 - DNA, 25 bp, Mus musculus
ctgctggctgggctggttcttctga

SEQ ID NO: 274872 - DNA, 25 bp, Mus musculus
ctgctgggaaaggaaggatttaatg

SEQ ID NO: 274873 - DNA, 25 bp, Mus musculus
ctgctgggaaagtccagatagtatc

SEQ ID NO: 274874 - DNA, 25 bp, Mus musculus
ctgctgggaagatgagccagatagc

SEQ ID NO: 274875 - DNA, 25 bp, Mus musculus
ctgctgggaaggatctggttctaca

SEQ ID NO: 274876 - DNA, 25 bp, Mus musculus
ctgctgggaagggagagcacctggc

SEQ ID NO: 274877 - DNA, 25 bp, Mus musculus
ctgctgggaagtccgcccgtgctgt

SEQ ID NO: 274878 - DNA, 25 bp, Mus musculus
ctgctgggatccagaatttggggtg

SEQ ID NO: 274879 - DNA, 25 bp, Mus musculus
ctgctgggattaatgatgctctcca

SEQ ID NO: 274880 - DNA, 25 bp, Mus musculus
ctgctgggcagctccagatgaaaat

SEQ ID NO: 274881 - DNA, 25 bp, Mus musculus
ctgctgggcgctgtctcagcctctc

SEQ ID NO: 274882 - DNA, 25 bp, Mus musculus
ctgctgggctcagagggagtggggc

SEQ ID NO: 274883 - DNA, 25 bp, Mus musculus
ctgctgggcttggttcctgcctcaa

SEQ ID NO: 274884 - DNA, 25 bp, Mus musculus
ctgctgggcttgtgtcttccaaaat

SEQ ID NO: 274885 - DNA, 25 bp, Mus musculus
ctgctggggaacatggaaagctgcc

SEQ ID NO: 274886 - DNA, 25 bp, Mus musculus
ctgctggggtccagctgtcaccctg

SEQ ID NO: 274887 - DNA, 25 bp, Mus musculus
ctgctggggtccagggaaaggctcg

SEQ ID NO: 274888 - DNA, 25 bp, Mus musculus
ctgctgggtcaggactaatgtaatt

SEQ ID NO: 274889 - DNA, 25 bp, Mus musculus
ctgctgggtcagggataaaaagagc

SEQ ID NO: 274890 - DNA, 25 bp, Mus musculus
ctgctgggtcaggtcaggaagcagg

SEQ ID NO: 274891 - DNA, 25 bp, Mus musculus
ctgctggtagatgctgacggctaga

SEQ ID NO: 274892 - DNA, 25 bp, Mus musculus
ctgctggtagatggtgactagagga

SEQ ID NO: 274893 - DNA, 25 bp, Mus musculus
ctgctggtcagagaattgaccttgc

SEQ ID NO: 274894 - DNA, 25 bp, Mus musculus
ctgctggtcagctctgcaatctgag

SEQ ID NO: 274895 - DNA, 25 bp, Mus musculus
ctgctggtcaggcagagttcacggc

SEQ ID NO: 274896 - DNA, 25 bp, Mus musculus
ctgctggtcattaagggaaagatgg

SEQ ID NO: 274897 - DNA, 25 bp, Mus musculus
ctgctggtccccctggtgctactgg

SEQ ID NO: 274898 - DNA, 25 bp, Mus musculus
ctgctggtgagaggaagctttgtct

SEQ ID NO: 274899 - DNA, 25 bp, Mus musculus
ctgctggtgctcaggcattgcagct

SEQ ID NO: 274900 - DNA, 25 bp, Mus musculus
ctgctggtgctgctggtgctcgggg

SEQ ID NO: 274901 - DNA, 25 bp, Mus musculus
ctgctggtggctcagtttctacagt

SEQ ID NO: 274902 - DNA, 25 bp, Mus musculus
ctgctggtggctcagtttcttcggc

SEQ ID NO: 274903 - DNA, 25 bp, Mus musculus
ctgctggtgggcaggtgtgctgatg

SEQ ID NO: 274904 - DNA, 25 bp, Mus musculus
ctgctggtgggcagtggagaaaaat

SEQ ID NO: 274905 - DNA, 25 bp, Mus musculus
ctgctggtggtgaactaaagcaccg

SEQ ID NO: 274906 - DNA, 25 bp, Mus musculus
ctgctggtggtgaactgctgtatct

SEQ ID NO: 274907 - DNA, 25 bp, Mus musculus
ctgctggtggtgaagtatatcatgt

SEQ ID NO: 274908 - DNA, 25 bp, Mus musculus
ctgctggtttatttacaccaagctg

SEQ ID NO: 274909 - DNA, 25 bp, Mus musculus
ctgctgtaaaggctggctactgttt

SEQ ID NO: 274910 - DNA, 25 bp, Mus musculus
ctgctgtaaatgaaggaatatgctc

SEQ ID NO: 274911 - DNA, 25 bp, Mus musculus
ctgctgtacgcgtcttgttggagat

SEQ ID NO: 274912 - DNA, 25 bp, Mus musculus
ctgctgtacgcgtgccggaattgcg

SEQ ID NO: 274913 - DNA, 25 bp, Mus musculus
ctgctgtacggtagcagatatcaaa

SEQ ID NO: 274914 - DNA, 25 bp, Mus musculus
ctgctgtacgtgagtcagccggcag

SEQ ID NO: 274915 - DNA, 25 bp, Mus musculus
ctgctgtataccctggtcagcctgc

SEQ ID NO: 274916 - DNA, 25 bp, Mus musculus
ctgctgtataccggtcagctgctgg

SEQ ID NO: 274917 - DNA, 25 bp, Mus musculus
ctgctgtatgcccttctctaggaag

SEQ ID NO: 274918 - DNA, 25 bp, Mus musculus
ctgctgtatgggtggtctatcacac

SEQ ID NO: 274919 - DNA, 25 bp, Mus musculus
ctgctgtatggtgcccagcacggcc

SEQ ID NO: 274920 - DNA, 25 bp, Mus musculus
ctgctgtatttcccacaggtttttg

SEQ ID NO: 274921 - DNA, 25 bp, Mus musculus
ctgctgtatttctcacagatctttg

SEQ ID NO: 274922 - DNA, 25 bp, Mus musculus
ctgctgtcaacggggtctcattctt

SEQ ID NO: 274923 - DNA, 25 bp, Mus musculus
ctgctgtcaatgggagccggtgaag

SEQ ID NO: 274924 - DNA, 25 bp, Mus musculus
ctgctgtcactggtgctcctggctc

SEQ ID NO: 274925 - DNA, 25 bp, Mus musculus
ctgctgtcaggtacaggtcaagttc

SEQ ID NO: 274926 - DNA, 25 bp, Mus musculus
ctgctgtcatggaggtttatcacca

SEQ ID NO: 274927 - DNA, 25 bp, Mus musculus
ctgctgtccaagttggggctcgctg

SEQ ID NO: 274928 - DNA, 25 bp, Mus musculus
ctgctgtccacaggtccacggtgtg

SEQ ID NO: 274929 - DNA, 25 bp, Mus musculus
ctgctgtcccaggtgctcctggtca

SEQ ID NO: 274930 - DNA, 25 bp, Mus musculus
ctgctgtcctagggacaaagtatag

SEQ ID NO: 274931 - DNA, 25 bp, Mus musculus
ctgctgtcctaggggctcaaggaac

SEQ ID NO: 274932 - DNA, 25 bp, Mus musculus
ctgctgtcctatgcttcccatgatg

SEQ ID NO: 274933 - DNA, 25 bp, Mus musculus
ctgctgtcctgaggattcggccctt

SEQ ID NO: 274934 - DNA, 25 bp, Mus musculus
ctgctgtccttcctgcttagacgcc

SEQ ID NO: 274935 - DNA, 25 bp, Mus musculus
ctgctgtctccaggtgacattccaa

SEQ ID NO: 274936 - DNA, 25 bp, Mus musculus
ctgctgtctgcaaggagaagatcgg

SEQ ID NO: 274937 - DNA, 25 bp, Mus musculus
ctgctgtctgtgaacaaatctacca

SEQ ID NO: 274938 - DNA, 25 bp, Mus musculus
ctgctgtctgtgcagtactccagga

SEQ ID NO: 274939 - DNA, 25 bp, Mus musculus
ctgctgtgaaatcttctattccaag

SEQ ID NO: 274940 - DNA, 25 bp, Mus musculus
ctgctgtgagtgcccgctatggaca

SEQ ID NO: 274941 - DNA, 25 bp, Mus musculus
ctgctgtgcagctttttagaacttc

SEQ ID NO: 274942 - DNA, 25 bp, Mus musculus
ctgctgtgctctcctgctatgcagt

SEQ ID NO: 274943 - DNA, 25 bp, Mus musculus
ctgctgtgcttgaggtgattgaaga

SEQ ID NO: 274944 - DNA, 25 bp, Mus musculus
ctgctgtggaagctgggattcttca

SEQ ID NO: 274945 - DNA, 25 bp, Mus musculus
ctgctgtggaagtgtggcttcttcc

SEQ ID NO: 274946 - DNA, 25 bp, Mus musculus
ctgctgtggacaagaaaggtgacac

SEQ ID NO: 274947 - DNA, 25 bp, Mus musculus
ctgctgtgggaacttatttagaagt

SEQ ID NO: 274948 - DNA, 25 bp, Mus musculus
ctgctgtgggcagggtgcctggcta

SEQ ID NO: 274949 - DNA, 25 bp, Mus musculus
ctgctgttaaggaagaagagctgga

SEQ ID NO: 274950 - DNA, 25 bp, Mus musculus
ctgctgttacctcttatgccctgct

SEQ ID NO: 274951 - DNA, 25 bp, Mus musculus
ctgctgttacctcttctggctcatc

SEQ ID NO: 274952 - DNA, 25 bp, Mus musculus
ctgctgttcagccagggacagtggc

SEQ ID NO: 274953 - DNA, 25 bp, Mus musculus
ctgctgttcagtcaaggacagtggc

SEQ ID NO: 274954 - DNA, 25 bp, Mus musculus
ctgctgttcctgattatctattatc

SEQ ID NO: 274955 - DNA, 25 bp, Mus musculus
ctgctgttctggctagccggatcag

SEQ ID NO: 274956 - DNA, 25 bp, Mus musculus
ctgctgttgctcggtgcgggcgagt

SEQ ID NO: 274957 - DNA, 25 bp, Mus musculus
ctgctgtttcctcctaggatgtcag

SEQ ID NO: 274958 - DNA, 25 bp, Mus musculus
ctgctgttttgaagattaaaggttg

SEQ ID NO: 274959 - DNA, 25 bp, Mus musculus
ctgcttaaaatcaggaaattttgcc

SEQ ID NO: 274960 - DNA, 25 bp, Mus musculus
ctgcttaaaatcaggcagggagaag

SEQ ID NO: 274961 - DNA, 25 bp, Mus musculus
ctgcttaaaatttggattcctgtct

SEQ ID NO: 274962 - DNA, 25 bp, Mus musculus
ctgcttaaacaaggtgattctgctg

SEQ ID NO: 274963 - DNA, 25 bp, Mus musculus
ctgcttaagagaaggtgttaggagt

SEQ ID NO: 274964 - DNA, 25 bp, Mus musculus
ctgcttaatagatcacaactggcta

SEQ ID NO: 274965 - DNA, 25 bp, Mus musculus
ctgcttaatgaaaagtatttttctg

SEQ ID NO: 274966 - DNA, 25 bp, Mus musculus
ctgcttacaggaagccgagataccc

SEQ ID NO: 274967 - DNA, 25 bp, Mus musculus
ctgcttacccgccgcagctccggag

SEQ ID NO: 274968 - DNA, 25 bp, Mus musculus
ctgcttacccggtacctggcagcat

SEQ ID NO: 274969 - DNA, 25 bp, Mus musculus
ctgcttaccggtatgacccatatgg

SEQ ID NO: 274970 - DNA, 25 bp, Mus musculus
ctgcttacgctcagacagtccaggg

SEQ ID NO: 274971 - DNA, 25 bp, Mus musculus
ctgcttactggtttctctcgaagat

SEQ ID NO: 274972 - DNA, 25 bp, Mus musculus
ctgcttactggtttctgtctgatga

SEQ ID NO: 274973 - DNA, 25 bp, Mus musculus
ctgcttactgtgagcgtgcaatgat

SEQ ID NO: 274974 - DNA, 25 bp, Mus musculus
ctgcttagagagttttgtcaagagt

SEQ ID NO: 274975 - DNA, 25 bp, Mus musculus
ctgcttagcataaaggcatttacac

SEQ ID NO: 274976 - DNA, 25 bp, Mus musculus
ctgcttataagactgaagagggaac

SEQ ID NO: 274977 - DNA, 25 bp, Mus musculus
ctgcttataagagagcttcatggag

SEQ ID NO: 274978 - DNA, 25 bp, Mus musculus
ctgcttataaggacccatagatgaa

SEQ ID NO: 274979 - DNA, 25 bp, Mus musculus
ctgcttataaggtgcacacaggacg

SEQ ID NO: 274980 - DNA, 25 bp, Mus musculus
ctgcttatggagaccacacaggagg

SEQ ID NO: 274981 - DNA, 25 bp, Mus musculus
ctgcttcaagaggcttggctttctg

SEQ ID NO: 274982 - DNA, 25 bp, Mus musculus
ctgcttcaagcagcatgattgggct

SEQ ID NO: 274983 - DNA, 25 bp, Mus musculus
ctgcttcaagcagcgttccacgcct

SEQ ID NO: 274984 - DNA, 25 bp, Mus musculus
ctgcttcaagcagtgtggcattgtc

SEQ ID NO: 274985 - DNA, 25 bp, Mus musculus
ctgcttcaccaccacctccaaagac

SEQ ID NO: 274986 - DNA, 25 bp, Mus musculus
ctgcttcagggagacacacctgcaa

SEQ ID NO: 274987 - DNA, 25 bp, Mus musculus
ctgcttcagtctcgttcgagaaatg

SEQ ID NO: 274988 - DNA, 25 bp, Mus musculus
ctgcttcatctgtggcctggagaga

SEQ ID NO: 274989 - DNA, 25 bp, Mus musculus
ctgcttcatggactggtgtccaaag

SEQ ID NO: 274990 - DNA, 25 bp, Mus musculus
ctgcttcatgtctggatgtgtctag

SEQ ID NO: 274991 - DNA, 25 bp, Mus musculus
ctgcttccaaagcagatcctggagt

SEQ ID NO: 274992 - DNA, 25 bp, Mus musculus
ctgcttccacagccggagagtcaaa

SEQ ID NO: 274993 - DNA, 25 bp, Mus musculus
ctgcttccacctgtcacagcaaact

SEQ ID NO: 274994 - DNA, 25 bp, Mus musculus
ctgcttccagcagaataacaacaag

SEQ ID NO: 274995 - DNA, 25 bp, Mus musculus
ctgcttccagcccctatgttactac

SEQ ID NO: 274996 - DNA, 25 bp, Mus musculus
ctgcttccaggcttttatttgtggg

SEQ ID NO: 274997 - DNA, 25 bp, Mus musculus
ctgcttccatccgagattgagcttg

SEQ ID NO: 274998 - DNA, 25 bp, Mus musculus
ctgcttccatccgagcctgacctga

SEQ ID NO: 274999 - DNA, 25 bp, Mus musculus
ctgcttccatccgagtggcagcaag

SEQ ID NO: 275000 - DNA, 25 bp, Mus musculus
ctgcttcccaggctaaggagaaggc

SEQ ID NO: 275001 - DNA, 25 bp, Mus musculus
ctgcttccccagagaacacagcagg

SEQ ID NO: 275002 - DNA, 25 bp, Mus musculus
ctgcttccctctttccatgaagtct

SEQ ID NO: 275003 - DNA, 25 bp, Mus musculus
ctgcttccctgtgctggtccacagg

SEQ ID NO: 275004 - DNA, 25 bp, Mus musculus
ctgcttccctgtggtattattcagg

SEQ ID NO: 275005 - DNA, 25 bp, Mus musculus
ctgcttccgggtgttggaaggacaa

SEQ ID NO: 275006 - DNA, 25 bp, Mus musculus
ctgcttccgttaaaggtcacacaac

SEQ ID NO: 275007 - DNA, 25 bp, Mus musculus
ctgcttcctcaagctggcagcagtg

SEQ ID NO: 275008 - DNA, 25 bp, Mus musculus
ctgcttcctgccacagcacccacat

SEQ ID NO: 275009 - DNA, 25 bp, Mus musculus
ctgcttccttcatccgctctgcttt

SEQ ID NO: 275010 - DNA, 25 bp, Mus musculus
ctgcttcgaagaaagaagatggacg

SEQ ID NO: 275011 - DNA, 25 bp, Mus musculus
ctgcttcgtcccatggtccttcaga

SEQ ID NO: 275012 - DNA, 25 bp, Mus musculus
ctgcttctaagactctgaattcggt

SEQ ID NO: 275013 - DNA, 25 bp, Mus musculus
ctgcttctaggtgctggagagtctg

SEQ ID NO: 275014 - DNA, 25 bp, Mus musculus
ctgcttctatgaggttgactgtggg

SEQ ID NO: 275015 - DNA, 25 bp, Mus musculus
ctgcttctcagtcaggatggctaaa

SEQ ID NO: 275016 - DNA, 25 bp, Mus musculus
ctgcttctcggttcagcatgggctc

SEQ ID NO: 275017 - DNA, 25 bp, Mus musculus
ctgcttctcgttggtgcctttgtgc

SEQ ID NO: 275018 - DNA, 25 bp, Mus musculus
ctgcttctctgggtctgtgaactcg

SEQ ID NO: 275019 - DNA, 25 bp, Mus musculus
ctgcttctgcagaaggtttcaacac

SEQ ID NO: 275020 - DNA, 25 bp, Mus musculus
ctgcttctgccaagattacagtagc

SEQ ID NO: 275021 - DNA, 25 bp, Mus musculus
ctgcttctgccttgtccccacagag

SEQ ID NO: 275022 - DNA, 25 bp, Mus musculus
ctgcttctgcgggtgcttctgtttc

SEQ ID NO: 275023 - DNA, 25 bp, Mus musculus
ctgcttctggagggtgatgcccacg

SEQ ID NO: 275024 - DNA, 25 bp, Mus musculus
ctgcttctggatttatttattatta

SEQ ID NO: 275025 - DNA, 25 bp, Mus musculus
ctgcttctggctggccggcctggct

SEQ ID NO: 275026 - DNA, 25 bp, Mus musculus
ctgcttctgggtgccggtgaatccg

SEQ ID NO: 275027 - DNA, 25 bp, Mus musculus
ctgcttctgtatcaagatattatct

SEQ ID NO: 275028 - DNA, 25 bp, Mus musculus
ctgcttctgtgctaacctcaggagg

SEQ ID NO: 275029 - DNA, 25 bp, Mus musculus
ctgcttcttcacgtgacctgacagt

SEQ ID NO: 275030 - DNA, 25 bp, Mus musculus
ctgcttcttgaaaggaactctgttg

SEQ ID NO: 275031 - DNA, 25 bp, Mus musculus
ctgcttgaaaagacactgagtcctc

SEQ ID NO: 275032 - DNA, 25 bp, Mus musculus
ctgcttgacaacaagcctgaccacc

SEQ ID NO: 275033 - DNA, 25 bp, Mus musculus
ctgcttgagcgcggcatccagccag

SEQ ID NO: 275034 - DNA, 25 bp, Mus musculus
ctgcttgagtccaggttcacattga

SEQ ID NO: 275035 - DNA, 25 bp, Mus musculus
ctgcttgcaaaggtggtacccggga

SEQ ID NO: 275036 - DNA, 25 bp, Mus musculus
ctgcttgcagacctgatgcaacaga

SEQ ID NO: 275037 - DNA, 25 bp, Mus musculus
ctgcttgcaggcgatcctaaagagg

SEQ ID NO: 275038 - DNA, 25 bp, Mus musculus
ctgcttgcaggtggctttgctgagt

SEQ ID NO: 275039 - DNA, 25 bp, Mus musculus
ctgcttgcgaggcaggaaacagcct

SEQ ID NO: 275040 - DNA, 25 bp, Mus musculus
ctgcttgcgagggtgacacttccca

SEQ ID NO: 275041 - DNA, 25 bp, Mus musculus
ctgcttgcggtcacctctgtcttcc

SEQ ID NO: 275042 - DNA, 25 bp, Mus musculus
ctgcttgctcatcccagcctgcttt

SEQ ID NO: 275043 - DNA, 25 bp, Mus musculus
ctgcttggaaggctgcccaccaaga

SEQ ID NO: 275044 - DNA, 25 bp, Mus musculus
ctgcttggagtacaaggttctgctg

SEQ ID NO: 275045 - DNA, 25 bp, Mus musculus
ctgcttggataagattaatgtcctt

SEQ ID NO: 275046 - DNA, 25 bp, Mus musculus
ctgcttggatgaactgtatgacatc

SEQ ID NO: 275047 - DNA, 25 bp, Mus musculus
ctgcttggattacaggtgaccagga

SEQ ID NO: 275048 - DNA, 25 bp, Mus musculus
ctgcttggattacaggtggtgctct

SEQ ID NO: 275049 - DNA, 25 bp, Mus musculus
ctgcttggggtttgcccagatgggg

SEQ ID NO: 275050 - DNA, 25 bp, Mus musculus
ctgcttggtcctaaggccctttttg

SEQ ID NO: 275051 - DNA, 25 bp, Mus musculus
ctgcttgtaaggcatctcagaagga

SEQ ID NO: 275052 - DNA, 25 bp, Mus musculus
ctgcttgtataagctggaaaacagg

SEQ ID NO: 275053 - DNA, 25 bp, Mus musculus
ctgcttgtcaacaggaggagccatg

SEQ ID NO: 275054 - DNA, 25 bp, Mus musculus
ctgcttgtcaacagggtccaggtgc

SEQ ID NO: 275055 - DNA, 25 bp, Mus musculus
ctgcttgtgagaagaaatggaaatg

SEQ ID NO: 275056 - DNA, 25 bp, Mus musculus
ctgcttgtgggccaccccttccacc

SEQ ID NO: 275057 - DNA, 25 bp, Mus musculus
ctgcttgtgtcgggaatgtgtttct

SEQ ID NO: 275058 - DNA, 25 bp, Mus musculus
ctgcttgtgtggacgctcgaattat

SEQ ID NO: 275059 - DNA, 25 bp, Mus musculus
ctgctttaaacatggtaccgggtgc

SEQ ID NO: 275060 - DNA, 25 bp, Mus musculus
ctgctttaaacatgtacccctctat

SEQ ID NO: 275061 - DNA, 25 bp, Mus musculus
ctgctttaaacctaaacagaatata

SEQ ID NO: 275062 - DNA, 25 bp, Mus musculus
ctgctttaaacgacctgatctctgc

SEQ ID NO: 275063 - DNA, 25 bp, Mus musculus
ctgctttaaacgtcgattgagtgat

SEQ ID NO: 275064 - DNA, 25 bp, Mus musculus
ctgctttacagatcgctgtggagaa

SEQ ID NO: 275065 - DNA, 25 bp, Mus musculus
ctgctttacagctgacttggagctg

SEQ ID NO: 275066 - DNA, 25 bp, Mus musculus
ctgctttaccagaccatagaatcca

SEQ ID NO: 275067 - DNA, 25 bp, Mus musculus
ctgctttaccagagcaaggcttaga

SEQ ID NO: 275068 - DNA, 25 bp, Mus musculus
ctgctttatgaccctctggagatct

SEQ ID NO: 275069 - DNA, 25 bp, Mus musculus
ctgctttcaagaaaggcgacagggt

SEQ ID NO: 275070 - DNA, 25 bp, Mus musculus
ctgctttccagcaagccccgcccaa

SEQ ID NO: 275071 - DNA, 25 bp, Mus musculus
ctgctttcctggaaaattgttgtgt

SEQ ID NO: 275072 - DNA, 25 bp, Mus musculus
ctgctttcctgggaaggtgtgaacc

SEQ ID NO: 275073 - DNA, 25 bp, Mus musculus
ctgctttctatccctgtgcacatgt

SEQ ID NO: 275074 - DNA, 25 bp, Mus musculus
ctgctttgcacacagatggagtggc

SEQ ID NO: 275075 - DNA, 25 bp, Mus musculus
ctgctttgcggactttgaatgtgga

SEQ ID NO: 275076 - DNA, 25 bp, Mus musculus
ctgctttgcggtactggaattgcag

SEQ ID NO: 275077 - DNA, 25 bp, Mus musculus
ctgctttggactcagaggcttgctg

SEQ ID NO: 275078 - DNA, 25 bp, Mus musculus
ctgctttgttctgaggtgacgccat

SEQ ID NO: 275079 - DNA, 25 bp, Mus musculus
ctgcttttaagtaacggcacagcca

SEQ ID NO: 275080 - DNA, 25 bp, Mus musculus
ctgcttttagcccagatagtcgcca

SEQ ID NO: 275081 - DNA, 25 bp, Mus musculus
ctgcttttataagacaggaaaagac

SEQ ID NO: 275082 - DNA, 25 bp, Mus musculus
ctgcttttataagatgaagacagga

SEQ ID NO: 275083 - DNA, 25 bp, Mus musculus
ctgcttttataagtctttgcagatt

SEQ ID NO: 275084 - DNA, 25 bp, Mus musculus
ctgcttttcatctggagactgctca

SEQ ID NO: 275085 - DNA, 25 bp, Mus musculus
ctgcttttcatctggagagtctgca

SEQ ID NO: 275086 - DNA, 25 bp, Mus musculus
ctgcttttcctcagattgtctaaag

SEQ ID NO: 275087 - DNA, 25 bp, Mus musculus
ctgcttttgaggagttccactccag

SEQ ID NO: 275088 - DNA, 25 bp, Mus musculus
ctgcttttgccctctccgctccctg

SEQ ID NO: 275089 - DNA, 25 bp, Mus musculus
ctgcttttgtctgctgcccatcatt

SEQ ID NO: 275090 - DNA, 25 bp, Mus musculus
ctgctttttaggaccttgttccttg

SEQ ID NO: 275091 - DNA, 25 bp, Mus musculus
ctgctttttagtggtgatcatgtgt

SEQ ID NO: 275092 - DNA, 25 bp, Mus musculus
ctgctttttctcaggtgccttcagt

SEQ ID NO: 275093 - DNA, 25 bp, Mus musculus
ctgctttttggagaggacgacctag

SEQ ID NO: 275094 - DNA, 25 bp, Mus musculus
ctggaaaaaggacaggtgcagtcag

SEQ ID NO: 275095 - DNA, 25 bp, Mus musculus
ctggaaaaaggataggtgcggtcag

SEQ ID NO: 275096 - DNA, 25 bp, Mus musculus
ctggaaaaattaaccacatgagata

SEQ ID NO: 275097 - DNA, 25 bp, Mus musculus
ctggaaaacacagccatcaccatcg

SEQ ID NO: 275098 - DNA, 25 bp, Mus musculus
ctggaaaacacaggtcgcctgacga

SEQ ID NO: 275099 - DNA, 25 bp, Mus musculus
ctggaaaacagatttattcttcatt

SEQ ID NO: 275100 - DNA, 25 bp, Mus musculus
ctggaaaacagctttcctagcaaga

SEQ ID NO: 275101 - DNA, 25 bp, Mus musculus
ctggaaaacaggcccacagaacatg

SEQ ID NO: 275102 - DNA, 25 bp, Mus musculus
ctggaaaacagtgaaggcccacggt

SEQ ID NO: 275103 - DNA, 25 bp, Mus musculus
ctggaaaacgaagaaatgattctgg

SEQ ID NO: 275104 - DNA, 25 bp, Mus musculus
ctggaaaagaactactgccgaaacc

SEQ ID NO: 275105 - DNA, 25 bp, Mus musculus
ctggaaaagatgaaggagcttcata

SEQ ID NO: 275106 - DNA, 25 bp, Mus musculus
ctggaaaagatgaaggggatggtaa

SEQ ID NO: 275107 - DNA, 25 bp, Mus musculus
ctggaaaagcaactggatgaactgc

SEQ ID NO: 275108 - DNA, 25 bp, Mus musculus
ctggaaaagccgctggacgactctg

SEQ ID NO: 275109 - DNA, 25 bp, Mus musculus
ctggaaaagccgtcccgcacggtga

SEQ ID NO: 275110 - DNA, 25 bp, Mus musculus
ctggaaaagcgagctgggagaacag

SEQ ID NO: 275111 - DNA, 25 bp, Mus musculus
ctggaaaagcgaggccttggaacag

SEQ ID NO: 275112 - DNA, 25 bp, Mus musculus
ctggaaaagtcaggctattgacctt

SEQ ID NO: 275113 - DNA, 25 bp, Mus musculus
ctggaaaatacagagcatacgatgc

SEQ ID NO: 275114 - DNA, 25 bp, Mus musculus
ctggaaaatacagatctgtgtcagc

SEQ ID NO: 275115 - DNA, 25 bp, Mus musculus
ctggaaaatatcaggaagcagtgca

SEQ ID NO: 275116 - DNA, 25 bp, Mus musculus
ctggaaaatgccactccgtgtatca

SEQ ID NO: 275117 - DNA, 25 bp, Mus musculus
ctggaaaatgccatcgagacacaga

SEQ ID NO: 275118 - DNA, 25 bp, Mus musculus
ctggaaaatggtggtggcttggtgg

SEQ ID NO: 275119 - DNA, 25 bp, Mus musculus
ctggaaacaaatgagatattctcct

SEQ ID NO: 275120 - DNA, 25 bp, Mus musculus
ctggaaacaagataaaacaaaatta

SEQ ID NO: 275121 - DNA, 25 bp, Mus musculus
ctggaaacacagccggatgttcttt

SEQ ID NO: 275122 - DNA, 25 bp, Mus musculus
ctggaaaccaggaagtgagtgcctt

SEQ ID NO: 275123 - DNA, 25 bp, Mus musculus
ctggaaaccaggagaacagtacgga

SEQ ID NO: 275124 - DNA, 25 bp, Mus musculus
ctggaaaccagggatcctggtaggg

SEQ ID NO: 275125 - DNA, 25 bp, Mus musculus
ctggaaacgactacatcgaccagct

SEQ ID NO: 275126 - DNA, 25 bp, Mus musculus
ctggaaacgacttgtaccaggggct

SEQ ID NO: 275127 - DNA, 25 bp, Mus musculus
ctggaaacggattttggcaagtcaa

SEQ ID NO: 275128 - DNA, 25 bp, Mus musculus
ctggaaagagaaaacatcgctctca

SEQ ID NO: 275129 - DNA, 25 bp, Mus musculus
ctggaaagagagaaggggaacagcc

SEQ ID NO: 275130 - DNA, 25 bp, Mus musculus
ctggaaagagatggctgtctcaaat

SEQ ID NO: 275131 - DNA, 25 bp, Mus musculus
ctggaaagccaggaataagatgtca

SEQ ID NO: 275132 - DNA, 25 bp, Mus musculus
ctggaaagccaggacgttaaaggat

SEQ ID NO: 275133 - DNA, 25 bp, Mus musculus
ctggaaaggaacaggtatgtcactg

SEQ ID NO: 275134 - DNA, 25 bp, Mus musculus
ctggaaaggaagaggagccgctgct

SEQ ID NO: 275135 - DNA, 25 bp, Mus musculus
ctggaaaggagtatgtttgtcctgg

SEQ ID NO: 275136 - DNA, 25 bp, Mus musculus
ctggaaaggagtattgcaagaagaa

SEQ ID NO: 275137 - DNA, 25 bp, Mus musculus
ctggaaaggtcgaggaccaaactct

SEQ ID NO: 275138 - DNA, 25 bp, Mus musculus
ctggaaagtgagttacatgaacatg

SEQ ID NO: 275139 - DNA, 25 bp, Mus musculus
ctggaaagtgtggagagcctcaagt

SEQ ID NO: 275140 - DNA, 25 bp, Mus musculus
ctggaaagttaggaagaagagctgg

SEQ ID NO: 275141 - DNA, 25 bp, Mus musculus
ctggaaagttggggttcacggctgg

SEQ ID NO: 275142 - DNA, 25 bp, Mus musculus
ctggaaataacaaagatgctactac

SEQ ID NO: 275143 - DNA, 25 bp, Mus musculus
ctggaaataacaaaggctcaccatc

SEQ ID NO: 275144 - DNA, 25 bp, Mus musculus
ctggaaataaggccgttgactactt

SEQ ID NO: 275145 - DNA, 25 bp, Mus musculus
ctggaaatacccggccccagcctgc

SEQ ID NO: 275146 - DNA, 25 bp, Mus musculus
ctggaaatgtagggtaagggtcgtc

SEQ ID NO: 275147 - DNA, 25 bp, Mus musculus
ctggaaatgtaggtggttgtgagcc

SEQ ID NO: 275148 - DNA, 25 bp, Mus musculus
ctggaacaacagaaaatcaatcttt

SEQ ID NO: 275149 - DNA, 25 bp, Mus musculus
ctggaacaacaggtcctcagaatgg

SEQ ID NO: 275150 - DNA, 25 bp, Mus musculus
ctggaacaacccgcaatactggagt

SEQ ID NO: 275151 - DNA, 25 bp, Mus musculus
ctggaacaacgcgggggaccttatg

SEQ ID NO: 275152 - DNA, 25 bp, Mus musculus
ctggaacacaaaacgaaacctcgtg

SEQ ID NO: 275153 - DNA, 25 bp, Mus musculus
ctggaacagctggacatgcgccggg

SEQ ID NO: 275154 - DNA, 25 bp, Mus musculus
ctggaacagctgggctccctttcct

SEQ ID NO: 275155 - DNA, 25 bp, Mus musculus
ctggaacagctgtgtcactacttcg

SEQ ID NO: 275156 - DNA, 25 bp, Mus musculus
ctggaacaggaaggttcatatggga

SEQ ID NO: 275157 - DNA, 25 bp, Mus musculus
ctggaacaggaggagctgatccgag

SEQ ID NO: 275158 - DNA, 25 bp, Mus musculus
ctggaacatattggctccctgaccc

SEQ ID NO: 275159 - DNA, 25 bp, Mus musculus
ctggaaccaaggtgatgaatctttc

SEQ ID NO: 275160 - DNA, 25 bp, Mus musculus
ctggaaccacagggagttaatgagg

SEQ ID NO: 275161 - DNA, 25 bp, Mus musculus
ctggaaccaggcacggctggagcga

SEQ ID NO: 275162 - DNA, 25 bp, Mus musculus
ctggaacccaaaagatcttcccctg

SEQ ID NO: 275163 - DNA, 25 bp, Mus musculus
ctggaacccatcagatcttcccctg

SEQ ID NO: 275164 - DNA, 25 bp, Mus musculus
ctggaaccctctagcacctaaagga

SEQ ID NO: 275165 - DNA, 25 bp, Mus musculus
ctggaaccctctgtgcagagaggtg

SEQ ID NO: 275166 - DNA, 25 bp, Mus musculus
ctggaaccgcccagggttcgctgat

SEQ ID NO: 275167 - DNA, 25 bp, Mus musculus
ctggaaccgcccaggtgctttttga

SEQ ID NO: 275168 - DNA, 25 bp, Mus musculus
ctggaacctgatctaacaaacatga

SEQ ID NO: 275169 - DNA, 25 bp, Mus musculus
ctggaacctgatgaagagctggaag

SEQ ID NO: 275170 - DNA, 25 bp, Mus musculus
ctggaacctggagggaaaagcagtt

SEQ ID NO: 275171 - DNA, 25 bp, Mus musculus
ctggaacctgggcaggagctcgggg

SEQ ID NO: 275172 - DNA, 25 bp, Mus musculus
ctggaaccttccagggctcactgat

SEQ ID NO: 275173 - DNA, 25 bp, Mus musculus
ctggaacggcagatcacagagcagc

SEQ ID NO: 275174 - DNA, 25 bp, Mus musculus
ctggaacggcagcgtgttgaggaga

SEQ ID NO: 275175 - DNA, 25 bp, Mus musculus
ctggaacggcaggtagagatgaccc

SEQ ID NO: 275176 - DNA, 25 bp, Mus musculus
ctggaacggctattcgctgcctgat

SEQ ID NO: 275177 - DNA, 25 bp, Mus musculus
ctggaacggctgctggtccaggtcc

SEQ ID NO: 275178 - DNA, 25 bp, Mus musculus
ctggaacggctggtggtgaggtcga

SEQ ID NO: 275179 - DNA, 25 bp, Mus musculus
ctggaactaaaggaaggccctcata

SEQ ID NO: 275180 - DNA, 25 bp, Mus musculus
ctggaactcaagttggtgggaactc

SEQ ID NO: 275181 - DNA, 25 bp, Mus musculus
ctggaactcaagtttggacgtcatg

SEQ ID NO: 275182 - DNA, 25 bp, Mus musculus
ctggaactctgacagtgtccattct

SEQ ID NO: 275183 - DNA, 25 bp, Mus musculus
ctggaactctgccaaaaatggattt

SEQ ID NO: 275184 - DNA, 25 bp, Mus musculus
ctggaactgctgctcctccgttccc

SEQ ID NO: 275185 - DNA, 25 bp, Mus musculus
ctggaacttcacgattcctgtgttg

SEQ ID NO: 275186 - DNA, 25 bp, Mus musculus
ctggaagaaggtcaagcactctcca

SEQ ID NO: 275187 - DNA, 25 bp, Mus musculus
ctggaagaagtgcatgctttctctg

SEQ ID NO: 275188 - DNA, 25 bp, Mus musculus
ctggaagacaaggggctgcactgga

SEQ ID NO: 275189 - DNA, 25 bp, Mus musculus
ctggaagacaagtgcctggagctgg

SEQ ID NO: 275190 - DNA, 25 bp, Mus musculus
ctggaagacaagttgctgtctcaca

SEQ ID NO: 275191 - DNA, 25 bp, Mus musculus
ctggaagacaccagcaccaatggaa

SEQ ID NO: 275192 - DNA, 25 bp, Mus musculus
ctggaagacatccagaaactgaagg

SEQ ID NO: 275193 - DNA, 25 bp, Mus musculus
ctggaagacatccagccggatggcg

SEQ ID NO: 275194 - DNA, 25 bp, Mus musculus
ctggaagacctggataactggactg

SEQ ID NO: 275195 - DNA, 25 bp, Mus musculus
ctggaagacgtgaaattgcaagctt

SEQ ID NO: 275196 - DNA, 25 bp, Mus musculus
ctggaagacgtgaatatccgctcca

SEQ ID NO: 275197 - DNA, 25 bp, Mus musculus
ctggaagactctcaggccggggagc

SEQ ID NO: 275198 - DNA, 25 bp, Mus musculus
ctggaagagtattctttggtacagg

SEQ ID NO: 275199 - DNA, 25 bp, Mus musculus
ctggaagatcttgtggtcaagagca

SEQ ID NO: 275200 - DNA, 25 bp, Mus musculus
ctggaagattcattattgaagaagt

SEQ ID NO: 275201 - DNA, 25 bp, Mus musculus
ctggaagattcgggcttcagttgtg

SEQ ID NO: 275202 - DNA, 25 bp, Mus musculus
ctggaagcaagaggttgcagaattc

SEQ ID NO: 275203 - DNA, 25 bp, Mus musculus
ctggaagcagatgttttgggtccag

SEQ ID NO: 275204 - DNA, 25 bp, Mus musculus
ctggaagcagcagccgcagcctact

SEQ ID NO: 275205 - DNA, 25 bp, Mus musculus
ctggaagcaggacaacaatcctctc

SEQ ID NO: 275206 - DNA, 25 bp, Mus musculus
ctggaagcaggagcctccagacagg

SEQ ID NO: 275207 - DNA, 25 bp, Mus musculus
ctggaagccaactgggtggtgatgc

SEQ ID NO: 275208 - DNA, 25 bp, Mus musculus
ctggaagccaagaaagccctctctg

SEQ ID NO: 275209 - DNA, 25 bp, Mus musculus
ctggaagcccagaagaaactgtgga

SEQ ID NO: 275210 - DNA, 25 bp, Mus musculus
ctggaagccctcgatgccaattctc

SEQ ID NO: 275211 - DNA, 25 bp, Mus musculus
ctggaagcgcagaaccctgttctgc

SEQ ID NO: 275212 - DNA, 25 bp, Mus musculus
ctggaagctaaaaatctggccgccc

SEQ ID NO: 275213 - DNA, 25 bp, Mus musculus
ctggaagctatttaacattgaggct

SEQ ID NO: 275214 - DNA, 25 bp, Mus musculus
ctggaagctgaggacctacctgtgc

SEQ ID NO: 275215 - DNA, 25 bp, Mus musculus
ctggaagctgcagactttgtggtgc

SEQ ID NO: 275216 - DNA, 25 bp, Mus musculus
ctggaaggaactatgctgttggctg

SEQ ID NO: 275217 - DNA, 25 bp, Mus musculus
ctggaaggaggaagatgggctcctg

SEQ ID NO: 275218 - DNA, 25 bp, Mus musculus
ctggaaggcatctggcacacctcta

SEQ ID NO: 275219 - DNA, 25 bp, Mus musculus
ctggaaggcatctgggagggacatt

SEQ ID NO: 275220 - DNA, 25 bp, Mus musculus
ctggaaggctgggttcctgaatgcc

SEQ ID NO: 275221 - DNA, 25 bp, Mus musculus
ctggaagggctcagccagagtaaca

SEQ ID NO: 275222 - DNA, 25 bp, Mus musculus
ctggaaggggagtgggctcacccga

SEQ ID NO: 275223 - DNA, 25 bp, Mus musculus
ctggaaggtccagagaaggcaagct

SEQ ID NO: 275224 - DNA, 25 bp, Mus musculus
ctggaaggtccaggacctcagacaa

SEQ ID NO: 275225 - DNA, 25 bp, Mus musculus
ctggaaggtcccggagcatgcaaaa

SEQ ID NO: 275226 - DNA, 25 bp, Mus musculus
ctggaaggtcccggagcatgcattc

SEQ ID NO: 275227 - DNA, 25 bp, Mus musculus
ctggaaggtcccggattgaaaagat

SEQ ID NO: 275228 - DNA, 25 bp, Mus musculus
ctggaagtaaagcttgttttcaggc

SEQ ID NO: 275229 - DNA, 25 bp, Mus musculus
ctggaagtaaaggtcaccttggctg

SEQ ID NO: 275230 - DNA, 25 bp, Mus musculus
ctggaagtaacctaggtctgctgca

SEQ ID NO: 275231 - DNA, 25 bp, Mus musculus
ctggaagtatttgatcctgtgccca

SEQ ID NO: 275232 - DNA, 25 bp, Mus musculus
ctggaagtatttgccagatcttctg

SEQ ID NO: 275233 - DNA, 25 bp, Mus musculus
ctggaagtccggcggtagccaccaa

SEQ ID NO: 275234 - DNA, 25 bp, Mus musculus
ctggaagtgaagaacccagattcca

SEQ ID NO: 275235 - DNA, 25 bp, Mus musculus
ctggaagtgaaggcctgaaccaaaa

SEQ ID NO: 275236 - DNA, 25 bp, Mus musculus
ctggaagtgagagttcattgtttcc

SEQ ID NO: 275237 - DNA, 25 bp, Mus musculus
ctggaataaaaattgggatgaatgg

SEQ ID NO: 275238 - DNA, 25 bp, Mus musculus
ctggaatacactgcatctatattgg

SEQ ID NO: 275239 - DNA, 25 bp, Mus musculus
ctggaatacgtgaagttctccaagg

SEQ ID NO: 275240 - DNA, 25 bp, Mus musculus
ctggaatatatacgggttctccttg

SEQ ID NO: 275241 - DNA, 25 bp, Mus musculus
ctggaatatcctggaccatgctgct

SEQ ID NO: 275242 - DNA, 25 bp, Mus musculus
ctggaatatgaagtatggatggaag

SEQ ID NO: 275243 - DNA, 25 bp, Mus musculus
ctggaatcacaggccaactactgta

SEQ ID NO: 275244 - DNA, 25 bp, Mus musculus
ctggaatcagcagccagtgaggagg

SEQ ID NO: 275245 - DNA, 25 bp, Mus musculus
ctggaatccctgagatcaaaaccat

SEQ ID NO: 275246 - DNA, 25 bp, Mus musculus
ctggaatcctcacagccaacgaggt

SEQ ID NO: 275247 - DNA, 25 bp, Mus musculus
ctggaatcggaaggcaggagagtat

SEQ ID NO: 275248 - DNA, 25 bp, Mus musculus
ctggaatctcaggcaaaacccattt

SEQ ID NO: 275249 - DNA, 25 bp, Mus musculus
ctggaatctgcgacccatacgtgaa

SEQ ID NO: 275250 - DNA, 25 bp, Mus musculus
ctggaatctggccctggttctgagc

SEQ ID NO: 275251 - DNA, 25 bp, Mus musculus
ctggaatctgtgggcgggcagctga

SEQ ID NO: 275252 - DNA, 25 bp, Mus musculus
ctggaatcttgacaagtggagagta

SEQ ID NO: 275253 - DNA, 25 bp, Mus musculus
ctggaatgaaaggcattttcccgac

SEQ ID NO: 275254 - DNA, 25 bp, Mus musculus
ctggaatgaagatctttctgagacc

SEQ ID NO: 275255 - DNA, 25 bp, Mus musculus
ctggaatgaagggagaagcaggtcc

SEQ ID NO: 275256 - DNA, 25 bp, Mus musculus
ctggaatgacagatcagctcgaacg

SEQ ID NO: 275257 - DNA, 25 bp, Mus musculus
ctggaatgaggccctgctccctggg

SEQ ID NO: 275258 - DNA, 25 bp, Mus musculus
ctggaatgcagataacaattgaaat

SEQ ID NO: 275259 - DNA, 25 bp, Mus musculus
ctggaatgcagcttgaaggtcttcc

SEQ ID NO: 275260 - DNA, 25 bp, Mus musculus
ctggaatgcgcagattaagaaacaa

SEQ ID NO: 275261 - DNA, 25 bp, Mus musculus
ctggaatgtcatggccttatcacaa

SEQ ID NO: 275262 - DNA, 25 bp, Mus musculus
ctggaatgtggaacagccccaacag

SEQ ID NO: 275263 - DNA, 25 bp, Mus musculus
ctggaatgtggtagcgagatgggag

SEQ ID NO: 275264 - DNA, 25 bp, Mus musculus
ctggaattaaacaggcatgatgcac

SEQ ID NO: 275265 - DNA, 25 bp, Mus musculus
ctggaattaaagctctaagaacagg

SEQ ID NO: 275266 - DNA, 25 bp, Mus musculus
ctggaattaaaggaaactagaagtc

SEQ ID NO: 275267 - DNA, 25 bp, Mus musculus
ctggaattacaggatgagcctgccc

SEQ ID NO: 275268 - DNA, 25 bp, Mus musculus
ctggaattacagggatcgcttacac

SEQ ID NO: 275269 - DNA, 25 bp, Mus musculus
ctggaattccagattcgagtcaata

SEQ ID NO: 275270 - DNA, 25 bp, Mus musculus
ctggaattccaggcacgtgctctaa

SEQ ID NO: 275271 - DNA, 25 bp, Mus musculus
ctggaattgtgcatggcagaagagg

SEQ ID NO: 275272 - DNA, 25 bp, Mus musculus
ctggaattgtgcatgttccccctac

SEQ ID NO: 275273 - DNA, 25 bp, Mus musculus
ctggacaaagaaacaacttcctgcg

SEQ ID NO: 275274 - DNA, 25 bp, Mus musculus
ctggacaaaggactgaggtctggca

SEQ ID NO: 275275 - DNA, 25 bp, Mus musculus
ctggacaaaggatgttgggaagtct

SEQ ID NO: 275276 - DNA, 25 bp, Mus musculus
ctggacaacctatgtcttttgtgct

SEQ ID NO: 275277 - DNA, 25 bp, Mus musculus
ctggacaacgagcgagtggtgacgt

SEQ ID NO: 275278 - DNA, 25 bp, Mus musculus
ctggacaacgagcgagttgggatgg

SEQ ID NO: 275279 - DNA, 25 bp, Mus musculus
ctggacaagagcggttccggagcct

SEQ ID NO: 275280 - DNA, 25 bp, Mus musculus
ctggacaatgaaaacgtatccaacg

SEQ ID NO: 275281 - DNA, 25 bp, Mus musculus
ctggacaatggtgaacaacccagac

SEQ ID NO: 275282 - DNA, 25 bp, Mus musculus
ctggacaattacggtgcccgagggc

SEQ ID NO: 275283 - DNA, 25 bp, Mus musculus
ctggacaatttaggctacagaacag

SEQ ID NO: 275284 - DNA, 25 bp, Mus musculus
ctggacacacaatgggtgatccatt

SEQ ID NO: 275285 - DNA, 25 bp, Mus musculus
ctggacaccacagagctccttggta

SEQ ID NO: 275286 - DNA, 25 bp, Mus musculus
ctggacaccacaggaaagaatgttt

SEQ ID NO: 275287 - DNA, 25 bp, Mus musculus
ctggacaccacgcagaatggtggca

SEQ ID NO: 275288 - DNA, 25 bp, Mus musculus
ctggacaccacgcagcccccacatc

SEQ ID NO: 275289 - DNA, 25 bp, Mus musculus
ctggacacccatggctttgagcaca

SEQ ID NO: 275290 - DNA, 25 bp, Mus musculus
ctggacaccgatgactttgtgaaat

SEQ ID NO: 275291 - DNA, 25 bp, Mus musculus
ctggacaccgccacagtacatgtgt

SEQ ID NO: 275292 - DNA, 25 bp, Mus musculus
ctggacactcaagaaaattacaaca

SEQ ID NO: 275293 - DNA, 25 bp, Mus musculus
ctggacactcaagagagggactcct

SEQ ID NO: 275294 - DNA, 25 bp, Mus musculus
ctggacactcaaggcatttccccac

SEQ ID NO: 275295 - DNA, 25 bp, Mus musculus
ctggacactggcagtttccaggcac

SEQ ID NO: 275296 - DNA, 25 bp, Mus musculus
ctggacacttaaagctgcgcaaacc

SEQ ID NO: 275297 - DNA, 25 bp, Mus musculus
ctggacagaactcagcagatatctc

SEQ ID NO: 275298 - DNA, 25 bp, Mus musculus
ctggacagaaggtctgtgtgtggta

SEQ ID NO: 275299 - DNA, 25 bp, Mus musculus
ctggacagacagtgggaagtctgtt

SEQ ID NO: 275300 - DNA, 25 bp, Mus musculus
ctggacagaccctggacatcaacat

SEQ ID NO: 275301 - DNA, 25 bp, Mus musculus
ctggacagactgaaggacagggtgg

SEQ ID NO: 275302 - DNA, 25 bp, Mus musculus
ctggacagagagttaattgacaagt

SEQ ID NO: 275303 - DNA, 25 bp, Mus musculus
ctggacagagcgaggtgtggacagt

SEQ ID NO: 275304 - DNA, 25 bp, Mus musculus
ctggacagagtttgatgagtggtgt

SEQ ID NO: 275305 - DNA, 25 bp, Mus musculus
ctggacagcaggtcatgttgggact

SEQ ID NO: 275306 - DNA, 25 bp, Mus musculus
ctggacagccaggtgtggagggctt

SEQ ID NO: 275307 - DNA, 25 bp, Mus musculus
ctggacagccagtttgtaggtgtgg

SEQ ID NO: 275308 - DNA, 25 bp, Mus musculus
ctggacagccatgctgagcttcttg

SEQ ID NO: 275309 - DNA, 25 bp, Mus musculus
ctggacaggagaggatgggagccag

SEQ ID NO: 275310 - DNA, 25 bp, Mus musculus
ctggacaggatgtgtgaagatctgt

SEQ ID NO: 275311 - DNA, 25 bp, Mus musculus
ctggacagtgctctgagaacagtac

SEQ ID NO: 275312 - DNA, 25 bp, Mus musculus
ctggacagtggtgaggtgtatggct

SEQ ID NO: 275313 - DNA, 25 bp, Mus musculus
ctggacatcacagcatggtttattg

SEQ ID NO: 275314 - DNA, 25 bp, Mus musculus
ctggacatcacgggttatatatttg

SEQ ID NO: 275315 - DNA, 25 bp, Mus musculus
ctggacatcatccggcgcctgtctc

SEQ ID NO: 275316 - DNA, 25 bp, Mus musculus
ctggacatcctgatcttaggacagc

SEQ ID NO: 275317 - DNA, 25 bp, Mus musculus
ctggacatctcccaaacccaagcat

SEQ ID NO: 275318 - DNA, 25 bp, Mus musculus
ctggacatgaaatggtgccacatcc

SEQ ID NO: 275319 - DNA, 25 bp, Mus musculus
ctggacatgttgaagagactttcaa

SEQ ID NO: 275320 - DNA, 25 bp, Mus musculus
ctggacatgttgaaggtgttggctg

SEQ ID NO: 275321 - DNA, 25 bp, Mus musculus
ctggacattactggccagttcacaa

SEQ ID NO: 275322 - DNA, 25 bp, Mus musculus
ctggacattcggatttccatttcct

SEQ ID NO: 275323 - DNA, 25 bp, Mus musculus
ctggacattcggtcacagtctctgt

SEQ ID NO: 275324 - DNA, 25 bp, Mus musculus
ctggacattctggggaacggattgc

SEQ ID NO: 275325 - DNA, 25 bp, Mus musculus
ctggacattgatgaaactgttattg

SEQ ID NO: 275326 - DNA, 25 bp, Mus musculus
ctggaccaaagggtgctcagggaga

SEQ ID NO: 275327 - DNA, 25 bp, Mus musculus
ctggaccaaggtgcttcacctgggg

SEQ ID NO: 275328 - DNA, 25 bp, Mus musculus
ctggaccaatgggtccaattggttc

SEQ ID NO: 275329 - DNA, 25 bp, Mus musculus
ctggaccaatgggtcctcttgggat

SEQ ID NO: 275330 - DNA, 25 bp, Mus musculus
ctggaccaatttgaaattgcagact

SEQ ID NO: 275331 - DNA, 25 bp, Mus musculus
ctggaccacagtgctgccatagtgg

SEQ ID NO: 275332 - DNA, 25 bp, Mus musculus
ctggaccacagtgggcctgtgcttt

SEQ ID NO: 275333 - DNA, 25 bp, Mus musculus
ctggaccacccttggtgaaggcagc

SEQ ID NO: 275334 - DNA, 25 bp, Mus musculus
ctggaccactggcagcattagcagt

SEQ ID NO: 275335 - DNA, 25 bp, Mus musculus
ctggaccagatggcttcctgtttgg

SEQ ID NO: 275336 - DNA, 25 bp, Mus musculus
ctggaccagggacagactcactctg

SEQ ID NO: 275337 - DNA, 25 bp, Mus musculus
ctggaccagggcagtgccctgcaga

SEQ ID NO: 275338 - DNA, 25 bp, Mus musculus
ctggaccattggagggttcccagtg

SEQ ID NO: 275339 - DNA, 25 bp, Mus musculus
ctggaccattttagactacatccag

SEQ ID NO: 275340 - DNA, 25 bp, Mus musculus
ctggacccaaaggccctgcctgcct

SEQ ID NO: 275341 - DNA, 25 bp, Mus musculus
ctggacccaaatcaatactacaaga

SEQ ID NO: 275342 - DNA, 25 bp, Mus musculus
ctggacccaagggaaagcgtggaga

SEQ ID NO: 275343 - DNA, 25 bp, Mus musculus
ctggacccagaaggattgccacaag

SEQ ID NO: 275344 - DNA, 25 bp, Mus musculus
ctggacccagaaggtttgaggctct

SEQ ID NO: 275345 - DNA, 25 bp, Mus musculus
ctggacccagacaggtgcgtggtcc

SEQ ID NO: 275346 - DNA, 25 bp, Mus musculus
ctggacccaggctgccctgccctcc

SEQ ID NO: 275347 - DNA, 25 bp, Mus musculus
ctggacccatgtccttcaggaccca

SEQ ID NO: 275348 - DNA, 25 bp, Mus musculus
ctggaccccagacctgcagctaaag

SEQ ID NO: 275349 - DNA, 25 bp, Mus musculus
ctggaccccatggcccctcaccgtt

SEQ ID NO: 275350 - DNA, 25 bp, Mus musculus
ctggaccccgagagccccaaggacg

SEQ ID NO: 275351 - DNA, 25 bp, Mus musculus
ctggaccccgagatccagttggact

SEQ ID NO: 275352 - DNA, 25 bp, Mus musculus
ctggaccccgaggcactgcctctgt

SEQ ID NO: 275353 - DNA, 25 bp, Mus musculus
ctggacccctgaaggacatagcatt

SEQ ID NO: 275354 - DNA, 25 bp, Mus musculus
ctggacccctgaaggttacagtctc

SEQ ID NO: 275355 - DNA, 25 bp, Mus musculus
ctggacccggaaaagcatgccttgg

SEQ ID NO: 275356 - DNA, 25 bp, Mus musculus
ctggaccctgcatggtttattgaaa

SEQ ID NO: 275357 - DNA, 25 bp, Mus musculus
ctggaccctgtggaagggcggctgg

SEQ ID NO: 275358 - DNA, 25 bp, Mus musculus
ctggacccttggcaggagctgtgaa

SEQ ID NO: 275359 - DNA, 25 bp, Mus musculus
ctggaccgaagcccaaagcccacca

SEQ ID NO: 275360 - DNA, 25 bp, Mus musculus
ctggaccgagagaaagtccctgagt

SEQ ID NO: 275361 - DNA, 25 bp, Mus musculus
ctggaccgcaccaaagtggagcccc

SEQ ID NO: 275362 - DNA, 25 bp, Mus musculus
ctggaccgcagaggagagcccccct

SEQ ID NO: 275363 - DNA, 25 bp, Mus musculus
ctggacctaaagcctgagaatatct

SEQ ID NO: 275364 - DNA, 25 bp, Mus musculus
ctggacctacaacaccacctctgca

SEQ ID NO: 275365 - DNA, 25 bp, Mus musculus
ctggacctagaggcctttatccagc

SEQ ID NO: 275366 - DNA, 25 bp, Mus musculus
ctggacctagcacgcttacagttcc

SEQ ID NO: 275367 - DNA, 25 bp, Mus musculus
ctggacctagcaggcttacagttcc

SEQ ID NO: 275368 - DNA, 25 bp, Mus musculus
ctggacctcaatggcaatgccctcg

SEQ ID NO: 275369 - DNA, 25 bp, Mus musculus
ctggacctcacctccttatagctcc

SEQ ID NO: 275370 - DNA, 25 bp, Mus musculus
ctggacctccggggatataaaattc

SEQ ID NO: 275371 - DNA, 25 bp, Mus musculus
ctggacctccgggtcctgtgggtcc

SEQ ID NO: 275372 - DNA, 25 bp, Mus musculus
ctggacctcctggtccaaatggtga

SEQ ID NO: 275373 - DNA, 25 bp, Mus musculus
ctggacctcggagaacttccaggtc

SEQ ID NO: 275374 - DNA, 25 bp, Mus musculus
ctggacctcggagccacagagatcc

SEQ ID NO: 275375 - DNA, 25 bp, Mus musculus
ctggacctcggagctgcccagaccc

SEQ ID NO: 275376 - DNA, 25 bp, Mus musculus
ctggacctcggagggatgactcgag

SEQ ID NO: 275377 - DNA, 25 bp, Mus musculus
ctggacctgacaggtgatctggaga

SEQ ID NO: 275378 - DNA, 25 bp, Mus musculus
ctggacctgcagacccaagaatctt

SEQ ID NO: 275379 - DNA, 25 bp, Mus musculus
ctggacctgcagcacgtgggataag

SEQ ID NO: 275380 - DNA, 25 bp, Mus musculus
ctggacctggctgcaggtcctggtg

SEQ ID NO: 275381 - DNA, 25 bp, Mus musculus
ctggacctggctttgtctgttgctg

SEQ ID NO: 275382 - DNA, 25 bp, Mus musculus
ctggacctgggggcagcccgggcca

SEQ ID NO: 275383 - DNA, 25 bp, Mus musculus
ctggacctgggtcagaacatctttg

SEQ ID NO: 275384 - DNA, 25 bp, Mus musculus
ctggacgaccggcgtgtgcagcctg

SEQ ID NO: 275385 - DNA, 25 bp, Mus musculus
ctggacgaccgtatctggactagaa

SEQ ID NO: 275386 - DNA, 25 bp, Mus musculus
ctggacgagagggcagccctggtgc

SEQ ID NO: 275387 - DNA, 25 bp, Mus musculus
ctggacgcaagggcattgaaaacat

SEQ ID NO: 275388 - DNA, 25 bp, Mus musculus
ctggacgcaagggtttgtgtttagt

SEQ ID NO: 275389 - DNA, 25 bp, Mus musculus
ctggacgcacagcctttgcttcctt

SEQ ID NO: 275390 - DNA, 25 bp, Mus musculus
ctggacgcacaggcctcctgtgcca

SEQ ID NO: 275391 - DNA, 25 bp, Mus musculus
ctggacgccattcccccactttgtt

SEQ ID NO: 275392 - DNA, 25 bp, Mus musculus
ctggacgcgcggaaaggaaacctcg

SEQ ID NO: 275393 - DNA, 25 bp, Mus musculus
ctggacgcgggagagaagatggagg

SEQ ID NO: 275394 - DNA, 25 bp, Mus musculus
ctggacgctcagccttcaaacagta

SEQ ID NO: 275395 - DNA, 25 bp, Mus musculus
ctggacgctcaggacccaccagagg

SEQ ID NO: 275396 - DNA, 25 bp, Mus musculus
ctggacgctcggactgggctatatg

SEQ ID NO: 275397 - DNA, 25 bp, Mus musculus
ctggacgcttgcctttgtctggaaa

SEQ ID NO: 275398 - DNA, 25 bp, Mus musculus
ctggacgcttgtcaccagatttcgt

SEQ ID NO: 275399 - DNA, 25 bp, Mus musculus
ctggacggcaggtgaagtggaagat

SEQ ID NO: 275400 - DNA, 25 bp, Mus musculus
ctggacggcctgtatgccctgatgt

SEQ ID NO: 275401 - DNA, 25 bp, Mus musculus
ctggacgggacccagggtgaaatgg

SEQ ID NO: 275402 - DNA, 25 bp, Mus musculus
ctggacgggacctcattcctctctg

SEQ ID NO: 275403 - DNA, 25 bp, Mus musculus
ctggacgtaagaccaatcgcagcct

SEQ ID NO: 275404 - DNA, 25 bp, Mus musculus
ctggacgtaagaccagtgggagcag

SEQ ID NO: 275405 - DNA, 25 bp, Mus musculus
ctggacgtggagcacctgggagata

SEQ ID NO: 275406 - DNA, 25 bp, Mus musculus
ctggacgttgagtgtggaaaatgct

SEQ ID NO: 275407 - DNA, 25 bp, Mus musculus
ctggactaaggatcaccactacttt

SEQ ID NO: 275408 - DNA, 25 bp, Mus musculus
ctggactacagagcagaaaaggaag

SEQ ID NO: 275409 - DNA, 25 bp, Mus musculus
ctggactatggctggcagagggaga

SEQ ID NO: 275410 - DNA, 25 bp, Mus musculus
ctggactcaagcggatagccaagga

SEQ ID NO: 275411 - DNA, 25 bp, Mus musculus
ctggactcaagctctcttgagtcat

SEQ ID NO: 275412 - DNA, 25 bp, Mus musculus
ctggactccacgtggaacttaggca

SEQ ID NO: 275413 - DNA, 25 bp, Mus musculus
ctggactccagggctgacagcttcg

SEQ ID NO: 275414 - DNA, 25 bp, Mus musculus
ctggactcccacagccagcgtttcc

SEQ ID NO: 275415 - DNA, 25 bp, Mus musculus
ctggactcccgggagatgcagcttc

SEQ ID NO: 275416 - DNA, 25 bp, Mus musculus
ctggactcccgggaggctcaccatc

SEQ ID NO: 275417 - DNA, 25 bp, Mus musculus
ctggactctaaactggtcagcctgc

SEQ ID NO: 275418 - DNA, 25 bp, Mus musculus
ctggactctcaggttgtgaggactg

SEQ ID NO: 275419 - DNA, 25 bp, Mus musculus
ctggactctctcaaaccccttatcc

SEQ ID NO: 275420 - DNA, 25 bp, Mus musculus
ctggactgaagatctctctgaaaca

SEQ ID NO: 275421 - DNA, 25 bp, Mus musculus
ctggactgaaggacgcagatagagc

SEQ ID NO: 275422 - DNA, 25 bp, Mus musculus
ctggactgacgcagatgaagagcta

SEQ ID NO: 275423 - DNA, 25 bp, Mus musculus
ctggactgatgggaaggaggccatg

SEQ ID NO: 275424 - DNA, 25 bp, Mus musculus
ctggactgcagaggccacttcttca

SEQ ID NO: 275425 - DNA, 25 bp, Mus musculus
ctggactgcagcctcttttatgaaa

SEQ ID NO: 275426 - DNA, 25 bp, Mus musculus
ctggactgcctgaacagggacaact

SEQ ID NO: 275427 - DNA, 25 bp, Mus musculus
ctggactgcgccatctctgtctgcc

SEQ ID NO: 275428 - DNA, 25 bp, Mus musculus
ctggactgctgtaagtgtggacatt

SEQ ID NO: 275429 - DNA, 25 bp, Mus musculus
ctggactgctgtcaatgggagccgg

SEQ ID NO: 275430 - DNA, 25 bp, Mus musculus
ctggactggaaggaaatctacaagc

SEQ ID NO: 275431 - DNA, 25 bp, Mus musculus
ctggactggcaaatcaccccttttc

SEQ ID NO: 275432 - DNA, 25 bp, Mus musculus
ctggactggccgcaggaagctaagc

SEQ ID NO: 275433 - DNA, 25 bp, Mus musculus
ctggactggccgcagggtacattcg

SEQ ID NO: 275434 - DNA, 25 bp, Mus musculus
ctggactgggaggtaggggtccatg

SEQ ID NO: 275435 - DNA, 25 bp, Mus musculus
ctggactgtgcaaggaagatctgga

SEQ ID NO: 275436 - DNA, 25 bp, Mus musculus
ctggactgttaggaacagcctcagg

SEQ ID NO: 275437 - DNA, 25 bp, Mus musculus
ctggactgttatccaactgaggagc

SEQ ID NO: 275438 - DNA, 25 bp, Mus musculus
ctggacttacaggtactatgggttg

SEQ ID NO: 275439 - DNA, 25 bp, Mus musculus
ctggacttcagaaatgggacactac

SEQ ID NO: 275440 - DNA, 25 bp, Mus musculus
ctggacttcagaaattgtgaaggtt

SEQ ID NO: 275441 - DNA, 25 bp, Mus musculus
ctggacttcagaaccagcagctgct

SEQ ID NO: 275442 - DNA, 25 bp, Mus musculus
ctggacttcagggagaggaacagga

SEQ ID NO: 275443 - DNA, 25 bp, Mus musculus
ctggacttcgggtcagtgaatgctt

SEQ ID NO: 275444 - DNA, 25 bp, Mus musculus
ctggacttcggtatatccaaagcct

SEQ ID NO: 275445 - DNA, 25 bp, Mus musculus
ctggacttctatgtggtgctgggta

SEQ ID NO: 275446 - DNA, 25 bp, Mus musculus
ctggacttgctgtaggttatgatga

SEQ ID NO: 275447 - DNA, 25 bp, Mus musculus
ctggacttggggcgacgtatgtgat

SEQ ID NO: 275448 - DNA, 25 bp, Mus musculus
ctggacttggggggacgtatgtgat

SEQ ID NO: 275449 - DNA, 25 bp, Mus musculus
ctggactttcaagatgacgggacga

SEQ ID NO: 275450 - DNA, 25 bp, Mus musculus
ctggactttcaagcctatgtgtttc

SEQ ID NO: 275451 - DNA, 25 bp, Mus musculus
ctggactttgcttcagaaaatgcct

SEQ ID NO: 275452 - DNA, 25 bp, Mus musculus
ctggactttggttcagaaaatgcct

SEQ ID NO: 275453 - DNA, 25 bp, Mus musculus
ctggagaaaaacagtaccaaggagt

SEQ ID NO: 275454 - DNA, 25 bp, Mus musculus
ctggagaaaaaggggaccatggcct

SEQ ID NO: 275455 - DNA, 25 bp, Mus musculus
ctggagaaaagggtgaacctggtcc

SEQ ID NO: 275456 - DNA, 25 bp, Mus musculus
ctggagaaaattagagccccttcca

SEQ ID NO: 275457 - DNA, 25 bp, Mus musculus
ctggagaaacagggtcatgatggtg

SEQ ID NO: 275458 - DNA, 25 bp, Mus musculus
ctggagaaagaggctgccactcgct

SEQ ID NO: 275459 - DNA, 25 bp, Mus musculus
ctggagaaagaggtggaggtgattg

SEQ ID NO: 275460 - DNA, 25 bp, Mus musculus
ctggagaaagagtacttcttagcct

SEQ ID NO: 275461 - DNA, 25 bp, Mus musculus
ctggagaaagagtggaggtgattgg

SEQ ID NO: 275462 - DNA, 25 bp, Mus musculus
ctggagaaagagtttgagaggaccc

SEQ ID NO: 275463 - DNA, 25 bp, Mus musculus
ctggagaaatatgaggaacacatca

SEQ ID NO: 275464 - DNA, 25 bp, Mus musculus
ctggagaaatatgagtggttccatg

SEQ ID NO: 275465 - DNA, 25 bp, Mus musculus
ctggagaacatgattaatgacttcc

SEQ ID NO: 275466 - DNA, 25 bp, Mus musculus
ctggagaacatggaggttgctatcg

SEQ ID NO: 275467 - DNA, 25 bp, Mus musculus
ctggagaacggggaagtctaggacc

SEQ ID NO: 275468 - DNA, 25 bp, Mus musculus
ctggagaagaagaagtatgaacgag

SEQ ID NO: 275469 - DNA, 25 bp, Mus musculus
ctggagaagaagcacaagcttctgg

SEQ ID NO: 275470 - DNA, 25 bp, Mus musculus
ctggagaagaagcaggaattcttag

SEQ ID NO: 275471 - DNA, 25 bp, Mus musculus
ctggagaagacaagtccatctaccg

SEQ ID NO: 275472 - DNA, 25 bp, Mus musculus
ctggagaagacctgtgccgtgtgac

SEQ ID NO: 275473 - DNA, 25 bp, Mus musculus
ctggagaagactgcggttctacggg

SEQ ID NO: 275474 - DNA, 25 bp, Mus musculus
ctggagaagagaaaggtctgtatcc

SEQ ID NO: 275475 - DNA, 25 bp, Mus musculus
ctggagaaggccagacccccatccc

SEQ ID NO: 275476 - DNA, 25 bp, Mus musculus
ctggagaaggccagggtagacagca

SEQ ID NO: 275477 - DNA, 25 bp, Mus musculus
ctggagaagttgtgtgactccctcc

SEQ ID NO: 275478 - DNA, 25 bp, Mus musculus
ctggagaatcgaggaaaacttccca

SEQ ID NO: 275479 - DNA, 25 bp, Mus musculus
ctggagaatgtgctagagatcaata

SEQ ID NO: 275480 - DNA, 25 bp, Mus musculus
ctggagaattccttctctgaagcgc

SEQ ID NO: 275481 - DNA, 25 bp, Mus musculus
ctggagacaaaattgcaatgcatga

SEQ ID NO: 275482 - DNA, 25 bp, Mus musculus
ctggagacaaaattgtagaagaacc

SEQ ID NO: 275483 - DNA, 25 bp, Mus musculus
ctggagacaagctacgcatggagta

SEQ ID NO: 275484 - DNA, 25 bp, Mus musculus
ctggagacaagtagtcttttacaga

SEQ ID NO: 275485 - DNA, 25 bp, Mus musculus
ctggagacaatacgcatggagtacc

SEQ ID NO: 275486 - DNA, 25 bp, Mus musculus
ctggagacaatggtctgtgggagcc

SEQ ID NO: 275487 - DNA, 25 bp, Mus musculus
ctggagacacagcatcttgcagccc

SEQ ID NO: 275488 - DNA, 25 bp, Mus musculus
ctggagacaccaacaggtggaaggg

SEQ ID NO: 275489 - DNA, 25 bp, Mus musculus
ctggagacactagacctgaactata

SEQ ID NO: 275490 - DNA, 25 bp, Mus musculus
ctggagacagcaggcacaccaagat

SEQ ID NO: 275491 - DNA, 25 bp, Mus musculus
ctggagacaggccgggtgaccaaga

SEQ ID NO: 275492 - DNA, 25 bp, Mus musculus
ctggagaccaggttctctgccaacc

SEQ ID NO: 275493 - DNA, 25 bp, Mus musculus
ctggagaccccagcaccacatctgc

SEQ ID NO: 275494 - DNA, 25 bp, Mus musculus
ctggagacccggatgggagccagga

SEQ ID NO: 275495 - DNA, 25 bp, Mus musculus
ctggagaccggtggaggatctggag

SEQ ID NO: 275496 - DNA, 25 bp, Mus musculus
ctggagacctggaggatccccagga

SEQ ID NO: 275497 - DNA, 25 bp, Mus musculus
ctggagacctggccaaccgctgcaa

SEQ ID NO: 275498 - DNA, 25 bp, Mus musculus
ctggagacctggtacggagcagagc

SEQ ID NO: 275499 - DNA, 25 bp, Mus musculus
ctggagacgagagctggcattccta

SEQ ID NO: 275500 - DNA, 25 bp, Mus musculus
ctggagacgctcaaatcatgcactc

SEQ ID NO: 275501 - DNA, 25 bp, Mus musculus
ctggagacgctcaacttgtcccaaa

SEQ ID NO: 275502 - DNA, 25 bp, Mus musculus
ctggagacggaaaagtgtcattggt

SEQ ID NO: 275503 - DNA, 25 bp, Mus musculus
ctggagagaaagacggtcgctgagt

SEQ ID NO: 275504 - DNA, 25 bp, Mus musculus
ctggagagaaggataaaggggagtg

SEQ ID NO: 275505 - DNA, 25 bp, Mus musculus
ctggagagaaggcctgcctgcctac

SEQ ID NO: 275506 - DNA, 25 bp, Mus musculus
ctggagagaagggctattggcttac

SEQ ID NO: 275507 - DNA, 25 bp, Mus musculus
ctggagagaaggtcatttgagaccc

SEQ ID NO: 275508 - DNA, 25 bp, Mus musculus
ctggagagactgctgactcgatacc

SEQ ID NO: 275509 - DNA, 25 bp, Mus musculus
ctggagagagaggtgctcctggcaa

SEQ ID NO: 275510 - DNA, 25 bp, Mus musculus
ctggagagagccaagagcgccttgc

SEQ ID NO: 275511 - DNA, 25 bp, Mus musculus
ctggagagaggagcaccgtgagagc

SEQ ID NO: 275512 - DNA, 25 bp, Mus musculus
ctggagagagggaaatctacaagcg

SEQ ID NO: 275513 - DNA, 25 bp, Mus musculus
ctggagagagttcaccttttccact

SEQ ID NO: 275514 - DNA, 25 bp, Mus musculus
ctggagagatcttgtggcgccatgt

SEQ ID NO: 275515 - DNA, 25 bp, Mus musculus
ctggagagcaatatggtacctcaca

SEQ ID NO: 275516 - DNA, 25 bp, Mus musculus
ctggagagcacaggattcagtaacc

SEQ ID NO: 275517 - DNA, 25 bp, Mus musculus
ctggagagccagaagtacctgcact

SEQ ID NO: 275518 - DNA, 25 bp, Mus musculus
ctggagagctgtgtggctgagcagc

SEQ ID NO: 275519 - DNA, 25 bp, Mus musculus
ctggagaggaagaagcgacttgaag

SEQ ID NO: 275520 - DNA, 25 bp, Mus musculus
ctggagaggaaggcacagagaactg

SEQ ID NO: 275521 - DNA, 25 bp, Mus musculus
ctggagaggagggtctagagacatg

SEQ ID NO: 275522 - DNA, 25 bp, Mus musculus
ctggagagggaggggctctgcctcc

SEQ ID NO: 275523 - DNA, 25 bp, Mus musculus
ctggagataggacgagtgaccaaaa

SEQ ID NO: 275524 - DNA, 25 bp, Mus musculus
ctggagatcaaaatggctcgcgctg

SEQ ID NO: 275525 - DNA, 25 bp, Mus musculus
ctggagatcaggaggcgccagctga

SEQ ID NO: 275526 - DNA, 25 bp, Mus musculus
ctggagatcaggattgacttgtgga

SEQ ID NO: 275527 - DNA, 25 bp, Mus musculus
ctggagatcaggttcaatgctccct

SEQ ID NO: 275528 - DNA, 25 bp, Mus musculus
ctggagatccaggcttccgtggggc

SEQ ID NO: 275529 - DNA, 25 bp, Mus musculus
ctggagatgaaactgctgccacagg

SEQ ID NO: 275530 - DNA, 25 bp, Mus musculus
ctggagatgagaaataaagatttca

SEQ ID NO: 275531 - DNA, 25 bp, Mus musculus
ctggagatgagtcacagcccagcac

SEQ ID NO: 275532 - DNA, 25 bp, Mus musculus
ctggagatgccacagcccgtgttcc

SEQ ID NO: 275533 - DNA, 25 bp, Mus musculus
ctggagatgccacagctcccaaccc

SEQ ID NO: 275534 - DNA, 25 bp, Mus musculus
ctggagatggaagtgtaaatggcat

SEQ ID NO: 275535 - DNA, 25 bp, Mus musculus
ctggagatggacctcctctggtaaa

SEQ ID NO: 275536 - DNA, 25 bp, Mus musculus
ctggagatggcagttccctccaggc

SEQ ID NO: 275537 - DNA, 25 bp, Mus musculus
ctggagatggtcaagcaagaagcga

SEQ ID NO: 275538 - DNA, 25 bp, Mus musculus
ctggagatgtatcagattcagctac

SEQ ID NO: 275539 - DNA, 25 bp, Mus musculus
ctggagatgtggctcaccatgccta

SEQ ID NO: 275540 - DNA, 25 bp, Mus musculus
ctggagattaaagtaattggcaact

SEQ ID NO: 275541 - DNA, 25 bp, Mus musculus
ctggagattgtcctgctttaaggct

SEQ ID NO: 275542 - DNA, 25 bp, Mus musculus
ctggagcaaagattgcgccaggctg

SEQ ID NO: 275543 - DNA, 25 bp, Mus musculus
ctggagcaaagtgaaaaagatttgg

SEQ ID NO: 275544 - DNA, 25 bp, Mus musculus
ctggagcaacaaggggaaagcgaga

SEQ ID NO: 275545 - DNA, 25 bp, Mus musculus
ctggagcaacaagtccgtgcactgg

SEQ ID NO: 275546 - DNA, 25 bp, Mus musculus
ctggagcaaggcatggaactcagtg

SEQ ID NO: 275547 - DNA, 25 bp, Mus musculus
ctggagcaaggtggccctgacaagt

SEQ ID NO: 275548 - DNA, 25 bp, Mus musculus
ctggagcagaagaataaagagatag

SEQ ID NO: 275549 - DNA, 25 bp, Mus musculus
ctggagcagaagacaaaagaaattg

SEQ ID NO: 275550 - DNA, 25 bp, Mus musculus
ctggagcagaagatctatccctatg

SEQ ID NO: 275551 - DNA, 25 bp, Mus musculus
ctggagcagaaggataaacaaaggt

SEQ ID NO: 275552 - DNA, 25 bp, Mus musculus
ctggagcagaaggttatgttcttgc

SEQ ID NO: 275553 - DNA, 25 bp, Mus musculus
ctggagcagaggatttcagcgtcag

SEQ ID NO: 275554 - DNA, 25 bp, Mus musculus
ctggagcagcaccagaaataccggt

SEQ ID NO: 275555 - DNA, 25 bp, Mus musculus
ctggagcagcagcagtaggcactgg

SEQ ID NO: 275556 - DNA, 25 bp, Mus musculus
ctggagcagcagcctcagggctggc

SEQ ID NO: 275557 - DNA, 25 bp, Mus musculus
ctggagcagggccacgtggcaccgg

SEQ ID NO: 275558 - DNA, 25 bp, Mus musculus
ctggagcagtgggagaaagatgatg

SEQ ID NO: 275559 - DNA, 25 bp, Mus musculus
ctggagcagttggggaccagagttg

SEQ ID NO: 275560 - DNA, 25 bp, Mus musculus
ctggagcatcagctgctgacctgat

SEQ ID NO: 275561 - DNA, 25 bp, Mus musculus
ctggagcatcagctgtggtcctcta

SEQ ID NO: 275562 - DNA, 25 bp, Mus musculus
ctggagcatctcaagaacactcacc

SEQ ID NO: 275563 - DNA, 25 bp, Mus musculus
ctggagcatgagagcgtagcaggag

SEQ ID NO: 275564 - DNA, 25 bp, Mus musculus
ctggagcatgaggagtggtggagag

SEQ ID NO: 275565 - DNA, 25 bp, Mus musculus
ctggagccaagagagctgaagcgct

SEQ ID NO: 275566 - DNA, 25 bp, Mus musculus
ctggagccaagatgataaatcatca

SEQ ID NO: 275567 - DNA, 25 bp, Mus musculus
ctggagccacaaactcctgcttcct

SEQ ID NO: 275568 - DNA, 25 bp, Mus musculus
ctggagccacaaattgcggttgcca

SEQ ID NO: 275569 - DNA, 25 bp, Mus musculus
ctggagccaccccaaatctgccatc

SEQ ID NO: 275570 - DNA, 25 bp, Mus musculus
ctggagccagaagaacagacaaggt

SEQ ID NO: 275571 - DNA, 25 bp, Mus musculus
ctggagccagaaggtttggattcct

SEQ ID NO: 275572 - DNA, 25 bp, Mus musculus
ctggagccagaattcacactggagc

SEQ ID NO: 275573 - DNA, 25 bp, Mus musculus
ctggagccagaggctgcattgtgat

SEQ ID NO: 275574 - DNA, 25 bp, Mus musculus
ctggagccaggagaaggctgctatt

SEQ ID NO: 275575 - DNA, 25 bp, Mus musculus
ctggagccaggggtcttaccggtcg

SEQ ID NO: 275576 - DNA, 25 bp, Mus musculus
ctggagcccaaaaagatggcacttc

SEQ ID NO: 275577 - DNA, 25 bp, Mus musculus
ctggagcccacgaaccttcttttaa

SEQ ID NO: 275578 - DNA, 25 bp, Mus musculus
ctggagccccgagcccttccagcag

SEQ ID NO: 275579 - DNA, 25 bp, Mus musculus
ctggagccccgagctcctctaattt

SEQ ID NO: 275580 - DNA, 25 bp, Mus musculus
ctggagcccctgaaagagatgacat

SEQ ID NO: 275581 - DNA, 25 bp, Mus musculus
ctggagcccgagtggcaccagcttc

SEQ ID NO: 275582 - DNA, 25 bp, Mus musculus
ctggagcccgatggttttcggaagg

SEQ ID NO: 275583 - DNA, 25 bp, Mus musculus
ctggagccgattcaaaaggtgatga

SEQ ID NO: 275584 - DNA, 25 bp, Mus musculus
ctggagccggtgagcctggaggcct

SEQ ID NO: 275585 - DNA, 25 bp, Mus musculus
ctggagcctggaatagagcaatcaa

SEQ ID NO: 275586 - DNA, 25 bp, Mus musculus
ctggagcgacaccaggaacaccgga

SEQ ID NO: 275587 - DNA, 25 bp, Mus musculus
ctggagcgcagtgtgaaactggccc

SEQ ID NO: 275588 - DNA, 25 bp, Mus musculus
ctggagcgtctggtgctacaagtgt

SEQ ID NO: 275589 - DNA, 25 bp, Mus musculus
ctggagctacaggctggtaagaaca

SEQ ID NO: 275590 - DNA, 25 bp, Mus musculus
ctggagctagcatctagtgcttttt

SEQ ID NO: 275591 - DNA, 25 bp, Mus musculus
ctggagctagcatctcgctctccag

SEQ ID NO: 275592 - DNA, 25 bp, Mus musculus
ctggagctagcatgctcacgcacat

SEQ ID NO: 275593 - DNA, 25 bp, Mus musculus
ctggagctaggtcattttacctggg

SEQ ID NO: 275594 - DNA, 25 bp, Mus musculus
ctggagctcagcacaggggatgaac

SEQ ID NO: 275595 - DNA, 25 bp, Mus musculus
ctggagctcggcaggcatttcaggg

SEQ ID NO: 275596 - DNA, 25 bp, Mus musculus
ctggagctgagatgacgttgcaccg

SEQ ID NO: 275597 - DNA, 25 bp, Mus musculus
ctggagctgagcacggagcctggtg

SEQ ID NO: 275598 - DNA, 25 bp, Mus musculus
ctggagctgagggagacgcactact

SEQ ID NO: 275599 - DNA, 25 bp, Mus musculus
ctggagctgatagaaacatctttct

SEQ ID NO: 275600 - DNA, 25 bp, Mus musculus
ctggagctgatggaacacccattct

SEQ ID NO: 275601 - DNA, 25 bp, Mus musculus
ctggagctgcaggttcggggtgaag

SEQ ID NO: 275602 - DNA, 25 bp, Mus musculus
ctggagctgccagcatttgacattg

SEQ ID NO: 275603 - DNA, 25 bp, Mus musculus
ctggagctgccatcaacaccccctt

SEQ ID NO: 275604 - DNA, 25 bp, Mus musculus
ctggagctgctgagatcttagcctc

SEQ ID NO: 275605 - DNA, 25 bp, Mus musculus
ctggagctgctgagggagctgaatc

SEQ ID NO: 275606 - DNA, 25 bp, Mus musculus
ctggagctggccaggactgccgctt

SEQ ID NO: 275607 - DNA, 25 bp, Mus musculus
ctggagctgtgcatccttttataca

SEQ ID NO: 275608 - DNA, 25 bp, Mus musculus
ctggagctgtggttcgttctcccag

SEQ ID NO: 275609 - DNA, 25 bp, Mus musculus
ctggagcttccgcaggcgccatgga

SEQ ID NO: 275610 - DNA, 25 bp, Mus musculus
ctggagcttgcaggaataacagaag

SEQ ID NO: 275611 - DNA, 25 bp, Mus musculus
ctggagcttggtgtctgtctctcta

SEQ ID NO: 275612 - DNA, 25 bp, Mus musculus
ctggagctttgatgctgcattccgt

SEQ ID NO: 275613 - DNA, 25 bp, Mus musculus
ctggagcttttgcggtttgtagtgc

SEQ ID NO: 275614 - DNA, 25 bp, Mus musculus
ctggagcttttgcgttcagttcggt

SEQ ID NO: 275615 - DNA, 25 bp, Mus musculus
ctggaggaaaccaggaatgggcctt

SEQ ID NO: 275616 - DNA, 25 bp, Mus musculus
ctggaggaactgagaagacattttc

SEQ ID NO: 275617 - DNA, 25 bp, Mus musculus
ctggaggaagccaagaagaagctgg

SEQ ID NO: 275618 - DNA, 25 bp, Mus musculus
ctggaggaaggaattctttgtgtgg

SEQ ID NO: 275619 - DNA, 25 bp, Mus musculus
ctggaggacaaaggggagacaccat

SEQ ID NO: 275620 - DNA, 25 bp, Mus musculus
ctggaggacaaaggtcaagcaggta

SEQ ID NO: 275621 - DNA, 25 bp, Mus musculus
ctggaggacaagggcaggattctgg

SEQ ID NO: 275622 - DNA, 25 bp, Mus musculus
ctggaggacaaggtgactgcaaagg

SEQ ID NO: 275623 - DNA, 25 bp, Mus musculus
ctggaggacaatgtctgttctgagt

SEQ ID NO: 275624 - DNA, 25 bp, Mus musculus
ctggaggacaatgttttgatgagtg

SEQ ID NO: 275625 - DNA, 25 bp, Mus musculus
ctggaggacggaaaccactgagaaa

SEQ ID NO: 275626 - DNA, 25 bp, Mus musculus
ctggaggacttcaggtatccgtggt

SEQ ID NO: 275627 - DNA, 25 bp, Mus musculus
ctggaggacttcagtgtgtctccag

SEQ ID NO: 275628 - DNA, 25 bp, Mus musculus
ctggaggagcagaattttctacaga

SEQ ID NO: 275629 - DNA, 25 bp, Mus musculus
ctggaggagctctgggaacctcctc

SEQ ID NO: 275630 - DNA, 25 bp, Mus musculus
ctggaggagctctggggcccagcaa

SEQ ID NO: 275631 - DNA, 25 bp, Mus musculus
ctggaggagctgaattttctgaaga

SEQ ID NO: 275632 - DNA, 25 bp, Mus musculus
ctggaggagctgttttctgaagaga

SEQ ID NO: 275633 - DNA, 25 bp, Mus musculus
ctggaggaggacaaggagcgccatg

SEQ ID NO: 275634 - DNA, 25 bp, Mus musculus
ctggaggaggagctgcagttctccc

SEQ ID NO: 275635 - DNA, 25 bp, Mus musculus
ctggaggaggccgggccaaagtaga

SEQ ID NO: 275636 - DNA, 25 bp, Mus musculus
ctggaggaggccgggtccagatagt

SEQ ID NO: 275637 - DNA, 25 bp, Mus musculus
ctggaggaggccgggttcagattca

SEQ ID NO: 275638 - DNA, 25 bp, Mus musculus
ctggaggagttcaaggacgacagcc

SEQ ID NO: 275639 - DNA, 25 bp, Mus musculus
ctggaggagttgagttaaaagaaga

SEQ ID NO: 275640 - DNA, 25 bp, Mus musculus
ctggaggatacgtcctctgccagag

SEQ ID NO: 275641 - DNA, 25 bp, Mus musculus
ctggaggatcagttggcaaagctcc

SEQ ID NO: 275642 - DNA, 25 bp, Mus musculus
ctggaggatgggctaggaaatcaag

SEQ ID NO: 275643 - DNA, 25 bp, Mus musculus
ctggaggcaaggatggccaggctat

SEQ ID NO: 275644 - DNA, 25 bp, Mus musculus
ctggaggcaaggctatgctgtggga

SEQ ID NO: 275645 - DNA, 25 bp, Mus musculus
ctggaggcagaaagaattgcctatc

SEQ ID NO: 275646 - DNA, 25 bp, Mus musculus
ctggaggccagcatattcaggaggc

SEQ ID NO: 275647 - DNA, 25 bp, Mus musculus
ctggaggcccaggatttggtgtcat

SEQ ID NO: 275648 - DNA, 25 bp, Mus musculus
ctggaggcccaggtgcgcaagttgg

SEQ ID NO: 275649 - DNA, 25 bp, Mus musculus
ctggaggcccccaggattccccctc

SEQ ID NO: 275650 - DNA, 25 bp, Mus musculus
ctggaggcctcaaaggttaaggagc

SEQ ID NO: 275651 - DNA, 25 bp, Mus musculus
ctggaggcctctgagatcgaggatg

SEQ ID NO: 275652 - DNA, 25 bp, Mus musculus
ctggaggcgagaaccatgtgtgctc

SEQ ID NO: 275653 - DNA, 25 bp, Mus musculus
ctggaggcgagtatttcctaaatga

SEQ ID NO: 275654 - DNA, 25 bp, Mus musculus
ctggaggctcaagtgagggcattgc

SEQ ID NO: 275655 - DNA, 25 bp, Mus musculus
ctggaggctcaagtgtgagggagat

SEQ ID NO: 275656 - DNA, 25 bp, Mus musculus
ctggaggctctacaggttttggctc

SEQ ID NO: 275657 - DNA, 25 bp, Mus musculus
ctggaggcttggcaggatgacatgc

SEQ ID NO: 275658 - DNA, 25 bp, Mus musculus
ctggaggcttggcagtttgcgtcct

SEQ ID NO: 275659 - DNA, 25 bp, Mus musculus
ctggagggaaggaaggcacagctga

SEQ ID NO: 275660 - DNA, 25 bp, Mus musculus
ctggagggagacagaagcaggtggc

SEQ ID NO: 275661 - DNA, 25 bp, Mus musculus
ctggagggagacagaaggaggtggt

SEQ ID NO: 275662 - DNA, 25 bp, Mus musculus
ctggagggagacagagcaggtggca

SEQ ID NO: 275663 - DNA, 25 bp, Mus musculus
ctggagggagagacgtgaaaaatga

SEQ ID NO: 275664 - DNA, 25 bp, Mus musculus
ctggagggaggttgtgtagcctgac

SEQ ID NO: 275665 - DNA, 25 bp, Mus musculus
ctggagggcaagatattagcatttg

SEQ ID NO: 275666 - DNA, 25 bp, Mus musculus
ctggagggcagaggctcagaggcac

SEQ ID NO: 275667 - DNA, 25 bp, Mus musculus
ctggagggcatatcctttttactgg

SEQ ID NO: 275668 - DNA, 25 bp, Mus musculus
ctggagggctagatgggatgtgacc

SEQ ID NO: 275669 - DNA, 25 bp, Mus musculus
ctggagggctaggcttcaacttgcg

SEQ ID NO: 275670 - DNA, 25 bp, Mus musculus
ctggaggggcgctggcaccttcaaa

SEQ ID NO: 275671 - DNA, 25 bp, Mus musculus
ctggaggggcgctgggctacgatgg

SEQ ID NO: 275672 - DNA, 25 bp, Mus musculus
ctggaggggcttcagacaccaatga

SEQ ID NO: 275673 - DNA, 25 bp, Mus musculus
ctggaggggtgagtgtggatctgca

SEQ ID NO: 275674 - DNA, 25 bp, Mus musculus
ctggagggtgaggctctgggtgctc

SEQ ID NO: 275675 - DNA, 25 bp, Mus musculus
ctggaggtacaagagggaagaagaa

SEQ ID NO: 275676 - DNA, 25 bp, Mus musculus
ctggaggtcatggtgaaacatccac

SEQ ID NO: 275677 - DNA, 25 bp, Mus musculus
ctggaggtcatggtgaaacatgagc

SEQ ID NO: 275678 - DNA, 25 bp, Mus musculus
ctggaggtccgagcacaccctgaaa

SEQ ID NO: 275679 - DNA, 25 bp, Mus musculus
ctggaggtccgaggcgagtgagctc

SEQ ID NO: 275680 - DNA, 25 bp, Mus musculus
ctggaggtcgagcccgtgacaccat

SEQ ID NO: 275681 - DNA, 25 bp, Mus musculus
ctggaggtggcaatgttcagattca

SEQ ID NO: 275682 - DNA, 25 bp, Mus musculus
ctggaggtggcagagtataaaggag

SEQ ID NO: 275683 - DNA, 25 bp, Mus musculus
ctggaggtggccgatgtgacagcat

SEQ ID NO: 275684 - DNA, 25 bp, Mus musculus
ctggaggtgttcagctcctgcttct

SEQ ID NO: 275685 - DNA, 25 bp, Mus musculus
ctggaggtgttcagggaggcagatc

SEQ ID NO: 275686 - DNA, 25 bp, Mus musculus
ctggaggttaaagcttctgccacac

SEQ ID NO: 275687 - DNA, 25 bp, Mus musculus
ctggaggttgtcagggttacagcca

SEQ ID NO: 275688 - DNA, 25 bp, Mus musculus
ctggaggtttgctgttatttcgctg

SEQ ID NO: 275689 - DNA, 25 bp, Mus musculus
ctggagtacagtaagggatgttctg

SEQ ID NO: 275690 - DNA, 25 bp, Mus musculus
ctggagtacagtaagtactggctct

SEQ ID NO: 275691 - DNA, 25 bp, Mus musculus
ctggagtacagtaagttcatagaca

SEQ ID NO: 275692 - DNA, 25 bp, Mus musculus
ctggagtagaaccaggggaaagcgc

SEQ ID NO: 275693 - DNA, 25 bp, Mus musculus
ctggagtagacaggctcctcatagt

SEQ ID NO: 275694 - DNA, 25 bp, Mus musculus
ctggagtagagaaggtccatctctg

SEQ ID NO: 275695 - DNA, 25 bp, Mus musculus
ctggagtatgccagacagctgaggc

SEQ ID NO: 275696 - DNA, 25 bp, Mus musculus
ctggagtatgccaggtactacatga

SEQ ID NO: 275697 - DNA, 25 bp, Mus musculus
ctggagtcaagctggaaccacctga

SEQ ID NO: 275698 - DNA, 25 bp, Mus musculus
ctggagtcaagggagatcgtggtga

SEQ ID NO: 275699 - DNA, 25 bp, Mus musculus
ctggagtcacgggaagtcctgcatg

SEQ ID NO: 275700 - DNA, 25 bp, Mus musculus
ctggagtcagaacagggagcccccg

SEQ ID NO: 275701 - DNA, 25 bp, Mus musculus
ctggagtcagaccagggagcccccg

SEQ ID NO: 275702 - DNA, 25 bp, Mus musculus
ctggagtcagaggagtttgacaaga

SEQ ID NO: 275703 - DNA, 25 bp, Mus musculus
ctggagtcatcaggggtttcctgag

SEQ ID NO: 275704 - DNA, 25 bp, Mus musculus
ctggagtcattagagtgttcagtgt

SEQ ID NO: 275705 - DNA, 25 bp, Mus musculus
ctggagtcattaggggccctgggac

SEQ ID NO: 275706 - DNA, 25 bp, Mus musculus
ctggagtccagcaatccaaacttcc

SEQ ID NO: 275707 - DNA, 25 bp, Mus musculus
ctggagtccataggctgtaccaact

SEQ ID NO: 275708 - DNA, 25 bp, Mus musculus
ctggagtccatcctgatggagtgca

SEQ ID NO: 275709 - DNA, 25 bp, Mus musculus
ctggagtccatgtgtaaagagctgg

SEQ ID NO: 275710 - DNA, 25 bp, Mus musculus
ctggagtccatgtttactgtcttgg

SEQ ID NO: 275711 - DNA, 25 bp, Mus musculus
ctggagtccattcgacaaagatgac

SEQ ID NO: 275712 - DNA, 25 bp, Mus musculus
ctggagtcctttcagggcttcttcg

SEQ ID NO: 275713 - DNA, 25 bp, Mus musculus
ctggagtctctggcgctgatcccac

SEQ ID NO: 275714 - DNA, 25 bp, Mus musculus
ctggagtctctggcggccccactga

SEQ ID NO: 275715 - DNA, 25 bp, Mus musculus
ctggagtctgtgaagagccacaatc

SEQ ID NO: 275716 - DNA, 25 bp, Mus musculus
ctggagtctgtgaaggagaagtttg

SEQ ID NO: 275717 - DNA, 25 bp, Mus musculus
ctggagtgagagagcctgtgctgtg

SEQ ID NO: 275718 - DNA, 25 bp, Mus musculus
ctggagtgagagaggaggagcgctt

SEQ ID NO: 275719 - DNA, 25 bp, Mus musculus
ctggagtgagagctgggaagtcatc

SEQ ID NO: 275720 - DNA, 25 bp, Mus musculus
ctggagtgaggaaaatggcacacca

SEQ ID NO: 275721 - DNA, 25 bp, Mus musculus
ctggagtgaggagaagaaacactgc

SEQ ID NO: 275722 - DNA, 25 bp, Mus musculus
ctggagtgaggcctgccacccctag

SEQ ID NO: 275723 - DNA, 25 bp, Mus musculus
ctggagtgaggtcaagggtcttcta

SEQ ID NO: 275724 - DNA, 25 bp, Mus musculus
ctggagtgcagccaccaggacgcag

SEQ ID NO: 275725 - DNA, 25 bp, Mus musculus
ctggagtgcggacacccggcctggc

SEQ ID NO: 275726 - DNA, 25 bp, Mus musculus
ctggagtggcaggagaagcgtagac

SEQ ID NO: 275727 - DNA, 25 bp, Mus musculus
ctggagtggcaggaggcctatgtga

SEQ ID NO: 275728 - DNA, 25 bp, Mus musculus
ctggagtgtactggatgtttgagac

SEQ ID NO: 275729 - DNA, 25 bp, Mus musculus
ctggagtgtccacagtacctgagaa

SEQ ID NO: 275730 - DNA, 25 bp, Mus musculus
ctggagtgtgagataacacgtatag

SEQ ID NO: 275731 - DNA, 25 bp, Mus musculus
ctggagtgtgggccagacccatggg

SEQ ID NO: 275732 - DNA, 25 bp, Mus musculus
ctggagttacagaaggtttggaggt

SEQ ID NO: 275733 - DNA, 25 bp, Mus musculus
ctggagttacagcttcgttacgacg

SEQ ID NO: 275734 - DNA, 25 bp, Mus musculus
ctggagttacggtgaaactagattg

SEQ ID NO: 275735 - DNA, 25 bp, Mus musculus
ctggagttagagctgaccatttgaa

SEQ ID NO: 275736 - DNA, 25 bp, Mus musculus
ctggagttagaggtgaccatttgaa

SEQ ID NO: 275737 - DNA, 25 bp, Mus musculus
ctggagttagccagaatggagaatg

SEQ ID NO: 275738 - DNA, 25 bp, Mus musculus
ctggagttatttagacaagatcctg

SEQ ID NO: 275739 - DNA, 25 bp, Mus musculus
ctggagttcagtgatgacttggatg

SEQ ID NO: 275740 - DNA, 25 bp, Mus musculus
ctggagttgcagagaaccccaaagg

SEQ ID NO: 275741 - DNA, 25 bp, Mus musculus
ctggagttgcagagacctcagacag

SEQ ID NO: 275742 - DNA, 25 bp, Mus musculus
ctggagttgcagctgttccatcggg

SEQ ID NO: 275743 - DNA, 25 bp, Mus musculus
ctggagttgcagtcctatcttcaga

SEQ ID NO: 275744 - DNA, 25 bp, Mus musculus
ctggagttggcgcgcaggctaccac

SEQ ID NO: 275745 - DNA, 25 bp, Mus musculus
ctggagtttcaggaactaatgacca

SEQ ID NO: 275746 - DNA, 25 bp, Mus musculus
ctggagtttctagcctcaaagcgga

SEQ ID NO: 275747 - DNA, 25 bp, Mus musculus
ctggagtttctcagtgacatcactg

SEQ ID NO: 275748 - DNA, 25 bp, Mus musculus
ctggagttttaggaaagatataccg

SEQ ID NO: 275749 - DNA, 25 bp, Mus musculus
ctggataaaaaggtagcaacaattg

SEQ ID NO: 275750 - DNA, 25 bp, Mus musculus
ctggataaagagttcaggaaggagt

SEQ ID NO: 275751 - DNA, 25 bp, Mus musculus
ctggataaagccgatcacgcgtcca

SEQ ID NO: 275752 - DNA, 25 bp, Mus musculus
ctggataacagtgcctccggagcca

SEQ ID NO: 275753 - DNA, 25 bp, Mus musculus
ctggataacttaaagagtatagaaa

SEQ ID NO: 275754 - DNA, 25 bp, Mus musculus
ctggataagaaccagactgcagaga

SEQ ID NO: 275755 - DNA, 25 bp, Mus musculus
ctggataagaaccagagaaggaaga

SEQ ID NO: 275756 - DNA, 25 bp, Mus musculus
ctggataagaaccagtactgggttg

SEQ ID NO: 275757 - DNA, 25 bp, Mus musculus
ctggataatggcggggaagctcagt

SEQ ID NO: 275758 - DNA, 25 bp, Mus musculus
ctggatacagacaggatctttctac

SEQ ID NO: 275759 - DNA, 25 bp, Mus musculus
ctggatacagccaaggtctccaagc

SEQ ID NO: 275760 - DNA, 25 bp, Mus musculus
ctggatacaggggtctgtgatgtga

SEQ ID NO: 275761 - DNA, 25 bp, Mus musculus
ctggatacaggtggaaacgtcctca

SEQ ID NO: 275762 - DNA, 25 bp, Mus musculus
ctggatacagttaccagtaagattg

SEQ ID NO: 275763 - DNA, 25 bp, Mus musculus
ctggatacccagtttgcagatggcg

SEQ ID NO: 275764 - DNA, 25 bp, Mus musculus
ctggatactgcctgtgcctcacaac

SEQ ID NO: 275765 - DNA, 25 bp, Mus musculus
ctggatactggtaacagcatgacca

SEQ ID NO: 275766 - DNA, 25 bp, Mus musculus
ctggatagaaggaagcaggccagca

SEQ ID NO: 275767 - DNA, 25 bp, Mus musculus
ctggatagagcggcagtacatccct

SEQ ID NO: 275768 - DNA, 25 bp, Mus musculus
ctggatagcctgcttggcagtgacc

SEQ ID NO: 275769 - DNA, 25 bp, Mus musculus
ctggatagcctggtaggacagtcct

SEQ ID NO: 275770 - DNA, 25 bp, Mus musculus
ctggatagtaaggtgaacatcattc

SEQ ID NO: 275771 - DNA, 25 bp, Mus musculus
ctggatatacttcagaatctgacca

SEQ ID NO: 275772 - DNA, 25 bp, Mus musculus
ctggatatacttcagctccaacaga

SEQ ID NO: 275773 - DNA, 25 bp, Mus musculus
ctggatatacttcaggaactaattc

SEQ ID NO: 275774 - DNA, 25 bp, Mus musculus
ctggatatgcaagctcttgaagaca

SEQ ID NO: 275775 - DNA, 25 bp, Mus musculus
ctggatatgcaagttttgattatga

SEQ ID NO: 275776 - DNA, 25 bp, Mus musculus
ctggatcaaaggcctacagtttcaa

SEQ ID NO: 275777 - DNA, 25 bp, Mus musculus
ctggatcaaggagaaaatacaactg

SEQ ID NO: 275778 - DNA, 25 bp, Mus musculus
ctggatcacactggatgcagcctac

SEQ ID NO: 275779 - DNA, 25 bp, Mus musculus
ctggatcaccaggtgttgatgctca

SEQ ID NO: 275780 - DNA, 25 bp, Mus musculus
ctggatcagaaaaggaagtggaagc

SEQ ID NO: 275781 - DNA, 25 bp, Mus musculus
ctggatcagaccctgaatctgtgga

SEQ ID NO: 275782 - DNA, 25 bp, Mus musculus
ctggatcagactaagagcagcgtta

SEQ ID NO: 275783 - DNA, 25 bp, Mus musculus
ctggatcagaggtatcctgtcttgg

SEQ ID NO: 275784 - DNA, 25 bp, Mus musculus
ctggatcatgcacctccagagatcc

SEQ ID NO: 275785 - DNA, 25 bp, Mus musculus
ctggatccaggcttacaattacttt

SEQ ID NO: 275786 - DNA, 25 bp, Mus musculus
ctggatccaggtgaaccttctgcgg

SEQ ID NO: 275787 - DNA, 25 bp, Mus musculus
ctggatccaggtggtacccgggaga

SEQ ID NO: 275788 - DNA, 25 bp, Mus musculus
ctggatcccaagacagaccctgtgc

SEQ ID NO: 275789 - DNA, 25 bp, Mus musculus
ctggatccccacaatgatctgcatc

SEQ ID NO: 275790 - DNA, 25 bp, Mus musculus
ctggatccgggaggaacatcacaag

SEQ ID NO: 275791 - DNA, 25 bp, Mus musculus
ctggatcctcccagccactggtgtg

SEQ ID NO: 275792 - DNA, 25 bp, Mus musculus
ctggatcctcccagggttcactgat

SEQ ID NO: 275793 - DNA, 25 bp, Mus musculus
ctggatcgagagaaagtgcaacagt

SEQ ID NO: 275794 - DNA, 25 bp, Mus musculus
ctggatcgagagcgtctgtcctgtg

SEQ ID NO: 275795 - DNA, 25 bp, Mus musculus
ctggatcgagagggtctgtcctgtg

SEQ ID NO: 275796 - DNA, 25 bp, Mus musculus
ctggatcgagagtaagtgcaacagt

SEQ ID NO: 275797 - DNA, 25 bp, Mus musculus
ctggatctaacaaggagcgagattt

SEQ ID NO: 275798 - DNA, 25 bp, Mus musculus
ctggatctaacaaggttcatttaat

SEQ ID NO: 275799 - DNA, 25 bp, Mus musculus
ctggatctcttccaggaatgtctcg

SEQ ID NO: 275800 - DNA, 25 bp, Mus musculus
ctggatctgaagatccttcttgatg

SEQ ID NO: 275801 - DNA, 25 bp, Mus musculus
ctggatctgaaggcggcacgttttc

SEQ ID NO: 275802 - DNA, 25 bp, Mus musculus
ctggatctgagggaaatctgctcca

SEQ ID NO: 275803 - DNA, 25 bp, Mus musculus
ctggatctgagtcaggatgcgtaca

SEQ ID NO: 275804 - DNA, 25 bp, Mus musculus
ctggatctggagcctgatctctcaa

SEQ ID NO: 275805 - DNA, 25 bp, Mus musculus
ctggatctggtgaagcaggaaggcc

SEQ ID NO: 275806 - DNA, 25 bp, Mus musculus
ctggatcttacggagggctggatcg

SEQ ID NO: 275807 - DNA, 25 bp, Mus musculus
ctggatcttgcaactccatctcgga

SEQ ID NO: 275808 - DNA, 25 bp, Mus musculus
ctggatcttgcaactgaatctgcct

SEQ ID NO: 275809 - DNA, 25 bp, Mus musculus
ctggatctttaaagcgcagtgctaa

SEQ ID NO: 275810 - DNA, 25 bp, Mus musculus
ctggatgaaaggtcgagatttcagg

SEQ ID NO: 275811 - DNA, 25 bp, Mus musculus
ctggatgaaagtgaggcagcagcat

SEQ ID NO: 275812 - DNA, 25 bp, Mus musculus
ctggatgaacaacactttcatggtg

SEQ ID NO: 275813 - DNA, 25 bp, Mus musculus
ctggatgaagatgggtttgtggagg

SEQ ID NO: 275814 - DNA, 25 bp, Mus musculus
ctggatgaagctgtagcaatggagt

SEQ ID NO: 275815 - DNA, 25 bp, Mus musculus
ctggatgaatttgacttcttagcac

SEQ ID NO: 275816 - DNA, 25 bp, Mus musculus
ctggatgacaagccaagcccgatca

SEQ ID NO: 275817 - DNA, 25 bp, Mus musculus
ctggatgacagctctgaccaggctc

SEQ ID NO: 275818 - DNA, 25 bp, Mus musculus
ctggatgaccggttctaatcagaga

SEQ ID NO: 275819 - DNA, 25 bp, Mus musculus
ctggatgacgagttgatagacacac

SEQ ID NO: 275820 - DNA, 25 bp, Mus musculus
ctggatgacgttaatgaaatcatca

SEQ ID NO: 275821 - DNA, 25 bp, Mus musculus
ctggatgactctgctcactggaggg

SEQ ID NO: 275822 - DNA, 25 bp, Mus musculus
ctggatgagagggtttaccagcccc

SEQ ID NO: 275823 - DNA, 25 bp, Mus musculus
ctggatgaggagaactttgtgaaag

SEQ ID NO: 275824 - DNA, 25 bp, Mus musculus
ctggatgagtggatctccacttggg

SEQ ID NO: 275825 - DNA, 25 bp, Mus musculus
ctggatgatacctggaaaaatggtg

SEQ ID NO: 275826 - DNA, 25 bp, Mus musculus
ctggatgatctatacctactcaggc

SEQ ID NO: 275827 - DNA, 25 bp, Mus musculus
ctggatgatgggctaggccatggca

SEQ ID NO: 275828 - DNA, 25 bp, Mus musculus
ctggatgatggtgtgattgccagca

SEQ ID NO: 275829 - DNA, 25 bp, Mus musculus
ctggatgcagaccttcaatttggtt

SEQ ID NO: 275830 - DNA, 25 bp, Mus musculus
ctggatgccactggtaagaccacac

SEQ ID NO: 275831 - DNA, 25 bp, Mus musculus
ctggatgccactggtactggcatag

SEQ ID NO: 275832 - DNA, 25 bp, Mus musculus
ctggatgccaggcgcaagcggcgga

SEQ ID NO: 275833 - DNA, 25 bp, Mus musculus
ctggatgccatcgatgccctcatga

SEQ ID NO: 275834 - DNA, 25 bp, Mus musculus
ctggatgccccaggaactggatgcc

SEQ ID NO: 275835 - DNA, 25 bp, Mus musculus
ctggatgccccagttttataggcaa

SEQ ID NO: 275836 - DNA, 25 bp, Mus musculus
ctggatgcctatgctgaacaccctg

SEQ ID NO: 275837 - DNA, 25 bp, Mus musculus
ctggatgcgtctaggtcttccaagt

SEQ ID NO: 275838 - DNA, 25 bp, Mus musculus
ctggatgctagaggtctgtgaggaa

SEQ ID NO: 275839 - DNA, 25 bp, Mus musculus
ctggatgctatgagctgatacaagt

SEQ ID NO: 275840 - DNA, 25 bp, Mus musculus
ctggatgctatgtcaggatcgcagc

SEQ ID NO: 275841 - DNA, 25 bp, Mus musculus
ctggatgctcagacatggtgcctgg

SEQ ID NO: 275842 - DNA, 25 bp, Mus musculus
ctggatgctcagagacaatgtctat

SEQ ID NO: 275843 - DNA, 25 bp, Mus musculus
ctggatggaacctgttcgatttctc

SEQ ID NO: 275844 - DNA, 25 bp, Mus musculus
ctggatggaccaagggccaagtgtg

SEQ ID NO: 275845 - DNA, 25 bp, Mus musculus
ctggatggagagggccctggatgtc

SEQ ID NO: 275846 - DNA, 25 bp, Mus musculus
ctggatggcagccatagattgtaag

SEQ ID NO: 275847 - DNA, 25 bp, Mus musculus
ctggatggcttttatgatcatttta

SEQ ID NO: 275848 - DNA, 25 bp, Mus musculus
ctggatggggggtgtgccagccttc

SEQ ID NO: 275849 - DNA, 25 bp, Mus musculus
ctggatgtactggacaaacaaacaa

SEQ ID NO: 275850 - DNA, 25 bp, Mus musculus
ctggatgtcagctctctgctggaaa

SEQ ID NO: 275851 - DNA, 25 bp, Mus musculus
ctggatgtctctgcaccatcggttt

SEQ ID NO: 275852 - DNA, 25 bp, Mus musculus
ctggatgtgcagtattcccccacag

SEQ ID NO: 275853 - DNA, 25 bp, Mus musculus
ctggatgttcaaattggggaatggc

SEQ ID NO: 275854 - DNA, 25 bp, Mus musculus
ctggattaaaaaggatcagttctta

SEQ ID NO: 275855 - DNA, 25 bp, Mus musculus
ctggattaaaaagggccaaatcctt

SEQ ID NO: 275856 - DNA, 25 bp, Mus musculus
ctggattaaaaagtgcctgcacccg

SEQ ID NO: 275857 - DNA, 25 bp, Mus musculus
ctggattagcaccaggaatgtcact

SEQ ID NO: 275858 - DNA, 25 bp, Mus musculus
ctggattcaaggggaagaagccagc

SEQ ID NO: 275859 - DNA, 25 bp, Mus musculus
ctggattcacaggaattcactgtga

SEQ ID NO: 275860 - DNA, 25 bp, Mus musculus
ctggattcagaagaataccacaacc

SEQ ID NO: 275861 - DNA, 25 bp, Mus musculus
ctggattcagtcatttgaagactga

SEQ ID NO: 275862 - DNA, 25 bp, Mus musculus
ctggattcagtggcgccgacatcgc

SEQ ID NO: 275863 - DNA, 25 bp, Mus musculus
ctggattcagtgggcagagccagca

SEQ ID NO: 275864 - DNA, 25 bp, Mus musculus
ctggattccttacagtgtcctagat

SEQ ID NO: 275865 - DNA, 25 bp, Mus musculus
ctggattctcggagagtccttcttg

SEQ ID NO: 275866 - DNA, 25 bp, Mus musculus
ctggattctcggtgggagccagcgc

SEQ ID NO: 275867 - DNA, 25 bp, Mus musculus
ctggattgggtttatgcagaactct

SEQ ID NO: 275868 - DNA, 25 bp, Mus musculus
ctggattgggtttgaactcggagag

SEQ ID NO: 275869 - DNA, 25 bp, Mus musculus
ctggattgtagaacttcaatgcagg

SEQ ID NO: 275870 - DNA, 25 bp, Mus musculus
ctggattgtggaaggggaggagcgc

SEQ ID NO: 275871 - DNA, 25 bp, Mus musculus
ctggatttaaccagagctgtctgtc

SEQ ID NO: 275872 - DNA, 25 bp, Mus musculus
ctggatttaaccaggtgccagattt

SEQ ID NO: 275873 - DNA, 25 bp, Mus musculus
ctggatttaagattgagattttttt

SEQ ID NO: 275874 - DNA, 25 bp, Mus musculus
ctggatttatccaggtgtgaaattg

SEQ ID NO: 275875 - DNA, 25 bp, Mus musculus
ctggatttatgataaagctgctcaa

SEQ ID NO: 275876 - DNA, 25 bp, Mus musculus
ctggatttggggaatacacatgcca

SEQ ID NO: 275877 - DNA, 25 bp, Mus musculus
ctggatttgggggtcctgttacaga

SEQ ID NO: 275878 - DNA, 25 bp, Mus musculus
ctggattttcgcaactgcgcaaacc

SEQ ID NO: 275879 - DNA, 25 bp, Mus musculus
ctggcaaaagatgcttgcattgggc

SEQ ID NO: 275880 - DNA, 25 bp, Mus musculus
ctggcaaaaggtgcccgaggtgacc

SEQ ID NO: 275881 - DNA, 25 bp, Mus musculus
ctggcaaaatgcgtgcccacacttt

SEQ ID NO: 275882 - DNA, 25 bp, Mus musculus
ctggcaaacagtcagtgtgaatttg

SEQ ID NO: 275883 - DNA, 25 bp, Mus musculus
ctggcaaaccctatgtttgatgacc

SEQ ID NO: 275884 - DNA, 25 bp, Mus musculus
ctggcaaactgttctgcggtggagg

SEQ ID NO: 275885 - DNA, 25 bp, Mus musculus
ctggcaaactgttctgtggtggttc

SEQ ID NO: 275886 - DNA, 25 bp, Mus musculus
ctggcaaagcaagagattcgagtaa

SEQ ID NO: 275887 - DNA, 25 bp, Mus musculus
ctggcaaagggtatacctggccttg

SEQ ID NO: 275888 - DNA, 25 bp, Mus musculus
ctggcaaaggtgggttccagcactg

SEQ ID NO: 275889 - DNA, 25 bp, Mus musculus
ctggcaacagtgatccggagcatct

SEQ ID NO: 275890 - DNA, 25 bp, Mus musculus
ctggcaaccagcatctgatgacatg

SEQ ID NO: 275891 - DNA, 25 bp, Mus musculus
ctggcaaccaggaagctgccctcag

SEQ ID NO: 275892 - DNA, 25 bp, Mus musculus
ctggcaacccagaactgatagtgca

SEQ ID NO: 275893 - DNA, 25 bp, Mus musculus
ctggcaacccagattgacttgatgc

SEQ ID NO: 275894 - DNA, 25 bp, Mus musculus
ctggcaactatgacgctgatttcca

SEQ ID NO: 275895 - DNA, 25 bp, Mus musculus
ctggcaagacggcttccttgtgggt

SEQ ID NO: 275896 - DNA, 25 bp, Mus musculus
ctggcaagagaaatgtctcaggctg

SEQ ID NO: 275897 - DNA, 25 bp, Mus musculus
ctggcaagagagtgctaacagccaa

SEQ ID NO: 275898 - DNA, 25 bp, Mus musculus
ctggcaagaggagcactcacccctg

SEQ ID NO: 275899 - DNA, 25 bp, Mus musculus
ctggcaagaggtccgtcttccacgg

SEQ ID NO: 275900 - DNA, 25 bp, Mus musculus
ctggcaagcaagaacaaggatgaga

SEQ ID NO: 275901 - DNA, 25 bp, Mus musculus
ctggcaagcacgatctgcccatgga

SEQ ID NO: 275902 - DNA, 25 bp, Mus musculus
ctggcaagtggctgagtatctccag

SEQ ID NO: 275903 - DNA, 25 bp, Mus musculus
ctggcaataaggagaggatggctgt

SEQ ID NO: 275904 - DNA, 25 bp, Mus musculus
ctggcaatctcagagctaagtaaaa

SEQ ID NO: 275905 - DNA, 25 bp, Mus musculus
ctggcaatctcagtttgtgactctg

SEQ ID NO: 275906 - DNA, 25 bp, Mus musculus
ctggcaatgacattggtccctatgg

SEQ ID NO: 275907 - DNA, 25 bp, Mus musculus
ctggcacaacagtggggtgagttta

SEQ ID NO: 275908 - DNA, 25 bp, Mus musculus
ctggcacaaggcaggcgacaagcat

SEQ ID NO: 275909 - DNA, 25 bp, Mus musculus
ctggcacaagggtgactgtggccct

SEQ ID NO: 275910 - DNA, 25 bp, Mus musculus
ctggcacaaggtaacacggaagtca

SEQ ID NO: 275911 - DNA, 25 bp, Mus musculus
ctggcacaaggtgatagagggaaag

SEQ ID NO: 275912 - DNA, 25 bp, Mus musculus
ctggcacacaatctgccattatttg

SEQ ID NO: 275913 - DNA, 25 bp, Mus musculus
ctggcacacgccccaaggaaagtat

SEQ ID NO: 275914 - DNA, 25 bp, Mus musculus
ctggcacagctccgggaggcctttg

SEQ ID NO: 275915 - DNA, 25 bp, Mus musculus
ctggcacaggagagggaggcctgga

SEQ ID NO: 275916 - DNA, 25 bp, Mus musculus
ctggcacaggaggcctggaggagct

SEQ ID NO: 275917 - DNA, 25 bp, Mus musculus
ctggcacatgaggtcgggtggaagt

SEQ ID NO: 275918 - DNA, 25 bp, Mus musculus
ctggcaccagaggtattagaagata

SEQ ID NO: 275919 - DNA, 25 bp, Mus musculus
ctggcaccagctgaggatggttccc

SEQ ID NO: 275920 - DNA, 25 bp, Mus musculus
ctggcaccagctggagaacataggt

SEQ ID NO: 275921 - DNA, 25 bp, Mus musculus
ctggcacccagaaggacctcttaaa

SEQ ID NO: 275922 - DNA, 25 bp, Mus musculus
ctggcaccttccggcagaaaggtgt

SEQ ID NO: 275923 - DNA, 25 bp, Mus musculus
ctggcacgaaatcctagtttcgtcc

SEQ ID NO: 275924 - DNA, 25 bp, Mus musculus
ctggcacggagtggactgctggatc

SEQ ID NO: 275925 - DNA, 25 bp, Mus musculus
ctggcactaacagaacctttagaag

SEQ ID NO: 275926 - DNA, 25 bp, Mus musculus
ctggcactacagatgctcatgacat

SEQ ID NO: 275927 - DNA, 25 bp, Mus musculus
ctggcactactggcctgcccaaggc

SEQ ID NO: 275928 - DNA, 25 bp, Mus musculus
ctggcactcagggagcatggcactc

SEQ ID NO: 275929 - DNA, 25 bp, Mus musculus
ctggcactgaggtttgggaaccaga

SEQ ID NO: 275930 - DNA, 25 bp, Mus musculus
ctggcactgcagagcaaaaaaacac

SEQ ID NO: 275931 - DNA, 25 bp, Mus musculus
ctggcactgcagtggagaaagcatg

SEQ ID NO: 275932 - DNA, 25 bp, Mus musculus
ctggcactgcctagagacttcctgc

SEQ ID NO: 275933 - DNA, 25 bp, Mus musculus
ctggcactgtgaaaattccacctaa

SEQ ID NO: 275934 - DNA, 25 bp, Mus musculus
ctggcagaaagggctgaggccacgc

SEQ ID NO: 275935 - DNA, 25 bp, Mus musculus
ctggcagaagctcttggcatttgtg

SEQ ID NO: 275936 - DNA, 25 bp, Mus musculus
ctggcagaaggttctctctcttgcc

SEQ ID NO: 275937 - DNA, 25 bp, Mus musculus
ctggcagaagtagagaaggatgtcc

SEQ ID NO: 275938 - DNA, 25 bp, Mus musculus
ctggcagaatgagaatgtgattctg

SEQ ID NO: 275939 - DNA, 25 bp, Mus musculus
ctggcagagaacgaatcttggagag

SEQ ID NO: 275940 - DNA, 25 bp, Mus musculus
ctggcagagaagcaacatggcttct

SEQ ID NO: 275941 - DNA, 25 bp, Mus musculus
ctggcagagaagcaataccacatca

SEQ ID NO: 275942 - DNA, 25 bp, Mus musculus
ctggcagagaaggaggccgcatcca

SEQ ID NO: 275943 - DNA, 25 bp, Mus musculus
ctggcagagacggagggcatgctca

SEQ ID NO: 275944 - DNA, 25 bp, Mus musculus
ctggcagaggcctgcctcaaaatgc

SEQ ID NO: 275945 - DNA, 25 bp, Mus musculus
ctggcagagtcccgttgccgagaga

SEQ ID NO: 275946 - DNA, 25 bp, Mus musculus
ctggcagagtctaagtgttctgagc

SEQ ID NO: 275947 - DNA, 25 bp, Mus musculus
ctggcagatgctcaggtatgggctt

SEQ ID NO: 275948 - DNA, 25 bp, Mus musculus
ctggcagcaatgctggctttcaatg

SEQ ID NO: 275949 - DNA, 25 bp, Mus musculus
ctggcagcagacttttcacagattg

SEQ ID NO: 275950 - DNA, 25 bp, Mus musculus
ctggcagccagatgaggatgatgcc

SEQ ID NO: 275951 - DNA, 25 bp, Mus musculus
ctggcagccatggtcacgtctctgg

SEQ ID NO: 275952 - DNA, 25 bp, Mus musculus
ctggcagcgaacatgcgccgggatg

SEQ ID NO: 275953 - DNA, 25 bp, Mus musculus
ctggcagcgataggaaggacctgga

SEQ ID NO: 275954 - DNA, 25 bp, Mus musculus
ctggcagcgataggcttcattctca

SEQ ID NO: 275955 - DNA, 25 bp, Mus musculus
ctggcagcgatagggcttacccact

SEQ ID NO: 275956 - DNA, 25 bp, Mus musculus
ctggcagcgataggtcacttgccca

SEQ ID NO: 275957 - DNA, 25 bp, Mus musculus
ctggcagctagagagaattccagaa

SEQ ID NO: 275958 - DNA, 25 bp, Mus musculus
ctggcagctagagaggacccttatg

SEQ ID NO: 275959 - DNA, 25 bp, Mus musculus
ctggcaggaaggagactgcggccca

SEQ ID NO: 275960 - DNA, 25 bp, Mus musculus
ctggcaggaaggccatattgacaca

SEQ ID NO: 275961 - DNA, 25 bp, Mus musculus
ctggcaggaaggccatcttgacaca

SEQ ID NO: 275962 - DNA, 25 bp, Mus musculus
ctggcaggagacaagaacttcatca

SEQ ID NO: 275963 - DNA, 25 bp, Mus musculus
ctggcaggagacctagaacttcatc

SEQ ID NO: 275964 - DNA, 25 bp, Mus musculus
ctggcaggaggcagaaaggatgagc

SEQ ID NO: 275965 - DNA, 25 bp, Mus musculus
ctggcaggaggcaggtcattcattc

SEQ ID NO: 275966 - DNA, 25 bp, Mus musculus
ctggcaggatgggagcctcctgcct

SEQ ID NO: 275967 - DNA, 25 bp, Mus musculus
ctggcaggatgggccaccgctgact

SEQ ID NO: 275968 - DNA, 25 bp, Mus musculus
ctggcaggctctgtcccaggtaaat

SEQ ID NO: 275969 - DNA, 25 bp, Mus musculus
ctggcagggactggtccagcacctg

SEQ ID NO: 275970 - DNA, 25 bp, Mus musculus
ctggcagggctaacttcccgctcgg

SEQ ID NO: 275971 - DNA, 25 bp, Mus musculus
ctggcaggtcccaagggtgcccctg

SEQ ID NO: 275972 - DNA, 25 bp, Mus musculus
ctggcaggtgtccctgccgtgtgtc

SEQ ID NO: 275973 - DNA, 25 bp, Mus musculus
ctggcagtaactggcaagaagacag

SEQ ID NO: 275974 - DNA, 25 bp, Mus musculus
ctggcagtaccgagaggtcgactca

SEQ ID NO: 275975 - DNA, 25 bp, Mus musculus
ctggcagtcagcaaacaaaaccggg

SEQ ID NO: 275976 - DNA, 25 bp, Mus musculus
ctggcagtcagcaaccaccctcccc

SEQ ID NO: 275977 - DNA, 25 bp, Mus musculus
ctggcagtgagatccgccatcgcga

SEQ ID NO: 275978 - DNA, 25 bp, Mus musculus
ctggcagttttttgcatgttacatg

SEQ ID NO: 275979 - DNA, 25 bp, Mus musculus
ctggcataaggatgctttcattggc

SEQ ID NO: 275980 - DNA, 25 bp, Mus musculus
ctggcataaggccactcagaagggt

SEQ ID NO: 275981 - DNA, 25 bp, Mus musculus
ctggcataagggagctggtaagccg

SEQ ID NO: 275982 - DNA, 25 bp, Mus musculus
ctggcatactacaggatctatgggc

SEQ ID NO: 275983 - DNA, 25 bp, Mus musculus
ctggcatagttggagcgataggtct

SEQ ID NO: 275984 - DNA, 25 bp, Mus musculus
ctggcatcatgggagcaggctgcac

SEQ ID NO: 275985 - DNA, 25 bp, Mus musculus
ctggcatcatggtcaaaaatgctgc

SEQ ID NO: 275986 - DNA, 25 bp, Mus musculus
ctggcatcatttgtaccatctgtac

SEQ ID NO: 275987 - DNA, 25 bp, Mus musculus
ctggcatccaggtgcgctacctgaa

SEQ ID NO: 275988 - DNA, 25 bp, Mus musculus
ctggcatcgctggtgaggaaccaca

SEQ ID NO: 275989 - DNA, 25 bp, Mus musculus
ctggcatcgctggtgggggcgctcc

SEQ ID NO: 275990 - DNA, 25 bp, Mus musculus
ctggcatcgtcaagaccactgggag

SEQ ID NO: 275991 - DNA, 25 bp, Mus musculus
ctggcatcttgaaggtaagtgacct

SEQ ID NO: 275992 - DNA, 25 bp, Mus musculus
ctggcatgaaatcctggggcagagt

SEQ ID NO: 275993 - DNA, 25 bp, Mus musculus
ctggcatgcggcctcctcctccagg

SEQ ID NO: 275994 - DNA, 25 bp, Mus musculus
ctggcatggaagatgaaagagaaga

SEQ ID NO: 275995 - DNA, 25 bp, Mus musculus
ctggcatggacgagatggcagttga

SEQ ID NO: 275996 - DNA, 25 bp, Mus musculus
ctggcatggagccagaccactcggc

SEQ ID NO: 275997 - DNA, 25 bp, Mus musculus
ctggcatgggatggagagtctgtat

SEQ ID NO: 275998 - DNA, 25 bp, Mus musculus
ctggcatgggatgggggacagctgt

SEQ ID NO: 275999 - DNA, 25 bp, Mus musculus
ctggcatgtctaagccaatcaaagt

SEQ ID NO: 276000 - DNA, 25 bp, Mus musculus
ctggcattagggcaggctggatata

SEQ ID NO: 276001 - DNA, 25 bp, Mus musculus
ctggcattagtacactgtagctgtc

SEQ ID NO: 276002 - DNA, 25 bp, Mus musculus
ctggcattgcagatttatttcctgg

SEQ ID NO: 276003 - DNA, 25 bp, Mus musculus
ctggcattgcaggccgaggagaatc

SEQ ID NO: 276004 - DNA, 25 bp, Mus musculus
ctggcattggaccatctgctgcaag

SEQ ID NO: 276005 - DNA, 25 bp, Mus musculus
ctggcattggatctcaggaaaaatg

SEQ ID NO: 276006 - DNA, 25 bp, Mus musculus
ctggcattgggattccaggcatagt

SEQ ID NO: 276007 - DNA, 25 bp, Mus musculus
ctggccaaaatttatgagaagatct

SEQ ID NO: 276008 - DNA, 25 bp, Mus musculus
ctggccaaaatttcctctgtgaagc

SEQ ID NO: 276009 - DNA, 25 bp, Mus musculus
ctggccaaacgaaagctgggctctc

SEQ ID NO: 276010 - DNA, 25 bp, Mus musculus
ctggccaaagggtcattatcgttat

SEQ ID NO: 276011 - DNA, 25 bp, Mus musculus
ctggccaaaggtcagcctccaagac

SEQ ID NO: 276012 - DNA, 25 bp, Mus musculus
ctggccaaaggtcggacatcaaata

SEQ ID NO: 276013 - DNA, 25 bp, Mus musculus
ctggccaagaaggggatgaggtgtt

SEQ ID NO: 276014 - DNA, 25 bp, Mus musculus
ctggccaagcttaagcaaagtgaga

SEQ ID NO: 276015 - DNA, 25 bp, Mus musculus
ctggccaagcttaagctatgtactt

SEQ ID NO: 276016 - DNA, 25 bp, Mus musculus
ctggccaagcttaaggccttggaag

SEQ ID NO: 276017 - DNA, 25 bp, Mus musculus
ctggccaagtactgtgaggtgctga

SEQ ID NO: 276018 - DNA, 25 bp, Mus musculus
ctggccaagttcagcaagaaggccg

SEQ ID NO: 276019 - DNA, 25 bp, Mus musculus
ctggccacagagttcctggagtccc

SEQ ID NO: 276020 - DNA, 25 bp, Mus musculus
ctggccacaggaccagctgccaata

SEQ ID NO: 276021 - DNA, 25 bp, Mus musculus
ctggccacaggcctgcccaaggctg

SEQ ID NO: 276022 - DNA, 25 bp, Mus musculus
ctggccacaggggcattgttgtgac

SEQ ID NO: 276023 - DNA, 25 bp, Mus musculus
ctggccaccagccccactctgcccc

SEQ ID NO: 276024 - DNA, 25 bp, Mus musculus
ctggccaccaggataaagcatgagt

SEQ ID NO: 276025 - DNA, 25 bp, Mus musculus
ctggccaccccgtgtcctatgcacc

SEQ ID NO: 276026 - DNA, 25 bp, Mus musculus
ctggccacctctgcgatgctcaaaa

SEQ ID NO: 276027 - DNA, 25 bp, Mus musculus
ctggccactccctaccgaggatgct

SEQ ID NO: 276028 - DNA, 25 bp, Mus musculus
ctggccactgagctcaccctcgttc

SEQ ID NO: 276029 - DNA, 25 bp, Mus musculus
ctggccactgaggacccctataata

SEQ ID NO: 276030 - DNA, 25 bp, Mus musculus
ctggccactgcttggcctgtccact

SEQ ID NO: 276031 - DNA, 25 bp, Mus musculus
ctggccactgtcacggtctgtctga

SEQ ID NO: 276032 - DNA, 25 bp, Mus musculus
ctggccactgtggtcaaagcacgaa

SEQ ID NO: 276033 - DNA, 25 bp, Mus musculus
ctggccactgtgtttacttatttta

SEQ ID NO: 276034 - DNA, 25 bp, Mus musculus
ctggccagaaacagatctggagaat

SEQ ID NO: 276035 - DNA, 25 bp, Mus musculus
ctggccagaaggatgtcaatgggcc

SEQ ID NO: 276036 - DNA, 25 bp, Mus musculus
ctggccagactcagacacaacaaca

SEQ ID NO: 276037 - DNA, 25 bp, Mus musculus
ctggccagagaaggtgcttgacatc

SEQ ID NO: 276038 - DNA, 25 bp, Mus musculus
ctggccagagaagtctttctgtctt

SEQ ID NO: 276039 - DNA, 25 bp, Mus musculus
ctggccagagagcaatggaagtacc

SEQ ID NO: 276040 - DNA, 25 bp, Mus musculus
ctggccagaggacacggatgctctc

SEQ ID NO: 276041 - DNA, 25 bp, Mus musculus
ctggccagagtcatggatttgatag

SEQ ID NO: 276042 - DNA, 25 bp, Mus musculus
ctggccagcaacacaacaacatttt

SEQ ID NO: 276043 - DNA, 25 bp, Mus musculus
ctggccagctttggaatctctgttg

SEQ ID NO: 276044 - DNA, 25 bp, Mus musculus
ctggccagctttggcactttctagg

SEQ ID NO: 276045 - DNA, 25 bp, Mus musculus
ctggccaggagtgaattggaggaag

SEQ ID NO: 276046 - DNA, 25 bp, Mus musculus
ctggccaggagtgagaagacataat

SEQ ID NO: 276047 - DNA, 25 bp, Mus musculus
ctggccagggagaggagatcgaggg

SEQ ID NO: 276048 - DNA, 25 bp, Mus musculus
ctggccagtaaggcccgaatggctg

SEQ ID NO: 276049 - DNA, 25 bp, Mus musculus
ctggccagtcaagatagccagccct

SEQ ID NO: 276050 - DNA, 25 bp, Mus musculus
ctggccagtgatcttctagagtgga

SEQ ID NO: 276051 - DNA, 25 bp, Mus musculus
ctggccagtgggttgatttcttcat

SEQ ID NO: 276052 - DNA, 25 bp, Mus musculus
ctggccagttcagcttccaaaggcc

SEQ ID NO: 276053 - DNA, 25 bp, Mus musculus
ctggccagttcaggatttccactta

SEQ ID NO: 276054 - DNA, 25 bp, Mus musculus
ctggccatacatagggaaaggcagg

SEQ ID NO: 276055 - DNA, 25 bp, Mus musculus
ctggccataggcttcttccctggga

SEQ ID NO: 276056 - DNA, 25 bp, Mus musculus
ctggccatcactgatgtgtccttcc

SEQ ID NO: 276057 - DNA, 25 bp, Mus musculus
ctggccatcactgcttcaccacgac

SEQ ID NO: 276058 - DNA, 25 bp, Mus musculus
ctggccatccgagcagtggcaaagc

SEQ ID NO: 276059 - DNA, 25 bp, Mus musculus
ctggccatctcaggtgagttggagt

SEQ ID NO: 276060 - DNA, 25 bp, Mus musculus
ctggccatgaagcacgagaacgagg

SEQ ID NO: 276061 - DNA, 25 bp, Mus musculus
ctggccatgagtactttgtgttctg

SEQ ID NO: 276062 - DNA, 25 bp, Mus musculus
ctggccatgttgcagaggttctcag

SEQ ID NO: 276063 - DNA, 25 bp, Mus musculus
ctggcccaagaggcattatcgacct

SEQ ID NO: 276064 - DNA, 25 bp, Mus musculus
ctggcccacaagacccgccctagtt

SEQ ID NO: 276065 - DNA, 25 bp, Mus musculus
ctggcccacaagcccccactgtgaa

SEQ ID NO: 276066 - DNA, 25 bp, Mus musculus
ctggcccacagaattacggcagcgg

SEQ ID NO: 276067 - DNA, 25 bp, Mus musculus
ctggcccacagactgacccttggtt

SEQ ID NO: 276068 - DNA, 25 bp, Mus musculus
ctggcccacggacgaccatgacacc

SEQ ID NO: 276069 - DNA, 25 bp, Mus musculus
ctggcccagcagctggagcaattca

SEQ ID NO: 276070 - DNA, 25 bp, Mus musculus
ctggcccagcgggtacaccaggaaa

SEQ ID NO: 276071 - DNA, 25 bp, Mus musculus
ctggcccagctctgggatgggttga

SEQ ID NO: 276072 - DNA, 25 bp, Mus musculus
ctggcccagctctggggagaactct

SEQ ID NO: 276073 - DNA, 25 bp, Mus musculus
ctggcccaggaggtgtctgagactg

SEQ ID NO: 276074 - DNA, 25 bp, Mus musculus
ctggcccataaatgctgttggctgc

SEQ ID NO: 276075 - DNA, 25 bp, Mus musculus
ctggccccaaggtggccattgaaga

SEQ ID NO: 276076 - DNA, 25 bp, Mus musculus
ctggccccagacaggttcagaactt

SEQ ID NO: 276077 - DNA, 25 bp, Mus musculus
ctggccccagtgcagattaaggttg

SEQ ID NO: 276078 - DNA, 25 bp, Mus musculus
ctggccccatgggtccttctggtcc

SEQ ID NO: 276079 - DNA, 25 bp, Mus musculus
ctggcccccaaggccatgaagaaga

SEQ ID NO: 276080 - DNA, 25 bp, Mus musculus
ctggccccccgcggacttccaatag

SEQ ID NO: 276081 - DNA, 25 bp, Mus musculus
ctggccccccgggcgatggcatcaa

SEQ ID NO: 276082 - DNA, 25 bp, Mus musculus
ctggccccgagatgaagtgactgag

SEQ ID NO: 276083 - DNA, 25 bp, Mus musculus
ctggccccgggccctcagcatcctc

SEQ ID NO: 276084 - DNA, 25 bp, Mus musculus
ctggccccgtgggagcccttggact

SEQ ID NO: 276085 - DNA, 25 bp, Mus musculus
ctggcccctacataaaatggttcct

SEQ ID NO: 276086 - DNA, 25 bp, Mus musculus
ctggcccctgtcgatctttgggttc

SEQ ID NO: 276087 - DNA, 25 bp, Mus musculus
ctggcccctgtcggaactgctgcac

SEQ ID NO: 276088 - DNA, 25 bp, Mus musculus
ctggccccttgcaagtgcccctctc

SEQ ID NO: 276089 - DNA, 25 bp, Mus musculus
ctggccccttgcaagttctgggcca

SEQ ID NO: 276090 - DNA, 25 bp, Mus musculus
ctggcccgaacaggtcttattttag

SEQ ID NO: 276091 - DNA, 25 bp, Mus musculus
ctggcccgccaggactgcagtaatg

SEQ ID NO: 276092 - DNA, 25 bp, Mus musculus
ctggcccgcccggattgatgaactc

SEQ ID NO: 276093 - DNA, 25 bp, Mus musculus
ctggcccgcccggtgcatttctagg

SEQ ID NO: 276094 - DNA, 25 bp, Mus musculus
ctggcccggccctcctgaagccctt

SEQ ID NO: 276095 - DNA, 25 bp, Mus musculus
ctggccctaacaaaggtgacactcg

SEQ ID NO: 276096 - DNA, 25 bp, Mus musculus
ctggccctaagggcaactccggagg

SEQ ID NO: 276097 - DNA, 25 bp, Mus musculus
ctggccctagaggtccacctggccc

SEQ ID NO: 276098 - DNA, 25 bp, Mus musculus
ctggccctcacaagtggccaatcaa

SEQ ID NO: 276099 - DNA, 25 bp, Mus musculus
ctggccctcacggtatatgctatga

SEQ ID NO: 276100 - DNA, 25 bp, Mus musculus
ctggccctcagctccatgaagagtc

SEQ ID NO: 276101 - DNA, 25 bp, Mus musculus
ctggccctcagctccatgaagagtt

SEQ ID NO: 276102 - DNA, 25 bp, Mus musculus
ctggccctcagggacctgcaggtga

SEQ ID NO: 276103 - DNA, 25 bp, Mus musculus
ctggccctccgggtccttctggaga

SEQ ID NO: 276104 - DNA, 25 bp, Mus musculus
ctggccctcctggtgctgatggcca

SEQ ID NO: 276105 - DNA, 25 bp, Mus musculus
ctggccctctacaggagtgtgcacc

SEQ ID NO: 276106 - DNA, 25 bp, Mus musculus
ctggccctctggtgtgccacagatc

SEQ ID NO: 276107 - DNA, 25 bp, Mus musculus
ctggccctgcccagagcctgacccc

SEQ ID NO: 276108 - DNA, 25 bp, Mus musculus
ctggccctgcccagatactcccccc

SEQ ID NO: 276109 - DNA, 25 bp, Mus musculus
ctggccctggagcctggttacctgg

SEQ ID NO: 276110 - DNA, 25 bp, Mus musculus
ctggccctggcaggtctccctgcag

SEQ ID NO: 276111 - DNA, 25 bp, Mus musculus
ctggccctggggatgtgacaagcag

SEQ ID NO: 276112 - DNA, 25 bp, Mus musculus
ctggccctgggtattgactttgcaa

SEQ ID NO: 276113 - DNA, 25 bp, Mus musculus
ctggcccttagagtaatccatatgc

SEQ ID NO: 276114 - DNA, 25 bp, Mus musculus
ctggccgaagcatgacccgccggga

SEQ ID NO: 276115 - DNA, 25 bp, Mus musculus
ctggccgagaggggagcccagagga

SEQ ID NO: 276116 - DNA, 25 bp, Mus musculus
ctggccgagtaccagagcccacaga

SEQ ID NO: 276117 - DNA, 25 bp, Mus musculus
ctggccgagtaccaggacctgacgt

SEQ ID NO: 276118 - DNA, 25 bp, Mus musculus
ctggccgagtaccaggctaaccctt

SEQ ID NO: 276119 - DNA, 25 bp, Mus musculus
ctggccgatgaggtaatcactgtgt

SEQ ID NO: 276120 - DNA, 25 bp, Mus musculus
ctggccgatgagtaatatgcagact

SEQ ID NO: 276121 - DNA, 25 bp, Mus musculus
ctggccgcacttggttacaagaacg

SEQ ID NO: 276122 - DNA, 25 bp, Mus musculus
ctggccgcaggaagctaagcaacca

SEQ ID NO: 276123 - DNA, 25 bp, Mus musculus
ctggccgcaggctggcaacatggct

SEQ ID NO: 276124 - DNA, 25 bp, Mus musculus
ctggccgcagggtacattcgcctct

SEQ ID NO: 276125 - DNA, 25 bp, Mus musculus
ctggccgccacggatgggtgctaca

SEQ ID NO: 276126 - DNA, 25 bp, Mus musculus
ctggccgccatcatgtctgccacaa

SEQ ID NO: 276127 - DNA, 25 bp, Mus musculus
ctggccgcccaagacctccctgggc

SEQ ID NO: 276128 - DNA, 25 bp, Mus musculus
ctggccgctcagaaaagatgtcttt

SEQ ID NO: 276129 - DNA, 25 bp, Mus musculus
ctggccgctcagtgtcttaaaacat

SEQ ID NO: 276130 - DNA, 25 bp, Mus musculus
ctggccgctctggggatgtcaacct

SEQ ID NO: 276131 - DNA, 25 bp, Mus musculus
ctggccgctgtagaattggaaaagc

SEQ ID NO: 276132 - DNA, 25 bp, Mus musculus
ctggccgcttcttcactgactatgg

SEQ ID NO: 276133 - DNA, 25 bp, Mus musculus
ctggccgcttgcggaggtttggatt

SEQ ID NO: 276134 - DNA, 25 bp, Mus musculus
ctggccggccagactacagcaatga

SEQ ID NO: 276135 - DNA, 25 bp, Mus musculus
ctggccggcccggattgatgacatt

SEQ ID NO: 276136 - DNA, 25 bp, Mus musculus
ctggccgggcaagctgccaaaagcc

SEQ ID NO: 276137 - DNA, 25 bp, Mus musculus
ctggccgggctaactggactcatgc

SEQ ID NO: 276138 - DNA, 25 bp, Mus musculus
ctggccgtaaatggttcagactggg

SEQ ID NO: 276139 - DNA, 25 bp, Mus musculus
ctggccgtcgcggctggactgtact

SEQ ID NO: 276140 - DNA, 25 bp, Mus musculus
ctggccgtggatattagcatttggc

SEQ ID NO: 276141 - DNA, 25 bp, Mus musculus
ctggccgtttttgtgatctgccagc

SEQ ID NO: 276142 - DNA, 25 bp, Mus musculus
ctggcctaccgtgtggataaacgtt

SEQ ID NO: 276143 - DNA, 25 bp, Mus musculus
ctggcctaccgtgtggccttcagtg

SEQ ID NO: 276144 - DNA, 25 bp, Mus musculus
ctggcctagcctatgctgctggggc

SEQ ID NO: 276145 - DNA, 25 bp, Mus musculus
ctggcctatctcgacgtcggatgcg

SEQ ID NO: 276146 - DNA, 25 bp, Mus musculus
ctggcctatgatgatcctcatgggt

SEQ ID NO: 276147 - DNA, 25 bp, Mus musculus
ctggcctatgatggatctgatgaac

SEQ ID NO: 276148 - DNA, 25 bp, Mus musculus
ctggcctcaaaaatactgggcggtt

SEQ ID NO: 276149 - DNA, 25 bp, Mus musculus
ctggcctcaacagttcctgggtgga

SEQ ID NO: 276150 - DNA, 25 bp, Mus musculus
ctggcctcagacctcacagtggatg

SEQ ID NO: 276151 - DNA, 25 bp, Mus musculus
ctggcctcagatgccctgctgtgaa

SEQ ID NO: 276152 - DNA, 25 bp, Mus musculus
ctggcctcaggtaaccatggagaag

SEQ ID NO: 276153 - DNA, 25 bp, Mus musculus
ctggcctcccaagaaaccagctctt

SEQ ID NO: 276154 - DNA, 25 bp, Mus musculus
ctggcctcccaagttcttggggaca

SEQ ID NO: 276155 - DNA, 25 bp, Mus musculus
ctggcctccctgggccccaaggacc

SEQ ID NO: 276156 - DNA, 25 bp, Mus musculus
ctggcctccgctcaggaacgagttc

SEQ ID NO: 276157 - DNA, 25 bp, Mus musculus
ctggcctccgctcaggtaaacagaa

SEQ ID NO: 276158 - DNA, 25 bp, Mus musculus
ctggcctccggataaagatagagaa

SEQ ID NO: 276159 - DNA, 25 bp, Mus musculus
ctggcctccgggtttgtattgaggg

SEQ ID NO: 276160 - DNA, 25 bp, Mus musculus
ctggcctcctcctaccccatcccag

SEQ ID NO: 276161 - DNA, 25 bp, Mus musculus
ctggcctcgccaagagttcctccag

SEQ ID NO: 276162 - DNA, 25 bp, Mus musculus
ctggcctcgccaaggtatgtggacc

SEQ ID NO: 276163 - DNA, 25 bp, Mus musculus
ctggcctctgagagctgtcggccat

SEQ ID NO: 276164 - DNA, 25 bp, Mus musculus
ctggcctgaagacattgtctttcct

SEQ ID NO: 276165 - DNA, 25 bp, Mus musculus
ctggcctgaagcaaggtattggttt

SEQ ID NO: 276166 - DNA, 25 bp, Mus musculus
ctggcctgacaggagtccccggcat

SEQ ID NO: 276167 - DNA, 25 bp, Mus musculus
ctggcctgcttgaaatggaatttat

SEQ ID NO: 276168 - DNA, 25 bp, Mus musculus
ctggcctggaaaggtacagttaaag

SEQ ID NO: 276169 - DNA, 25 bp, Mus musculus
ctggcctggcgcttaatgaaaaact

SEQ ID NO: 276170 - DNA, 25 bp, Mus musculus
ctggcctggggtctacatcaccgtt

SEQ ID NO: 276171 - DNA, 25 bp, Mus musculus
ctggccttatgtccagccatttcaa

SEQ ID NO: 276172 - DNA, 25 bp, Mus musculus
ctggccttccacgagttcgaggaag

SEQ ID NO: 276173 - DNA, 25 bp, Mus musculus
ctggccttcgagtttgatcctgagt

SEQ ID NO: 276174 - DNA, 25 bp, Mus musculus
ctggccttctctctgaaggtgttcc

SEQ ID NO: 276175 - DNA, 25 bp, Mus musculus
ctggccttcttgagctgaaaattga

SEQ ID NO: 276176 - DNA, 25 bp, Mus musculus
ctggccttcttgagggccttcttga

SEQ ID NO: 276177 - DNA, 25 bp, Mus musculus
ctggccttggaggaaactttgcttc

SEQ ID NO: 276178 - DNA, 25 bp, Mus musculus
ctggccttggaggtttgcctggaga

SEQ ID NO: 276179 - DNA, 25 bp, Mus musculus
ctggccttggcagcacaaacttgac

SEQ ID NO: 276180 - DNA, 25 bp, Mus musculus
ctggccttggcaggtctctcttcag

SEQ ID NO: 276181 - DNA, 25 bp, Mus musculus
ctggccttgtcgggtgtgatcatgg

SEQ ID NO: 276182 - DNA, 25 bp, Mus musculus
ctggcgaaagctgataacacatgat

SEQ ID NO: 276183 - DNA, 25 bp, Mus musculus
ctggcgaaagctgattccaaattac

SEQ ID NO: 276184 - DNA, 25 bp, Mus musculus
ctggcgaaagctggttccttgtgga

SEQ ID NO: 276185 - DNA, 25 bp, Mus musculus
ctggcgaaagctggtttaactcaca

SEQ ID NO: 276186 - DNA, 25 bp, Mus musculus
ctggcgaatgggaaagggccaaata

SEQ ID NO: 276187 - DNA, 25 bp, Mus musculus
ctggcgacaggcccacatgcaggcc

SEQ ID NO: 276188 - DNA, 25 bp, Mus musculus
ctggcgacaggctctgatgggcgcc

SEQ ID NO: 276189 - DNA, 25 bp, Mus musculus
ctggcgacatgatatttgaaggaaa

SEQ ID NO: 276190 - DNA, 25 bp, Mus musculus
ctggcgaccaggcttcagatgctag

SEQ ID NO: 276191 - DNA, 25 bp, Mus musculus
ctggcgaccgcagcaacccttctgg

SEQ ID NO: 276192 - DNA, 25 bp, Mus musculus
ctggcgactattcttctatgagtgc

SEQ ID NO: 276193 - DNA, 25 bp, Mus musculus
ctggcgagaagaccaccatgcggga

SEQ ID NO: 276194 - DNA, 25 bp, Mus musculus
ctggcgagaggagggctctggtctg

SEQ ID NO: 276195 - DNA, 25 bp, Mus musculus
ctggcgagaggaggtctcgaagtcc

SEQ ID NO: 276196 - DNA, 25 bp, Mus musculus
ctggcgagcggatctacgaagtagt

SEQ ID NO: 276197 - DNA, 25 bp, Mus musculus
ctggcgaggctcaaagcccgatttg

SEQ ID NO: 276198 - DNA, 25 bp, Mus musculus
ctggcgagtagcaggaataaacacg

SEQ ID NO: 276199 - DNA, 25 bp, Mus musculus
ctggcgagtctgtgaaggccccaaa

SEQ ID NO: 276200 - DNA, 25 bp, Mus musculus
ctggcgattggggtggtcctgccga

SEQ ID NO: 276201 - DNA, 25 bp, Mus musculus
ctggcgcaagatgacgttgcaccgt

SEQ ID NO: 276202 - DNA, 25 bp, Mus musculus
ctggcgcaaggttcccaatcaagga

SEQ ID NO: 276203 - DNA, 25 bp, Mus musculus
ctggcgcagtcctaggactgcattt

SEQ ID NO: 276204 - DNA, 25 bp, Mus musculus
ctggcgcagtcctagggcctggtgg

SEQ ID NO: 276205 - DNA, 25 bp, Mus musculus
ctggcgcagtcctaggtgaagaaga

SEQ ID NO: 276206 - DNA, 25 bp, Mus musculus
ctggcgcatcccagggttctgcctg

SEQ ID NO: 276207 - DNA, 25 bp, Mus musculus
ctggcgcccagggcaaggacagcca

SEQ ID NO: 276208 - DNA, 25 bp, Mus musculus
ctggcgcccagtgagtgaaccccca

SEQ ID NO: 276209 - DNA, 25 bp, Mus musculus
ctggcgccccacagcttgaggaggc

SEQ ID NO: 276210 - DNA, 25 bp, Mus musculus
ctggcgcctagagaagcctccccag

SEQ ID NO: 276211 - DNA, 25 bp, Mus musculus
ctggcgcggccgaggctgcttccgc

SEQ ID NO: 276212 - DNA, 25 bp, Mus musculus
ctggcgctaaaaggtcctgtttctt

SEQ ID NO: 276213 - DNA, 25 bp, Mus musculus
ctggcgctaaaagtgatgcgattga

SEQ ID NO: 276214 - DNA, 25 bp, Mus musculus
ctggcgctggagagcctgaccagac

SEQ ID NO: 276215 - DNA, 25 bp, Mus musculus
ctggcggaagctcaagatgacagca

SEQ ID NO: 276216 - DNA, 25 bp, Mus musculus
ctggcggacaggctgggccgtcgga

SEQ ID NO: 276217 - DNA, 25 bp, Mus musculus
ctggcggagtcggaggccctaatgc

SEQ ID NO: 276218 - DNA, 25 bp, Mus musculus
ctggcggcttaaaaggcagtatgat

SEQ ID NO: 276219 - DNA, 25 bp, Mus musculus
ctggcgggaggcgcaacagcgtgac

SEQ ID NO: 276220 - DNA, 25 bp, Mus musculus
ctggcgggagggctcaggatccgag

SEQ ID NO: 276221 - DNA, 25 bp, Mus musculus
ctggcgggcaatggtgaatgagaat

SEQ ID NO: 276222 - DNA, 25 bp, Mus musculus
ctggcgggcgaaggggaactgatca

SEQ ID NO: 276223 - DNA, 25 bp, Mus musculus
ctggcgggtcctgcgttcttggccc

SEQ ID NO: 276224 - DNA, 25 bp, Mus musculus
ctggcggtaacagagtactgtttgg

SEQ ID NO: 276225 - DNA, 25 bp, Mus musculus
ctggcggtgaggagaggtttcatag

SEQ ID NO: 276226 - DNA, 25 bp, Mus musculus
ctggcgtctcccaggtgttcttgaa

SEQ ID NO: 276227 - DNA, 25 bp, Mus musculus
ctggcgtcttatgggttggaggatg

SEQ ID NO: 276228 - DNA, 25 bp, Mus musculus
ctggcgtgttctgagatgacagtca

SEQ ID NO: 276229 - DNA, 25 bp, Mus musculus
ctggcgtgttctgaggatcctggaa

SEQ ID NO: 276230 - DNA, 25 bp, Mus musculus
ctggcgttcatggaatatgaagaca

SEQ ID NO: 276231 - DNA, 25 bp, Mus musculus
ctggcgttggagggtgctgagtact

SEQ ID NO: 276232 - DNA, 25 bp, Mus musculus
ctggcgttggatggttacatccagg

SEQ ID NO: 276233 - DNA, 25 bp, Mus musculus
ctggctaagagctgcttttagaagg

SEQ ID NO: 276234 - DNA, 25 bp, Mus musculus
ctggctaagaggagaaaggcagcct

SEQ ID NO: 276235 - DNA, 25 bp, Mus musculus
ctggctaagtggctctgtatttctg

SEQ ID NO: 276236 - DNA, 25 bp, Mus musculus
ctggctaagtggctgagccaaacca

SEQ ID NO: 276237 - DNA, 25 bp, Mus musculus
ctggctacaaaaggtgcaccaatgg

SEQ ID NO: 276238 - DNA, 25 bp, Mus musculus
ctggctacaaaaggtgcttccactc

SEQ ID NO: 276239 - DNA, 25 bp, Mus musculus
ctggctacaaggctgagggaaaata

SEQ ID NO: 276240 - DNA, 25 bp, Mus musculus
ctggctacaagggatgggcataatt

SEQ ID NO: 276241 - DNA, 25 bp, Mus musculus
ctggctacactgggcgccctgtgct

SEQ ID NO: 276242 - DNA, 25 bp, Mus musculus
ctggctaccatgggagccccgcaag

SEQ ID NO: 276243 - DNA, 25 bp, Mus musculus
ctggctacccaaggccgcacatgcc

SEQ ID NO: 276244 - DNA, 25 bp, Mus musculus
ctggctacctttctgaaggacgggc

SEQ ID NO: 276245 - DNA, 25 bp, Mus musculus
ctggctacgggcacggctcggatgg

SEQ ID NO: 276246 - DNA, 25 bp, Mus musculus
ctggctagactacagggaaagccac

SEQ ID NO: 276247 - DNA, 25 bp, Mus musculus
ctggctagcatgagaacaaatataa

SEQ ID NO: 276248 - DNA, 25 bp, Mus musculus
ctggctagcatgagcatcagttggg

SEQ ID NO: 276249 - DNA, 25 bp, Mus musculus
ctggctagtgcaaagatcagctact

SEQ ID NO: 276250 - DNA, 25 bp, Mus musculus
ctggctatcatactgctgataaaga

SEQ ID NO: 276251 - DNA, 25 bp, Mus musculus
ctggctatcccagatggatgactgg

SEQ ID NO: 276252 - DNA, 25 bp, Mus musculus
ctggctatgttgagattcattttat

SEQ ID NO: 276253 - DNA, 25 bp, Mus musculus
ctggctatgttgagcttcgttacga

SEQ ID NO: 276254 - DNA, 25 bp, Mus musculus
ctggctattaaccaggtcttcaaga

SEQ ID NO: 276255 - DNA, 25 bp, Mus musculus
ctggctattgacaagaaggcttggg

SEQ ID NO: 276256 - DNA, 25 bp, Mus musculus
ctggctattgactccacggctgacc

SEQ ID NO: 276257 - DNA, 25 bp, Mus musculus
ctggctattgagctcttcctcatgg

SEQ ID NO: 276258 - DNA, 25 bp, Mus musculus
ctggctcaaaaaaaaaaagcctcta

SEQ ID NO: 276259 - DNA, 25 bp, Mus musculus
ctggctcaaactaagtggcctgctt

SEQ ID NO: 276260 - DNA, 25 bp, Mus musculus
ctggctcaacagatccaaaaggtaa

SEQ ID NO: 276261 - DNA, 25 bp, Mus musculus
ctggctcaaggaaccatctggtgac

SEQ ID NO: 276262 - DNA, 25 bp, Mus musculus
ctggctcaaggctttggctccctcg

SEQ ID NO: 276263 - DNA, 25 bp, Mus musculus
ctggctcacagagaaggacttgatc

SEQ ID NO: 276264 - DNA, 25 bp, Mus musculus
ctggctcagaggtgtctgccttatt

SEQ ID NO: 276265 - DNA, 25 bp, Mus musculus
ctggctcatcagccacggcaagctc

SEQ ID NO: 276266 - DNA, 25 bp, Mus musculus
ctggctcatggggaagtctaaagct

SEQ ID NO: 276267 - DNA, 25 bp, Mus musculus
ctggctcatgggttctgcaatcttc

SEQ ID NO: 276268 - DNA, 25 bp, Mus musculus
ctggctccaactggcgtccctacag

SEQ ID NO: 276269 - DNA, 25 bp, Mus musculus
ctggctccaactgggtctgagtgcc

SEQ ID NO: 276270 - DNA, 25 bp, Mus musculus
ctggctccactgtcttatatcggat

SEQ ID NO: 276271 - DNA, 25 bp, Mus musculus
ctggctccagaaggatctgttccaa

SEQ ID NO: 276272 - DNA, 25 bp, Mus musculus
ctggctccagagaaatcttctaggt

SEQ ID NO: 276273 - DNA, 25 bp, Mus musculus
ctggctccagatgacctcatcccac

SEQ ID NO: 276274 - DNA, 25 bp, Mus musculus
ctggctccagcggacgcccgtggtc

SEQ ID NO: 276275 - DNA, 25 bp, Mus musculus
ctggctccatgcagctgaggtctac

SEQ ID NO: 276276 - DNA, 25 bp, Mus musculus
ctggctcccagtgtgctccaactgc

SEQ ID NO: 276277 - DNA, 25 bp, Mus musculus
ctggctccctgaggggtacctcgga

SEQ ID NO: 276278 - DNA, 25 bp, Mus musculus
ctggctccgccgagcacagtgtatg

SEQ ID NO: 276279 - DNA, 25 bp, Mus musculus
ctggctccgccgaggaagaaaatac

SEQ ID NO: 276280 - DNA, 25 bp, Mus musculus
ctggctcggcgtcgccggcagctgc

SEQ ID NO: 276281 - DNA, 25 bp, Mus musculus
ctggctcgtgaaagattcaactggc

SEQ ID NO: 276282 - DNA, 25 bp, Mus musculus
ctggctcgtgaaagtgcattgttgg

SEQ ID NO: 276283 - DNA, 25 bp, Mus musculus
ctggctctctgaacccccacattgt

SEQ ID NO: 276284 - DNA, 25 bp, Mus musculus
ctggctctctgaggtggaggctctc

SEQ ID NO: 276285 - DNA, 25 bp, Mus musculus
ctggctctgaatttctcttctttaa

SEQ ID NO: 276286 - DNA, 25 bp, Mus musculus
ctggctctgacagcgacgaaccgtc

SEQ ID NO: 276287 - DNA, 25 bp, Mus musculus
ctggctctggaccctcttctagccc

SEQ ID NO: 276288 - DNA, 25 bp, Mus musculus
ctggctctggcacagccggagagaa

SEQ ID NO: 276289 - DNA, 25 bp, Mus musculus
ctggctctggcacaggtgctttgcc

SEQ ID NO: 276290 - DNA, 25 bp, Mus musculus
ctggctctgtctagagctgaggacc

SEQ ID NO: 276291 - DNA, 25 bp, Mus musculus
ctggctcttaagatcttctgtgtgc

SEQ ID NO: 276292 - DNA, 25 bp, Mus musculus
ctggctcttggcgacaactggccaa

SEQ ID NO: 276293 - DNA, 25 bp, Mus musculus
ctggctgaaagataagcccctggtc

SEQ ID NO: 276294 - DNA, 25 bp, Mus musculus
ctggctgaacagacttggctttctt

SEQ ID NO: 276295 - DNA, 25 bp, Mus musculus
ctggctgaacagagaacagagtttc

SEQ ID NO: 276296 - DNA, 25 bp, Mus musculus
ctggctgaacagtgagcttcactag

SEQ ID NO: 276297 - DNA, 25 bp, Mus musculus
ctggctgaacagtttccgctgcctt

SEQ ID NO: 276298 - DNA, 25 bp, Mus musculus
ctggctgaaggtaccttaacatggg

SEQ ID NO: 276299 - DNA, 25 bp, Mus musculus
ctggctgaatagcctgagaaatgcc

SEQ ID NO: 276300 - DNA, 25 bp, Mus musculus
ctggctgacaaggcacccacatctt

SEQ ID NO: 276301 - DNA, 25 bp, Mus musculus
ctggctgactgcagatctgatttgt

SEQ ID NO: 276302 - DNA, 25 bp, Mus musculus
ctggctgactgctgtacacttcctg

SEQ ID NO: 276303 - DNA, 25 bp, Mus musculus
ctggctgagaaaatggctgttgatg

SEQ ID NO: 276304 - DNA, 25 bp, Mus musculus
ctggctgagcagcaaaggtgaatga

SEQ ID NO: 276305 - DNA, 25 bp, Mus musculus
ctggctgaggacctcctttcttatt

SEQ ID NO: 276306 - DNA, 25 bp, Mus musculus
ctggctgaggacctcggatgggtcc

SEQ ID NO: 276307 - DNA, 25 bp, Mus musculus
ctggctgaggagaagcaaaccaaga

SEQ ID NO: 276308 - DNA, 25 bp, Mus musculus
ctggctgaggctcaggagaccacca

SEQ ID NO: 276309 - DNA, 25 bp, Mus musculus
ctggctgaggctcagtggagaccag

SEQ ID NO: 276310 - DNA, 25 bp, Mus musculus
ctggctgagtatagacaactgtcat

SEQ ID NO: 276311 - DNA, 25 bp, Mus musculus
ctggctgagtataggaaggggccag

SEQ ID NO: 276312 - DNA, 25 bp, Mus musculus
ctggctgagttccagagcccccttc

SEQ ID NO: 276313 - DNA, 25 bp, Mus musculus
ctggctgatagggtgggagagggcc

SEQ ID NO: 276314 - DNA, 25 bp, Mus musculus
ctggctgatctgcatccccaaaagc

SEQ ID NO: 276315 - DNA, 25 bp, Mus musculus
ctggctgatggcatgtgtccaaatg

SEQ ID NO: 276316 - DNA, 25 bp, Mus musculus
ctggctgcagagcgggaggagactc

SEQ ID NO: 276317 - DNA, 25 bp, Mus musculus
ctggctgcagatccgcccctccttc

SEQ ID NO: 276318 - DNA, 25 bp, Mus musculus
ctggctgcagatccggtcctctccg

SEQ ID NO: 276319 - DNA, 25 bp, Mus musculus
ctggctgcagggaattgatgtccga

SEQ ID NO: 276320 - DNA, 25 bp, Mus musculus
ctggctgcatagatgacgccacacg

SEQ ID NO: 276321 - DNA, 25 bp, Mus musculus
ctggctgccacgcagactgtatcgt

SEQ ID NO: 276322 - DNA, 25 bp, Mus musculus
ctggctgccattcaaacacacacag

SEQ ID NO: 276323 - DNA, 25 bp, Mus musculus
ctggctgccattcaaattcatgaga

SEQ ID NO: 276324 - DNA, 25 bp, Mus musculus
ctggctgccattcaagaaggagaaa

SEQ ID NO: 276325 - DNA, 25 bp, Mus musculus
ctggctgctaaccgggtctttgggg

SEQ ID NO: 276326 - DNA, 25 bp, Mus musculus
ctggctgctgcaggtcctgtgggaa

SEQ ID NO: 276327 - DNA, 25 bp, Mus musculus
ctggctgctgcagtgctggggatca

SEQ ID NO: 276328 - DNA, 25 bp, Mus musculus
ctggctggaggcactttcccagagg

SEQ ID NO: 276329 - DNA, 25 bp, Mus musculus
ctggctggaggttggggtttcttgg

SEQ ID NO: 276330 - DNA, 25 bp, Mus musculus
ctggctggcagcactgaaaactgat

SEQ ID NO: 276331 - DNA, 25 bp, Mus musculus
ctggctggcaggaggcacagtggtg

SEQ ID NO: 276332 - DNA, 25 bp, Mus musculus
ctggctggcgaaggatgatgccctg

SEQ ID NO: 276333 - DNA, 25 bp, Mus musculus
ctggctgtagcagctgcaccacata

SEQ ID NO: 276334 - DNA, 25 bp, Mus musculus
ctggctgtagcagtgcaccacatat

SEQ ID NO: 276335 - DNA, 25 bp, Mus musculus
ctggctgtagccaaagagactgctt

SEQ ID NO: 276336 - DNA, 25 bp, Mus musculus
ctggctgtcagctgctgactgtgca

SEQ ID NO: 276337 - DNA, 25 bp, Mus musculus
ctggctgtctgaccaagtaacttag

SEQ ID NO: 276338 - DNA, 25 bp, Mus musculus
ctggctgtctggtttaacttgcaca

SEQ ID NO: 276339 - DNA, 25 bp, Mus musculus
ctggctgtgtgcggtctgttcctgc

SEQ ID NO: 276340 - DNA, 25 bp, Mus musculus
ctggctgttagtaagaatcccagta

SEQ ID NO: 276341 - DNA, 25 bp, Mus musculus
ctggctgttgctcgtcttggggatg

SEQ ID NO: 276342 - DNA, 25 bp, Mus musculus
ctggctgtttatcgcaggaggcaga

SEQ ID NO: 276343 - DNA, 25 bp, Mus musculus
ctggctgtttctgggtgtggccatc

SEQ ID NO: 276344 - DNA, 25 bp, Mus musculus
ctggctgtttgccgagattgctctc

SEQ ID NO: 276345 - DNA, 25 bp, Mus musculus
ctggcttacagacaaagcctatttc

SEQ ID NO: 276346 - DNA, 25 bp, Mus musculus
ctggcttacaggttcagaggttcag

SEQ ID NO: 276347 - DNA, 25 bp, Mus musculus
ctggcttatctgaggtggggaaaga

SEQ ID NO: 276348 - DNA, 25 bp, Mus musculus
ctggcttcaatatggaatctttctg

SEQ ID NO: 276349 - DNA, 25 bp, Mus musculus
ctggcttccaaatggaactctgaaa

SEQ ID NO: 276350 - DNA, 25 bp, Mus musculus
ctggcttccacaggattttcacctt

SEQ ID NO: 276351 - DNA, 25 bp, Mus musculus
ctggcttccagggctggcgctgcaa

SEQ ID NO: 276352 - DNA, 25 bp, Mus musculus
ctggcttccatttctgcaaggagtc

SEQ ID NO: 276353 - DNA, 25 bp, Mus musculus
ctggcttccgagtccctcctggggg

SEQ ID NO: 276354 - DNA, 25 bp, Mus musculus
ctggcttccgtatcaatttctgcca

SEQ ID NO: 276355 - DNA, 25 bp, Mus musculus
ctggcttccgtatctatttctgcca

SEQ ID NO: 276356 - DNA, 25 bp, Mus musculus
ctggcttcctcccgaggccgagctg

SEQ ID NO: 276357 - DNA, 25 bp, Mus musculus
ctggcttcctgcctggcacggcgca

SEQ ID NO: 276358 - DNA, 25 bp, Mus musculus
ctggcttcctggatgtccagaagga

SEQ ID NO: 276359 - DNA, 25 bp, Mus musculus
ctggcttctcaccgcttagaattac

SEQ ID NO: 276360 - DNA, 25 bp, Mus musculus
ctggcttctcaccgggcgagccttt

SEQ ID NO: 276361 - DNA, 25 bp, Mus musculus
ctggcttctcaccggtgcacgcctc

SEQ ID NO: 276362 - DNA, 25 bp, Mus musculus
ctggcttctcaccgttatcctaggc

SEQ ID NO: 276363 - DNA, 25 bp, Mus musculus
ctggcttctcagatgggagctcaga

SEQ ID NO: 276364 - DNA, 25 bp, Mus musculus
ctggcttctcagttccagagcctct

SEQ ID NO: 276365 - DNA, 25 bp, Mus musculus
ctggcttctggctccaggccgggcc

SEQ ID NO: 276366 - DNA, 25 bp, Mus musculus
ctggcttgagtgggccttcccgctc

SEQ ID NO: 276367 - DNA, 25 bp, Mus musculus
ctggcttgcacaccggggccctggg

SEQ ID NO: 276368 - DNA, 25 bp, Mus musculus
ctggcttgcagtgtgcctgcagtcc

SEQ ID NO: 276369 - DNA, 25 bp, Mus musculus
ctggcttgccgggccctccaggtcc

SEQ ID NO: 276370 - DNA, 25 bp, Mus musculus
ctggctttcaagggaacaaagaatc

SEQ ID NO: 276371 - DNA, 25 bp, Mus musculus
ctggctttcaagttgtggagctcct

SEQ ID NO: 276372 - DNA, 25 bp, Mus musculus
ctggctttcagggacttcctggacc

SEQ ID NO: 276373 - DNA, 25 bp, Mus musculus
ctggctttgaagaatcaggcccagg

SEQ ID NO: 276374 - DNA, 25 bp, Mus musculus
ctggcttttacagacccataactgg

SEQ ID NO: 276375 - DNA, 25 bp, Mus musculus
ctggcttttacagggagggtagacc

SEQ ID NO: 276376 - DNA, 25 bp, Mus musculus
ctggcttttacagttgttctgatgt

SEQ ID NO: 276377 - DNA, 25 bp, Mus musculus
ctggcttttctgattcaccccacca

SEQ ID NO: 276378 - DNA, 25 bp, Mus musculus
ctggcttttctgattttcagaaaga

SEQ ID NO: 276379 - DNA, 25 bp, Mus musculus
ctggcttttgctggagggagctggg

SEQ ID NO: 276380 - DNA, 25 bp, Mus musculus
ctgggaaaaggacgctattacaagg

SEQ ID NO: 276381 - DNA, 25 bp, Mus musculus
ctgggaaaagggtcaatgctaggtg

SEQ ID NO: 276382 - DNA, 25 bp, Mus musculus
ctgggaaaaggtaaatgttggagat

SEQ ID NO: 276383 - DNA, 25 bp, Mus musculus
ctgggaaaaggtggcagtgggggag

SEQ ID NO: 276384 - DNA, 25 bp, Mus musculus
ctgggaaaagtgagccccaggccat

SEQ ID NO: 276385 - DNA, 25 bp, Mus musculus
ctgggaaaccatgtggtgctctaag

SEQ ID NO: 276386 - DNA, 25 bp, Mus musculus
ctgggaaagaagatgaaagcagaag

SEQ ID NO: 276387 - DNA, 25 bp, Mus musculus
ctgggaaagaagggactcgtactgg

SEQ ID NO: 276388 - DNA, 25 bp, Mus musculus
ctgggaaagcaggggagaagtcaat

SEQ ID NO: 276389 - DNA, 25 bp, Mus musculus
ctgggaaaggacccagctgttgtcc

SEQ ID NO: 276390 - DNA, 25 bp, Mus musculus
ctgggaaaggagtgtgctcgggtgt

SEQ ID NO: 276391 - DNA, 25 bp, Mus musculus
ctgggaaaggatcatcgggttatag

SEQ ID NO: 276392 - DNA, 25 bp, Mus musculus
ctgggaaatgatgagaatggcttgg

SEQ ID NO: 276393 - DNA, 25 bp, Mus musculus
ctgggaaatgatgtggttgagaaat

SEQ ID NO: 276394 - DNA, 25 bp, Mus musculus
ctgggaacaaaggaggaggacatct

SEQ ID NO: 276395 - DNA, 25 bp, Mus musculus
ctgggaacaagtaccattaattaag

SEQ ID NO: 276396 - DNA, 25 bp, Mus musculus
ctgggaaccggcggcttcatggcgg

SEQ ID NO: 276397 - DNA, 25 bp, Mus musculus
ctgggaactccagcccttttacaca

SEQ ID NO: 276398 - DNA, 25 bp, Mus musculus
ctgggaactgcaggtaaggaactgc

SEQ ID NO: 276399 - DNA, 25 bp, Mus musculus
ctgggaactgcagtttccctgcagg

SEQ ID NO: 276400 - DNA, 25 bp, Mus musculus
ctgggaagaaagatgtgtacactct

SEQ ID NO: 276401 - DNA, 25 bp, Mus musculus
ctgggaagaagacggatctccatct

SEQ ID NO: 276402 - DNA, 25 bp, Mus musculus
ctgggaagaggacaggcttttccct

SEQ ID NO: 276403 - DNA, 25 bp, Mus musculus
ctgggaagctgtcagcattctgcct

SEQ ID NO: 276404 - DNA, 25 bp, Mus musculus
ctgggaagctgtcagttctgagaag

SEQ ID NO: 276405 - DNA, 25 bp, Mus musculus
ctgggaagctgtgctcagtagtcct

SEQ ID NO: 276406 - DNA, 25 bp, Mus musculus
ctgggaaggtggaggtgtggtacat

SEQ ID NO: 276407 - DNA, 25 bp, Mus musculus
ctgggaagtcgctgatgaggagact

SEQ ID NO: 276408 - DNA, 25 bp, Mus musculus
ctgggaagtgtcgccagagaaacaa

SEQ ID NO: 276409 - DNA, 25 bp, Mus musculus
ctgggaagtgtcgcttccaacagtg

SEQ ID NO: 276410 - DNA, 25 bp, Mus musculus
ctgggaatagattccaagagcagag

SEQ ID NO: 276411 - DNA, 25 bp, Mus musculus
ctgggaattcatatgactgtgatga

SEQ ID NO: 276412 - DNA, 25 bp, Mus musculus
ctgggaattcatgtctgcccggaca

SEQ ID NO: 276413 - DNA, 25 bp, Mus musculus
ctgggaattgagaatatgaacgagg

SEQ ID NO: 276414 - DNA, 25 bp, Mus musculus
ctgggacaacagtttacctacgttg

SEQ ID NO: 276415 - DNA, 25 bp, Mus musculus
ctgggacaattcaggacccttttgt

SEQ ID NO: 276416 - DNA, 25 bp, Mus musculus
ctgggacaattgaacaattgcctat

SEQ ID NO: 276417 - DNA, 25 bp, Mus musculus
ctgggacaattgactggctgtgttt

SEQ ID NO: 276418 - DNA, 25 bp, Mus musculus
ctgggacacaaggtgtcccaaatgg

SEQ ID NO: 276419 - DNA, 25 bp, Mus musculus
ctgggacacacaggagagtactaaa

SEQ ID NO: 276420 - DNA, 25 bp, Mus musculus
ctgggacacagagtcttcaagcagc

SEQ ID NO: 276421 - DNA, 25 bp, Mus musculus
ctgggacagtagggaagttgccacc

SEQ ID NO: 276422 - DNA, 25 bp, Mus musculus
ctgggacagtagggcagcaccagcg

SEQ ID NO: 276423 - DNA, 25 bp, Mus musculus
ctgggacatgatgtgattaagacgc

SEQ ID NO: 276424 - DNA, 25 bp, Mus musculus
ctgggaccaactcagtacctgtggc

SEQ ID NO: 276425 - DNA, 25 bp, Mus musculus
ctgggaccagagagggtccgggcca

SEQ ID NO: 276426 - DNA, 25 bp, Mus musculus
ctgggacccgaacaatttcgaagag

SEQ ID NO: 276427 - DNA, 25 bp, Mus musculus
ctgggaccctggtacctcatcaact

SEQ ID NO: 276428 - DNA, 25 bp, Mus musculus
ctgggaccggattcccgaagcccag

SEQ ID NO: 276429 - DNA, 25 bp, Mus musculus
ctgggacctaaaactttgcagattc

SEQ ID NO: 276430 - DNA, 25 bp, Mus musculus
ctgggacctacctgaactacctggg

SEQ ID NO: 276431 - DNA, 25 bp, Mus musculus
ctgggacctacgtatcacaaggctg

SEQ ID NO: 276432 - DNA, 25 bp, Mus musculus
ctgggacctcaacagggtgagccag

SEQ ID NO: 276433 - DNA, 25 bp, Mus musculus
ctgggacctcaacagtgggcagctg

SEQ ID NO: 276434 - DNA, 25 bp, Mus musculus
ctgggacctcatcattctctggcag

SEQ ID NO: 276435 - DNA, 25 bp, Mus musculus
ctgggacctcatctacgtgggccgg

SEQ ID NO: 276436 - DNA, 25 bp, Mus musculus
ctgggacctggtcactcctgtcccc

SEQ ID NO: 276437 - DNA, 25 bp, Mus musculus
ctgggacctttctaggtgactactt

SEQ ID NO: 276438 - DNA, 25 bp, Mus musculus
ctgggacgagcggatacgggccaca

SEQ ID NO: 276439 - DNA, 25 bp, Mus musculus
ctgggacgcggccatccatggcttc

SEQ ID NO: 276440 - DNA, 25 bp, Mus musculus
ctgggacgcgttctgtggatctacc

SEQ ID NO: 276441 - DNA, 25 bp, Mus musculus
ctgggacgcttggtaaagcgttcgg

SEQ ID NO: 276442 - DNA, 25 bp, Mus musculus
ctgggacgtgaaggacttcaagacc

SEQ ID NO: 276443 - DNA, 25 bp, Mus musculus
ctgggactaaagagatggatgtcct

SEQ ID NO: 276444 - DNA, 25 bp, Mus musculus
ctgggactaaaggggacagctgttg

SEQ ID NO: 276445 - DNA, 25 bp, Mus musculus
ctgggactacagggatccgtgaacc

SEQ ID NO: 276446 - DNA, 25 bp, Mus musculus
ctgggactcagatggaccacacagc

SEQ ID NO: 276447 - DNA, 25 bp, Mus musculus
ctgggactgaagactcggatgacgc

SEQ ID NO: 276448 - DNA, 25 bp, Mus musculus
ctgggactgaatatagtatgtgcag

SEQ ID NO: 276449 - DNA, 25 bp, Mus musculus
ctgggagaaagaaggcatgtcatgt

SEQ ID NO: 276450 - DNA, 25 bp, Mus musculus
ctgggagaacagatacaaaggatgg

SEQ ID NO: 276451 - DNA, 25 bp, Mus musculus
ctgggagaagatgctcagaccagtg

SEQ ID NO: 276452 - DNA, 25 bp, Mus musculus
ctgggagaatcaggcatcgcctcca

SEQ ID NO: 276453 - DNA, 25 bp, Mus musculus
ctgggagacccaagacgatactgta

SEQ ID NO: 276454 - DNA, 25 bp, Mus musculus
ctgggagacccaagctgtcctggaa

SEQ ID NO: 276455 - DNA, 25 bp, Mus musculus
ctgggagaccttgagacagatggga

SEQ ID NO: 276456 - DNA, 25 bp, Mus musculus
ctgggagagagggttgaaaactagc

SEQ ID NO: 276457 - DNA, 25 bp, Mus musculus
ctgggagagcagcgggaacttcatt

SEQ ID NO: 276458 - DNA, 25 bp, Mus musculus
ctgggagagcaggaggtgtaaagaa

SEQ ID NO: 276459 - DNA, 25 bp, Mus musculus
ctgggagaggacgcgtgagcatgcc

SEQ ID NO: 276460 - DNA, 25 bp, Mus musculus
ctgggagagggggaccaagtcattg

SEQ ID NO: 276461 - DNA, 25 bp, Mus musculus
ctgggagcaggaattaccttgcatt

SEQ ID NO: 276462 - DNA, 25 bp, Mus musculus
ctgggagcccaggcctccagatcta

SEQ ID NO: 276463 - DNA, 25 bp, Mus musculus
ctgggagccgggagccccgatgacc

SEQ ID NO: 276464 - DNA, 25 bp, Mus musculus
ctgggagcgagttaagagaaaatga

SEQ ID NO: 276465 - DNA, 25 bp, Mus musculus
ctgggagctttgaacatgggaaacc

SEQ ID NO: 276466 - DNA, 25 bp, Mus musculus
ctgggagctttgaagatgggaaacc

SEQ ID NO: 276467 - DNA, 25 bp, Mus musculus
ctgggaggagaaggtcctgttgagt

SEQ ID NO: 276468 - DNA, 25 bp, Mus musculus
ctgggaggagagcgacatgtttgtg

SEQ ID NO: 276469 - DNA, 25 bp, Mus musculus
ctgggaggagcagatattcagtgaa

SEQ ID NO: 276470 - DNA, 25 bp, Mus musculus
ctgggaggagccacccgcggtcagc

SEQ ID NO: 276471 - DNA, 25 bp, Mus musculus
ctgggaggaggtggcccagagtggt

SEQ ID NO: 276472 - DNA, 25 bp, Mus musculus
ctgggaggatggcagctcagctgtt

SEQ ID NO: 276473 - DNA, 25 bp, Mus musculus
ctgggaggatggcagggccaggttg

SEQ ID NO: 276474 - DNA, 25 bp, Mus musculus
ctgggaggccaggattgataagtat

SEQ ID NO: 276475 - DNA, 25 bp, Mus musculus
ctgggaggccaggctttttgatcac

SEQ ID NO: 276476 - DNA, 25 bp, Mus musculus
ctgggaggctcaagcactgctacag

SEQ ID NO: 276477 - DNA, 25 bp, Mus musculus
ctgggagggagccagcctggaggcc

SEQ ID NO: 276478 - DNA, 25 bp, Mus musculus
ctgggaggtggagatgtcatcaggc

SEQ ID NO: 276479 - DNA, 25 bp, Mus musculus
ctgggagtaagtcgaatctacaaaa

SEQ ID NO: 276480 - DNA, 25 bp, Mus musculus
ctgggagtacagctgactcaagaga

SEQ ID NO: 276481 - DNA, 25 bp, Mus musculus
ctgggagtgaacggtctcaggagct

SEQ ID NO: 276482 - DNA, 25 bp, Mus musculus
ctgggagtgaggcccagcctgcagg

SEQ ID NO: 276483 - DNA, 25 bp, Mus musculus
ctgggagtgagtcaggaacaaagta

SEQ ID NO: 276484 - DNA, 25 bp, Mus musculus
ctgggagtgtctggcaccgtggact

SEQ ID NO: 276485 - DNA, 25 bp, Mus musculus
ctgggagttcgctatctgcaggtgt

SEQ ID NO: 276486 - DNA, 25 bp, Mus musculus
ctgggagtttgaggaattagaaagt

SEQ ID NO: 276487 - DNA, 25 bp, Mus musculus
ctgggataaaggattccagcagatt

SEQ ID NO: 276488 - DNA, 25 bp, Mus musculus
ctgggatagaagggcttcttggtaa

SEQ ID NO: 276489 - DNA, 25 bp, Mus musculus
ctgggatagagccagcacgcatttg

SEQ ID NO: 276490 - DNA, 25 bp, Mus musculus
ctgggatagagccagtatccatgga

SEQ ID NO: 276491 - DNA, 25 bp, Mus musculus
ctgggatcattcacagatcattcta

SEQ ID NO: 276492 - DNA, 25 bp, Mus musculus
ctgggatcattgtctgcgtggtggc

SEQ ID NO: 276493 - DNA, 25 bp, Mus musculus
ctgggatccagaatccaactgtgtt

SEQ ID NO: 276494 - DNA, 25 bp, Mus musculus
ctgggatccagaatttggggtgctg

SEQ ID NO: 276495 - DNA, 25 bp, Mus musculus
ctgggatcctaaagtggccgtgcct

SEQ ID NO: 276496 - DNA, 25 bp, Mus musculus
ctgggatcctataaatttgaaaatt

SEQ ID NO: 276497 - DNA, 25 bp, Mus musculus
ctgggatcctgggagaatttagagc

SEQ ID NO: 276498 - DNA, 25 bp, Mus musculus
ctgggatctaagtaaaattggagaa

SEQ ID NO: 276499 - DNA, 25 bp, Mus musculus
ctgggatctcacaacgggcaccacc

SEQ ID NO: 276500 - DNA, 25 bp, Mus musculus
ctgggatctcagagggatttgaccc

SEQ ID NO: 276501 - DNA, 25 bp, Mus musculus
ctgggatctgaacttcactggacca

SEQ ID NO: 276502 - DNA, 25 bp, Mus musculus
ctgggatctgctgtgtcccaggaat

SEQ ID NO: 276503 - DNA, 25 bp, Mus musculus
ctgggatgcacacagccaaccccaa

SEQ ID NO: 276504 - DNA, 25 bp, Mus musculus
ctgggatgggaggtcccacgtgatc

SEQ ID NO: 276505 - DNA, 25 bp, Mus musculus
ctgggatggggaacatgacatcgag

SEQ ID NO: 276506 - DNA, 25 bp, Mus musculus
ctgggatgtgccgacggtggttcct

SEQ ID NO: 276507 - DNA, 25 bp, Mus musculus
ctgggatgtgccggaatgcaggctc

SEQ ID NO: 276508 - DNA, 25 bp, Mus musculus
ctgggatgttgggtagcggaaagac

SEQ ID NO: 276509 - DNA, 25 bp, Mus musculus
ctgggattaaaaagaatggaatcat

SEQ ID NO: 276510 - DNA, 25 bp, Mus musculus
ctgggattaaagagacttccttgag

SEQ ID NO: 276511 - DNA, 25 bp, Mus musculus
ctgggattaaagatccagctgagct

SEQ ID NO: 276512 - DNA, 25 bp, Mus musculus
ctgggattaaagatggcagactttc

SEQ ID NO: 276513 - DNA, 25 bp, Mus musculus
ctgggattaaagattcatcagtggg

SEQ ID NO: 276514 - DNA, 25 bp, Mus musculus
ctgggattaaagcagatataatttc

SEQ ID NO: 276515 - DNA, 25 bp, Mus musculus
ctgggattaaagcgtgagggtcaca

SEQ ID NO: 276516 - DNA, 25 bp, Mus musculus
ctgggattaaaggaaacaaatgtcc

SEQ ID NO: 276517 - DNA, 25 bp, Mus musculus
ctgggattaaaggatgaaaatgagt

SEQ ID NO: 276518 - DNA, 25 bp, Mus musculus
ctgggattaaagggcatgaatcttt

SEQ ID NO: 276519 - DNA, 25 bp, Mus musculus
ctgggattaaaggggtccctccaat

SEQ ID NO: 276520 - DNA, 25 bp, Mus musculus
ctgggattaaaggtatagtccagat

SEQ ID NO: 276521 - DNA, 25 bp, Mus musculus
ctgggattaaaggtgtgggaacaag

SEQ ID NO: 276522 - DNA, 25 bp, Mus musculus
ctgggattaaaggttgtaagcatca

SEQ ID NO: 276523 - DNA, 25 bp, Mus musculus
ctgggattaaagtgctctgtgaaga

SEQ ID NO: 276524 - DNA, 25 bp, Mus musculus
ctgggattaacctggatcctgaccc

SEQ ID NO: 276525 - DNA, 25 bp, Mus musculus
ctgggattaatgatgctctccaagt

SEQ ID NO: 276526 - DNA, 25 bp, Mus musculus
ctgggattacagactcctccaccct

SEQ ID NO: 276527 - DNA, 25 bp, Mus musculus
ctgggattacaggggctgagattta

SEQ ID NO: 276528 - DNA, 25 bp, Mus musculus
ctgggattacaggttccacagcact

SEQ ID NO: 276529 - DNA, 25 bp, Mus musculus
ctgggattacaggttggcttcctga

SEQ ID NO: 276530 - DNA, 25 bp, Mus musculus
ctgggattacagtcttgaaatacag

SEQ ID NO: 276531 - DNA, 25 bp, Mus musculus
ctgggattagaggagttggaaccct

SEQ ID NO: 276532 - DNA, 25 bp, Mus musculus
ctgggattaggagtgccaggaggta

SEQ ID NO: 276533 - DNA, 25 bp, Mus musculus
ctgggattatgaggactccaagccc

SEQ ID NO: 276534 - DNA, 25 bp, Mus musculus
ctgggattcagtcattaggattgga

SEQ ID NO: 276535 - DNA, 25 bp, Mus musculus
ctgggattccaggatggcagctcct

SEQ ID NO: 276536 - DNA, 25 bp, Mus musculus
ctgggattccaggtgacagagtgcc

SEQ ID NO: 276537 - DNA, 25 bp, Mus musculus
ctgggattctgtctcaaaccatgaa

SEQ ID NO: 276538 - DNA, 25 bp, Mus musculus
ctgggattgcagttttcaaagatac

SEQ ID NO: 276539 - DNA, 25 bp, Mus musculus
ctgggattgggctagtgaaccggag

SEQ ID NO: 276540 - DNA, 25 bp, Mus musculus
ctgggatttaagtctgtgcgagggt

SEQ ID NO: 276541 - DNA, 25 bp, Mus musculus
ctgggatttagtctggcgtgtgcag

SEQ ID NO: 276542 - DNA, 25 bp, Mus musculus
ctgggatttgtcgccagagagacaa

SEQ ID NO: 276543 - DNA, 25 bp, Mus musculus
ctgggcaaagaggtgcgtgagcaca

SEQ ID NO: 276544 - DNA, 25 bp, Mus musculus
ctgggcaaaggggggctcctggcaa

SEQ ID NO: 276545 - DNA, 25 bp, Mus musculus
ctgggcaacaagggaaatactgggg

SEQ ID NO: 276546 - DNA, 25 bp, Mus musculus
ctgggcaacaaggtggacccccttt

SEQ ID NO: 276547 - DNA, 25 bp, Mus musculus
ctgggcaagctggtggtaacggaaa

SEQ ID NO: 276548 - DNA, 25 bp, Mus musculus
ctgggcaaggagatccacgatttgt

SEQ ID NO: 276549 - DNA, 25 bp, Mus musculus
ctgggcaataaatatgcttcatctt

SEQ ID NO: 276550 - DNA, 25 bp, Mus musculus
ctgggcacacaggccagcggtgtga

SEQ ID NO: 276551 - DNA, 25 bp, Mus musculus
ctgggcacacagggttttgaaggcc

SEQ ID NO: 276552 - DNA, 25 bp, Mus musculus
ctgggcacagacatggagtcagtga

SEQ ID NO: 276553 - DNA, 25 bp, Mus musculus
ctgggcacagaccgcgggacagtgc

SEQ ID NO: 276554 - DNA, 25 bp, Mus musculus
ctgggcacagattggtgttggtact

SEQ ID NO: 276555 - DNA, 25 bp, Mus musculus
ctgggcacagcattgatctggtggc

SEQ ID NO: 276556 - DNA, 25 bp, Mus musculus
ctgggcacctgactcagcgtgaagg

SEQ ID NO: 276557 - DNA, 25 bp, Mus musculus
ctgggcacctggaagaccgatgctg

SEQ ID NO: 276558 - DNA, 25 bp, Mus musculus
ctgggcacctggaagtcccctcctg

SEQ ID NO: 276559 - DNA, 25 bp, Mus musculus
ctgggcacctggaagtcttccccag

SEQ ID NO: 276560 - DNA, 25 bp, Mus musculus
ctgggcacgaggctggaaggctgcg

SEQ ID NO: 276561 - DNA, 25 bp, Mus musculus
ctgggcacgccggagctccctgtgg

SEQ ID NO: 276562 - DNA, 25 bp, Mus musculus
ctgggcacgggagcctatgggaagg

SEQ ID NO: 276563 - DNA, 25 bp, Mus musculus
ctgggcacgggagtccgggtttgca

SEQ ID NO: 276564 - DNA, 25 bp, Mus musculus
ctgggcactcagggcccaggacggc

SEQ ID NO: 276565 - DNA, 25 bp, Mus musculus
ctgggcactcaggtgaagccaacac

SEQ ID NO: 276566 - DNA, 25 bp, Mus musculus
ctgggcactcatgcatgctagtccc

SEQ ID NO: 276567 - DNA, 25 bp, Mus musculus
ctgggcactgctgtgcttatggcaa

SEQ ID NO: 276568 - DNA, 25 bp, Mus musculus
ctgggcagaaaggtgatcgagggtc

SEQ ID NO: 276569 - DNA, 25 bp, Mus musculus
ctgggcagagccagagaatgttgct

SEQ ID NO: 276570 - DNA, 25 bp, Mus musculus
ctgggcagagggatctttggccagc

SEQ ID NO: 276571 - DNA, 25 bp, Mus musculus
ctgggcagatcacagacactgcaga

SEQ ID NO: 276572 - DNA, 25 bp, Mus musculus
ctgggcagcatcagcccccggcagc

SEQ ID NO: 276573 - DNA, 25 bp, Mus musculus
ctgggcatctcactgcaatgcctgt

SEQ ID NO: 276574 - DNA, 25 bp, Mus musculus
ctgggcatctcactggtggagctgg

SEQ ID NO: 276575 - DNA, 25 bp, Mus musculus
ctgggcatctgtgtgatctcagtga

SEQ ID NO: 276576 - DNA, 25 bp, Mus musculus
ctgggcatgaagctgagtgaagatg

SEQ ID NO: 276577 - DNA, 25 bp, Mus musculus
ctgggcatgtggccattatgtttgt

SEQ ID NO: 276578 - DNA, 25 bp, Mus musculus
ctgggcatgtggggtgatcctgtat

SEQ ID NO: 276579 - DNA, 25 bp, Mus musculus
ctgggccaagatgaaagcttgcggc

SEQ ID NO: 276580 - DNA, 25 bp, Mus musculus
ctgggccaatgaaaaccaactctac

SEQ ID NO: 276581 - DNA, 25 bp, Mus musculus
ctgggccaattctggaccaccaagg

SEQ ID NO: 276582 - DNA, 25 bp, Mus musculus
ctgggccacagggacttggatgttg

SEQ ID NO: 276583 - DNA, 25 bp, Mus musculus
ctgggccacagggtcctactggagt

SEQ ID NO: 276584 - DNA, 25 bp, Mus musculus
ctgggccacggagcagctgaaggcc

SEQ ID NO: 276585 - DNA, 25 bp, Mus musculus
ctgggccagaaggtccggctggtaa

SEQ ID NO: 276586 - DNA, 25 bp, Mus musculus
ctgggccagcagactggaagctcct

SEQ ID NO: 276587 - DNA, 25 bp, Mus musculus
ctgggccagcaggtggcccgaggca

SEQ ID NO: 276588 - DNA, 25 bp, Mus musculus
ctgggccaggacctgtgtgctccca

SEQ ID NO: 276589 - DNA, 25 bp, Mus musculus
ctgggccatgaagtgggctttgtta

SEQ ID NO: 276590 - DNA, 25 bp, Mus musculus
ctgggccatggatggcggggatctg

SEQ ID NO: 276591 - DNA, 25 bp, Mus musculus
ctgggccatggatggtgttgttaca

SEQ ID NO: 276592 - DNA, 25 bp, Mus musculus
ctgggccatttcaagtccgaggtcc

SEQ ID NO: 276593 - DNA, 25 bp, Mus musculus
ctgggcccaagaggcctcaaagagc

SEQ ID NO: 276594 - DNA, 25 bp, Mus musculus
ctgggcccaagaggcctcgtggagc

SEQ ID NO: 276595 - DNA, 25 bp, Mus musculus
ctgggcccagaccctggcctatgga

SEQ ID NO: 276596 - DNA, 25 bp, Mus musculus
ctgggcccaggggagaaatacgaac

SEQ ID NO: 276597 - DNA, 25 bp, Mus musculus
ctgggcccagtatcgttgatctgat

SEQ ID NO: 276598 - DNA, 25 bp, Mus musculus
ctgggcccatctcaggagcaggcga

SEQ ID NO: 276599 - DNA, 25 bp, Mus musculus
ctgggccccaagggcttctagactg

SEQ ID NO: 276600 - DNA, 25 bp, Mus musculus
ctgggccccacaaggacctgctctc

SEQ ID NO: 276601 - DNA, 25 bp, Mus musculus
ctgggcccccgtcacagtttgcact

SEQ ID NO: 276602 - DNA, 25 bp, Mus musculus
ctgggccctggcaggacaacagtcc

SEQ ID NO: 276603 - DNA, 25 bp, Mus musculus
ctgggccctgtttttgggaataacg

SEQ ID NO: 276604 - DNA, 25 bp, Mus musculus
ctgggccgactccgggacagacaat

SEQ ID NO: 276605 - DNA, 25 bp, Mus musculus
ctgggccgactccgtggaaacctct

SEQ ID NO: 276606 - DNA, 25 bp, Mus musculus
ctgggccgaggctcttctgcgatgt

SEQ ID NO: 276607 - DNA, 25 bp, Mus musculus
ctgggccgggattctgaaaggcctg

SEQ ID NO: 276608 - DNA, 25 bp, Mus musculus
ctgggcctaagttatgaggagtcca

SEQ ID NO: 276609 - DNA, 25 bp, Mus musculus
ctgggcctagcagtggcatctttct

SEQ ID NO: 276610 - DNA, 25 bp, Mus musculus
ctgggcctcaagtccccaagacttc

SEQ ID NO: 276611 - DNA, 25 bp, Mus musculus
ctgggcctcaccagtgaagcggccc

SEQ ID NO: 276612 - DNA, 25 bp, Mus musculus
ctgggcctcgtggagttcaggacct

SEQ ID NO: 276613 - DNA, 25 bp, Mus musculus
ctgggcctggcaggggctgcgatgg

SEQ ID NO: 276614 - DNA, 25 bp, Mus musculus
ctgggcctggcaggttcagtcctcg

SEQ ID NO: 276615 - DNA, 25 bp, Mus musculus
ctgggccttccagccatgctgcaag

SEQ ID NO: 276616 - DNA, 25 bp, Mus musculus
ctgggccttgggggcctgggctggt

SEQ ID NO: 276617 - DNA, 25 bp, Mus musculus
ctgggccttgtgttttttcagttct

SEQ ID NO: 276618 - DNA, 25 bp, Mus musculus
ctgggcgagctgttgatgtgatggc

SEQ ID NO: 276619 - DNA, 25 bp, Mus musculus
ctgggcgaggagagaacacatttta

SEQ ID NO: 276620 - DNA, 25 bp, Mus musculus
ctgggcgagttaaagcacatggtga

SEQ ID NO: 276621 - DNA, 25 bp, Mus musculus
ctgggcgatggggcactggctccag

SEQ ID NO: 276622 - DNA, 25 bp, Mus musculus
ctgggcgcaggaagatttggaaaat

SEQ ID NO: 276623 - DNA, 25 bp, Mus musculus
ctgggcgcaggtttacctatttcca

SEQ ID NO: 276624 - DNA, 25 bp, Mus musculus
ctgggcgcgctcggagacattccaa

SEQ ID NO: 276625 - DNA, 25 bp, Mus musculus
ctgggcgctcagcagttctccgacc

SEQ ID NO: 276626 - DNA, 25 bp, Mus musculus
ctgggcgctgcagggtaattcagag

SEQ ID NO: 276627 - DNA, 25 bp, Mus musculus
ctgggcgctggaagagactctcatg

SEQ ID NO: 276628 - DNA, 25 bp, Mus musculus
ctgggcggagccccttaggtgagga

SEQ ID NO: 276629 - DNA, 25 bp, Mus musculus
ctgggcggagtagcgctggggacct

SEQ ID NO: 276630 - DNA, 25 bp, Mus musculus
ctgggcggcggggaggacttgcact

SEQ ID NO: 276631 - DNA, 25 bp, Mus musculus
ctgggcgggaaccaggtgctacaga

SEQ ID NO: 276632 - DNA, 25 bp, Mus musculus
ctgggcgggagagatggatgcgagt

SEQ ID NO: 276633 - DNA, 25 bp, Mus musculus
ctgggcgtctgggcaagacctgcag

SEQ ID NO: 276634 - DNA, 25 bp, Mus musculus
ctgggcgtggaagctatggaggttt

SEQ ID NO: 276635 - DNA, 25 bp, Mus musculus
ctgggctacaaagctgctgatgaga

SEQ ID NO: 276636 - DNA, 25 bp, Mus musculus
ctgggctacaaggtgaagaagcatc

SEQ ID NO: 276637 - DNA, 25 bp, Mus musculus
ctgggctacagagctcaccatgcct

SEQ ID NO: 276638 - DNA, 25 bp, Mus musculus
ctgggctacttcgcgtgggctgtct

SEQ ID NO: 276639 - DNA, 25 bp, Mus musculus
ctgggctataagacccagttgtagc

SEQ ID NO: 276640 - DNA, 25 bp, Mus musculus
ctgggctataaggatgtctcccgtg

SEQ ID NO: 276641 - DNA, 25 bp, Mus musculus
ctgggctataggtcggatatgaaga

SEQ ID NO: 276642 - DNA, 25 bp, Mus musculus
ctgggctcagagggagtggggccgg

SEQ ID NO: 276643 - DNA, 25 bp, Mus musculus
ctgggctccacaagcaaaaccttga

SEQ ID NO: 276644 - DNA, 25 bp, Mus musculus
ctgggctccagacagtccaatgcca

SEQ ID NO: 276645 - DNA, 25 bp, Mus musculus
ctgggctccagacagtcctaacagg

SEQ ID NO: 276646 - DNA, 25 bp, Mus musculus
ctgggctccagatctactactctga

SEQ ID NO: 276647 - DNA, 25 bp, Mus musculus
ctgggctcctctgggatttgttttg

SEQ ID NO: 276648 - DNA, 25 bp, Mus musculus
ctgggctcctggtctctgggccagg

SEQ ID NO: 276649 - DNA, 25 bp, Mus musculus
ctgggctcggagttttcaggaagag

SEQ ID NO: 276650 - DNA, 25 bp, Mus musculus
ctgggctctacgggtgacaccaggt

SEQ ID NO: 276651 - DNA, 25 bp, Mus musculus
ctgggctctgcagattctcattgcc

SEQ ID NO: 276652 - DNA, 25 bp, Mus musculus
ctgggctctgtgggggcagctggca

SEQ ID NO: 276653 - DNA, 25 bp, Mus musculus
ctgggctgaagctaggcggccgtca

SEQ ID NO: 276654 - DNA, 25 bp, Mus musculus
ctgggctgaaggagacagaggaagg

SEQ ID NO: 276655 - DNA, 25 bp, Mus musculus
ctgggctgaaggggagcttctggag

SEQ ID NO: 276656 - DNA, 25 bp, Mus musculus
ctgggctgagatgaggtgccacttc

SEQ ID NO: 276657 - DNA, 25 bp, Mus musculus
ctgggctgcaagcggattgggtttc

SEQ ID NO: 276658 - DNA, 25 bp, Mus musculus
ctgggctgcatgcattgtggctggg

SEQ ID NO: 276659 - DNA, 25 bp, Mus musculus
ctgggctgccccaggatccacctga

SEQ ID NO: 276660 - DNA, 25 bp, Mus musculus
ctgggctgcgggagccaatgtccct

SEQ ID NO: 276661 - DNA, 25 bp, Mus musculus
ctgggctgcgggtttgttttctgcc

SEQ ID NO: 276662 - DNA, 25 bp, Mus musculus
ctgggctgttttggtgtgcacatcc

SEQ ID NO: 276663 - DNA, 25 bp, Mus musculus
ctgggcttaaaaggcatccaaggaa

SEQ ID NO: 276664 - DNA, 25 bp, Mus musculus
ctgggcttcaggtgctgtgggacgg

SEQ ID NO: 276665 - DNA, 25 bp, Mus musculus
ctgggcttcccgatacgacatttca

SEQ ID NO: 276666 - DNA, 25 bp, Mus musculus
ctgggcttcccgattctgtttaggc

SEQ ID NO: 276667 - DNA, 25 bp, Mus musculus
ctgggcttcccggagccgaggacct

SEQ ID NO: 276668 - DNA, 25 bp, Mus musculus
ctgggcttcttctcgaccaacttgc

SEQ ID NO: 276669 - DNA, 25 bp, Mus musculus
ctgggcttcttggtgtctgaccgag

SEQ ID NO: 276670 - DNA, 25 bp, Mus musculus
ctgggcttctttcagacaagcgtga

SEQ ID NO: 276671 - DNA, 25 bp, Mus musculus
ctgggcttgcagattttcttctaac

SEQ ID NO: 276672 - DNA, 25 bp, Mus musculus
ctgggcttgcatgaggcaaaagaga

SEQ ID NO: 276673 - DNA, 25 bp, Mus musculus
ctgggcttgcatgagggctcgctgc

SEQ ID NO: 276674 - DNA, 25 bp, Mus musculus
ctgggcttggaggcaagggcagtga

SEQ ID NO: 276675 - DNA, 25 bp, Mus musculus
ctgggcttggggaagtcccagatct

SEQ ID NO: 276676 - DNA, 25 bp, Mus musculus
ctgggctttccaagttacctgattt

SEQ ID NO: 276677 - DNA, 25 bp, Mus musculus
ctgggctttgctgggacccatgttt

SEQ ID NO: 276678 - DNA, 25 bp, Mus musculus
ctgggcttttgcaggcacaacccgg

SEQ ID NO: 276679 - DNA, 25 bp, Mus musculus
ctggggaaaagggaaagcttggcgt

SEQ ID NO: 276680 - DNA, 25 bp, Mus musculus
ctggggaaagcattgtggaatttct

SEQ ID NO: 276681 - DNA, 25 bp, Mus musculus
ctggggaaagctactgggatggaga

SEQ ID NO: 276682 - DNA, 25 bp, Mus musculus
ctggggaacaggcaggatgagatag

SEQ ID NO: 276683 - DNA, 25 bp, Mus musculus
ctggggaacaggcaggtcacgaaag

SEQ ID NO: 276684 - DNA, 25 bp, Mus musculus
ctggggaacatggaaagctgccttt

SEQ ID NO: 276685 - DNA, 25 bp, Mus musculus
ctggggaagaagagcccttctccct

SEQ ID NO: 276686 - DNA, 25 bp, Mus musculus
ctggggaagcctgggtcacgtgaag

SEQ ID NO: 276687 - DNA, 25 bp, Mus musculus
ctggggaagctggctgtgactcgag

SEQ ID NO: 276688 - DNA, 25 bp, Mus musculus
ctggggaagctgggatctcaagcac

SEQ ID NO: 276689 - DNA, 25 bp, Mus musculus
ctggggaaggaaggtgaccattgtt

SEQ ID NO: 276690 - DNA, 25 bp, Mus musculus
ctggggaaggaagtgagcctggtgg

SEQ ID NO: 276691 - DNA, 25 bp, Mus musculus
ctggggaaggacgcatctcttcgcc

SEQ ID NO: 276692 - DNA, 25 bp, Mus musculus
ctggggaatattcctacctccactc

SEQ ID NO: 276693 - DNA, 25 bp, Mus musculus
ctggggacagaattgccctagaagg

SEQ ID NO: 276694 - DNA, 25 bp, Mus musculus
ctggggaccaaacggtgatggaaaa

SEQ ID NO: 276695 - DNA, 25 bp, Mus musculus
ctggggaccgagccctctgattgcc

SEQ ID NO: 276696 - DNA, 25 bp, Mus musculus
ctggggacgcgtccgactgaggctc

SEQ ID NO: 276697 - DNA, 25 bp, Mus musculus
ctggggacgcgtccggccccagcgg

SEQ ID NO: 276698 - DNA, 25 bp, Mus musculus
ctggggacgtgcagaattaccatga

SEQ ID NO: 276699 - DNA, 25 bp, Mus musculus
ctggggacgtgcagaccatcccatg

SEQ ID NO: 276700 - DNA, 25 bp, Mus musculus
ctggggacttggcagctcatgctgt

SEQ ID NO: 276701 - DNA, 25 bp, Mus musculus
ctggggacttggcaggtccaacgtc

SEQ ID NO: 276702 - DNA, 25 bp, Mus musculus
ctggggacttggggacggctgttct

SEQ ID NO: 276703 - DNA, 25 bp, Mus musculus
ctggggagaaaacaccagctacatc

SEQ ID NO: 276704 - DNA, 25 bp, Mus musculus
ctggggagaataagtgttttgcagc

SEQ ID NO: 276705 - DNA, 25 bp, Mus musculus
ctggggagagatctccatagtagag

SEQ ID NO: 276706 - DNA, 25 bp, Mus musculus
ctggggagaggccgacccgtggaag

SEQ ID NO: 276707 - DNA, 25 bp, Mus musculus
ctggggagccttttgcccttctttt

SEQ ID NO: 276708 - DNA, 25 bp, Mus musculus
ctggggaggagacagacaccatcca

SEQ ID NO: 276709 - DNA, 25 bp, Mus musculus
ctggggaggcagtaaattacagaga

SEQ ID NO: 276710 - DNA, 25 bp, Mus musculus
ctggggaggcagtgttcagggaggt

SEQ ID NO: 276711 - DNA, 25 bp, Mus musculus
ctggggagtacagaggtgcaggtcc

SEQ ID NO: 276712 - DNA, 25 bp, Mus musculus
ctggggataattggcctgtggaagc

SEQ ID NO: 276713 - DNA, 25 bp, Mus musculus
ctggggataattgggtctggcaact

SEQ ID NO: 276714 - DNA, 25 bp, Mus musculus
ctggggatcatgtcggtcacacagc

SEQ ID NO: 276715 - DNA, 25 bp, Mus musculus
ctggggatccgagagactcgggaaa

SEQ ID NO: 276716 - DNA, 25 bp, Mus musculus
ctggggatgcaggttctccgccatg

SEQ ID NO: 276717 - DNA, 25 bp, Mus musculus
ctggggatggcagattcctgtccat

SEQ ID NO: 276718 - DNA, 25 bp, Mus musculus
ctggggatgtgaagatcatcagaaa

SEQ ID NO: 276719 - DNA, 25 bp, Mus musculus
ctggggattctacagcacaggggat

SEQ ID NO: 276720 - DNA, 25 bp, Mus musculus
ctggggattcttcagcacaggggat

SEQ ID NO: 276721 - DNA, 25 bp, Mus musculus
ctggggattgaacttcgtgggcatc

SEQ ID NO: 276722 - DNA, 25 bp, Mus musculus
ctggggcaagaccaagatcaccgat

SEQ ID NO: 276723 - DNA, 25 bp, Mus musculus
ctggggcaagcctgaacctgtcaca

SEQ ID NO: 276724 - DNA, 25 bp, Mus musculus
ctggggcagaagattgctttggcct

SEQ ID NO: 276725 - DNA, 25 bp, Mus musculus
ctggggcagaagcgcattaaagagg

SEQ ID NO: 276726 - DNA, 25 bp, Mus musculus
ctggggcagatcctccttatcccac

SEQ ID NO: 276727 - DNA, 25 bp, Mus musculus
ctggggcaggagccgaaatgtctca

SEQ ID NO: 276728 - DNA, 25 bp, Mus musculus
ctggggcaggagccgagtctcctta

SEQ ID NO: 276729 - DNA, 25 bp, Mus musculus
ctggggcaggagccgatcccttttc

SEQ ID NO: 276730 - DNA, 25 bp, Mus musculus
ctggggcagggcgggagagtattgt

SEQ ID NO: 276731 - DNA, 25 bp, Mus musculus
ctggggcatactgcagtgcttaaat

SEQ ID NO: 276732 - DNA, 25 bp, Mus musculus
ctggggcatgcaggcttcctgcttt

SEQ ID NO: 276733 - DNA, 25 bp, Mus musculus
ctggggccagctcgcaagcaggctg

SEQ ID NO: 276734 - DNA, 25 bp, Mus musculus
ctggggccagctcgcttgaagctcc

SEQ ID NO: 276735 - DNA, 25 bp, Mus musculus
ctggggccatgatgagtacctatac

SEQ ID NO: 276736 - DNA, 25 bp, Mus musculus
ctggggccattggaggagtctgcgg

SEQ ID NO: 276737 - DNA, 25 bp, Mus musculus
ctggggccccatcggaagctcagaa

SEQ ID NO: 276738 - DNA, 25 bp, Mus musculus
ctggggcccgagttctctgggctag

SEQ ID NO: 276739 - DNA, 25 bp, Mus musculus
ctggggccgaaggcctgggatggga

SEQ ID NO: 276740 - DNA, 25 bp, Mus musculus
ctggggcctaactggtttgcatttc

SEQ ID NO: 276741 - DNA, 25 bp, Mus musculus
ctggggccttggtgttgggagccct

SEQ ID NO: 276742 - DNA, 25 bp, Mus musculus
ctggggcgatccggaacctggtggc

SEQ ID NO: 276743 - DNA, 25 bp, Mus musculus
ctggggcgatccgggaaggccatag

SEQ ID NO: 276744 - DNA, 25 bp, Mus musculus
ctggggctacagatagggtctctcc

SEQ ID NO: 276745 - DNA, 25 bp, Mus musculus
ctggggctacagatttatgacattc

SEQ ID NO: 276746 - DNA, 25 bp, Mus musculus
ctggggctacaggtggccttgcacg

SEQ ID NO: 276747 - DNA, 25 bp, Mus musculus
ctggggctactacggttgcaatgag

SEQ ID NO: 276748 - DNA, 25 bp, Mus musculus
ctggggctcccttactcagttccct

SEQ ID NO: 276749 - DNA, 25 bp, Mus musculus
ctggggctgaggccgggaccggagc

SEQ ID NO: 276750 - DNA, 25 bp, Mus musculus
ctggggctgatggcttccctaggat

SEQ ID NO: 276751 - DNA, 25 bp, Mus musculus
ctggggctgcgccggagcgcagagc

SEQ ID NO: 276752 - DNA, 25 bp, Mus musculus
ctggggctggacgttgagatcacca

SEQ ID NO: 276753 - DNA, 25 bp, Mus musculus
ctggggctgtggcagactaactcca

SEQ ID NO: 276754 - DNA, 25 bp, Mus musculus
ctggggcttactcaggatgtcaatg

SEQ ID NO: 276755 - DNA, 25 bp, Mus musculus
ctgggggacctcagaaggtctatat

SEQ ID NO: 276756 - DNA, 25 bp, Mus musculus
ctgggggacgctgcaagtgtggagg

SEQ ID NO: 276757 - DNA, 25 bp, Mus musculus
ctgggggacgctgggatttgaactg

SEQ ID NO: 276758 - DNA, 25 bp, Mus musculus
ctgggggagactcgggggaactgat

SEQ ID NO: 276759 - DNA, 25 bp, Mus musculus
ctgggggagtccagggccgcgtcac

SEQ ID NO: 276760 - DNA, 25 bp, Mus musculus
ctgggggagtctcttgtacagagga

SEQ ID NO: 276761 - DNA, 25 bp, Mus musculus
ctgggggagtgcgggaacagaactc

SEQ ID NO: 276762 - DNA, 25 bp, Mus musculus
ctgggggcaccgaggtctccagcag

SEQ ID NO: 276763 - DNA, 25 bp, Mus musculus
ctgggggcaccgagtcaaataattt

SEQ ID NO: 276764 - DNA, 25 bp, Mus musculus
ctgggggcagcagcaccatggccag

SEQ ID NO: 276765 - DNA, 25 bp, Mus musculus
ctgggggcagcagcttcctggcccc

SEQ ID NO: 276766 - DNA, 25 bp, Mus musculus
ctgggggcagcaggatcccagtgtg

SEQ ID NO: 276767 - DNA, 25 bp, Mus musculus
ctgggggcagccgaggaagtggaga

SEQ ID NO: 276768 - DNA, 25 bp, Mus musculus
ctgggggccaagtgctcaccgagtc

SEQ ID NO: 276769 - DNA, 25 bp, Mus musculus
ctgggggcgcgccctcaagaacaga

SEQ ID NO: 276770 - DNA, 25 bp, Mus musculus
ctgggggcgcgccctcacgtctgac

SEQ ID NO: 276771 - DNA, 25 bp, Mus musculus
ctgggggctgggggggccaagatgg

SEQ ID NO: 276772 - DNA, 25 bp, Mus musculus
ctggggggtccctggtgtcgcggaa

SEQ ID NO: 276773 - DNA, 25 bp, Mus musculus
ctgggggtcactggagtcgctgggg

SEQ ID NO: 276774 - DNA, 25 bp, Mus musculus
ctgggggtcgcggggctcggatggc

SEQ ID NO: 276775 - DNA, 25 bp, Mus musculus
ctggggtacagattcccgtggggct

SEQ ID NO: 276776 - DNA, 25 bp, Mus musculus
ctggggtacgcccgagctccagcaa

SEQ ID NO: 276777 - DNA, 25 bp, Mus musculus
ctggggtactgctgcaggtcctggt

SEQ ID NO: 276778 - DNA, 25 bp, Mus musculus
ctggggtatcagaaggttggaggct

SEQ ID NO: 276779 - DNA, 25 bp, Mus musculus
ctggggtcatcccgtactcactggc

SEQ ID NO: 276780 - DNA, 25 bp, Mus musculus
ctggggtcattgaatacaaaggtgc

SEQ ID NO: 276781 - DNA, 25 bp, Mus musculus
ctggggtccagctgtcaccctgctg

SEQ ID NO: 276782 - DNA, 25 bp, Mus musculus
ctggggtccagggaaaggctcgagt

SEQ ID NO: 276783 - DNA, 25 bp, Mus musculus
ctggggtccccagaatcactatcag

SEQ ID NO: 276784 - DNA, 25 bp, Mus musculus
ctggggtccccagcaggaagggccc

SEQ ID NO: 276785 - DNA, 25 bp, Mus musculus
ctggggtccccagccgatcgggtca

SEQ ID NO: 276786 - DNA, 25 bp, Mus musculus
ctggggtcccggacaagagtacatg

SEQ ID NO: 276787 - DNA, 25 bp, Mus musculus
ctggggtcccggatatttggaagat

SEQ ID NO: 276788 - DNA, 25 bp, Mus musculus
ctggggtcctgctcctgcaaaaaag

SEQ ID NO: 276789 - DNA, 25 bp, Mus musculus
ctggggtctggccaaagatctcatc

SEQ ID NO: 276790 - DNA, 25 bp, Mus musculus
ctggggtctggtcagaaagacagca

SEQ ID NO: 276791 - DNA, 25 bp, Mus musculus
ctggggtgagaagggcgttctctcc

SEQ ID NO: 276792 - DNA, 25 bp, Mus musculus
ctggggtgcagaatttctgaagtga

SEQ ID NO: 276793 - DNA, 25 bp, Mus musculus
ctggggttatgagggctggagacag

SEQ ID NO: 276794 - DNA, 25 bp, Mus musculus
ctggggttgcccttgaacatttatg

SEQ ID NO: 276795 - DNA, 25 bp, Mus musculus
ctggggttgcccttggtgaggcatg

SEQ ID NO: 276796 - DNA, 25 bp, Mus musculus
ctggggttgcctaggtgaggcatgc

SEQ ID NO: 276797 - DNA, 25 bp, Mus musculus
ctggggttgggcgacagagagagat

SEQ ID NO: 276798 - DNA, 25 bp, Mus musculus
ctggggttttaaggtgtctggctga

SEQ ID NO: 276799 - DNA, 25 bp, Mus musculus
ctgggtaaactgaggctcctagaag

SEQ ID NO: 276800 - DNA, 25 bp, Mus musculus
ctgggtacaggcaaccaagaacgga

SEQ ID NO: 276801 - DNA, 25 bp, Mus musculus
ctgggtacaggtcggccagtgagga

SEQ ID NO: 276802 - DNA, 25 bp, Mus musculus
ctgggtacccgctttcttgatcatg

SEQ ID NO: 276803 - DNA, 25 bp, Mus musculus
ctgggtacgatatatcacacagaac

SEQ ID NO: 276804 - DNA, 25 bp, Mus musculus
ctgggtagcccgtgtcccatcactg

SEQ ID NO: 276805 - DNA, 25 bp, Mus musculus
ctgggtagcccgttacatcttcaaa

SEQ ID NO: 276806 - DNA, 25 bp, Mus musculus
ctgggtcaaagcactccactcatca

SEQ ID NO: 276807 - DNA, 25 bp, Mus musculus
ctgggtcaaagcattcctcaaccac

SEQ ID NO: 276808 - DNA, 25 bp, Mus musculus
ctgggtcaaggacacggcaaatgaa

SEQ ID NO: 276809 - DNA, 25 bp, Mus musculus
ctgggtcaagtcaccctgtgaagac

SEQ ID NO: 276810 - DNA, 25 bp, Mus musculus
ctgggtcagaagcatactgaggata

SEQ ID NO: 276811 - DNA, 25 bp, Mus musculus
ctgggtcagaagcatacttagacgt

SEQ ID NO: 276812 - DNA, 25 bp, Mus musculus
ctgggtcagccgggatcaactgcac

SEQ ID NO: 276813 - DNA, 25 bp, Mus musculus
ctgggtcagccggttttttcattag

SEQ ID NO: 276814 - DNA, 25 bp, Mus musculus
ctgggtcaggactaatgtaattgta

SEQ ID NO: 276815 - DNA, 25 bp, Mus musculus
ctgggtcagggataaaaagagcaag

SEQ ID NO: 276816 - DNA, 25 bp, Mus musculus
ctgggtcagggggattgatgtgagt

SEQ ID NO: 276817 - DNA, 25 bp, Mus musculus
ctgggtcaggtcaggaagcaggctc

SEQ ID NO: 276818 - DNA, 25 bp, Mus musculus
ctgggtcatacggtaacatttcact

SEQ ID NO: 276819 - DNA, 25 bp, Mus musculus
ctgggtcctggatggagcctgcaga

SEQ ID NO: 276820 - DNA, 25 bp, Mus musculus
ctgggtcctgggagccacgctggta

SEQ ID NO: 276821 - DNA, 25 bp, Mus musculus
ctgggtcgctaccaccagtgctaca

SEQ ID NO: 276822 - DNA, 25 bp, Mus musculus
ctgggtctcagattatacagacacg

SEQ ID NO: 276823 - DNA, 25 bp, Mus musculus
ctgggtctcccagtttgtcactctt

SEQ ID NO: 276824 - DNA, 25 bp, Mus musculus
ctgggtctctgcagtgctatggggc

SEQ ID NO: 276825 - DNA, 25 bp, Mus musculus
ctgggtctggaggtttgaggctctg

SEQ ID NO: 276826 - DNA, 25 bp, Mus musculus
ctgggtctttcgaatccttcgaaat

SEQ ID NO: 276827 - DNA, 25 bp, Mus musculus
ctgggtgaaacacaggacttccata

SEQ ID NO: 276828 - DNA, 25 bp, Mus musculus
ctgggtgaaggagagtttgggtctg

SEQ ID NO: 276829 - DNA, 25 bp, Mus musculus
ctgggtgacagagtggaccagattg

SEQ ID NO: 276830 - DNA, 25 bp, Mus musculus
ctgggtgacctgggatggattcatg

SEQ ID NO: 276831 - DNA, 25 bp, Mus musculus
ctgggtgagaggctgcccctggaga

SEQ ID NO: 276832 - DNA, 25 bp, Mus musculus
ctgggtgaggaggttgtggcagcat

SEQ ID NO: 276833 - DNA, 25 bp, Mus musculus
ctgggtgataataaggacaaccgga

SEQ ID NO: 276834 - DNA, 25 bp, Mus musculus
ctgggtgataataagtttctgaggg

SEQ ID NO: 276835 - DNA, 25 bp, Mus musculus
ctgggtgataggtgaccatggagga

SEQ ID NO: 276836 - DNA, 25 bp, Mus musculus
ctgggtgatgaaagggctgtgcctg

SEQ ID NO: 276837 - DNA, 25 bp, Mus musculus
ctgggtgatgttttcagctttgtga

SEQ ID NO: 276838 - DNA, 25 bp, Mus musculus
ctgggtgcagaaactggaaacaaag

SEQ ID NO: 276839 - DNA, 25 bp, Mus musculus
ctgggtgcagggggaacagctgtgc

SEQ ID NO: 276840 - DNA, 25 bp, Mus musculus
ctgggtgcaggggtgtgccccagag

SEQ ID NO: 276841 - DNA, 25 bp, Mus musculus
ctgggtgcccgagaggttctgggag

SEQ ID NO: 276842 - DNA, 25 bp, Mus musculus
ctgggtgcccgggatgaaagtggga

SEQ ID NO: 276843 - DNA, 25 bp, Mus musculus
ctgggtggacaggtgagcaatgcca

SEQ ID NO: 276844 - DNA, 25 bp, Mus musculus
ctgggtggagaaaaatgttttacaa

SEQ ID NO: 276845 - DNA, 25 bp, Mus musculus
ctgggtggagagatcattcctcgat

SEQ ID NO: 276846 - DNA, 25 bp, Mus musculus
ctgggtggaggctaatctcgacgaa

SEQ ID NO: 276847 - DNA, 25 bp, Mus musculus
ctgggtggcagaggaggtccaactg

SEQ ID NO: 276848 - DNA, 25 bp, Mus musculus
ctgggtggttgacatgtgcgagtag

SEQ ID NO: 276849 - DNA, 25 bp, Mus musculus
ctgggtgtcagatgatgcatcccag

SEQ ID NO: 276850 - DNA, 25 bp, Mus musculus
ctgggtgtccagacgctgcggccag

SEQ ID NO: 276851 - DNA, 25 bp, Mus musculus
ctgggtgtgagattctctccagagg

SEQ ID NO: 276852 - DNA, 25 bp, Mus musculus
ctgggtgtggcaaggggaaactgtt

SEQ ID NO: 276853 - DNA, 25 bp, Mus musculus
ctgggtgtggccagatcagactcca

SEQ ID NO: 276854 - DNA, 25 bp, Mus musculus
ctgggtgtggccagcgttttaccaa

SEQ ID NO: 276855 - DNA, 25 bp, Mus musculus
ctgggttaaatattgatgagaaggc

SEQ ID NO: 276856 - DNA, 25 bp, Mus musculus
ctgggttaaggagagcacacagctg

SEQ ID NO: 276857 - DNA, 25 bp, Mus musculus
ctgggttagagatgagacctgctcg

SEQ ID NO: 276858 - DNA, 25 bp, Mus musculus
ctgggttcacacaggagtgccagga

SEQ ID NO: 276859 - DNA, 25 bp, Mus musculus
ctgggttcaggcatcagaaacacaa

SEQ ID NO: 276860 - DNA, 25 bp, Mus musculus
ctgggttcaggtgtttccaggacag

SEQ ID NO: 276861 - DNA, 25 bp, Mus musculus
ctgggttccagaccagccacgatgc

SEQ ID NO: 276862 - DNA, 25 bp, Mus musculus
ctgggttcccagtgatagaaaacga

SEQ ID NO: 276863 - DNA, 25 bp, Mus musculus
ctgggttcctagctggaggaaatcc

SEQ ID NO: 276864 - DNA, 25 bp, Mus musculus
ctgggttcctaggtccagctggagg

SEQ ID NO: 276865 - DNA, 25 bp, Mus musculus
ctgggttcggacccagcaatgtccc

SEQ ID NO: 276866 - DNA, 25 bp, Mus musculus
ctgggttcggtcccagcaatgtccc

SEQ ID NO: 276867 - DNA, 25 bp, Mus musculus
ctgggttgagtaaattcacagatac

SEQ ID NO: 276868 - DNA, 25 bp, Mus musculus
ctgggttgcagcccagaggacttcc

SEQ ID NO: 276869 - DNA, 25 bp, Mus musculus
ctgggttgcagttataataaagacc

SEQ ID NO: 276870 - DNA, 25 bp, Mus musculus
ctgggtttaaagaatacttgaacta

SEQ ID NO: 276871 - DNA, 25 bp, Mus musculus
ctgggtttaaagacagtatttgaag

SEQ ID NO: 276872 - DNA, 25 bp, Mus musculus
ctgggtttactgcagctctgcattg

SEQ ID NO: 276873 - DNA, 25 bp, Mus musculus
ctgggtttactgcaggacattaagg

SEQ ID NO: 276874 - DNA, 25 bp, Mus musculus
ctgggtttgccgattcccacccctg

SEQ ID NO: 276875 - DNA, 25 bp, Mus musculus
ctgggtttgccggattatcacaaaa

SEQ ID NO: 276876 - DNA, 25 bp, Mus musculus
ctggtaaaagctgatgaagagacta

SEQ ID NO: 276877 - DNA, 25 bp, Mus musculus
ctggtaaagtggttcatcggaacct

SEQ ID NO: 276878 - DNA, 25 bp, Mus musculus
ctggtaaatgctactgagtgacacc

SEQ ID NO: 276879 - DNA, 25 bp, Mus musculus
ctggtaacagaagaaaagatgtgga

SEQ ID NO: 276880 - DNA, 25 bp, Mus musculus
ctggtaaccaaagctgttctgtgtc

SEQ ID NO: 276881 - DNA, 25 bp, Mus musculus
ctggtaactgctgggggctctcttc

SEQ ID NO: 276882 - DNA, 25 bp, Mus musculus
ctggtaagttcccagcttcttctgt

SEQ ID NO: 276883 - DNA, 25 bp, Mus musculus
ctggtaatgatgaccattaattaag

SEQ ID NO: 276884 - DNA, 25 bp, Mus musculus
ctggtacacctacacaaatgtcccc

SEQ ID NO: 276885 - DNA, 25 bp, Mus musculus
ctggtacagaccatattaaccagct

SEQ ID NO: 276886 - DNA, 25 bp, Mus musculus
ctggtacagaccatattgatcagtt

SEQ ID NO: 276887 - DNA, 25 bp, Mus musculus
ctggtacagaggtatctacacaagc

SEQ ID NO: 276888 - DNA, 25 bp, Mus musculus
ctggtacagtatgctgtgtcccaca

SEQ ID NO: 276889 - DNA, 25 bp, Mus musculus
ctggtacatggtggtcaacctgttg

SEQ ID NO: 276890 - DNA, 25 bp, Mus musculus
ctggtaccaacggaggtcctgggtg

SEQ ID NO: 276891 - DNA, 25 bp, Mus musculus
ctggtaccaactgtgtaaggagaag

SEQ ID NO: 276892 - DNA, 25 bp, Mus musculus
ctggtaccacagaatgagagccacg

SEQ ID NO: 276893 - DNA, 25 bp, Mus musculus
ctggtaccacagagcatttctgaag

SEQ ID NO: 276894 - DNA, 25 bp, Mus musculus
ctggtaccccgtcggcaatgatggc

SEQ ID NO: 276895 - DNA, 25 bp, Mus musculus
ctggtacccgagctgatgtacctca

SEQ ID NO: 276896 - DNA, 25 bp, Mus musculus
ctggtacccgaggagaaactggaaa

SEQ ID NO: 276897 - DNA, 25 bp, Mus musculus
ctggtacccgaggagaccaaacagt

SEQ ID NO: 276898 - DNA, 25 bp, Mus musculus
ctggtacccgaggagaccaaagaag

SEQ ID NO: 276899 - DNA, 25 bp, Mus musculus
ctggtacccgtgctgatgtacctca

SEQ ID NO: 276900 - DNA, 25 bp, Mus musculus
ctggtacctgcagcccatacctgga

SEQ ID NO: 276901 - DNA, 25 bp, Mus musculus
ctggtacctgcagtgcctgagacgt

SEQ ID NO: 276902 - DNA, 25 bp, Mus musculus
ctggtacctgcggctgaaggtgaag

SEQ ID NO: 276903 - DNA, 25 bp, Mus musculus
ctggtactaatggatagatgcctgc

SEQ ID NO: 276904 - DNA, 25 bp, Mus musculus
ctggtactaatgtgccagtattagc

SEQ ID NO: 276905 - DNA, 25 bp, Mus musculus
ctggtactcacaccgcatgactaca

SEQ ID NO: 276906 - DNA, 25 bp, Mus musculus
ctggtactcacactgcggtccaacc

SEQ ID NO: 276907 - DNA, 25 bp, Mus musculus
ctggtactcacagcgcatgactaca

SEQ ID NO: 276908 - DNA, 25 bp, Mus musculus
ctggtactcacagtgcggtccaacc

SEQ ID NO: 276909 - DNA, 25 bp, Mus musculus
ctggtactggagcagagggtcccca

SEQ ID NO: 276910 - DNA, 25 bp, Mus musculus
ctggtactgtccgcatgagacactg

SEQ ID NO: 276911 - DNA, 25 bp, Mus musculus
ctggtagaccagtaacttccctctc

SEQ ID NO: 276912 - DNA, 25 bp, Mus musculus
ctggtagagaagggaccacagtatg

SEQ ID NO: 276913 - DNA, 25 bp, Mus musculus
ctggtagagctgcgcttgtgcactt

SEQ ID NO: 276914 - DNA, 25 bp, Mus musculus
ctggtagatgctgacggctagaccc

SEQ ID NO: 276915 - DNA, 25 bp, Mus musculus
ctggtagatggtgactagaggactg

SEQ ID NO: 276916 - DNA, 25 bp, Mus musculus
ctggtagatttgttgaatgacaaag

SEQ ID NO: 276917 - DNA, 25 bp, Mus musculus
ctggtagcagttggaacaagaggac

SEQ ID NO: 276918 - DNA, 25 bp, Mus musculus
ctggtagcccaggcaagcgcttcca

SEQ ID NO: 276919 - DNA, 25 bp, Mus musculus
ctggtagcccaggccaccatggcag

SEQ ID NO: 276920 - DNA, 25 bp, Mus musculus
ctggtagccggagcgatctttgggt

SEQ ID NO: 276921 - DNA, 25 bp, Mus musculus
ctggtagcctcggattccagagggg

SEQ ID NO: 276922 - DNA, 25 bp, Mus musculus
ctggtaggaaagagaaaatccctga

SEQ ID NO: 276923 - DNA, 25 bp, Mus musculus
ctggtaggaaaggtccagcaagact

SEQ ID NO: 276924 - DNA, 25 bp, Mus musculus
ctggtagtagatgtcccatattatg

SEQ ID NO: 276925 - DNA, 25 bp, Mus musculus
ctggtatatcgaactcgcacttgca

SEQ ID NO: 276926 - DNA, 25 bp, Mus musculus
ctggtatatcgttgtgcagactaca

SEQ ID NO: 276927 - DNA, 25 bp, Mus musculus
ctggtatatgctcccggcaacttct

SEQ ID NO: 276928 - DNA, 25 bp, Mus musculus
ctggtatcaactgtgtaaggagaag

SEQ ID NO: 276929 - DNA, 25 bp, Mus musculus
ctggtatcatgggtataggtccagt

SEQ ID NO: 276930 - DNA, 25 bp, Mus musculus
ctggtatccttggggcactgcgtga

SEQ ID NO: 276931 - DNA, 25 bp, Mus musculus
ctggtatctgaagacgctcatgatc

SEQ ID NO: 276932 - DNA, 25 bp, Mus musculus
ctggtatctggttggcagatattcc

SEQ ID NO: 276933 - DNA, 25 bp, Mus musculus
ctggtatgcatgcggtctcccactg

SEQ ID NO: 276934 - DNA, 25 bp, Mus musculus
ctggtatgcatgcggtgtgagcatc

SEQ ID NO: 276935 - DNA, 25 bp, Mus musculus
ctggtatgttgccagatggatttgt

SEQ ID NO: 276936 - DNA, 25 bp, Mus musculus
ctggtattccaggaatcatggccca

SEQ ID NO: 276937 - DNA, 25 bp, Mus musculus
ctggtatttgagaggtagtgattta

SEQ ID NO: 276938 - DNA, 25 bp, Mus musculus
ctggtcaaagatgacctggatggac

SEQ ID NO: 276939 - DNA, 25 bp, Mus musculus
ctggtcaacacaaaacacagatact

SEQ ID NO: 276940 - DNA, 25 bp, Mus musculus
ctggtcaacacaggtcttctgacgc

SEQ ID NO: 276941 - DNA, 25 bp, Mus musculus
ctggtcaacacataacacagatact

SEQ ID NO: 276942 - DNA, 25 bp, Mus musculus
ctggtcaagaacagcatgggtacac

SEQ ID NO: 276943 - DNA, 25 bp, Mus musculus
ctggtcaagaggaaattgatgaggc

SEQ ID NO: 276944 - DNA, 25 bp, Mus musculus
ctggtcaatagggtacacctggtga

SEQ ID NO: 276945 - DNA, 25 bp, Mus musculus
ctggtcacaaggctccgacatgaag

SEQ ID NO: 276946 - DNA, 25 bp, Mus musculus
ctggtcacaagtgcgaatctgtcca

SEQ ID NO: 276947 - DNA, 25 bp, Mus musculus
ctggtcacaggagtcctttggaacc

SEQ ID NO: 276948 - DNA, 25 bp, Mus musculus
ctggtcacaggtgcccagcagagga

SEQ ID NO: 276949 - DNA, 25 bp, Mus musculus
ctggtcacaggtgcgggtagcggca

SEQ ID NO: 276950 - DNA, 25 bp, Mus musculus
ctggtcacatggtgacctggcctca

SEQ ID NO: 276951 - DNA, 25 bp, Mus musculus
ctggtcacgagctcttctgatctcc

SEQ ID NO: 276952 - DNA, 25 bp, Mus musculus
ctggtcacgaggtaaccatcttgga

SEQ ID NO: 276953 - DNA, 25 bp, Mus musculus
ctggtcactgaacaggttgctccag

SEQ ID NO: 276954 - DNA, 25 bp, Mus musculus
ctggtcagagaattgaccttgctgt

SEQ ID NO: 276955 - DNA, 25 bp, Mus musculus
ctggtcagatgagggtacgggcgct

SEQ ID NO: 276956 - DNA, 25 bp, Mus musculus
ctggtcagccaaatggtgttgtgtg

SEQ ID NO: 276957 - DNA, 25 bp, Mus musculus
ctggtcagccaaatgtctttctgta

SEQ ID NO: 276958 - DNA, 25 bp, Mus musculus
ctggtcagccaaattgaggatgcca

SEQ ID NO: 276959 - DNA, 25 bp, Mus musculus
ctggtcaggtgagcagattgatgat

SEQ ID NO: 276960 - DNA, 25 bp, Mus musculus
ctggtcagtgtctccctccaagcca

SEQ ID NO: 276961 - DNA, 25 bp, Mus musculus
ctggtcataaaggttccagatgatg

SEQ ID NO: 276962 - DNA, 25 bp, Mus musculus
ctggtcatcaacaggctctcctttt

SEQ ID NO: 276963 - DNA, 25 bp, Mus musculus
ctggtcatcgaggtcttccagaaac

SEQ ID NO: 276964 - DNA, 25 bp, Mus musculus
ctggtcatgagaggagaaagagtcc

SEQ ID NO: 276965 - DNA, 25 bp, Mus musculus
ctggtcatgagaggagggcaggttt

SEQ ID NO: 276966 - DNA, 25 bp, Mus musculus
ctggtcattaagggaaagatggagc

SEQ ID NO: 276967 - DNA, 25 bp, Mus musculus
ctggtccaaacagactgaaagtgtc

SEQ ID NO: 276968 - DNA, 25 bp, Mus musculus
ctggtccacataaaaggaaattgtg

SEQ ID NO: 276969 - DNA, 25 bp, Mus musculus
ctggtccaccgtgtcagactcagtc

SEQ ID NO: 276970 - DNA, 25 bp, Mus musculus
ctggtccagaacagcctgcacttcg

SEQ ID NO: 276971 - DNA, 25 bp, Mus musculus
ctggtccagaacagctggaggtggc

SEQ ID NO: 276972 - DNA, 25 bp, Mus musculus
ctggtccagcagatgcgtcgagccc

SEQ ID NO: 276973 - DNA, 25 bp, Mus musculus
ctggtccaggataaataggatttac

SEQ ID NO: 276974 - DNA, 25 bp, Mus musculus
ctggtccatcctctggaccgtgatt

SEQ ID NO: 276975 - DNA, 25 bp, Mus musculus
ctggtccatggggtgcgccccggga

SEQ ID NO: 276976 - DNA, 25 bp, Mus musculus
ctggtcccagcgcaagagcctgtta

SEQ ID NO: 276977 - DNA, 25 bp, Mus musculus
ctggtcccagcgcaggagcctgtta

SEQ ID NO: 276978 - DNA, 25 bp, Mus musculus
ctggtccccaggcctggctgctgcc

SEQ ID NO: 276979 - DNA, 25 bp, Mus musculus
ctggtcccccaataccgtgactgtc

SEQ ID NO: 276980 - DNA, 25 bp, Mus musculus
ctggtccccctggtgctactggctt

SEQ ID NO: 276981 - DNA, 25 bp, Mus musculus
ctggtccctgttgacaatatcttta

SEQ ID NO: 276982 - DNA, 25 bp, Mus musculus
ctggtccctgttgacgaacctaaaa

SEQ ID NO: 276983 - DNA, 25 bp, Mus musculus
ctggtccgagggctactgacagtcg

SEQ ID NO: 276984 - DNA, 25 bp, Mus musculus
ctggtcctacgatcccaggctccgg

SEQ ID NO: 276985 - DNA, 25 bp, Mus musculus
ctggtcctacggctgtgtggtgaag

SEQ ID NO: 276986 - DNA, 25 bp, Mus musculus
ctggtcctcaggcattaacaagtgc

SEQ ID NO: 276987 - DNA, 25 bp, Mus musculus
ctggtcctgtgggtctccctggtcc

SEQ ID NO: 276988 - DNA, 25 bp, Mus musculus
ctggtcctgtgggtgaaccaggtct

SEQ ID NO: 276989 - DNA, 25 bp, Mus musculus
ctggtcctgtgggtgagcaaggcct

SEQ ID NO: 276990 - DNA, 25 bp, Mus musculus
ctggtcgaagctgggttgaaaacta

SEQ ID NO: 276991 - DNA, 25 bp, Mus musculus
ctggtcgcagaagtacagcacgtgg

SEQ ID NO: 276992 - DNA, 25 bp, Mus musculus
ctggtcgggagtcagaaagagccca

SEQ ID NO: 276993 - DNA, 25 bp, Mus musculus
ctggtctaaagaatcagaagtactc

SEQ ID NO: 276994 - DNA, 25 bp, Mus musculus
ctggtctacaaagaaatgttctgcg

SEQ ID NO: 276995 - DNA, 25 bp, Mus musculus
ctggtctacaaagtggatcccactg

SEQ ID NO: 276996 - DNA, 25 bp, Mus musculus
ctggtctacaagatcacagagcagc

SEQ ID NO: 276997 - DNA, 25 bp, Mus musculus
ctggtctacagaatagacatgctaa

SEQ ID NO: 276998 - DNA, 25 bp, Mus musculus
ctggtctacagagctctcagacact

SEQ ID NO: 276999 - DNA, 25 bp, Mus musculus
ctggtctacagatacaaatatagag

SEQ ID NO: 277000 - DNA, 25 bp, Mus musculus
ctggtctacatagggctccaacacc

SEQ ID NO: 277001 - DNA, 25 bp, Mus musculus
ctggtctacatagtgtgagtcattc

SEQ ID NO: 277002 - DNA, 25 bp, Mus musculus
ctggtctatcctggccgcctgggaa

SEQ ID NO: 277003 - DNA, 25 bp, Mus musculus
ctggtctatcctggggacctaaaac

SEQ ID NO: 277004 - DNA, 25 bp, Mus musculus
ctggtctatcctggtgatccactgc

SEQ ID NO: 277005 - DNA, 25 bp, Mus musculus
ctggtctcaggaatctatgaatact

SEQ ID NO: 277006 - DNA, 25 bp, Mus musculus
ctggtctcaggtaatctccaaaaaa

SEQ ID NO: 277007 - DNA, 25 bp, Mus musculus
ctggtctcaggtaatctccaaaaac

SEQ ID NO: 277008 - DNA, 25 bp, Mus musculus
ctggtctccctggggcatcagccgt

SEQ ID NO: 277009 - DNA, 25 bp, Mus musculus
ctggtctcgctctggcttcccattt

SEQ ID NO: 277010 - DNA, 25 bp, Mus musculus
ctggtctctgtggagaactactgca

SEQ ID NO: 277011 - DNA, 25 bp, Mus musculus
ctggtctcttccttacacatgatga

SEQ ID NO: 277012 - DNA, 25 bp, Mus musculus
ctggtctgagaggtcttcctggaaa

SEQ ID NO: 277013 - DNA, 25 bp, Mus musculus
ctggtcttaggttcttgattgtcta

SEQ ID NO: 277014 - DNA, 25 bp, Mus musculus
ctggtcttcacagggacctgtggga

SEQ ID NO: 277015 - DNA, 25 bp, Mus musculus
ctggtcttcacctgcctctgcctcc

SEQ ID NO: 277016 - DNA, 25 bp, Mus musculus
ctggtcttcagagtggaattgggct

SEQ ID NO: 277017 - DNA, 25 bp, Mus musculus
ctggtctttggagatatggaaggcc

SEQ ID NO: 277018 - DNA, 25 bp, Mus musculus
ctggtgaaatgaggaagaaaagcga

SEQ ID NO: 277019 - DNA, 25 bp, Mus musculus
ctggtgaacccattggtcagtgaca

SEQ ID NO: 277020 - DNA, 25 bp, Mus musculus
ctggtgaagcacctcctggacctcc

SEQ ID NO: 277021 - DNA, 25 bp, Mus musculus
ctggtgaatgctctggtgtccgccg

SEQ ID NO: 277022 - DNA, 25 bp, Mus musculus
ctggtgaatggggtcagtggtgagc

SEQ ID NO: 277023 - DNA, 25 bp, Mus musculus
ctggtgacaagaagactagcagtga

SEQ ID NO: 277024 - DNA, 25 bp, Mus musculus
ctggtgacaagggagaccagggcct

SEQ ID NO: 277025 - DNA, 25 bp, Mus musculus
ctggtgacaggatggctgggcacag

SEQ ID NO: 277026 - DNA, 25 bp, Mus musculus
ctggtgacaggatgttggtgttggt

SEQ ID NO: 277027 - DNA, 25 bp, Mus musculus
ctggtgacccacaaccgcacttacc

SEQ ID NO: 277028 - DNA, 25 bp, Mus musculus
ctggtgacgacggtgaagctgggaa

SEQ ID NO: 277029 - DNA, 25 bp, Mus musculus
ctggtgactactggaataccagttg

SEQ ID NO: 277030 - DNA, 25 bp, Mus musculus
ctggtgactcacagctgaaggtgga

SEQ ID NO: 277031 - DNA, 25 bp, Mus musculus
ctggtgactcacagggaacaacccc

SEQ ID NO: 277032 - DNA, 25 bp, Mus musculus
ctggtgactctggggctgacaaaaa

SEQ ID NO: 277033 - DNA, 25 bp, Mus musculus
ctggtgagaagaacagcagtggtga

SEQ ID NO: 277034 - DNA, 25 bp, Mus musculus
ctggtgagaggaagctttgtctcct

SEQ ID NO: 277035 - DNA, 25 bp, Mus musculus
ctggtgagccatcttttctggggac

SEQ ID NO: 277036 - DNA, 25 bp, Mus musculus
ctggtgagcctcccgagcaccatca

SEQ ID NO: 277037 - DNA, 25 bp, Mus musculus
ctggtgaggctagaaagaaggattt

SEQ ID NO: 277038 - DNA, 25 bp, Mus musculus
ctggtgagtatgcagctgataaaga

SEQ ID NO: 277039 - DNA, 25 bp, Mus musculus
ctggtgatcaaggtgttcctggaga

SEQ ID NO: 277040 - DNA, 25 bp, Mus musculus
ctggtgatccctgcagacggctctg

SEQ ID NO: 277041 - DNA, 25 bp, Mus musculus
ctggtgattaggacaaagccaaagt

SEQ ID NO: 277042 - DNA, 25 bp, Mus musculus
ctggtgcaaagttggtatatccaaa

SEQ ID NO: 277043 - DNA, 25 bp, Mus musculus
ctggtgcaagagagtgtccaagcac

SEQ ID NO: 277044 - DNA, 25 bp, Mus musculus
ctggtgcacctggtccacaaggttt

SEQ ID NO: 277045 - DNA, 25 bp, Mus musculus
ctggtgcacgaccttctgccccctg

SEQ ID NO: 277046 - DNA, 25 bp, Mus musculus
ctggtgcagcggaagggcgtgtgga

SEQ ID NO: 277047 - DNA, 25 bp, Mus musculus
ctggtgcagggtgtggtgtgtcctc

SEQ ID NO: 277048 - DNA, 25 bp, Mus musculus
ctggtgcagtatgatctgaagagtg

SEQ ID NO: 277049 - DNA, 25 bp, Mus musculus
ctggtgccaagggcgaagctggtcc

SEQ ID NO: 277050 - DNA, 25 bp, Mus musculus
ctggtgccagcaactggccatgcca

SEQ ID NO: 277051 - DNA, 25 bp, Mus musculus
ctggtgccagctctaggaatgattc

SEQ ID NO: 277052 - DNA, 25 bp, Mus musculus
ctggtgccagggtttctctgtgtgg

SEQ ID NO: 277053 - DNA, 25 bp, Mus musculus
ctggtgcccagagagaggcaggaag

SEQ ID NO: 277054 - DNA, 25 bp, Mus musculus
ctggtgcccagggtgctggtgttga

SEQ ID NO: 277055 - DNA, 25 bp, Mus musculus
ctggtgcctagatgctgaatgctcc

SEQ ID NO: 277056 - DNA, 25 bp, Mus musculus
ctggtgcctgactttaagcaagaag

SEQ ID NO: 277057 - DNA, 25 bp, Mus musculus
ctggtgccttcagaattgttttact

SEQ ID NO: 277058 - DNA, 25 bp, Mus musculus
ctggtgcgagacaccccccaggcct

SEQ ID NO: 277059 - DNA, 25 bp, Mus musculus
ctggtgcgagagtcacccagcacag

SEQ ID NO: 277060 - DNA, 25 bp, Mus musculus
ctggtgctaagggtgaagctggccc

SEQ ID NO: 277061 - DNA, 25 bp, Mus musculus
ctggtgctaatacaacctgtgggtg

SEQ ID NO: 277062 - DNA, 25 bp, Mus musculus
ctggtgctaatcacagaactgttac

SEQ ID NO: 277063 - DNA, 25 bp, Mus musculus
ctggtgctaatgtctgtgcgtcctg

SEQ ID NO: 277064 - DNA, 25 bp, Mus musculus
ctggtgctacctttttttgatcctg

SEQ ID NO: 277065 - DNA, 25 bp, Mus musculus
ctggtgctagcacaggttagtgtct

SEQ ID NO: 277066 - DNA, 25 bp, Mus musculus
ctggtgctagcaggttttatgaccc

SEQ ID NO: 277067 - DNA, 25 bp, Mus musculus
ctggtgctagctggtgaagacacac

SEQ ID NO: 277068 - DNA, 25 bp, Mus musculus
ctggtgctaggagtggcctgcagtg

SEQ ID NO: 277069 - DNA, 25 bp, Mus musculus
ctggtgctcaggcattgcagctctt

SEQ ID NO: 277070 - DNA, 25 bp, Mus musculus
ctggtgctccgcagctggctcctcc

SEQ ID NO: 277071 - DNA, 25 bp, Mus musculus
ctggtgctccgcaggtatctgaatc

SEQ ID NO: 277072 - DNA, 25 bp, Mus musculus
ctggtgctccgcaggttgaactgga

SEQ ID NO: 277073 - DNA, 25 bp, Mus musculus
ctggtgctccggcattgcagctctt

SEQ ID NO: 277074 - DNA, 25 bp, Mus musculus
ctggtgctccgtggaccctaatgac

SEQ ID NO: 277075 - DNA, 25 bp, Mus musculus
ctggtgctctgaagggggtacttcg

SEQ ID NO: 277076 - DNA, 25 bp, Mus musculus
ctggtgctctgaaggtcagcaagtc

SEQ ID NO: 277077 - DNA, 25 bp, Mus musculus
ctggtgctgcatgggctcccctcag

SEQ ID NO: 277078 - DNA, 25 bp, Mus musculus
ctggtgctgccccacacctctggcc

SEQ ID NO: 277079 - DNA, 25 bp, Mus musculus
ctggtgctgcccccggccagccctg

SEQ ID NO: 277080 - DNA, 25 bp, Mus musculus
ctggtgctgctggtgctcggggtaa

SEQ ID NO: 277081 - DNA, 25 bp, Mus musculus
ctggtgctggagagcaaaaaaacac

SEQ ID NO: 277082 - DNA, 25 bp, Mus musculus
ctggtgctggagtggagaaagcatg

SEQ ID NO: 277083 - DNA, 25 bp, Mus musculus
ctggtgctggggtcctttatggaga

SEQ ID NO: 277084 - DNA, 25 bp, Mus musculus
ctggtgctgtgtggatctctcagac

SEQ ID NO: 277085 - DNA, 25 bp, Mus musculus
ctggtgcttcctcagtgtggcttga

SEQ ID NO: 277086 - DNA, 25 bp, Mus musculus
ctggtggaactggaaggcacaatgg

SEQ ID NO: 277087 - DNA, 25 bp, Mus musculus
ctggtggaagccgaggaacgccgcc

SEQ ID NO: 277088 - DNA, 25 bp, Mus musculus
ctggtggaagccgaggagctggagg

SEQ ID NO: 277089 - DNA, 25 bp, Mus musculus
ctggtggaaggaggcaggattgacc

SEQ ID NO: 277090 - DNA, 25 bp, Mus musculus
ctggtggaaggggagcaaactggac

SEQ ID NO: 277091 - DNA, 25 bp, Mus musculus
ctggtggagaaggtgtaaccagcca

SEQ ID NO: 277092 - DNA, 25 bp, Mus musculus
ctggtggagaccagcatgattgggc

SEQ ID NO: 277093 - DNA, 25 bp, Mus musculus
ctggtggagagaggcaaactgctcc

SEQ ID NO: 277094 - DNA, 25 bp, Mus musculus
ctggtggagagcgagctgcagcgac

SEQ ID NO: 277095 - DNA, 25 bp, Mus musculus
ctggtggagatccagtgtcctgagc

SEQ ID NO: 277096 - DNA, 25 bp, Mus musculus
ctggtggagcaaggtggccctgtct

SEQ ID NO: 277097 - DNA, 25 bp, Mus musculus
ctggtggagctgcagggatacaaac

SEQ ID NO: 277098 - DNA, 25 bp, Mus musculus
ctggtggagctggatcgggcggtgc

SEQ ID NO: 277099 - DNA, 25 bp, Mus musculus
ctggtggaggaacatggccaccacc

SEQ ID NO: 277100 - DNA, 25 bp, Mus musculus
ctggtggaggagaagatggagcgag

SEQ ID NO: 277101 - DNA, 25 bp, Mus musculus
ctggtggagttctaccccacaatca

SEQ ID NO: 277102 - DNA, 25 bp, Mus musculus
ctggtggagttctatgccccgtggt

SEQ ID NO: 277103 - DNA, 25 bp, Mus musculus
ctggtggagttctatgccccttggt

SEQ ID NO: 277104 - DNA, 25 bp, Mus musculus
ctggtggatcagctggaaaacaggc

SEQ ID NO: 277105 - DNA, 25 bp, Mus musculus
ctggtggatgactatgggctcagac

SEQ ID NO: 277106 - DNA, 25 bp, Mus musculus
ctggtggcagctgagaaacttggaa

SEQ ID NO: 277107 - DNA, 25 bp, Mus musculus
ctggtggcaggatcaagttctctgc

SEQ ID NO: 277108 - DNA, 25 bp, Mus musculus
ctggtggcattccattgacaatttg

SEQ ID NO: 277109 - DNA, 25 bp, Mus musculus
ctggtggccaattggagcatctcta

SEQ ID NO: 277110 - DNA, 25 bp, Mus musculus
ctggtggccacaggctcccataatg

SEQ ID NO: 277111 - DNA, 25 bp, Mus musculus
ctggtggccacaggttggttttatc

SEQ ID NO: 277112 - DNA, 25 bp, Mus musculus
ctggtggccacctactcccagatgg

SEQ ID NO: 277113 - DNA, 25 bp, Mus musculus
ctggtggccagagagctgaagcgct

SEQ ID NO: 277114 - DNA, 25 bp, Mus musculus
ctggtggccagcaaccttcctgctt

SEQ ID NO: 277115 - DNA, 25 bp, Mus musculus
ctggtggcccaggaggtcctgtcct

SEQ ID NO: 277116 - DNA, 25 bp, Mus musculus
ctggtggccgccgacaacactggta

SEQ ID NO: 277117 - DNA, 25 bp, Mus musculus
ctggtggccgccgatacatatacca

SEQ ID NO: 277118 - DNA, 25 bp, Mus musculus
ctggtggcctcaagggttacaggga

SEQ ID NO: 277119 - DNA, 25 bp, Mus musculus
ctggtggcctcctggactgtgctgg

SEQ ID NO: 277120 - DNA, 25 bp, Mus musculus
ctggtggcctcctgggtggtgcaga

SEQ ID NO: 277121 - DNA, 25 bp, Mus musculus
ctggtggcgacagatgtgaaggcac

SEQ ID NO: 277122 - DNA, 25 bp, Mus musculus
ctggtggcgggagcctttttctggc

SEQ ID NO: 277123 - DNA, 25 bp, Mus musculus
ctggtggcggggaaggcagatgagg

SEQ ID NO: 277124 - DNA, 25 bp, Mus musculus
ctggtggctcaagttttcctgactt

SEQ ID NO: 277125 - DNA, 25 bp, Mus musculus
ctggtggctcagtttctacagttaa

SEQ ID NO: 277126 - DNA, 25 bp, Mus musculus
ctggtggctcagtttcttcggctgt

SEQ ID NO: 277127 - DNA, 25 bp, Mus musculus
ctggtggctgtgcaggtataatggc

SEQ ID NO: 277128 - DNA, 25 bp, Mus musculus
ctggtgggaatcagtgggtatcaca

SEQ ID NO: 277129 - DNA, 25 bp, Mus musculus
ctggtgggaccagtttaaaaggatg

SEQ ID NO: 277130 - DNA, 25 bp, Mus musculus
ctggtgggcaccccaggtgaaagca

SEQ ID NO: 277131 - DNA, 25 bp, Mus musculus
ctggtgggcagcttcatgttgtgtg

SEQ ID NO: 277132 - DNA, 25 bp, Mus musculus
ctggtgggcagggccttcgtatacc

SEQ ID NO: 277133 - DNA, 25 bp, Mus musculus
ctggtgggcaggtgtgctgatgtca

SEQ ID NO: 277134 - DNA, 25 bp, Mus musculus
ctggtgggcagtggagaaaaatggt

SEQ ID NO: 277135 - DNA, 25 bp, Mus musculus
ctggtggtatcttcgaaccaagtat

SEQ ID NO: 277136 - DNA, 25 bp, Mus musculus
ctggtggtcctggggccatcagctc

SEQ ID NO: 277137 - DNA, 25 bp, Mus musculus
ctggtggtcctggggtacaatggtg

SEQ ID NO: 277138 - DNA, 25 bp, Mus musculus
ctggtggtcttccaggggaatgcag

SEQ ID NO: 277139 - DNA, 25 bp, Mus musculus
ctggtggtgaactaaagcaccgagt

SEQ ID NO: 277140 - DNA, 25 bp, Mus musculus
ctggtggtgaactgctgtatcttgg

SEQ ID NO: 277141 - DNA, 25 bp, Mus musculus
ctggtggtgaagtatatcatgtata

SEQ ID NO: 277142 - DNA, 25 bp, Mus musculus
ctggtggtggcattgggctggaaag

SEQ ID NO: 277143 - DNA, 25 bp, Mus musculus
ctggtggtttaacaggtgtcactct

SEQ ID NO: 277144 - DNA, 25 bp, Mus musculus
ctggtgtaaagggagatcgaggccc

SEQ ID NO: 277145 - DNA, 25 bp, Mus musculus
ctggtgtaaaggtagatcgaggccc

SEQ ID NO: 277146 - DNA, 25 bp, Mus musculus
ctggtgtaagaaatgaagctcaaga

SEQ ID NO: 277147 - DNA, 25 bp, Mus musculus
ctggtgtacagggatcagaacaagt

SEQ ID NO: 277148 - DNA, 25 bp, Mus musculus
ctggtgtactggagaaaatgttttc

SEQ ID NO: 277149 - DNA, 25 bp, Mus musculus
ctggtgtactggagagggtgtaaca

SEQ ID NO: 277150 - DNA, 25 bp, Mus musculus
ctggtgtaggcagtctcatcaagca

SEQ ID NO: 277151 - DNA, 25 bp, Mus musculus
ctggtgtcaaaggagaccaaggtgt

SEQ ID NO: 277152 - DNA, 25 bp, Mus musculus
ctggtgtcaacattgtggagatgct

SEQ ID NO: 277153 - DNA, 25 bp, Mus musculus
ctggtgtcaagcctgagggatctga

SEQ ID NO: 277154 - DNA, 25 bp, Mus musculus
ctggtgtcaagctcccagactccac

SEQ ID NO: 277155 - DNA, 25 bp, Mus musculus
ctggtgtcagacatggctaaagaga

SEQ ID NO: 277156 - DNA, 25 bp, Mus musculus
ctggtgtcagtctctgcttccttcg

SEQ ID NO: 277157 - DNA, 25 bp, Mus musculus
ctggtgtccagagagttgtgtggcc

SEQ ID NO: 277158 - DNA, 25 bp, Mus musculus
ctggtgtcccgggatgccaagcctt

SEQ ID NO: 277159 - DNA, 25 bp, Mus musculus
ctggtgtccgagatgcatgctgttc

SEQ ID NO: 277160 - DNA, 25 bp, Mus musculus
ctggtgtccgaggtcttcagattac

SEQ ID NO: 277161 - DNA, 25 bp, Mus musculus
ctggtgtccgagtgtcctgcaggtc

SEQ ID NO: 277162 - DNA, 25 bp, Mus musculus
ctggtgtcctaggccacagaaggac

SEQ ID NO: 277163 - DNA, 25 bp, Mus musculus
ctggtgtcgctcgagttcctgagga

SEQ ID NO: 277164 - DNA, 25 bp, Mus musculus
ctggtgtcgctcgggtatcaagtct

SEQ ID NO: 277165 - DNA, 25 bp, Mus musculus
ctggtgtcggaggatataaaattcc

SEQ ID NO: 277166 - DNA, 25 bp, Mus musculus
ctggtgtctctggtcccatgggtcc

SEQ ID NO: 277167 - DNA, 25 bp, Mus musculus
ctggtgtctggtggcactgacaccc

SEQ ID NO: 277168 - DNA, 25 bp, Mus musculus
ctggtgtgagccttctctgaggatg

SEQ ID NO: 277169 - DNA, 25 bp, Mus musculus
ctggtgtgccaacgaggaatatcct

SEQ ID NO: 277170 - DNA, 25 bp, Mus musculus
ctggtgtgccaacgccagctttttt

SEQ ID NO: 277171 - DNA, 25 bp, Mus musculus
ctggtgtgccaggagagtactaaat

SEQ ID NO: 277172 - DNA, 25 bp, Mus musculus
ctggtgtgcttggattacacagtgc

SEQ ID NO: 277173 - DNA, 25 bp, Mus musculus
ctggtgtgcttgtgctcgccgtggg

SEQ ID NO: 277174 - DNA, 25 bp, Mus musculus
ctggtgtggcagtagaaacagatac

SEQ ID NO: 277175 - DNA, 25 bp, Mus musculus
ctggtgtggcattttttggaccata

SEQ ID NO: 277176 - DNA, 25 bp, Mus musculus
ctggtgtgggctaaattggttccag

SEQ ID NO: 277177 - DNA, 25 bp, Mus musculus
ctggtgtgtctagggtgtgcttata

SEQ ID NO: 277178 - DNA, 25 bp, Mus musculus
ctggtgttcggtagagctggtgagt

SEQ ID NO: 277179 - DNA, 25 bp, Mus musculus
ctggtgttcggtgaagatggttctg

SEQ ID NO: 277180 - DNA, 25 bp, Mus musculus
ctggtgttggagcccctgggaacaa

SEQ ID NO: 277181 - DNA, 25 bp, Mus musculus
ctggtgttggagctctgtgatacat

SEQ ID NO: 277182 - DNA, 25 bp, Mus musculus
ctggtgttggaggaagtaaagctct

SEQ ID NO: 277183 - DNA, 25 bp, Mus musculus
ctggtgttttcaggcctctgctcga

SEQ ID NO: 277184 - DNA, 25 bp, Mus musculus
ctggttaacctgattcctggtttgg

SEQ ID NO: 277185 - DNA, 25 bp, Mus musculus
ctggttaacctggatggggaggtga

SEQ ID NO: 277186 - DNA, 25 bp, Mus musculus
ctggttaacctgggagtttctgcat

SEQ ID NO: 277187 - DNA, 25 bp, Mus musculus
ctggttaacgcttatttcctcaagc

SEQ ID NO: 277188 - DNA, 25 bp, Mus musculus
ctggttaactgccagatggttcttc

SEQ ID NO: 277189 - DNA, 25 bp, Mus musculus
ctggttacctagaggtgggaggctt

SEQ ID NO: 277190 - DNA, 25 bp, Mus musculus
ctggttagagatgaatccgccagtt

SEQ ID NO: 277191 - DNA, 25 bp, Mus musculus
ctggttagaggtgaagaatattgag

SEQ ID NO: 277192 - DNA, 25 bp, Mus musculus
ctggttccaggcggggtacatggct

SEQ ID NO: 277193 - DNA, 25 bp, Mus musculus
ctggttccaggcggggttaaactca

SEQ ID NO: 277194 - DNA, 25 bp, Mus musculus
ctggttccataggtgcggctctggg

SEQ ID NO: 277195 - DNA, 25 bp, Mus musculus
ctggttcccaaggacttgtactggt

SEQ ID NO: 277196 - DNA, 25 bp, Mus musculus
ctggttcccaatgatctgattggct

SEQ ID NO: 277197 - DNA, 25 bp, Mus musculus
ctggttcccaatgatggcagcaaga

SEQ ID NO: 277198 - DNA, 25 bp, Mus musculus
ctggttcctggagggatcaatgtga

SEQ ID NO: 277199 - DNA, 25 bp, Mus musculus
ctggttcgaaggccatgacagtagc

SEQ ID NO: 277200 - DNA, 25 bp, Mus musculus
ctggttcgaaggggctcatcctgtt

SEQ ID NO: 277201 - DNA, 25 bp, Mus musculus
ctggttcgcctgggtggcggctgac

SEQ ID NO: 277202 - DNA, 25 bp, Mus musculus
ctggttcggggccgtcgtgaccctg

SEQ ID NO: 277203 - DNA, 25 bp, Mus musculus
ctggttctagaacagttcttaggaa

SEQ ID NO: 277204 - DNA, 25 bp, Mus musculus
ctggttctgagaatctgcctgtgga

SEQ ID NO: 277205 - DNA, 25 bp, Mus musculus
ctggttctgagttctcatctccctc

SEQ ID NO: 277206 - DNA, 25 bp, Mus musculus
ctggttctgcaggagcagagcccgg

SEQ ID NO: 277207 - DNA, 25 bp, Mus musculus
ctggttctggaaatcctgagaatat

SEQ ID NO: 277208 - DNA, 25 bp, Mus musculus
ctggttctggaaatggctgaccaag

SEQ ID NO: 277209 - DNA, 25 bp, Mus musculus
ctggttctggaatgatctcaacttc

SEQ ID NO: 277210 - DNA, 25 bp, Mus musculus
ctggttctggtgctgaaacccttca

SEQ ID NO: 277211 - DNA, 25 bp, Mus musculus
ctggttcttaagtcagagagcgagg

SEQ ID NO: 277212 - DNA, 25 bp, Mus musculus
ctggttcttcaagatctggagaccc

SEQ ID NO: 277213 - DNA, 25 bp, Mus musculus
ctggttcttcaaggccacgaaagac

SEQ ID NO: 277214 - DNA, 25 bp, Mus musculus
ctggttgaagagggtgctgatactt

SEQ ID NO: 277215 - DNA, 25 bp, Mus musculus
ctggttgaagaggtgcacactttat

SEQ ID NO: 277216 - DNA, 25 bp, Mus musculus
ctggttgagcaacaaaatcttgcta

SEQ ID NO: 277217 - DNA, 25 bp, Mus musculus
ctggttgagcaagaaaatcttgcta

SEQ ID NO: 277218 - DNA, 25 bp, Mus musculus
ctggttgccaagaaggggtagagga

SEQ ID NO: 277219 - DNA, 25 bp, Mus musculus
ctggttgccaaggctacataaactg

SEQ ID NO: 277220 - DNA, 25 bp, Mus musculus
ctggttgccaaggtccaaggacctt

SEQ ID NO: 277221 - DNA, 25 bp, Mus musculus
ctggttgccaggctccacccgcggt

SEQ ID NO: 277222 - DNA, 25 bp, Mus musculus
ctggttgcccaggtgctgggcttgg

SEQ ID NO: 277223 - DNA, 25 bp, Mus musculus
ctggttgctgtggccctctgattgc

SEQ ID NO: 277224 - DNA, 25 bp, Mus musculus
ctggttgcttctggggtcacaggat

SEQ ID NO: 277225 - DNA, 25 bp, Mus musculus
ctggttggacttggtgtgagtcatt

SEQ ID NO: 277226 - DNA, 25 bp, Mus musculus
ctggttggagaaatctctggtcgct

SEQ ID NO: 277227 - DNA, 25 bp, Mus musculus
ctggttggatgggcacacgctgcca

SEQ ID NO: 277228 - DNA, 25 bp, Mus musculus
ctggttggcggagagagtacccagt

SEQ ID NO: 277229 - DNA, 25 bp, Mus musculus
ctggttggctaccagggacctcctg

SEQ ID NO: 277230 - DNA, 25 bp, Mus musculus
ctggttgtgattcagatacaaacag

SEQ ID NO: 277231 - DNA, 25 bp, Mus musculus
ctggttgtgattcagatcaactgcc

SEQ ID NO: 277232 - DNA, 25 bp, Mus musculus
ctggtttagattctcaaaccatgaa

SEQ ID NO: 277233 - DNA, 25 bp, Mus musculus
ctggtttatcagagatttgaagttc

SEQ ID NO: 277234 - DNA, 25 bp, Mus musculus
ctggtttatcaggacccagcatgaa

SEQ ID NO: 277235 - DNA, 25 bp, Mus musculus
ctggtttatcgggaccagaataagt

SEQ ID NO: 277236 - DNA, 25 bp, Mus musculus
ctggtttatttacaccaagctggat

SEQ ID NO: 277237 - DNA, 25 bp, Mus musculus
ctggtttcaaggtgacagatcagtc

SEQ ID NO: 277238 - DNA, 25 bp, Mus musculus
ctggtttcacaggtcaactttgtga

SEQ ID NO: 277239 - DNA, 25 bp, Mus musculus
ctggtttcagaaggtttgaagactc

SEQ ID NO: 277240 - DNA, 25 bp, Mus musculus
ctggtttcagaggaggcctttccca

SEQ ID NO: 277241 - DNA, 25 bp, Mus musculus
ctggtttcaggccttcccctgaagg

SEQ ID NO: 277242 - DNA, 25 bp, Mus musculus
ctggtttcagggcagcccctggaag

SEQ ID NO: 277243 - DNA, 25 bp, Mus musculus
ctggtttccactgagtccttagcca

SEQ ID NO: 277244 - DNA, 25 bp, Mus musculus
ctggtttccactgcacctcctggcc

SEQ ID NO: 277245 - DNA, 25 bp, Mus musculus
ctggtttcccattgaaggtttcagg

SEQ ID NO: 277246 - DNA, 25 bp, Mus musculus
ctggtttcccattgagtacccagac

SEQ ID NO: 277247 - DNA, 25 bp, Mus musculus
ctggtttcccgggtatgcatggacc

SEQ ID NO: 277248 - DNA, 25 bp, Mus musculus
ctggtttccctggatcaggacatgc

SEQ ID NO: 277249 - DNA, 25 bp, Mus musculus
ctggtttccgaggtctctgtgttgg

SEQ ID NO: 277250 - DNA, 25 bp, Mus musculus
ctggtttctctagatctcacactcc

SEQ ID NO: 277251 - DNA, 25 bp, Mus musculus
ctggtttctctaggtgtgagcatct

SEQ ID NO: 277252 - DNA, 25 bp, Mus musculus
ctggtttctcttgtccatctcagtc

SEQ ID NO: 277253 - DNA, 25 bp, Mus musculus
ctggtttctggtttgccagctccgg

SEQ ID NO: 277254 - DNA, 25 bp, Mus musculus
ctggtttctggtttgtcaaagacat

SEQ ID NO: 277255 - DNA, 25 bp, Mus musculus
ctggtttgaagatcccaatacttct

SEQ ID NO: 277256 - DNA, 25 bp, Mus musculus
ctggtttgaaggtttggagtcgaga

SEQ ID NO: 277257 - DNA, 25 bp, Mus musculus
ctggtttgcctcctgaataaaaagt

SEQ ID NO: 277258 - DNA, 25 bp, Mus musculus
ctggtttgcgctccctccaacatgc

SEQ ID NO: 277259 - DNA, 25 bp, Mus musculus
ctggtttgggaagggctgtcatggg

SEQ ID NO: 277260 - DNA, 25 bp, Mus musculus
ctggtttgggtccgtgttcaccttg

SEQ ID NO: 277261 - DNA, 25 bp, Mus musculus
ctggtttgtgtggggttcactgatc

SEQ ID NO: 277262 - DNA, 25 bp, Mus musculus
ctggttttaggtccagcgagcacaa

SEQ ID NO: 277263 - DNA, 25 bp, Mus musculus
ctggttttcatgatcatccagtcct

SEQ ID NO: 277264 - DNA, 25 bp, Mus musculus
ctggttttgccctgcactcctgggc

SEQ ID NO: 277265 - DNA, 25 bp, Mus musculus
ctggttttgccctgggctacggcgt

SEQ ID NO: 277266 - DNA, 25 bp, Mus musculus
ctggttttggaggctgataagctgg

SEQ ID NO: 277267 - DNA, 25 bp, Mus musculus
ctgtaaaactactgagaaggtcctt

SEQ ID NO: 277268 - DNA, 25 bp, Mus musculus
ctgtaaaactactgtcctcggccca

SEQ ID NO: 277269 - DNA, 25 bp, Mus musculus
ctgtaaaactactgttttggtgaaa

SEQ ID NO: 277270 - DNA, 25 bp, Mus musculus
ctgtaaacagagactcacttctgct

SEQ ID NO: 277271 - DNA, 25 bp, Mus musculus
ctgtaaacagataggtaccctactc

SEQ ID NO: 277272 - DNA, 25 bp, Mus musculus
ctgtaaaccaggtcactcctgtccc

SEQ ID NO: 277273 - DNA, 25 bp, Mus musculus
ctgtaaagaagctggctgtgaacac

SEQ ID NO: 277274 - DNA, 25 bp, Mus musculus
ctgtaaagatcatgagacagaactt

SEQ ID NO: 277275 - DNA, 25 bp, Mus musculus
ctgtaaagtatgtgggctggaaaaa

SEQ ID NO: 277276 - DNA, 25 bp, Mus musculus
ctgtaaagtatgtggttctgctcat

SEQ ID NO: 277277 - DNA, 25 bp, Mus musculus
ctgtaaagttgacagtcccacagtc

SEQ ID NO: 277278 - DNA, 25 bp, Mus musculus
ctgtaaataggtttgagtacagtga

SEQ ID NO: 277279 - DNA, 25 bp, Mus musculus
ctgtaaatgaaggaatatgctcaga

SEQ ID NO: 277280 - DNA, 25 bp, Mus musculus
ctgtaaatggcttgctgaaagggca

SEQ ID NO: 277281 - DNA, 25 bp, Mus musculus
ctgtaacaacaggaggcccagcctc

SEQ ID NO: 277282 - DNA, 25 bp, Mus musculus
ctgtaacatcttctcacatcatggc

SEQ ID NO: 277283 - DNA, 25 bp, Mus musculus
ctgtaacattgccattatcctcaat

SEQ ID NO: 277284 - DNA, 25 bp, Mus musculus
ctgtaaccagaatggattgaatgca

SEQ ID NO: 277285 - DNA, 25 bp, Mus musculus
ctgtaaccgtgggactcgatctgcc

SEQ ID NO: 277286 - DNA, 25 bp, Mus musculus
ctgtaacgagcgcttgtacaggttg

SEQ ID NO: 277287 - DNA, 25 bp, Mus musculus
ctgtaactacagaggcctccaggtg

SEQ ID NO: 277288 - DNA, 25 bp, Mus musculus
ctgtaactacagttgtgcccctgtc

SEQ ID NO: 277289 - DNA, 25 bp, Mus musculus
ctgtaactccaggggcactatgaac

SEQ ID NO: 277290 - DNA, 25 bp, Mus musculus
ctgtaactgaggctttaacagaaaa

SEQ ID NO: 277291 - DNA, 25 bp, Mus musculus
ctgtaagaaggtcccaggtaaatca

SEQ ID NO: 277292 - DNA, 25 bp, Mus musculus
ctgtaagaaggtgattttaaaaatg

SEQ ID NO: 277293 - DNA, 25 bp, Mus musculus
ctgtaagagcttgtgccattcctgc

SEQ ID NO: 277294 - DNA, 25 bp, Mus musculus
ctgtaagagcttgtgttattggatt

SEQ ID NO: 277295 - DNA, 25 bp, Mus musculus
ctgtaagcagcctaggatgtcaggc

SEQ ID NO: 277296 - DNA, 25 bp, Mus musculus
ctgtaagcatggtcccctgtgtagg

SEQ ID NO: 277297 - DNA, 25 bp, Mus musculus
ctgtaaggacttaaatattttatgg

SEQ ID NO: 277298 - DNA, 25 bp, Mus musculus
ctgtaaggagacgttcatttgaatt

SEQ ID NO: 277299 - DNA, 25 bp, Mus musculus
ctgtaaggcccatcctttgtgagat

SEQ ID NO: 277300 - DNA, 25 bp, Mus musculus
ctgtaagtccctcttagagtttcaa

SEQ ID NO: 277301 - DNA, 25 bp, Mus musculus
ctgtaagtgattctgcaaaaaatac

SEQ ID NO: 277302 - DNA, 25 bp, Mus musculus
ctgtaataaggatgaggctgtggat

SEQ ID NO: 277303 - DNA, 25 bp, Mus musculus
ctgtaatcattgagaatgaaaagaa

SEQ ID NO: 277304 - DNA, 25 bp, Mus musculus
ctgtaatgaaggaaaatatctgcag

SEQ ID NO: 277305 - DNA, 25 bp, Mus musculus
ctgtaatggcagtttgagatggtat

SEQ ID NO: 277306 - DNA, 25 bp, Mus musculus
ctgtaattgtagctgatgaagagtt

SEQ ID NO: 277307 - DNA, 25 bp, Mus musculus
ctgtaattgtaggtgccgcaccagt

SEQ ID NO: 277308 - DNA, 25 bp, Mus musculus
ctgtacaaaggggcagccacagaac

SEQ ID NO: 277309 - DNA, 25 bp, Mus musculus
ctgtacaagattgggcagcccagac

SEQ ID NO: 277310 - DNA, 25 bp, Mus musculus
ctgtacaagattggtcaactcagat

SEQ ID NO: 277311 - DNA, 25 bp, Mus musculus
ctgtacaagggccagatgctgcata

SEQ ID NO: 277312 - DNA, 25 bp, Mus musculus
ctgtacaccaggtcctgataagccc

SEQ ID NO: 277313 - DNA, 25 bp, Mus musculus
ctgtacactgacgaggatagtgcca

SEQ ID NO: 277314 - DNA, 25 bp, Mus musculus
ctgtacactgacgtccagaaacgct

SEQ ID NO: 277315 - DNA, 25 bp, Mus musculus
ctgtacagaacagctaggactcaga

SEQ ID NO: 277316 - DNA, 25 bp, Mus musculus
ctgtacagaacaggcaaagacaaga

SEQ ID NO: 277317 - DNA, 25 bp, Mus musculus
ctgtacagaattggacaaaatcccc

SEQ ID NO: 277318 - DNA, 25 bp, Mus musculus
ctgtacagagacaggttgcttttaa

SEQ ID NO: 277319 - DNA, 25 bp, Mus musculus
ctgtacagagatggcccacacggat

SEQ ID NO: 277320 - DNA, 25 bp, Mus musculus
ctgtacagggatggctaccagagac

SEQ ID NO: 277321 - DNA, 25 bp, Mus musculus
ctgtacaggtggggtttaggtcaca

SEQ ID NO: 277322 - DNA, 25 bp, Mus musculus
ctgtacagtgcaaaggtaatgctga

SEQ ID NO: 277323 - DNA, 25 bp, Mus musculus
ctgtacagttccagaggcagcagtg

SEQ ID NO: 277324 - DNA, 25 bp, Mus musculus
ctgtacagttccagattcagcactt

SEQ ID NO: 277325 - DNA, 25 bp, Mus musculus
ctgtacatgggatgctagccaacga

SEQ ID NO: 277326 - DNA, 25 bp, Mus musculus
ctgtaccaaggcagctcaggctggc

SEQ ID NO: 277327 - DNA, 25 bp, Mus musculus
ctgtaccaagtgcagctcagtccag

SEQ ID NO: 277328 - DNA, 25 bp, Mus musculus
ctgtaccaccttcccaggaccagtc

SEQ ID NO: 277329 - DNA, 25 bp, Mus musculus
ctgtaccactaaacgattggtgacc

SEQ ID NO: 277330 - DNA, 25 bp, Mus musculus
ctgtaccacttagatagttgaagta

SEQ ID NO: 277331 - DNA, 25 bp, Mus musculus
ctgtaccagggtgtacattggtgaa

SEQ ID NO: 277332 - DNA, 25 bp, Mus musculus
ctgtaccatatcaagtttagagacg

SEQ ID NO: 277333 - DNA, 25 bp, Mus musculus
ctgtaccattgcctatggcctgggc

SEQ ID NO: 277334 - DNA, 25 bp, Mus musculus
ctgtacccagatgaagttgcctgtg

SEQ ID NO: 277335 - DNA, 25 bp, Mus musculus
ctgtaccccagctatcatgaacata

SEQ ID NO: 277336 - DNA, 25 bp, Mus musculus
ctgtaccccgaaagagctcctgggc

SEQ ID NO: 277337 - DNA, 25 bp, Mus musculus
ctgtaccccgggagggacattgctt

SEQ ID NO: 277338 - DNA, 25 bp, Mus musculus
ctgtacccttgccaaaagcggggag

SEQ ID NO: 277339 - DNA, 25 bp, Mus musculus
ctgtacccttgccaaggttcccaga

SEQ ID NO: 277340 - DNA, 25 bp, Mus musculus
ctgtacccttgtggaccagcagaga

SEQ ID NO: 277341 - DNA, 25 bp, Mus musculus
ctgtaccgaggtctgatcccacagc

SEQ ID NO: 277342 - DNA, 25 bp, Mus musculus
ctgtacctagaaggaagagaaaaga

SEQ ID NO: 277343 - DNA, 25 bp, Mus musculus
ctgtacctatggagtaatggttcct

SEQ ID NO: 277344 - DNA, 25 bp, Mus musculus
ctgtacctatggatgtgctgggcca

SEQ ID NO: 277345 - DNA, 25 bp, Mus musculus
ctgtacctatggcagggccaccaaa

SEQ ID NO: 277346 - DNA, 25 bp, Mus musculus
ctgtacctccacgaggcgagcctgt

SEQ ID NO: 277347 - DNA, 25 bp, Mus musculus
ctgtacctcccacccttggactctc

SEQ ID NO: 277348 - DNA, 25 bp, Mus musculus
ctgtacctgcaactcaatcgtttac

SEQ ID NO: 277349 - DNA, 25 bp, Mus musculus
ctgtacctgcaagaagaaagtcctc

SEQ ID NO: 277350 - DNA, 25 bp, Mus musculus
ctgtaccttcattacgtgcgaccct

SEQ ID NO: 277351 - DNA, 25 bp, Mus musculus
ctgtaccttcattgaactccaagat

SEQ ID NO: 277352 - DNA, 25 bp, Mus musculus
ctgtaccttggacaaagtggggcag

SEQ ID NO: 277353 - DNA, 25 bp, Mus musculus
ctgtaccttggcaggagccaacaga

SEQ ID NO: 277354 - DNA, 25 bp, Mus musculus
ctgtacgacgatgacgtggcgcagt

SEQ ID NO: 277355 - DNA, 25 bp, Mus musculus
ctgtacgcagttttacagagagcac

SEQ ID NO: 277356 - DNA, 25 bp, Mus musculus
ctgtacggctgcgaggaagaagaaa

SEQ ID NO: 277357 - DNA, 25 bp, Mus musculus
ctgtacggctgcgaggaattcatca

SEQ ID NO: 277358 - DNA, 25 bp, Mus musculus
ctgtacggtgttcagggactgctga

SEQ ID NO: 277359 - DNA, 25 bp, Mus musculus
ctgtacggtgttcaggtcactgcaa

SEQ ID NO: 277360 - DNA, 25 bp, Mus musculus
ctgtacgtacacaggttttcctttg

SEQ ID NO: 277361 - DNA, 25 bp, Mus musculus
ctgtactacacagttcaacgggaag

SEQ ID NO: 277362 - DNA, 25 bp, Mus musculus
ctgtactagggaatattggcagctc

SEQ ID NO: 277363 - DNA, 25 bp, Mus musculus
ctgtactcaagactgcaggcgctaa

SEQ ID NO: 277364 - DNA, 25 bp, Mus musculus
ctgtactcaaggagaatctgggagc

SEQ ID NO: 277365 - DNA, 25 bp, Mus musculus
ctgtactcaagtcctggatcagtga

SEQ ID NO: 277366 - DNA, 25 bp, Mus musculus
ctgtactccacgtgatccgaggacc

SEQ ID NO: 277367 - DNA, 25 bp, Mus musculus
ctgtactctcaaactagatttcctc

SEQ ID NO: 277368 - DNA, 25 bp, Mus musculus
ctgtactctcgggaggtgttcctgc

SEQ ID NO: 277369 - DNA, 25 bp, Mus musculus
ctgtactctgaaactagactctaca

SEQ ID NO: 277370 - DNA, 25 bp, Mus musculus
ctgtactctgaaactctgccgagtg

SEQ ID NO: 277371 - DNA, 25 bp, Mus musculus
ctgtactgccaaggtcaaggctggt

SEQ ID NO: 277372 - DNA, 25 bp, Mus musculus
ctgtactgcgtggtgacatctccca

SEQ ID NO: 277373 - DNA, 25 bp, Mus musculus
ctgtactgtaagaggcttctcagga

SEQ ID NO: 277374 - DNA, 25 bp, Mus musculus
ctgtacttggagaggctccggctca

SEQ ID NO: 277375 - DNA, 25 bp, Mus musculus
ctgtactttgtgcaggtcccagcca

SEQ ID NO: 277376 - DNA, 25 bp, Mus musculus
ctgtactttgtgcagtggctcgtgg

SEQ ID NO: 277377 - DNA, 25 bp, Mus musculus
ctgtagaaaaagggcttttcctaga

SEQ ID NO: 277378 - DNA, 25 bp, Mus musculus
ctgtagaaaggaacatgtctcagga

SEQ ID NO: 277379 - DNA, 25 bp, Mus musculus
ctgtagaaggcagaggtggcacggc

SEQ ID NO: 277380 - DNA, 25 bp, Mus musculus
ctgtagaagttgtcctagaatcgaa

SEQ ID NO: 277381 - DNA, 25 bp, Mus musculus
ctgtagacaccacgggtgctggtga

SEQ ID NO: 277382 - DNA, 25 bp, Mus musculus
ctgtagacctggccttccctccggg

SEQ ID NO: 277383 - DNA, 25 bp, Mus musculus
ctgtagacgctcttttcagacccaa

SEQ ID NO: 277384 - DNA, 25 bp, Mus musculus
ctgtagagaacctccatgtactcag

SEQ ID NO: 277385 - DNA, 25 bp, Mus musculus
ctgtagagccaaacatccagaaccc

SEQ ID NO: 277386 - DNA, 25 bp, Mus musculus
ctgtagagccaggaagtgactgtgg

SEQ ID NO: 277387 - DNA, 25 bp, Mus musculus
ctgtagattctggtggctttgatga

SEQ ID NO: 277388 - DNA, 25 bp, Mus musculus
ctgtagattctggtggtggacttct

SEQ ID NO: 277389 - DNA, 25 bp, Mus musculus
ctgtagcaacagaggaacatgtgta

SEQ ID NO: 277390 - DNA, 25 bp, Mus musculus
ctgtagcaaggacaaatctgttgcc

SEQ ID NO: 277391 - DNA, 25 bp, Mus musculus
ctgtagcacccagttcttgcaggtg

SEQ ID NO: 277392 - DNA, 25 bp, Mus musculus
ctgtagcaccccaggtgttgactgt

SEQ ID NO: 277393 - DNA, 25 bp, Mus musculus
ctgtagcaccccagttcttgcaggt

SEQ ID NO: 277394 - DNA, 25 bp, Mus musculus
ctgtagcacccctctactcaatagt

SEQ ID NO: 277395 - DNA, 25 bp, Mus musculus
ctgtagcagtgcaccacatatctac

SEQ ID NO: 277396 - DNA, 25 bp, Mus musculus
ctgtagccaaagagactgcttctaa

SEQ ID NO: 277397 - DNA, 25 bp, Mus musculus
ctgtagccaagaccacatccttcac

SEQ ID NO: 277398 - DNA, 25 bp, Mus musculus
ctgtagccaaggtcagattacctgc

SEQ ID NO: 277399 - DNA, 25 bp, Mus musculus
ctgtagcccggacatcaccttgaag

SEQ ID NO: 277400 - DNA, 25 bp, Mus musculus
ctgtagccctagatcctttacaagc

SEQ ID NO: 277401 - DNA, 25 bp, Mus musculus
ctgtagcctggaaggagctttggtt

SEQ ID NO: 277402 - DNA, 25 bp, Mus musculus
ctgtagcctggaagggcatactttg

SEQ ID NO: 277403 - DNA, 25 bp, Mus musculus
ctgtagcgatgaagaaagaggaacc

SEQ ID NO: 277404 - DNA, 25 bp, Mus musculus
ctgtagctggaagagtatctgtggg

SEQ ID NO: 277405 - DNA, 25 bp, Mus musculus
ctgtaggaacccagcccaacctacc

SEQ ID NO: 277406 - DNA, 25 bp, Mus musculus
ctgtaggaactgcaggacagtaatg

SEQ ID NO: 277407 - DNA, 25 bp, Mus musculus
ctgtaggactttgagctgaggctgc

SEQ ID NO: 277408 - DNA, 25 bp, Mus musculus
ctgtagggctgcctctctggatggg

SEQ ID NO: 277409 - DNA, 25 bp, Mus musculus
ctgtagggctgttgccaaggcacct

SEQ ID NO: 277410 - DNA, 25 bp, Mus musculus
ctgtaggtccgccggtttcaacctc

SEQ ID NO: 277411 - DNA, 25 bp, Mus musculus
ctgtagtctggggggtcagcagcct

SEQ ID NO: 277412 - DNA, 25 bp, Mus musculus
ctgtagtgatgctgcatgccatgaa

SEQ ID NO: 277413 - DNA, 25 bp, Mus musculus
ctgtagtgcatgagtttccagatcc

SEQ ID NO: 277414 - DNA, 25 bp, Mus musculus
ctgtagtggaagaagaatgactgtc

SEQ ID NO: 277415 - DNA, 25 bp, Mus musculus
ctgtagtggaagagaaatcactgtc

SEQ ID NO: 277416 - DNA, 25 bp, Mus musculus
ctgtagttctgtgcatctgggtggt

SEQ ID NO: 277417 - DNA, 25 bp, Mus musculus
ctgtataatgaaagcccagttcgga

SEQ ID NO: 277418 - DNA, 25 bp, Mus musculus
ctgtatacaggccgcttggacatcg

SEQ ID NO: 277419 - DNA, 25 bp, Mus musculus
ctgtataccagcacctgaggagagg

SEQ ID NO: 277420 - DNA, 25 bp, Mus musculus
ctgtatagaagtgggaagatgcccg

SEQ ID NO: 277421 - DNA, 25 bp, Mus musculus
ctgtatatcatgcatccatttttgt

SEQ ID NO: 277422 - DNA, 25 bp, Mus musculus
ctgtatattcagggtcacagcttcc

SEQ ID NO: 277423 - DNA, 25 bp, Mus musculus
ctgtatcaagcaatgtgacccagaa

SEQ ID NO: 277424 - DNA, 25 bp, Mus musculus
ctgtatcacagctgcctcatataca

SEQ ID NO: 277425 - DNA, 25 bp, Mus musculus
ctgtatcacttgatattaaactaac

SEQ ID NO: 277426 - DNA, 25 bp, Mus musculus
ctgtatcacttgggtgagaatgcct

SEQ ID NO: 277427 - DNA, 25 bp, Mus musculus
ctgtatcagctgcgaatccctcgtg

SEQ ID NO: 277428 - DNA, 25 bp, Mus musculus
ctgtatcagggtgcgcaggcttgtg

SEQ ID NO: 277429 - DNA, 25 bp, Mus musculus
ctgtatccacgagaggcacgccacc

SEQ ID NO: 277430 - DNA, 25 bp, Mus musculus
ctgtatccagcgagacggtcatctg

SEQ ID NO: 277431 - DNA, 25 bp, Mus musculus
ctgtatccataggagttttaaagcc

SEQ ID NO: 277432 - DNA, 25 bp, Mus musculus
ctgtatccataggatttacatggat

SEQ ID NO: 277433 - DNA, 25 bp, Mus musculus
ctgtatccctgttgctgagctggtg

SEQ ID NO: 277434 - DNA, 25 bp, Mus musculus
ctgtatcctcagttcatgttccatc

SEQ ID NO: 277435 - DNA, 25 bp, Mus musculus
ctgtatcctgagagacaggcaatac

SEQ ID NO: 277436 - DNA, 25 bp, Mus musculus
ctgtatctctctctgtggaggtgaa

SEQ ID NO: 277437 - DNA, 25 bp, Mus musculus
ctgtatctctttcaggtagagcttg

SEQ ID NO: 277438 - DNA, 25 bp, Mus musculus
ctgtatctctttcagtatcctgtgc

SEQ ID NO: 277439 - DNA, 25 bp, Mus musculus
ctgtatctggtgctctaccttagca

SEQ ID NO: 277440 - DNA, 25 bp, Mus musculus
ctgtatctggtgctctaccttcagg

SEQ ID NO: 277441 - DNA, 25 bp, Mus musculus
ctgtatgaccagaattatcccatcc

SEQ ID NO: 277442 - DNA, 25 bp, Mus musculus
ctgtatgagaagctgaagcagtcgc

SEQ ID NO: 277443 - DNA, 25 bp, Mus musculus
ctgtatgagtggcctcgaactcaga

SEQ ID NO: 277444 - DNA, 25 bp, Mus musculus
ctgtatgatccacaggccctttgga

SEQ ID NO: 277445 - DNA, 25 bp, Mus musculus
ctgtatgcactcctcccagcagtta

SEQ ID NO: 277446 - DNA, 25 bp, Mus musculus
ctgtatgcactcctggatatccggc

SEQ ID NO: 277447 - DNA, 25 bp, Mus musculus
ctgtatgcagaaatttacacagagt

SEQ ID NO: 277448 - DNA, 25 bp, Mus musculus
ctgtatgcagcatctgtctgagcat

SEQ ID NO: 277449 - DNA, 25 bp, Mus musculus
ctgtatgccccgagcacagatatgg

SEQ ID NO: 277450 - DNA, 25 bp, Mus musculus
ctgtatgcccggagcacagatatgg

SEQ ID NO: 277451 - DNA, 25 bp, Mus musculus
ctgtatgctacaaaggaaagaattg

SEQ ID NO: 277452 - DNA, 25 bp, Mus musculus
ctgtatggaaagatggcctctgcac

SEQ ID NO: 277453 - DNA, 25 bp, Mus musculus
ctgtatggcacgaatgaggaagagt

SEQ ID NO: 277454 - DNA, 25 bp, Mus musculus
ctgtatggcgatgagaatgaagttg

SEQ ID NO: 277455 - DNA, 25 bp, Mus musculus
ctgtatggcggcccgtgggacgtgc

SEQ ID NO: 277456 - DNA, 25 bp, Mus musculus
ctgtatgggggcaggtggctttgtg

SEQ ID NO: 277457 - DNA, 25 bp, Mus musculus
ctgtatgtatacgacaccacggcga

SEQ ID NO: 277458 - DNA, 25 bp, Mus musculus
ctgtatgtatacgatccccccacaa

SEQ ID NO: 277459 - DNA, 25 bp, Mus musculus
ctgtatgtatacgcaccaccaccac

SEQ ID NO: 277460 - DNA, 25 bp, Mus musculus
ctgtatgtgttgaggaggagagaac

SEQ ID NO: 277461 - DNA, 25 bp, Mus musculus
ctgtattacagcagcaatattcaca

SEQ ID NO: 277462 - DNA, 25 bp, Mus musculus
ctgtattagaaaaggaaactgcatt

SEQ ID NO: 277463 - DNA, 25 bp, Mus musculus
ctgtattagaaaagtctctccagag

SEQ ID NO: 277464 - DNA, 25 bp, Mus musculus
ctgtattatcgttatgagtattgga

SEQ ID NO: 277465 - DNA, 25 bp, Mus musculus
ctgtattcacgtagggtgatatggg

SEQ ID NO: 277466 - DNA, 25 bp, Mus musculus
ctgtattccagaatgcccatatcac

SEQ ID NO: 277467 - DNA, 25 bp, Mus musculus
ctgtattctcagttcctgtagttgc

SEQ ID NO: 277468 - DNA, 25 bp, Mus musculus
ctgtattgagaaacctgaaaaatga

SEQ ID NO: 277469 - DNA, 25 bp, Mus musculus
ctgtatttaagaatgcaccaaacaa

SEQ ID NO: 277470 - DNA, 25 bp, Mus musculus
ctgtatttaaggcccatctccgagt

SEQ ID NO: 277471 - DNA, 25 bp, Mus musculus
ctgtatttaaggttcttggacttgc

SEQ ID NO: 277472 - DNA, 25 bp, Mus musculus
ctgtattttctcaggtgtgcatgta

SEQ ID NO: 277473 - DNA, 25 bp, Mus musculus
ctgtcaaaacttggctcttgaccgc

SEQ ID NO: 277474 - DNA, 25 bp, Mus musculus
ctgtcaaaccagggttctctaaatg

SEQ ID NO: 277475 - DNA, 25 bp, Mus musculus
ctgtcaaaccaggttaaggagctcc

SEQ ID NO: 277476 - DNA, 25 bp, Mus musculus
ctgtcaaactacagagtgaatgcca

SEQ ID NO: 277477 - DNA, 25 bp, Mus musculus
ctgtcaaacttcagagtgaatgcca

SEQ ID NO: 277478 - DNA, 25 bp, Mus musculus
ctgtcaacaaggtctaggaaacctt

SEQ ID NO: 277479 - DNA, 25 bp, Mus musculus
ctgtcaaccctgaagatattgtgaa

SEQ ID NO: 277480 - DNA, 25 bp, Mus musculus
ctgtcaactgacaggccataaaatc

SEQ ID NO: 277481 - DNA, 25 bp, Mus musculus
ctgtcaagaacaaggcccagtctgt

SEQ ID NO: 277482 - DNA, 25 bp, Mus musculus
ctgtcaagattgagattcccctctt

SEQ ID NO: 277483 - DNA, 25 bp, Mus musculus
ctgtcaagcacggggcgggggcaga

SEQ ID NO: 277484 - DNA, 25 bp, Mus musculus
ctgtcaagcagatgagacaaggagc

SEQ ID NO: 277485 - DNA, 25 bp, Mus musculus
ctgtcaagccaaacatccagaaccc

SEQ ID NO: 277486 - DNA, 25 bp, Mus musculus
ctgtcaagctgagactgttggtgaa

SEQ ID NO: 277487 - DNA, 25 bp, Mus musculus
ctgtcaaggcggcccagaccagtga

SEQ ID NO: 277488 - DNA, 25 bp, Mus musculus
ctgtcaaggttcaggtcttatatcc

SEQ ID NO: 277489 - DNA, 25 bp, Mus musculus
ctgtcaagtcgatgagcagtttgca

SEQ ID NO: 277490 - DNA, 25 bp, Mus musculus
ctgtcaatactacatttatgatctg

SEQ ID NO: 277491 - DNA, 25 bp, Mus musculus
ctgtcaatatgagaagaacaaacac

SEQ ID NO: 277492 - DNA, 25 bp, Mus musculus
ctgtcaatatgatataaatgaatgt

SEQ ID NO: 277493 - DNA, 25 bp, Mus musculus
ctgtcaatcataaggatgagaacaa

SEQ ID NO: 277494 - DNA, 25 bp, Mus musculus
ctgtcaatcataagggcgagatgtg

SEQ ID NO: 277495 - DNA, 25 bp, Mus musculus
ctgtcaatgcagcccagatggagct

SEQ ID NO: 277496 - DNA, 25 bp, Mus musculus
ctgtcaatgcagcttgttttagccc

SEQ ID NO: 277497 - DNA, 25 bp, Mus musculus
ctgtcaatgcaggcgacctggcatt

SEQ ID NO: 277498 - DNA, 25 bp, Mus musculus
ctgtcacaaagatcatagcccaggt

SEQ ID NO: 277499 - DNA, 25 bp, Mus musculus
ctgtcacaacagctcgcaatgccct

SEQ ID NO: 277500 - DNA, 25 bp, Mus musculus
ctgtcacaaggcagccatggaattt

SEQ ID NO: 277501 - DNA, 25 bp, Mus musculus
ctgtcacaaggcaggggcaagcgga

SEQ ID NO: 277502 - DNA, 25 bp, Mus musculus
ctgtcacactgaagctcgcactgga

SEQ ID NO: 277503 - DNA, 25 bp, Mus musculus
ctgtcacactgaaggccgttcctca

SEQ ID NO: 277504 - DNA, 25 bp, Mus musculus
ctgtcacagattgaaatggatgcag

SEQ ID NO: 277505 - DNA, 25 bp, Mus musculus
ctgtcacaggggcaggtggcagtgc

SEQ ID NO: 277506 - DNA, 25 bp, Mus musculus
ctgtcacatgggaccatctgggcca

SEQ ID NO: 277507 - DNA, 25 bp, Mus musculus
ctgtcaccaactcagctctctgctc

SEQ ID NO: 277508 - DNA, 25 bp, Mus musculus
ctgtcaccaaggaccccaactggta

SEQ ID NO: 277509 - DNA, 25 bp, Mus musculus
ctgtcaccaaggcccacgtttttgc

SEQ ID NO: 277510 - DNA, 25 bp, Mus musculus
ctgtcacccagactaagaaacttca

SEQ ID NO: 277511 - DNA, 25 bp, Mus musculus
ctgtcacccatatggcccacacgga

SEQ ID NO: 277512 - DNA, 25 bp, Mus musculus
ctgtcacccatggtccgacttttga

SEQ ID NO: 277513 - DNA, 25 bp, Mus musculus
ctgtcacccctgtatatcaacctga

SEQ ID NO: 277514 - DNA, 25 bp, Mus musculus
ctgtcaccctgtctggaaagaaatg

SEQ ID NO: 277515 - DNA, 25 bp, Mus musculus
ctgtcaccgactatttgcatcagta

SEQ ID NO: 277516 - DNA, 25 bp, Mus musculus
ctgtcaccgagaggcttcattaaca

SEQ ID NO: 277517 - DNA, 25 bp, Mus musculus
ctgtcaccgagtttgtctctgtcta

SEQ ID NO: 277518 - DNA, 25 bp, Mus musculus
ctgtcaccgatgtggataagtcctg

SEQ ID NO: 277519 - DNA, 25 bp, Mus musculus
ctgtcacctacatggataagaatgg

SEQ ID NO: 277520 - DNA, 25 bp, Mus musculus
ctgtcacctcggaggtcccacccag

SEQ ID NO: 277521 - DNA, 25 bp, Mus musculus
ctgtcaccttccgagaactccgtgc

SEQ ID NO: 277522 - DNA, 25 bp, Mus musculus
ctgtcactcagaagaaacccagagg

SEQ ID NO: 277523 - DNA, 25 bp, Mus musculus
ctgtcactcaggtctgtggaggaag

SEQ ID NO: 277524 - DNA, 25 bp, Mus musculus
ctgtcactcctgctggttgcatgta

SEQ ID NO: 277525 - DNA, 25 bp, Mus musculus
ctgtcactgagaaggtgtccttggt

SEQ ID NO: 277526 - DNA, 25 bp, Mus musculus
ctgtcactgcagcgacggctccggg

SEQ ID NO: 277527 - DNA, 25 bp, Mus musculus
ctgtcactgcagcgctgctgtggct

SEQ ID NO: 277528 - DNA, 25 bp, Mus musculus
ctgtcactttgcagtgccctgctct

SEQ ID NO: 277529 - DNA, 25 bp, Mus musculus
ctgtcagaactcaaataattttgca

SEQ ID NO: 277530 - DNA, 25 bp, Mus musculus
ctgtcagaactcagcatcttatgga

SEQ ID NO: 277531 - DNA, 25 bp, Mus musculus
ctgtcagaactcagtcaggctgttc

SEQ ID NO: 277532 - DNA, 25 bp, Mus musculus
ctgtcagaagaaagagtgcagcagc

SEQ ID NO: 277533 - DNA, 25 bp, Mus musculus
ctgtcagaagccacattgaatttgc

SEQ ID NO: 277534 - DNA, 25 bp, Mus musculus
ctgtcagaatgatcatgcgtccaga

SEQ ID NO: 277535 - DNA, 25 bp, Mus musculus
ctgtcagagctctcgtgacagcctt

SEQ ID NO: 277536 - DNA, 25 bp, Mus musculus
ctgtcagaggaggatacgggaagcc

SEQ ID NO: 277537 - DNA, 25 bp, Mus musculus
ctgtcagaggtaaacagaaagaatt

SEQ ID NO: 277538 - DNA, 25 bp, Mus musculus
ctgtcagatcccagacttggagaga

SEQ ID NO: 277539 - DNA, 25 bp, Mus musculus
ctgtcagatcccaggaagccatgac

SEQ ID NO: 277540 - DNA, 25 bp, Mus musculus
ctgtcagatcccagtatatttgtgt

SEQ ID NO: 277541 - DNA, 25 bp, Mus musculus
ctgtcagcaaagttatttcgcttgg

SEQ ID NO: 277542 - DNA, 25 bp, Mus musculus
ctgtcagcaagaaagatgttattct

SEQ ID NO: 277543 - DNA, 25 bp, Mus musculus
ctgtcagcaagaaagctgcaggaat

SEQ ID NO: 277544 - DNA, 25 bp, Mus musculus
ctgtcagccaagaagaccaccaagt

SEQ ID NO: 277545 - DNA, 25 bp, Mus musculus
ctgtcagccaagaaggccagcaccc

SEQ ID NO: 277546 - DNA, 25 bp, Mus musculus
ctgtcagccggggcctcccccagca

SEQ ID NO: 277547 - DNA, 25 bp, Mus musculus
ctgtcagccggtaacctccgtgctt

SEQ ID NO: 277548 - DNA, 25 bp, Mus musculus
ctgtcaggaagaggagctttggctg

SEQ ID NO: 277549 - DNA, 25 bp, Mus musculus
ctgtcaggaagaggctgtcaacagg

SEQ ID NO: 277550 - DNA, 25 bp, Mus musculus
ctgtcaggaagagggagtcccagca

SEQ ID NO: 277551 - DNA, 25 bp, Mus musculus
ctgtcaggaagggactggaatacgc

SEQ ID NO: 277552 - DNA, 25 bp, Mus musculus
ctgtcaggaattccttaactccatt

SEQ ID NO: 277553 - DNA, 25 bp, Mus musculus
ctgtcaggagaacagccagtcctac

SEQ ID NO: 277554 - DNA, 25 bp, Mus musculus
ctgtcaggagaagagtctgttcaag

SEQ ID NO: 277555 - DNA, 25 bp, Mus musculus
ctgtcaggagaagtggctggtgagg

SEQ ID NO: 277556 - DNA, 25 bp, Mus musculus
ctgtcaggagatcttcctgtggctt

SEQ ID NO: 277557 - DNA, 25 bp, Mus musculus
ctgtcaggcagaatgggcttatgtc

SEQ ID NO: 277558 - DNA, 25 bp, Mus musculus
ctgtcaggtgctgatttcaacgttg

SEQ ID NO: 277559 - DNA, 25 bp, Mus musculus
ctgtcagtcctatggcagtaccagt

SEQ ID NO: 277560 - DNA, 25 bp, Mus musculus
ctgtcatagcaaccaccgctcttga

SEQ ID NO: 277561 - DNA, 25 bp, Mus musculus
ctgtcatagcactggaccacgggtt

SEQ ID NO: 277562 - DNA, 25 bp, Mus musculus
ctgtcatcacaccggtgttttggcc

SEQ ID NO: 277563 - DNA, 25 bp, Mus musculus
ctgtcatcacagacaccctctctcc

SEQ ID NO: 277564 - DNA, 25 bp, Mus musculus
ctgtcatcacagattctttaagatt

SEQ ID NO: 277565 - DNA, 25 bp, Mus musculus
ctgtcatcagatgacctcatcccac

SEQ ID NO: 277566 - DNA, 25 bp, Mus musculus
ctgtcatcagattgatcttttcaag

SEQ ID NO: 277567 - DNA, 25 bp, Mus musculus
ctgtcatcatgaatgtgaaagagtt

SEQ ID NO: 277568 - DNA, 25 bp, Mus musculus
ctgtcatccagaatgccttattgtt

SEQ ID NO: 277569 - DNA, 25 bp, Mus musculus
ctgtcatccaggaccccatgcctgc

SEQ ID NO: 277570 - DNA, 25 bp, Mus musculus
ctgtcatccagggcttcctactatg

SEQ ID NO: 277571 - DNA, 25 bp, Mus musculus
ctgtcatccggaagctggcaaaaac

SEQ ID NO: 277572 - DNA, 25 bp, Mus musculus
ctgtcatcctcgaagccaagctgga

SEQ ID NO: 277573 - DNA, 25 bp, Mus musculus
ctgtcatcctcgtgcctggctgctt

SEQ ID NO: 277574 - DNA, 25 bp, Mus musculus
ctgtcatcctggacatggcccgtgt

SEQ ID NO: 277575 - DNA, 25 bp, Mus musculus
ctgtcatccttgtctcattgggaga

SEQ ID NO: 277576 - DNA, 25 bp, Mus musculus
ctgtcatcgaaggagctgtgcggtc

SEQ ID NO: 277577 - DNA, 25 bp, Mus musculus
ctgtcatcgccacctgcggccccga

SEQ ID NO: 277578 - DNA, 25 bp, Mus musculus
ctgtcatgaggaactcagaaatccg

SEQ ID NO: 277579 - DNA, 25 bp, Mus musculus
ctgtcatgaggaactcagccacctt

SEQ ID NO: 277580 - DNA, 25 bp, Mus musculus
ctgtcatgatcacaggacacctata

SEQ ID NO: 277581 - DNA, 25 bp, Mus musculus
ctgtcatgatcacaggtgacaatct

SEQ ID NO: 277582 - DNA, 25 bp, Mus musculus
ctgtcatggaaagttacttcaatga

SEQ ID NO: 277583 - DNA, 25 bp, Mus musculus
ctgtcatggaggtttatcaccagat

SEQ ID NO: 277584 - DNA, 25 bp, Mus musculus
ctgtcatgggtcctctacagcctgc

SEQ ID NO: 277585 - DNA, 25 bp, Mus musculus
ctgtcatgttcttcttcagaaacaa

SEQ ID NO: 277586 - DNA, 25 bp, Mus musculus
ctgtcattaatccaggatccacagg

SEQ ID NO: 277587 - DNA, 25 bp, Mus musculus
ctgtcattagaccatttccaggact

SEQ ID NO: 277588 - DNA, 25 bp, Mus musculus
ctgtcattcacgagcaccctgaaac

SEQ ID NO: 277589 - DNA, 25 bp, Mus musculus
ctgtcattcacggtgaaggcagctt

SEQ ID NO: 277590 - DNA, 25 bp, Mus musculus
ctgtcattcactgtataagcatgat

SEQ ID NO: 277591 - DNA, 25 bp, Mus musculus
ctgtcattgagaagtgccccaagcc

SEQ ID NO: 277592 - DNA, 25 bp, Mus musculus
ctgtcattgagaagtgcctgtgaca

SEQ ID NO: 277593 - DNA, 25 bp, Mus musculus
ctgtccaaagatctcaccacatctc

SEQ ID NO: 277594 - DNA, 25 bp, Mus musculus
ctgtccaaaggaccatgaccttggg

SEQ ID NO: 277595 - DNA, 25 bp, Mus musculus
ctgtccaaaggaggagaccttggtc

SEQ ID NO: 277596 - DNA, 25 bp, Mus musculus
ctgtccaaaggcctcaatctaaaca

SEQ ID NO: 277597 - DNA, 25 bp, Mus musculus
ctgtccaagttggggctcgctgtgg

SEQ ID NO: 277598 - DNA, 25 bp, Mus musculus
ctgtccacaaccagaaaagccagct

SEQ ID NO: 277599 - DNA, 25 bp, Mus musculus
ctgtccacaaccagccctcagcggc

SEQ ID NO: 277600 - DNA, 25 bp, Mus musculus
ctgtccacaaccaggctcccaccac

SEQ ID NO: 277601 - DNA, 25 bp, Mus musculus
ctgtccacacaagctttgaaccact

SEQ ID NO: 277602 - DNA, 25 bp, Mus musculus
ctgtccacacaaggtttcacgactt

SEQ ID NO: 277603 - DNA, 25 bp, Mus musculus
ctgtccacacaggtttatgaagctg

SEQ ID NO: 277604 - DNA, 25 bp, Mus musculus
ctgtccacactacaggctccttcct

SEQ ID NO: 277605 - DNA, 25 bp, Mus musculus
ctgtccacactacaggtctgtaact

SEQ ID NO: 277606 - DNA, 25 bp, Mus musculus
ctgtccacaggtccacggtgtggtg

SEQ ID NO: 277607 - DNA, 25 bp, Mus musculus
ctgtccacatgcccctgtgatgcca

SEQ ID NO: 277608 - DNA, 25 bp, Mus musculus
ctgtccacatgcgtttgatatcgtt

SEQ ID NO: 277609 - DNA, 25 bp, Mus musculus
ctgtccacgcggttctatggtacag

SEQ ID NO: 277610 - DNA, 25 bp, Mus musculus
ctgtccacgcgtgcagtctgcatca

SEQ ID NO: 277611 - DNA, 25 bp, Mus musculus
ctgtccactgtgccactcctgcctg

SEQ ID NO: 277612 - DNA, 25 bp, Mus musculus
ctgtccactgtgccagcaccagacc

SEQ ID NO: 277613 - DNA, 25 bp, Mus musculus
ctgtccagaaagcgaccataacctg

SEQ ID NO: 277614 - DNA, 25 bp, Mus musculus
ctgtccagaaggacaaggtggaacc

SEQ ID NO: 277615 - DNA, 25 bp, Mus musculus
ctgtccagatcacggaccaggaggg

SEQ ID NO: 277616 - DNA, 25 bp, Mus musculus
ctgtccagcaggccacgattgctgc

SEQ ID NO: 277617 - DNA, 25 bp, Mus musculus
ctgtccagcgctgagcttcacctgg

SEQ ID NO: 277618 - DNA, 25 bp, Mus musculus
ctgtccagtaagcagataaggatga

SEQ ID NO: 277619 - DNA, 25 bp, Mus musculus
ctgtccatcaaagccctgtgcccac

SEQ ID NO: 277620 - DNA, 25 bp, Mus musculus
ctgtccatcaaagggtcgtcttctg

SEQ ID NO: 277621 - DNA, 25 bp, Mus musculus
ctgtccatgaccggaatccatgccc

SEQ ID NO: 277622 - DNA, 25 bp, Mus musculus
ctgtccattcatcaactggccttga

SEQ ID NO: 277623 - DNA, 25 bp, Mus musculus
ctgtccattcatcaggaagcaggtg

SEQ ID NO: 277624 - DNA, 25 bp, Mus musculus
ctgtccattgcaaaggctgggatca

SEQ ID NO: 277625 - DNA, 25 bp, Mus musculus
ctgtcccacaaggcatgctagtccc

SEQ ID NO: 277626 - DNA, 25 bp, Mus musculus
ctgtcccacattggcaagacattgc

SEQ ID NO: 277627 - DNA, 25 bp, Mus musculus
ctgtcccacctcagcaccaggaccc

SEQ ID NO: 277628 - DNA, 25 bp, Mus musculus
ctgtcccaccttgtgcgccccgcac

SEQ ID NO: 277629 - DNA, 25 bp, Mus musculus
ctgtcccattctctggtgccctgcc

SEQ ID NO: 277630 - DNA, 25 bp, Mus musculus
ctgtccccaaaacctgacgtccacg

SEQ ID NO: 277631 - DNA, 25 bp, Mus musculus
ctgtccccaagccagccccgcagcc

SEQ ID NO: 277632 - DNA, 25 bp, Mus musculus
ctgtccccaggaggccccactcacc

SEQ ID NO: 277633 - DNA, 25 bp, Mus musculus
ctgtccccaggcgtatgggcaagtc

SEQ ID NO: 277634 - DNA, 25 bp, Mus musculus
ctgtccccagggaacagactgcttt

SEQ ID NO: 277635 - DNA, 25 bp, Mus musculus
ctgtccccagggactgaaaggaggt

SEQ ID NO: 277636 - DNA, 25 bp, Mus musculus
ctgtccccagtgcatgggtacagag

SEQ ID NO: 277637 - DNA, 25 bp, Mus musculus
ctgtccccatatgagcataaatcaa

SEQ ID NO: 277638 - DNA, 25 bp, Mus musculus
ctgtccccatatgatgggaaataag

SEQ ID NO: 277639 - DNA, 25 bp, Mus musculus
ctgtcccccaaggaggtaagcctgg

SEQ ID NO: 277640 - DNA, 25 bp, Mus musculus
ctgtcccccaggtttcacggggctg

SEQ ID NO: 277641 - DNA, 25 bp, Mus musculus
ctgtccccgaggctgcttatgatcc

SEQ ID NO: 277642 - DNA, 25 bp, Mus musculus
ctgtcccctagaaggaagagtcact

SEQ ID NO: 277643 - DNA, 25 bp, Mus musculus
ctgtcccctcagttccccagtgaag

SEQ ID NO: 277644 - DNA, 25 bp, Mus musculus
ctgtcccctgcccggaattctgatc

SEQ ID NO: 277645 - DNA, 25 bp, Mus musculus
ctgtcccgaggacaagaagatgcca

SEQ ID NO: 277646 - DNA, 25 bp, Mus musculus
ctgtcccgagttgaggccggcgctg

SEQ ID NO: 277647 - DNA, 25 bp, Mus musculus
ctgtcccggatggagtgtcgagggg

SEQ ID NO: 277648 - DNA, 25 bp, Mus musculus
ctgtcccgtcatctcccccagatct

SEQ ID NO: 277649 - DNA, 25 bp, Mus musculus
ctgtccctcaagttgcctgcaggag

SEQ ID NO: 277650 - DNA, 25 bp, Mus musculus
ctgtccctcaatgcaaaaaggccag

SEQ ID NO: 277651 - DNA, 25 bp, Mus musculus
ctgtccctcaatggcacgctcctgt

SEQ ID NO: 277652 - DNA, 25 bp, Mus musculus
ctgtccctcaatttcgaggactcca

SEQ ID NO: 277653 - DNA, 25 bp, Mus musculus
ctgtccctcccctttctcccttgcc

SEQ ID NO: 277654 - DNA, 25 bp, Mus musculus
ctgtccctctatgccaaaaggccag

SEQ ID NO: 277655 - DNA, 25 bp, Mus musculus
ctgtccctgctggagaatgagagag

SEQ ID NO: 277656 - DNA, 25 bp, Mus musculus
ctgtccctgctggaggagctgatgc

SEQ ID NO: 277657 - DNA, 25 bp, Mus musculus
ctgtccctggagaaggatatgaatc

SEQ ID NO: 277658 - DNA, 25 bp, Mus musculus
ctgtccctggagaaggcgtgggtga

SEQ ID NO: 277659 - DNA, 25 bp, Mus musculus
ctgtccctggagaagtcaaacaggt

SEQ ID NO: 277660 - DNA, 25 bp, Mus musculus
ctgtccctggtccaggtgaaatcgc

SEQ ID NO: 277661 - DNA, 25 bp, Mus musculus
ctgtccgagagaagacacagctggt

SEQ ID NO: 277662 - DNA, 25 bp, Mus musculus
ctgtccgagagaagaccaccaaggc

SEQ ID NO: 277663 - DNA, 25 bp, Mus musculus
ctgtccgagagaaggtgggtgacat

SEQ ID NO: 277664 - DNA, 25 bp, Mus musculus
ctgtccgcactgtgagaaggagggg

SEQ ID NO: 277665 - DNA, 25 bp, Mus musculus
ctgtccgctcagggatggtctgtag

SEQ ID NO: 277666 - DNA, 25 bp, Mus musculus
ctgtccgctcagggcttctgacccc

SEQ ID NO: 277667 - DNA, 25 bp, Mus musculus
ctgtccgggcagccaaggagatcca

SEQ ID NO: 277668 - DNA, 25 bp, Mus musculus
ctgtccgggggcctcgcctgctcct

SEQ ID NO: 277669 - DNA, 25 bp, Mus musculus
ctgtccgtcaagtttggaaatgatg

SEQ ID NO: 277670 - DNA, 25 bp, Mus musculus
ctgtccgtgccagacctcgcagtaa

SEQ ID NO: 277671 - DNA, 25 bp, Mus musculus
ctgtccgtgccagtaaccctgacct

SEQ ID NO: 277672 - DNA, 25 bp, Mus musculus
ctgtcctaagaaaccatcaagaagc

SEQ ID NO: 277673 - DNA, 25 bp, Mus musculus
ctgtcctaagaaacgcaggctccag

SEQ ID NO: 277674 - DNA, 25 bp, Mus musculus
ctgtcctacaatgatgatgtgctga

SEQ ID NO: 277675 - DNA, 25 bp, Mus musculus
ctgtcctagggacaaagtatagaca

SEQ ID NO: 277676 - DNA, 25 bp, Mus musculus
ctgtcctaggggctcaaggaacctg

SEQ ID NO: 277677 - DNA, 25 bp, Mus musculus
ctgtcctatgcttcccatgatgaaa

SEQ ID NO: 277678 - DNA, 25 bp, Mus musculus
ctgtcctcaaatcggggaaaaactc

SEQ ID NO: 277679 - DNA, 25 bp, Mus musculus
ctgtcctcaagtgagccccaggcca

SEQ ID NO: 277680 - DNA, 25 bp, Mus musculus
ctgtcctcaccaagatcctccaatt

SEQ ID NO: 277681 - DNA, 25 bp, Mus musculus
ctgtcctcaccaaggtttctctgga

SEQ ID NO: 277682 - DNA, 25 bp, Mus musculus
ctgtcctcactatgcccgaccctcg

SEQ ID NO: 277683 - DNA, 25 bp, Mus musculus
ctgtcctcagaggtgtgctcctgca

SEQ ID NO: 277684 - DNA, 25 bp, Mus musculus
ctgtcctcagggaccgcagcagcca

SEQ ID NO: 277685 - DNA, 25 bp, Mus musculus
ctgtcctcagggccttcagggaccg

SEQ ID NO: 277686 - DNA, 25 bp, Mus musculus
ctgtcctcataccagaatctggtca

SEQ ID NO: 277687 - DNA, 25 bp, Mus musculus
ctgtcctcatagcagaatctggtca

SEQ ID NO: 277688 - DNA, 25 bp, Mus musculus
ctgtcctccccgttctgatacccga

SEQ ID NO: 277689 - DNA, 25 bp, Mus musculus
ctgtcctcccgggtaaatagctgtg

SEQ ID NO: 277690 - DNA, 25 bp, Mus musculus
ctgtcctcctgctgatgctttcatt

SEQ ID NO: 277691 - DNA, 25 bp, Mus musculus
ctgtcctcggaaaccatcgagcgtt

SEQ ID NO: 277692 - DNA, 25 bp, Mus musculus
ctgtcctcgtaggaatcagagaagc

SEQ ID NO: 277693 - DNA, 25 bp, Mus musculus
ctgtcctctcaaggctcaaactcag

SEQ ID NO: 277694 - DNA, 25 bp, Mus musculus
ctgtcctctgcctgctccggctcct

SEQ ID NO: 277695 - DNA, 25 bp, Mus musculus
ctgtcctgaaagccagagacccgcc

SEQ ID NO: 277696 - DNA, 25 bp, Mus musculus
ctgtcctgaaagtaggcttctttgg

SEQ ID NO: 277697 - DNA, 25 bp, Mus musculus
ctgtcctgaaagtctcagaggagca

SEQ ID NO: 277698 - DNA, 25 bp, Mus musculus
ctgtcctgactatatgatggggctg

SEQ ID NO: 277699 - DNA, 25 bp, Mus musculus
ctgtcctgaggagtgtgcagccaca

SEQ ID NO: 277700 - DNA, 25 bp, Mus musculus
ctgtcctgaggattcggcccttttg

SEQ ID NO: 277701 - DNA, 25 bp, Mus musculus
ctgtcctgaggttgctacaggcact

SEQ ID NO: 277702 - DNA, 25 bp, Mus musculus
ctgtcctgatgaggtttatcagctt

SEQ ID NO: 277703 - DNA, 25 bp, Mus musculus
ctgtcctgcacaaggttctgaacca

SEQ ID NO: 277704 - DNA, 25 bp, Mus musculus
ctgtcctggaactgtgttacatcct

SEQ ID NO: 277705 - DNA, 25 bp, Mus musculus
ctgtcctggaggagagggaagaatt

SEQ ID NO: 277706 - DNA, 25 bp, Mus musculus
ctgtcctgggttcaggcatcagaaa

SEQ ID NO: 277707 - DNA, 25 bp, Mus musculus
ctgtcctgggttcaggtgtttccag

SEQ ID NO: 277708 - DNA, 25 bp, Mus musculus
ctgtcctgtggagagcctccaacgt

SEQ ID NO: 277709 - DNA, 25 bp, Mus musculus
ctgtcctgtggaggtgtaaagaaac

SEQ ID NO: 277710 - DNA, 25 bp, Mus musculus
ctgtccttaatgaacctcccactga

SEQ ID NO: 277711 - DNA, 25 bp, Mus musculus
ctgtccttacagggaatttaatgaa

SEQ ID NO: 277712 - DNA, 25 bp, Mus musculus
ctgtccttcaggaaggtggtcagcg

SEQ ID NO: 277713 - DNA, 25 bp, Mus musculus
ctgtccttcctgccccttccatcaa

SEQ ID NO: 277714 - DNA, 25 bp, Mus musculus
ctgtccttcgggacctgctagaagt

SEQ ID NO: 277715 - DNA, 25 bp, Mus musculus
ctgtccttcgggtactatgggttgt

SEQ ID NO: 277716 - DNA, 25 bp, Mus musculus
ctgtccttgaagagcccacctgaat

SEQ ID NO: 277717 - DNA, 25 bp, Mus musculus
ctgtcgaacccctggaattgtggag

SEQ ID NO: 277718 - DNA, 25 bp, Mus musculus
ctgtcgacccgacaaaacttacctg

SEQ ID NO: 277719 - DNA, 25 bp, Mus musculus
ctgtcgacccggaggaggaggagga

SEQ ID NO: 277720 - DNA, 25 bp, Mus musculus
ctgtcgactttggaggtctcccagt

SEQ ID NO: 277721 - DNA, 25 bp, Mus musculus
ctgtcgagagaagggtttctcatct

SEQ ID NO: 277722 - DNA, 25 bp, Mus musculus
ctgtcgcagacggttcccagcagtg

SEQ ID NO: 277723 - DNA, 25 bp, Mus musculus
ctgtcgcaggctgttgattcagaaa

SEQ ID NO: 277724 - DNA, 25 bp, Mus musculus
ctgtcgcagggagcttatgggggcc

SEQ ID NO: 277725 - DNA, 25 bp, Mus musculus
ctgtcgcatccatgtcattgaccac

SEQ ID NO: 277726 - DNA, 25 bp, Mus musculus
ctgtcgccattggatcatctgtccc

SEQ ID NO: 277727 - DNA, 25 bp, Mus musculus
ctgtcgcctgtagttgcagccccac

SEQ ID NO: 277728 - DNA, 25 bp, Mus musculus
ctgtcgcctgtctgccacaacttct

SEQ ID NO: 277729 - DNA, 25 bp, Mus musculus
ctgtcgctgtggctacgtgttctgt

SEQ ID NO: 277730 - DNA, 25 bp, Mus musculus
ctgtcggaagcaaggtctggtccat

SEQ ID NO: 277731 - DNA, 25 bp, Mus musculus
ctgtcggataaccagtggcatcctt

SEQ ID NO: 277732 - DNA, 25 bp, Mus musculus
ctgtcggcatggcagcccacccaaa

SEQ ID NO: 277733 - DNA, 25 bp, Mus musculus
ctgtcggctgagaggcaggctgcaa

SEQ ID NO: 277734 - DNA, 25 bp, Mus musculus
ctgtcggctgagaggcaggctgtca

SEQ ID NO: 277735 - DNA, 25 bp, Mus musculus
ctgtcgggaccgtgaagtggatggg

SEQ ID NO: 277736 - DNA, 25 bp, Mus musculus
ctgtcgggagatgagaatcagctgt

SEQ ID NO: 277737 - DNA, 25 bp, Mus musculus
ctgtcgggagatgagcattcgcagc

SEQ ID NO: 277738 - DNA, 25 bp, Mus musculus
ctgtcgggagatggatccttaaatt

SEQ ID NO: 277739 - DNA, 25 bp, Mus musculus
ctgtcggtgagatgggtgcaaggat

SEQ ID NO: 277740 - DNA, 25 bp, Mus musculus
ctgtcgtacacaaatgaagagagac

SEQ ID NO: 277741 - DNA, 25 bp, Mus musculus
ctgtcgtagagacactctgcacaaa

SEQ ID NO: 277742 - DNA, 25 bp, Mus musculus
ctgtcgtatagagtctgaaggaagg

SEQ ID NO: 277743 - DNA, 25 bp, Mus musculus
ctgtcgtcgccgagaagacctcctt

SEQ ID NO: 277744 - DNA, 25 bp, Mus musculus
ctgtcgtctgcctctgtccagttgt

SEQ ID NO: 277745 - DNA, 25 bp, Mus musculus
ctgtcgtgagaagcatggtgaagaa

SEQ ID NO: 277746 - DNA, 25 bp, Mus musculus
ctgtcgtgagaaggtatagcagtgt

SEQ ID NO: 277747 - DNA, 25 bp, Mus musculus
ctgtctacaaccgctcccaccaaca

SEQ ID NO: 277748 - DNA, 25 bp, Mus musculus
ctgtctacaaccggtggcaggatcc

SEQ ID NO: 277749 - DNA, 25 bp, Mus musculus
ctgtctaccccaggtggcagccttg

SEQ ID NO: 277750 - DNA, 25 bp, Mus musculus
ctgtctacgaacacggccaaagtga

SEQ ID NO: 277751 - DNA, 25 bp, Mus musculus
ctgtctacgagaccctgaagaatcg

SEQ ID NO: 277752 - DNA, 25 bp, Mus musculus
ctgtctagaatacgcgtctgatggc

SEQ ID NO: 277753 - DNA, 25 bp, Mus musculus
ctgtctatctgccagcagaatggca

SEQ ID NO: 277754 - DNA, 25 bp, Mus musculus
ctgtctatgagacattgaaaaatac

SEQ ID NO: 277755 - DNA, 25 bp, Mus musculus
ctgtctcaacaaaagggctctacta

SEQ ID NO: 277756 - DNA, 25 bp, Mus musculus
ctgtctcaagtaccggcagtccttt

SEQ ID NO: 277757 - DNA, 25 bp, Mus musculus
ctgtctcacatccagggtaaagccc

SEQ ID NO: 277758 - DNA, 25 bp, Mus musculus
ctgtctcacatccaggtaaccgaga

SEQ ID NO: 277759 - DNA, 25 bp, Mus musculus
ctgtctcacccaggatgagtttcat

SEQ ID NO: 277760 - DNA, 25 bp, Mus musculus
ctgtctcagatcttgtaggactccc

SEQ ID NO: 277761 - DNA, 25 bp, Mus musculus
ctgtctcagcgcggattaccttatg

SEQ ID NO: 277762 - DNA, 25 bp, Mus musculus
ctgtctcaggaaaggtaaacctagc

SEQ ID NO: 277763 - DNA, 25 bp, Mus musculus
ctgtctccaagccaagaggacctgc

SEQ ID NO: 277764 - DNA, 25 bp, Mus musculus
ctgtctccacgaccctgctttttgc

SEQ ID NO: 277765 - DNA, 25 bp, Mus musculus
ctgtctccaggacacccaacacacc

SEQ ID NO: 277766 - DNA, 25 bp, Mus musculus
ctgtctccaggtgacattccaagcc

SEQ ID NO: 277767 - DNA, 25 bp, Mus musculus
ctgtctccagtgcaagcagcccagc

SEQ ID NO: 277768 - DNA, 25 bp, Mus musculus
ctgtctcccgagtgccttagtcctg

SEQ ID NO: 277769 - DNA, 25 bp, Mus musculus
ctgtctccgattttactcctaaaaa

SEQ ID NO: 277770 - DNA, 25 bp, Mus musculus
ctgtctccgcaggggaacagtacat

SEQ ID NO: 277771 - DNA, 25 bp, Mus musculus
ctgtctcctccaaaacctcaggctg

SEQ ID NO: 277772 - DNA, 25 bp, Mus musculus
ctgtctcgagagctgaagacaccag

SEQ ID NO: 277773 - DNA, 25 bp, Mus musculus
ctgtctcggtgctcttcaaatgtcg

SEQ ID NO: 277774 - DNA, 25 bp, Mus musculus
ctgtctcggtgtccttcccgtcgaa

SEQ ID NO: 277775 - DNA, 25 bp, Mus musculus
ctgtctctcagatgaccactctaga

SEQ ID NO: 277776 - DNA, 25 bp, Mus musculus
ctgtctctccggatggacctgatcg

SEQ ID NO: 277777 - DNA, 25 bp, Mus musculus
ctgtctctccggcccccgcgcgccg

SEQ ID NO: 277778 - DNA, 25 bp, Mus musculus
ctgtctctgacaaatcgccagtacc

SEQ ID NO: 277779 - DNA, 25 bp, Mus musculus
ctgtctctgacaaattctctccaga

SEQ ID NO: 277780 - DNA, 25 bp, Mus musculus
ctgtctctgcagaacaacactgaag

SEQ ID NO: 277781 - DNA, 25 bp, Mus musculus
ctgtctctgcagagagtcagtcctt

SEQ ID NO: 277782 - DNA, 25 bp, Mus musculus
ctgtctctgcagagtctgcgagaaa

SEQ ID NO: 277783 - DNA, 25 bp, Mus musculus
ctgtctctgcagccaaaacaacacc

SEQ ID NO: 277784 - DNA, 25 bp, Mus musculus
ctgtctctgcagccaaaacaacagc

SEQ ID NO: 277785 - DNA, 25 bp, Mus musculus
ctgtctctgcaggtaatgaaaaggg

SEQ ID NO: 277786 - DNA, 25 bp, Mus musculus
ctgtctctttgacaggagaaggaat

SEQ ID NO: 277787 - DNA, 25 bp, Mus musculus
ctgtctgaaaacgatgatggagctg

SEQ ID NO: 277788 - DNA, 25 bp, Mus musculus
ctgtctgaaaagggccggcaggagg

SEQ ID NO: 277789 - DNA, 25 bp, Mus musculus
ctgtctgaaatactgatccagaaca

SEQ ID NO: 277790 - DNA, 25 bp, Mus musculus
ctgtctgaaatgagcatctgtaaca

SEQ ID NO: 277791 - DNA, 25 bp, Mus musculus
ctgtctgaaggatctcacataaccc

SEQ ID NO: 277792 - DNA, 25 bp, Mus musculus
ctgtctgaaggcacttctggatcca

SEQ ID NO: 277793 - DNA, 25 bp, Mus musculus
ctgtctgacaatgagctgtgtgtcc

SEQ ID NO: 277794 - DNA, 25 bp, Mus musculus
ctgtctgaccaggaaaagaaagatg

SEQ ID NO: 277795 - DNA, 25 bp, Mus musculus
ctgtctgagccgctacagaacctga

SEQ ID NO: 277796 - DNA, 25 bp, Mus musculus
ctgtctgagtctgaagaagacaaag

SEQ ID NO: 277797 - DNA, 25 bp, Mus musculus
ctgtctgatggaggtaaaagtaact

SEQ ID NO: 277798 - DNA, 25 bp, Mus musculus
ctgtctgattctgaggtgtggcttg

SEQ ID NO: 277799 - DNA, 25 bp, Mus musculus
ctgtctgcaagagaccgggctcatc

SEQ ID NO: 277800 - DNA, 25 bp, Mus musculus
ctgtctgcaaggagaagatcggatg

SEQ ID NO: 277801 - DNA, 25 bp, Mus musculus
ctgtctgcaaggatccagcaatgcc

SEQ ID NO: 277802 - DNA, 25 bp, Mus musculus
ctgtctgcaatcccaaaccttgtca

SEQ ID NO: 277803 - DNA, 25 bp, Mus musculus
ctgtctgcactatcggtctgtgcac

SEQ ID NO: 277804 - DNA, 25 bp, Mus musculus
ctgtctgcactatcggtttggaggt

SEQ ID NO: 277805 - DNA, 25 bp, Mus musculus
ctgtctgcactggtgaccatgtaca

SEQ ID NO: 277806 - DNA, 25 bp, Mus musculus
ctgtctgcaggaagggtccccctgt

SEQ ID NO: 277807 - DNA, 25 bp, Mus musculus
ctgtctgcaggaaggtgtggggcgg

SEQ ID NO: 277808 - DNA, 25 bp, Mus musculus
ctgtctgcaggtgttatttccaatt

SEQ ID NO: 277809 - DNA, 25 bp, Mus musculus
ctgtctgcagtaggggctgctgaat

SEQ ID NO: 277810 - DNA, 25 bp, Mus musculus
ctgtctgccagccaggtgcccagga

SEQ ID NO: 277811 - DNA, 25 bp, Mus musculus
ctgtctgctattaagatcgagttct

SEQ ID NO: 277812 - DNA, 25 bp, Mus musculus
ctgtctgctcctggccttcccagag

SEQ ID NO: 277813 - DNA, 25 bp, Mus musculus
ctgtctgcttggagccctgcactat

SEQ ID NO: 277814 - DNA, 25 bp, Mus musculus
ctgtctggaaggtcgctgtgctatg

SEQ ID NO: 277815 - DNA, 25 bp, Mus musculus
ctgtctggacagagtttgatgagtg

SEQ ID NO: 277816 - DNA, 25 bp, Mus musculus
ctgtctggacggcctgtatgccctg

SEQ ID NO: 277817 - DNA, 25 bp, Mus musculus
ctgtctggagaagattgaagaaatg

SEQ ID NO: 277818 - DNA, 25 bp, Mus musculus
ctgtctggagaaggtggactatagt

SEQ ID NO: 277819 - DNA, 25 bp, Mus musculus
ctgtctggcacaagggtgactgtgg

SEQ ID NO: 277820 - DNA, 25 bp, Mus musculus
ctgtctgggaggagccacccgcggt

SEQ ID NO: 277821 - DNA, 25 bp, Mus musculus
ctgtctggtagcagttggaacaaga

SEQ ID NO: 277822 - DNA, 25 bp, Mus musculus
ctgtctgtatccagcgagacggtca

SEQ ID NO: 277823 - DNA, 25 bp, Mus musculus
ctgtctgtattgagaaacctgaaaa

SEQ ID NO: 277824 - DNA, 25 bp, Mus musculus
ctgtctgtctctttgacaggagaag

SEQ ID NO: 277825 - DNA, 25 bp, Mus musculus
ctgtctgtgactggattggccgcag

SEQ ID NO: 277826 - DNA, 25 bp, Mus musculus
ctgtctgtggcggcacagtggttga

SEQ ID NO: 277827 - DNA, 25 bp, Mus musculus
ctgtctgtggcggtcattgtcatga

SEQ ID NO: 277828 - DNA, 25 bp, Mus musculus
ctgtctgtggctgtcctccaggagg

SEQ ID NO: 277829 - DNA, 25 bp, Mus musculus
ctgtctgtggtcctgaatccttcac

SEQ ID NO: 277830 - DNA, 25 bp, Mus musculus
ctgtctgttgcggtggcactgcttc

SEQ ID NO: 277831 - DNA, 25 bp, Mus musculus
ctgtctgttgtttctctgctgccct

SEQ ID NO: 277832 - DNA, 25 bp, Mus musculus
ctgtcttaaaggccgttgatgctca

SEQ ID NO: 277833 - DNA, 25 bp, Mus musculus
ctgtcttaaaggtatctcattcagt

SEQ ID NO: 277834 - DNA, 25 bp, Mus musculus
ctgtcttaagaccttcacagcctgg

SEQ ID NO: 277835 - DNA, 25 bp, Mus musculus
ctgtcttaatcagtggatggagacc

SEQ ID NO: 277836 - DNA, 25 bp, Mus musculus
ctgtcttatttaaagctgagtgcaa

SEQ ID NO: 277837 - DNA, 25 bp, Mus musculus
ctgtcttcaaggtgccgccatgctg

SEQ ID NO: 277838 - DNA, 25 bp, Mus musculus
ctgtcttcatttagggacaagaaga

SEQ ID NO: 277839 - DNA, 25 bp, Mus musculus
ctgtcttccccccaggattcttcct

SEQ ID NO: 277840 - DNA, 25 bp, Mus musculus
ctgtcttccccccaggcttaagata

SEQ ID NO: 277841 - DNA, 25 bp, Mus musculus
ctgtcttctgtgatggactgcagta

SEQ ID NO: 277842 - DNA, 25 bp, Mus musculus
ctgtcttctgtgatggccaaagatc

SEQ ID NO: 277843 - DNA, 25 bp, Mus musculus
ctgtcttgagtgtctagctgccagc

SEQ ID NO: 277844 - DNA, 25 bp, Mus musculus
ctgtcttgcaggtggaatgccatcc

SEQ ID NO: 277845 - DNA, 25 bp, Mus musculus
ctgtcttggtcgatgggatgcttta

SEQ ID NO: 277846 - DNA, 25 bp, Mus musculus
ctgtcttggtcggaggtggctattg

SEQ ID NO: 277847 - DNA, 25 bp, Mus musculus
ctgtcttgtaaccctgagataacag

SEQ ID NO: 277848 - DNA, 25 bp, Mus musculus
ctgtctttacagtatgtaggccatg

SEQ ID NO: 277849 - DNA, 25 bp, Mus musculus
ctgtctttattagatgatgcagtcc

SEQ ID NO: 277850 - DNA, 25 bp, Mus musculus
ctgtctttcagggtggtaggaatgt

SEQ ID NO: 277851 - DNA, 25 bp, Mus musculus
ctgtctttccaacagagcttaccaa

SEQ ID NO: 277852 - DNA, 25 bp, Mus musculus
ctgtctttgcccggaacacacgccg

SEQ ID NO: 277853 - DNA, 25 bp, Mus musculus
ctgtctttggagagctcaaagagaa

SEQ ID NO: 277854 - DNA, 25 bp, Mus musculus
ctgtctttggagatctctgacatct

SEQ ID NO: 277855 - DNA, 25 bp, Mus musculus
ctgtctttgggcagctcaaagagaa

SEQ ID NO: 277856 - DNA, 25 bp, Mus musculus
ctgtctttgtaccaggatcttgaaa

SEQ ID NO: 277857 - DNA, 25 bp, Mus musculus
ctgtctttgtaccagggggctggtg

SEQ ID NO: 277858 - DNA, 25 bp, Mus musculus
ctgtcttttctgcccccagctattt

SEQ ID NO: 277859 - DNA, 25 bp, Mus musculus
ctgtcttttttgaaattggcaccga

SEQ ID NO: 277860 - DNA, 25 bp, Mus musculus
ctgtcttttttgctgagaaagtgat

SEQ ID NO: 277861 - DNA, 25 bp, Mus musculus
ctgtgaaaaaccaggtggaggatct

SEQ ID NO: 277862 - DNA, 25 bp, Mus musculus
ctgtgaaaaatgagtttggcaaagg

SEQ ID NO: 277863 - DNA, 25 bp, Mus musculus
ctgtgaaaagagtggacaagattac

SEQ ID NO: 277864 - DNA, 25 bp, Mus musculus
ctgtgaaaagccattggcacagcgt

SEQ ID NO: 277865 - DNA, 25 bp, Mus musculus
ctgtgaaaagggtcaagcagtgtaa

SEQ ID NO: 277866 - DNA, 25 bp, Mus musculus
ctgtgaaacagacaagcagatgggg

SEQ ID NO: 277867 - DNA, 25 bp, Mus musculus
ctgtgaaacagggaagcagctggcc

SEQ ID NO: 277868 - DNA, 25 bp, Mus musculus
ctgtgaaaccgagaccaactactac

SEQ ID NO: 277869 - DNA, 25 bp, Mus musculus
ctgtgaaaccggttgttctacacag

SEQ ID NO: 277870 - DNA, 25 bp, Mus musculus
ctgtgaaagtgtatgagaagttgat

SEQ ID NO: 277871 - DNA, 25 bp, Mus musculus
ctgtgaaatcaaggttacagaatgt

SEQ ID NO: 277872 - DNA, 25 bp, Mus musculus
ctgtgaacacaagggtcatccaaac

SEQ ID NO: 277873 - DNA, 25 bp, Mus musculus
ctgtgaacactgagcctacacaggt

SEQ ID NO: 277874 - DNA, 25 bp, Mus musculus
ctgtgaacactgcgaaattgcccat

SEQ ID NO: 277875 - DNA, 25 bp, Mus musculus
ctgtgaacaggttgatcgtgtcctg

SEQ ID NO: 277876 - DNA, 25 bp, Mus musculus
ctgtgaacagtatgtctggatttgg

SEQ ID NO: 277877 - DNA, 25 bp, Mus musculus
ctgtgaacagttcaaattccatcaa

SEQ ID NO: 277878 - DNA, 25 bp, Mus musculus
ctgtgaacagtttaaagcatgctag

SEQ ID NO: 277879 - DNA, 25 bp, Mus musculus
ctgtgaacctgaaaaatcatgtggg

SEQ ID NO: 277880 - DNA, 25 bp, Mus musculus
ctgtgaacctgacgtggccattcgt

SEQ ID NO: 277881 - DNA, 25 bp, Mus musculus
ctgtgaacgaagggaacaagtcata

SEQ ID NO: 277882 - DNA, 25 bp, Mus musculus
ctgtgaactagagcttctggaattt

SEQ ID NO: 277883 - DNA, 25 bp, Mus musculus
ctgtgaagaaccagggccagtgcgg

SEQ ID NO: 277884 - DNA, 25 bp, Mus musculus
ctgtgaagaaccgacgcagaccctt

SEQ ID NO: 277885 - DNA, 25 bp, Mus musculus
ctgtgaagaagtggggtgccgccat

SEQ ID NO: 277886 - DNA, 25 bp, Mus musculus
ctgtgaagatggagagcttccctat

SEQ ID NO: 277887 - DNA, 25 bp, Mus musculus
ctgtgaagccacgcttgcctctcca

SEQ ID NO: 277888 - DNA, 25 bp, Mus musculus
ctgtgaagccacgttgtgggaccta

SEQ ID NO: 277889 - DNA, 25 bp, Mus musculus
ctgtgaagcgagcgcagcaatctag

SEQ ID NO: 277890 - DNA, 25 bp, Mus musculus
ctgtgaagcgaggtctaagccgact

SEQ ID NO: 277891 - DNA, 25 bp, Mus musculus
ctgtgaagcgagtttcagggacacg

SEQ ID NO: 277892 - DNA, 25 bp, Mus musculus
ctgtgaagcgcctcagtgggctcgc

SEQ ID NO: 277893 - DNA, 25 bp, Mus musculus
ctgtgaaggaagccaaagagaaaac

SEQ ID NO: 277894 - DNA, 25 bp, Mus musculus
ctgtgaagggtcagatttctcagct

SEQ ID NO: 277895 - DNA, 25 bp, Mus musculus
ctgtgaagtcattcaattctggaac

SEQ ID NO: 277896 - DNA, 25 bp, Mus musculus
ctgtgaagtccaagctggaggcatt

SEQ ID NO: 277897 - DNA, 25 bp, Mus musculus
ctgtgaagtgtgccttacatccatg

SEQ ID NO: 277898 - DNA, 25 bp, Mus musculus
ctgtgaagtgtttggattcacaaca

SEQ ID NO: 277899 - DNA, 25 bp, Mus musculus
ctgtgaatctaggtgtagaagccac

SEQ ID NO: 277900 - DNA, 25 bp, Mus musculus
ctgtgaatctgtttcccatgctgag

SEQ ID NO: 277901 - DNA, 25 bp, Mus musculus
ctgtgaatgaaataatagctactct

SEQ ID NO: 277902 - DNA, 25 bp, Mus musculus
ctgtgaatgggtgaatttggaaggc

SEQ ID NO: 277903 - DNA, 25 bp, Mus musculus
ctgtgaatgggttctaacgttcctg

SEQ ID NO: 277904 - DNA, 25 bp, Mus musculus
ctgtgaatgtctgtgtcagcagctc

SEQ ID NO: 277905 - DNA, 25 bp, Mus musculus
ctgtgaattagatgcaacgtgtaac

SEQ ID NO: 277906 - DNA, 25 bp, Mus musculus
ctgtgaattgtagcaccatcccgat

SEQ ID NO: 277907 - DNA, 25 bp, Mus musculus
ctgtgaattttgaggtggcccggga

SEQ ID NO: 277908 - DNA, 25 bp, Mus musculus
ctgtgaattttgagtctttccttct

SEQ ID NO: 277909 - DNA, 25 bp, Mus musculus
ctgtgacaaaggggaggaaatcttc

SEQ ID NO: 277910 - DNA, 25 bp, Mus musculus
ctgtgacaactgtgatgatccggga

SEQ ID NO: 277911 - DNA, 25 bp, Mus musculus
ctgtgacaaggccaggtgtggaggc

SEQ ID NO: 277912 - DNA, 25 bp, Mus musculus
ctgtgacaagggagcagaaagaaaa

SEQ ID NO: 277913 - DNA, 25 bp, Mus musculus
ctgtgacaaggtcatagtccgccac

SEQ ID NO: 277914 - DNA, 25 bp, Mus musculus
ctgtgacacctgttgagggcgaggc

SEQ ID NO: 277915 - DNA, 25 bp, Mus musculus
ctgtgacacttggtccctccagcta

SEQ ID NO: 277916 - DNA, 25 bp, Mus musculus
ctgtgacagaaaggcgatctctttc

SEQ ID NO: 277917 - DNA, 25 bp, Mus musculus
ctgtgacagaaagggaacgcatcat

SEQ ID NO: 277918 - DNA, 25 bp, Mus musculus
ctgtgacatcacagctggtgaatga

SEQ ID NO: 277919 - DNA, 25 bp, Mus musculus
ctgtgaccacagaatcagacacaag

SEQ ID NO: 277920 - DNA, 25 bp, Mus musculus
ctgtgaccacagatcttaccttctc

SEQ ID NO: 277921 - DNA, 25 bp, Mus musculus
ctgtgaccactcaagcccatcgttt

SEQ ID NO: 277922 - DNA, 25 bp, Mus musculus
ctgtgaccactcaaggcaccacaat

SEQ ID NO: 277923 - DNA, 25 bp, Mus musculus
ctgtgaccactcgtcctgaggttag

SEQ ID NO: 277924 - DNA, 25 bp, Mus musculus
ctgtgaccatggtttgggatcaaag

SEQ ID NO: 277925 - DNA, 25 bp, Mus musculus
ctgtgacccaccaacatgacctggg

SEQ ID NO: 277926 - DNA, 25 bp, Mus musculus
ctgtgacccaggagctgccttacag

SEQ ID NO: 277927 - DNA, 25 bp, Mus musculus
ctgtgaccgagatcaagatccactt

SEQ ID NO: 277928 - DNA, 25 bp, Mus musculus
ctgtgaccgaggttgaacatttcaa

SEQ ID NO: 277929 - DNA, 25 bp, Mus musculus
ctgtgacctcctcctctactgctgc

SEQ ID NO: 277930 - DNA, 25 bp, Mus musculus
ctgtgacctgcttggttcaactgga

SEQ ID NO: 277931 - DNA, 25 bp, Mus musculus
ctgtgacctgtataatggttacaca

SEQ ID NO: 277932 - DNA, 25 bp, Mus musculus
ctgtgaccttagaatcagctgcccg

SEQ ID NO: 277933 - DNA, 25 bp, Mus musculus
ctgtgaccttggtctgccttgacca

SEQ ID NO: 277934 - DNA, 25 bp, Mus musculus
ctgtgacgcgggtctgcaccggtga

SEQ ID NO: 277935 - DNA, 25 bp, Mus musculus
ctgtgactcaggattctctacctga

SEQ ID NO: 277936 - DNA, 25 bp, Mus musculus
ctgtgactccaaacatccagaaccc

SEQ ID NO: 277937 - DNA, 25 bp, Mus musculus
ctgtgactgagagcgagctgaccaa

SEQ ID NO: 277938 - DNA, 25 bp, Mus musculus
ctgtgactgagagtgagaaagcgct

SEQ ID NO: 277939 - DNA, 25 bp, Mus musculus
ctgtgacttgctgctgcgatactat

SEQ ID NO: 277940 - DNA, 25 bp, Mus musculus
ctgtgactttacaggaaaaccacca

SEQ ID NO: 277941 - DNA, 25 bp, Mus musculus
ctgtgactttgcagtttcaccaaac

SEQ ID NO: 277942 - DNA, 25 bp, Mus musculus
ctgtgagacagacattgacgagtgc

SEQ ID NO: 277943 - DNA, 25 bp, Mus musculus
ctgtgagacagactcttcctgagtc

SEQ ID NO: 277944 - DNA, 25 bp, Mus musculus
ctgtgagaggcagggcttgtcaatg

SEQ ID NO: 277945 - DNA, 25 bp, Mus musculus
ctgtgagagggtatgtctcctgtgc

SEQ ID NO: 277946 - DNA, 25 bp, Mus musculus
ctgtgagcaaaaacctgtgctggct

SEQ ID NO: 277947 - DNA, 25 bp, Mus musculus
ctgtgagcaaagaggcaagagacag

SEQ ID NO: 277948 - DNA, 25 bp, Mus musculus
ctgtgagcaagaggaagcttttctt

SEQ ID NO: 277949 - DNA, 25 bp, Mus musculus
ctgtgagcaagatcattgagcgctg

SEQ ID NO: 277950 - DNA, 25 bp, Mus musculus
ctgtgagcaaggctctacccctggt

SEQ ID NO: 277951 - DNA, 25 bp, Mus musculus
ctgtgagcaagtgaacacggattcg

SEQ ID NO: 277952 - DNA, 25 bp, Mus musculus
ctgtgagcacaggacataataagaa

SEQ ID NO: 277953 - DNA, 25 bp, Mus musculus
ctgtgagcagcgcggatgtcgaagt

SEQ ID NO: 277954 - DNA, 25 bp, Mus musculus
ctgtgagcaggaatcccttcgccaa

SEQ ID NO: 277955 - DNA, 25 bp, Mus musculus
ctgtgagcaggagccagaggaagag

SEQ ID NO: 277956 - DNA, 25 bp, Mus musculus
ctgtgagcagtggcagtggcacgct

SEQ ID NO: 277957 - DNA, 25 bp, Mus musculus
ctgtgagcccacagcaacctcaagc

SEQ ID NO: 277958 - DNA, 25 bp, Mus musculus
ctgtgagcccacagccttctcatca

SEQ ID NO: 277959 - DNA, 25 bp, Mus musculus
ctgtgagccggtgatctctgggcta

SEQ ID NO: 277960 - DNA, 25 bp, Mus musculus
ctgtgagcgactgcatcgtcaacgt

SEQ ID NO: 277961 - DNA, 25 bp, Mus musculus
ctgtgagctagagaagatccagatc

SEQ ID NO: 277962 - DNA, 25 bp, Mus musculus
ctgtgagctaggaaccggagtggcc

SEQ ID NO: 277963 - DNA, 25 bp, Mus musculus
ctgtgagctgaagatcctagacttt

SEQ ID NO: 277964 - DNA, 25 bp, Mus musculus
ctgtgagctgcaaaaggaagttcga

SEQ ID NO: 277965 - DNA, 25 bp, Mus musculus
ctgtgagctggcccagtcctcctct

SEQ ID NO: 277966 - DNA, 25 bp, Mus musculus
ctgtgagctggttcacccacccatc

SEQ ID NO: 277967 - DNA, 25 bp, Mus musculus
ctgtgagcttggcagactgtataac

SEQ ID NO: 277968 - DNA, 25 bp, Mus musculus
ctgtgaggacagcatccctggcacc

SEQ ID NO: 277969 - DNA, 25 bp, Mus musculus
ctgtgaggagttcaaggatgtggcc

SEQ ID NO: 277970 - DNA, 25 bp, Mus musculus
ctgtgagtaggcaaggaccccatga

SEQ ID NO: 277971 - DNA, 25 bp, Mus musculus
ctgtgagtcagaaccatctggtgac

SEQ ID NO: 277972 - DNA, 25 bp, Mus musculus
ctgtgagtgatggaggacttctgtg

SEQ ID NO: 277973 - DNA, 25 bp, Mus musculus
ctgtgagtgctccgtggcctctcaa

SEQ ID NO: 277974 - DNA, 25 bp, Mus musculus
ctgtgagttagagttccagttacta

SEQ ID NO: 277975 - DNA, 25 bp, Mus musculus
ctgtgagttgcacggatgttctgag

SEQ ID NO: 277976 - DNA, 25 bp, Mus musculus
ctgtgataaagaccagaatatggtg

SEQ ID NO: 277977 - DNA, 25 bp, Mus musculus
ctgtgataaaggtgtccccaaggaa

SEQ ID NO: 277978 - DNA, 25 bp, Mus musculus
ctgtgataccagaccctgaagaaga

SEQ ID NO: 277979 - DNA, 25 bp, Mus musculus
ctgtgatcacggtgacaaacttgaa

SEQ ID NO: 277980 - DNA, 25 bp, Mus musculus
ctgtgatccacagagatgtgaagcc

SEQ ID NO: 277981 - DNA, 25 bp, Mus musculus
ctgtgatccgcccagtgggggcagg

SEQ ID NO: 277982 - DNA, 25 bp, Mus musculus
ctgtgatcctccgcaatgcacggct

SEQ ID NO: 277983 - DNA, 25 bp, Mus musculus
ctgtgatcgctgggttcctgagact

SEQ ID NO: 277984 - DNA, 25 bp, Mus musculus
ctgtgatctactgctgagaagagga

SEQ ID NO: 277985 - DNA, 25 bp, Mus musculus
ctgtgatctactgtacagagctatc

SEQ ID NO: 277986 - DNA, 25 bp, Mus musculus
ctgtgatctccaatggactaaattc

SEQ ID NO: 277987 - DNA, 25 bp, Mus musculus
ctgtgatgacaactacgaaagagcc

SEQ ID NO: 277988 - DNA, 25 bp, Mus musculus
ctgtgatgataagaacaaattggaa

SEQ ID NO: 277989 - DNA, 25 bp, Mus musculus
ctgtgatgcactgaccctgcagttg

SEQ ID NO: 277990 - DNA, 25 bp, Mus musculus
ctgtgatggtaaaaatactggctcg

SEQ ID NO: 277991 - DNA, 25 bp, Mus musculus
ctgtgatgtatcagggtaagacata

SEQ ID NO: 277992 - DNA, 25 bp, Mus musculus
ctgtgattaaagccatcatgttaag

SEQ ID NO: 277993 - DNA, 25 bp, Mus musculus
ctgtgattatcaggactagcggaca

SEQ ID NO: 277994 - DNA, 25 bp, Mus musculus
ctgtgattatgtctgtcagaatctc

SEQ ID NO: 277995 - DNA, 25 bp, Mus musculus
ctgtgatttacaggtggaaagcttt

SEQ ID NO: 277996 - DNA, 25 bp, Mus musculus
ctgtgatttcctggattctcaggac

SEQ ID NO: 277997 - DNA, 25 bp, Mus musculus
ctgtgcaaatggcaagctgtgcatt

SEQ ID NO: 277998 - DNA, 25 bp, Mus musculus
ctgtgcaaatggtacaatcagctgc

SEQ ID NO: 277999 - DNA, 25 bp, Mus musculus
ctgtgcaacttctagccctgctgtc

SEQ ID NO: 278000 - DNA, 25 bp, Mus musculus
ctgtgcaagaattactacggtagta

SEQ ID NO: 278001 - DNA, 25 bp, Mus musculus
ctgtgcaagccagccccaggtatgg

SEQ ID NO: 278002 - DNA, 25 bp, Mus musculus
ctgtgcaatgaccggggtcgctgtt

SEQ ID NO: 278003 - DNA, 25 bp, Mus musculus
ctgtgcacacatgtctgagagcaag

SEQ ID NO: 278004 - DNA, 25 bp, Mus musculus
ctgtgcacagactgactttgcacga

SEQ ID NO: 278005 - DNA, 25 bp, Mus musculus
ctgtgcacattcaggagtgtgttcc

SEQ ID NO: 278006 - DNA, 25 bp, Mus musculus
ctgtgcaccacgagatgtgtgttaa

SEQ ID NO: 278007 - DNA, 25 bp, Mus musculus
ctgtgcaccacgaggatcagaactt

SEQ ID NO: 278008 - DNA, 25 bp, Mus musculus
ctgtgcaccaggtacaagcagtcag

SEQ ID NO: 278009 - DNA, 25 bp, Mus musculus
ctgtgcacggcactgccactgattc

SEQ ID NO: 278010 - DNA, 25 bp, Mus musculus
ctgtgcactcagccatagattgtaa

SEQ ID NO: 278011 - DNA, 25 bp, Mus musculus
ctgtgcactgctgaagaaggacccc

SEQ ID NO: 278012 - DNA, 25 bp, Mus musculus
ctgtgcactggaggttccaatacca

SEQ ID NO: 278013 - DNA, 25 bp, Mus musculus
ctgtgcagaagattgataagtatct

SEQ ID NO: 278014 - DNA, 25 bp, Mus musculus
ctgtgcagacagcccctgcaggaac

SEQ ID NO: 278015 - DNA, 25 bp, Mus musculus
ctgtgcagagatattcacaacgttg

SEQ ID NO: 278016 - DNA, 25 bp, Mus musculus
ctgtgcagagcagatctggtggccc

SEQ ID NO: 278017 - DNA, 25 bp, Mus musculus
ctgtgcagagccaatatgaagagaa

SEQ ID NO: 278018 - DNA, 25 bp, Mus musculus
ctgtgcagaggttcacctggtcatc

SEQ ID NO: 278019 - DNA, 25 bp, Mus musculus
ctgtgcagcagcaggaggtgtatgg

SEQ ID NO: 278020 - DNA, 25 bp, Mus musculus
ctgtgcagcccagagaagagtttag

SEQ ID NO: 278021 - DNA, 25 bp, Mus musculus
ctgtgcagctgcgaggctctacaca

SEQ ID NO: 278022 - DNA, 25 bp, Mus musculus
ctgtgcagcttcaggaccacagcca

SEQ ID NO: 278023 - DNA, 25 bp, Mus musculus
ctgtgcagtggcactccaaagtccg

SEQ ID NO: 278024 - DNA, 25 bp, Mus musculus
ctgtgcatcggaggtcaccttcgtc

SEQ ID NO: 278025 - DNA, 25 bp, Mus musculus
ctgtgcatgccatgacccccgaggc

SEQ ID NO: 278026 - DNA, 25 bp, Mus musculus
ctgtgcatgctgggatagctcaggt

SEQ ID NO: 278027 - DNA, 25 bp, Mus musculus
ctgtgcatgggccagcgtgacggct

SEQ ID NO: 278028 - DNA, 25 bp, Mus musculus
ctgtgcatgtgacagacctcactca

SEQ ID NO: 278029 - DNA, 25 bp, Mus musculus
ctgtgcatgtgacagataattcaca

SEQ ID NO: 278030 - DNA, 25 bp, Mus musculus
ctgtgccaacaaggcagagatggag

SEQ ID NO: 278031 - DNA, 25 bp, Mus musculus
ctgtgccaacatggccatcctggac

SEQ ID NO: 278032 - DNA, 25 bp, Mus musculus
ctgtgccaactgcgggaaggagcta

SEQ ID NO: 278033 - DNA, 25 bp, Mus musculus
ctgtgccaaggtcgagtatgcctac

SEQ ID NO: 278034 - DNA, 25 bp, Mus musculus
ctgtgccacacagatgctggagagc

SEQ ID NO: 278035 - DNA, 25 bp, Mus musculus
ctgtgccacgccccctgattgaacc

SEQ ID NO: 278036 - DNA, 25 bp, Mus musculus
ctgtgccactaccccacagcggcag

SEQ ID NO: 278037 - DNA, 25 bp, Mus musculus
ctgtgccagagaggaccccggagct

SEQ ID NO: 278038 - DNA, 25 bp, Mus musculus
ctgtgccagtgacacccgtgccggc

SEQ ID NO: 278039 - DNA, 25 bp, Mus musculus
ctgtgcccaagattgggtgtgatcg

SEQ ID NO: 278040 - DNA, 25 bp, Mus musculus
ctgtgcccacaagcctcccctcgca

SEQ ID NO: 278041 - DNA, 25 bp, Mus musculus
ctgtgcccacaaggttcttgttcat

SEQ ID NO: 278042 - DNA, 25 bp, Mus musculus
ctgtgcccagatcaaatcgtgtcca

SEQ ID NO: 278043 - DNA, 25 bp, Mus musculus
ctgtgcccagatcaactattagaca

SEQ ID NO: 278044 - DNA, 25 bp, Mus musculus
ctgtgcccagcctacggttgtctac

SEQ ID NO: 278045 - DNA, 25 bp, Mus musculus
ctgtgcccagcctacgtggtgaaga

SEQ ID NO: 278046 - DNA, 25 bp, Mus musculus
ctgtgcccataggttacaaccatcc

SEQ ID NO: 278047 - DNA, 25 bp, Mus musculus
ctgtgcccccaagtctgtcttctcc

SEQ ID NO: 278048 - DNA, 25 bp, Mus musculus
ctgtgcccctggctgggtttggtta

SEQ ID NO: 278049 - DNA, 25 bp, Mus musculus
ctgtgcccctgttcacctgctgttg

SEQ ID NO: 278050 - DNA, 25 bp, Mus musculus
ctgtgccctcggaaccaccatctgg

SEQ ID NO: 278051 - DNA, 25 bp, Mus musculus
ctgtgccctgctgggtggggagaca

SEQ ID NO: 278052 - DNA, 25 bp, Mus musculus
ctgtgccgactacgtggaggagccc

SEQ ID NO: 278053 - DNA, 25 bp, Mus musculus
ctgtgccgtgtgacgcagtgggcca

SEQ ID NO: 278054 - DNA, 25 bp, Mus musculus
ctgtgcctaccgtgccagcccccat

SEQ ID NO: 278055 - DNA, 25 bp, Mus musculus
ctgtgcctaccgtgcttgccattcc

SEQ ID NO: 278056 - DNA, 25 bp, Mus musculus
ctgtgcctatccagaccctcctccc

SEQ ID NO: 278057 - DNA, 25 bp, Mus musculus
ctgtgcctcagggtgacagaactgg

SEQ ID NO: 278058 - DNA, 25 bp, Mus musculus
ctgtgcctcagggttgcagtaatga

SEQ ID NO: 278059 - DNA, 25 bp, Mus musculus
ctgtgcctcaggttgccctctgtct

SEQ ID NO: 278060 - DNA, 25 bp, Mus musculus
ctgtgcctcctagatgccctttgaa

SEQ ID NO: 278061 - DNA, 25 bp, Mus musculus
ctgtgcctcgatggcactgcctttt

SEQ ID NO: 278062 - DNA, 25 bp, Mus musculus
ctgtgcctctctgtgagcaaagaaa

SEQ ID NO: 278063 - DNA, 25 bp, Mus musculus
ctgtgcctggaggaccagctctctc

SEQ ID NO: 278064 - DNA, 25 bp, Mus musculus
ctgtgcctgtcctggttgttcctca

SEQ ID NO: 278065 - DNA, 25 bp, Mus musculus
ctgtgccttcaggctcacccaggaa

SEQ ID NO: 278066 - DNA, 25 bp, Mus musculus
ctgtgccttggacggctgttctcag

SEQ ID NO: 278067 - DNA, 25 bp, Mus musculus
ctgtgcgctgctcccgccagtgaag

SEQ ID NO: 278068 - DNA, 25 bp, Mus musculus
ctgtgcggcgagaaggactccatga

SEQ ID NO: 278069 - DNA, 25 bp, Mus musculus
ctgtgcggcgagacacaccagaaga

SEQ ID NO: 278070 - DNA, 25 bp, Mus musculus
ctgtgcggcgagatcccacgggttc

SEQ ID NO: 278071 - DNA, 25 bp, Mus musculus
ctgtgcgggaccagctgatccgagc

SEQ ID NO: 278072 - DNA, 25 bp, Mus musculus
ctgtgcgggaccaggcctttaagac

SEQ ID NO: 278073 - DNA, 25 bp, Mus musculus
ctgtgctaagaggtccagcatgctg

SEQ ID NO: 278074 - DNA, 25 bp, Mus musculus
ctgtgctaagtgacattgaccagca

SEQ ID NO: 278075 - DNA, 25 bp, Mus musculus
ctgtgctacaaaaaactgagacgta

SEQ ID NO: 278076 - DNA, 25 bp, Mus musculus
ctgtgctacaagtccacacacgttc

SEQ ID NO: 278077 - DNA, 25 bp, Mus musculus
ctgtgctacagatgtcacagccatt

SEQ ID NO: 278078 - DNA, 25 bp, Mus musculus
ctgtgctacagattacacctttgcg

SEQ ID NO: 278079 - DNA, 25 bp, Mus musculus
ctgtgctaccttaggatcgagcggt

SEQ ID NO: 278080 - DNA, 25 bp, Mus musculus
ctgtgctagacaagtgctacgttga

SEQ ID NO: 278081 - DNA, 25 bp, Mus musculus
ctgtgctatgaaggtgaagcttccc

SEQ ID NO: 278082 - DNA, 25 bp, Mus musculus
ctgtgctcaagttactgggcctggt

SEQ ID NO: 278083 - DNA, 25 bp, Mus musculus
ctgtgctcaggggagaaaggccttg

SEQ ID NO: 278084 - DNA, 25 bp, Mus musculus
ctgtgctcaggtaatggaaaaggtg

SEQ ID NO: 278085 - DNA, 25 bp, Mus musculus
ctgtgctcaggtcgcaggcatcctc

SEQ ID NO: 278086 - DNA, 25 bp, Mus musculus
ctgtgctcattataggggtgatcct

SEQ ID NO: 278087 - DNA, 25 bp, Mus musculus
ctgtgctccaggctctcacagcagc

SEQ ID NO: 278088 - DNA, 25 bp, Mus musculus
ctgtgctccctaaagttgcagaatt

SEQ ID NO: 278089 - DNA, 25 bp, Mus musculus
ctgtgctcctgcgggcggcatcgct

SEQ ID NO: 278090 - DNA, 25 bp, Mus musculus
ctgtgctctcaggggactcctctcg

SEQ ID NO: 278091 - DNA, 25 bp, Mus musculus
ctgtgctgagctgggtgaagatgat

SEQ ID NO: 278092 - DNA, 25 bp, Mus musculus
ctgtgctgcagaaaaagcagacgga

SEQ ID NO: 278093 - DNA, 25 bp, Mus musculus
ctgtgctgcccagatcttggtgacc

SEQ ID NO: 278094 - DNA, 25 bp, Mus musculus
ctgtgctgcgcaaggtttctctgtg

SEQ ID NO: 278095 - DNA, 25 bp, Mus musculus
ctgtgctgcgcaaggtttctgacat

SEQ ID NO: 278096 - DNA, 25 bp, Mus musculus
ctgtgctgctgccttccctcctcta

SEQ ID NO: 278097 - DNA, 25 bp, Mus musculus
ctgtgctgctgcgcggtgaccacac

SEQ ID NO: 278098 - DNA, 25 bp, Mus musculus
ctgtgctggtggatattcattagct

SEQ ID NO: 278099 - DNA, 25 bp, Mus musculus
ctgtgctgtacagagatggcccaca

SEQ ID NO: 278100 - DNA, 25 bp, Mus musculus
ctgtgctgtgttggtccggaccgct

SEQ ID NO: 278101 - DNA, 25 bp, Mus musculus
ctgtgctgtttggaagtgaaatgga

SEQ ID NO: 278102 - DNA, 25 bp, Mus musculus
ctgtgcttagagctcctcctcccat

SEQ ID NO: 278103 - DNA, 25 bp, Mus musculus
ctgtgcttatgacaggattgtggtt

SEQ ID NO: 278104 - DNA, 25 bp, Mus musculus
ctgtgcttatgacaggctgaagcca

SEQ ID NO: 278105 - DNA, 25 bp, Mus musculus
ctgtgcttcagagtctgaaagggtg

SEQ ID NO: 278106 - DNA, 25 bp, Mus musculus
ctgtgcttgaggtgattgaagaaga

SEQ ID NO: 278107 - DNA, 25 bp, Mus musculus
ctgtgcttgccaggggctgacaagt

SEQ ID NO: 278108 - DNA, 25 bp, Mus musculus
ctgtgcttgggggagccatgacagt

SEQ ID NO: 278109 - DNA, 25 bp, Mus musculus
ctgtgcttttcctggaagagtatct

SEQ ID NO: 278110 - DNA, 25 bp, Mus musculus
ctgtggaaaactgatgagaaatgaa

SEQ ID NO: 278111 - DNA, 25 bp, Mus musculus
ctgtggaaagcaagatatattttgc

SEQ ID NO: 278112 - DNA, 25 bp, Mus musculus
ctgtggaaatattgcatactcctat

SEQ ID NO: 278113 - DNA, 25 bp, Mus musculus
ctgtggaaatccaggctgttcatca

SEQ ID NO: 278114 - DNA, 25 bp, Mus musculus
ctgtggaaatccagggcagagatga

SEQ ID NO: 278115 - DNA, 25 bp, Mus musculus
ctgtggaaatggggaacttctgtgg

SEQ ID NO: 278116 - DNA, 25 bp, Mus musculus
ctgtggaaatggggcactttctgca

SEQ ID NO: 278117 - DNA, 25 bp, Mus musculus
ctgtggaaatggggggtcttcttgt

SEQ ID NO: 278118 - DNA, 25 bp, Mus musculus
ctgtggaacagccgtgtaggtttct

SEQ ID NO: 278119 - DNA, 25 bp, Mus musculus
ctgtggaacaggtcccctgttccag

SEQ ID NO: 278120 - DNA, 25 bp, Mus musculus
ctgtggaagaaggtggtgatcttca

SEQ ID NO: 278121 - DNA, 25 bp, Mus musculus
ctgtggaagagtccctgattgtccc

SEQ ID NO: 278122 - DNA, 25 bp, Mus musculus
ctgtggaagtcccaggctctgtgtg

SEQ ID NO: 278123 - DNA, 25 bp, Mus musculus
ctgtggaagtcggtgatggcatgca

SEQ ID NO: 278124 - DNA, 25 bp, Mus musculus
ctgtggaatacgcatgggatgccaa

SEQ ID NO: 278125 - DNA, 25 bp, Mus musculus
ctgtggacaaagacggttatattaa

SEQ ID NO: 278126 - DNA, 25 bp, Mus musculus
ctgtggacaagaaaggtgacactcc

SEQ ID NO: 278127 - DNA, 25 bp, Mus musculus
ctgtggaccagtacctgatactacc

SEQ ID NO: 278128 - DNA, 25 bp, Mus musculus
ctgtggaccgtgggagaactactat

SEQ ID NO: 278129 - DNA, 25 bp, Mus musculus
ctgtggacctagattcatcagccag

SEQ ID NO: 278130 - DNA, 25 bp, Mus musculus
ctgtggacctagggtttctctgtag

SEQ ID NO: 278131 - DNA, 25 bp, Mus musculus
ctgtggacgaagaaaatattcccga

SEQ ID NO: 278132 - DNA, 25 bp, Mus musculus
ctgtggacgaagcaatggcaagccg

SEQ ID NO: 278133 - DNA, 25 bp, Mus musculus
ctgtggacgctctgctcatttggga

SEQ ID NO: 278134 - DNA, 25 bp, Mus musculus
ctgtggacgctctggtcatccaact

SEQ ID NO: 278135 - DNA, 25 bp, Mus musculus
ctgtggactggagtgagtcagcagt

SEQ ID NO: 278136 - DNA, 25 bp, Mus musculus
ctgtggacttagggctgaccagttt

SEQ ID NO: 278137 - DNA, 25 bp, Mus musculus
ctgtggacttaggtgacaagttccg

SEQ ID NO: 278138 - DNA, 25 bp, Mus musculus
ctgtggagaagggtcaactgctgct

SEQ ID NO: 278139 - DNA, 25 bp, Mus musculus
ctgtggagaagggtttcaaagctga

SEQ ID NO: 278140 - DNA, 25 bp, Mus musculus
ctgtggagagaaagtttgctcttca

SEQ ID NO: 278141 - DNA, 25 bp, Mus musculus
ctgtggagagagatggtatggtgta

SEQ ID NO: 278142 - DNA, 25 bp, Mus musculus
ctgtggagaggagatacttcaagcg

SEQ ID NO: 278143 - DNA, 25 bp, Mus musculus
ctgtggagattccagcaattcctgg

SEQ ID NO: 278144 - DNA, 25 bp, Mus musculus
ctgtggagattccaggaagcccctg

SEQ ID NO: 278145 - DNA, 25 bp, Mus musculus
ctgtggagcaggctcctagaaggtg

SEQ ID NO: 278146 - DNA, 25 bp, Mus musculus
ctgtggaggagaatggggagacctg

SEQ ID NO: 278147 - DNA, 25 bp, Mus musculus
ctgtggaggagtctctatggaagag

SEQ ID NO: 278148 - DNA, 25 bp, Mus musculus
ctgtggaggatctggaaagagaact

SEQ ID NO: 278149 - DNA, 25 bp, Mus musculus
ctgtggagggacagcaactgctttg

SEQ ID NO: 278150 - DNA, 25 bp, Mus musculus
ctgtggagggacagtgacaggtttc

SEQ ID NO: 278151 - DNA, 25 bp, Mus musculus
ctgtggagtgtggattttatggata

SEQ ID NO: 278152 - DNA, 25 bp, Mus musculus
ctgtggataagctatatccacctta

SEQ ID NO: 278153 - DNA, 25 bp, Mus musculus
ctgtggatcaagtgtttgcaaaaaa

SEQ ID NO: 278154 - DNA, 25 bp, Mus musculus
ctgtggatgaggtcactacttcagt

SEQ ID NO: 278155 - DNA, 25 bp, Mus musculus
ctgtggatgccctagtcctgcgctt

SEQ ID NO: 278156 - DNA, 25 bp, Mus musculus
ctgtggatggaccagggaaagagtt

SEQ ID NO: 278157 - DNA, 25 bp, Mus musculus
ctgtggatgggtcagggaaagagtt

SEQ ID NO: 278158 - DNA, 25 bp, Mus musculus
ctgtggattcaatcgaagatgctgg

SEQ ID NO: 278159 - DNA, 25 bp, Mus musculus
ctgtggattttcggcctggccgagt

SEQ ID NO: 278160 - DNA, 25 bp, Mus musculus
ctgtggcaaaagactgctggagtta

SEQ ID NO: 278161 - DNA, 25 bp, Mus musculus
ctgtggcaaaagccctggaagagag

SEQ ID NO: 278162 - DNA, 25 bp, Mus musculus
ctgtggcaaagtaggagttggcatc

SEQ ID NO: 278163 - DNA, 25 bp, Mus musculus
ctgtggcaaagttagagaacgtgga

SEQ ID NO: 278164 - DNA, 25 bp, Mus musculus
ctgtggcaagggagtcatccagggc

SEQ ID NO: 278165 - DNA, 25 bp, Mus musculus
ctgtggcacaaggcaaagacatcag

SEQ ID NO: 278166 - DNA, 25 bp, Mus musculus
ctgtggcacacatcactcaactgca

SEQ ID NO: 278167 - DNA, 25 bp, Mus musculus
ctgtggcaccacacgctacaggtac

SEQ ID NO: 278168 - DNA, 25 bp, Mus musculus
ctgtggcactaaggctggtgttccc

SEQ ID NO: 278169 - DNA, 25 bp, Mus musculus
ctgtggcagcaatggaagcccctaa

SEQ ID NO: 278170 - DNA, 25 bp, Mus musculus
ctgtggcataaggtgatgttccctg

SEQ ID NO: 278171 - DNA, 25 bp, Mus musculus
ctgtggcatcagagccaaggctaaa

SEQ ID NO: 278172 - DNA, 25 bp, Mus musculus
ctgtggcatgcagctccatgactgg

SEQ ID NO: 278173 - DNA, 25 bp, Mus musculus
ctgtggcatgcaggtgtaccagctg

SEQ ID NO: 278174 - DNA, 25 bp, Mus musculus
ctgtggcatgccaggtactgctgga

SEQ ID NO: 278175 - DNA, 25 bp, Mus musculus
ctgtggcatgccagtgaagagagag

SEQ ID NO: 278176 - DNA, 25 bp, Mus musculus
ctgtggcattaagcactgaatgcac

SEQ ID NO: 278177 - DNA, 25 bp, Mus musculus
ctgtggccacgtgttctgccgatct

SEQ ID NO: 278178 - DNA, 25 bp, Mus musculus
ctgtggccaggtccttcattccaga

SEQ ID NO: 278179 - DNA, 25 bp, Mus musculus
ctgtggccatttctggcagctctac

SEQ ID NO: 278180 - DNA, 25 bp, Mus musculus
ctgtggcccaggttgctacaggcac

SEQ ID NO: 278181 - DNA, 25 bp, Mus musculus
ctgtggcccagtcactggccggggc

SEQ ID NO: 278182 - DNA, 25 bp, Mus musculus
ctgtggccttttcagaactcaagct

SEQ ID NO: 278183 - DNA, 25 bp, Mus musculus
ctgtggccttttcagggctacagtg

SEQ ID NO: 278184 - DNA, 25 bp, Mus musculus
ctgtggcgaggagaaagcggtggag

SEQ ID NO: 278185 - DNA, 25 bp, Mus musculus
ctgtggctaagactctagccttgtt

SEQ ID NO: 278186 - DNA, 25 bp, Mus musculus
ctgtggctaagctaccgatttattg

SEQ ID NO: 278187 - DNA, 25 bp, Mus musculus
ctgtggctaagtaagaaatccagtc

SEQ ID NO: 278188 - DNA, 25 bp, Mus musculus
ctgtggctaagtgactaataaacat

SEQ ID NO: 278189 - DNA, 25 bp, Mus musculus
ctgtggctaatcctgtctgtagacc

SEQ ID NO: 278190 - DNA, 25 bp, Mus musculus
ctgtggctaatttcagagtgataaa

SEQ ID NO: 278191 - DNA, 25 bp, Mus musculus
ctgtggctcagctatcttccagatc

SEQ ID NO: 278192 - DNA, 25 bp, Mus musculus
ctgtggctgaaggagaacttgagag

SEQ ID NO: 278193 - DNA, 25 bp, Mus musculus
ctgtggctgaaggaggtctctctgc

SEQ ID NO: 278194 - DNA, 25 bp, Mus musculus
ctgtggctgatcgcgtggctgagga

SEQ ID NO: 278195 - DNA, 25 bp, Mus musculus
ctgtggctgatctcttcattgggac

SEQ ID NO: 278196 - DNA, 25 bp, Mus musculus
ctgtggctgatgtatgtgtaagtgc

SEQ ID NO: 278197 - DNA, 25 bp, Mus musculus
ctgtggctgctgactctgctctccc

SEQ ID NO: 278198 - DNA, 25 bp, Mus musculus
ctgtggctgctgatgccatactcca

SEQ ID NO: 278199 - DNA, 25 bp, Mus musculus
ctgtggctgctgtctccccattcag

SEQ ID NO: 278200 - DNA, 25 bp, Mus musculus
ctgtggctggaggggagtggggccg

SEQ ID NO: 278201 - DNA, 25 bp, Mus musculus
ctgtggctgggaccaggagctgaca

SEQ ID NO: 278202 - DNA, 25 bp, Mus musculus
ctgtggcttcaagttttggaaacat

SEQ ID NO: 278203 - DNA, 25 bp, Mus musculus
ctgtggcttgccaggtgaatattgg

SEQ ID NO: 278204 - DNA, 25 bp, Mus musculus
ctgtggctttaataaaccacgttta

SEQ ID NO: 278205 - DNA, 25 bp, Mus musculus
ctgtggctttaatatgggcggcaac

SEQ ID NO: 278206 - DNA, 25 bp, Mus musculus
ctgtgggaaactatgatctcttcac

SEQ ID NO: 278207 - DNA, 25 bp, Mus musculus
ctgtgggaaagaaggttaacctctg

SEQ ID NO: 278208 - DNA, 25 bp, Mus musculus
ctgtgggaaagtacattgagcatta

SEQ ID NO: 278209 - DNA, 25 bp, Mus musculus
ctgtgggaacaggaacagaatggaa

SEQ ID NO: 278210 - DNA, 25 bp, Mus musculus
ctgtgggaacaggtattgaagcccc

SEQ ID NO: 278211 - DNA, 25 bp, Mus musculus
ctgtgggaagaacactgctgtgctg

SEQ ID NO: 278212 - DNA, 25 bp, Mus musculus
ctgtgggaagacaaagccattggcc

SEQ ID NO: 278213 - DNA, 25 bp, Mus musculus
ctgtgggaagcccccggcagcagca

SEQ ID NO: 278214 - DNA, 25 bp, Mus musculus
ctgtgggacccgaacaatttcgaag

SEQ ID NO: 278215 - DNA, 25 bp, Mus musculus
ctgtgggacctccgggcctagctgg

SEQ ID NO: 278216 - DNA, 25 bp, Mus musculus
ctgtgggattatctgaacgatgctg

SEQ ID NO: 278217 - DNA, 25 bp, Mus musculus
ctgtgggcaacgctgaatggtgcca

SEQ ID NO: 278218 - DNA, 25 bp, Mus musculus
ctgtgggcaacgctgtcagcgaagg

SEQ ID NO: 278219 - DNA, 25 bp, Mus musculus
ctgtgggcacctgagagagaagaca

SEQ ID NO: 278220 - DNA, 25 bp, Mus musculus
ctgtgggcagaaatccctagcctat

SEQ ID NO: 278221 - DNA, 25 bp, Mus musculus
ctgtgggcagggtgcctggctacgg

SEQ ID NO: 278222 - DNA, 25 bp, Mus musculus
ctgtgggccagatctgccacctccc

SEQ ID NO: 278223 - DNA, 25 bp, Mus musculus
ctgtgggcccagaccattccccttg

SEQ ID NO: 278224 - DNA, 25 bp, Mus musculus
ctgtgggctgcttgctctctaactg

SEQ ID NO: 278225 - DNA, 25 bp, Mus musculus
ctgtgggctgcttggcttacttctt

SEQ ID NO: 278226 - DNA, 25 bp, Mus musculus
ctgtggggaaaaccagttgggtctc

SEQ ID NO: 278227 - DNA, 25 bp, Mus musculus
ctgtggggaaagcatctgaactact

SEQ ID NO: 278228 - DNA, 25 bp, Mus musculus
ctgtggggaacagaagccggatggt

SEQ ID NO: 278229 - DNA, 25 bp, Mus musculus
ctgtggggaagaattcttgaagtca

SEQ ID NO: 278230 - DNA, 25 bp, Mus musculus
ctgtggggaagctcctgactatgat

SEQ ID NO: 278231 - DNA, 25 bp, Mus musculus
ctgtggggagaccggtactttgatc

SEQ ID NO: 278232 - DNA, 25 bp, Mus musculus
ctgtggggccgcacggttggtacac

SEQ ID NO: 278233 - DNA, 25 bp, Mus musculus
ctgtggggcgcacagccctgtgaag

SEQ ID NO: 278234 - DNA, 25 bp, Mus musculus
ctgtggggctccacagaattgtggc

SEQ ID NO: 278235 - DNA, 25 bp, Mus musculus
ctgtggggctccctccatgtgctgt

SEQ ID NO: 278236 - DNA, 25 bp, Mus musculus
ctgtggggctgcagaccccacgtgg

SEQ ID NO: 278237 - DNA, 25 bp, Mus musculus
ctgtgggggaacctggagctgccca

SEQ ID NO: 278238 - DNA, 25 bp, Mus musculus
ctgtgggggaacctgggagccaccc

SEQ ID NO: 278239 - DNA, 25 bp, Mus musculus
ctgtgggggcctgcatggcctgatt

SEQ ID NO: 278240 - DNA, 25 bp, Mus musculus
ctgtggggtccctggctcctggccc

SEQ ID NO: 278241 - DNA, 25 bp, Mus musculus
ctgtgggtaacacagaagccaccat

SEQ ID NO: 278242 - DNA, 25 bp, Mus musculus
ctgtgggtaccttgatgccatcccg

SEQ ID NO: 278243 - DNA, 25 bp, Mus musculus
ctgtgggtcgggcacattgcctctt

SEQ ID NO: 278244 - DNA, 25 bp, Mus musculus
ctgtgggtcggggaagagttgggct

SEQ ID NO: 278245 - DNA, 25 bp, Mus musculus
ctgtgggtgatccaggtcattgtgg

SEQ ID NO: 278246 - DNA, 25 bp, Mus musculus
ctgtgggtgatgactcagcttctaa

SEQ ID NO: 278247 - DNA, 25 bp, Mus musculus
ctgtgggtgatgactgttgctttca

SEQ ID NO: 278248 - DNA, 25 bp, Mus musculus
ctgtgggttagcgctaactgtcctt

SEQ ID NO: 278249 - DNA, 25 bp, Mus musculus
ctgtgggtttcaggatccagccgca

SEQ ID NO: 278250 - DNA, 25 bp, Mus musculus
ctgtggtagcagacccaacagttcc

SEQ ID NO: 278251 - DNA, 25 bp, Mus musculus
ctgtggtcatgaaggcatttgagca

SEQ ID NO: 278252 - DNA, 25 bp, Mus musculus
ctgtggtccgagggctgctggacct

SEQ ID NO: 278253 - DNA, 25 bp, Mus musculus
ctgtggtcctagggttctccacata

SEQ ID NO: 278254 - DNA, 25 bp, Mus musculus
ctgtggtcctgaatccttcacacct

SEQ ID NO: 278255 - DNA, 25 bp, Mus musculus
ctgtggtctatgaaaccaatgtttt

SEQ ID NO: 278256 - DNA, 25 bp, Mus musculus
ctgtggtgacaggcattgagatgtt

SEQ ID NO: 278257 - DNA, 25 bp, Mus musculus
ctgtggtgacgctagagaactggca

SEQ ID NO: 278258 - DNA, 25 bp, Mus musculus
ctgtggtgatcaggatctgcacctg

SEQ ID NO: 278259 - DNA, 25 bp, Mus musculus
ctgtggtgcacaggacacaaaaaag

SEQ ID NO: 278260 - DNA, 25 bp, Mus musculus
ctgtggtgcacagtttccctcagga

SEQ ID NO: 278261 - DNA, 25 bp, Mus musculus
ctgtggtgcggctgtgtggcacctt

SEQ ID NO: 278262 - DNA, 25 bp, Mus musculus
ctgtggtgctaagaggcttcctgga

SEQ ID NO: 278263 - DNA, 25 bp, Mus musculus
ctgtggtgctaaggcaacatctgca

SEQ ID NO: 278264 - DNA, 25 bp, Mus musculus
ctgtggtgctaaggtggtggagaaa

SEQ ID NO: 278265 - DNA, 25 bp, Mus musculus
ctgtggtggaagaggagacaagttt

SEQ ID NO: 278266 - DNA, 25 bp, Mus musculus
ctgtggtggagtacgaatatattgt

SEQ ID NO: 278267 - DNA, 25 bp, Mus musculus
ctgtggtggccatggtctgggaagg

SEQ ID NO: 278268 - DNA, 25 bp, Mus musculus
ctgtggtggttctttcagctacaaa

SEQ ID NO: 278269 - DNA, 25 bp, Mus musculus
ctgtggttcctgatatgctctctgc

SEQ ID NO: 278270 - DNA, 25 bp, Mus musculus
ctgtggttgagctagaaaattatgg

SEQ ID NO: 278271 - DNA, 25 bp, Mus musculus
ctgtggttgagtacgtgaagggcta

SEQ ID NO: 278272 - DNA, 25 bp, Mus musculus
ctgtggtttctctaggtattctcat

SEQ ID NO: 278273 - DNA, 25 bp, Mus musculus
ctgtgtaaaaagagtattacaacaa

SEQ ID NO: 278274 - DNA, 25 bp, Mus musculus
ctgtgtaaaaaggaagtgttaaaca

SEQ ID NO: 278275 - DNA, 25 bp, Mus musculus
ctgtgtaaaaggccttaaccatggc

SEQ ID NO: 278276 - DNA, 25 bp, Mus musculus
ctgtgtaacaaggaggcttacagtg

SEQ ID NO: 278277 - DNA, 25 bp, Mus musculus
ctgtgtaacccagagatttatttta

SEQ ID NO: 278278 - DNA, 25 bp, Mus musculus
ctgtgtaactcagaaagaagattat

SEQ ID NO: 278279 - DNA, 25 bp, Mus musculus
ctgtgtaatgaagaaaagtccatca

SEQ ID NO: 278280 - DNA, 25 bp, Mus musculus
ctgtgtaatgaagacttgtgacacc

SEQ ID NO: 278281 - DNA, 25 bp, Mus musculus
ctgtgtacagggttcggcagactcc

SEQ ID NO: 278282 - DNA, 25 bp, Mus musculus
ctgtgtacccaggaataaaacccaa

SEQ ID NO: 278283 - DNA, 25 bp, Mus musculus
ctgtgtacccaggttgtgactacac

SEQ ID NO: 278284 - DNA, 25 bp, Mus musculus
ctgtgtacctcagctggattcatcg

SEQ ID NO: 278285 - DNA, 25 bp, Mus musculus
ctgtgtactaaaaatagcccagaag

SEQ ID NO: 278286 - DNA, 25 bp, Mus musculus
ctgtgtagaagccatccgttctcgt

SEQ ID NO: 278287 - DNA, 25 bp, Mus musculus
ctgtgtatagagttcgaaatttgag

SEQ ID NO: 278288 - DNA, 25 bp, Mus musculus
ctgtgtatagatgatgaggaatctg

SEQ ID NO: 278289 - DNA, 25 bp, Mus musculus
ctgtgtatatggacatctggattat

SEQ ID NO: 278290 - DNA, 25 bp, Mus musculus
ctgtgtatcagaggacctcagaata

SEQ ID NO: 278291 - DNA, 25 bp, Mus musculus
ctgtgtcaacgaggaaatgttgtcc

SEQ ID NO: 278292 - DNA, 25 bp, Mus musculus
ctgtgtcaacgaggtccccggacct

SEQ ID NO: 278293 - DNA, 25 bp, Mus musculus
ctgtgtcaagcccaacaagcttcga

SEQ ID NO: 278294 - DNA, 25 bp, Mus musculus
ctgtgtcacccaaggtccagtttga

SEQ ID NO: 278295 - DNA, 25 bp, Mus musculus
ctgtgtcagatcgaaccttgttcag

SEQ ID NO: 278296 - DNA, 25 bp, Mus musculus
ctgtgtcaggatatgacataatgaa

SEQ ID NO: 278297 - DNA, 25 bp, Mus musculus
ctgtgtccaagctgtcagtagaagc

SEQ ID NO: 278298 - DNA, 25 bp, Mus musculus
ctgtgtccaggcttcagaagagcgc

SEQ ID NO: 278299 - DNA, 25 bp, Mus musculus
ctgtgtccctcatacaactagaccg

SEQ ID NO: 278300 - DNA, 25 bp, Mus musculus
ctgtgtcctcaggtggcagtttatg

SEQ ID NO: 278301 - DNA, 25 bp, Mus musculus
ctgtgtcctgaggatctttccaacc

SEQ ID NO: 278302 - DNA, 25 bp, Mus musculus
ctgtgtcctgagtatcccaggcgcg

SEQ ID NO: 278303 - DNA, 25 bp, Mus musculus
ctgtgtcctgctcaggtgactcaga

SEQ ID NO: 278304 - DNA, 25 bp, Mus musculus
ctgtgtccttgaggcccatctgaac

SEQ ID NO: 278305 - DNA, 25 bp, Mus musculus
ctgtgtcgctcctgggaccatttac

SEQ ID NO: 278306 - DNA, 25 bp, Mus musculus
ctgtgtctaaagggcttctctgcct

SEQ ID NO: 278307 - DNA, 25 bp, Mus musculus
ctgtgtctaaaggtaaaacagacta

SEQ ID NO: 278308 - DNA, 25 bp, Mus musculus
ctgtgtctaaggaaacagcaagaca

SEQ ID NO: 278309 - DNA, 25 bp, Mus musculus
ctgtgtctaagtgtctgtgcttgga

SEQ ID NO: 278310 - DNA, 25 bp, Mus musculus
ctgtgtctgaaaaggctcccccacc

SEQ ID NO: 278311 - DNA, 25 bp, Mus musculus
ctgtgtctgatgtcctggaatcgga

SEQ ID NO: 278312 - DNA, 25 bp, Mus musculus
ctgtgtctgccagaatggggaggta

SEQ ID NO: 278313 - DNA, 25 bp, Mus musculus
ctgtgtctgccgtgcgtctcttcct

SEQ ID NO: 278314 - DNA, 25 bp, Mus musculus
ctgtgtctggaggaggtaaatgaaa

SEQ ID NO: 278315 - DNA, 25 bp, Mus musculus
ctgtgtcttcagtaaatgaagcatt

SEQ ID NO: 278316 - DNA, 25 bp, Mus musculus
ctgtgtgaaggagcttctgcgttca

SEQ ID NO: 278317 - DNA, 25 bp, Mus musculus
ctgtgtgacaccaacgacctgcagc

SEQ ID NO: 278318 - DNA, 25 bp, Mus musculus
ctgtgtgacaccattcattgatgca

SEQ ID NO: 278319 - DNA, 25 bp, Mus musculus
ctgtgtgacctcaggggagctgctg

SEQ ID NO: 278320 - DNA, 25 bp, Mus musculus
ctgtgtgaccttggggaaagatgga

SEQ ID NO: 278321 - DNA, 25 bp, Mus musculus
ctgtgtgaccttggttcttccatca

SEQ ID NO: 278322 - DNA, 25 bp, Mus musculus
ctgtgtgagagtgtggctatcttgc

SEQ ID NO: 278323 - DNA, 25 bp, Mus musculus
ctgtgtgagagttgacggcgtccaa

SEQ ID NO: 278324 - DNA, 25 bp, Mus musculus
ctgtgtgagagttgagtcctacctg

SEQ ID NO: 278325 - DNA, 25 bp, Mus musculus
ctgtgtgataaagttggagtcattc

SEQ ID NO: 278326 - DNA, 25 bp, Mus musculus
ctgtgtgatcaggagttcctctgtg

SEQ ID NO: 278327 - DNA, 25 bp, Mus musculus
ctgtgtgatcatcagccacttccac

SEQ ID NO: 278328 - DNA, 25 bp, Mus musculus
ctgtgtgatcatcaggccatctgcc

SEQ ID NO: 278329 - DNA, 25 bp, Mus musculus
ctgtgtgatgattgaagattatgat

SEQ ID NO: 278330 - DNA, 25 bp, Mus musculus
ctgtgtgatgcgggtgcctggctac

SEQ ID NO: 278331 - DNA, 25 bp, Mus musculus
ctgtgtgattactggataagaaaac

SEQ ID NO: 278332 - DNA, 25 bp, Mus musculus
ctgtgtgcaaagctgtgccaccgca

SEQ ID NO: 278333 - DNA, 25 bp, Mus musculus
ctgtgtgcaggagagatgggtggag

SEQ ID NO: 278334 - DNA, 25 bp, Mus musculus
ctgtgtgcatgaaaggcctgacaag

SEQ ID NO: 278335 - DNA, 25 bp, Mus musculus
ctgtgtgccaaggcgaaagcccatg

SEQ ID NO: 278336 - DNA, 25 bp, Mus musculus
ctgtgtgccaaggtttgacctgcca

SEQ ID NO: 278337 - DNA, 25 bp, Mus musculus
ctgtgtgcctctctgctaggtttat

SEQ ID NO: 278338 - DNA, 25 bp, Mus musculus
ctgtgtgcctctgtgctaggtttat

SEQ ID NO: 278339 - DNA, 25 bp, Mus musculus
ctgtgtgcgggagaaaccactggta

SEQ ID NO: 278340 - DNA, 25 bp, Mus musculus
ctgtgtgcggggatctgaagttgga

SEQ ID NO: 278341 - DNA, 25 bp, Mus musculus
ctgtgtgcgtgtattctagtcaaga

SEQ ID NO: 278342 - DNA, 25 bp, Mus musculus
ctgtgtgcgtgttaaaagagccaaa

SEQ ID NO: 278343 - DNA, 25 bp, Mus musculus
ctgtgtggaagaacccctcagcagc

SEQ ID NO: 278344 - DNA, 25 bp, Mus musculus
ctgtgtggacgagagagactcggga

SEQ ID NO: 278345 - DNA, 25 bp, Mus musculus
ctgtgtggagaaatctgacgtttgg

SEQ ID NO: 278346 - DNA, 25 bp, Mus musculus
ctgtgtggaggtacattcgctcaga

SEQ ID NO: 278347 - DNA, 25 bp, Mus musculus
ctgtgtggaggtactacaagcctgg

SEQ ID NO: 278348 - DNA, 25 bp, Mus musculus
ctgtgtggagtgttcagcaaaaaac

SEQ ID NO: 278349 - DNA, 25 bp, Mus musculus
ctgtgtggatatctatgatagagaa

SEQ ID NO: 278350 - DNA, 25 bp, Mus musculus
ctgtgtggatatgtttctgaacaaa

SEQ ID NO: 278351 - DNA, 25 bp, Mus musculus
ctgtgtggatattgtgattcgtcat

SEQ ID NO: 278352 - DNA, 25 bp, Mus musculus
ctgtgtggcgtcggggtgacatgga

SEQ ID NO: 278353 - DNA, 25 bp, Mus musculus
ctgtgtgggagacggccccgactct

SEQ ID NO: 278354 - DNA, 25 bp, Mus musculus
ctgtgtgggagagaggcaccatgac

SEQ ID NO: 278355 - DNA, 25 bp, Mus musculus
ctgtgtgtagccccatgtggaaccc

SEQ ID NO: 278356 - DNA, 25 bp, Mus musculus
ctgtgtgtataaagtacaacctgag

SEQ ID NO: 278357 - DNA, 25 bp, Mus musculus
ctgtgtgtcggagaggctggtccag

SEQ ID NO: 278358 - DNA, 25 bp, Mus musculus
ctgtgtgtcggagcctccgaagtag

SEQ ID NO: 278359 - DNA, 25 bp, Mus musculus
ctgtgtgtctcagcctcagctttat

SEQ ID NO: 278360 - DNA, 25 bp, Mus musculus
ctgtgtgtctgcctcgtgcctcaat

SEQ ID NO: 278361 - DNA, 25 bp, Mus musculus
ctgtgtgtctggcgtgtgtgtgcag

SEQ ID NO: 278362 - DNA, 25 bp, Mus musculus
ctgtgtgtcttcagcctcagcttta

SEQ ID NO: 278363 - DNA, 25 bp, Mus musculus
ctgtgtgtgcagggaaatctgctcc

SEQ ID NO: 278364 - DNA, 25 bp, Mus musculus
ctgtgtgtgccaagtctatatttga

SEQ ID NO: 278365 - DNA, 25 bp, Mus musculus
ctgtgtgtgccaagttccatatctg

SEQ ID NO: 278366 - DNA, 25 bp, Mus musculus
ctgtgtgttctgtagattcgagtaa

SEQ ID NO: 278367 - DNA, 25 bp, Mus musculus
ctgtgttacaagctaatggcactga

SEQ ID NO: 278368 - DNA, 25 bp, Mus musculus
ctgtgttacaagggactgagtgggg

SEQ ID NO: 278369 - DNA, 25 bp, Mus musculus
ctgtgttactgaggcaacgtttcat

SEQ ID NO: 278370 - DNA, 25 bp, Mus musculus
ctgtgttactgagggactttgtaaa

SEQ ID NO: 278371 - DNA, 25 bp, Mus musculus
ctgtgttatgcacaatcagagtcct

SEQ ID NO: 278372 - DNA, 25 bp, Mus musculus
ctgtgttcagccctgacagaagcta

SEQ ID NO: 278373 - DNA, 25 bp, Mus musculus
ctgtgttcaggctcttcaaacggcg

SEQ ID NO: 278374 - DNA, 25 bp, Mus musculus
ctgtgttcatcaaactttcatggat

SEQ ID NO: 278375 - DNA, 25 bp, Mus musculus
ctgtgttccttctgcttctaccagg

SEQ ID NO: 278376 - DNA, 25 bp, Mus musculus
ctgtgttcggcaggttcgcagacca

SEQ ID NO: 278377 - DNA, 25 bp, Mus musculus
ctgtgttctagactcaagaatgaat

SEQ ID NO: 278378 - DNA, 25 bp, Mus musculus
ctgtgttctgatatagatgagtgtg

SEQ ID NO: 278379 - DNA, 25 bp, Mus musculus
ctgtgttgagcacatcgagtcacgt

SEQ ID NO: 278380 - DNA, 25 bp, Mus musculus
ctgtgttgaggtcctgagttcaatt

SEQ ID NO: 278381 - DNA, 25 bp, Mus musculus
ctgtgttgccagaaaaagatcttcc

SEQ ID NO: 278382 - DNA, 25 bp, Mus musculus
ctgtgttggcctttgagtagagtat

SEQ ID NO: 278383 - DNA, 25 bp, Mus musculus
ctgtgttggctcaggagggtgtgaa

SEQ ID NO: 278384 - DNA, 25 bp, Mus musculus
ctgtgtttactcactttcaaaactt

SEQ ID NO: 278385 - DNA, 25 bp, Mus musculus
ctgtgtttactcactttgaaaaaga

SEQ ID NO: 278386 - DNA, 25 bp, Mus musculus
ctgtgtttatggactacaaagaagg

SEQ ID NO: 278387 - DNA, 25 bp, Mus musculus
ctgtgtttattcaggtgcactgcat

SEQ ID NO: 278388 - DNA, 25 bp, Mus musculus
ctgtgtttccctacatccagaaccc

SEQ ID NO: 278389 - DNA, 25 bp, Mus musculus
ctgtgtttgaggaattattttatat

SEQ ID NO: 278390 - DNA, 25 bp, Mus musculus
ctgtgtttgaggaggtagggtctga

SEQ ID NO: 278391 - DNA, 25 bp, Mus musculus
ctgtgtttgaggaggtgtacaggaa

SEQ ID NO: 278392 - DNA, 25 bp, Mus musculus
ctgtgtttgctagagggcaatgcga

SEQ ID NO: 278393 - DNA, 25 bp, Mus musculus
ctgtgtttgtggtcctccactcttt

SEQ ID NO: 278394 - DNA, 25 bp, Mus musculus
ctgtgtttgtggtctttgctgattc

SEQ ID NO: 278395 - DNA, 25 bp, Mus musculus
ctgtgttttattggatcgtggagtt

SEQ ID NO: 278396 - DNA, 25 bp, Mus musculus
ctgtgttttgtgaagagtacccagt

SEQ ID NO: 278397 - DNA, 25 bp, Mus musculus
ctgtgttttgtgaagcctggatggt

SEQ ID NO: 278398 - DNA, 25 bp, Mus musculus
ctgttaaaatatcagaaatcatgag

SEQ ID NO: 278399 - DNA, 25 bp, Mus musculus
ctgttaaaatatcagaggctaaaga

SEQ ID NO: 278400 - DNA, 25 bp, Mus musculus
ctgttaacagcacagattctaccag

SEQ ID NO: 278401 - DNA, 25 bp, Mus musculus
ctgttaacaggacattcgacatgaa

SEQ ID NO: 278402 - DNA, 25 bp, Mus musculus
ctgttaacaggcagcaaacagaaag

SEQ ID NO: 278403 - DNA, 25 bp, Mus musculus
ctgttaacaggccatggatgcccgg

SEQ ID NO: 278404 - DNA, 25 bp, Mus musculus
ctgttaacagttcaaggcctggcag

SEQ ID NO: 278405 - DNA, 25 bp, Mus musculus
ctgttaagaaagaaacgctgcatcc

SEQ ID NO: 278406 - DNA, 25 bp, Mus musculus
ctgttaagaaagattaaagatgaac

SEQ ID NO: 278407 - DNA, 25 bp, Mus musculus
ctgttaagaaaggacaaagatgttg

SEQ ID NO: 278408 - DNA, 25 bp, Mus musculus
ctgttaatagcccacaggtcctgcc

SEQ ID NO: 278409 - DNA, 25 bp, Mus musculus
ctgttaataggtcctgcctcccaac

SEQ ID NO: 278410 - DNA, 25 bp, Mus musculus
ctgttacacagcccagggaatattg

SEQ ID NO: 278411 - DNA, 25 bp, Mus musculus
ctgttacagcaaggtggctcaggag

SEQ ID NO: 278412 - DNA, 25 bp, Mus musculus
ctgttaccaatgcaccttccagcca

SEQ ID NO: 278413 - DNA, 25 bp, Mus musculus
ctgttaccggaacagaaatcatcgt

SEQ ID NO: 278414 - DNA, 25 bp, Mus musculus
ctgttaccggaacggcacgacgcga

SEQ ID NO: 278415 - DNA, 25 bp, Mus musculus
ctgttacctcgccgagctggaattc

SEQ ID NO: 278416 - DNA, 25 bp, Mus musculus
ctgttacctcttatgccctgctgtg

SEQ ID NO: 278417 - DNA, 25 bp, Mus musculus
ctgttacctcttctggctcatcgcc

SEQ ID NO: 278418 - DNA, 25 bp, Mus musculus
ctgttacctgggcccccagattgcg

SEQ ID NO: 278419 - DNA, 25 bp, Mus musculus
ctgttacgcttgtacttcatcctgc

SEQ ID NO: 278420 - DNA, 25 bp, Mus musculus
ctgttagacagaatggcaatcccaa

SEQ ID NO: 278421 - DNA, 25 bp, Mus musculus
ctgttagacattggatgccgccttg

SEQ ID NO: 278422 - DNA, 25 bp, Mus musculus
ctgttagacattggctgcggttctg

SEQ ID NO: 278423 - DNA, 25 bp, Mus musculus
ctgttagcgagttccagaatacctt

SEQ ID NO: 278424 - DNA, 25 bp, Mus musculus
ctgttagctgaggtgccgacaatgg

SEQ ID NO: 278425 - DNA, 25 bp, Mus musculus
ctgttaggaaacagctatataaaag

SEQ ID NO: 278426 - DNA, 25 bp, Mus musculus
ctgttaggaaacagggtggactctc

SEQ ID NO: 278427 - DNA, 25 bp, Mus musculus
ctgttaggaacagcctcaggccctt

SEQ ID NO: 278428 - DNA, 25 bp, Mus musculus
ctgttaggcaccgtgggcctaacca

SEQ ID NO: 278429 - DNA, 25 bp, Mus musculus
ctgttagtaagaatcccagtaaacc

SEQ ID NO: 278430 - DNA, 25 bp, Mus musculus
ctgttagtgacctgacgttgatgtc

SEQ ID NO: 278431 - DNA, 25 bp, Mus musculus
ctgttagtgacctgactcctgggtg

SEQ ID NO: 278432 - DNA, 25 bp, Mus musculus
ctgttatctccagaagtgacagaca

SEQ ID NO: 278433 - DNA, 25 bp, Mus musculus
ctgttatgacaagcccgtctcgata

SEQ ID NO: 278434 - DNA, 25 bp, Mus musculus
ctgttatgtcagtatatgactgctg

SEQ ID NO: 278435 - DNA, 25 bp, Mus musculus
ctgttattcagctaccactacccct

SEQ ID NO: 278436 - DNA, 25 bp, Mus musculus
ctgttattcaggctttcaccactga

SEQ ID NO: 278437 - DNA, 25 bp, Mus musculus
ctgttattccagcccaggaggaaga

SEQ ID NO: 278438 - DNA, 25 bp, Mus musculus
ctgttattctggtatgggacgtttc

SEQ ID NO: 278439 - DNA, 25 bp, Mus musculus
ctgttattgaaaggtgacattccca

SEQ ID NO: 278440 - DNA, 25 bp, Mus musculus
ctgttattgaaggacctctcttgcc

SEQ ID NO: 278441 - DNA, 25 bp, Mus musculus
ctgttcaaaatcgaacaccaaacag

SEQ ID NO: 278442 - DNA, 25 bp, Mus musculus
ctgttcaacagcactgttgccaagg

SEQ ID NO: 278443 - DNA, 25 bp, Mus musculus
ctgttcaacagggaccaaatgacgt

SEQ ID NO: 278444 - DNA, 25 bp, Mus musculus
ctgttcaaccctgactctaaggggc

SEQ ID NO: 278445 - DNA, 25 bp, Mus musculus
ctgttcaccaggagctggaatttgg

SEQ ID NO: 278446 - DNA, 25 bp, Mus musculus
ctgttcactatgaagattcacagac

SEQ ID NO: 278447 - DNA, 25 bp, Mus musculus
ctgttcactcagaggcagccatgga

SEQ ID NO: 278448 - DNA, 25 bp, Mus musculus
ctgttcagagactgggtgggtcttt

SEQ ID NO: 278449 - DNA, 25 bp, Mus musculus
ctgttcagagatggtggagactgag

SEQ ID NO: 278450 - DNA, 25 bp, Mus musculus
ctgttcagagggagagccgagagca

SEQ ID NO: 278451 - DNA, 25 bp, Mus musculus
ctgttcagaggtcctgatagctccc

SEQ ID NO: 278452 - DNA, 25 bp, Mus musculus
ctgttcaggagatggtaaccaagtc

SEQ ID NO: 278453 - DNA, 25 bp, Mus musculus
ctgttcaggtgttaggggatgctgg

SEQ ID NO: 278454 - DNA, 25 bp, Mus musculus
ctgttcagtagacagtataacaaac

SEQ ID NO: 278455 - DNA, 25 bp, Mus musculus
ctgttcagtcaaggacagtggcctt

SEQ ID NO: 278456 - DNA, 25 bp, Mus musculus
ctgttcagtctcaccggctggggag

SEQ ID NO: 278457 - DNA, 25 bp, Mus musculus
ctgttcatgggagaagggcaggttt

SEQ ID NO: 278458 - DNA, 25 bp, Mus musculus
ctgttcatgggagaggggtaactat

SEQ ID NO: 278459 - DNA, 25 bp, Mus musculus
ctgttccaaccccgatgctctgaac

SEQ ID NO: 278460 - DNA, 25 bp, Mus musculus
ctgttccaccaggctgggccggtaa

SEQ ID NO: 278461 - DNA, 25 bp, Mus musculus
ctgttccaccagtatttgaggcaga

SEQ ID NO: 278462 - DNA, 25 bp, Mus musculus
ctgttccagttgcagattgaacttc

SEQ ID NO: 278463 - DNA, 25 bp, Mus musculus
ctgttccagttgcagcaggtactct

SEQ ID NO: 278464 - DNA, 25 bp, Mus musculus
ctgttccagttgcaggtacaacata

SEQ ID NO: 278465 - DNA, 25 bp, Mus musculus
ctgttccattgagatctgtgccgct

SEQ ID NO: 278466 - DNA, 25 bp, Mus musculus
ctgttcccacagatgaagtgtccta

SEQ ID NO: 278467 - DNA, 25 bp, Mus musculus
ctgttcccacagatggaacagattc

SEQ ID NO: 278468 - DNA, 25 bp, Mus musculus
ctgttcccatgagaacccctgagcc

SEQ ID NO: 278469 - DNA, 25 bp, Mus musculus
ctgttcccatggaatcattggtctg

SEQ ID NO: 278470 - DNA, 25 bp, Mus musculus
ctgttccgcaaggaggtgctggctc

SEQ ID NO: 278471 - DNA, 25 bp, Mus musculus
ctgttccgcccaagttggtcacaat

SEQ ID NO: 278472 - DNA, 25 bp, Mus musculus
ctgttcctaacactaatgagcgagt

SEQ ID NO: 278473 - DNA, 25 bp, Mus musculus
ctgttcctacggtttcacaaggtat

SEQ ID NO: 278474 - DNA, 25 bp, Mus musculus
ctgttcctagaacaggccttcgata

SEQ ID NO: 278475 - DNA, 25 bp, Mus musculus
ctgttcctaggcaaggtgctgatag

SEQ ID NO: 278476 - DNA, 25 bp, Mus musculus
ctgttcctctgaaaaggaaaagaag

SEQ ID NO: 278477 - DNA, 25 bp, Mus musculus
ctgttcctgcaaaaggctctgagtt

SEQ ID NO: 278478 - DNA, 25 bp, Mus musculus
ctgttccttccgaaccctgtgtatt

SEQ ID NO: 278479 - DNA, 25 bp, Mus musculus
ctgttccttcctggaggacgacttc

SEQ ID NO: 278480 - DNA, 25 bp, Mus musculus
ctgttcgagaggcctccaacatggg

SEQ ID NO: 278481 - DNA, 25 bp, Mus musculus
ctgttcgccagcaacatctccagca

SEQ ID NO: 278482 - DNA, 25 bp, Mus musculus
ctgttcgcgaagaatcgagatccga

SEQ ID NO: 278483 - DNA, 25 bp, Mus musculus
ctgttcgcgaagtgcgtccccacgc

SEQ ID NO: 278484 - DNA, 25 bp, Mus musculus
ctgttcgtcccagcgtcagcccagg

SEQ ID NO: 278485 - DNA, 25 bp, Mus musculus
ctgttcgttcttagaatcctattct

SEQ ID NO: 278486 - DNA, 25 bp, Mus musculus
ctgttctaaagaggacagatcacag

SEQ ID NO: 278487 - DNA, 25 bp, Mus musculus
ctgttctaaagagtaaccaggactg

SEQ ID NO: 278488 - DNA, 25 bp, Mus musculus
ctgttctaaagagtccaggtctcca

SEQ ID NO: 278489 - DNA, 25 bp, Mus musculus
ctgttctaaagagttggagaacaga

SEQ ID NO: 278490 - DNA, 25 bp, Mus musculus
ctgttctaaagatgctgaaggcatc

SEQ ID NO: 278491 - DNA, 25 bp, Mus musculus
ctgttctaaaggtgctttccagcta

SEQ ID NO: 278492 - DNA, 25 bp, Mus musculus
ctgttctacaggctgcggctgtgtt

SEQ ID NO: 278493 - DNA, 25 bp, Mus musculus
ctgttctagaagttggtagtttaca

SEQ ID NO: 278494 - DNA, 25 bp, Mus musculus
ctgttctctaattttccaggtgccg

SEQ ID NO: 278495 - DNA, 25 bp, Mus musculus
ctgttctctgatttggggatattcc

SEQ ID NO: 278496 - DNA, 25 bp, Mus musculus
ctgttctctggcgtaatagcttgga

SEQ ID NO: 278497 - DNA, 25 bp, Mus musculus
ctgttctctggtgaagaaatcttga

SEQ ID NO: 278498 - DNA, 25 bp, Mus musculus
ctgttctcttggagttctgacggga

SEQ ID NO: 278499 - DNA, 25 bp, Mus musculus
ctgttctgcagaccatcctgtcagc

SEQ ID NO: 278500 - DNA, 25 bp, Mus musculus
ctgttctgcagacgaagacatgggg

SEQ ID NO: 278501 - DNA, 25 bp, Mus musculus
ctgttctgcaggcttgcgagaaggt

SEQ ID NO: 278502 - DNA, 25 bp, Mus musculus
ctgttctgcatctcaccagcccccc

SEQ ID NO: 278503 - DNA, 25 bp, Mus musculus
ctgttctggcggatgaaatgtggca

SEQ ID NO: 278504 - DNA, 25 bp, Mus musculus
ctgttctgtatgcttcctgcgggca

SEQ ID NO: 278505 - DNA, 25 bp, Mus musculus
ctgttcttatgcctgaaaaagacct

SEQ ID NO: 278506 - DNA, 25 bp, Mus musculus
ctgttcttcagaaacaacatgccag

SEQ ID NO: 278507 - DNA, 25 bp, Mus musculus
ctgttcttcagaaacagacatctaa

SEQ ID NO: 278508 - DNA, 25 bp, Mus musculus
ctgttcttgatatacatgataatca

SEQ ID NO: 278509 - DNA, 25 bp, Mus musculus
ctgttcttgatccataacaaactga

SEQ ID NO: 278510 - DNA, 25 bp, Mus musculus
ctgttcttgcgacatttgtgacaca

SEQ ID NO: 278511 - DNA, 25 bp, Mus musculus
ctgttcttggaggagggcaatgcga

SEQ ID NO: 278512 - DNA, 25 bp, Mus musculus
ctgttcttgtggctcaggggactcc

SEQ ID NO: 278513 - DNA, 25 bp, Mus musculus
ctgttctttaaaggggactttgcca

SEQ ID NO: 278514 - DNA, 25 bp, Mus musculus
ctgttctttaaaggggagtttgtgt

SEQ ID NO: 278515 - DNA, 25 bp, Mus musculus
ctgttgaaaaaagcttatccatgac

SEQ ID NO: 278516 - DNA, 25 bp, Mus musculus
ctgttgaaactttagccacttacat

SEQ ID NO: 278517 - DNA, 25 bp, Mus musculus
ctgttgaagagcaagttgctccccg

SEQ ID NO: 278518 - DNA, 25 bp, Mus musculus
ctgttgaataagttcgtgtgtaaga

SEQ ID NO: 278519 - DNA, 25 bp, Mus musculus
ctgttgaatgaccctcttccatttt

SEQ ID NO: 278520 - DNA, 25 bp, Mus musculus
ctgttgacactcgaggatgtgaagc

SEQ ID NO: 278521 - DNA, 25 bp, Mus musculus
ctgttgacactgaagttggtgagtc

SEQ ID NO: 278522 - DNA, 25 bp, Mus musculus
ctgttgacagggtctgcagcatagt

SEQ ID NO: 278523 - DNA, 25 bp, Mus musculus
ctgttgacctggaggagatggtgga

SEQ ID NO: 278524 - DNA, 25 bp, Mus musculus
ctgttgacctggaggagctgttggg

SEQ ID NO: 278525 - DNA, 25 bp, Mus musculus
ctgttgagaagacgggatatcgctc

SEQ ID NO: 278526 - DNA, 25 bp, Mus musculus
ctgttgagcaggccacagaaggacc

SEQ ID NO: 278527 - DNA, 25 bp, Mus musculus
ctgttgagcgaagaacaaattacct

SEQ ID NO: 278528 - DNA, 25 bp, Mus musculus
ctgttgagcgaagacccttaccagg

SEQ ID NO: 278529 - DNA, 25 bp, Mus musculus
ctgttgagggaggagctttcatgga

SEQ ID NO: 278530 - DNA, 25 bp, Mus musculus
ctgttgatccacagggatggccacg

SEQ ID NO: 278531 - DNA, 25 bp, Mus musculus
ctgttgcaagagggtgaagaagctg

SEQ ID NO: 278532 - DNA, 25 bp, Mus musculus
ctgttgcaagcctacttctccctac

SEQ ID NO: 278533 - DNA, 25 bp, Mus musculus
ctgttgcaaggtgatctctgcacga

SEQ ID NO: 278534 - DNA, 25 bp, Mus musculus
ctgttgcagctatgtcaaagataag

SEQ ID NO: 278535 - DNA, 25 bp, Mus musculus
ctgttgcagtcttcgcataaggaat

SEQ ID NO: 278536 - DNA, 25 bp, Mus musculus
ctgttgcatttgcaggtcgctatgc

SEQ ID NO: 278537 - DNA, 25 bp, Mus musculus
ctgttgccaaattggctccacttac

SEQ ID NO: 278538 - DNA, 25 bp, Mus musculus
ctgttgccgtgacctttgcagatca

SEQ ID NO: 278539 - DNA, 25 bp, Mus musculus
ctgttgcgcagcgtctcctgtaacg

SEQ ID NO: 278540 - DNA, 25 bp, Mus musculus
ctgttgctcggtgcgggcgagtcag

SEQ ID NO: 278541 - DNA, 25 bp, Mus musculus
ctgttgctgctgttatttccgagag

SEQ ID NO: 278542 - DNA, 25 bp, Mus musculus
ctgttgcttcccagaggaagtcaca

SEQ ID NO: 278543 - DNA, 25 bp, Mus musculus
ctgttggaaagacagggggcagtgc

SEQ ID NO: 278544 - DNA, 25 bp, Mus musculus
ctgttggaaagacagtgtttgtaag

SEQ ID NO: 278545 - DNA, 25 bp, Mus musculus
ctgttggaaagtcgacagaggcaag

SEQ ID NO: 278546 - DNA, 25 bp, Mus musculus
ctgttggacaagccccacgcaatca

SEQ ID NO: 278547 - DNA, 25 bp, Mus musculus
ctgttggagaaacactgaggacggg

SEQ ID NO: 278548 - DNA, 25 bp, Mus musculus
ctgttggagaaactggcagagctgt

SEQ ID NO: 278549 - DNA, 25 bp, Mus musculus
ctgttggagaacggggtgaccgtgg

SEQ ID NO: 278550 - DNA, 25 bp, Mus musculus
ctgttggagcgggcggcaggaaatg

SEQ ID NO: 278551 - DNA, 25 bp, Mus musculus
ctgttggataaaggataaggtagct

SEQ ID NO: 278552 - DNA, 25 bp, Mus musculus
ctgttggattatgggtgggtgcatc

SEQ ID NO: 278553 - DNA, 25 bp, Mus musculus
ctgttggattatggtccacagtgag

SEQ ID NO: 278554 - DNA, 25 bp, Mus musculus
ctgttggcagttctggcaggtgatc

SEQ ID NO: 278555 - DNA, 25 bp, Mus musculus
ctgttggccgaggtggtcctgccga

SEQ ID NO: 278556 - DNA, 25 bp, Mus musculus
ctgttggcctctcagaaaacatcca

SEQ ID NO: 278557 - DNA, 25 bp, Mus musculus
ctgttggcctctcaggtcaaaggct

SEQ ID NO: 278558 - DNA, 25 bp, Mus musculus
ctgttggcctggtacaggaccctgg

SEQ ID NO: 278559 - DNA, 25 bp, Mus musculus
ctgttggctaatggagcccgctgtg

SEQ ID NO: 278560 - DNA, 25 bp, Mus musculus
ctgttgggaagatttctgggcttca

SEQ ID NO: 278561 - DNA, 25 bp, Mus musculus
ctgttgggaagggtctctcattgga

SEQ ID NO: 278562 - DNA, 25 bp, Mus musculus
ctgttgggagtaaatatttctacca

SEQ ID NO: 278563 - DNA, 25 bp, Mus musculus
ctgttgggcatggaaccatctggag

SEQ ID NO: 278564 - DNA, 25 bp, Mus musculus
ctgttgggcttcagcgagaactttc

SEQ ID NO: 278565 - DNA, 25 bp, Mus musculus
ctgttggggctaggtgtctccagtg

SEQ ID NO: 278566 - DNA, 25 bp, Mus musculus
ctgttggggctagtgcttatcctgg

SEQ ID NO: 278567 - DNA, 25 bp, Mus musculus
ctgttggtggcacggatggcaatgt

SEQ ID NO: 278568 - DNA, 25 bp, Mus musculus
ctgttggttggaacgaatgcctcca

SEQ ID NO: 278569 - DNA, 25 bp, Mus musculus
ctgttggttggagcatttgacattg

SEQ ID NO: 278570 - DNA, 25 bp, Mus musculus
ctgttggttggagtgctcaaggagg

SEQ ID NO: 278571 - DNA, 25 bp, Mus musculus
ctgttgtaaaatggtatggcctcac

SEQ ID NO: 278572 - DNA, 25 bp, Mus musculus
ctgttgtaaatgcagggtctcgtgg

SEQ ID NO: 278573 - DNA, 25 bp, Mus musculus
ctgttgtaaatgcagtgattgatga

SEQ ID NO: 278574 - DNA, 25 bp, Mus musculus
ctgttgtacttggccagccgtgtgg

SEQ ID NO: 278575 - DNA, 25 bp, Mus musculus
ctgttgtcatggagagaatgcctcc

SEQ ID NO: 278576 - DNA, 25 bp, Mus musculus
ctgttgtcatggaggactgtcacca

SEQ ID NO: 278577 - DNA, 25 bp, Mus musculus
ctgttgtgaataggatggagacaac

SEQ ID NO: 278578 - DNA, 25 bp, Mus musculus
ctgttgtgtagatgaacgagaccgt

SEQ ID NO: 278579 - DNA, 25 bp, Mus musculus
ctgttgttctgaggactctcattgg

SEQ ID NO: 278580 - DNA, 25 bp, Mus musculus
ctgttgttctggattccacccagaa

SEQ ID NO: 278581 - DNA, 25 bp, Mus musculus
ctgtttaaattggggtccaagtaca

SEQ ID NO: 278582 - DNA, 25 bp, Mus musculus
ctgtttaacacaaaggcaaggcagc

SEQ ID NO: 278583 - DNA, 25 bp, Mus musculus
ctgtttaatgaagactttgtatcat

SEQ ID NO: 278584 - DNA, 25 bp, Mus musculus
ctgtttaatgaagtgtcacgagcaa

SEQ ID NO: 278585 - DNA, 25 bp, Mus musculus
ctgtttaatgaggaaagactaatag

SEQ ID NO: 278586 - DNA, 25 bp, Mus musculus
ctgtttaatgaggaaggcttgttgt

SEQ ID NO: 278587 - DNA, 25 bp, Mus musculus
ctgtttaattcagattccaaggaaa

SEQ ID NO: 278588 - DNA, 25 bp, Mus musculus
ctgtttacgtaaagggcctgacaag

SEQ ID NO: 278589 - DNA, 25 bp, Mus musculus
ctgtttactcccaatatgaagactc

SEQ ID NO: 278590 - DNA, 25 bp, Mus musculus
ctgtttagaagtaacagcctccacc

SEQ ID NO: 278591 - DNA, 25 bp, Mus musculus
ctgtttatcgaggaggcagcgggcc

SEQ ID NO: 278592 - DNA, 25 bp, Mus musculus
ctgtttatctgaaggatcctaccca

SEQ ID NO: 278593 - DNA, 25 bp, Mus musculus
ctgtttcatttgggagaaccatggc

SEQ ID NO: 278594 - DNA, 25 bp, Mus musculus
ctgtttccaagctctgtccgggcct

SEQ ID NO: 278595 - DNA, 25 bp, Mus musculus
ctgtttcccaaactatgtcggacgg

SEQ ID NO: 278596 - DNA, 25 bp, Mus musculus
ctgtttcccagaccaggtcgacctc

SEQ ID NO: 278597 - DNA, 25 bp, Mus musculus
ctgtttcccagggtcccaaaggccg

SEQ ID NO: 278598 - DNA, 25 bp, Mus musculus
ctgtttcccgcgggcaaggcacgag

SEQ ID NO: 278599 - DNA, 25 bp, Mus musculus
ctgtttcccgcgggtgtcctggctg

SEQ ID NO: 278600 - DNA, 25 bp, Mus musculus
ctgtttccgagaagagtagcagctc

SEQ ID NO: 278601 - DNA, 25 bp, Mus musculus
ctgtttccgagggtcagataacact

SEQ ID NO: 278602 - DNA, 25 bp, Mus musculus
ctgtttccgggtgccatgcagaagg

SEQ ID NO: 278603 - DNA, 25 bp, Mus musculus
ctgtttcctagaagggaggtggtgt

SEQ ID NO: 278604 - DNA, 25 bp, Mus musculus
ctgtttcctccctgagaatgaggtg

SEQ ID NO: 278605 - DNA, 25 bp, Mus musculus
ctgtttcctgaactcggaaggtgaa

SEQ ID NO: 278606 - DNA, 25 bp, Mus musculus
ctgtttcctgatgcttttgggtcgc

SEQ ID NO: 278607 - DNA, 25 bp, Mus musculus
ctgtttctactctggtgaccatagc

SEQ ID NO: 278608 - DNA, 25 bp, Mus musculus
ctgtttctattgaaaccatagacag

SEQ ID NO: 278609 - DNA, 25 bp, Mus musculus
ctgtttctattgaaggtgttgttgc

SEQ ID NO: 278610 - DNA, 25 bp, Mus musculus
ctgtttctcgctggaaggctctaca

SEQ ID NO: 278611 - DNA, 25 bp, Mus musculus
ctgtttgaaaacagctcgaggctgg

SEQ ID NO: 278612 - DNA, 25 bp, Mus musculus
ctgtttgaaatggctcggttttact

SEQ ID NO: 278613 - DNA, 25 bp, Mus musculus
ctgtttgacccaagacaaggtctca

SEQ ID NO: 278614 - DNA, 25 bp, Mus musculus
ctgtttgagcagcagcaaaaagatg

SEQ ID NO: 278615 - DNA, 25 bp, Mus musculus
ctgtttgagcgatttattgccaagc

SEQ ID NO: 278616 - DNA, 25 bp, Mus musculus
ctgtttgaggcgatggattgtaagc

SEQ ID NO: 278617 - DNA, 25 bp, Mus musculus
ctgtttgagtgatgagccggcaggt

SEQ ID NO: 278618 - DNA, 25 bp, Mus musculus
ctgtttgattccagccataatcgca

SEQ ID NO: 278619 - DNA, 25 bp, Mus musculus
ctgtttgcaagaatgcatcttaaca

SEQ ID NO: 278620 - DNA, 25 bp, Mus musculus
ctgtttgcaaggtatccattatgat

SEQ ID NO: 278621 - DNA, 25 bp, Mus musculus
ctgtttgcccagatgggttttgatg

SEQ ID NO: 278622 - DNA, 25 bp, Mus musculus
ctgtttgcccagctctctgtgctat

SEQ ID NO: 278623 - DNA, 25 bp, Mus musculus
ctgtttgccgagattgctctctcac

SEQ ID NO: 278624 - DNA, 25 bp, Mus musculus
ctgtttgctcagggtgcagtgagcc

SEQ ID NO: 278625 - DNA, 25 bp, Mus musculus
ctgtttggagaaatcttcaagacct

SEQ ID NO: 278626 - DNA, 25 bp, Mus musculus
ctgtttggaggccaatgaggcgagc

SEQ ID NO: 278627 - DNA, 25 bp, Mus musculus
ctgtttggtcaggtggtacgtgggc

SEQ ID NO: 278628 - DNA, 25 bp, Mus musculus
ctgtttgtaaaagtaaaggagtgag

SEQ ID NO: 278629 - DNA, 25 bp, Mus musculus
ctgtttgtaaaattccttctgatgt

SEQ ID NO: 278630 - DNA, 25 bp, Mus musculus
ctgtttgtgacctcgtactagaaga

SEQ ID NO: 278631 - DNA, 25 bp, Mus musculus
ctgttttaaaaggattgcgggcttt

SEQ ID NO: 278632 - DNA, 25 bp, Mus musculus
ctgttttaaagcaaacggtgctggt

SEQ ID NO: 278633 - DNA, 25 bp, Mus musculus
ctgttttacaaaaggtcacaaccat

SEQ ID NO: 278634 - DNA, 25 bp, Mus musculus
ctgttttagaaccaaccgatgttac

SEQ ID NO: 278635 - DNA, 25 bp, Mus musculus
ctgttttatcctggtctctaataaa

SEQ ID NO: 278636 - DNA, 25 bp, Mus musculus
ctgttttatgagatgtccagctcgc

SEQ ID NO: 278637 - DNA, 25 bp, Mus musculus
ctgttttatggctggcctggtctgt

SEQ ID NO: 278638 - DNA, 25 bp, Mus musculus
ctgttttcacaggaactggtgacta

SEQ ID NO: 278639 - DNA, 25 bp, Mus musculus
ctgttttcagacagctggttcgatg

SEQ ID NO: 278640 - DNA, 25 bp, Mus musculus
ctgttttccccttctgttgtacttt

SEQ ID NO: 278641 - DNA, 25 bp, Mus musculus
ctgttttctccaggaaggaactcaa

SEQ ID NO: 278642 - DNA, 25 bp, Mus musculus
ctgttttctgttgagcggctgcaaa

SEQ ID NO: 278643 - DNA, 25 bp, Mus musculus
ctgttttgaaacatgtccacctcgt

SEQ ID NO: 278644 - DNA, 25 bp, Mus musculus
ctgttttgaagattaaaggttgcac

SEQ ID NO: 278645 - DNA, 25 bp, Mus musculus
ctgttttgatgattccaagagcaga

SEQ ID NO: 278646 - DNA, 25 bp, Mus musculus
ctgttttgctttgtttacagacctg

SEQ ID NO: 278647 - DNA, 25 bp, Mus musculus
ctgttttggaatgagagacatgtct

SEQ ID NO: 278648 - DNA, 25 bp, Mus musculus
ctgttttgtgaaggacaaggctaca

SEQ ID NO: 278649 - DNA, 25 bp, Mus musculus
ctgttttgttgctttcccagcacta

SEQ ID NO: 278650 - DNA, 25 bp, Mus musculus
ctgtttttacttcgcggagtgctct

SEQ ID NO: 278651 - DNA, 25 bp, Mus musculus
ctgtttttccaaggagtgtggggcc

SEQ ID NO: 278652 - DNA, 25 bp, Mus musculus
ctgtttttcctcagagcccagatgc

SEQ ID NO: 278653 - DNA, 25 bp, Mus musculus
ctgtttttgaagagctacagacagt

SEQ ID NO: 278654 - DNA, 25 bp, Mus musculus
ctgtttttgttgtacggacattgct

SEQ ID NO: 278655 - DNA, 25 bp, Mus musculus
ctgttttttagcacaatggaaggtc

SEQ ID NO: 278656 - DNA, 25 bp, Mus musculus
ctgttttttcaggatgacttgatta

SEQ ID NO: 278657 - DNA, 25 bp, Mus musculus
cttaaaaaagaatccatgcccagaa

SEQ ID NO: 278658 - DNA, 25 bp, Mus musculus
cttaaaaaaggatgctcatgtggac

SEQ ID NO: 278659 - DNA, 25 bp, Mus musculus
cttaaaaagacttggtgattgggat

SEQ ID NO: 278660 - DNA, 25 bp, Mus musculus
cttaaaaagtgcttctctctgaatc

SEQ ID NO: 278661 - DNA, 25 bp, Mus musculus
cttaaaaatgcaccaacaattctct

SEQ ID NO: 278662 - DNA, 25 bp, Mus musculus
cttaaaacaagtgcctccaaaacca

SEQ ID NO: 278663 - DNA, 25 bp, Mus musculus
cttaaaacaagtgttttgtcaagtt

SEQ ID NO: 278664 - DNA, 25 bp, Mus musculus
cttaaaactctgcgaggcagaggct

SEQ ID NO: 278665 - DNA, 25 bp, Mus musculus
cttaaaagaggtctggaagactccc

SEQ ID NO: 278666 - DNA, 25 bp, Mus musculus
cttaaaagatactgagagaagtgtg

SEQ ID NO: 278667 - DNA, 25 bp, Mus musculus
cttaaaagatgattcataataccca

SEQ ID NO: 278668 - DNA, 25 bp, Mus musculus
cttaaaatcaggaaattttgccaaa

SEQ ID NO: 278669 - DNA, 25 bp, Mus musculus
cttaaaatcaggcagggagaagaaa

SEQ ID NO: 278670 - DNA, 25 bp, Mus musculus
cttaaaattgcctgtacacagagtt

SEQ ID NO: 278671 - DNA, 25 bp, Mus musculus
cttaaaatttggattcctgtctctg

SEQ ID NO: 278672 - DNA, 25 bp, Mus musculus
cttaaacaacctagagcttcaggat

SEQ ID NO: 278673 - DNA, 25 bp, Mus musculus
cttaaacaagatccatgcatacaac

SEQ ID NO: 278674 - DNA, 25 bp, Mus musculus
cttaaacaagcaataccttctgaca

SEQ ID NO: 278675 - DNA, 25 bp, Mus musculus
cttaaacaggtcaaggagagtgtca

SEQ ID NO: 278676 - DNA, 25 bp, Mus musculus
cttaaacataaaggtgactgatttt

SEQ ID NO: 278677 - DNA, 25 bp, Mus musculus
cttaaaccagaatgcatacacagcc

SEQ ID NO: 278678 - DNA, 25 bp, Mus musculus
cttaaaccaggtttgcatgcagcct

SEQ ID NO: 278679 - DNA, 25 bp, Mus musculus
cttaaactcggtgtgtatgaagccc

SEQ ID NO: 278680 - DNA, 25 bp, Mus musculus
cttaaactgggagtgtgtgccgaca

SEQ ID NO: 278681 - DNA, 25 bp, Mus musculus
cttaaagacgatgaacgtgtcgtgg

SEQ ID NO: 278682 - DNA, 25 bp, Mus musculus
cttaaagagcatgaaagccaaagca

SEQ ID NO: 278683 - DNA, 25 bp, Mus musculus
cttaaagagcatggacggagattac

SEQ ID NO: 278684 - DNA, 25 bp, Mus musculus
cttaaagagggcttggggcatatct

SEQ ID NO: 278685 - DNA, 25 bp, Mus musculus
cttaaagatgaggtcctgtaataaa

SEQ ID NO: 278686 - DNA, 25 bp, Mus musculus
cttaaagatggaggcgccgaggaga

SEQ ID NO: 278687 - DNA, 25 bp, Mus musculus
cttaaagatggcttgtccatgcgat

SEQ ID NO: 278688 - DNA, 25 bp, Mus musculus
cttaaagatgggggctgaggcgatg

SEQ ID NO: 278689 - DNA, 25 bp, Mus musculus
cttaaagctggcgagcttctgcagt

SEQ ID NO: 278690 - DNA, 25 bp, Mus musculus
cttaaagctggcggtccccaaccat

SEQ ID NO: 278691 - DNA, 25 bp, Mus musculus
cttaaaggagagcttgaacttggag

SEQ ID NO: 278692 - DNA, 25 bp, Mus musculus
cttaaataaaggtatggcctcacat

SEQ ID NO: 278693 - DNA, 25 bp, Mus musculus
cttaaatcgggagagtgtgctgggc

SEQ ID NO: 278694 - DNA, 25 bp, Mus musculus
cttaaatctggggaaggaagccagc

SEQ ID NO: 278695 - DNA, 25 bp, Mus musculus
cttaaatctggttaactatttgtaa

SEQ ID NO: 278696 - DNA, 25 bp, Mus musculus
cttaaatctgttcacacagaagatg

SEQ ID NO: 278697 - DNA, 25 bp, Mus musculus
cttaaattgagtaggaagagtggtg

SEQ ID NO: 278698 - DNA, 25 bp, Mus musculus
cttaaattgctcaagagacatttta

SEQ ID NO: 278699 - DNA, 25 bp, Mus musculus
cttaaattgctcaagagtcctaaac

SEQ ID NO: 278700 - DNA, 25 bp, Mus musculus
cttaaattgggaagatgctggtggt

SEQ ID NO: 278701 - DNA, 25 bp, Mus musculus
cttaaattgggtgcttccaatagtc

SEQ ID NO: 278702 - DNA, 25 bp, Mus musculus
cttaaattggttctactagtgctcc

SEQ ID NO: 278703 - DNA, 25 bp, Mus musculus
cttaacaagcacaatgggtgtgttt

SEQ ID NO: 278704 - DNA, 25 bp, Mus musculus
cttaacacaagaaggctacatggat

SEQ ID NO: 278705 - DNA, 25 bp, Mus musculus
cttaacacctgcagatgcaagttgt

SEQ ID NO: 278706 - DNA, 25 bp, Mus musculus
cttaacacgaccaggtctcccagtg

SEQ ID NO: 278707 - DNA, 25 bp, Mus musculus
cttaacagaaaaggagtgtgtgagg

SEQ ID NO: 278708 - DNA, 25 bp, Mus musculus
cttaacagaacaggagtgtgtgagg

SEQ ID NO: 278709 - DNA, 25 bp, Mus musculus
cttaacagcaggctctctggagtcc

SEQ ID NO: 278710 - DNA, 25 bp, Mus musculus
cttaacagcgttggcctggaacagc

SEQ ID NO: 278711 - DNA, 25 bp, Mus musculus
cttaacagtgaaagatttccgagta

SEQ ID NO: 278712 - DNA, 25 bp, Mus musculus
cttaacagtgaggaatgatattgcc

SEQ ID NO: 278713 - DNA, 25 bp, Mus musculus
cttaacatgaaggaccttctgtcat

SEQ ID NO: 278714 - DNA, 25 bp, Mus musculus
cttaacatggagatgagtgtgaatg

SEQ ID NO: 278715 - DNA, 25 bp, Mus musculus
cttaacatggaggaccctctgtcat

SEQ ID NO: 278716 - DNA, 25 bp, Mus musculus
cttaaccaaagaggatatagatctg

SEQ ID NO: 278717 - DNA, 25 bp, Mus musculus
cttaaccaaggacattcactgaaca

SEQ ID NO: 278718 - DNA, 25 bp, Mus musculus
cttaaccaagggatgactggcaatt

SEQ ID NO: 278719 - DNA, 25 bp, Mus musculus
cttaaccctgcaactgatgagatgc

SEQ ID NO: 278720 - DNA, 25 bp, Mus musculus
cttaacctagagcgggtgactgaga

SEQ ID NO: 278721 - DNA, 25 bp, Mus musculus
cttaacgctgttggtcagaaaacac

SEQ ID NO: 278722 - DNA, 25 bp, Mus musculus
cttaacggtgtgcagttcatggacc

SEQ ID NO: 278723 - DNA, 25 bp, Mus musculus
cttaacgtcggctgcccgctttgag

SEQ ID NO: 278724 - DNA, 25 bp, Mus musculus
cttaactgatgtgccggtgaatccg

SEQ ID NO: 278725 - DNA, 25 bp, Mus musculus
cttaactggagttggtcgaattatg

SEQ ID NO: 278726 - DNA, 25 bp, Mus musculus
cttaactggtatgatcctcatgggt

SEQ ID NO: 278727 - DNA, 25 bp, Mus musculus
cttaactttcatagatcctgaaggg

SEQ ID NO: 278728 - DNA, 25 bp, Mus musculus
cttaagaaagaatgggaaacagcac

SEQ ID NO: 278729 - DNA, 25 bp, Mus musculus
cttaagaaatgctgcggcaccatta

SEQ ID NO: 278730 - DNA, 25 bp, Mus musculus
cttaagaagaaagcagcacacacag

SEQ ID NO: 278731 - DNA, 25 bp, Mus musculus
cttaagaagaaaggactgacagacg

SEQ ID NO: 278732 - DNA, 25 bp, Mus musculus
cttaagaccagagtagcttatctac

SEQ ID NO: 278733 - DNA, 25 bp, Mus musculus
cttaagaccattcaaatccctgagc

SEQ ID NO: 278734 - DNA, 25 bp, Mus musculus
cttaagactggcctgctgcaaaaat

SEQ ID NO: 278735 - DNA, 25 bp, Mus musculus
cttaagagaaggtgttaggagtgga

SEQ ID NO: 278736 - DNA, 25 bp, Mus musculus
cttaagaggaggtccttgttcacca

SEQ ID NO: 278737 - DNA, 25 bp, Mus musculus
cttaagcacagaaggtgggactggg

SEQ ID NO: 278738 - DNA, 25 bp, Mus musculus
cttaagctcttacaggcaccaacag

SEQ ID NO: 278739 - DNA, 25 bp, Mus musculus
cttaaggaactgaaggagtctttgt

SEQ ID NO: 278740 - DNA, 25 bp, Mus musculus
cttaaggagagctaacatttagagg

SEQ ID NO: 278741 - DNA, 25 bp, Mus musculus
cttaaggagagctcacattcagggg

SEQ ID NO: 278742 - DNA, 25 bp, Mus musculus
cttaaggagctaagggaacaattaa

SEQ ID NO: 278743 - DNA, 25 bp, Mus musculus
cttaaggatgtggtccttctggctt

SEQ ID NO: 278744 - DNA, 25 bp, Mus musculus
cttaagggacagcaaggagtccgtg

SEQ ID NO: 278745 - DNA, 25 bp, Mus musculus
cttaagtacatggcgcagcagcagt

SEQ ID NO: 278746 - DNA, 25 bp, Mus musculus
cttaagtaccagctgctggacggag

SEQ ID NO: 278747 - DNA, 25 bp, Mus musculus
cttaagtaccaggtgctggacggag

SEQ ID NO: 278748 - DNA, 25 bp, Mus musculus
cttaagtatttgatgctggagaagc

SEQ ID NO: 278749 - DNA, 25 bp, Mus musculus
cttaagtatttggctcagtgtttag

SEQ ID NO: 278750 - DNA, 25 bp, Mus musculus
cttaagtgaggacaggcttttgatt

SEQ ID NO: 278751 - DNA, 25 bp, Mus musculus
cttaagttcaggtcagaggaacgcc

SEQ ID NO: 278752 - DNA, 25 bp, Mus musculus
cttaagttccagtggtaactcataa

SEQ ID NO: 278753 - DNA, 25 bp, Mus musculus
cttaagtttatgaattcctcagaga

SEQ ID NO: 278754 - DNA, 25 bp, Mus musculus
cttaagtttatggctgcagttccgg

SEQ ID NO: 278755 - DNA, 25 bp, Mus musculus
cttaagtttatgtgctctatgccca

SEQ ID NO: 278756 - DNA, 25 bp, Mus musculus
cttaataaagaagatatgcacctat

SEQ ID NO: 278757 - DNA, 25 bp, Mus musculus
cttaatactgcttaagtatttttct

SEQ ID NO: 278758 - DNA, 25 bp, Mus musculus
cttaatataacttgcaccgattagc

SEQ ID NO: 278759 - DNA, 25 bp, Mus musculus
cttaatattaaagagtccttcactc

SEQ ID NO: 278760 - DNA, 25 bp, Mus musculus
cttaatcaccaaggtcacgtgaaac

SEQ ID NO: 278761 - DNA, 25 bp, Mus musculus
cttaatcaccgtcattacccaaaca

SEQ ID NO: 278762 - DNA, 25 bp, Mus musculus
cttaatccaggaagcatttgtcaag

SEQ ID NO: 278763 - DNA, 25 bp, Mus musculus
cttaatcttccttcctactagacgt

SEQ ID NO: 278764 - DNA, 25 bp, Mus musculus
cttaatgaaaagtatttttctgacc

SEQ ID NO: 278765 - DNA, 25 bp, Mus musculus
cttaatgaaacccacagcactggtc

SEQ ID NO: 278766 - DNA, 25 bp, Mus musculus
cttaatgaactaaagcttgacaaaa

SEQ ID NO: 278767 - DNA, 25 bp, Mus musculus
cttaatgacaaattaaaagagatgt

SEQ ID NO: 278768 - DNA, 25 bp, Mus musculus
cttaatgagatcctcacattagctt

SEQ ID NO: 278769 - DNA, 25 bp, Mus musculus
cttaatgagtaagtggcttgcagcg

SEQ ID NO: 278770 - DNA, 25 bp, Mus musculus
cttaatgcggttacgaagaagagga

SEQ ID NO: 278771 - DNA, 25 bp, Mus musculus
cttaatgggtctggttctccacatg

SEQ ID NO: 278772 - DNA, 25 bp, Mus musculus
cttaatgtaccagctcaaacaggcc

SEQ ID NO: 278773 - DNA, 25 bp, Mus musculus
cttaatgtaccagtgtatctctatg

SEQ ID NO: 278774 - DNA, 25 bp, Mus musculus
cttaatgtcagccataacaaactga

SEQ ID NO: 278775 - DNA, 25 bp, Mus musculus
cttaatgtttgtgtgtctaaacagc

SEQ ID NO: 278776 - DNA, 25 bp, Mus musculus
cttaattaagaacattacttcatat

SEQ ID NO: 278777 - DNA, 25 bp, Mus musculus
cttaattcctgaggtaaaggggaat

SEQ ID NO: 278778 - DNA, 25 bp, Mus musculus
cttaattcctgaggttcttaatatg

SEQ ID NO: 278779 - DNA, 25 bp, Mus musculus
cttaattctggcagttaaaccagag

SEQ ID NO: 278780 - DNA, 25 bp, Mus musculus
cttaattgagaaggcatacaaatgc

SEQ ID NO: 278781 - DNA, 25 bp, Mus musculus
cttacaaatcaggagtatacaagca

SEQ ID NO: 278782 - DNA, 25 bp, Mus musculus
cttacaacaacctgaaggagctcca

SEQ ID NO: 278783 - DNA, 25 bp, Mus musculus
cttacaagaagacttgcctaacgat

SEQ ID NO: 278784 - DNA, 25 bp, Mus musculus
cttacaagaagagtaccagcctcac

SEQ ID NO: 278785 - DNA, 25 bp, Mus musculus
cttacaagaaggatgagaacaagtt

SEQ ID NO: 278786 - DNA, 25 bp, Mus musculus
cttacaagagcctcaggacagcatt

SEQ ID NO: 278787 - DNA, 25 bp, Mus musculus
cttacaagagggggaaggacttgaa

SEQ ID NO: 278788 - DNA, 25 bp, Mus musculus
cttacaagtggatgaacagccagtc

SEQ ID NO: 278789 - DNA, 25 bp, Mus musculus
cttacaatcaagatttctgaccgag

SEQ ID NO: 278790 - DNA, 25 bp, Mus musculus
cttacaatcaagttttctgaccgag

SEQ ID NO: 278791 - DNA, 25 bp, Mus musculus
cttacaatgggagatgatggccctt

SEQ ID NO: 278792 - DNA, 25 bp, Mus musculus
cttacaatgggaggtgctggatagt

SEQ ID NO: 278793 - DNA, 25 bp, Mus musculus
cttacaatgggagtgaacacggatt

SEQ ID NO: 278794 - DNA, 25 bp, Mus musculus
cttacacaaacagatctttgagggg

SEQ ID NO: 278795 - DNA, 25 bp, Mus musculus
cttacacaaacagtcaaagcagtcc

SEQ ID NO: 278796 - DNA, 25 bp, Mus musculus
cttacacacaggctgagggtatcgc

SEQ ID NO: 278797 - DNA, 25 bp, Mus musculus
cttacacatacagagttcgttatct

SEQ ID NO: 278798 - DNA, 25 bp, Mus musculus
cttacacatgtgcacattttactgt

SEQ ID NO: 278799 - DNA, 25 bp, Mus musculus
cttacacattgcggatagagacatc

SEQ ID NO: 278800 - DNA, 25 bp, Mus musculus
cttacacctcgttttactgcaatca

SEQ ID NO: 278801 - DNA, 25 bp, Mus musculus
cttacacttcaacggtctgagcgca

SEQ ID NO: 278802 - DNA, 25 bp, Mus musculus
cttacacttcaagatgtttgatgtg

SEQ ID NO: 278803 - DNA, 25 bp, Mus musculus
cttacagaagtaccctcctccactg

SEQ ID NO: 278804 - DNA, 25 bp, Mus musculus
cttacagaagttactggacagtgac

SEQ ID NO: 278805 - DNA, 25 bp, Mus musculus
cttacagacgggctgactcctcact

SEQ ID NO: 278806 - DNA, 25 bp, Mus musculus
cttacagacgggctttgctgttggt

SEQ ID NO: 278807 - DNA, 25 bp, Mus musculus
cttacagagcagcagaaaattgtcc

SEQ ID NO: 278808 - DNA, 25 bp, Mus musculus
cttacagagctatctaaactctgtt

SEQ ID NO: 278809 - DNA, 25 bp, Mus musculus
cttacagataaagaggactcacgga

SEQ ID NO: 278810 - DNA, 25 bp, Mus musculus
cttacagataaagaggtgctaggac

SEQ ID NO: 278811 - DNA, 25 bp, Mus musculus
cttacagataaagagtgtgactggc

SEQ ID NO: 278812 - DNA, 25 bp, Mus musculus
cttacagatccagggagcatggcac

SEQ ID NO: 278813 - DNA, 25 bp, Mus musculus
cttacagcacacaggcagaggtgtt

SEQ ID NO: 278814 - DNA, 25 bp, Mus musculus
cttacagcaggtggccccttctgcc

SEQ ID NO: 278815 - DNA, 25 bp, Mus musculus
cttacagcccaagcagccacctaga

SEQ ID NO: 278816 - DNA, 25 bp, Mus musculus
cttacagctattgcgtctgcaccag

SEQ ID NO: 278817 - DNA, 25 bp, Mus musculus
cttacagctcacagaaggacatggc

SEQ ID NO: 278818 - DNA, 25 bp, Mus musculus
cttacagctcagcaaatggagacag

SEQ ID NO: 278819 - DNA, 25 bp, Mus musculus
cttacagctcagcaacaagaagaaa

SEQ ID NO: 278820 - DNA, 25 bp, Mus musculus
cttacagctcaggaaatggagacag

SEQ ID NO: 278821 - DNA, 25 bp, Mus musculus
cttacagctcaggaacaagaagaaa

SEQ ID NO: 278822 - DNA, 25 bp, Mus musculus
cttacagctctttaggtctgaacgg

SEQ ID NO: 278823 - DNA, 25 bp, Mus musculus
cttacaggagccaggccacagagga

SEQ ID NO: 278824 - DNA, 25 bp, Mus musculus
cttacaggaggttgtgccagccatt

SEQ ID NO: 278825 - DNA, 25 bp, Mus musculus
cttacaggtaaacagggattcgata

SEQ ID NO: 278826 - DNA, 25 bp, Mus musculus
cttacagtaacagaggtgataagat

SEQ ID NO: 278827 - DNA, 25 bp, Mus musculus
cttacagtaacagagttgacagttc

SEQ ID NO: 278828 - DNA, 25 bp, Mus musculus
cttacagtaagaggtaaagttcaag

SEQ ID NO: 278829 - DNA, 25 bp, Mus musculus
cttacagtaaggggctccacgggcc

SEQ ID NO: 278830 - DNA, 25 bp, Mus musculus
cttacagtggaatgggcctgctccg

SEQ ID NO: 278831 - DNA, 25 bp, Mus musculus
cttacagtgggaagacatgggatct

SEQ ID NO: 278832 - DNA, 25 bp, Mus musculus
cttacagttaaggaagctgtgctga

SEQ ID NO: 278833 - DNA, 25 bp, Mus musculus
cttacagtttcagagtttctaagct

SEQ ID NO: 278834 - DNA, 25 bp, Mus musculus
cttacataggcaaggatagttcatg

SEQ ID NO: 278835 - DNA, 25 bp, Mus musculus
cttacatataataagaacctatggg

SEQ ID NO: 278836 - DNA, 25 bp, Mus musculus
cttacatatataaataaataaatct

SEQ ID NO: 278837 - DNA, 25 bp, Mus musculus
cttacatcacggagaatgtactggt

SEQ ID NO: 278838 - DNA, 25 bp, Mus musculus
cttacatggaaggaggcatggagaa

SEQ ID NO: 278839 - DNA, 25 bp, Mus musculus
cttacatggaagggcgtggagctgg

SEQ ID NO: 278840 - DNA, 25 bp, Mus musculus
cttacattcaatgctcagtgctgcc

SEQ ID NO: 278841 - DNA, 25 bp, Mus musculus
cttaccaaaaggatatccaggtacc

SEQ ID NO: 278842 - DNA, 25 bp, Mus musculus
cttaccaaaaggtacctgtgtgccc

SEQ ID NO: 278843 - DNA, 25 bp, Mus musculus
cttaccaaagaggaattcaagggct

SEQ ID NO: 278844 - DNA, 25 bp, Mus musculus
cttaccaacagggagtacaccttta

SEQ ID NO: 278845 - DNA, 25 bp, Mus musculus
cttaccaacagtctcaagaaggatc

SEQ ID NO: 278846 - DNA, 25 bp, Mus musculus
cttaccaatcccagtgactctggac

SEQ ID NO: 278847 - DNA, 25 bp, Mus musculus
cttaccaatgaagacagttgattca

SEQ ID NO: 278848 - DNA, 25 bp, Mus musculus
cttaccacaaggagccagaactaca

SEQ ID NO: 278849 - DNA, 25 bp, Mus musculus
cttaccacagaatccagattctctt

SEQ ID NO: 278850 - DNA, 25 bp, Mus musculus
cttaccacaggctccaagattttaa

SEQ ID NO: 278851 - DNA, 25 bp, Mus musculus
cttaccacaggtgctacttttccat

SEQ ID NO: 278852 - DNA, 25 bp, Mus musculus
cttaccacctgtggtggactggtga

SEQ ID NO: 278853 - DNA, 25 bp, Mus musculus
cttaccagaagcagtgcgatgactt

SEQ ID NO: 278854 - DNA, 25 bp, Mus musculus
cttaccagacactaatctgacccca

SEQ ID NO: 278855 - DNA, 25 bp, Mus musculus
cttaccagacactgcacaagggcac

SEQ ID NO: 278856 - DNA, 25 bp, Mus musculus
cttaccagctagaaacgagatgtcc

SEQ ID NO: 278857 - DNA, 25 bp, Mus musculus
cttaccagctagaaacttctcctct

SEQ ID NO: 278858 - DNA, 25 bp, Mus musculus
cttaccaggaagcatctgtctgagc

SEQ ID NO: 278859 - DNA, 25 bp, Mus musculus
cttaccagtgaggctgtgtctactc

SEQ ID NO: 278860 - DNA, 25 bp, Mus musculus
cttaccatagaagtacctcaaatcg

SEQ ID NO: 278861 - DNA, 25 bp, Mus musculus
cttaccatagaagttgctcctttgg

SEQ ID NO: 278862 - DNA, 25 bp, Mus musculus
cttaccatcataacagcactaccac

SEQ ID NO: 278863 - DNA, 25 bp, Mus musculus
cttaccatcataggccagttcacaa

SEQ ID NO: 278864 - DNA, 25 bp, Mus musculus
cttaccatgaggatccagcaatgcc

SEQ ID NO: 278865 - DNA, 25 bp, Mus musculus
cttaccatggcattgatatgaacca

SEQ ID NO: 278866 - DNA, 25 bp, Mus musculus
cttaccatgggaaggtgtcttgctg

SEQ ID NO: 278867 - DNA, 25 bp, Mus musculus
cttaccatgggcttcactgtataaa

SEQ ID NO: 278868 - DNA, 25 bp, Mus musculus
cttaccattgatcatgctactaatc

SEQ ID NO: 278869 - DNA, 25 bp, Mus musculus
cttacccaaagcccacctggaagca

SEQ ID NO: 278870 - DNA, 25 bp, Mus musculus
cttacccaacttcaggtaccaatgg

SEQ ID NO: 278871 - DNA, 25 bp, Mus musculus
cttacccagtggggtacatgtaccc

SEQ ID NO: 278872 - DNA, 25 bp, Mus musculus
cttaccccatggaggttatttttga

SEQ ID NO: 278873 - DNA, 25 bp, Mus musculus
cttaccctagccagcataattaaat

SEQ ID NO: 278874 - DNA, 25 bp, Mus musculus
cttaccctagccagggttgatttct

SEQ ID NO: 278875 - DNA, 25 bp, Mus musculus
cttaccctccgaagctctggatggg

SEQ ID NO: 278876 - DNA, 25 bp, Mus musculus
cttacctccagaacccgctcagttg

SEQ ID NO: 278877 - DNA, 25 bp, Mus musculus
cttacctctggaaggcatcagtttg

SEQ ID NO: 278878 - DNA, 25 bp, Mus musculus
cttacctctgtcccaattcacaggt

SEQ ID NO: 278879 - DNA, 25 bp, Mus musculus
cttacctgagagcactgtggacaag

SEQ ID NO: 278880 - DNA, 25 bp, Mus musculus
cttacctgagcacagttcccagagg

SEQ ID NO: 278881 - DNA, 25 bp, Mus musculus
cttacctgcaaagtaacagcctcca

SEQ ID NO: 278882 - DNA, 25 bp, Mus musculus
cttacctgcctggaaagccaacagg

SEQ ID NO: 278883 - DNA, 25 bp, Mus musculus
cttacctgcctgggtctgggatctg

SEQ ID NO: 278884 - DNA, 25 bp, Mus musculus
cttacctggagagagttcacctttt

SEQ ID NO: 278885 - DNA, 25 bp, Mus musculus
cttaccttaccactgagatactaga

SEQ ID NO: 278886 - DNA, 25 bp, Mus musculus
cttaccttctggattcttggcgccc

SEQ ID NO: 278887 - DNA, 25 bp, Mus musculus
cttacgaaggaagtggttccagcat

SEQ ID NO: 278888 - DNA, 25 bp, Mus musculus
cttacgactacagaagtgacctcta

SEQ ID NO: 278889 - DNA, 25 bp, Mus musculus
cttacgactacagaagtgacctctg

SEQ ID NO: 278890 - DNA, 25 bp, Mus musculus
cttacgctcagacagtccagggccc

SEQ ID NO: 278891 - DNA, 25 bp, Mus musculus
cttacgctctcctactccgtggtgt

SEQ ID NO: 278892 - DNA, 25 bp, Mus musculus
cttacggaagcttggtaatgcaggt

SEQ ID NO: 278893 - DNA, 25 bp, Mus musculus
cttacggactaggccagcaggtggc

SEQ ID NO: 278894 - DNA, 25 bp, Mus musculus
cttacggactagggccctgcacaca

SEQ ID NO: 278895 - DNA, 25 bp, Mus musculus
cttacggactaggtggccatcaaga

SEQ ID NO: 278896 - DNA, 25 bp, Mus musculus
cttacggcaaagtctcatacatccc

SEQ ID NO: 278897 - DNA, 25 bp, Mus musculus
cttacggcttgtcacattcccacga

SEQ ID NO: 278898 - DNA, 25 bp, Mus musculus
cttacgtcattgggaggaaaactcc

SEQ ID NO: 278899 - DNA, 25 bp, Mus musculus
cttacgtcattgggtgggtgttcgt

SEQ ID NO: 278900 - DNA, 25 bp, Mus musculus
cttactacagctgggcatggcagac

SEQ ID NO: 278901 - DNA, 25 bp, Mus musculus
cttactacaggaatgagtgccactt

SEQ ID NO: 278902 - DNA, 25 bp, Mus musculus
cttactacaggtggctgcggcttcc

SEQ ID NO: 278903 - DNA, 25 bp, Mus musculus
cttactatctgacaggatggcttgc

SEQ ID NO: 278904 - DNA, 25 bp, Mus musculus
cttactatgaaaagggatggatctt

SEQ ID NO: 278905 - DNA, 25 bp, Mus musculus
cttactatgaaaaggtgacgtgcac

SEQ ID NO: 278906 - DNA, 25 bp, Mus musculus
cttactcccaagactctgaggtcca

SEQ ID NO: 278907 - DNA, 25 bp, Mus musculus
cttactcccaagatggctgtctcaa

SEQ ID NO: 278908 - DNA, 25 bp, Mus musculus
cttactcccaagcccctggaccttc

SEQ ID NO: 278909 - DNA, 25 bp, Mus musculus
cttactccgtggcgaatctcattag

SEQ ID NO: 278910 - DNA, 25 bp, Mus musculus
cttactctcccagcatgctggacta

SEQ ID NO: 278911 - DNA, 25 bp, Mus musculus
cttactctcttagcagtgaagcaga

SEQ ID NO: 278912 - DNA, 25 bp, Mus musculus
cttactgaactgatggctgcccaag

SEQ ID NO: 278913 - DNA, 25 bp, Mus musculus
cttactgacagcttttttattaagc

SEQ ID NO: 278914 - DNA, 25 bp, Mus musculus
cttactgacagtgtacactcttttc

SEQ ID NO: 278915 - DNA, 25 bp, Mus musculus
cttactgacagttgaacaccagtgt

SEQ ID NO: 278916 - DNA, 25 bp, Mus musculus
cttactgcaccgatcctagttccgt

SEQ ID NO: 278917 - DNA, 25 bp, Mus musculus
cttactgcagcagcttcaaactgtt

SEQ ID NO: 278918 - DNA, 25 bp, Mus musculus
cttactgcagcaggagtgtgataat

SEQ ID NO: 278919 - DNA, 25 bp, Mus musculus
cttactgccaagatatagatgagtg

SEQ ID NO: 278920 - DNA, 25 bp, Mus musculus
cttactgctttgactgtactccctc

SEQ ID NO: 278921 - DNA, 25 bp, Mus musculus
cttactggaagattatcctgtcctt

SEQ ID NO: 278922 - DNA, 25 bp, Mus musculus
cttactggactatccgatacacctc

SEQ ID NO: 278923 - DNA, 25 bp, Mus musculus
cttactggccgcagcaagaacaagt

SEQ ID NO: 278924 - DNA, 25 bp, Mus musculus
cttactggcctttcaggcagcaaga

SEQ ID NO: 278925 - DNA, 25 bp, Mus musculus
cttactgtcccgagaaggtgtaggg

SEQ ID NO: 278926 - DNA, 25 bp, Mus musculus
cttactgtgagcgtgcaatgatgcg

SEQ ID NO: 278927 - DNA, 25 bp, Mus musculus
cttactgttcttgatatacatgata

SEQ ID NO: 278928 - DNA, 25 bp, Mus musculus
cttactgttcttgatccataacaaa

SEQ ID NO: 278929 - DNA, 25 bp, Mus musculus
cttacttaaaggaagtggaacaact

SEQ ID NO: 278930 - DNA, 25 bp, Mus musculus
cttacttaaggaactcagagaaagc

SEQ ID NO: 278931 - DNA, 25 bp, Mus musculus
cttacttcagccctgcattttgcag

SEQ ID NO: 278932 - DNA, 25 bp, Mus musculus
cttacttccctgcaattttgaaccc

SEQ ID NO: 278933 - DNA, 25 bp, Mus musculus
cttacttctacagtgatggagaaag

SEQ ID NO: 278934 - DNA, 25 bp, Mus musculus
cttacttctgcccgggctgagcgcc

SEQ ID NO: 278935 - DNA, 25 bp, Mus musculus
cttacttctgcccggtgctggccac

SEQ ID NO: 278936 - DNA, 25 bp, Mus musculus
cttacttctttcaggtactcatgtg

SEQ ID NO: 278937 - DNA, 25 bp, Mus musculus
cttacttgtgaaactataagcagca

SEQ ID NO: 278938 - DNA, 25 bp, Mus musculus
cttactttgataagaatggcaatcc

SEQ ID NO: 278939 - DNA, 25 bp, Mus musculus
cttactttgataaggatggcattgt

SEQ ID NO: 278940 - DNA, 25 bp, Mus musculus
cttagaaaatattggattggaagcc

SEQ ID NO: 278941 - DNA, 25 bp, Mus musculus
cttagaaagagcaactgtcctgtcc

SEQ ID NO: 278942 - DNA, 25 bp, Mus musculus
cttagaacaagatttaccggacagc

SEQ ID NO: 278943 - DNA, 25 bp, Mus musculus
cttagaaccaccataacacaaagac

SEQ ID NO: 278944 - DNA, 25 bp, Mus musculus
cttagaactgtggagtatcacggtg

SEQ ID NO: 278945 - DNA, 25 bp, Mus musculus
cttagaagaaagttggggctgtgcg

SEQ ID NO: 278946 - DNA, 25 bp, Mus musculus
cttagaagatggagatcagccagat

SEQ ID NO: 278947 - DNA, 25 bp, Mus musculus
cttagaagatggagatggctcttgg

SEQ ID NO: 278948 - DNA, 25 bp, Mus musculus
cttagaagcagaatggaatgaccta

SEQ ID NO: 278949 - DNA, 25 bp, Mus musculus
cttagaatatgaagctttggttcca

SEQ ID NO: 278950 - DNA, 25 bp, Mus musculus
cttagacccagccagggttgtcgcc

SEQ ID NO: 278951 - DNA, 25 bp, Mus musculus
cttagacctcaagaattaaaacagg

SEQ ID NO: 278952 - DNA, 25 bp, Mus musculus
cttagacctcaagggagaaggtgat

SEQ ID NO: 278953 - DNA, 25 bp, Mus musculus
cttagacctggaatcagatgaagag

SEQ ID NO: 278954 - DNA, 25 bp, Mus musculus
cttagactccatgtgctcggcgctc

SEQ ID NO: 278955 - DNA, 25 bp, Mus musculus
cttagacttgaaagcacagtggttg

SEQ ID NO: 278956 - DNA, 25 bp, Mus musculus
cttagagaaggaagggaacatgccg

SEQ ID NO: 278957 - DNA, 25 bp, Mus musculus
cttagagaccctgaattaccggtat

SEQ ID NO: 278958 - DNA, 25 bp, Mus musculus
cttagagagaagaaagaatatcttg

SEQ ID NO: 278959 - DNA, 25 bp, Mus musculus
cttagagagaagaaatctccacagc

SEQ ID NO: 278960 - DNA, 25 bp, Mus musculus
cttagagagaagcaactggtctccg

SEQ ID NO: 278961 - DNA, 25 bp, Mus musculus
cttagagagagtgcagttctccgtg

SEQ ID NO: 278962 - DNA, 25 bp, Mus musculus
cttagagagcttcctgccagcactg

SEQ ID NO: 278963 - DNA, 25 bp, Mus musculus
cttagagataaggttcatcatttgg

SEQ ID NO: 278964 - DNA, 25 bp, Mus musculus
cttagagcagaaagccaatgctctt

SEQ ID NO: 278965 - DNA, 25 bp, Mus musculus
cttagagcagaacatctggccctaa

SEQ ID NO: 278966 - DNA, 25 bp, Mus musculus
cttagagcagcaggtatggacaaca

SEQ ID NO: 278967 - DNA, 25 bp, Mus musculus
cttagagctggtgtgtctccaggct

SEQ ID NO: 278968 - DNA, 25 bp, Mus musculus
cttagaggactagcccactgtgccg

SEQ ID NO: 278969 - DNA, 25 bp, Mus musculus
cttagaggactgtcagaaaacccag

SEQ ID NO: 278970 - DNA, 25 bp, Mus musculus
cttagaggagagccaagttgaagtt

SEQ ID NO: 278971 - DNA, 25 bp, Mus musculus
cttagaggaggcacagaccccacag

SEQ ID NO: 278972 - DNA, 25 bp, Mus musculus
cttagaggcctcactagggcagggc

SEQ ID NO: 278973 - DNA, 25 bp, Mus musculus
cttagagtaccagcgcgggatgcgg

SEQ ID NO: 278974 - DNA, 25 bp, Mus musculus
cttagataagaaggtcggagctgaa

SEQ ID NO: 278975 - DNA, 25 bp, Mus musculus
cttagatcaatatgagtggtactgc

SEQ ID NO: 278976 - DNA, 25 bp, Mus musculus
cttagatcagaaaagattcggcagt

SEQ ID NO: 278977 - DNA, 25 bp, Mus musculus
cttagatcagaggcggcagacccct

SEQ ID NO: 278978 - DNA, 25 bp, Mus musculus
cttagatgatgtgaacgagattatt

SEQ ID NO: 278979 - DNA, 25 bp, Mus musculus
cttagatgcctgagggcaggatggc

SEQ ID NO: 278980 - DNA, 25 bp, Mus musculus
cttagatggaaaggtgtcgcaacat

SEQ ID NO: 278981 - DNA, 25 bp, Mus musculus
cttagcaaaaaagggtctcgtagca

SEQ ID NO: 278982 - DNA, 25 bp, Mus musculus
cttagcaaaaaaggtgttcctcagc

SEQ ID NO: 278983 - DNA, 25 bp, Mus musculus
cttagcaagcataaacagattccgg

SEQ ID NO: 278984 - DNA, 25 bp, Mus musculus
cttagcacgaatgtgtgagaaaacc

SEQ ID NO: 278985 - DNA, 25 bp, Mus musculus
cttagcagaacaggtgtttggattt

SEQ ID NO: 278986 - DNA, 25 bp, Mus musculus
cttagcataaaggcatttacactct

SEQ ID NO: 278987 - DNA, 25 bp, Mus musculus
cttagcatacagaatatgaacatcg

SEQ ID NO: 278988 - DNA, 25 bp, Mus musculus
cttagcatacaggtccaacccagtg

SEQ ID NO: 278989 - DNA, 25 bp, Mus musculus
cttagcatccagtgggtgtataaca

SEQ ID NO: 278990 - DNA, 25 bp, Mus musculus
cttagcatcggcaggacagcagcgc

SEQ ID NO: 278991 - DNA, 25 bp, Mus musculus
cttagcatggcagatgaaccggaca

SEQ ID NO: 278992 - DNA, 25 bp, Mus musculus
cttagccatgaaacactctctggag

SEQ ID NO: 278993 - DNA, 25 bp, Mus musculus
cttagccccaggtgctgcagtcgca

SEQ ID NO: 278994 - DNA, 25 bp, Mus musculus
cttagcccgcgaggaacagtctgag

SEQ ID NO: 278995 - DNA, 25 bp, Mus musculus
cttagccgaggctgtgtgtgtgaag

SEQ ID NO: 278996 - DNA, 25 bp, Mus musculus
cttagccgagttcaatctcatccct

SEQ ID NO: 278997 - DNA, 25 bp, Mus musculus
cttagccggaggatactcagctctg

SEQ ID NO: 278998 - DNA, 25 bp, Mus musculus
cttagcctacccctgaccatcccct

SEQ ID NO: 278999 - DNA, 25 bp, Mus musculus
cttagcgagcagggcgtaagaacaa

SEQ ID NO: 279000 - DNA, 25 bp, Mus musculus
cttagcgatttccgggacctcatgt

SEQ ID NO: 279001 - DNA, 25 bp, Mus musculus
cttagcggcggactggtgcagtcag

SEQ ID NO: 279002 - DNA, 25 bp, Mus musculus
cttagcggcgggagtctatcctgaa

SEQ ID NO: 279003 - DNA, 25 bp, Mus musculus
cttagcggcgggtactataccaact

SEQ ID NO: 279004 - DNA, 25 bp, Mus musculus
cttagctacctgcctaaccagcccc

SEQ ID NO: 279005 - DNA, 25 bp, Mus musculus
cttagctgaccgtgctattcactgg

SEQ ID NO: 279006 - DNA, 25 bp, Mus musculus
cttagctgaccgtggtgagttgagg

SEQ ID NO: 279007 - DNA, 25 bp, Mus musculus
cttagctgagatagaagctttggag

SEQ ID NO: 279008 - DNA, 25 bp, Mus musculus
cttagctggcggtgtggcacccact

SEQ ID NO: 279009 - DNA, 25 bp, Mus musculus
cttagctgtgcaagctgacttcgga

SEQ ID NO: 279010 - DNA, 25 bp, Mus musculus
cttaggaaagccccggcagcccaac

SEQ ID NO: 279011 - DNA, 25 bp, Mus musculus
cttaggaacccagattttgttcctg

SEQ ID NO: 279012 - DNA, 25 bp, Mus musculus
cttaggaccagctcgcaggattaag

SEQ ID NO: 279013 - DNA, 25 bp, Mus musculus
cttaggacctgggatggattgtaag

SEQ ID NO: 279014 - DNA, 25 bp, Mus musculus
cttaggagagtgacagctagaatat

SEQ ID NO: 279015 - DNA, 25 bp, Mus musculus
cttaggagccagaagctgactgctg

SEQ ID NO: 279016 - DNA, 25 bp, Mus musculus
cttaggagccagaaggaggctggca

SEQ ID NO: 279017 - DNA, 25 bp, Mus musculus
cttaggagccagaggaagtcacaga

SEQ ID NO: 279018 - DNA, 25 bp, Mus musculus
cttaggaggaatgccctgctggagg

SEQ ID NO: 279019 - DNA, 25 bp, Mus musculus
cttaggaggaatggcctactgaacc

SEQ ID NO: 279020 - DNA, 25 bp, Mus musculus
cttaggaggtcctaacaagacagaa

SEQ ID NO: 279021 - DNA, 25 bp, Mus musculus
cttaggcccaaagctctacagactc

SEQ ID NO: 279022 - DNA, 25 bp, Mus musculus
cttaggcccaaaggtacagagatgt

SEQ ID NO: 279023 - DNA, 25 bp, Mus musculus
cttaggcccaaaggtgttctacact

SEQ ID NO: 279024 - DNA, 25 bp, Mus musculus
cttaggcttgcttgttggtgattgt

SEQ ID NO: 279025 - DNA, 25 bp, Mus musculus
cttagggaacagacactctccccga

SEQ ID NO: 279026 - DNA, 25 bp, Mus musculus
cttagggatggagcctcccaagctg

SEQ ID NO: 279027 - DNA, 25 bp, Mus musculus
cttagggcaagattctcagccaccg

SEQ ID NO: 279028 - DNA, 25 bp, Mus musculus
cttagggccggacaggattgtggaa

SEQ ID NO: 279029 - DNA, 25 bp, Mus musculus
cttagggccggacagtgtctcgttc

SEQ ID NO: 279030 - DNA, 25 bp, Mus musculus
cttagggttcaggaggggtgagtca

SEQ ID NO: 279031 - DNA, 25 bp, Mus musculus
cttaggtaaggtggtcagcgcgctg

SEQ ID NO: 279032 - DNA, 25 bp, Mus musculus
cttaggtaggctcagagtgcgatgc

SEQ ID NO: 279033 - DNA, 25 bp, Mus musculus
cttaggtaggctcagagttcgagga

SEQ ID NO: 279034 - DNA, 25 bp, Mus musculus
cttaggtttgatcagacctactgtg

SEQ ID NO: 279035 - DNA, 25 bp, Mus musculus
cttaggtttgcagatgatacgtata

SEQ ID NO: 279036 - DNA, 25 bp, Mus musculus
cttaggtttgcatgggacacagcag

SEQ ID NO: 279037 - DNA, 25 bp, Mus musculus
cttagtaaaacttacctcactgtgg

SEQ ID NO: 279038 - DNA, 25 bp, Mus musculus
cttagtaaatgaaggctggagccag

SEQ ID NO: 279039 - DNA, 25 bp, Mus musculus
cttagtaagcatgtgtcatggctcc

SEQ ID NO: 279040 - DNA, 25 bp, Mus musculus
cttagtagacaagggagcatatgca

SEQ ID NO: 279041 - DNA, 25 bp, Mus musculus
cttagtagcttccaggtggtggtcc

SEQ ID NO: 279042 - DNA, 25 bp, Mus musculus
cttagtataggtgattgaagcctca

SEQ ID NO: 279043 - DNA, 25 bp, Mus musculus
cttagtataggtgtcctcagataga

SEQ ID NO: 279044 - DNA, 25 bp, Mus musculus
cttagtattccaggaaaagatggca

SEQ ID NO: 279045 - DNA, 25 bp, Mus musculus
cttagtattgcatatagtcctgatg

SEQ ID NO: 279046 - DNA, 25 bp, Mus musculus
cttagtcaagggtctcatgtactcc

SEQ ID NO: 279047 - DNA, 25 bp, Mus musculus
cttagtcaaggttggcttcctgaag

SEQ ID NO: 279048 - DNA, 25 bp, Mus musculus
cttagtcaccagtgccagcggattg

SEQ ID NO: 279049 - DNA, 25 bp, Mus musculus
cttagtcccagtggaagcaccagcc

SEQ ID NO: 279050 - DNA, 25 bp, Mus musculus
cttagtccgagccgccatgggctgc

SEQ ID NO: 279051 - DNA, 25 bp, Mus musculus
cttagtccgcagacccccaggaaac

SEQ ID NO: 279052 - DNA, 25 bp, Mus musculus
cttagtcctgatgctgtctatgtac

SEQ ID NO: 279053 - DNA, 25 bp, Mus musculus
cttagtgcaggaaacttcgcggctc

SEQ ID NO: 279054 - DNA, 25 bp, Mus musculus
cttagtgcaggccaaaagtcacatg

SEQ ID NO: 279055 - DNA, 25 bp, Mus musculus
cttagtgcaggctttggcagctcaa

SEQ ID NO: 279056 - DNA, 25 bp, Mus musculus
cttagttcagaatgtgattctgctt

SEQ ID NO: 279057 - DNA, 25 bp, Mus musculus
cttagttcagatcctagcccgatgt

SEQ ID NO: 279058 - DNA, 25 bp, Mus musculus
cttagttggacagagctggcaaggg

SEQ ID NO: 279059 - DNA, 25 bp, Mus musculus
cttagttggtcgaccgcccctgctg

SEQ ID NO: 279060 - DNA, 25 bp, Mus musculus
cttataaaagacggcatccagctca

SEQ ID NO: 279061 - DNA, 25 bp, Mus musculus
cttataagaagccagatgtgaactg

SEQ ID NO: 279062 - DNA, 25 bp, Mus musculus
cttataagagagatgctaacatttt

SEQ ID NO: 279063 - DNA, 25 bp, Mus musculus
cttataagagaggtagaaatgggtc

SEQ ID NO: 279064 - DNA, 25 bp, Mus musculus
cttatacccggagagagaagcgctt

SEQ ID NO: 279065 - DNA, 25 bp, Mus musculus
cttatacctcaagctggcacagtga

SEQ ID NO: 279066 - DNA, 25 bp, Mus musculus
cttatactggaacaagaaacagtca

SEQ ID NO: 279067 - DNA, 25 bp, Mus musculus
cttatactggaagaagaaacagtca

SEQ ID NO: 279068 - DNA, 25 bp, Mus musculus
cttatacttgctagctgccgactac

SEQ ID NO: 279069 - DNA, 25 bp, Mus musculus
cttataggagctttactgaagactg

SEQ ID NO: 279070 - DNA, 25 bp, Mus musculus
cttatagtatgagagcatattccgc

SEQ ID NO: 279071 - DNA, 25 bp, Mus musculus
cttatagtatgaggtacctgtcgta

SEQ ID NO: 279072 - DNA, 25 bp, Mus musculus
cttatagtatgagtgatgtcctcgc

SEQ ID NO: 279073 - DNA, 25 bp, Mus musculus
cttatagtctgattcctttctcctt

SEQ ID NO: 279074 - DNA, 25 bp, Mus musculus
cttatatatgacattatgcagaatt

SEQ ID NO: 279075 - DNA, 25 bp, Mus musculus
cttatatggaaagtaaattcagttc

SEQ ID NO: 279076 - DNA, 25 bp, Mus musculus
cttatatgtgcacatggcgactgct

SEQ ID NO: 279077 - DNA, 25 bp, Mus musculus
cttatatgtggagctgtgtggacag

SEQ ID NO: 279078 - DNA, 25 bp, Mus musculus
cttatattaaaaggtgtccagtgtg

SEQ ID NO: 279079 - DNA, 25 bp, Mus musculus
cttatcaaaggtgtggcccaccagt

SEQ ID NO: 279080 - DNA, 25 bp, Mus musculus
cttatcaccagggagctaagaagat

SEQ ID NO: 279081 - DNA, 25 bp, Mus musculus
cttatcacgaagaaaaacgtgaaca

SEQ ID NO: 279082 - DNA, 25 bp, Mus musculus
cttatcagtcaggattctgaatcag

SEQ ID NO: 279083 - DNA, 25 bp, Mus musculus
cttatcagtcagggttacagagtca

SEQ ID NO: 279084 - DNA, 25 bp, Mus musculus
cttatcatatgataatattaagaat

SEQ ID NO: 279085 - DNA, 25 bp, Mus musculus
cttatcatatgatagtctgatatgc

SEQ ID NO: 279086 - DNA, 25 bp, Mus musculus
cttatcatcagcaacagcaacagag

SEQ ID NO: 279087 - DNA, 25 bp, Mus musculus
cttatcatccttagcaagagatgtc

SEQ ID NO: 279088 - DNA, 25 bp, Mus musculus
cttatcattattcagggattgctta

SEQ ID NO: 279089 - DNA, 25 bp, Mus musculus
cttatcattattcagttgtttgttg

SEQ ID NO: 279090 - DNA, 25 bp, Mus musculus
cttatccaaaatcaggaacccactg

SEQ ID NO: 279091 - DNA, 25 bp, Mus musculus
cttatccagagttgtttcttgagat

SEQ ID NO: 279092 - DNA, 25 bp, Mus musculus
cttatccatgaaggagcctacagaa

SEQ ID NO: 279093 - DNA, 25 bp, Mus musculus
cttatccatgaaggagtccgctcag

SEQ ID NO: 279094 - DNA, 25 bp, Mus musculus
cttatcccaatgtggaagaagctca

SEQ ID NO: 279095 - DNA, 25 bp, Mus musculus
cttatcccactctgcccgacctctg

SEQ ID NO: 279096 - DNA, 25 bp, Mus musculus
cttatccccaacagcgggaacttca

SEQ ID NO: 279097 - DNA, 25 bp, Mus musculus
cttatccccaacaggtggtgaagca

SEQ ID NO: 279098 - DNA, 25 bp, Mus musculus
cttatccctgtcctctacagcctgc

SEQ ID NO: 279099 - DNA, 25 bp, Mus musculus
cttatccgactacgggtggactata

SEQ ID NO: 279100 - DNA, 25 bp, Mus musculus
cttatcctggactgagctcctggct

SEQ ID NO: 279101 - DNA, 25 bp, Mus musculus
cttatcggaaatggtgaagcaaatc

SEQ ID NO: 279102 - DNA, 25 bp, Mus musculus
cttatctacgagaccctcctctggc

SEQ ID NO: 279103 - DNA, 25 bp, Mus musculus
cttatctagggtggaagaaagccca

SEQ ID NO: 279104 - DNA, 25 bp, Mus musculus
cttatctccatctcttcccactgga

SEQ ID NO: 279105 - DNA, 25 bp, Mus musculus
cttatctctgtgtgtgccgacaaca

SEQ ID NO: 279106 - DNA, 25 bp, Mus musculus
cttatctgaggtggggaaagatcaa

SEQ ID NO: 279107 - DNA, 25 bp, Mus musculus
cttatctggaaaatgccactccgtg

SEQ ID NO: 279108 - DNA, 25 bp, Mus musculus
cttatcttcctgagatgctgtcccc

SEQ ID NO: 279109 - DNA, 25 bp, Mus musculus
cttatgaaaactggtgaagggccgg

SEQ ID NO: 279110 - DNA, 25 bp, Mus musculus
cttatgaacagatcaagcgggccat

SEQ ID NO: 279111 - DNA, 25 bp, Mus musculus
cttatgaacatggtgaagtatttgt

SEQ ID NO: 279112 - DNA, 25 bp, Mus musculus
cttatgaagatcccacataccattt

SEQ ID NO: 279113 - DNA, 25 bp, Mus musculus
cttatgacaaacatttttcagtatg

SEQ ID NO: 279114 - DNA, 25 bp, Mus musculus
cttatgacagctggaacgctttagc

SEQ ID NO: 279115 - DNA, 25 bp, Mus musculus
cttatgacaggattgtggttgctgg

SEQ ID NO: 279116 - DNA, 25 bp, Mus musculus
cttatgacaggctgaagccatcagt

SEQ ID NO: 279117 - DNA, 25 bp, Mus musculus
cttatgacaggtctaaaaggcttgg

SEQ ID NO: 279118 - DNA, 25 bp, Mus musculus
cttatgacaggtctatgctgagggg

SEQ ID NO: 279119 - DNA, 25 bp, Mus musculus
cttatgacaggtggctgtctgccca

SEQ ID NO: 279120 - DNA, 25 bp, Mus musculus
cttatgacaggttctgtccattcta

SEQ ID NO: 279121 - DNA, 25 bp, Mus musculus
cttatgacatgatgatgcagtccct

SEQ ID NO: 279122 - DNA, 25 bp, Mus musculus
cttatgacctgatggccaacttagc

SEQ ID NO: 279123 - DNA, 25 bp, Mus musculus
cttatgacctggcagaacagctttt

SEQ ID NO: 279124 - DNA, 25 bp, Mus musculus
cttatgagactggagagacgagaga

SEQ ID NO: 279125 - DNA, 25 bp, Mus musculus
cttatgagactggatctctttcctt

SEQ ID NO: 279126 - DNA, 25 bp, Mus musculus
cttatgatcaggaaccagctcctga

SEQ ID NO: 279127 - DNA, 25 bp, Mus musculus
cttatgatcaggcggcttggatttt

SEQ ID NO: 279128 - DNA, 25 bp, Mus musculus
cttatgcagacacgagatcttgtac

SEQ ID NO: 279129 - DNA, 25 bp, Mus musculus
cttatgcatggaaaggaagttggca

SEQ ID NO: 279130 - DNA, 25 bp, Mus musculus
cttatgccgtcatgtcccggaacag

SEQ ID NO: 279131 - DNA, 25 bp, Mus musculus
cttatgcgtcttcaggtaataaagc

SEQ ID NO: 279132 - DNA, 25 bp, Mus musculus
cttatgctagaaaaggttgcacgat

SEQ ID NO: 279133 - DNA, 25 bp, Mus musculus
cttatggacttaaaggtgcctggaa

SEQ ID NO: 279134 - DNA, 25 bp, Mus musculus
cttatggagaccacacaggaggggg

SEQ ID NO: 279135 - DNA, 25 bp, Mus musculus
cttatggagcggcactggagcaaac

SEQ ID NO: 279136 - DNA, 25 bp, Mus musculus
cttatggagcggtcgtgtatcagga

SEQ ID NO: 279137 - DNA, 25 bp, Mus musculus
cttatggagcttttagaacgtttta

SEQ ID NO: 279138 - DNA, 25 bp, Mus musculus
cttatggaggaaggtcgtggacttc

SEQ ID NO: 279139 - DNA, 25 bp, Mus musculus
cttatggcagctgctgtgtggatgt

SEQ ID NO: 279140 - DNA, 25 bp, Mus musculus
cttatggcaggtccaaacatcacac

SEQ ID NO: 279141 - DNA, 25 bp, Mus musculus
cttatggcaggtgctgacctgagct

SEQ ID NO: 279142 - DNA, 25 bp, Mus musculus
cttatggccaatgaggtcactcgtt

SEQ ID NO: 279143 - DNA, 25 bp, Mus musculus
cttatggccaatggtcagttggtga

SEQ ID NO: 279144 - DNA, 25 bp, Mus musculus
cttatggccatcaagacctctcaca

SEQ ID NO: 279145 - DNA, 25 bp, Mus musculus
cttatggcgaggagccatcaagcaa

SEQ ID NO: 279146 - DNA, 25 bp, Mus musculus
cttatggcgaggaggaggtgtagcc

SEQ ID NO: 279147 - DNA, 25 bp, Mus musculus
cttatggcgttggagatctcatccc

SEQ ID NO: 279148 - DNA, 25 bp, Mus musculus
cttatggcgttggagtgtcccatcc

SEQ ID NO: 279149 - DNA, 25 bp, Mus musculus
cttatggctgacaagatgcaggtac

SEQ ID NO: 279150 - DNA, 25 bp, Mus musculus
cttatgggaggtccaaatatcacac

SEQ ID NO: 279151 - DNA, 25 bp, Mus musculus
cttatgggatatcttcagaaaaaat

SEQ ID NO: 279152 - DNA, 25 bp, Mus musculus
cttatgtacttcattgtacgatctt

SEQ ID NO: 279153 - DNA, 25 bp, Mus musculus
cttatgtgcatatgtggcaaagttt

SEQ ID NO: 279154 - DNA, 25 bp, Mus musculus
cttattaaaaacaatctggaacttc

SEQ ID NO: 279155 - DNA, 25 bp, Mus musculus
cttattaccacagcgtttatgtttg

SEQ ID NO: 279156 - DNA, 25 bp, Mus musculus
cttattaccacaggaactgcatgag

SEQ ID NO: 279157 - DNA, 25 bp, Mus musculus
cttattactaccaagccccaggaga

SEQ ID NO: 279158 - DNA, 25 bp, Mus musculus
cttattatcaacctgaccctctatg

SEQ ID NO: 279159 - DNA, 25 bp, Mus musculus
cttattatcaacctggaggacggtg

SEQ ID NO: 279160 - DNA, 25 bp, Mus musculus
cttattattcaagattaaaccagaa

SEQ ID NO: 279161 - DNA, 25 bp, Mus musculus
cttattcaaagactcctggaagtag

SEQ ID NO: 279162 - DNA, 25 bp, Mus musculus
cttattcaaagttgtccgtgtaatt

SEQ ID NO: 279163 - DNA, 25 bp, Mus musculus
cttattcaaggcctggtgtgtgcct

SEQ ID NO: 279164 - DNA, 25 bp, Mus musculus
cttattcaaggggtgtggaatatta

SEQ ID NO: 279165 - DNA, 25 bp, Mus musculus
cttattccagaactttgtgccctgc

SEQ ID NO: 279166 - DNA, 25 bp, Mus musculus
cttattccagaggcatttggattta

SEQ ID NO: 279167 - DNA, 25 bp, Mus musculus
cttattccaggatggctaatcgcga

SEQ ID NO: 279168 - DNA, 25 bp, Mus musculus
cttattccagtcccactcacttaca

SEQ ID NO: 279169 - DNA, 25 bp, Mus musculus
cttattccatagtagtgggcagcag

SEQ ID NO: 279170 - DNA, 25 bp, Mus musculus
cttattcctcctatgaggcgtctgg

SEQ ID NO: 279171 - DNA, 25 bp, Mus musculus
cttattcctgaagcagaaccaccaa

SEQ ID NO: 279172 - DNA, 25 bp, Mus musculus
cttattcctgaaggaggctgtgaaa

SEQ ID NO: 279173 - DNA, 25 bp, Mus musculus
cttattcgcagtggctgtgacgtga

SEQ ID NO: 279174 - DNA, 25 bp, Mus musculus
cttattcttttggcctaagatcacc

SEQ ID NO: 279175 - DNA, 25 bp, Mus musculus
cttattgaaacatccatttcagtcc

SEQ ID NO: 279176 - DNA, 25 bp, Mus musculus
cttattgaaaggatgaagaaacacg

SEQ ID NO: 279177 - DNA, 25 bp, Mus musculus
cttattgaatatccagaagatgtgg

SEQ ID NO: 279178 - DNA, 25 bp, Mus musculus
cttattgagttcagctatgaactct

SEQ ID NO: 279179 - DNA, 25 bp, Mus musculus
cttattgagttcattcaggctggtg

SEQ ID NO: 279180 - DNA, 25 bp, Mus musculus
cttattgccaaagatactgatcaat

SEQ ID NO: 279181 - DNA, 25 bp, Mus musculus
cttattgccaaagctagttatgaac

SEQ ID NO: 279182 - DNA, 25 bp, Mus musculus
cttattgccaaagctgcgtctttgc

SEQ ID NO: 279183 - DNA, 25 bp, Mus musculus
cttattggacaagtgcaactgtagc

SEQ ID NO: 279184 - DNA, 25 bp, Mus musculus
cttattgtcgctctattctctccta

SEQ ID NO: 279185 - DNA, 25 bp, Mus musculus
cttattgtcggttggtgatgagaaa

SEQ ID NO: 279186 - DNA, 25 bp, Mus musculus
cttattgtggggcatgaaggatggc

SEQ ID NO: 279187 - DNA, 25 bp, Mus musculus
cttattgttcctgacaaccctccat

SEQ ID NO: 279188 - DNA, 25 bp, Mus musculus
cttattgttcctggtttctctttgt

SEQ ID NO: 279189 - DNA, 25 bp, Mus musculus
cttatttaaagctgagtgcaatatc

SEQ ID NO: 279190 - DNA, 25 bp, Mus musculus
cttatttaagacttcattgaaccag

SEQ ID NO: 279191 - DNA, 25 bp, Mus musculus
cttatttattggcacagacacagga

SEQ ID NO: 279192 - DNA, 25 bp, Mus musculus
cttatttcaactttggccaccagtt

SEQ ID NO: 279193 - DNA, 25 bp, Mus musculus
cttatttcaactttggcctaccttc

SEQ ID NO: 279194 - DNA, 25 bp, Mus musculus
cttatttccaaccacggctcactcc

SEQ ID NO: 279195 - DNA, 25 bp, Mus musculus
cttatttctacatggtctcttcatg

SEQ ID NO: 279196 - DNA, 25 bp, Mus musculus
cttatttctgtgacagctatattgt

SEQ ID NO: 279197 - DNA, 25 bp, Mus musculus
cttatttgaggagaatgagatcaac

SEQ ID NO: 279198 - DNA, 25 bp, Mus musculus
cttatttgaggagtttgggctttgc

SEQ ID NO: 279199 - DNA, 25 bp, Mus musculus
cttattttacagtgaaaatgtgcta

SEQ ID NO: 279200 - DNA, 25 bp, Mus musculus
cttattttgaagtgatgagactatc

SEQ ID NO: 279201 - DNA, 25 bp, Mus musculus
cttcaaaaaagatggtttttgatca

SEQ ID NO: 279202 - DNA, 25 bp, Mus musculus
cttcaaaaagtcaaggtgattctgg

SEQ ID NO: 279203 - DNA, 25 bp, Mus musculus
cttcaaaaatagctcggtcgaggag

SEQ ID NO: 279204 - DNA, 25 bp, Mus musculus
cttcaaaaattaagtgtctctgcca

SEQ ID NO: 279205 - DNA, 25 bp, Mus musculus
cttcaaaaattaagttagctgacaa

SEQ ID NO: 279206 - DNA, 25 bp, Mus musculus
cttcaaaatgcgtttcaagcaccaa

SEQ ID NO: 279207 - DNA, 25 bp, Mus musculus
cttcaaacaagttcaaaaggatgct

SEQ ID NO: 279208 - DNA, 25 bp, Mus musculus
cttcaaacagcggatcactgcagac

SEQ ID NO: 279209 - DNA, 25 bp, Mus musculus
cttcaaacccagctctgcatgccca

SEQ ID NO: 279210 - DNA, 25 bp, Mus musculus
cttcaaacccagggcaagacagact

SEQ ID NO: 279211 - DNA, 25 bp, Mus musculus
cttcaaacctggtgcgttcattcct

SEQ ID NO: 279212 - DNA, 25 bp, Mus musculus
cttcaaacgtggggttctatggcct

SEQ ID NO: 279213 - DNA, 25 bp, Mus musculus
cttcaaagaatgattctgttggctc

SEQ ID NO: 279214 - DNA, 25 bp, Mus musculus
cttcaaagacaagctcaaacatgtc

SEQ ID NO: 279215 - DNA, 25 bp, Mus musculus
cttcaaagacaaggtgagggtggtg

SEQ ID NO: 279216 - DNA, 25 bp, Mus musculus
cttcaaagacctactgaaagccaat

SEQ ID NO: 279217 - DNA, 25 bp, Mus musculus
cttcaaagagcagcctctattaaga

SEQ ID NO: 279218 - DNA, 25 bp, Mus musculus
cttcaaagatctgtgaagttcattc

SEQ ID NO: 279219 - DNA, 25 bp, Mus musculus
cttcaaagcagaagcctcctgccaa

SEQ ID NO: 279220 - DNA, 25 bp, Mus musculus
cttcaaagccaaggcaaagctgatg

SEQ ID NO: 279221 - DNA, 25 bp, Mus musculus
cttcaaagccaaggctgcctacctg

SEQ ID NO: 279222 - DNA, 25 bp, Mus musculus
cttcaaagcccgggtatcatccgga

SEQ ID NO: 279223 - DNA, 25 bp, Mus musculus
cttcaaaggagtgtcactactccat

SEQ ID NO: 279224 - DNA, 25 bp, Mus musculus
cttcaaagtaccaggaaaggacaca

SEQ ID NO: 279225 - DNA, 25 bp, Mus musculus
cttcaaagtagaaggttacatccag

SEQ ID NO: 279226 - DNA, 25 bp, Mus musculus
cttcaaataaaaaggtgcttgagca

SEQ ID NO: 279227 - DNA, 25 bp, Mus musculus
cttcaaatactgaactgtccctgat

SEQ ID NO: 279228 - DNA, 25 bp, Mus musculus
cttcaaatggacccataactggtgt

SEQ ID NO: 279229 - DNA, 25 bp, Mus musculus
cttcaaatggatagtcacatgctgg

SEQ ID NO: 279230 - DNA, 25 bp, Mus musculus
cttcaaatgggaagaagatggacaa

SEQ ID NO: 279231 - DNA, 25 bp, Mus musculus
cttcaaatggggagggtagacctga

SEQ ID NO: 279232 - DNA, 25 bp, Mus musculus
cttcaacaaaggtgatctgcaattc

SEQ ID NO: 279233 - DNA, 25 bp, Mus musculus
cttcaacaaggtaatgcaggtggtg

SEQ ID NO: 279234 - DNA, 25 bp, Mus musculus
cttcaacaatcatggctgcttgtgc

SEQ ID NO: 279235 - DNA, 25 bp, Mus musculus
cttcaacaggaaggtgactgtggac

SEQ ID NO: 279236 - DNA, 25 bp, Mus musculus
cttcaacattgaggatcataaagac

SEQ ID NO: 279237 - DNA, 25 bp, Mus musculus
cttcaaccaacaggagctctttgga

SEQ ID NO: 279238 - DNA, 25 bp, Mus musculus
cttcaaccagcgaattcagcttgct

SEQ ID NO: 279239 - DNA, 25 bp, Mus musculus
cttcaaccaggtcaggctgttcctg

SEQ ID NO: 279240 - DNA, 25 bp, Mus musculus
cttcaaccagtgtttgtcagcagaa

SEQ ID NO: 279241 - DNA, 25 bp, Mus musculus
cttcaaccatcaggggctggtgtca

SEQ ID NO: 279242 - DNA, 25 bp, Mus musculus
cttcaaccatcaggtctaggtggct

SEQ ID NO: 279243 - DNA, 25 bp, Mus musculus
cttcaaccccacagtaaactacatt

SEQ ID NO: 279244 - DNA, 25 bp, Mus musculus
cttcaaccgaagtgagtccattcgc

SEQ ID NO: 279245 - DNA, 25 bp, Mus musculus
cttcaaccgagttgagtccattcgc

SEQ ID NO: 279246 - DNA, 25 bp, Mus musculus
cttcaacctctaaaagcccgatttg

SEQ ID NO: 279247 - DNA, 25 bp, Mus musculus
cttcaacctctatgtgacggacgcc

SEQ ID NO: 279248 - DNA, 25 bp, Mus musculus
cttcaacctgacgctgtccatgctt

SEQ ID NO: 279249 - DNA, 25 bp, Mus musculus
cttcaacctggatgccctccacaca

SEQ ID NO: 279250 - DNA, 25 bp, Mus musculus
cttcaacggaggtactgtattggca

SEQ ID NO: 279251 - DNA, 25 bp, Mus musculus
cttcaactacagccttacctgcctc

SEQ ID NO: 279252 - DNA, 25 bp, Mus musculus
cttcaactccaggcctctagactgt

SEQ ID NO: 279253 - DNA, 25 bp, Mus musculus
cttcaactccaggtatctccacagg

SEQ ID NO: 279254 - DNA, 25 bp, Mus musculus
cttcaactccccagagcaccccttg

SEQ ID NO: 279255 - DNA, 25 bp, Mus musculus
cttcaactccccaggaagctacagg

SEQ ID NO: 279256 - DNA, 25 bp, Mus musculus
cttcaactctgtagtgaatgtgggc

SEQ ID NO: 279257 - DNA, 25 bp, Mus musculus
cttcaagaaagatgtccttggctcc

SEQ ID NO: 279258 - DNA, 25 bp, Mus musculus
cttcaagaaaggtttcagactgaaa

SEQ ID NO: 279259 - DNA, 25 bp, Mus musculus
cttcaagaaatccggcaacttgaat

SEQ ID NO: 279260 - DNA, 25 bp, Mus musculus
cttcaagaaatccgggcagtttagg

SEQ ID NO: 279261 - DNA, 25 bp, Mus musculus
cttcaagaacaagtatgaggatgaa

SEQ ID NO: 279262 - DNA, 25 bp, Mus musculus
cttcaagaacattgcgacgctccag

SEQ ID NO: 279263 - DNA, 25 bp, Mus musculus
cttcaagaaggagaacagagaaagc

SEQ ID NO: 279264 - DNA, 25 bp, Mus musculus
cttcaagaaggagtatggctgtaag

SEQ ID NO: 279265 - DNA, 25 bp, Mus musculus
cttcaagaatgacattgtcaactgg

SEQ ID NO: 279266 - DNA, 25 bp, Mus musculus
cttcaagacagatcctcaagaatgc

SEQ ID NO: 279267 - DNA, 25 bp, Mus musculus
cttcaagacagcgtgggtgggctcg

SEQ ID NO: 279268 - DNA, 25 bp, Mus musculus
cttcaagagaaagccttgtttgcag

SEQ ID NO: 279269 - DNA, 25 bp, Mus musculus
cttcaagagaaaggttcaattttat

SEQ ID NO: 279270 - DNA, 25 bp, Mus musculus
cttcaagaggaccctggcccagtcg

SEQ ID NO: 279271 - DNA, 25 bp, Mus musculus
cttcaagaggacgtccttcatttct

SEQ ID NO: 279272 - DNA, 25 bp, Mus musculus
cttcaagagggcgaggcagaggtag

SEQ ID NO: 279273 - DNA, 25 bp, Mus musculus
cttcaagatgagagcgatgacagag

SEQ ID NO: 279274 - DNA, 25 bp, Mus musculus
cttcaagatgaggcgagtggcagtg

SEQ ID NO: 279275 - DNA, 25 bp, Mus musculus
cttcaagcaagtaaaggccggcgag

SEQ ID NO: 279276 - DNA, 25 bp, Mus musculus
cttcaagcagagaaagaacgaacga

SEQ ID NO: 279277 - DNA, 25 bp, Mus musculus
cttcaagcagattaacctgtggaag

SEQ ID NO: 279278 - DNA, 25 bp, Mus musculus
cttcaagcagcatgattgggctgat

SEQ ID NO: 279279 - DNA, 25 bp, Mus musculus
cttcaagcagcctgaaaggcaaggt

SEQ ID NO: 279280 - DNA, 25 bp, Mus musculus
cttcaagcagcgttccacgcctacg

SEQ ID NO: 279281 - DNA, 25 bp, Mus musculus
cttcaagcagtgtggcattgtcctg

SEQ ID NO: 279282 - DNA, 25 bp, Mus musculus
cttcaagccaaaaggtgaaacctca

SEQ ID NO: 279283 - DNA, 25 bp, Mus musculus
cttcaagccagaagcctgcctggaa

SEQ ID NO: 279284 - DNA, 25 bp, Mus musculus
cttcaagcccagctatgggacccct

SEQ ID NO: 279285 - DNA, 25 bp, Mus musculus
cttcaagcccagtcttgcctccagc

SEQ ID NO: 279286 - DNA, 25 bp, Mus musculus
cttcaagcgtgttagatatcgatga

SEQ ID NO: 279287 - DNA, 25 bp, Mus musculus
cttcaagctcttatgtgagacgtgg

SEQ ID NO: 279288 - DNA, 25 bp, Mus musculus
cttcaagctggatcttctatcgggc

SEQ ID NO: 279289 - DNA, 25 bp, Mus musculus
cttcaagctgggtgcgcatggtgag

SEQ ID NO: 279290 - DNA, 25 bp, Mus musculus
cttcaaggaaggaatcttttgtgtt

SEQ ID NO: 279291 - DNA, 25 bp, Mus musculus
cttcaaggagaagagaacagaaagc

SEQ ID NO: 279292 - DNA, 25 bp, Mus musculus
cttcaaggaggtttgcggggagcag

SEQ ID NO: 279293 - DNA, 25 bp, Mus musculus
cttcaaggccaggttgatggaaacc

SEQ ID NO: 279294 - DNA, 25 bp, Mus musculus
cttcaaggcctgacaacatcgctgt

SEQ ID NO: 279295 - DNA, 25 bp, Mus musculus
cttcaagggcaagatcctatttatc

SEQ ID NO: 279296 - DNA, 25 bp, Mus musculus
cttcaagggcggaggtgagtgcagg

SEQ ID NO: 279297 - DNA, 25 bp, Mus musculus
cttcaaggtcaacaggcgcaacctg

SEQ ID NO: 279298 - DNA, 25 bp, Mus musculus
cttcaagtacagagatgaactcaag

SEQ ID NO: 279299 - DNA, 25 bp, Mus musculus
cttcaagtacaggtatgaactcaag

SEQ ID NO: 279300 - DNA, 25 bp, Mus musculus
cttcaagtgatagttctcagtatgt

SEQ ID NO: 279301 - DNA, 25 bp, Mus musculus
cttcaagtgcaaggtcatcttccat

SEQ ID NO: 279302 - DNA, 25 bp, Mus musculus
cttcaataaagcagttttccacatc

SEQ ID NO: 279303 - DNA, 25 bp, Mus musculus
cttcaataatgatttccagggtagc

SEQ ID NO: 279304 - DNA, 25 bp, Mus musculus
cttcaataatgtggtgaaaacaact

SEQ ID NO: 279305 - DNA, 25 bp, Mus musculus
cttcaatacagtagtctggacagag

SEQ ID NO: 279306 - DNA, 25 bp, Mus musculus
cttcaatatcttgggagccgaagag

SEQ ID NO: 279307 - DNA, 25 bp, Mus musculus
cttcaatatcttggtacagggagcc

SEQ ID NO: 279308 - DNA, 25 bp, Mus musculus
cttcaatatggaatctttctgacat

SEQ ID NO: 279309 - DNA, 25 bp, Mus musculus
cttcaatcaagtttttgcagcctgt

SEQ ID NO: 279310 - DNA, 25 bp, Mus musculus
cttcaatccccaagaccctgaagaa

SEQ ID NO: 279311 - DNA, 25 bp, Mus musculus
cttcaatccccaaggttcattctgt

SEQ ID NO: 279312 - DNA, 25 bp, Mus musculus
cttcaatcgcagaggagaactgcgg

SEQ ID NO: 279313 - DNA, 25 bp, Mus musculus
cttcaatcggacagggatgagaccg

SEQ ID NO: 279314 - DNA, 25 bp, Mus musculus
cttcaatcttcctagtgacggctct

SEQ ID NO: 279315 - DNA, 25 bp, Mus musculus
cttcaatcttcctagtgagccccgg

SEQ ID NO: 279316 - DNA, 25 bp, Mus musculus
cttcaatcttctcagggacaggggc

SEQ ID NO: 279317 - DNA, 25 bp, Mus musculus
cttcaatgacttcagagaatacctg

SEQ ID NO: 279318 - DNA, 25 bp, Mus musculus
cttcaatgacttcagctgctgacct

SEQ ID NO: 279319 - DNA, 25 bp, Mus musculus
cttcaatgagaagtgaacatgtatg

SEQ ID NO: 279320 - DNA, 25 bp, Mus musculus
cttcaatgagcagggttggtttttg

SEQ ID NO: 279321 - DNA, 25 bp, Mus musculus
cttcaatgagcaggtttcagcggac

SEQ ID NO: 279322 - DNA, 25 bp, Mus musculus
cttcaatgcctgcctgcaaatttca

SEQ ID NO: 279323 - DNA, 25 bp, Mus musculus
cttcaatgtggctcactttagtgcc

SEQ ID NO: 279324 - DNA, 25 bp, Mus musculus
cttcaatgtttcaggacagtcggcc

SEQ ID NO: 279325 - DNA, 25 bp, Mus musculus
cttcaattaccagggtgaaagaatt

SEQ ID NO: 279326 - DNA, 25 bp, Mus musculus
cttcacaacaaaccgagaaaggaac

SEQ ID NO: 279327 - DNA, 25 bp, Mus musculus
cttcacaacaacaagcatcacccta

SEQ ID NO: 279328 - DNA, 25 bp, Mus musculus
cttcacaacaacaaggagcacttta

SEQ ID NO: 279329 - DNA, 25 bp, Mus musculus
cttcacaacagcgaggtgtaccacg

SEQ ID NO: 279330 - DNA, 25 bp, Mus musculus
cttcacaaccattcctggtctgacg

SEQ ID NO: 279331 - DNA, 25 bp, Mus musculus
cttcacaatggccaaagatgagagc

SEQ ID NO: 279332 - DNA, 25 bp, Mus musculus
cttcacaatggccagaaagaagact

SEQ ID NO: 279333 - DNA, 25 bp, Mus musculus
cttcacaatgtgatacctgactgtc

SEQ ID NO: 279334 - DNA, 25 bp, Mus musculus
cttcacacacatttaccttcagtga

SEQ ID NO: 279335 - DNA, 25 bp, Mus musculus
cttcacaccaggagagcactgtgaa

SEQ ID NO: 279336 - DNA, 25 bp, Mus musculus
cttcacaccagtcttcgctgataga

SEQ ID NO: 279337 - DNA, 25 bp, Mus musculus
cttcacactaatcttgtaaccacca

SEQ ID NO: 279338 - DNA, 25 bp, Mus musculus
cttcacactgctttggtgcggcaag

SEQ ID NO: 279339 - DNA, 25 bp, Mus musculus
cttcacactgttccaggctttacct

SEQ ID NO: 279340 - DNA, 25 bp, Mus musculus
cttcacagaacaagcagacttccag

SEQ ID NO: 279341 - DNA, 25 bp, Mus musculus
cttcacagacttctacctggtgatg

SEQ ID NO: 279342 - DNA, 25 bp, Mus musculus
cttcacagagaaatattactggaaa

SEQ ID NO: 279343 - DNA, 25 bp, Mus musculus
cttcacagagagcatgtgaccgact

SEQ ID NO: 279344 - DNA, 25 bp, Mus musculus
cttcacagatgtgcagcttgaagga

SEQ ID NO: 279345 - DNA, 25 bp, Mus musculus
cttcacagcctcatcattacagatg

SEQ ID NO: 279346 - DNA, 25 bp, Mus musculus
cttcacaggagagatagacccagtg

SEQ ID NO: 279347 - DNA, 25 bp, Mus musculus
cttcacagtgcctggacaggtcctg

SEQ ID NO: 279348 - DNA, 25 bp, Mus musculus
cttcacagtgcctggtgtcgaggag

SEQ ID NO: 279349 - DNA, 25 bp, Mus musculus
cttcacagtggaaggacattcccat

SEQ ID NO: 279350 - DNA, 25 bp, Mus musculus
cttcacatacaggagcgacagtttt

SEQ ID NO: 279351 - DNA, 25 bp, Mus musculus
cttcacatcatgaagtgtgatctgg

SEQ ID NO: 279352 - DNA, 25 bp, Mus musculus
cttcacatggtctcttcagatggag

SEQ ID NO: 279353 - DNA, 25 bp, Mus musculus
cttcacattgtcagatctcagggca

SEQ ID NO: 279354 - DNA, 25 bp, Mus musculus
cttcacattgtcagatgtccattca

SEQ ID NO: 279355 - DNA, 25 bp, Mus musculus
cttcaccaatttatcaaaagtttat

SEQ ID NO: 279356 - DNA, 25 bp, Mus musculus
cttcaccacagtgtttacaaaatat
